United States Patent 9,328,346 (POLYCOMB-ASSOCIATED NON-CODING RNAS) - sequence listing, part 113

SEQ ID NO: 50482 - RNA, 44 nt, Mus musculus
gucugugugugugugugucugucugucugugugugugucucugu

SEQ ID NO: 50483 - RNA, 48 nt, Mus musculus
ugucucugugugugugugugugugugucugugucucucugugugugug

SEQ ID NO: 50484 - RNA, 45 nt, Mus musculus
ugugugucugugucucucugugugugugucucugugugugugucu

SEQ ID NO: 50485 - RNA, 41 nt, Mus musculus
gucccucacaaacacugcuaggcaggcaggcuggggggagg

SEQ ID NO: 50486 - RNA, 46 nt, Mus musculus
ugccuuuucuugaugcugugacaaaacaccagacaggcaggugcug

SEQ ID NO: 50487 - RNA, 45 nt, Mus musculus
aaaacuuaauucacaagguaaaguaggcuaucaaagggucagaag

SEQ ID NO: 50488 - RNA, 47 nt, Mus musculus
cuagggaguuuugcugaguaagugagcuuaaauuucagugagagauc

SEQ ID NO: 50489 - RNA, 46 nt, Mus musculus
cuuugggugcaagugugccguuuguaaaguggauauguguuugugu

SEQ ID NO: 50490 - RNA, 25 nt, Mus musculus
agugucagagagagaaagggugaaa

SEQ ID NO: 50491 - RNA, 42 nt, Mus musculus
aguuagggaugagguaggaggggcagggaaacagguccagac

SEQ ID NO: 50492 - RNA, 46 nt, Mus musculus
acauuauacaucuuuauucagacagucggagauaugaaggccagug

SEQ ID NO: 50493 - RNA, 41 nt, Mus musculus
gcaaacucagacaagugagauggcugugcuugcuggcaaca

SEQ ID NO: 50494 - RNA, 42 nt, Mus musculus
cagcuugauccacucacaaauacuucacagauacaccagcag

SEQ ID NO: 50495 - RNA, 42 nt, Mus musculus
cacaguuccaaccacuguuuccuucauugcuggccaccuuau

SEQ ID NO: 50496 - RNA, 41 nt, Mus musculus
uaagugagaggaaugagaaauuaaaccaggauagcucgagu

SEQ ID NO: 50497 - RNA, 45 nt, Mus musculus
agggugcguuagagaaacuauugccuguugcaguuguccugguga

SEQ ID NO: 50498 - RNA, 46 nt, Mus musculus
aagauuuuaaaagaauagaaaguccucaaagacuacauggcuauaa

SEQ ID NO: 50499 - RNA, 46 nt, Mus musculus
aaaguguuaacugagaacagccacaacccuaccuccugggguagag

SEQ ID NO: 50500 - RNA, 42 nt, Mus musculus
gaggaggaggaggaggaggaggaggaggaggaggagggucau

SEQ ID NO: 50501 - RNA, 24 nt, Mus musculus
aggaagggagagugaguggggaga

SEQ ID NO: 50502 - RNA, 45 nt, Mus musculus
acuggucucuaggagccuuggggugauagcaaacaguacaaggaa

SEQ ID NO: 50503 - RNA, 45 nt, Mus musculus
uuccuauagagaagaguagaggaggaagaggagaaggagggagag

SEQ ID NO: 50504 - RNA, 46 nt, Mus musculus
uuucaugagaugcuauaauguuuguuugcuauuuaaauggcauauu

SEQ ID NO: 50505 - RNA, 46 nt, Mus musculus
gagccgcuuguuuguuuucagaugugauuuaucuggugcgccaggg

SEQ ID NO: 50506 - RNA, 42 nt, Mus musculus
cuccugagggccugcgggggcaacugagaacauccuggagcc

SEQ ID NO: 50507 - RNA, 42 nt, Mus musculus
caggucgcagcuccgaauggggaauuaaagguccugcccauc

SEQ ID NO: 50508 - RNA, 45 nt, Mus musculus
cuacauucggagagagaaaagagccagaaagcuggugcuuacuga

SEQ ID NO: 50509 - RNA, 42 nt, Mus musculus
gcuuauccuuaaaggaguucucagauguugugucagagggag

SEQ ID NO: 50510 - RNA, 26 nt, Mus musculus
gcacuuacaagaauaauccaccaggc

SEQ ID NO: 50511 - RNA, 46 nt, Mus musculus
auuggauuuuaauuagauuuuuaaagguuccucacagcuuauagaa

SEQ ID NO: 50512 - RNA, 45 nt, Mus musculus
uguaugauucuggagaaaggggaaguguagcucagguagagggca

SEQ ID NO: 50513 - RNA, 46 nt, Mus musculus
agaaagaaagaaagagagagaagagggagacagagagagagagaga

SEQ ID NO: 50514 - RNA, 45 nt, Mus musculus
agacggacagacagacagaaggaagggaaagaaagaaagaaagaa

SEQ ID NO: 50515 - RNA, 46 nt, Mus musculus
ucacaaccauccguaaugagaucugacucccucuucugcugugucu

SEQ ID NO: 50516 - RNA, 42 nt, Mus musculus
ccgucaucccagcagcucaggcaggguauguuuagccagccu

SEQ ID NO: 50517 - RNA, 24 nt, Mus musculus
ugcccuugucuccugggaagaugc

SEQ ID NO: 50518 - RNA, 48 nt, Mus musculus
augcccccccaugggaagucauagacauagguaggggacacaagcaag

SEQ ID NO: 50519 - RNA, 46 nt, Mus musculus
gugugcgauggugccuaggcggcagcugggccguguuggcacggag

SEQ ID NO: 50520 - RNA, 45 nt, Mus musculus
ggucacuguugcucugaugaaacaccaugaccaaaagcaaccugg

SEQ ID NO: 50521 - RNA, 42 nt, Mus musculus
uacccugugaagcuuuccugccuuuugggaagcaccagccag

SEQ ID NO: 50522 - RNA, 77 nt, Mus musculus
ggacaugcugagcaagagaguucuaucucaaagccuagaugacacacaggaccuauggagaaguccauggaaggaug

SEQ ID NO: 50523 - RNA, 42 nt, Mus musculus
cuuccgacaucccgcucuccuuccagcagucacacggcccuu

SEQ ID NO: 50524 - RNA, 70 nt, Mus musculus
cuccugagggguccagaccugaacagaaggagcagaagggccgugugacugcuggaaggagagcgggaug

SEQ ID NO: 50525 - RNA, 40 nt, Mus musculus
gauggauauuuuuggauggugacugccugcucugugcaga

SEQ ID NO: 50526 - RNA, 43 nt, Mus musculus
ggggagccguguccguaccguuuuuugauagggagaacauuaa

SEQ ID NO: 50527 - RNA, 46 nt, Mus musculus
uuauagagagcuucuugaggguggagcauuuggugcgugauuggag

SEQ ID NO: 50528 - RNA, 46 nt, Mus musculus
gaucagugcagccagcggcaacccugaccugauaaaacuguuggac

SEQ ID NO: 50529 - RNA, 46 nt, Mus musculus
aguucagacuacaacaaaugcuuuucaaaaggaauugacaggaagg

SEQ ID NO: 50530 - RNA, 42 nt, Mus musculus
acccaacugcacacauggugcaugcugucugaaaacgggagu

SEQ ID NO: 50531 - RNA, 46 nt, Mus musculus
caaaggagauagggaugggaagaacacgggggugauugguggucag

SEQ ID NO: 50532 - RNA, 46 nt, Mus musculus
caggcagacaaggagcagagccaugagaacuggcagagggggcaga

SEQ ID NO: 50533 - RNA, 46 nt, Mus musculus
cacuucuguaaccuccucagaccuuuguaccaaaaaucuggcagga

SEQ ID NO: 50534 - RNA, 46 nt, Mus musculus
uggaagauugugaagaacaaggcuuaugaaaaugaagcagggagaa

SEQ ID NO: 50535 - RNA, 57 nt, Mus musculus
uagacuguguuuaguccauuucugguuuuccuauuuguuuuugggagaggguugggg

SEQ ID NO: 50536 - RNA, 46 nt, Mus musculus
uucugugacccauguucugacaucccaccauuccucagccccgaug

SEQ ID NO: 50537 - RNA, 46 nt, Mus musculus
auaugugcacgugcacacacacacacacacacacacacgcacuaaa

SEQ ID NO: 50538 - RNA, 46 nt, Mus musculus
ggcuuuucucuucuauuaacuuucuaauaaaaaaauccaugcacac

SEQ ID NO: 50539 - RNA, 45 nt, Mus musculus
uuacucaugguggagacagccaucguggaugguagacaauaaaag

SEQ ID NO: 50540 - RNA, 32 nt, Mus musculus
cccucucccucucuuccccccccccucuccuu

SEQ ID NO: 50541 - RNA, 46 nt, Mus musculus
gagaaacccugacucggggagaaaaaaaaaacagucacccuggaau

SEQ ID NO: 50542 - RNA, 42 nt, Mus musculus
caugccugacuuuucauugugcuguucuuacacacgugccuu

SEQ ID NO: 50543 - RNA, 42 nt, Mus musculus
uucauugcguuugaagguaaugggcuuugcaguaaugaagag

SEQ ID NO: 50544 - RNA, 46 nt, Mus musculus
cagcagccgagcuagguggguuuguaggugugcgguagaccuugag

SEQ ID NO: 50545 - RNA, 45 nt, Mus musculus
aagagugagagaagucaugucugccacugggaaucuaaccaacuc

SEQ ID NO: 50546 - RNA, 46 nt, Mus musculus
uuguugagugggucugaagacaagaaagccgcugguuacugccaag

SEQ ID NO: 50547 - RNA, 45 nt, Mus musculus
gcauguacuguaugcuacgacaaaaagaggagucaauggcgauau

SEQ ID NO: 50548 - RNA, 51 nt, Mus musculus
agaaaggaagaaagagaaagagagauugagagauagaaagauugaaagaga

SEQ ID NO: 50549 - RNA, 42 nt, Mus musculus
agcagcaaguguccaauaguccaaauaagacagcguucaggg

SEQ ID NO: 50550 - RNA, 45 nt, Mus musculus
aaagcuauucccugauucucccccuuggauauaguaaaugcccag

SEQ ID NO: 50551 - RNA, 46 nt, Mus musculus
augcugagugguaaagauaccguucagcacuggaacuggaccucag

SEQ ID NO: 50552 - RNA, 45 nt, Mus musculus
caugacaauuuguuguaugaguccaacgaaagugcuuucaggaca

SEQ ID NO: 50553 - RNA, 46 nt, Mus musculus
aaaaggagggcugugugugugugugugugugugugugugugugugu

SEQ ID NO: 50554 - RNA, 46 nt, Mus musculus
cuccuucaaaaagaguauuauuucuacagaauauuuuaccaggcag

SEQ ID NO: 50555 - RNA, 46 nt, Mus musculus
gcugaagguuuugcuuguguuugucugcccugagucuuucccuccu

SEQ ID NO: 50556 - RNA, 45 nt, Mus musculus
ugauguccuucacuuucaacgaagucggaucaugaggagcaacug

SEQ ID NO: 50557 - RNA, 45 nt, Mus musculus
uucuuuuucaguauuuuauuccauuuuuguuuagacuugccccag

SEQ ID NO: 50558 - RNA, 93 nt, Mus musculus
uggaaaaauacuuuccuacaauguuucguguucauugaacgaggagacacagucaguuuuggagaucuucgauccucaacacagagcagagau

SEQ ID NO: 50559 - RNA, 42 nt, Mus musculus
gguuguuucaaagacuggauacgcccagauguguggccgugc

SEQ ID NO: 50560 - RNA, 42 nt, Mus musculus
cauggccaaggaagacaagggcagucucccauggggacagga

SEQ ID NO: 50561 - RNA, 45 nt, Mus musculus
gcugaacacuccagaaccagucuagauccuacuaugugucuacca

SEQ ID NO: 50562 - RNA, 45 nt, Mus musculus
guagucacaagucauguuggggucgugacgccaggugaggaagau

SEQ ID NO: 50563 - RNA, 46 nt, Mus musculus
gcccugccuccuggacuggagaaagguuccuucaaacagcacggag

SEQ ID NO: 50564 - RNA, 45 nt, Mus musculus
cuguuugaaggaaccuuucuccaguccaggaggcagggcucagac

SEQ ID NO: 50565 - RNA, 42 nt, Mus musculus
gcccuguccaagggcacccuacuuguucugcaagcccaagug

SEQ ID NO: 50566 - RNA, 47 nt, Mus musculus
ucacaaaggggccugcugggugaugcagagagaacggagggcugaag

SEQ ID NO: 50567 - RNA, 41 nt, Mus musculus
gaccgugcugaccacacgguggugccugggaaguaggaaua

SEQ ID NO: 50568 - RNA, 46 nt, Mus musculus
caauuauggaacguaacaguugguaucccugguuagugcacccaua

SEQ ID NO: 50569 - RNA, 46 nt, Mus musculus
auaccaacuguuacguuccauaauuggauacguagaagaacugggu

SEQ ID NO: 50570 - RNA, 45 nt, Mus musculus
ucccauugucgcgccaaauuucaccguggaagauacgucggcaga

SEQ ID NO: 50571 - RNA, 43 nt, Mus musculus
agagcuccgaggcuuccuaagaggguauuuauuuuacuuucag

SEQ ID NO: 50572 - RNA, 46 nt, Mus musculus
ccuuucugaaaguaaaauaaauacccucuuaggaagccucggagcu

SEQ ID NO: 50573 - RNA, 46 nt, Mus musculus
uguccuacaccucauacucugcuuacccagccccagagcggugacc

SEQ ID NO: 50574 - RNA, 45 nt, Mus musculus
aggacauccagagcuggcucuggggucccugggccugcaaggagu

SEQ ID NO: 50575 - RNA, 51 nt, Mus musculus
ggcuuggcuuggcgguggcuuggaggugaccauggcuaggagugcagagag

SEQ ID NO: 50576 - RNA, 109 nt, Mus musculus
ggugaaggccaucaccgugucuccccacagcggauccugauggaaagaggcaguccacgguuuuaagacguuuauugucauggcugaaaguggaugagugaaaccauac

SEQ ID NO: 50577 - RNA, 82 nt, Mus musculus
ccccuucucagggugggccugagguuaaauaccuugggcagggaggaguaucagaguuuucccuuagucacagacagggaag

SEQ ID NO: 50578 - RNA, 44 nt, Mus musculus
augccacauccccuacagagucagagaagccagaguugggagua

SEQ ID NO: 50579 - RNA, 93 nt, Mus musculus
gaguuuaaagugaccucagggugagugagauuauccuuugcuuuagaucauucugacaucaagcuaaagaacaucacugacauaucccagaag

SEQ ID NO: 50580 - RNA, 64 nt, Mus musculus
auugccauccucaucccaguggcuguggcugucauuguuggcgugguaacgagcauccuuugcu

SEQ ID NO: 50581 - RNA, 44 nt, Mus musculus
uagccauggucaauuuaucuuugaaggggugugggguggggaga

SEQ ID NO: 50582 - RNA, 30 nt, Mus musculus
cuugggagucucccagcagagcgagagcaa

SEQ ID NO: 50583 - RNA, 24 nt, Mus musculus
cugcccuggggagagcccuggagg

SEQ ID NO: 50584 - RNA, 46 nt, Mus musculus
aaugaaaggaguaauacacaaauagaauaaccuauuucggcaacua

SEQ ID NO: 50585 - RNA, 46 nt, Mus musculus
auucuacccagauauucccaauccagaaaacuguaaggcgcuacag

SEQ ID NO: 50586 - RNA, 46 nt, Mus musculus
gcucuuaagacauuggaaaugaaccccuguaccccgaacaacguug

SEQ ID NO: 50587 - RNA, 47 nt, Mus musculus
guguacaucgaugugcaguccauguaucagccgcaagccaaagcaga

SEQ ID NO: 50588 - RNA, 79 nt, Mus musculus
caaguggagucugaugaugaagagucaaagaaugaaccagaauggaaaaaacguaaaauuugaagaaucucguugaaga

SEQ ID NO: 50589 - RNA, 46 nt, Mus musculus
uuaaugauuuauauuuaauaauugaaaugcaaucagugccccagac

SEQ ID NO: 50590 - RNA, 45 nt, Mus musculus
aaggggcaagccuuggcuccagagaguuguaggggcggagggagc

SEQ ID NO: 50591 - RNA, 46 nt, Mus musculus
ugccuuacugagccgguucacgguucaccguauccacacgguagga

SEQ ID NO: 50592 - RNA, 46 nt, Mus musculus
cccaccuauaaagagccuauuaaaagucauauugaguucauaagcc

SEQ ID NO: 50593 - RNA, 46 nt, Mus musculus
gccucugccucccaagugcugggauuaaaggcuuccaccaccacua

SEQ ID NO: 50594 - RNA, 45 nt, Mus musculus
gcacccuguccuccuacauugugaagaacaucgcuuuggacaaga

SEQ ID NO: 50595 - RNA, 46 nt, Mus musculus
cauguuccgugagccccgccagcgaaguacgaggaaacagcuggag

SEQ ID NO: 50596 - RNA, 46 nt, Mus musculus
auuacaguguucuagguuaacauguuauucugugaaucaacaagau

SEQ ID NO: 50597 - RNA, 42 nt, Mus musculus
uuucugcuggggucuacuacauacagggagagggagggggag

SEQ ID NO: 50598 - RNA, 52 nt, Mus musculus
uuggaacuggaaauggacuggcaaaaguguacuacgaccccaacaagaguca

SEQ ID NO: 50599 - RNA, 45 nt, Mus musculus
cagaguaccaguuauucaucaccagacaugaauucagaccauagc

SEQ ID NO: 50600 - RNA, 46 nt, Mus musculus
acauugauggagucauacuuaggauugucauuuggugcuguguaag

SEQ ID NO: 50601 - RNA, 46 nt, Mus musculus
ucauucugcggguguucugcagcggcaguacacaggguguaaaguu

SEQ ID NO: 50602 - RNA, 46 nt, Mus musculus
ucauucugcuaguguucugcagcggcaguacacaggguguaaagau

SEQ ID NO: 50603 - RNA, 46 nt, Mus musculus
ucauucugcgaguguucugcaguggcaguacacaggguguaaagau

SEQ ID NO: 50604 - RNA, 46 nt, Mus musculus
ucauucugcgaguguucugcagcggcaguacacaggguguaaagau

SEQ ID NO: 50605 - RNA, 46 nt, Mus musculus
uauguaaagacugugggacuuuuaaaguuguuuaggucuuguggau

SEQ ID NO: 50606 - RNA, 46 nt, Mus musculus
uuuuggagauaccaguaccaugagaugaccaccaagaacagcagca

SEQ ID NO: 50607 - RNA, 46 nt, Mus musculus
ugaggaguaauacacagagcuuccugcagugcagaugccaccagaa

SEQ ID NO: 50608 - RNA, 46 nt, Mus musculus
acucagacuguagucagcuucuguuauuuaugccuguggaggagag

SEQ ID NO: 50609 - RNA, 48 nt, Mus musculus
ucauguguguucuuguuaggggagaacacuuauaugucaaguuugaag

SEQ ID NO: 50610 - RNA, 67 nt, Mus musculus
uuaaaauuaauaacauugauguuuaagaaaauugcuguauguauuaccuaagcauauaaaaugccaa

SEQ ID NO: 50611 - RNA, 46 nt, Mus musculus
uucuuauugaaaguaguauauacaaaaucuuagaaaagacagaaga

SEQ ID NO: 50612 - RNA, 50 nt, Mus musculus
ugcaucuucccuuacccuacaagaucuaauccuucagacacaucccaacu

SEQ ID NO: 50613 - RNA, 46 nt, Mus musculus
uuauugcuuacaucuucaggagccagagugcaaagaagcaagagag

SEQ ID NO: 50614 - RNA, 46 nt, Mus musculus; identical to SEQ ID NO: 50613

SEQ ID NO: 50615 - RNA, 42 nt, Mus musculus
ucugcuauaacuacagcaccacaguagugugucggcccaguc

SEQ ID NO: 50616 - RNA, 41 nt, Mus musculus
uucucuccauaagacuuguuagggccuuguagacuggcuga

SEQ ID NO: 50617 - RNA, 48 nt, Mus musculus
gacugcugcuucagcccugacgacaaacucauaguuaccgguaccucu

SEQ ID NO: 50618 - RNA, 44 nt, Mus musculus
ugggauguccggcaauuuaauaagccauuauuuucagccucaga

SEQ ID NO: 50619 - RNA, 45 nt, Mus musculus
caaggcuuagugggacuguguuuuuguuaauguaccuuugucagu

SEQ ID NO: 50620 - RNA, 46 nt, Mus musculus
cugugugcacugugucuggaauauacuaagaauaaaaugggcauuu

SEQ ID NO: 50621 - RNA, 41 nt, Mus musculus
gccaccuuuguaaaacaaacaagcaaacacucgccccuuga

SEQ ID NO: 50622 - RNA, 42 nt, Mus musculus
uucucaauccgggguuucauagaucaucuaguucccagauaa

SEQ ID NO: 50623 - RNA, 45 nt, Mus musculus
cauguauauguuugugggucauaaaaccguaaaaggggucuugag

SEQ ID NO: 50624 - RNA, 27 nt, Mus musculus
uuaauucuaaccaaccaagugaaagac

SEQ ID NO: 50625 - RNA, 45 nt, Mus musculus
uaagcacuuuuuagcagauugauaauggguaccuuauagcaagua

SEQ ID NO: 50626 - RNA, 42 nt, Mus musculus
auccuuaagagucucuuucggauuacuuuuccuggaccagag

SEQ ID NO: 50627 - RNA, 45 nt, Mus musculus
auauuguagcucgacucaccauuuuuucaugauuauuaaagagau

SEQ ID NO: 50628 - RNA, 45 nt, Mus musculus
gaggggaauagaucaucacgaauagaaagacauuugagcauugga

SEQ ID NO: 50629 - RNA, 46 nt, Mus musculus
uaucugacauccauacacagacauacaugcaggcaaagcaucagua

SEQ ID NO: 50630 - RNA, 42 nt, Mus musculus
acaugucuuugcguaaacaugcauagaugacauugaggagaa

SEQ ID NO: 50631 - RNA, 42 nt, Mus musculus
ugcuuacucauucuaccuaccuauuuuuacuuugggccagau

SEQ ID NO: 50632 - RNA, 45 nt, Mus musculus
uauuugccuuacucuccccacauuaguguucaucacugaaggaag

SEQ ID NO: 50633 - RNA, 41 nt, Mus musculus
guccgggguuuuaaggcauuuauuguagaaaggcagagaga

SEQ ID NO: 50634 - RNA, 53 nt, Mus musculus
aacuuaacuuaaacugcagauguacccagauggaauuggcucaagguaucaga

SEQ ID NO: 50635 - RNA, 46 nt, Mus musculus
guuuuaaaaaacuguacaugacaggaggcuggcaagaggguucagc

SEQ ID NO: 50636 - RNA, 46 nt, Mus musculus; identical to SEQ ID NO: 24286

SEQ ID NO: 50637 - RNA, 50 nt, Mus musculus
guuuuuccggcaaugagcccgggaauggacagucacaggcuugcagauga

SEQ ID NO: 50638 - RNA, 45 nt, Mus musculus; identical to SEQ ID NO: 24288

SEQ ID NO: 50639 - RNA, 50 nt, Mus musculus
ccggcgcuuucgugcuuccuuggucuuagaccugcgagccucagccuggu

SEQ ID NO: 50640 - RNA, 46 nt, Mus musculus
caagaagcuauaaagaggccuuuguguuaggcguagauggaaaagg

SEQ ID NO: 50641 - RNA, 46 nt, Mus musculus
cuaugaguuuccauuuccugaucuucgaguuacuuaaacugcaguc

SEQ ID NO: 50642 - RNA, 46 nt, Mus musculus
acgggaaccuuguggccgcugccugccagaacggaagcauucagau

SEQ ID NO: 50643 - RNA, 46 nt, Mus musculus
cuuuggagaaaaauuaagccaagaucuaagugauuuccgugcagaa

SEQ ID NO: 50644 - RNA, 42 nt, Mus musculus
gaagcugcaacauccuggaugcugcugccauggcaucaaguc

SEQ ID NO: 50645 - RNA, 41 nt, Mus musculus
acacacacacacacgcacacacaguuugagaagcucagagu

SEQ ID NO: 50646 - RNA, 46 nt, Mus musculus
aaagaaccagagguuaacucugacaagaagacagugcuuaagagac

SEQ ID NO: 50647 - RNA, 42 nt, Mus musculus
acauggggaaaagaaaccgagaaaggcuuaauuaggggguga

SEQ ID NO: 50648 - RNA, 46 nt, Mus musculus
gaggcuggaagagggcaugggauccuuuuauacuggauguacagau

SEQ ID NO: 50649 - RNA, 46 nt, Mus musculus
uguccaggcaugguuuucuggccacuaaaauuucaguuaagaagau

SEQ ID NO: 50650 - RNA, 45 nt, Mus musculus
gcugugcagcauguuuuucucaaaguggagcauuucuguugagag

SEQ ID NO: 50651 - RNA, 46 nt, Mus musculus
gggggaaucaucugaauugaacagcguguuucuggccgugguaguu

SEQ ID NO: 50652 - RNA, 45 nt, Mus musculus
aggcucugucagguuuuugucagagauuuuuuuuuaaagaaagga

SEQ ID NO: 50653 - RNA, 45 nt, Mus musculus
aaaccuacugucugaggauauaugggagacaaugaugaagaagau

SEQ ID NO: 50654 - RNA, 47 nt, Mus musculus
agcagcaagcauucugaacugccgagccaccucuccugccccaaguu

SEQ ID NO: 50655 - RNA, 46 nt, Mus musculus
gugagcaccacaguuuuaauguuucacuuagaauuuaaccacagau

SEQ ID NO: 50656 - RNA, 46 nt, Mus musculus
auaagcucuaaagacgaauuagacaguaaaaaauuuuccaaguuuu

SEQ ID NO: 50657 - RNA, 42 nt, Mus musculus
ccacaauaagaauaugaccaaggauaagaguauggcacaggg

SEQ ID NO: 50658 - RNA, 41 nt, Mus musculus
uuuuuauuuuuuaagugugugugugugugugugugugugug

SEQ ID NO: 50659 - RNA, 47 nt, Mus musculus
gaaggugcuuuccugaccaaagugauccugaaacccugagauucgaa

SEQ ID NO: 50660 - RNA, 45 nt, Mus musculus
aaacagagaacauagaaggauuuaccacacauaaagcaguuauca

SEQ ID NO: 50661 - RNA, 46 nt, Mus musculus
agagcgauauuuuucuuguauagcuuuauuuuggacuuuguuagag

SEQ ID NO: 50662 - RNA, 41 nt, Mus musculus
agaagguagaaacagagaggcuggccauggcacgugcagag

SEQ ID NO: 50663 - RNA, 46 nt, Mus musculus
uuaggcaggagauagaggugggacauuccggucgaggcuggaagaa

SEQ ID NO: 50664 - RNA, 45 nt, Mus musculus
acgauaagauuuuucuucuuuguaauuaaugaguaauuugcagag

SEQ ID NO: 50665 - RNA, 86 nt, Mus musculus
cuacugcuagguguaagcguguuuucagaugaaccuacuucuauccuuuccauuauuaauauaaaaauuuucucuccucgccuuca

SEQ ID NO: 50666 - RNA, 45 nt, Mus musculus
ccuagcaaacacguucuccaaugcgccaucucaagggccccacag

SEQ ID NO: 50667 - RNA, 45 nt, Mus musculus
ggcccugucauuccgcuguacuggggcauauaaugauugcaagac

SEQ ID NO: 50668 - RNA, 46 nt, Mus musculus
acuauuggaaaaagcugggaugguaggaugaugaguuuggcuagcu

SEQ ID NO: 50669 - RNA, 68 nt, Mus musculus
ugcucaugugggugcugaggcuagaacccaguaagugcuuuuagcuguugagcccucaacccccaugu

SEQ ID NO: 50670 - RNA, 46 nt, Mus musculus
uggaagagagagagagaaagagagagagagagagagagagaacuug

SEQ ID NO: 50671 - RNA, 45 nt, Mus musculus
aauaauuacaaugcaauaaaaacagagaaaaaaaaugagccaaag

SEQ ID NO: 50672 - RNA, 45 nt, Mus musculus
auaaaagcucuauuuauuuuuauuuuauuuucuacuguucuugga

SEQ ID NO: 50673 - RNA, 45 nt, Mus musculus
gguguccuuaaacacagacacauaucaaauaaauuauguauugau

SEQ ID NO: 50674 - RNA, 45 nt, Mus musculus
auuugugaacucaccuauauacuuaaacuuuuuauaaccccagau

SEQ ID NO: 50675 - RNA, 59 nt, Mus musculus
guguggauuguuugggagguuuuagguaggauagugucaccaggccucccucagauggu

SEQ ID NO: 50676 - RNA, 48 nt, Mus musculus
agccuggucuguaaagcgaguuccaggccagccagggcugcaucgaga

SEQ ID NO: 50677 - RNA, 46 nt, Mus musculus
gugggcagggggaagaaagaaagagacaaaggaaaaggaaagaaca

SEQ ID NO: 50678 - RNA, 45 nt, Mus musculus
guuuugucacagcauagaaaauuaacuacaguauaggcaccucug

SEQ ID NO: 50679 - RNA, 42 nt, Mus musculus
ggauaugauuacgauguuaaauuuugggauuuugcuggaaug

SEQ ID NO: 50680 - RNA, 46 nt, Mus musculus
caugugaagcucaagacugagaaaaugaugaauguccuuuaaagag

SEQ ID NO: 50681 - RNA, 46 nt, Mus musculus
aguauuuaaaauacuucgcuuuaaucacaagaaaaaacugucaaau

SEQ ID NO: 50682 - RNA, 46 nt, Mus musculus
cucucgugaguucuuggguguccacuauugucccgaggccugagcg

SEQ ID NO: 50683 - RNA, 44 nt, Mus musculus
ugaaagauccugacagaauguaaaaggucacagaagccuugaaa

SEQ ID NO: 50684 - RNA, 46 nt, Mus musculus
agggggaaggagagacauuuuuauuccaauugucuccuauuuagag

SEQ ID NO: 50685 - RNA, 46 nt, Mus musculus
ugaacucacaaaaaucagccugacucugccucccaagugcugggau

SEQ ID NO: 50686 - RNA, 46 nt, Mus musculus
ucuaucagagaaacuucaugaggaggagcagaccuuggccuuggaa

SEQ ID NO: 50687 - RNA, 24 nt, Mus musculus
ugagaauagaagaugaggccaauu

SEQ ID NO: 50688 - RNA, 45 nt, Mus musculus
acgaaagguuaaaaguaaagaaauauacaaggauauugcagagac

SEQ ID NO: 50689 - RNA, 47 nt, Mus musculus
aggaagaaaugaacagagaaaaagaauuaagaaaacaaauugaagau

SEQ ID NO: 50690 - RNA, 46 nt, Mus musculus
gagcaggagugcucuuaaccacugagccaucucuccagccccuggu

SEQ ID NO: 50691 - RNA, 46 nt, Mus musculus
uaauuccuuugcuuuucauguccccuucccagaugccaagugagau

SEQ ID NO: 50692 - RNA, 45 nt, Mus musculus
ucuuuaaaaaauauuuguguguguguguguguguguguguggaga

SEQ ID NO: 50693 - RNA, 40 nt, Mus musculus
gcaaaaggaaagcaugcagcaaugauguagagggcaaaga

SEQ ID NO: 50694 - RNA, 46 nt, Mus musculus
ugugcccagcaguuaguuuugguuuuaaaaugcugaauuguggggc

SEQ ID NO: 50695 - RNA, 45 nt, Mus musculus
gcuaccaauaccuagaucugacccaaauucaauuuuagugacaaa

SEQ ID NO: 50696 - RNA, 41 nt, Mus musculus
cgaaggacagcgguggaaagaagccggaaaacacuggguaa

SEQ ID NO: 50697 - RNA, 45 nt, Mus musculus
cuuuuaaaaguuauauuuaaaaaauuaguuuacuguggcuggaga

SEQ ID NO: 50698 - RNA, 41 nt, Mus musculus
gacccucagcuggcggucaccaugggcuucacaggauucgg

SEQ ID NO: 50699 - RNA, 46 nt, Mus musculus
accuccaaccaaaaaauuucgcaaagccacaaagccaaugacccag

SEQ ID NO: 50700 - RNA, 42 nt, Mus musculus
agaaaaauaccagaagcaaagauagucuuuguacuugacaag

SEQ ID NO: 50701 - RNA, 46 nt, Mus musculus
ccuauugcuuuguauuuagcuauuugauaaauauuagauuacucag

SEQ ID NO: 50702 - RNA, 46 nt, Mus musculus
agauaggcagagcuacauagugagacugugucucaaaaaaaagaag

SEQ ID NO: 50703 - RNA, 41 nt, Mus musculus
agcuuccaggcuagccugagcuaacagugagacugccucaa

SEQ ID NO: 50704 - RNA, 42 nt, Mus musculus
aagaaaaagggagagggaaggaaagagaaaagaaggaagccu

SEQ ID NO: 50705 - RNA, 44 nt, Mus musculus
ucuagucaauguuugcccguguauaccagucaucuugggggcau

SEQ ID NO: 50706 - RNA, 47 nt, Mus musculus
uuuauguacuuuaauacuuuaacauaguaauauuuaagcaucagaau

SEQ ID NO: 50707 - RNA, 46 nt, Mus musculus
ugcugguuuuggcaaccccuguggauauaguaauucuuggacucag

SEQ ID NO: 50708 - RNA, 30 nt, Mus musculus
gcauguguggcggcaugcagcugcuuccag

SEQ ID NO: 50709 - RNA, 33 nt, Mus musculus
gaagcaggcugguucagucaaagauguaggaag

SEQ ID NO: 50710 - RNA, 44 nt, Mus musculus
guucaaauugaaauugauaauuccagaaauauuuuguauacacg

SEQ ID NO: 50711 - RNA, 42 nt, Mus musculus
uguucagauagcugugauugagaguucugaaucccuggacug

SEQ ID NO: 50712 - RNA, 46 nt, Mus musculus
gucucugugucugugugucugugugugucugugugucugugugugu

SEQ ID NO: 50713 - RNA, 46 nt, Mus musculus
guauuucagcacuuguccguuuagacagccauuagcucggccgaau

SEQ ID NO: 50714 - RNA, 48 nt, Mus musculus
uuauggugugucaaccaugauacauuuccuuuucaaaagccaaugaug

SEQ ID NO: 50715 - RNA, 46 nt, Mus musculus
aauugcaccaacacauauaaaugcuggggaucaaaacuggguccuc

SEQ ID NO: 50716 - RNA, 45 nt, Mus musculus
cugucuucagacacaccagaagagggcaucagauccucaucaaag

SEQ ID NO: 50717 - RNA, 63 nt, Mus musculus
cuuuugccucaugcucugagguguggucuuaccaacaguagauaguuucuccgauugugcaac

SEQ ID NO: 50718 - RNA, 42 nt, Mus musculus
ccacaauuccuuccagaaccacuguccccaacuccuagcccu

SEQ ID NO: 50719 - RNA, 46 nt, Mus musculus
ugauuuguaccguccaccuuccacuggagcacgcaaaggccauaau

SEQ ID NO: 50720 - RNA, 45 nt, Mus musculus
guucacuugguauuuguguucuauauuaaucguaaaagaggaggg

SEQ ID NO: 50721 - RNA, 46 nt, Mus musculus
uaugucuuuaagaaauguuugcaaacugucauuuccaaccuuacag

SEQ ID NO: 50722 - RNA, 42 nt, Mus musculus
uaucacugcuucuaaauuaguaguuuauaugugaggcuucau

SEQ ID NO: 50723 - RNA, 45 nt, Mus musculus
cagaguggaucagaacagaguccgcuauauggauuuacucuggag

SEQ ID NO: 50724 - RNA, 46 nt, Mus musculus
aagagcacucagugcucuuaaccucugagccaucuccagcccccaa

SEQ ID NO: 50725 - RNA, 42 nt, Mus musculus
gaggggggaggagagggagaggggggagagggagagggggga

SEQ ID NO: 50726 - RNA, 45 nt, Mus musculus
ugggaaaguaacuaaaguucucuuugacagcuugucacuggccag

SEQ ID NO: 50727 - RNA, 41 nt, Mus musculus
gcugguguugaacuuguggcauuccugccucugcuggcauu

SEQ ID NO: 50728 - RNA, 45 nt, Mus musculus
uacaggugagauuuuugacuccagguauagguagguuaucauuua

SEQ ID NO: 50729 - RNA, 45 nt, Mus musculus
guauccauguacuguugacaagauauguugagaauccuagccuag

SEQ ID NO: 50730 - RNA, 46 nt, Mus musculus
gucuaugaacagcuggaauaagacuguguaugauuaugacacacaa

SEQ ID NO: 50731 - RNA, 45 nt, Mus musculus
uaucaaagacaaaaaaaccugagaauuacuaaggcuaaccaagag

SEQ ID NO: 50732 - RNA, 45 nt, Mus musculus
ugguuucuacuccuuaguuguuuuguuauuuuauuuuugcagcag

SEQ ID NO: 50733 - RNA, 42 nt, Mus musculus
cugaaugaguuaaguucacaguccucaacuccccacccccac

SEQ ID NO: 50734 - RNA, 45 nt, Mus musculus
aggaagcugcuuagguggaagaagaaaggguuuaaagucguggau

SEQ ID NO: 50735 - RNA, 41 nt, Mus musculus
agcuucugagucccuuccagacgcugucuggcgagguccga

SEQ ID NO: 50736 - RNA, 46 nt, Mus musculus
aaggucuucuguagacagccuggagacuggaauucuacagugggag

SEQ ID NO: 50737 - RNA, 46 nt, Mus musculus
ugagacagagauuguaagacuuauuuaaucaaucuuuacggcacaa

SEQ ID NO: 50738 - RNA, 46 nt, Mus musculus
augagaucugacacccucuucuggugugucugaagacagcugcagu

SEQ ID NO: 50739 - RNA, 47 nt, Mus musculus
cuugcuugguaucucugcuuucucauugucuucauacugccgcugga

SEQ ID NO: 50740 - RNA, 45 nt, Mus musculus
acacacacacacacacacacacacacacagagagagagaaacaga

SEQ ID NO: 50741 - RNA, 42 nt, Mus musculus
cagucauaugcaagaucuggagguuucuccaucaccggcaag

SEQ ID NO: 50742 - RNA, 45 nt, Mus musculus
ugaagacuuacuuuaaggcagccaaacugaugacagagaaggcag

SEQ ID NO: 50743 - RNA, 46 nt, Mus musculus
ccauguucugucauuggguuuugcuccauuuuaacuuuugugguag

SEQ ID NO: 50744 - RNA, 42 nt, Mus musculus
gucucgcguagcuaaaccaugacauuccacuuccuggccccc

SEQ ID NO: 50745 - RNA, 46 nt, Mus musculus
uggccucucacagugccaaaucucagcugcucuccuugaccccuuc

SEQ ID NO: 50746 - RNA, 96 nt, Mus musculus
cuaauuucuuaguuucagcugaccagcaucaauugucccaguaaucucuccuaagcuuggcaguacugaaacuugcuguagauugaccuugaacuc

SEQ ID NO: 50747 - RNA, 46 nt, Mus musculus
ucugucuccuggaauuaaagucauauaccaccuugucuagaccuaa

SEQ ID NO: 50748 - RNA, 46 nt, Mus musculus
gauuuauucaguucaaaggcaccgucggacucaagugcaauggcag

SEQ ID NO: 50749 - RNA, 45 nt, Mus musculus
uuuacuucuaauucuccuucuuccagaagccauugcuugccugua

SEQ ID NO: 50750 - RNA, 46 nt, Mus musculus
acuuuuagaguccuacucucgcuacccugauacuccuaagccauag

SEQ ID NO: 50751 - RNA, 46 nt, Mus musculus
acucugaagcaguauugguggguaguggagaggagacaggagauag

SEQ ID NO: 50752 - RNA, 45 nt, Mus musculus
aaaagucaccauuguuagcaagacaacgucuaggaaaggcuaugg

SEQ ID NO: 50753 - RNA, 42 nt, Mus musculus
ugugacuguuacaaaaccugacacaaacaaccuaggggaaga

SEQ ID NO: 50754 - RNA, 52 nt, Mus musculus
agagacuuuagucuagcauuacuugauauuuuuuugggcaagaagugaggcu

SEQ ID NO: 50755 - RNA, 41 nt, Mus musculus
ccauauggauucauccaucucccaccagaauacccagccaa

SEQ ID NO: 50756 - RNA, 59 nt, Mus musculus
agguucuccaucugcagacaguucaaagaauagagaaguggaauuauucuguugcaguu

SEQ ID NO: 50757 - RNA, 46 nt, Mus musculus
ucuuugggcuuauucuauauuguugcuggguuuuuaaauucugcag

SEQ ID NO: 50758 - RNA, 48 nt, Mus musculus
aaggaaaguuucccguguuccuggcugacccuauacccacgcaaguau

SEQ ID NO: 50759 - RNA, 45 nt, Mus musculus
aaaagaugcaaaguuaagggaggagguguuaaggaguauggggac

SEQ ID NO: 50760 - RNA, 66 nt, Mus musculus
uaaaaucuuaaugaagaaauaucauuguagggcuggagauguagcuggagagggaagcucggggga

SEQ ID NO: 50761 - RNA, 44 nt, Mus musculus
aguggauguguaaaaccuuaccccacuucucagggugggccuga

SEQ ID NO: 50762 - RNA, 81 nt, Mus musculus
cuugguuuccagcaguucaugggagauaaugauaugacaucagaucuaguugaugaaggaaaagaauuaaucagacgaggu

SEQ ID NO: 50763 - RNA, 46 nt, Mus musculus
auaucuuggaaacaccaugagaaucuuacuuggaguauauaguuac

SEQ ID NO: 50764 - RNA, 47 nt, Mus musculus
uuuuuuaaggcuuuuacauacacguagcgugcuagguauccugucag

SEQ ID NO: 50765 - RNA, 45 nt, Mus musculus
gggaggggauuaccacaauaugaggaacuguguugaagggucuua

SEQ ID NO: 50766 - RNA, 46 nt, Mus musculus
uugagucuuuuaauuuuuauaauuuguuuuguacuugugggugcag

SEQ ID NO: 50767 - RNA, 46 nt, Mus musculus
aagugaacugagaccucaaauaauuacuguauucacuaaacucaug

SEQ ID NO: 50768 - RNA, 41 nt, Mus musculus
uucuauuuguguuucucacagaauacguucuacauggggug

SEQ ID NO: 50769 - RNA, 46 nt, Mus musculus
augcugcuuauaauuucaugauugguuucuggaauaacuuaggcag

SEQ ID NO: 50770 - RNA, 43 nt, Mus musculus
cuuuagccuuguugcauaagacacaaagagauaaugcgucaga

SEQ ID NO: 50771 - RNA, 46 nt, Mus musculus
uuagaggcuugagaaaguucucgcucucucaccuggggccuaagau

SEQ ID NO: 50772 - RNA, 46 nt, Mus musculus
uuggcgcgcugucccugcagcaagggcgcuaacuaugccccuaacc

SEQ ID NO: 50773 - RNA, 46 nt, Mus musculus
ucucuuaaggagagagggauaagaguuuaaaaaaaaaaaggggaau

SEQ ID NO: 50774 - RNA, 46 nt, Mus musculus
uaaacuuuuggucucaagaccuuuuuaaacucuuaaagcagaauca

SEQ ID NO: 50775 - RNA, 46 nt, Mus musculus
ggguccacucugacccaguccuuauguccacuggacagcccagaag

SEQ ID NO: 50776 - RNA, 46 nt, Mus musculus
ucccagcaaccacaugguggcuuacaaccaucuguaacaagaccug

SEQ ID NO: 50777 - RNA, 46 nt, Mus musculus
aaggauuugucacaagcugggcaguaaagguccugguaaagcucag

SEQ ID NO: 50778 - RNA, 45 nt, Mus musculus
ucuaugaaccaucacaacugagcugacaacuauuuggcuaguaag

SEQ ID NO: 50779 - RNA, 42 nt, Mus musculus
ggaagaagaaaacaaucaagggaggcagaaagagggugggag

SEQ ID NO: 50780 - RNA, 44 nt, Mus musculus
ccucugccuuccucgccuucucugcguucugcuccuccacaagc

SEQ ID NO: 50781 - RNA, 50 nt, Mus musculus
ucauacucuuccuuccaggaaaaauucuuuugugugcagaaacucugcca

SEQ ID NO: 50782 - RNA, 46 nt, Mus musculus
ugaagucccucaucagcagugcuggucugaccaacagcaggcgcag

SEQ ID NO: 50783 - RNA, 36 nt, Mus musculus
uuugaauacuuggucccaguugguggaauuguuugg

SEQ ID NO: 50784 - RNA, 42 nt, Mus musculus
cuccuccucgcuggcgucgcgccgcacccccagcgccucgua

SEQ ID NO: 50785 - RNA, 45 nt, Mus musculus
ggcggcgcuggcuguccucuccuccggcgggagcccggcgccagc

SEQ ID NO: 50786 - RNA, 44 nt, Mus musculus
cuaugccuaauuagggcaccauuuuaaaaaacugaaaucuuuaa

SEQ ID NO: 50787 - RNA, 84 nt, Mus musculus
ccacugcagacguguuuguuauaccagcggaggagaagccaguagaaauacagugggugaaaccagagccuaaaguagaucuga

SEQ ID NO: 50788 - RNA, 46 nt, Mus musculus
aggggaaguggggcuucuagaaaucucuagcaguaauuugucauaa

SEQ ID NO: 50789 - RNA, 46 nt, Mus musculus
gaugacuugccacauuaugcuuuguuaaaggaauucuuaauucagg

SEQ ID NO: 50790 - RNA, 46 nt, Mus musculus
aauuaaagaugacuggaaacuguuugaaagguucucggccccuuuu

SEQ ID NO: 50791 - RNA, 45 nt, Mus musculus
auaauaaauaaauaaaucuaaaaaaaaaaaagaaugccagcaaga

SEQ ID NO: 50792 - RNA, 46 nt, Mus musculus
cacuuugaaauagguuuuguuuacuuuuccuuaccaauccccuaau

SEQ ID NO: 50793 - RNA, 46 nt, Mus musculus
ggaaguuugaaaguucaaggccagccugaacaaauuagugagagca

SEQ ID NO: 50794 - RNA, 99 nt, Mus musculus
aggaacggauccucaucuuuucuuccagaggaauaaauuucagaacaagacacuuaaugcaggacuugagaauguugaugccucauucuaaagcaggua

SEQ ID NO: 50795 - RNA, 46 nt, Mus musculus
gccagggcuacacagagaaacccugucuugaaaaauagagagagag

SEQ ID NO: 50796 - RNA, 77 nt, Mus musculus
uguaaacagugaacauguaguauagaggguauuugacauuuugagguuuggaaaccaagauuaaauuggggcuaguu

SEQ ID NO: 50797 - RNA, 45 nt, Mus musculus
cacuaguuuuacugugucaaacagugcgacacacuuauaccaaga

SEQ ID NO: 50798 - RNA, 45 nt, Mus musculus
guauguauguauguauguauguauuuauuuauuuauuugccaagc

SEQ ID NO: 50799 - RNA, 55 nt, Mus musculus
uugucuuccaguuacugacccccaccccgccuccccagaguaaugguuuuccuuu

SEQ ID NO: 50800 - RNA, 45 nt, Mus musculus
ucccuggagggacuggacaguguuuaugucuaauuuucguguaga

SEQ ID NO: 50801 - RNA, 46 nt, Mus musculus
gccgggcagccagcuaagcaggccgauguggccaaagaggcggagg

SEQ ID NO: 50802 - RNA, 42 nt, Mus musculus
aggggcucccuuaguggccgcugugcggcgagcgggccgaag

SEQ ID NO: 50803 - RNA, 46 nt, Mus musculus
cugugucuucuagaagauuagcaaguauucuuaacugaugagccau

SEQ ID NO: 50804 - RNA, 46 nt, Mus musculus
caggaagaaucuguuacuuuucgaauuaacuuaacuauccuuuuag

SEQ ID NO: 50805 - RNA, 46 nt, Mus musculus
ggcauuuuucagcaaaaacuguucugauaggauauuucgucccagc

SEQ ID NO: 50806 - RNA, 44 nt, Mus musculus
uuagaauaauuuuauagaacuuaaaauuuuugaagaagugcaga

SEQ ID NO: 50807 - RNA, 46 nt, Mus musculus
ucauuuuggauuguauagagagaugcauggagaaaauaggagcaag

SEQ ID NO: 50808 - RNA, 48 nt, Mus musculus
uagcccaaacccuugaaaagucugcaggccuucacacauguaccggca

SEQ ID NO: 50809 - RNA, 46 nt, Mus musculus
agaccuccgucucagggaauagaugccgcagacccucugggccccu

SEQ ID NO: 50810 - RNA, 42 nt, Mus musculus
uaagaaaauaacuuaaccucauacaccccaaaaugccagugu

SEQ ID NO: 50811 - RNA, 121 nt, Mus musculus
gguuucuuacuccuuggaggccauguaggccaugagguccaucacucuguugcuguagccguauucauugucauaccaggaaaugagcuugacaaaguugucauugagagcaaugccagcc

SEQ ID NO: 50812 - RNA, 41 nt, Mus musculus
gguccucaguguagcccaagaugaccuucagagggcccuca

SEQ ID NO: 50813 - RNA, 45 nt, Mus musculus
uuccaaguuccagcuucaagaucaccucauuuacuuugggccaua

SEQ ID NO: 50814 - RNA, 46 nt, Mus musculus
aggaagaggaagaggaggaauggggagcuuaaaaugucuggauugu

SEQ ID NO: 50815 - RNA, 45 nt, Mus musculus
aaccacaaaacaauugauugcuuuccucuaaaggugucauggaga

SEQ ID NO: 50816 - RNA, 45 nt, Mus musculus
gugguucccugaagaggugacagaaugcuaauguguagcacugag

SEQ ID NO: 50817 - RNA, 33 nt, Mus musculus
cugaggaacuccccucccagaugagcucagcag

SEQ ID NO: 50818 - RNA, 46 nt, Mus musculus
uuucaagcuccgcgacacuuccuggagcggaaucauuuauccaaca

SEQ ID NO: 50819 - RNA, 42 nt, Mus musculus
guaaaaagacaacuacaacaguacagguuugauauggcucag

SEQ ID NO: 50820 - RNA, 46 nt, Mus musculus
gccaacaagaauaauucccagccaagccccccaggcgcuacaggag

SEQ ID NO: 50821 - RNA, 46 nt, Mus musculus
cucacuccaucuauucucuccgaugccccuuuccuuaagcucagac

SEQ ID NO: 50822 - RNA, 45 nt, Mus musculus
aacuuuaaugaggcuuuacuggggugguuucuuggaggccggggg

SEQ ID NO: 50823 - RNA, 60 nt, Mus musculus
accguaguuuauagaccgaccagucggugcccggggcuggggaauacugaaaacauccca

SEQ ID NO: 50824 - RNA, 42 nt, Mus musculus
cccggagcccagccauguuugccgagcgcgccccccgccccu

SEQ ID NO: 50825 - RNA, 46 nt, Mus musculus
cuccgcuccggccgaccaaaaaccucugccucgcucgcucgccuac

SEQ ID NO: 50826 - RNA, 41 nt, Mus musculus
cgcugccgacaaggagcgggcggcgggaggcggcggcggca

SEQ ID NO: 50827 - RNA, 46 nt, Mus musculus
agaucucaacagucuuggguuggaguugccauuauuugcggcagac

SEQ ID NO: 50828 - RNA, 45 nt, Mus musculus
gcaacucaaguuuuacauaagaaagagggccgacagcaaguagau

SEQ ID NO: 50829 - RNA, 46 nt, Mus musculus
auauaaagcuguuaccaguuauuuuucugugauugguucccgugaa

SEQ ID NO: 50830 - RNA, 71 nt, Mus musculus
gcuggaguaagccaggagacaaagagagcaagaggccaagagaccacauagccaaaaggcaggguuauaga

SEQ ID NO: 50831 - RNA, 46 nt, Mus musculus
ugcuguuguugugugugugugugugugugugugugugugugugugu

SEQ ID NO: 50832 - RNA, 45 nt, Mus musculus
uaacacuuuacuguacuuucccccuuugucuuugcgaagcccuag

SEQ ID NO: 50833 - RNA, 24 nt, Mus musculus
gguuucugugguggaaaucauauu

SEQ ID NO: 50834 - RNA, 44 nt, Mus musculus
ugucccuuaaaagcuaaaaaucuaggcuggugagauggcucagu

SEQ ID NO: 50835 - RNA, 41 nt, Mus musculus
aaaacagaagguguagacuagggacuagagaagaacccuca

SEQ ID NO: 50836 - RNA, 45 nt, Mus musculus
acagacacagacacagacacagagagagagagagagagagagaga

SEQ ID NO: 50837 - RNA, 46 nt, Mus musculus
ucucucucucucucucucucugugucugugucugugucugugucug

SEQ ID NO: 50838 - RNA, 45 nt, Mus musculus
cauguguuugaaacagagcaaggggaguguaugggauggcuugga

SEQ ID NO: 50839 - RNA, 45 nt, Mus musculus
gaaauuauuagaacuugcaaaaugaguugccaguccuggaugaag

SEQ ID NO: 50840 - RNA, 45 nt, Mus musculus
caucccagugcaaagaugauuagaaaauggggaaaucagccaggc

SEQ ID NO: 50841 - RNA, 45 nt, Mus musculus
aagugucuggucagucaguuccgugucacugcagacaccaaggag

SEQ ID NO: 50842 - RNA, 45 nt, Mus musculus
aauauggcauagacaaguuagcagagaagugcucagucaggaggu

SEQ ID NO: 50843 - RNA, 42 nt, Mus musculus
augugguugcugggaauugaacucaggaccucaggaccccag

SEQ ID NO: 50844 - RNA, 42 nt, Mus musculus
acuauguaggcaaaacaccaaugcacauaaaauaaaaauaaa

SEQ ID NO: 50845 - RNA, 46 nt, Mus musculus
uuaauugaauuagcuuugagaggaagguuacaguuagaggcuugug

SEQ ID NO: 50846 - RNA, 46 nt, Mus musculus
gcacauguuggucuugaacuagaguuccucccacccgcaccuccag

SEQ ID NO: 50847 - RNA, 42 nt, Mus musculus
gcagugguuguuaagugugugggggcauggaggugagaggag

SEQ ID NO: 50848 - RNA, 46 nt, Mus musculus
uuaaugaaaguauucuuaagacauuaaaaaaguucaaggccucuag

SEQ ID NO: 50849 - RNA, 42 nt, Mus musculus
uguauaguuaccuauacaaacguggugaugguagggaugaua

SEQ ID NO: 50850 - RNA, 46 nt, Mus musculus
ggaccauacagaaggcccggcauugauucccaguccugggaaggag

SEQ ID NO: 50851 - RNA, 69 nt, Mus musculus
aggaggaaguagaccucggauuaaacuuuuaacaggcaacagugcacacacacagaaggaaaugucaga

SEQ ID NO: 50852 - RNA, 42 nt, Mus musculus
ccaugaacaaggauagcaaaggugagaaagccagcgacaagg

SEQ ID NO: 50853 - RNA, 44 nt, Mus musculus
agugucuaccuaccgaagcaaaagccaauacuuuuucccacaag

SEQ ID NO: 50854 - RNA, 73 nt, Mus musculus
gcagugaggugggaguggguggguggaggagcacccucauagaagcaggggaagaggggaggggauggggguu

SEQ ID NO: 50855 - RNA, 41 nt, Mus musculus
uugaccagagccugacaaauacagaugagaacgcucgcagu

SEQ ID NO: 50856 - RNA, 46 nt, Mus musculus
aggauuagcuuauaaucagagccauguuuuccuucugucuguugaa

SEQ ID NO: 50857 - RNA, 46 nt, Mus musculus
ggaauccauuaaaauugcauuaucaauuaagaaacguacgggaacg

SEQ ID NO: 50858 - RNA, 45 nt, Mus musculus
gagauguauacuuagcaaaauuauuuuucaauugaaacagcacag

SEQ ID NO: 50859 - RNA, 41 nt, Mus musculus
gaaugaaagcugucacugacgauacaaauaaaaggcggcag

SEQ ID NO: 50860 - RNA, 23 nt, Mus musculus
ggugaagaaugugacucuguggu

SEQ ID NO: 50861 - RNA, 40 nt, Mus musculus
ggagagagauaggaugggggauugagauagagaauggcau

SEQ ID NO: 50862 - RNA, 45 nt, Mus musculus
gaaaaugugcaccacaugacaugcuacacacacagagaagucaag

SEQ ID NO: 50863 - RNA, 43 nt, Mus musculus
gucucagaggugcugcccggcagcccacgaaucuggccuaggu

SEQ ID NO: 50864 - RNA, 28 nt, Mus musculus
cgguuacagaugccuuuaacaaccgaag

SEQ ID NO: 50865 - RNA, 45 nt, Mus musculus; identical to SEQ ID NO: 35277

SEQ ID NO: 50866 - RNA, 46 nt, Mus musculus; identical to SEQ ID NO: 35278

SEQ ID NO: 50867 - RNA, 46 nt, Mus musculus; identical to SEQ ID NO: 35279

SEQ ID NO: 50868 - RNA, 101 nt, Mus musculus; identical to SEQ ID NO: 35280

SEQ ID NO: 50869 - RNA, 47 nt, Mus musculus
auagggaccagcagcuucucaaaguucuaugguaagggaacagaugg

SEQ ID NO: 50870 - RNA, 46 nt, Mus musculus
uguuuauuuuauuuuauuuuuuuauuaccaaauuaucuccagauag

SEQ ID NO: 50871 - RNA, 45 nt, Mus musculus
ugguuuugguugucuagguaaaaguggacgacgguguuuguagac

SEQ ID NO: 50872 - RNA, 45 nt, Mus musculus
guauggggauccccucuugugugugugccggccgguguaucuguu

SEQ ID NO: 50873 - RNA, 42 nt, Mus musculus
gccuuguuugaguaggugugucacagugggcgugggcuauaa

SEQ ID NO: 50874 - RNA, 46 nt, Mus musculus
auauguggucaugcccgcccuguuguuauggacucucccuguggaa

SEQ ID NO: 50875 - RNA, 43 nt, Mus musculus
agcgggugcgggcgcagcgcgcgguggccgaggcggcggaggc

SEQ ID NO: 50876 - RNA, 46 nt, Mus musculus
gaagcagcagugggaggacggagaggaggagggagaggaagaggag

SEQ ID NO: 50877 - RNA, 46 nt, Mus musculus
ucacaccuuuaaaaguaaauuuauuuuucaaaacuuuggcuuaaag

SEQ ID NO: 50878 - RNA, 45 nt, Mus musculus
gccgucauuaauuaagugcuuacuaccugccaggcacuucacuga

SEQ ID NO: 50879 - RNA, 42 nt, Mus musculus
cugugcagcccuggcuguccuggaacucacuauguagaccag

SEQ ID NO: 50880 - RNA, 45 nt, Mus musculus
ggaggggcaggauccugcugagcuugaggccuuguccacagacaa

SEQ ID NO: 50881 - RNA, 23 nt, Mus musculus
aaaaauguaguggcagcgugugg

SEQ ID NO: 50882 - RNA, 45 nt, Mus musculus
uuccagaagauaauaucuauaaaaaaucuuauaaauuacaugcag

SEQ ID NO: 50883 - RNA, 65 nt, Mus musculus
caugcaauaugugcagaggaugaaaucaaaauggaugcugaagauaggaaugaagaacaacgcca

SEQ ID NO: 50884 - RNA, 24 nt, Mus musculus
uagccagcuugucagaggcuauua

SEQ ID NO: 50885 - RNA, 45 nt, Mus musculus
uggugacaaccuaagaaguuuaaugagcauuaugauacaaugaua

SEQ ID NO: 50886 - RNA, 46 nt, Mus musculus
uuggaguaauuguuagccccaaauaggugaccugagggguggacag

SEQ ID NO: 50887 - RNA, 44 nt, Mus musculus
ggaugagguaauaguuccucuaaaguuuuagugcaggagugaga

SEQ ID NO: 50888 - RNA, 66 nt, Mus musculus
uggaguaggcuguagaugggucuuaacaaaagaagacaaugcuuggcuguuaggaugaaagaguug

SEQ ID NO: 50889 - RNA, 44 nt, Mus musculus
gauguguaugaagaagagucauuuuuagguggaggaaugaaagg

SEQ ID NO: 50890 - RNA, 45 nt, Mus musculus
guagaaacaagauuaaugaggcagggagcaaauaauaacaccagg

SEQ ID NO: 50891 - RNA, 45 nt, Mus musculus
ucccacagccacuacccauuuuuacaauagacgucacuguuagau

SEQ ID NO: 50892 - RNA, 42 nt, Mus musculus
gauacugaggaucaugggagaggggaaggcugugggccagaa

SEQ ID NO: 50893 - RNA, 46 nt, Mus musculus
guagguagguagguagguagguagguagguagguaggucgguagau

SEQ ID NO: 50894 - RNA, 45 nt, Mus musculus
uucucacugauuuauuuucucacucguucacucguacuaugaagg

SEQ ID NO: 50895 - RNA, 44 nt, Mus musculus
gucaaacggugcacgcacccccagcucugggccgcuccugucgg

SEQ ID NO: 50896 - RNA, 45 nt, Mus musculus
cagagacagagacacacaaagagauagacagagagacagagagau

SEQ ID NO: 50897 - RNA, 89 nt, Mus musculus
uagaugaagccugguggauccugaccauuguuuuccauaugcagacccagccucucuacaagguggagcccagcuccagggccccagaa

SEQ ID NO: 50898 - RNA, 42 nt, Mus musculus
gcaggggcuaggugggacuagcuacugaagucuagggcaggu

SEQ ID NO: 50899 - RNA, 45 nt, Mus musculus
uugaguugucaguaaagaaagcugggggccgauugcugggcagaa

SEQ ID NO: 50900 - RNA, 45 nt, Mus musculus
ggugagaggagagccagacuuuaugaugaguguguguacccaaga

SEQ ID NO: 50901 - RNA, 46 nt, Mus musculus
agaucaaguuuacagagguucaaauuauuggccaugaaucauagug

SEQ ID NO: 50902 - RNA, 45 nt, Mus musculus
agcuucaugggcaugugugugggacaguuucgcgggcaugcgugu

SEQ ID NO: 50903 - RNA, 30 nt, Mus musculus
ggugcugaguacuucacauugucccugacc

SEQ ID NO: 50904 - RNA, 35 nt, Mus musculus
cuagaggaucgggucuaucauggcuggggaggugu

SEQ ID NO: 50905 - RNA, 42 nt, Mus musculus
acauaccaguuuagggcacagugcugccuuaaagccagaaag

SEQ ID NO: 50906 - RNA, 46 nt, Mus musculus
acacacacacacacacacacacacacacacauaaaugccaccaaau

SEQ ID NO: 50907 - RNA, 46 nt, Mus musculus
cuggaagaucuagagugcuaggaaggaaggaaggaagugcccagaa

SEQ ID NO: 50908 - RNA, 46 nt, Mus musculus
gccuggccacagcgagucguuacaacaacaacaacucuuagcagau

SEQ ID NO: 50909 - RNA, 46 nt, Mus musculus
cauacacacuuuuccagaauguuaauuagggcacaaucugccaaau

SEQ ID NO: 50910 - RNA, 41 nt, Mus musculus
ucaagacugaaaggcuaccuuuaagaggacaguggauggau

SEQ ID NO: 50911 - RNA, 42 nt, Mus musculus
ucaacugcagccugcugauuuuuaguguuaggaggguaaggg

SEQ ID NO: 50912 - RNA, 42 nt, Mus musculus
caacauuuucacccuuuucuccugaccuccauggccccgacc

SEQ ID NO: 50913 - RNA, 45 nt, Mus musculus
auauuuuaaguagauugucuuagaagacaaagaaugggguccggc

SEQ ID NO: 50914 - RNA, 42 nt, Mus musculus
gacucuggaucuaaccugcugcuuucuacuugggcuccugug

SEQ ID NO: 50915 - RNA, 32 nt, Mus musculus
caagcaguggaaacuuggacugaaauuugaug

SEQ ID NO: 50916 - RNA, 46 nt, Mus musculus
auguacgugugugugugugugugugugucugugucucugugugugu

SEQ ID NO: 50917 - RNA, 57 nt, Mus musculus
uaauaguucuucuaaacuuuuauuaucaugugucugugugagugugugugugugugu

SEQ ID NO: 50918 - RNA, 45 nt, Mus musculus
guucuuacuucuguccagaaccagcccguuugacugcaggcagau

SEQ ID NO: 50919 - RNA, 42 nt, Mus musculus
gcauuuggucuuggacaguaugaaaaugugucacuggcagga

SEQ ID NO: 50920 - RNA, 57 nt, Mus musculus
augaauguguuuuacaacuuacuaaagaaagaaauggaaauuuuaauuuauuuuuag

SEQ ID NO: 50921 - RNA, 26 nt, Mus musculus
gucaugggagagagucccugggaucu

SEQ ID NO: 50922 - RNA, 46 nt, Mus musculus
uaaaucaagaaagucuuacugaaggcccuaaauucaauccccagua

SEQ ID NO: 50923 - RNA, 45 nt, Mus musculus
ucuuccaucucugaugcccacuggggcggaguccuggccucauuc

SEQ ID NO: 50924 - RNA, 45 nt, Mus musculus
cucuugaauuucacagaguaacagugguuguuuucaugucuaggu

SEQ ID NO: 50925 - RNA, 46 nt, Mus musculus
gguguuuucaaagugggagccacauucauuaucuuugccuggaauu

SEQ ID NO: 50926 - RNA, 48 nt, Mus musculus
ccagaccuccuuguugcaggcagcuguguuguccuuaugcgcuucugg

SEQ ID NO: 50927 - RNA, 45 nt, Mus musculus
augcuguuuucuguccuugcccagccuagcuuccagaguggggua

SEQ ID NO: 50928 - RNA, 45 nt, Mus musculus
guuuacucugagauugaugcuggguaugcucuuguauggaggcau

SEQ ID NO: 50929 - RNA, 46 nt, Mus musculus
aguuauugaaaauauuuuuaccuuaaaauagggaccauggugagau

SEQ ID NO: 50930 - RNA, 41 nt, Mus musculus
augccacugcaguguggggcaaaaauaaaccggcagcgugg

SEQ ID NO: 50931 - RNA, 45 nt, Mus musculus
uuaguaaaacaugcuuagauguuuuaagugaagucaacaaaaagg

SEQ ID NO: 50932 - RNA, 46 nt, Mus musculus
uagguucaggauuguuuugauaccuguauuuauaauaaaagguguu

SEQ ID NO: 50933 - RNA, 44 nt, Mus musculus
uuaugauguccaaagaaaauaugaagcuuccacagccuccagaa

SEQ ID NO: 50934 - RNA, 47 nt, Mus musculus
aagacaugacacuuacaagguggacaggcaugauuauugggccacca

SEQ ID NO: 50935 - RNA, 42 nt, Mus musculus
guuaaaguuccucguaauuuucgcuuguuggaagaacuugaa

SEQ ID NO: 50936 - RNA, 45 nt, Mus musculus
aagcaaacauucacacuacagauacuguacaaacgaacuaauagu

SEQ ID NO: 50937 - RNA, 42 nt, Mus musculus
auagaagaugaaacaccauguccgggaguucaagcgccagau

SEQ ID NO: 50938 - RNA, 46 nt, Mus musculus
uggaggucagagcccaugcagccuagcaauuaccugucuuggugga

SEQ ID NO: 50939 - RNA, 45 nt, Mus musculus
gcugguccucucacagcuguagaugcuggaauaaaagcagcuguc

SEQ ID NO: 50940 - RNA, 43 nt, Mus musculus
aucagcaugucauagaaaccuugauuggcaaaaagcagcagau

SEQ ID NO: 50941 - RNA, 74 nt, Mus musculus
aaaagacaaaaugcugguuaucgagaaguguaagaacucuagagcugugaccauuuucaucagaggaggaaaca

SEQ ID NO: 50942 - RNA, 62 nt, Mus musculus
gagcucaccucugagaagcugggcuuugcugguguggugcaggagaucuccuuuggcacuac

SEQ ID NO: 50943 - RNA, 46 nt, Mus musculus
guauucaguaucacuugagcagcacuuaccuguaacaaccacagca

SEQ ID NO: 50944 - RNA, 44 nt, Mus musculus
aaagaaacuggugcuaaccuagcuauuugccaguggggcuuuga

SEQ ID NO: 50945 - RNA, 36 nt, Mus musculus
agaaguacgaaaaggagaaguuugaagagaugauua

SEQ ID NO: 50946 - RNA, 53 nt, Mus musculus
gagagauguugacuuugagcucauuaaaguggaaggcaaaguaggugggcggc

SEQ ID NO: 50947 - RNA, 73 nt, Mus musculus
ggauuaacagcugucaccgacagauggcugagaucgccgugaaugccguccucacgguggcagauauggagcg

SEQ ID NO: 50948 - RNA, 46 nt, Mus musculus
ggcagcuuuaugaccucuuguuaaauagugugaguggugcuuagau

SEQ ID NO: 50949 - RNA, 61 nt, Mus musculus
gagcaggcugcccgaauugcaauacaacaccuggacaagaucagcgauaaagugcuugucg

SEQ ID NO: 50950 - RNA, 46 nt, Mus musculus
agcugaugguugaacuguccaaaucccaggaugaugaaauuggaga

SEQ ID NO: 50951 - RNA, 48 nt, Mus musculus
guugauaaggauggcgaugugacuauaacaaacgauggugccaccauu

SEQ ID NO: 50952 - RNA, 48 nt, Mus musculus
ggcugccaaagcuguagcaaacacaaugcggacgucacugggaccaaa

SEQ ID NO: 50953 - RNA, 84 nt, Mus musculus
gguauuaagacccuagaguggcuuugaaccuuuagaaucauuagagucacuagaaaaugaggaaauuagcauagcgaccaagaa

SEQ ID NO: 50954 - RNA, 46 nt, Mus musculus
cuccccaauuugugucuuugucaugauguuuugugcagguauagaa

SEQ ID NO: 50955 - RNA, 45 nt, Mus musculus
gcugguuuucugucaacuugacacaggauggaauuaucacagaga

SEQ ID NO: 50956 - RNA, 36 nt, Mus musculus
aguggacauagcaacugaggccugguagaugcuugg

SEQ ID NO: 50957 - RNA, 81 nt, Mus musculus
aagaaaggcuacccaagagccggugcuaggcccccagaggagaaaggagugacagucacugguguugccacaaaaagcuca

SEQ ID NO: 50958 - RNA, 79 nt, Mus musculus
ggaaacaaagaaguuacccugagggaaggcagagccgaaguguugagucggaaggcaugucucacagaaggagaggaau

SEQ ID NO: 50959 - RNA, 56 nt, Mus musculus
aagucccuugggccagaaaacgcaugguggugacuuuuggaguggaaggagagagu

SEQ ID NO: 50960 - RNA, 60 nt, Mus musculus
uugucccuuagaagcggggcugucccgaaagggagaaaacuagugagaaacgugcacagg

SEQ ID NO: 50961 - RNA, 42 nt, Mus musculus
cugcgggagagggcguagaggccuucgucccacgguggggua

SEQ ID NO: 50962 - RNA, 43 nt, Mus musculus
ucgaugaguaugggcgccccuuucucauuaucaaggaccaaga

SEQ ID NO: 50963 - RNA, 42 nt, Mus musculus
guucugcucuuguuguccucccuguggaaccacagccggcag

SEQ ID NO: 50964 - RNA, 71 nt, Mus musculus
gguagccuacauaucagauauucguauuaugagucauaacaguagcaaggaaguagcaaguauaauuauga

SEQ ID NO: 50965 - RNA, 51 nt, Mus musculus
acccagacaccggaguccgccgagugaaagcacaacgcugcccuguaggac

SEQ ID NO: 50966 - RNA, 45 nt, Mus musculus
uggauccugcucaccuugggcuugauggccuguguguccgcagag

SEQ ID NO: 50967 - RNA, 42 nt, Mus musculus
gugccagccccuaucugggucacuacaggucuguuuuggcag

SEQ ID NO: 50968 - RNA, 46 nt, Mus musculus
ccucuacuguugaaucuauuuuaugaaaaauguuacaaagaugcag

SEQ ID NO: 50969 - RNA, 41 nt, Mus musculus
cgaacaaacacguagucucucaugaguuaugcuggccccua

SEQ ID NO: 50970 - RNA, 45 nt, Mus musculus
cagcugaggaggacagaggcucagagaaguuaaguuaccagcuua

SEQ ID NO: 50971 - RNA, 46 nt, Mus musculus
ccacagagaaaaaucauguuuucccauuccccaguuagagcugaag

SEQ ID NO: 50972 - RNA, 41 nt, Mus musculus
cauauaaucuaucacaaaacaggucucaacggauacaagaa

SEQ ID NO: 50973 - RNA, 41 nt, Mus musculus
agaugccaacaaccaauagcucagcagaaaagacagguggg

SEQ ID NO: 50974 - RNA, 46 nt, Mus musculus
agggcuaguacucuuuaucuuuccagcagggauuuuucucuuucua

SEQ ID NO: 50975 - RNA, 46 nt, Mus musculus
cuuucuuuguuuugugcauuugguguuuagauuauuauguguugag

SEQ ID NO: 50976 - RNA, 33 nt, Mus musculus
agcuucugccuguuuaccuguauucccuuguaa

SEQ ID NO: 50977 - RNA, 45 nt, Mus musculus
uuauaaaacucuguguguguguguguguguguguguguguguuuc

SEQ ID NO: 50978 - RNA, 45 nt, Mus musculus
augccccuguggcauuguagagcaucuuuugacuauauccccaag

SEQ ID NO: 50979 - RNA, 41 nt, Mus musculus
gaaggaaggaaaggaagaaaggaagaaaggaagaaaggaag

SEQ ID NO: 50980 - RNA, 45 nt, Mus musculus
uauaagauuaggccacgugagcuuccuugggguuuugugugugug

SEQ ID NO: 50981 - RNA, 65 nt, Mus musculus
cugaugaagacauagagaguccaguucugacaacaucccaacugauuccaagaaucccacucacu

SEQ ID NO: 50982 - RNA, 68 nt, Mus musculus
agugcugcuucccccaaaguggaaaccaugacguugaagacacaaagcauuacaccugcucagacuga

SEQ ID NO: 50983 - RNA, 63 nt, Mus musculus
ccagucaccugaagaaacugacaaggaggaaguugacauuucugaggcagaagagaagcuggg

SEQ ID NO: 50984 - RNA, 75 nt, Mus musculus
cccugcuauaaaaagcacagauguguacacggagaaacauucagacaaucuguuuaaacggacagaaguucuagc

SEQ ID NO: 50985 - RNA, 42 nt, Mus musculus
auaggaggaacaacaauaugaaccaaccaguacccccauagc

SEQ ID NO: 50986 - RNA, 48 nt, Mus musculus
cgaccuuggagaacgcaaaccauccagcgcagcuuaccagaaggcacc

SEQ ID NO: 50987 - RNA, 46 nt, Mus musculus
cuauuuaggagagcacugaacuuuucaaaauaaagcuuuggcauag

SEQ ID NO: 50988 - RNA, 82 nt, Mus musculus
gggaagguagggggcucugccuguugaaugacagccuggcugcuuaagauggauguuucuagaaaagguaaugccagaggag

SEQ ID NO: 50989 - RNA, 53 nt, Mus musculus
uaagacagucccucugacagacaacacggugaucgaggagcaccuggggagau

SEQ ID NO: 50990 - RNA, 47 nt, Mus musculus
gugaguuuauugguaaagagcaccaucaugaaacuuggccugaagaa

SEQ ID NO: 50991 - RNA, 46 nt, Mus musculus
gcucucauguugugagcccugagaaggguagagcuuuggaccacau

SEQ ID NO: 50992 - RNA, 46 nt, Mus musculus
ggcauucaauuguugucccauuaaccauggggcauuuagugaagag

SEQ ID NO: 50993 - RNA, 46 nt, Mus musculus
cucuuugcccuuacugaagauuuuuuagaaaacucccaaucgccau

SEQ ID NO: 50994 - RNA, 42 nt, Mus musculus
gaagucuacugggcacagaaaauaaccgauucauggcccaug

SEQ ID NO: 50995 - RNA, 46 nt, Mus musculus
acuuagaggcuugagaaaguucucgcucucucaccuggggccuaag

SEQ ID NO: 50996 - RNA, 43 nt, Mus musculus
caaucauaaaggauccauaggacuuccaggcacccgccccccu

SEQ ID NO: 50997 - RNA, 43 nt, Mus musculus
ugcuuuagccuuguugcauaagacacaaagagauaaugcguca

SEQ ID NO: 50998 - RNA, 46 nt, Mus musculus
aaacacauauaauucauuuugucaaugguguuuuuguugguugcag

SEQ ID NO: 50999 - RNA, 46 nt, Mus musculus
aagguugagugccccagggaccuuuccccagaaaaaaacggcacag

SEQ ID NO: 51000 - RNA, 46 nt, Mus musculus
gacagcuacaguguacuuacauguaauaaauaaauaaauaaaaaaa

SEQ ID NO: 51001 - RNA, 41 nt, Mus musculus
uugcucagaaauugaaacauuccauccugcagggaagcccu

SEQ ID NO: 51002 - RNA, 45 nt, Mus musculus
gagcagaugggauuagucugacucuuuggagguagaaaacccgca

SEQ ID NO: 51003 - RNA, 46 nt, Mus musculus
uuuggcagaucuaagugacuuagaccggcaugugaagagaguccag

SEQ ID NO: 51004 - RNA, 42 nt, Mus musculus
gaagaaguuggucuccgauacuguggagacaaaugugccaag

SEQ ID NO: 51005 - RNA, 46 nt, Mus musculus
gguuugaaggauacuguccucagcgaaagucagagacuaggggcag

SEQ ID NO: 51006 - RNA, 44 nt, Mus musculus
ggauucuggucucagacauuuugcuguagugaagaggcacuggg

SEQ ID NO: 51007 - RNA, 44 nt, Mus musculus
aguugaugagagguuggucaaaguugucucauggccacauaggu

SEQ ID NO: 51008 - RNA, 46 nt, Mus musculus
agagcacagauuuauuucuuugccaugugguacuuuuucucaggag

SEQ ID NO: 51009 - RNA, 80 nt, Mus musculus
auuugucacagugcucuaauuugccuguuguucaauuuggaaggagauuuauucaugauauagcauacauuuauggcaua

SEQ ID NO: 51010 - RNA, 45 nt, Mus musculus
uucaucucucugccuagguccagagagauggagguggauaccagg

SEQ ID NO: 51011 - RNA, 46 nt, Mus musculus
aucgcucuuugagaauucucagugauaaguuauaaauaaucaacag

SEQ ID NO: 51012 - RNA, 45 nt, Mus musculus
uuaaagccuuucuagucacgcuaaugagaaacacaauaaaggcag

SEQ ID NO: 51013 - RNA, 44 nt, Mus musculus
augagaucugacccccucuacuggggugucugaagacagcuaca

SEQ ID NO: 51014 - RNA, 46 nt, Mus musculus
gcauugcauucaaaacuaucucaucccaggaauuaaauuaggucag

SEQ ID NO: 51015 - RNA, 40 nt, Mus musculus
ggguaguauugguggcuggguauugaggagcuucuaauag

SEQ ID NO: 51016 - RNA, 74 nt, Mus musculus
aguggaaagaaugguugguggggauagggaggagggaagugaggagagaggaauggcugaggggagugggggag

SEQ ID NO: 51017 - RNA, 46 nt, Mus musculus
aaaauaaacauguaagacuucgcuauuuagaaagaugugccauuag

SEQ ID NO: 51018 - RNA, 45 nt, Mus musculus
cagucaucuauaggauggaacacaaggcccccaauguaggagcua

SEQ ID NO: 51019 - RNA, 46 nt, Mus musculus
acuccuccgauguccugguguauguuaccagcaaugauaccacagu

SEQ ID NO: 51020 - RNA, 46 nt, Mus musculus
augaauuauccugugguuucacuuccaugaugaacucucugagcca

SEQ ID NO: 51021 - RNA, 44 nt, Mus musculus
cucuggagucgaucaacucuaggcuccaacuuguuaugaaaagu

SEQ ID NO: 51022 - RNA, 68 nt, Mus musculus
gauuauaauccucucuucuguccucuguguaugcuagguuggggguugucccgcaccuaaggcaggaa

SEQ ID NO: 51023 - RNA, 79 nt, Mus musculus
acugccgaagaccaauuaccgcugucgcuuucgcucccccagaucauguucucgguucccgggacaacgcgccgaaaaa

SEQ ID NO: 51024 - RNA, 45 nt, Mus musculus
uguuagacacuucucauuaacucccagccugaacgcccagaccac

SEQ ID NO: 51025 - RNA, 41 nt, Mus musculus
ucacuucuuuccgcugcucuuaaggcuuccugggggugcca

SEQ ID NO: 51026 - RNA, 44 nt, Mus musculus
aaggacggagagguugacuuccuaacuauuugauuuuggguuaa

SEQ ID NO: 51027 - RNA, 57 nt, Mus musculus
cggcugaugauuuuggaaguaaauuuguggcaaaaccaggagagacacuuggcuuua

SEQ ID NO: 51028 - RNA, 49 nt, Mus musculus
agaaagauguucaaccaccaaagcagcagccaaugauauauauuugugg

SEQ ID NO: 51029 - RNA, 46 nt, Mus musculus
uuuuaaguagagugcauguggacuuauuaagaaugagagcugagag

SEQ ID NO: 51030 - RNA, 46 nt, Mus musculus
auauauggcuuaauuuauugcuuuuguaauccgucacacagugaag

SEQ ID NO: 51031 - RNA, 42 nt, Mus musculus
gccaaguauuuguugcuauucaagcuauacgguccccagauu

SEQ ID NO: 51032 - RNA, 42 nt, Mus musculus
uacuuggcuugauucaugcguggauguuuacggauuaucuag

SEQ ID NO: 51033 - RNA, 42 nt, Mus musculus
cugugcauuaagauguugcuggggauugcggacucccgcagc

SEQ ID NO: 51034 - RNA, 48 nt, Mus musculus
gagcaguccagcgaggacuuggucuuaguugagcaauuuggcuaggag

SEQ ID NO: 51035 - RNA, 57 nt, Mus musculus
gccaugaaguaaccugaaggaggugcuggcugguagggguugaucacgggguugggc

SEQ ID NO: 51036 - RNA, 46 nt, Mus musculus
gggaugagaaacauacaaaaccaaacccuuugcugcgcccacccuc

SEQ ID NO: 51037 - RNA, 23 nt, Mus musculus
gucaugaaaaugaauggcacugu

SEQ ID NO: 51038 - RNA, 45 nt, Mus musculus
augaauauguugccuacuccacuuuugcgaagugauggaucacgc

SEQ ID NO: 51039 - RNA, 42 nt, Mus musculus
gcccaaggagcggcgggugaucaugucccugcagacccggau

SEQ ID NO: 51040 - RNA, 81 nt, Mus musculus
cacggcugcccgcggggccgcaggccgcgaccuuucccgugagaggaggagagcgagugcggggccgggggacggagccgg

SEQ ID NO: 51041 - RNA, 42 nt, Mus musculus
gacaaaauucaaccggaaucgacgcguacucaacggccgugg

SEQ ID NO: 51042 - RNA, 29 nt, Mus musculus
cuuggagcugcggggccgcgggcgggcgg

SEQ ID NO: 51043 - RNA, 69 nt, Mus musculus
uuggauuuuuuaauaauaaauguguguuccgagcccggagcacacacuccgcacucucagcacuaaccg

SEQ ID NO: 51044 - RNA, 41 nt, Mus musculus
cggccgcuggucacgccccuugcgcacacgccccgcccccg

SEQ ID NO: 51045 - RNA, 46 nt, Mus musculus
uuucauauggaacuuuuuacuaaauaaacuuuugugauacucaaaa

SEQ ID NO: 51046 - RNA, 42 nt, Mus musculus
caaagcccacccucccgaacugaagaaguuuauggacaagaa

SEQ ID NO: 51047 - RNA, 46 nt, Mus musculus
aaagaaacacaaaaccuuuuaaguugauuagauguucugcccgaga

SEQ ID NO: 51048 - RNA, 42 nt, Mus musculus
ccucugauuggcuaauacagagcugaucagccaauagcugga

SEQ ID NO: 51049 - RNA, 46 nt, Mus musculus
aguguggccuuugagcucaguaaccagcucuaaugcuugcuuauuu

SEQ ID NO: 51050 - RNA, 45 nt, Mus musculus
agauccucggaggagggucaggagauuaaaguugcuccaggagag

SEQ ID NO: 51051 - RNA, 46 nt, Mus musculus
ggggaagggaaagagaagaaaagucacuaagucccagaaaguagcu

SEQ ID NO: 51052 - RNA, 44 nt, Mus musculus
guuguuacuuucggauuaacucaagcugggagggagguguuuga

SEQ ID NO: 51053 - RNA, 48 nt, Mus musculus
ccaugcccuaaauaaacuccauaccaugccucagggggaggggaugcc

SEQ ID NO: 51054 - RNA, 46 nt, Mus musculus
ccaggcacagcacccguguugguagaggcgcuguauggugggugag

SEQ ID NO: 51055 - RNA, 46 nt, Mus musculus
gagaguagggagcuuuaccaauucuccagugcuuggguggagaggu

SEQ ID NO: 51056 - RNA, 42 nt, Mus musculus
gcacucacccagggguagagguccgagaacgaagcaucagua

SEQ ID NO: 51057 - RNA, 46 nt, Mus musculus
aggaugguuugccuaagcguaggauuuuuucagcagugugcaagag

SEQ ID NO: 51058 - RNA, 45 nt, Mus musculus
uggguauaggggccaaauuuuaaccaggagacgugcuagcaaaga

SEQ ID NO: 51059 - RNA, 42 nt, Mus musculus
ggcggauggaaaguacgugguggcggcagaaucaggggagca

SEQ ID NO: 51060 - RNA, 41 nt, Mus musculus
cacucccguagccaucgcuugccgccaagccacgccccuca

SEQ ID NO: 51061 - RNA, 42 nt, Mus musculus
ccaugugagggcucccuccccccaucccaccuuuccggcuag

SEQ ID NO: 51062 - RNA, 45 nt, Mus musculus
ugcacagacuugaaaguccaguuucaccagaggcugaggcuccag

SEQ ID NO: 51063 - RNA, 41 nt, Mus musculus
ccggcugagguaggcggaucucuaggcaguggggcggggcc

SEQ ID NO: 51064 - RNA, 42 nt, Mus musculus
guaugucuguacugcauguaugcagugcccauggagcacaga

SEQ ID NO: 51065 - RNA, 46 nt, Mus musculus
gaggaauagagugggacauaaagucgagaaauacaaguauuugcag

SEQ ID NO: 51066 - RNA, 46 nt, Mus musculus
gcuugcacucggggguaaagccucucuccaagugccugccgaugag

SEQ ID NO: 51067 - RNA, 46 nt, Mus musculus
agagaagagaagagaagagaagagaagagaagagaagacaagacau

SEQ ID NO: 51068 - RNA, 46 nt, Mus musculus
ucaaaucucagcaaccacaugguggcucacaaccauccauaguaag

SEQ ID NO: 51069 - RNA, 48 nt, Mus musculus
agagcagagcagagcagagcagagagcagagggagcagagcagagcag

SEQ ID NO: 51070 - RNA, 49 nt, Mus musculus
cagagcagagcagagcagagcagagagcagagggagcagagcagagcag

SEQ ID NO: 51071 - RNA, 45 nt, Mus musculus
caaauguggcugaucagccaaggguauggcuucagccaaaggcac

SEQ ID NO: 51072 - RNA, 45 nt, Mus musculus
ucauagagucugaacgucggaaaaauggaugguuuuggccaguuu

SEQ ID NO: 51073 - RNA, 42 nt, Mus musculus
caucuggcaaugugugcagacacuuuuagcuguuacaaggag

SEQ ID NO: 51074 - RNA, 45 nt, Mus musculus
aaagaccucaaagauaagaaucacccagcccaaagcaacagugca

SEQ ID NO: 51075 - RNA, 42 nt, Mus musculus
uguggguuccgaaugauguaagaugacugagacugacuggag

SEQ ID NO: 51076 - RNA, 45 nt, Mus musculus
ccagauaaaccauuuccauacaaaacauuaacauaccugcuugcc

SEQ ID NO: 51077 - RNA, 32 nt, Mus musculus
acgaagccauuuccacacuaagaaugacaaac

SEQ ID NO: 51078 - RNA, 42 nt, Mus musculus
ucacgucaaaggaggggaaagggaauccugaaaccaguccag

SEQ ID NO: 51079 - RNA, 41 nt, Mus musculus
ucuuacuuggcagaaagaagcucucguagauaaggcugcag

SEQ ID NO: 51080 - RNA, 45 nt, Mus musculus
aucucccuaguaccacagacagcaaccucuucauccucaccccag

SEQ ID NO: 51081 - RNA, 46 nt, Mus musculus
caaauauauguuacuaauauuuuauuuaauaaauucaaauugccag

SEQ ID NO: 51082 - RNA, 46 nt, Mus musculus
augauugcuguuaaagguucacucggccccaaagguuagaaaccac

SEQ ID NO: 51083 - RNA, 49 nt, Mus musculus
auuugguugcaagcacccacauggcagcucacaaucaucuguaacucca

SEQ ID NO: 51084 - RNA, 46 nt, Mus musculus
ugggagaugaacaacucagaacaagacacuaauagauuaggcagag

SEQ ID NO: 51085 - RNA, 46 nt, Mus musculus
guacauuuuagugcugaaaaggaaccugaaaugaaaaugcagcaug

SEQ ID NO: 51086 - RNA, 46 nt, Mus musculus
aauuuucaaaggcuuuuaccauggaccuacaucagacugaaagaag

SEQ ID NO: 51087 - RNA, 72 nt, Mus musculus
augaguauggcaccucauagaagagagauggaaacugagcagauccaaauugguggguauggcuucugaagg

SEQ ID NO: 51088 - RNA, 46 nt, Mus musculus
cugucuucgaggcagcugacaccacuucuuuagcuacugucucuag

SEQ ID NO: 51089 - RNA, 47 nt, Mus musculus
uggcuacucauucccguguguguaugugugugugugugugugugugu

SEQ ID NO: 51090 - RNA, 41 nt, Mus musculus
ccucuuugcugguagagccccuuucauuaucaaaugaggcu

SEQ ID NO: 51091 - RNA, 39 nt, Mus musculus
gcagaagcucugagucucucucuaagggaagaaggagaa

SEQ ID NO: 51092 - RNA, 42 nt, Mus musculus
uucccagccaccacgugguggcucacaaccaucucuaauggg

SEQ ID NO: 51093 - RNA, 45 nt, Mus musculus
ggaaaguagauagauagauagauagagagagagagagagagagag

SEQ ID NO: 51094 - RNA, 46 nt, Mus musculus
cucagaaaacauggcaucagcaucaauaaugacacuugggugggca

SEQ ID NO: 51095 - RNA, 46 nt, Mus musculus
aauccuuuuuuagccuuacuauuaaacacaaacucucuucucccag

SEQ ID NO: 51096 - RNA, 46 nt, Mus musculus
auaguagcaguuuaugaaugagagagagagagaaagagagagagag

SEQ ID NO: 51097 - RNA, 46 nt, Mus musculus
uauggcgcugcacaucuuuaaucccagaaucugggaggcagaggca

SEQ ID NO: 51098 - RNA, 42 nt, Mus musculus
gugagccaccauucgguugcugggauaugaacucaggaccuu

SEQ ID NO: 51099 - RNA, 45 nt, Mus musculus
ucuugccucaucucacuucuuuauucucccccuccuccuaggcag

SEQ ID NO: 51100 - RNA, 45 nt, Mus musculus
ccaagccaucgcuaacucagcuacuagaaaaccagucauccugaa

SEQ ID NO: 51101 - RNA, 46 nt, Mus musculus
ccuaaauugaaaccaaacagaaacucucuaauaagaucuuagggag

SEQ ID NO: 51102 - RNA, 24 nt, Mus musculus
acagagauuugaagagucuguugu

SEQ ID NO: 51103 - RNA, 45 nt, Mus musculus
agccuggucuacagagugaguucuagaacagccagggcuacagag

SEQ ID NO: 51104 - RNA, 46 nt, Mus musculus
aaaaaaaaaaaagaauagcuaccuguggucuucagauaacuugaaa

SEQ ID NO: 51105 - RNA, 45 nt, Mus musculus
uuucaaauuccugccuauucuaucuuguaccuuuucagcccccgg

SEQ ID NO: 51106 - RNA, 46 nt, Mus musculus
guccuugggcuucaacaggaacuaacacaaauucacugggaggcug

SEQ ID NO: 51107 - RNA, 45 nt, Mus musculus
uccuacaccagcugcacacaugguacugauggauacaugcaggca

SEQ ID NO: 51108 - RNA, 45 nt, Mus musculus
cuaaauauucuuaauacaguacaugggcuuuaggaaaagcugaga

SEQ ID NO: 51109 - RNA, 46 nt, Mus musculus
aguuuaaaaacaaaaaaacacuaagugaggcagugguggggcccgc

SEQ ID NO: 51110 - RNA, 45 nt, Mus musculus
aauucuugguacauaaaguuaggaccaccacaaaaagcaugcccu

SEQ ID NO: 51111 - RNA, 41 nt, Mus musculus
gucaacucagagauggucagacacuugauggaugagcagag

SEQ ID NO: 51112 - RNA, 39 nt, Mus musculus
ugaggcuagccugggcuauaugaaacugucuaaagagaa

SEQ ID NO: 51113 - RNA, 46 nt, Mus musculus
ugaaauggcaagaccaaagagcauugaaugcucaugguucucugag

SEQ ID NO: 51114 - RNA, 46 nt, Mus musculus
aaagacuggaaaacuugaaaaggcacaagaaaaggguggggggggg

SEQ ID NO: 51115 - RNA, 46 nt, Mus musculus
agccuguccucugccccagagaguuaaaugugugacuuuagaccaa

SEQ ID NO: 51116 - RNA, 46 nt, Mus musculus
cacugaugagggccugacagaaacauguaguacagcaaagcugaga

SEQ ID NO: 51117 - RNA, 46 nt, Mus musculus
aaaauuuucuuaguuaggguuuucuugcugugaagaaacagggcaa

SEQ ID NO: 51118 - RNA, 46 nt, Mus musculus
uuaguucguucaucaucauggcagaaaggcggugaaauguaggcag

SEQ ID NO: 51119 - RNA, 42 nt, Mus musculus
aagagacugugucccagacugggcauagcuugagcacaggag

SEQ ID NO: 51120 - RNA, 45 nt, Mus musculus
ccaucuuugguauacugaggcgagcauuaggcuuaaauagaggag

SEQ ID NO: 51121 - RNA, 45 nt, Mus musculus
aacauuuaauuuggugauuaccuucacaaaaagaaacugcuggaa

SEQ ID NO: 51122 - RNA, 33 nt, Mus musculus
aggguaccuagcggcuucucaaguugcagaaag

SEQ ID NO: 51123 - RNA, 56 nt, Mus musculus
ggcaggaccacaaccagcgcagacuggcgcgccccagggaucucugagugaguauc

SEQ ID NO: 51124 - RNA, 83 nt, Mus musculus
ucucugagcgccucacucucaagcacgacuaggaggccucugugccuuccaaggggcuccccacucugcucugcaccagcccg

SEQ ID NO: 51125 - RNA, 23 nt, Mus musculus
guaucauggcuaagaauccuagu

SEQ ID NO: 51126 - RNA, 42 nt, Mus musculus
cugcuaccagccugucuaaucuggcaucucacagccccuccc

SEQ ID NO: 51127 - RNA, 46 nt, Mus musculus
gugucuuuuuauuuauaggaguuuuucaggaugucagaguagauag

SEQ ID NO: 51128 - RNA, 46 nt, Mus musculus
uaaaauucuucuuuggcauuuuguuuugaaaguuuaggcauuuuac

SEQ ID NO: 51129 - RNA, 46 nt, Mus musculus
aaggauugguuucaagaauauagaggcuggaaauuacgguacagaa

SEQ ID NO: 51130 - RNA, 45 nt, Mus musculus
acaggcaggucacagaggacagggcucaguucuuaccacagagag

SEQ ID NO: 51131 - RNA, 47 nt, Mus musculus
cugccuccgaccccugcuuccgcacagugacggccagaagauggaga

SEQ ID NO: 51132 - RNA, 46 nt, Mus musculus
augcccgacgccaccuaucagccaagaagcugccaaacuggcaaau

SEQ ID NO: 51133 - RNA, 45 nt, Mus musculus
ugagccccaguggcaccagacugucucccauugccccugcuccug

SEQ ID NO: 51134 - RNA, 45 nt, Mus musculus
cauuucaagaaauaccuugaaaacaggccugucacaccagugucu

SEQ ID NO: 51135 - RNA, 46 nt, Mus musculus
gagacgagugagcuggaggggcugucucccuggaagcgcgguuuag

SEQ ID NO: 51136 - RNA, 42 nt, Mus musculus
gccagcucauuggcugaggccucacacaccuuugccgcugau

SEQ ID NO: 51137 - RNA, 46 nt, Mus musculus
uuaccacauuguaaacccagccugugguauccuuuaauacagcuga

SEQ ID NO: 51138 - RNA, 45 nt, Mus musculus
ccacugcugcucagcuggugucggugccgcgcguuucccccacgu

SEQ ID NO: 51139 - RNA, 48 nt, Mus musculus
gguggggagaggauucagccucgucacuccgcagagcagcagagcgag

SEQ ID NO: 51140 - RNA, 45 nt, Mus musculus
uuuaaaaaaaaaaucuacugcaccauauugcaacaugcgaacacg

SEQ ID NO: 51141 - RNA, 78 nt, Mus musculus
ccgcagggcuaucgcucacugacccgaggugucucaggaggcggcggcggcgacaggugcggaggcaggaagccuggu

SEQ ID NO: 51142 - RNA, 47 nt, Mus musculus
ccuccuucuucuuccaaagacaccaacccuaggcccugagaugcgga

SEQ ID NO: 51143 - RNA, 46 nt, Mus musculus
ugucuccgugagaaaugcacaggacuauuucaaguacuagucagaa

SEQ ID NO: 51144 - RNA, 45 nt, Mus musculus
ugugaaacccuagcuuauaaaacaaaaacaacagggccaaggaga

SEQ ID NO: 51145 - RNA, 46 nt, Mus musculus
aacuugaaugauggccacagaucucuaugagaaggugggagggugu

SEQ ID NO: 51146 - RNA, 46 nt, Mus musculus
acuguauacuccuucugagauggugggagggcugaacagacggcuc

SEQ ID NO: 51147 - RNA, 41 nt, Mus musculus
ucucucucucucucucuuacacacauaccagugcccucaga

SEQ ID NO: 51148 - RNA, 42 nt, Mus musculus
ucagucauguuuguuaccucuuuggcaagcaagggagaagcu

SEQ ID NO: 51149 - RNA, 46 nt, Mus musculus
ucugugcaucauguguguguguaugugguaccauuggaggucagaa

SEQ ID NO: 51150 - RNA, 46 nt, Mus musculus
cugaggcagggguuguacaagcuuaagguuaaucuaggcuguagag

SEQ ID NO: 51151 - RNA, 42 nt, Mus musculus
ggggcggagggcggcggugaccgcggugcgggagaccggcca

SEQ ID NO: 51152 - RNA, 45 nt, Mus musculus
agugaacagauccgugugcaagccgaggaaagaaggaaaacccug

SEQ ID NO: 51153 - RNA, 45 nt, Mus musculus
gcucgacaacgcuaugaggaccagcugaaacaacagcaacuucug

SEQ ID NO: 51154 - RNA, 44 nt, Mus musculus
uccugaggaaggcaucugcuucauccacaaagagcaggaggccu

SEQ ID NO: 51155 - RNA, 71 nt, Mus musculus
caguaaccagccugagcaguuugauugggcuaucaaugaccgcguugacgagauggucugcuuugcccugc

SEQ ID NO: 51156 - RNA, 45 nt, Mus musculus
cuggugagaauguauuuugacaaguauguccuuaagccggccaca

SEQ ID NO: 51157 - RNA, 44 nt, Mus musculus
ugaaggauguggcggcuuguuggucugggaaucgggucucacua

SEQ ID NO: 51158 - RNA, 25 nt, Mus musculus
ccucccucugccagcacucagaguc

SEQ ID NO: 51159 - RNA, 46 nt, Mus musculus
agcauaagaauaauccaagccaugugguaaaaucggagucuggcaa

SEQ ID NO: 51160 - RNA, 46 nt, Mus musculus
gugagccaaucaccguucccagauguaugaaaaugacuuacaacau

SEQ ID NO: 51161 - RNA, 46 nt, Mus musculus
uguuuucuuuauauaagauacuugcuaaaagaaaguccacuuguag

SEQ ID NO: 51162 - RNA, 46 nt, Mus musculus
aucguggcugcuacagcucaucuuccuucaggauggcaugcuguag

SEQ ID NO: 51163 - RNA, 41 nt, Mus musculus
aggggcugugaggagaucguggucauuguuuuuucuccugg

SEQ ID NO: 51164 - RNA, 46 nt, Mus musculus
ggguugaaacauuaggaagguuaagagccucugucuuaaacaggag

SEQ ID NO: 51165 - RNA, 46 nt, Mus musculus
auagaucaucuaggcaucuugaguuuaacucugaagauaccccgag

SEQ ID NO: 51166 - RNA, 49 nt, Mus musculus
ucugggcuccgagacuaaguccuuugucuguuagucugaagcaguugaa

SEQ ID NO: 51167 - RNA, 70 nt, Mus musculus
caauucuguucucacaccuccgagcacaggucagccagguuggaauauucagggccugcugugguggggu

SEQ ID NO: 51168 - RNA, 49 nt, Mus musculus
ccuguaggcuccagggaaacgugucuggcuauuaggagcugagguuuag

SEQ ID NO: 51169 - RNA, 46 nt, Mus musculus
acacccagaucugcuaagucaguccucuggauaugggggcagagug

SEQ ID NO: 51170 - RNA, 45 nt, Mus musculus
ggagacuggacuuugaggaauggaaggagaggugaagaucgcagu

SEQ ID NO: 51171 - RNA, 45 nt, Mus musculus
cugagacugaggggcugccuuggaggagcagagggagaggugaag

SEQ ID NO: 51172 - RNA, 46 nt, Mus musculus
aucuguuugauacacuggagguaggggcagagagaaguuggggcag

SEQ ID NO: 51173 - RNA, 46 nt, Mus musculus
aagcccaaggcaggagcagcauggaaagagaagcaaaggagagcgg

SEQ ID NO: 51174 - RNA, 105 nt, Mus musculus
ggaccuagguuucagauaaucacauugguggaacuauggagugguggauguaaguuuagcaagcgugggaugcagugagacccacaggaggcuuucagugggcca

SEQ ID NO: 51175 - RNA, 48 nt, Mus musculus
aagggagaaucgcaagauuuguugauggacuggauauaaugugaaagg

SEQ ID NO: 51176 - RNA, 66 nt, Mus musculus
acaaaugaaguugucaggaagcagauguucacauguggagugcacagagaaauggggcuggugguu

SEQ ID NO: 51177 - RNA, 77 nt, Mus musculus
uuuccuggagcaguguucuggcgggaguguuucgggaucuaugcucuagggcauuucccuugcuuagaaguaagaag

SEQ ID NO: 51178 - RNA, 70 nt, Mus musculus
auccagaagaguuaguguccucuaaaaccaaaggaaaaaucuucagaaacuggaguuguggcgguuggug

SEQ ID NO: 51179 - RNA, 46 nt, Mus musculus
cuucugaccucacugauucugcucuccugucagaauagcugcacag

SEQ ID NO: 51180 - RNA, 45 nt, Mus musculus
caauugaacuaauaaggaaagugggaaaugaauguguguccagaa

SEQ ID NO: 51181 - RNA, 46 nt, Mus musculus
uguggugggugauucucaccauuacgugguucuuagcugccgggag

SEQ ID NO: 51182 - RNA, 42 nt, Mus musculus
ccggaaccaagagaagcuaaagaaauucaugauucgcaucgg

SEQ ID NO: 51183 - RNA, 42 nt, Mus musculus
ugugaguucuuccugaagcacaacucuaaagugaagcacaag

SEQ ID NO: 51184 - RNA, 45 nt, Mus musculus
cauaggcugaaggucauuuccaaguccaugggaacuagcacagga

SEQ ID NO: 51185 - RNA, 46 nt, Mus musculus
aaggaaaauucacuguuacagucuuccuugcacuuaaaccagcuuu

SEQ ID NO: 51186 - RNA, 50 nt, Mus musculus
ccccaaacuauaagcaguguucguggaguucgcugaacuauggcauagau

SEQ ID NO: 51187 - RNA, 45 nt, Mus musculus
uuaucaaguuaguaaggggaggggguacaaugcaggcagugugga

SEQ ID NO: 51188 - RNA, 46 nt, Mus musculus
agaugguuucaagauuuuuuuucauuauuauuuuuuaagccuauau

SEQ ID NO: 51189 - RNA, 88 nt, Mus musculus
guaugagaaguauccuggcccugaagcaggaauuaagcuggcuagaggagagcagauugaagauggggccauugcaguuuguugagau

SEQ ID NO: 51190 - RNA, 42 nt, Mus musculus
ggcuauaacacaaaagccagagugagagugauguugccacgu

SEQ ID NO: 51191 - RNA, 42 nt, Mus musculus
aagaaggcaucgguggauuuuacaaaggaauugcccccaauc

SEQ ID NO: 51192 - RNA, 46 nt, Mus musculus
cuuguacagguuuaauagcaaggagagaugcuugugaagucuagag

SEQ ID NO: 51193 - RNA, 46 nt, Mus musculus
uuacaaauagcccuuuaaucuuaauuccuuccuuaaaggcccuguc

SEQ ID NO: 51194 - RNA, 46 nt, Mus musculus
ugauaguagagcaauuacuauauuucucuuuuguugagcccagacc

SEQ ID NO: 51195 - RNA, 96 nt, Mus musculus
gaauaaugccgacauuuugugcuuccauauaauuaagcccacuuauuaaaauuacugucuagcaauggugaggaaggcuaauccugaaugcauaug

SEQ ID NO: 51196 - RNA, 46 nt, Mus musculus
acuugccugcaggccaucuggaugaaggcacuuucucaacugaggu

SEQ ID NO: 51197 - RNA, 46 nt, Mus musculus
auuuauuacaaacuaaauuuuuccagaaaaucaaaucuuuagagau

SEQ ID NO: 51198 - RNA, 44 nt, Mus musculus
uuaguuugcaguauuuaaaaauaugcauugucuggugaaggaag

SEQ ID NO: 51199 - RNA, 44 nt, Mus musculus
aaaccaagcuggacauacaaagaggugagaggaacuggaacaga

SEQ ID NO: 51200 - RNA, 47 nt, Mus musculus
acgaguguuugcaaagccguuccuugcuucccuggauggucaccgug

SEQ ID NO: 51201 - RNA, 44 nt, Mus musculus
gcaaagcauccaaagagccuggcuucuguccuuucuggggcaug

SEQ ID NO: 51202 - RNA, 45 nt, Mus musculus
ucuuaaacugauuuaguuuuccaucuaaucuuaaaauggugucag

SEQ ID NO: 51203 - RNA, 70 nt, Mus musculus
gaaucugacuaaacgaaaauguauccgaacaauacaagcacaugaagguuuugugcggggaaugugcacu

SEQ ID NO: 51204 - RNA, 70 nt, Mus musculus
cgcuuuuguggcacuucuuuuuuuacuguaaguguacuauuaacucauuaaggcccuucuucaacuucac

SEQ ID NO: 51205 - RNA, 45 nt, Mus musculus
cucuuuuaugaguauauguucauggagcacaugccugcaggugag

SEQ ID NO: 51206 - RNA, 47 nt, Mus musculus
gacaaaacugugaagcaguggaaaauggauggaccaggcuauggaga

SEQ ID NO: 51207 - RNA, 45 nt, Mus musculus
aucaucacuggaaagacccagucuuugccacuuguggacagcaag

SEQ ID NO: 51208 - RNA, 46 nt, Mus musculus
gagcugcagggucagugagaggcugucucagaaaauaaggggaugg

SEQ ID NO: 51209 - RNA, 45 nt, Mus musculus
aguugugcuucugauaggaauauaguacuguaugauaugcggcaa

SEQ ID NO: 51210 - RNA, 46 nt, Mus musculus
auacaaucuguuggaacccuauggaagcuuucaauuuuacugcagc

SEQ ID NO: 51211 - RNA, 46 nt, Mus musculus
cuguaucaaguuaggucaaaucaggugguuuucuuuuauugucuag

SEQ ID NO: 51212 - RNA, 42 nt, Mus musculus
ccccaaagccuugaaaagcagauguagcugugcuguugaggg

SEQ ID NO: 51213 - RNA, 36 nt, Mus musculus
agcuuuuugaaguacuuaaucaggguaacaccauug

SEQ ID NO: 51214 - RNA, 47 nt, Mus musculus
uuagcuuacaucacgagaaaaagcagcaaaugauuauaaccagaagu

SEQ ID NO: 51215 - RNA, 86 nt, Mus musculus
uuucaauaccauccacauguaaaacggauugcucgccaccgacaucucccgaaaucuaucuacagccagauucaggagcagcgcgu

SEQ ID NO: 51216 - RNA, 46 nt, Mus musculus
aucgucguaaacauagcaagccuggaucugugccgauugugucaga

SEQ ID NO: 51217 - RNA, 45 nt, Mus musculus
gccaggagccggcuagugcccgauggggaagggaagguuuggaga

SEQ ID NO: 51218 - RNA, 49 nt, Mus musculus
uagaagggcgguguguccugaaccaggaugacagaaggggagauagaug

SEQ ID NO: 51219 - RNA, 46 nt, Mus musculus
uuuagaaaguggccuggaagggagggcuggaaaggugaugagggau

SEQ ID NO: 51220 - RNA, 46 nt, Mus musculus
guggaucuggcaaauuuaugggucguggaggaaacuuuggaggugg

SEQ ID NO: 51221 - RNA, 42 nt, Mus musculus
aguagggucccacgcugugcugcuuaguggcaacgaggagac

SEQ ID NO: 51222 - RNA, 45 nt, Mus musculus
acaacacauucauuucugccaauuuggaucaguuuguuuauagaa

SEQ ID NO: 51223 - RNA, 46 nt, Mus musculus
gaucuucucuuugauaacugccauagccugauugaggacagaggcc

SEQ ID NO: 51224 - RNA, 42 nt, Mus musculus
ucaauacuggaaaacucucaagucuaggguugacagccagga

SEQ ID NO: 51225 - RNA, 46 nt, Mus musculus
cggagaauuaauccuccaacauuugucuaaaaaguauccaguggua

SEQ ID NO: 51226 - RNA, 42 nt, Mus musculus
guuggcccaggaauauuccucacucagacccugcccccuacc

SEQ ID NO: 51227 - RNA, 46 nt, Mus musculus
guaauagcacgucuaaacuguuguggauaauaagacauuugguaga

SEQ ID NO: 51228 - RNA, 46 nt, Mus musculus
auugauacucauaagggaaauuggucugaaguucucuuucuuuauu

SEQ ID NO: 51229 - RNA, 46 nt, Mus musculus
uggaaggaaaacucuauucaucuauugaucacgaaggcagcacaug

SEQ ID NO: 51230 - RNA, 46 nt, Mus musculus
agugaggaugauuugacaguaacggucaggcuuccagaaagcagua

SEQ ID NO: 51231 - RNA, 41 nt, Mus musculus
cagggagacgugugugugugugugugugugugugugugugu

SEQ ID NO: 51232 - RNA, 44 nt, Mus musculus
aaugauuguaucuuacaaguccuucaagguuauuucgggagauc

SEQ ID NO: 51233 - RNA, 46 nt, Mus musculus
caucauguucuccguggaaagucagugccacauuaugcugcaauug

SEQ ID NO: 51234 - RNA, 46 nt, Mus musculus
ggcuauccugcuucuucgaauagagaaggaggaauuggaccugaaa

SEQ ID NO: 51235 - RNA, 45 nt, Mus musculus
cauuggaacaggugaccguggaaacaguccugaaaaaugggaggu

SEQ ID NO: 51236 - RNA, 46 nt, Mus musculus
uacuucauucgaaaucuaaaguaaacacuuaauugcaccaggaauc

SEQ ID NO: 51237 - RNA, 46 nt, Mus musculus
uaugucguggucuuuggacguuauggcuauugacuugacuuuggug

SEQ ID NO: 51238 - RNA, 42 nt, Mus musculus
aauucuagccuuuguaucggcuggcgaggaaagcugccagau

SEQ ID NO: 51239 - RNA, 45 nt, Mus musculus
guuaacaauagauuugcaaguaccucugguuuuuguguguauguc

SEQ ID NO: 51240 - RNA, 46 nt, Mus musculus
uacuugcgggauuuuuuucuucuggucacauccacuuggcccaugc

SEQ ID NO: 51241 - RNA, 46 nt, Mus musculus
gggucccaugggaaucuccaaauaacccaagauguugccaagagua

SEQ ID NO: 51242 - RNA, 46 nt, Mus musculus
guucuaacugaaaucuccaaauaaugggggaaacacagccccaacu

SEQ ID NO: 51243 - RNA, 45 nt, Mus musculus
gggacaaauagaucuccuuagagaugggaaagagaauagacuaga

SEQ ID NO: 51244 - RNA, 46 nt, Mus musculus
uguacaaaacaccaaagaccucaccguaaaaccaaauacauuagau

SEQ ID NO: 51245 - RNA, 42 nt, Mus musculus
acaaaaauuaguagcccuccuauguacaaaugaugagcagau

SEQ ID NO: 51246 - RNA, 70 nt, Mus musculus
acaagucugcccacacguauucgguguagugcuugaaggcugagcugagcaaugauacaauugaaggaga

SEQ ID NO: 51247 - RNA, 48 nt, Mus musculus
cauacauaaauugaugaauguaaucuaccacauaaaaaaacugaaaga

SEQ ID NO: 51248 - RNA, 47 nt, Mus musculus
caugaggacacaguuauccuaauacccaaaccacauaaagacccaac

SEQ ID NO: 51249 - RNA, 41 nt, Mus musculus
ccagggccaggaagcaggaguggguggguugaggaucaggg

SEQ ID NO: 51250 - RNA, 46 nt, Mus musculus
cauaaacaaccaccaagcccagacacuauugcuuaugccaacaaga

SEQ ID NO: 51251 - RNA, 46 nt, Mus musculus
augaguggugcugauuaaaagacuugcuaaauaaaugagugaauaa

SEQ ID NO: 51252 - RNA, 49 nt, Mus musculus
accuggcccauuauccuuuuucuuacaagauccuaaguucugaaaaggu

SEQ ID NO: 51253 - RNA, 44 nt, Mus musculus
cuucggcugcccggacuuagacccucaguagcucgggcaccuaa

SEQ ID NO: 51254 - RNA, 42 nt, Mus musculus
ugaucguaacuagucggcugugaagaggaguagcugguagga

SEQ ID NO: 51255 - RNA, 46 nt, Mus musculus
aggaaggccuagauuaagaucugguccuucauccauggguccacca

SEQ ID NO: 51256 - RNA, 46 nt, Mus musculus
acggcuuugguaugguuuauauggaucuacguucauccaggcagca

SEQ ID NO: 51257 - RNA, 46 nt, Mus musculus
gauaagaaaaagcauucaauuuguaguccugauuugaacaccagac

SEQ ID NO: 51258 - RNA, 46 nt, Mus musculus
ucucaaaaugccaauguaaaacuaacagcaauauucaccagcagaa

SEQ ID NO: 51259 - RNA, 46 nt, Mus musculus
cuaguucggaguguucucauguguuucugaucauagugcaacaguu

SEQ ID NO: 51260 - RNA, 51 nt, Mus musculus
gugcauuaaaguuguaaacgguaacaugaaacaaaggaaguucucagugua

SEQ ID NO: 51261 - RNA, 46 nt, Mus musculus
uaaaauucuagccaaaugagaagaaaaugaaucuccagggcaaugg

SEQ ID NO: 51262 - RNA, 46 nt, Mus musculus
gucuuaugaagaccuauuaaaaaaauaauucauagagccugccuua

SEQ ID NO: 51263 - RNA, 116 nt, Mus musculus
guugccauggugacaguggaccuuuccagugcagcauaugccagcaucuuugcacggacaaauaugacuucacaacacauauccagaggggccugcauaggaacaaugcacaagca

SEQ ID NO: 51264 - RNA, 111 nt, Mus musculus
ccaacugcaaauggugccuccaaggagaaaaccaaggcaccaccaacuguaaaaaaugaaggucccuugaauguaguuaagacggagaaaguugacagaagcacucaagau

SEQ ID NO: 51265 - RNA, 85 nt, Mus musculus
cuugccaaaacuaugugccuuaucccaccuucaaucugccuccucauuucucagcuguuggaucagacaaugacauuccucuaga

SEQ ID NO: 51266 - RNA, 24 nt, Mus musculus
gacuuccagagugaagcugauugg

SEQ ID NO: 51267 - RNA, 48 nt, Mus musculus
gcagccuuugcacauucagauaaaaaguccucaggaaaguacuggaga

SEQ ID NO: 51268 - RNA, 46 nt, Mus musculus
ggaaguggggaggagcaggucaauggaagccccuuagagaggaggu

SEQ ID NO: 51269 - RNA, 46 nt, Mus musculus
agacucccaggccuuuaaacaucauuaaacaaaacaacggcgagca

SEQ ID NO: 51270 - RNA, 46 nt, Mus musculus
uguguauaucaaguuuuagauugauuugauuuaaaauggccaagau

SEQ ID NO: 51271 - RNA, 46 nt, Mus musculus
uguguuguuguuguuguuguuguuguugauguuguuguuguuggga

SEQ ID NO: 51272 - RNA, 46 nt, Mus musculus
uugucuauaggaugaaaagauaggaguucuuuaaaggcagcuauag

SEQ ID NO: 51273 - RNA, 42 nt, Mus musculus
accacaugcucucuucuucuagcugucaaccucagagcaagg

SEQ ID NO: 51274 - RNA, 46 nt, Mus musculus
uccuucugaucucagagaauauggaguguaugcaaggugcccaauu

SEQ ID NO: 51275 - RNA, 46 nt, Mus musculus
agguaugugugagaguugagaguacucuauaacccaggaaucagag

SEQ ID NO: 51276 - RNA, 42 nt, Mus musculus
gaaaaaauacagaacaacaccaaaaaaagaggugggggaggu

SEQ ID NO: 51277 - RNA, 46 nt, Mus musculus
ugccagggccaagaagcaggaguggguggguaggggaaagggagug

SEQ ID NO: 51278 - RNA, 41 nt, Mus musculus
ggaacccauuuaauucuuauuuugaauauuuaccuuugaga

SEQ ID NO: 51279 - RNA, 46 nt, Mus musculus
caccagaaaaauauacuaugcuuuggcauuuucaucucagaaagau

SEQ ID NO: 51280 - RNA, 23 nt, Mus musculus
ggacuacaaaaaugagggggaaa

SEQ ID NO: 51281 - RNA, 23 nt, Mus musculus
aaauuaacaccacuuuacugcau

SEQ ID NO: 51282 - RNA, 45 nt, Mus musculus
ucaucauugaaacauucaaauaaaacuaaauguuucuuuuuagau

SEQ ID NO: 51283 - RNA, 42 nt, Mus musculus
uuacacagacauauauacacucacaugggaauggggccagag

SEQ ID NO: 51284 - RNA, 26 nt, Mus musculus
uguuuggaggcauuuuaggaugaaau

SEQ ID NO: 51285 - RNA, 46 nt, Mus musculus
ggagggaaccaguccagaaguggaaggaaggcagagaggcacugua

SEQ ID NO: 51286 - RNA, 45 nt, Mus musculus
caugagcugggcacacauggaugcacuggucuucaguccugaaga

SEQ ID NO: 51287 - RNA, 42 nt, Mus musculus
aguuacccagggguuccugugaaacaguccugugagcaagau

SEQ ID NO: 51288 - RNA, 45 nt, Mus musculus
ggcagagguccagugagagugaugccaagaucgaguacuggaaau

SEQ ID NO: 51289 - RNA, 46 nt, Mus musculus
acagaagaccacuagaagcaaaaguuggauacaguagcagccagau

SEQ ID NO: 51290 - RNA, 46 nt, Mus musculus
ugagucuaaguagcaaauauuugucccuacuuuuacaccuggguau

SEQ ID NO: 51291 - RNA, 46 nt, Mus musculus
acugcuagucugucuuaaaguaugguaauggggcuaauuaggagag

SEQ ID NO: 51292 - RNA, 44 nt, Mus musculus
cauccaguucaggauucacugucuagguccacaucaccagcaga

SEQ ID NO: 51293 - RNA, 27 nt, Mus musculus
uccccauuuggucucacuuuugcacac

SEQ ID NO: 51294 - RNA, 42 nt, Mus musculus
aagcguucauccguuacacagacuuucaacuuccauggguaa

SEQ ID NO: 51295 - RNA, 45 nt, Mus musculus
cauuuuuauuuuuauuuuauuuuuuaucuaagacucaggauaagu

SEQ ID NO: 51296 - RNA, 45 nt, Mus musculus
ugcauaagaguuuucauguuguugcuaaguucuuggggguggaga

SEQ ID NO: 51297 - RNA, 46 nt, Mus musculus
cuaaaccuuaaagugcauaggcgaaauucuaaaccuuaaagaagag

SEQ ID NO: 51298 - RNA, 46 nt, Mus musculus
ugagagaauuacucuuuucccucugcauaccaagauagacucagac

SEQ ID NO: 51299 - RNA, 42 nt, Mus musculus
aggucauaacuuuagucugaaauauaggcuccucacugagau

SEQ ID NO: 51300 - RNA, 46 nt, Mus musculus
guuuggggggauaaucaugcuuuuuggaaagaggaagagggcagau

SEQ ID NO: 51301 - RNA, 46 nt, Mus musculus
ugcuuaugaaggcaucauauauaaaaacaaauucuaaaagccagau

SEQ ID NO: 51302 - RNA, 46 nt, Mus musculus
agcaauuaguucuucuaaaacagguucucaugcugaucugccagga

SEQ ID NO: 51303 - RNA, 46 nt, Mus musculus
acuuguacauguaaguccacacuuguaugcggacugaaagaaagau

SEQ ID NO: 51304 - RNA, 45 nt, Mus musculus
ggucuacuaaaguuguacauaauuucagaacaguucucuggagau

SEQ ID NO: 51305 - RNA, 46 nt, Mus musculus
acccagggcuagacucaaggcuggggggauauucuugccugcaaag

SEQ ID NO: 51306 - RNA, 46 nt, Mus musculus
cucgucaggguuuuugcuauuggaauugaaaaucuuuugcagagac

SEQ ID NO: 51307 - RNA, 46 nt, Mus musculus
auccauaauuagaaauacauauucuaggaaacaauaaguggaagau

SEQ ID NO: 51308 - RNA, 42 nt, Mus musculus
gcucuauaaaauauuguauuuucuuuucuauaucauagcuca

SEQ ID NO: 51309 - RNA, 45 nt, Mus musculus
aacaugggacgcacccuguagaaauuugucauuauugaaggagau

SEQ ID NO: 51310 - RNA, 42 nt, Mus musculus
uagggggauaacuaggcaggaggaugagaagaaacaggaauu

SEQ ID NO: 51311 - RNA, 46 nt, Mus musculus
ucacuuauauuuguuuuuccucauaaaugaacuacaaggcacauua

SEQ ID NO: 51312 - RNA, 46 nt, Mus musculus
uuauggagcuacgggcuaaaguggggguuaaguuaguuucugaguu

SEQ ID NO: 51313 - RNA, 46 nt, Mus musculus
aaauucacaaguguacuucuugauguuccauuuauaugggcgugau

SEQ ID NO: 51314 - RNA, 46 nt, Mus musculus
gaagagccuugggcuggagagauggcucagccguuaaaugccagac

SEQ ID NO: 51315 - RNA, 46 nt, Mus musculus
aauguaaagacauuaaucuuuugggcauauaaugccauacccagau

SEQ ID NO: 51316 - RNA, 46 nt, Mus musculus
aauugucuguuugauuuuuacaaucaucuuuauucugggcagaaga

SEQ ID NO: 51317 - RNA, 42 nt, Mus musculus
accagauuaagaaaauaagcauaacuaaagguaccaucaguu

SEQ ID NO: 51318 - RNA, 46 nt, Mus musculus
guuuaaagaacacuaaaaggcccauguugauugaguuuugacuuga

SEQ ID NO: 51319 - RNA, 46 nt, Mus musculus
cucagaauuaaucuaauuaaguaacuguuuccauuuaaggugagau

SEQ ID NO: 51320 - RNA, 46 nt, Mus musculus
ggaagauuaauuuagcaucuuucuucaaguaucagcuuuugaagau

SEQ ID NO: 51321 - RNA, 43 nt, Mus musculus
uguugauguuguaaauacaaaauucauauuaauaggggcucug

SEQ ID NO: 51322 - RNA, 95 nt, Mus musculus
agauuaugugguucgagacauuggaaucacuugagcagaucagcuuuuguguguugacaguuggaauagcagacaaaugaaauuagaagcacaaa

SEQ ID NO: 51323 - RNA, 46 nt, Mus musculus
ccuauguguuuauuugaugacaaugauagauuauuaaaauacagau

SEQ ID NO: 51324 - RNA, 52 nt, Mus musculus
gaggacuagauggggugggaggagaauagaaguguauggaguggggaauugg

SEQ ID NO: 51325 - RNA, 83 nt, Mus musculus
aaaggugucuacccucacugaaacuugauaugccauguuugguuaguauccacuggaggccuuugaauuuuuaaagaugaacc

SEQ ID NO: 51326 - RNA, 46 nt, Mus musculus
auguugucauagcaaccggaauuauaaaaaacgaauuuaaagaggu

SEQ ID NO: 51327 - RNA, 46 nt, Mus musculus
gauacacccuguaagaagcaacagugaaucuauuuugcugccagcu

SEQ ID NO: 51328 - RNA, 42 nt, Mus musculus
gggugaggaugcuauggguccguggggcucugggguccagga

SEQ ID NO: 51329 - RNA, 48 nt, Mus musculus
gaaagauauauaacagucacacauacucuccagagauguauaucaagg

SEQ ID NO: 51330 - RNA, 46 nt, Mus musculus
aacauguucaaagaaucacuaagaaggauuuuaaggcaugagagag

SEQ ID NO: 51331 - RNA, 46 nt, Mus musculus
gaacacacuggaucuauuaagaaagucugugucuguauaaagagau

SEQ ID NO: 51332 - RNA, 46 nt, Mus musculus
uguguucucugcccccagugucaugccuuacaccuagcagcuaguc

SEQ ID NO: 51333 - RNA, 46 nt, Mus musculus
uaauuuuucaaaguguucaugucuauuccagagggcagccugaauu

SEQ ID NO: 51334 - RNA, 46 nt, Mus musculus
uacaaacuaguuuuguaaugaguacaagacaauaugagccaguguu

SEQ ID NO: 51335 - RNA, 46 nt, Mus musculus
uaugcuuacacuggacagacuuaugugccccauguaugcaaagagg

SEQ ID NO: 51336 - RNA, 46 nt, Mus musculus
uauaaaagccuuacuggaaaauauagauacagaacuguggacagca

SEQ ID NO: 51337 - RNA, 46 nt, Mus musculus
gauacccuuugucuuggagaacuauagcaagacuuagccauccagg

SEQ ID NO: 51338 - RNA, 46 nt, Mus musculus
aguuauaaauggaaaccuauagcaaaccuuuaguguccauccaguc

SEQ ID NO: 51339 - RNA, 80 nt, Mus musculus
agagagaacaaucuaaaacugcauaucaaucaacaaguaauauuuuagauuucuuuguacaucugauaaagugagccuca

SEQ ID NO: 51340 - RNA, 46 nt, Mus musculus
auauauuuuuuucgguguuuugaucucagauuuuaacgguucagug

SEQ ID NO: 51341 - RNA, 49 nt, Mus musculus
acaagagcauuccucucuggaaaacccugccauugagacgagaguccug

SEQ ID NO: 51342 - RNA, 46 nt, Mus musculus
cacaauaucuuuuugugaagcaaaauagcccuuuauucagaaagau

SEQ ID NO: 51343 - RNA, 54 nt, Mus musculus
acaaguauaauuuauuauaauaaauagguagcaaccaaaguuggagcaaguaga

SEQ ID NO: 51344 - RNA, 50 nt, Mus musculus
caaggguaacuuauuauaauaaauaggaagugaucaaacuugcuggaagc

SEQ ID NO: 51345 - RNA, 46 nt, Mus musculus
caauucuauuucuacccuugguuuacuauguuaaugcaagguacac

SEQ ID NO: 51346 - RNA, 91 nt, Mus musculus
gguacauccuccacaagaucacuuuuguaucugugcauuucaaaucuucuacuaucucuguucuuaagagauuucuauaagggggagcuau

SEQ ID NO: 51347 - RNA, 48 nt, Mus musculus
agggaaaaaaaaaccaacacaaauuacagaauuacacaacugggucaa

SEQ ID NO: 51348 - RNA, 32 nt, Mus musculus
uuaguugaucuuaucuggugugugugugugug

SEQ ID NO: 51349 - RNA, 51 nt, Mus musculus
ucaguaacuuuaauuuuaaagcauauacaaacauacuuucugagaucauua

SEQ ID NO: 51350 - RNA, 46 nt, Mus musculus
ugaacaucacccaacucacgucagucacugaaucacaacuuaagac

SEQ ID NO: 51351 - RNA, 46 nt, Mus musculus
acagaauucaguuucuguugugucucccccaagaaacaauagagaa

SEQ ID NO: 51352 - RNA, 46 nt, Mus musculus
cuaaccaaauuauuuuuaauauauacuauuauuuuagggggccaca

SEQ ID NO: 51353 - RNA, 49 nt, Mus musculus
uaugugcgauugucuaaaucucugaaaugaguguuuuaucaugaagaua

SEQ ID NO: 51354 - RNA, 45 nt, Mus musculus
uaacagaacaauuauucaaacaugauuucgaagucucaccaaggc

SEQ ID NO: 51355 - RNA, 46 nt, Mus musculus
uuaugaaauuugaguuuauuaugacaccacacacacacacacacac

SEQ ID NO: 51356 - RNA, 50 nt, Mus musculus
uauguccauagguuuuaggaaacacuuagccuuuaauauacugguuguag

SEQ ID NO: 51357 - RNA, 80 nt, Mus musculus
uauuaucugugacacuguaagcaaauaaggaaacacaucagauggaauuucaaauuacaacuuuguuuaacugaugacag

SEQ ID NO: 51358 - RNA, 44 nt, Mus musculus
gaguuucuaaaacuuaauacaaucauuuaagaaaggcagcaaga

SEQ ID NO: 51359 - RNA, 56 nt, Mus musculus
gccuugaagaagaucuggaaaucuaacaggaaguaguaugcaaagcaggugaggca

SEQ ID NO: 51360 - RNA, 46 nt, Mus musculus
cacucgaauuugaguccaacuuguucacucaggaaaucccauagaa

SEQ ID NO: 51361 - RNA, 46 nt, Mus musculus
aaaauuucugauucuaaauauuaaucacagacuaaugacugcagcu

SEQ ID NO: 51362 - RNA, 46 nt, Mus musculus
guaccuuugacagugcaaguccucaagaaagauuacccaaugaaac

SEQ ID NO: 51363 - RNA, 46 nt, Mus musculus
cccagggugcuggguuccuaccagcuuuuguuaguccacagagaga

SEQ ID NO: 51364 - RNA, 45 nt, Mus musculus
gauggguaguaucuaaacaaucaaaguauauaaaagcauacuaau

SEQ ID NO: 51365 - RNA, 46 nt, Mus musculus
cauaauugaacaugauuuggaacauauaccuuguauacugucugua

SEQ ID NO: 51366 - RNA, 46 nt, Mus musculus
uggguaauaaaaacaucuuuuaagugcuugcuguuugaugggacuu

SEQ ID NO: 51367 - RNA, 46 nt, Mus musculus
aaaacucagagaacacaaagacagagucaauagaaacaccagagga

SEQ ID NO: 51368 - RNA, 46 nt, Mus musculus
cuggagggagaaaaggagagacugaguaaggcuguggggagguaga

SEQ ID NO: 51369 - RNA, 42 nt, Mus musculus
aucacaaaucacccuuuacuuuugcuuuuauaugccccaugu

SEQ ID NO: 51370 - RNA, 42 nt, Mus musculus
gagucaggcagaaacuuuaauuuuccuuggaacaggcuuaca

SEQ ID NO: 51371 - RNA, 45 nt, Mus musculus
gcucuaaaaccaagaacaauccccucucacacuguagguuaauga

SEQ ID NO: 51372 - RNA, 46 nt, Mus musculus
cagauuucucaagaacaaauauagagucagauuuaauaggcaaguu

SEQ ID NO: 51373 - RNA, 46 nt, Mus musculus
aaaacauaaacagaauagaauuaaaugcaggccaauaaugggagac

SEQ ID NO: 51374 - RNA, 45 nt, Mus musculus
guauaccucauaaugcugguauguuaaaggguacaguacuggagg

SEQ ID NO: 51375 - RNA, 45 nt, Mus musculus
caagcaacaauauaagaauucuguuucuuacuaagaauauagaga

SEQ ID NO: 51376 - RNA, 42 nt, Mus musculus
auaaaacauucagagaugucuggcauuaagguggauggagau

SEQ ID NO: 51377 - RNA, 46 nt, Mus musculus
cuuuccaugaacuauuauaucaauuguggaaguugaguuucuagau

SEQ ID NO: 51378 - RNA, 45 nt, Mus musculus
ccgaaacaggcaugcucguuacacauaccucauauaaaccacagg

SEQ ID NO: 51379 - RNA, 42 nt, Mus musculus
aaguguuaugacagcuaggaaacuuaagggagucggggagaa

SEQ ID NO: 51380 - RNA, 42 nt, Mus musculus
gccuggguuacaucugcuucuuuggaagauuuggaggguaga

SEQ ID NO: 51381 - RNA, 46 nt, Mus musculus
auuauuauuauuuuuauuuugucucuuuaaccuagaggaaacagaa

SEQ ID NO: 51382 - RNA, 46 nt, Mus musculus
auuugcaaaaucaauuauaccaaacaaauagaaaauguccacaucg

SEQ ID NO: 51383 - RNA, 24 nt, Mus musculus
agucccuguuucacgccagugggu

SEQ ID NO: 51384 - RNA, 45 nt, Mus musculus
gugauguaggauaacuggcacaaaaauguggcagagauaugagau

SEQ ID NO: 51385 - RNA, 46 nt, Mus musculus
gaucacagaauuuaugguauuucuuuaaaaaaaauucucugaagac

SEQ ID NO: 51386 - RNA, 46 nt, Mus musculus
auaucuaagggauaauugaaaaugccaccucucuuagagaacagau

SEQ ID NO: 51387 - RNA, 65 nt, Mus musculus
ugaggugaauccugauaggacaggagauggggaggaaguuggggagguagugaggggugacauuu

SEQ ID NO: 51388 - RNA, 44 nt, Mus musculus
gauguuaggaaugaauaaaaucaaaauauaugaaguucgcaaug

SEQ ID NO: 51389 - RNA, 46 nt, Mus musculus
uaaaauugcugauauuguaccuauaaaaauuuaaguacaucuagau

SEQ ID NO: 51390 - RNA, 45 nt, Mus musculus
ugugguuuucagcauugcugauagccucuagcuugaggguaagag

SEQ ID NO: 51391 - RNA, 49 nt, Mus musculus
cacugaugcccguuuuguucucugucagauguacugaucagaaguuugg

SEQ ID NO: 51392 - RNA, 46 nt, Mus musculus
ucauguugcaaaaaagucagacauuuagaggcugcucuaugauuca

SEQ ID NO: 51393 - RNA, 46 nt, Mus musculus
cauuuuguuuuauaguauauucugucuuuguuaccaaugcugagaa

SEQ ID NO: 51394 - RNA, 45 nt, Mus musculus
ugaguuuguuuaggugugagagggggaagaauauacaggugaccc

SEQ ID NO: 51395 - RNA, 44 nt, Mus musculus
auuaucugccuguauuuuguauugaugccuuuuauggggggaga

SEQ ID NO: 51396 - RNA, 68 nt, Mus musculus
cugcugauaccggaguccuuucagaugcaaaaauguucuuuuggaagcagccaugcaaacaagccccc

SEQ ID NO: 51397 - RNA, 46 nt, Mus musculus
auaguaagcuaguaaaugcuuuuauagaaauugcuauugccgagag

SEQ ID NO: 51398 - RNA, 76 nt, Mus musculus
gaaagaaaccuggucacagugacaagcggagaaaauuuugguugagaaacugaggagauuuguauucuugguggug

SEQ ID NO: 51399 - RNA, 44 nt, Mus musculus
caaugccuuaucuucugauuuagaaguuuuaaagucggccauuu

SEQ ID NO: 51400 - RNA, 80 nt, Mus musculus
uacagucugcuaaacccagacucuaaaaugggagaaacaguucccgagagcauagucaagagagagaaacuugaugacaa

SEQ ID NO: 51401 - RNA, 45 nt, Mus musculus
gaaguacaaggcuauagguuuagucuuuaguucagcaaaacagau

SEQ ID NO: 51402 - RNA, 46 nt, Mus musculus
gguaaguuuuauaugugugcacuguuacaaaguuugcuuuguagau

SEQ ID NO: 51403 - RNA, 46 nt, Mus musculus
caaauuaaggggacuuuccaaagcuuacccuucacuucacuaagaa

SEQ ID NO: 51404 - RNA, 46 nt, Mus musculus
accaaaugcgauuuuauaacccagguggaagaagagaucucgagac

SEQ ID NO: 51405 - RNA, 41 nt, Mus musculus
ggcucugucauuaaucagaaugaucuagccaaaaguguaga

SEQ ID NO: 51406 - RNA, 42 nt, Mus musculus
gugggaaaguggcaggacaaaaugacagucaaagcuggagau

SEQ ID NO: 51407 - RNA, 46 nt, Mus musculus
cuccucaacugaacuagagcaacauuuucuucagacgcacccgaau

SEQ ID NO: 51408 - RNA, 45 nt, Mus musculus
acuuuuuuugcuguguauuuuuauuuaacuaagauaggaggagau

SEQ ID NO: 51409 - RNA, 24 nt, Mus musculus
ugagugugcgucucugugugucug

SEQ ID NO: 51410 - RNA, 45 nt, Mus musculus
uguauguguguuugugauugauguguguguaugugugugugugag

SEQ ID NO: 51411 - RNA, 42 nt, Mus musculus
gauauaguauaugugguauauaugugggguguguggguguga

SEQ ID NO: 51412 - RNA, 45 nt, Mus musculus
gugguguauacauguuuguguauguaguggcugguauauguggua

SEQ ID NO: 51413 - RNA, 46 nt, Mus musculus
gcaccaggcaggaugcugagcuggacagcaaaaucuuggcccuuca

SEQ ID NO: 51414 - RNA, 46 nt, Mus musculus
ccucugucuccagagcuucaggacuuuaaaugcaauaucuguggau

SEQ ID NO: 51415 - RNA, 46 nt, Mus musculus
gucaagguuugaguccaguuuccguggccucaaaaaacccacaagu

SEQ ID NO: 51416 - RNA, 46 nt, Mus musculus
ccucaagauauggccugcaccccaucaggggauucauuggagacaa

SEQ ID NO: 51417 - RNA, 90 nt, Mus musculus
gcauggccaagagccaucuuccagcgguaagaaggacuugcaaaucucaggccugagugagaaggcuggcuucaauuaugaaagccccag

SEQ ID NO: 51418 - RNA, 113 nt, Mus musculus
gcuacagagagcaagguaucugggaagaacaaagaauugucugcagaucagaugucagaaaauacagaucagagugauguugcagaguugaacucgaaggaggaacacagcac

SEQ ID NO: 51419 - RNA, 46 nt, Mus musculus
aauuaaacauguacaucucuguucuguaagcagcaaaccugcauau

SEQ ID NO: 51420 - RNA, 45 nt, Mus musculus
cacagagggcuaaccucugcuaaaaguaacaugauuugggaauga

SEQ ID NO: 51421 - RNA, 45 nt, Mus musculus
uuguuuauuauguguacauuucauuguguccaugagcacccugua

SEQ ID NO: 51422 - RNA, 46 nt, Mus musculus
gaauguuauagaaagauggcagaguauuuaacaagcugugaguuaa

SEQ ID NO: 51423 - RNA, 42 nt, Mus musculus
cucccagcuccucaucuuggcucagucuccagguacucagau

SEQ ID NO: 51424 - RNA, 45 nt, Mus musculus
gcagugugccugcccugaguuuaagaacaaggcugaaugccauga

SEQ ID NO: 51425 - RNA, 46 nt, Mus musculus
aauuauccugagaccaaacaugcugucucuguuacuaccccaugcu

SEQ ID NO: 51426 - RNA, 45 nt, Mus musculus
uuugaacaaagguaacauauuuugauuugugaaauucuuugguag

SEQ ID NO: 51427 - RNA, 46 nt, Mus musculus
gcaagcugcugcugaaguuuaagucuuuguuguaauaauaccagau

SEQ ID NO: 51428 - RNA, 45 nt, Mus musculus
ucuguaggauauaauaauggagaaauugauuuggguuggaaagag

SEQ ID NO: 51429 - RNA, 46 nt, Mus musculus
uauacagcauaucuauggaauagcuacauuuuauuuggggcuaugu

SEQ ID NO: 51430 - RNA, 41 nt, Mus musculus
aagagauaguacaaaaacaaaaauacagauaagggccugag

SEQ ID NO: 51431 - RNA, 45 nt, Mus musculus
uccgguuuggggaaaucaccgcuagcauuuuaaacaagguaagug

SEQ ID NO: 51432 - RNA, 46 nt, Mus musculus
agacaggcucuuugcuuucugucuaguuccuguuugggcuguagag

SEQ ID NO: 51433 - RNA, 46 nt, Mus musculus
cuuggaguggcccacaaagugguaaaacagcauagacugccuuugg

SEQ ID NO: 51434 - RNA, 46 nt, Mus musculus
gugauuucuuucuuucuucucuucuguucccuuuacacccccacuc

SEQ ID NO: 51435 - RNA, 42 nt, Mus musculus
ggggggggagggaagggaaagggggggaggcaggaaagaccu

SEQ ID NO: 51436 - RNA, 44 nt, Mus musculus
uuaaacaacaacaacaacaacaaaaaaccccaacaacacccccu

SEQ ID NO: 51437 - RNA, 86 nt, Mus musculus
uaauaguguuggugucuugaaacugacguaaugcgcggagagugagguccugacaagcgauaacauuucugauaaagacccgaucu

SEQ ID NO: 51438 - RNA, 42 nt, Mus musculus
ggcuggugcggccggccggucccgcgggcggcggcggcgggu

SEQ ID NO: 51439 - RNA, 41 nt, Mus musculus
ucgccucggcugccacgcauugccccccgcgccccccaagg

SEQ ID NO: 51440 - RNA, 46 nt, Mus musculus
uaguguccauguucugacagggaaacaagucacaguaacugaaguc

SEQ ID NO: 51441 - RNA, 46 nt, Mus musculus
uuuucuuuucaauacgacgugccuguaaccauggauguccccuuug

SEQ ID NO: 51442 - RNA, 47 nt, Mus musculus
gagaaaaacauccuaauaaaggcuuuauuauuaacagaccagauagc

SEQ ID NO: 51443 - RNA, 46 nt, Mus musculus
uauuuauuauaaauguuaguacucaucuuuuuccaaggcugcacac

SEQ ID NO: 51444 - RNA, 42 nt, Mus musculus
ccugccugcugaagggcagaccaaugagagacuaccccagau

SEQ ID NO: 51445 - RNA, 46 nt, Mus musculus
cagugaaaccaacggucugguuaaccacuguaguagggauagugug

SEQ ID NO: 51446 - RNA, 46 nt, Mus musculus
uuacuauguugaaaggaaaaccugccuaggaaaaugccugacacuu

SEQ ID NO: 51447 - RNA, 47 nt, Mus musculus
ucgagcuagugauaacucacuaguacauacaaauugcccccgugugc

SEQ ID NO: 51448 - RNA, 54 nt, Mus musculus
cagcaaaguucuacagcuuuuugguucuuaagaagcagcaagccaucgagcuca

SEQ ID NO: 51449 - RNA, 45 nt, Mus musculus
ugaagaugcuucagggggugaucaggaucaagaggaaaggagaug

SEQ ID NO: 51450 - RNA, 59 nt, Mus musculus
agagcuccuaccggagaaggagaaggaaaaagagaaggagaaggaagaggaggaggagg

SEQ ID NO: 51451 - RNA, 76 nt, Mus musculus
uagagcaaauggaaauaccaccaguagaacuucccccagaggagccuccaaauaucugucagcugaucccggaguu

SEQ ID NO: 51452 - RNA, 63 nt, Mus musculus
agcugcaaggggcguuuaaggagucugaguuaggagucucgguuuagaucuggaaguggaucg

SEQ ID NO: 51453 - RNA, 92 nt, Mus musculus
gaagagccaagccgccuccaggacucagugauggaggccagcagaacaaccauagaagaaucagccaugcccccaccacccccucaaggagu

SEQ ID NO: 51454 - RNA, 58 nt, Mus musculus
cccaaaacucggaaaacuaaauucuuuucuugugauaauugcagaugagcccauuaua

SEQ ID NO: 51455 - RNA, 44 nt, Mus musculus
gguuuggaggcauggaagugcauggaucuccucaccuugcagga

SEQ ID NO: 51456 - RNA, 76 nt, Mus musculus
aaagaguuugagaauccagagguucccagagaggagcagcagccacagcagcagcagccacagccgcagcgagaug

SEQ ID NO: 51457 - RNA, 43 nt, Mus musculus
cucuucacacgcugccuuaccccacuuguaccagaagaccuua

SEQ ID NO: 51458 - RNA, 44 nt, Mus musculus
gacagugucaaagaauuggauaguaagaccauuagagcccagcu

SEQ ID NO: 51459 - RNA, 45 nt, Mus musculus
cucuguggauccugucgaaccgaugccaacuaugacugaucagac

SEQ ID NO: 51460 - RNA, 46 nt, Mus musculus
ggaugaagaugacaauggcucacgugagcauuuuauguuuugggau

SEQ ID NO: 51461 - RNA, 68 nt, Mus musculus
ugaaucacuuagaguacgaagaccaguacaaagaugacaauuuuggagaaggaaaugauggcgguaua

SEQ ID NO: 51462 - RNA, 68 nt, Mus musculus
agugagcaccagcgcuuccaaccuucuccucgagccagagcagagcaccagcaaccugaaugaaaaga

SEQ ID NO: 51463 - RNA, 55 nt, Mus musculus
gcccagcaguucagccugaaccaaagcagaguagaagagauaaccaugagagaag

SEQ ID NO: 51464 - RNA, 45 nt, Mus musculus
cacaugaauaauaacaacugaaguaaacuccugucugcugcaccu

SEQ ID NO: 51465 - RNA, 46 nt, Mus musculus
uauuacaguuauguacuguugucuuaaacuacugaaagcugcaccu

SEQ ID NO: 51466 - RNA, 47 nt, Mus musculus
uaaucccucaucuuuuagauuguuuagugcaucucugaccuccaguu

SEQ ID NO: 51467 - RNA, 46 nt, Mus musculus
uuacuuuaccugaggaauuccacgauuuugaucagccacugccaga

SEQ ID NO: 51468 - RNA, 45 nt, Mus musculus
ucccagggccucucugaccagcuagcuuuguagaaucagugagau

SEQ ID NO: 51469 - RNA, 91 nt, Mus musculus
cucaguugacugagguaugugugugcgccugcucaauaagacguuuuaaccgacaggucugaaauaaucuuucuuuuuuuuaaggccagga

SEQ ID NO: 51470 - RNA, 46 nt, Mus musculus
uugacuguccuuuggugcaucaucacccacacagcaggaaagggag

SEQ ID NO: 51471 - RNA, 46 nt, Mus musculus
gugcuuaacaaaaggaaaaguguuaaagggacauuccaagacagau

SEQ ID NO: 51472 - RNA, 88 nt, Mus musculus
uaucuuuuaaugaguauguuuuuaccauagaauuugggaagcuugaguuuaugguaugauuugaaugaagaacuaucugggggaacuu

SEQ ID NO: 51473 - RNA, 53 nt, Mus musculus
ugcuuuaaaucacauaagaugaccauaaauacagaggcuagauugcagaggag

SEQ ID NO: 51474 - RNA, 47 nt, Mus musculus
uuaccuaacuuuacccacucuaaaccaaacuaguacaggcgcuacau

SEQ ID NO: 51475 - RNA, 46 nt, Mus musculus
gaagaaccaucccaggcccccuuuguuuagcauauagccgguggcc

SEQ ID NO: 51476 - RNA, 27 nt, Mus musculus
acacuacaaaaagucugagagauaaga

SEQ ID NO: 51477 - RNA, 46 nt, Mus musculus
aaacaaagagauguucauagcaucuuuacucagacuugccacaaca

SEQ ID NO: 51478 - RNA, 42 nt, Mus musculus
ugccaaaaauuuuaggcagauguuaacuguaagcccaaaguc

SEQ ID NO: 51479 - RNA, 45 nt, Mus musculus
aauccagccauugaagccacggcagcaaaaugauauaguagagaa

SEQ ID NO: 51480 - RNA, 47 nt, Mus musculus
acaagaagcuaaccaaagcccauguauuugagugcaacuuagagagc

SEQ ID NO: 51481 - RNA, 45 nt, Mus musculus
auagaaaaacccugucucgaaaaaccaaaaaaaaaaaaaguuaga

SEQ ID NO: 51482 - RNA, 46 nt, Mus musculus
acauaaaacaaaaguguuagucuuaaaagguaaucaaaaauuagau

SEQ ID NO: 51483 - RNA, 46 nt, Mus musculus
uuuguauccuaugaaguuaauugggguuaauguaaaauggccagau

SEQ ID NO: 51484 - RNA, 51 nt, Mus musculus
aauuaaccccauuucccucuucagaucacuuauaccccgcuguuucuauug

SEQ ID NO: 51485 - RNA, 45 nt, Mus musculus
uuaaaaucuucccaccacuuuuccucaaugaccccccccccccag

SEQ ID NO: 51486 - RNA, 45 nt, Mus musculus
guaaugaugcuuguggguuuuuucuuuauucagauacaggcuaua

SEQ ID NO: 51487 - RNA, 46 nt, Mus musculus
aguuuugcugucaaaucagcaaaagcuacucuuccaucaagcacuu

SEQ ID NO: 51488 - RNA, 42 nt, Mus musculus
auucccuaauacaccguauuguuuagggagugaugaaaagga

SEQ ID NO: 51489 - RNA, 46 nt, Mus musculus
ccagccaaccuauagauagaugccauuuuuuccccaacauucagau

SEQ ID NO: 51490 - RNA, 45 nt, Mus musculus
cagaucacaguuggguauuuugcuaacuugauagcugaugcagau

SEQ ID NO: 51491 - RNA, 46 nt, Mus musculus
uuucaggccacuaccaggcagcucucuuucugugugagcuggguau

SEQ ID NO: 51492 - RNA, 46 nt, Mus musculus
uauuguuguuaggagaggugaggaaauccgauuauguaccccaggc

SEQ ID NO: 51493 - RNA, 45 nt, Mus musculus
ccucgggggggaagauggcugucugcaaagacgcgggacucaggg

SEQ ID NO: 51494 - RNA, 23 nt, Mus musculus
acgguguugcgcaggcgcugcau

SEQ ID NO: 51495 - RNA, 45 nt, Mus musculus
aacucaaaucaacauaugcacucuccauccucucuaggcccacuc

SEQ ID NO: 51496 - RNA, 45 nt, Mus musculus
ccucucccaucccaugccuucagcuagucaccagagaugcccccc

SEQ ID NO: 51497 - RNA, 53 nt, Mus musculus
augcaguccuguccagccagagccuguuuguagaaaccccagauggauuauua

SEQ ID NO: 51498 - RNA, 49 nt, Mus musculus
gaugaggacuaauggucacagaggaugcuuugccuaagagccacagugg

SEQ ID NO: 51499 - RNA, 44 nt, Mus musculus
uaaagaacaauauaagcauauuauucacauguaaucaccaauag

SEQ ID NO: 51500 - RNA, 46 nt, Mus musculus
ggcuucugauauuaaaugucugcuucuacuugaaggaaccacaaaa

SEQ ID NO: 51501 - RNA, 45 nt, Mus musculus
acaaaaaagacaaaaaaagaaaaaggaaaaaauaaacagcuuaga

SEQ ID NO: 51502 - RNA, 48 nt, Mus musculus
cugcugugacaaaauugccuccaaucaaagugacccagaagaaacagu

SEQ ID NO: 51503 - RNA, 42 nt, Mus musculus
cagccagccugaagaacaugguagaccaacuggccaacugug

SEQ ID NO: 51504 - RNA, 46 nt, Mus musculus
augacuacuccaugguguugacaggagcugcuaucuaccacaagug

SEQ ID NO: 51505 - RNA, 46 nt, Mus musculus
gcucugcacaugugaccuggcacaaacaccccaucaaccccaagac

SEQ ID NO: 51506 - RNA, 45 nt, Mus musculus
gauggcucccccuucuucucccuuugcuuccuccuaaaucccaga

SEQ ID NO: 51507 - RNA, 45 nt, Mus musculus
ugggugugcugugaugaaguccugggaccauacaauuuagaggac

SEQ ID NO: 51508 - RNA, 42 nt, Mus musculus
gucuauucaucaggauaaaauccuagcacuuagacagcagac

SEQ ID NO: 51509 - RNA, 45 nt, Mus musculus
aagauuuuguggacuugaggaggaagaggagaaggaagaggagga

SEQ ID NO: 51510 - RNA, 24 nt, Mus musculus
gacuagaagaaggaugugcaugug

SEQ ID NO: 51511 - RNA, 41 nt, Mus musculus
ccaaaacagccuuaccauuuuccucucauuguagcccccaa

SEQ ID NO: 51512 - RNA, 45 nt, Mus musculus
ucucacuguguguguguguguguguguguguguguguguguuuua

SEQ ID NO: 51513 - RNA, 46 nt, Mus musculus
cugauuaccacauuacaguucugaacugccagugaucauucaagau

SEQ ID NO: 51514 - RNA, 46 nt, Mus musculus
gguucuuuuauugucagugucuccucuuuucccucugugcccaggu

SEQ ID NO: 51515 - RNA, 26 nt, Mus musculus
acauccagugcuucuaaccacugagc

SEQ ID NO: 51516 - RNA, 46 nt, Mus musculus
aaguuauuccuaagucaaaaauugaaacucagugauggugaaagua

SEQ ID NO: 51517 - RNA, 46 nt, Mus musculus
uuguaagccaccaugugguugcugggauuugaacuucggacuuucg

SEQ ID NO: 51518 - RNA, 32 nt, Mus musculus
uuggagacccugaguauauucuuuuuuaaaga

SEQ ID NO: 51519 - RNA, 46 nt, Mus musculus
uauauaaaugauugauugauagaugauagauugauagaugauagau

SEQ ID NO: 51520 - RNA, 46 nt, Mus musculus
ucaccaaaaauccaauauuucuuuaauauuaucacaauuagcagcu

SEQ ID NO: 51521 - RNA, 42 nt, Mus musculus
gugccuagcuuccuauauauuuacuucuguuaucggggagga

SEQ ID NO: 51522 - RNA, 46 nt, Mus musculus
uuuugguuuucaggcugucugguauggagcagcagauaccagagaa

SEQ ID NO: 51523 - RNA, 46 nt, Mus musculus
uucauucaacaaaaggcucacuacuuacucauauccaccccaagua

SEQ ID NO: 51524 - RNA, 45 nt, Mus musculus
gcgcucauuugggaauagcuaucagaagaaacagaagcagagcag

SEQ ID NO: 51525 - RNA, 42 nt, Mus musculus
uacaaagaaaugcuggcuucuggcuuccuuuggggccaaggu

SEQ ID NO: 51526 - RNA, 46 nt, Mus musculus
gaaaaacuaaagaaggguaugcaauuuacccauccuucagcccacu

SEQ ID NO: 51527 - RNA, 45 nt, Mus musculus
uuugcuucuguccaaauggcuuauccgugcuuuaucugucgauag

SEQ ID NO: 51528 - RNA, 46 nt, Mus musculus
uggaguaaaaauaaauaaacuccucuuuguaaguuagagaguugau

SEQ ID NO: 51529 - RNA, 46 nt, Mus musculus
uaguacacaguauagcaucacuugugguuacuaaaaauggcagacg

SEQ ID NO: 51530 - RNA, 44 nt, Mus musculus
gaagguaacaugaauggcaugaaucauggauuaauuagccaggg

SEQ ID NO: 51531 - RNA, 45 nt, Mus musculus
uuuuuuucuuucuuauugguaugauuaugaauauugcuguuuugg

SEQ ID NO: 51532 - RNA, 46 nt, Mus musculus
aguaacugcuccgcuuaauauuauuugaaacuugaauuggggagag

SEQ ID NO: 51533 - RNA, 45 nt, Mus musculus
aagucucauuggcauguaaauauuuucacuccuuacaggcauuua

SEQ ID NO: 51534 - RNA, 46 nt, Mus musculus
guaauugucaccuucuaguggauggauuggucccuccuuggucuuu

SEQ ID NO: 51535 - RNA, 42 nt, Mus musculus
cuagaagagagguuagggcaccauuuuccugcaggcccuguc

SEQ ID NO: 51536 - RNA, 23 nt, Mus musculus
cuccaaggaaagauugaugaaau

SEQ ID NO: 51537 - RNA, 46 nt, Mus musculus
cuaugacccaaggugggaacagaaauguguaauuuggcacgaugac

SEQ ID NO: 51538 - RNA, 54 nt, Mus musculus
guccaaacccagcucagggagucaggaagaucaucgcaguugauaggaaaaugg

SEQ ID NO: 51539 - RNA, 46 nt, Mus musculus
ggguuuuggguuaucuugaugcugcaaagccugagcaaagcugugg

SEQ ID NO: 51540 - RNA, 46 nt, Mus musculus
uacuauguaucucuggcuguccuggaacucacuauguacaacagac

SEQ ID NO: 51541 - RNA, 45 nt, Mus musculus
cuuugaauuuagagaauaagcuuacaaauagaaguggugccaguc

SEQ ID NO: 51542 - RNA, 45 nt, Mus musculus
ucggucagacucaguuucccuguuaugugaggauaaugaaugaga

SEQ ID NO: 51543 - RNA, 46 nt, Mus musculus
gcagagagagcgagagagagagagagagagagagagagacagagac

SEQ ID NO: 51544 - RNA, 42 nt, Mus musculus
aaugagccagcuuagaauccguucuaugaauuaccugcuggu

SEQ ID NO: 51545 - RNA, 68 nt, Mus musculus
cuuuauaaaauggaugacgcgcuucaguacaaaugucuguuuucuguuuuuauaucacuuaagauaau

SEQ ID NO: 51546 - RNA, 46 nt, Mus musculus
agucuaacaaagaugauagucugcacauccccggaagcccugagaa

SEQ ID NO: 51547 - RNA, 47 nt, Mus musculus
ugugcauccuggcaacuuuccucugccacccgggggucagcguuugg

SEQ ID NO: 51548 - RNA, 46 nt, Mus musculus
uccaucaguuuuauauauaaaaaaauuaaauugaacagcugcaaga

SEQ ID NO: 51549 - RNA, 46 nt, Mus musculus
cacuccaguuuuggugacaaauguauuuuucucuugggaacaagau

SEQ ID NO: 51550 - RNA, 65 nt, Mus musculus
auuauaaccccacugagcaccauugggguuaaaaauaaggcuccagauauaguuuuagcgcuaac

SEQ ID NO: 51551 - RNA, 67 nt, Mus musculus
ugguagggcauugguuuuagauaauucaccauugcagagaauguguagaauaguaauagaguuuuga

SEQ ID NO: 51552 - RNA, 110 nt, Mus musculus
uguuuggugucagugauugaaacugagcccccacaccugugaucccacacuaauugaauguauagcaucagacacaaauugagccauuuagcaacucauuaauauccagc

SEQ ID NO: 51553 - RNA, 42 nt, Mus musculus
guucuuuaccuagcccuaccaaauugcugaaucaaugcagag

SEQ ID NO: 51554 - RNA, 45 nt, Mus musculus
cuaagauuaggagcccugaaauuuccaccccaucucccauccugg

SEQ ID NO: 51555 - RNA, 47 nt, Mus musculus
gaggacuuuuuuuuucuccuuccuguuuuaaaauacuuccuugggau

SEQ ID NO: 51556 - RNA, 44 nt, Mus musculus
ccgcuuuccuugcuuuuggccccaugguuuaagcuagcccuuug

SEQ ID NO: 51557 - RNA, 46 nt, Mus musculus
gaccacuaaaaugucuccaacgaggccauauaaacagaguagaguu

SEQ ID NO: 51558 - RNA, 44 nt, Mus musculus
gaguaaaagacuugucaaggaacacaguguacuugggcagaaga

SEQ ID NO: 51559 - RNA, 49 nt, Mus musculus
gccugcgguagcauuuccucugccuagguuuuuguuuguagaaagguga

SEQ ID NO: 51560 - RNA, 48 nt, Mus musculus
ucguuuaccuguguuucauuucaguugagcacuugugauagcaguugg

SEQ ID NO: 51561 - RNA, 46 nt, Mus musculus
uuuuaacccucagaagagggggcccuuaaaaagauucagcuccaaa

SEQ ID NO: 51562 - RNA, 24 nt, Mus musculus
uggaagaggaggaaauugcaggag

SEQ ID NO: 51563 - RNA, 46 nt, Mus musculus
ucuugagagaaaauuggcauccccauagcaguagaauacaggagaa

SEQ ID NO: 51564 - RNA, 46 nt, Mus musculus
uauggaauaaaagauuaccugccguuuaaguagccaguuucccgau

SEQ ID NO: 51565 - RNA, 45 nt, Mus musculus
aauuucccaagauguguuaauuauccuugucaugcaagugcagcc

SEQ ID NO: 51566 - RNA, 45 nt, Mus musculus
ugcuuuucacguuguccuucuuuugcacaugacuaaggcaugaac

SEQ ID NO: 51567 - RNA, 42 nt, Mus musculus
gcagcuggcucccagauggaaaaacugaaaacgccccaaguu

SEQ ID NO: 51568 - RNA, 55 nt, Mus musculus
uugaaaugagugcagguggcuggcugcaggucacucccuuuccaaacaggaggag

SEQ ID NO: 51569 - RNA, 109 nt, Mus musculus
gaauuugccuguguucguccggaauugggguuauguggagucagguuggggaaagggaauaauagcuucauuuucuuuccaguuugugcagugagugaaauggucagau

SEQ ID NO: 51570 - RNA, 46 nt, Mus musculus
gagccaugggaaaugggguugggggaggaggauacuggggcaagua

SEQ ID NO: 51571 - RNA, 45 nt, Mus musculus
uaccugacuagggugugugaaauccucuaugaacaggcacgugga

SEQ ID NO: 51572 - RNA, 46 nt, Mus musculus
gguagcuuuugaacggagacagaaaaucaggaugaaucggccaugu

SEQ ID NO: 51573 - RNA, 46 nt, Mus musculus
uuguagaaguuguggagagaccuggcuugugcuugcgccugggaga

SEQ ID NO: 51574 - RNA, 46 nt, Mus musculus
aaaauuuuaaauccaaggaaguaaaucaaagcagcuacccaucccc

SEQ ID NO: 51575 - RNA, 45 nt, Mus musculus
agaagaaagggggcagaggguugaaagaauacagggggaaaaagg

SEQ ID NO: 51576 - RNA, 45 nt, Mus musculus
agaaaggaaaaagucuuaggguucaugccugccacugccccaaua

SEQ ID NO: 51577 - RNA, 42 nt, Mus musculus
ccgagcaaugugaagaggaggcgggcgccauucugcucagau

SEQ ID NO: 51578 - RNA, 46 nt, Mus musculus
uauguacuugagaacacaguaauguggcuuaaaucagugguggggc

SEQ ID NO: 51579 - RNA, 46 nt, Mus musculus
uaguccugcugcuaacaaguuuuacagaugcuugucuuugccagau

SEQ ID NO: 51580 - RNA, 46 nt, Mus musculus
uaagagacaugagccauauuuaccuuagccacuauuugaacugaga

SEQ ID NO: 51581 - RNA, 46 nt, Mus musculus
aagcuuuccugaauguuuaaugcaaagcuuaauauuuacaauagca

SEQ ID NO: 51582 - RNA, 46 nt, Mus musculus
cauuaggcuaacccacuacauuguacugauuguuuugucuagagac

SEQ ID NO: 51583 - RNA, 47 nt, Mus musculus
uucuuccucuuccuccugcacuucuccugguuccccuaugcccccaa

SEQ ID NO: 51584 - RNA, 45 nt, Mus musculus
acugugcugaugggucagaaugcuagcuccauuuauuuguaagau

SEQ ID NO: 51585 - RNA, 46 nt, Mus musculus
ggugguggcgcacgccuuuaaucccagcacucgaggaggcagaggc

SEQ ID NO: 51586 - RNA, 54 nt, Mus musculus
augauggauuuaagagaggggagaacauuaaguauuaagauugcagauaccuuu

SEQ ID NO: 51587 - RNA, 51 nt, Mus musculus
ugaagaacuguaggaauaauguaguuuuacaaaaugucucagauguuccaa

SEQ ID NO: 51588 - RNA, 84 nt, Mus musculus
uuuucuucaacaaaacaaaacaaaaacauuaguugcuuggcucaggguggguagagggucagugaaagaggaauauucaguugc

SEQ ID NO: 51589 - RNA, 46 nt, Mus musculus
uggguaagaucaugagaauaaaaucaguguucagcaggcugggucu

SEQ ID NO: 51590 - RNA, 42 nt, Mus musculus
aauggcggcuucguacucaccauugguuuucagaguggugaa

SEQ ID NO: 51591 - RNA, 42 nt, Mus musculus
agaagcagaggcaggaggaaggaaaacaauaagaaaccaggc

SEQ ID NO: 51592 - RNA, 46 nt, Mus musculus
uguuauacaaggguuaauaccacuuagcucucugguaccucccuga

SEQ ID NO: 51593 - RNA, 71 nt, Mus musculus
uacacagcgaaaacccugucucaaaaaaaccaaauagguagguagguagauagauagauagauagauagau

SEQ ID NO: 51594 - RNA, 44 nt, Mus musculus
uuauuauacauaaguacacuguagcuaacuucagaagcaccaga

SEQ ID NO: 51595 - RNA, 41 nt, Mus musculus
caguguuaauggagaccuguggcaguucauugcaugggaau

SEQ ID NO: 51596 - RNA, 46 nt, Mus musculus
aaaaugcuaacugguucuggggauuuuaaggccuggccugcaaaga

SEQ ID NO: 51597 - RNA, 46 nt, Mus musculus
uucugcaugugcguaguguuugacagauaauaugagacucggagau

SEQ ID NO: 51598 - RNA, 27 nt, Mus musculus
uucucauuuguuuugaugagauuuagg

SEQ ID NO: 51599 - RNA, 42 nt, Mus musculus
ucuagcaaaugaagaaauugaagucugagauggggcgcagug

SEQ ID NO: 51600 - RNA, 46 nt, Mus musculus
ucaguagagggagcgcacuguaggugaccuguuuaaugcugaagaa

SEQ ID NO: 51601 - RNA, 45 nt, Mus musculus
gggagaggaggaggaggagaaggaagagaaggaagaagaggagga

SEQ ID NO: 51602 - RNA, 66 nt, Mus musculus
uguaccauacuuuuauuuuacacaagcaaugaccucguggagaugccauuugcagguaggggaagu

SEQ ID NO: 51603 - RNA, 48 nt, Mus musculus
uacauuauugaaauauggauugucuguuguacauuaugacgcagcugg

SEQ ID NO: 51604 - RNA, 46 nt, Mus musculus
ucuguccccuuuggcuuauuacuguguucguuuucuugggccauug

SEQ ID NO: 51605 - RNA, 43 nt, Mus musculus
ugagaugaguuugcacgugcuauagguuauuuuuuccugagau

SEQ ID NO: 51606 - RNA, 28 nt, Mus musculus
uugcuugcuuuauaaaucagucgcaaga

SEQ ID NO: 51607 - RNA, 45 nt, Mus musculus
ugguauuccucugugugugugugugugugugugugugugugugug

SEQ ID NO: 51608 - RNA, 46 nt, Mus musculus
ucuucuccaaguugcucaguaauaucacuauaugacagccugacaa

SEQ ID NO: 51609 - RNA, 65 nt, Mus musculus
caaaucccagaaggcuguaauaaaagggcaccucucuacagcagaaggaagucguuuaaguuuga

SEQ ID NO: 51610 - RNA, 41 nt, Mus musculus
ccauuuuggucaaacuuugguaguucauagugaggccucag

SEQ ID NO: 51611 - RNA, 46 nt, Mus musculus
uaauggaauuaugaaaauaacagggcuggugagauggcucaguugg

SEQ ID NO: 51612 - RNA, 45 nt, Mus musculus
cacuccuggcauuucccccccucuguuguuucuaauaguucuuga

SEQ ID NO: 51613 - RNA, 45 nt, Mus musculus
ugcaugcuaguuaggcaugcacuuaaacaaucugucccgccuccu

SEQ ID NO: 51614 - RNA, 45 nt, Mus musculus
aaaccuccacuuuuacucugcucuuuaaacacccagucucuagca

SEQ ID NO: 51615 - RNA, 42 nt, Mus musculus
uuuguaaguugauaucacgacucacacuuuaugcccccaccc

SEQ ID NO: 51616 - RNA, 46 nt, Mus musculus
ccacgugagugcugaucuugugcuggggauauuuuugaacuaaaua

SEQ ID NO: 51617 - RNA, 46 nt, Mus musculus
cauuggucauauuaaucacauuuaaagguaggccccaugcccagua

SEQ ID NO: 51618 - RNA, 46 nt, Mus musculus
uggaaguggacaagaacaaccauccuuaaccaagaagccgucucca

SEQ ID NO: 51619 - RNA, 49 nt, Mus musculus
gugguaauuuuaagaagucacacugggacagucugcaaacagccagaga

SEQ ID NO: 51620 - RNA, 75 nt, Mus musculus
aguggcacugggaaagagccaguggacaacagcagaguagacaggaagggagggguugcuucuugccuggggggu

SEQ ID NO: 51621 - RNA, 42 nt, Mus musculus
gcccacagaagucacucugugguuguuuuauuugagggagcu

SEQ ID NO: 51622 - RNA, 46 nt, Mus musculus
uguuucuguccccuugcucucugggucuguccugccuuguccaguu

SEQ ID NO: 51623 - RNA, 45 nt, Mus musculus
augacaagaaggaaagagaaaugacauugucuccaaguggaaguc

SEQ ID NO: 51624 - RNA, 47 nt, Mus musculus
aacuguaggguaguuggaauuguaccaaggaagaaagcccaggcuag

SEQ ID NO: 51625 - RNA, 46 nt, Mus musculus
ucaugccuacauagacuuguuuuugagucucagcugucaccccagg

SEQ ID NO: 51626 - RNA, 42 nt, Mus musculus
ggaauucacacuugaguguuguuguucugagauggggucuug

SEQ ID NO: 51627 - RNA, 46 nt, Mus musculus
gccucaaauuagugaaacauacuuauaaguggacuugugauagaua

SEQ ID NO: 51628 - RNA, 46 nt, Mus musculus
guguauguguguguauauguguguguguguguguguauguguguau

SEQ ID NO: 51629 - RNA, 45 nt, Mus musculus
uaauacagucuggcuauaaggggguuaguguucugugcucugagg

SEQ ID NO: 51630 - RNA, 48 nt, Mus musculus
caauuuguugagacaaggcaaaaauacagaggagaaaaggcacuaagg

SEQ ID NO: 51631 - RNA, 46 nt, Mus musculus
gagcuuaguuucugauggaggggauaaacuguaagagacaaaaagg

SEQ ID NO: 51632 - RNA, 41 nt, Mus musculus
acagacagaguuuggccguccaugaugauuguugugggagu

SEQ ID NO: 51633 - RNA, 46 nt, Mus musculus
ggucacugugcuuggauguguagaauuauaugucucaaauauaucu

SEQ ID NO: 51634 - RNA, 46 nt, Mus musculus
gcuuugaggcauuuggcuuugcuucacaauucgaagaacugcaaag

SEQ ID NO: 51635 - RNA, 48 nt, Mus musculus
aaaaagaugaacgguuauugugauuccauuucaaaggaggggaaacug

SEQ ID NO: 51636 - RNA, 45 nt, Mus musculus
aaaauugaauuugagauaaauaacagauaauguccuauuagcagg

SEQ ID NO: 51637 - RNA, 45 nt, Mus musculus
gguugugagccaccaugugguugcugggaauugaacucggguccu

SEQ ID NO: 51638 - RNA, 46 nt, Mus musculus
gaugacauuuuggcuuuuggguuggugggaagcuaaguucauagau

SEQ ID NO: 51639 - RNA, 46 nt, Mus musculus
ucuggauccaaaucugaaugacuaugcaugccccaggagcacagau

SEQ ID NO: 51640 - RNA, 41 nt, Mus musculus
gucaucccuaggcuggugguugcuaaaagaaagcaggcaga

SEQ ID NO: 51641 - RNA, 45 nt, Mus musculus
auguggcuauagacaagccuguauggauuuagacaagccuguaga

SEQ ID NO: 51642 - RNA, 46 nt, Mus musculus
uuagcuugcuuucuucaccuaaugggaugacucugaaccgcuuccg

SEQ ID NO: 51643 - RNA, 61 nt, Mus musculus
cagcuggccccauugucuucccagauucaaggaaagaucccccaacagcacccagauuucc

SEQ ID NO: 51644 - RNA, 46 nt, Mus musculus
gugucaagcgaaagcacagaaaugaguccguacaaauuaguuaggu

SEQ ID NO: 51645 - RNA, 45 nt, Mus musculus
ugaugucuggaggugacuuuuaacuguggaccugagacacccguu

SEQ ID NO: 51646 - RNA, 46 nt, Mus musculus
agucguuugagugggugcagaucauuuaaagauuuuaagagaggag

SEQ ID NO: 51647 - RNA, 46 nt, Mus musculus
ccuuccucaaauaugagagaugcuaggggaagcgaaggugcugcgg

SEQ ID NO: 51648 - RNA, 42 nt, Mus musculus
uaggaaggacagggugaguuacagagcacauuaggcagaauc

SEQ ID NO: 51649 - RNA, 46 nt, Mus musculus
guugcuuuuauuuuaguucguucuuucccagccuggacccccaaga

SEQ ID NO: 51650 - RNA, 42 nt, Mus musculus
ugagauuacgugugugugugugugugugugugugugugugug

SEQ ID NO: 51651 - RNA, 46 nt, Mus musculus
gaucacccuguuguauuuggcaugcuguagaacaguaaguagagaa

SEQ ID NO: 51652 - RNA, 45 nt, Mus musculus
agcguccccuuuauagccuuaccuuccacugguaagcacccaauu

SEQ ID NO: 51653 - RNA, 46 nt, Mus musculus
uuauaaagacugagauacuuucugugcaauagauagauggucagua

SEQ ID NO: 51654 - RNA, 46 nt, Mus musculus
gauaauuagguaacaguguaaauauauaauuaaacagggugguugu

SEQ ID NO: 51655 - RNA, 46 nt, Mus musculus
cagacauguguggaaguccuguuuguuuguuuuggaaaggccaagu

SEQ ID NO: 51656 - RNA, 46 nt, Mus musculus
aacuuagcaaggcugcugucaugaauauuuaauggccaggacaguu

SEQ ID NO: 51657 - RNA, 67 nt, Mus musculus
caggaugguuucaagacuuaaaccaaguacagcaagauucaaaacggcaaccuccgccacacagacc

SEQ ID NO: 51658 - RNA, 42 nt, Mus musculus
uuagguaaggagggagaugcacuugaaccaaagcagccagug

SEQ ID NO: 51659 - RNA, 45 nt, Mus musculus
ggucuggcacaccagugagggcuccuugcuuuugcugugaaguuu

SEQ ID NO: 51660 - RNA, 44 nt, Mus musculus
gaaaccaagucagaugccucuuuguuguuuaacauaggaccagu

SEQ ID NO: 51661 - RNA, 46 nt, Mus musculus
augugggcuaagccuucuagaauguugagaaaguaauuagugggug

SEQ ID NO: 51662 - RNA, 42 nt, Mus musculus
ucuggggucauaagaacacaccgugcucucccaguggcagag

SEQ ID NO: 51663 - RNA, 46 nt, Mus musculus
auuauuauuauuauuaccuuauuauuaaucugaauuucuggcuaau

SEQ ID NO: 51664 - RNA, 96 nt, Mus musculus
gcaucuucugugcccuaagugcuaaggauuccaaucugugagugacuuuguaggagccaauuaaucaaacuucagaggaggacccagacuucauga

SEQ ID NO: 51665 - RNA, 53 nt, Mus musculus
cuuuuauguuaaugggauuauucagcuaagccuuaggcaugagagaagacugg

SEQ ID NO: 51666 - RNA, 48 nt, Mus musculus
aagcagcuuauagggaucuugacuuuuucucuauuccguguguuugaa

SEQ ID NO: 51667 - RNA, 46 nt, Mus musculus
gucacuuugcugagcccuguuuuuuuguuuguuuguuuuaaaguuu

SEQ ID NO: 51668 - RNA, 46 nt, Mus musculus
guaagcaaggugagaaguagacuugucccauucuuccccagagaca

SEQ ID NO: 51669 - RNA, 45 nt, Mus musculus
guuccuuuaaaauagauuaucagagagaauaaacaggggcguaga

SEQ ID NO: 51670 - RNA, 46 nt, Mus musculus
acauaguucugccuacuacagauguaauuguguauaggaaggagaa

SEQ ID NO: 51671 - RNA, 46 nt, Mus musculus
uuuaucuuuagcaaaugaguaucaguugaaagaaauucauccaggu

SEQ ID NO: 51672 - RNA, 46 nt, Mus musculus
aaauaggcaucugguauuuguuuuguauaacacaauccccauaaaa

SEQ ID NO: 51673 - RNA, 45 nt, Mus musculus
ugugacuggaucaaaagcaaacaacaacaacagcaacagcaaaag

SEQ ID NO: 51674 - RNA, 46 nt, Mus musculus
cagcgcccuuaaagugagcuuaguuucugucuugucacuagcaacu

SEQ ID NO: 51675 - RNA, 46 nt, Mus musculus
acuguuagucuccuggagaaaaauaaagacaagcuuuccuugaggc

SEQ ID NO: 51676 - RNA, 42 nt, Mus musculus
gcaauagaaaccuaacuaagacaaugguaaauccaugggggu

SEQ ID NO: 51677 - RNA, 45 nt, Mus musculus
guaagcaguuuuccucuguggccucugcuucaguuccugccucaa

SEQ ID NO: 51678 - RNA, 45 nt, Mus musculus
uagaugugugugugugugugugugugugugugugugaaagagugu

SEQ ID NO: 51679 - RNA, 42 nt, Mus musculus
agcgccugcauggagggucuucuuacagccucacccccaaug

SEQ ID NO: 51680 - RNA, 46 nt, Mus musculus
gcuccggccaaaaaccucucuggucucuuuaacugugcuggcagcc

SEQ ID NO: 51681 - RNA, 41 nt, Mus musculus
auaaaaaaaagaaaaaaaaaaagaaaaaaaagaaaguuaaa

SEQ ID NO: 51682 - RNA, 46 nt, Mus musculus
cauuaggagagcugagccaugcucaaguuugauuuagcugccuaac

SEQ ID NO: 51683 - RNA, 45 nt, Mus musculus
uccugggaugaugccccagguggcugugugauccaacagcauaga

SEQ ID NO: 51684 - RNA, 48 nt, Mus musculus
uucgggugcuacuuggagggauauuugcgagucgaaugaguccagagu

SEQ ID NO: 51685 - RNA, 49 nt, Mus musculus
ccccguaauugugugauggcccaaaaguguugcuaaaguagcccacaga

SEQ ID NO: 51686 - RNA, 46 nt, Mus musculus
caaaacauuucuuuagugcgugugugcgcaugcgugaaggucagag

SEQ ID NO: 51687 - RNA, 41 nt, Mus musculus
ucugggggugcuugugccuucuaggaauuucuuuggcuggc

SEQ ID NO: 51688 - RNA, 87 nt, Mus musculus
ggagaaaccucucagcugaguacaagaggaacuggcagagguuggcagauugugcaauugauucaugaaaugcagaauaggggaaaa

SEQ ID NO: 51689 - RNA, 52 nt, Mus musculus
ccugcaagcauggcaaagacuggcaaaagcacaaggauucucgcugugacag

SEQ ID NO: 51690 - RNA, 44 nt, Mus musculus
ggagaaaaucgccgaaaguuaccaaaacauucuagcggccaucg

SEQ ID NO: 51691 - RNA, 46 nt, Mus musculus
ggaauggcuugcaccagcccaguccggaucauuucuggccccgcuu

SEQ ID NO: 51692 - RNA, 76 nt, Mus musculus
cucuugucucgcccuuuuguuuuauuuuggaggcgugcaguuuagggcaucgaggagccacagccggagagaagag

SEQ ID NO: 51693 - RNA, 41 nt, Mus musculus
ggagaguuugaagucuuuacaggcgggaagauggcggacug

SEQ ID NO: 51694 - RNA, 45 nt, Mus musculus
gaucuucugcccggcucucucccgugcauugugcagcccaaagau

SEQ ID NO: 51695 - RNA, 37 nt, Mus musculus
ggcuuaggaagccucuguguaugggaagccacuugua

SEQ ID NO: 51696 - RNA, 45 nt, Mus musculus
aaggagagaagggagagaggccacaaauauccaaugagcccagag

SEQ ID NO: 51697 - RNA, 44 nt, Mus musculus
ccaguauagcggaaugccagggcaggaagacaggaguagguggc

SEQ ID NO: 51698 - RNA, 46 nt, Mus musculus
ucagaauacccaagauacaauucacagaccauaugaagcccaagaa

SEQ ID NO: 51699 - RNA, 45 nt, Mus musculus
agccugaggaagaacuggccuuggaauucucuucgugugugugug

SEQ ID NO: 51700 - RNA, 46 nt, Mus musculus
acauguuggguucuuuucuuuuggauuucuuccaucuguccugugu

SEQ ID NO: 51701 - RNA, 42 nt, Mus musculus
uuugcuguuugcgagcuuggauauagauaauuuggcccacac

SEQ ID NO: 51702 - RNA, 48 nt, Mus musculus
cauaauaagccaggcaugguugugcaugccuguaauuccagcaguugg

SEQ ID NO: 51703 - RNA, 46 nt, Mus musculus
ucgcgacacagcgagcaccaucaccaccaucaccaugagcacaaga

SEQ ID NO: 51704 - RNA, 45 nt, Mus musculus
aaauggucccuucacccacucccuuucccugccccugucccgaag

SEQ ID NO: 51705 - RNA, 52 nt, Mus musculus
aaucaccuuuugggaucaaguaaguuagagguggccaugugugggagugaga

SEQ ID NO: 51706 - RNA, 46 nt, Mus musculus
gacagcugaguuugauccucagaucccacaugauggaaggagagag

SEQ ID NO: 51707 - RNA, 46 nt, Mus musculus; identical to SEQ ID NO: 51706

SEQ ID NO: 51708 - RNA, 42 nt, Mus musculus
aaggcacagagcacacauaaagcugcugauaacuggugagcu

SEQ ID NO: 51709 - RNA, 29 nt, Mus musculus
uuaccaacucucuugucugggcugcugag

SEQ ID NO: 51710 - RNA, 46 nt, Mus musculus
uccaaagauuuauuuuuauuauuguuauuagugugugugugugugu

SEQ ID NO: 51711 - RNA, 46 nt, Mus musculus
uuaccuagugggucaguauuguagcucccaccaugcugcagcugug

SEQ ID NO: 51712 - RNA, 25 nt, Mus musculus
ccagucuaaccccaacucacguaaa

SEQ ID NO: 51713 - RNA, 24 nt, Mus musculus
auguuuuuaauuccugggagaagc

SEQ ID NO: 51714 - RNA, 42 nt, Mus musculus
ggagggagggagggagggagggagggaggggggccuuguuuu

SEQ ID NO: 51715 - RNA, 48 nt, Mus musculus
uguuaggcaaagcuagauuaacuagaucaaccaguaaugaguguggca

SEQ ID NO: 51716 - RNA, 51 nt, Mus musculus
guuacacuugcaggaggcuuucuguuaaaugguaaguuagagggagagcgg

SEQ ID NO: 51717 - RNA, 46 nt, Mus musculus
agucucucuuuacuagaauguucugcuguaaaaccugccccaacau

SEQ ID NO: 51718 - RNA, 45 nt, Mus musculus
gcuuaauguggauggggcccuguguuuaaucccugauauaaagau

SEQ ID NO: 51719 - RNA, 46 nt, Mus musculus
agggcagaaagcucauuugcuaucaaaggaugagaggcagccagug

SEQ ID NO: 51720 - RNA, 46 nt, Mus musculus
agauuuacugagaaaauuaugagcaaaaaaccuuguuugcccagaa

SEQ ID NO: 51721 - RNA, 44 nt, Mus musculus
aaguuuaugauaugacugagaacucuacuuggaauugggcgaga

SEQ ID NO: 51722 - RNA, 71 nt, Mus musculus
cugucucuaaucguaaccaugucucuuaagccuuuggaacugaauuuugaaaggaauuuggaacaguuugg

SEQ ID NO: 51723 - RNA, 83 nt, Mus musculus
auacaggaccauguguguucuugaggcccgcuaaggccagaaacguaaugauaguguggcgccgcagccugcacuugucagau

SEQ ID NO: 51724 - RNA, 45 nt, Mus musculus
aaaauacugagaaggaauaaaucaauuuauagaacaaaucagaga

SEQ ID NO: 51725 - RNA, 44 nt, Mus musculus
uaaaagcaguauuuuguuuaucuauuucucaccaugcacauaga

SEQ ID NO: 51726 - RNA, 46 nt, Mus musculus
ucaacuagaguaggugagcacuguaagugccugugcgguggcaagu

SEQ ID NO: 51727 - RNA, 49 nt, Mus musculus
gguuuuauauacagaccuagaauauaauugaagaacauaauagacggug

SEQ ID NO: 51728 - RNA, 46 nt, Mus musculus
aagucaaagaagagagaaagcuguuuucaguguguuugggagcaga

SEQ ID NO: 51729 - RNA, 45 nt, Mus musculus
cuuguuuugccuuuuuaaugaaagguacuuuucaggugacuagau

SEQ ID NO: 51730 - RNA, 45 nt, Mus musculus
gucacugguacaguuaacguuuagaauuaagauucucggggaaca

SEQ ID NO: 51731 - RNA, 42 nt, Mus musculus
cacuugcugcucuguucccucauuuaacuccugugagaagau

SEQ ID NO: 51732 - RNA, 42 nt, Mus musculus
caauggacggauggcacagcccucagguaacaugggagagug

SEQ ID NO: 51733 - RNA, 46 nt, Mus musculus
uucuaagugaugaauccgggauucagguauuuacaaggguccuuuu

SEQ ID NO: 51734 - RNA, 97 nt, Mus musculus
ugugagacaagagaguuugguggcuguuaagagagugaguuagggucagguuuugggaugagcagagaagagagucccagaaauugcaggagcaaag

SEQ ID NO: 51735 - RNA, 46 nt, Mus musculus
agcucugcccugcagaggauccucugaaggaucauuuauaggaggg

SEQ ID NO: 51736 - RNA, 41 nt, Mus musculus
aucaggucgucuguaucaacaacauaaacuuccagcgaaaa

SEQ ID NO: 51737 - RNA, 44 nt, Mus musculus
agagagggacagggaggggaggggagaagaagggauaagggagg

SEQ ID NO: 51738 - RNA, 45 nt, Mus musculus
ccaaaauaaaccgaacccuuccuuaaguugcuuuuguucaaguag

SEQ ID NO: 51739 - RNA, 45 nt, Mus musculus
ugccucccaagugcugggauuaaaggccuguggccaccaccuccu

SEQ ID NO: 51740 - RNA, 46 nt, Mus musculus
uaauuauuuucgcuuaugacucaccguuguguuguuauugcccuug

SEQ ID NO: 51741 - RNA, 42 nt, Mus musculus
cccaccaaccacaugauggcucacaaccaccuguaaugaaaa

SEQ ID NO: 51742 - RNA, 45 nt, Mus musculus
guauuuauuaauuauuuuaugaggcuguguguguuugcaugugga

SEQ ID NO: 51743 - RNA, 46 nt, Mus musculus
cucccugucaagguccaugauaauuagaaacagcaggaguccaaga

SEQ ID NO: 51744 - RNA, 29 nt, Mus musculus
ugggauggaacguucaggguuggggggua

SEQ ID NO: 51745 - RNA, 48 nt, Mus musculus
caggcagguuuauugaaaagcugcucuaggguccaaagccaucauggg

SEQ ID NO: 51746 - RNA, 41 nt, Mus musculus
uuuuuauaggccauguuucuguauugcauaauagcagcagg

SEQ ID NO: 51747 - RNA, 42 nt, Mus musculus
cuggcugggaacacaugcauagagaggaggggagggagagag

SEQ ID NO: 51748 - RNA, 42 nt, Mus musculus
caguacaaagauauucuuuuuuuuuuuuccaagacaggagga

SEQ ID NO: 51749 - RNA, 42 nt, Mus musculus
acacucaagaaggccaagccucagcaggaaagugcaguagaa

SEQ ID NO: 51750 - RNA, 42 nt, Mus musculus
cugaauguuuccugaaguauuaccaugacccaaggcagagag

SEQ ID NO: 51751 - RNA, 46 nt, Mus musculus
ucacuuuaacuucuuuaguuuugaguuuugcauaguuuugccggag

SEQ ID NO: 51752 - RNA, 46 nt, Mus musculus
auacuuagacuaccuccuuacuuaugagaagaaauugaaaggaaga

SEQ ID NO: 51753 - RNA, 75 nt, Mus musculus
gaggaagaacuuaccugaaauagcuauuauuccaccaaaaauagaugauucaagaauaaagucucccuuugggau

SEQ ID NO: 51754 - RNA, 46 nt, Mus musculus
uuauauucaugaccagcaaaaucgugauagcauuuuuuaaccagau

SEQ ID NO: 51755 - RNA, 46 nt, Mus musculus
ucagcgagccuguuuguacaucguguuuacauaaaguaucuaagua

SEQ ID NO: 51756 - RNA, 45 nt, Mus musculus
aguuaguauugguuaaucccauuuucuuauaaguuggaaaguauc

SEQ ID NO: 51757 - RNA, 45 nt, Mus musculus
ggucgagccuugucuccagaaaauaaggagcaguaaacagaaagg

SEQ ID NO: 51758 - RNA, 45 nt, Mus musculus
uguguguguguguguguguguguguguguggugcccaugcauaua

SEQ ID NO: 51759 - RNA, 45 nt, Mus musculus
aacuuuauuuuuuaaagccauaauguguccguuugcccccugaaa

SEQ ID NO: 51760 - RNA, 46 nt, Mus musculus
uugagaucuauggagcuauagcaagaaaaaacguguuucggaugau

SEQ ID NO: 51761 - RNA, 44 nt, Mus musculus
acucaagccgccagguggaagauaaacuguucacagaugggaga

SEQ ID NO: 51762 - RNA, 41 nt, Mus musculus
ccgacguaggacauuauuuugcagccaaccugagcggcagg

SEQ ID NO: 51763 - RNA, 27 nt, Mus musculus
aauccauccagaugacaguacauuccc

SEQ ID NO: 51764 - RNA, 45 nt, Mus musculus
ucuucucuuuuacuucuccaucugauaauauccuuuaaggcccag

SEQ ID NO: 51765 - RNA, 114 nt, Mus musculus
cagacagcaagcauguaggcaguggcuaucugagggcaguuagagggagaaagccugacuuaaugcugagguggcuuagguuaggagaaaggaggcauaacugacauuagaagu

SEQ ID NO: 51766 - RNA, 80 nt, Mus musculus
cuggcuggugccauuuacuaagaaggaagcauugcuaagaagguggcauuaugaagaaggaacuaagauguccuguguag

SEQ ID NO: 51767 - RNA, 48 nt, Mus musculus
ucuggguauagguggaaaccgugcgauagaggagauuguuuacagaug

SEQ ID NO: 51768 - RNA, 46 nt, Mus musculus
uucaaggaacaucauuuuuaagagaugccagaauuagugccacaga

SEQ ID NO: 51769 - RNA, 45 nt, Mus musculus
uuuaugcugagagauuaaauauuaacaaagcuaaaaauuaauaag

SEQ ID NO: 51770 - RNA, 44 nt, Mus musculus
gagaagagcaguguccuuuauuauuaaaaccugcugcuggcuug

SEQ ID NO: 51771 - RNA, 42 nt, Mus musculus
augccaggguccgucagggaagaugugcucgacuggcaccag

SEQ ID NO: 51772 - RNA, 41 nt, Mus musculus
ugauuaacugauugauugauugauuaaucagcauugagcca

SEQ ID NO: 51773 - RNA, 48 nt, Mus musculus
cucugggaaggcauuuguaugacuuaucuuuucaugguacgacagggg

SEQ ID NO: 51774 - RNA, 32 nt, Mus musculus
gcuuugcuuguuucucuuuucuuugguuuuug

SEQ ID NO: 51775 - RNA, 42 nt, Mus musculus
uuagcaauguacucaucccaccucccagccaacuggccucaa

SEQ ID NO: 51776 - RNA, 46 nt, Mus musculus
gauggauaguggaagcuucugaauaauaauaugacacaggucacau

SEQ ID NO: 51777 - RNA, 46 nt, Mus musculus
uggcuaucuauguuuggaagauguuuuaggaaugugaaguuaguag

SEQ ID NO: 51778 - RNA, 46 nt, Mus musculus
cuccacaggcaccuggcccccauggagugcacagacaagcaugcgg

SEQ ID NO: 51779 - RNA, 42 nt, Mus musculus
cauuucugguucuuagcuagaucuuuguuuuccaguucccga

SEQ ID NO: 51780 - RNA, 72 nt, Mus musculus
acauacauaugcuaugucacuaggcuuauuacagacagggaacagagggacagaaacaacccaggauccauc

SEQ ID NO: 51781 - RNA, 45 nt, Mus musculus
accagcccagggauggccccacccacaaggggccuuucccccuug

SEQ ID NO: 51782 - RNA, 45 nt, Mus musculus
augcauaauuucuaggaaaguccauaaauuggagauaguagccua

SEQ ID NO: 51783 - RNA, 91 nt, Mus musculus
uaguuguaucaagguaguuguacaucaauuuguaauguucgaucaaggaaaguacuguuaaaaagaaacaucaguuucaguaaacgguggg

SEQ ID NO: 51784 - RNA, 46 nt, Mus musculus
ggcacacucgugcacacauacacacaugcacgcucacauacaggua

SEQ ID NO: 51785 - RNA, 46 nt, Mus musculus
gguaagccgacauauauacauacagccaaaccacccgagcacauaa

SEQ ID NO: 51786 - RNA, 45 nt, Mus musculus
uagcucgaagcccagggauguugacauauggaaggagaggagaag

SEQ ID NO: 51787 - RNA, 45 nt, Mus musculus
cacuacagcucaguguugauuccuucuuuaaacaugaagggccau

SEQ ID NO: 51788 - RNA, 86 nt, Mus musculus
uguaucucccugagugcugaauuuaucucuguccacccucacuugcuuggcucugcuggaguccgaccugugcaguaaacugugag

SEQ ID NO: 51789 - RNA, 117 nt, Mus musculus
augcaccuuagagugcaccaagggaauaagaaacacuagcaaacacuauuuguuacauuucuuuuagaaggacugagacaaaaacugaggaauuaaauaaaaauaaugcagugggga

SEQ ID NO: 51790 - RNA, 45 nt, Mus musculus
ugcccuuuugugggaagccggguccuacacccuuugacagcacag

SEQ ID NO: 51791 - RNA, 46 nt, Mus musculus
cucaucgggcuaucggguguccgagaauugacauguuccuugggag

SEQ ID NO: 51792 - RNA, 46 nt, Mus musculus
uuuuuuguuuuacuuguauuugcuuuuagguacuuauuuugcacag

SEQ ID NO: 51793 - RNA, 46 nt, Mus musculus
uugccuucccaagcgaguugcaauaguaaucaucaccaucacacag

SEQ ID NO: 51794 - RNA, 85 nt, Mus musculus
ccaaagauaccucaaagaccaguucaggacaaaaacgagcacacgaaucaaaaucaucaaagcaaaugaaggaaucacgguccca

SEQ ID NO: 51795 - RNA, 45 nt, Mus musculus
uuagacaguguggcuagaaaagaaacuccaugaggagaaccuggg

SEQ ID NO: 51796 - RNA, 41 nt, Mus musculus
auuacaaaaaguacuaaagagguagcuguuacuuugggcca

SEQ ID NO: 51797 - RNA, 32 nt, Mus musculus
acgggcagcaucacuacaaaaaccaaguggag

SEQ ID NO: 51798 - RNA, 46 nt, Mus musculus
aaaguuauaaacacuagaauucucccagaaauaaaacugugcccau

SEQ ID NO: 51799 - RNA, 56 nt, Mus musculus
cacacacacauacacaauaauuuaagaaaaagaaagccauagauuuagaagacagc

SEQ ID NO: 51800 - RNA, 44 nt, Mus musculus
gcuaauuauggggcccaagcugugggguaaccguacggcagagg

SEQ ID NO: 51801 - RNA, 45 nt, Mus musculus
uguguguaucugucugucugucugucugucugucuguguuuggug

SEQ ID NO: 51802 - RNA, 46 nt, Mus musculus
ugaaaacaucaaggggucucuuugaagaaaugaagaaaacagccaa

SEQ ID NO: 51803 - RNA, 47 nt, Mus musculus
agagggagaagaagauaaucaaaaaagauacuaucuuaggcagagaa

SEQ ID NO: 51804 - RNA, 41 nt, Mus musculus
uaaaugguugggagccaccaugggggugcugggaauugaaa

SEQ ID NO: 51805 - RNA, 42 nt, Mus musculus
uauccagcgagcugaugaagaaacaacugauaaccaggacgg

SEQ ID NO: 51806 - RNA, 46 nt, Mus musculus
aguguacuuacauauaacaauaaauaaaucuuuaaaaaaaagaaag

SEQ ID NO: 51807 - RNA, 46 nt, Mus musculus
augugccaccacugcucggccuguuuuuaucuuauuugugucugaa

SEQ ID NO: 51808 - RNA, 42 nt, Mus musculus
acaagaacguggacagaacagagaaauacuccaauggcagac

SEQ ID NO: 51809 - RNA, 42 nt, Mus musculus
cuacgcgggacgcaugugucuacaacagcugcuauuggugag

SEQ ID NO: 51810 - RNA, 41 nt, Mus musculus
ccucacaguaaucccaagagguagguacuggugugauugca

SEQ ID NO: 51811 - RNA, 46 nt, Mus musculus
gggaaagcagacagccauacauaagcuaagucuggcuggugguaaa

SEQ ID NO: 51812 - RNA, 46 nt, Mus musculus
ucaggaaccaccacuauggaagugagggugauuauaggaaaggcag

SEQ ID NO: 51813 - RNA, 45 nt, Mus musculus
ccaggaggcuagaagaagauucccccagacuggauuuagugcuag

SEQ ID NO: 51814 - RNA, 42 nt, Mus musculus
cuaaagccaccuguuagcccucugucagaggaggugguuaag

SEQ ID NO: 51815 - RNA, 46 nt, Mus musculus
ucuguuggaggagugcuaugcagucuucauaucaaaugagaagaag

SEQ ID NO: 51816 - RNA, 45 nt, Mus musculus
cagugcucuuaacugcucagccaucucuccagccuccagcccccg

SEQ ID NO: 51817 - RNA, 42 nt, Mus musculus
ugucuguguaccuugugugcacuguaccuaccgaagccagga

SEQ ID NO: 51818 - RNA, 42 nt, Mus musculus
guuaguaaaaggaucuucugagaaaggaugccugggguagaa

SEQ ID NO: 51819 - RNA, 42 nt, Mus musculus
uuucccauaggguugguuugcuguagucucugaaaccaugag

SEQ ID NO: 51820 - RNA, 42 nt, Mus musculus
cccugcaauagaccugcauucacagaguuuuaccgcgccuca

SEQ ID NO: 51821 - RNA, 45 nt, Mus musculus
gcaguccaguugagggugccuugacaguuaggaacagagcaggcu

SEQ ID NO: 51822 - RNA, 46 nt, Mus musculus
aggcuuuaguuauuucugcacauauaaaugucaucuguaauacgag

SEQ ID NO: 51823 - RNA, 46 nt, Mus musculus
gacagccagggcuacacagagaaaccuuaucuugaaaaaccaaaaa

SEQ ID NO: 51824 - RNA, 46 nt, Mus musculus
ugagccaccauguguguggcuguuaggcaucaaaccuauacccccu

SEQ ID NO: 51825 - RNA, 42 nt, Mus musculus
aguuuuucagggcuucucacucacucccuauuucuggugcag

SEQ ID NO: 51826 - RNA, 46 nt, Mus musculus
aaccuaccaagccugacauccgggcugcagcuagagaagcucuagg

SEQ ID NO: 51827 - RNA, 46 nt, Mus musculus
aaaggcagggagaagguaaaagagagagagagaagaaaggcuagag

SEQ ID NO: 51828 - RNA, 45 nt, Mus musculus
gccuguaccaccagacuuagugucucugucuucaugaagcuuauu

SEQ ID NO: 51829 - RNA, 46 nt, Mus musculus
agagaaaggcagugcuuggauauguccggucucuuaaaauagggau

SEQ ID NO: 51830 - RNA, 26 nt, Mus musculus
caauguauauacaaaugucagacgag

SEQ ID NO: 51831 - RNA, 42 nt, Mus musculus
auuaaugagggcccgguuuccagugguccgcuguccaguugg

SEQ ID NO: 51832 - RNA, 46 nt, Mus musculus
gugagccaccaugugguugcugggauuugaacuccugacccccaga

SEQ ID NO: 51833 - RNA, 45 nt, Mus musculus
ggauugaaccaacaacgcuguaccugauacacaagcaccccaguu

SEQ ID NO: 51834 - RNA, 44 nt, Mus musculus
ggcguaaacuuuuuagaauauaaccaagggguccuggaaccuua

SEQ ID NO: 51835 - RNA, 46 nt, Mus musculus
uacauauuuuaauucuguaaaacagcuaaguuauuauaucaaagug

SEQ ID NO: 51836 - RNA, 46 nt, Mus musculus
acaccauuacagugaugaacugcauauaccguggugguucugagau

SEQ ID NO: 51837 - RNA, 34 nt, Mus musculus
uaaggguugugugaaagucagugguagaccagaa

SEQ ID NO: 51838 - RNA, 46 nt, Mus musculus
ugggaacguacgugcugaacugggacaugcacuuguggcuguggaa

SEQ ID NO: 51839 - RNA, 45 nt, Mus musculus
cauguggggaguagccugguuuaguuggcugaaaaggaaauaugg

SEQ ID NO: 51840 - RNA, 45 nt, Mus musculus
gggugaagaagaaaaaccagaauuagauggugaugaauaucuaga

SEQ ID NO: 51841 - RNA, 46 nt, Mus musculus
uuaguacgcagcuuuauaggacuccagucuugucucugucuuauug

SEQ ID NO: 51842 - RNA, 41 nt, Mus musculus
aaaucacuggaacaaauagagaccaaaucccugcgcgcaga

SEQ ID NO: 51843 - RNA, 48 nt, Mus musculus
uaauauuuagguaauaggucagaguuccuagaaaaaauguuccaagag

SEQ ID NO: 51844 - RNA, 46 nt, Mus musculus
cuaugccaauuaacaugaauaaaaacauuucagugccuuagcugag

SEQ ID NO: 51845 - RNA, 45 nt, Mus musculus
guuauguacuuuuaaaauguguuuuugcuacugaugaacuccaua

SEQ ID NO: 51846 - RNA, 44 nt, Mus musculus
cguuaagauaggauauuuuuaaaacaagugcggaaugugguagg

SEQ ID NO: 51847 - RNA, 46 nt, Mus musculus
agagagagagagagagaaagacagaaagaaagaaagaaaucucaag

SEQ ID NO: 51848 - RNA, 46 nt, Mus musculus
aaaauucaauauauacucuuucuauaaauugauuauucauacagau

SEQ ID NO: 51849 - RNA, 44 nt, Mus musculus
acauuacuacuccaaauauaaauucgauaauauugcccguggag

SEQ ID NO: 51850 - RNA, 45 nt, Mus musculus
ugcauguaggcacaucauacaagcccgaauuuuacuuccugacuc

SEQ ID NO: 51851 - RNA, 46 nt, Mus musculus
uggguuuggauuuucauugggugcaauaaauccguuguuguuagau

SEQ ID NO: 51852 - RNA, 46 nt, Mus musculus
gcacuggagagaaccaaagauauguucccagcaccagguaucaggc

SEQ ID NO: 51853 - RNA, 45 nt, Mus musculus
gggagucaggucagauacagacaaacaccuugagcaaaggcagcc

SEQ ID NO: 51854 - RNA, 45 nt, Mus musculus
ccacucugggcuugccucuaauaguuauaguuuaauagcgcagau

SEQ ID NO: 51855 - RNA, 42 nt, Mus musculus
auuuagugugugggaggcugugcuuuacuggggggugcggua

SEQ ID NO: 51856 - RNA, 45 nt, Mus musculus
ggaggcagugaaguuacugucuaagagaugcgccgucgcggugac

SEQ ID NO: 51857 - RNA, 46 nt, Mus musculus
gggcagugauuaucaaggagcagugaaaagaccagggcugcaggau

SEQ ID NO: 51858 - RNA, 46 nt, Mus musculus
uggggguggaucuuuuucuagaaggguacccugugaucuuugcuag

SEQ ID NO: 51859 - RNA, 41 nt, Mus musculus
ucuccaaagcacugcaugaccccuucaguccugggccauca

SEQ ID NO: 51860 - RNA, 69 nt, Mus musculus
ucagugaccauccuuugggaguaaagauuguuauuuaggucacaguuccauguaucaguggaagaacgu

SEQ ID NO: 51861 - RNA, 69 nt, Mus musculus
uugaguagauaaucuguguuuuaaaaaugcucacguacacaaaauuucauauacaauuucaggagaggu

SEQ ID NO: 51862 - RNA, 41 nt, Mus musculus
aauauauauucucuacucucacugcacugugacagccaugg

SEQ ID NO: 51863 - RNA, 42 nt, Mus musculus
gauauuaugagaagaaauagagaccgguauguggguggagug

SEQ ID NO: 51864 - RNA, 46 nt, Mus musculus
cccaaacauuaguuaauaaagucauagaacaacaaagggcauugug

SEQ ID NO: 51865 - RNA, 44 nt, Mus musculus
ugcuuguuaaagaccaagaauggaaacaaggagagggccugagu

SEQ ID NO: 51866 - RNA, 73 nt, Mus musculus
cuuuaaaaauucuaucacugugucugugcaucuguauaagggaguuagaagaggguaucagauccacuguagc

SEQ ID NO: 51867 - RNA, 47 nt, Mus musculus
ugguuuuauaaaacacauuuuuucccuuuucaaguguccaguaggua

SEQ ID NO: 51868 - RNA, 46 nt, Mus musculus
acucaggaacuccugagugcacagcaagcacacugccgaccaagcc

SEQ ID NO: 51869 - RNA, 46 nt, Mus musculus
auuuugaccgacuucaguuuugucccaaagauacucaacucaagua

SEQ ID NO: 51870 - RNA, 42 nt, Mus musculus
agggccaggaagcaggaguaaguggguuggggaguaggguug

SEQ ID NO: 51871 - RNA, 46 nt, Mus musculus
cguaauuaugaagaagucuuucucagaacugcuuaagguacaaaua

SEQ ID NO: 51872 - RNA, 72 nt, Mus musculus
cagcugagggugaaucuaaaacccagcauucagaagguagaggaaggagaauagcaaguuagaggccagccu

SEQ ID NO: 51873 - RNA, 45 nt, Mus musculus
cuuuuacuaaggcgacgucugugaagacaaccucugcuacaagau

SEQ ID NO: 51874 - RNA, 46 nt, Mus musculus
ucccucaggucauggugacugccugccaggguuacuguugccagag

SEQ ID NO: 51875 - RNA, 45 nt, Mus musculus
cugcugauuuaaaagaaaacaauuuaaaauguucaaccauuacua

SEQ ID NO: 51876 - RNA, 46 nt, Mus musculus
ugaauauuaaacuuaaaaguugauuuauuuuagccauaugggagug

SEQ ID NO: 51877 - RNA, 44 nt, Mus musculus
cuugcaauguuauaauacaauuuaaaauauauuuaauguugugg

SEQ ID NO: 51878 - RNA, 46 nt, Mus musculus
aggacauccaaauagagacauccuccgagcacucaaaaguggaauc

SEQ ID NO: 51879 - RNA, 62 nt, Mus musculus
uuguggcagauaaggggacgaauguaaguauuucagguuuugcaaacagggaaaagaauaga

SEQ ID NO: 51880 - RNA, 57 nt, Mus musculus
uauuuaagggugggaagugacagggaggagguuacccugauagucguuuuguagauu

SEQ ID NO: 51881 - RNA, 41 nt, Mus musculus
uugugcuuuuuuuguguguguuuaauucaacuggaaagaga

SEQ ID NO: 51882 - RNA, 23 nt, Mus musculus
ccaacauaugccaccguaugaga

SEQ ID NO: 51883 - RNA, 45 nt, Mus musculus
caccgacccuguguccagccccacuguuuggccugggcacaccua

SEQ ID NO: 51884 - RNA, 46 nt, Mus musculus
ccuguccgaccgacacuugccuuccucgagagugaauggcugucuc

SEQ ID NO: 51885 - RNA, 46 nt, Mus musculus
aaaagauggccacggcgucccgaagcgcggcggcagccuggcagcu

SEQ ID NO: 51886 - RNA, 46 nt, Mus musculus
ccuggcuguaaacggucuuuugucaccagcagcaggugcucgguag

SEQ ID NO: 51887 - RNA, 45 nt, Mus musculus
aauugaucacaucugacucgugauccugaaacuauuuauuggaag

SEQ ID NO: 51888 - RNA, 46 nt, Mus musculus
gagacccccaaaacacaaaauccucagccuuggcuggugccaccaa

SEQ ID NO: 51889 - RNA, 46 nt, Mus musculus
ccaagaaaaguccacauggcucaaaaggcuucuuugguggcaccag

SEQ ID NO: 51890 - RNA, 23 nt, Mus musculus
cuuggcccagaagaagccaauaa

SEQ ID NO: 51891 - RNA, 46 nt, Mus musculus
uggggccagugguaggugaugagagaggaacagggcggcaagucag

SEQ ID NO: 51892 - RNA, 45 nt, Mus musculus
uggugugcuuggaucugccuuggcagcaguucucuccagagaugg

SEQ ID NO: 51893 - RNA, 47 nt, Mus musculus
auaauaagcuuuacaugaacuaaaaacuuucugugacaaugagagcg

SEQ ID NO: 51894 - RNA, 45 nt, Mus musculus
uuacugcugucuuugagcgagguguucugcugaguaaguaccaag

SEQ ID NO: 51895 - RNA, 46 nt, Mus musculus
uugaacugugguccucugaucagccagcugagaccucugcugagaa

SEQ ID NO: 51896 - RNA, 54 nt, Mus musculus
agcggagauucauuugauacaagaauauuuuuauggccauguaugauaaaguag

SEQ ID NO: 51897 - RNA, 25 nt, Mus musculus
ucaggguuuuguugccuggagaccg

SEQ ID NO: 51898 - RNA, 46 nt, Mus musculus
uggucucccauugccucacugaccucuguacuuucauggcccagag

SEQ ID NO: 51899 - RNA, 47 nt, Mus musculus
augcccaucauauacauggcuacauaguucaugacuaugaaagcaga

SEQ ID NO: 51900 - RNA, 44 nt, Mus musculus
cauuuucuuucuauuugugcgugcuuguguacagaugucugagg

SEQ ID NO: 51901 - RNA, 46 nt, Mus musculus
uguaaucggcgugcaauacaaggacaaggagacuggggacaccaag

SEQ ID NO: 51902 - RNA, 41 nt, Mus musculus
gcauaaaguugaagcagagaguuggcuaccuuggccagaaa

SEQ ID NO: 51903 - RNA, 41 nt, Mus musculus
acauuccugaccuuuaugaugaugcugcuauuuuccaggua

SEQ ID NO: 51904 - RNA, 72 nt, Mus musculus
gucaagaaaaaggacccauuccuuuguugugaauguauuggcucaggccuuguaugaauuauuuucagcuac

SEQ ID NO: 51905 - RNA, 46 nt, Mus musculus
acuacccacugccaugugguaguucuuguggugucucaguguugag

SEQ ID NO: 51906 - RNA, 42 nt, Mus musculus
ucagcucgacuggagaccagccugcaauuccccacaucucag

SEQ ID NO: 51907 - RNA, 45 nt, Mus musculus
uucuuuaaauauuuuuuuuuuacuuugcaaguuuaauacauggau

SEQ ID NO: 51908 - RNA, 46 nt, Mus musculus
uaucguucucugcuauuuugucuacuucgcugucauuaaccccgag

SEQ ID NO: 51909 - RNA, 45 nt, Mus musculus
uauauguauaaaacauacuuugaagaacugaaguuaguggcagac

SEQ ID NO: 51910 - RNA, 46 nt, Mus musculus
auacguaauuuaaaaguaacuuguaaguauuagaaaauagaaacag

SEQ ID NO: 51911 - RNA, 46 nt, Mus musculus
gggaauucuaggacuguuuuuuguuuguuuguuuuuguuuuuugag

SEQ ID NO: 51912 - RNA, 45 nt, Mus musculus
caucagcuccgaaaagcuugcuuucuguauuuuaaacuuggugga

SEQ ID NO: 51913 - RNA, 45 nt, Mus musculus
uugccacaugugugcuauguauguagugugcgcccugcccccagg

SEQ ID NO: 51914 - RNA, 41 nt, Mus musculus
gccgugggcuacaaaaccacgggcccuuuucaguagcggug

SEQ ID NO: 51915 - RNA, 47 nt, Mus musculus
agcauguaaauauaagccuuacuuuacaguugaaaaugaaggucaga

SEQ ID NO: 51916 - RNA, 49 nt, Mus musculus
cucaaguuuuucuuuugauuucaguauuuggggugacucauugggacaa

SEQ ID NO: 51917 - RNA, 46 nt, Mus musculus
ccuucuugggcacgggcauguugguggugacccggaaaugguagua

SEQ ID NO: 51918 - RNA, 39 nt, Mus musculus
aaguuauauaguagagauguguguuaggaacugagaagg

SEQ ID NO: 51919 - RNA, 46 nt, Mus musculus
uauggagagugguguggugugggcgaggagaaagcugcugauugag

SEQ ID NO: 51920 - RNA, 46 nt, Mus musculus
caaucaaggucuuuagcucuggucuuuagugcuaauggaugaggag

SEQ ID NO: 51921 - RNA, 45 nt, Mus musculus
agagaaagaaagaaagacagagacagagagaauauguguguaugu

SEQ ID NO: 51922 - RNA, 46 nt, Mus musculus
cuuggguauuguuugcuucauaguuccucagugucuuaggauucag

SEQ ID NO: 51923 - RNA, 46 nt, Mus musculus
agaugaccaucucaaucccaguuauucauucaugauuaagcagcag

SEQ ID NO: 51924 - RNA, 46 nt, Mus musculus
ggguauuuugcuuuuugcugaaaucauaauagaaccuuaagccaaa

SEQ ID NO: 51925 - RNA, 45 nt, Mus musculus
uacugaaccuugauguuuucuaaguugauauuuaaggaauuguga

SEQ ID NO: 51926 - RNA, 42 nt, Mus musculus
auaugguauguagauucuuuuuugaagaaauuuuaugggcag

SEQ ID NO: 51927 - RNA, 45 nt, Mus musculus
aggacagccugggcuguauagugaugagaggagaggagaccaaca

SEQ ID NO: 51928 - RNA, 46 nt, Mus musculus
aacaaggcccuuuaaaacaacugagcaaggcucauaggaacucuga

SEQ ID NO: 51929 - RNA, 39 nt, Mus musculus
uuuaaagauuauuuauuuuauguauaugaguacacugua

SEQ ID NO: 51930 - RNA, 46 nt, Mus musculus
ugcuuaauauaccuucaaugcucuuucagugcuucaaagcagggaa

SEQ ID NO: 51931 - RNA, 46 nt, Mus musculus
uuuaagggggcuggggauguagcucagugauaaaauucuugccuag

SEQ ID NO: 51932 - RNA, 46 nt, Mus musculus
ucuagcuuuaacuaauaugcaucucuugcaaaauuuuuagaaucag

SEQ ID NO: 51933 - RNA, 46 nt, Mus musculus
cccuuagauuaucagucaucagcgauaaaauauauuacuucauaua

SEQ ID NO: 51934 - RNA, 45 nt, Mus musculus
gucuaggaaacugggaaguaagcagagcacaccagauucagggca

SEQ ID NO: 51935 - RNA, 46 nt, Mus musculus
acauuuaagcauaaguaguuuguuucggucuacuuucuguuaagca

SEQ ID NO: 51936 - RNA, 46 nt, Mus musculus
agcgagacacccuuuugagucuccaaccuucuuagugagccuggga

SEQ ID NO: 51937 - RNA, 46 nt, Mus musculus
ucauggaagacaguggcaauguugucucucugugugugaggcugug

SEQ ID NO: 51938 - RNA, 42 nt, Mus musculus
gagaguuugggauuuagcaagguggucuuauagugcguuagg

SEQ ID NO: 51939 - RNA, 42 nt, Mus musculus
gucaguaugguuguucaaaggucuccuuagucauguaguuag

SEQ ID NO: 51940 - RNA, 42 nt, Mus musculus
cauaggcacaucugcuggaaggaccaugaguuggugagggag

SEQ ID NO: 51941 - RNA, 46 nt, Mus musculus
acaaacaaacaaacaaaaagcuaccaaccccugagcuuacccuaag

SEQ ID NO: 51942 - RNA, 42 nt, Mus musculus
caggguuuaacaaguucauggacuuagugacaggcuguguag

SEQ ID NO: 51943 - RNA, 46 nt, Mus musculus
guuuaaauugugauuauuacuuuuuuaauauggggaaagagaaaga

SEQ ID NO: 51944 - RNA, 41 nt, Mus musculus
aaucuuauuauguuuauuguguauuauguaaugugaggaga

SEQ ID NO: 51945 - RNA, 35 nt, Mus musculus
ggucuaggcuuagcaggaaagaaggucuaauguga

SEQ ID NO: 51946 - RNA, 46 nt, Mus musculus
gagaaaauuauaucuaccccaguuuauuucuuagcauugcacccag

SEQ ID NO: 51947 - RNA, 46 nt, Mus musculus
uuugccuuguuuucuuuguuucuguuugguugauuucugccccgag

SEQ ID NO: 51948 - RNA, 45 nt, Mus musculus
cuggcagauacacucacaaggaggagagaaguuuuagaaggugag

SEQ ID NO: 51949 - RNA, 46 nt, Mus musculus
auguuauacugaagaaaauaauuauauugucaaauuguaauuccag

SEQ ID NO: 51950 - RNA, 47 nt, Mus musculus
agauuguuuuaaguaaguaaaacagucaucuuuucagguucagauaa

SEQ ID NO: 51951 - RNA, 45 nt, Mus musculus
uaagacaaagcguuaugucccuuuuuaucaaggucaccuuggcag

SEQ ID NO: 51952 - RNA, 46 nt, Mus musculus
gcugggcaagaugaaaggggcgggacuuuuagauugcacacauaag

SEQ ID NO: 51953 - RNA, 45 nt, Mus musculus
cuugaaaaaggugacacuguuguggcauauaggauagacuggaau

SEQ ID NO: 51954 - RNA, 45 nt, Mus musculus
agcuuagccauuugggaaaauaucauuacaaauugcaugggagaa

SEQ ID NO: 51955 - RNA, 46 nt, Mus musculus
agaauaacgaagauacuuaaugaacacaaauaauaaagucugggaa

SEQ ID NO: 51956 - RNA, 46 nt, Mus musculus
uuguagaauaaggaaaugucuagaauauuauaauuuugagccagua

SEQ ID NO: 51957 - RNA, 25 nt, Mus musculus
gaagucgagagaaguuacaggucag

SEQ ID NO: 51958 - RNA, 68 nt, Mus musculus
uuaggacaguggggggccugugauuggacaggaaaagggaggcggagcuaggaguuggggagacagag

SEQ ID NO: 51959 - RNA, 46 nt, Mus musculus
acugucacugucugugauccuguguaaagauuccaugucguaccug

SEQ ID NO: 51960 - RNA, 46 nt, Mus musculus
ugagcuaaauuuacucuggguugaauauuaacacagcuccuggcag

SEQ ID NO: 51961 - RNA, 42 nt, Mus musculus
cucacagaguucugccugccucucccucccuggugcugggau

SEQ ID NO: 51962 - RNA, 46 nt, Mus musculus
uuucucucucggggaguguaguagaguuuuugacaguuguagacag

SEQ ID NO: 51963 - RNA, 41 nt, Mus musculus
uuccugcacugugucccccugccuccagauagauagcccag

SEQ ID NO: 51964 - RNA, 46 nt, Mus musculus
ugaucugggccucaaaccuggauaggauugcaugggagaaagcuag

SEQ ID NO: 51965 - RNA, 45 nt, Mus musculus
acuaagucacaagcucaugugaggcaggaccaaaacucaagcuag

SEQ ID NO: 51966 - RNA, 55 nt, Mus musculus
gcagauggaucaaaucuguuaauauacaaaugcuaagacuguuagaggggaaagu

SEQ ID NO: 51967 - RNA, 45 nt, Mus musculus
aaugcaacuauaaugugaauacaaugggaaaguagaaugagagag

SEQ ID NO: 51968 - RNA, 46 nt, Mus musculus
gcagugggggagccaagaaaguguaaagaauguaaaucguguugug

SEQ ID NO: 51969 - RNA, 46 nt, Mus musculus
uucauuaagauaaagagaaaauugcgaguuaagcaaugcgaagcaa

SEQ ID NO: 51970 - RNA, 45 nt, Mus musculus
uccccucccccaugcuacugcucuuuguguguuguuguuguuguu

SEQ ID NO: 51971 - RNA, 42 nt, Mus musculus
aaucuacucaggggauuuuguaaguugcuucaguugggcgau

SEQ ID NO: 51972 - RNA, 42 nt, Mus musculus
cuucugcucuuguuucauggaguccucauuccuagcacccag

SEQ ID NO: 51973 - RNA, 41 nt, Mus musculus
cucuucaagcaacacaacccacuucuucccuugcuggccuc

SEQ ID NO: 51974 - RNA, 44 nt, Mus musculus
uaccucugaaagaaggucaggccagaugaugauagaccauuuau

SEQ ID NO: 51975 - RNA, 78 nt, Mus musculus
uccaagaauucccugcugcccguguauuuccaggcagaaccagacauuagacagagccagauauguugauugaagcau

SEQ ID NO: 51976 - RNA, 46 nt, Mus musculus
ucaaccugaccagcauggugguccauaccuuuaaccccagcaucag

SEQ ID NO: 51977 - RNA, 45 nt, Mus musculus
gcaucgaagauuucaguucugacaagaucugacaguaucuggauu

SEQ ID NO: 51978 - RNA, 42 nt, Mus musculus
agugguguauacagagugaaaguacugcuuagcucauuggag

SEQ ID NO: 51979 - RNA, 98 nt, Mus musculus
aaacaagucauggucggcauugugucaugaucugggaaggaugaagaagagauuuaggggagagcuaaacuagaaucagaaaaagaaggaagcucuaa

SEQ ID NO: 51980 - RNA, 105 nt, Mus musculus
guggaaguguuuauuauccaucuggacauagagaagaagaauggaacuugaaagaaugacuugaacuugaaagcugcuuaggaauuagguaacaagugcaaugga

SEQ ID NO: 51981 - RNA, 46 nt, Mus musculus
gcuggugccagccuugggcucucuaaggugaagaauugcaacagag

SEQ ID NO: 51982 - RNA, 45 nt, Mus musculus
cugccagugacuccagcuccaagggaauccaacauccccggccuc

SEQ ID NO: 51983 - RNA, 43 nt, Mus musculus
cucugaauccuagucauuucuauuguucauuuuacuguccaag

SEQ ID NO: 51984 - RNA, 46 nt, Mus musculus
ucuuccagggagcccuuaccagcggagcaaaacuaaacucguucag

SEQ ID NO: 51985 - RNA, 46 nt, Mus musculus
guuuccuguucccuggcggccuuccaugagucccucugauggcaag

SEQ ID NO: 51986 - RNA, 46 nt, Mus musculus
aagcccacgaacauuugaacagagaagaagccaaaagacaaaggag

SEQ ID NO: 51987 - RNA, 100 nt, Mus musculus
uaugcuuugacaguauggcagagguauuuccucagugcugggccgaggcugggagguggguagauuuugguaugauuuugcuucaauugggaggaccgcu

SEQ ID NO: 51988 - RNA, 100 nt, Mus musculus
uuucucuuucuuuggguauuguuuugcuuuuuccaucuguaauacacaugccagucccagaugcugaaauucaccugaaccuguccaaaaauugccaaga

SEQ ID NO: 51989 - RNA, 45 nt, Mus musculus
aacagacaaauguggaaauguaagccauauaaagcucugugcuug

SEQ ID NO: 51990 - RNA, 45 nt, Mus musculus
ugugguucggugcaccugggagcugagccguagcuugaggcgguu

SEQ ID NO: 51991 - RNA, 46 nt, Mus musculus
gcuucuugcaaguaauuuugccugagucauggauggaaacggcgag

SEQ ID NO: 51992 - RNA, 46 nt, Mus musculus
ugcucuuccagagguccugaguucaauucugagcaaccacgcggag

SEQ ID NO: 51993 - RNA, 41 nt, Mus musculus
cuucguugauugcuuccaauaaguaaagcaauuaugccaug

SEQ ID NO: 51994 - RNA, 28 nt, Mus musculus
cucaaaaguaaaccuuuaaaagacauag

SEQ ID NO: 51995 - RNA, 44 nt, Mus musculus
ugagcuguggugugggaguuaaucugacacauuucauaacugga

SEQ ID NO: 51996 - RNA, 46 nt, Mus musculus
cuugugugcccaaucugagccuucaaugcccuugucacauccccag

SEQ ID NO: 51997 - RNA, 46 nt, Mus musculus
uguccuagaagugugagugaagcagagguguggaagaaacggcagg

SEQ ID NO: 51998 - RNA, 46 nt, Mus musculus
gucuuaccauuuauuaaagaugaaauuaauuugcauacugaccaga

SEQ ID NO: 51999 - RNA, 45 nt, Mus musculus
cuagauuuuuaacaacuaaccaucuugaucuguauuuuccuguua

SEQ ID NO: 52000 - RNA, 46 nt, Mus musculus
accaugcaguguacuuggaaacaguccaguuugguucuaaagagag

SEQ ID NO: 52001 - RNA, 42 nt, Mus musculus
uuggcagugauugaccuggugacaugacccaucgaguuagaa

SEQ ID NO: 52002 - RNA, 23 nt, Mus musculus
gccacaugcccaucauuucagua

SEQ ID NO: 52003 - RNA, 41 nt, Mus musculus
caaacuuuauaugcccugguacaggggaacgccagggccaa

SEQ ID NO: 52004 - RNA, 42 nt, Mus musculus
acagaggaccuggguucaaucccagcacccacauggcagcua

SEQ ID NO: 52005 - RNA, 42 nt, Mus musculus
gauugguguuuugcauguucccuccucaugaugcugcugcug

SEQ ID NO: 52006 - RNA, 41 nt, Mus musculus
acauucuucaucucuaugccugauuuaauucauauaugcag

SEQ ID NO: 52007 - RNA, 46 nt, Mus musculus
cacggcuggcauucacccuucucucucguuaccucccuguucguga

SEQ ID NO: 52008 - RNA, 46 nt, Mus musculus
cagcggggcucccugccgccccuguaccuuucuacauuaccugccc

SEQ ID NO: 52009 - RNA, 46 nt, Mus musculus
auacgaagaggaagccauuguucgcaugauugaauccaagcauaag

SEQ ID NO: 52010 - RNA, 65 nt, Mus musculus
gaguugauugaagcuuuugauuuucuaauugucaaugccaagaacaccauaaaugcauaguacca

SEQ ID NO: 52011 - RNA, 66 nt, Mus musculus
ugacuuuucuaaaaucaaacauucuauuauauuacaagacaaagauacaaugauuugcuacaaccu

SEQ ID NO: 52012 - RNA, 46 nt, Mus musculus
cacguggaagugagguguguaugcgcccgacagaaugugguagcug

SEQ ID NO: 52013 - RNA, 48 nt, Mus musculus
agcuggggugagcagguggggggcuacgcagccagauuccaggcaaaa

SEQ ID NO: 52014 - RNA, 45 nt, Mus musculus
cuguagccacacagacaugagaaugucagaucucauuccggauga

SEQ ID NO: 52015 - RNA, 42 nt, Mus musculus
agaugguaucccuggcagugaauagaaugacccguaccccag

SEQ ID NO: 52016 - RNA, 42 nt, Mus musculus
uguguguguguauacagcgugagucaccgggaggcggaggag

SEQ ID NO: 52017 - RNA, 42 nt, Mus musculus
cguucuggggaggggggccaaccaggguggaugggggucgag

SEQ ID NO: 52018 - RNA, 46 nt, Mus musculus
uuagggaugccggggguaccuuccccuagcuacuuacugucugcua

SEQ ID NO: 52019 - RNA, 41 nt, Mus musculus
cccuacaguagggggugggcucugggagugugcuagcccag

SEQ ID NO: 52020 - RNA, 42 nt, Mus musculus
cuccuaagacgagaaccuucugagagacucacagcuccucag

SEQ ID NO: 52021 - RNA, 46 nt, Mus musculus
uccgauuguugucauuuggcucugcagcuuguuuugucgucugugu

SEQ ID NO: 52022 - RNA, 95 nt, Mus musculus
cccagcuccuguaucugugauacauucccuggcugaggacucggggcuggccugggcauuugccuggacugcuggaaacacuaggucuccugugc

SEQ ID NO: 52023 - RNA, 47 nt, Mus musculus
gaaaugcaucgugauuccugucccuuggauuguaagguuuauguagg

SEQ ID NO: 52024 - RNA, 45 nt, Mus musculus
augaccgcaggaggaguccuccaccucggcgcagauccccaagaa

SEQ ID NO: 52025 - RNA, 51 nt, Mus musculus
cuaggucaaaugaaaggaaauagaagaccaguuugcaaaagugguguacag

SEQ ID NO: 52026 - RNA, 46 nt, Mus musculus
aaugugauaucaagaauuguuacuuuacaauguucccuuaagcaag

SEQ ID NO: 52027 - RNA, 46 nt, Mus musculus
cuguaguccucuaguagccgagacacuguggcacuguggguggaau

SEQ ID NO: 52028 - RNA, 26 nt, Mus musculus
gcucaacuuuucaguuacugugcaag

SEQ ID NO: 52029 - RNA, 75 nt, Mus musculus
cacgguauuaaguauggugguacugccuggccuuuagaagcagaagagagagagggagaaggggauggggggcgg

SEQ ID NO: 52030 - RNA, 45 nt, Mus musculus
gagagagagagagagagagagagagagagagagagagaucgucuu

SEQ ID NO: 52031 - RNA, 46 nt, Mus musculus
cccuuuccucugucaucuugacaagucgcucuaccccgacucagau

SEQ ID NO: 52032 - RNA, 46 nt, Mus musculus
agcgugcuguacuuccaagugugugugugugugugugugugugugu

SEQ ID NO: 52033 - RNA, 42 nt, Mus musculus
ugucuccucaugcagcacuaggggcucagggcuggcccgugg

SEQ ID NO: 52034 - RNA, 23 nt, Mus musculus
gggcggucugggggggggggggg

SEQ ID NO: 52035 - RNA, 46 nt, Mus musculus
ugggccucugagagccugugguugcuucuccccaaggucgcagcag

SEQ ID NO: 52036 - RNA, 41 nt, Mus musculus
caaggccaggaugaagagaagcuacgaacuuagcauuccca

SEQ ID NO: 52037 - RNA, 45 nt, Mus musculus
uguuaaccuugcacuuuuccucaucacuagacucgagauugccag

SEQ ID NO: 52038 - RNA, 44 nt, Mus musculus
ugaccuagagaaagccaaaugugugugugugugugugugugugu

SEQ ID NO: 52039 - RNA, 51 nt, Mus musculus
ggccugcucucagugcuuggaugugugcuaguuacaucucggaggugagga

SEQ ID NO: 52040 - RNA, 45 nt, Mus musculus
agacauuaaggcugguuuaagacauugugggcuauugugcuggga

SEQ ID NO: 52041 - RNA, 46 nt, Mus musculus
uccuugaaagucugucugcugaguucuuaccaucuccacggauccg

SEQ ID NO: 52042 - RNA, 46 nt, Mus musculus
cuuccauguccgggaccuucugucugccugcccaaucuagcugcua

SEQ ID NO: 52043 - RNA, 79 nt, Mus musculus
auacuuuagauguauauuuuagaugccacauggccuuugcgugcacuggcuuguuauugugucuuucuuccucuaguug

SEQ ID NO: 52044 - RNA, 92 nt, Mus musculus
guugcagacauagcguucugcauguugcuaacacucccccccccucccuuuuucucccuaauaucaguuuaugaaaucacuaagagaccaga

SEQ ID NO: 52045 - RNA, 48 nt, Mus musculus
cugaugacuuacugaaaccuacuguggcacaagagaaccaagucccca

SEQ ID NO: 52046 - RNA, 46 nt, Mus musculus
agguguggugguucaugccuauaauccaaggauaugggaaguugaa

SEQ ID NO: 52047 - RNA, 46 nt, Mus musculus
auaacucugcagaaauacguaugaaaaacguccagcuuucauggag

SEQ ID NO: 52048 - RNA, 34 nt, Mus musculus
cucagggugacaggcauguuagccagguccucuu

SEQ ID NO: 52049 - RNA, 46 nt, Mus musculus
caguuucugugucuguaaaauuggguaacugagcugcugugaggau

SEQ ID NO: 52050 - RNA, 46 nt, Mus musculus
ggggagaggucagacaggcaccaaggucagaguggggaucugcaag

SEQ ID NO: 52051 - RNA, 64 nt, Mus musculus
aaacuguacuugguaauguuuccaugagacagucugaggucugggaggcauuuagugaacagug

SEQ ID NO: 52052 - RNA, 45 nt, Mus musculus
gggcaugccuaaaaccuggccuugaucucuaucuaacacggaggg

SEQ ID NO: 52053 - RNA, 66 nt, Mus musculus
acauuaaaaaaaauccuucuacggcagagaaaaaggagggugaacauaacugcuggcccguuugag

SEQ ID NO: 52054 - RNA, 47 nt, Mus musculus
ccauugagcagccuggucccugggucaugggguguugaauggagaca

SEQ ID NO: 52055 - RNA, 46 nt, Mus musculus
augagcuuauucgucagaaugggaaggaggacugggggacagacag

SEQ ID NO: 52056 - RNA, 45 nt, Mus musculus
aagccucuguaaacaccacccccaucagggaggggaaggagggag

SEQ ID NO: 52057 - RNA, 45 nt, Mus musculus
uccuuaugaacucuaggcuagccaaacauuuaugaucuccccaau

SEQ ID NO: 52058 - RNA, 49 nt, Mus musculus
ugagguagaggucagacgcugagguucaaaguuaacuagagagacggaa

SEQ ID NO: 52059 - RNA, 48 nt, Mus musculus
uguuuuuguccuuguucauguucagcucauguuuagacagucauguug

SEQ ID NO: 52060 - RNA, 45 nt, Mus musculus
gagaauggauuggccaguuaacaauagaagccagaaaguuuggag

SEQ ID NO: 52061 - RNA, 44 nt, Mus musculus
aucuugcccggagggaaugugacugauuuugaacuagggcagaa

SEQ ID NO: 52062 - RNA, 46 nt, Mus musculus
uguacuuaaaaagcuuuuaaugguuugucauuguuauugggcgucu

SEQ ID NO: 52063 - RNA, 32 nt, Mus musculus
ugugguagcaucagggaggcagaggcagggag

SEQ ID NO: 52064 - RNA, 41 nt, Mus musculus
gaaacccaguuaaagccaucucccuuggugucagggcccag

SEQ ID NO: 52065 - RNA, 42 nt, Mus musculus
uguggcagagauccccugagagcagcucacuuaccccuggau

SEQ ID NO: 52066 - RNA, 46 nt, Mus musculus
uaaucuacaggaauauccuuguguguguguguauguguauguguau

SEQ ID NO: 52067 - RNA, 39 nt, Mus musculus
augcugccacccagaagguaagcauucaaguacugacag

SEQ ID NO: 52068 - RNA, 46 nt, Mus musculus
gauugcucuuaggacacuauagcuguaugcucuuagacaccacacc

SEQ ID NO: 52069 - RNA, 50 nt, Mus musculus
gacauggggaggggagucaagaggguaguagaggcuggccaugagcacau

SEQ ID NO: 52070 - RNA, 46 nt, Mus musculus
cuucuucugagaugucugaagacagcuacaguguacuuacauauaa

SEQ ID NO: 52071 - RNA, 45 nt, Mus musculus
aaaccugaagguucauggauuggaagaucuaauauauggggauca

SEQ ID NO: 52072 - RNA, 45 nt, Mus musculus
uguguuugaagcuaucaugggcuggguaauaagacauugguuuua

SEQ ID NO: 52073 - RNA, 46 nt, Mus musculus
cuacaacugcuccugacuccuuuuaugggaguguguauugaucaag

SEQ ID NO: 52074 - RNA, 42 nt, Mus musculus
gggucuucuuaauauuaauaaggaaaacugagacacggggcg

SEQ ID NO: 52075 - RNA, 45 nt, Mus musculus
cuggcuuuuauagacgugucagaaaacuuaaccucuacgugguag

SEQ ID NO: 52076 - RNA, 45 nt, Mus musculus
acaaguccuuuaaaggcuugucacugaggaguguugagaggccca

SEQ ID NO: 52077 - RNA, 44 nt, Mus musculus
gguuguccuggauuacgugcuagguucuauuuucugccagcuaa

SEQ ID NO: 52078 - RNA, 46 nt, Mus musculus
guugaguaacuuggcccaagguuggcccaguuaauaaaaggcagag

SEQ ID NO: 52079 - RNA, 42 nt, Mus musculus
gguaagugaccauguaugacuuaugggcuaucaguggccuca

SEQ ID NO: 52080 - RNA, 41 nt, Mus musculus
auaaacacagguagugcuguuggcauggcaaagaaacccuu

SEQ ID NO: 52081 - RNA, 46 nt, Mus musculus
ugguugugacagaagcuuucuguagggguguauuugcugggcugag

SEQ ID NO: 52082 - RNA, 42 nt, Mus musculus
ucuggccucugauagaggagggcuuucaacuguugggggcag

SEQ ID NO: 52083 - RNA, 42 nt, Mus musculus
gcauuuugaauaguagcauaaaggcagauggugauggggaaa

SEQ ID NO: 52084 - RNA, 46 nt, Mus musculus
uaaaagcugcuucuacgcaucuguuucagcuccagcucuggauuag

SEQ ID NO: 52085 - RNA, 45 nt, Mus musculus
ugaaucugggcagggccauuuccuggaaccaucagggaacuggcu

SEQ ID NO: 52086 - RNA, 42 nt, Mus musculus
cuaaaguuugcuccacccagucaucucuccaucucuggccac

SEQ ID NO: 52087 - RNA, 45 nt, Mus musculus
cuucuuucaguuugcuuccucuguuaagaccagcugcucgcccag

SEQ ID NO: 52088 - RNA, 45 nt, Mus musculus
agucgcacagguccacaggugucugggcgcaucuuucaccuccag

SEQ ID NO: 52089 - RNA, 48 nt, Mus musculus
gagaacucugccugcauggcuccaggcccuguccuguugagacagaaa

SEQ ID NO: 52090 - RNA, 42 nt, Mus musculus
ggggggagggggaggaggcagacugguaggugacaucaggga

SEQ ID NO: 52091 - RNA, 42 nt, Mus musculus
aucucggcugggaguggcugucuagcauucaaaagccucuag

SEQ ID NO: 52092 - RNA, 42 nt, Mus musculus
cuggggggggggggagggggcuagaaucuguugucgcagaag

SEQ ID NO: 52093 - RNA, 45 nt, Mus musculus
ugguugaaucucauuucuuaugcacauauguuauuggaaugggag

SEQ ID NO: 52094 - RNA, 45 nt, Mus musculus
cuaacaucacuguaaacgucacuuuuuauucaacaucugucuguc

SEQ ID NO: 52095 - RNA, 44 nt, Mus musculus
uacauuuucugauuauaacauacauaauuauucugucuagcaua

SEQ ID NO: 52096 - RNA, 46 nt, Mus musculus
cacuuagaaauaagcacugugugaagacacacaggugccacaggag

SEQ ID NO: 52097 - RNA, 45 nt, Mus musculus
uagguaacccaguaggaggaaaaggguccuuuuugcuuuugagca

SEQ ID NO: 52098 - RNA, 47 nt, Mus musculus
agucauucaucuuuuccuuaugagaaaagaaccugguuagccacaag

SEQ ID NO: 52099 - RNA, 45 nt, Mus musculus
uaugccauuauuuggacuggggauuucugugacauaauuacuuca

SEQ ID NO: 52100 - RNA, 46 nt, Mus musculus
gaaccaguaucccugauguuaucaagaguauucuaauauaggcuaa

SEQ ID NO: 52101 - RNA, 46 nt, Mus musculus
ugcauauuucugaaaguuuucauguuauauuuucuuuggauuagag

SEQ ID NO: 52102 - RNA, 46 nt, Mus musculus
ucaaaaaauugcauuuuuauuuauauguaugaauauuuguagguag

SEQ ID NO: 52103 - RNA, 32 nt, Mus musculus
gagaggucuggggaugugcaaagucucaaagu

SEQ ID NO: 52104 - RNA, 46 nt, Mus musculus
augcaguuuccuggggaguaauucugguggauacaaauuccggagu

SEQ ID NO: 52105 - RNA, 42 nt, Mus musculus
auaaaugaagaugugaugguuaauucauuaagacacuggcag

SEQ ID NO: 52106 - RNA, 82 nt, Mus musculus
gcaccccccuccccccuggcugaauaucagcuaaccugcguaucagauauuuauauuaugauucauaacaguagcaaaauua

SEQ ID NO: 52107 - RNA, 99 nt, Mus musculus
caguagcaaugaaauaauuuuaugauggugggggaauaguuuuacgaggaaguguauuaaagggucucaguacuggguugagaaccacugguuuggaga

SEQ ID NO: 52108 - RNA, 42 nt, Mus musculus
acuagcagcuaucaccauuuauuaagccagugcaggcggcau

SEQ ID NO: 52109 - RNA, 46 nt, Mus musculus
gcaguuauaggcagugguuaucucucaugugaguguuggaauugag

SEQ ID NO: 52110 - RNA, 42 nt, Mus musculus
gagaaugaaauaaaacacacauuugagcguuugagucagcgg

SEQ ID NO: 52111 - RNA, 41 nt, Mus musculus
uaagcugugauauugacagagaguacauguacuuuggcugg

SEQ ID NO: 52112 - RNA, 41 nt, Mus musculus
caugcacagcaaaucccuaauccaauuccacaucgccaggc

SEQ ID NO: 52113 - RNA, 46 nt, Mus musculus
cagaugccaagaggacaaaugagcccuauuagugaaaguguuggag

SEQ ID NO: 52114 - RNA, 45 nt, Mus musculus
gugguguucauuccaggcuauauuuuugggguggggaugggggag

SEQ ID NO: 52115 - RNA, 46 nt, Mus musculus
cacuccagagccagggcauggaaagagcaucgugucagagugagcg

SEQ ID NO: 52116 - RNA, 44 nt, Mus musculus
caugaagguccaaggcaccauugcagaucugaugagcaggggac

SEQ ID NO: 52117 - RNA, 45 nt, Mus musculus
uggaaagucaggauuggaaauugcuggaaguucaacccuguggaa

SEQ ID NO: 52118 - RNA, 46 nt, Mus musculus
ccuuucaagggcuggaauuauagugugcuguguauguuguccccag

SEQ ID NO: 52119 - RNA, 46 nt, Mus musculus
aucacaguccugcauaucuucuuaucuugaauauccauucaccuag

SEQ ID NO: 52120 - RNA, 46 nt, Mus musculus
cuuccuggggaugauaaauguuuagauaacgacaaacaacggggag

SEQ ID NO: 52121 - RNA, 45 nt, Mus musculus
agaaggggagggguguguguguguggggggagagugauagcugaa

SEQ ID NO: 52122 - RNA, 45 nt, Mus musculus
uggauaaauugacaucuaggcuuagggggaaaaaaacaauaggaa

SEQ ID NO: 52123 - RNA, 42 nt, Mus musculus
gaaccccaccgcagguuaugggugggacaugguuaguggcgg

SEQ ID NO: 52124 - RNA, 42 nt, Mus musculus
ugcugcagcuugguuggagcccaucguucagugaacagugca

SEQ ID NO: 52125 - RNA, 42 nt, Mus musculus
cuaagcagccuuguuuuggaguccuggauagcagagagggug

SEQ ID NO: 52126 - RNA, 44 nt, Mus musculus
ccaucaguauuuauggccuuuacaauuugcuucaugugcugccg

SEQ ID NO: 52127 - RNA, 46 nt, Mus musculus
cgugaaaacaaagcacucauaaacucauugcuaacauccagcccag

SEQ ID NO: 52128 - RNA, 46 nt, Mus musculus
augguaaacacucguuaaauguuaacuauugauacuggugugccug

SEQ ID NO: 52129 - RNA, 46 nt, Mus musculus
gguucuuuucaguaugaucuacauuugugugugugugugugugugu

SEQ ID NO: 52130 - RNA, 42 nt, Mus musculus
aucucuaguggguaguuugugucucaauggcuuagugaucaa

SEQ ID NO: 52131 - RNA, 49 nt, Mus musculus
agaaauuaggaacaggcuugggagaauucugaagacaugagacuuguca

SEQ ID NO: 52132 - RNA, 46 nt, Mus musculus
cauagaaugcaccucuuucccuccuccccccaacacacgcgcacac

SEQ ID NO: 52133 - RNA, 42 nt, Mus musculus
caucuggcuuguuucuuugugccaggcaggcuccuuggguag

SEQ ID NO: 52134 - RNA, 46 nt, Mus musculus
agcuuuccccuuaguuuugggcaggguuuugaaguuucugggcaag

SEQ ID NO: 52135 - RNA, 46 nt, Mus musculus
agcucuuuuauaaguugcuuugguaaugguguucugucacagcaac

SEQ ID NO: 52136 - RNA, 46 nt, Mus musculus
cagaugucaccucagcgauucucagcaucaggcuucccaagaccag

SEQ ID NO: 52137 - RNA, 46 nt, Mus musculus
uuuuacauauagcacuuuuauugagauuuaguucaaacacacccca

SEQ ID NO: 52138 - RNA, 46 nt, Mus musculus
aauagugccacauccuaggccaagcauauucaaaccaccacaggga

SEQ ID NO: 52139 - RNA, 45 nt, Mus musculus
ucacacggggagccaugcuucgauaaaaagggcugauauagcaag

SEQ ID NO: 52140 - RNA, 32 nt, Mus musculus
ccguuuccucgccuggccaugugugacugcau

SEQ ID NO: 52141 - RNA, 46 nt, Mus musculus
auauuucaugaaaggacagauuucucaagcauccugaaucauuuca

SEQ ID NO: 52142 - RNA, 45 nt, Mus musculus
uuuaagacuaggcaugguggcucacaccuuuaauuccagcacucc

SEQ ID NO: 52143 - RNA, 47 nt, Mus musculus
uguguccuggcuggaacuugugaugucuuugaacaagucuggaucug

SEQ ID NO: 52144 - RNA, 45 nt, Mus musculus
agguggccauugagaauucaaguguaccucuuggucccugaugca

SEQ ID NO: 52145 - RNA, 42 nt, Mus musculus
cuuauccugcauaccucugccaguaggcaacaacccaggccc

SEQ ID NO: 52146 - RNA, 46 nt, Mus musculus
gcacggaggcaggagcaugaaguagcuaaucacauuguauuuguaa

SEQ ID NO: 52147 - RNA, 45 nt, Mus musculus
guauugucuucaggaaugccaucacuuucuuugaaacagcuucuc

SEQ ID NO: 52148 - RNA, 46 nt, Mus musculus
cugcauguaaguuuucuuggaaaucauuuggacacauucucagcag

SEQ ID NO: 52149 - RNA, 42 nt, Mus musculus
aauaaucucuuuuuaauucacauauauuuauucuagggagga

SEQ ID NO: 52150 - RNA, 37 nt, Mus musculus
uuuucuucuaauuaugauggaaaagauguaugaaaau

SEQ ID NO: 52151 - RNA, 58 nt, Mus musculus
aauaaaauagcuuuuauuuaaaaaaauaaauuaaaaacccccaaaacagugaucacau

SEQ ID NO: 52152 - RNA, 42 nt, Mus musculus
ggaucguuggaaagcaaaauaaaacgaaacaaacccugccag

SEQ ID NO: 52153 - RNA, 41 nt, Mus musculus
acguuuugcuuaugcuauuucaugaauagugugcuggggga

SEQ ID NO: 52154 - RNA, 46 nt, Mus musculus
gcagguaucaguguguagguuaauaagcaggaugcuuacucuggag

SEQ ID NO: 52155 - RNA, 47 nt, Mus musculus
guaugaucaaaaacaucaauuaaaaacacucaacaguuugacugccu

SEQ ID NO: 52156 - RNA, 45 nt, Mus musculus
gagcugaaauuuuugaugaggugccuccagagaagggacuugcag

SEQ ID NO: 52157 - RNA, 46 nt, Mus musculus
guccugacugccgauacccugggugguuugcaggggagggggguag

SEQ ID NO: 52158 - RNA, 45 nt, Mus musculus
ucuucagcaccuagaauucuugcaaugagacgaauggaaauacca

SEQ ID NO: 52159 - RNA, 44 nt, Mus musculus
uuccuaaaucaaagguggaauauuuggggauuuggaaaauugag

SEQ ID NO: 52160 - RNA, 44 nt, Mus musculus
cagaaagcuauaucagaguuaaaguagucuuacuuuccccacug

SEQ ID NO: 52161 - RNA, 46 nt, Mus musculus
uuuacuaguaggacagcuauccuuuucuacccuuuugugccccacu

SEQ ID NO: 52162 - RNA, 29 nt, Mus musculus
ucuuggcccagccaaauugacacacugag

SEQ ID NO: 52163 - RNA, 47 nt, Mus musculus
ugagggcacaaaagcacuccuuuccaauccaaguuuugcaacaaggu

SEQ ID NO: 52164 - RNA, 46 nt, Mus musculus
ugugacgcuucccuugaugagcccuaaugagacucuguagcaccaa

SEQ ID NO: 52165 - RNA, 41 nt, Mus musculus
auagacuggaaauagccuugucaaaauagaccaagggcaaa

SEQ ID NO: 52166 - RNA, 42 nt, Mus musculus
cauaggcuugaaauccuggcacuuagaaggucaaagcagagg

SEQ ID NO: 52167 - RNA, 46 nt, Mus musculus
aagcccuuuuaccuccgagccaccucaccaguucgagccucucaag

SEQ ID NO: 52168 - RNA, 46 nt, Mus musculus
augagcuucccgcuuuggauggucauugaguuaauuaccgaaagag

SEQ ID NO: 52169 - RNA, 46 nt, Mus musculus
ugacauuaucaaguuauucaugaaguauaugugggccacuguccag

SEQ ID NO: 52170 - RNA, 42 nt, Mus musculus
caugccucccaaggcugaguguacuaccaucuaaaccaacag

SEQ ID NO: 52171 - RNA, 46 nt, Mus musculus
gcaauaagaaagcuuugagaauguuuagagauuucuaugaccacug

SEQ ID NO: 52172 - RNA, 46 nt, Mus musculus
accaaaaaaaccaaauaaccaaccaaccaaccaaccaggcaaccaa

SEQ ID NO: 52173 - RNA, 46 nt, Mus musculus
caauuaaccaacuaaccaaguaauuaaccaaccaaccaaaacccaa

SEQ ID NO: 52174 - RNA, 47 nt, Mus musculus
acuuacaaacucccaaauugaugcuauuuuuaauacuuuggauggga

SEQ ID NO: 52175 - RNA, 45 nt, Mus musculus
uccuucguaaagugcauuguacccauagaaagcuugcgagcauua

SEQ ID NO: 52176 - RNA, 48 nt, Mus musculus
aaauguucuucaauagaccgggacaaagauucuucuuuaaaggccaag

SEQ ID NO: 52177 - RNA, 48 nt, Mus musculus
auacauuuaaaugagaagguaaaaaaaucuuaaagacauagucuagaa

SEQ ID NO: 52178 - RNA, 46 nt, Mus musculus
caaaaagucagagcagaauuugcccuucaaauacuuagaguggaau

SEQ ID NO: 52179 - RNA, 46 nt, Mus musculus
ggcacagugguaagaauagccaagaaacauauuaaauaauaccaag

SEQ ID NO: 52180 - RNA, 46 nt, Mus musculus
uuugugaaugaagaacuuggggcacagccaggcuaaagggugcuau

SEQ ID NO: 52181 - RNA, 45 nt, Mus musculus
uuggagagggacuugauagaaaggguuaaagaagcuggagugaga

SEQ ID NO: 52182 - RNA, 46 nt, Mus musculus
caguacaaacuccaguuucccacagcagauaacaauguuccaugaa

SEQ ID NO: 52183 - RNA, 46 nt, Mus musculus
gauaacucuugaacuuuacaaggacaggagcuaaauagcaucacac

SEQ ID NO: 52184 - RNA, 46 nt, Mus musculus
uuaugugauccacugauuaauugggucuccauaugaaagcaugcuc

SEQ ID NO: 52185 - RNA, 23 nt, Mus musculus
acccagagggacuccuggcuggg

SEQ ID NO: 52186 - RNA, 45 nt, Mus musculus
ggcugaggaggcugcagugaaguuauuguugggacugugggcuaa

SEQ ID NO: 52187 - RNA, 42 nt, Mus musculus
ggguuaaucucgagcagcuagaaacccgaguugcuacuuaga

SEQ ID NO: 52188 - RNA, 51 nt, Mus musculus
aauguucuugggugccgcaccucugucauguccagaagaaacuauuuggca

SEQ ID NO: 52189 - RNA, 45 nt, Mus musculus
cacagcaaaaagaagcuguuuugacaaggccugagaguugcacuc

SEQ ID NO: 52190 - RNA, 46 nt, Mus musculus
auaacuuuuagcuucuggcagcauucauagcaucuuccagcacucu

SEQ ID NO: 52191 - RNA, 46 nt, Mus musculus
auucugggccugggaguuuucaugauuauguaagccaacacccccc

SEQ ID NO: 52192 - RNA, 46 nt, Mus musculus
acagcuggaagagaccaucaaaaacugccugucugcagcugaggau

SEQ ID NO: 52193 - RNA, 47 nt, Mus musculus
ugaggguggagggcaucguccauccaaccacagcugagaucgaccuc

SEQ ID NO: 52194 - RNA, 46 nt, Mus musculus
ucuugccugauguggccuuccuuccucuuuucucugggggugggag

SEQ ID NO: 52195 - RNA, 45 nt, Mus musculus
guggggguguccugccgagaauucuccacgaacugcuggccaaga

SEQ ID NO: 52196 - RNA, 42 nt, Mus musculus
agcaagcuaagaggaaaaucgaggcaagaugucaggccggag

SEQ ID NO: 52197 - RNA, 42 nt, Mus musculus
ccaaucuuagccaugaugacuuggcuuuuuuaaaggagggua

SEQ ID NO: 52198 - RNA, 45 nt, Mus musculus
gggugcugguuaguucauaauguugauccaccuauaggguugcag

SEQ ID NO: 52199 - RNA, 46 nt, Mus musculus
acuucuugugcucuaugggaagcauagucuuaucacccaauuggag

SEQ ID NO: 52200 - RNA, 45 nt, Mus musculus
gcguuguuaucauaugcccuugaauuucuuguuucccugucccca

SEQ ID NO: 52201 - RNA, 42 nt, Mus musculus
acaaccccagcccuuucuucuuccuuuccuugaagcccccgu

SEQ ID NO: 52202 - RNA, 46 nt, Mus musculus
gccugaugauccuuucuucuaaaagcaaaaaugucucuguccccau

SEQ ID NO: 52203 - RNA, 64 nt, Mus musculus
guggucccagacuuugcaauaguucuuucaaaaagaugcaccagaugaauuaauaaacagcaau

SEQ ID NO: 52204 - RNA, 87 nt, Mus musculus
gaccuguggcaaucucaaaacaagagagacugucuuaaucagcgauugacgugggagggcagcagcaucccugcguaggguggccug

SEQ ID NO: 52205 - RNA, 45 nt, Mus musculus
uaagaugcuugggucaugguuugucauggcaacagacagcaaaca

SEQ ID NO: 52206 - RNA, 46 nt, Mus musculus
cuaucucaucuauguaguaugcugguaguucauaaauaggcccuuu

SEQ ID NO: 52207 - RNA, 46 nt, Mus musculus
uacacuucuguagcauguggauguuaacauaaucuuugguacauag

SEQ ID NO: 52208 - RNA, 46 nt, Mus musculus
uucuaaacauguucuuuucaaacagcuuuauuuagacagaacucac

SEQ ID NO: 52209 - RNA, 46 nt, Mus musculus
acaaaauucaauaggaggaauaaauaugguccuuaguauauugaag

SEQ ID NO: 52210 - RNA, 46 nt, Mus musculus
ggugcggagccuacaaugaggugaaugacucauaacuugcagccac

SEQ ID NO: 52211 - RNA, 46 nt, Mus musculus
augccaaguaacucagcagaugucacacagacgauaaauagcaaag

SEQ ID NO: 52212 - RNA, 41 nt, Mus musculus
caggaaaacugguccuuagucuguagaugaugugguugcaa

SEQ ID NO: 52213 - RNA, 32 nt, Mus musculus
auuccuagauccuugaugggaaaaacuugaug

SEQ ID NO: 52214 - RNA, 48 nt, Mus musculus
gcagccauguugaaccuaugaggugaugaaaaaccaugcaacuagaaa

SEQ ID NO: 52215 - RNA, 46 nt, Mus musculus
cuggagcaugacacgcccccuaaacucuugucucaaaacacccacu

SEQ ID NO: 52216 - RNA, 45 nt, Mus musculus
gcuugugaaaaagaaggggcugugaucaucaaaucguguuaguag

SEQ ID NO: 52217 - RNA, 63 nt, Mus musculus
agcuaaagggaugcucagacucucuguccuuucuguguagugagggaccaggcugcugggcga

SEQ ID NO: 52218 - RNA, 46 nt, Mus musculus
uagacauuauuucaaaauaguucuugaucauuaaagaaccaaccag

SEQ ID NO: 52219 - RNA, 42 nt, Mus musculus
ucgcuauuauagcuguucggacagaccagucaaaacagacuu

SEQ ID NO: 52220 - RNA, 45 nt, Mus musculus
cagacucaacucugaugggaaauucuagauccuuguuccugcaca

SEQ ID NO: 52221 - RNA, 46 nt, Mus musculus
aaggcacuugcugagugucuucaccaaccaucuccuauagcuugug

SEQ ID NO: 52222 - RNA, 42 nt, Mus musculus
gauaaacucuugccauugguggcaacauggaugaagcugaag

SEQ ID NO: 52223 - RNA, 45 nt, Mus musculus
acacauggacucagacguaggaaaagagaggcuacuagaggcugg

SEQ ID NO: 52224 - RNA, 45 nt, Mus musculus
cuccucacgguggagaguagaguggagcuccacuaugacagguca

SEQ ID NO: 52225 - RNA, 60 nt, Mus musculus
ugcuacugucaugacaugcaaagacaugucagagcaaaggaugagaagguggaauuacca

SEQ ID NO: 52226 - RNA, 48 nt, Mus musculus
gaguuauuuuuuaucagucugauacauuccuaaagggaacagugccaa

SEQ ID NO: 52227 - RNA, 45 nt, Mus musculus
ucauuggggcucccuggccaugggaugguaccucuccaguucaga

SEQ ID NO: 52228 - RNA, 56 nt, Mus musculus
caggagacagacuuugugccaauguguucuccaugugaccaaauaagaagaaaaug

SEQ ID NO: 52229 - RNA, 45 nt, Mus musculus
agcucgauauuugcuagaggaagauucauucacaugaaugaggag

SEQ ID NO: 52230 - RNA, 45 nt, Mus musculus
aaggagugucuuuuguaaaaauacgaauccuauucacaagggccu

SEQ ID NO: 52231 - RNA, 46 nt, Mus musculus
ggaguauggauauuuuaauacacaauuaugcaaaauaaggugaaag

SEQ ID NO: 52232 - RNA, 42 nt, Mus musculus
gugcaaaccuuuauucagaaccaucccuaagucugcuggcaa

SEQ ID NO: 52233 - RNA, 61 nt, Mus musculus
cuuucuggggacaggauagucaagccaagguuugaaggagcuggcaaugcagggaaagggg

SEQ ID NO: 52234 - RNA, 66 nt, Mus musculus
aggugggcccacagguuugagagacaccaggcuuuuauuuuaaaaucacuguggcuucugagugga

SEQ ID NO: 52235 - RNA, 46 nt, Mus musculus
uggaagcccagaaauccaagggcuuuggugcaauguggcagagaaa

SEQ ID NO: 52236 - RNA, 44 nt, Mus musculus
acaucaggaacuuaaaguuagugaagcugauacuagaauucaga

SEQ ID NO: 52237 - RNA, 51 nt, Mus musculus
gcccaugguauaauaaucucuaggaaacagagauuuggcuugucugucagg

SEQ ID NO: 52238 - RNA, 46 nt, Mus musculus
gaugcucuacauagcuauuugggaaugaauaucggguagccuuaga

SEQ ID NO: 52239 - RNA, 45 nt, Mus musculus
uguggggaaagguaaaaguuuggucuucuagcaacaucccccuua

SEQ ID NO: 52240 - RNA, 46 nt, Mus musculus
uaccccugugcacaaaacauucuagauaauucacggaugcggucau

SEQ ID NO: 52241 - RNA, 45 nt, Mus musculus
gcccuuguuguguagcaacuuugcauacccauugaguccccaggu

SEQ ID NO: 52242 - RNA, 27 nt, Mus musculus
ggaccuucucccuugcacuguaaaagg

SEQ ID NO: 52243 - RNA, 46 nt, Mus musculus
aagggcuauacucaggcuugcuagggacaaaauccuuagccgugug

SEQ ID NO: 52244 - RNA, 41 nt, Mus musculus
uguguguguguguguguguguguguguguguaccuguacaa

SEQ ID NO: 52245 - RNA, 46 nt, Mus musculus
uuagaauaauuuuuagaguugagcaagauaaaugucacggugucag

SEQ ID NO: 52246 - RNA, 45 nt, Mus musculus
gacugcccuaccugggauccaucccauaaacaaccaccaaaccca

SEQ ID NO: 52247 - RNA, 45 nt, Mus musculus
uuuaauaaaagacacauauucuacauuuaacacuuucggcuuuca

SEQ ID NO: 52248 - RNA, 45 nt, Mus musculus
aauaguugucugagaauuaaacaagcaauuagauacagauggguu

SEQ ID NO: 52249 - RNA, 45 nt, Mus musculus
aacagagaacaagggaagaaugacagauguaaagagcagggggca

SEQ ID NO: 52250 - RNA, 46 nt, Mus musculus
acacaagaaccaugaugguguuugcuccuuuaucuucuugggagag

SEQ ID NO: 52251 - RNA, 44 nt, Mus musculus
ggucugugcuauuggaaugccaccgaaaaggaaagucccggaca

SEQ ID NO: 52252 - RNA, 46 nt, Mus musculus
gccucaguacaggggaaugccagggccaagaagugggaguuggggg

SEQ ID NO: 52253 - RNA, 45 nt, Mus musculus
cauucuccuuaucauaacaaaauauaugacaugaaaaauucaagg

SEQ ID NO: 52254 - RNA, 42 nt, Mus musculus
aaaauguaaaugaggaaaauaccuaauaaaaagaaaauggag

SEQ ID NO: 52255 - RNA, 42 nt, Mus musculus
ccaguacaggggaaugccagggccaggaguugggagugugug

SEQ ID NO: 52256 - RNA, 46 nt, Mus musculus
uauuauaauucauaacagcaacaaaauuacaguuauaaaguagcaa

SEQ ID NO: 52257 - RNA, 44 nt, Mus musculus
ccuaugugguguggaggcugcgagggguacagguuugauaggga

SEQ ID NO: 52258 - RNA, 45 nt, Mus musculus
cuucugggcuaauauccacuuaucagugagugcaugccaugugug

SEQ ID NO: 52259 - RNA, 46 nt, Mus musculus
agcuuguuguggcaggguaugggccagcagguggguaaggacagcc

SEQ ID NO: 52260 - RNA, 106 nt, Mus musculus
ggaaauggauggugcccaggcagagcuuaaugccuugaaacgaacagaggaagaucugaaaaaaggccaccagaaacuggaagagauggucacccgcuuagaucaa

SEQ ID NO: 52261 - RNA, 46 nt, Mus musculus
ccucuguucguuucaaggcauuaagcucugccugggcaccauccau

SEQ ID NO: 52262 - RNA, 45 nt, Mus musculus
gaaaaugcuauugaagacacuaucuuuuaccuuggagaagcuuug

SEQ ID NO: 52263 - RNA, 46 nt, Mus musculus
uaaagcauucuuuucuucuucuuuuucucaucaguagaacccacaa

SEQ ID NO: 52264 - RNA, 47 nt, Mus musculus
gagcaagaaaaagaaggaagaggaagaugaggaggaggaugaagaug

SEQ ID NO: 52265 - RNA, 23 nt, Mus musculus
aacagcagcucaaggacuaaccu

SEQ ID NO: 52266 - RNA, 44 nt, Mus musculus
ccucggugaagugggcucugggauucaccugucacauuugugcc

SEQ ID NO: 52267 - RNA, 46 nt, Mus musculus
ucuuucuuucucaaaggaauuggggaggcaggugugguuuacagag

SEQ ID NO: 52268 - RNA, 42 nt, Mus musculus
ugugucugugucucuguguguguuuaugacaugaaaguagaa

SEQ ID NO: 52269 - RNA, 46 nt, Mus musculus
guccucuucaagguuucagauauccaaacauaggcccacgugagau

SEQ ID NO: 52270 - RNA, 46 nt, Mus musculus
gggcgucuuguccacacgaggcaauuacagaacucagccacccuuu

SEQ ID NO: 52271 - RNA, 46 nt, Mus musculus
uccucuccugauuccuggcugaaggcuauaccuguagagaccagau

SEQ ID NO: 52272 - RNA, 45 nt, Mus musculus
gcugagacuaacucagguagugcacaauuaaaaaggaagacuggg

SEQ ID NO: 52273 - RNA, 46 nt, Mus musculus
ggacacccuuguuggagaauauagguuuuaccagaaacagucuauc

SEQ ID NO: 52274 - RNA, 46 nt, Mus musculus
ugagggucaaagcagagaauagacuuggccugagugccuggaagua

SEQ ID NO: 52275 - RNA, 46 nt, Mus musculus
acacucaucaguaaauguaacguguuuacagguuucagcagguuag

SEQ ID NO: 52276 - RNA, 45 nt, Mus musculus
ucaugagggaagacugggcgguaaggagucaugguaccccagggc

SEQ ID NO: 52277 - RNA, 46 nt, Mus musculus
acuuuucucaucacugugacagaggaucugauaaacaaccuaaggg

SEQ ID NO: 52278 - RNA, 44 nt, Mus musculus
auuccaucuguggcuggcaaauggacacaaagguauuggauuca

SEQ ID NO: 52279 - RNA, 35 nt, Mus musculus
gguaccaaucauguaccguuguaccuggagguuag

SEQ ID NO: 52280 - RNA, 46 nt, Mus musculus
gaccuguuccuacauaacugcucucaaagugacaucuuguacccag

SEQ ID NO: 52281 - RNA, 42 nt, Mus musculus
aggcccucucuccaacccccacaacaaugaccuucaccccag

SEQ ID NO: 52282 - RNA, 46 nt, Mus musculus
gugcguuauguacacacauacaugagagagagagagagagagagag

SEQ ID NO: 52283 - RNA, 46 nt, Mus musculus
guguaugcuacaucagcaauauauagauauauggauagaugcuuag

SEQ ID NO: 52284 - RNA, 44 nt, Mus musculus
gagaacaccucaaggccuggcaccugugcugcguguggcauggu

SEQ ID NO: 52285 - RNA, 41 nt, Mus musculus
cugucucuccaucucugugucugucucugucucucgugugu

SEQ ID NO: 52286 - RNA, 46 nt, Mus musculus
ugacacugacacauggguaccaaaauggaaaaaaaaaucaggagag

SEQ ID NO: 52287 - RNA, 42 nt, Mus musculus
agaaccaguaucaugaaguccuuccucagaugccaagccuag

SEQ ID NO: 52288 - RNA, 46 nt, Mus musculus
uuuuuuccuaagugauaaugagguuguuaccuauuuuagagguaga

SEQ ID NO: 52289 - RNA, 48 nt, Mus musculus
gaggcuaauaaguucaaucaaagucaccuaucugaagacucauagcca

SEQ ID NO: 52290 - RNA, 42 nt, Mus musculus
gaaacugagcugagcaucuucaaccaaaggaguuagggugau

SEQ ID NO: 52291 - RNA, 46 nt, Mus musculus
caaaggcacugaggagcugaggcucagaagcauguuuaguccacuc

SEQ ID NO: 52292 - RNA, 82 nt, Mus musculus
auuugaaagcuuucagaagucccacccccaccccauccccagaugcuuagaaacuaaagaagcaaugaggaugagcuagccu

SEQ ID NO: 52293 - RNA, 47 nt, Mus musculus
guuuguaagcacccuaguuaauucuggacuacauaugcauagagauu

SEQ ID NO: 52294 - RNA, 46 nt, Mus musculus
uguguauuuaaauauuccuccugccauuuuguaagugauuacgcau

SEQ ID NO: 52295 - RNA, 45 nt, Mus musculus
uccuaccguggaggaggaguuccacugaccuuguguagaaagauc

SEQ ID NO: 52296 - RNA, 46 nt, Mus musculus
cagcccucaaggccuggcgacuuccaggaucuuggaguugcuagag

SEQ ID NO: 52297 - RNA, 45 nt, Mus musculus
caggugacagggguccuugucugggaugagucuuuaggaugggaa

SEQ ID NO: 52298 - RNA, 50 nt, Mus musculus
caaccuuuuaacgugcaagaaaaacugguaacaaaccccaggcuuuauag

SEQ ID NO: 52299 - RNA, 59 nt, Mus musculus
gcaggaaaguugggcgccuuauuuuaaguagagaaaccaagaaaggaagagaaaaaaag

SEQ ID NO: 52300 - RNA, 26 nt, Mus musculus
gaguuguguagaggagacagugacuc

SEQ ID NO: 52301 - RNA, 46 nt, Mus musculus
gaaacagccuccagcaaagucuccugacuacagugugauugcuacc

SEQ ID NO: 52302 - RNA, 42 nt, Mus musculus
uauauuaagacccugucucugaaagacaggaagggagggaaa

SEQ ID NO: 52303 - RNA, 45 nt, Mus musculus
cuaaauguuucaggugguaggacagggugcaggggacucaugaca

SEQ ID NO: 52304 - RNA, 45 nt, Mus musculus
acgacaugaacccgagcaaccuacacuuauucaucagcgccuaca

SEQ ID NO: 52305 - RNA, 45 nt, Mus musculus
uguguguguuuguuuuaaauuacaaaacccugcugguacugaguc

SEQ ID NO: 52306 - RNA, 45 nt, Mus musculus
auggguagugguaagaagaacaggaguucaaagacagccucaacu

SEQ ID NO: 52307 - RNA, 46 nt, Mus musculus
gauuucugugaguuggaaaucaaccuagccuacauaaguuacaggu

SEQ ID NO: 52308 - RNA, 55 nt, Mus musculus
gaugacuaagucuucaaauacaugagccuaugugugugugugugggggggggcau

SEQ ID NO: 52309 - RNA, 46 nt, Mus musculus
cuaucagcgggcuggggauguaggagaaucauuuuaguagcaagga

SEQ ID NO: 52310 - RNA, 46 nt, Mus musculus
caggcuguguccucacagugccccagggacuccccagcaccacagg

SEQ ID NO: 52311 - RNA, 46 nt, Mus musculus
uuuuucugaugucccaaagcugcaguacuucccuuaugaccuagau

SEQ ID NO: 52312 - RNA, 46 nt, Mus musculus
aaguguuuaaaucauguguugaaguggaagcaaagucaguucagug

SEQ ID NO: 52313 - RNA, 45 nt, Mus musculus
aauaggaacuuaccuucuuaccaaguuuugggugaggccaguagg

SEQ ID NO: 52314 - RNA, 46 nt, Mus musculus
gauacuuuuaaagccuuuuuauucuauuagguagcaugagguagca

SEQ ID NO: 52315 - RNA, 45 nt, Mus musculus
aauccaucuuuguagugagauaggaguucaucuaaauaggggaug

SEQ ID NO: 52316 - RNA, 45 nt, Mus musculus
cacuuuguagccaguguucaggaauggucaacgaaaugaacagau

SEQ ID NO: 52317 - RNA, 46 nt, Mus musculus
uuacuaagcuaguuuuguggcucuuauauuuuuauuaaagagagau

SEQ ID NO: 52318 - RNA, 47 nt, Mus musculus
cuagcauggcuguccucugaggcccaagaagcagcugauugagacag

SEQ ID NO: 52319 - RNA, 67 nt, Mus musculus
accugggaggugagauacucucagaacuuaaaaggagggaccuuagaugaaauguccaacagugggg

SEQ ID NO: 52320 - RNA, 47 nt, Mus musculus
agaagcccugagggccagcagaauaaauggagauaugcaaccuugag

SEQ ID NO: 52321 - RNA, 30 nt, Mus musculus
agggcccaugaggacacucacuugggaggg

SEQ ID NO: 52322 - RNA, 41 nt, Mus musculus
aaacagagaauucacaacagaaaaaucucgaauggccaaga

SEQ ID NO: 52323 - RNA, 45 nt, Mus musculus
cagggugaugauggagcuggggcagcuggggcaggagcccuggag

SEQ ID NO: 52324 - RNA, 39 nt, Mus musculus
cuucuucggcccagauuucaucacagucacaaaggagaa

SEQ ID NO: 52325 - RNA, 41 nt, Mus musculus
cuucacaccuucaauucugaauaacugccuggccagagggg

SEQ ID NO: 52326 - RNA, 46 nt, Mus musculus
caaguccuuaaagaaaaacaggaaaacacaaucaaacaggcagaag

SEQ ID NO: 52327 - RNA, 44 nt, Mus musculus
acaaagaaagagagaaggggagauaaggcaaauaaggauaaaga

SEQ ID NO: 52328 - RNA, 46 nt, Mus musculus
gaagaaagaaagaaagaaagaaagaaagaagaaagaagaagaaaga

SEQ ID NO: 52329 - RNA, 39 nt, Mus musculus
ggaggggaaaaaggaggaggaggagauggaggaggugga

SEQ ID NO: 52330 - RNA, 46 nt, Mus musculus
auccaggacugcauugaccacaucacugccuucagcacgggugggg

SEQ ID NO: 52331 - RNA, 61 nt, Mus musculus
agccaccauucuccaccuccgucaccaggaagucagcaccuuucuccuucaccugcaguga

SEQ ID NO: 52332 - RNA, 42 nt, Mus musculus
acguucaucccagacuuaaucaucuccuucagcaucuccaua

SEQ ID NO: 52333 - RNA, 42 nt, Mus musculus
cucugccuucgggagagagcaccuucacaaauggccuuagaa

SEQ ID NO: 52334 - RNA, 45 nt, Mus musculus
auuguuuugggggaaucacauuauugguuuuuuuuuugugugugu

SEQ ID NO: 52335 - RNA, 45 nt, Mus musculus
uuguucucugggcacauccacugaugugcucucuuggggugagag

SEQ ID NO: 52336 - RNA, 42 nt, Mus musculus
cuucagaccccagaaagucugcuccuuuuuguagucaucuau

SEQ ID NO: 52337 - RNA, 57 nt, Mus musculus
ccucucugaauuucauggguuucugucucacaagguuuaacuauuuuauauacacug

SEQ ID NO: 52338 - RNA, 46 nt, Mus musculus
guuugcuauaguguuuucuuuucaccuccuuauguagccccauaac

SEQ ID NO: 52339 - RNA, 46 nt, Mus musculus
acucucugugccucaguuuccccaucuacagaaagcccaugaaccu

SEQ ID NO: 52340 - RNA, 41 nt, Mus musculus
gaauaccacucuguaauugcaaaaaaaaaauugcggcuguu

SEQ ID NO: 52341 - RNA, 82 nt, Mus musculus
aggaugaggaagaggaggaagaagaggaagacgaagaugaagaagaagaugaugaugaugaauaaguugguucuagcgcagu

SEQ ID NO: 52342 - RNA, 23 nt, Mus musculus
cuauuuucaccaagccuugaaua

SEQ ID NO: 52343 - RNA, 42 nt, Mus musculus
guaccccuggggccugucaggacuucccggauaacccagaaa

SEQ ID NO: 52344 - RNA, 45 nt, Mus musculus
cugaagcagcagaccugacauccuggcaccuccuggcccccaggu

SEQ ID NO: 52345 - RNA, 44 nt, Mus musculus
gguaccagcuggaucugcugugucugcaggagugggcugcaucc

SEQ ID NO: 52346 - RNA, 46 nt, Mus musculus
agcccuggacacuggagcagaaugaggaagccagaucguguucugu

SEQ ID NO: 52347 - RNA, 45 nt, Mus musculus
ccugccgcagguacucuuccagguggcucaggaacucccgugggu

SEQ ID NO: 52348 - RNA, 42 nt, Mus musculus
gaguggugguggugguugcuccugugugggggugggggugga

SEQ ID NO: 52349 - RNA, 45 nt, Mus musculus
augggguggggugggccaagcgcuagcuguggaaauagcagcaga

SEQ ID NO: 52350 - RNA, 44 nt, Mus musculus
augagaccagcagccagcugcuccgugcugagagcggccucagu

SEQ ID NO: 52351 - RNA, 45 nt, Mus musculus
cagaugcacaggguccuggagcacaagggccagcagaacccaaag

SEQ ID NO: 52352 - RNA, 45 nt, Mus musculus
gaggauauacccuguucuaggcuggucgccaugacgucuggggcu

SEQ ID NO: 52353 - RNA, 53 nt, Mus musculus
cccccccccccgcacccuccucacccccauccccacccccaccuccaccucca

SEQ ID NO: 52354 - RNA, 69 nt, Mus musculus
cgcugcuaugcuugccuuagugcugucaaggggaaagcugcaacccguuuuauuuaaagaaagcacaag

SEQ ID NO: 52355 - RNA, 45 nt, Mus musculus
accucucucccauuaagagaugggauaaaccgaguucuacagcag

SEQ ID NO: 52356 - RNA, 45 nt, Mus musculus
gaugaaaucgcccugggaagguggaacagacagaaucuaaacaag

SEQ ID NO: 52357 - RNA, 42 nt, Mus musculus
ggugugccgggcuugugaguguggaagguuguugcuauggag

SEQ ID NO: 52358 - RNA, 46 nt, Mus musculus
aguagcauguuucugucaggcauucuugacagugucugggauggag

SEQ ID NO: 52359 - RNA, 45 nt, Mus musculus
ucagggagccccgugcuuuauacacagguccaaagcuugggaugc

SEQ ID NO: 52360 - RNA, 42 nt, Mus musculus
aggugccacaccacagagucuaaacucauuauggcucuagau

SEQ ID NO: 52361 - RNA, 45 nt, Mus musculus
cuacugguggcuuggacaaugccauugagccuagauguaaguaug

SEQ ID NO: 52362 - RNA, 41 nt, Mus musculus
uucuaacaagggcaugguaagcaaauccaguguuagggaag

SEQ ID NO: 52363 - RNA, 42 nt, Mus musculus
uguucagaggcccgaggaaagggcaccagaaaauggucagag

SEQ ID NO: 52364 - RNA, 42 nt, Mus musculus
aaaagagguuuagaggucugagguagggcaggguggggaggg

SEQ ID NO: 52365 - RNA, 25 nt, Mus musculus
ccuccccagagugaggagcgggaag

SEQ ID NO: 52366 - RNA, 45 nt, Mus musculus
ggagguguuccucagguccccagggcccugccccguugccugcag

SEQ ID NO: 52367 - RNA, 46 nt, Mus musculus
gaaugcugaaaccaucuacaaaggggacauaaggcauauuggggag

SEQ ID NO: 52368 - RNA, 45 nt, Mus musculus
ugcccagaagggcugccaacagcacaggcaggaagacucucaugu

SEQ ID NO: 52369 - RNA, 65 nt, Mus musculus
ugaugugcuucucauguaccgaucagaagaacaauauaaacugccuguggccaguuucaugccag

SEQ ID NO: 52370 - RNA, 45 nt, Mus musculus
gcggggcuuuccccauuuccugcuacccugucugucuguccccuc

SEQ ID NO: 52371 - RNA, 43 nt, Mus musculus
gacgccacaccgagauugagauugacauuuucacuggggcaga

SEQ ID NO: 52372 - RNA, 46 nt, Mus musculus
caaucucaaucucgguguggcguccgugaacagcuacugcugccaa

SEQ ID NO: 52373 - RNA, 26 nt, Mus musculus
cugggugugucuaguucccccuccac

SEQ ID NO: 52374 - RNA, 45 nt, Mus musculus
cuucaacagagcagguaugggugaguuugguacuuagcccugacg

SEQ ID NO: 52375 - RNA, 50 nt, Mus musculus
gaaggggugaagaucuccuuggagucucaagaguaccagagucagcgccg

SEQ ID NO: 52376 - RNA, 45 nt, Mus musculus
aggacugccaccccuccagaugaaggcucccacuacccgaugcag

SEQ ID NO: 52377 - RNA, 42 nt, Mus musculus
uuguggcuugcuaaucuugguccuggagucauguggccagca

SEQ ID NO: 52378 - RNA, 45 nt, Mus musculus
gggaagaacccucaggauagggcuguggugggagugagauuagga

SEQ ID NO: 52379 - RNA, 44 nt, Mus musculus
aaacuuauacauaacccacaaaauuuugguguccugcccucagu

SEQ ID NO: 52380 - RNA, 46 nt, Mus musculus
cguuggggugugaggucucagauguucacuuccugcugccugugga

SEQ ID NO: 52381 - RNA, 41 nt, Mus musculus
ccagcuucuggcugccucucauuucccugcuaggacacagc

SEQ ID NO: 52382 - RNA, 46 nt, Mus musculus
gccuccaucagauaaguaugugugugcuuugugugguugugugauu

SEQ ID NO: 52383 - RNA, 42 nt, Mus musculus
gcacuuugugggaacauuuguugucuuuacuuagggggagau

SEQ ID NO: 52384 - RNA, 46 nt, Mus musculus
auugcguuuuagauggccacagagaaaaaauaggcaauuucaagac

SEQ ID NO: 52385 - RNA, 45 nt, Mus musculus
gaggaggcucaucacacaccuugacaaaugugacuucacggagau

SEQ ID NO: 52386 - RNA, 45 nt, Mus musculus
ucuauauugauugaacaguuacagacaaaacacauuauuguaggu

SEQ ID NO: 52387 - RNA, 46 nt, Mus musculus
caugugccauggugcacuguggaagucagaggacaucuuugcagag

SEQ ID NO: 52388 - RNA, 47 nt, Mus musculus
aacacuggagugccccagaaacucugugugugugugugugugugugu

SEQ ID NO: 52389 - RNA, 45 nt, Mus musculus
gcugcuccuuuuccuccaucuccggaguccgcgacgccuagccag

SEQ ID NO: 52390 - RNA, 46 nt, Mus musculus
uuuuaucaauuuauuuguuugagacaggauguauuucuggcuggag

SEQ ID NO: 52391 - RNA, 41 nt, Mus musculus
uuucuuacuccuuggaggccauguaggccauaagguccacc

SEQ ID NO: 52392 - RNA, 46 nt, Mus musculus
gcuacacagagaaacccugucucgaaaaaccaaaagagaaaagaaa

SEQ ID NO: 52393 - RNA, 42 nt, Mus musculus
ccacauacuaacauucuucuccacuaaaaucuaucgggccag

SEQ ID NO: 52394 - RNA, 46 nt, Mus musculus
ucugagguucaguccauuaucaucaaggcaggaagcauggcagugu

SEQ ID NO: 52395 - RNA, 42 nt, Mus musculus
ugcaaggguuccuuccucccaggaauacugggaagccuauga

SEQ ID NO: 52396 - RNA, 46 nt, Mus musculus
uuugccugacgcugaauucucuccuauccagcuguuacccccgaac

SEQ ID NO: 52397 - RNA, 42 nt, Mus musculus
ccagcacggcuguacaguauuuagaaaacuuuaugaacagau

SEQ ID NO: 52398 - RNA, 41 nt, Mus musculus
gaugaguccgcagucccuucccaggccggugagugggcaug

SEQ ID NO: 52399 - RNA, 41 nt, Mus musculus
cgaggccuggcugggggagcuuucguucuaaugggaggagu

SEQ ID NO: 52400 - RNA, 41 nt, Mus musculus
ggccagggaguggcacuauuaggagguguguguggccuugu

SEQ ID NO: 52401 - RNA, 42 nt, Mus musculus
gccaaucugucuucaugaaauucccgagacucagaggcagag

SEQ ID NO: 52402 - RNA, 46 nt, Mus musculus
aauggcggauaaggcuugaacuccgaaugaaggauuucccacacuc

SEQ ID NO: 52403 - RNA, 47 nt, Mus musculus
aggcuuucccacagucuuugcacucaaagggucugucuccagugugg

SEQ ID NO: 52404 - RNA, 44 nt, Mus musculus
cuuucccgcaguaacugcacacauagggcuucuccccgguauga

SEQ ID NO: 52405 - RNA, 50 nt, Mus musculus
uuagacagcuuuuggaccuuggcugcuuucuugucuccuucaguacguac

SEQ ID NO: 52406 - RNA, 46 nt, Mus musculus
aaagucucuuggggccacugguauuuucuucacuauauacucacag

SEQ ID NO: 52407 - RNA, 46 nt, Mus musculus
auuuauguauaugagugcacuguaacugucuucagacacaccagaa

SEQ ID NO: 52408 - RNA, 45 nt, Mus musculus
uagaaagggucuguauaggucaggcuggccuugaauccaagagau

SEQ ID NO: 52409 - RNA, 42 nt, Mus musculus
acugcaggacaugcgacagcagcugcuagagcagcgggagca

SEQ ID NO: 52410 - RNA, 105 nt, Mus musculus
gaguucccaaggaacuguggcccagggagguuuuagcugaggugagacggaagcaagggugaagauuuucagagaggucgaagguugaggagucaggacagggag

SEQ ID NO: 52411 - RNA, 46 nt, Mus musculus
ucucuuggaaaccacuuggagagaaaggguuucugugugccuagug

SEQ ID NO: 52412 - RNA, 46 nt, Mus musculus
gggugaggguggaacaguugcuuccagagcaggauggggauguggg

SEQ ID NO: 52413 - RNA, 42 nt, Mus musculus
agccuaggcccuggggagagcagaggaggcuagggccuugga

SEQ ID NO: 52414 - RNA, 46 nt, Mus musculus
uugggucccagcuaucuaguuucaaucuguucaucuguucccagau

SEQ ID NO: 52415 - RNA, 46 nt, Mus musculus
acuuuguggcauaggugcagaggauggccuuugaaagccccuaacc

SEQ ID NO: 52416 - RNA, 41 nt, Mus musculus
gcuggggacagguacacaagggucauggguggaccaacagg

SEQ ID NO: 52417 - RNA, 46 nt, Mus musculus
uuacuuucuuuuucaguaauuuuuuuuauucacuuuauauccagau

SEQ ID NO: 52418 - RNA, 26 nt, Mus musculus
ccacagggcaugggcacaggguagag

SEQ ID NO: 52419 - RNA, 45 nt, Mus musculus
ugcugugcagaugcgaguguggagggaaagaaugguggagccgga

SEQ ID NO: 52420 - RNA, 42 nt, Mus musculus
aguaucgcagggggaaaaggcucuacccccuacaaaggagau

SEQ ID NO: 52421 - RNA, 50 nt, Mus musculus
gcccaugaggaggaagaggaggaggaggaggagaacagggaugaggagga

SEQ ID NO: 52422 - RNA, 46 nt, Mus musculus
gccuaguggccggcagaggcucauccgcaaagacacgccccacuac

SEQ ID NO: 52423 - RNA, 45 nt, Mus musculus
ggccaggcugccacccucaucuuucuucccacuuagcccacagug

SEQ ID NO: 52424 - RNA, 45 nt, Mus musculus
cggguuccaggguagggcaaauuucacuucucagccaggcucagu

SEQ ID NO: 52425 - RNA, 46 nt, Mus musculus
agguacaagggcuaggccagcaugaggccaugccugcacaggagga

SEQ ID NO: 52426 - RNA, 51 nt, Mus musculus
ggugucccagggccaagugcuaggcacgccaugguggcagagguugggcug

SEQ ID NO: 52427 - RNA, 45 nt, Mus musculus
cugggggcucugccuaaccuucgggagcuaugguuagaccgaaac

SEQ ID NO: 52428 - RNA, 41 nt, Mus musculus
aucucucccugcguaaguuuggggccuccacccagcagagg

SEQ ID NO: 52429 - RNA, 42 nt, Mus musculus
uucugagauaggggacucaguggucugauauucuugccggcu

SEQ ID NO: 52430 - RNA, 46 nt, Mus musculus
uucacuuacccccacuugaagcuucccagagaagaauggaugagaa

SEQ ID NO: 52431 - RNA, 45 nt, Mus musculus
uggaagcugggacuuaccuccugcuccuucaagcuauuggcagaa

SEQ ID NO: 52432 - RNA, 47 nt, Mus musculus
gguuugagacgacacacacacacacacacacacacacacacagagag

SEQ ID NO: 52433 - RNA, 46 nt, Mus musculus
ucucucucucugugugugugugugugugugugugugugugucgucu

SEQ ID NO: 52434 - RNA, 45 nt, Mus musculus
uuuccuugguucuugaacugccucucucccaacuucaaaccaggu

SEQ ID NO: 52435 - RNA, 45 nt, Mus musculus
ccucaagcaccaagagcagaguaagcugcagacggaagggcgugg

SEQ ID NO: 52436 - RNA, 24 nt, Mus musculus
ccugcuguacugugcugucucuag

SEQ ID NO: 52437 - RNA, 42 nt, Mus musculus
uggcuuggaucucgaguacagccaucugggugcagggacaaa

SEQ ID NO: 52438 - RNA, 42 nt, Mus musculus
gagcuaaacagacaaguuucuccaugguccccacacccccag

SEQ ID NO: 52439 - RNA, 46 nt, Mus musculus
uggggggacugcaggcgugcaaaaaacugcaagcauagaggaugag

SEQ ID NO: 52440 - RNA, 44 nt, Mus musculus
aggaggguguagaagugguguggaacgaacuucacuucggggau

SEQ ID NO: 52441 - RNA, 24 nt, Mus musculus
uacuaccgcucuggggaucucccc

SEQ ID NO: 52442 - RNA, 23 nt, Mus musculus
agaggcacguggaggugguccca

SEQ ID NO: 52443 - RNA, 42 nt, Mus musculus
gaauaaaccuguacuugaaaccaguuagaaggaccggcugga

SEQ ID NO: 52444 - RNA, 42 nt, Mus musculus
gccaagcgugccucucugucgguacuggaucgcuacucgccu

SEQ ID NO: 52445 - RNA, 45 nt, Mus musculus
ucucgggguagagacagguccugugaguagguuaaaguucugaga

SEQ ID NO: 52446 - RNA, 41 nt, Mus musculus
uuucuacagagguggagggauguggagagagcaagggaaga

SEQ ID NO: 52447 - RNA, 45 nt, Mus musculus
guugugagccaccaugugguugcugggauuugagcuccagaccuu

SEQ ID NO: 52448 - RNA, 46 nt, Mus musculus
aagaagaagaagaagaagaagaaaagaaagaaagaaagaaagaaag

SEQ ID NO: 52449 - RNA, 45 nt, Mus musculus
guccugucucggcugggggugcucacuggugauugggauguggag

SEQ ID NO: 52450 - RNA, 46 nt, Mus musculus
acauacauaaaauaaauaaaucuuuaagaaagaaagaaagaaagaa

SEQ ID NO: 52451 - RNA, 46 nt, Mus musculus
aaauaucuauuaaauuucaacccacuaaaccuauacagcguuggag

SEQ ID NO: 52452 - RNA, 47 nt, Mus musculus
uuagguguggccuuuguuggaguaggugugguguggccuuguuggag

SEQ ID NO: 52453 - RNA, 46 nt, Mus musculus
uuuucacaagggccuggaucaccaagcaccagaagaagaaggagga

SEQ ID NO: 52454 - RNA, 56 nt, Mus musculus
aaagcagcacgcgggauaaacuguagagggcuugcagcacuggguucgggaaaggu

SEQ ID NO: 52455 - RNA, 42 nt, Mus musculus
ccaguaccguccggcgaagcgaagccgccgccgccgccaugu

SEQ ID NO: 52456 - RNA, 60 nt, Mus musculus
ugcccaacgcugacagcaucaccuuucggccucgagaagggccagacuucgaggacaagg

SEQ ID NO: 52457 - RNA, 45 nt, Mus musculus
cggccagggaaguugucugacuauuuuccaaaaccauacccuaac

SEQ ID NO: 52458 - RNA, 46 nt, Mus musculus
gucauugcgagaaggccucuauuucaacccuuacuuucccggccag

SEQ ID NO: 52459 - RNA, 46 nt, Mus musculus
gacccaugcguuuucgauggucaugcucugguucugaugcccagcg

SEQ ID NO: 52460 - RNA, 47 nt, Mus musculus
uguuguugaugaugggccugcugcugccccugaccuaugccaugaag

SEQ ID NO: 52461 - RNA, 42 nt, Mus musculus
uaucugcuugucaucuugccagaacaagcucucagcagccca

SEQ ID NO: 52462 - RNA, 46 nt, Mus musculus
ggccaggagaccagacucuugcuucugaucuuccuucagcccucag

SEQ ID NO: 52463 - RNA, 46 nt, Mus musculus
caguucccagcacucaacaugguggcucaaaaccaucugucuccag

SEQ ID NO: 52464 - RNA, 46 nt, Mus musculus
cuuauuugaauauguccgggccaccuggucgagguuggggguagug

SEQ ID NO: 52465 - RNA, 45 nt, Mus musculus
gacccugccucaccuguggugcuccuggcagugcacgcggcgguc

SEQ ID NO: 52466 - RNA, 46 nt, Mus musculus
guuucuggccggcggaaguacucgacaguucucuaucacggaagca

SEQ ID NO: 52467 - RNA, 45 nt, Mus musculus
ucagaggagugggguugggcccgucggacgcuuguuguugucggg

SEQ ID NO: 52468 - RNA, 45 nt, Mus musculus
cccucuucuaucugauugccacccucaaugaguccuuccggccag

SEQ ID NO: 52469 - RNA, 44 nt, Mus musculus
gaagucauagucuggccggaaggacucauugaggguggcaauca

SEQ ID NO: 52470 - RNA, 45 nt, Mus musculus
agguggaggcggugagggcagggcagaggagaccagcaccaugga

SEQ ID NO: 52471 - RNA, 45 nt, Mus musculus
ugccucagggcugucuggugcuagagggaagacuacaagagggag

SEQ ID NO: 52472 - RNA, 53 nt, Mus musculus
uggagcccggccucacggcucaggucuuagaguuacuucuggagaagaugagc

SEQ ID NO: 52473 - RNA, 45 nt, Mus musculus
aacuauuucucugugagcaaagacccuguacuggaagccccgucc

SEQ ID NO: 52474 - RNA, 42 nt, Mus musculus
ugaguugcagcuguguggauggaaggaggugacagggcagau

SEQ ID NO: 52475 - RNA, 46 nt, Mus musculus
gaggcuaccaagacaauguacaugccccacaggccacgggucagga

SEQ ID NO: 52476 - RNA, 49 nt, Mus musculus
gcucuuuucugaaaggaaaugaaggaauaguagaucucggagagaaggg

SEQ ID NO: 52477 - RNA, 41 nt, Mus musculus
auauucagggaguggcauuauuagaaggugugaccuuguca

SEQ ID NO: 52478 - RNA, 45 nt, Mus musculus
cacagcugagucuccaugggaaguggaaauagauuugugggugga

SEQ ID NO: 52479 - RNA, 45 nt, Mus musculus
gugaaacaggcuuaaacagaaacaguggagcaaguggacacagga

SEQ ID NO: 52480 - RNA, 44 nt, Mus musculus
cuugcuugacacggaccagagugcugcuggacagaggccugaac

SEQ ID NO: 52481 - RNA, 45 nt, Mus musculus
gcaguuggggacaaagggguauccauggaggaugggcgcccaggg

SEQ ID NO: 52482 - RNA, 45 nt, Mus musculus
ggagugugcaggcagccaggaaccccuccagaacuccaggcccag

SEQ ID NO: 52483 - RNA, 45 nt, Mus musculus
agauccuggcgggcccacagcccuuccagccuucuccauagguag

SEQ ID NO: 52484 - RNA, 41 nt, Mus musculus
agccccggaagccgggcuggaagaauuaggauuuggcagag

SEQ ID NO: 52485 - RNA, 45 nt, Mus musculus
accccuuccugcaaagcccugggcccugccccagcugcaguccag

SEQ ID NO: 52486 - RNA, 46 nt, Mus musculus
cuaggucccaucuuacagaaagguuuagggguugguguugccacug

SEQ ID NO: 52487 - RNA, 46 nt, Mus musculus
ugcugguggggacagcuucuguggugacugggguggaugaggucau

SEQ ID NO: 52488 - RNA, 42 nt, Mus musculus
cgaggucccaacacccguuuccucuuuuguuucugggcccuu

SEQ ID NO: 52489 - RNA, 46 nt, Mus musculus
aaguagcugcucuagacaccacuggacuuccuccaggccccgguag

SEQ ID NO: 52490 - RNA, 49 nt, Mus musculus
cugucguugccucccccgaggucugaagcgcgucuaccggggccuggag

SEQ ID NO: 52491 - RNA, 46 nt, Mus musculus
ggacuucuaagggaauacggucuccccaaccagaguccaggcccug

SEQ ID NO: 52492 - RNA, 46 nt, Mus musculus
uccaguccaggcccgggcccugcccaucgaccccaaagcuuuggag

SEQ ID NO: 52493 - RNA, 46 nt, Mus musculus
uggggguguccuugccuauucccugcccuuggaguauggcccuucu

SEQ ID NO: 52494 - RNA, 45 nt, Mus musculus
cuggccacuucauuggcgguguucugucaugagcugccccaugaa

SEQ ID NO: 52495 - RNA, 46 nt, Mus musculus
uacagagaaacccugucucgaaagaaagaaagaaagagagagagag

SEQ ID NO: 52496 - RNA, 45 nt, Mus musculus
ggaguccagacacauuauuuaccuuagugcugcugcugcccucua

SEQ ID NO: 52497 - RNA, 45 nt, Mus musculus
guucggccucaguagguguuggggaggcugccagagggggcugcg

SEQ ID NO: 52498 - RNA, 42 nt, Mus musculus
uucagcacugucacugugggcccuuuauuuagggcugggggg

SEQ ID NO: 52499 - RNA, 42 nt, Mus musculus
agcuacuguccgaggccugcguuuagugguggcgggggcacc

SEQ ID NO: 52500 - RNA, 46 nt, Mus musculus
acaggacugcagaggcaggucugccugcuaagcgacagcccuacaa

SEQ ID NO: 52501 - RNA, 42 nt, Mus musculus
gcauaugugcucuccagggcccagacggugagggcugaccag

SEQ ID NO: 52502 - RNA, 45 nt, Mus musculus
ggcugaaggaggagcaggccacaugucccaacugucguugugaga

SEQ ID NO: 52503 - RNA, 42 nt, Mus musculus
guuaguacacugcgaagaaggaaagggaggugaagcucacag

SEQ ID NO: 52504 - RNA, 46 nt, Mus musculus
aggcuagcagucugcuccuggugaucccauuuauaucaacccaguu

SEQ ID NO: 52505 - RNA, 45 nt, Mus musculus
uagcaagauagcagcccugagauucccaggaagccacagccccac

SEQ ID NO: 52506 - RNA, 45 nt, Mus musculus
gucucuguggccagagccagcacaggcuuagguggcuuucagggu

SEQ ID NO: 52507 - RNA, 50 nt, Mus musculus
auagaaggccucaagauggggucuuguuacagucaggcccaauaggaagc

SEQ ID NO: 52508 - RNA, 46 nt, Mus musculus
ccuucacauaccgcccaguguggacuuuuguaagauagacucagcc

SEQ ID NO: 52509 - RNA, 42 nt, Mus musculus
ugggaauuggcccugcagguccaaaggcugucucaggcccag

SEQ ID NO: 52510 - RNA, 45 nt, Mus musculus
uucccuguccuaaggacugggagaguccucuagaauaugucauuu

SEQ ID NO: 52511 - RNA, 45 nt, Mus musculus
gggcaucugaagucaggcagcugagggauguacuagaugaaguga

SEQ ID NO: 52512 - RNA, 45 nt, Mus musculus
cugacuccccagggcacaaaagaagauuuacuuaguuguucagau

SEQ ID NO: 52513 - RNA, 45 nt, Mus musculus
acacagaaaaugagauucagagcaagaaaggauaaggagccucga

SEQ ID NO: 52514 - RNA, 46 nt, Mus musculus
guuccuguacuugcaucuuguugaccuuuauaccgucgcgcaagag

SEQ ID NO: 52515 - RNA, 45 nt, Mus musculus
aaccagaaugcuaacaacaggucuucaggacacuuggggccuggg

SEQ ID NO: 52516 - RNA, 42 nt, Mus musculus
gagcagcugccggcuuccugcuccagaccuuugcugccauca

SEQ ID NO: 52517 - RNA, 46 nt, Mus musculus
uaucauucucaggcauggaaggccauaacuaggaccgugcccagac

SEQ ID NO: 52518 - RNA, 24 nt, Mus musculus
agcucuccgaguccagguggccua

SEQ ID NO: 52519 - RNA, 45 nt, Mus musculus
gcugcagggccuucaaggggcccuccggcagcuccagcaggagac

SEQ ID NO: 52520 - RNA, 31 nt, Mus musculus
gacaccccacucacuggaacuuccugcaccc

SEQ ID NO: 52521 - RNA, 46 nt, Mus musculus
aauguuaugcuuugagaaaggaucgccuccacccuuccacccccag

SEQ ID NO: 52522 - RNA, 88 nt, Mus musculus
uuugcccuuaucacagcacacagcagggggccagagcugcaggaaccagaccccagaccaagugguuucccaagucgccacccugccc

SEQ ID NO: 52523 - RNA, 46 nt, Mus musculus
ggugcuacccucuacccaggcauuugagagagggcaagacuucaga

SEQ ID NO: 52524 - RNA, 53 nt, Mus musculus
uaccuccccuugggaacucucccccucuaugauugugggcccaggaagggagc

SEQ ID NO: 52525 - RNA, 46 nt, Mus musculus
gagcccaggaugcuggggccauguggauucuuucccaggguccccu

SEQ ID NO: 52526 - RNA, 47 nt, Mus musculus
guguucugaaggcgcagcgccucagcaggaaucaggcucacauccac

SEQ ID NO: 52527 - RNA, 45 nt, Mus musculus
ugggggcucgggguagucggaguguaaguugaggccaggucccag

SEQ ID NO: 52528 - RNA, 42 nt, Mus musculus
cuuauuaauuuuuuuuaagagagagaauuucagauggcccag

SEQ ID NO: 52529 - RNA, 46 nt, Mus musculus
acgaauuuuuuuccuuguucacccaccugaaguaagcugacuugga

SEQ ID NO: 52530 - RNA, 45 nt, Mus musculus
cccauacuugaaguaauagcuuaaacaaaacaacaacaaccaaga

SEQ ID NO: 52531 - RNA, 41 nt, Mus musculus
aggguucugggcacuaagacccuugcaugaacuugccccag

SEQ ID NO: 52532 - RNA, 45 nt, Mus musculus
ggaaagaguuuauuucuguucacauuucuagguaguaagcugucg

SEQ ID NO: 52533 - RNA, 46 nt, Mus musculus
cuucuucagccucgaucucauuccuguauuuuggucacacccccuu

SEQ ID NO: 52534 - RNA, 46 nt, Mus musculus
cauucuguccucuggcuugcucuguccugccucauuuugcacacug

SEQ ID NO: 52535 - RNA, 46 nt, Mus musculus
cuguuccccacaucccuggccagcucugcccuuuugcagaccucag

SEQ ID NO: 52536 - RNA, 46 nt, Mus musculus
cuuuguguuuauuucagacuccgcuauuagaacugaucgcaagcag

SEQ ID NO: 52537 - RNA, 46 nt, Mus musculus
aggagcugcaggccaccgauguggguuaucggccugaugaccagag

SEQ ID NO: 52538 - RNA, 42 nt, Mus musculus
ucagaagaugaugcauacagcggagaaaucucaaaugccgag

SEQ ID NO: 52539 - RNA, 46 nt, Mus musculus
cauccaaaccaccacacuaaaaguaauguaacuaugaauaagccag

SEQ ID NO: 52540 - RNA, 46 nt, Mus musculus
ggcccugagaccuugcggcaaaggagcccgccugagucuagcagaa

SEQ ID NO: 52541 - RNA, 49 nt, Mus musculus
ugcaauuuugcaaacauugccaugcuagagguuugaguaguggagaacu

SEQ ID NO: 52542 - RNA, 42 nt, Mus musculus
ccaagcgccaggcaguuuccaagggaaggaaacacggcucag

SEQ ID NO: 52543 - RNA, 45 nt, Mus musculus
caccgccacccugcagcagccgcugucugaacugagccguguuuc

SEQ ID NO: 52544 - RNA, 46 nt, Mus musculus
uguagugaaaauguuugucuggauguuccucuuucagcccggagag

SEQ ID NO: 52545 - RNA, 44 nt, Mus musculus
aggaauccagcuucuaguaauauucgcagcauagaaagcccagg

SEQ ID NO: 52546 - RNA, 46 nt, Mus musculus
cauggauacagagaaacaacuguauuuuauagauuauagaggagau

SEQ ID NO: 52547 - RNA, 56 nt, Mus musculus
uauauagcacugggacuccaguguugugaacacugcagaggcaguuucuaguagua

SEQ ID NO: 52548 - RNA, 46 nt, Mus musculus
uugauggugacaauuuucccaaguaauggcaucauuuaggagagaa

SEQ ID NO: 52549 - RNA, 31 nt, Mus musculus
ugucuguguuugugucuguccuugugucuac

SEQ ID NO: 52550 - RNA, 45 nt, Mus musculus
auuuuccacaaugaaagguaucaggaaucagggaagccacacaga

SEQ ID NO: 52551 - RNA, 45 nt, Mus musculus
aauguguaucugaagcugcugacccugaauucuuacagcguagac

SEQ ID NO: 52552 - RNA, 25 nt, Mus musculus
acucuggugugcuguggccaugcua

SEQ ID NO: 52553 - RNA, 46 nt, Mus musculus
agcugaugaaguugauccuaacagcuucucucauuaaccccaaguu

SEQ ID NO: 52554 - RNA, 46 nt, Mus musculus
uaaaaggacuccagaugcuaaagguggucuguguaacccagcagau

SEQ ID NO: 52555 - RNA, 46 nt, Mus musculus
uguauguuucagaauucuuugaauacucaguuaggcaagaacccuu

SEQ ID NO: 52556 - RNA, 46 nt, Mus musculus
uacguggagacuaacgcagguaaagccugccuacagacaccagaag

SEQ ID NO: 52557 - RNA, 46 nt, Mus musculus
ccucaaaccuuugccuugucucaauauccacagcuacagcccccac

SEQ ID NO: 52558 - RNA, 45 nt, Mus musculus
ucugggacugucuguaaucccacuacuguggagguugaagcagga

SEQ ID NO: 52559 - RNA, 42 nt, Mus musculus
aaacugagcugaggagaaguuuuuagacagaacauuuuuuag

SEQ ID NO: 52560 - RNA, 45 nt, Mus musculus
gugcagaaugcagaggaaaagaggaagaaagaggaugucgcagag

SEQ ID NO: 52561 - RNA, 42 nt, Mus musculus
ccugggauuucucaguauccaccaugguuuucaauaaaauga

SEQ ID NO: 52562 - RNA, 41 nt, Mus musculus
uagccccaggcccacaugacagggugcacccagccccggga

SEQ ID NO: 52563 - RNA, 45 nt, Mus musculus
cccugggcagagccgugugcaucucucuuggaaagacuuugaagu

SEQ ID NO: 52564 - RNA, 46 nt, Mus musculus
ggcaaggagcuguucucugaaaugcuggauaaguuggcaaguagug

SEQ ID NO: 52565 - RNA, 45 nt, Mus musculus
uccaaagguaaacuaucuucagcuggcaaagucgcgcccccacca

SEQ ID NO: 52566 - RNA, 45 nt, Mus musculus
guggucacagcacaggagggacagacugagagugaagggcuugug

SEQ ID NO: 52567 - RNA, 45 nt, Mus musculus
gaaaacacagccagcugggaaggacccggccuagggcagcaagga

SEQ ID NO: 52568 - RNA, 46 nt, Mus musculus
gaaaguuaaagacagaaucaguuugugaccgugagagacuggaguc

SEQ ID NO: 52569 - RNA, 46 nt, Mus musculus
gcuggauuagaaagaggauugcgugugugugugugugugugugugu

SEQ ID NO: 52570 - RNA, 46 nt, Mus musculus
gccucaggcccuggugucagcuguccccgaauccuaacccccuuuc

SEQ ID NO: 52571 - RNA, 41 nt, Mus musculus
ggacaguggcuacauuuccccauuauuuucugccuguccca

SEQ ID NO: 52572 - RNA, 45 nt, Mus musculus
gaguucuacaacauugguccucugauucgaaucaucaaagacagg

SEQ ID NO: 52573 - RNA, 42 nt, Mus musculus
cuagcuacccaugcucacaagaugguaucaguagcagcccag

SEQ ID NO: 52574 - RNA, 42 nt, Mus musculus
caggcuggggagcagacaggcaggaccauugcaaggcuccag

SEQ ID NO: 52575 - RNA, 45 nt, Mus musculus
gggcugcccuagucccagucucccgcgcccucuccccaagccccc

SEQ ID NO: 52576 - RNA, 42 nt, Mus musculus
aagacagcaaggcuacaagaugauaucagguugggggcaggg

SEQ ID NO: 52577 - RNA, 46 nt, Mus musculus
cuagaauaucugagaggcucccagaauugaggaugucuuauuauga

SEQ ID NO: 52578 - RNA, 46 nt, Mus musculus
ccacguucuggguagcuuagugguagaccaaguagaucaguagauc

SEQ ID NO: 52579 - RNA, 44 nt, Mus musculus
caugggcacagaaggauccccuauagauuuacuuuuucgggugu

SEQ ID NO: 52580 - RNA, 42 nt, Mus musculus
gugugcgugugcgugugcgugugcguguguguguguggucaa

SEQ ID NO: 52581 - RNA, 46 nt, Mus musculus
gagggagagagagccugggccugcuuugcucuggcugggcggagag

SEQ ID NO: 52582 - RNA, 42 nt, Mus musculus
gcauggucugaccauggcuaaugucugggggaaagaaggggg

SEQ ID NO: 52583 - RNA, 41 nt, Mus musculus
auuugcuuuauugcugggcacagggcaagaacguggagcau

SEQ ID NO: 52584 - RNA, 45 nt, Mus musculus
auauguaagccccaaaguaucagaaaaacgaagcuaagaggagag

SEQ ID NO: 52585 - RNA, 46 nt, Mus musculus
gaaggagcuuaaagugagcggcugccugcuggagguacgcuggauc

SEQ ID NO: 52586 - RNA, 46 nt, Mus musculus
ugaaauagaauaaacaguuaauugaguuacgaguuagucggggaac

SEQ ID NO: 52587 - RNA, 46 nt, Mus musculus
gcaugcuuguauuguuuauguuuauuguggguauuuaucucuagag

SEQ ID NO: 52588 - RNA, 45 nt, Mus musculus
aguuuccuuugguucuuugcugaugaagcaggacuguccccugag

SEQ ID NO: 52589 - RNA, 44 nt, Mus musculus
gggaacuccucaccucuuccauacuccuucucugcagagcuaga

SEQ ID NO: 52590 - RNA, 46 nt, Mus musculus
uagguuuuccuacccaagggcuugcugcucguucauugguggagag

SEQ ID NO: 52591 - RNA, 41 nt, Mus musculus
auacagaaccuggcagggggugcugcuggguaggggugggg

SEQ ID NO: 52592 - RNA, 45 nt, Mus musculus
uagguggaguaaagcuagaacgucacuggacagauggcugugugg

SEQ ID NO: 52593 - RNA, 45 nt, Mus musculus
cucuagcucugauuugggaggggaaggaggagcagggggaggagg

SEQ ID NO: 52594 - RNA, 44 nt, Mus musculus
uggguuggcauccucuuugugaguugggucugugcgugugugau

SEQ ID NO: 52595 - RNA, 45 nt, Mus musculus
ucuagggauucagugagguccaggcugggaaugucagcggcagag

SEQ ID NO: 52596 - RNA, 45 nt, Mus musculus
cccucuacucagggagacacccccacaaagcuccuggccguucug

SEQ ID NO: 52597 - RNA, 41 nt, Mus musculus
cugcgcagccgagaccugcagcuggcgguaggcccaggaga

SEQ ID NO: 52598 - RNA, 42 nt, Mus musculus
acucaguucuugaugacugagguccggaggcuucgggaagcu

SEQ ID NO: 52599 - RNA, 41 nt, Mus musculus
gcgccaccgggucaccggggugggugggcggcgcccgcucc

SEQ ID NO: 52600 - RNA, 27 nt, Mus musculus
guuucuccccagcauugagcaaacgga

SEQ ID NO: 52601 - RNA, 42 nt, Mus musculus
ggguacuggccucucagugacagcugagaaaaagggcuagaa

SEQ ID NO: 52602 - RNA, 42 nt, Mus musculus
ugagacaguccccuuguggagcccccaacacugccgggugaa

SEQ ID NO: 52603 - RNA, 45 nt, Mus musculus
ugugagcuuccucaccugaguguaggaaaucaaacuuggggucuu

SEQ ID NO: 52604 - RNA, 42 nt, Mus musculus
gguaguuccuuccaugugggugucuagcggggccuggaagug

SEQ ID NO: 52605 - RNA, 42 nt, Mus musculus
uuagccugcaggaucucagcuggaacaggaaggcgaggagag

SEQ ID NO: 52606 - RNA, 46 nt, Mus musculus
aaggagagucugaccucgugugucaggugaguaucugugggcaggg

SEQ ID NO: 52607 - RNA, 42 nt, Mus musculus
caaaacacuggaccuaaauggaucuccacacuggggggaccu

SEQ ID NO: 52608 - RNA, 45 nt, Mus musculus
gagccugcugcauaaggguuuuccccaagagguccaggucgucca

SEQ ID NO: 52609 - RNA, 44 nt, Mus musculus
cggaugggcuggggcgccgugcucagcauagagaccaccaccac

SEQ ID NO: 52610 - RNA, 46 nt, Mus musculus
acagugacuagucuucgugccuuuggcuuagaagggugauggucag

SEQ ID NO: 52611 - RNA, 45 nt, Mus musculus
uugagacauuccccagguuugagauucagguugcuggcgaccaga

SEQ ID NO: 52612 - RNA, 44 nt, Mus musculus
aaccugaaucucaaaccuggggaaugucucaaaguucggggaga

SEQ ID NO: 52613 - RNA, 58 nt, Mus musculus
acagcaacaaccugugccuacacuucaauccucgcuucaaugcccauggagacgccaa

SEQ ID NO: 52614 - RNA, 46 nt, Mus musculus
uugguguuacacacaaugguguuggcgucuccaugggcauugaagc

SEQ ID NO: 52615 - RNA, 45 nt, Mus musculus
ggggaaccgaacaccgggaaccugccuuccccuuccagcccggga

SEQ ID NO: 52616 - RNA, 45 nt, Mus musculus
ugugcaucaccuuugaccaggcugaccugaccaucaagcugccag

SEQ ID NO: 52617 - RNA, 46 nt, Mus musculus
agcccucaauaaaggcagcugccucugcuccccauaauccagcccu

SEQ ID NO: 52618 - RNA, 46 nt, Mus musculus
gauggaugaacagccggaccgcauuugucuuaauaaaagccagaaa

SEQ ID NO: 52619 - RNA, 42 nt, Mus musculus
ggaguccuaggcuccgagagaguuuagaggcuccgagauuug

SEQ ID NO: 52620 - RNA, 42 nt, Mus musculus
gagaguucuccuuucccuggucgugacuuagguguaggaggu

SEQ ID NO: 52621 - RNA, 44 nt, Mus musculus
cccggcgcgggucgcgagcugcucugcgcucccagcccccaccg

SEQ ID NO: 52622 - RNA, 45 nt, Mus musculus
aaccugacucgcgaucugcucucccgcuccacuagcaggccagac

SEQ ID NO: 52623 - RNA, 49 nt, Mus musculus
aucggaaggcuccuugaacagugggagcaggccggccaccaugaccgag

SEQ ID NO: 52624 - RNA, 42 nt, Mus musculus
cuuggcccguuugggcuucgccgccggggcggagguggaguu

SEQ ID NO: 52625 - RNA, 79 nt, Mus musculus
aacgggccaaggcuuccaagaaguccacggaccaccccaaguauucagacaugaucguggcugcuauccaggcagagaa

SEQ ID NO: 52626 - RNA, 43 nt, Mus musculus
gagaacgccgacucccagaucaaguuguccaucaagcgccuag

SEQ ID NO: 52627 - RNA, 46 nt, Mus musculus
gcuugagaacaccgguggucacuaggcgcuugauggacaacuugau

SEQ ID NO: 52628 - RNA, 45 nt, Mus musculus
aaagaaggcagccaagcccaagaaggcugccuccaaagccccaag

SEQ ID NO: 52629 - RNA, 46 nt, Mus musculus
caagaagaagccggcugccacgcccaagaaagccaaaaagcccaag

SEQ ID NO: 52630 - RNA, 46 nt, Mus musculus
uucuuacgggguuagggaugggaggggggaggauguguguuucagu

SEQ ID NO: 52631 - RNA, 46 nt, Mus musculus
gcacccuaccccaccccuuuuuaaacaaguguaacuagugcccggg

SEQ ID NO: 52632 - RNA, 46 nt, Mus musculus
gcacauucagcgcuggcucaguugcgcugcauccuggacagcgaac

SEQ ID NO: 52633 - RNA, 42 nt, Mus musculus
gaacaaaacuuuccuugagcagaugugugugaagggcuccag

SEQ ID NO: 52634 - RNA, 46 nt, Mus musculus
aagagcagagggagccauuuugacuuccucaucccuuaugcccaag

SEQ ID NO: 52635 - RNA, 46 nt, Mus musculus
cccuucucugucccacagaagcacaggcugcgccugguggccacag

SEQ ID NO: 52636 - RNA, 45 nt, Mus musculus
ggugcagaucucagcuguacacagugaggaagacauugaccgcug

SEQ ID NO: 52637 - RNA, 41 nt, Mus musculus
ccgugaaagcgagaaugagguggcaacaacgcagacaggca

SEQ ID NO: 52638 - RNA, 46 nt, Mus musculus
agagaugacggcguugaccagggcagugauugccaccagagaagag

SEQ ID NO: 52639 - RNA, 46 nt, Mus musculus
agcagucgggugcccuuacccacugagccaucucaccagcccaaag

SEQ ID NO: 52640 - RNA, 74 nt, Mus musculus
cgaguuugggcagcucccucagacauugugcaccacgggaggcugaugagauggaggaggggcuaaaggugaaa

SEQ ID NO: 52641 - RNA, 24 nt, Mus musculus
uugaguuacagcuccagcccugaa

SEQ ID NO: 52642 - RNA, 45 nt, Mus musculus
gccccucacuugggaaagucuggagcaacgguggcucugggcgcu

SEQ ID NO: 52643 - RNA, 46 nt, Mus musculus
guaaaccccaaacaaccaccacuacaacaaaaaacaccuacccaaa

SEQ ID NO: 52644 - RNA, 74 nt, Mus musculus
ccacuggggcacugauggacgaugcccuucaguuacucccauuauguguagagcgcggacacaggcagaucagg

SEQ ID NO: 52645 - RNA, 89 nt, Mus musculus
auuagcagagaccagaauauuuagucauaaacuaauaagugucagucucaggguggcugguccccaaagucacccagcaccucugaagu

SEQ ID NO: 52646 - RNA, 52 nt, Mus musculus
aauacaguggaggcauggaaguuuguuguggcuggaaugaaggugccaggcu

SEQ ID NO: 52647 - RNA, 42 nt, Mus musculus
ggauguugcugugaaugccuuugcuguuggagcauuacccag

SEQ ID NO: 52648 - RNA, 45 nt, Mus musculus
uaguaaaauggaagucagaguaggccucccucgcugaagcggagg

SEQ ID NO: 52649 - RNA, 46 nt, Mus musculus
cuaugaaggacaacugacuccaucaaggaccccacauaucagagau

SEQ ID NO: 52650 - RNA, 72 nt, Mus musculus
caauggacgcuuccuggauggagggcugcuggccaacaaccccacacuggaugccaugacugaaauccauga

SEQ ID NO: 52651 - RNA, 92 nt, Mus musculus
accuauuccggaauuacgaugcucccgaagccguucgagagccccgcugcaaccaaaacauuaaccugaagccaccgacucagccugcaggu

SEQ ID NO: 52652 - RNA, 25 nt, Mus musculus
ucuaaucaaagaugugaaagaugcu

SEQ ID NO: 52653 - RNA, 44 nt, Mus musculus
agacuuguacucauggacaccaugggacuaaaggagcaggaaga

SEQ ID NO: 52654 - RNA, 83 nt, Mus musculus
uggggagcacaccaagaugacagaugucaaaaaacccaaguaagccauacucucuccuccugcucugccuaagucuggggagc

SEQ ID NO: 52655 - RNA, 42 nt, Mus musculus
cccuguggccaggacuagggcuggccaucuccacagccuccc

SEQ ID NO: 52656 - RNA, 31 nt, Mus musculus
aggauccuaggaaggggaucuguggggaucu

SEQ ID NO: 52657 - RNA, 43 nt, Mus musculus
auccagggggucuccacggagcagggcucugcagcugcaacuc

SEQ ID NO: 52658 - RNA, 41 nt, Mus musculus
cagcuauauuggccacauaggucugaucuuagguagccaga

SEQ ID NO: 52659 - RNA, 62 nt, Mus musculus
cucuguaaugcccgcugcaacaucauggggcccgguggcuuccccauccacacagccaugaa

SEQ ID NO: 52660 - RNA, 78 nt, Mus musculus
cagguaaacaaccaagggcugacuccacugcaccuggccugcaagaugggaaagcaggagauggugcgcguccugcug

SEQ ID NO: 52661 - RNA, 59 nt, Mus musculus
gcaagggugacagugagauccugguggagcugguacaauacugccacgcccagauggau

SEQ ID NO: 52662 - RNA, 58 nt, Mus musculus
agcugugccaacagcacagagaaugaggagggcugcaccccacuacaucuggccugcc

SEQ ID NO: 52663 - RNA, 34 nt, Mus musculus
cggcauccgggagugcuuccaucacagccgcauc

SEQ ID NO: 52664 - RNA, 45 nt, Mus musculus
gaacuuccagcaguucuccucccagcugccgcccuucuacgagag

SEQ ID NO: 52665 - RNA, 41 nt, Mus musculus
guguuggaacaagaagaucagccugcagccuggggcagaga

SEQ ID NO: 52666 - RNA, 41 nt, Mus musculus
ggcacagacaggcuggcuccauugacaaagccgggggaggg

SEQ ID NO: 52667 - RNA, 46 nt, Mus musculus
gguuuugucuuguuuucuaagagauuuauucaugggccagugagau

SEQ ID NO: 52668 - RNA, 44 nt, Mus musculus
gugugccucacugccagcacugcuguguaacaaagcacccagaa

SEQ ID NO: 52669 - RNA, 46 nt, Mus musculus
uucuugguucuagaagaucaggguagaacuccagggcaaggcagag

SEQ ID NO: 52670 - RNA, 45 nt, Mus musculus
acagagcuggugugugugugugugugugugugugugugugugugu

SEQ ID NO: 52671 - RNA, 45 nt, Mus musculus
gggcggccucuggggaaggcaauauacuuucuagaagcccaagaa

SEQ ID NO: 52672 - RNA, 69 nt, Mus musculus
uauuugagugcauauccuuugucuauuaugagagagauguuaaguggggguaggagugauacaggccag

SEQ ID NO: 52673 - RNA, 45 nt, Mus musculus
ccaucuguaauggaauuugauguccucuucuggugcgucugaagu

SEQ ID NO: 52674 - RNA, 45 nt, Mus musculus
cuccagcucccuccgaugaccuggaagcuggcgacuaggagccug

SEQ ID NO: 52675 - RNA, 46 nt, Mus musculus
gcuuccugcguccgucccuuugugcccaaccccugagcccccauuu

SEQ ID NO: 52676 - RNA, 41 nt, Mus musculus
guggagagccguagugucgucacgugggcggggcgcgucag

SEQ ID NO: 52677 - RNA, 79 nt, Mus musculus
gcaggaaccugguggaccaacuggggaaaagcggagagguaucagaggauggcaguggucuggaggggagaaggcaaga

SEQ ID NO: 52678 - RNA, 48 nt, Mus musculus
cguuaggguucuaaguuucccugggcugaaaguccggcucaaauugaa

SEQ ID NO: 52679 - RNA, 86 nt, Mus musculus
gagacuugggaaugccaggcuuucccaagcuaagagucuuuggaacggaucaauggagcucaguugacacauggggaagcugucag

SEQ ID NO: 52680 - RNA, 94 nt, Mus musculus
ccaaguggggccuucuuacagcugccuuaaugaacauuccaagcguggcuuucacagggggaacaguaccccgggacugaauaacaugguagga

SEQ ID NO: 52681 - RNA, 99 nt, Mus musculus
gggagacagcugugugguggggaaagaagcugaaggagagagaaggugacacaaaggguugaggugaggagcuggccagccagagaaagauggauggag

SEQ ID NO: 52682 - RNA, 43 nt, Mus musculus
agccagaguccagcuccucuucccugggaaauacgugggcccu

SEQ ID NO: 52683 - RNA, 46 nt, Mus musculus
uggcccaucucuucugugccuuagucacauaugaaagccccucccc

SEQ ID NO: 52684 - RNA, 41 nt, Mus musculus
gcuccauugaggaggugguggggaacccaagcccuggcaca

SEQ ID NO: 52685 - RNA, 45 nt, Mus musculus
ccugggggcuggcucugguccuugcagcaugccagacaggccuag

SEQ ID NO: 52686 - RNA, 46 nt, Mus musculus
accugcccagaaugugacaaaacucacacuggacaagggugaccag

SEQ ID NO: 52687 - RNA, 44 nt, Mus musculus
ccuccccaacaagauaucugccgagcugucaggcccagcccacc

SEQ ID NO: 52688 - RNA, 43 nt, Mus musculus
ucgcagagaugugacagcuacagccgcuguccucugccccugc

SEQ ID NO: 52689 - RNA, 45 nt, Mus musculus
auaaaagggcagcagccaugcugugcugguugcucugcuccccag

SEQ ID NO: 52690 - RNA, 63 nt, Mus musculus
caucuccagcagccucaaagagaccaugaacccacacgauauugugcaggacgccauccacaa

SEQ ID NO: 52691 - RNA, 46 nt, Mus musculus
cugcacaauaucguguggguucauggucucuuugaggcugcuggag

SEQ ID NO: 52692 - RNA, 38 nt, Mus musculus
ucccuguaggcauagcuccagcagaccuaggagaagug

SEQ ID NO: 52693 - RNA, 46 nt, Mus musculus
accaugggucccugugguuggcauggggagucuuagggacccacaa

SEQ ID NO: 52694 - RNA, 42 nt, Mus musculus
caccagggcuaugggauacugccuuagcaacaaggauuagag

SEQ ID NO: 52695 - RNA, 46 nt, Mus musculus
uggcccugcggcaugccuucaccuacaaggucuacgcugacaagag

SEQ ID NO: 52696 - RNA, 41 nt, Mus musculus
augaaguccugguagccggcagccacggugcccucacccac

SEQ ID NO: 52697 - RNA, 46 nt, Mus musculus
caugcugcuggccaucuuagagaagugcggggccauccccaagauc

SEQ ID NO: 52698 - RNA, 50 nt, Mus musculus
uuugccacaagggagcugcucagccccuacagcccuguccucaaguucuu

SEQ ID NO: 52699 - RNA, 45 nt, Mus musculus
gacagggcuguaggggcugagcagcucccuuguggcaaaguagaa

SEQ ID NO: 52700 - RNA, 52 nt, Mus musculus
ucauggccgucagcaccguuauacuccaggccuuuggcaaguaccgggacgg

SEQ ID NO: 52701 - RNA, 42 nt, Mus musculus
cgaacucagaaauccgucugccucugccuuccaagugcuggg

SEQ ID NO: 52702 - RNA, 42 nt, Mus musculus
acgugcugccucuggggaaagaccuacuccaucggauuccug

SEQ ID NO: 52703 - RNA, 45 nt, Mus musculus
gugcuaugaguaccucgggggagagagugccaucaugucugagau

SEQ ID NO: 52704 - RNA, 46 nt, Mus musculus
ucuccagcauuaucaccuauggcaaaggccagggcaggccacaggc

SEQ ID NO: 52705 - RNA, 46 nt, Mus musculus
ugggcagcugcuuacccuccucgauguuagaaucuacuuugcuauc

SEQ ID NO: 52706 - RNA, 44 nt, Mus musculus
aguggaucugaguaaagggagagagaggccugaaggaagaggag

SEQ ID NO: 52707 - RNA, 45 nt, Mus musculus
cucuuuuuaaguuacauucgugugugugugugugugugugugugu

SEQ ID NO: 52708 - RNA, 46 nt, Mus musculus
cuuucauuuccuuugguuuggggcagguccuuaugcagccccuuau

SEQ ID NO: 52709 - RNA, 46 nt, Mus musculus
gauaggaccuguaguacauggggacacaggaggggagcuaccaggc

SEQ ID NO: 52710 - RNA, 44 nt, Mus musculus
gaggcuaagcaggcacaaaaauacauccccaaucuaguccgugu

SEQ ID NO: 52711 - RNA, 45 nt, Mus musculus
uagccaucucuccagcccuagccucaaacucccgugccccugaaa

SEQ ID NO: 52712 - RNA, 46 nt, Mus musculus
gaagaucucauguagccugggcuggccucagacuuuuugguuagug

SEQ ID NO: 52713 - RNA, 42 nt, Mus musculus
cagcgccacaucgugcgcauccucuucaucgugcccaucuac

SEQ ID NO: 52714 - RNA, 41 nt, Mus musculus
cgauguggcgcugcucauugggacggcuguagcagcgcaga

SEQ ID NO: 52715 - RNA, 45 nt, Mus musculus
ccggcuucuuuguguggacagcucugcucaucacuugccaccagg

SEQ ID NO: 52716 - RNA, 42 nt, Mus musculus
uggcaagugaugagcagagcuguccacacaaagaagccggag

SEQ ID NO: 52717 - RNA, 42 nt, Mus musculus
cagggugcuccauggcuguggggcugcccucggggguggcag

SEQ ID NO: 52718 - RNA, 45 nt, Mus musculus
cagacccagcgucacccacaaccacaacagcuucaccuagcgucu

SEQ ID NO: 52719 - RNA, 42 nt, Mus musculus
aauagcuagggcaugugaaauggccuggaguauccgguuggg

SEQ ID NO: 52720 - RNA, 46 nt, Mus musculus
aaaacagaagggggagcugaauuggaaagccccaggccagcgagag

SEQ ID NO: 52721 - RNA, 41 nt, Mus musculus
ugcagugcgcauguuccgucugugucagacuuccugcaguu

SEQ ID NO: 52722 - RNA, 42 nt, Mus musculus
ucaaaacaauugcagccuggauaaaggaggagaaagcaggag

SEQ ID NO: 52723 - RNA, 45 nt, Mus musculus
cuccgccuugacuugucugcagugugcauuucugaaccuccagaa

SEQ ID NO: 52724 - RNA, 48 nt, Mus musculus
cuuuccucugccauuucuucccccaccacaagcgccauugccaacagu

SEQ ID NO: 52725 - RNA, 42 nt, Mus musculus
gccgagauggggacagucacuggagcuuauguacggcuaggc

SEQ ID NO: 52726 - RNA, 45 nt, Mus musculus
gccuagccguacauaagcuccagugacuguccccaucucggccac

SEQ ID NO: 52727 - RNA, 40 nt, Mus musculus
aguaugcaccaguaugcaggggagcaucaggugggcccag

SEQ ID NO: 52728 - RNA, 41 nt, Mus musculus
ugaguguuugcaugacugugaugucccacagcuguggcagg

SEQ ID NO: 52729 - RNA, 46 nt, Mus musculus
ugcccccauccucuaugacuggcuggcuacagggugaugcuuagau

SEQ ID NO: 52730 - RNA, 46 nt, Mus musculus
agguggagagggaggcaggaccuucagauaguggguccauguggag

SEQ ID NO: 52731 - RNA, 47 nt, Mus musculus
guacacacaccccuguuucuuuuacagccugaagucugggcagagau

SEQ ID NO: 52732 - RNA, 47 nt, Mus musculus
aggcuggucaccagggugagagccagguuggcaggucucaagguugu

SEQ ID NO: 52733 - RNA, 46 nt, Mus musculus
uguaugaguuuugccucaugccugcaugcgucuagcguacccaggg

SEQ ID NO: 52734 - RNA, 45 nt, Mus musculus
guuacuuuggagguugaggcaggaggauggguucaaggcuggucu

SEQ ID NO: 52735 - RNA, 45 nt, Mus musculus
cuacauauugagacuuucucucaaacaauaaagcaauagauagau

SEQ ID NO: 52736 - RNA, 42 nt, Mus musculus
cagaacaaagaaguuucaguucaguggggccaaaugacagag

SEQ ID NO: 52737 - RNA, 41 nt, Mus musculus
aggcuucaguacaaagggacagucgagccaaagcuggguga

SEQ ID NO: 52738 - RNA, 45 nt, Mus musculus
uggugggguguguguguguguguguguguguguguguguuggcug

SEQ ID NO: 52739 - RNA, 44 nt, Mus musculus
cagagccgaugccaucugggagcagacuccaagaacuugccuaa

SEQ ID NO: 52740 - RNA, 45 nt, Mus musculus
cccucagggucucuguagagaggugacaggugugugugggggaga

SEQ ID NO: 52741 - RNA, 45 nt, Mus musculus
uggcaugugacccaguguccuuagaggaguguuggcagccuucag

SEQ ID NO: 52742 - RNA, 41 nt, Mus musculus
gucggcccgugagaucgcucugggagaaguauugccuggaa

SEQ ID NO: 52743 - RNA, 41 nt, Mus musculus
uaugcgggcccagcgcaaggccaagggcgggggcagggugg

SEQ ID NO: 52744 - RNA, 38 nt, Mus musculus
gaagacguagucguaggagaaacccugccggugaaaga

SEQ ID NO: 52745 - RNA, 44 nt, Mus musculus
agucaaugauguacaccagguugccuuucuuccccaggcccaug

SEQ ID NO: 52746 - RNA, 25 nt, Mus musculus
uaaugauuucuagccuaggcuauag

SEQ ID NO: 52747 - RNA, 34 nt, Mus musculus
uacggagucuuuguguguuucgggggagcagcau

SEQ ID NO: 52748 - RNA, 46 nt, Mus musculus
cacugcgagcaguccacugggagagccgacgagugaccugucccag

SEQ ID NO: 52749 - RNA, 46 nt, Mus musculus
agcggccugggaccuaagugauuagucaaagccuucugacccccag

SEQ ID NO: 52750 - RNA, 46 nt, Mus musculus
ugcugcagcgccaggagaggcauucagcucauuuaacccucuccag

SEQ ID NO: 52751 - RNA, 45 nt, Mus musculus
gcuggugauaucagccuggcccagggauguggagcuggcucugag

SEQ ID NO: 52752 - RNA, 47 nt, Mus musculus
aaauaucuggaggcuggguugaugauuucaguccccggguuaauaag

SEQ ID NO: 52753 - RNA, 63 nt, Mus musculus
agaggaugggcaggguaugugcucaagguacaggguacgguguugagaacacccgugcaaaua

SEQ ID NO: 52754 - RNA, 65 nt, Mus musculus
cguagaagccacagggcauagggcauguccugggaaggacacaggaggaagaggaauccagaagg

SEQ ID NO: 52755 - RNA, 41 nt, Mus musculus
aaugcccugccuuagggagcugaccuacugagagaccagca

SEQ ID NO: 52756 - RNA, 46 nt, Mus musculus
cacuauggguagaacccugagccuacaagguuaagaggacuggagg

SEQ ID NO: 52757 - RNA, 46 nt, Mus musculus
agucacuacaggggucacaggaugcagacccuguguucacuuggaa

SEQ ID NO: 52758 - RNA, 46 nt, Mus musculus
agagaggcuaaagaauacuggggcguggugacuggaggggugugag

SEQ ID NO: 52759 - RNA, 42 nt, Mus musculus
ucuuucacuaauaaaaccccugguuguagcggcacaagccug

SEQ ID NO: 52760 - RNA, 46 nt, Mus musculus
ggccaacuggaucaggcgguaccagacagagaacuucuaugaccag

SEQ ID NO: 52761 - RNA, 46 nt, Mus musculus
gauaccuagcccaucugcccaaggauggugcccuacaagugccaag

SEQ ID NO: 52762 - RNA, 48 nt, Mus musculus
ccaugagcacuucuucaagcuucacuaaugcuccgcagucacucgcac

SEQ ID NO: 52763 - RNA, 45 nt, Mus musculus
acugaaggccaccuaagagcaagccuagaaucggguuucuccagc

SEQ ID NO: 52764 - RNA, 46 nt, Mus musculus
uaugccauggccugaaacuccacucacuaacugggagagucagcag

SEQ ID NO: 52765 - RNA, 46 nt, Mus musculus
auagagaacagugaaaugaggucgcugaucuguuugacuuuaggag

SEQ ID NO: 52766 - RNA, 42 nt, Mus musculus
cucugaaaauugauaguauauuuaaaaaaggaguuucuggag

SEQ ID NO: 52767 - RNA, 45 nt, Mus musculus
aaggacaacuugcaaguuucuuugaauuauaaauauacacugaag

SEQ ID NO: 52768 - RNA, 45 nt, Mus musculus
ccaugaaccuggcggggcagagccugaaguuugaaaacggccagu

SEQ ID NO: 52769 - RNA, 46 nt, Mus musculus
ggguguggaccggagggaaacucagcgccugcgcaaacgaaaccaa

SEQ ID NO: 52770 - RNA, 46 nt, Mus musculus
gagcauuaacaggcccuggcucccuugggcaggggauagggaggag

SEQ ID NO: 52771 - RNA, 45 nt, Mus musculus
guaggcuaaccuuccacauggcuguacuccagcauuggagugaga

SEQ ID NO: 52772 - RNA, 46 nt, Mus musculus
ugaccuuaaugguuuuuuacugagauuuguuuuuauuuuguaugaa

SEQ ID NO: 52773 - RNA, 41 nt, Mus musculus
ggcagcgaucgaggcgggagcgggaagcgcgggaggccggg

SEQ ID NO: 52774 - RNA, 46 nt, Mus musculus
cgguguacgaaucaguucucuccuucacuaggugaguccuggggau

SEQ ID NO: 52775 - RNA, 44 nt, Mus musculus
gucucuaauuuaugccuaugcaaaaaauaaaggaugcccaggau

SEQ ID NO: 52776 - RNA, 71 nt, Mus musculus
ucuccugauucagugccaauagccacaguguggcucaagauacagguagaggggcuacacuagcccacccc

SEQ ID NO: 52777 - RNA, 86 nt, Mus musculus
ucccagugcugggaccacugcuuuuuuuccugauguggggugagggucuauucuguuucccauuccugcugcauccugccugugcc

SEQ ID NO: 52778 - RNA, 46 nt, Mus musculus
cagcugggacugucccuggcaagugccugguaaaggacaccgaggc

SEQ ID NO: 52779 - RNA, 46 nt, Mus musculus
gcuacagugaggacaggauuggaaugguggauuacgcccuggaauc

SEQ ID NO: 52780 - RNA, 46 nt, Mus musculus
uuggagacaggggugcgcgcagcgggcuccugcagagagaugagau

SEQ ID NO: 52781 - RNA, 41 nt, Mus musculus
ugcugcccugggcccaugcucugucuuuccucuggcccacc

SEQ ID NO: 52782 - RNA, 41 nt, Mus musculus; identical to SEQ ID NO: 52781

SEQ ID NO: 52783 - RNA, 41 nt, Mus musculus; identical to SEQ ID NO: 52781

SEQ ID NO: 52784 - RNA, 41 nt, Mus musculus; identical to SEQ ID NO: 52781

SEQ ID NO: 52785 - RNA, 41 nt, Mus musculus; identical to SEQ ID NO: 52781

SEQ ID NO: 52786 - RNA, 41 nt, Mus musculus; identical to SEQ ID NO: 52781

SEQ ID NO: 52787 - RNA, 41 nt, Mus musculus
cgugugugugugugucugugugagugugugucuguguguga

SEQ ID NO: 52788 - RNA, 45 nt, Mus musculus
acauagcaguuacacaaccaauauuuguuaacagaaguaaggcag

SEQ ID NO: 52789 - RNA, 45 nt, Mus musculus
ggccacgggucucaacacagcagugccacuuaugaggccauggug

SEQ ID NO: 52790 - RNA, 41 nt, Mus musculus
gccuccauaugggaggaagaggaaccuggcacacugccuga

SEQ ID NO: 52791 - RNA, 46 nt, Mus musculus
ccaugucaccugcucuccaggccugugucuguauucccagcuauuu

SEQ ID NO: 52792 - RNA, 45 nt, Mus musculus
uuacagaggaagagggguuguuagagaugacgcgcuuccacacag

SEQ ID NO: 52793 - RNA, 45 nt, Mus musculus
gcugcaccagaauacagggucauaagaaucucucuuccuuucugu

SEQ ID NO: 52794 - RNA, 45 nt, Mus musculus
agcucagcugccugccguguucucccuucccuuagaggccugaga

SEQ ID NO: 52795 - RNA, 42 nt, Mus musculus
auaagcaacaucucucaagugauuuuugaauggccagcaugg

SEQ ID NO: 52796 - RNA, 42 nt, Mus musculus
aagaacacaauugagaaaggaggggggaaaaaaagcuggggg

SEQ ID NO: 52797 - RNA, 41 nt, Mus musculus
ugaggucauaacagacaaaaagaagaaauuaggggguggag

SEQ ID NO: 52798 - RNA, 26 nt, Mus musculus
ggccucggcuccggcccccgcgggag

SEQ ID NO: 52799 - RNA, 46 nt, Mus musculus
aacacagugcuuacuguuaacagcauccgugaucccgucugggcca

SEQ ID NO: 52800 - RNA, 45 nt, Mus musculus
ggugauucugcggaaggcacaguucagaagguauagagccaugag

SEQ ID NO: 52801 - RNA, 68 nt, Mus musculus
ugcagggucaacguaguaggagugcagggucaacauaguaggucaaguagaggggaagacaaagaaag

SEQ ID NO: 52802 - RNA, 45 nt, Mus musculus
aaacacaaguggccccuggugugaggugagauagagucauugguu

SEQ ID NO: 52803 - RNA, 45 nt, Mus musculus
uugaucucauggugcauucugggccaacaggaaggagcuguuaac

SEQ ID NO: 52804 - RNA, 56 nt, Mus musculus
uuguuaacagcuccuuccuguuggcccagaaugcaccaugagaucaagugacugcc

SEQ ID NO: 52805 - RNA, 42 nt, Mus musculus
cagucaccaaaaaucagucagguccccugaaagagcagucag

SEQ ID NO: 52806 - RNA, 42 nt, Mus musculus
gccaaaugccaaagugaaagccggccagcucagagaggcaga

SEQ ID NO: 52807 - RNA, 46 nt, Mus musculus
cucuugaccugucuuugacuuuauuuaacucuuguuucccggaaag

SEQ ID NO: 52808 - RNA, 46 nt, Mus musculus
caauguaaucaaauauccuucgacaccuggaauacagagccaggac

SEQ ID NO: 52809 - RNA, 46 nt, Mus musculus
agaugucacagaucuggcaagaacaagaaauagcucaggugcggua

SEQ ID NO: 52810 - RNA, 45 nt, Mus musculus
uggauaucuacuguguaucccacccucuguaagcuuuacccugag

SEQ ID NO: 52811 - RNA, 45 nt, Mus musculus
uuggaaaguagggccuuugucuuauucaccaccuuaccucucuag

SEQ ID NO: 52812 - RNA, 45 nt, Mus musculus
gaauacacuguagcugucuuuagacacaccagaagagggcauggg

SEQ ID NO: 52813 - RNA, 45 nt, Mus musculus
uauuuucuacaaguuguccucugacuuccauguugauugggcaca

SEQ ID NO: 52814 - RNA, 45 nt, Mus musculus
cuguagcucaguaggacagugaugacuaagucuugccuuuugggg

SEQ ID NO: 52815 - RNA, 45 nt, Mus musculus
uucaaaucccagcaaccacaugguggcucacaaccaucaguaagg

SEQ ID NO: 52816 - RNA, 45 nt, Mus musculus
uacauaugauaaauaaaucuuuaaaaaaaaaaaauaucuucgagg

SEQ ID NO: 52817 - RNA, 41 nt, Mus musculus
guuucuugggcuugugggaaucagucauuagcuaggaggaa

SEQ ID NO: 52818 - RNA, 45 nt, Mus musculus
gacagcuacaguguacuuacauauaacaaacaaacaaacaaauaa

SEQ ID NO: 52819 - RNA, 45 nt, Mus musculus
ggaagagcagugacgggcagagguuccaaggagcaaauggguuuc

SEQ ID NO: 52820 - RNA, 103 nt, Mus musculus
aagaagaagaacucugaguuguccuaccgugagauuauaaagaacagcuccaacgaugagaccaucgcugccaaacagguaacauggggcagccagccaguca

SEQ ID NO: 52821 - RNA, 41 nt, Mus musculus
uaaaggucccagugugggggaaggacauggagauggcccca

SEQ ID NO: 52822 - RNA, 45 nt, Mus musculus
gcccuggugucacccucuggggacacacugcaguaguccagucuu

SEQ ID NO: 52823 - RNA, 44 nt, Mus musculus
ucuaggagggugccagggccacgcuccuuacucucccacuccca

SEQ ID NO: 52824 - RNA, 46 nt, Mus musculus
ggcaggaccuguuacuaugccagugugccccccccccccccaggag

SEQ ID NO: 52825 - RNA, 41 nt, Mus musculus
auuuugcguguggcacgccacuuccagugcacagaccccaa

SEQ ID NO: 52826 - RNA, 44 nt, Mus musculus
agccaccggcgccgggccaaggcccugcuggacuuugagcggca

SEQ ID NO: 52827 - RNA, 47 nt, Mus musculus
ggagugccagccauaugguauacuauacuaaccaaaaaccuugggaa

SEQ ID NO: 52828 - RNA, 42 nt, Mus musculus
caccgccucguucgccuccuggcccgggcuccgcggcucgcc

SEQ ID NO: 52829 - RNA, 46 nt, Mus musculus
ggacacaaggaaaaagaaagaagguucuggagaacagaguccccag

SEQ ID NO: 52830 - RNA, 45 nt, Mus musculus
ccuccgaauguuaaugugucuaggugaugucagugggagcuggga

SEQ ID NO: 52831 - RNA, 76 nt, Mus musculus
ccaagccaaacugccugggaaacuuuaucuuacaguucuuggugauaagaucugcagucggcuuugccugaagagg

SEQ ID NO: 52832 - RNA, 45 nt, Mus musculus
gaggggccagcaggaaggccgacauggcagguugucagcuucuag

SEQ ID NO: 52833 - RNA, 45 nt, Mus musculus
ccaagauguuccuuguucauuguuguccaccagaguauauugagu

SEQ ID NO: 52834 - RNA, 44 nt, Mus musculus
ggcccucaugccccaaugaaacauaagaugaauacccugugucg

SEQ ID NO: 52835 - RNA, 46 nt, Mus musculus
cucucucucccccgccccuuccucccuucucucccaggccccagag

SEQ ID NO: 52836 - RNA, 44 nt, Mus musculus
uccagucggcauggagaggugaguuuuggggcccagggaguuag

SEQ ID NO: 52837 - RNA, 46 nt, Mus musculus
uuuacucuuauuauuacuaauaauaauaacguaaucauaccucuag

SEQ ID NO: 52838 - RNA, 46 nt, Mus musculus
gguguggggcaaucucccuugcgucuggagguuugggugugcgcgc

SEQ ID NO: 52839 - RNA, 42 nt, Mus musculus
uuagggucccccuuuccuuuuguauucgcuuugaauccgcag

SEQ ID NO: 52840 - RNA, 45 nt, Mus musculus
cagagaaacccugucucaaaaaaugaacaguuggacagugguaga

SEQ ID NO: 52841 - RNA, 139 nt, Mus musculus
gcacacacacaauuagucuuuuaaaacugaaaucaagaauuuaggaagaaaaaaaaagaguucuauaguuaguguacuaagaggaggcaagauggcaccuggaaauguugaggaauguuuccugaaggagguagagcuu

SEQ ID NO: 52842 - RNA, 45 nt, Mus musculus
ucuguaaugggauccaaugcccucuucugguguaucugaagagag

SEQ ID NO: 52843 - RNA, 42 nt, Mus musculus
uccauuggagagauuaggacaaacgguuuauacaugggcuag

SEQ ID NO: 52844 - RNA, 45 nt, Mus musculus
uuauucuauuaguugggaaaauuaacugguagagaaaaauguuua

SEQ ID NO: 52845 - RNA, 46 nt, Mus musculus
accaggcaggacuugaaaucaaagauccuccuaccucugccucccg

SEQ ID NO: 52846 - RNA, 44 nt, Mus musculus
ggcugguugcugaguuaggguauugagugagucagggggaugua

SEQ ID NO: 52847 - RNA, 42 nt, Mus musculus
cauuacagaugguugugagcugggauuugaacucaggaccuc

SEQ ID NO: 52848 - RNA, 41 nt, Mus musculus
cugcagacacugauggagaggcagaaacggaaggcggacau

SEQ ID NO: 52849 - RNA, 42 nt, Mus musculus
gcuccccagcccugcuccccuccacucccacgaugccccugu

SEQ ID NO: 52850 - RNA, 46 nt, Mus musculus
guacccucagggccaaacauggccaaugucucccuauuguagccgg

SEQ ID NO: 52851 - RNA, 54 nt, Mus musculus
guacggggauaacugcaccuucgccuaccaucaggaggagaucgauguguggac

SEQ ID NO: 52852 - RNA, 46 nt, Mus musculus
gucuagagaaagaugucuauggcuagccuuuucacaucucccccag

SEQ ID NO: 52853 - RNA, 45 nt, Mus musculus
gaucugcuucgacagcaagccccggaucaucagcaaagggaccaa

SEQ ID NO: 52854 - RNA, 45 nt, Mus musculus
ugccuggugcacaucguccgcuccaccucucucaaguacuccaag

SEQ ID NO: 52855 - RNA, 45 nt, Mus musculus
uaaauugucucuuggacuugaaguagaggugucgaugagugggca

SEQ ID NO: 52856 - RNA, 45 nt, Mus musculus
aucguucaggaauccaagaaauacuggcaacagauggaagcccac

SEQ ID NO: 52857 - RNA, 42 nt, Mus musculus
gccaaggucaccucccacuccccaaagugacggcuggggcaa

SEQ ID NO: 52858 - RNA, 45 nt, Mus musculus
agugucugaagacagcuacaguguacuuacauauaagaaaaaaua

SEQ ID NO: 52859 - RNA, 42 nt, Mus musculus
cagaugaaguuugugugcggucaguguuggaggaaugggcag

SEQ ID NO: 52860 - RNA, 23 nt, Mus musculus
acugcuggcucugcggcaagaac

SEQ ID NO: 52861 - RNA, 41 nt, Mus musculus
ucggggguggguugggggcaggggacuaccccaucaggcag

SEQ ID NO: 52862 - RNA, 46 nt, Mus musculus
gugauuugcccaggguuuuuagcccucucugguacagaacugggau

SEQ ID NO: 52863 - RNA, 52 nt, Mus musculus
augagcucagguucugacaaggugcaaagcguggggaggcucugaggaauau

SEQ ID NO: 52864 - RNA, 47 nt, Mus musculus
ccucucuuuccugggaacccucugugguccucucuaaaagacccaga

SEQ ID NO: 52865 - RNA, 71 nt, Mus musculus
aguaugucugcaccuuucccccacccccacagguagacacagccuccccuggcuacccaagacauuccaga

SEQ ID NO: 52866 - RNA, 42 nt, Mus musculus
gcucccuuacauucuagaccuauguccccccccauggaagag

SEQ ID NO: 52867 - RNA, 46 nt, Mus musculus
agauguuuuaauaacaauuuuuguccuucuuaaaauaaaaugagag

SEQ ID NO: 52868 - RNA, 25 nt, Mus musculus
gcaaggccugagaugacaacaacaa

SEQ ID NO: 52869 - RNA, 47 nt, Mus musculus
ccggcucaccaagcacgaggagaagcugaagaccaagaagcagcagc

SEQ ID NO: 52870 - RNA, 44 nt, Mus musculus
gccugucacuuuggcgacccgaagcugggacaauuccaccuuca

SEQ ID NO: 52871 - RNA, 46 nt, Mus musculus
gacugcgcggcaagaagaaggaggagcuguugaaacaacugggcga

SEQ ID NO: 52872 - RNA, 42 nt, Mus musculus
cauuucggcguuguucauggcugaagcagccugguucgagag

SEQ ID NO: 52873 - RNA, 45 nt, Mus musculus
ccucccuccgccccuuugggaucaguguguugaggcucaccggga

SEQ ID NO: 52874 - RNA, 46 nt, Mus musculus
ucuucucauucucccagcuaggaaaaggauucgcccaggcacagag

SEQ ID NO: 52875 - RNA, 41 nt, Mus musculus
agcggagcggccuagcuguggaggaugugcgugccaacgug

SEQ ID NO: 52876 - RNA, 45 nt, Mus musculus
agauccucacagaucaccuuccugaaacacaaggcuugcccagau

SEQ ID NO: 52877 - RNA, 41 nt, Mus musculus
gcugcuuaacagaucuguuuguucuuuuuuggaaggguagu

SEQ ID NO: 52878 - RNA, 46 nt, Mus musculus
uguuaaaaugcccccaccuacccacauuuaccugaagcauggagau

SEQ ID NO: 52879 - RNA, 41 nt, Mus musculus
ccccaggaucaaagagagugauggagagcgaaacaggggcg

SEQ ID NO: 52880 - RNA, 37 nt, Mus musculus
cgucagaacugaagagucaugccgucuaggucuuagg

SEQ ID NO: 52881 - RNA, 42 nt, Mus musculus
auggcagagaaggggcauuacuuaaaggacucugucacagau

SEQ ID NO: 52882 - RNA, 42 nt, Mus musculus
agggcgggaaugacuuugagaucuaugcggacccccggacug

SEQ ID NO: 52883 - RNA, 45 nt, Mus musculus
ggaugaagacagcuuugacaucauccacuucuuuggaaaugagac

SEQ ID NO: 52884 - RNA, 46 nt, Mus musculus
gggcugagggguuacgggccugguguaccaauagaaggcccucuga

SEQ ID NO: 52885 - RNA, 46 nt, Mus musculus
ugcucagcaaguaccuuauugccgacccacaacaccgcccacccca

SEQ ID NO: 52886 - RNA, 46 nt, Mus musculus
agcagucauugcucuuaaccgcugagccaucucuccagaccccaag

SEQ ID NO: 52887 - RNA, 46 nt, Mus musculus
caagcuauggucauauuacgauugcacauugcuauucacaccagau

SEQ ID NO: 52888 - RNA, 63 nt, Mus musculus
guucucggaacuggacaaggugccguuugccgggcagcuguagacccugucacucggccacuc

SEQ ID NO: 52889 - RNA, 70 nt, Mus musculus
uugaguuccggaauggcaugcugaacgucucgcccauuggccgcagcugcacccuggaggagaggaucga

SEQ ID NO: 52890 - RNA, 39 nt, Mus musculus
ucugccuuagcuacauggcccugcucagacugcccaaga

SEQ ID NO: 52891 - RNA, 42 nt, Mus musculus
ucauugagaaguuugacuacguguuugcugagaaugggacag

SEQ ID NO: 52892 - RNA, 42 nt, Mus musculus
ccuaggaugcacaacuaguccguccucaagcuagcgugagaa

SEQ ID NO: 52893 - RNA, 46 nt, Mus musculus
uuauaccauucuagguacuugcagagaauagggucaguucuuuuug

SEQ ID NO: 52894 - RNA, 46 nt, Mus musculus
agcagaacacacacacacacacacacacacagagagagagagagag

SEQ ID NO: 52895 - RNA, 42 nt, Mus musculus
agcuugccacccuaucauucugccacacccacugcuggagcc

SEQ ID NO: 52896 - RNA, 46 nt, Mus musculus
gaaacagcguuaaaccugcgugcuaauucacuuagguucagcagua

SEQ ID NO: 52897 - RNA, 41 nt, Mus musculus
ucaccucugcaaucaagcucucucaauaaacgugugcagaa

SEQ ID NO: 52898 - RNA, 61 nt, Mus musculus
cuuacaaccauccguaaugagaucugaugcccucuucuggagugccugaagacagcuagug

SEQ ID NO: 52899 - RNA, 41 nt, Mus musculus
cccagcaaccacaugguggcucacaaucuucuguaauggga

SEQ ID NO: 52900 - RNA, 46 nt, Mus musculus
aagauuugacagaauaggauacgcccaacugucaacgagaagagag

SEQ ID NO: 52901 - RNA, 46 nt, Mus musculus
ggauuuaggcaaguggucccugguuaccugagugugacuuggagug

SEQ ID NO: 52902 - RNA, 41 nt, Mus musculus
ccaacaaacacaugguggcucacaaccaucuguaaugagau

SEQ ID NO: 52903 - RNA, 46 nt, Mus musculus
agcuucccggcgggcccacucgaucaucuuauaguuuggcacauaa

SEQ ID NO: 52904 - RNA, 45 nt, Mus musculus
aguggccuccccaucauggaguccaacuauuuugaccccaccaag

SEQ ID NO: 52905 - RNA, 46 nt, Mus musculus
gggcccacaccucaguaacacugauugaccuaaauaugcuaaagag

SEQ ID NO: 52906 - RNA, 46 nt, Mus musculus
agucaccuguggggccuucaccuuguggucugcuuacuuccuggag

SEQ ID NO: 52907 - RNA, 45 nt, Mus musculus
augguggcucacaaccaccuguaaugagaucugaugcccaccacu

SEQ ID NO: 52908 - RNA, 45 nt, Mus musculus
aucaugugaaacugcuccaauuccucccccagccccagacccuuu

SEQ ID NO: 52909 - RNA, 42 nt, Mus musculus
ggcugucaaaggcugagaaggguuucagacaauggggcauuc

SEQ ID NO: 52910 - RNA, 46 nt, Mus musculus
cuaugcuagggaguuuccuuuggacuuagcauuucagccugcagga

SEQ ID NO: 52911 - RNA, 42 nt, Mus musculus
ugcagagcggaacuggacucugcucaaggacagcacccagua

SEQ ID NO: 52912 - RNA, 46 nt, Mus musculus
aagucucugauguagaaaauaccauaaugauguagauucauggugg

SEQ ID NO: 52913 - RNA, 44 nt, Mus musculus
ccuccuccuccuccuaucugagugccaacccucgaugcccaccc

SEQ ID NO: 52914 - RNA, 44 nt, Mus musculus
uccucccgagacaaggccacucaucacagcccagccggagcagc

SEQ ID NO: 52915 - RNA, 47 nt, Mus musculus
ccaccucgccagggcuuuuccuuuuuaaacaaaacaaacccuaccag

SEQ ID NO: 52916 - RNA, 42 nt, Mus musculus
ggggaaaggcagacacacaaagguagggagguggggggaauc

SEQ ID NO: 52917 - RNA, 42 nt, Mus musculus
ggaccugaaaccccaccccuccuuaaggagcugcugggagag

SEQ ID NO: 52918 - RNA, 45 nt, Mus musculus
gcuuucugcuccuggagcacaaaccugggauacucagcucauaaa

SEQ ID NO: 52919 - RNA, 45 nt, Mus musculus
cagcuuagccagaagguucagcaaaggccucccaugaccccucug

SEQ ID NO: 52920 - RNA, 59 nt, Mus musculus
gaagacagaauuuuuuuuaggauguaaucucuugagauccucuugccucugacucccaa

SEQ ID NO: 52921 - RNA, 45 nt, Mus musculus
aaaggaaagaaaagaaaagaaaagaaaagaaaagaaaggaaaaga

SEQ ID NO: 52922 - RNA, 46 nt, Mus musculus
accucuauaguuguacacaaggaugaguucuucuucggcagcagcg

SEQ ID NO: 52923 - RNA, 45 nt, Mus musculus
gagcauuuagcuuggcuccauucuuucugaagaauugcaccuuag

SEQ ID NO: 52924 - RNA, 45 nt, Mus musculus
acuccacccacccccgugucagugcugggaaacaaaauuccucug

SEQ ID NO: 52925 - RNA, 46 nt, Mus musculus
gucaucaucaggcaugugucugucaccugcuuuuaccuacugaguc

SEQ ID NO: 52926 - RNA, 42 nt, Mus musculus
uucuguaaguuuagugugcauguaaguacuaugcaugcaugu

SEQ ID NO: 52927 - RNA, 45 nt, Mus musculus
caucuaaaccaagcauggugauagaugucuuuaaucccaacaggu

SEQ ID NO: 52928 - RNA, 77 nt, Mus musculus
auggcuuugugcccuacuuucauagcuccuauuaccacccccaccucaucucuugccauccuaaucuugcacccaaa

SEQ ID NO: 52929 - RNA, 46 nt, Mus musculus
cgcuuacuguuggugaagugccaguuacacuacuuugcugcuaggg

SEQ ID NO: 52930 - RNA, 42 nt, Mus musculus
auuagaguuacuauugccaugaccaaggcagcuuggggagaa

SEQ ID NO: 52931 - RNA, 46 nt, Mus musculus
cugcucuuuaaacuucguggccucuuuucgugaaaaggcguguaga

SEQ ID NO: 52932 - RNA, 56 nt, Mus musculus
uguaugcaaugucugcuggugcccauggaggccagaagagggcacugggcuagagu

SEQ ID NO: 52933 - RNA, 46 nt, Mus musculus
uuacuuuuuaagauaauaacuuaagggcuggugagauggcucagug

SEQ ID NO: 52934 - RNA, 42 nt, Mus musculus
uguguguaaaauaacaaacgugaucuguguugaaugcaaggu

SEQ ID NO: 52935 - RNA, 48 nt, Mus musculus
uaauguuuaacaaagcuggguagacugggaaaagauguuugcagacau

SEQ ID NO: 52936 - RNA, 42 nt, Mus musculus
ggaggaaggccuauuucuuaaggaacacaaggggcagggauc

SEQ ID NO: 52937 - RNA, 46 nt, Mus musculus
ugaggauaucgguugugcucaguucaaaugguuucaugcugagaga

SEQ ID NO: 52938 - RNA, 46 nt, Mus musculus
accaguccuguuccgccuucuggggagaaaggagcaugacccaggu

SEQ ID NO: 52939 - RNA, 28 nt, Mus musculus
cucuauaaguaucugguguggcacagag

SEQ ID NO: 52940 - RNA, 42 nt, Mus musculus
uuuuaucuuucucgguuccauagaacaccacugccaggagau

SEQ ID NO: 52941 - RNA, 45 nt, Mus musculus
uuugaagacagcuacaguguacuuacauauaauaaacaaaucuua

SEQ ID NO: 52942 - RNA, 29 nt, Mus musculus
ucaccgagcuuaaacuuuaaccuggggga

SEQ ID NO: 52943 - RNA, 23 nt, Mus musculus
gacaggcgcuggcugucccuuga

SEQ ID NO: 52944 - RNA, 42 nt, Mus musculus
cuccucuuccuggggcaccaaagccacaaaauacggggagac

SEQ ID NO: 52945 - RNA, 46 nt, Mus musculus
gaaaaggaucauuugcccagaacuagaaguaacagauagcaaagau

SEQ ID NO: 52946 - RNA, 45 nt, Mus musculus
aguguacuuacauauaauaaauaaauaaaucuuaaaaaauguuua

SEQ ID NO: 52947 - RNA, 41 nt, Mus musculus
guacaccuauugaaaccuccucuguccucugcaucugagau

SEQ ID NO: 52948 - RNA, 45 nt, Mus musculus
agccuaggguuuugguuuugguuuugguuuuuuuucucagaagau

SEQ ID NO: 52949 - RNA, 45 nt, Mus musculus
cacaccuaggagaccuuuacaaggcuaagugacaggauucgcuga

SEQ ID NO: 52950 - RNA, 23 nt, Mus musculus
ucagcaaguggaaggccucugug

SEQ ID NO: 52951 - RNA, 42 nt, Mus musculus
cugagaaggccuaaugaccuauuggagaaaguacugggagag

SEQ ID NO: 52952 - RNA, 46 nt, Mus musculus
uaauuccuguggucuggguuaggugacaggacaacggcuuacagua

SEQ ID NO: 52953 - RNA, 26 nt, Mus musculus
uugcugauggaagggaccagcucccu

SEQ ID NO: 52954 - RNA, 45 nt, Mus musculus
uaagauuuuuaauuacauugcuuguguguuugugugugugugugu

SEQ ID NO: 52955 - RNA, 27 nt, Mus musculus
ucuguuagagagggcagacauucagga

SEQ ID NO: 52956 - RNA, 46 nt, Mus musculus
ggacacagaguaaaaaaagagaagcagauaugauuagggaucagaa

SEQ ID NO: 52957 - RNA, 45 nt, Mus musculus
uccccacgaaucuucuguuuccccaagaaguccuagccuuccucc

SEQ ID NO: 52958 - RNA, 42 nt, Mus musculus
ccuaucugaugauuugucugguuuggcucugcacgcgcgaga

SEQ ID NO: 52959 - RNA, 42 nt, Mus musculus
gagugucugucuugaggcgggacgaagggauugaggccggug

SEQ ID NO: 52960 - RNA, 47 nt, Mus musculus
cacgaggaggcaaaauaccaaugcacauagaauaaauuacugaaaga

SEQ ID NO: 52961 - RNA, 45 nt, Mus musculus
acagcaguaaucccagcaccggggagguggaggcaggaacaccag

SEQ ID NO: 52962 - RNA, 45 nt, Mus musculus
aaagcccucagccucaccuccucaugguuugugacaagagcccag

SEQ ID NO: 52963 - RNA, 42 nt, Mus musculus
acagaguacuggaaauaacaagcaagcaaauuaggaguguau

SEQ ID NO: 52964 - RNA, 42 nt, Mus musculus
ugaaugaccccacagcaccagggauccuccccgccccccccc

SEQ ID NO: 52965 - RNA, 46 nt, Mus musculus
aauaaugaguuuauuuauacucuaguuaaauauuaacaugcaccuu

SEQ ID NO: 52966 - RNA, 45 nt, Mus musculus
gguguuaaguacuauaugaauuugggagcuaagggguacugccaa

SEQ ID NO: 52967 - RNA, 45 nt, Mus musculus
ggguaaacuucagagucaggagccaagucagaaaggaagcagaca

SEQ ID NO: 52968 - RNA, 42 nt, Mus musculus
ugagacgcuauuuccagucuugguuguguggucuuugggucc

SEQ ID NO: 52969 - RNA, 46 nt, Mus musculus
agcacacaggagcuccgugugugccccacaccgcaagucugguaag

SEQ ID NO: 52970 - RNA, 54 nt, Mus musculus
gggauuguuggcuauaaccaggaaguggagagggauuguuggcuauaaccagga

SEQ ID NO: 52971 - RNA, 65 nt, Mus musculus
agggauuguuggcuauaaccaggaaguggagagggauuguuggcuauaaccaggagguggagagg

SEQ ID NO: 52972 - RNA, 80 nt, Mus musculus
gauuguuggcuauaaccaggaagcggagagggauuguuggcuauaaccaggagguggagagggauuguuggcuauaauca

SEQ ID NO: 52973 - RNA, 45 nt, Mus musculus
cacgggcgcccgcucugccgcucagcgcgcggacucaccacagga

SEQ ID NO: 52974 - RNA, 44 nt, Mus musculus
uuguugaaauagaaaugaauacaaagcuugaacuugcuccagag

SEQ ID NO: 52975 - RNA, 49 nt, Mus musculus
guucugucacgguugccauguuaggagcuacugcuggcaccugcugucc

SEQ ID NO: 52976 - RNA, 45 nt, Mus musculus
cccgacaugaacagacacuuccagaagugauuuccaggcccaggg

SEQ ID NO: 52977 - RNA, 45 nt, Mus musculus
gcaccaggaugcgcccuccuucccggaacucuuuacuagacagau

SEQ ID NO: 52978 - RNA, 46 nt, Mus musculus
guaaugaacuuuguccugggcccggggaaacugagcacaucuggcg

SEQ ID NO: 52979 - RNA, 46 nt, Mus musculus
gaggcucucuguccugaggucugcauuagaacugcagcccugagcc

SEQ ID NO: 52980 - RNA, 45 nt, Mus musculus
aacccagaggguucugaguccaccuccagcuucgaguccacggag

SEQ ID NO: 52981 - RNA, 46 nt, Mus musculus
cugccauguacagggugccccgcacucgcuacucacccaccauguu

SEQ ID NO: 52982 - RNA, 48 nt, Mus musculus
guaaaauauaaguacauuuaaaaaaaaaauuccgggcuggugagaugg

SEQ ID NO: 52983 - RNA, 45 nt, Mus musculus
aguccaucucuaacucacaaacaugagcagacaaaauacugucag

SEQ ID NO: 52984 - RNA, 45 nt, Mus musculus
aguucccagguagccagagcuacaggagaaaacaaaaaagcagag

SEQ ID NO: 52985 - RNA, 42 nt, Mus musculus
aguucacccuccugggccacaguuuuggugagucagccuaag

SEQ ID NO: 52986 - RNA, 45 nt, Mus musculus
aucuaaugcuuaccguacaguucuagagaccgagucucaacucca

SEQ ID NO: 52987 - RNA, 45 nt, Mus musculus
aaagacuguggggaacucauccuacagagaggaaccacgaaggug

SEQ ID NO: 52988 - RNA, 42 nt, Mus musculus
ucguuccuuccugaacaaaucuccaaacguacugaggccagu

SEQ ID NO: 52989 - RNA, 45 nt, Mus musculus
gaaggaugcugagagauaacacuguaccuuaagugggaaccugag

SEQ ID NO: 52990 - RNA, 45 nt, Mus musculus
ucacugcccugccccccgaggccuucuaccccauccccuggcaga

SEQ ID NO: 52991 - RNA, 45 nt, Mus musculus
agucccaacuuucuauuuauguguucuguggaaucagcugccagg

SEQ ID NO: 52992 - RNA, 46 nt, Mus musculus
gaucuccauccugaucuacuggcacacugugggugcacccaaggac

SEQ ID NO: 52993 - RNA, 42 nt, Mus musculus
accagugccuccaccaucugacuguucuucccuucucuuccc

SEQ ID NO: 52994 - RNA, 26 nt, Mus musculus
cuagagugaaguauucgaggcuugag

SEQ ID NO: 52995 - RNA, 47 nt, Mus musculus
ggagcauaccuggcuuuugucagguuaacugugggggguggagaagc

SEQ ID NO: 52996 - RNA, 46 nt, Mus musculus
agcacagagagguggucugugguuuuagagcuuuauuguacgagag

SEQ ID NO: 52997 - RNA, 42 nt, Mus musculus
ucggaagaacugagaacaaagugagggcuggggggcgggggg

SEQ ID NO: 52998 - RNA, 47 nt, Mus musculus
ggaggaggagggaaaaccuugccauuauauacaguguggggcgccgu

SEQ ID NO: 52999 - RNA, 46 nt, Mus musculus
uuguugcugggaguaauuugaacuguguugaccuggcccaugagau

SEQ ID NO: 53000 - RNA, 46 nt, Mus musculus
uauuuggggguguggccuuguuggaauuggugugaccugguuggag

SEQ ID NO: 53001 - RNA, 46 nt, Mus musculus; identical to SEQ ID NO: 52999

SEQ ID NO: 53002 - RNA, 42 nt, Mus musculus
uaagccucacugagaaccugaauucaggcccucaacccauua

SEQ ID NO: 53003 - RNA, 38 nt, Mus musculus
cuggguuuagugaaaccucuaugguggugcacucuaac

SEQ ID NO: 53004 - RNA, 40 nt, Mus musculus
agaaggaguaagaugaguuuaacgucaguguggauugugg

SEQ ID NO: 53005 - RNA, 45 nt, Mus musculus
ccuggugcuggaauuaaaaggcccgugucaccacgcccaccuaga

SEQ ID NO: 53006 - RNA, 46 nt, Mus musculus
guacacuguaauauugucuauaaucacagccacugggggcugaggc

SEQ ID NO: 53007 - RNA, 46 nt, Mus musculus
ucaaggccaucucuucagacauguacuuuggaauucaagcccagac

SEQ ID NO: 53008 - RNA, 41 nt, Mus musculus
uccugggcauauauguauaauauauacauguggggccaggg

SEQ ID NO: 53009 - RNA, 47 nt, Mus musculus
cugggaugauggugccgauuccuacuggaagaaagacagcagcagag

SEQ ID NO: 53010 - RNA, 48 nt, Mus musculus
cugugagugacuggggaccccccauaggguaccagagcagagaguccc

SEQ ID NO: 53011 - RNA, 48 nt, Mus musculus
aacugcaggggugcguucagaggggaggaagaugcagggugagggcca

SEQ ID NO: 53012 - RNA, 45 nt, Mus musculus
cauagagugcuuuuacugcuuccaaauuauucaucagccauuaga

SEQ ID NO: 53013 - RNA, 46 nt, Mus musculus
cccucuaguucccuugaugaccacagugacauagcaggguugagug

SEQ ID NO: 53014 - RNA, 42 nt, Mus musculus
ggcuggugagagaaaggguucuggguacggucuccagcugag

SEQ ID NO: 53015 - RNA, 45 nt, Mus musculus
cuccaaguggucugagcagagcagcagguauggggguguuaaaga

SEQ ID NO: 53016 - RNA, 42 nt, Mus musculus
uuucugugcuguuugugucaauguagauugucuccugugaug

SEQ ID NO: 53017 - RNA, 44 nt, Mus musculus
guggguagguaagucaggcacacacacagacacaggcacacugg

SEQ ID NO: 53018 - RNA, 45 nt, Mus musculus
auugagaagcagacacuuaguuaccugggcucuuuucucuuugac

SEQ ID NO: 53019 - RNA, 46 nt, Mus musculus
ugguggcucuggggaacagcagugguccuugggggagccaugggca

SEQ ID NO: 53020 - RNA, 44 nt, Mus musculus
aagcuugggagcccagaaacugacaaauacauccuucacugaga

SEQ ID NO: 53021 - RNA, 45 nt, Mus musculus
uauugcauuugauuuaucuguggagggauacguauccuggcaugu

SEQ ID NO: 53022 - RNA, 42 nt, Mus musculus
caccuggccauccuucacaccugacuucacaucugggcauuc

SEQ ID NO: 53023 - RNA, 46 nt, Mus musculus
accugaugcccucuucuggugugucugaagacagacagcuacagua

SEQ ID NO: 53024 - RNA, 42 nt, Mus musculus
cuguggguuucuuuuucgcauccugugauugagccaccuugg

SEQ ID NO: 53025 - RNA, 42 nt, Mus musculus
uuuuacgcauugucuccuuguguagcccuaacuggccuagaa

SEQ ID NO: 53026 - RNA, 42 nt, Mus musculus
agagagagagggagagagggagagagagagagagugugugug

SEQ ID NO: 53027 - RNA, 45 nt, Mus musculus
gaccagcgagugccaaggggcagccguuuguaccagggcccgcac

SEQ ID NO: 53028 - RNA, 45 nt, Mus musculus
gguggaaaauggaagggacagggcuggagagacagaugagcagug

SEQ ID NO: 53029 - RNA, 41 nt, Mus musculus
auuguaaaaaaaaaggggggggccucaaaaauacguuguca

SEQ ID NO: 53030 - RNA, 45 nt, Mus musculus
agacacuaaaccacaugaaugcagcccucccccuuuuuucauuuu

SEQ ID NO: 53031 - RNA, 45 nt, Mus musculus
accuugacccagaagcacagacaugguaggguggaggaaacagau

SEQ ID NO: 53032 - RNA, 46 nt, Mus musculus
uacccagacgccagacuaccugggggcuuagagagaaggcuaguuc

SEQ ID NO: 53033 - RNA, 46 nt, Mus musculus
cugugaaauuuucuuucuauuuuucuauuuuuaguacuguacggau

SEQ ID NO: 53034 - RNA, 46 nt, Mus musculus
caccuaugggcuugaauuugaccagaugagcgguggaccaggagau

SEQ ID NO: 53035 - RNA, 46 nt, Mus musculus
ucagaaacaccucuaagcgcgcaucucucucagccccagcacagaa

SEQ ID NO: 53036 - RNA, 46 nt, Mus musculus
uuguagucuuuucucuaggcacagccauccuaccuuguucggagau

SEQ ID NO: 53037 - RNA, 45 nt, Mus musculus
cauuugaaucuuggccuaauuaaacauuugcccaugcacccauga

SEQ ID NO: 53038 - RNA, 46 nt, Mus musculus
ccaguggccauugcacacccugggcuucggcacuaaaggcaguuag

SEQ ID NO: 53039 - RNA, 45 nt, Mus musculus
auucauaacagcaaaauuacauuaugaaguaucaucgaaaauaau

SEQ ID NO: 53040 - RNA, 42 nt, Mus musculus
cucauggaaccaggauucauguugucauaagugcuagggcag

SEQ ID NO: 53041 - RNA, 45 nt, Mus musculus
gaaaaaaggcagucuagcagcuggagagaugucucagugguuaag

SEQ ID NO: 53042 - RNA, 46 nt, Mus musculus
gcacccuaccacaaguuuuuuuuuuuuucccuccuuuaagacucag

SEQ ID NO: 53043 - RNA, 24 nt, Mus musculus
auggcuggggaggagaggccagca

SEQ ID NO: 53044 - RNA, 42 nt, Mus musculus
caaggccuuccaaaugagauuggugcaguaaagagcaaccca

SEQ ID NO: 53045 - RNA, 28 nt, Mus musculus
gagagagagagagaaagaagccaggcag

SEQ ID NO: 53046 - RNA, 46 nt, Mus musculus
uugccugugagguccugaguguggaguagugggcucauguguccag

SEQ ID NO: 53047 - RNA, 46 nt, Mus musculus
ucaguggauaguuugcaugguucaaucccugugcuaccauuaggaa

SEQ ID NO: 53048 - RNA, 45 nt, Mus musculus
aagagagggaaggagagagggagaggggaaaaacagaaagggcaa

SEQ ID NO: 53049 - RNA, 42 nt, Mus musculus
caagaggggaagagagaguaggagggagggaaggagggagag

SEQ ID NO: 53050 - RNA, 48 nt, Mus musculus
gcgccccagcggggccgguagaucuggaagauggugauccagguggug

SEQ ID NO: 53051 - RNA, 45 nt, Mus musculus
ucaacuucuccucauuggauacccgcuccaaguucauaguugcgc

SEQ ID NO: 53052 - RNA, 46 nt, Mus musculus
cuuuguccaguguuuuagaugggcuuuugcaagcaugggcgccugg

SEQ ID NO: 53053 - RNA, 42 nt, Mus musculus
ggcuuauuggugggugaagcuguggguguucaggugguggag

SEQ ID NO: 53054 - RNA, 46 nt, Mus musculus
aaggaaagaaaagaaaccaggaacuagggugcagcucaguugucag

SEQ ID NO: 53055 - RNA, 41 nt, Mus musculus
cuuugcagaugcuuaacgagaaaaaggucaggagugucccg

SEQ ID NO: 53056 - RNA, 52 nt, Mus musculus
uuugguugggcgcgggcaccgccuuggggcagcagccggagagggagccaug

SEQ ID NO: 53057 - RNA, 49 nt, Mus musculus
gucuggagccccucccgucgaguggaacugacuuuggagcacuggggga

SEQ ID NO: 53058 - RNA, 46 nt, Mus musculus
uuuugauggacuugggcggacuaaggaugacaucaucauuugugaa

SEQ ID NO: 53059 - RNA, 42 nt, Mus musculus
cucucucuccuguuuuguuuuccuuuuccccccuuuguuuag

SEQ ID NO: 53060 - RNA, 46 nt, Mus musculus
gccucacucugcagagagcaccccagcccuuggcagguugugacgu

SEQ ID NO: 53061 - RNA, 46 nt, Mus musculus
ugcccaauggguuagaugucaccuuugaagugacagagcugaggag

SEQ ID NO: 53062 - RNA, 71 nt, Mus musculus
uuccaguuuucuuauggaaccaaagaaacuuccuacggccuguccuucuucaagccacagccuggaaacuu

SEQ ID NO: 53063 - RNA, 45 nt, Mus musculus
auauaaaguuacugggcaguucccguggagcucacuucgggagac

SEQ ID NO: 53064 - RNA, 43 nt, Mus musculus
gugggaggguguguggcgggagcugggcugccucucgaggacu

SEQ ID NO: 53065 - RNA, 47 nt, Mus musculus
agcaugccauggucaucgacucucgaaauucaucuaucuugccaaga

SEQ ID NO: 53066 - RNA, 47 nt, Mus musculus
cucuuacccacccauuugugugcuccccaccugcucccuggcugcca

SEQ ID NO: 53067 - RNA, 61 nt, Mus musculus
gcauucaaauccaugagccuauucaaaccaccacaaggguagaacccaaagagaacaggaa

SEQ ID NO: 53068 - RNA, 42 nt, Mus musculus
gaggagaagcaucagagcaguuagugugaguucagcaggcag

SEQ ID NO: 53069 - RNA, 45 nt, Mus musculus
cugccaaccuaaggccacuucaaaauaaaaugcuuauuuuaagag

SEQ ID NO: 53070 - RNA, 41 nt, Mus musculus
ggagcaguauucacaucgcucuggauuuucauguggaauca

SEQ ID NO: 53071 - RNA, 30 nt, Mus musculus
uuuuguuuuuguuuucuuguuuuguuuuuu

SEQ ID NO: 53072 - RNA, 45 nt, Mus musculus
gcaccucuacaccccacugcccuuccggccaggccaggguggcuu

SEQ ID NO: 53073 - RNA, 45 nt, Mus musculus
ugguugugagccaccaugagguugcugggauuugaacucuggacc

SEQ ID NO: 53074 - RNA, 104 nt, Mus musculus
ggagggaccaacugggacaaaugcuuugucccauuccaggagguggggguaggauguagggugagcuaggauacccagcacaggaagugucuaagaaugaauag

SEQ ID NO: 53075 - RNA, 43 nt, Mus musculus
ccuggucagaaaagggaagugugacuaacugugcacauuggaa

SEQ ID NO: 53076 - RNA, 46 nt, Mus musculus
gcuucagcuaaaaaaaauaaaauaaaaggugccucuuggcccugag

SEQ ID NO: 53077 - RNA, 25 nt, Mus musculus
uauaagcuuguguauuuaugcuuau

SEQ ID NO: 53078 - RNA, 43 nt, Mus musculus
uuuacuugcuccagcccucuauuugggugacacuuagccccag

SEQ ID NO: 53079 - RNA, 28 nt, Mus musculus
cugucugcauguaugccuacaagucaga

SEQ ID NO: 53080 - RNA, 46 nt, Mus musculus
cacacacacacagagagagagagagagagacacacacacacacaug

SEQ ID NO: 53081 - RNA, 48 nt, Mus musculus
agguguggggugugugugugugugugugugugugugugugugugcuag

SEQ ID NO: 53082 - RNA, 46 nt, Mus musculus
auaacuucagcuugugucaaguugaauacagggcccuaaggcccca

SEQ ID NO: 53083 - RNA, 44 nt, Mus musculus
caggcuccugaaagggccauugaggcuacauuagaaaggggugg

SEQ ID NO: 53084 - RNA, 47 nt, Mus musculus
caaaccccagcaaccacaugguggcucaaaaccacccguaaugagau

SEQ ID NO: 53085 - RNA, 44 nt, Mus musculus
cuucccuucccccuucccuucccuucccuucccuucccccuucc

SEQ ID NO: 53086 - RNA, 41 nt, Mus musculus
ugcuggagguuguacaaagugucaaacuucucagccaggga

SEQ ID NO: 53087 - RNA, 47 nt, Mus musculus
ggggcuggggggaagacaugcuugggaccaggaaauggauuguggga

SEQ ID NO: 53088 - RNA, 41 nt, Mus musculus
uuuugagcaucugucgugcuuauugggcuauuaaggggcga

SEQ ID NO: 53089 - RNA, 76 nt, Mus musculus
uaaggcgcaucuccauccccuuggggacaacacagccaggucucuguuuggaagugauuaaaccguaacugucacg

SEQ ID NO: 53090 - RNA, 101 nt, Mus musculus
gcccuggggaagacagacugcaggcccgauuauaauucagagggaacuaaggggaaaguaauuuuuuauucugguuagagcaagcucacagagcuggccau

SEQ ID NO: 53091 - RNA, 42 nt, Mus musculus
gugauggacagaaagugacaggaccccccaaugguccggcgg

SEQ ID NO: 53092 - RNA, 73 nt, Mus musculus
gaaguugggggaagguaggguuuacaguggagauggguuucaaacacugugcuaauggagcagccaggcgcga

SEQ ID NO: 53093 - RNA, 44 nt, Mus musculus
agccugugggaagggaccccgaggagugucacaugggaggagga

SEQ ID NO: 53094 - RNA, 42 nt, Mus musculus
ggacaauggcguugauuuugagagcggcacacgggcguugag

SEQ ID NO: 53095 - RNA, 45 nt, Mus musculus
accaacuuauuugaaaugaggccaugcgaggcuggaaggcaugag

SEQ ID NO: 53096 - RNA, 41 nt, Mus musculus
caccacuauguggccauucuuaacuaguauuggaagccgag

SEQ ID NO: 53097 - RNA, 24 nt, Mus musculus
ucuaguugguguuucuugccugga

SEQ ID NO: 53098 - RNA, 42 nt, Mus musculus
cgguucucaaggucaugcgugugaucuugugaacuugggcag

SEQ ID NO: 53099 - RNA, 45 nt, Mus musculus
ggggaagugggguggcaagcaugggucaugugggaccccugcuug

SEQ ID NO: 53100 - RNA, 46 nt, Mus musculus
cuuuccaaacuagugacuucuccaguacaggagggaaauugauggg

SEQ ID NO: 53101 - RNA, 46 nt, Mus musculus
ucucaucacguuugugaacaaacaccugaauaagcuaaacuuggag

SEQ ID NO: 53102 - RNA, 46 nt, Mus musculus
ugugugugugagagagagagagagagagagagagagagauugagag

SEQ ID NO: 53103 - RNA, 45 nt, Mus musculus
gguugugagccaccaugugguuacugggauuugaacucggugaac

SEQ ID NO: 53104 - RNA, 45 nt, Mus musculus
uucuuacauauucccguguuuguucugaccuuuuccuccucgggg

SEQ ID NO: 53105 - RNA, 42 nt, Mus musculus
ccaugaugucagcaagccaccccucccuccccccgcccccca

SEQ ID NO: 53106 - RNA, 41 nt, Mus musculus
cggugacauuaaagagccacacugacaaaauacccgggacu

SEQ ID NO: 53107 - RNA, 46 nt, Mus musculus
aggcggucuggggcggggauccuagaugcaaagaccuaccgugcug

SEQ ID NO: 53108 - RNA, 45 nt, Mus musculus
cugcggagcugccauucauaccauagccuggacaaaggcaccaau

SEQ ID NO: 53109 - RNA, 42 nt, Mus musculus
caaaguugucauugagagcaaugucagcccggcaucgaaggu

SEQ ID NO: 53110 - RNA, 41 nt, Mus musculus
uuugucaagcucauuuccugguaugacaaugaauacggacg

SEQ ID NO: 53111 - RNA, 43 nt, Mus musculus
ggccauggcgcgagggaggugaccgggagacagagcccagagc

SEQ ID NO: 53112 - RNA, 45 nt, Mus musculus
uauguucaauugcuucuugcuguucuuuuuuucccuucggcaggc

SEQ ID NO: 53113 - RNA, 45 nt, Mus musculus
gauguugagaccucaaaacagggcgacugagcacagagggacagg

SEQ ID NO: 53114 - RNA, 28 nt, Mus musculus
uggguuugggcuguaguuggcaagcaga

SEQ ID NO: 53115 - RNA, 41 nt, Mus musculus
ccuguuuuuuguuuugcccuccccccaacccccugccgcag

SEQ ID NO: 53116 - RNA, 45 nt, Mus musculus
gugguuccuaaggaccaacuucucaagggucugauuccuguaggu

SEQ ID NO: 53117 - RNA, 45 nt, Mus musculus
aaucccagcaaccacauggugguucacagccauccauaaugagau

SEQ ID NO: 53118 - RNA, 46 nt, Mus musculus
ugaucucagaucccacacggugaaaggugagaacugacuccacguu

SEQ ID NO: 53119 - RNA, 112 nt, Mus musculus
agauggggggcguuuaaagcaagcacaguuaagauguugaaugugcuaguggagaagauguauauaccaugcauauauggauggugauuucagcagauaaauaguaguggga

SEQ ID NO: 53120 - RNA, 135 nt, Mus musculus
cuuuaccaccuuaccaacaaaccccaguuuauaacucagauugagaccacaaggaagagcaaagaaacagcuuugcugccaaggaccaaaauaggcacagagccacacacaguggagauguuagauagaccuauc

SEQ ID NO: 53121 - RNA, 46 nt, Mus musculus
ccuugaauauagaagugccaucaaacaguuaagaaugcagccuuau

SEQ ID NO: 53122 - RNA, 46 nt, Mus musculus
ccugcugagacaggggagcugagcaggccuggagaagccaggagcu

SEQ ID NO: 53123 - RNA, 45 nt, Mus musculus
ccagggugucuuggugucagauguggucaggagagggcucacaga

SEQ ID NO: 53124 - RNA, 46 nt, Mus musculus
ucagugauacugucauucuuuuacuaaaaaaaccuaugccacuauc

SEQ ID NO: 53125 - RNA, 46 nt, Mus musculus
cugacaauuccagagcuggcaccgcucauccuggaugcugccccuc

SEQ ID NO: 53126 - RNA, 46 nt, Mus musculus
ucuggagcugugcuggguuuguccuggagcacgucacucugggauc

SEQ ID NO: 53127 - RNA, 46 nt, Mus musculus
aaaaaaaacuuagaacaauaauaucaaccaaccagaccccccagaa

SEQ ID NO: 53128 - RNA, 45 nt, Mus musculus
gcuacugaagaccuguagacaccagacucgaggcuugaagcagac

SEQ ID NO: 53129 - RNA, 46 nt, Mus musculus
aauggguuuguugugguagacacggccucugucuugcagcucagau

SEQ ID NO: 53130 - RNA, 46 nt, Mus musculus
acuggcauuuucuccauugcuaacugcuguaggaaagggcccagcc

SEQ ID NO: 53131 - RNA, 45 nt, Mus musculus
gccugagugucccuucccuccccacugcucccucaggaggccagg

SEQ ID NO: 53132 - RNA, 42 nt, Mus musculus
cacuagucugucgcucuggcugccccuggguccugcuggguc

SEQ ID NO: 53133 - RNA, 45 nt, Mus musculus
uggucuccuggcggcuagcaagaguccugcagguuagucccagua

SEQ ID NO: 53134 - RNA, 46 nt, Mus musculus
cuucgugucuccgugccuauucguuuuucagcugaagcccaggcag

SEQ ID NO: 53135 - RNA, 28 nt, Mus musculus
uguucuggcggcgcugagagcgcucggg

SEQ ID NO: 53136 - RNA, 41 nt, Mus musculus
uguuaugggcaccugcagaggggacagggaagagaaauaag

SEQ ID NO: 53137 - RNA, 45 nt, Mus musculus
uuuggaauuaacacgggucagggugaaaaugaucgugagguuaca

SEQ ID NO: 53138 - RNA, 24 nt, Mus musculus
gaaggauucuggcagaaacccaac

SEQ ID NO: 53139 - RNA, 45 nt, Mus musculus
gugcacuguggugugguguggugugguguggugugguguggugug

SEQ ID NO: 53140 - RNA, 42 nt, Mus musculus
uuuguguuugcuguuguguggggcuggugcucuguagugcag

SEQ ID NO: 53141 - RNA, 75 nt, Mus musculus
ugggguuugugugcuauaguguggguguguugugugggguuugugugcuauaguguggguguguugugugggguu

SEQ ID NO: 53142 - RNA, 46 nt, Mus musculus
guugugugggguuugugugcuguaguguguuauguggggcuugugu

SEQ ID NO: 53143 - RNA, 75 nt, Mus musculus; identical to SEQ ID NO: 53141

SEQ ID NO: 53144 - RNA, 94 nt, Mus musculus
gugugcuguaguguggguguguuacuguguggggcuugugugcuguaguguggguguguuaugggugcuugugugcuguagugugaguguguug

SEQ ID NO: 53145 - RNA, 46 nt, Mus musculus
gugcuguaguguggguguguuacccuguggggcuugugugcuguag

SEQ ID NO: 53146 - RNA, 57 nt, Mus musculus
gugugcuguaguguggguguguuaugggugcuugugugcuguagugugaguguguug

SEQ ID NO: 53147 - RNA, 41 nt, Mus musculus
ugagaugcaugagggacacugccuauucuuucuggccuugu

SEQ ID NO: 53148 - RNA, 46 nt, Mus musculus
uggguuuguaacagggaggugguggagaccaggagguagagccuag

SEQ ID NO: 53149 - RNA, 25 nt, Mus musculus
auagcugguaccaaggaaugggguu

SEQ ID NO: 53150 - RNA, 24 nt, Mus musculus
aaagaaguuuuagagggaagaaua

SEQ ID NO: 53151 - RNA, 45 nt, Mus musculus
agaaauacaaaauaugcagagugaggaaaaaaaguagugccaggg

SEQ ID NO: 53152 - RNA, 41 nt, Mus musculus
gcucuggggucuaacggcagaauuucuuccuguggccucag

SEQ ID NO: 53153 - RNA, 42 nt, Mus musculus
gggaaaugggguaaggauugucucugcugagugggccuugag

SEQ ID NO: 53154 - RNA, 97 nt, Mus musculus
cagcgccgagccucaggaggagcggcugucgcgguucuggcguuuguaaaaagggaagucauuuguuuuugaaguuaauuaggauaagauuaagugu

SEQ ID NO: 53155 - RNA, 56 nt, Mus musculus
cuugguaggaagaaagaaauuuuccccuuuauaucguggugauaaaaauuaauaag

SEQ ID NO: 53156 - RNA, 46 nt, Mus musculus
caaguucuugcccugcccuuccucgaugguagacucuuaccuggaa

SEQ ID NO: 53157 - RNA, 45 nt, Mus musculus
uuucuuccagaggaccuggguuuaauucccagcaaucacauggca

SEQ ID NO: 53158 - RNA, 46 nt, Mus musculus
cccagcaaccacaugguggcucacaaccaucccuaacgagaucaga

SEQ ID NO: 53159 - RNA, 43 nt, Mus musculus
uuuuuauguaccuggcuucaaauacuuuaguuucuacuucugg

SEQ ID NO: 53160 - RNA, 67 nt, Mus musculus
ugugugugugagcguguguguguguaaguaagugugugugaguguguguguguaagugugagugugu

SEQ ID NO: 53161 - RNA, 81 nt, Mus musculus
guguaagugugaguguaagugugaguguguguguaagugugagugugugugcgugcguguguguguguguguaagugugag

SEQ ID NO: 53162 - RNA, 68 nt, Mus musculus
uguguguguaagugagagugugugugcgugugugagugcgugcgugcgugugugugugagugugugug

SEQ ID NO: 53163 - RNA, 58 nt, Mus musculus
gugugaguguguguguguaagugugagugugugugcgugagugagugcgugcgugcgu

SEQ ID NO: 53164 - RNA, 45 nt, Mus musculus
acccagauuugccuuguucaacuaauugccuuaccucugcagaca

SEQ ID NO: 53165 - RNA, 42 nt, Mus musculus
cuccaccugccagcuacagggauguaacucuguccacuguau

SEQ ID NO: 53166 - RNA, 46 nt, Mus musculus
auuuuuaaauggacuucauuuaauguguuacaguuugaaugcgaag

SEQ ID NO: 53167 - RNA, 46 nt, Mus musculus
acaagaguaaccaucaugaucugaacaaggacaccacaauagccau

SEQ ID NO: 53168 - RNA, 46 nt, Mus musculus
guauaauaauaaauaaaucuuggugcuagagugaguagaagcagag

SEQ ID NO: 53169 - RNA, 46 nt, Mus musculus
gugaguaagugcaaaaaguggaugugucccauuaucaaugagggag

SEQ ID NO: 53170 - RNA, 46 nt, Mus musculus
acaugaugaauacccuuguauaucaccuauaauaauuuagguugag

SEQ ID NO: 53171 - RNA, 45 nt, Mus musculus
gaagaaaagguugccauuaucguggucaggaaaggcaccuccauu

SEQ ID NO: 53172 - RNA, 46 nt, Mus musculus
gauuccccagggcuuuuguguaucccagaaugacuaggcuagggaa

SEQ ID NO: 53173 - RNA, 45 nt, Mus musculus
uuuauguuuaaauguuugagcuacaguuguuggaacuguuuggaa

SEQ ID NO: 53174 - RNA, 45 nt, Mus musculus
aaggacugugugugcccucaagauggcggggcuccugacuuggag

SEQ ID NO: 53175 - RNA, 41 nt, Mus musculus
uguccagaaaauggcucccaagaucccauccccugaccaaa

SEQ ID NO: 53176 - RNA, 46 nt, Mus musculus
ccccuugauagcuccaaggcugucuguguccacuguaugaaugagu

SEQ ID NO: 53177 - RNA, 46 nt, Mus musculus
gaacgggggcaacacaggcaucccaccauuguacccuaugcccccc

SEQ ID NO: 53178 - RNA, 42 nt, Mus musculus
cuguacagacgccacccugaggugguugggaaccagaaggac

SEQ ID NO: 53179 - RNA, 88 nt, Mus musculus
cuccugagacaucugcagcgguuccauggccauguacucaagaaugaugucucagaggccacucugucccguucuccaggcauccgga

SEQ ID NO: 53180 - RNA, 46 nt, Mus musculus
caacguuggcuuuaacaggcugcucgaauacuugaaaccucaguac

SEQ ID NO: 53181 - RNA, 45 nt, Mus musculus
gcuggaguguuggugggaagccugggugacuuccauuggccuuca

SEQ ID NO: 53182 - RNA, 42 nt, Mus musculus
gagccagaggauggugcagaacuuacugaguauugcccggaa

SEQ ID NO: 53183 - RNA, 45 nt, Mus musculus
cuggcacagaggagagccuguggucacucgcaccgauaaagagag

SEQ ID NO: 53184 - RNA, 24 nt, Mus musculus
ccaccagacuggaaacgugcuuca

SEQ ID NO: 53185 - RNA, 46 nt, Mus musculus
uguaggguuuuuauucaguuguguaaaaaccacaaaucaggugcug

SEQ ID NO: 53186 - RNA, 46 nt, Mus musculus
gaccuuuuagaaaacaaauguuguguugaaauacugugugggcucg

SEQ ID NO: 53187 - RNA, 42 nt, Mus musculus
cagcaagcggaugacgccgcgcgcgccgcccgccgcgcccac

SEQ ID NO: 53188 - RNA, 42 nt, Mus musculus
gaccucuucgacuucaucacugaacgaggcgcccuggacgag

SEQ ID NO: 53189 - RNA, 24 nt, Mus musculus
aggagggaggagaggaguggggga

SEQ ID NO: 53190 - RNA, 68 nt, Mus musculus
cgggacucaggaaaggagggacauggagggcaggggaggaacaggagugaaggggaggugaaggccca

SEQ ID NO: 53191 - RNA, 42 nt, Mus musculus
uccggaggagggucuccccagguguguuguagaagcuggcug

SEQ ID NO: 53192 - RNA, 43 nt, Mus musculus
gugcccuggauacugacgacggagccaguaccacuuccagcag

SEQ ID NO: 53193 - RNA, 45 nt, Mus musculus
gcgggcuaagcaagguccugcccuggguggauacuugaaccagag

SEQ ID NO: 53194 - RNA, 42 nt, Mus musculus
gaggaagcauuuguacaguggcuaauuuaaggggagugggag

SEQ ID NO: 53195 - RNA, 88 nt, Mus musculus
aucaggggugggguuguauaaguucaaaagugugaaaugucugaagaucauauuuuuuauacagguauuucaauuaaauguuuuggua

SEQ ID NO: 53196 - RNA, 45 nt, Mus musculus
aaugccauagcaaccacaacugcccucgccacagcagcaacauug

SEQ ID NO: 53197 - RNA, 45 nt, Mus musculus
uguaguuuuaagcaauuuggcuuuuagaaucgggggcgauuugac

SEQ ID NO: 53198 - RNA, 30 nt, Mus musculus
aaauaugggcugcagagguguguccaagcu

SEQ ID NO: 53199 - RNA, 46 nt, Mus musculus
agaccgggcagugcaauuaccugccggcagagggcguguugcguua

SEQ ID NO: 53200 - RNA, 45 nt, Mus musculus
ggccuaaacuaccagguuaggcuaggaggaugcugggggcaagaa

SEQ ID NO: 53201 - RNA, 45 nt, Mus musculus
ggggauggggagaugaggggugacuugcaaaccauagcaccccag

SEQ ID NO: 53202 - RNA, 45 nt, Mus musculus
uaaggacuucuugguaaguaagcucuggggaggggaaugaaaaag

SEQ ID NO: 53203 - RNA, 41 nt, Mus musculus
gcuuagcaccauagccaaugcuagaucugaagcccagccua

SEQ ID NO: 53204 - RNA, 38 nt, Mus musculus
ucugcuuacuacucccuccccagcaugacuggugcuug

SEQ ID NO: 53205 - RNA, 46 nt, Mus musculus
cuuguagacuguagcgucuuucuccugagcaauacugcccgggcgc

SEQ ID NO: 53206 - RNA, 51 nt, Mus musculus
acaagggcaucagacagauggugcaggucagcgaccaggacaugaauacgc

SEQ ID NO: 53207 - RNA, 41 nt, Mus musculus
caagcuguuguaugcuaaggagaucucuaccuacaagaaga

SEQ ID NO: 53208 - RNA, 46 nt, Mus musculus
acguccacgaagugguggacgccucccugucagucaucgcacagac

SEQ ID NO: 53209 - RNA, 46 nt, Mus musculus
cacccgccgucaaguacuucuucgauuucuuggacgagcaggcaga

SEQ ID NO: 53210 - RNA, 45 nt, Mus musculus
aacagaugagguagaugaaggcaaguccaagcgcggcagcaugaa

SEQ ID NO: 53211 - RNA, 32 nt, Mus musculus
gccaaguacacccucaaugacacaggccugcu

SEQ ID NO: 53212 - RNA, 57 nt, Mus musculus
agcaagcccucuaccaguucuccaaccugcuuaauagcaaguccuuccucaucaaug

SEQ ID NO: 53213 - RNA, 96 nt, Mus musculus
ccgaccgcguauucuuccugccauccaaggauggugacaaggaugugaugaucaccggcaagcuagacaucccugagucacggcggcccauugugg

SEQ ID NO: 53214 - RNA, 74 nt, Mus musculus
gaugaucgagauggaggaccagacgaaugacgugcaugaggcaggcauccccacgcuggacuacaagaccuaca

SEQ ID NO: 53215 - RNA, 48 nt, Mus musculus
cgagcgcgaguacgagaagaucaaaucccagcucgagggcuuggagga

SEQ ID NO: 53216 - RNA, 45 nt, Mus musculus
acccaugguguuuaucaucguggucuccaucuacugcuacuggug

SEQ ID NO: 53217 - RNA, 46 nt, Mus musculus
ccgagagugggugcuaggccgaguggaguacgacacgcgugcgagu

SEQ ID NO: 53218 - RNA, 81 nt, Mus musculus
guugcauuaugaagacgcugaccgagacggaccuguacugcgagcccccagaggugcagccuccacccaagcggcggcaga

SEQ ID NO: 53219 - RNA, 62 nt, Mus musculus
gggaaccaaucugaacaaagccaugacucuggaggaggcagaggcauuugugggugcugagc

SEQ ID NO: 53220 - RNA, 45 nt, Mus musculus
guggcgucaaaaagcaggucaacaagcucauccacgcccggguaa

SEQ ID NO: 53221 - RNA, 29 nt, Mus musculus
cgucuucuugucuccugcuguccccgaag

SEQ ID NO: 53222 - RNA, 85 nt, Mus musculus
ccggagcaucaacguuacuggccagggcuucagccucauccagaaguuugccaugguugucaucgcugagcccuugcgguccugg

SEQ ID NO: 53223 - RNA, 71 nt, Mus musculus
gugacacuagaaaucuacuaugggggcuccagagugcccagccccggcaucucuuucaccuacugcgagaa

SEQ ID NO: 53224 - RNA, 57 nt, Mus musculus
acaaaguuuggagcacagcuacagugugucacaggucaacaguuggcuccaggccag

SEQ ID NO: 53225 - RNA, 47 nt, Mus musculus
caauggcacucaccuggacacaggcuccaaggaggaugugcggguga

SEQ ID NO: 53226 - RNA, 45 nt, Mus musculus
caaccccagccucucaguguggagccacgacaggggccacaggca

SEQ ID NO: 53227 - RNA, 48 nt, Mus musculus
ugagguggauguuaauggaaaacucggccauucaccgccacacgucca

SEQ ID NO: 53228 - RNA, 64 nt, Mus musculus
uaacuguggcuggccagaacugugccuuugaaccaagaggguacuccguauccacccggugagu

SEQ ID NO: 53229 - RNA, 51 nt, Mus musculus
ucacuauccauggguccaaucugggugucaaagcagaugacgucaagaaga

SEQ ID NO: 53230 - RNA, 42 nt, Mus musculus
ccuccacagugacucucuacaacugcuccuuuggccgcagug

SEQ ID NO: 53231 - RNA, 44 nt, Mus musculus
ugaccaugcaugaaucagacaccuucucuuuuaggaccccaaag

SEQ ID NO: 53232 - RNA, 45 nt, Mus musculus
ugaaccaugagacagaggugaccuuccagggcaagaacuuggaga

SEQ ID NO: 53233 - RNA, 47 nt, Mus musculus
aaugccugagcuauguaaccugcgcucagugucgugacucccaagau

SEQ ID NO: 53234 - RNA, 27 nt, Mus musculus
gcagaguaugguucuaucccaguagac

SEQ ID NO: 53235 - RNA, 42 nt, Mus musculus
ugaccacacuguugcguuccugggcaccucagauggccggau

SEQ ID NO: 53236 - RNA, 42 nt, Mus musculus
auagaagccaaccguaacgccugcuacacaggugcccgagag

SEQ ID NO: 53237 - RNA, 42 nt, Mus musculus
agagauggaccugcagugucaggaucccagugacccccaaga

SEQ ID NO: 53238 - RNA, 100 nt, Mus musculus
ugaggaugauuucuaugucuucuucgucuuuaaccaucaagacaagcauccugcuaagaaccgcacgcugcuggcgcgcaugugcaaagacgaccccucc

SEQ ID NO: 53239 - RNA, 52 nt, Mus musculus
gagcgcgugcuguuugugggcaaaggcaaugggccgcacgacaaugguauca

SEQ ID NO: 53240 - RNA, 46 nt, Mus musculus
ggauggcagcggcgagaaguccuucguggccagcaaugacgagaga

SEQ ID NO: 53241 - RNA, 48 nt, Mus musculus
guccagcagcacguggucacaggccccuucauggauaacaagaagugc

SEQ ID NO: 53242 - RNA, 93 nt, Mus musculus
gggccuaggguugagccugcggucccgaaagccggagaguuuccgcagugagacagagcugaaccaccuggcuguggaugaggucacaggugu

SEQ ID NO: 53243 - RNA, 45 nt, Mus musculus
agcgaguccugaugccagccuaaaacagagacggagaccacugga

SEQ ID NO: 53244 - RNA, 46 nt, Mus musculus
acaagcggagagucucggugggguuagagguggacagcgccuggaa

SEQ ID NO: 53245 - RNA, 46 nt, Mus musculus
uuuaaagggauggagaaaacacuggugacagggaggccagccagcu

SEQ ID NO: 53246 - RNA, 41 nt, Mus musculus
ccacaguggcguccauaugucacauguccccccuaccagau

SEQ ID NO: 53247 - RNA, 45 nt, Mus musculus
aaacaccuagagggugggagcugucagccugaucccacacccgga

SEQ ID NO: 53248 - RNA, 51 nt, Mus musculus
cgcaacgcagagcgcggccccggcgccaucgaacgacggcugcggaggagc

SEQ ID NO: 53249 - RNA, 26 nt, Mus musculus
uggcgggggcggggccggcggcuccc

SEQ ID NO: 53250 - RNA, 45 nt, Mus musculus
ggauuuggaagaaagaaucaagguucagcagcccucacccucggg

SEQ ID NO: 53251 - RNA, 45 nt, Mus musculus
aauuccagcaaccacaugguggcucacaaccacccguagugagau

SEQ ID NO: 53252 - RNA, 46 nt, Mus musculus
ccuccccccagcccagaggucccuuacaguuuagaugccuggagag

SEQ ID NO: 53253 - RNA, 25 nt, Mus musculus
uacagagccacgagggcacaaaguu

SEQ ID NO: 53254 - RNA, 46 nt, Mus musculus
uccucuggugagacaggcaggagugugccaguauugggcaugaggg

SEQ ID NO: 53255 - RNA, 46 nt, Mus musculus
aagggaauggggcugcaggcagaucagaccaccaucuucaucaucg

SEQ ID NO: 53256 - RNA, 35 nt, Mus musculus
gcgucagugugggggacaaaggagccucuggcagg

SEQ ID NO: 53257 - RNA, 36 nt, Mus musculus
aacaaaaagcaaaacccacaaaaccaccaggaagau

SEQ ID NO: 53258 - RNA, 50 nt, Mus musculus
cagcaaccacaugguggcucacaaccauccguaagaucugacucccucuu

SEQ ID NO: 53259 - RNA, 27 nt, Mus musculus
ucuuuuaaaaaaaagggagggggcugg

SEQ ID NO: 53260 - RNA, 45 nt, Mus musculus
caaaggagccugagcuauagaaucagaccuuguugaaagaaagag

SEQ ID NO: 53261 - RNA, 45 nt, Mus musculus
gcugagacuagugggaaacuucuaagaagcccaggggccauuagg

SEQ ID NO: 53262 - RNA, 45 nt, Mus musculus
ugaaacaggagagguuaggcugaacauacaauuuugagcagggag

SEQ ID NO: 53263 - RNA, 46 nt, Mus musculus
guguguguaguaugugaguaugugugccaugguugcauguguuaug

SEQ ID NO: 53264 - RNA, 46 nt, Mus musculus
guguguguaguaugugagugugugugccaugguugcauguguuaug

SEQ ID NO: 53265 - RNA, 47 nt, Mus musculus
aguaugugugccaugguugcauguguuaugacuguguaucuguagua

SEQ ID NO: 53266 - RNA, 47 nt, Mus musculus
guguguguaguaugugagugugugugccaugguugcauguguuauga

SEQ ID NO: 53267 - RNA, 93 nt, Mus musculus
acaaaaaacauuauuagauaaccaauaauagcugacuuaugacaagcagggacuagaaaacaaugaaauaaguucuuugaagggagggccaaa

SEQ ID NO: 53268 - RNA, 46 nt, Mus musculus
uccuauagauaauaauuguaaguucugaacaaaauauuaaaaacag

SEQ ID NO: 53269 - RNA, 71 nt, Mus musculus
auuacacacauggcacaaagagagaaggaagaugaagacuaagcagaguagaggcugagcaggaguagccc

SEQ ID NO: 53270 - RNA, 46 nt, Mus musculus
ucuagugggcugagaucaaaggguaggcaggaaaacaugauggcag

SEQ ID NO: 53271 - RNA, 41 nt, Mus musculus
caauaugggggaguucagcauguuuauuuuguacagcacag

SEQ ID NO: 53272 - RNA, 42 nt, Mus musculus
cucagugccugugucuuauuuugucuauucuuucggcuguug

SEQ ID NO: 53273 - RNA, 43 nt, Mus musculus
agaucugacgcccucuucuucuggugugucugaagacagcuac

SEQ ID NO: 53274 - RNA, 37 nt, Mus musculus
gcuccgcuggugacaaggccuggcuugugaaguuuca

SEQ ID NO: 53275 - RNA, 46 nt, Mus musculus
accugacucuaauccuagccucuauguuaccccacauuccccccau

SEQ ID NO: 53276 - RNA, 30 nt, Mus musculus
ucuuaacuacugagcuaucucuuuagccac

SEQ ID NO: 53277 - RNA, 45 nt, Mus musculus
agcugauggaugaagaugacaucuugcaggaguguaaggcccaga

SEQ ID NO: 53278 - RNA, 47 nt, Mus musculus
agugcauggaggagcuggugaaccucaucacacaggacccaccccag

SEQ ID NO: 53279 - RNA, 42 nt, Mus musculus
uauguagaccagcugcuaacaagaaagccuggaaucacacau

SEQ ID NO: 53280 - RNA, 46 nt, Mus musculus
cagugugggccuuugcuuacugauuugaaggcacagagaggagaga

SEQ ID NO: 53281 - RNA, 46 nt, Mus musculus
acugcaaguggggagauaagcauggccuacagagagaauccaggag

SEQ ID NO: 53282 - RNA, 46 nt, Mus musculus
guuuguuuguuuguuuguuuuuuaaaauaauguuauuuacagaaga

SEQ ID NO: 53283 - RNA, 45 nt, Mus musculus
guucagccacccgacauggacacugggaacugaacucagguccuc

SEQ ID NO: 53284 - RNA, 53 nt, Mus musculus
caaacacagccugugagcuucugacuugugaugugccacagaucagcgacaga

SEQ ID NO: 53285 - RNA, 41 nt, Mus musculus
ucauacugagcugugugcuccaaaccuaggugcugccugga

SEQ ID NO: 53286 - RNA, 46 nt, Mus musculus
aauuuaaaagaaauuuaaaauuuaaaauugggauuuuugguucuag

SEQ ID NO: 53287 - RNA, 41 nt, Mus musculus
ugguuauugcuccuguguagaaaugcaauuuugugugugug

SEQ ID NO: 53288 - RNA, 46 nt, Mus musculus
ucuccuacacagaaagaagguccucgcucagagagugauucagcag

SEQ ID NO: 53289 - RNA, 42 nt, Mus musculus
ugauauuggaacuuaagggguuucccucagcuaagcgggaag

SEQ ID NO: 53290 - RNA, 45 nt, Mus musculus
ugguaguuggugugugggaacugaggcaguauacagggugacaga

SEQ ID NO: 53291 - RNA, 46 nt, Mus musculus
ucucucuaggucugggcuugcuugcuugacaccuugggcaugagga

SEQ ID NO: 53292 - RNA, 58 nt, Mus musculus
ugugacucaggcuucucccagauacauugucccagcccauaacucugccuggugcagu

SEQ ID NO: 53293 - RNA, 23 nt, Mus musculus
uggcacccucaggcagcagccuc

SEQ ID NO: 53294 - RNA, 45 nt, Mus musculus
ccuggaacuuacucuguaggccaggcuggccuugaacucagaaau

SEQ ID NO: 53295 - RNA, 45 nt, Mus musculus
agcccaacagaugggugcucuguccaucccucuaguccagcagau

SEQ ID NO: 53296 - RNA, 46 nt, Mus musculus
gguccagcagaugggugcucuguuuaucccucuaguccagcagaug

SEQ ID NO: 53297 - RNA, 45 nt, Mus musculus; identical to SEQ ID NO: 53295

SEQ ID NO: 53298 - RNA, 68 nt, Mus musculus
gcagaugggugcucuguccaucccucuaguccagcagaugggugcucuguccaucccucuaguccagc

SEQ ID NO: 53299 - RNA, 60 nt, Mus musculus
ugccagaggccucucaguccagcagauggaugcucuguccaucccucuaguccagcagau

SEQ ID NO: 53300 - RNA, 61 nt, Mus musculus
ggcccucacuccuuugaccauaaaccugaccauuuccucgccuuccguaaaccagcacauc

SEQ ID NO: 53301 - RNA, 27 nt, Mus musculus
uuuauuacaaccaaucaacagcaagau

SEQ ID NO: 53302 - RNA, 42 nt, Mus musculus
gccuuuccuaccaccccagacuucuguauuugguacccugag

SEQ ID NO: 53303 - RNA, 46 nt, Mus musculus
cugcugcgggagcgggcaggguugggagaccuggagagugccagca

SEQ ID NO: 53304 - RNA, 54 nt, Mus musculus
gaggcgccuguggccaacccugagccgugagaagcagcaggagcugguacagaa

SEQ ID NO: 53305 - RNA, 41 nt, Mus musculus
agcaggcagugaugggagaugcuguucuguaauggccagag

SEQ ID NO: 53306 - RNA, 41 nt, Mus musculus
ggaguguguguuuguuuguuugauugauuuuugguggggga

SEQ ID NO: 53307 - RNA, 46 nt, Mus musculus
ggauccagaacuggaguuggcugaccuugccuucccacccccuaca

SEQ ID NO: 53308 - RNA, 46 nt, Mus musculus
gugcacauuccaccccugccagagccacuacaaagccagacccaca

SEQ ID NO: 53309 - RNA, 47 nt, Mus musculus
auuggggucaaugcagccuuccaggcagagacucaggagcugguaag

SEQ ID NO: 53310 - RNA, 69 nt, Mus musculus
agcuucacuuaugugcccaucuugccggcacagcugcuggaaguccuuagcacaccuacgccuuucauc

SEQ ID NO: 53311 - RNA, 46 nt, Mus musculus
gcacaaaguccucuucuuguccaggagcuaccaacgucuagcagau

SEQ ID NO: 53312 - RNA, 27 nt, Mus musculus
agcgcugcucagccaacagaggcagag

SEQ ID NO: 53313 - RNA, 42 nt, Mus musculus
ggggggguuagugugugugugugugugugugugugugugugu

SEQ ID NO: 53314 - RNA, 46 nt, Mus musculus
aaauccuucauacaaaugcaagcuagcaguuuggggucucagagga

SEQ ID NO: 53315 - RNA, 45 nt, Mus musculus
cuuucugcucucauguauucaagucuauaucuuuuggcacucagu

SEQ ID NO: 53316 - RNA, 49 nt, Mus musculus
cugagauugccuugcuguugcccuaucuucagcauagaaucuggcauag

SEQ ID NO: 53317 - RNA, 46 nt, Mus musculus
gugacaucaaccacagccauggagacaacaguguugggggguguug

SEQ ID NO: 53318 - RNA, 42 nt, Mus musculus
ugcuaggucugaagccucaagcaccgcuugauggggugcagu

SEQ ID NO: 53319 - RNA, 27 nt, Mus musculus
ggggagcagguagaggaggcugaugca

SEQ ID NO: 53320 - RNA, 42 nt, Mus musculus
gcuggggggcaugacgacgagacuuccagacuacaggcugaa

SEQ ID NO: 53321 - RNA, 46 nt, Mus musculus
ucugagaugcgcaggccccugucggugcagauucuacagccuagau

SEQ ID NO: 53322 - RNA, 44 nt, Mus musculus
uaggaauuugacccauuucaccaccagccagguccacaggaagu

SEQ ID NO: 53323 - RNA, 41 nt, Mus musculus
agcccuugauaguagggccgcaggcucuccacauccgguag

SEQ ID NO: 53324 - RNA, 45 nt, Mus musculus
cuuaaugaccguuucuaguaugggcaggugugugugugugugugu

SEQ ID NO: 53325 - RNA, 42 nt, Mus musculus
ccccgcaccauccaggcaaagcaacgcuucuuccaccuccag

SEQ ID NO: 53326 - RNA, 45 nt, Mus musculus
ugggauccgaugcccucuucuggugugucugaaaauagccacagu

SEQ ID NO: 53327 - RNA, 44 nt, Mus musculus
aauaaaucuuaaaaaaaaaaaaagggaagagaguucauugugcg

SEQ ID NO: 53328 - RNA, 24 nt, Mus musculus
uugggguuuuuguucgguuuuugg

SEQ ID NO: 53329 - RNA, 45 nt, Mus musculus
cccagcuccgccucgcccggucccagcuccaccuagccccgacuc

SEQ ID NO: 53330 - RNA, 57 nt, Mus musculus
aucucaucagaggaaaugagacaaacagcccaccauucgccagaggaacuccagaca

SEQ ID NO: 53331 - RNA, 58 nt, Mus musculus
ucccauuaguucaauacuaaugugcccuaagcuauaccacacaggaacccagcaaccc

SEQ ID NO: 53332 - RNA, 46 nt, Mus musculus
aucucaacgccuauacauaaccaugaugagaggcaguaggguaggg

SEQ ID NO: 53333 - RNA, 46 nt, Mus musculus
auuucauuauggacaguugugagacaccacgugguugcugggauuu

SEQ ID NO: 53334 - RNA, 42 nt, Mus musculus
guaugugugugugugugaguguaugugugcacgcgugugugu

SEQ ID NO: 53335 - RNA, 42 nt, Mus musculus
caugugccuugccucagcacgugaauccagucagccccaguc

SEQ ID NO: 53336 - RNA, 42 nt, Mus musculus
cggcuggaaaucgacaacucugagcugcugcacaugcuggag

SEQ ID NO: 53337 - RNA, 45 nt, Mus musculus
cugcccagaaggugggcacuguugcugcugcuaccucuuagacaa

SEQ ID NO: 53338 - RNA, 47 nt, Mus musculus; identical to SEQ ID NO: 23623

SEQ ID NO: 53339 - RNA, 45 nt, Mus musculus
cugggacugaaggcugcugaaaaaacuaaagcuagggcagguuga

SEQ ID NO: 53340 - RNA, 45 nt, Mus musculus
acuaaguaagaaggcagguugaaaaugaacaauguguguggugug

SEQ ID NO: 53341 - RNA, 42 nt, Mus musculus
ugucugugucugugugucugugugugugugugucuguguuuc

SEQ ID NO: 53342 - RNA, 46 nt, Mus musculus
cauaaaacacugucuacgcagugguucucacuuuccuagugcugag

SEQ ID NO: 53343 - RNA, 46 nt, Mus musculus
cucagucccggcaggaugcaauccuucaagcuggaaucccauuggg

SEQ ID NO: 53344 - RNA, 45 nt, Mus musculus
uuugugcugauguuuggcguucggcugcucucuuucccgcgggaa

SEQ ID NO: 53345 - RNA, 45 nt, Mus musculus
uggcacuucaagaaacgacuggguguugaaagaaacgcccuagaa

SEQ ID NO: 53346 - RNA, 46 nt, Mus musculus
auccagcgaaugcccacugcugccagugccugugcgcaccccggag

SEQ ID NO: 53347 - RNA, 86 nt, Mus musculus
guuuccuuuucuucuucuucucuuucuucuuuggaggcucacgcucgccaagcauguuuuuaggacaggcauaacuuaagugucca

SEQ ID NO: 53348 - RNA, 46 nt, Mus musculus
aaugaaccacuauaguugcuguuacugauagaaacgugcccugacc

SEQ ID NO: 53349 - RNA, 46 nt, Mus musculus
acucuaagugcuaacaugcuacaguaauaacuagggagcaaaguag

SEQ ID NO: 53350 - RNA, 45 nt, Mus musculus
ucauaacacuuagauuuaucaaaguaguuucgucuccggaugaac

SEQ ID NO: 53351 - RNA, 42 nt, Mus musculus
uuaccuguuuauuauuuauugcucuggugcaguuuaaggcag

SEQ ID NO: 53352 - RNA, 72 nt, Mus musculus
aaucauuguuuguuagggagaaaggcaaguuggauacauaaacugugcuuuuacuuggcgccaagccaccgc

SEQ ID NO: 53353 - RNA, 45 nt, Mus musculus
cgcgcaaaagcgcgggcguccgcgaacgcagcgcggugcagcgcu

SEQ ID NO: 53354 - RNA, 42 nt, Mus musculus
augugcuuuauucuggacuccuaguggaaccuggagagggac

SEQ ID NO: 53355 - RNA, 45 nt, Mus musculus
ucccgagugcugggauuaaaggcaugcgccaccacgcauggcuag

SEQ ID NO: 53356 - RNA, 91 nt, Mus musculus
uccuuuacaagagcaaaaacaaugcuuuuacuggaagcuggcuuuaaacaaguaucuccugccucugcuucuagaguucuuggauuacaga

SEQ ID NO: 53357 - RNA, 79 nt, Mus musculus
acguugcgggaguucagggaugugcauaaugagacccaagccaaccagggcuacuuagugaaacacucaaacugcugcc

SEQ ID NO: 53358 - RNA, 39 nt, Mus musculus
cuugcuugcuugcuugcuugcuugcuucuuaugugauag

SEQ ID NO: 53359 - RNA, 46 nt, Mus musculus
ucaggccuuucagaaucacuccuaaugcuuugcccuuugccuggag

SEQ ID NO: 53360 - RNA, 42 nt, Mus musculus
cuccucccaagggcauuuuggagacugcaaagguaggaccug

SEQ ID NO: 53361 - RNA, 45 nt, Mus musculus
agauuaucuaggugagaguaaaccaugaaaggacuaugcagggag

SEQ ID NO: 53362 - RNA, 45 nt, Mus musculus
gguuguuagccaccaugugguuucugggauuugaacucaggaccu

SEQ ID NO: 53363 - RNA, 46 nt, Mus musculus
aaggcauaaauauuuguuuaucugucaagaauuuuuuauaguguua

SEQ ID NO: 53364 - RNA, 45 nt, Mus musculus
guuugacgaagcuauccgagcaguucucugucccccuccugucaa

SEQ ID NO: 53365 - RNA, 46 nt, Mus musculus
uuuuuguuacagauuaauuuuuccauaaaaccauuuugaaccaaug

SEQ ID NO: 53366 - RNA, 46 nt, Mus musculus
uuaaauguaagaauuccaacuuacagucuauuaaaauucagcccua

SEQ ID NO: 53367 - RNA, 28 nt, Mus musculus
ugugggugugcuggguggagugugaaac

SEQ ID NO: 53368 - RNA, 45 nt, Mus musculus
guguguugagaagucacaguguuagucugagaauuagaauugaag

SEQ ID NO: 53369 - RNA, 42 nt, Mus musculus
agagggagaagcuggccauggccauguggagagaagggggaa

SEQ ID NO: 53370 - RNA, 42 nt, Mus musculus
cuacgcucugcugucuuaccagccccugucuuaguuagggag

SEQ ID NO: 53371 - RNA, 46 nt, Mus musculus
ggucuggagauugagugucgcuugguuagaauguagacaggugggc

SEQ ID NO: 53372 - RNA, 83 nt, Mus musculus
gacuggaguggucuauaggauguuuccuuuuccacguaggaguguggagguugauaggucugggugggaagguuagaugugau

SEQ ID NO: 53373 - RNA, 45 nt, Mus musculus
augguaaauuacccaagaaguguacuccccaggcuggauccuagg

SEQ ID NO: 53374 - RNA, 45 nt, Mus musculus
uugugagccaccaugugguugcuaggauuugaacuuaggaccuua

SEQ ID NO: 53375 - RNA, 45 nt, Mus musculus
caagggauuguauguccuagaaagaagacuggaaagcagcagaca

SEQ ID NO: 53376 - RNA, 46 nt, Mus musculus
uuauauaugcugucuucauucauuuauuauauuucuuuuaugccag

SEQ ID NO: 53377 - RNA, 46 nt, Mus musculus
uuucacugccugucaucuggcuguuggcuguggucuuagcagacag

SEQ ID NO: 53378 - RNA, 46 nt, Mus musculus
gccuugucagugguaaguuucugcccuuccaguggaguaggcacag

SEQ ID NO: 53379 - RNA, 44 nt, Mus musculus
cagguguuugauuucuaauaaucuguuuuccaauagucgugacu

SEQ ID NO: 53380 - RNA, 45 nt, Mus musculus
ccaucagcucucuugucuuucugauccuccugccuccaccuucag

SEQ ID NO: 53381 - RNA, 46 nt, Mus musculus
acagaugguugugagccaccaugugguugcugggauuuuaacccag

SEQ ID NO: 53382 - RNA, 46 nt, Mus musculus
guacagguggggugucucuucugggugccuggugaggaauuuucag

SEQ ID NO: 53383 - RNA, 45 nt, Mus musculus
cacuauuaggaggugugaccuuguuggaguagguguggccuuauu

SEQ ID NO: 53384 - RNA, 42 nt, Mus musculus
ccccaagaguacggcuuggggaaaauccgugugagccccgug

SEQ ID NO: 53385 - RNA, 42 nt, Mus musculus
guuuacaucuuuaggagcaagagagcaagccccaagccccaa

SEQ ID NO: 53386 - RNA, 54 nt, Mus musculus
aguuaagucuaggccucuccuaucaccuguaucugccaugauugucauaggacc

SEQ ID NO: 53387 - RNA, 44 nt, Mus musculus
cucugguauuuuuucucacagugguaaaagccgaacagcacaga

SEQ ID NO: 53388 - RNA, 45 nt, Mus musculus
ucaaaucccagcaaccacaugcuggcucacaaccauccguaacaa

SEQ ID NO: 53389 - RNA, 59 nt, Mus musculus
ggcuguccggccaauggagaggaagagaggaggaggggcagggguugucaaguggagag

SEQ ID NO: 53390 - RNA, 46 nt, Mus musculus
gguuaccccuaaggccaauuagaaaaaacaaaaaccaaaaccaaag

SEQ ID NO: 53391 - RNA, 45 nt, Mus musculus
cuuggcuucucuucaguuagggcugcucuggcauuucugccucag

SEQ ID NO: 53392 - RNA, 45 nt, Mus musculus
cugagcuacaguaguaaugcccuguuucuggaaggcgaagucuga

SEQ ID NO: 53393 - RNA, 45 nt, Mus musculus
agaaaaguucuauaauuaguuuaaauuucaguucuauuggaaagu

SEQ ID NO: 53394 - RNA, 47 nt, Mus musculus
gucccaguacuugaaggcugagacaggaggaugagcagacagcagag

SEQ ID NO: 53395 - RNA, 45 nt, Mus musculus
uguguaggagugucugggcacuacuugugugccuggugccuucag

SEQ ID NO: 53396 - RNA, 46 nt, Mus musculus
uuuccaauuuaaggauuaaauaucaauggauagaaagucaugaggg

SEQ ID NO: 53397 - RNA, 46 nt, Mus musculus
uaaaacgauagugaacaacaacaacaaaaaaccuauauaggcccuu

SEQ ID NO: 53398 - RNA, 45 nt, Mus musculus
gucgcagcaagaaucuuguguuaaguaaaucaaucacagcccaac

SEQ ID NO: 53399 - RNA, 45 nt, Mus musculus
uuugaauuuuuaaccaccuucuuaguagcugcuggauaugcguag

SEQ ID NO: 53400 - RNA, 45 nt, Mus musculus
ucaaauuauuauagaccccacaguugaugauggucagaugggaaa

SEQ ID NO: 53401 - RNA, 46 nt, Mus musculus
gcuguuuuuguuguaaggguaggagggaaacugaagauaaacggag

SEQ ID NO: 53402 - RNA, 41 nt, Mus musculus
uuugguuaaaggaaaucacaugagaugaugaggaagcaaca

SEQ ID NO: 53403 - RNA, 40 nt, Mus musculus
auuagaaaagucuguccaguuugcacugaggcagaacuua

SEQ ID NO: 53404 - RNA, 81 nt, Mus musculus
ugccucaccauaaggccuugaugaucaauauggggaaagcagauacuguaaaugcaaaauaaagcauccgauacuaaguaa

SEQ ID NO: 53405 - RNA, 46 nt, Mus musculus
accuuacuggacgcgagucuuccagugcaggggggcgggggauggg

SEQ ID NO: 53406 - RNA, 46 nt, Mus musculus
uucugaucacauccaucuguagcugucgcucuacaaucucgagcag

SEQ ID NO: 53407 - RNA, 46 nt, Mus musculus
ucuguucuacuggacgugagaugcagcacagacaccaugcacugac

SEQ ID NO: 53408 - RNA, 24 nt, Mus musculus
ggggaucaauacaaagcagccuuu

SEQ ID NO: 53409 - RNA, 31 nt, Mus musculus
ccgugcgcgccuccagcguuccggcccgcag

SEQ ID NO: 53410 - RNA, 42 nt, Mus musculus
auaaagaacguuugucuaaaaagguauaagaagggcagagag

SEQ ID NO: 53411 - RNA, 45 nt, Mus musculus
cggaccuuguuaauuuccuucuuuaaucuccaggaaugugcagau

SEQ ID NO: 53412 - RNA, 46 nt, Mus musculus
ggaaaugcaccuuagagaccgaacauugcaugguaagcacacagga

SEQ ID NO: 53413 - RNA, 73 nt, Mus musculus
aguaugugugagugugugugugugagugccugggugugugugugugaguaugugugagugugugugugagugc

SEQ ID NO: 53414 - RNA, 104 nt, Mus musculus
ugugaguaugugugagugugagugccuggguguguguuugaguaugugugagugugugugugugagugccugggugugugugugugaguaugugugagugugug

SEQ ID NO: 53415 - RNA, 44 nt, Mus musculus
ugugaguauaugugugaguguguguguaugugugugaugugagu

SEQ ID NO: 53416 - RNA, 46 nt, Mus musculus
uacauaaugauguucuaucucaaagagagagagagagagagagaga

SEQ ID NO: 53417 - RNA, 45 nt, Mus musculus
agacagcuagcuguuucuggacuaaccagacuguagcaccuaaga

SEQ ID NO: 53418 - RNA, 43 nt, Mus musculus
uuuguuuuuuuuuuuguuguuguuguuuuuuccuggugccagu

SEQ ID NO: 53419 - RNA, 46 nt, Mus musculus
ucucccucccucccuccuuccgugugugugugugugugugugugug

SEQ ID NO: 53420 - RNA, 47 nt, Mus musculus
caguggucggaaacacaaagagaaugugaaagacuauuaccagaaau

SEQ ID NO: 53421 - RNA, 45 nt, Mus musculus
auuaaagaguuuacacguagcuauggcguguuuuguucggccuag

SEQ ID NO: 53422 - RNA, 42 nt, Mus musculus
gagccgagagcagccgagugacggucuccgggagacaugcag

SEQ ID NO: 53423 - RNA, 45 nt, Mus musculus
cugcaauugaaaccucugccuccaaucuuguaguguuaaagcucu

SEQ ID NO: 53424 - RNA, 45 nt, Mus musculus
agaugcauuucauaacaggguuguaucaccuugauacaguuuuag

SEQ ID NO: 53425 - RNA, 52 nt, Mus musculus
gcagcaaguuauauuucaaggcuguaaaaggagagcaaaccaggauggcaca

SEQ ID NO: 53426 - RNA, 46 nt, Mus musculus
ggggagcauggcuuugaaaagcagggcugggugaagaaggcucaag

SEQ ID NO: 53427 - RNA, 46 nt, Mus musculus
aguugcccuggggaacuagucgggcgcaggcuuuauuuaugaugau

SEQ ID NO: 53428 - RNA, 42 nt, Mus musculus
acuucugcuguguaaaauauccauuugcuauuauguccccag

SEQ ID NO: 53429 - RNA, 46 nt, Mus musculus
guugcuuucugucuugauucuguuuucuucauuguugaagcaugag

SEQ ID NO: 53430 - RNA, 46 nt, Mus musculus
ggcacaagacucuauuuucuuuuguguuuaaaagacuacaugggag

SEQ ID NO: 53431 - RNA, 42 nt, Mus musculus
uggggggggugggggugggguguguguguguguguggguggg

SEQ ID NO: 53432 - RNA, 46 nt, Mus musculus
uuauaaaguacauaaagacgaaaggcuggugcucaucuacguacag

SEQ ID NO: 53433 - RNA, 42 nt, Mus musculus
ccauggcuccuuuaagguuuauggugacaucacuugucccag

SEQ ID NO: 53434 - RNA, 42 nt, Mus musculus
caggggcuacugaaggagaaaaggaaguggugccucuuggag

SEQ ID NO: 53435 - RNA, 46 nt, Mus musculus
cagcccucaagauccugcccaggcagauuccucacccucagugcag

SEQ ID NO: 53436 - RNA, 45 nt, Mus musculus
ucaaauugcaaagccuuucacaguguucucaacuguuucauuuga

SEQ ID NO: 53437 - RNA, 47 nt, Mus musculus
uauguaggucuccccucacguggccgguucuggagaaaagcccauaa

SEQ ID NO: 53438 - RNA, 45 nt, Mus musculus
ccaaaugagacuacuuauuaacuuugagcauuuacuauguuggaa

SEQ ID NO: 53439 - RNA, 46 nt, Mus musculus
ccaucggucuccccuccuccccuaaagcuuuucuuuuuccccacag

SEQ ID NO: 53440 - RNA, 46 nt, Mus musculus
gcccucagcuccagcuauuuaugaaauacuucaaccagaguacaag

SEQ ID NO: 53441 - RNA, 42 nt, Mus musculus
cccguuuuacacguuaacuuugucuccugucuaugccugcuc

SEQ ID NO: 53442 - RNA, 46 nt, Mus musculus
gaaaaccuuaucugauggugacccugugccuacuaacagcccucac

SEQ ID NO: 53443 - RNA, 46 nt, Mus musculus
gcucacaaccaucugcaaugugaucugaugcccucuucuggugugu

SEQ ID NO: 53444 - RNA, 46 nt, Mus musculus
ggaagagagugagagucucugacagacagauuacagguacucgugu

SEQ ID NO: 53445 - RNA, 45 nt, Mus musculus
gcaugagaucugagugggagaccauaggaugccgagugugcggga

SEQ ID NO: 53446 - RNA, 45 nt, Mus musculus
aaugugugaggucauaguuuaaaucaccaguacugaagggggaga

SEQ ID NO: 53447 - RNA, 111 nt, Mus musculus
agagagagagagagagagggagagagagagagacuagagagagagaaagaaggaggaagaggaggaggaagaggaagaggaggaggaagaggaggaggaaggaggaggagg

SEQ ID NO: 53448 - RNA, 41 nt, Mus musculus
ccgucacgugaugaggcagcauugucacgugacgaggcuca

SEQ ID NO: 53449 - RNA, 42 nt, Mus musculus
aggcagaggcagaggcagaggcagagaggcagagaggggcag

SEQ ID NO: 53450 - RNA, 42 nt, Mus musculus; identical to SEQ ID NO: 53449

SEQ ID NO: 53451 - RNA, 42 nt, Mus musculus
gcagaaaggcagaggcagagaggcagaggcagagaggggcag

SEQ ID NO: 53452 - RNA, 41 nt, Mus musculus
agaggcgcagaggcgcagaggggcagaggggcagaggggca

SEQ ID NO: 53453 - RNA, 45 nt, Mus musculus
auggugugggauggauaggcuaggugguuaagugacaugggagug

SEQ ID NO: 53454 - RNA, 45 nt, Mus musculus
accuuuggaucacuggagaaucagcaggacuucaggacuccagag

SEQ ID NO: 53455 - RNA, 46 nt, Mus musculus
uguugguauugggaggggucacaggugccuuggcacucaugugcag

SEQ ID NO: 53456 - RNA, 42 nt, Mus musculus
cauauaaguaauggcuaucauuuggagcauggcugggaauag

SEQ ID NO: 53457 - RNA, 46 nt, Mus musculus
gugccugagccucaggucauccagaagaggucagaauuaguagaag

SEQ ID NO: 53458 - RNA, 48 nt, Mus musculus
ccacagugguuagggacuggaacaccuucuggaacagugagccccaag

SEQ ID NO: 53459 - RNA, 80 nt, Mus musculus
uaucuuaggagcuaacacuuugguaagagagacuuaagauacaaaguaaauaauacaauauaaguuauaaaauaauauaa

SEQ ID NO: 53460 - RNA, 45 nt, Mus musculus
uaguagggauuguaugagugugugugugugugugugugugugugu

SEQ ID NO: 53461 - RNA, 46 nt, Mus musculus
aggucugugaguagauugcuuaugaauguuagaaagaggucaccag

SEQ ID NO: 53462 - RNA, 46 nt, Mus musculus
ccacagccgugcucugcuuagcucacagucggucuggauagcugua

SEQ ID NO: 53463 - RNA, 46 nt, Mus musculus
acucuaccauguugcuugaaguuauuuuguauuuuguaaggaacau

SEQ ID NO: 53464 - RNA, 46 nt, Mus musculus
auugcucuuuaauuauaugaaaauuuuaauauuuuucaccgugcag

SEQ ID NO: 53465 - RNA, 57 nt, Mus musculus
ggaagcccgacucccucuuuuucaccgauggccagaggcgaaucgacuucauccucg

SEQ ID NO: 53466 - RNA, 45 nt, Mus musculus
gauuguaaagugaacagcgugcugguuuuagguaagcaggcaggu

SEQ ID NO: 53467 - RNA, 44 nt, Mus musculus
acuuacauauauaauaaauaaauaaaucuuaaaaaagagagaga

SEQ ID NO: 53468 - RNA, 46 nt, Mus musculus
ccaucuuuaaccuuuuaaguucuccuuauucauuggaagcaagugg

SEQ ID NO: 53469 - RNA, 45 nt, Mus musculus
auguguuacacugaaucccauuagucauauuaaucuuuaacccua

SEQ ID NO: 53470 - RNA, 46 nt, Mus musculus
gaaucuugccccaaacccagggauaaagagaaauccaaauuaugag

SEQ ID NO: 53471 - RNA, 45 nt, Mus musculus
uacgaaucuaaccuuaucugccaugggcugcagcuggaagcaaca

SEQ ID NO: 53472 - RNA, 88 nt, Mus musculus
cguaaaagugcacgcgcccugggaagugcugugcaccuaugcugagaucaugcacaucaaacucccgcuaaagccaaacgaccugaaa

SEQ ID NO: 53473 - RNA, 49 nt, Mus musculus
ugaacgagagugucaucaagccagagcaggaguucuucacugccccuuu

SEQ ID NO: 53474 - RNA, 47 nt, Mus musculus
uuucuacauccucgauagagauuccuucuucaacccugccaccagaa

SEQ ID NO: 53475 - RNA, 55 nt, Mus musculus
acguuaacaaauuugggauuaauagacuggucagcucuggaaucuacaaagcagc

SEQ ID NO: 53476 - RNA, 44 nt, Mus musculus
acccagaacaucaaacaagugcuugacucacauggauaagcaga

SEQ ID NO: 53477 - RNA, 48 nt, Mus musculus
uagcgagcguuaccuccuguacagagaaugggcucacccucggaguau

SEQ ID NO: 53478 - RNA, 42 nt, Mus musculus
guugucuuacuuguacgagcuuaucccauauaaugucggaag

SEQ ID NO: 53479 - RNA, 28 nt, Mus musculus
cuuuuaugacuuagcaaacacuguccca

SEQ ID NO: 53480 - RNA, 41 nt, Mus musculus
cccacgcccugccaccaaacaauucugaaaucauagcgcag

SEQ ID NO: 53481 - RNA, 85 nt, Mus musculus
gucugugauccugacaucgguggccagauccugaugugcccccagugugacaggcuguguccguucuggaggcugaauaucaccu

SEQ ID NO: 53482 - RNA, 44 nt, Mus musculus
agccuaaaaugugugcuuguagauuuguacuuaaaaacccugca

SEQ ID NO: 53483 - RNA, 46 nt, Mus musculus
aacccuaacuaugacagaagucaauuagauuuuuuuacccagccag

SEQ ID NO: 53484 - RNA, 49 nt, Mus musculus
ccccucccccucuccuuugacuagacaaucacaggaaccucguuagucc

SEQ ID NO: 53485 - RNA, 44 nt, Mus musculus
aacaguccccacaguuagaauucagccuggggcaggggcagcag

SEQ ID NO: 53486 - RNA, 69 nt, Mus musculus
uuuuaaacaagguguagugauuucugggaaagauccauggacucagaaagcgcagcacccacacuuggg

SEQ ID NO: 53487 - RNA, 46 nt, Mus musculus
agcucuguagaaagcuuggcuuuucccaggcuucaaucggugacag

SEQ ID NO: 53488 - RNA, 42 nt, Mus musculus
guuacauuguuuuuggaguuuuggaagcggcgccaggcagag

SEQ ID NO: 53489 - RNA, 45 nt, Mus musculus
gaggcccagugcaaucacguggugauaaacgagaucacucaggua

SEQ ID NO: 53490 - RNA, 46 nt, Mus musculus
uaaaauuugagcagggcaugguggugcacgccuuuaaucccagcac

SEQ ID NO: 53491 - RNA, 46 nt, Mus musculus
aagagcccaaguaggaggcagugagaacucuaagaaauugcagcag

SEQ ID NO: 53492 - RNA, 42 nt, Mus musculus
gcaggugauuuuguuucucagucuuuccuagaaagcaggugg

SEQ ID NO: 53493 - RNA, 45 nt, Mus musculus
guguguguguguguguguguuagcuuacuuuagcuuuuacagacu

SEQ ID NO: 53494 - RNA, 45 nt, Mus musculus
acaacuuaauuauccaguagguacccagucggcugaggguuuaga

SEQ ID NO: 53495 - RNA, 47 nt, Mus musculus
cagaaguaccugaccccacagauggccacauccaucacagccuccau

SEQ ID NO: 53496 - RNA, 66 nt, Mus musculus
acccagacggauuaugagaacagccugaccaugaagauguucuuguuccaguuugucaacuauuac

SEQ ID NO: 53497 - RNA, 60 nt, Mus musculus
cauucuucaagggcaaauucgugggcuaucccggggacccaguguacuugcugggcaaau

SEQ ID NO: 53498 - RNA, 46 nt, Mus musculus
cagugugacccggggggcugccuccuugaacugaccacacagcuga

SEQ ID NO: 53499 - RNA, 43 nt, Mus musculus
cacaaccaccuguaaugagaucugacucccucuucuggugcau

SEQ ID NO: 53500 - RNA, 45 nt, Mus musculus
uaucaccguguuuuguuaauguuaugguaaauuuguacaggaguu

SEQ ID NO: 53501 - RNA, 30 nt, Mus musculus
ucuuucaaguucuguggugugauucccacg

SEQ ID NO: 53502 - RNA, 45 nt, Mus musculus
aggucuauaccaggacagaagauauauugggaagcccagaaagaa

SEQ ID NO: 53503 - RNA, 45 nt, Mus musculus
uuucaggggccucagagucugaguuccuccuugccuggccuccua

SEQ ID NO: 53504 - RNA, 49 nt, Mus musculus
gauggguuaugaaucuaauuggacgauauaaaagagucucgggaucaga

SEQ ID NO: 53505 - RNA, 46 nt, Mus musculus
uguuaauguuuauguuguucaaagcuaaggauuuauuacugggcaa

SEQ ID NO: 53506 - RNA, 38 nt, Mus musculus
guaugcccuaugguuuuuguucuuguuacugcugcuag

SEQ ID NO: 53507 - RNA, 46 nt, Mus musculus
uagcgagacagagggagaaguuuggugaccauuauauaaccagggg

SEQ ID NO: 53508 - RNA, 45 nt, Mus musculus
ucaccuguuuuaaaaauguaccucaucuuauaaaaaaaagcuuuc

SEQ ID NO: 53509 - RNA, 66 nt, Mus musculus
agcguuuaagucugugauaaagaaaugguuuucacggugcuuucauuuuaguaacacucaaaaaga

SEQ ID NO: 53510 - RNA, 42 nt, Mus musculus
ccagauguguccaaaaucacgaaaagcaagaucaagagggag

SEQ ID NO: 53511 - RNA, 42 nt, Mus musculus
cgagagucaccucaaagaccugaccaaaaacauggggaucau

SEQ ID NO: 53512 - RNA, 46 nt, Mus musculus
agagaggauggcauuggaacuccuaggcaggcggagucuugcccau

SEQ ID NO: 53513 - RNA, 45 nt, Mus musculus
aaucuaucccagaccuauuuuguccggacagcaccaucaccaaag

SEQ ID NO: 53514 - RNA, 46 nt, Mus musculus
caauguugacuggcuuucagaucuuaaggguauauaagaugaaaag

SEQ ID NO: 53515 - RNA, 46 nt, Mus musculus
gccacggugaccagcuuccuugcccagcuccauucguugccugcua

SEQ ID NO: 53516 - RNA, 45 nt, Mus musculus
cauugcacagcugaaaccaagugccacuccuugccccuaccccca

SEQ ID NO: 53517 - RNA, 42 nt, Mus musculus
caaauaaaaagugcauuucuucaucuauauuccccagccaag

SEQ ID NO: 53518 - RNA, 46 nt, Mus musculus
aaaaaaaaaaaacuuccuuuucugaaaggagcacucauggcaucug

SEQ ID NO: 53519 - RNA, 45 nt, Mus musculus
uugugugcuccuuguguucguuccuacaaugguugagaaguggag

SEQ ID NO: 53520 - RNA, 32 nt, Mus musculus
agagaaagagaaagagaggaagagagagagaa

SEQ ID NO: 53521 - RNA, 57 nt, Mus musculus
aaaccaacaaauagcugaagucaggauagaauaaggagagauguaagcaagaagcug

SEQ ID NO: 53522 - RNA, 51 nt, Mus musculus
ccaagguuuauggccugggcauuuauuaauaauuagucucagagucuucau

SEQ ID NO: 53523 - RNA, 46 nt, Mus musculus
cuccuucgaaugccaucacaggagugagcacuaagcuggaggaaga

SEQ ID NO: 53524 - RNA, 46 nt, Mus musculus
cugaggugaguccauggagggacaugcuuggaaagccuaggaauaa

SEQ ID NO: 53525 - RNA, 36 nt, Mus musculus
agacguuuggcuaaagccaaacgaaaagcacuugag

SEQ ID NO: 53526 - RNA, 46 nt, Mus musculus
caggcuugcccacuaaucuuuccgccucuuccuccugaaugcugag

SEQ ID NO: 53527 - RNA, 28 nt, Mus musculus
ugggagggagcucaaagcagauuaacug

SEQ ID NO: 53528 - RNA, 44 nt, Mus musculus
agcacauauaaaucuauuccaauccucuaggcuaaucuggcuac

SEQ ID NO: 53529 - RNA, 46 nt, Mus musculus
gugcgugugcgugcgugugugugucugugugugugugugugugugu

SEQ ID NO: 53530 - RNA, 42 nt, Mus musculus
gucauuacccuuugggaugcucaaagagucucaucguggcug

SEQ ID NO: 53531 - RNA, 46 nt, Mus musculus
cuuccugucuuucuaaagugcauuuccacuuaaagguaacucugag

SEQ ID NO: 53532 - RNA, 45 nt, Mus musculus
ggaaccuugcucccucacaggagguuugggaagucucuccacacu

SEQ ID NO: 53533 - RNA, 45 nt, Mus musculus
cagcacagccaaucggacaacaaggagaagaaugucaguccccac

SEQ ID NO: 53534 - RNA, 42 nt, Mus musculus
guguguguaugauauguuaguuacagcugaaguucggagcag

SEQ ID NO: 53535 - RNA, 45 nt, Mus musculus
gacaacgagagggagaaggaggaaccccagcaggauucgccggac

SEQ ID NO: 53536 - RNA, 46 nt, Mus musculus
uacaccuccaaccuucuuuuccuuaugucacagguucuagggcgag

SEQ ID NO: 53537 - RNA, 45 nt, Mus musculus
aacccaucuauuuuacaauuaacaauaccuucuggaaaggcuggc

SEQ ID NO: 53538 - RNA, 45 nt, Mus musculus
ugcggcucgcucgcggcgcgggcuuccuuuuguccuuggcggcgc

SEQ ID NO: 53539 - RNA, 47 nt, Mus musculus
gugcucucccugcgagcuggcccaccucacggcagcgucucccgugg

SEQ ID NO: 53540 - RNA, 42 nt, Mus musculus
gcccggggagacgcuagcaccagggguggggugguagcagga

SEQ ID NO: 53541 - RNA, 45 nt, Mus musculus
ucguccauucucaguccuggccccacuggcgaugccucugcugac

SEQ ID NO: 53542 - RNA, 46 nt, Mus musculus
uagauguuuccuauaaucgaaucccuuccauaccgaugcaccauau

SEQ ID NO: 53543 - RNA, 42 nt, Mus musculus
gaguggaggggaggaggggagaggagaggagaggagaggagg

SEQ ID NO: 53544 - RNA, 56 nt, Mus musculus
augagacuagugcucuuaggacaggagaagaggagaggagaggagaggagagggga

SEQ ID NO: 53545 - RNA, 46 nt, Mus musculus
ugacuggaaccucuucaacaggauccaccaggugcaggagguagag

SEQ ID NO: 53546 - RNA, 45 nt, Mus musculus
ggccugggaaguaguuggggugagccuuacaggcuuugguuuauu

SEQ ID NO: 53547 - RNA, 42 nt, Mus musculus
uguuucuuuccugggacgggcgcuuugacuuggaguggagga

SEQ ID NO: 53548 - RNA, 42 nt, Mus musculus
ggaugcugugaggaugcuguggggaugcugugaggaugcugu

SEQ ID NO: 53549 - RNA, 42 nt, Mus musculus; identical to SEQ ID NO: 53548

SEQ ID NO: 53550 - RNA, 42 nt, Mus musculus
gucuuguuuuauuuucaggugaauuuuaccgugaaggcugag

SEQ ID NO: 53551 - RNA, 46 nt, Mus musculus
ugugaagauuucauacauuggccacauaucccagagcaccuuggag

SEQ ID NO: 53552 - RNA, 44 nt, Mus musculus
uuuaccacaugguauaaguagaggaggaagaagaaacccgcaga

SEQ ID NO: 53553 - RNA, 68 nt, Mus musculus
uguggaaccuagggccuucccucuauguuccagccccaccccaccccccacacugaacccccuggccc

SEQ ID NO: 53554 - RNA, 44 nt, Mus musculus
uccccucgacagagccagcugcuaggaagggcuaaugugggaga

SEQ ID NO: 53555 - RNA, 46 nt, Mus musculus
aaauauuuauugccaugaauacaagaauaugagacaugcaacagaa

SEQ ID NO: 53556 - RNA, 42 nt, Mus musculus
agggccacuguccaugugugucuccuucucucgcugccucuc

SEQ ID NO: 53557 - RNA, 42 nt, Mus musculus
aguuuucuaugcagucuucuccccgauucccugcgcccagcc

SEQ ID NO: 53558 - RNA, 45 nt, Mus musculus
cacacagugaucccagcaagcccuguguaucgggccuuuguagau

SEQ ID NO: 53559 - RNA, 42 nt, Mus musculus
aaccaccagcauguaggacacacauccccaagacgcagaguc

SEQ ID NO: 53560 - RNA, 46 nt, Mus musculus
gcccaguguaaccuguuaaggguauagagcgaaaauugugguagaa

SEQ ID NO: 53561 - RNA, 46 nt, Mus musculus
ucuuuuuagaaaacaaauucagaugccaaauucacagcccagaguu

SEQ ID NO: 53562 - RNA, 42 nt, Mus musculus
ggugucuagcugugaguaacuccuuuauuuuugauggcauga

SEQ ID NO: 53563 - RNA, 46 nt, Mus musculus
aggacagucugcuacagagugagacccugucucaacccaagcagug

SEQ ID NO: 53564 - RNA, 40 nt, Mus musculus
cuggcuaguggcucgugggauggagggagacccagcagug

SEQ ID NO: 53565 - RNA, 45 nt, Mus musculus
cacuugaggagagaacgacuugcaucuaaacucagccugcauauc

SEQ ID NO: 53566 - RNA, 43 nt, Mus musculus
cacugcugcugcccuuucauccugagcacugugaccccgucuc

SEQ ID NO: 53567 - RNA, 25 nt, Mus musculus
cugggacuaggagggucuuuauagg

SEQ ID NO: 53568 - RNA, 46 nt, Mus musculus
aaagaugguacuuguaacuucaccugggaaggaaaggccauggcca

SEQ ID NO: 53569 - RNA, 45 nt, Mus musculus
gaaauggaaaaagaaauaaagaauguauuucguaacgguaaccag

SEQ ID NO: 53570 - RNA, 45 nt, Mus musculus
agcuucccaaguguuccccaugaaccagagacaccuucgccuggg

SEQ ID NO: 53571 - RNA, 42 nt, Mus musculus
ugcgacacguggaggccccacagugguaccccagagugggaa

SEQ ID NO: 53572 - RNA, 46 nt, Mus musculus
cagcugggugccaaguguccaagugccagagacuggcgggcauuuc

SEQ ID NO: 53573 - RNA, 46 nt, Mus musculus
auuaaauguuaaaaugcuaucaaaguguaaagugaucuggaucgau

SEQ ID NO: 53574 - RNA, 48 nt, Mus musculus
uuuaauagggacagaugcaggcggcuggggaugggugcagaucccagg

SEQ ID NO: 53575 - RNA, 42 nt, Mus musculus
gaagaaacaacccuuguucucucugguuucacagccucagua

SEQ ID NO: 53576 - RNA, 46 nt, Mus musculus
aggacuuauuccaccccuuacuucaagccgcaguccgucaccgggg

SEQ ID NO: 53577 - RNA, 42 nt, Mus musculus
cauugucaguuguagcuuauugauguccuagaugcugcugac

SEQ ID NO: 53578 - RNA, 45 nt, Mus musculus
uagcaucuuuuuccucccucgguuuaaacagacucugucccuguu

SEQ ID NO: 53579 - RNA, 46 nt, Mus musculus
cugucuugaaaaacaaaaaacaaacaaacaaaaagaaccuguguga

SEQ ID NO: 53580 - RNA, 46 nt, Mus musculus
gugugugugugaacaugcauguguuaugugcacaucagagggcagu

SEQ ID NO: 53581 - RNA, 46 nt, Mus musculus
aauacaagccauuagccuuuacuuacugagccaaucugccagccuu

SEQ ID NO: 53582 - RNA, 46 nt, Mus musculus
ugccucagucaggagcguagguguugacuguaauuagagagagaga

SEQ ID NO: 53583 - RNA, 47 nt, Mus musculus
cugagauguagugcaguauagaaugucugucugccuugagagagaga

SEQ ID NO: 53584 - RNA, 42 nt, Mus musculus
gaagucaaaagaggugucggauccccuggaguggaguuaguu

SEQ ID NO: 53585 - RNA, 46 nt, Mus musculus
cauuuuaaagaaaggauacauuacauaucccuugaacucucagaga

SEQ ID NO: 53586 - RNA, 46 nt, Mus musculus
ccagacuuuuuguucugagacaaaaccuaauucuguagccugaguu

SEQ ID NO: 53587 - RNA, 41 nt, Mus musculus
agaagcucugcucugauuggcccuugacagaaggcccuguu

SEQ ID NO: 53588 - RNA, 44 nt, Mus musculus
uccucagauguauaagcccgagcagguacugucugugccagacg

SEQ ID NO: 53589 - RNA, 45 nt, Mus musculus
uagugggcuggaggggagauuggagacuccuguaacacggaagau

SEQ ID NO: 53590 - RNA, 88 nt, Mus musculus
ggaguggauagaauaguaaagauaguccccuccccucaaaauagugauaggaagagguggggagaacccccucugggucuuugguagg

SEQ ID NO: 53591 - RNA, 42 nt, Mus musculus
cuuuaauguaauccuacauaguugggagacaggcaggaggau

SEQ ID NO: 53592 - RNA, 45 nt, Mus musculus
gcccuaacuuguaggcuuuaaacuuacucaaauuagaaacuuuga

SEQ ID NO: 53593 - RNA, 62 nt, Mus musculus
uuacuguggguuuucugccccgaacaugagucucuacugugaguuuuugugcaguauuauug

SEQ ID NO: 53594 - RNA, 48 nt, Mus musculus
uaggggcggggagcugaagaaacagcugagucauuggugacggaugug

SEQ ID NO: 53595 - RNA, 46 nt, Mus musculus
guucauuaaugcugccaagggcuccuccaauuccugugccaucaag

SEQ ID NO: 53596 - RNA, 42 nt, Mus musculus
gcucuuacacagggaaauccuguucugaaaaacaaagcagau

SEQ ID NO: 53597 - RNA, 42 nt, Mus musculus
cuugucuguaaccucacugcuuugugggaggaugaggcaguc

SEQ ID NO: 53598 - RNA, 46 nt, Mus musculus
cgugaguccaggcuuuguucucugucagucagccugugccugagua

SEQ ID NO: 53599 - RNA, 42 nt, Mus musculus
aguagucuccugacuggcccugagggacuuuuggccaaagag

SEQ ID NO: 53600 - RNA, 46 nt, Mus musculus
ccugcucaaagagaagaagcgccgcuauuuacacaaccggaaagug

SEQ ID NO: 53601 - RNA, 46 nt, Mus musculus
aacucaaauuuuaauuauauguuaaguucuacucuaaccccugguc

SEQ ID NO: 53602 - RNA, 26 nt, Mus musculus
cuaucuauacuuagacgcgugcugca

SEQ ID NO: 53603 - RNA, 46 nt, Mus musculus
acagcuggagugauggggaccaggaacccaucacuguggaucagac

SEQ ID NO: 53604 - RNA, 46 nt, Mus musculus
cucugauuuucugugagauacugcuaacuuuuuuugugugugugug

SEQ ID NO: 53605 - RNA, 46 nt, Mus musculus
ggcuuuacuagguaauuuguaaacagcuaguucuagauuugaagcg

SEQ ID NO: 53606 - RNA, 82 nt, Mus musculus
aagaaugcacccuucaaacaauguaguuacgucucgacgaagaauggaaaaaggugccccagugcugccccaaagcccgaga

SEQ ID NO: 53607 - RNA, 45 nt, Mus musculus
gccaaggcgcucgggucggggcugugagcgcugaggcggccaggg

SEQ ID NO: 53608 - RNA, 42 nt, Mus musculus
uuguuuuguuuuguuuugucugauuuuuguacugcucagcau

SEQ ID NO: 53609 - RNA, 45 nt, Mus musculus
caguguaugcugagggagugauuagcugauggcuauaaugaaguc

SEQ ID NO: 53610 - RNA, 42 nt, Mus musculus
ucgagagggaugcuugacagcauguuaauugaagccagagca

SEQ ID NO: 53611 - RNA, 67 nt, Mus musculus
auucuaaagauguuaacgugaacuuggcaauggaaaggggaaggaaaauaauauuuaauaaaaauca

SEQ ID NO: 53612 - RNA, 56 nt, Mus musculus
ugaugaguuauuuugauacucaugcuaggaaaagggagaaacaaaaccaucuugag

SEQ ID NO: 53613 - RNA, 46 nt, Mus musculus
auuuguugagauuuuguuuuccauccugaccuucccaaacggaaaa

SEQ ID NO: 53614 - RNA, 46 nt, Mus musculus
gcgccugccguugcugugcacaacaaggagcuccuugcugauaaac

SEQ ID NO: 53615 - RNA, 45 nt, Mus musculus
gacacugaggcaguuacuagugcugacacacuggcccaacggaga

SEQ ID NO: 53616 - RNA, 45 nt, Mus musculus
guguguguauguguacacacacauauauguggguuuuggggggua

SEQ ID NO: 53617 - RNA, 46 nt, Mus musculus
uugcuguuauuugguucauugcaugaguguguauguguguguauau

SEQ ID NO: 53618 - RNA, 45 nt, Mus musculus
aauauauuugaugaaggaaaucuugaaaaaauacugacuagauaa

SEQ ID NO: 53619 - RNA, 45 nt, Mus musculus
uugcuuguccugucugaaaagaccagaccaugugugcuacuagga

SEQ ID NO: 53620 - RNA, 46 nt, Mus musculus
uagcagcccucucgcuucuaguucugaccugacuccugcgccagua

SEQ ID NO: 53621 - RNA, 41 nt, Mus musculus
caggccucuugaaguauugagaucuuuaaaagugcgugugu

SEQ ID NO: 53622 - RNA, 46 nt, Mus musculus
uaaagaaaguaaguuauguuuaguuuuuuuuauauaaucgggaggg

SEQ ID NO: 53623 - RNA, 46 nt, Mus musculus
uugcuauugagacaagugggcgggugguggagggagggccucaguu

SEQ ID NO: 53624 - RNA, 41 nt, Mus musculus
ggaagagacuggggcagcaguauuugaucauccagccaaga

SEQ ID NO: 53625 - RNA, 44 nt, Mus musculus
augaguguuugccuacauuuaugugcauguacuaccuguggagg

SEQ ID NO: 53626 - RNA, 46 nt, Mus musculus
gucugacucccauauuguuuguucggucauccccagucaccaagug

SEQ ID NO: 53627 - RNA, 46 nt, Mus musculus
gcauacauaauucuaugcauuaacuuugcuauaaaauguccaagag

SEQ ID NO: 53628 - RNA, 46 nt, Mus musculus
cauuuuaaaugagcugauguucaaaauaaagcuugccucucuagau

SEQ ID NO: 53629 - RNA, 47 nt, Mus musculus
gaccuccgguugcuggugagaacuuuuccucacuuccucugccugag

SEQ ID NO: 53630 - RNA, 46 nt, Mus musculus
uuuuaaauuaaaaccuaaaaucuuuaguaugugucgugcgugagac

SEQ ID NO: 53631 - RNA, 44 nt, Mus musculus
gguugugagccaccaugugguugcugggauuuaaaccucagacc

SEQ ID NO: 53632 - RNA, 46 nt, Mus musculus
uugugaguucaagaguaagaccuauucaacuauacaaauagcaaac

SEQ ID NO: 53633 - RNA, 42 nt, Mus musculus
gcgugguggcgcacaugccuuuaaucccagcacucgggaggc

SEQ ID NO: 53634 - RNA, 45 nt, Mus musculus
guguuugcagggagugugugacucuacccaguauaccugcaaucu

SEQ ID NO: 53635 - RNA, 46 nt, Mus musculus
ccaucccgaaugcagaaacacuuaaucugaaacuucucccuaagaa

SEQ ID NO: 53636 - RNA, 46 nt, Mus musculus
uauuauauuucuauggguugccauucuaauuucuuaagccccugug

SEQ ID NO: 53637 - RNA, 74 nt, Mus musculus
augaaugugcaaucccagaaucaucccccucagaacgcaggcauaaguccacuagaacucuuaacauguaucaa

SEQ ID NO: 53638 - RNA, 66 nt, Mus musculus
gauuauaugucagagcaucaucaguuuuaaucuguaaaggcagauccaagacagccaucaucucug

SEQ ID NO: 53639 - RNA, 73 nt, Mus musculus
cccugguaccuggacccuuuaacacgugagacuacaggagacauuucauagucaaaucauaacaccuuccccc

SEQ ID NO: 53640 - RNA, 45 nt, Mus musculus
ucaaugauuucaaccugugguuacuuagcuauauugcuuuugguc

SEQ ID NO: 53641 - RNA, 46 nt, Mus musculus
ugauucuagccaaaaggcugagaaacacauggucauugucagaguu

SEQ ID NO: 53642 - RNA, 44 nt, Mus musculus
ugagccaccaugugguugcugggauuugaacuuuggaccgucgg

SEQ ID NO: 53643 - RNA, 46 nt, Mus musculus
acccacagaaauccuucaacuguguaccuacaccucccugccagug

SEQ ID NO: 53644 - RNA, 52 nt, Mus musculus
aaugaaguuuaggccaggcaugguagugcguggcuuuaauuucagcaccaag

SEQ ID NO: 53645 - RNA, 45 nt, Mus musculus
uguuguuucucauaaucuagguggccgaaaggagacagggcauag

SEQ ID NO: 53646 - RNA, 47 nt, Mus musculus
uaaaaaaggacuuggcuuuauuuuugccuguguuuggguuagggaau

SEQ ID NO: 53647 - RNA, 42 nt, Mus musculus
aucaucuguuuagcuuggccauuuguuacuuuggggggagau

SEQ ID NO: 53648 - RNA, 23 nt, Mus musculus
uguuuguacugauuuacaacuug

SEQ ID NO: 53649 - RNA, 45 nt, Mus musculus
ugaacacugcccacccaccuccucaccucccccacgccccccccc

SEQ ID NO: 53650 - RNA, 45 nt, Mus musculus
guggaugacuaucaaaugguuucaaagguuuuauacuucagaggu

SEQ ID NO: 53651 - RNA, 46 nt, Mus musculus
ccugugccuuugaucugagcuuuggagaaguagaagcaggccagaa

SEQ ID NO: 53652 - RNA, 41 nt, Mus musculus
uggccgagccacuguucgcgcgagggaagugaggcggaguc

SEQ ID NO: 53653 - RNA, 42 nt, Mus musculus
ccccgccgcugccucuugguugaagcacuauggagggagaga

SEQ ID NO: 53654 - RNA, 43 nt, Mus musculus
acgcucgcugcgcuuggcuggguaguuuccgaggacgugcgug

SEQ ID NO: 53655 - RNA, 29 nt, Mus musculus
ccuauuuuguagcagccuuuccucccguu

SEQ ID NO: 53656 - RNA, 45 nt, Mus musculus
accaaacucaaguccucugggagacugucagcucucucucugucu

SEQ ID NO: 53657 - RNA, 46 nt, Mus musculus
uucucagcccuaaaaaauccaagcauggaggcacgugccuguaacc

SEQ ID NO: 53658 - RNA, 46 nt, Mus musculus
cgguaccaaguguauacgugauacacaggcaaagcacacaggcaca

SEQ ID NO: 53659 - RNA, 45 nt, Mus musculus
cagacaguugugagcugccauuugggugccaggaaucaaacccag

SEQ ID NO: 53660 - RNA, 42 nt, Mus musculus
cccucauucugagccagagauggcugccacagcucugugggg

SEQ ID NO: 53661 - RNA, 46 nt, Mus musculus
cuucagacauauuuauagcaaaugcugcaucaggggauggagccug

SEQ ID NO: 53662 - RNA, 45 nt, Mus musculus
auucuguuucagcgggugcugacgguacuguuugaacccaagaga

SEQ ID NO: 53663 - RNA, 42 nt, Mus musculus
agaggguaggaguugagacugggucuuguuuugguuuugguu

SEQ ID NO: 53664 - RNA, 56 nt, Mus musculus
uguacuuacauauaauaaauaaauaaauaaauaaauaaauauuuaaaaaaaaaaaa

SEQ ID NO: 53665 - RNA, 58 nt, Mus musculus
auaaccaucugaaauaaaaucugauacucucuucuggagugucugaagacagcuacag

SEQ ID NO: 53666 - RNA, 44 nt, Mus musculus
gcauccauggugugucugaacaagucuagcccagugcccccgaa

SEQ ID NO: 53667 - RNA, 41 nt, Mus musculus
uguaacaggcagggcuauuucuucacugggagacccuagag

SEQ ID NO: 53668 - RNA, 47 nt, Mus musculus
cucaucucuccucauuaccacccucgaugcccccacccccaccccca

SEQ ID NO: 53669 - RNA, 61 nt, Mus musculus
ccaaaaagaagcuaaaagaggagaaacgaaacaagaguaagaagaaauaaauagugguuuu

SEQ ID NO: 53670 - RNA, 79 nt, Mus musculus
guaggcaucgccauggugccggcgcuccuggggcugaucggguaucaccuguacagaaaggccagcagacccaaagucu

SEQ ID NO: 53671 - RNA, 42 nt, Mus musculus
cacgagauucuuacaccaguguugccuguagggggcccugga

SEQ ID NO: 53672 - RNA, 42 nt, Mus musculus
uaaccaggccuuucuccugccugucacacacagucccaagaa

SEQ ID NO: 53673 - RNA, 45 nt, Mus musculus
auccuugcucaaaaaugugggauaaugcaaugacugugcccuggu

SEQ ID NO: 53674 - RNA, 77 nt, Mus musculus
ccugcauuccucucuuuacuguuccugcgucccccucugucgaccucacucucucugccguuucuaagccccuaccc

SEQ ID NO: 53675 - RNA, 47 nt, Mus musculus
uguguguguaagugugagugugugugagugugugugugugugagugu

SEQ ID NO: 53676 - RNA, 46 nt, Mus musculus
cucaggaacucagagggagguggguuagugggaccugcauguagag

SEQ ID NO: 53677 - RNA, 46 nt, Mus musculus
aaugaagcuguuacgguuucguggggugguccccauugguuucagg

SEQ ID NO: 53678 - RNA, 23 nt, Mus musculus
ccauggccagcccuugcccugau

SEQ ID NO: 53679 - RNA, 46 nt, Mus musculus
cccccaccccccacccccggcucucacgccacaucuuagcguagau

SEQ ID NO: 53680 - RNA, 46 nt, Mus musculus
aaggauacagaccuugcagaggggguuacauuuuaauuagggagau

SEQ ID NO: 53681 - RNA, 65 nt, Mus musculus
gaucacagauguaugugucaccaugcccagcuuuacagcacauugaucaacuguaguccauagau

SEQ ID NO: 53682 - RNA, 45 nt, Mus musculus
auaguuguggguagccuugaacuucugaucuccuugccuccaggu

SEQ ID NO: 53683 - RNA, 45 nt, Mus musculus
gcuuacccaucaucuuggauuuauuuccauuaaugcccccccccc

SEQ ID NO: 53684 - RNA, 46 nt, Mus musculus
ucuggcugcucccggaagcuuaguggcuaccagguaucugugagau

SEQ ID NO: 53685 - RNA, 46 nt, Mus musculus
gaagauaguuuuccaagugcacuaccuggccaguuuagcugcaggu

SEQ ID NO: 53686 - RNA, 46 nt, Mus musculus
ugucuugcugucuagaccaggcuggcuuugaacucaaauccuccaa

SEQ ID NO: 53687 - RNA, 46 nt, Mus musculus
gagccaucucucaccuuuuucugucugaagaauugucauccaguuc

SEQ ID NO: 53688 - RNA, 45 nt, Mus musculus
aaucugcauuaaguucuaaagcgaauauccucguccuuaccagau

SEQ ID NO: 53689 - RNA, 41 nt, Mus musculus
gugguggcgcacgccuuuaaucccaacagaggcaggcagau

SEQ ID NO: 53690 - RNA, 45 nt, Mus musculus
aaaucucaacaaccacaugauggcucacaaccauccuuaaugaga

SEQ ID NO: 53691 - RNA, 25 nt, Mus musculus
cagaaagcaaucugaagagaaaagg

SEQ ID NO: 53692 - RNA, 45 nt, Mus musculus
gacuugccagguggugguggccuguuuuaaucccagcacucagga

SEQ ID NO: 53693 - RNA, 42 nt, Mus musculus
aacuauaguacauaaaacauuuuagugaggaagugggcuguu

SEQ ID NO: 53694 - RNA, 42 nt, Mus musculus
aacaaacaagcaaacaaaaaguuaaagauuggggcuggagag

SEQ ID NO: 53695 - RNA, 45 nt, Mus musculus
gauuugagccaggcgugguggcgcacaccuuuaaucccagcacuc

SEQ ID NO: 53696 - RNA, 46 nt, Mus musculus
gaugugcugaaauaaauaaauaaaucuuauaagaagauggugggcu

SEQ ID NO: 53697 - RNA, 45 nt, Mus musculus
agcuccaggagacccaaccaaaccugcaugcacacacguauaguu

SEQ ID NO: 53698 - RNA, 45 nt, Mus musculus
ccugagucugauuccguacuccugccccagguccacaagguagaa

SEQ ID NO: 53699 - RNA, 49 nt, Mus musculus
cauguaguguggcaccaacacucaggcagggcugcuguaaaagagagcu

SEQ ID NO: 53700 - RNA, 41 nt, Mus musculus
acccuuggguccauggcaugaaaguuuuauugggaggagau

SEQ ID NO: 53701 - RNA, 23 nt, Mus musculus
uuuugaaggaaggagggggaggu

SEQ ID NO: 53702 - RNA, 45 nt, Mus musculus
ggggccuuccucccccaggcggagcgggggcggugucaccgaagg

SEQ ID NO: 53703 - RNA, 41 nt, Mus musculus
ccgccucccccgagggugcgaccugggcugcagaggugagc

SEQ ID NO: 53704 - RNA, 58 nt, Mus musculus
cagcuccugucgccgucgcggcuuccggugcuagguggagggcgggcaggagggagcc

SEQ ID NO: 53705 - RNA, 42 nt, Mus musculus
ucuguccccgugcaccugucuuacaucuccccugccauuggu

SEQ ID NO: 53706 - RNA, 45 nt, Mus musculus
ucgaugcuguggaaacuucagccaagguccaggugugacuaagcu

SEQ ID NO: 53707 - RNA, 41 nt, Mus musculus
uagggugggcaaacaucaggaccagcgagugugucugagaa

SEQ ID NO: 53708 - RNA, 42 nt, Mus musculus
auguuaguggcagcacagcccacgccaaccuuccaugcagag

SEQ ID NO: 53709 - RNA, 44 nt, Mus musculus
gguagucuuuuugaacccacaauucccuugccuuuccucuaagg

SEQ ID NO: 53710 - RNA, 41 nt, Mus musculus
ccagcaaccacaugguggcucacaccuauccguaacgagau

SEQ ID NO: 53711 - RNA, 44 nt, Mus musculus
ugugaacgugaguauaguugccugaggaggccagaggcaccaga

SEQ ID NO: 53712 - RNA, 45 nt, Mus musculus
auacucacguucacacacauggauacuuaaaaauaaaccugccag

SEQ ID NO: 53713 - RNA, 42 nt, Mus musculus
acgagaucccuagaccucaccacacccugcucugccccugcc

SEQ ID NO: 53714 - RNA, 46 nt, Mus musculus
ugagucuucucucaggagcuccacgcccacugucuagagcuagaga

SEQ ID NO: 53715 - RNA, 24 nt, Mus musculus
gggcaagaagagggaggcugcuug

SEQ ID NO: 53716 - RNA, 44 nt, Mus musculus
acuacagguaaggcggagacucggugcuguacaaagaugcccag

SEQ ID NO: 53717 - RNA, 42 nt, Mus musculus
augagggauggagguguccugggcgacacucacguggcagug

SEQ ID NO: 53718 - RNA, 42 nt, Mus musculus
uuuaaagcgcucucucuuccuccacccccagcgccccugucc

SEQ ID NO: 53719 - RNA, 46 nt, Mus musculus
ccuuuaaaaaaaaauaaaucgcugacaagugugaacccgugaagaa

SEQ ID NO: 53720 - RNA, 33 nt, Mus musculus
uuaaaguacccugccuguauaauugcaucagaa

SEQ ID NO: 53721 - RNA, 45 nt, Mus musculus
uugcuguccccaaagccacagagcugaacggucuaggcauuaggu

SEQ ID NO: 53722 - RNA, 42 nt, Mus musculus
gccuuuuuuuuuucuuuucuuuucuuuuuuuuuuuuuuaaag

SEQ ID NO: 53723 - RNA, 51 nt, Mus musculus
aauuacuauuuucaagaaucagauuaucuggauuguagagaugggcuggau

SEQ ID NO: 53724 - RNA, 55 nt, Mus musculus
gucugcugggguaacaauguauauuuccaaauaaacugagaaaucuuuuguugac

SEQ ID NO: 53725 - RNA, 45 nt, Mus musculus
uggcuucuaacuccuugguuuucuaaaccaauuuuuacagucugu

SEQ ID NO: 53726 - RNA, 42 nt, Mus musculus
gccccaaggcaaacagcgcuuccuaacuauccccaccaccaa

SEQ ID NO: 53727 - RNA, 46 nt, Mus musculus
ggcaguugaagggaagaagcuagcagaguccuggggugcgauguuu

SEQ ID NO: 53728 - RNA, 46 nt, Mus musculus
gaugcuugacugaagcaauuuuacaucuugauugguuuuucgagac

SEQ ID NO: 53729 - RNA, 61 nt, Mus musculus
aacccgguaaguggcuuuaggacauagagaccugaggguguggaaggaagcgaaaggguga

SEQ ID NO: 53730 - RNA, 45 nt, Mus musculus
gaacuaaaacccuagcucuguuucuuauguuugaagcuuucagau

SEQ ID NO: 53731 - RNA, 45 nt, Mus musculus
gcagagaguuaaccgaguauacaagaacguaaccauggaccccga

SEQ ID NO: 53732 - RNA, 72 nt, Mus musculus
guccaugguuacguucuuguauacucgguuaacucucugcgcagguacgcacggagguuuuugagugggggc

SEQ ID NO: 53733 - RNA, 47 nt, Mus musculus
gugugcagggcucaguggagcuacuucauaaaaauuuguuugaugga

SEQ ID NO: 53734 - RNA, 45 nt, Mus musculus
aauguuauaguucagcccuaaauuauaaagucugguagugugugu

SEQ ID NO: 53735 - RNA, 45 nt, Mus musculus
augaaguagcaacaaaaauaauuuuaugguugaggaucaagcauu

SEQ ID NO: 53736 - RNA, 45 nt, Mus musculus
auccucaaccauaaaauuauuuuuguugcuacuucauagcuauga

SEQ ID NO: 53737 - RNA, 57 nt, Mus musculus
guuuugagacaagguuucuuuguguauccuuggcugcuagaacuagcuuuguagacc

SEQ ID NO: 53738 - RNA, 53 nt, Mus musculus
aacaaucuuugguccuuaaagggaagacaucuuuggcacaucaauuuguggaa

SEQ ID NO: 53739 - RNA, 46 nt, Mus musculus
cuucagcgagcuacucuucuucccagaguccaccucggccugcacc

SEQ ID NO: 53740 - RNA, 45 nt, Mus musculus
acuccgcuaaaaggcuugccagcgcgugcauuucagggaugaguu

SEQ ID NO: 53741 - RNA, 46 nt, Mus musculus
aacaucgcagaccacuggaaugcagguagauugaugucucugagcu

SEQ ID NO: 53742 - RNA, 55 nt, Mus musculus
uaggggcgcacccagaccaccaauggguuaacgcuagaggcugaaaggaggagga

SEQ ID NO: 53743 - RNA, 42 nt, Mus musculus
acuuuccauuacaccaccuaauugugugugcaaggggcaggc

SEQ ID NO: 53744 - RNA, 46 nt, Mus musculus
agcaaucagugcucuuaaccauugagccaucucuccagcccccuau

SEQ ID NO: 53745 - RNA, 45 nt, Mus musculus
acagaguaaguaagaccuugucgcuaaaaugaggagggguugaga

SEQ ID NO: 53746 - RNA, 46 nt, Mus musculus
gcaucuauucagcuguuuagccagaugaaacagagcacacagagac

SEQ ID NO: 53747 - RNA, 46 nt, Mus musculus
agcugacaguggcugaccggcgccagaaacgagagauccggcagcu

SEQ ID NO: 53748 - RNA, 46 nt, Mus musculus
gcugcuuuugucaugauucuggaaauuguucuguucccugaaaguc

SEQ ID NO: 53749 - RNA, 45 nt, Mus musculus
cuugguuuucuacagcucaggcugaccucuugccuccgucuccca

SEQ ID NO: 53750 - RNA, 46 nt, Mus musculus
cgucuuacccaucauguaauccucacaggacguuuggcagacagca

SEQ ID NO: 53751 - RNA, 46 nt, Mus musculus
gacuguugcuuuuuccaguuccuuggccuggggacagggauggggu

SEQ ID NO: 53752 - RNA, 42 nt, Mus musculus
aagugggcaggccacgcgcugggccgauggaaaccggcagug

SEQ ID NO: 53753 - RNA, 56 nt, Mus musculus
gccgcagguucccgggcuccuucacuggaccuugcccugguuauuucuaccacagg

SEQ ID NO: 53754 - RNA, 54 nt, Mus musculus
aaggcucccaguacuccuguaccucccagcccugccccaaccccugggcugacc

SEQ ID NO: 53755 - RNA, 61 nt, Mus musculus
agggggccggcgggguggagucaggccgcugcucagggagcgagcccuccucuagugagaa

SEQ ID NO: 53756 - RNA, 76 nt, Mus musculus
cacagguucaucaaaaggaagaaauucgaugaugaacugguagagagcagccuggccaaauccuccacccggguga

SEQ ID NO: 53757 - RNA, 42 nt, Mus musculus
cccaaaccacguuugaaucguccgaaggaaccacccgcuuua

SEQ ID NO: 53758 - RNA, 41 nt, Mus musculus
cgcuaccaccggccugugggccucagagccagauggcgaga

SEQ ID NO: 53759 - RNA, 45 nt, Mus musculus
uuuuuaccucauaucacaagcuggccugaaacuauggcaguccuc

SEQ ID NO: 53760 - RNA, 68 nt, Mus musculus
uuuaagaagcaaggcagacccaggcgugguugcucaugagaaauccucgcacuugugaggcagaggca

SEQ ID NO: 53761 - RNA, 46 nt, Mus musculus
uggcuaaguuaugcccugguguuuugguuguacccauucucaagau

SEQ ID NO: 53762 - RNA, 40 nt, Mus musculus
ccaccaaggggggucacaagaaagaagucacaggugagau

SEQ ID NO: 53763 - RNA, 46 nt, Mus musculus
cagagcacagaccccauggacccugaaaggaaauggacgcauagau

SEQ ID NO: 53764 - RNA, 42 nt, Mus musculus
agagaaaccagcaggauacacagagagaguacaaggccaguu

SEQ ID NO: 53765 - RNA, 42 nt, Mus musculus
ccuugggaggguaaggugaggaccagcaggaaguggccagga

SEQ ID NO: 53766 - RNA, 42 nt, Mus musculus
gggagaggggaccagggguacugggguagucuggggggacca

SEQ ID NO: 53767 - RNA, 45 nt, Mus musculus
ccugggauguuuucugacccauacuaacccuuaccuguaacaugu

SEQ ID NO: 53768 - RNA, 46 nt, Mus musculus
aaguuagcugcuucugucuuuggugaaguuuuucugugaaacagau

SEQ ID NO: 53769 - RNA, 97 nt, Mus musculus
cuacuuuuagcauuuuccagacuuuaaauaaaguugaacgcguaugagaguuugaguguugcauagcucccucccaccuggacacuuagcaccuuua

SEQ ID NO: 53770 - RNA, 25 nt, Mus musculus
cugcacgagacaccccugucugcuc

SEQ ID NO: 53771 - RNA, 45 nt, Mus musculus
aggacaguaguuuauugaagcuauauugauguaucugccuguagu

SEQ ID NO: 53772 - RNA, 42 nt, Mus musculus
ucacagagguuguacaaccucuccaagagcacacccagguau

SEQ ID NO: 53773 - RNA, 46 nt, Mus musculus
aagugaaugucagcuguuuguugaguaguuggauaguucagaagau

SEQ ID NO: 53774 - RNA, 42 nt, Mus musculus
ggaaauugguuuucccuucccaugaugugggucccagggauc

SEQ ID NO: 53775 - RNA, 42 nt, Mus musculus
cuugcauacauggugagaccaaaaaccagcugcucuuauaga

SEQ ID NO: 53776 - RNA, 47 nt, Mus musculus
acugggauucuucuuuggugaagaauuucaaaaugaagaaacgagag

SEQ ID NO: 53777 - RNA, 46 nt, Mus musculus
uuauuuauuauauaucaguacacuguaguugucuucagccacacca

SEQ ID NO: 53778 - RNA, 45 nt, Mus musculus
ucucauuuuuuuaagauuaaaaauaugaguauuuaugggugaggg

SEQ ID NO: 53779 - RNA, 49 nt, Mus musculus
guugguccgaggggaaucuuacuuuguucgguguggugagauagggccu

SEQ ID NO: 53780 - RNA, 46 nt, Mus musculus
gucuuuuaagcuuugcuuaggguguugucucacuguggguacaguu

SEQ ID NO: 53781 - RNA, 45 nt, Mus musculus
cuuuccucaaccgaggccaagcauccaguggccacgccggcaaca

SEQ ID NO: 53782 - RNA, 46 nt, Mus musculus
uuuuucucuggcuuguugugauguuccacucugcuuuggucuguag

SEQ ID NO: 53783 - RNA, 45 nt, Mus musculus
uggacgugaagcugaagcaugcccguaaucaaguggacguggaga

SEQ ID NO: 53784 - RNA, 42 nt, Mus musculus
cuggucauuuucagauguguuugaccauauaguccagcaaga

SEQ ID NO: 53785 - RNA, 71 nt, Mus musculus
ugacugugaaggagguuguuuuuauuuuaugugacuguccuggugugugacagcuaccccaaagguauccc

SEQ ID NO: 53786 - RNA, 73 nt, Mus musculus
uuauccacaucuacuagagcauauuguagcaguuauaccugaauuugcuguuuaacucuggcucagcaauaug

SEQ ID NO: 53787 - RNA, 46 nt, Mus musculus
uucagacacaccaggagaucucauuacgucacacauucugccagcc

SEQ ID NO: 53788 - RNA, 60 nt, Mus musculus
uguguuggggaccccaugggagccagaggagggcaagggagccucuggagcugcagguac

SEQ ID NO: 53789 - RNA, 46 nt, Mus musculus
uggacucuguuugagcagcuugugcgccggauggagauuaucaaug

SEQ ID NO: 53790 - RNA, 46 nt, Mus musculus
aucacgaagaauugucggcgugagauucuuacgauguggcugcaga

SEQ ID NO: 53791 - RNA, 45 nt, Mus musculus
gcacaugcuuguaaucucagcauuuggaaggcuggggcaggaaga

SEQ ID NO: 53792 - RNA, 42 nt, Mus musculus
ccuggaacucacucuguagaccaggacccaaacccaagagau

SEQ ID NO: 53793 - RNA, 42 nt, Mus musculus
gcugagguagaagcaggguucacuuaggauucugagguagaa

SEQ ID NO: 53794 - RNA, 44 nt, Mus musculus
uguuugguugugggauugcgcugcgguuguugagccggugcagg

SEQ ID NO: 53795 - RNA, 47 nt, Mus musculus
ucuguuccucucuuucauuuugugugggguaguguuguguauguggc

SEQ ID NO: 53796 - RNA, 46 nt, Mus musculus
acaguaacaccugggagucaguaggacagcugauguauaugaagga

SEQ ID NO: 53797 - RNA, 46 nt, Mus musculus
aauagucuguuguucugaaggacugucugucucuuuccugggugau

SEQ ID NO: 53798 - RNA, 46 nt, Mus musculus
uuuaauaauguuauuuguaggacgaguauagaugccuuucccagga

SEQ ID NO: 53799 - RNA, 60 nt, Mus musculus
uuuugaaugaaagcaacuuagucugagcuugucuuuaguaggaguaugucuguggcagug

SEQ ID NO: 53800 - RNA, 45 nt, Mus musculus
acuucagugcugucugcuggucaacuuggcuuuuggguugaugaa

SEQ ID NO: 53801 - RNA, 46 nt, Mus musculus
uucccuuggaaugagagcuuuguuuuugugccucagaaagagagga

SEQ ID NO: 53802 - RNA, 44 nt, Mus musculus
agcuacaguguacguacauauaauaaauaaaucugaagcagcag

SEQ ID NO: 53803 - RNA, 46 nt, Mus musculus
agguccugaguucaaaucccagcaaccacaugauggcucaaccauc

SEQ ID NO: 53804 - RNA, 46 nt, Mus musculus
uuagcuccugaggugacagccuguuccuggggauacccuugaucaa

SEQ ID NO: 53805 - RNA, 42 nt, Mus musculus
uuggcuaaguaaccacauuauuuuacaaaugcacggcuggag

SEQ ID NO: 53806 - RNA, 42 nt, Mus musculus
aaacagacaguggguguccuagagguagggaugagguagggg

SEQ ID NO: 53807 - RNA, 46 nt, Mus musculus
acagaugguugugagcuaccaugugguugcuuggaauugaacucag

SEQ ID NO: 53808 - RNA, 41 nt, Mus musculus
auagggaauugauguaaguaacuaagugccucugggggcag

SEQ ID NO: 53809 - RNA, 46 nt, Mus musculus
gccuggauaucacaguaagaccccaaauaaauaaacacgugaccag

SEQ ID NO: 53810 - RNA, 25 nt, Mus musculus
ggagggcagguagccuagugguuug

SEQ ID NO: 53811 - RNA, 47 nt, Mus musculus
aggguguaugugugugugugugugugugugugugugugugcacagug

SEQ ID NO: 53812 - RNA, 45 nt, Mus musculus
uuauaccacaucucucuauguaguuuguguaggagugugcacuug

SEQ ID NO: 53813 - RNA, 42 nt, Mus musculus
ugggggcagagagauggggagaaaagagaaggggaugaggag

SEQ ID NO: 53814 - RNA, 42 nt, Mus musculus
agaugguugguccuuuagaacccagguuaaauacaggggcag

SEQ ID NO: 53815 - RNA, 41 nt, Mus musculus
accggcuguguagacgugggaagugccagaaggaggcuaag

SEQ ID NO: 53816 - RNA, 45 nt, Mus musculus
ggacauccugccgggaugacguacgcugccaacauccuaccucac

SEQ ID NO: 53817 - RNA, 41 nt, Mus musculus
uccuacccaggaauggaggacacuaagcggagagaguuaca

SEQ ID NO: 53818 - RNA, 42 nt, Mus musculus
gucaaauccauauggcauucuccucaccuagaaaggggggac

SEQ ID NO: 53819 - RNA, 45 nt, Mus musculus
uccccagaaaggggagggaggagggaggcagaaagaaagacagaa

SEQ ID NO: 53820 - RNA, 41 nt, Mus musculus
aggaugccacgagaagggaagugggagagggcgcuguguga

SEQ ID NO: 53821 - RNA, 84 nt, Mus musculus
guagaggcuucugaggaagcaaguguugcuaggagaaguuagagugggguuguuugagagcuuuguauuuuguuagcaaacagu

SEQ ID NO: 53822 - RNA, 46 nt, Mus musculus
auuagauuccugcuccccaaagagggugcuggcagcugggugcagg

SEQ ID NO: 53823 - RNA, 41 nt, Mus musculus
auaaagugugguuuuuccagaaacuggaagaguugggggag

SEQ ID NO: 53824 - RNA, 41 nt, Mus musculus
gaaaaaaucauccuuguuuaauagcagccacacucgggcau

SEQ ID NO: 53825 - RNA, 31 nt, Mus musculus
ucacugcaggaaaaccuguacuaaccgaggu

SEQ ID NO: 53826 - RNA, 46 nt, Mus musculus
ggaaaacugucugggagauuccaggcaugaagcagagaagccagag

SEQ ID NO: 53827 - RNA, 45 nt, Mus musculus
ucucugagcgaggauaccggcucuggauaacugcuuccggacgag

SEQ ID NO: 53828 - RNA, 68 nt, Mus musculus
aagcaguuauccagagccgguauccucgcucagagaacagccacgauuuuaaagcccaggccacggag

SEQ ID NO: 53829 - RNA, 42 nt, Mus musculus
cagcucugacuccaggagcaggcuuguccgucacuucagcag

SEQ ID NO: 53830 - RNA, 64 nt, Mus musculus
uucuuguuccucuagaacccugaaagucugccccagcacuuuagaagagggacccugucugugu

SEQ ID NO: 53831 - RNA, 41 nt, Mus musculus
uacugcccugccacaaggagcgagcauccacccagggccca

SEQ ID NO: 53832 - RNA, 46 nt, Mus musculus
ccaagauagcuacaaaguagauaaagauaaauaauagagaggagga

SEQ ID NO: 53833 - RNA, 44 nt, Mus musculus
cagcccaggacuggagaggucagagaauuaggggauuagcagcu

SEQ ID NO: 53834 - RNA, 46 nt, Mus musculus
aaugagaucugaugcccucuucuggugcgucugaagacaguguacu

SEQ ID NO: 53835 - RNA, 46 nt, Mus musculus
ucaauucccagcaaccacgugguggcucacaaccaucuguaacggg

SEQ ID NO: 53836 - RNA, 46 nt, Mus musculus
uauaggcauugucuuagacuggguuucuauucccacacaaacauca

SEQ ID NO: 53837 - RNA, 46 nt, Mus musculus
guauaaagccugucuagcgugcccacacacaagguuuggguaccag

SEQ ID NO: 53838 - RNA, 46 nt, Mus musculus
aagaaauaguucuuggugucuacuaugucccaaacaccagggaaag

SEQ ID NO: 53839 - RNA, 42 nt, Mus musculus
agcauggguacugagaggcccuaucuaaaaaauggaggggga

SEQ ID NO: 53840 - RNA, 69 nt, Mus musculus
ggcccagagagacaucauagaacacaccugaagccuagaaagccagagcaauauaaaaaugcagauguc

SEQ ID NO: 53841 - RNA, 45 nt, Mus musculus
aaguacacugaaacuaucuucagacacaccagaagagggugucag

SEQ ID NO: 53842 - RNA, 46 nt, Mus musculus
caaugcucaccauuuauucucugccuugucaaucaaaacuggagaa

SEQ ID NO: 53843 - RNA, 42 nt, Mus musculus
cagggaugggcaugggaguacacaccuauaaccccagcauuu

SEQ ID NO: 53844 - RNA, 70 nt, Mus musculus
uuaguggacccccuaacaacagugagagagcacugugaacagcuggagaaguguguaaaggcccgggaac

SEQ ID NO: 53845 - RNA, 41 nt, Mus musculus
guuuugaauauaauuuacuuaaauuugacuuuauggcugag

SEQ ID NO: 53846 - RNA, 24 nt, Mus musculus
acgguucuaucaggguauagugga

SEQ ID NO: 53847 - RNA, 46 nt, Mus musculus
cuuucuaccaaaaagcugacaccgcacugcuaacccuugcgcagau

SEQ ID NO: 53848 - RNA, 65 nt, Mus musculus
cuguucacguguauuauuuuacagagaauaagaauugacuuugagaaaucaguuuuuucuauggc

SEQ ID NO: 53849 - RNA, 46 nt, Mus musculus
acgugccaguuuggguaagauuuuaagguuauaaaacuugauagau

SEQ ID NO: 53850 - RNA, 45 nt, Mus musculus
uuugcucucauacccauccucacguucacaagccugcggccagug

SEQ ID NO: 53851 - RNA, 45 nt, Mus musculus
ugccaagccucacgcuggaaccugggagcuagggguggcugaggg

SEQ ID NO: 53852 - RNA, 55 nt, Mus musculus
ugucuuccaggauguggagcaccuaacggggaugaaugacuuccugaauguccug

SEQ ID NO: 53853 - RNA, 50 nt, Mus musculus
aaccuaaaauggucgcgcuuugcccgagugauccugacccggucuaucgc

SEQ ID NO: 53854 - RNA, 23 nt, Mus musculus
aacucaguuugccuuuccacuca

SEQ ID NO: 53855 - RNA, 46 nt, Mus musculus
agauuaacuguaaaauacagaccuuguggaaacgcugcugucaggu

SEQ ID NO: 53856 - RNA, 46 nt, Mus musculus
ugugcagaugcccaucaaggcuagaagugucagaucuccaggaguu

SEQ ID NO: 53857 - RNA, 46 nt, Mus musculus
caggccaggugaccaaggcaacacugcugucacgcugugguuagaa

SEQ ID NO: 53858 - RNA, 44 nt, Mus musculus
gaaaaacacuguuaaaggugggcaaagcaucuuugggugggaga

SEQ ID NO: 53859 - RNA, 43 nt, Mus musculus
agccucaccaucaauuccguuccagugguuggagaugccagga

SEQ ID NO: 53860 - RNA, 50 nt, Mus musculus
gcagaagcugcaucaucaaucagcagggcuagugagcagcuaugguucag

SEQ ID NO: 53861 - RNA, 33 nt, Mus musculus
aucgugucagcuccucccauugaggaauaggga

SEQ ID NO: 53862 - RNA, 45 nt, Mus musculus
ggcacaguuccagucccaagggaucuggcacgaaaaugcccccag

SEQ ID NO: 53863 - RNA, 41 nt, Mus musculus
agguugagucuucuugcagucuuucuuguuggucauggggu

SEQ ID NO: 53864 - RNA, 46 nt, Mus musculus
ccuauucuggggugucugaagacagcuacaguguacuuacaaauaa

SEQ ID NO: 53865 - RNA, 39 nt, Mus musculus
cggaaagagggacauucggauugagaguuuuugagcuag

SEQ ID NO: 53866 - RNA, 45 nt, Mus musculus
uguguguguguguguguauguguguguguguaugugugugucggg

SEQ ID NO: 53867 - RNA, 46 nt, Mus musculus
ucaaguuccagcaaccacaugguggcucacaaccaucaauaaugag

SEQ ID NO: 53868 - RNA, 44 nt, Mus musculus
uggcgcacgccuuuaaucccagcacucgggaggcagaggcugcu

SEQ ID NO: 53869 - RNA, 23 nt, Mus musculus
ccggaaaccccgcccccucgcag

SEQ ID NO: 53870 - RNA, 42 nt, Mus musculus
accguccgcgacgccgagugggagcggacucagagccaccau

SEQ ID NO: 53871 - RNA, 67 nt, Mus musculus
acucgcucuguagaccagacuggccucaaacucggagaucccccugucucugccccuaagugcuagg

SEQ ID NO: 53872 - RNA, 46 nt, Mus musculus
uuauuacuagaagcaaagaccagcauggcacagcaucacuccagag

SEQ ID NO: 53873 - RNA, 87 nt, Mus musculus
ucuggcuuucgguccugcaccacugauucuauggauagugaugggaggggguggaggagcagggacaguggacaggcugggcagagg

SEQ ID NO: 53874 - RNA, 42 nt, Mus musculus
uagaaucaguggugcaggaccgaaagccagacucagccccuu

SEQ ID NO: 53875 - RNA, 46 nt, Mus musculus
aggauccuuaugaaagaugaguuaaaaaaugucaagugggacaggu

SEQ ID NO: 53876 - RNA, 46 nt, Mus musculus
guucucagugcaaacuguccuaggaaaauuuaaagaugacaggcag

SEQ ID NO: 53877 - RNA, 46 nt, Mus musculus
ggauuaauauuucagggauccuuaauauuuugauuuguuuuccgag

SEQ ID NO: 53878 - RNA, 46 nt, Mus musculus
guggauuuuuuauacuaaaaauguagaauaaagacuauuuugaaga

SEQ ID NO: 53879 - RNA, 44 nt, Mus musculus
gguguguggguugggaggaggguauauguggcuugucgaguggg

SEQ ID NO: 53880 - RNA, 46 nt, Mus musculus
cuuguuguucucugacccuuuacucuugaccccuuuugccccagcu

SEQ ID NO: 53881 - RNA, 46 nt, Mus musculus
cagaacccagcacagaguacacacucaaucacuuacuugcacagac

SEQ ID NO: 53882 - RNA, 42 nt, Mus musculus
caaaggucaaaccacuggggggggggagaaccucacccucac

SEQ ID NO: 53883 - RNA, 46 nt, Mus musculus
uuugcuguugcugcugcugcuguuguuguuguuguuguuguuguug

SEQ ID NO: 53884 - RNA, 61 nt, Mus musculus
uggcaggaacugggggucaaaguuagggccuuccacaagcgaccuccacaauggcaggaac

SEQ ID NO: 53885 - RNA, 73 nt, Mus musculus
acccugaagugcggccuuucuuggaagcucagaaggggagagagggagaacuuguuucuuucuuugggaaaac

SEQ ID NO: 53886 - RNA, 46 nt, Mus musculus
gaaaguuauggaguaggggggcuguuuaagaauucccaccccagaa

SEQ ID NO: 53887 - RNA, 33 nt, Mus musculus
uugggggaaggauuuguuuauggaagcugauua

SEQ ID NO: 53888 - RNA, 42 nt, Mus musculus
uguguugugugugugucuauaccuaucuaucuugccccagag

SEQ ID NO: 53889 - RNA, 44 nt, Mus musculus
cucaggucaaguugggaccugacuaagaucacacagugcugaag

SEQ ID NO: 53890 - RNA, 42 nt, Mus musculus
gaaacaaaacuugaaccuuugcauuucagucagaagggugau

SEQ ID NO: 53891 - RNA, 45 nt, Mus musculus
ccucccucucucauuguucugauucacaccacagcgacucuuggc

SEQ ID NO: 53892 - RNA, 46 nt, Mus musculus
gccugcuggcacaacugccccagcucgcccccagaaaagcccugag

SEQ ID NO: 53893 - RNA, 45 nt, Mus musculus
ggaguacuucucggcguagcgcuugaggagguuggaggcugugag

SEQ ID NO: 53894 - RNA, 44 nt, Mus musculus
ccaggaccccuuuugccucuuugagggccucaccaaacucuaga

SEQ ID NO: 53895 - RNA, 45 nt, Mus musculus
uaguuuguucacacagcuccugggcagaugagauaaagcacuuua

SEQ ID NO: 53896 - RNA, 45 nt, Mus musculus
uagagccaccaaaguuugauuuagcagugaauucuccacccccac

SEQ ID NO: 53897 - RNA, 56 nt, Mus musculus
cguagcugccuuucuucagaaugcccaccuugugccgaaugagacggauacuagac

SEQ ID NO: 53898 - RNA, 57 nt, Mus musculus
ugcguugauguucaggugggcuugguaugauugaacuugcccuuuaaagcuuauucu

SEQ ID NO: 53899 - RNA, 81 nt, Mus musculus
cgucuugcugugcguggacuugagaccuguagagacugaguaaagaguaaaguguuugugcgcguguggugaucagacagc

SEQ ID NO: 53900 - RNA, 44 nt, Mus musculus
ccucguagcugaggcugaggcuggaggaucaucuggaguucaag

SEQ ID NO: 53901 - RNA, 46 nt, Mus musculus
gauuuggugaagagacuuuuuuuucuguagaauauuuuaagcccag

SEQ ID NO: 53902 - RNA, 45 nt, Mus musculus
ccugcacacucacauacaucacacacaacauacacacacacccca

SEQ ID NO: 53903 - RNA, 45 nt, Mus musculus
uggcucuugccacugagugugacaaccugaguuugauccccugag

SEQ ID NO: 53904 - RNA, 46 nt, Mus musculus
gcaagcgcacacacacacgcacacacaugcacacacaugagagcag

SEQ ID NO: 53905 - RNA, 45 nt, Mus musculus
caggccucccucauccuggaacugggugccugguguccaaaaaga

SEQ ID NO: 53906 - RNA, 46 nt, Mus musculus
cagcagccgagacaucugcucuggggacaggguaaacaucgugaag

SEQ ID NO: 53907 - RNA, 41 nt, Mus musculus
cgagagaaagguaguauuagagagaaucaaggcacgggcua

SEQ ID NO: 53908 - RNA, 45 nt, Mus musculus
ucaccacugguuuccagcaggaggcuguguuuaugaggaaggccg

SEQ ID NO: 53909 - RNA, 46 nt, Mus musculus
aauaagauacgaugauggccucaccaaaaacgcuucaugcccugag

SEQ ID NO: 53910 - RNA, 41 nt, Mus musculus
gcagggggugagcagguauguguagcugaguaggugcccuu

SEQ ID NO: 53911 - RNA, 46 nt, Mus musculus
aaaaacucauaaggagacuggcauggcgugucuggagggggcggag

SEQ ID NO: 53912 - RNA, 50 nt, Mus musculus
ccagcgcacaguggcccgaaccauuguuuuacaagagauuaucggcaagg

SEQ ID NO: 53913 - RNA, 46 nt, Mus musculus
aaaucuucucuucucgugaagaacggucuugguuccgugaagcaga

SEQ ID NO: 53914 - RNA, 46 nt, Mus musculus
uuuuaugccaagaugcucacacggaaccuggguuauugcguagcua

SEQ ID NO: 53915 - RNA, 46 nt, Mus musculus
gucaccucauagcuaugagacugguuucggucuguuuuauaccuag

SEQ ID NO: 53916 - RNA, 121 nt, Mus musculus
gcuucugcugccgguccucccccuccucuauccccucuccuuccccucucuauccccucuccuuccccucucuauccccucuccuuccccucucuauccccucuccuuucccucucuaucc

SEQ ID NO: 53917 - RNA, 63 nt, Mus musculus
cugacuaucacgagcauggcucacuguuugauuaucugaaccgcuacacagugaccauugagg

SEQ ID NO: 53918 - RNA, 58 nt, Mus musculus
gaaugauuaagcuagccuugucugcagccagugguuuggcacaccugcauauggagau

SEQ ID NO: 53919 - RNA, 41 nt, Mus musculus
cuccacaccacugagaagugaaggaacuauauagcugacau

SEQ ID NO: 53920 - RNA, 46 nt, Mus musculus
cuucaaaugugccgacaucuaugcccucgggcuugucuacugggag

SEQ ID NO: 53921 - RNA, 45 nt, Mus musculus
gucucugucucucugucuccuucucuccccucccccuggcuggca

SEQ ID NO: 53922 - RNA, 44 nt, Mus musculus
agcgauaacaagacccuaugucaaaaacaaaaggacaccgagau

SEQ ID NO: 53923 - RNA, 46 nt, Mus musculus
gggugagcacacacacgaauucaagucagaguccagaugccaucau

SEQ ID NO: 53924 - RNA, 119 nt, Mus musculus
ccccaggucucuccugaugccaccaucaguggcacaccccaggucucuccugaugccaccaucaguggcacaccccaggucucuccugaugccaccaucaguggcacaccccaggucuc

SEQ ID NO: 53925 - RNA, 67 nt, Mus musculus
uccugaugccaccaucaguggcacaccccaggucucuccugaugccaccaucaguggcacaccccag

SEQ ID NO: 53926 - RNA, 80 nt, Mus musculus
acccuuccauugaggagaugcgaaagguuguaugugaccagaagcuacggcccaauguccccaacugguggcagaguuau

SEQ ID NO: 53927 - RNA, 45 nt, Mus musculus
agcucugcgcaucaagaagacucugucccagcuaagcgugcagga

SEQ ID NO: 53928 - RNA, 45 nt, Mus musculus
agggacagagccugggagacgcgcacucccguuggguuugagaca

SEQ ID NO: 53929 - RNA, 42 nt, Mus musculus
ggagaagcuuuugggucaaaaugagggggacuugaugagcag

SEQ ID NO: 53930 - RNA, 41 nt, Mus musculus
gggaaaugagccagcccaagggcaucuuccuugacagcugu

SEQ ID NO: 53931 - RNA, 45 nt, Mus musculus
uauauuuuuggugguggguuuggggugggaagggauggguugcag

SEQ ID NO: 53932 - RNA, 46 nt, Mus musculus
agugguuuauuuuaauucaguuuauuuuauuuuauuuuggggggag

SEQ ID NO: 53933 - RNA, 46 nt, Mus musculus
ugagggcugcuuuuccccaugggggcuugcugucucguacucccug

SEQ ID NO: 53934 - RNA, 46 nt, Mus musculus
uggagcacuagagcugcgaaaguucagacgcuguagagucccagug

SEQ ID NO: 53935 - RNA, 41 nt, Mus musculus
gggcuggcgucccaaagccgucccuaacaccaucaagcaga

SEQ ID NO: 53936 - RNA, 46 nt, Mus musculus
auuuguuguuguuguuguuguuguugcuguuguuguugcuguuguu

SEQ ID NO: 53937 - RNA, 46 nt, Mus musculus
ggaaggggugggcaaaggaaacucugggcucccccaucagccuagg

SEQ ID NO: 53938 - RNA, 46 nt, Mus musculus
agucucucaagugcuccgguuacagaugugggcccaccauagccag

SEQ ID NO: 53939 - RNA, 46 nt, Mus musculus
ggcguuuucauuuuccuccuucacccuccaacuuggagaaggccag

SEQ ID NO: 53940 - RNA, 46 nt, Mus musculus
caggugugaguuaaacagaaacagcuaacuccgggaggggccuggg

SEQ ID NO: 53941 - RNA, 42 nt, Mus musculus
cugcaguaccuuaagguggggaucaagaaaguaugggcucug

SEQ ID NO: 53942 - RNA, 48 nt, Mus musculus
gagaggagauccacgauggaucauuccccacccuacagagacagacag

SEQ ID NO: 53943 - RNA, 88 nt, Mus musculus
caguguacggugggugcuguaaggucaugauuuuuuuaaagaugguguuuguggggccacgcuggugaggugaauggcucugaugaga

SEQ ID NO: 53944 - RNA, 46 nt, Mus musculus
acauggggacagacuugcccucuccuuccucagaggcugcccauag

SEQ ID NO: 53945 - RNA, 46 nt, Mus musculus
uuuuaacuuugcgcugaggaggcuggguggggaaaccuugggcagg

SEQ ID NO: 53946 - RNA, 45 nt, Mus musculus
gggucuuuuguggugaugggauggacuccagguuacaaaugcuag

SEQ ID NO: 53947 - RNA, 62 nt, Mus musculus
ggacagugcaugaaagagaugggguguacgcgcgggcgaaaaggaaggguguuuucgggucg

SEQ ID NO: 53948 - RNA, 45 nt, Mus musculus
acuagguccuggagccuccucugugggcuuuuuugaccagaugag

SEQ ID NO: 53949 - RNA, 45 nt, Mus musculus
ucuuuuggaccuggucucugccugugagcuuugugacucguugag

SEQ ID NO: 53950 - RNA, 45 nt, Mus musculus
guggacaagaucuuuauggacacauugucuuucugaccccugccc

SEQ ID NO: 53951 - RNA, 46 nt, Mus musculus
cacauaccacucuguuguaaauaagcugacgcuacuguaaauacag

SEQ ID NO: 53952 - RNA, 41 nt, Mus musculus
gagggaaaugcaaauguugucucuguguaaaaauuggcuga

SEQ ID NO: 53953 - RNA, 46 nt, Mus musculus
aaauaaaaaacaauccccccccaucuuaaaaacacuaauaaggcag

SEQ ID NO: 53954 - RNA, 41 nt, Mus musculus
ucugcaugagcgcucccacacugcacaccucacugccccau

SEQ ID NO: 53955 - RNA, 42 nt, Mus musculus
aaggccacauccccugucuauuccaaauaguucucaugagag

SEQ ID NO: 53956 - RNA, 88 nt, Mus musculus
agguguggacugucaaggugcacgugguagccuuggccacagagcaggagcggcagauaugcagggagaaggugggcgagaagcugug

SEQ ID NO: 53957 - RNA, 42 nt, Mus musculus
uguuucucuccgagcacagugugccccugggggaugggggag

SEQ ID NO: 53958 - RNA, 45 nt, Mus musculus
ggcuggggugaauaucccugaauguagacaguggaaggcaggaag

SEQ ID NO: 53959 - RNA, 45 nt, Mus musculus
gaaagcaaucacuguggggcagagagaaggagggaucugggcaaa

SEQ ID NO: 53960 - RNA, 45 nt, Mus musculus
agccccaagggccagaagaaagaaugaaaauaggcaacuucagga

SEQ ID NO: 53961 - RNA, 44 nt, Mus musculus
ggucacacgaagcagaccaggaaguggccauuucuagggguggg

SEQ ID NO: 53962 - RNA, 46 nt, Mus musculus
cugugucugugucugugugucugugucugugucugucucucugucu

SEQ ID NO: 53963 - RNA, 46 nt, Mus musculus
ugcaagguauaucuuaucuuugcuacccacccaauucuuuccccag

SEQ ID NO: 53964 - RNA, 45 nt, Mus musculus
guccacagaugugugugugucaaacagagacauguagccuauuag

SEQ ID NO: 53965 - RNA, 46 nt, Mus musculus
gagauaucucccugaaaaagaaccccaguguguccaccacauagaa

SEQ ID NO: 53966 - RNA, 41 nt, Mus musculus
cagaauuaucacaagugguuaugaacugcagugagggcugg

SEQ ID NO: 53967 - RNA, 42 nt, Mus musculus
gugaaacuuaagagccaaggaguggaggagggagagagacag

SEQ ID NO: 53968 - RNA, 41 nt, Mus musculus
ggugugugugguguuagggugcaaggagcauauauguggga

SEQ ID NO: 53969 - RNA, 30 nt, Mus musculus
agcuuccccgagaaagaugauccaggagaa

SEQ ID NO: 53970 - RNA, 45 nt, Mus musculus
agugugugugugaguguaugugugugaguaugugugaguguguau

SEQ ID NO: 53971 - RNA, 46 nt, Mus musculus
gugugugucagugugugugagagaggugugugucagugugugugag

SEQ ID NO: 53972 - RNA, 42 nt, Mus musculus
gugggaaagugugugugagaguuagaggugugugugugagag

SEQ ID NO: 53973 - RNA, 41 nt, Mus musculus
ccagcugucuguugcagcuccucauacuuuagccaccacaa

SEQ ID NO: 53974 - RNA, 45 nt, Mus musculus
acacauaacauauacacauacaacccaagggaauauggcaggcag

SEQ ID NO: 53975 - RNA, 25 nt, Mus musculus
acaaguggggggggggggcgcgucc

SEQ ID NO: 53976 - RNA, 44 nt, Mus musculus
uccagauagugcaggcccuggcagaggggcaaggaauccaggaa

SEQ ID NO: 53977 - RNA, 45 nt, Mus musculus
ggagcuggugcucaugugggccuucuggaagaagcuuaagguaag

SEQ ID NO: 53978 - RNA, 41 nt, Mus musculus
cuuuggccacgcucggccgcucacucaccugaggccgccau

SEQ ID NO: 53979 - RNA, 43 nt, Mus musculus
cgcgcaacggggugaaaagggugugagggggaggggaaggccu

SEQ ID NO: 53980 - RNA, 42 nt, Mus musculus
gccucgcgcucgcguucuaacugcacccccccgcccccacga

SEQ ID NO: 53981 - RNA, 26 nt, Mus musculus
gaaagaaaaaggcacaggagaaaucu

SEQ ID NO: 53982 - RNA, 46 nt, Mus musculus
cgaccuccacaaaccucacuugcaaugcagggaauauacauuccac

SEQ ID NO: 53983 - RNA, 45 nt, Mus musculus
acuuguuaaauaaccacagggaagacucaaaaaaucuauccagag

SEQ ID NO: 53984 - RNA, 24 nt, Mus musculus
gcuccggucaauauuggguucccg

SEQ ID NO: 53985 - RNA, 46 nt, Mus musculus
aucuaauuauaaauuuacagcccaaggauaguaggugguuugaaau

SEQ ID NO: 53986 - RNA, 44 nt, Mus musculus
cuagguggguagucaucaaaacugucuguggugggacgggcccu

SEQ ID NO: 53987 - RNA, 41 nt, Mus musculus
ucccgauauccgucccuauacccaucccgauaccggucuga

SEQ ID NO: 53988 - RNA, 46 nt, Mus musculus
auagucucugcugccucggucaucauagcgaucccggcccccauag

SEQ ID NO: 53989 - RNA, 45 nt, Mus musculus
ucugucauagcggucuucauagcgguccccaccuccucuguaguc

SEQ ID NO: 53990 - RNA, 46 nt, Mus musculus
ccaauuuucauccugaucaaagguagaaaaaaacuaacauucagau

SEQ ID NO: 53991 - RNA, 45 nt, Mus musculus
gaggugcuggcggaggcgucauccuccuuaggagcgcuucgaggc

SEQ ID NO: 53992 - RNA, 45 nt, Mus musculus
cuggcauuaccuuuagaggcuggucagguuuaggaggcuuagagg

SEQ ID NO: 53993 - RNA, 46 nt, Mus musculus
cucaccuuuucuugaugguccuuccucagggggcuggacugcagcu

SEQ ID NO: 53994 - RNA, 45 nt, Mus musculus
ccgggaccacggcugcagcuuccagcuuggccuuguguggcaccc

SEQ ID NO: 53995 - RNA, 45 nt, Mus musculus
ucguuucgggcccugcacuaugauauaugaaauguauguacagau

SEQ ID NO: 53996 - RNA, 43 nt, Mus musculus
aggaagaggaggaagaggaggaagaggaggauggggaagagau

SEQ ID NO: 53997 - RNA, 23 nt, Mus musculus
gcuggggagacagggugcagagu

SEQ ID NO: 53998 - RNA, 46 nt, Mus musculus
caggcccucauacuggugcaggcugguugaggcaggcagguugagu

SEQ ID NO: 53999 - RNA, 42 nt, Mus musculus
uguagaguaugggaggguaaacuuggcgguucuggugcugag

SEQ ID NO: 54000 - RNA, 42 nt, Mus musculus
agcaggagagcagccuaugguucggaguagcugcccuggguu

SEQ ID NO: 54001 - RNA, 42 nt, Mus musculus
gugauugauuguaugagaacuguacauauuucagcagaagcc

SEQ ID NO: 54002 - RNA, 46 nt, Mus musculus
gugcacacgugcacgugugcguguacguguggaagucaggacagau

SEQ ID NO: 54003 - RNA, 41 nt, Mus musculus
uuuugccuugauucaagucagcugggcuuucucauuauaga

SEQ ID NO: 54004 - RNA, 42 nt, Mus musculus
augcuguuagaguggagcugcugagacgggcugggaggagua

SEQ ID NO: 54005 - RNA, 46 nt, Mus musculus
agucuccucaguccugccuuccugcucugcuguccccuugcccagg

SEQ ID NO: 54006 - RNA, 45 nt, Mus musculus
guggccugcauccccucaagucugcauuucaaagacugggcacag

SEQ ID NO: 54007 - RNA, 45 nt, Mus musculus
ucuuucaguuuuucaggcaguaccucagagucugucccuguccgc

SEQ ID NO: 54008 - RNA, 46 nt, Mus musculus
agaaaauauuucuucaugguuuucccgcuuuuggaucucuggaaga

SEQ ID NO: 54009 - RNA, 43 nt, Mus musculus
ggcgcugggaugcagacugguugucgcgggggcugcguggagg

SEQ ID NO: 54010 - RNA, 62 nt, Mus musculus
ggagagagggacaaccgugcggggucuacagcccuaagugcgccccaggacugcagugccaa

SEQ ID NO: 54011 - RNA, 31 nt, Mus musculus
agggccgcugucaacgcgccagagggccguc

SEQ ID NO: 54012 - RNA, 41 nt, Mus musculus
acaccggggcagugagcaggcccuagagggccuggggaggg

SEQ ID NO: 54013 - RNA, 26 nt, Mus musculus
caucucagggcugggagggguggacu

SEQ ID NO: 54014 - RNA, 53 nt, Mus musculus
cauuugagcuguaugugaagcaaugaauaacucugugccccaagacccaccuu

SEQ ID NO: 54015 - RNA, 42 nt, Mus musculus
gcuguuggcuuguguacuaauaaaacaguauugggggggugu

SEQ ID NO: 54016 - RNA, 46 nt, Mus musculus
ggaaccugcggugcgcgcgcgugaccgcgaagcauuggagaggccg

SEQ ID NO: 54017 - RNA, 41 nt, Mus musculus
cgacccagccaguccacaagggaggaggccacuaggccaaa

SEQ ID NO: 54018 - RNA, 46 nt, Mus musculus
acggucauaauucucuccccaguuucguagagccaaggccccaguc

SEQ ID NO: 54019 - RNA, 46 nt, Mus musculus
acccaacagcaacacccggcggucagacagcaggcagcgcaggccu

SEQ ID NO: 54020 - RNA, 45 nt, Mus musculus
cugucugaccgccggguguugcuguugggugucauacaagcgcug

SEQ ID NO: 54021 - RNA, 68 nt, Mus musculus
gcuggcagccaugaagcuggagaacacaaugcccaguggggcuccgugugggucuagcacaggugucc

SEQ ID NO: 54022 - RNA, 63 nt, Mus musculus
ucgcuaccuccaagagguaccaccuucagcccaugcaccugcuuucccuugcuguccucauug

SEQ ID NO: 54023 - RNA, 46 nt, Mus musculus
caggauuuucuuggccugggcugguggagaaagucaacaugaagag

SEQ ID NO: 54024 - RNA, 46 nt, Mus musculus
ccuuuuuacuuauugaguuggccugcgggcucuacuuucccaguau

SEQ ID NO: 54025 - RNA, 43 nt, Mus musculus
ugcauuugcuggccugucuagggcuccuuguccuccacgacag

SEQ ID NO: 54026 - RNA, 46 nt, Mus musculus
gaaggacaugggggugacagacuggaaaggugccaaaagcugacag

SEQ ID NO: 54027 - RNA, 45 nt, Mus musculus
ugaacguucacagucuuuuguuuuguuuguuuuuugaaacagggu

SEQ ID NO: 54028 - RNA, 75 nt, Mus musculus
aggaauaaauuaaugcuucccccaauacagugaacagcagucgguuuccaucuggacuccagcagccagucuggg

SEQ ID NO: 54029 - RNA, 49 nt, Mus musculus
cgccucacaaguccacaucugggccucccagacucuaaaccaaagaaag

SEQ ID NO: 54030 - RNA, 46 nt, Mus musculus
aaggaguaguagccaggacuuugcugccaucuggggaccacagcag

SEQ ID NO: 54031 - RNA, 46 nt, Mus musculus
aacaaaaaacaaaaucaagccaagcaugaagggaacuacuggugag

SEQ ID NO: 54032 - RNA, 46 nt, Mus musculus
gaaaggggauccgaugcccucuucuggugugucugaagacagcgac

SEQ ID NO: 54033 - RNA, 44 nt, Mus musculus
agaaaaggugacagaaaaaaacaggcuaacagguguugggauga

SEQ ID NO: 54034 - RNA, 46 nt, Mus musculus
aaacugauucgagaggaggcccugucucaaauagagaaugagggag

SEQ ID NO: 54035 - RNA, 53 nt, Mus musculus
caggacaacgaccaaccagaauccugggcaugccugggcaaaguccguguagg

SEQ ID NO: 54036 - RNA, 42 nt, Mus musculus
aaaccagucaaccuccaggcgggcuccgugagcgguagggau

SEQ ID NO: 54037 - RNA, 46 nt, Mus musculus
uagaaccuaucucaaaaaagaaaaaaaaaaaaaaugcauccuggaa

SEQ ID NO: 54038 - RNA, 42 nt, Mus musculus
cuguugccacucuguuccuuugagguagggguagccccagag

SEQ ID NO: 54039 - RNA, 46 nt, Mus musculus
gaugaucuguugguuugcaccugguaugaucuguauuugaccagaa

SEQ ID NO: 54040 - RNA, 46 nt, Mus musculus
ucagggccacugguacauuggucacauacugagucuguccugagag

SEQ ID NO: 54041 - RNA, 46 nt, Mus musculus
cgagccuccugaugucugguucugcuggauguucagagaaucagac

SEQ ID NO: 54042 - RNA, 45 nt, Mus musculus
gaaugaugaugggaccagaguuuugaacagccugaagcuggaggu

SEQ ID NO: 54043 - RNA, 46 nt, Mus musculus
uguucaaguugaaucaucacaaucuguaaccuacuuggccagaacu

SEQ ID NO: 54044 - RNA, 46 nt, Mus musculus
aaacacuguuggggcuggugagauggcucaguggguaagagcaccc

SEQ ID NO: 54045 - RNA, 45 nt, Mus musculus
ccgaaauaagaucugacacccucuucuggugugucugaagucagc

SEQ ID NO: 54046 - RNA, 45 nt, Mus musculus
ugacagggcagaaugaggcaagaaccaagaggcaagauugacuua

SEQ ID NO: 54047 - RNA, 47 nt, Mus musculus
gaggaggcugggguaagaaguguaagaagaaccugggaugagauaaa

SEQ ID NO: 54048 - RNA, 46 nt, Mus musculus
ugggcuaucguucccaugauugugugcuucccuuucccuuaggaac

SEQ ID NO: 54049 - RNA, 41 nt, Mus musculus
gaauguagucucuuaacuuuagaaaaggcugagcggcucac

SEQ ID NO: 54050 - RNA, 45 nt, Mus musculus
uuugaauagcaccccgaagggugccuguuaggaggucccugaagg

SEQ ID NO: 54051 - RNA, 46 nt, Mus musculus
cccucgguaccugaucucuaaaucacuucucaacugaucccaaggu

SEQ ID NO: 54052 - RNA, 46 nt, Mus musculus
aaaaggaaggaagagauguucaagcaaugaggaccugcccacaaua

SEQ ID NO: 54053 - RNA, 42 nt, Mus musculus
acuauccacgaguuccugcccagcuccauaaaugcaccagcu

SEQ ID NO: 54054 - RNA, 49 nt, Mus musculus
accccugugaacaaccuugaaauauaaccacuccaugcaggcccaacug

SEQ ID NO: 54055 - RNA, 46 nt, Mus musculus
ugcaccgccuagaagaggaacuggugaugcggagaagggaggagcu

SEQ ID NO: 54056 - RNA, 42 nt, Mus musculus
aguagguaccuguaagcacagagaagagagaugggcccagau

SEQ ID NO: 54057 - RNA, 46 nt, Mus musculus
acucuauagccuaggcuggccugaaacucacuaugaagccagagau

SEQ ID NO: 54058 - RNA, 45 nt, Mus musculus
aucgguuuuuguuuuguuuuuuguuuuguuuuugugacccacaga

SEQ ID NO: 54059 - RNA, 41 nt, Mus musculus
gcagggaacugagaaauacacggagcaugugcggcccuggg

SEQ ID NO: 54060 - RNA, 41 nt, Mus musculus
gugguaugaaggaacuagagcccuggacccgacgccuggag

SEQ ID NO: 54061 - RNA, 41 nt, Mus musculus
ggugacagcucuccagguccgguggagggcaacggggggag

SEQ ID NO: 54062 - RNA, 42 nt, Mus musculus
gcugugagacgguggacgggacccgagagacucacuggcgag

SEQ ID NO: 54063 - RNA, 45 nt, Mus musculus
gguugauagguuuacaguucagguuacauucaugacuaagggaag

SEQ ID NO: 54064 - RNA, 45 nt, Mus musculus
cuccgagucugcaucggggggaaggaguucucaggggauggaaag

SEQ ID NO: 54065 - RNA, 42 nt, Mus musculus
ggccgacuaaacaaaaggacauuacagugacacuggccccug

SEQ ID NO: 54066 - RNA, 42 nt, Mus musculus
gucuucucacaagacuuuccgaaucaagcgauuccuggccaa

SEQ ID NO: 54067 - RNA, 67 nt, Mus musculus
aauugucaucaaucaguccuaccagauggauuucaacauuuaaaccuggagacuuuucgugucuuga

SEQ ID NO: 54068 - RNA, 26 nt, Mus musculus
uuaagcagaagaagccauaggagagg

SEQ ID NO: 54069 - RNA, 50 nt, Mus musculus
gagcuacggucagcccuccgugugcuucagaaggagaaggagcaguugca

SEQ ID NO: 54070 - RNA, 46 nt, Mus musculus
guauagagccaaaaucuucccaucgggaaaacagagacaggaagau

SEQ ID NO: 54071 - RNA, 46 nt, Mus musculus
cuggaguuagaggaugacauccagaccaugagugacaaagugcuga

SEQ ID NO: 54072 - RNA, 45 nt, Mus musculus
ugaccugaugcagcugaagcugcaguuggaggaucaggugacaga

SEQ ID NO: 54073 - RNA, 46 nt, Mus musculus
augugaugaagaggaagaccggguaugaauaaagcaggugucuaga

SEQ ID NO: 54074 - RNA, 42 nt, Mus musculus
uuaaucccauucauuuacacaacgaaagaggaacucccagua

SEQ ID NO: 54075 - RNA, 45 nt, Mus musculus
cacagugguauucaaggaagaauucaugcaauuaucuggauaauu

SEQ ID NO: 54076 - RNA, 42 nt, Mus musculus
gcauuuuaaccaugaaacuaccaaaggugggugcagcuggug

SEQ ID NO: 54077 - RNA, 45 nt, Mus musculus
uuggguguggaaaagcuaguauauuaggucguucuugguuucaga

SEQ ID NO: 54078 - RNA, 44 nt, Mus musculus
ggauaacgcgucaucucgccuucccaaaauuuccccccucgcua

SEQ ID NO: 54079 - RNA, 46 nt, Mus musculus
gcugaguagggauaagaaaucugacgagagggagccugggguagga

SEQ ID NO: 54080 - RNA, 46 nt, Mus musculus
ccccaggcucccucucgucagauuucuuaucccuacucagcccaag

SEQ ID NO: 54081 - RNA, 23 nt, Mus musculus
gagggagcggagagggagggcug

SEQ ID NO: 54082 - RNA, 41 nt, Mus musculus
ggagcguuuaagaaaggauggggagucggacugcugggggg

SEQ ID NO: 54083 - RNA, 45 nt, Mus musculus
acguguucgcgggucuuugagaagaaaccggggcaagccgggguu

SEQ ID NO: 54084 - RNA, 45 nt, Mus musculus
agaaaucggagggaaccgcggagaaucggcgcgaaggagugagau

SEQ ID NO: 54085 - RNA, 42 nt, Mus musculus
gcgggucgcccugauguuugaagcuagacagcuccagucggu

SEQ ID NO: 54086 - RNA, 46 nt, Mus musculus
cagaauagucagcuagaacugggcuuucuuccucccuuuccagcag

SEQ ID NO: 54087 - RNA, 24 nt, Mus musculus
ugugaaguggacuuucaaguuuuc

SEQ ID NO: 54088 - RNA, 46 nt, Mus musculus
guguguguguguguguguguguguacaaggaaguguuugguuagga

SEQ ID NO: 54089 - RNA, 41 nt, Mus musculus
ucccagacagagcagaaugagccugaaggaaggguagucuc

SEQ ID NO: 54090 - RNA, 46 nt, Mus musculus
ggcauccccaucccagcugccugcucacccuccuuugcccccaggu

SEQ ID NO: 54091 - RNA, 43 nt, Mus musculus
aacgcaggucgcggggaucagcaaagagaagggggcgguaaag

SEQ ID NO: 54092 - RNA, 45 nt, Mus musculus
gggagaggaagaaggagaaacagcaggggagggguacagucccuu

SEQ ID NO: 54093 - RNA, 38 nt, Mus musculus
ggaaagaagugaggguucagggacucucaggacuuggu

SEQ ID NO: 54094 - RNA, 46 nt, Mus musculus
ccaggcgggagaaagcacgaaaagaaaaggaaagaacaagauagag

SEQ ID NO: 54095 - RNA, 53 nt, Mus musculus
caaggcccaggaaggaauggcccagaccaaauaugagagagagagagagggag

SEQ ID NO: 54096 - RNA, 24 nt, Mus musculus
ccugggcuguuagaggaaagagcu

SEQ ID NO: 54097 - RNA, 42 nt, Mus musculus
uuucauguacccagcaugagcuccuacuucgucaacccccug

SEQ ID NO: 54098 - RNA, 45 nt, Mus musculus
uccagaagaucaauuauuuuucuuauuggaaaagcauuagucaga

SEQ ID NO: 54099 - RNA, 80 nt, Mus musculus
guggaaaaaggagaacaacaaggauaaacugccuggggcccgagaugaggagaagguggaagaagaagggaaugaggaag

SEQ ID NO: 54100 - RNA, 57 nt, Mus musculus
aggagaaagaggaggaggaaaaggaagaaaauaaggacuaaggaaaaaaagagagag

SEQ ID NO: 54101 - RNA, 46 nt, Mus musculus
uuuuauagagaauagaaugacacucacaacucuaacuaccugucag

SEQ ID NO: 54102 - RNA, 45 nt, Mus musculus
uauuugucuggggguugggagggggaaccugagacacagggaaaa

SEQ ID NO: 54103 - RNA, 47 nt, Mus musculus
ucuugggggaaaaaaaaaaaagaaagaaaaauuccuaauacaggagg

SEQ ID NO: 54104 - RNA, 46 nt, Mus musculus
ggccucucacaacaauggacacauauuuuucuucaguggugucaga

SEQ ID NO: 54105 - RNA, 42 nt, Mus musculus
cauugaugagaaagaggaagaaucaugccaaggccggcuaag

SEQ ID NO: 54106 - RNA, 45 nt, Mus musculus
gaaaggcaguacacauguaaagucagguggaggauggggccagau

SEQ ID NO: 54107 - RNA, 41 nt, Mus musculus
aaagcgggagcuguggguaagggugagugaagggggucaaa

SEQ ID NO: 54108 - RNA, 35 nt, Mus musculus
agcuacaaaaguaagauugcaagaguaacucacgc

SEQ ID NO: 54109 - RNA, 43 nt, Mus musculus
ucuucuccuucuugaguuugggcacuaggguggcagcuggcag

SEQ ID NO: 54110 - RNA, 42 nt, Mus musculus
uggagguguuuccucagaacgguucucagaucaggggucuag

SEQ ID NO: 54111 - RNA, 46 nt, Mus musculus
ugcuuuggaugggcucucccuccuaugcuuucuccccagcccagau

SEQ ID NO: 54112 - RNA, 45 nt, Mus musculus
ccccagcugggggcgcuguuuuagggugugauggaaacauuagga

SEQ ID NO: 54113 - RNA, 28 nt, Mus musculus
ggugguaguggugguguggugguggugg

SEQ ID NO: 54114 - RNA, 47 nt, Mus musculus
ccugguauaaucagggauaaggcacauuugaaaaaaaaaaaaaggca

SEQ ID NO: 54115 - RNA, 42 nt, Mus musculus
uggcucuggggcugaggagggaguuccucaucugguuuggag

SEQ ID NO: 54116 - RNA, 46 nt, Mus musculus
cgaauguauuuuccccuucuucuucuggguguucaagggcauaggu

SEQ ID NO: 54117 - RNA, 46 nt, Mus musculus
ugucccuaaaacgggggugauaugcuugcacaaugagagcagaagc

SEQ ID NO: 54118 - RNA, 41 nt, Mus musculus
agucucucuccuggagccugcagacauggaguggggggaag

SEQ ID NO: 54119 - RNA, 46 nt, Mus musculus
uucugcugcaaaugccuggaaagugaacagaaagccagcuugaggu

SEQ ID NO: 54120 - RNA, 46 nt, Mus musculus
uaugcuaaugaucagaagcagcuaggaacagcaguguuggguagaa

SEQ ID NO: 54121 - RNA, 86 nt, Mus musculus
ugugagauauugggugcuuuguuuuguuuuguuuuaaagugagagaaugagaaacaugggagggauuuaaauucugacuugaggga

SEQ ID NO: 54122 - RNA, 52 nt, Mus musculus
gagagaggcagagaggcagagagagagagaggcagagaggcagagaggcaga

SEQ ID NO: 54123 - RNA, 46 nt, Mus musculus
ucaggagacaugcuuuggacacauuuagugugagaugccugcuaaa

SEQ ID NO: 54124 - RNA, 46 nt, Mus musculus
uugagcccuucccuuuccucuucaagccuacauccuagcaccagag

SEQ ID NO: 54125 - RNA, 42 nt, Mus musculus
ugggcucuugccuggccagaagcagagaguaggggggcaaug

SEQ ID NO: 54126 - RNA, 45 nt, Mus musculus
gaagaucuuuggaagauucuaaggauguagcuuggugguagagug

SEQ ID NO: 54127 - RNA, 45 nt, Mus musculus
uagcaggagguugagaugcuaugggagaaaagagagccaccagau

SEQ ID NO: 54128 - RNA, 45 nt, Mus musculus
uaggccacacuugcauugcacagauagcgggagcuuuggcccccg

SEQ ID NO: 54129 - RNA, 42 nt, Mus musculus
ugggggacuagaauaugaggguuuggggaaacucaaguaggu

SEQ ID NO: 54130 - RNA, 46 nt, Mus musculus
aaccauccauaaugagaucugaugcccucuucugguguguccaaag

SEQ ID NO: 54131 - RNA, 46 nt, Mus musculus
uccgaagguccugaguucaaaucccagcaaccacaugguggguggc

SEQ ID NO: 54132 - RNA, 46 nt, Mus musculus
augcccagaccaagguagauuuugacucauuucuuggcccucuaga

SEQ ID NO: 54133 - RNA, 46 nt, Mus musculus
uuugccugcaugugugugcaucacaugcuugccugaggcccaaggu

SEQ ID NO: 54134 - RNA, 45 nt, Mus musculus
uggagaauggcaaccugcagauugcucuccacuaacaacugagaa

SEQ ID NO: 54135 - RNA, 42 nt, Mus musculus
cccagcaaacacaugguggcucgcaaccauccguaacaaaaa

SEQ ID NO: 54136 - RNA, 46 nt, Mus musculus
gaccccuucaaggcaugcagugacagaggaacacugagccagagaa

SEQ ID NO: 54137 - RNA, 46 nt, Mus musculus
agaucgaugcuacuuuuauagaccacugucaauccuuccaacagag

SEQ ID NO: 54138 - RNA, 46 nt, Mus musculus
gggucacuucccuggccuuccccuccuucaaacccagcggacaggc

SEQ ID NO: 54139 - RNA, 46 nt, Mus musculus
ucuucccuugcuugugugcgugggaacagagggcuacuggggaggu

SEQ ID NO: 54140 - RNA, 45 nt, Mus musculus
aaacccuaaaacaaaggccaaggaggggcugggaacagccagggg

SEQ ID NO: 54141 - RNA, 45 nt, Mus musculus
ccggugcaccacuugcugggggucgcucucuaggaucacccuaca

SEQ ID NO: 54142 - RNA, 46 nt, Mus musculus
caaggaagcuaacuaagugugaggucucaauucagaccuggcaggu

SEQ ID NO: 54143 - RNA, 46 nt, Mus musculus
ugugguucuccaagaugacccuaaggacauaaguugggggccugga

SEQ ID NO: 54144 - RNA, 46 nt, Mus musculus
uuaaacucuguugcaagugcaauaaaccccacccacugcccccacu

SEQ ID NO: 54145 - RNA, 63 nt, Mus musculus
acuugcaacagaguuuaaauaaguugggguggguucuggaggagaggggaggguuggcuaggg

SEQ ID NO: 54146 - RNA, 42 nt, Mus musculus
uccauucucuuucugacuuccauggaucugggucugggccag

SEQ ID NO: 54147 - RNA, 46 nt, Mus musculus
ucaggacaaaucccaaacaaaggucgaugcuggcccagacccagau

SEQ ID NO: 54148 - RNA, 46 nt, Mus musculus
gguucucuggcaagaccaaagaugcaucuuugcaggccggagucag

SEQ ID NO: 54149 - RNA, 60 nt, Mus musculus
ggggccucagguccagggacagaagcuccagcuuuccuucagccuuugcauuuuggagac

SEQ ID NO: 54150 - RNA, 45 nt, Mus musculus
cugaaggaaagcuggagcuucugucccuggaccugaggcccccau

SEQ ID NO: 54151 - RNA, 51 nt, Mus musculus
ccccccaugcacugugaaggacccucguuuacacaugcccucucguggaug

SEQ ID NO: 54152 - RNA, 52 nt, Mus musculus
gccuccagccaccucagaugccugagcccuccugaucucagacucaugaucc

SEQ ID NO: 54153 - RNA, 41 nt, Mus musculus
gaucaggagggcucaggcaucugagguggcuggaggcuuga

SEQ ID NO: 54154 - RNA, 42 nt, Mus musculus
aagggagggguccaauaggaaaaaagacaaauggggcgugag

SEQ ID NO: 54155 - RNA, 69 nt, Mus musculus
guuguggaucaucauccuagccauucuuuuuggccuccugcuccuaggucugcucaucuacguccucua

SEQ ID NO: 54156 - RNA, 48 nt, Mus musculus
ccuucagugugaggcuguauaugaagcucugaagaugcccuaccagau

SEQ ID NO: 54157 - RNA, 39 nt, Mus musculus
ugguaacuggacaaacacacacacacacacacacacaca

SEQ ID NO: 54158 - RNA, 45 nt, Mus musculus
aaugcagcugcagacuacggcucucuuggcggugcaguggcccaa

SEQ ID NO: 54159 - RNA, 75 nt, Mus musculus
uguuucaggcugcgcugugaguuugggccacugcaccgccaagagagccguagucugcagcugcauuuccgaguc

SEQ ID NO: 54160 - RNA, 55 nt, Mus musculus
cuccacaccaccugcagaaacgagaggcuccagggaggaguucuacugccucagg

SEQ ID NO: 54161 - RNA, 44 nt, Mus musculus
aggugacaggacucagcaacugcaccuccaacuacacccccaac

SEQ ID NO: 54162 - RNA, 51 nt, Mus musculus
gcugagcuccagcacacccuggcugauggagcugggccccugguugaugag

SEQ ID NO: 54163 - RNA, 46 nt, Mus musculus
cucaucuucaagacacaaagaaaaccauccaguuugacuuucagau

SEQ ID NO: 54164 - RNA, 45 nt, Mus musculus
acaauaucugugugccugaccugcagcuggauguguaugggugag

SEQ ID NO: 54165 - RNA, 44 nt, Mus musculus
cagaauucagagacaaacucuccccaauucacauugcccucaac

SEQ ID NO: 54166 - RNA, 25 nt, Mus musculus
ggccuacagagaaaugaggucagau

SEQ ID NO: 54167 - RNA, 27 nt, Mus musculus
agcaaaagggagggguccggcgggcac

SEQ ID NO: 54168 - RNA, 45 nt, Mus musculus
ugccagcgcaucucucaccaucuuccccuccauguucaacccaga

SEQ ID NO: 54169 - RNA, 49 nt, Mus musculus
guaccccagacuucuuuggcucugcccuucgaggaggacgagaucugga

SEQ ID NO: 54170 - RNA, 46 nt, Mus musculus
gggccucccgggaauauaaauacgacucccugcugggccuccccac

SEQ ID NO: 54171 - RNA, 69 nt, Mus musculus
gccauuggggcuccauuugguggggaggcccagcagggagucguauuuauauucccgggaggcccagga

SEQ ID NO: 54172 - RNA, 45 nt, Mus musculus
cgauucggcagcuccuugacacccuugggggaccuggaccaagac

SEQ ID NO: 54173 - RNA, 44 nt, Mus musculus
gggugucaaggagcugccgaaucggcugaacucaucuugcccag

SEQ ID NO: 54174 - RNA, 42 nt, Mus musculus
ugggcagggucuacaucuaucugcagcgcccagcgggcauag

SEQ ID NO: 54175 - RNA, 46 nt, Mus musculus
guccuuaauggcucagacauccacucccucuacaacgucucaggag

SEQ ID NO: 54176 - RNA, 46 nt, Mus musculus
auuacccagaguaucucaucaacccuguucaggggcagcugcagac

SEQ ID NO: 54177 - RNA, 46 nt, Mus musculus
ccuugccagaaguagcuuccagguccacccaggaccacacggccag

SEQ ID NO: 54178 - RNA, 64 nt, Mus musculus
ugggcaccugcuaccucuccacagaaaacuucacccggauucuggaguacgcaccuugccgcuc

SEQ ID NO: 54179 - RNA, 41 nt, Mus musculus
uccuuuucugugcgccagcuauacaguggagcacaugccug

SEQ ID NO: 54180 - RNA, 45 nt, Mus musculus
uacaaguccuugcagugguucggagcaacaguucgggcccauggc

SEQ ID NO: 54181 - RNA, 42 nt, Mus musculus
cacaggcuccucucccuuggcacuguacagugaggacuccag

SEQ ID NO: 54182 - RNA, 87 nt, Mus musculus
uguguaugaguggguguguauguuucuguggauguggguguguguguaugaguggguguguauguuucuguggaugugggugugugu

SEQ ID NO: 54183 - RNA, 47 nt, Mus musculus
aaagcagugcuacagagggcagaguuuagacuuggaaagagacagaa

SEQ ID NO: 54184 - RNA, 27 nt, Mus musculus
uguauguaggagcuggaaacaagagau

SEQ ID NO: 54185 - RNA, 45 nt, Mus musculus
aacccagaggaagagaggaaacccaaguuuacacugagacagggc

SEQ ID NO: 54186 - RNA, 44 nt, Mus musculus
auauugaacaacggcuugguuaaucaaaagccuggcuaggaaga

SEQ ID NO: 54187 - RNA, 41 nt, Mus musculus
gggcuaagggaccccagaugccauauuccugaaccccuuug

SEQ ID NO: 54188 - RNA, 42 nt, Mus musculus
uggccggaucaauccagggcggugcacggaugugucgggagg

SEQ ID NO: 54189 - RNA, 42 nt, Mus musculus
gaggacuggaagcgaccaggacuugaguuggagggcggaguu

SEQ ID NO: 54190 - RNA, 41 nt, Mus musculus
guguguguguguguguguguguguguguaucuuugugcuag

SEQ ID NO: 54191 - RNA, 50 nt, Mus musculus
agucagagacuugguugauuucacaagcuggagguuugaacuugaguaag

SEQ ID NO: 54192 - RNA, 76 nt, Mus musculus
gggcaauguccuccccagcccaggugccacuaggcacagcauaagagacuaagaauucaacaggggaaaggcugga

SEQ ID NO: 54193 - RNA, 81 nt, Mus musculus
cacucaggguuugggaguauaagcccccacuucuggcucaggggguugagaagcaggauaaacaaaaugaacuuggaaaag

SEQ ID NO: 54194 - RNA, 46 nt, Mus musculus
acuggccuuaagaguaagaccaaauggcugaugggagaauccacag

SEQ ID NO: 54195 - RNA, 67 nt, Mus musculus
ggcagugaccucacaaggacagcacaguuuuugcagcuuagaaaucacccaccuguccccaccccua

SEQ ID NO: 54196 - RNA, 46 nt, Mus musculus
agguguggggccacucucuggguccgagggaguggauggcucugca

SEQ ID NO: 54197 - RNA, 45 nt, Mus musculus
gaauuucuucuucuucuugggggucuccuugggggcgaccucccc

SEQ ID NO: 54198 - RNA, 45 nt, Mus musculus
gaaggaaauagcaaacugacaaaagccuagccuccacuagcaaaa

SEQ ID NO: 54199 - RNA, 46 nt, Mus musculus
acucccucugacaaagagaggagggauuaggugacugcggagagga

SEQ ID NO: 54200 - RNA, 42 nt, Mus musculus
aauuguaguuaccaccuuagaccccagagauccugcccuggc

SEQ ID NO: 54201 - RNA, 33 nt, Mus musculus
uccagacgaugguugaacaucaccuagggcaac

SEQ ID NO: 54202 - RNA, 45 nt, Mus musculus
ccuccuaauuuagagcccaguucugggaaauuaaagcacccagca

SEQ ID NO: 54203 - RNA, 41 nt, Mus musculus
uguccuucacaguccaccuugucaaugucuccacggcaacg

SEQ ID NO: 54204 - RNA, 46 nt, Mus musculus
uaccucaccaguaggaccuuugauguccucuucuaugcaccccaaa

SEQ ID NO: 54205 - RNA, 46 nt, Mus musculus
gagucuauaggauucagcaacaaucagcuuaauagauagcaggaca

SEQ ID NO: 54206 - RNA, 48 nt, Mus musculus
uucuauggacuaugccuaugcccagaaacagcagauuggcucagacga

SEQ ID NO: 54207 - RNA, 42 nt, Mus musculus
ccgcugccugaccgggagccauggagcccgacaacagcccac

SEQ ID NO: 54208 - RNA, 45 nt, Mus musculus
gcuucugcucucuaaguuccagacuauuacagauguuugcucagu

SEQ ID NO: 54209 - RNA, 46 nt, Mus musculus
aaagccauggauucugauugguuugcacaaaacuacauggguagga

SEQ ID NO: 54210 - RNA, 46 nt, Mus musculus
auuguaccuuucaaaguaccaggaaaggacacaguuaccaaagaua

SEQ ID NO: 54211 - RNA, 46 nt, Mus musculus
accaagccaugaccacagcuguuggucugauagcuuccggccagug

SEQ ID NO: 54212 - RNA, 46 nt, Mus musculus
uccacuuuuagaaacuuuucaacuacaucaaaaugggcucucagau

SEQ ID NO: 54213 - RNA, 41 nt, Mus musculus
agcucaaguugcagaaaaucaaacugaauuggucagacuaa

SEQ ID NO: 54214 - RNA, 46 nt, Mus musculus
auccucucaguaaaugaccaagaucugaagaaccugcugcaccaag

SEQ ID NO: 54215 - RNA, 46 nt, Mus musculus
gaacggaccuauaguacaucgaggugaaggagagccaaguggaguu

SEQ ID NO: 54216 - RNA, 46 nt, Mus musculus
ccacagugcucuuugcgagcaucauguucacaguugcguccauaga

SEQ ID NO: 54217 - RNA, 45 nt, Mus musculus
gggacucccaggcuguaaaggagaggggugaggaacaguuaucug

SEQ ID NO: 54218 - RNA, 45 nt, Mus musculus
guucugaaaaaccuaaaaguggugguaugaauucuguaaagguug

SEQ ID NO: 54219 - RNA, 50 nt, Mus musculus
gcucccuggcucucucucuucccuccugaagggaauguggaagauaagga

SEQ ID NO: 54220 - RNA, 46 nt, Mus musculus
cuuuucuccucugcuuuuagggugggagguuccccuaugcuacuag

SEQ ID NO: 54221 - RNA, 46 nt, Mus musculus
uuaagaguuuaaagcagagagucugaacuggagagaacuuccaaag

SEQ ID NO: 54222 - RNA, 46 nt, Mus musculus
ccgguggauuuaaaacuuuuaaucucauugucuucuaagagcccag

SEQ ID NO: 54223 - RNA, 46 nt, Mus musculus
cggcagggcaugcaccuuaccagacaucagagaacacacacaggag

SEQ ID NO: 54224 - RNA, 41 nt, Mus musculus
ggaaaacuucucucauagaucuaacuuaaucaggcaccaga

SEQ ID NO: 54225 - RNA, 45 nt, Mus musculus
ccuuuauuuugacccagguaugguuuggaugcuguauaagucuag

SEQ ID NO: 54226 - RNA, 46 nt, Mus musculus
aaaaagggaacuggagagauagacaguuacaauguggaauccacag

SEQ ID NO: 54227 - RNA, 46 nt, Mus musculus
ucaaaucucagcaaccacaugguggcucacaaccauccauaacgaa

SEQ ID NO: 54228 - RNA, 26 nt, Mus musculus
augaugaugaugacgacgacaguggc

SEQ ID NO: 54229 - RNA, 45 nt, Mus musculus
uuugcuggccuuguuuauccaugauaaugcugaugugugugugug

SEQ ID NO: 54230 - RNA, 42 nt, Mus musculus
aaggagauugagggagccuguguaagaaagcugugaacuagg

SEQ ID NO: 54231 - RNA, 45 nt, Mus musculus
uuuugagaaggaauucucacuaggcagagcccccuuucccacaag

SEQ ID NO: 54232 - RNA, 56 nt, Mus musculus
ccaccuuggauaaccugaaaauaccuuuccucuaaguggggcuggaaaugggagga

SEQ ID NO: 54233 - RNA, 46 nt, Mus musculus
aaaaaaaugaaaaccauauuaaagauacccaauaauaauaggcaag

SEQ ID NO: 54234 - RNA, 83 nt, Mus musculus
aagugcaaaccagucauugaaacuucacacaaacuaguguaguuguaauaauaauaauuuuaaaaagauaaaauauuggagaa

SEQ ID NO: 54235 - RNA, 46 nt, Mus musculus
augguaguaaacagucaaggggcuuaaaaaggcuaaauacugaggg

SEQ ID NO: 54236 - RNA, 45 nt, Mus musculus
ucagcaucugagggacugaacugguaguaaaggcaaggucuagag

SEQ ID NO: 54237 - RNA, 46 nt, Mus musculus
uaagaagcagagaguucaugguuuaaaccaccccuccccuagccag

SEQ ID NO: 54238 - RNA, 65 nt, Mus musculus
uuuuacuagaaaguuuaaaggaucauauuucaaccaccgcccaggaccacugcaaagccaucuac

SEQ ID NO: 54239 - RNA, 56 nt, Mus musculus
cugcauguucucaccaccaacaauacagcaauaaacuucuaugaaaacagagacuu

SEQ ID NO: 54240 - RNA, 46 nt, Mus musculus
ggcucagcacuagccaaccugagccccugcuccaucccacacagga

SEQ ID NO: 54241 - RNA, 45 nt, Mus musculus
uuuguggaaccuguuuuccugucugucugacuuuugcuguccuuu

SEQ ID NO: 54242 - RNA, 45 nt, Mus musculus
auguggcauucuccaaaguccuacauggacuuuccaugcugacaa

SEQ ID NO: 54243 - RNA, 45 nt, Mus musculus
auugcugagagcugggaucccaggccgagagaacagagaauugca

SEQ ID NO: 54244 - RNA, 45 nt, Mus musculus
cucauguuuugguauacccuggcucagcuaaaucccauaggccag

SEQ ID NO: 54245 - RNA, 46 nt, Mus musculus
cugcuccuucagcuccuuccuacaagauggacugaauuuugcugaa

SEQ ID NO: 54246 - RNA, 44 nt, Mus musculus
aggagaaugucaguuuuuguuuaggaaugcccuaaagaaguaua

SEQ ID NO: 54247 - RNA, 45 nt, Mus musculus
cccagcccuggcacuuuggcuccuauguccucuccaaggccccag

SEQ ID NO: 54248 - RNA, 41 nt, Mus musculus
gaaggagaugauauugaacuuguuucaaauucauuggcucu

SEQ ID NO: 54249 - RNA, 24 nt, Mus musculus
gagaagguugaggaagaccugcag

SEQ ID NO: 54250 - RNA, 42 nt, Mus musculus
gcuccaggcuaaccuaaaccacacaagagagaggacacauac

SEQ ID NO: 54251 - RNA, 47 nt, Mus musculus
accugccuggggaggcaggacuuaauacacaaacagugccaccaacu

SEQ ID NO: 54252 - RNA, 42 nt, Mus musculus
aguagaggaguacaguuuucagccagcguucacaguguggau

SEQ ID NO: 54253 - RNA, 48 nt, Mus musculus
ccaggaggaacgugcccaacugcuacagcccacacuggagaucaaccc

SEQ ID NO: 54254 - RNA, 42 nt, Mus musculus
uaguuaacuucacaaugcuucaggcccugucacaccccuagc

SEQ ID NO: 54255 - RNA, 46 nt, Mus musculus
uaucgaggccaggggcaaccacagguguuuucaaugaagaugagaa

SEQ ID NO: 54256 - RNA, 45 nt, Mus musculus
ugcuccuccugugcaggcucuugcaggugaccagacugacaaaga

SEQ ID NO: 54257 - RNA, 47 nt, Mus musculus
cucaucucuguggaaacagacaucgucguugaucacuacaaggagga

SEQ ID NO: 54258 - RNA, 44 nt, Mus musculus
gaaggagcaggggggcaagaggcaagggagagcagcaagaguaa

SEQ ID NO: 54259 - RNA, 74 nt, Mus musculus
aggggaguuaaggaguagcagagacagagaaaggcagagagaaagagagaguagaggcuggccaugcccacgug

SEQ ID NO: 54260 - RNA, 46 nt, Mus musculus
aaucuuaaaaaaaaaaaguauaggaauauguucuauuccauaaaau

SEQ ID NO: 54261 - RNA, 45 nt, Mus musculus
uuaaaagcacugacugcucucucaaagguccugaguucaacuccc

SEQ ID NO: 54262 - RNA, 46 nt, Mus musculus
cacaccuuuaaaggacacacccuaauugauguguuuauaaaaagau

SEQ ID NO: 54263 - RNA, 72 nt, Mus musculus
uauuuguccaucauugugacagaguagcugaggagaggacuuucaaggagggaagugacccuuugccaugga

SEQ ID NO: 54264 - RNA, 46 nt, Mus musculus
gauguucuacaacagagauugaucaaguucuucauugaccagagua

SEQ ID NO: 54265 - RNA, 46 nt, Mus musculus
aguacuuuggaguugaaugcugggauguguuuggugugugccaguc

SEQ ID NO: 54266 - RNA, 48 nt, Mus musculus
agacggacgcaccacucaacauccgcagcaucuucuaugugccagaga

SEQ ID NO: 54267 - RNA, 46 nt, Mus musculus
cugguuuuagaacacuuucagcauccugaaaagcauauccccacua

SEQ ID NO: 54268 - RNA, 46 nt, Mus musculus
ccuuccuggaagcacugcagaaccaggcagagaccagcagcaagau

SEQ ID NO: 54269 - RNA, 46 nt, Mus musculus
ugacuguuuauaugcuggguaccauaaguagaaauuguuuucagua

SEQ ID NO: 54270 - RNA, 45 nt, Mus musculus
ugacacaggaggagcugguguccaaccuuggcacaauugccagau

SEQ ID NO: 54271 - RNA, 42 nt, Mus musculus
uuuaaggaauccuuagaaaguuccagugugucugguugagau

SEQ ID NO: 54272 - RNA, 46 nt, Mus musculus
uguuagagaggaauacaaaaccuuucuguuuuguuuuuuucgagau

SEQ ID NO: 54273 - RNA, 46 nt, Mus musculus
agugguauuggaaguauggacucugcagaguuuuuguggcagugaa

SEQ ID NO: 54274 - RNA, 41 nt, Mus musculus
ggcaguguauuaguaugcuugaccucagucuauacccagga

SEQ ID NO: 54275 - RNA, 45 nt, Mus musculus
ucacucuguagaccaggcuggccuugaacucagauccaccuaccu

SEQ ID NO: 54276 - RNA, 45 nt, Mus musculus
gccguugagguuuuuguggcuuuucauuuagggugugggggaaac

SEQ ID NO: 54277 - RNA, 42 nt, Mus musculus
cacuggaaugagccguauagauaggagagugaguggugaaug

SEQ ID NO: 54278 - RNA, 61 nt, Mus musculus
gagaaagagacagagcgagacacacaucaaaaugucuagauuauauaagaaggaacgucua

SEQ ID NO: 54279 - RNA, 47 nt, Mus musculus
cuccacagccagugagauaaaccagauuagauuauaguaaaggcagg

SEQ ID NO: 54280 - RNA, 46 nt, Mus musculus
aauugguuguuugacucauuguuucuccagagcuucccugauuucu

SEQ ID NO: 54281 - RNA, 45 nt, Mus musculus
gagccagugaacuccgcguguuugaucccuggaauugaaagagaa

SEQ ID NO: 54282 - RNA, 26 nt, Mus musculus
ggcggcgucugaggcugugugcacac

SEQ ID NO: 54283 - RNA, 56 nt, Mus musculus
ggauucaacugcauggauucagaacucuucagcugaggaacggugguaccgguaag

SEQ ID NO: 54284 - RNA, 71 nt, Mus musculus
uguaaagaaauuaauguaaaucucugagaggcaugcucuccuacgaaguagauccauuaauugucgcuggg

SEQ ID NO: 54285 - RNA, 64 nt, Mus musculus
agccuugcuuaaagaaagggguuuaaaaauuucagaaagcacagugagcgguuuuuugagagaa

SEQ ID NO: 54286 - RNA, 48 nt, Mus musculus
cuaguugggaaaagcugggaaaagauauagcaagagaggaaguagaug

SEQ ID NO: 54287 - RNA, 49 nt, Mus musculus
aguaugucagaaacagagagaaaugaaaaagaaagcgcgcgcagaaaga

SEQ ID NO: 54288 - RNA, 45 nt, Mus musculus
agaggugaaggacugaggccccacugaggccuuggaccgcaccgc

SEQ ID NO: 54289 - RNA, 46 nt, Mus musculus
gugggggaugggaggguagucccuagaguuuacuguccucucccag

SEQ ID NO: 54290 - RNA, 45 nt, Mus musculus
cuccuuagcacccauucagccccacagcucuaagauggggaggac

SEQ ID NO: 54291 - RNA, 46 nt, Mus musculus
accuuccguggccugcggcgccuggagcgccucuaccugggcaaga

SEQ ID NO: 54292 - RNA, 52 nt, Mus musculus
gccuucgacgcgcuugaucgccuccuggagcucaagcugccagacaaugagc

SEQ ID NO: 54293 - RNA, 46 nt, Mus musculus
cuccaugacuuggauguuucugacaaccaguuggagcauaugccau

SEQ ID NO: 54294 - RNA, 46 nt, Mus musculus
ccauggagucugguaaccagugaaggaagcccccagaaauaaugag

SEQ ID NO: 54295 - RNA, 43 nt, Mus musculus
uccaaaaacugauggcucaucuuugucuguuacccuuagggcu

SEQ ID NO: 54296 - RNA, 46 nt, Mus musculus
uuuguuugcacuagaaugaagacucuauacagagcuagcacugcag

SEQ ID NO: 54297 - RNA, 46 nt, Mus musculus
guucaugguguacauagagugccagcuggggcaacaugagagagag

SEQ ID NO: 54298 - RNA, 45 nt, Mus musculus
cauaugcuuggcucagggaguggcacuauuuggagguguggccuu

SEQ ID NO: 54299 - RNA, 42 nt, Mus musculus
caaaacucuugcacagaaaagaaaaugaauauauacuggggg

SEQ ID NO: 54300 - RNA, 46 nt, Mus musculus
aacccaggaccucagaaaugcaaggcaagcaagcacucaccaucga

SEQ ID NO: 54301 - RNA, 45 nt, Mus musculus
ggaaucagccccacucaccguccugucagcugaaccggaggccag

SEQ ID NO: 54302 - RNA, 46 nt, Mus musculus
aaggagcugggcagugguggcgcaggccuuuaaucccagcacucgg

SEQ ID NO: 54303 - RNA, 42 nt, Mus musculus
gcccggccggcccggagcaggggugauccuagacugcuggaa

SEQ ID NO: 54304 - RNA, 41 nt, Mus musculus
agcgacucauggcagcugggacagagcaagcucaggcugga

SEQ ID NO: 54305 - RNA, 45 nt, Mus musculus
ugccauccccagcacagugacauaguccuauagucccagcauuca

SEQ ID NO: 54306 - RNA, 41 nt, Mus musculus
ccuccugcuugccuguguccccagaaauuccucucuugggc

SEQ ID NO: 54307 - RNA, 46 nt, Mus musculus
uguaacugccauuuagugagugcuaggcacccauaaaucaagggag

SEQ ID NO: 54308 - RNA, 44 nt, Mus musculus
ucuugucugucucuuuaaaaaauauuuuuguaaguuauuuugag

SEQ ID NO: 54309 - RNA, 46 nt, Mus musculus
agaugauuauuaccagauccugggagugccccgaaaugccagccag

SEQ ID NO: 54310 - RNA, 45 nt, Mus musculus
ccuuuggugggcaaugaaugugauaucaaucuguuaacguuuuaa

SEQ ID NO: 54311 - RNA, 46 nt, Mus musculus
aucuucuccuuuuggugauuuccagaauguguuugaucagccucag

SEQ ID NO: 54312 - RNA, 98 nt, Mus musculus
ucacugugaacauuauggauaccugugagcgcugugacggcaaggggaacgagccuggaaccaaagugcagcauugccauuacuguggcggcucgggc

SEQ ID NO: 54313 - RNA, 101 nt, Mus musculus
ggccuuuugugaugcguuccacaugucggagaugugguggccggggcuccaucaucacaaaucccuguguggucugcaggggagcaggacaagccaagcag

SEQ ID NO: 54314 - RNA, 46 nt, Mus musculus
ugugccuguuguaugcaugauuguacaguuagagauaaagccccaa

SEQ ID NO: 54315 - RNA, 45 nt, Mus musculus
uucuaggaguugaagauggucagacuguaaggaugccagugggaa

SEQ ID NO: 54316 - RNA, 45 nt, Mus musculus
aucugaugugugguggugguguuguuucuguauaaauuguugguu

SEQ ID NO: 54317 - RNA, 42 nt, Mus musculus
gcucaagcuauucuugggggcacagccaaagcccagggccug

SEQ ID NO: 54318 - RNA, 45 nt, Mus musculus
ggcaucccccggauuaauagcuauggcuauggugaccacuacauu

SEQ ID NO: 54319 - RNA, 42 nt, Mus musculus
aaugacugucuauaaagguaaaggggaccccccccccguguu

SEQ ID NO: 54320 - RNA, 41 nt, Mus musculus
acuccaauucuuugauaguugaaccuugguggucagcguca

SEQ ID NO: 54321 - RNA, 44 nt, Mus musculus
aggaggcugagcaguaggcagcagaaccugauccugagcuaugc

SEQ ID NO: 54322 - RNA, 46 nt, Mus musculus
uauuuaaauuacuccgugguaaauuucauugucuuuuccuguguaa

SEQ ID NO: 54323 - RNA, 42 nt, Mus musculus
gaagugggguagaacugucaucaucagagaagggggaggaga

SEQ ID NO: 54324 - RNA, 44 nt, Mus musculus
aggagcugagguggugguggugguggaaggauggugcuuccuaa

SEQ ID NO: 54325 - RNA, 47 nt, Mus musculus
aaaugaccagcuaggggcuuagauaugacuuuguuagggagagcagg

SEQ ID NO: 54326 - RNA, 42 nt, Mus musculus
gugguggccagggacgguugaacacaccuguaauguucauac

SEQ ID NO: 54327 - RNA, 44 nt, Mus musculus
cagcuaggcaugugaaccaugugugugacuagcauggccaucua

SEQ ID NO: 54328 - RNA, 42 nt, Mus musculus
augagacaacauuuuaagcagggcuggcauaauccaccccag

SEQ ID NO: 54329 - RNA, 42 nt, Mus musculus
ugcuugucuccccucccuccccuagaccuuuggcccccacac

SEQ ID NO: 54330 - RNA, 46 nt, Mus musculus
caagcagauggggacgggguguguguguguggggaggagauagugg

SEQ ID NO: 54331 - RNA, 46 nt, Mus musculus
aaaaacaaaacaugauuuugugcaauuaacaaagcuacugcaagaa

SEQ ID NO: 54332 - RNA, 55 nt, Mus musculus
cuguggaaaugcuuguaagaaagccccuacucccgcuuuuccuugaaaugacaga

SEQ ID NO: 54333 - RNA, 47 nt, Mus musculus
gggggcuggggguggggaagaugcuguaagaaaaccgguuagucaau

SEQ ID NO: 54334 - RNA, 47 nt, Mus musculus
guucagugcaauuguccauucacugggaugcugaacaguuucugucu

SEQ ID NO: 54335 - RNA, 42 nt, Mus musculus
ggagauauuucugucccauccucuuuugacccagccccagcc

SEQ ID NO: 54336 - RNA, 61 nt, Mus musculus
ugcauuccagcccaagggaaggggccguaagggccuugggagcagugaaguguaugggcgg

SEQ ID NO: 54337 - RNA, 46 nt, Mus musculus
cucuguuccucuguguucucugucucugucacacacacacccagga

SEQ ID NO: 54338 - RNA, 46 nt, Mus musculus
gcaacaugcuaacauauucuaugaugagacaccaugacccccaaaa

SEQ ID NO: 54339 - RNA, 46 nt, Mus musculus
cccaggcugaccacacccaaguacgggcaguuugguuacacuagag

SEQ ID NO: 54340 - RNA, 42 nt, Mus musculus
aaggaauccgccccgggaagugcuauguggacaugucaacgg

SEQ ID NO: 54341 - RNA, 45 nt, Mus musculus
gcagcagacagcacagcugugaauggcagcauuacacccacagac

SEQ ID NO: 54342 - RNA, 48 nt, Mus musculus
gggaaagaugguuuugugguggcaaagccguagaggaggcagccuggc

SEQ ID NO: 54343 - RNA, 45 nt, Mus musculus
guacugaugaugggaagggaacagaauuaggacucgggcaaagau

SEQ ID NO: 54344 - RNA, 46 nt, Mus musculus
caggcuagcuucaaacagaggucugccugccucugccuccugagug

SEQ ID NO: 54345 - RNA, 30 nt, Mus musculus
gcccccuaaggauaacugaaaaggccgacc

SEQ ID NO: 54346 - RNA, 45 nt, Mus musculus
caugcgugguaggcaagcacucuaccauuaaacuagccaucagau

SEQ ID NO: 54347 - RNA, 46 nt, Mus musculus
agaugaaugagagcaagaugcacagacauaggaaagagaugcagau

SEQ ID NO: 54348 - RNA, 50 nt, Mus musculus
caagcuuagccugucugaagggaaggugaagaagaacaugggagaaggaa

SEQ ID NO: 54349 - RNA, 42 nt, Mus musculus
ucucaggguggcuaugaagacaguucacagaacugcugagag

SEQ ID NO: 54350 - RNA, 110 nt, Mus musculus
ucaaaguggaacagcuaaagccuuaccaugcucacaaggaggagaugauaaagauuaacaaggguaaacgguuccagcaagcuguggaugcuguugaagaguuccucagg

SEQ ID NO: 54351 - RNA, 45 nt, Mus musculus
cugcucuauggaccaaguucuagaaaagcaggggcuacauagaga

SEQ ID NO: 54352 - RNA, 50 nt, Mus musculus
aacuaguuucuuuuuuguuuguuuuuguuuuucuuuguggauuuuaauuu

SEQ ID NO: 54353 - RNA, 46 nt, Mus musculus
cuuggugccaugggggaaaaaaagaggcuccuugccuggcauagua

SEQ ID NO: 54354 - RNA, 44 nt, Mus musculus
agcuuugugguggcaguauuucaaggaagacuacccuaaguugu

SEQ ID NO: 54355 - RNA, 46 nt, Mus musculus
acguggaaagaaaugcuucuuugugaaguuuuuuggaacagaagau

SEQ ID NO: 54356 - RNA, 46 nt, Mus musculus
cuggucgcaggguugccagcuggcccaggaguaguuuuauuaugca

SEQ ID NO: 54357 - RNA, 45 nt, Mus musculus
ucaaaucccagcaaccacaugguggcucacaaccaucuuuagagc

SEQ ID NO: 54358 - RNA, 46 nt, Mus musculus
uugguaaagaauauccgcgggaagguaaaaggccuucauccuggag

SEQ ID NO: 54359 - RNA, 46 nt, Mus musculus
ucagugccaaguaacucacccagccugauugauuuggggaauguau

SEQ ID NO: 54360 - RNA, 42 nt, Mus musculus
auagauuauaaucacuauuaauauuaaaauuccuugcccaag

SEQ ID NO: 54361 - RNA, 45 nt, Mus musculus
uacauaaguacacuguaugucagacaucccagaagaggccaucag

SEQ ID NO: 54362 - RNA, 46 nt, Mus musculus
cuuggauccuuucaaugaugaagaaaaagaaaggcauaagguggag

SEQ ID NO: 54363 - RNA, 45 nt, Mus musculus
uuuaugcagauuaaaucugcucuauuucaaguuuuaggggcggga

SEQ ID NO: 54364 - RNA, 45 nt, Mus musculus
aaggagaagaaaucgaaaaaguccaaguuuuccaaagccggguaa

SEQ ID NO: 54365 - RNA, 87 nt, Mus musculus
aaaaagaagaagaaguacucugggucauuaagcguuagagagaugcucaagaaauuucagaaggagaaagaggcucagaaaaaaagg

SEQ ID NO: 54366 - RNA, 45 nt, Mus musculus
gaugcccaagaaauccuuugugaaaguguaagccuuucccaaguu

SEQ ID NO: 54367 - RNA, 42 nt, Mus musculus
cacaaccaucuauaaugggaucugaugcccucuucuagugug

SEQ ID NO: 54368 - RNA, 95 nt, Mus musculus
uagcaccuaaguaauucacuauaaagccagauccuccaagaugcaguuuaaaagacuucagaaaaaaaauuuuuuuaaagguuauacagucagaa

SEQ ID NO: 54369 - RNA, 46 nt, Mus musculus
acuccuuuacagaaguaauuggaagugauuuaaagguaauuggaag

SEQ ID NO: 54370 - RNA, 45 nt, Mus musculus
ugggguagggaaaccugccuaggaacuuccaugugcagcuaagag

SEQ ID NO: 54371 - RNA, 42 nt, Mus musculus
cuagacuuguucuucaaguugucaucuuuaguaucacauaug

SEQ ID NO: 54372 - RNA, 46 nt, Mus musculus
guuggcaggugcucuuugggagcgaugacucugugccugcugguga

SEQ ID NO: 54373 - RNA, 45 nt, Mus musculus
cuaaggaucccaucugcugcacuaccuccuucugauagcccguua

SEQ ID NO: 54374 - RNA, 50 nt, Mus musculus
uagccaaguaccaggaugaaugccaagcacacacacaggcaaagguugcu

SEQ ID NO: 54375 - RNA, 58 nt, Mus musculus
accucagaauuccuucuauucccucuauaggaugcuggaggaagagaaagacaaggag

SEQ ID NO: 54376 - RNA, 57 nt, Mus musculus
cagagagaacggauuuguucugaugaagaagaggaugaagaaaaggggggccggaga

SEQ ID NO: 54377 - RNA, 45 nt, Mus musculus
cugaggucaagccucucuggcccaaaggcuggaugcaagccaggu

SEQ ID NO: 54378 - RNA, 46 nt, Mus musculus
uuggaaaagaaaagguuuauuuugucuuacagcuuauaguccauca

SEQ ID NO: 54379 - RNA, 45 nt, Mus musculus
gugaagaccaagcuauacaguuguaagauauaugcaaagggccua

SEQ ID NO: 54380 - RNA, 46 nt, Mus musculus
gaguggcaaaauuacugacuuccucccugaagccugcugcaguuag

SEQ ID NO: 54381 - RNA, 46 nt, Mus musculus
uuuauggaagcuuugguuuuaucuagaauuaaaauuuaucacggag

SEQ ID NO: 54382 - RNA, 42 nt, Mus musculus
ccucugccaaagcaggagucucuaaggaugccauugucacag

SEQ ID NO: 54383 - RNA, 46 nt, Mus musculus
accaugggaacaucccccaccucuggaagcugcauaguacccggga

SEQ ID NO: 54384 - RNA, 45 nt, Mus musculus
cauucauguccuaaagcugggaacucuguagugaguggaugucag

SEQ ID NO: 54385 - RNA, 46 nt, Mus musculus
accauuuuuauguuucccuccccuggucuuccaaagcuaucagaag

SEQ ID NO: 54386 - RNA, 41 nt, Mus musculus
guggguuuggcugacugccuagccagaccacauuuggggag

SEQ ID NO: 54387 - RNA, 46 nt, Mus musculus
ucuagugaugccucuugccucagggaaauguuucuuugauggggag

SEQ ID NO: 54388 - RNA, 45 nt, Mus musculus
uuguggggauugauuccuuuuaaaguaauuguguaggcugaacag

SEQ ID NO: 54389 - RNA, 79 nt, Mus musculus
uguggccugccucuggcucuguuuuuguggcacaaugucuaauaucuuaucucuuuugucugauucuucagcucagauc

SEQ ID NO: 54390 - RNA, 23 nt, Mus musculus
cucugugaagggaagggaccgcu

SEQ ID NO: 54391 - RNA, 46 nt, Mus musculus
cugccuggcuucuuggucaguuuaugccauuuguguuuggggacag

SEQ ID NO: 54392 - RNA, 47 nt, Mus musculus
gucucaaaaaaccaaaaaaaaaaaggaaagaaaaggaaagaagagaa

SEQ ID NO: 54393 - RNA, 46 nt, Mus musculus
ccuuccuguccuucagaugauuacacacacacacacacacagagag

SEQ ID NO: 54394 - RNA, 46 nt, Mus musculus
acagaugcuguggcugugaguggauaguugcugcagaggcuuuggu

SEQ ID NO: 54395 - RNA, 45 nt, Mus musculus
acugaguguggggugugcuguuugcagugaucucuguugugauag

SEQ ID NO: 54396 - RNA, 45 nt, Mus musculus
aggaaccagaagucucagaugccugucguccugacuaugaggccu

SEQ ID NO: 54397 - RNA, 44 nt, Mus musculus
agcucagaacccgagggguccuuuaguuuuucuucuaggcucug

SEQ ID NO: 54398 - RNA, 46 nt, Mus musculus
cuccuuguuacccccgcagcccgcacuacuaaaguaggcaagagac

SEQ ID NO: 54399 - RNA, 46 nt, Mus musculus
uuaugcacagugauguucaaguguuuauggaacauuugagccucag

SEQ ID NO: 54400 - RNA, 41 nt, Mus musculus
ccuuugcucaguuggguggagcagaugaacucuggggauau

SEQ ID NO: 54401 - RNA, 46 nt, Mus musculus
ccuuguccccucuauaaccacaagccugcuuauuagcuccacagag

SEQ ID NO: 54402 - RNA, 45 nt, Mus musculus
ugacaaagaaaacaaaauucaccuauaagauuuaaugagacccag

SEQ ID NO: 54403 - RNA, 51 nt, Mus musculus
ugggugguggauaggucagaugagugaauagaugguggguugguggaugga

SEQ ID NO: 54404 - RNA, 42 nt, Mus musculus
gugguaaauagcuggauggacagugguagaugaaugaguaag

SEQ ID NO: 54405 - RNA, 46 nt, Mus musculus
uggauggauggguggaugacugaguagguagauaaguaagaugcau

SEQ ID NO: 54406 - RNA, 48 nt, Mus musculus
gugagugugugugagugagugugugugugaguguauaugugugagugu

SEQ ID NO: 54407 - RNA, 52 nt, Mus musculus
ugugugugugagugugugugugugugaguguguguguauggugaguguguaa

SEQ ID NO: 54408 - RNA, 42 nt, Mus musculus
cucaggacagaguuugugagguucuuagcuggguucuaggag

SEQ ID NO: 54409 - RNA, 45 nt, Mus musculus
ugaauggagggagguaucaguucacagcaaccugaagugggccaa

SEQ ID NO: 54410 - RNA, 44 nt, Mus musculus
guguguuauuucuagaaucacugucauugggcacugugaacaug

SEQ ID NO: 54411 - RNA, 45 nt, Mus musculus
gggugggucgaggagucaggguguuucuaugcccauuugugugca

SEQ ID NO: 54412 - RNA, 41 nt, Mus musculus
uccuguguccuugucaucaccugugugugucacaguauccc

SEQ ID NO: 54413 - RNA, 46 nt, Mus musculus
ucaauucccagcagccacaugguggcucacaaccaucuguaaucaa

SEQ ID NO: 54414 - RNA, 42 nt, Mus musculus
guaguuucugagguugcuagaugcauuauuuggaggggugua

SEQ ID NO: 54415 - RNA, 73 nt, Mus musculus
gccugccucuucucuauccagaggcaguccuuugucaccauccauccccagaaaaaauaccccuucuucucuc

SEQ ID NO: 54416 - RNA, 46 nt, Mus musculus
caaccaaaagcucccuuuggcugcccuaauuagcaugcccaauaaa

SEQ ID NO: 54417 - RNA, 46 nt, Mus musculus
uuccuucccccuucccuuuccucccuccaaaccuucccuugcccuu

SEQ ID NO: 54418 - RNA, 25 nt, Mus musculus
ucuuuguguaggccuguggugggac

SEQ ID NO: 54419 - RNA, 46 nt, Mus musculus
uucacauccugcacacuaaacaagcauucuacaaagugagcaccag

SEQ ID NO: 54420 - RNA, 46 nt, Mus musculus
uggucagcccaggcguccugccugccaguccuagacccgaccgggg

SEQ ID NO: 54421 - RNA, 41 nt, Mus musculus
acagggugaggaccuggcauucugcuguggguguggacaga

SEQ ID NO: 54422 - RNA, 46 nt, Mus musculus
ccugggguagacacccuuuugacacugaggguuaaagugaccagac

SEQ ID NO: 54423 - RNA, 45 nt, Mus musculus
aguccuuugcaaucccuacuugguagguuugcacucuugacaggu

SEQ ID NO: 54424 - RNA, 46 nt, Mus musculus
gauuauuguagggcucacugcaguguugggggagagaggggaggaa

SEQ ID NO: 54425 - RNA, 63 nt, Mus musculus
guuaugaguaaggaaguugaucuagaaagcacagaaguagagauacagggaugggcacaagug

SEQ ID NO: 54426 - RNA, 41 nt, Mus musculus
acuuuucuugccacgcacauuuguuauugaaucaaggggau

SEQ ID NO: 54427 - RNA, 45 nt, Mus musculus
uuggcuguugugcaaugggcuugaaagacuucgaccuuacaugga

SEQ ID NO: 54428 - RNA, 45 nt, Mus musculus
gcaucaggauaauuguugaugcaccaacauuuguuaacuuuaucc

SEQ ID NO: 54429 - RNA, 46 nt, Mus musculus
gcguaucuuacauuuuuauaaaguacuguaauucaggggguggggu

SEQ ID NO: 54430 - RNA, 45 nt, Mus musculus
caccuuagaaccagaggccugaaagccugaccugaccagcacaga

SEQ ID NO: 54431 - RNA, 45 nt, Mus musculus
cgacagggcaaacgaucaccuguugccuuaaugaacuuuccacag

SEQ ID NO: 54432 - RNA, 45 nt, Mus musculus
guguccauaggucauuccguagggcaucuaguacacgucgguuca

SEQ ID NO: 54433 - RNA, 96 nt, Mus musculus
ccacagguggaaugaugagggcccaaaugugggacaucuaugcucagauauuaaaccuaagcucacguaagaagugggcaaagacuggcccugguu

SEQ ID NO: 54434 - RNA, 85 nt, Mus musculus
agaagaagaagaagaagaagaagaagaagaagaaagaauagagacagagaaggaguuucugcauucuugggaucacaaaccagac

SEQ ID NO: 54435 - RNA, 50 nt, Mus musculus
guuuccuuuaaaagcuuuuaugaagaagaagaaggagaaggagaaggaga

SEQ ID NO: 54436 - RNA, 46 nt, Mus musculus
gccucauguacaugauccugaggaagcguaaauaagugucagaagu

SEQ ID NO: 54437 - RNA, 46 nt, Mus musculus
cuauacagaccggcgccaagaccuucaccaacagaacagaaaacuc

SEQ ID NO: 54438 - RNA, 45 nt, Mus musculus
uaggucaucucuuccuggucuccugcaucuucuuacuagccagac

SEQ ID NO: 54439 - RNA, 41 nt, Mus musculus
acaagaucucccaagacuuugaggugcgagagcgugggagg

SEQ ID NO: 54440 - RNA, 42 nt, Mus musculus
ccagcacacuaaaucaacaaagaaguuaacaggcugucaaga

SEQ ID NO: 54441 - RNA, 43 nt, Mus musculus
aaggcgcccccacuuaaugcugcggcacagcggcagccgguca

SEQ ID NO: 54442 - RNA, 42 nt, Mus musculus
cucaccugcaagacccagccaccgcgggagcugccccaagaa

SEQ ID NO: 54443 - RNA, 45 nt, Mus musculus
ccagaguagagcaggaaacagagggacuuucccuuccuuuccaag

SEQ ID NO: 54444 - RNA, 45 nt, Mus musculus
gaguguaugugugagugacuguauuugaguaugugugugugugug

SEQ ID NO: 54445 - RNA, 45 nt, Mus musculus
ggaaccuccagaagcaaaagccugggccagcugaagacaggggac

SEQ ID NO: 54446 - RNA, 45 nt, Mus musculus
gcaaaacagcaagacaauuuuauuuggaacuaagcaauaguacag

SEQ ID NO: 54447 - RNA, 60 nt, Mus musculus
gaaagcagggcaguauuucucacugccuuggaggcccugggagguggaagcuuuggaugg

SEQ ID NO: 54448 - RNA, 48 nt, Mus musculus
uacaauagcacuggugaugugcccaguuaagugaugaguaggcagagg

SEQ ID NO: 54449 - RNA, 46 nt, Mus musculus
caagaaguuacagagaaaaaggcaagacauuaagaacagccugcug

SEQ ID NO: 54450 - RNA, 36 nt, Mus musculus
agaaugggaugaucaaggcaaguagagaggaguaag

SEQ ID NO: 54451 - RNA, 46 nt, Mus musculus
gccuuaggaaagauggugcauguagggguguaggugcuggccagug

SEQ ID NO: 54452 - RNA, 46 nt, Mus musculus
cgcagccuuggcuaaggaugaggacugggaccuggaguuaucugag

SEQ ID NO: 54453 - RNA, 45 nt, Mus musculus
cucagcaugcaugaguccagcuggcacucuaacagggcgaugcac

SEQ ID NO: 54454 - RNA, 45 nt, Mus musculus
gaggcugcuaaggaguucuuggauguguguuaguccugggagcag

SEQ ID NO: 54455 - RNA, 46 nt, Mus musculus
gcuaccuuuuuaaguguauaccagagccguacacuccaaugguuag

SEQ ID NO: 54456 - RNA, 46 nt, Mus musculus
caauaaaugcuaaaugacauucgaguucauuuuguagaccacugag

SEQ ID NO: 54457 - RNA, 55 nt, Mus musculus
cuuuggcuucagagacgaagcaugagaauaggacagacuaacuuuugaaggagcc

SEQ ID NO: 54458 - RNA, 45 nt, Mus musculus
auguguaguuuggcauaucuaauuaggucucuagugauuuuugau

SEQ ID NO: 54459 - RNA, 41 nt, Mus musculus
ggucuacagagcuaguuccaggacagccagggcuacagaga

SEQ ID NO: 54460 - RNA, 42 nt, Mus musculus
agucuuuuauucaaaacuucaguguucucuacagccccuuga

SEQ ID NO: 54461 - RNA, 44 nt, Mus musculus
uuaaagaacuuuaauaaaggaaacaaaaagcuucuggucugaga

SEQ ID NO: 54462 - RNA, 46 nt, Mus musculus
guguuuugcugcaugucugucuguauaccacaugugugcaguaccu

SEQ ID NO: 54463 - RNA, 73 nt, Mus musculus
gcucuaaguuuagagacuaugaagacagggugagcauagcuccuuaaguccuaguccuuuugucuguccaggu

SEQ ID NO: 54464 - RNA, 46 nt, Mus musculus
cagcaucacuggaggugcagggagagccaaugcuugccaaguggag

SEQ ID NO: 54465 - RNA, 62 nt, Mus musculus
aaagaagaaucucacuauauccuggaucccaaacaagcccucaugaaguucacucuagguac

SEQ ID NO: 54466 - RNA, 45 nt, Mus musculus
gccagggucaggaaguggaagaagagggcaggagaggcuuagaag

SEQ ID NO: 54467 - RNA, 46 nt, Mus musculus
aggcuuuuuuuucuuuccuucaaggaucccuuaauuggcccaaacu

SEQ ID NO: 54468 - RNA, 42 nt, Mus musculus
augaacuucacagcugagaacaucuauaagugggccucagaa

SEQ ID NO: 54469 - RNA, 25 nt, Mus musculus
gaguaagggggaaaaggagaacugg

SEQ ID NO: 54470 - RNA, 46 nt, Mus musculus
cggcuacucaguggugaucucucacucuaggugcaugaucucugag

SEQ ID NO: 54471 - RNA, 46 nt, Mus musculus
auauacauggguaaaaagguguguuaguaguucaggacugccaguu

SEQ ID NO: 54472 - RNA, 46 nt, Mus musculus
cugaccagagaaggccuugccauucagugguauuggauguggagaa

SEQ ID NO: 54473 - RNA, 46 nt, Mus musculus
cagcucacaaccaucuguaaugagauccaauacccucuucuggugu

SEQ ID NO: 54474 - RNA, 46 nt, Mus musculus
gucuuaugauaaacuaaguuguuuuaaaauuaagcaggauguaaaa

SEQ ID NO: 54475 - RNA, 41 nt, Mus musculus
uuuuaauggucuugaaguugauugaaaaaggaguaagacag

SEQ ID NO: 54476 - RNA, 46 nt, Mus musculus
gcuaggaacugcagugaacuuucccaggggcacaauagaggaagau

SEQ ID NO: 54477 - RNA, 42 nt, Mus musculus
guccucuuccuccaucaugaauuuaaaggaugaaaccaaggg

SEQ ID NO: 54478 - RNA, 45 nt, Mus musculus
ugguuuugugugugugugugugugugugugugugagagagagaga

SEQ ID NO: 54479 - RNA, 45 nt, Mus musculus
uaugcagagaaacccugucucgaaaaaccaagaaagaaggaaaga

SEQ ID NO: 54480 - RNA, 45 nt, Mus musculus
uuuuguuuuguuuuuuuaaagauuuauuuauuauuacacagaagu

SEQ ID NO: 54481 - RNA, 42 nt, Mus musculus
uccaccccuaacauggaagagaaacaaggauaaaagggagug

SEQ ID NO: 54482 - RNA, 46 nt, Mus musculus
cugcacuggggcuuugaaaugcccacaauucaucuuagcugcuuua

SEQ ID NO: 54483 - RNA, 44 nt, Mus musculus
auguauguauaugaacuauaugcauaccagaacuugaggcaauc

SEQ ID NO: 54484 - RNA, 45 nt, Mus musculus
aguuacauccucuuaacuguagagccaucucucuuaggcccaaga

SEQ ID NO: 54485 - RNA, 45 nt, Mus musculus
gcccuauuuuuaaguaaagaaaaugagacuucaaugggugaagau

SEQ ID NO: 54486 - RNA, 45 nt, Mus musculus
gguccuucuaaauugagaacuuauaguucuauguacauagcaggg

SEQ ID NO: 54487 - RNA, 41 nt, Mus musculus
ggaagcuaaugugcaucuuuucagaaaauuguguagauaga

SEQ ID NO: 54488 - RNA, 46 nt, Mus musculus
uacaauaaacaaacacuucagagaccuuaauaagugcuaugcaggg

SEQ ID NO: 54489 - RNA, 46 nt, Mus musculus
caaagaggaugagccacugcaugaaauuuggaauucagugucugag

SEQ ID NO: 54490 - RNA, 46 nt, Mus musculus
agacacugagaugcacucugucuggacccagagugcuacuguaagc

SEQ ID NO: 54491 - RNA, 46 nt, Mus musculus
gcccagggugagggacagucagaaaggucugacugucaucuggcag

SEQ ID NO: 54492 - RNA, 29 nt, Mus musculus
ugucuguaugucuaugugucugucugucu

SEQ ID NO: 54493 - RNA, 46 nt, Mus musculus
ggaugguugugagaugguugugaaccaccaugugguugguugcugg

SEQ ID NO: 54494 - RNA, 45 nt, Mus musculus
aggaaggaguaaaggaaaaggcacacuaaccaugggaggcuuaga

SEQ ID NO: 54495 - RNA, 45 nt, Mus musculus
gguacaauggguacauuuuguuguuguuguuguuuuagcagacuu

SEQ ID NO: 54496 - RNA, 54 nt, Mus musculus
gcucugaauagugcuccucaugugaggcagggggugcucuaccagacaagcuga

SEQ ID NO: 54497 - RNA, 46 nt, Mus musculus
gggucuuauuucuuuuauuuacauguuccugauagccuaggccaag

SEQ ID NO: 54498 - RNA, 46 nt, Mus musculus
aagagaugcaauguuuggauuuuaauguauaaaauccccugcuuga

SEQ ID NO: 54499 - RNA, 58 nt, Mus musculus
uaccuuauucucuuucucuccacccgcagccagaguuugcccuacauuucaaagccgg

SEQ ID NO: 54500 - RNA, 44 nt, Mus musculus
ucuucaucugaagucugcuagaagaagacuggcucaugggcagc

SEQ ID NO: 54501 - RNA, 41 nt, Mus musculus
uccuagagauaguuagauauugugugugugugugugugugu

SEQ ID NO: 54502 - RNA, 46 nt, Mus musculus
ucugugugugugucugugugugugugucugugugugugugcgugug

SEQ ID NO: 54503 - RNA, 46 nt, Mus musculus
cucagcucaaugcaccuguuguuaaugacuaugguuguugggagug

SEQ ID NO: 54504 - RNA, 42 nt, Mus musculus
gaggaggaaggggaggaggaagaagaggaagaggaggaggag

SEQ ID NO: 54505 - RNA, 46 nt, Mus musculus
gucaaaaagucuucagaucuggaagguagagcaucuaggguuugau

SEQ ID NO: 54506 - RNA, 45 nt, Mus musculus
acuggcuuccuccugccugggauuuuuuccucaccgccccaacuc

SEQ ID NO: 54507 - RNA, 42 nt, Mus musculus
uaugugugggccaccucugugacgggcaauaaugcugcugcu

SEQ ID NO: 54508 - RNA, 42 nt, Mus musculus
gauggagguggggaauguggcuaaugugccugugaagggagg

SEQ ID NO: 54509 - RNA, 77 nt, Mus musculus
acucaucccgggcugccucuuaacucaauacguacccaagaccugaacuuguguucuuccagccucagccugcagac

SEQ ID NO: 54510 - RNA, 42 nt, Mus musculus
aaagcuuuacaacaguacacauucauuucuuaggcuggagag

SEQ ID NO: 54511 - RNA, 45 nt, Mus musculus
aacucccagcaaccacaugguggcucacaaccaucuguacuggga

SEQ ID NO: 54512 - RNA, 41 nt, Mus musculus
cauuagauuucuuaacugcuaguauaaggguguuaaagggg

SEQ ID NO: 54513 - RNA, 46 nt, Mus musculus
uguucugugacugggcaucuagagaaauagagacaaaugcaucuuu

SEQ ID NO: 54514 - RNA, 47 nt, Mus musculus
uggucgaggaagaagauuggaaauauuaagaggugggcaugauugga

SEQ ID NO: 54515 - RNA, 45 nt, Mus musculus
gugaaggaugagguaauaguuccucuaaaguuucagugcaggagu

SEQ ID NO: 54516 - RNA, 46 nt, Mus musculus
ucaccaagagguggcucugacuuucuucucguuccagaggguagau

SEQ ID NO: 54517 - RNA, 46 nt, Mus musculus
acaaagaacaaaaacaaacaaacaaacaaaaacagcaccaagaaag

SEQ ID NO: 54518 - RNA, 46 nt, Mus musculus
uuugguuuuguuuuuaaaaggcauuuuaaagguuuugugguuuguu

SEQ ID NO: 54519 - RNA, 41 nt, Mus musculus
ccacacagggguaaaggaccuugugggcagaguagcuaggu

SEQ ID NO: 54520 - RNA, 29 nt, Mus musculus
aggccccagccacagugggccuggccuuc

SEQ ID NO: 54521 - RNA, 41 nt, Mus musculus
agaggcgugugcacgugaccuuggcgcucaggagguggagg

SEQ ID NO: 54522 - RNA, 46 nt, Mus musculus
gaaaugggggcuaugaggacaagagggugggaggaaggguccccau

SEQ ID NO: 54523 - RNA, 44 nt, Mus musculus
aagccauugauucccaguucuuaguaauaugaccugccccggau

SEQ ID NO: 54524 - RNA, 42 nt, Mus musculus
ucuggaggcagcaaauuggggauuuucuguguuuuguggggg

SEQ ID NO: 54525 - RNA, 46 nt, Mus musculus
gaagccugacuugguguucuuuccuucuuggaacuuuuugccacag

SEQ ID NO: 54526 - RNA, 42 nt, Mus musculus
ccucccuuaagucucaucuugcagauuuccuuucggccccuc

SEQ ID NO: 54527 - RNA, 47 nt, Mus musculus
uggggacagagcugaucuggcucuggguagcaguauucuugguagga

SEQ ID NO: 54528 - RNA, 45 nt, Mus musculus
ugaaaacuuguuacuucccagcacauagagugggcgagcugcuag

SEQ ID NO: 54529 - RNA, 45 nt, Mus musculus
gguauagguggcugagauggcuuaggggguaaaggugcuugccuc

SEQ ID NO: 54530 - RNA, 46 nt, Mus musculus
gcuuuagucaguguuucugggccuuauucuuaguucuggugaguca

SEQ ID NO: 54531 - RNA, 42 nt, Mus musculus
uguaauccuaguacagggagaguggaguguugaggcaggcag

SEQ ID NO: 54532 - RNA, 46 nt, Mus musculus
agugauuuccauuggccagugugguugcacaugccuuuagucccac

SEQ ID NO: 54533 - RNA, 82 nt, Mus musculus
cucugguccuguuucccccucuacuucuucuaucucucucgccaugaccggggcuacauccagaugacacaccucaacaaaa

SEQ ID NO: 54534 - RNA, 69 nt, Mus musculus
ggaucaucugcugggcagaccucuucuacucuuucugggaaagaagucagggagugcuccgagccccag

SEQ ID NO: 54535 - RNA, 46 nt, Mus musculus
gaagaagaggaagaagaacaagcuuagagcagacuugggggcagag

SEQ ID NO: 54536 - RNA, 45 nt, Mus musculus
auaguggagcugaagcccagagggcgaauaggaugaaggggcuga

SEQ ID NO: 54537 - RNA, 45 nt, Mus musculus
cguucuagguuaaaugagaggcucugugucaagaggauaaggcag

SEQ ID NO: 54538 - RNA, 42 nt, Mus musculus
gauacagcuugaacggaggaagggaguccaauccucgggaau

SEQ ID NO: 54539 - RNA, 46 nt, Mus musculus
uuucccaacaguaaaauuucauauggcuacaugugugucaucggag

SEQ ID NO: 54540 - RNA, 46 nt, Mus musculus
guccugcuucucagacugcucaccccuguucucugaaacuguccau

SEQ ID NO: 54541 - RNA, 46 nt, Mus musculus
acuucaccaaugcagacucacauugcauuccuguggaagcccauag

SEQ ID NO: 54542 - RNA, 46 nt, Mus musculus
ugugagugugagugugugugugugagugugugugugugugugagag

SEQ ID NO: 54543 - RNA, 46 nt, Mus musculus
ugcauauuaaaaaugugcucaauacguggauauguaaaguggggag

SEQ ID NO: 54544 - RNA, 24 nt, Mus musculus
augcagaacugugaagaugugggc

SEQ ID NO: 54545 - RNA, 47 nt, Mus musculus
aggacacaucagaagaagugguaccugugcuggugaauaacuggaag

SEQ ID NO: 54546 - RNA, 46 nt, Mus musculus
guuuggugucuugaauauucccugaauguucuuguuggaguugaau

SEQ ID NO: 54547 - RNA, 46 nt, Mus musculus
uaggcaaaaugccuugcacauuggauuguauaguuuuauaguaaga

SEQ ID NO: 54548 - RNA, 57 nt, Mus musculus
guauucagggacugcucccgugagaagauggcauucaaaacacucauucaaaggagg

SEQ ID NO: 54549 - RNA, 47 nt, Mus musculus
uacugaagguguaguaggaagucaggggcagauucuauacagggcug

SEQ ID NO: 54550 - RNA, 45 nt, Mus musculus
uuccuguacaaggcccuucaugaccugaugauguuugccggcccc

SEQ ID NO: 54551 - RNA, 46 nt, Mus musculus
acugcuguuugucagcgccugucugcagacacuggcacuccaccag

SEQ ID NO: 54552 - RNA, 46 nt, Mus musculus
gugugugugugugugugagagagagagagagagagagagaugcgca

SEQ ID NO: 54553 - RNA, 38 nt, Mus musculus
caaggguucaaggccagccugggcuucuagaguaaaac

SEQ ID NO: 54554 - RNA, 46 nt, Mus musculus
uguacgccugggagcuggccuuccaggacaaagucaugagcaucag

SEQ ID NO: 54555 - RNA, 44 nt, Mus musculus
uucugucucaugaggagcuggagccagacagcauugagcggagg

SEQ ID NO: 54556 - RNA, 71 nt, Mus musculus
aaaguguuucuggcagcuaauuaagggacuuaaaaauuagaggcagaagcaaaagugcagccaggggagag

SEQ ID NO: 54557 - RNA, 42 nt, Mus musculus
ucauguuccugggccacaaggggaguuugggguuuggggcag

SEQ ID NO: 54558 - RNA, 41 nt, Mus musculus
uaaugcuuuucucuuuccugugccaauacuccacugcccac

SEQ ID NO: 54559 - RNA, 55 nt, Mus musculus
gguaggcugcgggaagucaucucugcugucagcccugcuggcugagauggacaag

SEQ ID NO: 54560 - RNA, 45 nt, Mus musculus
uucugaauuuguuuuauuucacuucacaugaucuccagccccaac

SEQ ID NO: 54561 - RNA, 45 nt, Mus musculus
gauugucuugugugugugcuggaagugcagccaccuccaguguca

SEQ ID NO: 54562 - RNA, 46 nt, Mus musculus
ucuaacucugacaucuaccucuuugaugacccccucucggcugugg

SEQ ID NO: 54563 - RNA, 42 nt, Mus musculus
uaucagcuaccugccccaaguggaugucaucauugucaugag

SEQ ID NO: 54564 - RNA, 42 nt, Mus musculus
ccugugucuugggagcaguagcuucaguugacaugcacggag

SEQ ID NO: 54565 - RNA, 46 nt, Mus musculus
agcuauuaccucucugggaccugucuguuuucccacauguccccag

SEQ ID NO: 54566 - RNA, 47 nt, Mus musculus
aguuucccagaaguaaaacucucaucaaagucaaugaauggagaucc

SEQ ID NO: 54567 - RNA, 41 nt, Mus musculus
gaacaggaggcuacagugguagcuacugaaucaggguagga

SEQ ID NO: 54568 - RNA, 46 nt, Mus musculus
gguugcaaaggucugcccuaagucuggucuauuuguucucaggcag

SEQ ID NO: 54569 - RNA, 48 nt, Mus musculus
ggcuggagcuaaggaggagacguggaagcuaauggaagcagacaaggc

SEQ ID NO: 54570 - RNA, 44 nt, Mus musculus
ugcuugguguguguaucucacagcaagccucucagagcccaggg

SEQ ID NO: 54571 - RNA, 46 nt, Mus musculus
gcauuagccuguucaggugcuugacuggaagcucugugggaggcag

SEQ ID NO: 54572 - RNA, 60 nt, Mus musculus
ugcagcugucaguguacuggaacuacaugaaggccauuggccucuucaucaccuucuuga

SEQ ID NO: 54573 - RNA, 59 nt, Mus musculus
guaucuuccuuuuccugugcaaccauguaucugcacuggccucuaacuauuggcugagc

SEQ ID NO: 54574 - RNA, 48 nt, Mus musculus
cgcuugcaccuggaccugcuauacaauguucugcgaucacccaugagu

SEQ ID NO: 54575 - RNA, 46 nt, Mus musculus
uucuccaaggagcuggacacaguggacuccaugaucccgcagguca

SEQ ID NO: 54576 - RNA, 46 nt, Mus musculus
cccuggagguuaugagccauguuuagcuucucucaguauaccccag

SEQ ID NO: 54577 - RNA, 46 nt, Mus musculus
aaggucuuucucuagaagugcugcucagcuaucagaagggcccaga

SEQ ID NO: 54578 - RNA, 30 nt, Mus musculus
acuggagguggggaugguguuuuuacauuc

SEQ ID NO: 54579 - RNA, 46 nt, Mus musculus
uuuguucucggguucccuccgcaugaacuuggacccuuucagucag

SEQ ID NO: 54580 - RNA, 45 nt, Mus musculus
gcuuggugugagcuggucucuggcauauccaaugaggacugcagg

SEQ ID NO: 54581 - RNA, 46 nt, Mus musculus
ggaucugaccuugaagaagcuggaagacagaugcaccccacuucag

SEQ ID NO: 54582 - RNA, 45 nt, Mus musculus
cacgggcaagaaucugguaucaaagacagccagaguuccuuauag

SEQ ID NO: 54583 - RNA, 46 nt, Mus musculus
caagaauuugaugucugggagaagguacuagauucagggagcagcc

SEQ ID NO: 54584 - RNA, 46 nt, Mus musculus
cacaguucauacuugcuuugaauuuuggcucuaaugucagucccag

SEQ ID NO: 54585 - RNA, 41 nt, Mus musculus
uuuuuguaaguuaauaccauucuuucacuuuaaagggccca

SEQ ID NO: 54586 - RNA, 41 nt, Mus musculus
cugcacugugaugcccagucuaggaaaucguucagcugcaa

SEQ ID NO: 54587 - RNA, 46 nt, Mus musculus
cuuagcaagaaaaagccccaauucugaaugugugucugucuggcag

SEQ ID NO: 54588 - RNA, 45 nt, Mus musculus
uaauucguucuaugugaaguuuaaaauuauauuuacugacagcua

SEQ ID NO: 54589 - RNA, 42 nt, Mus musculus
gaacaguauuucuucuuaauagaauuguaauaguguuuccaa

SEQ ID NO: 54590 - RNA, 87 nt, Mus musculus
uaagagaaaaaaaaccaaaaacaagaaaaagaacagaacacaagagaauguauuaaaguauucuuguuuuauuuuugccaugugugc

SEQ ID NO: 54591 - RNA, 46 nt, Mus musculus
gaauacuugugaaaucaauguccuuuuuuaaaaaguaacuuucaag

SEQ ID NO: 54592 - RNA, 46 nt, Mus musculus
guaaauaaagaugccaacagcuaauagcugggcagaagagacauag

SEQ ID NO: 54593 - RNA, 46 nt, Mus musculus
aauaauggccacguugguuggcuaauuggaguuaagagcagcccag

SEQ ID NO: 54594 - RNA, 46 nt, Mus musculus
guaccuacauauaggacuuaaaagguguuaaagcggggcuggugag

SEQ ID NO: 54595 - RNA, 45 nt, Mus musculus
agaaagcugccauuucuccagcugaccagucccuaguccugccua

SEQ ID NO: 54596 - RNA, 45 nt, Mus musculus
ugcgccacccaggagaacguuccugggcccgcagggugaagcgau

SEQ ID NO: 54597 - RNA, 42 nt, Mus musculus
auauacugaaauucuucuccauugaaaccucuugggucaggu

SEQ ID NO: 54598 - RNA, 46 nt, Mus musculus
gaauaggaugauucagauucuccaugacuuuaaauagccacaggua

SEQ ID NO: 54599 - RNA, 83 nt, Mus musculus
aagaagccugugauugaacagggaaaagggagguggagcuaagaguugcagagauagggauagacacagaagaagaggaggag

SEQ ID NO: 54600 - RNA, 70 nt, Mus musculus
cagcaucuguuguccuugacuauugaccauaaagccagagucaaaugaccaaagcuguugaguucugcug

SEQ ID NO: 54601 - RNA, 41 nt, Mus musculus
cuuuuggagaguaugcucuggaaguaucaauaaggcccaga

SEQ ID NO: 54602 - RNA, 42 nt, Mus musculus
caggaaguggcaguauuagguguggccuuguuggaggaagug

SEQ ID NO: 54603 - RNA, 42 nt, Mus musculus
agccugaauauuuuuugauuuaacauuuucuuuggccgaguc

SEQ ID NO: 54604 - RNA, 46 nt, Mus musculus
auuaaucugggucaccagccaaagaaugugcagggguuggaccuag

SEQ ID NO: 54605 - RNA, 46 nt, Mus musculus
agauccauaaaagccuagccagggcacagccacaccagggacagau

SEQ ID NO: 54606 - RNA, 45 nt, Mus musculus
cccaacugauccugacgaugacucugcaaaacaaagcacccagca

SEQ ID NO: 54607 - RNA, 46 nt, Mus musculus
ugcggccaccaucuuccugccuuaggugugggacaacccccaagcc

SEQ ID NO: 54608 - RNA, 45 nt, Mus musculus
gacuggggaaggaaaaaacaaacacaaauuugggugagaaagggc

SEQ ID NO: 54609 - RNA, 45 nt, Mus musculus
uuaaaccaaaacugcuccaagcaaaauauucauuuacgucaaaga

SEQ ID NO: 54610 - RNA, 45 nt, Mus musculus
guguuucuguuuguuuguuuguuuuuuacugaguauauggacaga

SEQ ID NO: 54611 - RNA, 44 nt, Mus musculus
acagucccuaauaaagcgaucacgggaaggacucaagacaggaa

SEQ ID NO: 54612 - RNA, 52 nt, Mus musculus
ucaacuucugauaguugucuuuugaccgccacaugucugcugugucgggggu

SEQ ID NO: 54613 - RNA, 46 nt, Mus musculus
uauagcauaaaucaugucaacaacggcugagaaucaacugcaucca

SEQ ID NO: 54614 - RNA, 45 nt, Mus musculus
auaauacuuaaacugcgugugguggccuguaaucccaggaccuag

SEQ ID NO: 54615 - RNA, 45 nt, Mus musculus
gucacagucugcuccugacaucuuacccaagcacugcuauuccgc

SEQ ID NO: 54616 - RNA, 24 nt, Mus musculus
ggagaacugguuauggugcugaua

SEQ ID NO: 54617 - RNA, 46 nt, Mus musculus
aaaaggaagguggagcuaagaguuucagagauagagacagggacag

SEQ ID NO: 54618 - RNA, 46 nt, Mus musculus
agcuuuucuaucuguacaccagcagcaaacauacuaagaaggagau

SEQ ID NO: 54619 - RNA, 42 nt, Mus musculus
aguagaauucuaccagacuuucaaauauuguuacagccaaua

SEQ ID NO: 54620 - RNA, 46 nt, Mus musculus
aaaguuggaaaaaaaacaagaacaaauggaauuaacagaguuagaa

SEQ ID NO: 54621 - RNA, 45 nt, Mus musculus
auuuaguuccagaaagugaacugcuguuucagcaagaugccugcc

SEQ ID NO: 54622 - RNA, 46 nt, Mus musculus
cauuagauuaucaguauacagcaacaaauguugacugaaaggaaca

SEQ ID NO: 54623 - RNA, 42 nt, Mus musculus
caagaagagagugaguugcacauucaugccaccagaggaagc

SEQ ID NO: 54624 - RNA, 46 nt, Mus musculus
gaggaucauauaacaauuggacuuaauuucauuacugugcagagac

SEQ ID NO: 54625 - RNA, 46 nt, Mus musculus
agaaugccucauuagcaagauaaauaaacuugccagcaagacugag

SEQ ID NO: 54626 - RNA, 46 nt, Mus musculus
caucccaguagauaaagaaagggcuuugacaaaauccaacaugccu

SEQ ID NO: 54627 - RNA, 42 nt, Mus musculus
guguaauuuuuggcucuuaaguaugguguaucaucugcagau

SEQ ID NO: 54628 - RNA, 45 nt, Mus musculus
ccccugcuucagcucccuugacugaaaaacuaccaugcccagaau

SEQ ID NO: 54629 - RNA, 50 nt, Mus musculus
accucccgagugcagggauuaaaggcgugugccacuacaccuggcgagaa

SEQ ID NO: 54630 - RNA, 46 nt, Mus musculus
gagaauuguuuuguuuuguuuuuguuuuuguuuuuuuuuggggggg

SEQ ID NO: 54631 - RNA, 40 nt, Mus musculus
ucaacacagugggugcggacaucauccagcugccucagau

SEQ ID NO: 54632 - RNA, 42 nt, Mus musculus
cuacgacgaucugaggcagcuggaugauguccgcacccacug

SEQ ID NO: 54633 - RNA, 45 nt, Mus musculus
ccuccaugacccccgaaacacuggacccccaacccagcaggccac

SEQ ID NO: 54634 - RNA, 51 nt, Mus musculus
uuccucuucuccuccgcccuuuccucgggagcccgcacccauugggccggg

SEQ ID NO: 54635 - RNA, 42 nt, Mus musculus
cccggcccaaugggugcgggcucccgaggaaagggcggagga

SEQ ID NO: 54636 - RNA, 46 nt, Mus musculus
ugguguacuccugaauucccagcacucaggaguugaagauaggaag

SEQ ID NO: 54637 - RNA, 46 nt, Mus musculus
aaaauguuuuaaacagcuuauugcuauguaacugaguauagccuaa

SEQ ID NO: 54638 - RNA, 41 nt, Mus musculus
gacaggccugcggugccaagugugguucucagggggaguua

SEQ ID NO: 54639 - RNA, 26 nt, Mus musculus
uccccuuaggagucagcauuggcagu

SEQ ID NO: 54640 - RNA, 41 nt, Mus musculus
uacagcacuacccaggguccaguuagacccuguucccaaca

SEQ ID NO: 54641 - RNA, 45 nt, Mus musculus
gguacuagaaacaauaacaguugauaaggucacugcuuucccaua

SEQ ID NO: 54642 - RNA, 56 nt, Mus musculus
auaucuggaagggagugcaacaagcaagguacccagguugcaagggauuucugggg

SEQ ID NO: 54643 - RNA, 41 nt, Mus musculus
caugggcagguacuguggguauguagaccuugauaagcagg

SEQ ID NO: 54644 - RNA, 55 nt, Mus musculus
gacugggagauugcacagauguuuuuaaacaugacaaaguuagaaaaagaagcuu

SEQ ID NO: 54645 - RNA, 46 nt, Mus musculus
uucagucacaucuauuugcaguuuucaaaccuugcuuuggugccau

SEQ ID NO: 54646 - RNA, 80 nt, Mus musculus
cagcacgccaugcaaauagcugagagauuauacacacagggcuauaucagcuacccacggacagaaaccacccacuaucc

SEQ ID NO: 54647 - RNA, 45 nt, Mus musculus
cugaagggcucuuugcgacagcaggccaaucacccauacugggca

SEQ ID NO: 54648 - RNA, 42 nt, Mus musculus
gccucuaagacagaagugaagugguugcagcuaguuggggaa

SEQ ID NO: 54649 - RNA, 42 nt, Mus musculus
ggacagugaacagaguuugugugugaccucugaacaggagag

SEQ ID NO: 54650 - RNA, 45 nt, Mus musculus
caaugccaguaucuuccccuguaaacccugcccagguacccacag

SEQ ID NO: 54651 - RNA, 45 nt, Mus musculus
aucccuggagugagaagcaugccuuggguauuguaaggggccuua

SEQ ID NO: 54652 - RNA, 45 nt, Mus musculus
agagcugaugagcagggcugcagcucuguacucuaucacugacag

SEQ ID NO: 54653 - RNA, 46 nt, Mus musculus
gagacaugacccugugcugugcuuacucucaggcauggacgaguug

SEQ ID NO: 54654 - RNA, 46 nt, Mus musculus
aggagccggcuccuuuguuaccugaggcauuaauuaggaauccuca

SEQ ID NO: 54655 - RNA, 42 nt, Mus musculus
uccucaaagcuagacuaugugcucuugucugugugccuguuc

SEQ ID NO: 54656 - RNA, 46 nt, Mus musculus
uuggucucuugucccguuuuucagugcuaccugcccaaggccccag

SEQ ID NO: 54657 - RNA, 42 nt, Mus musculus
gagaaagagccacagauggagugaaggcugggaggcccagcu

SEQ ID NO: 54658 - RNA, 45 nt, Mus musculus
cugaacuguaucccccauuuuauaugcugagguuacugucucaga

SEQ ID NO: 54659 - RNA, 42 nt, Mus musculus
gaccuuucugaauuuaagagguugccugaacaagaggaggag

SEQ ID NO: 54660 - RNA, 46 nt, Mus musculus
cuagugggcugaugccuacccuguccccagcacucccugcccccag

SEQ ID NO: 54661 - RNA, 47 nt, Mus musculus
ucucugugaguucaggccagccucagcuacacagcaaguuccaggcc

SEQ ID NO: 54662 - RNA, 46 nt, Mus musculus
uccacgcagaccuggaggcucuuggauggcgacuuggagaguggag

SEQ ID NO: 54663 - RNA, 42 nt, Mus musculus
ggcaucggauccccuagagccgaaguuauggauccuccacaa

SEQ ID NO: 54664 - RNA, 41 nt, Mus musculus
acuaaaaauacauacauacauacagacagacagacagacag

SEQ ID NO: 54665 - RNA, 42 nt, Mus musculus
agcauacaggggaagccacuauguuguggaacccggaaugag

SEQ ID NO: 54666 - RNA, 45 nt, Mus musculus
guuuuaggccacauaagaaagaccccuaaaagcagcaaaacagag

SEQ ID NO: 54667 - RNA, 49 nt, Mus musculus
agcaaccacauggcagcucacagcugucuacugcaauuccagaggagca

SEQ ID NO: 54668 - RNA, 45 nt, Mus musculus
ggaugguugugagccaucaugugguugccggaaauugaacucagg

SEQ ID NO: 54669 - RNA, 82 nt, Mus musculus
augccgcagcugccuggaauccgaaucugggaagcaggcaggagaucccugaaucaagaugacuaacuuaaaacaagcagca

SEQ ID NO: 54670 - RNA, 46 nt, Mus musculus
acaaauucaaggaaagaagaggaugcuacccugaaccaugagaauc

SEQ ID NO: 54671 - RNA, 42 nt, Mus musculus
acaucuuaagcaaauagggagguuccugauguagaaggcgag

SEQ ID NO: 54672 - RNA, 51 nt, Mus musculus
ccaucuucacuccgccuguacugcucaaguuccaaccugugcccagaccca

SEQ ID NO: 54673 - RNA, 45 nt, Mus musculus
acaagccucuuugcuuugcacuguguuccucugucacucacaggc

SEQ ID NO: 54674 - RNA, 46 nt, Mus musculus
auccaggcaggcauggugcaggaggagcugagaguucuacuucuuu

SEQ ID NO: 54675 - RNA, 46 nt, Mus musculus
aagaaaaauacuauacagcauauggacuagguuaguucagagagau

SEQ ID NO: 54676 - RNA, 42 nt, Mus musculus
aggaggccaaaaccaaagaaaccagauccuaucuuucgagau

SEQ ID NO: 54677 - RNA, 42 nt, Mus musculus
cccagcacuggcggagagagucgugcggaagggcaagcagac

SEQ ID NO: 54678 - RNA, 47 nt, Mus musculus
gcggucugguagggcagaguauggagggaacugcaaacugggagagg

SEQ ID NO: 54679 - RNA, 42 nt, Mus musculus
cacaccuugaggcucagaagaaguguccugccugggccagau

SEQ ID NO: 54680 - RNA, 45 nt, Mus musculus
guauggaaaagguuuguauaccuugcuuagccuugacugccucgg

SEQ ID NO: 54681 - RNA, 46 nt, Mus musculus
ccagaucuagggcauccuggucuacauagugaguuuuaggacagcc

SEQ ID NO: 54682 - RNA, 41 nt, Mus musculus
aagcucuuagcccccuccccccagguuaagauaggggaguc

SEQ ID NO: 54683 - RNA, 41 nt, Mus musculus
ggccagaggcccugaggccauggaacgcugagaaccacaga

SEQ ID NO: 54684 - RNA, 46 nt, Mus musculus
aaccaaaacugggaucuuuggggacguggcaggguuggauguaguu

SEQ ID NO: 54685 - RNA, 46 nt, Mus musculus
cagaugaggacaacuuuuagaaguugauucuuaccuuccaccagaa

SEQ ID NO: 54686 - RNA, 46 nt, Mus musculus
acuccuuuuuccaucuguccccugaaauggcuuacauauaacagau

SEQ ID NO: 54687 - RNA, 46 nt, Mus musculus
cuaaaagagguguacaggugguucugucugccagguagaaguagau

SEQ ID NO: 54688 - RNA, 45 nt, Mus musculus
uuuagucuacuucaaaagaauggcauuucuuuucuugcccaaauu

SEQ ID NO: 54689 - RNA, 45 nt, Mus musculus
gccaugagugauuccagcaaguuugagcagagaccccgagcagug

SEQ ID NO: 54690 - RNA, 68 nt, Mus musculus
cccccagccugagcacccacuccgggcugaccuagcugaagaauacucuaaggaccguaaaaaauucu

SEQ ID NO: 54691 - RNA, 46 nt, Mus musculus
cuauggacccuugucucucucucucuuuuuuuuuuccgagacaggg

SEQ ID NO: 54692 - RNA, 27 nt, Mus musculus
gggggaugggggggggggggaugaagu

SEQ ID NO: 54693 - RNA, 46 nt, Mus musculus
uaugaccaaaagcagcacggggaggagaguuaauuucagcuuacau

SEQ ID NO: 54694 - RNA, 46 nt, Mus musculus
cccucgaaggcacaaaacgaugugauggugccugauagggagagug

SEQ ID NO: 54695 - RNA, 25 nt, Mus musculus
uuuucuggaaauacugcuuugagau

SEQ ID NO: 54696 - RNA, 46 nt, Mus musculus
uugaaaucaacuuuccagcagaguauccauucaaaccacccaagau

SEQ ID NO: 54697 - RNA, 46 nt, Mus musculus
uuucuauuccuacacagauaucaugaccaagaagcaaguuggggag

SEQ ID NO: 54698 - RNA, 44 nt, Mus musculus
agcucaggaaaaagaggaauauuacaaguucaaagcuagcuuca

SEQ ID NO: 54699 - RNA, 46 nt, Mus musculus
ugaaaccucuugaaccaggucuacacaguucaaaucacucucagca

SEQ ID NO: 54700 - RNA, 51 nt, Mus musculus
aucugcuagaauauaggauucaguuccauuuuacuuccuggugccccuuua

SEQ ID NO: 54701 - RNA, 59 nt, Mus musculus
ccauaccuggaacuaaauuuagcuggguaggaucuugcccccaaaucucuuaauguguu

SEQ ID NO: 54702 - RNA, 32 nt, Mus musculus
ugcuggggcugaaacuugcccccaaccccuua

SEQ ID NO: 54703 - RNA, 42 nt, Mus musculus
ggguuuuauugcugugaauacacaccaugagcaaggcaaguc

SEQ ID NO: 54704 - RNA, 46 nt, Mus musculus
agacgcacagaagaggguguuagaucucauuaccagugguugugag

SEQ ID NO: 54705 - RNA, 46 nt, Mus musculus
gccuuccaaaugcuaagauuucaggugugagcuaccccagucaguu

SEQ ID NO: 54706 - RNA, 45 nt, Mus musculus
auccagguugaugaagcuaauuuauugacuuggcaagggcuuauu

SEQ ID NO: 54707 - RNA, 109 nt, Mus musculus
agaagauguagcuugguaaauaggauaaggcuaauguuuauguuguagguuagaaggcaucuuggguguauaaggaggccaucaucugauugguggugaggccugauug

SEQ ID NO: 54708 - RNA, 44 nt, Mus musculus
uuuuuguuguuguugaugaugaugaugauggugauggugguggu

SEQ ID NO: 54709 - RNA, 46 nt, Mus musculus
gguugugagccgccaugugguugcugggauuugaacuccagaccuu

SEQ ID NO: 54710 - RNA, 46 nt, Mus musculus
uacuuauuuauuauuauacauaaguacacuguaguugucuucagac

SEQ ID NO: 54711 - RNA, 46 nt, Mus musculus
cugggacuaaagauguggccaccacuguccccuccugcccccuuuc

SEQ ID NO: 54712 - RNA, 42 nt, Mus musculus
ucccagcuaccacaugguggcucaaaccaucuguaacgagaa

SEQ ID NO: 54713 - RNA, 42 nt, Mus musculus
guggcucauaaccauccguaacaagaucugacgcccucuucu

SEQ ID NO: 54714 - RNA, 44 nt, Mus musculus
uuguuauugaaaucuuggaugaucuucugaacugaugccguuga

SEQ ID NO: 54715 - RNA, 46 nt, Mus musculus
gugugaggagugucgucaugacuggccaucucuacccugucugccu

SEQ ID NO: 54716 - RNA, 42 nt, Mus musculus
acuguggccaggcuggccuugaacuuauuccugccucuacuu

SEQ ID NO: 54717 - RNA, 46 nt, Mus musculus
gguggcuuauggccaaggccuuuaauaguugaauaaaauuucagua

SEQ ID NO: 54718 - RNA, 46 nt, Mus musculus
uguuaagccaucuuguguucuggaaaucaaauucugguccccugga

SEQ ID NO: 54719 - RNA, 45 nt, Mus musculus
gaauucugguuaggcuugagcagcaugcccuuuaucugcugaguc

SEQ ID NO: 54720 - RNA, 45 nt, Mus musculus
gucugguaauugucuuaagggguguggggagagcuaggugugaug

SEQ ID NO: 54721 - RNA, 46 nt, Mus musculus
ugcaaagcagcuaauucagcauugaaggcacaccuagauuguuacc

SEQ ID NO: 54722 - RNA, 45 nt, Mus musculus
cuaacugggcauggcaguacaccuguuaucccagcacuugagaga

SEQ ID NO: 54723 - RNA, 46 nt, Mus musculus
ucucacucgucauuccucaggguaucucucccccaacuccccagau

SEQ ID NO: 54724 - RNA, 45 nt, Mus musculus
agugcuugaggagcaggccauuaccauaucuauaccagcccagaa

SEQ ID NO: 54725 - RNA, 41 nt, Mus musculus
cuaagaucccacucagagaugguguaggaagauguggagau

SEQ ID NO: 54726 - RNA, 42 nt, Mus musculus
uguguggcuuucuuuaaaggggggucuuguagcucaguacgc

SEQ ID NO: 54727 - RNA, 45 nt, Mus musculus
cuuccuucccucccucucuccuuccuucccucccauacccccucu

SEQ ID NO: 54728 - RNA, 46 nt, Mus musculus
gcuccaucucuuugggcggacagcccacaacacagguauuuacaga

SEQ ID NO: 54729 - RNA, 46 nt, Mus musculus
gaaaacuaaccagggccuggagagacugcacuggcugccccaggaa

SEQ ID NO: 54730 - RNA, 46 nt, Mus musculus
uauagcuuacuuagaagugcucuuugaccagaccuugacccagagg

SEQ ID NO: 54731 - RNA, 53 nt, Mus musculus
uguucuaguaauauaaaacuaagcaauaacuugcagguaccaaagaauuauca

SEQ ID NO: 54732 - RNA, 42 nt, Mus musculus
accugggcuaaguguucuggaaaggucagccagccccaagau

SEQ ID NO: 54733 - RNA, 44 nt, Mus musculus
ugauaacugcagaaaauagagagauguaagagaaacacccagag

SEQ ID NO: 54734 - RNA, 46 nt, Mus musculus
ucaggguauuuguaucagugcuguacucugaggguuauccagccau

SEQ ID NO: 54735 - RNA, 45 nt, Mus musculus
gagucuuuauggguguagcuuuugauguuccuaggaggcacaauc

SEQ ID NO: 54736 - RNA, 46 nt, Mus musculus
guuucauaagcuuuucccugucuacuuuggcauguccauugguguc

SEQ ID NO: 54737 - RNA, 44 nt, Mus musculus
uggaggcuauuuucuuguugcuuuaugauccucccuccacugac

SEQ ID NO: 54738 - RNA, 48 nt, Mus musculus
accucaggcucagcagucccccauugcucaaaaccaaccaccacagau

SEQ ID NO: 54739 - RNA, 46 nt, Mus musculus
cagcagcagcagcaccugauuaaguugcaucaucaaagccagcaac

SEQ ID NO: 54740 - RNA, 46 nt, Mus musculus
ggcuggauacuuuuggucuauccaaaagacucacuuggcccuuuuc

SEQ ID NO: 54741 - RNA, 46 nt, Mus musculus
gaguucccaaaccuaccaacaguggcuaaaagaaauugugacagca

SEQ ID NO: 54742 - RNA, 23 nt, Mus musculus
ggccucagaucuguguuggagug

SEQ ID NO: 54743 - RNA, 42 nt, Mus musculus
guuuuucuguguagcccuggcuguccugacacucgcccugua

SEQ ID NO: 54744 - RNA, 45 nt, Mus musculus
ggcucacaaccauccuaacaagaucugacucccucuucuagagug

SEQ ID NO: 54745 - RNA, 46 nt, Mus musculus
ugaaacuuacagauaucaccugccucugucucccaugugcugggau

SEQ ID NO: 54746 - RNA, 46 nt, Mus musculus
guacugguuaguucauaauguuguuccaccuauaggguugucuacu

SEQ ID NO: 54747 - RNA, 46 nt, Mus musculus
aaaauaaacaaucuauuuuuuaaagaaaaagugacggccuagagag

SEQ ID NO: 54748 - RNA, 46 nt, Mus musculus
gaaagggucaguccauuauugucaggguggaaaccugguggcaguc

SEQ ID NO: 54749 - RNA, 45 nt, Mus musculus
aauuacagauuuucacgguguauccuguuguaagaggagcaacca

SEQ ID NO: 54750 - RNA, 32 nt, Mus musculus
uuuacuuuuuuuugaacugcuuuccacagaga

SEQ ID NO: 54751 - RNA, 46 nt, Mus musculus
uuuaucugucaaaacuauauacccacaugaacaaauaugugcaguu

SEQ ID NO: 54752 - RNA, 42 nt, Mus musculus
acucccacugcauguaucucuucaccagcagcucugccagac

SEQ ID NO: 54753 - RNA, 46 nt, Mus musculus
ccacauucaucuuucauuaauuaguguguucccccgacccccacac

SEQ ID NO: 54754 - RNA, 46 nt, Mus musculus
accuugcuaauuuauuauuauuaaugacaguaucucagucucuagu

SEQ ID NO: 54755 - RNA, 46 nt, Mus musculus
aaaccuggcuggcuggucucaaaguuacuugaucuucuugccuuag

SEQ ID NO: 54756 - RNA, 49 nt, Mus musculus
cacccucaaagugauacacuuccuccaacaaggccaaaccuacuccaag

SEQ ID NO: 54757 - RNA, 70 nt, Mus musculus
auggcaguguccaggcaggcaugguacaggagaagcugagaguucuacaucuucaucugaagacugcuag

SEQ ID NO: 54758 - RNA, 44 nt, Mus musculus
acuggguaacuuuagaauugugaaccaccaugugggugcuggaa

SEQ ID NO: 54759 - RNA, 45 nt, Mus musculus
caguacaaaguuuucaccucugugccauugcgccagccccaggag

SEQ ID NO: 54760 - RNA, 45 nt, Mus musculus
aauuucagcuuugugaccugaagaaugcaugguuuguugauagaa

SEQ ID NO: 54761 - RNA, 46 nt, Mus musculus
aagacauaaaaccuuuauacuuauaagaagccuuuaagcaccagau

SEQ ID NO: 54762 - RNA, 47 nt, Mus musculus
uuuggugacuguauaccugugcaucuguuagugugguugcauacaug

SEQ ID NO: 54763 - RNA, 46 nt, Mus musculus
cuauuucaagguggauguagugacuuuacuuucugggcuuuguaug

SEQ ID NO: 54764 - RNA, 46 nt, Mus musculus
uuuuuaaauuuuuuuaugauuuauuuuuauuuuuaaauugugugug

SEQ ID NO: 54765 - RNA, 29 nt, Mus musculus
uguggggagggggggaggaaagcugagaa

SEQ ID NO: 54766 - RNA, 46 nt, Mus musculus
ugagcuccagggcaaggauucuuugggaaagcccaguacaguggau

SEQ ID NO: 54767 - RNA, 45 nt, Mus musculus
ugcccggcccuuccuccaguguuuuacacguggucugccuugagg

SEQ ID NO: 54768 - RNA, 46 nt, Mus musculus
ggaagguaaauuggaagauugauguguuuggguuguaggcagugga

SEQ ID NO: 54769 - RNA, 45 nt, Mus musculus
agggaggaguuuguguuggcucacagauguuauaguuggccaugu

SEQ ID NO: 54770 - RNA, 46 nt, Mus musculus
augauucaauaguaacaauuaagcagcauauuuaacugaggcagga

SEQ ID NO: 54771 - RNA, 50 nt, Mus musculus
caaacaggaauggaauccugcaaugaacaagaaccaguugcaaaaugggc

SEQ ID NO: 54772 - RNA, 32 nt, Mus musculus
uccugcuuccaacauaccugacugaaccacgc

SEQ ID NO: 54773 - RNA, 45 nt, Mus musculus
cauuucccaagugguagaccccaaacuaaaccacaucuacaggcc

SEQ ID NO: 54774 - RNA, 46 nt, Mus musculus
aguagccaucuguuuuacuguacuuguuuuugugguggccguuuag

SEQ ID NO: 54775 - RNA, 45 nt, Mus musculus
cuucaggugucccuaugggucuaagaacuggcaguggggcaggca

SEQ ID NO: 54776 - RNA, 92 nt, Mus musculus
gagauagcacuugguaaguaacuauaguaugaucacaggaguauuuuugguccccuguucagaggaaacuggggauguugauguugaagcaa

SEQ ID NO: 54777 - RNA, 68 nt, Mus musculus
ccacuggaaaaaauaaggggaugacugcaagauauaggaggagaaucaagaacaaaggaucuuauaaa

SEQ ID NO: 54778 - RNA, 84 nt, Mus musculus
aacugacacaaacagacuaguuagaagggauucuggcuggagacgccauugagaauacgugccccggggacagggugcacugaa

SEQ ID NO: 54779 - RNA, 49 nt, Mus musculus
auaaccaucuccagggccuugugagaaggcaucugguucagguagaagg

SEQ ID NO: 54780 - RNA, 45 nt, Mus musculus
cuuuccuuccaucuguguggguuucaggcauuggauucagguugc

SEQ ID NO: 54781 - RNA, 46 nt, Mus musculus
ucacuuuagccgcccaucuccaccuccuacacacacacacacacac

SEQ ID NO: 54782 - RNA, 41 nt, Mus musculus
gagggcaggaacgccaaguaaugaggaacauuauggagcag

SEQ ID NO: 54783 - RNA, 46 nt, Mus musculus
ccgguuccuucuagucuguggcaucuccugcuuccuuugcacucag

SEQ ID NO: 54784 - RNA, 45 nt, Mus musculus
agguuuuaaacuaagccuacagaaaguuucaguuuucugucagaa

SEQ ID NO: 54785 - RNA, 45 nt, Mus musculus
accaagaagaaaacaggcauuucuuagucauuauuauucccuggc

SEQ ID NO: 54786 - RNA, 46 nt, Mus musculus
ugugugguuuguuuuguuuuuggucaaacuugcacuagcugaguag

SEQ ID NO: 54787 - RNA, 45 nt, Mus musculus
guuuaaggccagcuuuaguuauguaguaagaccuugugagggccg

SEQ ID NO: 54788 - RNA, 45 nt, Mus musculus
aggaaauagaugcgaagcaccugagccauaguauugaaggaggca

SEQ ID NO: 54789 - RNA, 46 nt, Mus musculus
accuuugaagcuacuguauagagagagugagggaggugggguggaa

SEQ ID NO: 54790 - RNA, 46 nt, Mus musculus
cuccacacacuccucaugaguaugaguaagggugcuugcugugaag

SEQ ID NO: 54791 - RNA, 45 nt, Mus musculus
aaccgaggcagccguacaggcuacgugcacaucuacgacauggag

SEQ ID NO: 54792 - RNA, 45 nt, Mus musculus
aguuugacaacucuagcgaggacuagggcucuccccaguguuugg

SEQ ID NO: 54793 - RNA, 45 nt, Mus musculus
cuagucuggucccugauggguuaaguaagguccuucuuucaagag

SEQ ID NO: 54794 - RNA, 41 nt, Mus musculus
aacuugaauggcauugaccccacaggacuaacaggagacug

SEQ ID NO: 54795 - RNA, 28 nt, Mus musculus
uugacacuuggacaacaaaguauacagu

SEQ ID NO: 54796 - RNA, 46 nt, Mus musculus
cugaguccugagcagcugguacuaagguauccugacugagucccag

SEQ ID NO: 54797 - RNA, 47 nt, Mus musculus
ccucacuuguguacuggcucaagaagacauccaggcugggcaguggc

SEQ ID NO: 54798 - RNA, 48 nt, Mus musculus
cuacggaggcuggccacgugccagguccucuccaucaagucaccagcu

SEQ ID NO: 54799 - RNA, 46 nt, Mus musculus
acccuuugguccucagccuaacugaaauaccuaccucacuagccug

SEQ ID NO: 54800 - RNA, 46 nt, Mus musculus
cucaguggaaugucagucaccuauccuccaugucaccggccuaagu

SEQ ID NO: 54801 - RNA, 60 nt, Mus musculus
auucucccuucugaucugguuguggcaagcccugagcccccagaguggccuuuaacaccg

SEQ ID NO: 54802 - RNA, 51 nt, Mus musculus
auaccggaacacccuggacugcggcuugaagauccuaaagaaugaggggcc

SEQ ID NO: 54803 - RNA, 46 nt, Mus musculus
gaaacacaccuuuggaugugaucaagaccaggaugcagguauggau

SEQ ID NO: 54804 - RNA, 46 nt, Mus musculus
gccuuacugcgacuguacugaagcagggcucaaaccaagccauccg

SEQ ID NO: 54805 - RNA, 46 nt, Mus musculus
aguaccgaggauuuuuccacgggguuagagagauuauucgggaaca

SEQ ID NO: 54806 - RNA, 45 nt, Mus musculus
aggcaucgaaaucugcaucaccuucccgaccgaauacgugaagac

SEQ ID NO: 54807 - RNA, 42 nt, Mus musculus
uggcugcgccucgcgggccccgcgcucugucggccgccgcgc

SEQ ID NO: 54808 - RNA, 42 nt, Mus musculus
accccagaagagggcacgaagagggcacgaggagccauagau

SEQ ID NO: 54809 - RNA, 45 nt, Mus musculus
ggcaaacaauguucuucuuucccucuuucuuauuuacgugugugu

SEQ ID NO: 54810 - RNA, 26 nt, Mus musculus
uuuaagaggccauaaauuugaaagag

SEQ ID NO: 54811 - RNA, 46 nt, Mus musculus
ugcugagcacuacauuuucaucuguaaggagagaaggggggaggga

SEQ ID NO: 54812 - RNA, 45 nt, Mus musculus
caguugguggaauuacuaaggaaggauuaggagguguggcuuuau

SEQ ID NO: 54813 - RNA, 46 nt, Mus musculus
acgauuucaaacaccguuccgucgagcagcgccagggccaagucgc

SEQ ID NO: 54814 - RNA, 42 nt, Mus musculus
ggagcacuggcaaguuguggggccggcaggacugcugggcuu

SEQ ID NO: 54815 - RNA, 44 nt, Mus musculus
uagccugcugcuccucccggauccgauguuccauggccugccau

SEQ ID NO: 54816 - RNA, 41 nt, Mus musculus
guggcacccgccagccauccuaggcaacggaggacagcaag

SEQ ID NO: 54817 - RNA, 83 nt, Mus musculus
caguggauggcagcaggcauagccaggaucuaaucagccccucagagagaucagaccuguuggcagcuggacaguagccccca

SEQ ID NO: 54818 - RNA, 42 nt, Mus musculus
gucaagggaggggcuacacaggaauaaggcaacacccaagcc

SEQ ID NO: 54819 - RNA, 45 nt, Mus musculus
cgcgugugugugugugugugugcgcgugugugugugugugugugu

SEQ ID NO: 54820 - RNA, 45 nt, Mus musculus
ugcucugcuuuuucucuuaggcuccagcagaaaaaaaccucagau

SEQ ID NO: 54821 - RNA, 46 nt, Mus musculus
ugagccucugaaggaguaaagaggaggacacaggcagugcaguagg

SEQ ID NO: 54822 - RNA, 45 nt, Mus musculus
augaaguuauuggacucugccuuuuauuucaugcacucagcgugu

SEQ ID NO: 54823 - RNA, 24 nt, Mus musculus
ccagacaagaaggggaggcugagg

SEQ ID NO: 54824 - RNA, 45 nt, Mus musculus
ccuccccaccuagagugagcugcaacagauccgauuguccuuuga

SEQ ID NO: 54825 - RNA, 45 nt, Mus musculus
cgggguccuggggcauuguuguuggccuggucagccugcagggag

SEQ ID NO: 54826 - RNA, 41 nt, Mus musculus
cugcagggcaggauugcgggcaccaccaaagccaggcccgg

SEQ ID NO: 54827 - RNA, 26 nt, Mus musculus
guugucauagcgcacaggagaggguu

SEQ ID NO: 54828 - RNA, 45 nt, Mus musculus
gguggaucugauggcccagggugcagguagggugaaugguagcug

SEQ ID NO: 54829 - RNA, 46 nt, Mus musculus
ggcugucauaugacaggcugccauuucgauugggcagugcaugagg

SEQ ID NO: 54830 - RNA, 45 nt, Mus musculus
cuucagagcgcaguggcuguaaggucaugugguccccaccccucc

SEQ ID NO: 54831 - RNA, 46 nt, Mus musculus
ucaugcuacaaagucaaaagcauaaugucaaagcuagugccaccug

SEQ ID NO: 54832 - RNA, 41 nt, Mus musculus
caggggugcuguaaagaggagagacaggugugaaggaagca

SEQ ID NO: 54833 - RNA, 46 nt, Mus musculus
guuauggucggggaucacaacaugauuacaggaucacaggcaccau

SEQ ID NO: 54834 - RNA, 46 nt, Mus musculus
aacaggaucaaucacuuucacuguugaaaaaacccuauggagauag

SEQ ID NO: 54835 - RNA, 42 nt, Mus musculus
aagcaaccagaguaauggggcuuaucuaucuuuccauuucag

SEQ ID NO: 54836 - RNA, 42 nt, Mus musculus
accugcucugacuugcuagauucuaaggugauucuggccauc

SEQ ID NO: 54837 - RNA, 46 nt, Mus musculus
acuaaggcacuuaaaaacacaauugacuauagacaaccuuggccag

SEQ ID NO: 54838 - RNA, 50 nt, Mus musculus
gcacgcaaaaccccucacggugaauccucugcacccaagaacaaaaaggg

SEQ ID NO: 54839 - RNA, 42 nt, Mus musculus
gguagugagcucaccaugcaaaccacuacaauaccccuggaa

SEQ ID NO: 54840 - RNA, 33 nt, Mus musculus
gcacgaugacacacacucacucugacccccucu

SEQ ID NO: 54841 - RNA, 42 nt, Mus musculus
cccugugugugaaaguccagugaacucuccaaggguguaugc

SEQ ID NO: 54842 - RNA, 46 nt, Mus musculus
cucaugaggauuaaaggauuaaagguguguaacaccacugccaggu

SEQ ID NO: 54843 - RNA, 42 nt, Mus musculus
ggccagcuaucuacaagcuccagacccugcuuaagggggggg

SEQ ID NO: 54844 - RNA, 46 nt, Mus musculus
cagcuuaucuugccuggcagacaguuguggauuuggacccagcaga

SEQ ID NO: 54845 - RNA, 49 nt, Mus musculus
uaccaugaaaggaaguacuugggaaguuuguuauugggaggcaucagac

SEQ ID NO: 54846 - RNA, 54 nt, Mus musculus
caaaacaaaacaaaacaaaacaaaaaaaacaaaaggaaagaaaggaagaaagaa

SEQ ID NO: 54847 - RNA, 45 nt, Mus musculus
cccugggguauacuaaccucugagcuccugagcacagcccaagau

SEQ ID NO: 54848 - RNA, 56 nt, Mus musculus
aagucuaagcccagccagggauacaugagacccugucuuaauagaagaggaaggag

SEQ ID NO: 54849 - RNA, 42 nt, Mus musculus
ugucuucuggggaacaaaggagcacagaauccaugaagggaa

SEQ ID NO: 54850 - RNA, 44 nt, Mus musculus
caaaccuuagggucaaaguuacagggcucagggauggucaguag

SEQ ID NO: 54851 - RNA, 47 nt, Mus musculus
ugaagggaggcaggugaccgaacuugaguaucagugcugugguggaa

SEQ ID NO: 54852 - RNA, 62 nt, Mus musculus
gaccuaggagagcgcaagccggcgcuggggaauggggacacaugugaagggggucugaucuu

SEQ ID NO: 54853 - RNA, 45 nt, Mus musculus
ucucugucuugucaccuuugucaaaagucauuggugggcuuagag

SEQ ID NO: 54854 - RNA, 51 nt, Mus musculus
auucuauacuagaccugucuaguauaugacugguaccucgaggaaggaagg

SEQ ID NO: 54855 - RNA, 45 nt, Mus musculus
ccuuuuccuuauuuauauuuccuggccacuauucaguuguaagau

SEQ ID NO: 54856 - RNA, 45 nt, Mus musculus
cuuguaucucucaacagaggcguuuacuuguguuucccaucagaa

SEQ ID NO: 54857 - RNA, 43 nt, Mus musculus
gguguaggcuagaagcucccuggauuccucugaggguugagaa

SEQ ID NO: 54858 - RNA, 46 nt, Mus musculus
uaccaaacuggucugucuuuuuuuguugguuuacuuggcuggcuuu

SEQ ID NO: 54859 - RNA, 45 nt, Mus musculus
acauuaccuauccuaugcuguuuaaauugaccaauaagaauucag

SEQ ID NO: 54860 - RNA, 46 nt, Mus musculus
aagugucaaccuccaaguggcgaccuacucuaaguuccagccucag

SEQ ID NO: 54861 - RNA, 46 nt, Mus musculus
uuucauggcuaccuagcacaaagacugaaauacgcagucuauccag

SEQ ID NO: 54862 - RNA, 46 nt, Mus musculus
cagcaacauggacaaguagaacauuugaaagcaaacauacugacag

SEQ ID NO: 54863 - RNA, 45 nt, Mus musculus
uauaacugauaagguaaaggcagucucaguguacauaaugguuag

SEQ ID NO: 54864 - RNA, 50 nt, Mus musculus
uguggggagccccaucaugugaucugggucccaggcugacuaaagggaga

SEQ ID NO: 54865 - RNA, 45 nt, Mus musculus
ccuuccuaauguugcuuuugguugaauauuuuguuucagggauga

SEQ ID NO: 54866 - RNA, 46 nt, Mus musculus
cuucccucccaucuccuacccucccucucaaauuuaagcaguacaa

SEQ ID NO: 54867 - RNA, 46 nt, Mus musculus
uuccuuuccuaggccuucucugguucugggaauagacuggauggga

SEQ ID NO: 54868 - RNA, 49 nt, Mus musculus
gucaggcuuugcuaaaugagaacuaucuuaaaagaagacaagaaaggaa

SEQ ID NO: 54869 - RNA, 24 nt, Mus musculus
agccaagaggcaguuugguguaga

SEQ ID NO: 54870 - RNA, 46 nt, Mus musculus
uagaguacuuggucagcauggccugauguccauuccuaacacuaag

SEQ ID NO: 54871 - RNA, 46 nt, Mus musculus
caaaaacaaaugaaugaaugagugaaugaaugaaugaaugaaugaa

SEQ ID NO: 54872 - RNA, 45 nt, Mus musculus
guucgaacaauggauaaaaauaggucuagguugaagcaggaaaaa

SEQ ID NO: 54873 - RNA, 55 nt, Mus musculus
aguacaaucuggcuaggcuauuaauaaccagauaaaugcccuauuauuugccagc

SEQ ID NO: 54874 - RNA, 46 nt, Mus musculus
uacagcacauuggucaauacaacguccauguccagacuacaaccug

SEQ ID NO: 54875 - RNA, 46 nt, Mus musculus
cagacacauacucaguacauauacauaggcaaaauauacaaaugag

SEQ ID NO: 54876 - RNA, 45 nt, Mus musculus
cugguuaaauccagucagucuccaaauagaacagacagaaauagg

SEQ ID NO: 54877 - RNA, 46 nt, Mus musculus
ucaucuauccuaacuuaaaagacauucuacaguauaccucacugaa

SEQ ID NO: 54878 - RNA, 57 nt, Mus musculus
uauacguucaaacagacgaaauuggucaagucuugugcucagauggauggaagagag

SEQ ID NO: 54879 - RNA, 45 nt, Mus musculus
acaaaucugcucaugaaagaauugauugugaguguuccuaacgcu

SEQ ID NO: 54880 - RNA, 45 nt, Mus musculus
ugcaggugcccuggcagccccgaagagggagucagaucccuugga

SEQ ID NO: 54881 - RNA, 45 nt, Mus musculus
aggcagauucauugcuuucucuggagaaggacagucacugcguaa

SEQ ID NO: 54882 - RNA, 73 nt, Mus musculus
cuccacucccuaacuccagcuucagggcccucacagccucagcagagcagcucccgauuccugacucacucuu

SEQ ID NO: 54883 - RNA, 47 nt, Mus musculus
gcuacucaggccagcacuugaguaccagacaaagauggccucuguuu

SEQ ID NO: 54884 - RNA, 81 nt, Mus musculus
uuuaaucugcucgcucucagugaauuccaugaugaagccagauaugaaaggcagaaugaauacaugcuugaguaacgugcc

SEQ ID NO: 54885 - RNA, 46 nt, Mus musculus
uucugcugaagaggugggcacuguuuaagcagcaggagcaugagau

SEQ ID NO: 54886 - RNA, 42 nt, Mus musculus
cucuccguucacucuccucaggugaaugcuccuccugagguc

SEQ ID NO: 54887 - RNA, 41 nt, Mus musculus
gugugucugacgugugccuggcagguuccagggauccugaa

SEQ ID NO: 54888 - RNA, 45 nt, Mus musculus
ggacagagaaggggagagagagagagacagaaagaaacagagaga

SEQ ID NO: 54889 - RNA, 45 nt, Mus musculus
cauauacuagacaggucuaguauagaauagaguuuauuugugggu

SEQ ID NO: 54890 - RNA, 51 nt, Mus musculus
cuauucuauacuagaccugucuaguauaugacugguaccucgaggaaggaa

SEQ ID NO: 54891 - RNA, 37 nt, Mus musculus
ccaccuccauagugcugggguugcaggaguaggccac

SEQ ID NO: 54892 - RNA, 24 nt, Mus musculus
uuccucauaauuuucgcuuguugg

SEQ ID NO: 54893 - RNA, 46 nt, Mus musculus
ggcagggacuucgcagaaaaagugaucaauggcucuugaguggcag

SEQ ID NO: 54894 - RNA, 45 nt, Mus musculus
auaucuggaaggcacagccugcaaaggaaauaguucugcugccug

SEQ ID NO: 54895 - RNA, 46 nt, Mus musculus
cacgaaauugugugccccaaaaagggaaaacuaagaaagcucauuc

SEQ ID NO: 54896 - RNA, 47 nt, Mus musculus
cucaguggcuagcaugugugagaaggcccuugguucaguccucagua

SEQ ID NO: 54897 - RNA, 45 nt, Mus musculus
agaugauccaaaacauucuaaaccaaauggaaaauaaggagaaug

SEQ ID NO: 54898 - RNA, 46 nt, Mus musculus
cucacaaccauccauaacgagaucugacucccucuucugagugucu

SEQ ID NO: 54899 - RNA, 45 nt, Mus musculus
guauuggggguggggggagcuacaaaaugacauuguuuccauguc

SEQ ID NO: 54900 - RNA, 46 nt, Mus musculus
uaggugucaaggaaaugcaaauaugugcaaagccaaggucuaguag

SEQ ID NO: 54901 - RNA, 46 nt, Mus musculus
ucuuaaggugguaauuuuguugucuuuguuggcuaguugguugguu

SEQ ID NO: 54902 - RNA, 46 nt, Mus musculus
guccuuggcaggcaggaacaucacauguucaaggucauccucaguu

SEQ ID NO: 54903 - RNA, 46 nt, Mus musculus
ucuguguucuacuugaacuggugacagcucaccucuugcauaccaa

SEQ ID NO: 54904 - RNA, 41 nt, Mus musculus
uuuguuguuguuuguuuuucaacuugauacaagcgagaguu

SEQ ID NO: 54905 - RNA, 45 nt, Mus musculus
gcaacuaagcguaaaguuuuugaaauggaccccaaaucucugaca

SEQ ID NO: 54906 - RNA, 46 nt, Mus musculus
agcuauggaaugcuuucugcaguauguguauacugggaaggugaag

SEQ ID NO: 54907 - RNA, 42 nt, Mus musculus
aguaugcagucugugcacugaggaaugauauucuuguuucag

SEQ ID NO: 54908 - RNA, 45 nt, Mus musculus
acaguuaaauaucuggaucagaguugcuucucuaaauaaaggcag

SEQ ID NO: 54909 - RNA, 46 nt, Mus musculus
guguauuccugugucugugcccuugaaggccagaaaauggugucag

SEQ ID NO: 54910 - RNA, 41 nt, Mus musculus
uugaugcucuguuaaaggauugauuggugauguuugcagaa

SEQ ID NO: 54911 - RNA, 41 nt, Mus musculus
ccagcaaccacaugguggcucccaaccaucugugaugggca

SEQ ID NO: 54912 - RNA, 41 nt, Mus musculus
guugggagccaccaugugguugcugggaauugaacucgaga

SEQ ID NO: 54913 - RNA, 46 nt, Mus musculus
agacuuauucauccaaggguguggaaagcacacauacaagacauag

SEQ ID NO: 54914 - RNA, 41 nt, Mus musculus
uagguguauguuguuggcggcuaugaugggcaaaacaggcu

SEQ ID NO: 54915 - RNA, 46 nt, Mus musculus
acgagguaguccaugguuuuaagguguuuauuguagaaagccagag

SEQ ID NO: 54916 - RNA, 47 nt, Mus musculus
guugaagacuacuggaugcauguacaaaacacauucagccggcaggu

SEQ ID NO: 54917 - RNA, 45 nt, Mus musculus
uccacaugugcugugacacacacacauacacacacacacacacac

SEQ ID NO: 54918 - RNA, 45 nt, Mus musculus
uuuggccuaugaauauacuuuggcauuuuugaaauacuauguggg

SEQ ID NO: 54919 - RNA, 69 nt, Mus musculus
caguggggccucucacuuguaacucugaccagcagcaguuccggucuccagagagaaaucucuuauuug

SEQ ID NO: 54920 - RNA, 46 nt, Mus musculus
augacaaacggcuguggagaacccaauuccugucagucagucagug

SEQ ID NO: 54921 - RNA, 35 nt, Mus musculus
uuuuuaaaaaucacucugagagcccaugcacauac

SEQ ID NO: 54922 - RNA, 45 nt, Mus musculus
uugggagaugugacaagaagaucaggaaaguuccaggacagccau

SEQ ID NO: 54923 - RNA, 45 nt, Mus musculus
gugcuuuguaaaauacucagauaaauacccacugagcuauuugga

SEQ ID NO: 54924 - RNA, 46 nt, Mus musculus
agagguucagggaaccauuacuauaaauguuaucaguggccuauaa

SEQ ID NO: 54925 - RNA, 46 nt, Mus musculus
uugggccccucauccuguccugcugaaacuucgccuuucccaguuu

SEQ ID NO: 54926 - RNA, 51 nt, Mus musculus
uuuagaugaagcuacagccgcuauggacacagagacagacuuacugaucca

SEQ ID NO: 54927 - RNA, 46 nt, Mus musculus
auuuucaugggauggaaacuaacagaauuacauauugcaaacaggc

SEQ ID NO: 54928 - RNA, 67 nt, Mus musculus
ugcccagcuaccucugaaacuugagucugaaguaauggagaacggggacaacuucucuguuggggaa

SEQ ID NO: 54929 - RNA, 45 nt, Mus musculus
auuuucaugggauggaaacuaacagaauuacauauugcaaauaug

SEQ ID NO: 54930 - RNA, 42 nt, Mus musculus
ugcacaaacaucaugaagaagcaaguugaagccgggcguggu

SEQ ID NO: 54931 - RNA, 76 nt, Mus musculus
ccuagaucaaaccuggacccuuucaaccaguacacggaagaccagaucugggaugcucuagagagaacgcacauga

SEQ ID NO: 54932 - RNA, 83 nt, Mus musculus
caagugaggaaaagaaagaaggcauuuucuacauucguacauagagagggauauagcugaaggaaaccacauuugcagguguc

SEQ ID NO: 54933 - RNA, 45 nt, Mus musculus
augggcgacacaauaguacuugaugcuuuuuuuaaguauauaguu

SEQ ID NO: 54934 - RNA, 83 nt, Mus musculus
cagccacagagaucaggagcuucagugggcguguagagggaggggagaagaagugagugcaguaggguagcaagugacagggg

SEQ ID NO: 54935 - RNA, 45 nt, Mus musculus
cuuaaaaaaauuuauauaguggguaugggggacuuuugggauagc

SEQ ID NO: 54936 - RNA, 42 nt, Mus musculus
aggccugucucaaaacaaaacauaauaaaaauggggcaagga

SEQ ID NO: 54937 - RNA, 45 nt, Mus musculus
uuaaccaaguaucucagcaaggcucugccacagcaguccagagau

SEQ ID NO: 54938 - RNA, 46 nt, Mus musculus
gccaucauuccucaggagccagugcuguucaguggcacugucaggu

SEQ ID NO: 54939 - RNA, 45 nt, Mus musculus
acccaggcuagauuggcugggcuacagaaaagauguggcugaggu

SEQ ID NO: 54940 - RNA, 45 nt, Mus musculus
uucugaguuuguuacagauggacagggucagggagaagaggagau

SEQ ID NO: 54941 - RNA, 41 nt, Mus musculus
acucgaucgcuccuguuguugguauucauauagugaugaga

SEQ ID NO: 54942 - RNA, 46 nt, Mus musculus
ucuggcuuuacuggggcguuuguucuccuugauuucauucuuugac

SEQ ID NO: 54943 - RNA, 45 nt, Mus musculus
gugaacagaaagugcaaaauucaguaguuguucuguccgugaggu

SEQ ID NO: 54944 - RNA, 46 nt, Mus musculus
guuagagugauugauugauugauugauugauugaggagaccaggaa

SEQ ID NO: 54945 - RNA, 42 nt, Mus musculus
gaguagaguuuauucagagcauggggaagggaguuaagagag

SEQ ID NO: 54946 - RNA, 47 nt, Mus musculus
uuuguauaugugugugugugguacauauguccacauguagaggucag

SEQ ID NO: 54947 - RNA, 92 nt, Mus musculus
ggauuugcagaacucuucccauugagaacuguacguucuagcagauguagcuucacuaaugugagaacgaacaucauugauuaucagaagac

SEQ ID NO: 54948 - RNA, 46 nt, Mus musculus
gaaagaaguauugcagggcuaguggagacugcauguuucucaagau

SEQ ID NO: 54949 - RNA, 47 nt, Mus musculus
uaggcuuggcuguuacugagacuauugguucuucccacccucccccu

SEQ ID NO: 54950 - RNA, 45 nt, Mus musculus
agagauaauuagggaguguucuuuaauccuacaacgaacaggaga

SEQ ID NO: 54951 - RNA, 44 nt, Mus musculus
cugcucaagguucaaauuuuuaauggcggacaugcuuuauaaaa

SEQ ID NO: 54952 - RNA, 46 nt, Mus musculus
ugccaucuccuacgcugugcaggucaguugugggcacuugacgagg

SEQ ID NO: 54953 - RNA, 42 nt, Mus musculus
ccugauucgugagcuaaagcgguuggacaauaucacgcaguc

SEQ ID NO: 54954 - RNA, 46 nt, Mus musculus
uaggcagcccucauggccaugacguuaagacuuuuaccccauggug

SEQ ID NO: 54955 - RNA, 46 nt, Mus musculus
ccccaugaaguuuuuugauacuaccccaacaggaaggauucucaac

SEQ ID NO: 54956 - RNA, 45 nt, Mus musculus
acugccuucagcaccugguggcuuagcuacuggaucaagcaagga

SEQ ID NO: 54957 - RNA, 42 nt, Mus musculus
ucccuuuggcccaguguagcuuuuagguuagagcugagugau

SEQ ID NO: 54958 - RNA, 46 nt, Mus musculus
aauuccccgcaaccacaugguggcucacaaccauuuguaaugggac

SEQ ID NO: 54959 - RNA, 49 nt, Mus musculus
aagacaagggcccuaagccagggucagugaagaaggagaaggcggugaa

SEQ ID NO: 54960 - RNA, 45 nt, Mus musculus
uacacaaacugaacacauccggguagggacagcuuugacuaagau

SEQ ID NO: 54961 - RNA, 42 nt, Mus musculus
acgauuuuuaauaaccuguugcugggagagacacccccaguu

SEQ ID NO: 54962 - RNA, 45 nt, Mus musculus
cucuucuagauuuaagauagaggcuuuccuuuuggguucauagau

SEQ ID NO: 54963 - RNA, 46 nt, Mus musculus
agauaaauuggcacagaauaagaagggcccucauuuguggguagaa

SEQ ID NO: 54964 - RNA, 41 nt, Mus musculus
ccugcggccugacuuggccauucuccccaacagcgaccuga

SEQ ID NO: 54965 - RNA, 46 nt, Mus musculus
aaagaacuuaacaaaauaugcaguuaauguuuaacugggcacgaga

SEQ ID NO: 54966 - RNA, 45 nt, Mus musculus
ccuguguauuguuugcuuuguaaaaagccauagaucuucugagga

SEQ ID NO: 54967 - RNA, 45 nt, Mus musculus
augggguucucagacucugggacauuuaggcaccacugggaguca

SEQ ID NO: 54968 - RNA, 62 nt, Mus musculus
ugccuguggauacauaauguccugcuaggcucagaaggguguguggagaaacaaggaaggaa

SEQ ID NO: 54969 - RNA, 46 nt, Mus musculus
agaggguaguguuugagcggagaacugagagagugagucgugagac

SEQ ID NO: 54970 - RNA, 45 nt, Mus musculus
ggacaccuccuccuggacagugacgagcggcccagcccggaagag

SEQ ID NO: 54971 - RNA, 42 nt, Mus musculus
caugggacuccucccacuccaguauacagaacucgcccaagc

SEQ ID NO: 54972 - RNA, 46 nt, Mus musculus
uuucuaauggaagagguucacaugauaaagaacaaaccggccaguc

SEQ ID NO: 54973 - RNA, 46 nt, Mus musculus
uaaauuaauuuuuaaaaagcauuuugaaaaucaccuugcaauagug

SEQ ID NO: 54974 - RNA, 45 nt, Mus musculus
ucagguguuguccgucaaagcgugucagggcugugggaagcagaa

SEQ ID NO: 54975 - RNA, 46 nt, Mus musculus
ugcggggggcuauccugacuauggcauucaagaagauccugaaguu

SEQ ID NO: 54976 - RNA, 46 nt, Mus musculus
uuuuuucuucuccuuaaucuucuuucuucagcagcaaggucuuuau

SEQ ID NO: 54977 - RNA, 49 nt, Mus musculus
augccagcauccuugcccagcaggccuagaaucucgcagucugucggga

SEQ ID NO: 54978 - RNA, 46 nt, Mus musculus
uaguaaacaauuugguauuaaguuacuuucauaaaaacugaaagag

SEQ ID NO: 54979 - RNA, 48 nt, Mus musculus
cccccauuugaucagguuauuuacuggggcuugacaugacccaagaga

SEQ ID NO: 54980 - RNA, 46 nt, Mus musculus
auacuggaaaagaaaccaaucuucuugcuaguuaaucuaugcagug

SEQ ID NO: 54981 - RNA, 57 nt, Mus musculus
ccaagggggcacccuaagguauaggaaaggaaggagcccaaacagcacccgcugccc

SEQ ID NO: 54982 - RNA, 45 nt, Mus musculus
uccaugcugucaggaucuggacuuggggggagugucucuguagug

SEQ ID NO: 54983 - RNA, 43 nt, Mus musculus
uuggaacccuaaucccaauaaauucuuuugacuggaaauugga

SEQ ID NO: 54984 - RNA, 49 nt, Mus musculus
cucccucugcugccguuuugggaagaacccuggggagucaauaggccua

SEQ ID NO: 54985 - RNA, 62 nt, Mus musculus
guuaaguuguuaaucuuucaauucugaugcagcaaccgggaugcuaacuucuagagacugcu

SEQ ID NO: 54986 - RNA, 64 nt, Mus musculus
ggauugcagggauaaaguuuuuacuccacaaaaaguaauugcaaaaugcaugcucacuuugaug

SEQ ID NO: 54987 - RNA, 45 nt, Mus musculus
aacacaggacaugugcccuuguuaagacuagagagacuguggcaa

SEQ ID NO: 54988 - RNA, 45 nt, Mus musculus
gcuuucccuggauaucucugugcauucucaucuccaaauucugga

SEQ ID NO: 54989 - RNA, 45 nt, Mus musculus
gcugugcaauuguuaggguuuucauucuuuagucuuguccuacug

SEQ ID NO: 54990 - RNA, 46 nt, Mus musculus
ccauugcagggcaagcacauugugcccugucagcagauuggcaguc

SEQ ID NO: 54991 - RNA, 46 nt, Mus musculus
gagugugaguccuagaacccacguaaaagcagguacagcagcagug

SEQ ID NO: 54992 - RNA, 46 nt, Mus musculus
aaaagauaacauuuagcuggagaacagagaaucagcauuuggagaa

SEQ ID NO: 54993 - RNA, 45 nt, Mus musculus
ugggcaaaucuggggucugcuuucagacacaggugaggaaggaga

SEQ ID NO: 54994 - RNA, 46 nt, Mus musculus
gugucagggaagugucugcacgccaugcuaagaacuuuugggagcg

SEQ ID NO: 54995 - RNA, 46 nt, Mus musculus
acagagguaaagaccuagauguauagaaaagaacguggcguguugg

SEQ ID NO: 54996 - RNA, 46 nt, Mus musculus
ggaaauugucugguaguuagaucugggaaaguuuuaaggguccacu

SEQ ID NO: 54997 - RNA, 46 nt, Mus musculus
ugacucuuauuuucuuaccugcugaaaaccccuugauuaaaaagac

SEQ ID NO: 54998 - RNA, 42 nt, Mus musculus
cgaagggauugagaaguugucuugugcugccugugugugugu

SEQ ID NO: 54999 - RNA, 46 nt, Mus musculus
gggcaacacagagaccccgaggaacccagguuccggagaacaagau

SEQ ID NO: 55000 - RNA, 48 nt, Mus musculus
guccucuguguggugaagaugaaagauauugacaugggaaaagaauau

SEQ ID NO: 55001 - RNA, 23 nt, Mus musculus
gggcuggagaggguccuggugua

SEQ ID NO: 55002 - RNA, 45 nt, Mus musculus
gcuuugugcaucgcgcuugcgcguugugggggacuaugccgcuau

SEQ ID NO: 55003 - RNA, 41 nt, Mus musculus
gcggcggcggcucgggcggcgggggaacccaaggugcggag

SEQ ID NO: 55004 - RNA, 42 nt, Mus musculus
aguggaggccccucuugugcuacuaaaucccccggggaagcc

SEQ ID NO: 55005 - RNA, 46 nt, Mus musculus
ggguguacaggaaacauuugucuuuugcugcuggaaagcugcucag

SEQ ID NO: 55006 - RNA, 45 nt, Mus musculus
gacaauuuugacuaccaaacucgagaugauuuuguacgaggcaua

SEQ ID NO: 55007 - RNA, 66 nt, Mus musculus
augaguguagcucuggguggugcugucagugaaguuuacuucuggagugagaggguagacccaucg

SEQ ID NO: 55008 - RNA, 45 nt, Mus musculus
uacccucucacuccagaaguaaacuucacugacagcaccacccag

SEQ ID NO: 55009 - RNA, 62 nt, Mus musculus
uccuccaggacgcugccauggcccaggcugacuucaggcccucgguagauguugugucggga

SEQ ID NO: 55010 - RNA, 97 nt, Mus musculus
ggcucggugaucucuuugcauccuccagaugcagaggaagaugaagaugauggccaguuuagugaugauucuggagcugaccaagaaaaggagaaag

SEQ ID NO: 55011 - RNA, 53 nt, Mus musculus
uuggccuugaaggccagggauaccucuggaaagcugagggugugaacucgaaa

SEQ ID NO: 55012 - RNA, 42 nt, Mus musculus
cucugcuuccuugcagcugcagagguucauccaguggcugag

SEQ ID NO: 55013 - RNA, 46 nt, Mus musculus
gguaauagagaaggcuucucugaauuaugaagcuaaauuggcuuaa

SEQ ID NO: 55014 - RNA, 45 nt, Mus musculus
ucauucccugucagcuucagagaaacucauccacagagcaauuaa

SEQ ID NO: 55015 - RNA, 46 nt, Mus musculus
caacccagaggaagugaacguaggauuaucacagagaggcgcacgg

SEQ ID NO: 55016 - RNA, 46 nt, Mus musculus
uucaaauuuaugaaggaaaauuauuuucaacucaauuguauuuuuu

SEQ ID NO: 55017 - RNA, 45 nt, Mus musculus
aagaaaaaagauccagcuuggaggagaagugccccuggggaugca

SEQ ID NO: 55018 - RNA, 42 nt, Mus musculus
ucuugggauccgagaguggccaggccggccuugugggggcug

SEQ ID NO: 55019 - RNA, 43 nt, Mus musculus
cuguucucagagcaaugggucacagagacugagcugccaccau

SEQ ID NO: 55020 - RNA, 78 nt, Mus musculus
cugucacaaacaucgcucgcaccagcuucuuccauguuaagcgguccaacaucuggcuggccgcagucaccaagcaga

SEQ ID NO: 55021 - RNA, 48 nt, Mus musculus
agaugugugauguaauggcugcuuacuuuggcaaaaucagcgaggaga

SEQ ID NO: 55022 - RNA, 72 nt, Mus musculus
uucuggacuuuggcuacccacagaacucagagacaggugcacugaaaaccuucaucacccagcaggguauca

SEQ ID NO: 55023 - RNA, 55 nt, Mus musculus
ggaagaacagucccagaucaccagccaggugaccgggcagauuggcuggcggcga

SEQ ID NO: 55024 - RNA, 64 nt, Mus musculus
caaguuuggaaugaaugacaagauugucauagaaaagcagggcaaaggcacagcugaugaaaca

SEQ ID NO: 55025 - RNA, 46 nt, Mus musculus
cugcaccuuccaccagugugugcgacucagcaaguuugacucugag

SEQ ID NO: 55026 - RNA, 45 nt, Mus musculus
aagguggucaucaaguccaacuucaagcccucacuucuggcccag

SEQ ID NO: 55027 - RNA, 79 nt, Mus musculus
aacacaagcgggguacaggugaucugcaugaaggggaaggccaaguacaaggccagcgagaacgccauuguauggaagu

SEQ ID NO: 55028 - RNA, 46 nt, Mus musculus
aucaagcgcauggcaggcaugaaggaaucccagaucagcgcagaga

SEQ ID NO: 55029 - RNA, 47 nt, Mus musculus
cguuccuccguccugcucugcugccuuuccuuuccaauagccccuga

SEQ ID NO: 55030 - RNA, 47 nt, Mus musculus
acuaccccucaccucagagcuuccccaaaggccaguaacagaucccc

SEQ ID NO: 55031 - RNA, 46 nt, Mus musculus
uuguacacgugugacuuuguccaguuacaaacccaauaaacaauag

SEQ ID NO: 55032 - RNA, 45 nt, Mus musculus
caguacacuguagcuguuuucagacacaccaaaagagggcaucag

SEQ ID NO: 55033 - RNA, 66 nt, Mus musculus
uucccagcacccacaugguggcucacaaccaucugcaaugugaucugacgcccucuucuggagugu

SEQ ID NO: 55034 - RNA, 45 nt, Mus musculus
gaacggacucuguguucuuagaauaaaccuugccaaguccaccuu

SEQ ID NO: 55035 - RNA, 46 nt, Mus musculus
ggugaagaggauggaaacaaucugugaugugaugguuaaggcuuug

SEQ ID NO: 55036 - RNA, 46 nt, Mus musculus
gaacuuuaaacccuuacccccaccccaccccuacugcccuccauuu

SEQ ID NO: 55037 - RNA, 61 nt, Mus musculus
uggcacugcugaaggauccuuccaaaaggaaaguuccaccccaagcccucacaccuaacca

SEQ ID NO: 55038 - RNA, 46 nt, Mus musculus
cuguuggcugcccaccuuagccuccucuugcuguuugcccucugua

SEQ ID NO: 55039 - RNA, 41 nt, Mus musculus
aaacagcaagaggaggcuaaggugggcagccaacagggcua

SEQ ID NO: 55040 - RNA, 41 nt, Mus musculus
uuccugcuggagaaccccauuggcuaccuaucccgcuccuu

SEQ ID NO: 55041 - RNA, 45 nt, Mus musculus
accacggaagccaaacugaguaagaagaaggaauagcaaucccgg

SEQ ID NO: 55042 - RNA, 45 nt, Mus musculus
auagccccguaaagauguacaaaaacccagcuggguagcuggaag

SEQ ID NO: 55043 - RNA, 45 nt, Mus musculus
ugacuacacacagcugcagggugacaccggaccucuugugugagu

SEQ ID NO: 55044 - RNA, 46 nt, Mus musculus
ugaguuuaaggccagccuagucuacagaguuccaggacagccagau

SEQ ID NO: 55045 - RNA, 44 nt, Mus musculus
ugaugcuugucuguagccuuagacagucacuucccaccgcagau

SEQ ID NO: 55046 - RNA, 50 nt, Mus musculus
cccacauagggagguuugggugccaggcuugguagcagguaggguccgcg

SEQ ID NO: 55047 - RNA, 41 nt, Mus musculus
aggggguugugucgaaggcagagguuucuggucggcuuaga

SEQ ID NO: 55048 - RNA, 45 nt, Mus musculus
gauguuacuggagggcaccgaggccagggguucggucgucuugau

SEQ ID NO: 55049 - RNA, 42 nt, Mus musculus
ucuggaggacaacgcgcguggccuucugggaaaaggggcggu

SEQ ID NO: 55050 - RNA, 74 nt, Mus musculus
cccaacagcccuccgcgacaacccccagcggcgcggacgagaagucgaguggcaaggagcgaagggaugccggg

SEQ ID NO: 55051 - RNA, 51 nt, Mus musculus
aggacaaacagcuucaagaugaacuggagaugcucguggagcgacucgggg

SEQ ID NO: 55052 - RNA, 46 nt, Mus musculus
cacacuauggcaaauugaaggaaaucuaugagaacauggccccugg

SEQ ID NO: 55053 - RNA, 46 nt, Mus musculus
guggcucacaaccauccguaacgaaaucugaugcccucuuuuggag

SEQ ID NO: 55054 - RNA, 46 nt, Mus musculus
ucuuggcaugauucugcugugggauguggaugguggccucacccag

SEQ ID NO: 55055 - RNA, 33 nt, Mus musculus
cucuccuugccugugguaucgugaauucuggag

SEQ ID NO: 55056 - RNA, 99 nt, Mus musculus
ugcugaagguucagcagcuccuccacaucuguagugagcacuuugacucuaaggaaaaggaggaagacaaagacaagaaggaaaagaaggacaaggaca

SEQ ID NO: 55057 - RNA, 62 nt, Mus musculus
agggaguagcuguucugggcauugcacuuauugcuaugggggaagagauuggugcagagaug

SEQ ID NO: 55058 - RNA, 45 nt, Mus musculus
gugagccaccaugugguugcugggaauugaacucaggaagaagag

SEQ ID NO: 55059 - RNA, 42 nt, Mus musculus
accagcugagauauggggagccuacccuccgucgcgcuguac

SEQ ID NO: 55060 - RNA, 46 nt, Mus musculus
uaucaugccaaggaccccaauaaccucuucauggugcgcuuggcac

SEQ ID NO: 55061 - RNA, 65 nt, Mus musculus
agcgggcagaguuggccacugaggaguuucuuccugucacccccauucuggaaggcuuuguuauu

SEQ ID NO: 55062 - RNA, 46 nt, Mus musculus
uuuuguuuuuagcaggcuguccugccugcuaugagggguggauacu

SEQ ID NO: 55063 - RNA, 45 nt, Mus musculus
cacugucagcaaagcugacccacugcaccaccugagcugcugccu

SEQ ID NO: 55064 - RNA, 44 nt, Mus musculus
ccagaaaaguucgagucuucaagugaguguccagcagccccagg

SEQ ID NO: 55065 - RNA, 68 nt, Mus musculus
uugguauuggggaaggccuggcgaaaagaaggcucuaagaccuguuuauagagccacaacaggguaca

SEQ ID NO: 55066 - RNA, 42 nt, Mus musculus
aacccuuuucuuuccuugggguaucuuuuuuaggcuggcucu

SEQ ID NO: 55067 - RNA, 44 nt, Mus musculus
cugcucacacucauccaucucuuccucaggagcuggggcagcug

SEQ ID NO: 55068 - RNA, 46 nt, Mus musculus
acgcuuaaacucauccaacacaaagguacucuugggcaggugagca

SEQ ID NO: 55069 - RNA, 44 nt, Mus musculus
guggagaggaaacucucucugguuuagauauugggaagcagacu

SEQ ID NO: 55070 - RNA, 49 nt, Mus musculus
uagaaaaaucauggguuuguugggagugauagcccaguugagauuggug

SEQ ID NO: 55071 - RNA, 46 nt, Mus musculus
aauauggguugaagcauuauuacuaagagacacuuguggccuugag

SEQ ID NO: 55072 - RNA, 35 nt, Mus musculus
gcucuaaccauccaggagaucgcugcacuggccag

SEQ ID NO: 55073 - RNA, 42 nt, Mus musculus
agacucauucaagaaacaagagggugcccagcacaggggcug

SEQ ID NO: 55074 - RNA, 42 nt, Mus musculus
guccgcgcugcaggcagguggagcagaaccccgcccgcagag

SEQ ID NO: 55075 - RNA, 45 nt, Mus musculus
agagauaaggcaccaucuacuuuuuccaagaauaaaguucagagc

SEQ ID NO: 55076 - RNA, 46 nt, Mus musculus
cgucuccugaauccuggauuauagacaaaagccaucacauccaggu

SEQ ID NO: 55077 - RNA, 42 nt, Mus musculus
aaacagaagcacaagucugucugacugugaguuugaggccag

SEQ ID NO: 55078 - RNA, 47 nt, Mus musculus
ggcugaccaguuugaguaugucauguaugggaaaguguacaggaucg

SEQ ID NO: 55079 - RNA, 42 nt, Mus musculus
cucucggaaggccgagagggagaacuuagcaugaaccugaag

SEQ ID NO: 55080 - RNA, 45 nt, Mus musculus
gcccuacucuagaggguagcggaacgcugguguccuaaguaguag

SEQ ID NO: 55081 - RNA, 42 nt, Mus musculus
gccccacccuggccugcaggcagccgcgccagcugccaggac

SEQ ID NO: 55082 - RNA, 46 nt, Mus musculus
cacuggaccagugcugucccguguguccaggugaauguccugcagg

SEQ ID NO: 55083 - RNA, 42 nt, Mus musculus
guguccuguaaggaaccucaguaucucuccauucugcaccag

SEQ ID NO: 55084 - RNA, 44 nt, Mus musculus
cuguacucaaucuauuauucaucucuaauguccuuggcccugcu

SEQ ID NO: 55085 - RNA, 41 nt, Mus musculus
ucaaaauguuucuucacuucuucucuccauucagccugagu

SEQ ID NO: 55086 - RNA, 46 nt, Mus musculus
gcugcagugaguguguaccggccgacucuggccacugcuuccaggg

SEQ ID NO: 55087 - RNA, 46 nt, Mus musculus
caccugugucagugcccagguccgagagaagccagaugacccccug

SEQ ID NO: 55088 - RNA, 45 nt, Mus musculus
cauccaacucagauucuccucaguucccaggacgcuaucccuuuc

SEQ ID NO: 55089 - RNA, 48 nt, Mus musculus
gaauguagcccucccaacaccugacagaugagaccaaacagccagcag

SEQ ID NO: 55090 - RNA, 45 nt, Mus musculus
ugggggugcagaggcagucuuagggccucauacauaggggguagc

SEQ ID NO: 55091 - RNA, 46 nt, Mus musculus
ugaagugucugcagcaaccuguagaaaaagaaggggaacuggaggu

SEQ ID NO: 55092 - RNA, 46 nt, Mus musculus
aaacaaauguggaguacuaugugaaagaauauuauuuugccaugaa

SEQ ID NO: 55093 - RNA, 45 nt, Mus musculus
ugugguggucuggaggucuacauuagauccauugguagcaggaaa

SEQ ID NO: 55094 - RNA, 42 nt, Mus musculus
gauccuccaaggguuggcacuguccccucuucccgagaagau

SEQ ID NO: 55095 - RNA, 45 nt, Mus musculus
guucaagcauaaucagucaaugguggcucauagauagcacugggg

SEQ ID NO: 55096 - RNA, 46 nt, Mus musculus
cuggauguucucagaagaggcaucagugcgccucacgucaccguau

SEQ ID NO: 55097 - RNA, 42 nt, Mus musculus
ucacccauaccgcacaguaguuguaggacaggauggggagga

SEQ ID NO: 55098 - RNA, 46 nt, Mus musculus
caccgugaggggcaccauugaagccugugccaaugcugagauagag

SEQ ID NO: 55099 - RNA, 42 nt, Mus musculus
cagaaaccugaagaaaauagaacaugagacagggaccaagau

SEQ ID NO: 55100 - RNA, 46 nt, Mus musculus
ggccauuaguuuuaagagccuggaagacagcagacagcaaccgaaa

SEQ ID NO: 55101 - RNA, 45 nt, Mus musculus
cgcugcggauccugguccccacccaguuuguuggugccaucaucg

SEQ ID NO: 55102 - RNA, 46 nt, Mus musculus
gucaacacagauacagaaacugccguugucaacgucaccuauauga

SEQ ID NO: 55103 - RNA, 46 nt, Mus musculus
aguugauuuacaaauccuacagguacacacuaauagacacagagac

SEQ ID NO: 55104 - RNA, 42 nt, Mus musculus
aggaggaagaaaagagagagagagagagagagagagagagag

SEQ ID NO: 55105 - RNA, 44 nt, Mus musculus
auccucaagauguuacuuagaagauaaggagauccuggggcagc

SEQ ID NO: 55106 - RNA, 46 nt, Mus musculus
cuguaugacuuuaauucuagcacuuaggagacugaggcaggcagau

SEQ ID NO: 55107 - RNA, 42 nt, Mus musculus
uuaagaacaaacugcccuggcccacaagaaaccaagagagag

SEQ ID NO: 55108 - RNA, 46 nt, Mus musculus
ugaccagauuuuuaucuuuuaccauuuuaucuuuuaccauucugau

SEQ ID NO: 55109 - RNA, 46 nt, Mus musculus
cacuacuccaggggcaguggagaagaugggaaagcuagagcuuuug

SEQ ID NO: 55110 - RNA, 45 nt, Mus musculus
cacaccacacaacaccaccacacaacaccaccacaccacaccacc

SEQ ID NO: 55111 - RNA, 48 nt, Mus musculus
gccugaucuacauucauuccgaaaccgucucagacagcacccaccacc

SEQ ID NO: 55112 - RNA, 58 nt, Mus musculus
ucugaacucacugccgcaugcaaauauuuguuuguauccugauuagucguaauuguag

SEQ ID NO: 55113 - RNA, 41 nt, Mus musculus
gagaaaagcgccugggcuggagugcuaagauggcugcccgu

SEQ ID NO: 55114 - RNA, 43 nt, Mus musculus
uuuguugcauugccuuuuucugugugugaauuugacuccagag

SEQ ID NO: 55115 - RNA, 46 nt, Mus musculus
uauacauguguauuugaaauucuaaguuccacuugagauggcagau

SEQ ID NO: 55116 - RNA, 46 nt, Mus musculus
cucucucauggugcccccugcugggaucucagauuauaaacaagau

SEQ ID NO: 55117 - RNA, 47 nt, Mus musculus
uauuuuuaugguaaaauuuauuagcuugagaauuaaaguccuaaagg

SEQ ID NO: 55118 - RNA, 46 nt, Mus musculus
uuggaugaauugggaagggauggcugugaggaggguugagggagaa

SEQ ID NO: 55119 - RNA, 45 nt, Mus musculus
gaaucauggugaacguggucugcagaaaaccacuuccgggccugu

SEQ ID NO: 55120 - RNA, 44 nt, Mus musculus
cagucuggugugucucuuguaaauuuuuaacuucuuuucuugga

SEQ ID NO: 55121 - RNA, 46 nt, Mus musculus
auuuacuuguguguguguccaugugugcacacacauguguggaggu

SEQ ID NO: 55122 - RNA, 46 nt, Mus musculus
uauuggcuuauuuuuuucuucuguuauuaauucaauaaagugaguu

SEQ ID NO: 55123 - RNA, 41 nt, Mus musculus
aagcccccgugaaauggugggaaauucagcaagccagaaag

SEQ ID NO: 55124 - RNA, 42 nt, Mus musculus
cuuuagucauuuuggaaguugguuuuauuuauuggcccuguu

SEQ ID NO: 55125 - RNA, 46 nt, Mus musculus
aauaaauaaauaaaucuuuaaaaaaaaagaaagaaaggagaaaaga

SEQ ID NO: 55126 - RNA, 41 nt, Mus musculus
uucuggaaagugugugugacaugaguguguguggaggccag

SEQ ID NO: 55127 - RNA, 47 nt, Mus musculus
aagggagagagagagagagagacagagagagagagacacagagagag

SEQ ID NO: 55128 - RNA, 42 nt, Mus musculus
ucucugggagccugugugugugugugugugugugugugugug

SEQ ID NO: 55129 - RNA, 27 nt, Mus musculus
uacauuucuuugugaguguguguaugu

SEQ ID NO: 55130 - RNA, 45 nt, Mus musculus
gugugugagugugugucugugugugugacugugagugagugagug

SEQ ID NO: 55131 - RNA, 44 nt, Mus musculus
ugucuguguguuuucaaggcaggguuucuuagugcagcccuggu

SEQ ID NO: 55132 - RNA, 44 nt, Mus musculus
uucuuuccucagucaagcuccugaagguagcuuaagguaucaga

SEQ ID NO: 55133 - RNA, 45 nt, Mus musculus
cuugauguggcauuuucuguguaguugugacucagaggaugggac

SEQ ID NO: 55134 - RNA, 55 nt, Mus musculus
uccuuuuguugacucucaugguagugguggugggacagaggguggaauuaucgag

SEQ ID NO: 55135 - RNA, 42 nt, Mus musculus
aaugacauacucaggaacugagcuggugugcagugcccuuca

SEQ ID NO: 55136 - RNA, 45 nt, Mus musculus
auaggacagcgggcucaacauuugagccacaaauuaggcacugac

SEQ ID NO: 55137 - RNA, 45 nt, Mus musculus
auggagucauuugucuaaggcagauaaauagauucacuagcaggg

SEQ ID NO: 55138 - RNA, 46 nt, Mus musculus
uaaauaauugauuggucuguuuuguuuuguuuuguuuuugcaguca

SEQ ID NO: 55139 - RNA, 45 nt, Mus musculus
uguacaacuaauuauggaucaguuuuuauuagaagaggcguagaa

SEQ ID NO: 55140 - RNA, 29 nt, Mus musculus
augaaggcuuugcucuccccaacaccccu

SEQ ID NO: 55141 - RNA, 45 nt, Mus musculus
agauuaauacaaugucacaugaauauuaaacuguaaagucacaga

SEQ ID NO: 55142 - RNA, 45 nt, Mus musculus; identical to SEQ ID NO: 55141

SEQ ID NO: 55143 - RNA, 42 nt, Mus musculus
cuucuucccaugccucgugccaaagaccucucgcccucuguc

SEQ ID NO: 55144 - RNA, 46 nt, Mus musculus
ccugaccaaguccucaccucgaccuugauagucaacagaugagcag

SEQ ID NO: 55145 - RNA, 45 nt, Mus musculus
uuacagccucacaugaguccaagccagaaauggguuacagggaag

SEQ ID NO: 55146 - RNA, 23 nt, Mus musculus
acccggugggugcuagacagugc

SEQ ID NO: 55147 - RNA, 42 nt, Mus musculus
cuccuucaaagcaccaauagcugcacuuuggaagcgcagauc

SEQ ID NO: 55148 - RNA, 42 nt, Mus musculus
acagccgggccgacucgucaguccgggcagggggcggcaggu

SEQ ID NO: 55149 - RNA, 46 nt, Mus musculus; identical to SEQ ID NO: 44531

SEQ ID NO: 55150 - RNA, 57 nt, Mus musculus
ccucucugaauuucauggauuucugucucacaagguuuaacuauuuuauauacacug

SEQ ID NO: 55151 - RNA, 71 nt, Mus musculus
aucaagugcagcucucugaagaagcauuuggggugcauaccaugugugaugaauuucauuauggauagggg

SEQ ID NO: 55152 - RNA, 83 nt, Mus musculus
ugaccccauccagcagccaccauguggaaucugggagggcagguacuggcuuauuuuguggcugauaaacauuccuugggcau

SEQ ID NO: 55153 - RNA, 39 nt, Mus musculus
cgucucagcuccucugugcagcuccucuuccuagccuag

SEQ ID NO: 55154 - RNA, 46 nt, Mus musculus
aaagcuagaguaagacuauaaaaagcauuccaggcaagggccauau

SEQ ID NO: 55155 - RNA, 46 nt, Mus musculus
ccuuuuuaauguccuuuauggaggcacuucgaggcacccccaagau

SEQ ID NO: 55156 - RNA, 45 nt, Mus musculus
gcacacuaauuuaccuggaauaaaggcaaacaggcuuggcugaua

SEQ ID NO: 55157 - RNA, 46 nt, Mus musculus
aaacucucugcuuuguggucaaaaguacgaguucugugggucagug

SEQ ID NO: 55158 - RNA, 46 nt, Mus musculus
cucauguagugaagugacauagcgucuggagaaaacgcccagagca

SEQ ID NO: 55159 - RNA, 46 nt, Mus musculus
uuauguuguugagaaaucugaguuguuuaaagcaccacccccagag

SEQ ID NO: 55160 - RNA, 46 nt, Mus musculus
uuuaaaugacucugaucucagucugaaucuguaggaaaggagagag

SEQ ID NO: 55161 - RNA, 46 nt, Mus musculus
guguacaggucauccccucuccucucaaauauccggugccugagaa

SEQ ID NO: 55162 - RNA, 45 nt, Mus musculus
acuguucucuuuauggggugaguagacaugcauuggugcccacag

SEQ ID NO: 55163 - RNA, 45 nt, Mus musculus
gaaaguagaaacuuguuagaagucuuaggagugagcagcuguugg

SEQ ID NO: 55164 - RNA, 45 nt, Mus musculus
ucauucuuucuucucucuaguugcccacuuuucucccuuucuuug

SEQ ID NO: 55165 - RNA, 36 nt, Mus musculus
ggcauucugaagcaguauauauacucuggcugcuca

SEQ ID NO: 55166 - RNA, 45 nt, Mus musculus
ucuggauauugauugaguuguuccaguuuuuguugcacgguccuc

SEQ ID NO: 55167 - RNA, 42 nt, Mus musculus
cagcuuccuuucuugcaaaauaaaaucauuuucauggaggag

SEQ ID NO: 55168 - RNA, 46 nt, Mus musculus
ugcaagccucacuuucugaguugcgggcagggggaggggaugggga

SEQ ID NO: 55169 - RNA, 46 nt, Mus musculus
gugaauugcuaggaucagagacugcucuuaaggcucacagcaagau

SEQ ID NO: 55170 - RNA, 46 nt, Mus musculus
gugaaccaccaugugguugcugggauuugaacucaguaccucugaa

SEQ ID NO: 55171 - RNA, 44 nt, Mus musculus
cuuuaggcuuuuacaguccuucaagcuagagagcuugcccugac

SEQ ID NO: 55172 - RNA, 46 nt, Mus musculus
uucccagcaaccacaugguggcucacaaccaucuguaauguugccg

SEQ ID NO: 55173 - RNA, 48 nt, Mus musculus
uacaaguaguccgagagaaagugaaaaauuuugcucaguuaacuguau

SEQ ID NO: 55174 - RNA, 46 nt, Mus musculus
augcuguagaaguagcugggagcuacaucuuaauucauaggcagag

SEQ ID NO: 55175 - RNA, 49 nt, Mus musculus
uauuuuaucaugcaguacagguagaaggcaaaaauaauuucauuccagu

SEQ ID NO: 55176 - RNA, 57 nt, Mus musculus
cuuuuguugaaauaacuaauaagugcuagugggguuuuuuuuuuaauguaaggggga

SEQ ID NO: 55177 - RNA, 44 nt, Mus musculus
cuugcccacuuugguaacagagcaggaaaacaagcccgguggaa

SEQ ID NO: 55178 - RNA, 87 nt, Mus musculus
caauguggaagcagcuucuuggaguguuuaguuuuacugggcggagaaaguugugaauucaggaaaguuuaaaauacauuggcaggu

SEQ ID NO: 55179 - RNA, 41 nt, Mus musculus
cauggagacgaaaggcagcagugggagggugugauggggaa

SEQ ID NO: 55180 - RNA, 45 nt, Mus musculus
agagagagagggagagagagagagagagagagagauagagagaga

SEQ ID NO: 55181 - RNA, 46 nt, Mus musculus
acugccaggcaagcaguuccccuuccauaucugggaaaggcuggug

SEQ ID NO: 55182 - RNA, 45 nt, Mus musculus
agucuucauucuguauggguaccuaugaggacaaacuauauucag

SEQ ID NO: 55183 - RNA, 45 nt, Mus musculus
uuuuuccuaccugucaauuacgaccuucggagggagagucaagca

SEQ ID NO: 55184 - RNA, 46 nt, Mus musculus
aaauagugggaccagauaugauggucacuguuggaauuuggcccua

SEQ ID NO: 55185 - RNA, 45 nt, Mus musculus
augaguuauuugagacagaaacauaagaucuacaaggcuguuacg

SEQ ID NO: 55186 - RNA, 45 nt, Mus musculus
cuugucuuguuucucuguaggacucauguaauugcuugucccauc

SEQ ID NO: 55187 - RNA, 46 nt, Mus musculus
ucuuuggaguggcccacaguggccucucuucuguaccucagucccu

SEQ ID NO: 55188 - RNA, 46 nt, Mus musculus
gcugacaacuuucucuugguaucuaugucccagaccuuuccccugu

SEQ ID NO: 55189 - RNA, 57 nt, Mus musculus
uccuuccaguccccauccaugaaugcaaaccaugccagcuguaucuuuguaguaagc

SEQ ID NO: 55190 - RNA, 42 nt, Mus musculus
ccuguaccucaaacacagaaccucagaaccucugugccucgg

SEQ ID NO: 55191 - RNA, 46 nt, Mus musculus
gggcuucugggugggagaaaagagagacuggcugaguugcugucag

SEQ ID NO: 55192 - RNA, 45 nt, Mus musculus
acagggugagacauuggugacaugccacuuucccuuugugguuca

SEQ ID NO: 55193 - RNA, 46 nt, Mus musculus
ugcuggcuuguuuuaugucaaccugauacacgcuauagucauuuag

SEQ ID NO: 55194 - RNA, 51 nt, Mus musculus
agaaggaugaaaagcuccgcucgcucugcaggaugcucagagaacauaagc

SEQ ID NO: 55195 - RNA, 45 nt, Mus musculus
gccuugagcagagaguugcucacacuacauucagaguuacaggag

SEQ ID NO: 55196 - RNA, 44 nt, Mus musculus
uuuguuguagaacaugacuucaucauggccaccuaccuagcacu

SEQ ID NO: 55197 - RNA, 46 nt, Mus musculus
aacuacauuuaucagaaugccugcuggaaggcuuaaaccagauaag

SEQ ID NO: 55198 - RNA, 46 nt, Mus musculus
ucagcagcuugauuuaacucaccuuaaagaacuaaaugucgaagau

SEQ ID NO: 55199 - RNA, 49 nt, Mus musculus
uucccccuucucucucucucuucccaccccaccccccaagucaaagugu

SEQ ID NO: 55200 - RNA, 45 nt, Mus musculus
cucuuuaugggucuuaccucaucacuucuagcuauguaaggcccu

SEQ ID NO: 55201 - RNA, 44 nt, Mus musculus
cccgcgcugagcagcuauggcugcggcgauagccagcuccuuga

SEQ ID NO: 55202 - RNA, 42 nt, Mus musculus
aauaaaacguuccuuuagaaaacgaaccaccaaccgcgacag

SEQ ID NO: 55203 - RNA, 45 nt, Mus musculus
cagucugugacaccugucuggucugaccccucuugggcaccagau

SEQ ID NO: 55204 - RNA, 46 nt, Mus musculus
aagagcugcuuuuaugacagguuuuggaaauuaaaacagcagagag

SEQ ID NO: 55205 - RNA, 42 nt, Mus musculus
ugucguguugacacuggcugggguagcagccaccggggagga

SEQ ID NO: 55206 - RNA, 42 nt, Mus musculus
cggaagucuggaagaaaucaccgcgggccgagagggacaccc

SEQ ID NO: 55207 - RNA, 41 nt, Mus musculus
cugggugugcccugaggugguauaauuaggccaggcccaga

SEQ ID NO: 55208 - RNA, 42 nt, Mus musculus
gaagcccggaggaagugagcggcggguuguuaccggccaaag

SEQ ID NO: 55209 - RNA, 79 nt, Mus musculus
aagaagaaagaugccggaaaguuggccaaaaaggauaaagacccaguaaauaaaucugguggcaaggccaagaagaagu

SEQ ID NO: 55210 - RNA, 45 nt, Mus musculus
cucuguaaggagguuccgaacuauaagcuuauuacuccagccgug

SEQ ID NO: 55211 - RNA, 47 nt, Mus musculus
aggagcuccuuaguaaaggacuuaucaagcugguuucaaagcacaag

SEQ ID NO: 55212 - RNA, 46 nt, Mus musculus
uuggaguggguguggcccuguugaaguagguguggccugguuggag

SEQ ID NO: 55213 - RNA, 46 nt, Mus musculus
cuaucaagugcccucucucccugcccucuccucccuucagccccag

SEQ ID NO: 55214 - RNA, 42 nt, Mus musculus
guggcagggcagugguggcgcacaccuuuaaucccagcacuu

SEQ ID NO: 55215 - RNA, 42 nt, Mus musculus
ggccuggguuuagugaaugccuccuggagacuggacuguggu

SEQ ID NO: 55216 - RNA, 46 nt, Mus musculus
acuugugcaauuugauucuuuucuucuuucuugaguccaggggauu

SEQ ID NO: 55217 - RNA, 46 nt, Mus musculus
ggcccuguggucuuuagcuucugggacaggucgugagcuucuagau

SEQ ID NO: 55218 - RNA, 41 nt, Mus musculus
ucacauguacacacacacacacacacacacacacagagaca

SEQ ID NO: 55219 - RNA, 46 nt, Mus musculus
auuccaccaucucgaugccuguggaaacuguauggcugugggugag

SEQ ID NO: 55220 - RNA, 42 nt, Mus musculus
ccccacccuguucgagcuugccucccuagcacucauugggag

SEQ ID NO: 55221 - RNA, 46 nt, Mus musculus
ucaugccccauguauugcggucaucaauggguucgaugguguuuag

SEQ ID NO: 55222 - RNA, 45 nt, Mus musculus
gaagaaauggaugugcugucaggauagcuggauguaucuggguag

SEQ ID NO: 55223 - RNA, 45 nt, Mus musculus
gaaggcgguuauucuggagugagacguuccucagguuggccagug

SEQ ID NO: 55224 - RNA, 46 nt, Mus musculus
gaaucagaaccugcaacugguucagguggcugaaggcauugucagg

SEQ ID NO: 55225 - RNA, 43 nt, Mus musculus
agggcgaugagggcugaaauguugaggaacuuguccucgggga

SEQ ID NO: 55226 - RNA, 41 nt, Mus musculus
agcuccacgaggcugccgggucaauaagaaggaggcggcga

SEQ ID NO: 55227 - RNA, 48 nt, Mus musculus
aaaaaaaaaaagguguguguguggguggguguuuguguguguauguuu

SEQ ID NO: 55228 - RNA, 46 nt, Mus musculus
guuuguguguguguguggggggguguuugugugugugugccugugu

SEQ ID NO: 55229 - RNA, 68 nt, Mus musculus
gacuuuuggguaacugggaccccaagcacgucaaccugccuucuagauauagcccuaggauuguaaug

SEQ ID NO: 55230 - RNA, 42 nt, Mus musculus
auggcagagugcaucagguucugccgacaaugaaggcaacag

SEQ ID NO: 55231 - RNA, 46 nt, Mus musculus
aaaaaaaauuuagaaucccugaccaccgcucuccuugcccccaagc

SEQ ID NO: 55232 - RNA, 46 nt, Mus musculus
acaauaaccuaccuaaaagauauccuuacuucuaauggcaucgaca

SEQ ID NO: 55233 - RNA, 42 nt, Mus musculus
acuggauccuggccaccgauuaugaaaacuaugcccucgugu

SEQ ID NO: 55234 - RNA, 46 nt, Mus musculus
agaugaacuuugggggagggggcagggugugucugugugugugugu

SEQ ID NO: 55235 - RNA, 46 nt, Mus musculus
ggucagauccccaugaauggucagagaacuuccuuaguuccaagau

SEQ ID NO: 55236 - RNA, 46 nt, Mus musculus
acccgacugccucacacauacuuuggucucaugguugcccugcuug

SEQ ID NO: 55237 - RNA, 46 nt, Mus musculus
gcaggggcacggagagggugugagcuacucaaacuaggcaggauga

SEQ ID NO: 55238 - RNA, 46 nt, Mus musculus
uaaaucaguuuuagaacauuuuuauuaucucaagaagaaaccacaa

SEQ ID NO: 55239 - RNA, 42 nt, Mus musculus
gucucugcaggcaucagggacagcugagaaacagcugcauga

SEQ ID NO: 55240 - RNA, 42 nt, Mus musculus
caucacaggcagaaaggcagcgagcuggaaauagcucaugug

SEQ ID NO: 55241 - RNA, 46 nt, Mus musculus
cugauggggugggauucagaguuggauggauaggaugaggugagga

SEQ ID NO: 55242 - RNA, 43 nt, Mus musculus
aaaucuuucccagaaaucuuaagaacaucucucggguacccca

SEQ ID NO: 55243 - RNA, 41 nt, Mus musculus
aucccuguucuuuuccaucgcuguuucuaauauaccucagg

SEQ ID NO: 55244 - RNA, 46 nt, Mus musculus
cucagccaauccuuacaaaaaccuggaagaucaaagggggcgaguc

SEQ ID NO: 55245 - RNA, 46 nt, Mus musculus
cuagcaagggucagauacggaaaccccagggagagacuccaaaaca

SEQ ID NO: 55246 - RNA, 46 nt, Mus musculus
agucucguccucuacgcgguuucuucacuuccuggagcggcaccau

SEQ ID NO: 55247 - RNA, 43 nt, Mus musculus
gccaggguugguggagacugggugggccucggugcuuggggga

SEQ ID NO: 55248 - RNA, 45 nt, Mus musculus
uucccccaagucuaguuugcucagguuuuccuuaauggugugagc

SEQ ID NO: 55249 - RNA, 42 nt, Mus musculus
gaccugcccacugugggugguaacauucccuaggaaggggga

SEQ ID NO: 55250 - RNA, 42 nt, Mus musculus
aaauguagacugugugggaugauuuggauaugcuuggcccag

SEQ ID NO: 55251 - RNA, 42 nt, Mus musculus
aaugcuggguauugaacccagggcuuugugcaugcuaggcaa

SEQ ID NO: 55252 - RNA, 82 nt, Mus musculus
ccggggguggggcggcccggaggcgagcggacgagcaggggccgcgggccgcggcgagcgggcgagcggcggcggccgaggc

SEQ ID NO: 55253 - RNA, 47 nt, Mus musculus
gaucgaaacuaagccaaacugaagacagacaacucagaaguuccaua

SEQ ID NO: 55254 - RNA, 45 nt, Mus musculus
gauugguucccaaggauggaggaauuaaaaaaaaaaacagcacau

SEQ ID NO: 55255 - RNA, 46 nt, Mus musculus
guggguuuaaaguccguuuguauuauuauuauuauuugcuggcaca

SEQ ID NO: 55256 - RNA, 42 nt, Mus musculus
auuaguacugcuuaugugcaugggcaacauaccaguggccac

SEQ ID NO: 55257 - RNA, 46 nt, Mus musculus
auguaaaaucaucuguaacuacuucuaagcuauuucuucgguguaa

SEQ ID NO: 55258 - RNA, 46 nt, Mus musculus
gggcuucacuaaaaaacuuccuucaagagggaaaaauagggcacag

SEQ ID NO: 55259 - RNA, 46 nt, Mus musculus
uacacaaaaaccauguaagauuugacaguaagaaaagaagccacag

SEQ ID NO: 55260 - RNA, 46 nt, Mus musculus
uuuacauguaugggucuuugucuucaugcgcuugcccggugcccac

SEQ ID NO: 55261 - RNA, 69 nt, Mus musculus
caaaucccagcgaccacaugguggcucacaaccauccguaacaggaucugacucccucuucuggagugu

SEQ ID NO: 55262 - RNA, 42 nt, Mus musculus
ugagugcugggaauugaacccagguccccugcaagagcagua

SEQ ID NO: 55263 - RNA, 38 nt, Mus musculus
ggaacuggaguuauggguaguugugagccaucauguag

SEQ ID NO: 55264 - RNA, 46 nt, Mus musculus
cauuaaaagcuagcuaaaugagugcacagacacuuaugguuggcag

SEQ ID NO: 55265 - RNA, 45 nt, Mus musculus
aauucugugacuaguaugugcuauagauuuauuuucuuauagaau

SEQ ID NO: 55266 - RNA, 66 nt, Mus musculus
gugcugggauuaaaggcgugugccaccacgccaggcuguuguuguuguuuuaucagacacuuuuau

SEQ ID NO: 55267 - RNA, 104 nt, Mus musculus
uuugguuuucaugauuauaugacccguauugcaauuuucagaaugauauaaaauuuugugccauccuucaaauuauaguugcaccauaugcaccuugaagacuc

SEQ ID NO: 55268 - RNA, 108 nt, Mus musculus
aguucaaaaccuuuaaaugugaaaucuucacccauuucuugguagaaacuaaucucuguauguguauagauagcucuuuguacuuuuuucuucuugaauaguggaguc

SEQ ID NO: 55269 - RNA, 47 nt, Mus musculus
uugguaacuuucuuuugggucccauauuuuacaauuaauuugggucc

SEQ ID NO: 55270 - RNA, 122 nt, Mus musculus
aaauucauugaguuugaguuaaguagguuuauaguuuuuacucacauuggaaaauuucacccacugacugggauuuaguaacauagccugaaaaaucuugagucagagacaagaauauuaca

SEQ ID NO: 55271 - RNA, 46 nt, Mus musculus
cuuccagaggaccuggauucaauucucagcacacauuugacugcuu

SEQ ID NO: 55272 - RNA, 77 nt, Mus musculus
acagauagauacauuuagccaagaaacccauacagacagagagagagaggagagaggagagaggagagagaggagag

SEQ ID NO: 55273 - RNA, 84 nt, Mus musculus
gagagaggagagaggagaggagagaggagagagaggagaggagagaggagagaggagagaggagaggagagagagaaagagaga

SEQ ID NO: 55274 - RNA, 46 nt, Mus musculus
auuuagccaagaaacucauuuacuaagauagguagauagaugggaa

SEQ ID NO: 55275 - RNA, 46 nt, Mus musculus
aaaugcagaauuuaauucagauuaaaugauccuucuugaguaugag

SEQ ID NO: 55276 - RNA, 42 nt, Mus musculus
guccuuauguuuauaaugcaagcacuuuaucaacugagccau

SEQ ID NO: 55277 - RNA, 46 nt, Mus musculus
uaauucugcauauuuuuuuaauaauaaauucagaaagauccagaaa

SEQ ID NO: 55278 - RNA, 46 nt, Mus musculus
cuccuuaggggcugcuuuuuguuaauaggacacaguaugagcgagg

SEQ ID NO: 55279 - RNA, 46 nt, Mus musculus
ugcuuuuacccuuugcauuauaauuuuacuaauuaacuagcuccaa

SEQ ID NO: 55280 - RNA, 45 nt, Mus musculus
cucuuugucucuaucugugugucugucucucucuguauguguugu

SEQ ID NO: 55281 - RNA, 42 nt, Mus musculus
aggauucaaccaccuguuacucagaggcacuugaggugggaa

SEQ ID NO: 55282 - RNA, 44 nt, Mus musculus
caguaccauaguuggcuuugagaauucgcaucuuuauuggucag

SEQ ID NO: 55283 - RNA, 46 nt, Mus musculus
ucugauaagcacccuucucuacaguguacucauuucuuccugucag

SEQ ID NO: 55284 - RNA, 45 nt, Mus musculus
acaugccugguggugguggugguggugguggugguggugguggug

SEQ ID NO: 55285 - RNA, 46 nt, Mus musculus
guuuuauuuuuguagacacauacuaggugggcacaugugccaggag

SEQ ID NO: 55286 - RNA, 44 nt, Mus musculus
ccucccccuugccucuaugagggugcucccucuacucacccacc

SEQ ID NO: 55287 - RNA, 46 nt, Mus musculus
gauuaaggaccaaugacuguugcuuccuguuauuuuuguuguuuga

SEQ ID NO: 55288 - RNA, 83 nt, Mus musculus
ugccucugaguguuguggcuuauauuuuaaaaaagaaaagaaaagaaaaagacuaugaaguuuggagaacauaaaggguggau

SEQ ID NO: 55289 - RNA, 45 nt, Mus musculus
gaguaaaauagauuguauacauguguaaaauucucaaaugcauaa

SEQ ID NO: 55290 - RNA, 46 nt, Mus musculus
aguaauacucauuagaaguacuuuaggauaguuguuagcccaacau

SEQ ID NO: 55291 - RNA, 42 nt, Mus musculus
uauaauuuuugcaauuaaaaauauuauguguuuaaaaaccag

SEQ ID NO: 55292 - RNA, 41 nt, Mus musculus
uugugauuaugauuucugucauugagucuuucugugugcca

SEQ ID NO: 55293 - RNA, 57 nt, Mus musculus
auucuuguaauaaagacaacucagucaaggcggggugggggagagugagggagacag

SEQ ID NO: 55294 - RNA, 46 nt, Mus musculus
gacuucaugaguuuuguaguauucccuuucugcuuuauguuguaag

SEQ ID NO: 55295 - RNA, 45 nt, Mus musculus
aaucaagacaagaguuuauuuugggcuuauauuuucagagguuga

SEQ ID NO: 55296 - RNA, 32 nt, Mus musculus
cuuguacuuuuaagcaguaacaaucguccuga

SEQ ID NO: 55297 - RNA, 42 nt, Mus musculus
cuucacaagucaacacuaaauuuuacucagauucaaaaacag

SEQ ID NO: 55298 - RNA, 45 nt, Mus musculus
gaaaauuaaagaaauuuuaaagaaaaaaauuaauuuaaaaaagag

SEQ ID NO: 55299 - RNA, 46 nt, Mus musculus
agucuaugguuuuagagcuuuauuguagaaaggcaaggggaaagag

SEQ ID NO: 55300 - RNA, 46 nt, Mus musculus
uuucucucucuuaauuggcauugaauuauuuucagguuauugcuag

SEQ ID NO: 55301 - RNA, 38 nt, Mus musculus
uuuuguaucuguucagucuugcuuuguuccauggggug

SEQ ID NO: 55302 - RNA, 45 nt, Mus musculus
uuaacaguaccaccaaggagaacucuccagcacuucuccgacuag

SEQ ID NO: 55303 - RNA, 50 nt, Mus musculus
cucuccugcucucaugcccuuggggccagcucacccacacccacaccucc

SEQ ID NO: 55304 - RNA, 46 nt, Mus musculus
ugcccaaguugcaggcuggggcacaccuccugaggaaagggcauug

SEQ ID NO: 55305 - RNA, 43 nt, Mus musculus
gggcauuugccauauauaugggaaauuguaaugacauggauaa

SEQ ID NO: 55306 - RNA, 45 nt, Mus musculus
cuuuggguaacaagauacuuguuuguauagagcagcuuuuugaga

SEQ ID NO: 55307 - RNA, 46 nt, Mus musculus
aaacauuuucccuuauguuauguaauacuaaacaaaacagucucag

SEQ ID NO: 55308 - RNA, 45 nt, Mus musculus
aguuguuaguuauaacuuuuugcuuuauaugauaaaauauagugg

SEQ ID NO: 55309 - RNA, 42 nt, Mus musculus
agucuuguauucuugugugugugugugugugugugugugugu

SEQ ID NO: 55310 - RNA, 46 nt, Mus musculus
agccacaugggaggaaacuguuuccuacuaagugaagagaaaacga

SEQ ID NO: 55311 - RNA, 45 nt, Mus musculus
uaauauggcuaccaccguuauuagcacuuccacaaaauacugugg

SEQ ID NO: 55312 - RNA, 45 nt, Mus musculus
ugacagugugugucugugugugugugugucugugugugugugugu

SEQ ID NO: 55313 - RNA, 45 nt, Mus musculus
uuugguguuuuuccugauuuuuguccuuaaugauuuuagcccaca

SEQ ID NO: 55314 - RNA, 46 nt, Mus musculus
agcugugaaguugagaucuuggaucagguuuuggcauauagugucu

SEQ ID NO: 55315 - RNA, 53 nt, Mus musculus
aacauaaggccuugaaacuuuaacaggacaagagguaacauggaaugaacaau

SEQ ID NO: 55316 - RNA, 46 nt, Mus musculus
ugcaugcguccaucucugugaguucauagaggcuuuugaucauguu

SEQ ID NO: 55317 - RNA, 46 nt, Mus musculus
gacagcuuagagacaccaacuuauguaaguucuacuucaccaccag

SEQ ID NO: 55318 - RNA, 46 nt, Mus musculus
uacuuuaguucuggaccuccauuucccagcccacccccagugccag

SEQ ID NO: 55319 - RNA, 45 nt, Mus musculus
auggauccauaaguuacaaugacaaaaguaugaaaugccuagcag

SEQ ID NO: 55320 - RNA, 45 nt, Mus musculus
guguacacacauacacacacacacacacacacacacacacguaua

SEQ ID NO: 55321 - RNA, 46 nt, Mus musculus
ugguugcccaggaaaauaaguaagacuaaaagggucuuucccacau

SEQ ID NO: 55322 - RNA, 44 nt, Mus musculus
gaugacucaaguauuuucaucaccaaaauuaucacaggcggagc

SEQ ID NO: 55323 - RNA, 34 nt, Mus musculus
cuuguucuagagagaaccuugucuaugugucugu

SEQ ID NO: 55324 - RNA, 46 nt, Mus musculus
ucauggagggacuuagaagcuuuauggcuuuaccucugaccucuag

SEQ ID NO: 55325 - RNA, 46 nt, Mus musculus
gaauagaaauaaaugcuagagcuauggagauagcucagugggaaag

SEQ ID NO: 55326 - RNA, 42 nt, Mus musculus
acguuugauuuaagagaugauuaucaaaguuuaggacaggga

SEQ ID NO: 55327 - RNA, 46 nt, Mus musculus
uugcuggggucugcacaccacuaacccuagauuauauugccaggag

SEQ ID NO: 55328 - RNA, 33 nt, Mus musculus
gcaggacuugucaguaucguagcguggacacag

SEQ ID NO: 55329 - RNA, 45 nt, Mus musculus
acacccaggggucaaaggaggguucuuuuaucuaaaaguuuggag

SEQ ID NO: 55330 - RNA, 46 nt, Mus musculus
ggaccuucuucaccuuggccuuauuuccuuugagcuucuugcccag

SEQ ID NO: 55331 - RNA, 46 nt, Mus musculus
aucuaguaauaaaucauaaauuuaucucaaacucagaauaugucag

SEQ ID NO: 55332 - RNA, 41 nt, Mus musculus
agggggaaaaaauauugaaaaaauaucugggcaaggcagca

SEQ ID NO: 55333 - RNA, 46 nt, Mus musculus
aaaugguuuauugucuguauucaaagggcagagaacuagaccguag

SEQ ID NO: 55334 - RNA, 45 nt, Mus musculus
auuuugugauuucuaagcauguuaauaucaucuuucaaacugguu

SEQ ID NO: 55335 - RNA, 45 nt, Mus musculus
ucucucucucucucucucucucucucucucccuccccccccacgu

SEQ ID NO: 55336 - RNA, 46 nt, Mus musculus
uuuuaaaaaguuucuagaaacuuaaauuuuagauaaaaaugaacag

SEQ ID NO: 55337 - RNA, 46 nt, Mus musculus
cgggcugucccaguuugagcgguaagcacacgcaggaaaguaguga

SEQ ID NO: 55338 - RNA, 41 nt, Mus musculus
acagucguuuugaagcuaaaauccaugacuuacgggagcag

SEQ ID NO: 55339 - RNA, 46 nt, Mus musculus
ugguggcaagccaggcaggucaccccagacggggagagugacgaag

SEQ ID NO: 55340 - RNA, 51 nt, Mus musculus
gaacgagcccgauuaaaaacggucaaauucaauucuaaaacaagaggagau

SEQ ID NO: 55341 - RNA, 46 nt, Mus musculus
guuaguugaguugaugaugcacacuuauaaucccauagagaaacag

SEQ ID NO: 55342 - RNA, 46 nt, Mus musculus
gcaaaaagauaauucacauccagcguagcauaagauuucaccauga

SEQ ID NO: 55343 - RNA, 46 nt, Mus musculus
uaaaaagaaccucuuuucccgaaaauuucccuucuacaagaacaag

SEQ ID NO: 55344 - RNA, 35 nt, Mus musculus
agcugccacagguuacugaguuucuucgccgggaa

SEQ ID NO: 55345 - RNA, 46 nt, Mus musculus
auacuaucacuugcccaucauacuagaauuauagauagacaugcau

SEQ ID NO: 55346 - RNA, 42 nt, Mus musculus
cuaucacuagcagcagcuuuuuaauguuuuaacuuuggaaaa

SEQ ID NO: 55347 - RNA, 46 nt, Mus musculus
aaauagaaacauucuuaaggaaaauuugugaaaaauaaagauuauc

SEQ ID NO: 55348 - RNA, 46 nt, Mus musculus
aaaguuuuauucagaaaauauugaagaagcagaaaaauaccaguag

SEQ ID NO: 55349 - RNA, 46 nt, Mus musculus
uaguguuauguucuucauauuaauuaagcuauacaaaauaggaugu

SEQ ID NO: 55350 - RNA, 29 nt, Mus musculus
ccggccaguauaacaaccaucuguauggg

SEQ ID NO: 55351 - RNA, 79 nt, Mus musculus
ucuggaguaucugaggacagcuacaguguacauuacauguaauaaauaaauaaauauuaaaaaaaaagaauagcagucg

SEQ ID NO: 55352 - RNA, 46 nt, Mus musculus
gcaaagaaauuggcaagguuuugcaagccccagugccuuuccccag

SEQ ID NO: 55353 - RNA, 46 nt, Mus musculus
agugcaggacauuugaaagugucacauguauggauagaauuuauag

SEQ ID NO: 55354 - RNA, 45 nt, Mus musculus
uaauuaaaaauaaaaauaaacaauuacugaaauaaauuuagggag

SEQ ID NO: 55355 - RNA, 47 nt, Mus musculus
gcacugaguaggucaacauguguuaugaauuucagaaugggagcagg

SEQ ID NO: 55356 - RNA, 79 nt, Mus musculus
aagaaaccucccagguuuuauuuaaaagauauugaguaaaguccaagcauaagaaacggaggugcccugacugaggcac

SEQ ID NO: 55357 - RNA, 46 nt, Mus musculus
aggcacugaagaaaugaagccugugaauccagcacccuaugcccag

SEQ ID NO: 55358 - RNA, 33 nt, Mus musculus
ucuuuucuugugcauaaauguuccuccguacag

SEQ ID NO: 55359 - RNA, 46 nt, Mus musculus
gcugaauccuuuuuaguuguauuaacuaacccuugauccucacaga

SEQ ID NO: 55360 - RNA, 90 nt, Mus musculus
ucaucuguacuauucuguguuacucuugguuucuggccacuuuucagaaugaagaugaauggccugaccagcuaucuaggguuuggggag

SEQ ID NO: 55361 - RNA, 46 nt, Mus musculus
caaacauauauauauauauuuaaaauauauuuuucuuuugccaccu

SEQ ID NO: 55362 - RNA, 46 nt, Mus musculus
gugucucaaggagccgugcguucugggcguggaugaagcgggccga

SEQ ID NO: 55363 - RNA, 42 nt, Mus musculus
aaaguagcagacucaaagaccuugacagagaaugagcgggag

SEQ ID NO: 55364 - RNA, 46 nt, Mus musculus
gacguccugucuccaaaccugaucucuaucagcaugcuugggcgag

SEQ ID NO: 55365 - RNA, 50 nt, Mus musculus
ugaaugucacucagguauuuguggacacuguaggaaugccagagacauac

SEQ ID NO: 55366 - RNA, 44 nt, Mus musculus
cuugggaucacugggauagccugagccauaaucggaguccagau

SEQ ID NO: 55367 - RNA, 46 nt, Mus musculus
aucuggacuccgauuauggcucaggcuaucccagugaucccaagac

SEQ ID NO: 55368 - RNA, 42 nt, Mus musculus
uugggcugugcuccaacugaaccguacaaacugggggaagcc

SEQ ID NO: 55369 - RNA, 45 nt, Mus musculus
caagcacuuuuuuuuuucuugaacagcuuuuauuccuggguuaga

SEQ ID NO: 55370 - RNA, 42 nt, Mus musculus
ggaacuccgccguggcguccgggaccguccagggcagcagaa

SEQ ID NO: 55371 - RNA, 45 nt, Mus musculus
uuucuuauaccuggaaaaauacuauaguaggacaaaugagcagag

SEQ ID NO: 55372 - RNA, 42 nt, Mus musculus
aaucaugacacaaccccucaugcagagggauacuguggucug

SEQ ID NO: 55373 - RNA, 46 nt, Mus musculus
aaccauccguaauaagaucugaugcccucuuuugggaugucugaag

SEQ ID NO: 55374 - RNA, 46 nt, Mus musculus
ucaaggacuuguaaaaagauauuuuaauaauauuacucaggaaaaa

SEQ ID NO: 55375 - RNA, 46 nt, Mus musculus
gaaaugggagaaucugagaaauggugaguaauuauaguuugacaag

SEQ ID NO: 55376 - RNA, 46 nt, Mus musculus
cugggcagccacuacuuaucucacuaacaagauuucuaguaaauag

SEQ ID NO: 55377 - RNA, 46 nt, Mus musculus
guagcauucccucuaaucccaguuuuggggagguugacgcagggag

SEQ ID NO: 55378 - RNA, 45 nt, Mus musculus
acaagcugggaauggugcauaguagugauccuagggccuggaugg

SEQ ID NO: 55379 - RNA, 42 nt, Mus musculus
auucccagcaaccacaugguggcucacaccaucuggaauggg

SEQ ID NO: 55380 - RNA, 47 nt, Mus musculus
ggcagagugagugcuaagcauagaucaggcuugguuuugggccacag

SEQ ID NO: 55381 - RNA, 46 nt, Mus musculus
ucaaucacagcaggacaaggcagugugaugaguuauauggugccaa

SEQ ID NO: 55382 - RNA, 46 nt, Mus musculus
ugauccuggcuccaugugguucacucaggggguccccgguaaucua

SEQ ID NO: 55383 - RNA, 46 nt, Mus musculus
ugcauguacaguauguguaguaugugugugcagagucuguagagac

SEQ ID NO: 55384 - RNA, 44 nt, Mus musculus
augguugugagccaccauguaguugcugggauuugaacugagga

SEQ ID NO: 55385 - RNA, 41 nt, Mus musculus
guucuuuuuuucuaguuuguguucuugagucugacguguaa

SEQ ID NO: 55386 - RNA, 23 nt, Mus musculus
aauaugucaaagcugguaaaaca

SEQ ID NO: 55387 - RNA, 45 nt, Mus musculus
gcauggggaggggaguugagaggguaguagagacagagagaggga

SEQ ID NO: 55388 - RNA, 46 nt, Mus musculus
aaaagaaaaaguugcugugcucuagauaauaaaugaaccccccugg

SEQ ID NO: 55389 - RNA, 46 nt, Mus musculus
uaacauguguagaggcuugguggugaagaggguaagccaugcagug

SEQ ID NO: 55390 - RNA, 42 nt, Mus musculus
gcaggggcagaggggcagaggggcaggggcagaggcaggcag

SEQ ID NO: 55391 - RNA, 46 nt, Mus musculus
uaaguacacuguagcugucuucagauacuccagaagagggugccag

SEQ ID NO: 55392 - RNA, 42 nt, Mus musculus
uagagaagaaguucgugcuccaauuccucaaaagcaagaaau

SEQ ID NO: 55393 - RNA, 45 nt, Mus musculus
aaacaggaaaauaagagauccauuuuaaauuuuguagaaauguua

SEQ ID NO: 55394 - RNA, 46 nt, Mus musculus
gguugccaugccaauuaggcaaguacuuuuaaugcuaagccccauc

SEQ ID NO: 55395 - RNA, 46 nt, Mus musculus
aacagaaauuuauaaaaauaugaaacuauauugguucucucaugag

SEQ ID NO: 55396 - RNA, 46 nt, Mus musculus
cuggcuauguagacugggcuaaccuugaacucagaucugccugccu

SEQ ID NO: 55397 - RNA, 42 nt, Mus musculus
cauguauauaaguguuuuuuuuucuugcacaccagaagggag

SEQ ID NO: 55398 - RNA, 46 nt, Mus musculus
cuguaacuccaguuuuaggacaucugacauccucuucuggucacau

SEQ ID NO: 55399 - RNA, 42 nt, Mus musculus
auaagaaacuaaccacccuugcagaucuauuucggcccccaa

SEQ ID NO: 55400 - RNA, 45 nt, Mus musculus
auaaaaauuaaaacuauuauaccuucaauauauuugacauuucua

SEQ ID NO: 55401 - RNA, 42 nt, Mus musculus
gacuuugcaugccagugccucaaccgugauguauggagcaau

SEQ ID NO: 55402 - RNA, 46 nt, Mus musculus
gguaaauucagugggauuuuguuuuuauuauaaauuuguguaugua

SEQ ID NO: 55403 - RNA, 28 nt, Mus musculus
uucuuaaugaagucauaauauguaugug

SEQ ID NO: 55404 - RNA, 46 nt, Mus musculus
ccuuaaacagcucaguggcugggccacuuccuaaccuccaugcagc

SEQ ID NO: 55405 - RNA, 46 nt, Mus musculus
caucuuuacuaaagccuauauuccaucuuggcugccccgaacccag

SEQ ID NO: 55406 - RNA, 46 nt, Mus musculus
cacaugguggcucacaacuauccguaacaagaucuggugcccucuu

SEQ ID NO: 55407 - RNA, 46 nt, Mus musculus
ugccucugccuccugagugcugggauuaaagaaaggugugcgccac

SEQ ID NO: 55408 - RNA, 46 nt, Mus musculus
ugccaucagagccuccuugcaagagacacauuucgacucggcccag

SEQ ID NO: 55409 - RNA, 54 nt, Mus musculus
cuaaguccagaaagucuccucauaaagauuuggggcauagaaaagaggagaaca

SEQ ID NO: 55410 - RNA, 44 nt, Mus musculus
cauccauggauucugaggucuuggagaugucaccugaaaaguca

SEQ ID NO: 55411 - RNA, 46 nt, Mus musculus
aacucuucuuuaggaccaaaagcacagcugaugcugcgguacccag

SEQ ID NO: 55412 - RNA, 42 nt, Mus musculus
acaaccaucuguaaugagauccgacguccucgucuggucugu

SEQ ID NO: 55413 - RNA, 46 nt, Mus musculus
gaaagaaauuaacaccauggccugaccucucucagcuuaccccuuu

SEQ ID NO: 55414 - RNA, 46 nt, Mus musculus
aucaauuauauuccucuuuccaguccuaggaugaaacuuuaguaag

SEQ ID NO: 55415 - RNA, 46 nt, Mus musculus
uuggaugccuguguacgugcagaucucucucggcaacuaggggguu

SEQ ID NO: 55416 - RNA, 44 nt, Mus musculus
uuuauuuaauuuugacaaggcguaugauuaucaaggcuggccca

SEQ ID NO: 55417 - RNA, 44 nt, Mus musculus
agcuuuguguacuggggggagaacagugccaggggaagggagca

SEQ ID NO: 55418 - RNA, 25 nt, Mus musculus
uucuacucauuuauaaauguggaag

SEQ ID NO: 55419 - RNA, 46 nt, Mus musculus
ucccucaguacaguaguuacagaacuagugaucuuuaaacagccag

SEQ ID NO: 55420 - RNA, 46 nt, Mus musculus
aaagcugaauugugugaguugugaaguucagaauugguuugggcag

SEQ ID NO: 55421 - RNA, 46 nt, Mus musculus
uacuuuauuaagcauaaugaagaaguuauuaaaauuugcuuguggg

SEQ ID NO: 55422 - RNA, 46 nt, Mus musculus
uucuuuccugcaucaagauaacugaugguauaguaugugucaccag

SEQ ID NO: 55423 - RNA, 44 nt, Mus musculus
uaguaugcuugugaguuuccagguuucuucccacagugcuagga

SEQ ID NO: 55424 - RNA, 46 nt, Mus musculus
ccugcaagccuagccggcuggggcugcccgaggggccaagguccau

SEQ ID NO: 55425 - RNA, 45 nt, Mus musculus
cucugggcucuggggaggaggccucaugguaugugucugggguuc

SEQ ID NO: 55426 - RNA, 42 nt, Mus musculus
gagcaaagaugugaauggcccggaaccccucaacagccggag

SEQ ID NO: 55427 - RNA, 46 nt, Mus musculus
gauguagaacagaagaugagcauccgauuucuucacuaaagggcag

SEQ ID NO: 55428 - RNA, 66 nt, Mus musculus
gguguauaaacagggcguuacagaaugguacccucugucugcuucuguucaguaucuacccaccag

SEQ ID NO: 55429 - RNA, 50 nt, Mus musculus
cugagugccaugcauccauccugucuggggaaaugaaccagccagcaaag

SEQ ID NO: 55430 - RNA, 47 nt, Mus musculus
uuguguccuuuugucuuugugucuguuacuuccuaccucucaaucau

SEQ ID NO: 55431 - RNA, 46 nt, Mus musculus
augugucucugggacguugccuauccaggagcuuuucagcaagcag

SEQ ID NO: 55432 - RNA, 41 nt, Mus musculus
ggcgcggggaagggauccgagggggaccggagccuggagga

SEQ ID NO: 55433 - RNA, 46 nt, Mus musculus
guuuuucuuucuguaaugauucuaugauuaaggaacugcagagaag

SEQ ID NO: 55434 - RNA, 45 nt, Mus musculus
cuucauauucuauucaaucuuuaugguuggagagucuacaaguaa

SEQ ID NO: 55435 - RNA, 45 nt, Mus musculus
auucccagcaaccacaugguggcucacaaccaccuguaacaggga

SEQ ID NO: 55436 - RNA, 47 nt, Mus musculus
cagggcuacacugagaaacugucucaaaaaaaccaaaaggaggagca

SEQ ID NO: 55437 - RNA, 46 nt, Mus musculus
aaugggauggcccauagguuuaaauauuuaaguauuuaguccccag

SEQ ID NO: 55438 - RNA, 46 nt, Mus musculus
gcauuuaauuuuaguacacuuauucauuuuuuuacuucuucauuga

SEQ ID NO: 55439 - RNA, 46 nt, Mus musculus
aaaaaagauuuauuuuuauguaugugaguacacuguagcuguacag

SEQ ID NO: 55440 - RNA, 62 nt, Mus musculus
cuacaaaaacuuugggauugcauuugccauguccauauuauccagaauaauuuucuugcccu

SEQ ID NO: 55441 - RNA, 45 nt, Mus musculus
uuacuuauuaguaaucaaggcaaacugaaaaugagaauguuagca

SEQ ID NO: 55442 - RNA, 46 nt, Mus musculus
ugaugagcuaacgcacaacuucaagggcuucacugugaugaacgag

SEQ ID NO: 55443 - RNA, 42 nt, Mus musculus
caucaucacccgcauuguccgugacuaugauguguaugcaag

SEQ ID NO: 55444 - RNA, 45 nt, Mus musculus
uagagcauuuauaccauuuuacacuaauguuuagggauguuggca

SEQ ID NO: 55445 - RNA, 79 nt, Mus musculus
accacuugcaagaacgaguugauaaaguaaagaagaaagugaaagauguggaggaaaagucaaaagaguuugugcagaa

SEQ ID NO: 55446 - RNA, 103 nt, Mus musculus
agaagugggaggagaagucccgagaguucauuggaaguuuccuggaaauguuugguccagaaggagcacuggugcgagccuuucuuccugacacuugagggaa

SEQ ID NO: 55447 - RNA, 46 nt, Mus musculus
ugcagcccuauauuuguugguugguuuauuuauuauuuuuuugaga

SEQ ID NO: 55448 - RNA, 102 nt, Mus musculus
aacuuguaauacuaauagcuucagccuccagucgauaaacaagugaauucaagagaauugcaaugcugugaaguggaaagaaauagagaaucuuugagcaga

SEQ ID NO: 55449 - RNA, 55 nt, Mus musculus
cugaaggagggaaaaggucggaugcugcaggccaucagucccaagcagagcccca

SEQ ID NO: 55450 - RNA, 62 nt, Mus musculus
gcagcagcccuacucaugagcgcucccccucccccuccuuucgguggcccuucucuggcaag

SEQ ID NO: 55451 - RNA, 47 nt, Mus musculus
agaagcucucugucgaauuccauuuugugaucccaacacuaaaccua

SEQ ID NO: 55452 - RNA, 46 nt, Mus musculus
gcaagaggaccugggaauggggaaccaaaacagcccaugcccugag

SEQ ID NO: 55453 - RNA, 47 nt, Mus musculus
uuucaaauauaguaaguagaacuaauuuuuugccccugaggaauggg

SEQ ID NO: 55454 - RNA, 45 nt, Mus musculus
uccugcaccccaccuguaaaggaagggacauuuugagggcuacug

SEQ ID NO: 55455 - RNA, 41 nt, Mus musculus
gccauggcagccacuccugggagcuaagccugagacccuaa

SEQ ID NO: 55456 - RNA, 47 nt, Mus musculus
agcuguggggaaggaagcugucagcagagccagaugaccacaggaac

SEQ ID NO: 55457 - RNA, 44 nt, Mus musculus
gggguaugggcggaaaagagaaagaaagagagggugugcacaga

SEQ ID NO: 55458 - RNA, 46 nt, Mus musculus
uguauguagugcaaaugaagccagucuuugcuggagaagggccugg

SEQ ID NO: 55459 - RNA, 41 nt, Mus musculus
agaggagaggagaggagaggagaggagaggagaggccagcu

SEQ ID NO: 55460 - RNA, 45 nt, Mus musculus
accauaugacauaguauggaauagaguuuauuuagggcgugggca

SEQ ID NO: 55461 - RNA, 45 nt, Mus musculus
ucaagggagggggggauuuauaaaaaaaggagaaccagggauaug

SEQ ID NO: 55462 - RNA, 44 nt, Mus musculus
agacauacuugcuguuagaaguccuguucccagcaggccugaaa

SEQ ID NO: 55463 - RNA, 45 nt, Mus musculus
gaaaaaacgagauuagucaaccaaaaauuaaaaggcaugggagca

SEQ ID NO: 55464 - RNA, 32 nt, Mus musculus
caaguugucgagugggguaugguggcgcccaa

SEQ ID NO: 55465 - RNA, 45 nt, Mus musculus
aaucccuggcgaacaauaaaauaccuaaauacauaaauaguccag

SEQ ID NO: 55466 - RNA, 46 nt, Mus musculus
uaauuuucuacaagucucuuguaauuuccugaaccuaccccuuggc

SEQ ID NO: 55467 - RNA, 46 nt, Mus musculus
aaagauaacgccuaaagauuugagagguaagauggcugaagcaggc

SEQ ID NO: 55468 - RNA, 46 nt, Mus musculus
ccuuaccuugcauucacaauuccguuuccccucgcaaagaccagag

SEQ ID NO: 55469 - RNA, 42 nt, Mus musculus
ggugccaaacuacagcuauggagcaggcaccuccggaccccg

SEQ ID NO: 55470 - RNA, 42 nt, Mus musculus
uccucaccgaccgcggccuccagcacagcgccagggccaccc

SEQ ID NO: 55471 - RNA, 58 nt, Mus musculus
ccuggcugggucuggugggugcggucccgagaccggaggaugacccgaugcggagugg

SEQ ID NO: 55472 - RNA, 42 nt, Mus musculus
gcccgcggugucagugggcgcgucccccggggucuggcccug

SEQ ID NO: 55473 - RNA, 45 nt, Mus musculus
uuuaggcauuuuaguuucaaaugggaguuaggugugugugugugu

SEQ ID NO: 55474 - RNA, 46 nt, Mus musculus
uuguuuacacauuggggaaaaauucaguuuaaugaacguuccaugu

SEQ ID NO: 55475 - RNA, 48 nt, Mus musculus
accucuugcucugcagucaccuugcccuuccccccaccauuugaguaa

SEQ ID NO: 55476 - RNA, 41 nt, Mus musculus
uuuuagugugugugugugugugugugugugugcgugcgugu

SEQ ID NO: 55477 - RNA, 44 nt, Mus musculus
cucaacucccuagugauuccuccccgugucuggagggggacaga

SEQ ID NO: 55478 - RNA, 54 nt, Mus musculus
aagugaguccugcucacuagaggcagugaaggacaggggagagauggagggagg

SEQ ID NO: 55479 - RNA, 45 nt, Mus musculus
aucauuguuuccaaagauggccuuggagucauuagacccugagau

SEQ ID NO: 55480 - RNA, 46 nt, Mus musculus
uaaaaccaugcggcaacaauuaaggacccucagcagaacaggagag

SEQ ID NO: 55481 - RNA, 46 nt, Mus musculus
agaggagagguuuggaagcccugcucuaggauauuuuugcccaagg

SEQ ID NO: 55482 - RNA, 46 nt, Mus musculus
ucuucccuucuacucuuccuuaaccagcccugcaugcagcaaagcc

SEQ ID NO: 55483 - RNA, 42 nt, Mus musculus
acaguguaaucacauauaauaaauaaauaaaucuugagagag

SEQ ID NO: 55484 - RNA, 45 nt, Mus musculus
uugguuguguuguguugggcuggauuggguuugguuggguuaggu

SEQ ID NO: 55485 - RNA, 46 nt, Mus musculus
agaaaaaaagacacaaaguugaguggguaaggaacaggggugaauc

SEQ ID NO: 55486 - RNA, 46 nt, Mus musculus
aagugacuaggcaggccucagaacugaggcagugagguuuguauaa

SEQ ID NO: 55487 - RNA, 45 nt, Mus musculus
uaagugugugugugugagugugugugugaguauguguguaugaau

SEQ ID NO: 55488 - RNA, 45 nt, Mus musculus
gugaaugaguauaaaugugugaguguauguguuuguguauauaug

SEQ ID NO: 55489 - RNA, 61 nt, Mus musculus
gaauagaguagaguagaguagaguagaguagaguagaguagaguagaguagaguagaguag

SEQ ID NO: 55490 - RNA, 46 nt, Mus musculus
ugaaagaagaggccacgcauucuacagagaggaaggcuuuggaggg

SEQ ID NO: 55491 - RNA, 44 nt, Mus musculus
aaacccugucucgaaaaacaaacaaacaaacaaaggaagcuggg

SEQ ID NO: 55492 - RNA, 44 nt, Mus musculus
cggauauggguauuaugacacaugggaaagggggagaaggaacg

SEQ ID NO: 55493 - RNA, 46 nt, Mus musculus
auccuucaucugccuugccuggugucugguucugagcaaaggaggg

SEQ ID NO: 55494 - RNA, 46 nt, Mus musculus
cuuauguauaauaauaaauaaaucuuuaaaaaaaaaaaaaagcaga

SEQ ID NO: 55495 - RNA, 90 nt, Mus musculus
ggagagagggagagagggagagggggagagagggagagagggagagagggagagggggagagagggagagggggagaaggagagagggag

SEQ ID NO: 55496 - RNA, 42 nt, Mus musculus
agggggagagagggagagagggagagagggagagggggagag

SEQ ID NO: 55497 - RNA, 45 nt, Mus musculus
ccaaccaaccaaccaaccaaccaaccugggaaauaggauggggag

SEQ ID NO: 55498 - RNA, 24 nt, Mus musculus
ccuugcagggaaaaagguggagug

SEQ ID NO: 55499 - RNA, 41 nt, Mus musculus
cauuacuguauaaauugcaaauuuaugacgacaacccuagg

SEQ ID NO: 55500 - RNA, 46 nt, Mus musculus
cucuggggacagagacucgggcacaucuaaaauagccugacagagg

SEQ ID NO: 55501 - RNA, 46 nt, Mus musculus
uguaguucuugggggcuuaguguuaccuccucaggggggugcagac

SEQ ID NO: 55502 - RNA, 45 nt, Mus musculus
guguguguguguguguguguguguguagugcagugccuaugaagg

SEQ ID NO: 55503 - RNA, 42 nt, Mus musculus
ggggagugugguagagaugagcaggaagugggcaaggcagau

SEQ ID NO: 55504 - RNA, 45 nt, Mus musculus
uucuagaaggugggaggagucauaagaaggugggcagagucagca

SEQ ID NO: 55505 - RNA, 61 nt, Mus musculus
caugcaugcaaagaacaugaacaagaaaagaaaggggaggaaaggaaggaaagggaggggg

SEQ ID NO: 55506 - RNA, 41 nt, Mus musculus
ggagauggagaaauaguguggggcuggauggucggucgggu

SEQ ID NO: 55507 - RNA, 45 nt, Mus musculus
gucagcaugacugcuacccacuagucuacagugauggcaccagau

SEQ ID NO: 55508 - RNA, 46 nt, Mus musculus
ucuucucuucucuccucuccucuccucuccucuccucuccccuccc

SEQ ID NO: 55509 - RNA, 46 nt, Mus musculus
gccaaaagaaaccaagguagcagugguuuuaaucuuauauuaagaa

SEQ ID NO: 55510 - RNA, 45 nt, Mus musculus
ggcaucaagaaagguucugguccuuugggcuuuuggauguuaaau

SEQ ID NO: 55511 - RNA, 46 nt, Mus musculus
aguccccccauacaggaagccagggaugagauguacaggcccaaua

SEQ ID NO: 55512 - RNA, 49 nt, Mus musculus
aucugggaauggagucaaggcagagaaagaaagggagagaagggagagg

SEQ ID NO: 55513 - RNA, 42 nt, Mus musculus
ugcacagacauacaugcagacaccacacacacacacacacac

SEQ ID NO: 55514 - RNA, 46 nt, Mus musculus
guguaugucugugguguguguauauguguguuuguguguaugagug

SEQ ID NO: 55515 - RNA, 46 nt, Mus musculus
ucagaaguccucguaggaaaggacaaaggagacccaggguccaaga

SEQ ID NO: 55516 - RNA, 46 nt, Mus musculus
uaucacaggccagagagcaaaggagagcagagagagcaccagcagc

SEQ ID NO: 55517 - RNA, 46 nt, Mus musculus
acccugagaucccaaaacacaacaaacagaaaccgagaagcuagaa

SEQ ID NO: 55518 - RNA, 46 nt, Mus musculus
guaugcacagacagaugguuugcaacuuacuguagaagcuccagau

SEQ ID NO: 55519 - RNA, 75 nt, Mus musculus
ugaggaaagagaaggaaaauaaagaaggagagggacugagagaggaggaagagggagggagagagggaggaggaa

SEQ ID NO: 55520 - RNA, 46 nt, Mus musculus
auaugaaaaauaauuuaaaaauuuuuugcaauaaaagagagaagga

SEQ ID NO: 55521 - RNA, 46 nt, Mus musculus
ggcacuugggaggcagaggcaggaagauaugaguuugaggccagcc

SEQ ID NO: 55522 - RNA, 41 nt, Mus musculus
gagugucaccagggcaguggcaccaacuaccuuuggccuga

SEQ ID NO: 55523 - RNA, 49 nt, Mus musculus
aaaucccagcaaccacaguggcucacaaccauccguaacgagaucugau

SEQ ID NO: 55524 - RNA, 42 nt, Mus musculus
aaaagauauccuauaaaaagaaaagaaggaaggaaggaagga

SEQ ID NO: 55525 - RNA, 46 nt, Mus musculus
agcgcuaacuggacucaguguuauuacacaaaaagaaggcaugaaa

SEQ ID NO: 55526 - RNA, 45 nt, Mus musculus
guguaguuaguauacauuacaaaauaaauaaaacaggggagggug

SEQ ID NO: 55527 - RNA, 42 nt, Mus musculus
gggagccuucagcuucuuugagaccuuguuucuggaccgauc

SEQ ID NO: 55528 - RNA, 46 nt, Mus musculus
ugucacaguuugaugaaacauucacuuaaauacgaaccaucaaugg

SEQ ID NO: 55529 - RNA, 30 nt, Mus musculus
caaacuuaaaauuguuauuggaguuuaaaa

SEQ ID NO: 55530 - RNA, 42 nt, Mus musculus
ugggugcuaugcagauuauaaaucauuagugauuaagucaaa

SEQ ID NO: 55531 - RNA, 46 nt, Mus musculus
cggaaaacagaugcaauucuaaaccuuuagaaggcagaaagaacag

SEQ ID NO: 55532 - RNA, 46 nt, Mus musculus
acuaaaagcuaauugugugugugugugugugugugugugugugugu

SEQ ID NO: 55533 - RNA, 46 nt, Mus musculus
gagcagccaaugcucuuaacugcugaaccaucucuccagccccaaa

SEQ ID NO: 55534 - RNA, 49 nt, Mus musculus
uuaauuaaugccuaggccacaagcuuuggcucauuccccugacuagcuc

SEQ ID NO: 55535 - RNA, 86 nt, Mus musculus
ccucaugguuaguuaccucuccucagcuucaugcacccaaguccagggcgaauuuccuuuuaauucuauccugaguucaucuaccu

SEQ ID NO: 55536 - RNA, 73 nt, Mus musculus
gcugguuaguuagcucuccuccagucccaccugcuucuuccucagcaucuggcucucaaauuucccaugccuc

SEQ ID NO: 55537 - RNA, 47 nt, Mus musculus
gucuuuccuuaucacguccugccuuuauucuuacugaaccugaagcu

SEQ ID NO: 55538 - RNA, 46 nt, Mus musculus
cagcuccuggggauggaaacucugguucuugugcuugagccagcag

SEQ ID NO: 55539 - RNA, 46 nt, Mus musculus
uauguggcugcuuucguacuacgguggcauugaguaguugugacag

SEQ ID NO: 55540 - RNA, 34 nt, Mus musculus
gggcugugcuguguugugcuguguugugcugugu

SEQ ID NO: 55541 - RNA, 45 nt, Mus musculus
cauccuaaaugaaugaaaccauuaauaagcgccauuaaaaucggg

SEQ ID NO: 55542 - RNA, 45 nt, Mus musculus
ugucucuacugcuuaucaauaacaugauugaagcauuagcuggag

SEQ ID NO: 55543 - RNA, 49 nt, Mus musculus
uguuugaguaacaaacaccccacuaagcuaucauccccagcccugccag

SEQ ID NO: 55544 - RNA, 34 nt, Mus musculus
cuugagcucuguauacguucaguaaugcccauca

SEQ ID NO: 55545 - RNA, 61 nt, Mus musculus
auuccccacacugucagacagcucaguggguuugcuuaauuagugaagggacucugcaauc

SEQ ID NO: 55546 - RNA, 48 nt, Mus musculus
uucccauggacuucaguaggauagugccugugagccaugugugccuga

SEQ ID NO: 55547 - RNA, 82 nt, Mus musculus
auuaccuuugucuccuugugagucuuacauuacauggcccuccaugcuuaggcauugccugagccuggcuuugcuagcagua

SEQ ID NO: 55548 - RNA, 78 nt, Mus musculus
cuucugcagugcuugaaucuauuggguaacuguugucagaauaggagcaguauucuuugaaucaccaauuuuccagua

SEQ ID NO: 55549 - RNA, 46 nt, Mus musculus
uguaggugcuaacccaagcuauuuucuaaguucauuuugugaccug

SEQ ID NO: 55550 - RNA, 48 nt, Mus musculus
uuuuuucuuuuguuuucuacugagaagcaaggacaaggaaccaggugg

SEQ ID NO: 55551 - RNA, 48 nt, Mus musculus
uuuugacuggggaaaccuaauuacuuacuuucaaaagaacuugggaug

SEQ ID NO: 55552 - RNA, 50 nt, Mus musculus
aucuaaugaagcuucuacugggagugacacagcacagcguuggucacuac

SEQ ID NO: 55553 - RNA, 55 nt, Mus musculus
ggauuaaaaacguuuaacucuuaagaacaguagugagagagaaagagaagaaauc

SEQ ID NO: 55554 - RNA, 45 nt, Mus musculus
cacaaacauuuuuauuucugugguccuaaaaauugaacccagcac

SEQ ID NO: 55555 - RNA, 44 nt, Mus musculus
agagggaucuacuuaagcucugaaaaucuagccuuuguugugca

SEQ ID NO: 55556 - RNA, 37 nt, Mus musculus
agccagacugcugaaaaaaucagacuugccaagugcu

SEQ ID NO: 55557 - RNA, 46 nt, Mus musculus
ucauggcagcagcagugacagcaguggcacugguguccccuguccu

SEQ ID NO: 55558 - RNA, 47 nt, Mus musculus
guaaggauaauaguaucucauucuaaucucagcaacccaaggagaua

SEQ ID NO: 55559 - RNA, 108 nt, Mus musculus
aaugaagucauugaaauaauuggccaaagaaugaaaaaaaaaaucucaauuagaaaggaggaaggacuaauguaaaaaacuauugugcaggauggugagugaugauag

SEQ ID NO: 55560 - RNA, 41 nt, Mus musculus
cccaggagcuagcaaaagagaugaaggaagcagcaggcaca

SEQ ID NO: 55561 - RNA, 46 nt, Mus musculus
uguacucuguuacaguaaguuucucuccaugccacauuuuaagguu

SEQ ID NO: 55562 - RNA, 46 nt, Mus musculus
aaaaauaauaaacccaaggccuugcacaugcccuaucacugagcua

SEQ ID NO: 55563 - RNA, 42 nt, Mus musculus
uuugcauauguauaguuauuucugaguaagcuuguccaggag

SEQ ID NO: 55564 - RNA, 45 nt, Mus musculus
agcuuucuuacaggaauugcuuguuauauuuuuuuccaggccuuc

SEQ ID NO: 55565 - RNA, 46 nt, Mus musculus
ugggguuuguaguuucauuuauuuagauuuuguguuugguuuuggg

SEQ ID NO: 55566 - RNA, 50 nt, Mus musculus
ccucccacuguaaaaacagccuucucugcccaagaccaagaacaccacag

SEQ ID NO: 55567 - RNA, 44 nt, Mus musculus
cauaagguuuacaguaugaauucccuccugugcagcaggccuca

SEQ ID NO: 55568 - RNA, 45 nt, Mus musculus
gccuucccacaucaaucauaagucaagaaaaugcccauaggccaa

SEQ ID NO: 55569 - RNA, 45 nt, Mus musculus
uauugauauaaaaaaugucauuggaaguguuuaauaaauugugug

SEQ ID NO: 55570 - RNA, 46 nt, Mus musculus
uucccuucagucgcugaauaugucgcugcagaaucagcugcaagag

SEQ ID NO: 55571 - RNA, 46 nt, Mus musculus
ggaauaacacugcgccagcgagaugcugagguugcacgacuuagag

SEQ ID NO: 55572 - RNA, 45 nt, Mus musculus
ggguaggucacuucauuucaucagaaaagugacagauucggccau

SEQ ID NO: 55573 - RNA, 46 nt, Mus musculus
acugugaaacccucacuguaauagaagauggguguaacguggacag

SEQ ID NO: 55574 - RNA, 45 nt, Mus musculus
gaugccaauauugcucgacuucagaaguccuuaaagaccggccuu

SEQ ID NO: 55575 - RNA, 45 nt, Mus musculus
gagagaagaaaguuguagaugagcaaguacuguggugcguuauuu

SEQ ID NO: 55576 - RNA, 45 nt, Mus musculus
guggcuaugcccuacucccuccauaagagcaaaggugccccagag

SEQ ID NO: 55577 - RNA, 42 nt, Mus musculus
gacaaucaccgggcaguguuuuuacuacucuuugggggagag

SEQ ID NO: 55578 - RNA, 45 nt, Mus musculus
acauuccaaaggcucucugcaaagguaaaggccucacacagaggg

SEQ ID NO: 55579 - RNA, 45 nt, Mus musculus
agagacuggcagggguuugaggaaagguaauuuggcuuaguaguc

SEQ ID NO: 55580 - RNA, 46 nt, Mus musculus
acuuaaagaagaaggacaguccccacagggguuuaagugccaaccg

SEQ ID NO: 55581 - RNA, 34 nt, Mus musculus
ggcaacugcucgcucaucaucagcgacgucugug

SEQ ID NO: 55582 - RNA, 79 nt, Mus musculus
gcugucaacagccucggagaagccaccugcacugcggagcucaucguggagaccauggaggaaggggaaggggaggagg

SEQ ID NO: 55583 - RNA, 46 nt, Mus musculus
agauagcaccuuaaacacuagugcagcuagauuccauuugggagag

SEQ ID NO: 55584 - RNA, 46 nt, Mus musculus
uacucacuuagaaaaggucaaacauuucccaguuuaacgcacccug

SEQ ID NO: 55585 - RNA, 45 nt, Mus musculus
ggcacacagguacugaguuuaugccagaaacucucuccaccccca

SEQ ID NO: 55586 - RNA, 41 nt, Mus musculus
caggaacauccuggccagggcacaaagggcaugaacccaca

SEQ ID NO: 55587 - RNA, 46 nt, Mus musculus
acugggcgaguaggugggacuuccggguuggauggaggaagaggag

SEQ ID NO: 55588 - RNA, 46 nt, Mus musculus
gauuuaauagggcuugcaagauaagguuuuaguuguugugccugag

SEQ ID NO: 55589 - RNA, 46 nt, Mus musculus
aaagcguggguucgccugauguucaccacaaaggccaugggggcuu

SEQ ID NO: 55590 - RNA, 43 nt, Mus musculus
gguugugagccaccaugugguugcugggauuugaacuuggcaa

SEQ ID NO: 55591 - RNA, 46 nt, Mus musculus
uuacuuaauuuguuuuggauuguuuuaacuuucaaaauggguguga

SEQ ID NO: 55592 - RNA, 40 nt, Mus musculus
augggggcggcaguggccgagucggggcuggcgacagcag

SEQ ID NO: 55593 - RNA, 45 nt, Mus musculus
ugugaucacguccuggugugaugacuguucugugguggcugugga

SEQ ID NO: 55594 - RNA, 45 nt, Mus musculus
auuuaucaggucugucaaggucaugacugagaaguuauuacagau

SEQ ID NO: 55595 - RNA, 47 nt, Mus musculus
auuacauaugcuuaacucaaucuuggaacacuggacacauccaaauu

SEQ ID NO: 55596 - RNA, 45 nt, Mus musculus
uuuggcaauagcagcaaggccgugaaagaaauacugccacugaga

SEQ ID NO: 55597 - RNA, 46 nt, Mus musculus
uaaggucuauauauaaauucugugccaguuugagaaugccagugaa

SEQ ID NO: 55598 - RNA, 45 nt, Mus musculus
auguggguguuuauaucaacuuaguuaugauuucaagggaacagc

SEQ ID NO: 55599 - RNA, 42 nt, Mus musculus
caagagauguuugucauaauguacaaauaacuaacacauaaa

SEQ ID NO: 55600 - RNA, 45 nt, Mus musculus
agauacugcaaguugaguaaacaggaauuuagagugggucauaga

SEQ ID NO: 55601 - RNA, 46 nt, Mus musculus
aagaauaaacaguacaucaccaugacagaauugaaagauaagagau

SEQ ID NO: 55602 - RNA, 42 nt, Mus musculus
ccuucauuuacaaggguuuaggagcccuguguuagggcagac

SEQ ID NO: 55603 - RNA, 46 nt, Mus musculus
uacuaaguucuuagagccgggagggaagagucccugugauucagaa

SEQ ID NO: 55604 - RNA, 46 nt, Mus musculus
auacuuguaccacauugcaaauuguacacauauuugggcaguaguu

SEQ ID NO: 55605 - RNA, 46 nt, Mus musculus
uuuaggcacaauuauaaagccuaauaacuauaaaaugaucaugaag

SEQ ID NO: 55606 - RNA, 42 nt, Mus musculus
uucacauauuccuucugaagcccucccuccccaccccccuuc

SEQ ID NO: 55607 - RNA, 45 nt, Mus musculus
uuagaggcaggcacuagauaggaccuuaaacuuacgucuggaagg

SEQ ID NO: 55608 - RNA, 46 nt, Mus musculus
aggaagcaggaaugggugaguuggugagcagggaguugggggagau

SEQ ID NO: 55609 - RNA, 81 nt, Mus musculus
uuauuauagaaaugcaggggaaagagagaaggagaaaggaggaaaagagagagagaagagaggaaagaagaagacaaagag

SEQ ID NO: 55610 - RNA, 46 nt, Mus musculus
uuacuguugagagugcuaaacagaaguaauauuggaagucccagga

SEQ ID NO: 55611 - RNA, 45 nt, Mus musculus
guacagggggaguggagaagauaguguucuggaaucuucuuggga

SEQ ID NO: 55612 - RNA, 46 nt, Mus musculus
uucaaagucauccucagcuguguaaaaguuuaaagaaccugggaua

SEQ ID NO: 55613 - RNA, 46 nt, Mus musculus
gagagaagagagagagagagagagaggggauggaggaagggagaaa

SEQ ID NO: 55614 - RNA, 48 nt, Mus musculus
ugcuguguguguguguaugugugugugagagagagagagagagaagga

SEQ ID NO: 55615 - RNA, 46 nt, Mus musculus
guacauguggcauaaacaaggcuguauauaauacaugguggguuag

SEQ ID NO: 55616 - RNA, 45 nt, Mus musculus
augucaggagcaggacuuugacaggacuacucauuguggauagga

SEQ ID NO: 55617 - RNA, 45 nt, Mus musculus
gguuggcuuuggaauuuaaaaaaaaaucagauuguguauuugaga

SEQ ID NO: 55618 - RNA, 46 nt, Mus musculus
guuuuuuagcuuuggaaaaccuucuugcuuggucuuguuguuuggu

SEQ ID NO: 55619 - RNA, 46 nt, Mus musculus
uggggaggcagaggcaagcugacagcugauacuaacuguggcaggu

SEQ ID NO: 55620 - RNA, 46 nt, Mus musculus
gcuggggagauucuggguggaagcuccagcaggagcagggucagag

SEQ ID NO: 55621 - RNA, 23 nt, Mus musculus
cugaggaggagggacagugaaau

SEQ ID NO: 55622 - RNA, 33 nt, Mus musculus
aacugagaagauaacuccauaauauagggcugu

SEQ ID NO: 55623 - RNA, 46 nt, Mus musculus
aaugagcuagauagagccagaggccuuacagguaaagccaccagag

SEQ ID NO: 55624 - RNA, 41 nt, Mus musculus
gggucuguuugcuauaugaauucugucguccagucagccgg

SEQ ID NO: 55625 - RNA, 41 nt, Mus musculus
gucuucagacguguguggcacacguguaaaguccagcaccc

SEQ ID NO: 55626 - RNA, 45 nt, Mus musculus
gucucacauuaauuuaaugacuacuagguaauaauagugcaggac

SEQ ID NO: 55627 - RNA, 48 nt, Mus musculus
acuuuaguagugcaccuuugcuugggugcacaugcaaugggagaaaag

SEQ ID NO: 55628 - RNA, 45 nt, Mus musculus
ucagggaauccuaugacagacucuaccuugacguggucgucucgg

SEQ ID NO: 55629 - RNA, 46 nt, Mus musculus
uccugauggcauuaaaucagauaacagccacaccaccugcuuggau

SEQ ID NO: 55630 - RNA, 46 nt, Mus musculus
ugagugacccagcaagucgcucaggacuguccaguuacuccuagac

SEQ ID NO: 55631 - RNA, 45 nt, Mus musculus
ugcuuguagaugaucaaacuguaagcauggugacauugagaaaga

SEQ ID NO: 55632 - RNA, 46 nt, Mus musculus
gaccagggauguuacaccuaagaaggagagugcugugguguuagau

SEQ ID NO: 55633 - RNA, 45 nt, Mus musculus
gcguaauucagcaacuuuaagaugaauacuugccuauggaguaga

SEQ ID NO: 55634 - RNA, 45 nt, Mus musculus
uguggaguugucaccuuuuuaaguaauauguucaugggagugcuu

SEQ ID NO: 55635 - RNA, 46 nt, Mus musculus
cuccugcauccuccugggaguguuccugaacagcagcguccccaua

SEQ ID NO: 55636 - RNA, 46 nt, Mus musculus
acuagaaugugcgaugguguuacccagcaacuccagggugagaggg

SEQ ID NO: 55637 - RNA, 45 nt, Mus musculus
aauuaacugaaguguuuacaacaggacaaauaaauaaccucguga

SEQ ID NO: 55638 - RNA, 46 nt, Mus musculus
augucuguguacgacaugcaugcaugcagugcccauggaggcccaa

SEQ ID NO: 55639 - RNA, 42 nt, Mus musculus
cagguaucugauucauauugcaaauaauuuuuagccacagug

SEQ ID NO: 55640 - RNA, 46 nt, Mus musculus
auauauacacacacgcacuuguguguguguguauguacauccagau

SEQ ID NO: 55641 - RNA, 46 nt, Mus musculus
gguaagcacagagaucugagaucagauccccauaaccuguguaaag

SEQ ID NO: 55642 - RNA, 41 nt, Mus musculus
agagaagagagcacagcuacccaacuggaaaagggggcagg

SEQ ID NO: 55643 - RNA, 45 nt, Mus musculus
acaccugcauagagucagacauuacagucaguuuuaaaggcagaa

SEQ ID NO: 55644 - RNA, 47 nt, Mus musculus
uaccaacaaacauggucaaucacauaucaaauaaauacaggaaagaa

SEQ ID NO: 55645 - RNA, 45 nt, Mus musculus
gaccaagcauuucguaucuccugggggacacaucuuggggcagac

SEQ ID NO: 55646 - RNA, 41 nt, Mus musculus
ggcagaggugacaagugccccgagcacaugggccugaaggc

SEQ ID NO: 55647 - RNA, 46 nt, Mus musculus
cuuccucccagugucgcugcugcgagccagcggcugaguuaccggc

SEQ ID NO: 55648 - RNA, 46 nt, Mus musculus
uucagaauuuggaguugucugccuaauauucucugccacgcuagcu

SEQ ID NO: 55649 - RNA, 46 nt, Mus musculus
aaauaagaugcgagagagagagagagagagagagagagagagagag

SEQ ID NO: 55650 - RNA, 46 nt, Mus musculus
guggcccucagggcuuguuuucugcgcagggcauugggggccacag

SEQ ID NO: 55651 - RNA, 33 nt, Mus musculus
cgcagaacugagccaggggcauuucuuugagaa

SEQ ID NO: 55652 - RNA, 45 nt, Mus musculus
gguacuuuucaauguguuauuaacuucuuuagggaguaggucuga

SEQ ID NO: 55653 - RNA, 46 nt, Mus musculus
gccauuaguuaugugacugagacuccacgcagugcuuucuagagaa

SEQ ID NO: 55654 - RNA, 42 nt, Mus musculus
cagaaggcugggagcugagagcaaguuacuaaagucuaagag

SEQ ID NO: 55655 - RNA, 46 nt, Mus musculus
ccagauuuaaagcaaccuuuauuuaauauuaaauacugaccaagag

SEQ ID NO: 55656 - RNA, 42 nt, Mus musculus
gagaaucucuguuucgaaacaaacaaacagaaagugagagag

SEQ ID NO: 55657 - RNA, 45 nt, Mus musculus
aaagaaaugggaagcaaaucaagacacuuuucaaauacaucaaug

SEQ ID NO: 55658 - RNA, 45 nt, Mus musculus
gcuuuuguuuuguaaaagaaagccagaaaagucacacgggucccg

SEQ ID NO: 55659 - RNA, 46 nt, Mus musculus
acucuuggcuucacgggguucucagaaugacaggauggccugugug

SEQ ID NO: 55660 - RNA, 46 nt, Mus musculus
guauguguauguauuaugcacaccuugugcaugccuggugccugug

SEQ ID NO: 55661 - RNA, 45 nt, Mus musculus
gugugugugugugugugugugugugugagugagagagagauuggu

SEQ ID NO: 55662 - RNA, 65 nt, Mus musculus
gugccuucucuuucaaucuguuccugggacaaauaccaugcccaaaagcaucuuaggggaggaaa

SEQ ID NO: 55663 - RNA, 46 nt, Mus musculus
agcuaucgagcugcuuaaggcguauuucaaauauaaaggcugagug

SEQ ID NO: 55664 - RNA, 45 nt, Mus musculus
ugagaugagugcaggacagagaggcauggccgccaugugaaggag

SEQ ID NO: 55665 - RNA, 63 nt, Mus musculus
uugggaccaggagaagaggaagaagaucgagaugccaggagaaggugaaggagaggagagacg

SEQ ID NO: 55666 - RNA, 23 nt, Mus musculus
cugagaaacagagaggacuggca

SEQ ID NO: 55667 - RNA, 41 nt, Mus musculus
cggguguuguacuuuccaccccuuuccauucaccagcaagg

SEQ ID NO: 55668 - RNA, 45 nt, Mus musculus
aaaggaaggacucugguguaacuugggugugaagacccugcuagu

SEQ ID NO: 55669 - RNA, 46 nt, Mus musculus
cccaggaggcugcugugcacgauuuagacuucuuagguuaugaggu

SEQ ID NO: 55670 - RNA, 54 nt, Mus musculus
caggcuucucacuuugccaauugccagugugauucugugagaugaggaaaaggc

SEQ ID NO: 55671 - RNA, 46 nt, Mus musculus
acuuacaaacuaauuuacagugauaaaguaaguuguugauugucag

SEQ ID NO: 55672 - RNA, 46 nt, Mus musculus
agaaggcucagcaguuaaaagcacugacugcuuauccagaggaccc

SEQ ID NO: 55673 - RNA, 45 nt, Mus musculus
cuaauauaauuggaaaauaucugguagucuugcagauggccugaa

SEQ ID NO: 55674 - RNA, 46 nt, Mus musculus
ucaguaaguagagaccuaauggccucuucucuuucuguaccugaag

SEQ ID NO: 55675 - RNA, 46 nt, Mus musculus
ccccugauccauggaaccuguccuagaggaugcacuugcccugcca

SEQ ID NO: 55676 - RNA, 46 nt, Mus musculus
aauaagguggaucgggacaugggggugcaugccuuuaaugucagaa

SEQ ID NO: 55677 - RNA, 46 nt, Mus musculus
guuuuuguuguuguuuugaggcaaagucuccuuauguggcucaggc

SEQ ID NO: 55678 - RNA, 44 nt, Mus musculus
auauguguauguguguguguguguguguguaugugggugugugc

SEQ ID NO: 55679 - RNA, 45 nt, Mus musculus
gucagugaccuugacuggcuugccacaucaccuugcgcaggcaau

SEQ ID NO: 55680 - RNA, 54 nt, Mus musculus
uacaucacuucuugagugagcagcuuuuggaacgggagcagaaacggaagggaa

SEQ ID NO: 55681 - RNA, 42 nt, Mus musculus
ugggcuagguggaugacauccuagauucuaggugguccugau

SEQ ID NO: 55682 - RNA, 55 nt, Mus musculus
ucauaauaccccuaccccuaccacuaccauuuaagugcuagauugugagugugua

SEQ ID NO: 55683 - RNA, 45 nt, Mus musculus
uuaacuauacaauaaccauuauucaaugucauugaaaugagagau

SEQ ID NO: 55684 - RNA, 46 nt, Mus musculus
aauaagucaacggaaucuuuauuuacaacauuaaaauggcuuggag

SEQ ID NO: 55685 - RNA, 46 nt, Mus musculus
aggucgcgguucgacuccaucugagaauuucccagcagacccaguu

SEQ ID NO: 55686 - RNA, 43 nt, Mus musculus
gccccggacaccuacgaggugaaguuccuaaaaaaagcaggug

SEQ ID NO: 55687 - RNA, 46 nt, Mus musculus
cuuuuuuuaggaacuucaccucguagguguccggggcgcuggggcc

SEQ ID NO: 55688 - RNA, 46 nt, Mus musculus
cuauccgcgucuggcucguuuggggcucaggggcgcugcacagaca

SEQ ID NO: 55689 - RNA, 45 nt, Mus musculus
gcggcggcucugcggagaacaaggagggaccuucuggggaaucga

SEQ ID NO: 55690 - RNA, 46 nt, Mus musculus
uucagauauuuauauuuguuuguguuuccaaguguagucuguagau

SEQ ID NO: 55691 - RNA, 45 nt, Mus musculus
acaggauucccuguguagcccugaaacucacucgauagaccaggc

SEQ ID NO: 55692 - RNA, 41 nt, Mus musculus
guugggagccaccaugugguuacugggaauugaacucagga

SEQ ID NO: 55693 - RNA, 45 nt, Mus musculus
uauuauuauauguaaguacacuguagcugacuucagacgcaccag

SEQ ID NO: 55694 - RNA, 46 nt, Mus musculus
uuuuguuaggguuuuuauugcuaugaagagacaccaugaccaagac

SEQ ID NO: 55695 - RNA, 46 nt, Mus musculus
gccuuuauaagaguugucuuggucauggugucucuucauagcaaua

SEQ ID NO: 55696 - RNA, 46 nt, Mus musculus
gagggauuuaacaaugaauccuguguuuucuucccuuuucagacag

SEQ ID NO: 55697 - RNA, 46 nt, Mus musculus
guaugucuuccauguggcauggcauucccaaaucaacaaauaccag

SEQ ID NO: 55698 - RNA, 44 nt, Mus musculus
augaggcuggaagcgcagaaaguucuauauuuugauccaaaggc

SEQ ID NO: 55699 - RNA, 42 nt, Mus musculus
agauguacuuucaaaccaguuugugauuauauaccgucuugc

SEQ ID NO: 55700 - RNA, 41 nt, Mus musculus
gucugucaaggacuacuugaccucccucagguagagggcgu

SEQ ID NO: 55701 - RNA, 42 nt, Mus musculus
agaaauaucuuggaggaggagaaggaggaggaggaggaagag

SEQ ID NO: 55702 - RNA, 46 nt, Mus musculus
gugggaauggagucuacuaggacagugguaugauguauucagguag

SEQ ID NO: 55703 - RNA, 50 nt, Mus musculus
aaucccagcaaccauaugguggcucacaaccauccuuaauaagaucugau

SEQ ID NO: 55704 - RNA, 46 nt, Mus musculus
guguguguguguguguguguguguguguguguguguccggagaguu

SEQ ID NO: 55705 - RNA, 42 nt, Mus musculus
ggagagaugugugaggcccaggaauggauugaaagguugcug

SEQ ID NO: 55706 - RNA, 48 nt, Mus musculus
ugaauguaugcugugugacguucaggaagaaguggcaggaaaaaggga

SEQ ID NO: 55707 - RNA, 46 nt, Mus musculus
cuucgaacuaagggaugagggagguguuaguauggguuaguauugg

SEQ ID NO: 55708 - RNA, 45 nt, Mus musculus
aaccaauaauauuccagagugcucucugugaauagagaagaugga

SEQ ID NO: 55709 - RNA, 46 nt, Mus musculus
cgaccagaaggaacacuugggagaacugacugcuuuguuugaagau

SEQ ID NO: 55710 - RNA, 41 nt, Mus musculus
uauuuacugugugcguucucaauuguuaauuguugggccag

SEQ ID NO: 55711 - RNA, 51 nt, Mus musculus
aguuuccgcuacuugagacccuuucggaaaggaaaggaaaggaaaggaaag

SEQ ID NO: 55712 - RNA, 44 nt, Mus musculus
guaaucauauuaacuguguuguguuuucauugccuggggauauu

SEQ ID NO: 55713 - RNA, 42 nt, Mus musculus
gagagagaaggagaaaauguaagagggagaggacaagaggag

SEQ ID NO: 55714 - RNA, 46 nt, Mus musculus
ucuuacuaagccauuagcuguaaugggacacauacuaugccuguag

SEQ ID NO: 55715 - RNA, 46 nt, Mus musculus
cugggcgugucuucagggcugccuacuugggcacaggcuagcagag

SEQ ID NO: 55716 - RNA, 46 nt, Mus musculus
ccuuaaaucccaggaacaguaccagggaagguuacugcagccagau

SEQ ID NO: 55717 - RNA, 46 nt, Mus musculus
cuucaucugccagauuauaccugcuucacugacaggaaauagagga

SEQ ID NO: 55718 - RNA, 34 nt, Mus musculus
cgguaccaagucuguucuuggugucuggauagau

SEQ ID NO: 55719 - RNA, 52 nt, Mus musculus
cggccuugggacucuugauuucucagagaucagucuagcaguaggguaagag

SEQ ID NO: 55720 - RNA, 46 nt, Mus musculus
ccucuugguaaaaugccucagguaucuauuauguauugaaaaucag

SEQ ID NO: 55721 - RNA, 46 nt, Mus musculus
gguccuuucagcaaaaucuugcuggcauguggaauagugucugcau

SEQ ID NO: 55722 - RNA, 46 nt, Mus musculus
aaauaaucugauggccuagauuuguuucaaccuacaaugaaagcag

SEQ ID NO: 55723 - RNA, 46 nt, Mus musculus
ucagauaggagcuucagucaugacucugcuacagaauauacuacag

SEQ ID NO: 55724 - RNA, 46 nt, Mus musculus
gaaaaauaugaggcagaaccauagcaauucaaguaaaguaauaaag

SEQ ID NO: 55725 - RNA, 46 nt, Mus musculus
agugagaacagguagcagggcaaagcuacucacuuacagccaugaa

SEQ ID NO: 55726 - RNA, 47 nt, Mus musculus
gucaaugccuaaagaguagacaaaagagccaggugggauuauauagg

SEQ ID NO: 55727 - RNA, 36 nt, Mus musculus
ucguugaucuuuuaaccccuaagauccaucaggaag

SEQ ID NO: 55728 - RNA, 46 nt, Mus musculus
augguaauugaaaagaagugcaguuuaggcaagagaaugaaaggag

SEQ ID NO: 55729 - RNA, 46 nt, Mus musculus
augaaagauuaaggcagaacugugaaguccuugaaaaggaaguaag

SEQ ID NO: 55730 - RNA, 42 nt, Mus musculus
ggaccuggaguuagacaguugugagccaccauguaggugcua

SEQ ID NO: 55731 - RNA, 45 nt, Mus musculus
uuucacgagagucacgcuugaacaugcuugaaauaauucauccag

SEQ ID NO: 55732 - RNA, 41 nt, Mus musculus
aauagggaaauggaagagaaaucagcauugacuauucagaa

SEQ ID NO: 55733 - RNA, 41 nt, Mus musculus
agccugcuuuguuuauucuagcacccacuaacuagcccagg

SEQ ID NO: 55734 - RNA, 45 nt, Mus musculus
auguuauuuuuuacugaaauuacaacauuaauuauguagguggac

SEQ ID NO: 55735 - RNA, 45 nt, Mus musculus
aaucacuauuaagcuacaacccuuacuuuccuguucauuccccaa

SEQ ID NO: 55736 - RNA, 46 nt, Mus musculus
aguauuuuauccuuccagagccuguccuccacaaaaugaaaagcag

SEQ ID NO: 55737 - RNA, 46 nt, Mus musculus
gcauacuaaaaaguaaaauauauggaaacaauaacauaaaagccag

SEQ ID NO: 55738 - RNA, 44 nt, Mus musculus
uaaaguuaggguauaaguuacuuuuguuuaaaaucugcuuuguu

SEQ ID NO: 55739 - RNA, 61 nt, Mus musculus
uuacccucacauccugagugauguccugugacgucagguugaaaucggaguuccguuacua

SEQ ID NO: 55740 - RNA, 75 nt, Mus musculus
accgcagucgaggcccacgaaugauccugcuguuggguuaggaagaugacggagagaugauccagaaggaaggga

SEQ ID NO: 55741 - RNA, 43 nt, Mus musculus
gguguggccuuguggcauggguuuguuguugcgcagcaggaau

SEQ ID NO: 55742 - RNA, 45 nt, Mus musculus
aguguggaggccuuucuagaaacaugaguaaauaggguuuggaug

SEQ ID NO: 55743 - RNA, 44 nt, Mus musculus
auucaggaaauguucuguuagaaaaaugagacgacuuggaguag

SEQ ID NO: 55744 - RNA, 46 nt, Mus musculus
gugacuugugggcaugugauuuagauuucagagaaaggaaugggag

SEQ ID NO: 55745 - RNA, 42 nt, Mus musculus
gcugcuagcagaaagcugucacccagcuccaggauggugcuu

SEQ ID NO: 55746 - RNA, 45 nt, Mus musculus
cugucuuuccccuuucacuuguguauugaccauaggucccgugga

SEQ ID NO: 55747 - RNA, 45 nt, Mus musculus
uuaucuguuuuccacauucauugauucagaugagauaacuagcug

SEQ ID NO: 55748 - RNA, 45 nt, Mus musculus
ucagcaccacaaaguaaagugaagcaaaguagcauaggggccuag

SEQ ID NO: 55749 - RNA, 42 nt, Mus musculus
aaugauuguaccugucccuuuguacuaauauauggccccaug

SEQ ID NO: 55750 - RNA, 46 nt, Mus musculus
agcauccuugcugaagaccaugggcacccuaaccaugauuacccug

SEQ ID NO: 55751 - RNA, 45 nt, Mus musculus
cgauuaucgggguuagcaaauaauguuuugcaugaauuaucagga

SEQ ID NO: 55752 - RNA, 46 nt, Mus musculus
gccugaaauguuuucuuuccagaaauugagggugaugcagaggaag

SEQ ID NO: 55753 - RNA, 46 nt, Mus musculus
uccaucaauaaacuaaggguaguagaauuuauaugaagggccuauu

SEQ ID NO: 55754 - RNA, 55 nt, Mus musculus
gacaggugugugcagagccuuguuguuuucuagccuccucccauuuccucaccug

SEQ ID NO: 55755 - RNA, 41 nt, Mus musculus
ucucucugccugaaguaccauguuucguuccuccuugccug

SEQ ID NO: 55756 - RNA, 45 nt, Mus musculus
ggcugucuuuaaaagccuaccccaucccucuucucuucccuugaa

SEQ ID NO: 55757 - RNA, 49 nt, Mus musculus
gagacacaguacagugcucuccagcaaagacauaagacagagauggagg

SEQ ID NO: 55758 - RNA, 46 nt, Mus musculus
cacgaccaggcugcugagucagcccaggccaugcggcagcuggaag

SEQ ID NO: 55759 - RNA, 59 nt, Mus musculus
cuuagaucaacuccagcaaaaaucuaaagaaauuagccaauuuguaaauaagccaaacu

SEQ ID NO: 55760 - RNA, 59 nt, Mus musculus
ugcaaaaaaaugaaacagcaucucagacuucuuuaccagauguuaauaaugagggcgac

SEQ ID NO: 55761 - RNA, 46 nt, Mus musculus
uuuguuugucuugcaccuaaaguuccugucuucucauucacugcua

SEQ ID NO: 55762 - RNA, 46 nt, Mus musculus
ucaugggugugacaguccugucauuuccagagacugcauuccacag

SEQ ID NO: 55763 - RNA, 45 nt, Mus musculus
aagaaagaugggugucuaguaagauaauaaaaagcaaaagacgca

SEQ ID NO: 55764 - RNA, 46 nt, Mus musculus
caggagugacucuucuccugaagaaaaugggcaggcuguucuagag

SEQ ID NO: 55765 - RNA, 38 nt, Mus musculus
agcuaucaguuuuauuaguggaaaugaaagaagcccag

SEQ ID NO: 55766 - RNA, 84 nt, Mus musculus
gacaaaucccucgcagugucccaugucugucagugucaccagggcgaacuggaaaggcugaaaacucaaguuuuggagcuugag

SEQ ID NO: 55767 - RNA, 95 nt, Mus musculus
acaagccuucauacagcagaggaaacuuacaagagaaacuuaagugagaaagugaaggaaauuagcagccuaacccagcuuagcgaagaggucaa

SEQ ID NO: 55768 - RNA, 59 nt, Mus musculus
agcuugaugucuuagcagaacugcgggcucggguccaagaacuggaaagcagccuugca

SEQ ID NO: 55769 - RNA, 69 nt, Mus musculus
uuugugaacagggaacccagaugaaaacccuucagagccagcuagaggcaaaggagagggaagugcgag

SEQ ID NO: 55770 - RNA, 49 nt, Mus musculus
gagauagccaagauggaccaacucuuguuagagaaacagaaagaugugg

SEQ ID NO: 55771 - RNA, 44 nt, Mus musculus
gcucaauuuauuguccagaacugaagaagcaacaaaagagcagg

SEQ ID NO: 55772 - RNA, 46 nt, Mus musculus
ggggcuucagcaggagcuggaguugcugcggaaagaaagugagcag

SEQ ID NO: 55773 - RNA, 79 nt, Mus musculus
gagagaggacucucggaaagagauucccuucggggagaaugagaggagaaagcuggaggaagacagagagaacagagau

SEQ ID NO: 55774 - RNA, 79 nt, Mus musculus
gacccagaagaaugggggacuucuaaguggcgagaaguagaagcuuccuuaaaacagacaauaucugaaaaagaagugg

SEQ ID NO: 55775 - RNA, 46 nt, Mus musculus
cugugguccagcggaugacucgggaccugcagaguaagacaaagca

SEQ ID NO: 55776 - RNA, 53 nt, Mus musculus
gaaacagcggcgagcagcccacccggugcagguggugaggagcacuggaagcc

SEQ ID NO: 55777 - RNA, 44 nt, Mus musculus
gcaaggcgauucugaaaaaggcacaagagaaagagaaacagcua

SEQ ID NO: 55778 - RNA, 46 nt, Mus musculus
uucuguugcccagauucaggcucaguugaaagaaauggagguugag

SEQ ID NO: 55779 - RNA, 46 nt, Mus musculus
ugagcuggccaaaaagucagaagaaguacuucucuuacaagaccag

SEQ ID NO: 55780 - RNA, 46 nt, Mus musculus
aacguuacagccugaacucgaugcacugcacaagcacaugggccag

SEQ ID NO: 55781 - RNA, 45 nt, Mus musculus
ggagcaugaagagaggcuaaagcaggcccagguggaaauuuguga

SEQ ID NO: 55782 - RNA, 46 nt, Mus musculus
ucaguggcucuugcgaaagccugaaacuagcucuggggggccucac

SEQ ID NO: 55783 - RNA, 49 nt, Mus musculus
agucguacgagaacgugagcaacgaagccgagaggauucagcacguggu

SEQ ID NO: 55784 - RNA, 74 nt, Mus musculus
gagcuguacgcaaaguuaaggagcacagagucggacaagagagagagagagaagcagcugcaggaugcagagca

SEQ ID NO: 55785 - RNA, 46 nt, Mus musculus
agcaacagaagauccuugagcuagaggaagaaaaugaccggcuuag

SEQ ID NO: 55786 - RNA, 45 nt, Mus musculus
aaacccuuucuaaggaguuugaggcuuuaauggcggagaaggacg

SEQ ID NO: 55787 - RNA, 46 nt, Mus musculus
gaugucauugaagagguaacacaagcuguggugggcaagucucaag

SEQ ID NO: 55788 - RNA, 46 nt, Mus musculus
aggaagaauugcugaguuagagauggagaaacagaaagacagggaa

SEQ ID NO: 55789 - RNA, 59 nt, Mus musculus
uuaccaggauguuacagaugcccaaauaaaaaacgagcaacuagagucggaaaugcgga

SEQ ID NO: 55790 - RNA, 45 nt, Mus musculus
cgagucccagaaggauuuggaugugaccaaaggaaaucuggccca

SEQ ID NO: 55791 - RNA, 100 nt, Mus musculus
aagcugcgagagugcuagcggacaaccucaaauugaaaaaggagcuucagucaaacaaagaauccaucaaaagccagauaaaacaaaaagaugaagaccu

SEQ ID NO: 55792 - RNA, 101 nt, Mus musculus
cuugcgaagacuggagcaagcagaggagaaacaccggaaagagaagaagaacaugcaagagaagcuggaugccuugcacagagagaaggcccacguggaag

SEQ ID NO: 55793 - RNA, 48 nt, Mus musculus
aucccugcaggaugaccgggacagggugaucgaugaagcuaagaaaug

SEQ ID NO: 55794 - RNA, 45 nt, Mus musculus
gauuuccaccagcuuauucccaaaggauugcuuuagugcccugag

SEQ ID NO: 55795 - RNA, 89 nt, Mus musculus
gcaaagaagaggcgauccaacuagcuguugaggaacugcaccagcaacacaguaaagagaucaaagaacuagaaaaccuguugucccag

SEQ ID NO: 55796 - RNA, 46 nt, Mus musculus
ucugcaaucuuggaaaaagaccagcucauccaagaugcugcugcug

SEQ ID NO: 55797 - RNA, 46 nt, Mus musculus
aggaagaaggaacgcuaggugucuaccaugcccaacugaaagcaaa

SEQ ID NO: 55798 - RNA, 87 nt, Mus musculus
aagagaacugcagaucuggaagaggaguuaguuuguguacagaaggaagcuaccaggaagguaagugaaauugaagaucagcugaag

SEQ ID NO: 55799 - RNA, 46 nt, Mus musculus
gggauaaugcgaaacgagacagaaacagccgaagagaggguggcag

SEQ ID NO: 55800 - RNA, 69 nt, Mus musculus
cagagagggggacguucuuucccaggcugccuuuccccuguccaccucugagaacgucuugucccgccu

SEQ ID NO: 55801 - RNA, 74 nt, Mus musculus
gaaugagagagaucgccuauggagugagcuggagaaauuccggaagucugaggaagggaagcagagggcugcag

SEQ ID NO: 55802 - RNA, 45 nt, Mus musculus
guacagagcuugaaaaaagccaugucuucacuccagaaugacaga

SEQ ID NO: 55803 - RNA, 46 nt, Mus musculus
auuccccucucucagcaguugcuuuucaucccugauguucgcuguu

SEQ ID NO: 55804 - RNA, 42 nt, Mus musculus
cugaggucuucuucccaggcucagauucucuccacacaguac

SEQ ID NO: 55805 - RNA, 42 nt, Mus musculus
gcagaagcugcaggcgguaaggcagcaagaggcuggggggug

SEQ ID NO: 55806 - RNA, 62 nt, Mus musculus
aguccaggcuguauacaucccuuccucaacaaaaggagcaagggcagagaagagaggagaaa

SEQ ID NO: 55807 - RNA, 46 nt, Mus musculus
gugccuuuccuugcaucaaaaggcaggaagaacugacaauggacag

SEQ ID NO: 55808 - RNA, 46 nt, Mus musculus
ucuccuugucuuagucuccugggauucauagccacuaugccucaag

SEQ ID NO: 55809 - RNA, 42 nt, Mus musculus
uuauuaggucagacuccagaaggaaaguggaaauucuuggag

SEQ ID NO: 55810 - RNA, 46 nt, Mus musculus
aacaucaugacuauuauacuagagugagucguuguuccccauagaa

SEQ ID NO: 55811 - RNA, 46 nt, Mus musculus
caggcuuaaaucauaagccaucuuuuaugaaggcuggaggcugggg

SEQ ID NO: 55812 - RNA, 45 nt, Mus musculus
uccuuuuaaacauuacagugaagugcuuaaauuaaaugaccccau

SEQ ID NO: 55813 - RNA, 46 nt, Mus musculus
ucaaaucccagcaaccacaugguggcucacagccaucuguagugag

SEQ ID NO: 55814 - RNA, 61 nt, Mus musculus
agauauucacaucaagugugggucacaugacacagggugaaagacuggaguagcguuagcg

SEQ ID NO: 55815 - RNA, 45 nt, Mus musculus
ucugaaggugugucauuaguccuauuuuagccucuacuuggucuu

SEQ ID NO: 55816 - RNA, 46 nt, Mus musculus
acauguauuuuguuuugucucaagugaauuuggcaaauuugagcug

SEQ ID NO: 55817 - RNA, 46 nt, Mus musculus
cggcauaacaggguucuuucuugccuacagauuccgggcuuuucug

SEQ ID NO: 55818 - RNA, 45 nt, Mus musculus
uagcuggaguuaaauagaaauacaaauuaauaauacauggcgaac

SEQ ID NO: 55819 - RNA, 49 nt, Mus musculus
cuuucuguuuggaaagugggugaaaucugagaccuguacaaggccagua

SEQ ID NO: 55820 - RNA, 67 nt, Mus musculus
gagugaggaggccucaguuccuggccccagaaacgagauccugaucacaagaacaauuugggcucuu

SEQ ID NO: 55821 - RNA, 47 nt, Mus musculus
uggaugacgauguugauggggaagugagcguacacagaccgcaucuu

SEQ ID NO: 55822 - RNA, 46 nt, Mus musculus; identical to SEQ ID NO: 44660

SEQ ID NO: 55823 - RNA, 46 nt, Mus musculus
uguugaaaggcuguaguaggaaguggcuguaguagaaaguggcugu

SEQ ID NO: 55824 - RNA, 42 nt, Mus musculus
ugucugugugugucuuugugugugugugugucugugugugug

SEQ ID NO: 55825 - RNA, 46 nt, Mus musculus
gcccaaauggcucuggccgcuagggacaacaggaacgagcagcccg

SEQ ID NO: 55826 - RNA, 46 nt, Mus musculus
gugguuaugaaacuuagcugcuagugaacucuugucauucagccag

SEQ ID NO: 55827 - RNA, 46 nt, Mus musculus
uaaccaaaaauggucaaaacaucugcaauuaguuaagccagcuaag

SEQ ID NO: 55828 - RNA, 45 nt, Mus musculus
gcuuucuguguuggcuggccuguuggcuaugugccugugugugag

SEQ ID NO: 55829 - RNA, 46 nt, Mus musculus
ggugaaagguauaugcuaccacaucucugguguuuaacauucccua

SEQ ID NO: 55830 - RNA, 45 nt, Mus musculus
guacucacauacauaaaauaaauaaauaaaaagaaaaaaggagag

SEQ ID NO: 55831 - RNA, 41 nt, Mus musculus
agggagccaugugcaaauugggauaauggaauuaagcugca

SEQ ID NO: 55832 - RNA, 42 nt, Mus musculus
gccagcaacacccagauagugcuugacuugacuaacggggag

SEQ ID NO: 55833 - RNA, 42 nt, Mus musculus
ugcaaccccugacuagguuacuaccuuagacuuucuggccag

SEQ ID NO: 55834 - RNA, 41 nt, Mus musculus
uuuuaggaggaaccuagaagcaaauccaagaucugcgccaa

SEQ ID NO: 55835 - RNA, 42 nt, Mus musculus
gcaaaccucacaagaggccuguguguggcaguaauggcaaga

SEQ ID NO: 55836 - RNA, 46 nt, Mus musculus
cucacuggauccaagauccagguugauuaugaugggcacugcaaag

SEQ ID NO: 55837 - RNA, 46 nt, Mus musculus
agaucauuccagauggcugguucucuaaaggcaguaacuacaguga

SEQ ID NO: 55838 - RNA, 76 nt, Mus musculus
cagugaauuccugaaauucguggagcagaaugaaacagccaucaacaucaccacuuaugcagaucaggagaacaac

SEQ ID NO: 55839 - RNA, 42 nt, Mus musculus
ucccagcaaccacaugauggcucacaaccaucuguaaauggu

SEQ ID NO: 55840 - RNA, 99 nt, Mus musculus
uggaaacucagcuuccaagaguuccucaagugccucaacccauccuucaacccuccugagaagaguacguccaaucuagaaacugagugcugcugggga

SEQ ID NO: 55841 - RNA, 46 nt, Mus musculus
agugugcccuggaggacgaaaccuaugcagauggagcugagacuga

SEQ ID NO: 55842 - RNA, 46 nt, Mus musculus
ugcaggaaagaaucagaaggggguccagacccacacagaggaggag

SEQ ID NO: 55843 - RNA, 47 nt, Mus musculus
gggcacagcagaaaagaccaagaaggugaacaccaaagagaucuaag

SEQ ID NO: 55844 - RNA, 86 nt, Mus musculus
gagcccagcgccuccucuucagcgcugagcccaguacacacagagucugcagcaaucaccaaaucacuaguauuugcuuguauggc

SEQ ID NO: 55845 - RNA, 68 nt, Mus musculus
ggacaccuugggacgagaggcaacuaaggaaacagcaucggguuggcagaggagcagaggcagguuug

SEQ ID NO: 55846 - RNA, 80 nt, Mus musculus
aaugaagccuuucuggggucacagcagcugcgaggagaauacaggaaaagcauagagaaacauugaacuagcccugcugg

SEQ ID NO: 55847 - RNA, 51 nt, Mus musculus
gucagcaugacagaccugcagcaagucugcuucuccuuuuggucccaacaa

SEQ ID NO: 55848 - RNA, 46 nt, Mus musculus
agguguuuaaaugaugcagacacuuauguacuucaagcgccaugga

SEQ ID NO: 55849 - RNA, 56 nt, Mus musculus
uuguaauuauuuuuucauuaguccuacuauuucagaagugaaggugaaggggguuu

SEQ ID NO: 55850 - RNA, 91 nt, Mus musculus
ucacauauuagaccgguugcaguucggagcugcaccccaacccagagcuucuagaaaaucagcuccaugccacgaagcacaagaggccccu

SEQ ID NO: 55851 - RNA, 47 nt, Mus musculus
ggaauagcauggauggguuuugcuuugguugaaaugauccuagcagg

SEQ ID NO: 55852 - RNA, 87 nt, Mus musculus
cagagguuuccccacacacaugaugauaaaacuuuucagauuuagagcgguuaaaacuggagaucgaaucuggauugagaaucagca

SEQ ID NO: 55853 - RNA, 48 nt, Mus musculus
uggagauuuuccugcauaggaaaguguggaauguugagcuauugagau

SEQ ID NO: 55854 - RNA, 46 nt, Mus musculus
ugugcccucccuuucaaaagcucugagccccgcucaugcaguccag

SEQ ID NO: 55855 - RNA, 86 nt, Mus musculus
aaaaaaaaaaagaaaaaaaaaguuuugcugguucuuggaggugaugggagagggcaggaguaucaauuuguucaaguagcugcagu

SEQ ID NO: 55856 - RNA, 45 nt, Mus musculus
gcuacuucaguguaacuagggcagcuguugucugaagcaccauag

SEQ ID NO: 55857 - RNA, 52 nt, Mus musculus
gcugcuaaguagccugguuugggagacuuggguugagauuugcaugggacca

SEQ ID NO: 55858 - RNA, 52 nt, Mus musculus
uuguucuuguuguuuuauuaacaucagugucucuuaagauccaggacccagg

SEQ ID NO: 55859 - RNA, 85 nt, Mus musculus
cuuuucacauacauauaccaggacucuuggguacuacugucagucuuggggaagcaggcuccuccaucggcaaccaaauccaugu

SEQ ID NO: 55860 - RNA, 46 nt, Mus musculus
acacacauacacacagacacacagagagagacacacagagagagug

SEQ ID NO: 55861 - RNA, 67 nt, Mus musculus
ugggagcuuugcgcgugugcgcucauaguugcuuucgccuggaaagaugccgggacuggcggccgcu

SEQ ID NO: 55862 - RNA, 67 nt, Mus musculus
agcccugccccgcccgaggcucaggagaagaagccacugaagcccugcugugccugcccggaaacca

SEQ ID NO: 55863 - RNA, 46 nt, Mus musculus
gaaaaggagaaacaggaaguuaauuucugugugauaggaggaccaa

SEQ ID NO: 55864 - RNA, 46 nt, Mus musculus
acaaacguuaagaccuuaguucuauggaacacuuuugugggaacag

SEQ ID NO: 55865 - RNA, 46 nt, Mus musculus
aagaacacuguggacaucucauugaagcccacaaggagugcaugag

SEQ ID NO: 55866 - RNA, 42 nt, Mus musculus
auuauucucuucuacucuguacagcaguguccccaggccuca

SEQ ID NO: 55867 - RNA, 46 nt, Mus musculus
ccugagugaccauucaguauucuucuccaucuugcauaucgacuag

SEQ ID NO: 55868 - RNA, 42 nt, Mus musculus
uacagcccucuuuacuuuaugucuggaaacacacaccgccuc

SEQ ID NO: 55869 - RNA, 70 nt, Mus musculus
agguggccuacuuugugaaugaauaauccuugaagaaugaagaagauuaaauauuuuggaaguucuuugg

SEQ ID NO: 55870 - RNA, 50 nt, Mus musculus
agaacuuugauaaauggauaaaguauuuauaauuuauuaaaaaacagaag

SEQ ID NO: 55871 - RNA, 44 nt, Mus musculus
ucccuuuuucccuuuuucccuuuuucccuuucccuuucccuuuc

SEQ ID NO: 55872 - RNA, 45 nt, Mus musculus
caaaauaccaucaaagcaggugcucaaaacaccuagcauccagca

SEQ ID NO: 55873 - RNA, 46 nt, Mus musculus
agaugggauagugacuuacguccuguguuacuauuacucugggcag

SEQ ID NO: 55874 - RNA, 45 nt, Mus musculus
ccaucagugagggagguguuuaggaucuuguguccuugugcuugg

SEQ ID NO: 55875 - RNA, 42 nt, Mus musculus
ccgaggauguaggagaggaggagggguacaguggacauggag

SEQ ID NO: 55876 - RNA, 46 nt, Mus musculus
acagccagggcuacacagagaaacccugucuugaaaaaaagauuua

SEQ ID NO: 55877 - RNA, 90 nt, Mus musculus
ugguccccagccccccacccccaaugggucuaggguagcaaagauggaauauagauuuuaguaaguaauaauucaggaguauuggagggg

SEQ ID NO: 55878 - RNA, 27 nt, Mus musculus
gagaaagcauacaaucauguaagagcc

SEQ ID NO: 55879 - RNA, 45 nt, Mus musculus
uucaguugauggggucagcuuuucccauucagaaaccucauaacc

SEQ ID NO: 55880 - RNA, 45 nt, Mus musculus
aaaagcugaccccaucaacugaaauaaaaagauucucauacacaa

SEQ ID NO: 55881 - RNA, 103 nt, Mus musculus
uguagcccugaagcucagucucuucagccuuuugagagucaagaauccuaauuuuguguuugaagaguucugagauaacaagucccuuggaugcguuuagccc

SEQ ID NO: 55882 - RNA, 42 nt, Mus musculus
cgagaagcucgaauaccgacagcggcuagaagaggccggaag

SEQ ID NO: 55883 - RNA, 49 nt, Mus musculus
gugagcuacucgggcugggguggcagcagcggacacgaugcccccauga

SEQ ID NO: 55884 - RNA, 42 nt, Mus musculus
uaggcaaucaugggggcaucguguccgcugcugccaccccag

SEQ ID NO: 55885 - RNA, 45 nt, Mus musculus
aggugccuacagugagguauccacuuggcuguuucaggcaaccau

SEQ ID NO: 55886 - RNA, 25 nt, Mus musculus
gugaauggcaagucaccauggcagu

SEQ ID NO: 55887 - RNA, 42 nt, Mus musculus
uggaucugcugauccaagugagcaucgagagcggccggauga

SEQ ID NO: 55888 - RNA, 42 nt, Mus musculus
gcaugcagaacgccaugcugcuacagcccaacagggccgacg

SEQ ID NO: 55889 - RNA, 41 nt, Mus musculus
auaacuggagguaggugugugugugugugugugugugugug

SEQ ID NO: 55890 - RNA, 68 nt, Mus musculus
aauaagaagcauauggacacacagacacaacggaugccauacacagagacagagcacguggggaccag

SEQ ID NO: 55891 - RNA, 86 nt, Mus musculus
auugggcaguaagagggaagguggaccugaaaaguugggagaagggagagagaaggagagggagggaggaugauggaggaggaaga

SEQ ID NO: 55892 - RNA, 45 nt, Mus musculus
auacaccagcaguuggcccagaugggugacuuggaagccauagau

SEQ ID NO: 55893 - RNA, 42 nt, Mus musculus
cucagcaccauggcagccacauaccucucaaucagcccccca

SEQ ID NO: 55894 - RNA, 45 nt, Mus musculus
cccagaccauguaauaugaagcauucuggcggcagggaacuaggu

SEQ ID NO: 55895 - RNA, 44 nt, Mus musculus
uggagguaccugggcuugaacuaaaccuaaaauggcgguuagag

SEQ ID NO: 55896 - RNA, 46 nt, Mus musculus
aaggaguaucuguuuuuaaaaacaacaaaaguuacucggcucugac

SEQ ID NO: 55897 - RNA, 48 nt, Mus musculus
aguuuuccuuaucauguugaagccagagggacucuugagaaagaucua

SEQ ID NO: 55898 - RNA, 56 nt, Mus musculus
cuauuccaaauuccuguccuauaauguaacaagaagaaaagauuauuaucagaucg

SEQ ID NO: 55899 - RNA, 45 nt, Mus musculus
gagcagccgggcgugauggcgcacgccuuuaaucccagcacucgg

SEQ ID NO: 55900 - RNA, 46 nt, Mus musculus
agucuaccucuacuuuuccuucaagggucuuucuaagugggccacc

SEQ ID NO: 55901 - RNA, 45 nt, Mus musculus
ugaaaguugauaaaugguugaaccaagaugguucauugagaggga

SEQ ID NO: 55902 - RNA, 44 nt, Mus musculus
cguaguccugacacuaguccacagcuuauucugcuggcuaccca

SEQ ID NO: 55903 - RNA, 78 nt, Mus musculus
uauuggccuuccagucccacccaccacagccuuaauuaccccagguccuguucgucauugccaaaucccugacuuacc

SEQ ID NO: 55904 - RNA, 46 nt, Mus musculus
auuauuuuuuuuucuuuaggaaacuuuucauuagcuuuauuuagac

SEQ ID NO: 55905 - RNA, 42 nt, Mus musculus
gcugccuucacuuauccauaugaacuuuaggcucacgcagau

SEQ ID NO: 55906 - RNA, 46 nt, Mus musculus
acacauauaauucauuuugucaaugguguuuuuguugguugcagaa

SEQ ID NO: 55907 - RNA, 43 nt, Mus musculus; identical to SEQ ID NO: 50770

SEQ ID NO: 55908 - RNA, 43 nt, Mus musculus
aucauaaaggauccauaggacuuccaggcacccgccccccugu

SEQ ID NO: 55909 - RNA, 42 nt, Mus musculus
agucuacugggcacagaaaauaaccgauucauggcccaugcc

SEQ ID NO: 55910 - RNA, 45 nt, Mus musculus
uuagcccuuacugaagauuuuuuagaaaacucccaaucgccaucu

SEQ ID NO: 55911 - RNA, 46 nt, Mus musculus
ucccauaaguacuucuccuuuugcuuguauugcccugccccuccca

SEQ ID NO: 55912 - RNA, 46 nt, Mus musculus
uaugugggcagaaauugguaguuuucaugucucuugaaugccaggu

SEQ ID NO: 55913 - RNA, 64 nt, Mus musculus
guggauacaacuauuuucugucguuguggguuuuagguaagagagaugguaguaaugucaaaga

SEQ ID NO: 55914 - RNA, 46 nt, Mus musculus
acuggguaagccagagcgagcuuggggauguuugcugacugcaguu

SEQ ID NO: 55915 - RNA, 46 nt, Mus musculus
guacacacugaggaaaugccccgccucuugaguuagucugcccuua

SEQ ID NO: 55916 - RNA, 54 nt, Mus musculus
uugucuuuuacacuuguacuguuucgggaucccaaagauaaucugugagaccuu

SEQ ID NO: 55917 - RNA, 47 nt, Mus musculus
uuccuuugugucucagaacugaaacuuggagaagucugcagauuggg

SEQ ID NO: 55918 - RNA, 45 nt, Mus musculus
cugcgucggagaaucaaaccaucaagcauuuauacuugcccuuuc

SEQ ID NO: 55919 - RNA, 25 nt, Mus musculus
acucagugagugacugagugaaggg

SEQ ID NO: 55920 - RNA, 45 nt, Mus musculus
guuccccggcacagacgccucggggagccucaacaaccgcacacu

SEQ ID NO: 55921 - RNA, 46 nt, Mus musculus
aaccugcggguuacuucugauacucuuagccuuguaccgagccaag

SEQ ID NO: 55922 - RNA, 45 nt, Mus musculus
agacgcuguuuuuccugagccucgggcuguucucacugggcuaca

SEQ ID NO: 55923 - RNA, 82 nt, Mus musculus
accgagaguuagguuugaacuacaugaauuuuagccacuaauauuggaucauuugcagucuaccucugcccccuccaaagaa

SEQ ID NO: 55924 - RNA, 45 nt, Mus musculus
ccuugucucuuucuauaguauuucuuuuuaaauagguagccuuaa

SEQ ID NO: 55925 - RNA, 88 nt, Mus musculus
gccgugcagaaccuucuggagggaaaaggaauuggaauaaagagcacgggggaugagugcuaggagcuagugacucaacggacuuggg

SEQ ID NO: 55926 - RNA, 107 nt, Mus musculus
uugggucagagcgaguggaggaaggcgggcggucgggaggggagggggaauaaacuggagcgguguagacuuuggggugccaaaauguuuaaggaaguagccaugga

SEQ ID NO: 55927 - RNA, 68 nt, Mus musculus
ucaguagguggagcuauugcuucagugguguguguguguguguguguguguguguugcccccccccuc

SEQ ID NO: 55928 - RNA, 45 nt, Mus musculus
uauucggugcucugcaaguacucugccacugagcuacguccccag

SEQ ID NO: 55929 - RNA, 44 nt, Mus musculus
augccacagacagcaaugacuggcccuguaauucguugucagug

SEQ ID NO: 55930 - RNA, 50 nt, Mus musculus
aaugccuuuaaauaaaauaugaaugcuaaguggaccaaaguaaagaugaa

SEQ ID NO: 55931 - RNA, 46 nt, Mus musculus
uaagauucuauaguuauaaaugaagcuuuguugauaaauacaaaau

SEQ ID NO: 55932 - RNA, 46 nt, Mus musculus
guaucugugucucuucucaaucaggguggggccccaaaccuucaga

SEQ ID NO: 55933 - RNA, 67 nt, Mus musculus
uuguauaccauuaaaacuuuuugaagaaacugaauagcagcaggucauauuuugcuuuuuguguaaa

SEQ ID NO: 55934 - RNA, 46 nt, Mus musculus
ucccucccugauaugcgguuucucuguguagccuuggcuguccugg

SEQ ID NO: 55935 - RNA, 42 nt, Mus musculus
uaucuagcuuacuagcagagugcuagucuucucugguacaau

SEQ ID NO: 55936 - RNA, 44 nt, Mus musculus
ccagcccagcagugugcucuuuaaaggcaaaaccugcaagggag

SEQ ID NO: 55937 - RNA, 45 nt, Mus musculus
acccugucuugaaaaaaaucgaaaaaacaaaaagaaaaaaagaga

SEQ ID NO: 55938 - RNA, 46 nt, Mus musculus
ugccugcuauacucuaauccugcugaaggguuuuuaaacagaacag

SEQ ID NO: 55939 - RNA, 46 nt, Mus musculus
aaguaccuauuuccucuaguuagaccuagcuucuccuagucaccca

SEQ ID NO: 55940 - RNA, 42 nt, Mus musculus
caaugggcaaaagcuagggaucugaugaugugcagccccaag

SEQ ID NO: 55941 - RNA, 49 nt, Mus musculus
gccagccuuggcuacaagagauacugucuuuaaaguuuaaaggaauugg

SEQ ID NO: 55942 - RNA, 46 nt, Mus musculus
gucauuuacugaaagucaggguuaaauuaaguccuauuaaucagga

SEQ ID NO: 55943 - RNA, 46 nt, Mus musculus
augcccaaguauaccuuuauuuguaaauauuuucuacaggcgcauu

SEQ ID NO: 55944 - RNA, 46 nt, Mus musculus
ggauuaaaggaauaagacaccaccgcuggacucuucuaguauuucu

SEQ ID NO: 55945 - RNA, 46 nt, Mus musculus
ggucauuauuuccuuaaaagugacacuaaugaaagauaacauuaga

SEQ ID NO: 55946 - RNA, 46 nt, Mus musculus
agugagcuaagcaucuguauugauaauagcaaaacaaaccagggag

SEQ ID NO: 55947 - RNA, 42 nt, Mus musculus
guuggggggagguauauaaggugauagguuaaaauggggcug

SEQ ID NO: 55948 - RNA, 45 nt, Mus musculus
cauaacuuuauggugcuaaaaagaggagaguauacccaguuugag

SEQ ID NO: 55949 - RNA, 32 nt, Mus musculus
gcucugucggauguuguguaggagcuugggag

SEQ ID NO: 55950 - RNA, 46 nt, Mus musculus
uucucuuauuauuuuaaaaguuuuuuuuucuuuacaaaaugaggag

SEQ ID NO: 55951 - RNA, 46 nt, Mus musculus
gccuguauuugucuaugcaggacaugugugccuagugucuguggag

SEQ ID NO: 55952 - RNA, 46 nt, Mus musculus
cauauuucaaugauauagcuguaggugcagugugcugcagggugga

SEQ ID NO: 55953 - RNA, 45 nt, Mus musculus
aacacaagagaagcccugugaaugaaugaacugaacugaaggaag

SEQ ID NO: 55954 - RNA, 46 nt, Mus musculus
ggggaaauaauguauagaugcacucuaauucugugucaggacuuag

SEQ ID NO: 55955 - RNA, 51 nt, Mus musculus
auaggaacuaaaauguuaaaucauguccuaaacaucugugagaaggauggc

SEQ ID NO: 55956 - RNA, 49 nt, Mus musculus
gcuucagaaaaaccucaaagucccaucuggucagaaugcagagacacag

SEQ ID NO: 55957 - RNA, 44 nt, Mus musculus
uguauaguuucacaguuaagaugucccgaaaauuggguggcaga

SEQ ID NO: 55958 - RNA, 41 nt, Mus musculus
guuuuuaaagcaauuuuuuucuauuugcugauuggcggggc

SEQ ID NO: 55959 - RNA, 45 nt, Mus musculus
uuguuauaauugauuuuuuuuccucuuguuuuucaguaagcccaa

SEQ ID NO: 55960 - RNA, 45 nt, Mus musculus
aucccuaaauaaaccugaagcaaguguuuucucuuggacgaacag

SEQ ID NO: 55961 - RNA, 23 nt, Mus musculus
uuuaaagauuuggaauaagagga

SEQ ID NO: 55962 - RNA, 46 nt, Mus musculus
uagucuugagugccaagaauauagauaaggggugggauggauggau

SEQ ID NO: 55963 - RNA, 49 nt, Mus musculus
cuggaagauacccagcuaucuucaucauuuuuucaggaaagaucauuuu

SEQ ID NO: 55964 - RNA, 48 nt, Mus musculus
caaagcaggucacucaauaacugaaaguccuccaaaaagagaacuagu

SEQ ID NO: 55965 - RNA, 44 nt, Mus musculus
uguugcuguuacaucuaaaauaaacuuaugugauguucugguag

SEQ ID NO: 55966 - RNA, 42 nt, Mus musculus
acugauucaaaguauuuguuuuugucaaccaaaccucuggag

SEQ ID NO: 55967 - RNA, 46 nt, Mus musculus
ugggagguagcaagacauauuucuaagcaaacgaucaaaaguuaag

SEQ ID NO: 55968 - RNA, 46 nt, Mus musculus
uggugccuagcaagcacguugaaaguuacuugauaacguggagugg

SEQ ID NO: 55969 - RNA, 41 nt, Mus musculus
gggaaacacuugauuguuugugaagagggaggggaccaguu

SEQ ID NO: 55970 - RNA, 46 nt, Mus musculus
aaacuugccuggcauaguuuacaccugggcaucaauuuaagccuag

SEQ ID NO: 55971 - RNA, 45 nt, Mus musculus
caguuacugugaaaggggugugcuuugacaaagcugacuuaggug

SEQ ID NO: 55972 - RNA, 42 nt, Mus musculus
acucauugcaugaguuuuaacuugugaguuaaagaacaguag

SEQ ID NO: 55973 - RNA, 24 nt, Mus musculus
aguaaggggacaagaagaguaaug

SEQ ID NO: 55974 - RNA, 53 nt, Mus musculus
uggacguucucaaacacgugauccaugaaguggagcacgagauggaagaguau

SEQ ID NO: 55975 - RNA, 45 nt, Mus musculus
acucaguuuuaguauaucuaguaaaauuuaugcuuguaguccccc

SEQ ID NO: 55976 - RNA, 46 nt, Mus musculus
cugacagcugaaauccucucccucagagaagagaauaguaccaugc

SEQ ID NO: 55977 - RNA, 25 nt, Mus musculus
uaggcguugugagauuaauucaggu

SEQ ID NO: 55978 - RNA, 45 nt, Mus musculus
gcucacacaugccauuaagaacuguccugugauaaauaacuccag

SEQ ID NO: 55979 - RNA, 41 nt, Mus musculus
cacaguucugaggaggacuguucagacucguccggccccac

SEQ ID NO: 55980 - RNA, 46 nt, Mus musculus
cagaacaucggaggcccuggugcagaggaaggacauuauggcccgg

SEQ ID NO: 55981 - RNA, 42 nt, Mus musculus
cuuacagcccccugccuuucucucuucuccuacagcccuggc

SEQ ID NO: 55982 - RNA, 45 nt, Mus musculus
gugggaacaguucaagaagguagggccacagggcuguugguacuc

SEQ ID NO: 55983 - RNA, 45 nt, Mus musculus
ccggcggucaaccucaccuccggcugcugcaaacucggggcgugg

SEQ ID NO: 55984 - RNA, 46 nt, Mus musculus
ucucaaggagccuucccauucuaugacucaaccuagccgcugccau

SEQ ID NO: 55985 - RNA, 46 nt, Mus musculus
uggucuucagcgguuuccagaugcgaaaaacuuaccuuguccugug

SEQ ID NO: 55986 - RNA, 46 nt, Mus musculus
ucuauuuuuuccucaucuggauuccaucccagaaaugucagggcua

SEQ ID NO: 55987 - RNA, 46 nt, Mus musculus
cugggauggaauccagaugaggaaaaaauagaaggagaagggggag

SEQ ID NO: 55988 - RNA, 56 nt, Mus musculus
uuuuacgcucggaaacaaagggacucggccagacugcaggaggggaagggugauaa

SEQ ID NO: 55989 - RNA, 118 nt, Mus musculus
gaaguucugggaaaacuccacagaagggaagagcgagauucagaaaucacuaggacuucacuuucaggaagaucccuguggcaaccaaggaccggcacacacagacccaggagaaacu

SEQ ID NO: 55990 - RNA, 46 nt, Mus musculus
gcguucaccuccucccacuggaccagaagguaaaagacacagccag

SEQ ID NO: 55991 - RNA, 45 nt, Mus musculus
agaaauccacccaggaagaaccaaauccucagccuuuccaaagga

SEQ ID NO: 55992 - RNA, 42 nt, Mus musculus
ugacccauacccuguucuuuccugcaaagcuggccaggauau

SEQ ID NO: 55993 - RNA, 45 nt, Mus musculus
gagaagggcaaguuuagcauggugcuguuaaaaaagacucugcag

SEQ ID NO: 55994 - RNA, 42 nt, Mus musculus
aggagcaggagguacaggccugggcggugauaagaggaaaga

SEQ ID NO: 55995 - RNA, 42 nt, Mus musculus
cuggagcaggaggaagggugguggcccuuggaguugggggag

SEQ ID NO: 55996 - RNA, 46 nt, Mus musculus
ccacaucccggguagugacaauagccgcaagaccuacaaccaccac

SEQ ID NO: 55997 - RNA, 27 nt, Mus musculus
cucgagaaaccugagaaggagaagaag

SEQ ID NO: 55998 - RNA, 46 nt, Mus musculus
aucaaaggcaugaaccaccauacacugccuccaaaccugcuugaac

SEQ ID NO: 55999 - RNA, 42 nt, Mus musculus
auauuuuuaaauugccuuuauucuuaauaaagaacuggggug

SEQ ID NO: 56000 - RNA, 46 nt, Mus musculus
uuugcuuuaucuuuacugugugaauauaacuaauuguuggcugcag

SEQ ID NO: 56001 - RNA, 40 nt, Mus musculus
cauaacuaauuuaaauagugauaaacgaauuaaaggucaa

SEQ ID NO: 56002 - RNA, 46 nt, Mus musculus
uuuauuucauaauguuuuguuauauuuaaauaguuacuaucaggag

SEQ ID NO: 56003 - RNA, 42 nt, Mus musculus
aaaaacuacucugugugugugugugugugugugugugugcgc

SEQ ID NO: 56004 - RNA, 47 nt, Mus musculus
uggaagcuaucauugaagaagaugauggugaugggggauggguagau

SEQ ID NO: 56005 - RNA, 45 nt, Mus musculus
aaguccuaguguaacuccacuggacaguaaaugcuuaaaaggaag

SEQ ID NO: 56006 - RNA, 85 nt, Mus musculus
aggacaguauaaaacuccaagauugcucagcacugugugaugaagaagacgaggaagaugaaggggaagcugcagacauggaagg

SEQ ID NO: 56007 - RNA, 46 nt, Mus musculus
uaauaagauucaugauccuauugccucagccuuuuugagugcugga

SEQ ID NO: 56008 - RNA, 46 nt, Mus musculus
gauaaaauauauuauguugaauuauuuucaguguuaaaagagaaag

SEQ ID NO: 56009 - RNA, 46 nt, Mus musculus
uaaaguauucuauagcuagagaauaagaagaagauaguggagucag

SEQ ID NO: 56010 - RNA, 46 nt, Mus musculus
uuuuuaaguagaugcaauaaaagaagcagaguagaaaauacugaag

SEQ ID NO: 56011 - RNA, 46 nt, Mus musculus
acaaggaaaauaguggaagccugcaaagcuaaggcugacgcuggag

SEQ ID NO: 56012 - RNA, 46 nt, Mus musculus
uagaauagugggacuugaaggggaaucuuugcuuguauugugucag

SEQ ID NO: 56013 - RNA, 49 nt, Mus musculus
gaauaugccaugaaggcuauggaaaacaguaguacagcuauugggauca

SEQ ID NO: 56014 - RNA, 46 nt, Mus musculus
ggacuacuuuuucuacuccaaacacaacaucgucuuuacaucugau

SEQ ID NO: 56015 - RNA, 46 nt, Mus musculus
gaguagaaaaaguaguccuuucuaaacuuuaugaagaaggcuccag

SEQ ID NO: 56016 - RNA, 42 nt, Mus musculus
cuuugcagccugccuggcuucgccaaucgcacagccccagca

SEQ ID NO: 56017 - RNA, 45 nt, Mus musculus
uggggcugugcgauuggcgaagccaggcaggcugcaaagacagag

SEQ ID NO: 56018 - RNA, 49 nt, Mus musculus
uuggugaauuaacuaaaggaagacaugaaauuguucccaaagacauaag

SEQ ID NO: 56019 - RNA, 37 nt, Mus musculus
caguggacggaagucuggggccccugugguugaauua

SEQ ID NO: 56020 - RNA, 41 nt, Mus musculus
auauauauaugaugcuggucaggaaaggaucauuucuggag

SEQ ID NO: 56021 - RNA, 46 nt, Mus musculus
cucucauucuuucuuuuugcaagaaauucucagacucaucuugguu

SEQ ID NO: 56022 - RNA, 45 nt, Mus musculus
ucuacccagaaguaaacaaagaagugccaccacaaggcccacuga

SEQ ID NO: 56023 - RNA, 46 nt, Mus musculus
auggccuugggcaguguugcaguuaccaaggaugauggcugcuacc

SEQ ID NO: 56024 - RNA, 41 nt, Mus musculus
ggccagugauuuaucgucuccauuaguuccuuucaugcauc

SEQ ID NO: 56025 - RNA, 45 nt, Mus musculus
uucugacauuucucccuggacuguagcaauauuuucucaaggaga

SEQ ID NO: 56026 - RNA, 42 nt, Mus musculus
aggcacuugucugacauguuaagucugcaacaaggcccaaga

SEQ ID NO: 56027 - RNA, 44 nt, Mus musculus
agcacccaucacccaauacacuguuuggaagagaccuggaggga

SEQ ID NO: 56028 - RNA, 42 nt, Mus musculus
aguuucuuuucccugaucuucuccaucacgagcagcccagag

SEQ ID NO: 56029 - RNA, 41 nt, Mus musculus
ccugucguacagaaggacacauauugaggcuagggcaagaa

SEQ ID NO: 56030 - RNA, 44 nt, Mus musculus
auccccaagaucucagagucaaagauggcuuuuaagcagaugga

SEQ ID NO: 56031 - RNA, 44 nt, Mus musculus
gaguaucaaacauccaagcugacaggaaucucauuuggugcagc

SEQ ID NO: 56032 - RNA, 42 nt, Mus musculus
ggggcucaaugaaaucugccaaaauguacaugggccccuggg

SEQ ID NO: 56033 - RNA, 45 nt, Mus musculus
cuucggauugaauggagaagucaggauggaugugauggaagagau

SEQ ID NO: 56034 - RNA, 78 nt, Mus musculus
agggacagaagugaaagggucaugagaaacuauacuacacaggcguauagagcauugggaagaguagaacuaggaaua

SEQ ID NO: 56035 - RNA, 41 nt, Mus musculus
cagucuguaacuccuugcaaacaagacuaccucggggacau

SEQ ID NO: 56036 - RNA, 42 nt, Mus musculus
ucuaggaaagaugacucacuuguaggcagucacggggaagug

SEQ ID NO: 56037 - RNA, 45 nt, Mus musculus
cuaaucuacucacauugaaguccaaaggaaacuuaaacccagaga

SEQ ID NO: 56038 - RNA, 45 nt, Mus musculus
ccuggaagaaagccacaaacauauauagacaauucagccuggauu

SEQ ID NO: 56039 - RNA, 46 nt, Mus musculus
uauuauaaauucacuuuucaguaggcuauccuuuguaaaacaaguu

SEQ ID NO: 56040 - RNA, 46 nt, Mus musculus
auugguggugguagcugguugauuguuugguuugguuugguugauu

SEQ ID NO: 56041 - RNA, 46 nt, Mus musculus
uuuagcagcagcguuauccacuauagauaguccuaugguuauggag

SEQ ID NO: 56042 - RNA, 46 nt, Mus musculus
ucaagagaucaucuuccuggauuucaaccacuucuaugccauggau

SEQ ID NO: 56043 - RNA, 41 nt, Mus musculus
gucuuuuuauucuuuacugagauuucugccccagcacuucu

SEQ ID NO: 56044 - RNA, 43 nt, Mus musculus
aucucaguauauacuuggugucugguucaaaaugggcaucggu

SEQ ID NO: 56045 - RNA, 46 nt, Mus musculus
auacauuguguccauccuuuuuauuucugugugugugugugugugu

SEQ ID NO: 56046 - RNA, 46 nt, Mus musculus
gggaugauuccacaaaaggugguguucucugcuuaaagacagagug

SEQ ID NO: 56047 - RNA, 70 nt, Mus musculus
gggaccagcaaaggccaugagacucugucucaaaacaaacaaacaaacaaccuaguggggugaggagggu

SEQ ID NO: 56048 - RNA, 69 nt, Mus musculus
uuagagguccaauaaucuguguuaggggcuuagcuucuccuuaacaagggugugaagaguaugaagggg

SEQ ID NO: 56049 - RNA, 64 nt, Mus musculus
aauucauuauagaugugucacauuugacaaaagggaaagaauaggagccaaggucauaaaguac

SEQ ID NO: 56050 - RNA, 31 nt, Mus musculus
acccuaggaggguuagaguuauggacaagau

SEQ ID NO: 56051 - RNA, 46 nt, Mus musculus
agagagagagagggagagggagagagggagaaggagagagaguagg

SEQ ID NO: 56052 - RNA, 61 nt, Mus musculus
uagugagcuugaaaucuacucucccacccccacccaacaaagagaaauaaggaaauuguca

SEQ ID NO: 56053 - RNA, 44 nt, Mus musculus
caagccuauccucacaauggaagcacagcacuuaauuaucauaa

SEQ ID NO: 56054 - RNA, 27 nt, Mus musculus
uuccagcucgcuuugaucccaauacuc

SEQ ID NO: 56055 - RNA, 46 nt, Mus musculus
uuuauuugugugugugugugucugucugucugucugucugucuguc

SEQ ID NO: 56056 - RNA, 41 nt, Mus musculus
caaagaaaauuugaguguuugucuuuauuuccacugcccag

SEQ ID NO: 56057 - RNA, 47 nt, Mus musculus
cuuauuucuaguuuggaaguauugguguugagauuuccauaggagaa

SEQ ID NO: 56058 - RNA, 74 nt, Mus musculus
gaugaagaaagugugauuuuaacgcugguccccuuuaaggaggaggaggagccaaacacagacuacgcuacgca

SEQ ID NO: 56059 - RNA, 46 nt, Mus musculus
cagaaauccugucuccaaaacaaaacaaaaacaauaaaaaccagag

SEQ ID NO: 56060 - RNA, 52 nt, Mus musculus
ccguucucuggugaggcaugcuggaaucaaacacccaaccagaaccauacca

SEQ ID NO: 56061 - RNA, 49 nt, Mus musculus
gaacacucuucgggaguggugucgguaucauaacuugaguacggauggc

SEQ ID NO: 56062 - RNA, 41 nt, Mus musculus
aguaggucauuaugagugucaccucaaaacaagaggagcua

SEQ ID NO: 56063 - RNA, 47 nt, Mus musculus; identical to SEQ ID NO: 27492

SEQ ID NO: 56064 - RNA, 45 nt, Mus musculus; identical to SEQ ID NO: 27493

SEQ ID NO: 56065 - RNA, 45 nt, Mus musculus
agccagcagaaaaugcauuggauuuuuagcaaagaguaguugacu

SEQ ID NO: 56066 - RNA, 42 nt, Mus musculus
uucucuuccuguuaccggccuguauuaucccagaaccaggag

SEQ ID NO: 56067 - RNA, 46 nt, Mus musculus
accaaaaacaaaaacaaaaaacccaauaaaacaaaaagcugggcau

SEQ ID NO: 56068 - RNA, 45 nt, Mus musculus
aacuuuaaaauuagaagccgugcaaagaaaaaugcccuaccccca

SEQ ID NO: 56069 - RNA, 27 nt, Mus musculus
ucuguuguccgcagguggugccugaag

SEQ ID NO: 56070 - RNA, 31 nt, Mus musculus
acuuagcagggaagucguaacucuauaucug

SEQ ID NO: 56071 - RNA, 37 nt, Mus musculus
gaacacuuaucccccauccuuucuauccuuacuccga

SEQ ID NO: 56072 - RNA, 46 nt, Mus musculus
gcugagucacauguguuugcugucuaacuagcuguuaugcugucag

SEQ ID NO: 56073 - RNA, 46 nt, Mus musculus
uaccaggcaugcacugugauacuccgauguacauauaccgaaacac

SEQ ID NO: 56074 - RNA, 45 nt, Mus musculus
agauggauggagcagguuuuaaggacaggaauggaaguguguaga

SEQ ID NO: 56075 - RNA, 42 nt, Mus musculus
gagugcguggguggguggcagaacaccuucauagaggcggga

SEQ ID NO: 56076 - RNA, 55 nt, Mus musculus
guuuuguuguugcuguuauuguugcuguuguuuuaacuauagauacaagauagaa

SEQ ID NO: 56077 - RNA, 44 nt, Mus musculus
acucagagaccaagagauuggcauagccccaaauggcuggguua

SEQ ID NO: 56078 - RNA, 47 nt, Mus musculus
uccagcccccagaacuaacguauccuaaaggaauaucguauagagaa

SEQ ID NO: 56079 - RNA, 45 nt, Mus musculus
aauccugaaauacaagaaauagauaugaauuuacaaagcugagaa

SEQ ID NO: 56080 - RNA, 46 nt, Mus musculus
gggaggaagaaauuagggagcuguugcuaccauccggaaaauccag

SEQ ID NO: 56081 - RNA, 46 nt, Mus musculus
ugagauaaauaaguguuuuccuccucacaaauuauccagccucaag

SEQ ID NO: 56082 - RNA, 46 nt, Mus musculus
gucaggcacacacauaagaaaaggguggccaucucaauggacugag

SEQ ID NO: 56083 - RNA, 46 nt, Mus musculus
cuuuguuuagauaguuuuuccuggucucuuuugauuaaaguggugg

SEQ ID NO: 56084 - RNA, 46 nt, Mus musculus
uagcggcuccaugagaaucggcaaagacuguauucuuuucacaaag

SEQ ID NO: 56085 - RNA, 45 nt, Mus musculus
gugugugugugucugugugucugugugucugugugucuguguucu

SEQ ID NO: 56086 - RNA, 41 nt, Mus musculus
ugugcugugguugcgcuagccuuauuuuuucaggcaggacu

SEQ ID NO: 56087 - RNA, 46 nt, Mus musculus
uggguuuuuauuuuuuucuuaugaagcugagaauuauccuuuacag

SEQ ID NO: 56088 - RNA, 45 nt, Mus musculus
ugugggcagcacuauccccuaggcagagaguccugaagucuauga

SEQ ID NO: 56089 - RNA, 46 nt, Mus musculus
aguugguagagcuguuuggaaaggagaaggagguguguccuuauug

SEQ ID NO: 56090 - RNA, 45 nt, Mus musculus
agagcagcaauugcucuuaccuguugagccauuuccccagccccu

SEQ ID NO: 56091 - RNA, 44 nt, Mus musculus
gaaauuuuaguuucucagugaguugaguucauuuuaaccaguca

SEQ ID NO: 56092 - RNA, 69 nt, Mus musculus
agcuguaugcuauuggccagguuuacaguaccagaugugaauccccucccaaggagcagcaccaagucc

SEQ ID NO: 56093 - RNA, 46 nt, Mus musculus
ggcuugccacuguagcacaagugggagcaucuccccuggcuggagu

SEQ ID NO: 56094 - RNA, 47 nt, Mus musculus
uaaccacuuguucuugugggaaagcaacagcaggagcaauagucuag

SEQ ID NO: 56095 - RNA, 37 nt, Mus musculus
cuuaccccugauuuguuucccuugaguucauagauac

SEQ ID NO: 56096 - RNA, 46 nt, Mus musculus
cuaaaacaauggaccuuaaaaauagaauauuucaucaagacagcag

SEQ ID NO: 56097 - RNA, 46 nt, Mus musculus
cuuggggacugggagaagucauuuauacagugucaaugaugagcug

SEQ ID NO: 56098 - RNA, 42 nt, Mus musculus
gugguggcgcacaccuuuaaucucaguacuugggaggcagag

SEQ ID NO: 56099 - RNA, 44 nt, Mus musculus
caaacaaacaaaaaaacccaaaaaaccaauugcauauuccugga

SEQ ID NO: 56100 - RNA, 46 nt, Mus musculus
acaucuucuuucaaagggaaguuuaaaacugaaguucaaaaggcag

SEQ ID NO: 56101 - RNA, 46 nt, Mus musculus
uccucaaaaaaauaucuauucaaauuauagcucuccauggauccag

SEQ ID NO: 56102 - RNA, 46 nt, Mus musculus
gugaggaaccccaugcugggucaaguucuuauuucuaagugggcag

SEQ ID NO: 56103 - RNA, 46 nt, Mus musculus
auuugucaguuuggacuuuaugaagaugucuauaugaagaggcccg

SEQ ID NO: 56104 - RNA, 46 nt, Mus musculus
cauauucuaguuuauugcagaauuauaaucucaugguuaaguacag

SEQ ID NO: 56105 - RNA, 73 nt, Mus musculus
uccaauugcagcugcuguaccagaugugguguucuuacuugagcaaauuaacauaucuccugguacauaguau

SEQ ID NO: 56106 - RNA, 88 nt, Mus musculus
auggcuauugauccagaaaaugcccuuuucagauaccuguccggaaggaguaccagaaguaguuuuucuuucaguugacaaguccagc

SEQ ID NO: 56107 - RNA, 45 nt, Mus musculus
uuccuuaugagguaaaagauaaguuauuucacucccgccaccaag

SEQ ID NO: 56108 - RNA, 46 nt, Mus musculus
ugaguguagccuagaacaagagaaguaucuucaacaaguccaggau

SEQ ID NO: 56109 - RNA, 46 nt, Mus musculus
ggacaugauucagcacaccuauugguucuugagauauaagugguag

SEQ ID NO: 56110 - RNA, 46 nt, Mus musculus
auauuuguguuucauguaaaugcucaucaaaaggugaugccagcag

SEQ ID NO: 56111 - RNA, 46 nt, Mus musculus
uauccuguaauuaaagucaauaggaaacuacaauaaccucaucaag

SEQ ID NO: 56112 - RNA, 46 nt, Mus musculus
cuugaugagguacuugcugaggguggaggaaauacagaauggguaa

SEQ ID NO: 56113 - RNA, 46 nt, Mus musculus
auauuucuuuauuaucaguuuuaagcuuaacauauacaguggccag

SEQ ID NO: 56114 - RNA, 41 nt, Mus musculus
caggaccaagaaugggaguggguguguuggggagcagggca

SEQ ID NO: 56115 - RNA, 74 nt, Mus musculus
acccgacuacacaaauacuuuuuauguguuauguguacagacaccacaaucauagcaacucuaauaaagaacua

SEQ ID NO: 56116 - RNA, 71 nt, Mus musculus
cauuuaauuaggaaaaaaaaagugaaaagggagccaauuucagaaucuuccccagaauaucacguaaaaaa

SEQ ID NO: 56117 - RNA, 48 nt, Mus musculus
gucucucacacacacauaugcacacacaaaaacagaucagauauuuca

SEQ ID NO: 56118 - RNA, 46 nt, Mus musculus
cacaggaauuaccacaaugauugacaggaucuacuuuaagcuguag

SEQ ID NO: 56119 - RNA, 83 nt, Mus musculus
gagaaagggcugccaggagaagggguuagaaggaccacacugggaaggaacaggagggaguaacagccaaaauguagguacaa

SEQ ID NO: 56120 - RNA, 46 nt, Mus musculus
gggggccacccagaaggagccagggaaacaaagauaaaauauggau

SEQ ID NO: 56121 - RNA, 50 nt, Mus musculus
uucagccuugacuuauagcuccaaauucauuguuauucuucauguggaca

SEQ ID NO: 56122 - RNA, 47 nt, Mus musculus
ggaggaaaguguucuagaggaagcauagacagccuugacuucaguga

SEQ ID NO: 56123 - RNA, 45 nt, Mus musculus
uugguagcccaauaucaacccuuccucuccccacaguacccccuc

SEQ ID NO: 56124 - RNA, 46 nt, Mus musculus
aaagaaaaagaaagagagaaagaaagaaaagaaaagaaaagaaaag

SEQ ID NO: 56125 - RNA, 45 nt, Mus musculus
guaucccuuugaccuguuuuuuuuuuuuuuaauuguucuagcuag

SEQ ID NO: 56126 - RNA, 46 nt, Mus musculus
uuuuucaguccuuuauacugacauaauggcuauuuuuguugcugag

SEQ ID NO: 56127 - RNA, 46 nt, Mus musculus
cagagaagaauaagcuagacacaggugaagacagaaugagccagag

SEQ ID NO: 56128 - RNA, 36 nt, Mus musculus
cagagcaguugcggagacucaagagagagaagccag

SEQ ID NO: 56129 - RNA, 46 nt, Mus musculus
uuuuuacagacucuagaagcuuccaggacuaggccuagguuaacag

SEQ ID NO: 56130 - RNA, 45 nt, Mus musculus
uagcucuugaaagacuccgagaggagccccucgcucaggccucag

SEQ ID NO: 56131 - RNA, 46 nt, Mus musculus
gcuacacagagaaacccugucucgaaaaaagccgagagagagagag

SEQ ID NO: 56132 - RNA, 42 nt, Mus musculus
gggccaggaagagggaguggguagguuggggagcagggggag

SEQ ID NO: 56133 - RNA, 45 nt, Mus musculus
aagaauuaauguucacuauauacaaaaaucucuaaaucuaccaag

SEQ ID NO: 56134 - RNA, 46 nt, Mus musculus
cugcccaacucucaugagaacagagaggaaagggaagcuacuugag

SEQ ID NO: 56135 - RNA, 61 nt, Mus musculus
gagagagagagagagagagagagagaacaaguuagacacaggugaagauagagcaagccag

SEQ ID NO: 56136 - RNA, 46 nt, Mus musculus
uucaguuguauaauuaaauauucaauaaucugaacaaaucaagcag

SEQ ID NO: 56137 - RNA, 45 nt, Mus musculus
gccagcagcguaaguucacagugagugaaacuugcgaccccagga

SEQ ID NO: 56138 - RNA, 45 nt, Mus musculus; identical to SEQ ID NO: 40643

SEQ ID NO: 56139 - RNA, 46 nt, Mus musculus
ucuugauuacagauucaaguuccuuacucauaauaacucuguucag

SEQ ID NO: 56140 - RNA, 46 nt, Mus musculus
cuccuuucugccaucuucagguuugguugacccauuuuucagcgag

SEQ ID NO: 56141 - RNA, 63 nt, Mus musculus
gauucaggaaguuucuauagcuaaagugugaugucgugggccagggaagaggaguggagcgaa

SEQ ID NO: 56142 - RNA, 45 nt, Mus musculus
uuauuuguguguuuauuuucuaaagagagaaggaaaguguuugga

SEQ ID NO: 56143 - RNA, 49 nt, Mus musculus
ggggaagagagacagagacaagggacagagagagagacagagacagaga

SEQ ID NO: 56144 - RNA, 42 nt, Mus musculus
cacacacgguacacaugcuuaugggugagcaaagcgccaaua

SEQ ID NO: 56145 - RNA, 46 nt, Mus musculus
uuaaaaauauuuuuuucauacuucuaguaaaguauuuccaaccuag

SEQ ID NO: 56146 - RNA, 45 nt, Mus musculus
gcauauaaaucaauaaacauauuccaccuauaaauaccaaacaga

SEQ ID NO: 56147 - RNA, 47 nt, Mus musculus
uaacacuguuuugggacgaauuuaaauaucagcauagcaaagacaca

SEQ ID NO: 56148 - RNA, 46 nt, Mus musculus
ggguaugugaacguuugaggcaaaaaguuuuugagcauggggugaa

SEQ ID NO: 56149 - RNA, 48 nt, Mus musculus
ggcuuggaguuaaggacaauauacuuucuaucacccgaaguccaguag

SEQ ID NO: 56150 - RNA, 46 nt, Mus musculus
gucaguccagagauaucaggacaagcugguggaagcgcagccgcag

SEQ ID NO: 56151 - RNA, 41 nt, Mus musculus
caacagaccauuauugaaauaguaaauauaucacauccuca

SEQ ID NO: 56152 - RNA, 94 nt, Mus musculus
agugaagagggucacuagguaucuuaguuaauucucuguugcugugauaaaaugugauaaaauuacccaaagcaauuuaaggaagacaggugua

SEQ ID NO: 56153 - RNA, 61 nt, Mus musculus
uuguguccaguuguggcuuucuaugaacaucucugcuggcuguaaagagagguuucuuugc

SEQ ID NO: 56154 - RNA, 77 nt, Mus musculus
ugaggguugguaacuauacuuaccuguggguucgggauaagauuuagaauguaguaagggaguaugcuggucuagag

SEQ ID NO: 56155 - RNA, 46 nt, Mus musculus
ucccucccuuggcaacuggucaaguaccuucuuguagaaaaccaga

SEQ ID NO: 56156 - RNA, 86 nt, Mus musculus
ugcaucucaaauucuguggcucucggugcucuagcacccacaaccaggacaguagaauguaacccuucucuuccucucaaaaccca

SEQ ID NO: 56157 - RNA, 45 nt, Mus musculus
guacacagccuaccuguguguagcaugccagucucuuaccccuag

SEQ ID NO: 56158 - RNA, 46 nt, Mus musculus
uggucaaaccgucaucuuuagaagaugacauuaaaccuucggucaa

SEQ ID NO: 56159 - RNA, 45 nt, Mus musculus
agaaggcaucagccugguguaauggcaugugauucacagaaccca

SEQ ID NO: 56160 - RNA, 44 nt, Mus musculus
acauagaauauucuuugauguucgccuucucccaacuccuccca

SEQ ID NO: 56161 - RNA, 50 nt, Mus musculus
augccuucaucaagcccuuccucucagggcucagugguguagaagaggaa

SEQ ID NO: 56162 - RNA, 105 nt, Mus musculus
uuuaaguaggaaaagaauguagcaagugguggcggaaauuugcuuuguagaacuuaggagacaaagauguuagaaauagagaaacggggcaggguagggagagag

SEQ ID NO: 56163 - RNA, 81 nt, Mus musculus
guaaucagucacaaacugcacucagaggugcauuacuuccucuuagaucuuaagugaaguaaaguuagaacauugcugugg

SEQ ID NO: 56164 - RNA, 47 nt, Mus musculus
ugucccacacaucaucaacacauacacaaaacagggaagugggagga

SEQ ID NO: 56165 - RNA, 56 nt, Mus musculus
auaaaaagauucgugauuaggaaauaguuauucauuagauagcggagagagaacug

SEQ ID NO: 56166 - RNA, 46 nt, Mus musculus
agugacuagcccgcaugccaucagggaggguuaauuuagcaaacag

SEQ ID NO: 56167 - RNA, 42 nt, Mus musculus
cuccuccuccuucuccucuuguauucucuugucuacccccac

SEQ ID NO: 56168 - RNA, 46 nt, Mus musculus
gcuugggggagucaagaugaaacaggagcuucaaaagaaaaaggag

SEQ ID NO: 56169 - RNA, 46 nt, Mus musculus
gcuuuuggaaccaaggcuugaaggaugaacgggguuuagcagaaag

SEQ ID NO: 56170 - RNA, 50 nt, Mus musculus
gguuaucuagugguucagcaguaugaaaggggcccguguaaacagggagg

SEQ ID NO: 56171 - RNA, 53 nt, Mus musculus
agaaguggucaggaucagaaguagacauuaggaagcagcucauaaggcuaugg

SEQ ID NO: 56172 - RNA, 46 nt, Mus musculus
ggauccaccaagcaagagaaagugcuguaaaaauaaccuguucgaa

SEQ ID NO: 56173 - RNA, 45 nt, Mus musculus
cuguguaggcaggcuuugagggcuccuagggucaaacucugccua

SEQ ID NO: 56174 - RNA, 46 nt, Mus musculus
ggaauaugcuccccaggggguggcacuauuggggagguuuggccuu

SEQ ID NO: 56175 - RNA, 51 nt, Mus musculus
augauggugguggagguggucacauuuuggucacauauuagggguacugaa

SEQ ID NO: 56176 - RNA, 45 nt, Mus musculus
auauucaccaaaauuggggguucaagagaacaacuggccugugga

SEQ ID NO: 56177 - RNA, 46 nt, Mus musculus
aucagaagagaaagagagagagagaaagagagagagaaagaaagag

SEQ ID NO: 56178 - RNA, 44 nt, Mus musculus
aaugagaaagaaaguugaaaaggaauaauuuauguaugggagca

SEQ ID NO: 56179 - RNA, 42 nt, Mus musculus
acucuguagacauugggaaaaaaaaacaaaacugcccugcag

SEQ ID NO: 56180 - RNA, 42 nt, Mus musculus
gaaaugggaguggguaggggagagcgggguauaggggacuuu

SEQ ID NO: 56181 - RNA, 45 nt, Mus musculus
cagucugagugacuauuacuucauugugcauaaaagcagcagcau

SEQ ID NO: 56182 - RNA, 46 nt, Mus musculus
ccaccugaguguugauucauuccuuguucacagccacucacaggag

SEQ ID NO: 56183 - RNA, 27 nt, Mus musculus
uaugaaaagaugacaggcuguagcuua

SEQ ID NO: 56184 - RNA, 46 nt, Mus musculus
gauaauuggaaggagccagauucauucuuuauuguguaacccagaa

SEQ ID NO: 56185 - RNA, 46 nt, Mus musculus
acuaaugacaguagcauuaguauauauucauagucacuguugagaa

SEQ ID NO: 56186 - RNA, 23 nt, Mus musculus
uugagaaggguuugggaagucau

SEQ ID NO: 56187 - RNA, 46 nt, Mus musculus
agagggaacagccagagaggcaucugcaagagccugggguagagag

SEQ ID NO: 56188 - RNA, 45 nt, Mus musculus
ggagaaaguuuccuuugggccugaccaguuggcaguaucuagagc

SEQ ID NO: 56189 - RNA, 41 nt, Mus musculus
ggggaacugggguuccaguugcaccugauauguaggggcag

SEQ ID NO: 56190 - RNA, 45 nt, Mus musculus
gcgggggcaaaggcaccaaggaagagaaggaaagaaaccuaauga

SEQ ID NO: 56191 - RNA, 45 nt, Mus musculus
cacugaaacaagaagaagaggaggaaguuccccucauaaagccag

SEQ ID NO: 56192 - RNA, 66 nt, Mus musculus
gaguuaaaaauuaggauagagccagauacuagaauguauguauguucggggugugugugugugugu

SEQ ID NO: 56193 - RNA, 45 nt, Mus musculus
aaaagauagacagaaaauaagcaaccaaugaaacaaaaagcccug

SEQ ID NO: 56194 - RNA, 46 nt, Mus musculus
aauuagugaauuaucacaaacuguguuuaaucaaugcuauccccaa

SEQ ID NO: 56195 - RNA, 42 nt, Mus musculus
aacaugguuauucuugacaucugaaaucccagcuugcccggg

SEQ ID NO: 56196 - RNA, 45 nt, Mus musculus
ugucagcugccggcuucaccaaugccuucucaaagcaugucugug

SEQ ID NO: 56197 - RNA, 46 nt, Mus musculus
ugaauccccuuauaggugggaguucucaaagaauagacgguagaag

SEQ ID NO: 56198 - RNA, 46 nt, Mus musculus
gacccaagcauucaaaccugagcccauagaggccauucuuguucag

SEQ ID NO: 56199 - RNA, 46 nt, Mus musculus
ucauggugacagugccauggaagaugggagggacaacuuuggccag

SEQ ID NO: 56200 - RNA, 46 nt, Mus musculus
gaugauuuuucauacuagaaacaucaguguucuaacaguauuccag

SEQ ID NO: 56201 - RNA, 46 nt, Mus musculus
augcccagagaauauaaacgaaaagcuaaaaacguguuucaaccag

SEQ ID NO: 56202 - RNA, 96 nt, Mus musculus
cagaaggggcuuacucaaccaaguguuucugggacagugugaacugaaaaggaagaggacugaggagaaacucagugaccuucgugcaaagcuggc

SEQ ID NO: 56203 - RNA, 41 nt, Mus musculus
gugagugacaggcugaggggcagcaacaagcucuggggaaa

SEQ ID NO: 56204 - RNA, 48 nt, Mus musculus
aucugggcuugagggauagugugauagacuguuggggacagacaggca

SEQ ID NO: 56205 - RNA, 47 nt, Mus musculus
ccuaauaccacuacaaagaggcaaauggugaccgcuaugaagagagg

SEQ ID NO: 56206 - RNA, 46 nt, Mus musculus
acuuucuuugguaaaaacucauggcucuaagcaagaagucuaggga

SEQ ID NO: 56207 - RNA, 78 nt, Mus musculus
uugcccaugccugugaggggagggguugcuguagacacagagaccgagcagucuggucugucuaaccauacacuguua

SEQ ID NO: 56208 - RNA, 59 nt, Mus musculus
aacacuagaaucuuggcuuguaccaugaguugaugaaaauaccuggacaaaaggagcuu

SEQ ID NO: 56209 - RNA, 46 nt, Mus musculus
uaccucauuuaacacagucaagauaaccuuccauaggcaugcccag

SEQ ID NO: 56210 - RNA, 46 nt, Mus musculus
aauuuuauuuuauauaaaaauaaaaauaaaauuuucuuaaucucag

SEQ ID NO: 56211 - RNA, 87 nt, Mus musculus
gagaagguagaaaggaggaagagagagagagagaaaagaagaaagagaaaggaaagaggagagagaagugacauaagagagagguga

SEQ ID NO: 56212 - RNA, 41 nt, Mus musculus
ccuguuccccaagcccagauggaaagggguuuuagcugcca

SEQ ID NO: 56213 - RNA, 63 nt, Mus musculus
aaauccuuaaccacuuguaaacguaaaauaagaugaaaugagagaaaacauuugcaaagguaa

SEQ ID NO: 56214 - RNA, 46 nt, Mus musculus
gacccgcagcagauugaugcuuacuuagaagauuugcuuaaagaag

SEQ ID NO: 56215 - RNA, 45 nt, Mus musculus
guacacauaugaaucaauaucuugggagauauguuauugggagau

SEQ ID NO: 56216 - RNA, 46 nt, Mus musculus
aaguuugaaacacagcucugaauauggccgaguggaugcugccaga

SEQ ID NO: 56217 - RNA, 42 nt, Mus musculus
aauauuuuuaaaaaauaaaagaaaggaauaaaggggggguag

SEQ ID NO: 56218 - RNA, 41 nt, Mus musculus
ccuccuugagcacuuacucaccagaaggacaggaggccagu

SEQ ID NO: 56219 - RNA, 46 nt, Mus musculus
uuagaaaaacaccagcugcagguaccaugcuagcuaauuggaggga

SEQ ID NO: 56220 - RNA, 26 nt, Mus musculus
cuugguccuguggguagagauguuug

SEQ ID NO: 56221 - RNA, 41 nt, Mus musculus
aaagacgauaggaauccaauaucaaggaaaauagccaggca

SEQ ID NO: 56222 - RNA, 45 nt, Mus musculus
cacaaguugacccccaacacaaacacauacacacuagagguggag

SEQ ID NO: 56223 - RNA, 48 nt, Mus musculus
gguuacuaaaaaguugaaucugggacccugggcuuugucacagagaca

SEQ ID NO: 56224 - RNA, 63 nt, Mus musculus
aaaaggacuaagauuccagauggcaaauucuaugaauggcagaaauccugguggucgaggagg

SEQ ID NO: 56225 - RNA, 46 nt, Mus musculus
gcguuguuuauugugaaaggaaaauguaugcuggaggcuguguggg

SEQ ID NO: 56226 - RNA, 45 nt, Mus musculus
uugaacucgaggggcuggaaaacaucuuucaccgaaggaaugaag

SEQ ID NO: 56227 - RNA, 45 nt, Mus musculus
gcagagucugaagguuggcgcaaugcaaggaagacuagggauggg

SEQ ID NO: 56228 - RNA, 46 nt, Mus musculus
auggggggaaaaucugcaguccccgagcaucuugaggguucccgaa

SEQ ID NO: 56229 - RNA, 75 nt, Mus musculus
ugguaaagagaugggaauuaggacauagaauagcaauggaaaggugaagaaagagcaguuguguauuaaucucua

SEQ ID NO: 56230 - RNA, 45 nt, Mus musculus
agacacacguaggggcguuuuaagugaauauauacaucucuuuug

SEQ ID NO: 56231 - RNA, 46 nt, Mus musculus
guaagacugugccaaaaucccaagcuucaguugaaaaacagcccac

SEQ ID NO: 56232 - RNA, 46 nt, Mus musculus
cuugccuguuuccuuuuccuauuauuuaaguuuggcaaaaguugag

SEQ ID NO: 56233 - RNA, 46 nt, Mus musculus
gauugugagauaggggucucuccucacuaaccuucagaccugccag

SEQ ID NO: 56234 - RNA, 42 nt, Mus musculus
guauuuccacauaguauucaaaacaguguucagacuuggcag

SEQ ID NO: 56235 - RNA, 46 nt, Mus musculus
ugcgcaugcgcagugagcauucacagcucucccacucaguggcugg

SEQ ID NO: 56236 - RNA, 46 nt, Mus musculus
uucagucaguuacccccaaaugaagauguggcauguuugucucagg

SEQ ID NO: 56237 - RNA, 45 nt, Mus musculus
gcuucaggcugagacuauuuucaucaccagcuucucaggaggaca

SEQ ID NO: 56238 - RNA, 44 nt, Mus musculus
ggggcauggggauuccacagucagaaggaugcaauagcaaggga

SEQ ID NO: 56239 - RNA, 87 nt, Mus musculus
cagcuguuucuguggaguccagacugccaucuauuuuuaguagaagcugggagaaugucagaggugauguuugaguuucuccgcccu

SEQ ID NO: 56240 - RNA, 45 nt, Mus musculus
uuucacuuauugaauucaagcacagccuuuuaauuucagcacacg

SEQ ID NO: 56241 - RNA, 85 nt, Mus musculus
ggccauugaaccgguucuauaaacaaggacuuuucugagccacagauaggaauacaagaaguacacagauagcgugucagccagc

SEQ ID NO: 56242 - RNA, 46 nt, Mus musculus
acuccccugaaggagcaggucugcugcuuugauuuaagaagcccgg

SEQ ID NO: 56243 - RNA, 46 nt, Mus musculus
caaaacacaauagaauauuugggaacaaaggauaacuguugacuag

SEQ ID NO: 56244 - RNA, 46 nt, Mus musculus
ugugugugugugugugugugugagagagagagagagagauggggaa

SEQ ID NO: 56245 - RNA, 46 nt, Mus musculus
uaaaauuccacuguuuauuuucacaagggagaaaauaagguugcag

SEQ ID NO: 56246 - RNA, 46 nt, Mus musculus
uuuguuacuuaccauugaauuguguguuugggaccuucgaccgucu

SEQ ID NO: 56247 - RNA, 45 nt, Mus musculus
uguuuucuguucucaucuucccacuucuauguaugugugugugua

SEQ ID NO: 56248 - RNA, 45 nt, Mus musculus
acacacacacacacacacacacacacagacacccuuaugugcaag

SEQ ID NO: 56249 - RNA, 45 nt, Mus musculus
gcacagugcuaguguaacaguaaguaccgacugaggugcguggag

SEQ ID NO: 56250 - RNA, 45 nt, Mus musculus
agccugcugcagaggaucagguuuguacaaaaccacaacagaaag

SEQ ID NO: 56251 - RNA, 45 nt, Mus musculus
agugaggaugaggaacagguacagugaggaugaggaacaggugca

SEQ ID NO: 56252 - RNA, 47 nt, Mus musculus
agugaggaugagaaacagguacagugaggaugaagaacaggugcagu

SEQ ID NO: 56253 - RNA, 45 nt, Mus musculus; identical to SEQ ID NO: 56251

SEQ ID NO: 56254 - RNA, 45 nt, Mus musculus; identical to SEQ ID NO: 56251

SEQ ID NO: 56255 - RNA, 47 nt, Mus musculus
guagugaggaugaggaacagugcagugaggaugaggaacaugugcag

SEQ ID NO: 56256 - RNA, 44 nt, Mus musculus
auuuuugaaauuaaaaagccaagggugggcuguuccagcugggu

SEQ ID NO: 56257 - RNA, 45 nt, Mus musculus
gguuagcguagaaugugcucuugagaaaagugaugauggcagguu

SEQ ID NO: 56258 - RNA, 23 nt, Mus musculus
agaugguaaaaagaacauacuca

SEQ ID NO: 56259 - RNA, 46 nt, Mus musculus
uacuacagggcaaaugugauaaaagcugcaugguacugguauagag

SEQ ID NO: 56260 - RNA, 42 nt, Mus musculus
gugguuuaagcuuaaugcuagcuguggcuuugaugcccgcag

SEQ ID NO: 56261 - RNA, 23 nt, Mus musculus
uggggagaggggagucuguaaau

SEQ ID NO: 56262 - RNA, 45 nt, Mus musculus
gcucucaugggguucugggucucucuuccuucauuucuccuguau

SEQ ID NO: 56263 - RNA, 46 nt, Mus musculus
uccucgguccuuaaaccaagccuggauaugauagacagucacagag

SEQ ID NO: 56264 - RNA, 46 nt, Mus musculus
agucuuccuaaagugugcacaauacuuuauggcuguugguugugua

SEQ ID NO: 56265 - RNA, 46 nt, Mus musculus
gcuuaguaacguaagacuucauagcagaguaaggauauggacccag

SEQ ID NO: 56266 - RNA, 46 nt, Mus musculus
cuuuauuuuuaucggcuuugcccgaauggaagcuuguauauagcag

SEQ ID NO: 56267 - RNA, 46 nt, Mus musculus
aaucaacuuucauauuuaauuuguuaacauuuuaauuagcccacaa

SEQ ID NO: 56268 - RNA, 42 nt, Mus musculus
cagaaaucaaggcgaucuuucccaauggccaguuccagggag

SEQ ID NO: 56269 - RNA, 23 nt, Mus musculus
uucacccuccuccaaaaggccac

SEQ ID NO: 56270 - RNA, 45 nt, Mus musculus
acggguaggugcugauuauuccuaauugguucuugauugugucaa

SEQ ID NO: 56271 - RNA, 41 nt, Mus musculus
guaaggccuuagugcacuuagggccugcagccucugcagca

SEQ ID NO: 56272 - RNA, 45 nt, Mus musculus
cucucucucugccuccaaacauuccccucccccucucagucccag

SEQ ID NO: 56273 - RNA, 45 nt, Mus musculus
gaaagcauagguaauguagcagcugugaugaccuucaccugggca

SEQ ID NO: 56274 - RNA, 46 nt, Mus musculus
gauuggugaaaagauguaauaacuaucacaauuucaaucccuaugu

SEQ ID NO: 56275 - RNA, 46 nt, Mus musculus
auucacacacuucucugugcacucacaggcaucguuaucaccccag

SEQ ID NO: 56276 - RNA, 41 nt, Mus musculus
ccaagauguucaccucgugucaccuagaaauuggcgagaaa

SEQ ID NO: 56277 - RNA, 46 nt, Mus musculus
cuucucaauaguuuuauuuuccauacucauuccuuuauuaaccaag

SEQ ID NO: 56278 - RNA, 45 nt, Mus musculus
cagagagaaucugugacuguaaaaugaugaguuguugccuuucua

SEQ ID NO: 56279 - RNA, 45 nt, Mus musculus
cccacugacgccagacagugcaguccucugcuacauaugugccag

SEQ ID NO: 56280 - RNA, 46 nt, Mus musculus
cuguuaaggagaagggugaauggguuaaaacuagaaacgacaauag

SEQ ID NO: 56281 - RNA, 46 nt, Mus musculus
cuucauauaaccuuuugcuuauuacugaaauggggcagugcuagag

SEQ ID NO: 56282 - RNA, 46 nt, Mus musculus
gcccagaacaaguccucacagcaggguaaugauuguuaaaugccag

SEQ ID NO: 56283 - RNA, 47 nt, Mus musculus
uccucaccccuugcccagagaagaaagccucagccagacccucucca

SEQ ID NO: 56284 - RNA, 43 nt, Mus musculus
gagauaccggacaguguuuaggucgguuguuuguaccuggaug

SEQ ID NO: 56285 - RNA, 76 nt, Mus musculus
cccccaugcauaacucgguguuauugaagggacuaggucuucuugcucagucagaaucgggaauguugaaucacug

SEQ ID NO: 56286 - RNA, 56 nt, Mus musculus
cuuauaaugacauucccacacucauuuaaacaggaacccucucuccccuacauuua

SEQ ID NO: 56287 - RNA, 47 nt, Mus musculus
acugaaaagaauuucaccucuuuagcucagauucaguuggccccagc

SEQ ID NO: 56288 - RNA, 46 nt, Mus musculus
cugauccaguaccguuaccaccugccaggccuccaccccgggacag

SEQ ID NO: 56289 - RNA, 46 nt, Mus musculus
gccugauacuuaagggcuggaaaaaagauuugaauuuaauuaugug

SEQ ID NO: 56290 - RNA, 46 nt, Mus musculus
uaaagucagacuggagauguguuaguggagcagaguugaagguugc

SEQ ID NO: 56291 - RNA, 46 nt, Mus musculus
auauuguacauuguguacauauauaaaguucugaagcaaaagaaag

SEQ ID NO: 56292 - RNA, 45 nt, Mus musculus
aacucacacugcagcagcuacgacggaagucucccucaugcccag

SEQ ID NO: 56293 - RNA, 46 nt, Mus musculus
guggggucaauagcaucauucaugugcaggauuucgaguguuauag

SEQ ID NO: 56294 - RNA, 46 nt, Mus musculus
guuccaccagccuccgaguccguccuggugccguggcucugugaug

SEQ ID NO: 56295 - RNA, 46 nt, Mus musculus
agucuuaggagaccuguuauuggaaauuguuuuacucucgugugug

SEQ ID NO: 56296 - RNA, 42 nt, Mus musculus
cagcuagaccccccaaaccacgaccccgaaggacugcaccag

SEQ ID NO: 56297 - RNA, 46 nt, Mus musculus
ccugugccaucuguuggaauccugugcgcaggacuggcaagaagau

SEQ ID NO: 56298 - RNA, 48 nt, Mus musculus
aggagccacggccuguuguguacugacuucggggugccagacggucaa

SEQ ID NO: 56299 - RNA, 45 nt, Mus musculus
ugcugcagugauguagucagccagagauucaggcacugugggcug

SEQ ID NO: 56300 - RNA, 61 nt, Mus musculus
ccacaaugucuaccauccgaagucgagccagagcaguggaaagucggagaauggccagcag

SEQ ID NO: 56301 - RNA, 44 nt, Mus musculus
guuuacggggagggucucagggaaacaaacagcgaaccgcucaa

SEQ ID NO: 56302 - RNA, 42 nt, Mus musculus
uuguagcuuuccacccauccaauucuagcugcucaggagggg

SEQ ID NO: 56303 - RNA, 42 nt, Mus musculus
auauaaaugacuucucuuccuaugaaagguauauggcaccag

SEQ ID NO: 56304 - RNA, 45 nt, Mus musculus
cacgccccgcauccuggaaagccagcggguccacccagcacccca

SEQ ID NO: 56305 - RNA, 42 nt, Mus musculus
ccagacugcggccggcggcugggcugcaggacuccggagcag

SEQ ID NO: 56306 - RNA, 46 nt, Mus musculus
uguguauauaugccauauauagugcauuaauauauaauuacuauau

SEQ ID NO: 56307 - RNA, 41 nt, Mus musculus
uaaguucucacuucauauaguaauuauauauuaaugcacua

SEQ ID NO: 56308 - RNA, 47 nt, Mus musculus
ugccauuuaucuguccugccuuuucuucuguauugcugucccccucc

SEQ ID NO: 56309 - RNA, 46 nt, Mus musculus
uuuuuuagaucuuagcauagauuuuaaacugaacuuaaucuggauu

SEQ ID NO: 56310 - RNA, 46 nt, Mus musculus
guagugagaauccagauuaaguucaguuuaaaaucuaugcuaagau

SEQ ID NO: 56311 - RNA, 46 nt, Mus musculus
uuaaaaucaaugucuauauugaaucaauauguaaaaauuaugagaa

SEQ ID NO: 56312 - RNA, 46 nt, Mus musculus
ucagcuugcuaaauucccacuggcggguagcuaccacaccagcccc

SEQ ID NO: 56313 - RNA, 46 nt, Mus musculus
cacuuacccuccacaaacguauacuacccaaccaucucagccugcc

SEQ ID NO: 56314 - RNA, 45 nt, Mus musculus
uagagaccugguuaauaaagcagcacugguuuugguugacuguag

SEQ ID NO: 56315 - RNA, 45 nt, Mus musculus
cauuagggagguugagaaccacugacuuaagguaaauuucagguc

SEQ ID NO: 56316 - RNA, 46 nt, Mus musculus
agaaaaacagaauagacaacaguaauaagcuacauauaagggagaa

SEQ ID NO: 56317 - RNA, 45 nt, Mus musculus
ccugcugaggaaugcugcuagcagggagugaaaccacccuaggag

SEQ ID NO: 56318 - RNA, 46 nt, Mus musculus
gcagcuguacuugguauuguguaagagucacccgcuuuuugaagca

SEQ ID NO: 56319 - RNA, 45 nt, Mus musculus
aguccagaauagaaggcauuacugggacaauugauucugguuagg

SEQ ID NO: 56320 - RNA, 46 nt, Mus musculus
auuuucuugauauuuuggugaagaauguggcugcuuuuugccguua

SEQ ID NO: 56321 - RNA, 45 nt, Mus musculus
cuucugaguaaugaugaaguuacaauaaaguauaaggaugaaggu

SEQ ID NO: 56322 - RNA, 51 nt, Mus musculus
ugguuuguugauucagugaaaguggguggagguaauaagcagaucauuuga

SEQ ID NO: 56323 - RNA, 46 nt, Mus musculus
acaaaagcacagcuuuaaaaagucacauaguguuuagggcuuugaa

SEQ ID NO: 56324 - RNA, 48 nt, Mus musculus
gaaagcuggcaauagugaaaguucaggaaugaaagcagaguagccugu

SEQ ID NO: 56325 - RNA, 52 nt, Mus musculus
gugauuuggugagggauuuuccacauuaaaggggcgggggugaaaauggagg

SEQ ID NO: 56326 - RNA, 46 nt, Mus musculus
uuguaagaucuucauuccugucagacuaucaaugaaaguaugagau

SEQ ID NO: 56327 - RNA, 41 nt, Mus musculus
aggcuacccagagaaauccugucuuggggaggcggggacaa

SEQ ID NO: 56328 - RNA, 45 nt, Mus musculus
uuagaauaaucaagguucuuuaaagaaagaaaagaaaagagagaa

SEQ ID NO: 56329 - RNA, 42 nt, Mus musculus
agcccaaagcguuugugccugauccccgggaguggcuuggac

SEQ ID NO: 56330 - RNA, 42 nt, Mus musculus
gccccgcugauaccccaaguccuguucccuccggccccagag

SEQ ID NO: 56331 - RNA, 46 nt, Mus musculus
agcucuuaacuagucugaugguuccuaggcauuucagucccaagau

SEQ ID NO: 56332 - RNA, 45 nt, Mus musculus
auauagucaguaauauuuugauuuggacaacuuacugccuguaaa

SEQ ID NO: 56333 - RNA, 45 nt, Mus musculus
guuugauucugggguggugucuguggcaugaagauagccccuaac

SEQ ID NO: 56334 - RNA, 45 nt, Mus musculus
caucguucuuuuuggaaauagcuuacugcaaagugggccugggca

SEQ ID NO: 56335 - RNA, 46 nt, Mus musculus
caccuugucuguguaggaguccuggguuaauucuuucuagucaggg

SEQ ID NO: 56336 - RNA, 45 nt, Mus musculus
auuguacuuaauucauuacauuaauacauugcauauuguucagaa

SEQ ID NO: 56337 - RNA, 44 nt, Mus musculus
gaugcugggaaacuguauaauaccugcucuguguuugggccuga

SEQ ID NO: 56338 - RNA, 42 nt, Mus musculus
aucagauaaccuuacccgggcuuguagccuagugcgggaggc

SEQ ID NO: 56339 - RNA, 46 nt, Mus musculus
gcccuggaggaugucuguucucuuuaucuguauuuugccugcagau

SEQ ID NO: 56340 - RNA, 48 nt, Mus musculus
acucuauucugauaucuaaauaaaaacaauguauuugagugguugaag

SEQ ID NO: 56341 - RNA, 45 nt, Mus musculus
guugguugauagaaauaucuagauguaccccaccaguagccagug

SEQ ID NO: 56342 - RNA, 46 nt, Mus musculus
uuaauguaaaagaaaguuauuuaagugaaauuaaggcaacgaagag

SEQ ID NO: 56343 - RNA, 46 nt, Mus musculus
ugauuccaaaugcaggagaugcuaccagagccauaaaacagcagau

SEQ ID NO: 56344 - RNA, 46 nt, Mus musculus
ugucagaugaugauaggaaagagguugucaacauccagaccuggau

SEQ ID NO: 56345 - RNA, 42 nt, Mus musculus
ugacaucuuuucucaaaagugcaacauguacucccaggaguu

SEQ ID NO: 56346 - RNA, 46 nt, Mus musculus
gggaagaagcugcuggggagagagcuguaagugaaaaagcuccaag

SEQ ID NO: 56347 - RNA, 47 nt, Mus musculus
aagaccaugaaguugauugaacucaccuccauuuucuccggaaggua

SEQ ID NO: 56348 - RNA, 41 nt, Mus musculus
accuuuguuggccuagcuuucccagucagaggcacgguuaa

SEQ ID NO: 56349 - RNA, 41 nt, Mus musculus
ggcucuggguguguguguguguguguguguguguguaugug

SEQ ID NO: 56350 - RNA, 49 nt, Mus musculus
uuuuaagagcaggcaaacuauucauguuuucauuaguuaaaaagcuacu

SEQ ID NO: 56351 - RNA, 46 nt, Mus musculus
agagguuguguguguguguguguguguguguguguguauguguguu

SEQ ID NO: 56352 - RNA, 45 nt, Mus musculus
ucucccuucccagaagaaagugaauguacaauuuccagugcagug

SEQ ID NO: 56353 - RNA, 46 nt, Mus musculus
ucuggaggaguuuuuaagccuaggaaaauucuuuugguaagcauuu

SEQ ID NO: 56354 - RNA, 47 nt, Mus musculus
auacuauccucccugcugacuaggcccaaguuuuacaccucauuuuu

SEQ ID NO: 56355 - RNA, 45 nt, Mus musculus
uacaguaaaagacccuuaaaguggaauaacuaaguccugucacua

SEQ ID NO: 56356 - RNA, 46 nt, Mus musculus
acuucuuuaugagauccuaaucuguucuuuguauaauauagaagaa

SEQ ID NO: 56357 - RNA, 46 nt, Mus musculus
cagccugccugccuaucuauccauccaucuaucuauccaucuaucu

SEQ ID NO: 56358 - RNA, 46 nt, Mus musculus; identical to SEQ ID NO: 56357

SEQ ID NO: 56359 - RNA, 46 nt, Mus musculus
cagccugccugccuaucuauccauccaucuaucuaucuaucuaucu

SEQ ID NO: 56360 - RNA, 46 nt, Mus musculus; identical to SEQ ID NO: 56359

SEQ ID NO: 56361 - RNA, 46 nt, Mus musculus; identical to SEQ ID NO: 56359

SEQ ID NO: 56362 - RNA, 45 nt, Mus musculus
cccaagauauaagauacaauuugugaaacucaugaaacucuacaa

SEQ ID NO: 56363 - RNA, 42 nt, Mus musculus
cauccaccaccaucaaagcaaaggacuucagcuuggucagcu

SEQ ID NO: 56364 - RNA, 45 nt, Mus musculus
ggaagagaagaagacuggcugcaucugaaggacagcacagacucc

SEQ ID NO: 56365 - RNA, 44 nt, Mus musculus
aauguggucuggaguaaccuuuaugugaaguggcugcccaggug

SEQ ID NO: 56366 - RNA, 46 nt, Mus musculus
uuggggugccacaguuugguaucaccgcugugcugguguaggagug

SEQ ID NO: 56367 - RNA, 42 nt, Mus musculus
ccggucuggggagacucugaaaauugcaugcuuggcgcugau

SEQ ID NO: 56368 - RNA, 41 nt, Mus musculus
uaauuuaauauguuccuuuaaaagcugugcucucugcccug

SEQ ID NO: 56369 - RNA, 42 nt, Mus musculus
uggccgcucauuggucucagcaugaggaggaggcguggccag

SEQ ID NO: 56370 - RNA, 45 nt, Mus musculus
agccuugcuuacguuugcaauucguucuucagagcaccugcccau

SEQ ID NO: 56371 - RNA, 46 nt, Mus musculus
ucacauuuaaacugagcaaccuaagguuuagaggucuaauaggcag

SEQ ID NO: 56372 - RNA, 46 nt, Mus musculus
gaaacaaaaauaauguuaugguuggggucagcacagcauuaggaac

SEQ ID NO: 56373 - RNA, 47 nt, Mus musculus
ugaagaucugcauuccuuuugaauucagaucuguaaauuauugcaug

SEQ ID NO: 56374 - RNA, 46 nt, Mus musculus
uaaauuccuaaauaaauguuuaaaacuugaauaaaacuaagaggag

SEQ ID NO: 56375 - RNA, 29 nt, Mus musculus
uaugaaauuccuacacauaaauacuaaag

SEQ ID NO: 56376 - RNA, 42 nt, Mus musculus
gagagugugaagauuggcaguguggggaaggggugaugggaa

SEQ ID NO: 56377 - RNA, 45 nt, Mus musculus
ugucuaaaaaccauaccugguuuggaguuuggauaaaacagcuug

SEQ ID NO: 56378 - RNA, 46 nt, Mus musculus
gauuauuucacagacauuugaauauguucaauguuuuccuugggga

SEQ ID NO: 56379 - RNA, 41 nt, Mus musculus
uauucagcucugaggggguugugacccacagaguaggucaa

SEQ ID NO: 56380 - RNA, 46 nt, Mus musculus
aacauugauuuuaaaauaacaaucucaaguugacugaugucugcag

SEQ ID NO: 56381 - RNA, 69 nt, Mus musculus
ucacaugugaguggcgugaggugugucgcagucacaugugaguggcgugaggugugucacagucacaug

SEQ ID NO: 56382 - RNA, 100 nt, Mus musculus
ucacaugugaguggcgugaggugugucgcagucacaugugaguggcgugaggugugucacagucacaugugaguggcgugaggugugucgcagucacaug

SEQ ID NO: 56383 - RNA, 46 nt, Mus musculus
uucucuccaucuugaguagaugugcuaagaaccguguugucugcug

SEQ ID NO: 56384 - RNA, 49 nt, Mus musculus
auaccuauccuaacagcacugugugugaaugggagauucgagucaggac

SEQ ID NO: 56385 - RNA, 45 nt, Mus musculus
ucaccuuaauuaccugaaaaucuuuaauggaauuggagucagcag

SEQ ID NO: 56386 - RNA, 84 nt, Mus musculus
caaguggucucauuucguccacauauuauaaugugucagagguaggaggagaaugcgaaggagaaggcgccgaaagcuaugacu

SEQ ID NO: 56387 - RNA, 45 nt, Mus musculus
aguccuuaauguaaggcacagaauuuuuaaauuuaucuugcccag

SEQ ID NO: 56388 - RNA, 63 nt, Mus musculus
guggucuggguuuacaaaugaaucagucaauugaguccaaaggcagugaagucacagugcugu

SEQ ID NO: 56389 - RNA, 57 nt, Mus musculus
ucaugaguggaacccaugcugcugggcgaggauuuuuggcuucauacucaguuauag

SEQ ID NO: 56390 - RNA, 46 nt, Mus musculus
ucccaauugacaucugaaagcauggaguuuuguauguccugucccg

SEQ ID NO: 56391 - RNA, 46 nt, Mus musculus
aaauuucaauucaaaaacaucauuuagagcuggagagaugguucag

SEQ ID NO: 56392 - RNA, 49 nt, Mus musculus
uaaaaaaauuuuuaagaagguauauaaaaagaaaggagaaaaagaaaga

SEQ ID NO: 56393 - RNA, 41 nt, Mus musculus
agaugaaauucccaucuuauucugccaagugcccuugccuc

SEQ ID NO: 56394 - RNA, 46 nt, Mus musculus
ccugaacaucuucaccacuuggggaccaaguguucaaaugccagag

SEQ ID NO: 56395 - RNA, 46 nt, Mus musculus
acauauuaugcugggagcaugcauguguugguuaagucaaauagaa

SEQ ID NO: 56396 - RNA, 25 nt, Mus musculus
gcagcaauagaaaagcuuuucagaa

SEQ ID NO: 56397 - RNA, 46 nt, Mus musculus
accuuacaaaaaaaccauuuagcacacuccuauaaucccagugcag

SEQ ID NO: 56398 - RNA, 46 nt, Mus musculus
uuugucuuucuuucuuuauuuauuaugcauacaguguucugccugc

SEQ ID NO: 56399 - RNA, 46 nt, Mus musculus
cucaugagccaccauaugguugcuggaaauugaauuuaggaccuca

SEQ ID NO: 56400 - RNA, 30 nt, Mus musculus
cugcaacuugaauauggacuuaggugacag

SEQ ID NO: 56401 - RNA, 46 nt, Mus musculus
cgugcuggguggccaaaucagcauugugauuagcaaagggacccca

SEQ ID NO: 56402 - RNA, 42 nt, Mus musculus
acagcaucgucugcacuggaguggacugaccacauggggcag

SEQ ID NO: 56403 - RNA, 45 nt, Mus musculus
cacugaugagcaucaguggcugcagauagaccuuaacaaggagaa

SEQ ID NO: 56404 - RNA, 45 nt, Mus musculus
uugagacagugucccaaguauuaugaaauuuacucaugagcugau

SEQ ID NO: 56405 - RNA, 45 nt, Mus musculus
ugacuucauuacagaugugcugcaccacacccaguucuaugagga

SEQ ID NO: 56406 - RNA, 46 nt, Mus musculus
uugcucucaauuacgaguuuccagcucacuuacuucaucuguauuu

SEQ ID NO: 56407 - RNA, 46 nt, Mus musculus
gaaagccuggugcuuagcuguguggucuguguccucucggccuccu

SEQ ID NO: 56408 - RNA, 47 nt, Mus musculus
aagcuuuuuuacccacauuauauauuaauucacuaauggggagagcu

SEQ ID NO: 56409 - RNA, 46 nt, Mus musculus
ucucagucaaagagagaaguucucuaggacgguuuuguugcaggau

SEQ ID NO: 56410 - RNA, 46 nt, Mus musculus
aauuacuauuccaaguaacuuggaacagaccguuuucagugcgaug

SEQ ID NO: 56411 - RNA, 46 nt, Mus musculus
guuucuaggugacaguggacuuguuauaauaugcauuuuggcccgu

SEQ ID NO: 56412 - RNA, 45 nt, Mus musculus
ccucaccacacucauccucauucuagugugugcuuggcacuggag

SEQ ID NO: 56413 - RNA, 46 nt, Mus musculus
aucucuagccaccaacauaacuacugaggugcugucugagcuuggg

SEQ ID NO: 56414 - RNA, 42 nt, Mus musculus
augguggugaaccacuauguggguacuaggaauugaacucag

SEQ ID NO: 56415 - RNA, 42 nt, Mus musculus
acugcaagccccuuuuccuacagauccaucucaccagcccaa

SEQ ID NO: 56416 - RNA, 45 nt, Mus musculus
gugugugucugugugugugugugucugugugugucugugugugac

SEQ ID NO: 56417 - RNA, 45 nt, Mus musculus
guauaguuggguacagcuucaggggggcugaaaaaauguuggcag

SEQ ID NO: 56418 - RNA, 46 nt, Mus musculus
aggaaugaagcagcuucucccugccaagucgguggaccacgaggag

SEQ ID NO: 56419 - RNA, 45 nt, Mus musculus
aggcauccauuuaaagcacauggcuuuuuucauucuuagugguag

SEQ ID NO: 56420 - RNA, 45 nt, Mus musculus
ugcuuuaaagggguuacugugugacacaguuacugcucgccugcu

SEQ ID NO: 56421 - RNA, 46 nt, Mus musculus
ugguggccuugcuccaaccuguguucauaaacccuggcagcuccua

SEQ ID NO: 56422 - RNA, 45 nt, Mus musculus
aacuaaaauuuaaccuucuuugcuuucuuuacacacaagcccaaa

SEQ ID NO: 56423 - RNA, 46 nt, Mus musculus
aaaaagaaagccaacaugagccaggucugauggcucaagccagcaa

SEQ ID NO: 56424 - RNA, 46 nt, Mus musculus
uuaagugguccuuugugucagaccugguugacagagaugcugugcg

SEQ ID NO: 56425 - RNA, 116 nt, Mus musculus
uuacuugucagugcuugacaaccgggcugcacucacgucaggucggguaaauuaaauguuacagcggauuagcacugaagcagcacaucggaugaaaacacaaacuugaucccucg

SEQ ID NO: 56426 - RNA, 46 nt, Mus musculus
gauuuggauagccuugaacaguguuaacugugcuuccuuccacaag

SEQ ID NO: 56427 - RNA, 49 nt, Mus musculus
augaagcaaaaaaaagcacagaugcuguacuaaaacauguaagaaugug

SEQ ID NO: 56428 - RNA, 46 nt, Mus musculus
uuuucauaacauaccuaguuauuguuauaugguuuucucuugcaga

SEQ ID NO: 56429 - RNA, 46 nt, Mus musculus
uacuuuuccuuuuaauuuuuuguauuauagauuacaugucugguaa

SEQ ID NO: 56430 - RNA, 46 nt, Mus musculus
aguggguuucucuuuuccugauaguacaauugauuagagacagcag

SEQ ID NO: 56431 - RNA, 46 nt, Mus musculus
aaguuacacuaacuuggcugucacuugauccuuggaaccagcacag

SEQ ID NO: 56432 - RNA, 45 nt, Mus musculus
gcaguaaagggaguaggaaagcaagauagaaaaaagacagacaag

SEQ ID NO: 56433 - RNA, 85 nt, Mus musculus
uuggguugaacuugaaaguccuugaacugcaaaaacucuaggaaguuggaugguuguaggguaucuagguuaacuguggcaccaa

SEQ ID NO: 56434 - RNA, 45 nt, Mus musculus
gcacugggaauggugaaaauaaaacuuacucaaguacagaagaag

SEQ ID NO: 56435 - RNA, 42 nt, Mus musculus
ccuuugcugauguuugcaccucauccucugugacccccagga

SEQ ID NO: 56436 - RNA, 42 nt, Mus musculus
cugauacaaaaaaaauaauauugggcaaaacacucacccaca

SEQ ID NO: 56437 - RNA, 45 nt, Mus musculus
uucccagaauuccuugaaaaaagucucuacuuugaugggugagau

SEQ ID NO: 56438 - RNA, 43 nt, Mus musculus
cuuauuuaaaaccuucuucuucccacugaugcuccggcagaca

SEQ ID NO: 56439 - RNA, 44 nt, Mus musculus
ccucuuaccucaacaucaucauaauguggagggaggcccugaga

SEQ ID NO: 56440 - RNA, 45 nt, Mus musculus
aggcuauucagagaaacccugucucgaaaaaccaaaaaaauaaaa

SEQ ID NO: 56441 - RNA, 46 nt, Mus musculus
gccacacaaaauaguuccaacauaagaaucuuugaaauggccaggc

SEQ ID NO: 56442 - RNA, 42 nt, Mus musculus
gagagagagagagagucagacagagucagagacagaaggagg

SEQ ID NO: 56443 - RNA, 45 nt, Mus musculus
aaucagggacuccaguucaugaaaagcaguauaaccugcaguaga

SEQ ID NO: 56444 - RNA, 77 nt, Mus musculus
auagagaaaaucaacaauucucugcauaaaggcacuagaguacuuggauuaaagacuccgaccagagagacagugcc

SEQ ID NO: 56445 - RNA, 41 nt, Mus musculus
aaaguauuuucggagccagugaugcucuuuaaaggaguuau

SEQ ID NO: 56446 - RNA, 45 nt, Mus musculus
uuuuuggagaaacaacuccuuuucugaccaccggccaugcugcag

SEQ ID NO: 56447 - RNA, 45 nt, Mus musculus
uaagacuugaaaauuccagcguguuccugguugucuucaggguaa

SEQ ID NO: 56448 - RNA, 46 nt, Mus musculus; identical to SEQ ID NO: 39186

SEQ ID NO: 56449 - RNA, 42 nt, Mus musculus; identical to SEQ ID NO: 39187

SEQ ID NO: 56450 - RNA, 51 nt, Mus musculus; identical to SEQ ID NO: 39189

SEQ ID NO: 56451 - RNA, 33 nt, Mus musculus
auuggauaagagcccgguuacgaaucugggugu

SEQ ID NO: 56452 - RNA, 46 nt, Mus musculus
acagacacacagacacacacacacacacagagagagagagagagag

SEQ ID NO: 56453 - RNA, 46 nt, Mus musculus
agaaggagacagagacagagagagagacagagacagagacacagag

SEQ ID NO: 56454 - RNA, 46 nt, Mus musculus
agcagguagauagaugauugacagauggauuauagauauaguagau

SEQ ID NO: 56455 - RNA, 42 nt, Mus musculus
caaggcucagcagagagaggcauuuccaaccaggccagagaa

SEQ ID NO: 56456 - RNA, 32 nt, Mus musculus
acaauguacaagauugacauucuguccccagg

SEQ ID NO: 56457 - RNA, 46 nt, Mus musculus
aaagaaaggaaggaaggaaggaaggaaggaaggaaggaaaauugaa

SEQ ID NO: 56458 - RNA, 45 nt, Mus musculus
aucacuuaguugaauauucaucuuaagaguauagaagugcccaau

SEQ ID NO: 56459 - RNA, 44 nt, Mus musculus
cauucucgucucccugugaugcacuguggcaucuuuugaggucu

SEQ ID NO: 56460 - RNA, 45 nt, Mus musculus
cuuacgcuugacugucaccagucaccaguuagauugcuaaccaga

SEQ ID NO: 56461 - RNA, 44 nt, Mus musculus
ccuuggcguaagaaguugcuguuggauauuaucuuggagcgagg

SEQ ID NO: 56462 - RNA, 46 nt, Mus musculus
cuaucuguauauaaagcauucugaugucccccccacaugccccaac

SEQ ID NO: 56463 - RNA, 46 nt, Mus musculus
uuaccacacacauacaacacgcacaacuuacauaacacucgcacaa

SEQ ID NO: 56464 - RNA, 45 nt, Mus musculus
ucuagaauaggggcuguaaauuaaaguuguaauuagaucccggag

SEQ ID NO: 56465 - RNA, 106 nt, Mus musculus
agcaagagagagcaagaaugagaaaacaagagaaagaaaaagcaagaacaagaaagcgagagaaagaacaagaacaagaaagcaagagaagagagaaagcaagaac

SEQ ID NO: 56466 - RNA, 46 nt, Mus musculus
ccaacuauuuacuuaaucaucucauuuacauuucagaaaauaggag

SEQ ID NO: 56467 - RNA, 66 nt, Mus musculus
ugcuaauguuauugggguuucauggauaacccugaccaacaauuuaaaggagggcuucucaugccu

SEQ ID NO: 56468 - RNA, 66 nt, Mus musculus
uagguauauaguaaauaauaugauuacuuaugacugcuucagauauccuuacuguuuauuucuccc

SEQ ID NO: 56469 - RNA, 46 nt, Mus musculus
caauuuagaauagaaauacccuggacuuacugacauuuauacauag

SEQ ID NO: 56470 - RNA, 45 nt, Mus musculus
gacagagagacagagagacagagacagagagagacagacagacag

SEQ ID NO: 56471 - RNA, 45 nt, Mus musculus
aaaagaggauaugaugucgcugagacagaaagaugagguggauau

SEQ ID NO: 56472 - RNA, 46 nt, Mus musculus
aauauuuuucuggcccauugguacauacauguaaucccagcacuug

SEQ ID NO: 56473 - RNA, 46 nt, Mus musculus
aaaugaauguaaagaucccucaaaugucaauggaggcugcagccag

SEQ ID NO: 56474 - RNA, 42 nt, Mus musculus
aacauuccaggagacuucgaaugugaaugucccgacggcuac

SEQ ID NO: 56475 - RNA, 53 nt, Mus musculus
cccuggaggcuacucuuguuacugugaugggaagaaaggauucaaacuugccc

SEQ ID NO: 56476 - RNA, 46 nt, Mus musculus
guuuucgacccaaaucacaacuggaggcaauguuauuaacaacggu

SEQ ID NO: 56477 - RNA, 44 nt, Mus musculus
guugugagccaccaugugguugcugggauuugaacuccuggccu

SEQ ID NO: 56478 - RNA, 46 nt, Mus musculus
gcagucauuguucacaugaagcuuacguuguaacacugagcagcag

SEQ ID NO: 56479 - RNA, 46 nt, Mus musculus
gaauuagacgacaguguuagcauuaaaauagcuaaggaggccguga

SEQ ID NO: 56480 - RNA, 45 nt, Mus musculus
auggauuucuggacaccaaaauauacuucgcaggcuuaccucgga

SEQ ID NO: 56481 - RNA, 43 nt, Mus musculus
guauacgaggcuggaaucugaugaaacaaggagcuuuaggugc

SEQ ID NO: 56482 - RNA, 41 nt, Mus musculus
aaucuaaacuuauacagaauaucugaaucagacugggcagu

SEQ ID NO: 56483 - RNA, 42 nt, Mus musculus
uuugccuuguccuugguggauucucgcucuggaacgucucag

SEQ ID NO: 56484 - RNA, 44 nt, Mus musculus
gaaaugcaauguuaacagaaauggacuggaacuguggaccccac

SEQ ID NO: 56485 - RNA, 46 nt, Mus musculus
gaaaguggcagagcugauagcauaucacaggugaauugaauggaag

SEQ ID NO: 56486 - RNA, 45 nt, Mus musculus
uccacuugagccaacaccuucacugaaauauagaacaagggcaga

SEQ ID NO: 56487 - RNA, 54 nt, Mus musculus
cauauuggguuuuaauuacuauagguggcuugaaugugauuguuaaaguuaaaa

SEQ ID NO: 56488 - RNA, 46 nt, Mus musculus
guuuguacuguaaguauauuugauacauguuuuuaaaugggugaug

SEQ ID NO: 56489 - RNA, 44 nt, Mus musculus
agaucugauucccucuucuggugugucugaagacagcuauagug

SEQ ID NO: 56490 - RNA, 46 nt, Mus musculus
aagagaucucaaagcuaagcaagagaugaagggggacaaaagagag

SEQ ID NO: 56491 - RNA, 48 nt, Mus musculus
uaguacacauacaaagaagccuuuaggacauagcauuacugagagcca

SEQ ID NO: 56492 - RNA, 46 nt, Mus musculus
aauaaaagauuaauguuuagcccuuuuugacuaaucauccucagaa

SEQ ID NO: 56493 - RNA, 46 nt, Mus musculus
gagugauugguaugcugacucauuuuauaucaauuugacacaagcu

SEQ ID NO: 56494 - RNA, 46 nt, Mus musculus
uuauacuuguuaaauuuuugcauuuaacucuaguaacuggggagau

SEQ ID NO: 56495 - RNA, 46 nt, Mus musculus
acuuauugcgguccaccaaauaaaucccacuugagauauuguagau

SEQ ID NO: 56496 - RNA, 42 nt, Mus musculus
cugaaucaguacugaagccaucuguaacauuugaaccaagug

SEQ ID NO: 56497 - RNA, 45 nt, Mus musculus
uucuuugaacuucuuaauucucagaauccuuuuuugggcccaccu

SEQ ID NO: 56498 - RNA, 46 nt, Mus musculus
aaaacaaaccaccaaauuuaguagcuauucugaaauggauggggaa

SEQ ID NO: 56499 - RNA, 46 nt, Mus musculus
gcugggcaaacuuuugcggacaugcggacccggaugagcaccagau

SEQ ID NO: 56500 - RNA, 42 nt, Mus musculus
gggcugccgaaaccuacucggccugcuggacaacgacgagau

SEQ ID NO: 56501 - RNA, 46 nt, Mus musculus
uucauguuugguuuaauaguguaugaaugaaaagccuaaaagggau

SEQ ID NO: 56502 - RNA, 46 nt, Mus musculus
caauggacacagugaaauagagcaaacaccauuaguuacaucagau

SEQ ID NO: 56503 - RNA, 46 nt, Mus musculus
ugauacuguuucaaauauaagcuugauagaccaaaagaugccugcc

SEQ ID NO: 56504 - RNA, 46 nt, Mus musculus
cauccaacugauuuaaaugugcggcaaacuguaaugaaguggagua

SEQ ID NO: 56505 - RNA, 24 nt, Mus musculus
uuuacuuauaucuugauauauguc

SEQ ID NO: 56506 - RNA, 45 nt, Mus musculus
aggcuuuuuuuuucucuuuuaacuucuauuaaucucaaagguagc

SEQ ID NO: 56507 - RNA, 102 nt, Mus musculus
cgugagaggaaacaaggaaauguggcuagagaaaauaggauggguaguagcaucaagcaagccacagagaagaaggcaggagcaagcaugaugggucagaag

SEQ ID NO: 56508 - RNA, 121 nt, Mus musculus
guguggauugggaagcacuuagagcaaaucaaaggcugagacaguuggaaaugaggagaaagacuugcuuuuuaaugaaaauuauaaagaguaaauaaauuacaggaaagauaagagccau

SEQ ID NO: 56509 - RNA, 49 nt, Mus musculus
uguugaacauauaaagauagucccauuugcaacagguuaagacauggag

SEQ ID NO: 56510 - RNA, 46 nt, Mus musculus
caguguugcaagcuguucuuaaagcccaaccggcaucucaggagau

SEQ ID NO: 56511 - RNA, 45 nt, Mus musculus
uaauuauucucguuuauucuguuuuuuuaaaaaguagcccacacu

SEQ ID NO: 56512 - RNA, 45 nt, Mus musculus
cuugacuuaguggaugguuuuggauaacaccguggaauuuguaga

SEQ ID NO: 56513 - RNA, 42 nt, Mus musculus
ucagccugcucucuuauagaaccaagacuaccagccagagau

SEQ ID NO: 56514 - RNA, 45 nt, Mus musculus
cuggguagguaccuaucaugucugcuuaggaaguuaacagguaga

SEQ ID NO: 56515 - RNA, 48 nt, Mus musculus
ccagagugagcggaccugacuggagcaagcgggguuuacuagagcgag

SEQ ID NO: 56516 - RNA, 42 nt, Mus musculus
ucuggcuguggcucucugcauuugcuccuaucugcugcugga

SEQ ID NO: 56517 - RNA, 45 nt, Mus musculus
cccaaccaauuucccuucccucuacacuuuuccucagccucagau

SEQ ID NO: 56518 - RNA, 45 nt, Mus musculus
cacauacagguuccuagacaggaaggaagucagaauagucacaga

SEQ ID NO: 56519 - RNA, 59 nt, Mus musculus
agaaagguuucuuuguuauuggaaauuaguagaagagagaacuguauuuugauacuagg

SEQ ID NO: 56520 - RNA, 45 nt, Mus musculus
agguagaacccacacuguuugggaaaguaaaugcaaaucacaagg

SEQ ID NO: 56521 - RNA, 58 nt, Mus musculus
uucuugagcauauugaugcaucucuuccuauaugguacugaucuguugagcaagccaa

SEQ ID NO: 56522 - RNA, 46 nt, Mus musculus
auuuccuuuuaacucucauauguaucauguucaaaaauuagcagug

SEQ ID NO: 56523 - RNA, 47 nt, Mus musculus
uguuugucaaugccaaacugaagccacugggguuucuacuaccagag

SEQ ID NO: 56524 - RNA, 51 nt, Mus musculus
uauaagguuaauuucaaacaugcaaaaucaaucauuuaaagacauagauac

SEQ ID NO: 56525 - RNA, 49 nt, Mus musculus
agcuuauggauuugggagcuagaagaaggguuuacauagugagaucugg

SEQ ID NO: 56526 - RNA, 47 nt, Mus musculus
ugggcggggaaaaggacugaagccuugagagucagccgaaagauugg

SEQ ID NO: 56527 - RNA, 46 nt, Mus musculus
aauguauauguaacaauuaaugaaaaaagagacugaucuagaauga

SEQ ID NO: 56528 - RNA, 46 nt, Mus musculus
auguauauuuuaugcuugcuggauuuagauaaaagauguaggggaa

SEQ ID NO: 56529 - RNA, 42 nt, Mus musculus
cgcaaacuggguccuaaggcucggacuuucccacccuguuag

SEQ ID NO: 56530 - RNA, 44 nt, Mus musculus
gaguugaagguggucucauggauaccacaggacuccaugcccag

SEQ ID NO: 56531 - RNA, 46 nt, Mus musculus
ucagucaggaucuucaugagguagucugucagguccccgccagcca

SEQ ID NO: 56532 - RNA, 46 nt, Mus musculus
gugaccccaucaccagaguccaugacaaugccaguggugcgcccag

SEQ ID NO: 56533 - RNA, 64 nt, Mus musculus
uccucaggagccacacgcagcucauuguagaagguguggugccagaucuucuccaugucguccc

SEQ ID NO: 56534 - RNA, 44 nt, Mus musculus
aaacaaaggcugaaaagcaauguucacaaugucagggcugggga

SEQ ID NO: 56535 - RNA, 46 nt, Mus musculus
uaauuugugguauauucuagagaaauuaaacaacauccucacugag

SEQ ID NO: 56536 - RNA, 52 nt, Mus musculus
ccguccacagucuucuucuugaagagggaggccauggugagcggccgcgccc

SEQ ID NO: 56537 - RNA, 46 nt, Mus musculus
cuccaagcucgaccugcggcgggcguggcuccgcgaggcucccgag

SEQ ID NO: 56538 - RNA, 46 nt, Mus musculus
cucacgcgccgccagccuugccaaccuagguccggacgggucgcaa

SEQ ID NO: 56539 - RNA, 57 nt, Mus musculus
gaaugcaugcugguuuuggaggguauuuaauugggaugaaguggaagaaaaagguug

SEQ ID NO: 56540 - RNA, 41 nt, Mus musculus
gccauggcuacauggagagaauaaagaaggaaaugcagaga

SEQ ID NO: 56541 - RNA, 46 nt, Mus musculus
uuaccccacuuucucaggguaagccugagguuaaauaccuuuugca

SEQ ID NO: 56542 - RNA, 48 nt, Mus musculus
ggguugaugagcagggagaggagggaagcaaugggggguguuucggag

SEQ ID NO: 56543 - RNA, 45 nt, Mus musculus
cagauguaugacaacucaagacaugaacaaaaucaauuugcagaa

SEQ ID NO: 56544 - RNA, 46 nt, Mus musculus
caguguuguaauaacuaaagaagagaacuaaaauuuugaaaaagau

SEQ ID NO: 56545 - RNA, 46 nt, Mus musculus
agagggagauagggaggggagaagagaagaagcaagcaagccagau

SEQ ID NO: 56546 - RNA, 46 nt, Mus musculus
uacauccuccuaaucuacagauuuuaauauauuugaaagaccaguu

SEQ ID NO: 56547 - RNA, 46 nt, Mus musculus
gacaacuuuacauaguguuuuguuuuagaaucgaauaugaccagau

SEQ ID NO: 56548 - RNA, 46 nt, Mus musculus
ccugaccuggcaguggugacaggaguggccauccaagcugggauug

SEQ ID NO: 56549 - RNA, 83 nt, Mus musculus
gagauggucaagcuaaacuugacaauucaucagucugcccagguaucaguuuuacucacuguggaggggaaggacagcaagga

SEQ ID NO: 56550 - RNA, 41 nt, Mus musculus
uacugaauaaacaaggagggauguuccuaacacgagcgaug

SEQ ID NO: 56551 - RNA, 41 nt, Mus musculus
aguggaaacuguuuccucccguggucuuucagggcugaaga

SEQ ID NO: 56552 - RNA, 46 nt, Mus musculus
auucccuugccaaacgcugagaugcuuuugagauuugucuguaggu

SEQ ID NO: 56553 - RNA, 23 nt, Mus musculus
ggcgucuggagucgggggucuga

SEQ ID NO: 56554 - RNA, 45 nt, Mus musculus
gacuuccucuaacaaggccacaccuucaaauagugccacucccug

SEQ ID NO: 56555 - RNA, 46 nt, Mus musculus
ucagcacaguuggcgaugcagaaucauuaaagggauggauuugaga

SEQ ID NO: 56556 - RNA, 46 nt, Mus musculus
auuuaaaacaaugcaugucaaaaagaaaggaaacagaagcauucug

SEQ ID NO: 56557 - RNA, 46 nt, Mus musculus
cuuuucuauucaaucagaggacuaucucuuagcacaccuugcagug

SEQ ID NO: 56558 - RNA, 46 nt, Mus musculus
cuacugccuccagaggagguggcuuuaaaaagugcuucguagugau

SEQ ID NO: 56559 - RNA, 47 nt, Mus musculus
acuccuuaaggauggcagcacacuugggcuucugucuggaugaugga

SEQ ID NO: 56560 - RNA, 72 nt, Mus musculus
uugccuuaguuuuggugagcuuuaaauugaaugugugcaauauggaaggguccacauuuacaagcuggguga

SEQ ID NO: 56561 - RNA, 63 nt, Mus musculus
auugguuuugcucuguccugaagaaaacuuaccuuugaagcuuuuuggaaggaguuucugggg

SEQ ID NO: 56562 - RNA, 46 nt, Mus musculus
gaugcuuagaauguauuuguguggcugauagguuuugccugcagaa

SEQ ID NO: 56563 - RNA, 75 nt, Mus musculus
aaaaggaaaagcauuucaagguacuuuucuaaguuuuaaaacucuaaagggauagacgauuauagcaccaccacc

SEQ ID NO: 56564 - RNA, 67 nt, Mus musculus
ccaaauucugcuauccacaucacugaaauuaguccaaaaaauaauaauaacaaaccauuaaagaaag

SEQ ID NO: 56565 - RNA, 46 nt, Mus musculus
aauagaagccuaguaaggucuuauguucaccuaaacuacuagagag

SEQ ID NO: 56566 - RNA, 42 nt, Mus musculus
aaccuaagauaauacucauuaucuuuaucuaauaaagcagau

SEQ ID NO: 56567 - RNA, 46 nt, Mus musculus
ucuugcugaaguaguacaacugagugcgaagcuccaacagcgaauc

SEQ ID NO: 56568 - RNA, 46 nt, Mus musculus
ucagucaaguacggggcccugauuccaauuccuggaaugcguggau

SEQ ID NO: 56569 - RNA, 45 nt, Mus musculus
aauuucuccuagguguugcuguuacuggguuacugggccccuuuu

SEQ ID NO: 56570 - RNA, 46 nt, Mus musculus
aguagccucaugaauucccugugcccuaaauacuauguagcucucc

SEQ ID NO: 56571 - RNA, 45 nt, Mus musculus
ucuuaacugcucaccccugccuuucauuccuccuccagcguaacu

SEQ ID NO: 56572 - RNA, 45 nt, Mus musculus
ccaucguggauucagaacucuucagcuggggaacgguacugguaa

SEQ ID NO: 56573 - RNA, 47 nt, Mus musculus
acucccccaccaaguucagaacuuucagcagucagugguugcuggca

SEQ ID NO: 56574 - RNA, 46 nt, Mus musculus
caggagcaggagcaggagcaggaggagcaggagcaggagacacugg

SEQ ID NO: 56575 - RNA, 46 nt, Mus musculus
auauggcaguggcauugacagaggaggagagggaggaggagcagga

SEQ ID NO: 56576 - RNA, 74 nt, Mus musculus
accauacauuuguuuaagcuuauaaagcucucuguccagaucuugcugauacucugggccaauaucaacagguc

SEQ ID NO: 56577 - RNA, 41 nt, Mus musculus
gaugauuuauagcugcccaagagacacucaaaagggcagug

SEQ ID NO: 56578 - RNA, 49 nt, Mus musculus
cuucaaaugcacagagacugcugaccgaaggacagaggagagccugaag

SEQ ID NO: 56579 - RNA, 41 nt, Mus musculus
agucugcgaccggacgccucuaggugagacagaagccaaac

SEQ ID NO: 56580 - RNA, 45 nt, Mus musculus
ucugaccuccacaagugcgcaugcgcaccuuauaaguggugucug

SEQ ID NO: 56581 - RNA, 27 nt, Mus musculus
cuucaaccaugacuaagagagaagcag

SEQ ID NO: 56582 - RNA, 47 nt, Mus musculus
guggaacaaaccuauaccccagcugaauguguaagccaggccauaga

SEQ ID NO: 56583 - RNA, 46 nt, Mus musculus
ggaagcacauugacccuugagacucagaagugugggcugccugacu

SEQ ID NO: 56584 - RNA, 85 nt, Mus musculus
uggauccagaccgaagcuuguuugaucaaggagugaaaacagaugggacuguacagcuuaguguacagguaauuucuuaccaagg

SEQ ID NO: 56585 - RNA, 46 nt, Mus musculus
gguuaguugauuggaaguuaacugaacaaagucagcagaguuguac

SEQ ID NO: 56586 - RNA, 46 nt, Mus musculus
aauggagccaaaguugaacauucuugaaauuguuaagacugcggaa

SEQ ID NO: 56587 - RNA, 59 nt, Mus musculus
uuauuauaagaaauucuacccuuagcaugcucacaauguaguggaagagaaagaagaua

SEQ ID NO: 56588 - RNA, 46 nt, Mus musculus
caauaacugacacagcaaagcaugucauuugagccuuacagaaauc

SEQ ID NO: 56589 - RNA, 45 nt, Mus musculus
gguaguuuauuugaccuuugagauagaaaguuaggaaucacccga

SEQ ID NO: 56590 - RNA, 46 nt, Mus musculus
cucgggcaggccuugaaccuuugaucuuccugccucaaacucccag

SEQ ID NO: 56591 - RNA, 45 nt, Mus musculus
ccaagguaauaauauacuuuagcugucauuugaugcaccagggaa

SEQ ID NO: 56592 - RNA, 51 nt, Mus musculus
uucgggaagagaauuauguagucucaaccaagaagauuuuuuucagcgggu

SEQ ID NO: 56593 - RNA, 45 nt, Mus musculus
auagaauugcuugccuguccagcaugaaucccugcucugccccag

SEQ ID NO: 56594 - RNA, 46 nt, Mus musculus
ugcaagguguuuucuaaaagagucucuauuguucccaagucuuguc

SEQ ID NO: 56595 - RNA, 42 nt, Mus musculus
uugcuuuuagcauuaucuuccuucucucaugcauggccaagg

SEQ ID NO: 56596 - RNA, 46 nt, Mus musculus
aguuuuaauaacacuuuucuucaaugagacuuuaagaacuugugag

SEQ ID NO: 56597 - RNA, 42 nt, Mus musculus
agcuaaaucagccugaguugguugcgcaaaaauggggacaac

SEQ ID NO: 56598 - RNA, 45 nt, Mus musculus
aaggaaaaaaaauacagagaaaagcaguggaguuacugucuugaa

SEQ ID NO: 56599 - RNA, 42 nt, Mus musculus
uguuugugacuugaagacucuuauuggauacagugcagcaga

SEQ ID NO: 56600 - RNA, 41 nt, Mus musculus
cagucacggcaguagcacuggcagccaccucucuacaggca

SEQ ID NO: 56601 - RNA, 45 nt, Mus musculus
acuggucaguauuaaugucuagcccuaccaaaaaauagccaguag

SEQ ID NO: 56602 - RNA, 46 nt, Mus musculus
uuacuaaacuaucagguuauuaauuuauaauuuacaagaagagagg

SEQ ID NO: 56603 - RNA, 46 nt, Mus musculus
cagacuuacaguguguuggagacauuauguuaaagcuuuagccaag

SEQ ID NO: 56604 - RNA, 45 nt, Mus musculus
cuccacugagaguucaaagauguguuguucuuauugaggccccag

SEQ ID NO: 56605 - RNA, 41 nt, Mus musculus
agccugaggucugugcuagccugaggucugagcuagccuga

SEQ ID NO: 56606 - RNA, 41 nt, Mus musculus
gcuggcugugacugagcuccucaugaugaguuagccaacug

SEQ ID NO: 56607 - RNA, 42 nt, Mus musculus
aaguguccagauccugccaaacaucucuuacggaagcgaguu

SEQ ID NO: 56608 - RNA, 42 nt, Mus musculus
gggaagcaagagaccaggccugccuggaaaacagggugagau

SEQ ID NO: 56609 - RNA, 46 nt, Mus musculus
uucuacacuguauuacauaaauaaauuaaauaaaauaacuccaggc

SEQ ID NO: 56610 - RNA, 46 nt, Mus musculus
aaaaaaauuaaaaaaaaauuaucccuguucaucauaagcacuuuua

SEQ ID NO: 56611 - RNA, 48 nt, Mus musculus
gaauagauucucuccuaauuauuuaucacauacauagccccuuagccc

SEQ ID NO: 56612 - RNA, 85 nt, Mus musculus
aauaacguggaaagaaacaaacccuuccguuuauuuacucacccucggcuuuugacagcugugcuguaacacaaguagaugccug

SEQ ID NO: 56613 - RNA, 46 nt, Mus musculus
uccaacuuacaaguucuuugagcaaaugcagaacuaagccccaccc

SEQ ID NO: 56614 - RNA, 46 nt, Mus musculus
ugugucuauacaguuucccuuuuugugucaaguaauaccccccuuu

SEQ ID NO: 56615 - RNA, 29 nt, Mus musculus
ucuggccuggcggaaaugaggccugaaug

SEQ ID NO: 56616 - RNA, 44 nt, Mus musculus
gaccaguguguugggugaggcccaggaaacugagggggcaagag

SEQ ID NO: 56617 - RNA, 47 nt, Mus musculus
aggcgccaucaucggacucauggugggcggcguugucauagcaaccg

SEQ ID NO: 56618 - RNA, 45 nt, Mus musculus
ugcagaauucggacaugauucaggauuugaaguccgccaucaaaa

SEQ ID NO: 56619 - RNA, 24 nt, Mus musculus
agcuaaugagaugaaacagaaagg

SEQ ID NO: 56620 - RNA, 45 nt, Mus musculus
ccaaauagcacauaccuucccacguuuacuuucuuuaugcccaga

SEQ ID NO: 56621 - RNA, 46 nt, Mus musculus
gagagggcaaccaagcuuuaaggauuaacaaguggcugaagggcag

SEQ ID NO: 56622 - RNA, 44 nt, Mus musculus
ugaaaggaaauccuuugagagcuguagguauuuuuaguagcuca

SEQ ID NO: 56623 - RNA, 45 nt, Mus musculus
gaccuccagccguggcacccuuuugggguggacucugugccagcc

SEQ ID NO: 56624 - RNA, 45 nt, Mus musculus
cacagaguccaccccaaaagggugccacggcuggaggucauccag

SEQ ID NO: 56625 - RNA, 46 nt, Mus musculus
acuacuccgacgaugucuuggccaacaugaucagugagcccagaau

SEQ ID NO: 56626 - RNA, 72 nt, Mus musculus
uauccugguacagaaaugugaucuugaacguuaguuuuaaggcagccaaguguuggguuugaaaacuaagau

SEQ ID NO: 56627 - RNA, 41 nt, Mus musculus
aggaaugacagcaugcaccuauaauccgggcccuaaaugau

SEQ ID NO: 56628 - RNA, 42 nt, Mus musculus
gauguuuuugcuauuguuagaucuuuuuuaggggagguggau

SEQ ID NO: 56629 - RNA, 42 nt, Mus musculus
agggaaggcaggccaugagcacauggagagguggggggagag

SEQ ID NO: 56630 - RNA, 46 nt, Mus musculus
uaauauucuuaauucaugggucaaccuguuguguuuuaugagagag

SEQ ID NO: 56631 - RNA, 35 nt, Mus musculus
gcacuguacuccacauuaucuuccaagcuccuaca

SEQ ID NO: 56632 - RNA, 46 nt, Mus musculus
ucuacacuacuuugauuacugugacuuugugguuaagcuuugagau

SEQ ID NO: 56633 - RNA, 46 nt, Mus musculus
auaauaaaaaauauuuacaaaaaaagagagaacauuacugagagag

SEQ ID NO: 56634 - RNA, 41 nt, Mus musculus
cauuuggcauugugcuccucuaaauauuagccacaagugag

SEQ ID NO: 56635 - RNA, 45 nt, Mus musculus
gcucuacaaugucccugcgguggcugaggagauucaagaugaagu

SEQ ID NO: 56636 - RNA, 50 nt, Mus musculus
uucaacaugcugaagaaguacguccgugcggagcagaaagacagacagca

SEQ ID NO: 56637 - RNA, 30 nt, Mus musculus
auaugugugugugugugugugucacuaguu

SEQ ID NO: 56638 - RNA, 43 nt, Mus musculus
gccaaugagagacagcagcuuguagagacacacauggccagag

SEQ ID NO: 56639 - RNA, 31 nt, Mus musculus
auaggucaugagagaaugggaagaggcagag

SEQ ID NO: 56640 - RNA, 45 nt, Mus musculus
cucaagaaacuaauuuaaaaaaaaaaaauccaacucacgugcuga

SEQ ID NO: 56641 - RNA, 103 nt, Mus musculus
acccccgacgccgucgacaaguaccuggagacacccggggacgagaacgagcaugcccauuuccagaaagccaaagagaggcuggaagccaagcaccgagaga

SEQ ID NO: 56642 - RNA, 24 nt, Mus musculus
caaaggcacagcuggguaccagac

SEQ ID NO: 56643 - RNA, 41 nt, Mus musculus
acauggugcuggacaggcagcugagaguucuucacccggau

SEQ ID NO: 56644 - RNA, 66 nt, Mus musculus
gaugucacugaagggaagugugucccauucuuuuacggcggauguggcggcaacaggaacaacuuu

SEQ ID NO: 56645 - RNA, 59 nt, Mus musculus
ugugcucugaacaagccgagaccgggccaugccgcgcaaugaucucccgcugguacuuu

SEQ ID NO: 56646 - RNA, 42 nt, Mus musculus
uacacaggagagaggggcguggcuggucagagagagagagag

SEQ ID NO: 56647 - RNA, 45 nt, Mus musculus
gagacugaauaagucucaaugugugugugugugugugugugugug

SEQ ID NO: 56648 - RNA, 23 nt, Mus musculus
uacacacugggcacagcauuauu

SEQ ID NO: 56649 - RNA, 107 nt, Mus musculus
ucuuccagugaagacaaaguaguagaagucgccgaagaggaggaaguggcugauguugaggaagaggaagcugaugaugaugaggauguggaggauggggacgaggu

SEQ ID NO: 56650 - RNA, 46 nt, Mus musculus
ugggaacccugugauccauccuauaggugacugugagcauccacuu

SEQ ID NO: 56651 - RNA, 42 nt, Mus musculus
uuagacuucagaaggccagucucuguuucuacuccaggugau

SEQ ID NO: 56652 - RNA, 46 nt, Mus musculus
augucaguuaguuaguaaugucagggauugguucuugccccuggga

SEQ ID NO: 56653 - RNA, 45 nt, Mus musculus
guugugagguagcuuuggaaggaagagacauaagagggggcagag

SEQ ID NO: 56654 - RNA, 42 nt, Mus musculus
agcaugcaacccgucgaccuuuccuuucuuuugcccaugauc

SEQ ID NO: 56655 - RNA, 71 nt, Mus musculus
auucugcggaugcagaggaggaugacucugaugucuggugggguggagcggacacagacuacgcugauggc

SEQ ID NO: 56656 - RNA, 45 nt, Mus musculus
aaacauccauccgcuccugguguaggaacuugcacuugucgggca

SEQ ID NO: 56657 - RNA, 46 nt, Mus musculus
agggcacagugagcuuccauuuugcccuuuguccugaggccuuuua

SEQ ID NO: 56658 - RNA, 41 nt, Mus musculus
ugacuggacauuuuagucucauucuuuucuaauggccagac

SEQ ID NO: 56659 - RNA, 24 nt, Mus musculus
cagcuuggccccuuguguggcuuu

SEQ ID NO: 56660 - RNA, 46 nt, Mus musculus
ggccacuugugacauguuuagaaaauuucccgggucuggggcagca

SEQ ID NO: 56661 - RNA, 46 nt, Mus musculus
auuuccucuucuccuguguuccccaggucuacccugaacugcagau

SEQ ID NO: 56662 - RNA, 41 nt, Mus musculus
uuagggcuugcucuugguguuguagcuccuaugggucagau

SEQ ID NO: 56663 - RNA, 46 nt, Mus musculus
cucucauuagcagaaucgaggcggaaaacaguuuuaagaugcaguu

SEQ ID NO: 56664 - RNA, 45 nt, Mus musculus
uagggaaagcuauggaggagaauauauucauuguacuguuuaaac

SEQ ID NO: 56665 - RNA, 46 nt, Mus musculus
ucacaaagcauuuuaucugacaacugaagcaugcugguggccauuu

SEQ ID NO: 56666 - RNA, 42 nt, Mus musculus
gauccacauugggucuugacuuuaacuggcacagagaaaaug

SEQ ID NO: 56667 - RNA, 42 nt, Mus musculus
cuucuggugcuaagaugggugccccuuggggcucaggaaggu

SEQ ID NO: 56668 - RNA, 45 nt, Mus musculus
cucaacaugcacaugaaugugcagaauggaaagugggagucagac

SEQ ID NO: 56669 - RNA, 46 nt, Mus musculus
aaaccaucagguggcuaaaucgugucuuugcagaagucucaaagag

SEQ ID NO: 56670 - RNA, 46 nt, Mus musculus
ccaucuguaaugggauccgaugcccucuucuggugugacugaagac

SEQ ID NO: 56671 - RNA, 45 nt, Mus musculus
aaaaaaaaaucaaaagaaaaagaaagagaaagagaaagagaaaaa

SEQ ID NO: 56672 - RNA, 46 nt, Mus musculus
ugcuuucauuuuggagcaccauuuuuuaaaaaaauaaacccagauu

SEQ ID NO: 56673 - RNA, 46 nt, Mus musculus
ugcacaauacaaagauccagguauugaucugaugcuguucagagau

SEQ ID NO: 56674 - RNA, 45 nt, Mus musculus
ucuaucuaucuaucuaucuaucuauccauacauacauacauacau

SEQ ID NO: 56675 - RNA, 46 nt, Mus musculus
gaggaggaggaggaagaggaagaagaggaagaagaggaagaaggaa

SEQ ID NO: 56676 - RNA, 42 nt, Mus musculus
aaaaaaaggggugcagauaaaaggauugaauagggugaagau

SEQ ID NO: 56677 - RNA, 44 nt, Mus musculus
uggggcagauuugggaacucuagcuuagucacccugggggggac

SEQ ID NO: 56678 - RNA, 41 nt, Mus musculus
agagagagagagagcgagccgggagugaggcgugcgucugg

SEQ ID NO: 56679 - RNA, 45 nt, Mus musculus
auuuucgugucucccuuuuguguaaguuccaagugaugggaggga

SEQ ID NO: 56680 - RNA, 41 nt, Mus musculus
ggcucacaagaggcaguaaaauaauacauguugugccagag

SEQ ID NO: 56681 - RNA, 46 nt, Mus musculus
gugaaguuuaugagguacacauaaaaacugaaggaaacaaugagca

SEQ ID NO: 56682 - RNA, 45 nt, Mus musculus
aaagcagaaagaugguaagacuggguuucaaacaaggcuugguuu

SEQ ID NO: 56683 - RNA, 88 nt, Mus musculus
cuuauaucuaucgcccaaauaauuuucagagucuggcagaagcccuguugcacuguacuaacuagauacuucuuaucacaaagauugg

SEQ ID NO: 56684 - RNA, 53 nt, Mus musculus
ggagggauccagugagucaaaccaguaagcagugagguguggcaaggaggugu

SEQ ID NO: 56685 - RNA, 50 nt, Mus musculus
ugacuuuugcacacugacacagugcaguuaagaggcguuagaggacaagg

SEQ ID NO: 56686 - RNA, 53 nt, Mus musculus
gcccacacuggcaggugggggauuggucaccauguuccaaaacuugcgggaag

SEQ ID NO: 56687 - RNA, 57 nt, Mus musculus
guggggggagugcuccaagacaugcggcucagguuggcagagaagaguagugcagug

SEQ ID NO: 56688 - RNA, 45 nt, Mus musculus
aauuccugcuggagccaccaacauugaagugaaacaucggaauca

SEQ ID NO: 56689 - RNA, 46 nt, Mus musculus
gggaacaucaucgccgucguucucuuuucaggaaaaacguucagag

SEQ ID NO: 56690 - RNA, 54 nt, Mus musculus
uggaguucaauacacaaugagagaaugugacaacccagucccaaagaacggagg

SEQ ID NO: 56691 - RNA, 42 nt, Mus musculus
ccuguucauggaagcuggggaccauggggaccguggggagac

SEQ ID NO: 56692 - RNA, 42 nt, Mus musculus
acgacgagacccugccaaccagcgacucgcgacccgagagcc

SEQ ID NO: 56693 - RNA, 45 nt, Mus musculus
agccucugugaaggugugcguggugccuucuaccuacaaggagag

SEQ ID NO: 56694 - RNA, 42 nt, Mus musculus
ccccacggaggaagaugaggagcugguccugcccucgcugga

SEQ ID NO: 56695 - RNA, 46 nt, Mus musculus
uauuugaauuccuuguugguucuaaacacaaguuuuauguuauuug

SEQ ID NO: 56696 - RNA, 46 nt, Mus musculus
auaaggacuuuucccuccagcuuuuuaaaugaaagcuuuaaagcag

SEQ ID NO: 56697 - RNA, 42 nt, Mus musculus
ucucauuuccaaaguuguucccccaaucccauggccuugaaa

SEQ ID NO: 56698 - RNA, 41 nt, Mus musculus
agguuaagaguuguguuuguagaguagaacuugcccagugu

SEQ ID NO: 56699 - RNA, 58 nt, Mus musculus
gcaaaaccagcuggugggcccaaaccuccaagugggaagaaggacugggaugacgacc

SEQ ID NO: 56700 - RNA, 46 nt, Mus musculus
uuaaauuagccgagaccauuuagacaugggggaugggggcuuggga

SEQ ID NO: 56701 - RNA, 48 nt, Mus musculus
uacuuacuugggaaaauacugggcuauuaaacuggccacuaaugcugc

SEQ ID NO: 56702 - RNA, 48 nt, Mus musculus
aaggccaaugaaguuaucucuaaacuuuauuccguacaccaagaagga

SEQ ID NO: 56703 - RNA, 52 nt, Mus musculus
auuaagaaguuugcugaagcguuugaagcgauuccacgggcacuggcagaaa

SEQ ID NO: 56704 - RNA, 46 nt, Mus musculus
uggagguggagcuaccgaaauugaauuggcuaaacaaaucacauca

SEQ ID NO: 56705 - RNA, 46 nt, Mus musculus
agggcaguagaugauggaguuaauacuuucaaaguucucacaaggg

SEQ ID NO: 56706 - RNA, 45 nt, Mus musculus
ucagauugucuguagaaccucgaagaacuauaguagaaauggcac

SEQ ID NO: 56707 - RNA, 47 nt, Mus musculus
agaagaaaugggacauugugacaguguuuaccucucagaaguuggag

SEQ ID NO: 56708 - RNA, 44 nt, Mus musculus
gguaaacacugucacaaugucccauuucuucuuggacgggagga

SEQ ID NO: 56709 - RNA, 92 nt, Mus musculus
uucaguaaacugagaacaauugauaaagggaaaaugaagaucaaacagcaaaaggauuuauauaggagggagaagugaacuuuacauaagca

SEQ ID NO: 56710 - RNA, 45 nt, Mus musculus
gugaaggccauugcaggcacuggugcaaaugucauaguaacaggc

SEQ ID NO: 56711 - RNA, 46 nt, Mus musculus
cgugcugauuaagacugccgaggagcuaaugaacuucaguaaggga

SEQ ID NO: 56712 - RNA, 41 nt, Mus musculus
auucaucaguaguuagauucauggcaaauaaucguggcaga

SEQ ID NO: 56713 - RNA, 46 nt, Mus musculus
ucaaaucccaacaaccacaugguggcucacaaccauccauaacgaa

SEQ ID NO: 56714 - RNA, 92 nt, Mus musculus
uagggcucugguauuuauucauccucaguauuacauggcaugguuuuuaagaaggaaacugaaggugaugugacaucugucaaagaugcaaa

SEQ ID NO: 56715 - RNA, 45 nt, Mus musculus
gagagagacccccaauauaggagguugguugugguuugguaacag

SEQ ID NO: 56716 - RNA, 46 nt, Mus musculus
cccuucucuccucucuagugaggggugaagcaggggaagaucccac

SEQ ID NO: 56717 - RNA, 42 nt, Mus musculus
cuuucuuuccuaccuagugaugggggugaaagcgggggaaag

SEQ ID NO: 56718 - RNA, 42 nt, Mus musculus
caugugcauacaguugcauggaggccaggagaggccaucagg

SEQ ID NO: 56719 - RNA, 45 nt, Mus musculus
gcugaagaacuucugaggauuggccugucaguaucagaggcaagu

SEQ ID NO: 56720 - RNA, 45 nt, Mus musculus
cauccugcugcaaagaugauagugauggccucucauaugcaagaa

SEQ ID NO: 56721 - RNA, 45 nt, Mus musculus
uucaaaucccagcaaccacaugguggcucacaaccauccaugaga

SEQ ID NO: 56722 - RNA, 46 nt, Mus musculus
cauagccacacacagacacacacaaaaauaaaaaugaccuucagaa

SEQ ID NO: 56723 - RNA, 46 nt, Mus musculus
caucaaucgccuggagaaguuguuugugacaaacgaugcagcgacu

SEQ ID NO: 56724 - RNA, 45 nt, Mus musculus
aaugguagauugcuuucuuguguucaaucccuggaaaaggcagaa

SEQ ID NO: 56725 - RNA, 46 nt, Mus musculus
cauugcuuauggagcgauuuguccugaguuccccaagcugccagau

SEQ ID NO: 56726 - RNA, 42 nt, Mus musculus
aggauaaaugaagccccaccccagaucgaauaggccguaguu

SEQ ID NO: 56727 - RNA, 43 nt, Mus musculus
gaaacagaacguccagaggagaguuuucaguagagcagugggg

SEQ ID NO: 56728 - RNA, 45 nt, Mus musculus
cccgaucgcggcgcggccgcccgcccgcaggccugucgcggucgc

SEQ ID NO: 56729 - RNA, 46 nt, Mus musculus
acggccggcccagagaguccgcgcagcgcguaaacagcgcgcagcc

SEQ ID NO: 56730 - RNA, 55 nt, Mus musculus
ggaagcgcggagcgcccgguagucccggaaccccggcccgcucggccuugccccc

SEQ ID NO: 56731 - RNA, 46 nt, Mus musculus
caucggcgcaauuccacuaaaugacaccaaagucccggagaagauc

SEQ ID NO: 56732 - RNA, 46 nt, Mus musculus
ccaagcauacaauaaaaacuauuuagaauugagugaggcaggcucu

SEQ ID NO: 56733 - RNA, 45 nt, Mus musculus
cccauguggcacagcuuuaguuacuacaaugcaggguucaaaaga

SEQ ID NO: 56734 - RNA, 45 nt, Mus musculus
aauacauuuaauucuuccuagacuuuucuuuauuaucuuugaguu

SEQ ID NO: 56735 - RNA, 46 nt, Mus musculus
cugcucauauguguguaaggcugacaaggaguagagcccgugaggu

SEQ ID NO: 56736 - RNA, 46 nt, Mus musculus
cugcaaaugucacuccagaagccuuuggccaggugcucugccaccu

SEQ ID NO: 56737 - RNA, 41 nt, Mus musculus
ucaaaccaacccaaccagagagcuucacagcacggcccaga

SEQ ID NO: 56738 - RNA, 46 nt, Mus musculus
agauagaacaucuccuaugaaaaccaaggagaacgcaggaucaccu

SEQ ID NO: 56739 - RNA, 42 nt, Mus musculus
gaucaguagguuauccacggcccacgaggacugcgugcagau

SEQ ID NO: 56740 - RNA, 42 nt, Mus musculus
ucuuuuccacauagacaagaaguaccccacuucuggggagau

SEQ ID NO: 56741 - RNA, 42 nt, Mus musculus
agcagcccgccuccaaugaagaggacagcagcgguugcccag

SEQ ID NO: 56742 - RNA, 45 nt, Mus musculus
aagacagucaagaugcagaauguguaggagucuucuagucuagag

SEQ ID NO: 56743 - RNA, 46 nt, Mus musculus
ccgcuguaguagcucaugauuuuagaaguggucguuuuuucuugug

SEQ ID NO: 56744 - RNA, 46 nt, Mus musculus
ccugggaaguaguuuccgcagcagaaauagcgagucaugguggcag

SEQ ID NO: 56745 - RNA, 45 nt, Mus musculus
agggcagcgaguuugcggacagugggaucgaaggggccaccaccg

SEQ ID NO: 56746 - RNA, 57 nt, Mus musculus
auguuugaccagucccagauccaggaguucaaagaggccuuuaacaugauugaccag

SEQ ID NO: 56747 - RNA, 48 nt, Mus musculus
cuucaacuacauugaguucacacgcauccugaagcacggcgcgaaaga

SEQ ID NO: 56748 - RNA, 46 nt, Mus musculus
cugaaaacgagaugcaaauaaaaaaugaaccacugugaaagcccaa

SEQ ID NO: 56749 - RNA, 46 nt, Mus musculus
uacuggagccgaaugcaagugacagugugcaggcguuggcauucga

SEQ ID NO: 56750 - RNA, 42 nt, Mus musculus
gggcaagagccuuuacuacuugguguucugcaugacccagau

SEQ ID NO: 56751 - RNA, 46 nt, Mus musculus
cuaauccuaauacaauuuuaaaauauaagguuaaguacucugaauc

SEQ ID NO: 56752 - RNA, 46 nt, Mus musculus
caaggacagacuugcagcuugucuuuccaacuaaaaauacugagac

SEQ ID NO: 56753 - RNA, 27 nt, Mus musculus
ucccauuugacauuuagaucugagcuc

SEQ ID NO: 56754 - RNA, 41 nt, Mus musculus
gaagugagagagugaacucuugccaggccgggugcgggcag

SEQ ID NO: 56755 - RNA, 41 nt, Mus musculus
gguuaaaucuagacucuugcucguugaaggcguccgaggca

SEQ ID NO: 56756 - RNA, 47 nt, Mus musculus
ugcuugaugccuagacuggugaucugagucgaaucucugggguccac

SEQ ID NO: 56757 - RNA, 46 nt, Mus musculus
cccaauauccuccaggcucccaagauguucuagucuaccuuacgag

SEQ ID NO: 56758 - RNA, 46 nt, Mus musculus
gagacagcuuugcccauucagaguuacauacuagcacaauuuggag

SEQ ID NO: 56759 - RNA, 46 nt, Mus musculus
aagaggcgcagguguccauaugccuuugauuuccuccugccuguau

SEQ ID NO: 56760 - RNA, 49 nt, Mus musculus
aauguguguguaugagugugugugugugugugugugugugagugaguga

SEQ ID NO: 56761 - RNA, 25 nt, Mus musculus
caggaaugccucuggacgugcaggg

SEQ ID NO: 56762 - RNA, 41 nt, Mus musculus
ucugucucuuguccagauuuagacuauuaugauauccccca

SEQ ID NO: 56763 - RNA, 42 nt, Mus musculus
aauggugcaguaucagaauguggagagacauagugccccugu

SEQ ID NO: 56764 - RNA, 46 nt, Mus musculus
gucuaaugccagaccaacucuucauggguacacuugaaaggcagag

SEQ ID NO: 56765 - RNA, 46 nt, Mus musculus
uagaaucaggcccuagaaguuuugaaauuuauacuuuuaucugcuc

SEQ ID NO: 56766 - RNA, 45 nt, Mus musculus
cauaggacauugaugguaagaagauuugagaauuaggcuguuggu

SEQ ID NO: 56767 - RNA, 46 nt, Mus musculus
uccagugcacaugucaaagccccgacugacucccaguaccuggaag

SEQ ID NO: 56768 - RNA, 42 nt, Mus musculus
agagugucaaccauacugugagaagggauuuucugccagcca

SEQ ID NO: 56769 - RNA, 46 nt, Mus musculus
ggacagcuuugcaugucucuugaguuguauuuaaacccagcccucu

SEQ ID NO: 56770 - RNA, 46 nt, Mus musculus
guuuccuauuuagggagucgguauaucauuguggaucuggcuuuca

SEQ ID NO: 56771 - RNA, 45 nt, Mus musculus
ccuugcaguuauguguagagcuguccugaugugaaauugugccag

SEQ ID NO: 56772 - RNA, 41 nt, Mus musculus
cuuuucugccugucccccuucccauguuuaggacaaggaca

SEQ ID NO: 56773 - RNA, 45 nt, Mus musculus
cacauacacguaggugcauaauuaaaaauaaaaccuuaggcugga

SEQ ID NO: 56774 - RNA, 42 nt, Mus musculus
auaaacucuagugcuuccacuucccagguucaaggacggggc

SEQ ID NO: 56775 - RNA, 46 nt, Mus musculus
gcagcuacuggcuggagcagagaguguguguguguguguguguguu

SEQ ID NO: 56776 - RNA, 45 nt, Mus musculus
ucugcugagggucaggagcgagaucuuccuuucuucuuaucccag

SEQ ID NO: 56777 - RNA, 48 nt, Mus musculus
auguuugacgugugugugugugugugugugugugugugugcgugugcg

SEQ ID NO: 56778 - RNA, 45 nt, Mus musculus
gugugugugugugugugugugcguugugugugugugugugugugu

SEQ ID NO: 56779 - RNA, 44 nt, Mus musculus
gugugugugguguguguguguguauguguaugugugugugugug

SEQ ID NO: 56780 - RNA, 46 nt, Mus musculus
uaagauuuuugauucgaucauauauuuuucuucuuacaaaaagaag

SEQ ID NO: 56781 - RNA, 45 nt, Mus musculus
agcaucuggugaugcuccaccucugguaaugugagcauuaucuac

SEQ ID NO: 56782 - RNA, 42 nt, Mus musculus
aauagggcaugaaagcaaaaaggaacaaaguccuugagauac

SEQ ID NO: 56783 - RNA, 45 nt, Mus musculus
ugacagggcagugucuucaggcuugagugcuguccgcugcccgcu

SEQ ID NO: 56784 - RNA, 52 nt, Mus musculus
auuauuguugcugauguguggauuuguguaugcgaugugcugugugugugug

SEQ ID NO: 56785 - RNA, 46 nt, Mus musculus
augugcuguguguguguguaugugaugugcugugugugugugugua

SEQ ID NO: 56786 - RNA, 45 nt, Mus musculus
cuguguguguguaugugaugugcugugugugugugugugugugug

SEQ ID NO: 56787 - RNA, 41 nt, Mus musculus
uuuucuguuacuauugaagucucccccaaaaccaagguguu

SEQ ID NO: 56788 - RNA, 46 nt, Mus musculus
cccaucaggaaaucucaucaacaugauaguagguuuauacauccag

SEQ ID NO: 56789 - RNA, 45 nt, Mus musculus
gccuuggagaagcacgugugugauccuggcuacucagaagucuaa

SEQ ID NO: 56790 - RNA, 42 nt, Mus musculus
gugugugugaaucuguaugugugagugugacuguguguguga

SEQ ID NO: 56791 - RNA, 43 nt, Mus musculus
guuuccuucccuuuggggaaaguuaagaaaauaaagcccgagu

SEQ ID NO: 56792 - RNA, 31 nt, Mus musculus
ucaaguaaugaaugcuauucagaaauuuuag

SEQ ID NO: 56793 - RNA, 46 nt, Mus musculus
acuuacaaccaucugcaaugagaucugauacccucuucuggugugu

SEQ ID NO: 56794 - RNA, 42 nt, Mus musculus
uccuggggaugcccgggugaacaucuuugaggaagcagagaa

SEQ ID NO: 56795 - RNA, 92 nt, Mus musculus
agaaaaagcggagauggugacuaucacagaaguucugggauagaaggggagagaacuuggccucugugggaggacacaaggcugggcugaga

SEQ ID NO: 56796 - RNA, 53 nt, Mus musculus
uccuuugucugagaccagcugugaaucucuaggauaaaaaagauggaaaaagg

SEQ ID NO: 56797 - RNA, 42 nt, Mus musculus
aggcuuuuaggcugaggguaggagaguagacuggagagucag

SEQ ID NO: 56798 - RNA, 45 nt, Mus musculus
aaagcccccuugcccugugucagaaacggaauaaagugaggcaag

SEQ ID NO: 56799 - RNA, 45 nt, Mus musculus
uuuuuguuuaaaucucuuuaaaaaugauuuauaaaacgugaacua

SEQ ID NO: 56800 - RNA, 45 nt, Mus musculus
gauuuuuaagagaaagagagagagaacaugaaauugggcggugag

SEQ ID NO: 56801 - RNA, 46 nt, Mus musculus
aaacuaccauauauaaaagagaaaagaaagcauggagaccggucaa

SEQ ID NO: 56802 - RNA, 46 nt, Mus musculus
gggagggccuucucgcugcaucacagugugguggaagggaccgugu

SEQ ID NO: 56803 - RNA, 41 nt, Mus musculus
gggagggggcgaacugugggaaucacaccuuccagccugag

SEQ ID NO: 56804 - RNA, 46 nt, Mus musculus
guucagcucccaggacuugacacugaaaauagaacucuuuaagcag

SEQ ID NO: 56805 - RNA, 45 nt, Mus musculus
agcaaacaaucguccuuugaauguguggcuguucggccugcccag

SEQ ID NO: 56806 - RNA, 42 nt, Mus musculus
uaagagguaaccguuucccguguuugaauuauaaggccaguu

SEQ ID NO: 56807 - RNA, 46 nt, Mus musculus
ucaaccuugaaagccgaguugaaauagagaagucuauaaagcaggu

SEQ ID NO: 56808 - RNA, 46 nt, Mus musculus
ugaugguaaagaauuuauuugguauuggaaaagacagauaguagau

SEQ ID NO: 56809 - RNA, 45 nt, Mus musculus
cagcagacugaguagaaagcucugccuuuuauguuugcuacccca

SEQ ID NO: 56810 - RNA, 46 nt, Mus musculus
gaaaagaagaaaggauccauuauuugauggugauagccccuuaaga

SEQ ID NO: 56811 - RNA, 101 nt, Mus musculus
gggcaaacaugucgagcgcagacgcguuagggcuagagaaggaacggccugaggagaaggcggccgcggcggagaacccgcugguguuccuuugugcccgc

SEQ ID NO: 56812 - RNA, 41 nt, Mus musculus
ggcuaugucgagcgaguccccccugcuggagaagcgucugu

SEQ ID NO: 56813 - RNA, 46 nt, Mus musculus
aggucaacgacuuaggauuugaaacuuuuugcuaguggccagagau

SEQ ID NO: 56814 - RNA, 24 nt, Mus musculus
agcugaugcuguucuaccacagaa

SEQ ID NO: 56815 - RNA, 42 nt, Mus musculus
cuauguggggaaaaaugagaaaaccaaaaucaucgucaagau

SEQ ID NO: 56816 - RNA, 46 nt, Mus musculus
gcagcccucgaagucauccaggagucggaggcacagcugugguggg

SEQ ID NO: 56817 - RNA, 46 nt, Mus musculus
agauggugaaagaugccuuggaccagcuucgaggugcggucaugau

SEQ ID NO: 56818 - RNA, 45 nt, Mus musculus
gaaaugaccuguuuauugaauacaccaauagauccuugcccacag

SEQ ID NO: 56819 - RNA, 41 nt, Mus musculus
cucgcgcgcaggcuuggggagaagggaugcgguggaagagg

SEQ ID NO: 56820 - RNA, 42 nt, Mus musculus
ccuagauccaggacgcgggggcgcgggaagauuggcugaggu

SEQ ID NO: 56821 - RNA, 44 nt, Mus musculus
ccauagcccaaucguagcccagcguuuucagaaaugcacacuca

SEQ ID NO: 56822 - RNA, 43 nt, Mus musculus
uuuaaaucggcaggaagauuuuuaaaucagaggccaaccuggg

SEQ ID NO: 56823 - RNA, 42 nt, Mus musculus
aagcauaccuuccguucugggacgucucuuccacagcaccug

SEQ ID NO: 56824 - RNA, 44 nt, Mus musculus
cuuucuaucccuaagauuuugcauaaaauucuugucagcccaga

SEQ ID NO: 56825 - RNA, 57 nt, Mus musculus
ccccccgaggaggccgagguguucgacaaacuaagcaucaucagcgaagagucugaa

SEQ ID NO: 56826 - RNA, 68 nt, Mus musculus
aguccaaggaugaagcucccucaccuccacacgaugaccccaaacugcucacgucgaccucagaagua

SEQ ID NO: 56827 - RNA, 45 nt, Mus musculus
cuagaacuuccugaugcugcacugguacacacaaccaaagagcua

SEQ ID NO: 56828 - RNA, 46 nt, Mus musculus
ucaaggccaagcuggacuagagacccugucuaagagagagagagag

SEQ ID NO: 56829 - RNA, 42 nt, Mus musculus
cgggacagacaugaacauuuuggauucccaaggagcaaagag

SEQ ID NO: 56830 - RNA, 46 nt, Mus musculus
uccuggcguaaacaauuuaaaaggaagaaaggaaauuuaggggguu

SEQ ID NO: 56831 - RNA, 45 nt, Mus musculus
guaaaucccaacaguuggacuggagaucaagcuaagaggauacgg

SEQ ID NO: 56832 - RNA, 42 nt, Mus musculus
ucacagugugccauauuuauuuuuaucaucuuaucgggccua

SEQ ID NO: 56833 - RNA, 45 nt, Mus musculus
auggcugugagccaccaugugguugcugggauuugaacucugaac

SEQ ID NO: 56834 - RNA, 46 nt, Mus musculus
uucacucagguucgcuccaucagcacagugacacucaccauaggag

SEQ ID NO: 56835 - RNA, 46 nt, Mus musculus
auauuuggacagagagaagcgauuuaaggaaacagaacuuuaagag

SEQ ID NO: 56836 - RNA, 46 nt, Mus musculus
ccguucagauaaauggaaaccaauaccaaccugugcaaauguccag

SEQ ID NO: 56837 - RNA, 41 nt, Mus musculus
ccucauaccggugaugaugggaaagaaaguuagugggggag

SEQ ID NO: 56838 - RNA, 46 nt, Mus musculus
aaugugugggaggaugugugugugugugugugugugugugugugug

SEQ ID NO: 56839 - RNA, 41 nt, Mus musculus
aauguacguguuugugugugugugugugugugugugugugu

SEQ ID NO: 56840 - RNA, 46 nt, Mus musculus
cuucaaaaaaccuuguacuucugacggcugaggagcacacggaaag

SEQ ID NO: 56841 - RNA, 42 nt, Mus musculus
accauucaguaagagagaagcuagugaaccugauggugaaag

SEQ ID NO: 56842 - RNA, 46 nt, Mus musculus
agcagugcugguggcuccagggcagacucaguugcaggccaaaaag

SEQ ID NO: 56843 - RNA, 46 nt, Mus musculus
cagucuccucaacagagagagaaugcagauugauuuucauccugag

SEQ ID NO: 56844 - RNA, 47 nt, Mus musculus
cucuguagagggcauggucaucgcggucugcaaucacgcugauaccc

SEQ ID NO: 56845 - RNA, 42 nt, Mus musculus
uaauaauucuacccagcacggcccagcccuguucacggcgga

SEQ ID NO: 56846 - RNA, 45 nt, Mus musculus
ucuucagggugaagcccaaagcagcuaucgguugcagcagcgggu

SEQ ID NO: 56847 - RNA, 42 nt, Mus musculus
ugguggcucacaaccaucuguaauaggaucugaugcccccuu

SEQ ID NO: 56848 - RNA, 59 nt, Mus musculus
guauguuugaggcucuuuccaaauugcuccucuauaaagagagagagggggagagggag

SEQ ID NO: 56849 - RNA, 88 nt, Mus musculus
aaggagagagcaaggaaggaagaaaagagaagagacaagacaagaaggaaaaggagagaaaagaaaagagaaaaaagaaaugaaaaga

SEQ ID NO: 56850 - RNA, 46 nt, Mus musculus
gaacuuuuaccuuuguauagcuggugaccagagaagaaacuacuaa

SEQ ID NO: 56851 - RNA, 47 nt, Mus musculus
ugaacuuuuaccuuuguauagcuggugaccagagaagaaacugcuag

SEQ ID NO: 56852 - RNA, 46 nt, Mus musculus
ugucugggaugccggugguuaugcucaccguggugaggggugccuc

SEQ ID NO: 56853 - RNA, 46 nt, Mus musculus
uuuaaagcuuaagagagguuucaacauggucucuaagugcccucag

SEQ ID NO: 56854 - RNA, 45 nt, Mus musculus
aaugaccacaccaggcugcagucagagucuuaaggaagagaacag

SEQ ID NO: 56855 - RNA, 46 nt, Mus musculus
ugaaaucucacuuugacucacaggaggcucaggcugugauagagau

SEQ ID NO: 56856 - RNA, 42 nt, Mus musculus
cuacuaugacuaccacagaaucuccaguuguugcugucacag

SEQ ID NO: 56857 - RNA, 46 nt, Mus musculus
aaguaaacaacucaaaucaaacuuuuucaugcaguacuuuccccag

SEQ ID NO: 56858 - RNA, 42 nt, Mus musculus
aguucaacaacagaagcauacuaucccaucaccagggaggag

SEQ ID NO: 56859 - RNA, 44 nt, Mus musculus
uacuuucugaccaagaaaagguaugauuauaauuuaugagugcc

SEQ ID NO: 56860 - RNA, 46 nt, Mus musculus
auuugcuuucaaaucuguauuucugugacaguguucaaggugccaa

SEQ ID NO: 56861 - RNA, 45 nt, Mus musculus
uuuuaugucagaaaaguaugcuuuguagaaaaaugauuuagucag

SEQ ID NO: 56862 - RNA, 70 nt, Mus musculus
uuuauaucgcauauuuuauaaaaaauuaugugaaauaacuggaaaauacuguuagguuaaaugaugaaaa

SEQ ID NO: 56863 - RNA, 42 nt, Mus musculus
cauucaugcuccguacccggggcugacacuacgcccgcugcc

SEQ ID NO: 56864 - RNA, 46 nt, Mus musculus
uggcuuuccuuaaugaugaaguuuggaauuugucaaaugcacaaca

SEQ ID NO: 56865 - RNA, 46 nt, Mus musculus
agagaagcuaucaaacacauuaccccaucucccccagaugccagau

SEQ ID NO: 56866 - RNA, 46 nt, Mus musculus
aucagaaauaguaaagccuugcuauuacaccaagggaaugccauua

SEQ ID NO: 56867 - RNA, 46 nt, Mus musculus
aguucccagcacccaccugguggcucacaaccaucuguaaugagau

SEQ ID NO: 56868 - RNA, 45 nt, Mus musculus
ccacagaggagccaagguuaucucaacagcacacagccuggagga

SEQ ID NO: 56869 - RNA, 46 nt, Mus musculus
aaaaaaaaaaaaaaaaaaaaaaaaaagaaagaaaaaaagaauuaca

SEQ ID NO: 56870 - RNA, 46 nt, Mus musculus
aaaggugucauggacggaagcugcuggcgucauccgggacggaguc

SEQ ID NO: 56871 - RNA, 42 nt, Mus musculus
aacaugucauagcuuuauggcuccaagaccagagcagcaaga

SEQ ID NO: 56872 - RNA, 45 nt, Mus musculus
cucucucuuccaagauaaggcuguguacccacagcuggucucaga

SEQ ID NO: 56873 - RNA, 46 nt, Mus musculus
uggaaccaaacacacacauucuacacagauauacauguugccagaa

SEQ ID NO: 56874 - RNA, 46 nt, Mus musculus
uaugaggccauuuuacuucguuuuccuuaucuguagacuagaagaa

SEQ ID NO: 56875 - RNA, 46 nt, Mus musculus
agagcuggcagaaaaaaaggaaaauuauuccucaaauauaggagaa

SEQ ID NO: 56876 - RNA, 46 nt, Mus musculus
gggucuuucuccuguuuguguuuugggggacuuacuguuuguuuga

SEQ ID NO: 56877 - RNA, 46 nt, Mus musculus
aaagagucugcuguccgagggugaaggcuggagucugggugaaguc

SEQ ID NO: 56878 - RNA, 45 nt, Mus musculus
acccaccugggaugcaguuugcaaaacaacaaagaauugugagau

SEQ ID NO: 56879 - RNA, 46 nt, Mus musculus
gagaaaaggccacagcaguaagucaggacugaauaggagcagagau

SEQ ID NO: 56880 - RNA, 46 nt, Mus musculus
uaaauuauguaguguuuuuuugauuuagcaaaguuuauaucgaguc

SEQ ID NO: 56881 - RNA, 45 nt, Mus musculus
gguguuuugccugaacguaggucugcgucuuuggagagcaguaga

SEQ ID NO: 56882 - RNA, 30 nt, Mus musculus
ccaaggugucccucuguuugcacagccgaa

SEQ ID NO: 56883 - RNA, 45 nt, Mus musculus
acagguagagauuuucuuaccagacaagagggggccgggcuaaga

SEQ ID NO: 56884 - RNA, 46 nt, Mus musculus
cagagauggcagucccagcagaggacguggccuacugagcugagug

SEQ ID NO: 56885 - RNA, 45 nt, Mus musculus
uuccggguucaguugccauggcguucgucacagccucccccagau

SEQ ID NO: 56886 - RNA, 44 nt, Mus musculus
ucugagaaagaucagauggaacaaacagaggggguagaguaaug

SEQ ID NO: 56887 - RNA, 45 nt, Mus musculus
cuccugccugugucuaucugaauagcuucauugaaaaagugucau

SEQ ID NO: 56888 - RNA, 45 nt, Mus musculus
cuagucuaaagagaguggcuuccccggccgccaagccagccauuc

SEQ ID NO: 56889 - RNA, 42 nt, Mus musculus
aagaggugugugcaugcagcuccacaugggugugggggagau

SEQ ID NO: 56890 - RNA, 24 nt, Mus musculus
caaguagaggaggggggggggggg

SEQ ID NO: 56891 - RNA, 45 nt, Mus musculus
ugcuuccugaccuguuugaguuccaguccugacuuccugugguga

SEQ ID NO: 56892 - RNA, 46 nt, Mus musculus
acauggcuaggugguuccauuauuuacuuucuuaaggggaccagag

SEQ ID NO: 56893 - RNA, 46 nt, Mus musculus
ggcacaggaucaggguuuuugccgccaggauauacagcagcagggg

SEQ ID NO: 56894 - RNA, 46 nt, Mus musculus
ucuguauuuucccgagugggcccgacuuuccuccuucagcacaaag

SEQ ID NO: 56895 - RNA, 46 nt, Mus musculus
aaguaguguuugguucagugagaggcaggcaaccauuucaauggag

SEQ ID NO: 56896 - RNA, 42 nt, Mus musculus
uuaagggcgugcgccaccacacccggcaaagaaugaguagua

SEQ ID NO: 56897 - RNA, 42 nt, Mus musculus
uucaccuuugaacagauuugaccuuagggcagagcuuuaguu

SEQ ID NO: 56898 - RNA, 44 nt, Mus musculus
ucugccauccaugaacacccacagcuugucuuguaggcugaggc

SEQ ID NO: 56899 - RNA, 46 nt, Mus musculus
gccuagauuguaugagggaugucggcaguagcugcucuugucagag

SEQ ID NO: 56900 - RNA, 47 nt, Mus musculus
cuggcagagugaaguauggaugcgguuagggaggcagagcuuuuaaa

SEQ ID NO: 56901 - RNA, 46 nt, Mus musculus
gauagccucuugugggggaagacauuaacaaaauuugacauuaguu

SEQ ID NO: 56902 - RNA, 45 nt, Mus musculus
guuuuaaagaaaaggggaaggggaaaagaaauagaucuuggaguu

SEQ ID NO: 56903 - RNA, 31 nt, Mus musculus
agaaugguuguuaugaugguaaucccaacac

SEQ ID NO: 56904 - RNA, 45 nt, Mus musculus
acuaaagacuaaacaaaaaauauauaacauuucuuauagggcaga

SEQ ID NO: 56905 - RNA, 44 nt, Mus musculus
ggucucugggaccccaccucaacacgaugcucugugcugcccgu

SEQ ID NO: 56906 - RNA, 90 nt, Mus musculus
gggagcauuuuagcugaagauugcaggugucugagccgucggcgucgcuaauggcuucugugcucuuuccccggcucgcccuucauguuc

SEQ ID NO: 56907 - RNA, 46 nt, Mus musculus
cuaguuagaacuacgcaguaagaccccgucucaaaaacaaacaaac

SEQ ID NO: 56908 - RNA, 45 nt, Mus musculus
uugcgagacagaauuaauucagcagcuccguuugacauggaaaag

SEQ ID NO: 56909 - RNA, 45 nt, Mus musculus
ggaguuuaagucuauguggaauaaugaagaugggucccuguaguc

SEQ ID NO: 56910 - RNA, 45 nt, Mus musculus
acuggcacacaguuaaugcugccauauucccagaauguauugaga

SEQ ID NO: 56911 - RNA, 46 nt, Mus musculus
ccuguuucugccucccgagagcugggauuaaaugugugugccacca

SEQ ID NO: 56912 - RNA, 46 nt, Mus musculus
agaaacaacagggccaaagccugaaaaaccgaaccaacacaauacu

SEQ ID NO: 56913 - RNA, 42 nt, Mus musculus
uagagagaggaugacuuaccucacugcauaugauguccagga

SEQ ID NO: 56914 - RNA, 46 nt, Mus musculus
caguaaaagagaauucugucuucagucccuuaaaugucacugagag

SEQ ID NO: 56915 - RNA, 42 nt, Mus musculus
uucagugguuaaaagcacuuacugcucuugcagaggccagag

SEQ ID NO: 56916 - RNA, 46 nt, Mus musculus
ggaugcuucaugcuaggccugaguucugucucuacaacuugcaugg

SEQ ID NO: 56917 - RNA, 42 nt, Mus musculus
cagguuucuguggcccugugugugugugugugugugugugug

SEQ ID NO: 56918 - RNA, 45 nt, Mus musculus
cacaguugcuauugucucaggagcagagcccagucaugacucagc

SEQ ID NO: 56919 - RNA, 44 nt, Mus musculus
aaguuccccaaaucuuuucccugaaggccauacaagcugucuga

SEQ ID NO: 56920 - RNA, 42 nt, Mus musculus
aguguacuuacauauaauaauaaauaaaucuucaggccagag

SEQ ID NO: 56921 - RNA, 46 nt, Mus musculus
aaaucccagcaaccacauggugacuuacaaccauccauaaugagau

SEQ ID NO: 56922 - RNA, 46 nt, Mus musculus
uuacugacuuccuucucauauugcugacauaaauaugcugacaggc

SEQ ID NO: 56923 - RNA, 42 nt, Mus musculus
gguacaguagaguugagagggagaguaaagcagcacagagag

SEQ ID NO: 56924 - RNA, 46 nt, Mus musculus
cuuauuaaguuucagccuccucuuuaaaauccagacauccccagua

SEQ ID NO: 56925 - RNA, 42 nt, Mus musculus
acugugcaccguuuacguggagaggcuuuagugggcugacuu

SEQ ID NO: 56926 - RNA, 46 nt, Mus musculus
uuggaggccaggggaaguggcucagauuguaaaauaguugccagua

SEQ ID NO: 56927 - RNA, 106 nt, Mus musculus
cccucccccacaaaacaaaaucccaaacaccaaguugccaucaccccuuauaaaagcgacuguacucuggcaagaugcacuaagaaaguggaaacucacuuaugcu

SEQ ID NO: 56928 - RNA, 46 nt, Mus musculus
ggacgcuaaaggcuagaaaccugauuauuuuaaaaagauuccagug

SEQ ID NO: 56929 - RNA, 42 nt, Mus musculus
gaggcccagugggcccgcgcucgggccuggggaccuggugug

SEQ ID NO: 56930 - RNA, 42 nt, Mus musculus
gagucagugacuccaaugacuugucuugucuuugcccagccc

SEQ ID NO: 56931 - RNA, 42 nt, Mus musculus
guaugaugacucagggcuguaaccuagacuguuuggguacag

SEQ ID NO: 56932 - RNA, 45 nt, Mus musculus
gacauggcaugaauucugucauggguguuauuauguaacugucaa

SEQ ID NO: 56933 - RNA, 46 nt, Mus musculus
gagagacuucucugggguuaaaguuggugucuuauaguuucugggg

SEQ ID NO: 56934 - RNA, 45 nt, Mus musculus
acauaacagcuuuuugacuuaaacuuuauacuuaucaacugacag

SEQ ID NO: 56935 - RNA, 45 nt, Mus musculus
gugacugaacccugaaccaaggauaucaccuguaggccacugagg

SEQ ID NO: 56936 - RNA, 46 nt, Mus musculus
ucagccuuuggaguagcugggguuauaggccuguaucaccuggccu

SEQ ID NO: 56937 - RNA, 46 nt, Mus musculus
caccuucuuuaaaauguuagaguauuuguguguuuguaugagugua

SEQ ID NO: 56938 - RNA, 45 nt, Mus musculus
aggugucuucuaaaaugucauaccaguuuauguguuuacaaucag

SEQ ID NO: 56939 - RNA, 72 nt, Mus musculus
ggccagguucccuuggucagguguguuuauggcuuuggagaggagaggcagggcagcuggacacagcgauga

SEQ ID NO: 56940 - RNA, 74 nt, Mus musculus
aggggaggaagcaagagcgggacugaggagugagagucaggacgggcugacaggcaggugcagcacagagcaug

SEQ ID NO: 56941 - RNA, 47 nt, Mus musculus
gcaaaugcauuucuguguucacagagcaauguggcugagguucugga

SEQ ID NO: 56942 - RNA, 45 nt, Mus musculus
cuagguucuuaguguggcagacuguaugagagcagucacaccaag

SEQ ID NO: 56943 - RNA, 46 nt, Mus musculus
agacugauccugugugcugauagaacuauugauugauuaggcagga

SEQ ID NO: 56944 - RNA, 45 nt, Mus musculus
caauagccauaaauuaaaucuccauuuaaagggacauaggaugau

SEQ ID NO: 56945 - RNA, 42 nt, Mus musculus
agagaggagaaaggaaggaagggaagguuaggaucguggcag

SEQ ID NO: 56946 - RNA, 43 nt, Mus musculus
agagacagucccuuuccucacagaguucacugaugaggugagu

SEQ ID NO: 56947 - RNA, 52 nt, Mus musculus
uuggaaggugaaguuguucguuauuccuuacuccuagccaacagaggaacau

SEQ ID NO: 56948 - RNA, 64 nt, Mus musculus
ucuuucagcuagaacuuagauccagcuuuguaguaggucucgugcacauuuaaaauaugucuag

SEQ ID NO: 56949 - RNA, 46 nt, Mus musculus
cucccugugccugguuccuugcuggcuucuugggacauggucaugg

SEQ ID NO: 56950 - RNA, 48 nt, Mus musculus
cuugggcuuaguuuugauggugacgcuuuauaacuuaaucucuggcaa

SEQ ID NO: 56951 - RNA, 46 nt, Mus musculus
gggugaugggagccaggguagucucgccagcaguguagagaggugg

SEQ ID NO: 56952 - RNA, 46 nt, Mus musculus
uaguuacucauuuagaugucaucucuaguuuucugugacuuggcag

SEQ ID NO: 56953 - RNA, 26 nt, Mus musculus
agacuuagcuccaaccaagccccaac

SEQ ID NO: 56954 - RNA, 42 nt, Mus musculus
gugaaugugugugugugugugugugugugcgugugugugcgu

SEQ ID NO: 56955 - RNA, 46 nt, Mus musculus
agacugaugguucugucucagaaucugaauuuuuaacaagcccccu

SEQ ID NO: 56956 - RNA, 46 nt, Mus musculus
aguggguucuugguauuugcugacuuugccucagcaguaucagagc

SEQ ID NO: 56957 - RNA, 48 nt, Mus musculus
agcuuccuaagccucauuggguucucugccuugucaguacauuagauu

SEQ ID NO: 56958 - RNA, 47 nt, Mus musculus
ggauagagaucuauggguuuauuaacaagcugaggcacuggcagggg

SEQ ID NO: 56959 - RNA, 42 nt, Mus musculus
uucacaggagccagguugcuuccccacugcugacgcgugaug

SEQ ID NO: 56960 - RNA, 23 nt, Mus musculus
uucucuugggaagcuguggggga

SEQ ID NO: 56961 - RNA, 42 nt, Mus musculus
cucucucuguaguggguacagucuucuuaguacaugcccaag

SEQ ID NO: 56962 - RNA, 46 nt, Mus musculus
aaagaacauuaaaauuguaaauguuaucuuuagacuuuggucccuc

SEQ ID NO: 56963 - RNA, 41 nt, Mus musculus
guuuguguguucucuuaugugaugguguuccucugggguca

SEQ ID NO: 56964 - RNA, 45 nt, Mus musculus
aaucugcauuaaauaggugcuauucuguguugagaaaguauggag

SEQ ID NO: 56965 - RNA, 46 nt, Mus musculus
ccaucuugucagcccuaaaauauguuuuagaaaagauaguugcuac

SEQ ID NO: 56966 - RNA, 45 nt, Mus musculus
gugguuguggcaggaaggaguggacaaggaagauuuaugaaauag

SEQ ID NO: 56967 - RNA, 46 nt, Mus musculus
ugugaacugugcaguugaguuuaacaauaaaaugcuugguggcgac

SEQ ID NO: 56968 - RNA, 46 nt, Mus musculus
uagugcgugcguguguguguguguguguguguguguguguauugug

SEQ ID NO: 56969 - RNA, 45 nt, Mus musculus
agcccuguguguuaugcucauaucaccauuaauuccuguuagcag

SEQ ID NO: 56970 - RNA, 63 nt, Mus musculus
gggguuagucuugaugacagggcuggcuuuugaggacucuaguugggaugagaauaggcuauu

SEQ ID NO: 56971 - RNA, 46 nt, Mus musculus
ggcugaaggcugccgaggagauuauggaaugugccggaagggauag

SEQ ID NO: 56972 - RNA, 41 nt, Mus musculus
aaaaagugugcuuagcugcuuaagcaucucucuggccccua

SEQ ID NO: 56973 - RNA, 45 nt, Mus musculus
uauagaauaaguuggagaaaggagaugcuugggaggaugcuguua

SEQ ID NO: 56974 - RNA, 46 nt, Mus musculus
acagaugguugugagccaccauauggcugcugggaauugaacucag

SEQ ID NO: 56975 - RNA, 46 nt, Mus musculus
ggaaguaauaaacaggaggggcugugagaaaagugagguggaccag

SEQ ID NO: 56976 - RNA, 46 nt, Mus musculus
cuucagauaacauugaguggcgggaauuacuuaggcaaguaugcag

SEQ ID NO: 56977 - RNA, 40 nt, Mus musculus
caguagccaguggguaagaugugacaaucaugguaaaucc

SEQ ID NO: 56978 - RNA, 45 nt, Mus musculus
agguuuguacacuuguuuuuuaguuauauuccagugaggcugagg

SEQ ID NO: 56979 - RNA, 46 nt, Mus musculus
cugcagguuccuuuacccacugaaucacccagucccucacuugcag

SEQ ID NO: 56980 - RNA, 46 nt, Mus musculus
uuacagcuuaacauagguacuuccuuuuuccucuaaaagugggcag

SEQ ID NO: 56981 - RNA, 46 nt, Mus musculus
auguaguaacuaucacaguggugugguaucaggguuugugcagaag

SEQ ID NO: 56982 - RNA, 46 nt, Mus musculus
ucuuggacaaaagaaaggaaaauuggggaagaugaaaauacaggag

SEQ ID NO: 56983 - RNA, 45 nt, Mus musculus
cucauauauauaaaauaaaauaaaaauaaucuuuaaaaccguuua

SEQ ID NO: 56984 - RNA, 45 nt, Mus musculus
aaacagaugaaaaagucccugccucgaauaaauaaauggugcaaa

SEQ ID NO: 56985 - RNA, 65 nt, Mus musculus
acucaacaaaacuaaauuucaaaguauauacccuaaacauuccagagaaaguaauaguuacugaa

SEQ ID NO: 56986 - RNA, 46 nt, Mus musculus
uccugguugucaacuugaguacauccagaaugaacugcaauccaga

SEQ ID NO: 56987 - RNA, 46 nt, Mus musculus
uugaggcugggagauagaagcuucugaccuggaucuuggcacggag

SEQ ID NO: 56988 - RNA, 45 nt, Mus musculus
cagcacaucuguuggaaucuaccagcugaaacaaguagccuugag

SEQ ID NO: 56989 - RNA, 46 nt, Mus musculus
gauuggacuuccuauccacagcugcccauuauucguuggacuacag

SEQ ID NO: 56990 - RNA, 46 nt, Mus musculus
uuaggccauaugugucccucagacacauaagaaacaaaagaaauag

SEQ ID NO: 56991 - RNA, 46 nt, Mus musculus
ugugaagucagacagcagcuguguccagggcuguuuuccaguugug

SEQ ID NO: 56992 - RNA, 46 nt, Mus musculus
augguugugagccaccaugugguugcugggauuugaacuccuuuuu

SEQ ID NO: 56993 - RNA, 42 nt, Mus musculus
agauaagagcaaccaaacucauuugcagugccuagcccacca

SEQ ID NO: 56994 - RNA, 45 nt, Mus musculus
cuggagaccgccuuguguacgugcaaagugcucuuguugcugcag

SEQ ID NO: 56995 - RNA, 82 nt, Mus musculus
uguguagauguuagugagguguaguguguguagauguuagugagguguaguguguguagauguuagugagguguagugugug

SEQ ID NO: 56996 - RNA, 130 nt, Mus musculus
uagauguuagugagguguaguguguguggauguuagugagguguaguguguguagauguuagugagguguaguguguguagauguuagugagguguaguguguguagauguuagugagguguagugugug

SEQ ID NO: 56997 - RNA, 177 nt, Mus musculus
uagauguuagugagguguaguguguguagauguuagugagguguaguguguguagauguuagugagguguaguguguguguagauguuagugagguguaguguguguagauguuagugagguguaguguguguguauguuagugagguguaguguguguagauguuagugaggugua

SEQ ID NO: 56998 - RNA, 53 nt, Mus musculus
gugaguguugauguuagugagguguaguguauguagauguuagugagguguag

SEQ ID NO: 56999 - RNA, 46 nt, Mus musculus
uguugauucaccaauacuauuuagaagaugguuugggaaggcuuag

SEQ ID NO: 57000 - RNA, 45 nt, Mus musculus
cauauuuuaaaguaugugauauuaaagaaauucccucaaccacaa

SEQ ID NO: 57001 - RNA, 45 nt, Mus musculus
guuucucuguguccugguuguacuggaacuugcuuuguagaccag

SEQ ID NO: 57002 - RNA, 84 nt, Mus musculus
gauucaucuauuugccucugucuggcuuagacaagcauugugaguggaaguagcaucuguguggucuggagguagugcugugag

SEQ ID NO: 57003 - RNA, 67 nt, Mus musculus
uuaauuguguuauauuacauaucaguaguuuauuucugucuuuuuuuauuuuauuuuacuuuuuuuu

SEQ ID NO: 57004 - RNA, 46 nt, Mus musculus
ugaaagucucuaugaguaucaugaagacugucuuaaauggccgugc

SEQ ID NO: 57005 - RNA, 46 nt, Mus musculus
uuaaaucuauaguaauuuuggaggaauuuuaaacuauugauucuuu

SEQ ID NO: 57006 - RNA, 45 nt, Mus musculus
gaaagcaguuuguugcagucaaccaagaugagaaaagaguuggag

SEQ ID NO: 57007 - RNA, 46 nt, Mus musculus
uugaacaaaccugugggggcugggaguggaaugugauggcuuguau

SEQ ID NO: 57008 - RNA, 46 nt, Mus musculus
aauuguuaauuucugucugaggcuuugccaaccaauuuuacaaaag

SEQ ID NO: 57009 - RNA, 46 nt, Mus musculus
cugagccagaaaugaguuuaagggcaaguuacaaaucaggccacag

SEQ ID NO: 57010 - RNA, 46 nt, Mus musculus
cugccagacgcuguugcagagcagcaagaaggucagugugguugag

SEQ ID NO: 57011 - RNA, 42 nt, Mus musculus
ugacagagaugauagaaguaagcuggaugaggaaugagagag

SEQ ID NO: 57012 - RNA, 40 nt, Mus musculus
agagagagagaagagagacugugugugugugugugugugu

SEQ ID NO: 57013 - RNA, 46 nt, Mus musculus
cucucgcccgcuuuaacaauccucgcuccguacucuuugcccccaa

SEQ ID NO: 57014 - RNA, 46 nt, Mus musculus
ugggaagcacuuuggaguucuguguucuucacaggacagugagcug

SEQ ID NO: 57015 - RNA, 25 nt, Mus musculus
agacauuugcaugcuggccucagag

SEQ ID NO: 57016 - RNA, 41 nt, Mus musculus
augcuuaugccucuuacaguuuccuguguuuuuuggccugg

SEQ ID NO: 57017 - RNA, 45 nt, Mus musculus
gguacagacguuagggagaacacacauggugauuggcucguucag

SEQ ID NO: 57018 - RNA, 46 nt, Mus musculus
uccuucccuccuucccucccucccuucccaaauugccagaccugag

SEQ ID NO: 57019 - RNA, 41 nt, Mus musculus
ucgccagccgagcauaagugaccagcaggugucugccuuac

SEQ ID NO: 57020 - RNA, 46 nt, Mus musculus
uuucauuauuaucagaaaugauguugaaauuacaacuuagcccuuu

SEQ ID NO: 57021 - RNA, 23 nt, Mus musculus
cauguuguguugucguugugcug

SEQ ID NO: 57022 - RNA, 46 nt, Mus musculus
augaccagucgcucaguucacugagguuaccgcuuagauggcaaag

SEQ ID NO: 57023 - RNA, 46 nt, Mus musculus
uaauuaucauugaauuauauuauucauauaauucauaauuauucag

SEQ ID NO: 57024 - RNA, 46 nt, Mus musculus
augagguacuuugauucuucauuaauggaauacauuagaccaguca

SEQ ID NO: 57025 - RNA, 46 nt, Mus musculus
ugaugauaacuaugauuauauuguaaaaaacggggaaaaguggaug

SEQ ID NO: 57026 - RNA, 73 nt, Mus musculus
uaugacagaguggagcaagaaugggucgccauuaaaaucaucaagaacaagaaagcguuucugaaucaagccc

SEQ ID NO: 57027 - RNA, 46 nt, Mus musculus
ucagcugcuguaauaaguuacugagcaucauuaauauugagugcag

SEQ ID NO: 57028 - RNA, 46 nt, Mus musculus
cuuccgaggggucucuuugaaccuaacacgaaaguuugcgcaacag

SEQ ID NO: 57029 - RNA, 46 nt, Mus musculus
gucgugagccaccaugugguugcugggauuugaacuuuagaccuuc

SEQ ID NO: 57030 - RNA, 61 nt, Mus musculus
auccucagcgcccacaguguauccauccucagugcccacaguguauccauccucagugccc

SEQ ID NO: 57031 - RNA, 61 nt, Mus musculus; identical to SEQ ID NO: 57030

SEQ ID NO: 57032 - RNA, 46 nt, Mus musculus
cgccuuuaauucccaaguauguaaggauuuguuuucuccugagcag

SEQ ID NO: 57033 - RNA, 46 nt, Mus musculus
cguucuccaguugcaugcaugguucugccgugcucaguauugcccc

SEQ ID NO: 57034 - RNA, 45 nt, Mus musculus
acccguaaacuucauaauauucuuggaguagaaacaggaggaccu

SEQ ID NO: 57035 - RNA, 46 nt, Mus musculus
cuggcucacaguucaaaaggaaaugauaccuugugucagggaagau

SEQ ID NO: 57036 - RNA, 24 nt, Mus musculus
cuuggucucaccccuuacugccag

SEQ ID NO: 57037 - RNA, 42 nt, Mus musculus
cauccuguucaagagacaaccuuucauguagccccccagcag

SEQ ID NO: 57038 - RNA, 37 nt, Mus musculus
cuugaaucagaaggagauuaacacacugaaccgcuac

SEQ ID NO: 57039 - RNA, 45 nt, Mus musculus
ugcaaagggacaaugaaguuuuuaagagccauguccacccaucuu

SEQ ID NO: 57040 - RNA, 42 nt, Mus musculus
ugagaagcaaucagcgggucgguuguggccaguccuggggag

SEQ ID NO: 57041 - RNA, 46 nt, Mus musculus
ucccuuccugcuuuucccuuuucuuuggcuuuuucucggcacgugg

SEQ ID NO: 57042 - RNA, 45 nt, Mus musculus
gacagagacauuggcugcaagugucuuugaaaguaaaaauuggag

SEQ ID NO: 57043 - RNA, 44 nt, Mus musculus
ggaagcaaugcagacagcugugugugguacagagggacugaggg

SEQ ID NO: 57044 - RNA, 45 nt, Mus musculus
auguguuuguaaaaagauagagaggggauaaguuuuauggaugug

SEQ ID NO: 57045 - RNA, 42 nt, Mus musculus
aggggaguugagaggauaguagaggcagagaaaggggggggg

SEQ ID NO: 57046 - RNA, 42 nt, Mus musculus
gauagagaugggguuuuggucgagaggauagagcaggagcag

SEQ ID NO: 57047 - RNA, 46 nt, Mus musculus
ugcuaagcaaaggguuaaaugaacggaggcaucugucugccaggcu

SEQ ID NO: 57048 - RNA, 25 nt, Mus musculus
agguccagcccaaagucuaucaguc

SEQ ID NO: 57049 - RNA, 45 nt, Mus musculus
auagaugucccagcauagggggaugccagggcaguaaggugagaa

SEQ ID NO: 57050 - RNA, 41 nt, Mus musculus
acgugggguuagggagucgcaaagugggcggguggcggagu

SEQ ID NO: 57051 - RNA, 30 nt, Mus musculus
accugaaguuccugacaguuguggcccagc

SEQ ID NO: 57052 - RNA, 47 nt, Mus musculus
uagcuuggguuaaacaaacaccccacauuaccuucuuuccagugaug

SEQ ID NO: 57053 - RNA, 47 nt, Mus musculus
cauucaaacagggucgguugcucccaacagucauuuagaggguacuu

SEQ ID NO: 57054 - RNA, 49 nt, Mus musculus
cuuaacuggggauaguacuuucccacagaggccucacuuuucccacaga

SEQ ID NO: 57055 - RNA, 45 nt, Mus musculus
aucaagugucuuuuaugcccacagaagcaggguauggggaggggg

SEQ ID NO: 57056 - RNA, 46 nt, Mus musculus
acagcgacagcucaagguaccacgagugucugucccugccucagac

SEQ ID NO: 57057 - RNA, 61 nt, Mus musculus
gaugauguagcaguuuugugugucauacagccuauagcaucaagauuuucuuuucccuuga

SEQ ID NO: 57058 - RNA, 78 nt, Mus musculus
ggaagcuaggcuugguguugcauaucugcaaucccaggaaggucaggaguucaaagccauucuucaguacagagugag

SEQ ID NO: 57059 - RNA, 44 nt, Mus musculus
aauguaaauguaaaggagaguuuaauauuuguagaacccgaaga

SEQ ID NO: 57060 - RNA, 41 nt, Mus musculus
uccagcaugagcgcguccgagacggaccgcugggcguggcu

SEQ ID NO: 57061 - RNA, 45 nt, Mus musculus
ggaaaaacaccccccauacauaaacagaaaccugaaugugcaaga

SEQ ID NO: 57062 - RNA, 46 nt, Mus musculus
auaguuuuuuuuaaaugguuuaaaggcuacagauagcaggacagau

SEQ ID NO: 57063 - RNA, 46 nt, Mus musculus
uugggccauccuccucacugagucaugaguuuccaguagcuagcag

SEQ ID NO: 57064 - RNA, 44 nt, Mus musculus
guuaggaugacauagcaaccuacaggguguacuccuggggccuu

SEQ ID NO: 57065 - RNA, 59 nt, Mus musculus
ugcuacagguggcaaggagcagggccaacuccaggcagcaagggauguggagggggagg

SEQ ID NO: 57066 - RNA, 59 nt, Mus musculus
gagguugguucucugauuuugaaugauagcucugugacuuuuuaaaaauguuggccuuu

SEQ ID NO: 57067 - RNA, 46 nt, Mus musculus
aucaccugcauucauguauguaugucuguguaucaccugccugcau

SEQ ID NO: 57068 - RNA, 69 nt, Mus musculus
ugguguaugucugugcaucaccugcaugccugguguccauggauucagaagaaguuguuggauccccua

SEQ ID NO: 57069 - RNA, 45 nt, Mus musculus
agauuggaauaacucucccuuugaguggagaacagugggcauuag

SEQ ID NO: 57070 - RNA, 38 nt, Mus musculus
cagaaggaugcagagcaggagucacagaugagggcaga

SEQ ID NO: 57071 - RNA, 46 nt, Mus musculus
caacaugauggacgaguuugccagauacgccaggcuggaaaggaag

SEQ ID NO: 57072 - RNA, 46 nt, Mus musculus
cucacuagccagggcuucauagugagguccugucuaucuguuuguc

SEQ ID NO: 57073 - RNA, 46 nt, Mus musculus
uuuuugucuggaguugugugugugugugugugugugugugugugug

SEQ ID NO: 57074 - RNA, 42 nt, Mus musculus
ugggugugguggcucaugccuguaaucccagcccugggggag

SEQ ID NO: 57075 - RNA, 46 nt, Mus musculus
uugcacacaaguccacagauucuuguguuuuauguuuuggaacauu

SEQ ID NO: 57076 - RNA, 45 nt, Mus musculus
ccaaauuguauuuguuuauuaauggguaauaaacauugaguuaaa

SEQ ID NO: 57077 - RNA, 44 nt, Mus musculus
ucugggugugacaucugauacuaaauccauaggaagcuugugug

SEQ ID NO: 57078 - RNA, 46 nt, Mus musculus
aggguggacaaguacaaaaauaagauuauucuagaaaacuccaggu

SEQ ID NO: 57079 - RNA, 46 nt, Mus musculus
uccagcagccgcgggagaacugaguuuaccugaaaggggugcugga

SEQ ID NO: 57080 - RNA, 46 nt, Mus musculus
gcuugcauagcucaacuugcaguggaguuaucaaucuguccuacaa

SEQ ID NO: 57081 - RNA, 45 nt, Mus musculus
auuggaggaccggcacaaguauuacagaaaugaaaaucccuguag

SEQ ID NO: 57082 - RNA, 40 nt, Mus musculus
gccaaucagagccuccaggcagaccugcgugucagaagag

SEQ ID NO: 57083 - RNA, 44 nt, Mus musculus
ggcagcagcagagagacucuggggggcuuggcaggaagucccgc

SEQ ID NO: 57084 - RNA, 57 nt, Mus musculus
gcuccguucccgcucucccccuaccucacacacagugcaugcucagucccugccuca

SEQ ID NO: 57085 - RNA, 42 nt, Mus musculus
cccaccccgcggagagauccgcaucugcagagacucgggcgg

SEQ ID NO: 57086 - RNA, 51 nt, Mus musculus
gcagaaaaacguugugaaaguguugaaggcacaagcacagagucagaaagc

SEQ ID NO: 57087 - RNA, 41 nt, Mus musculus
cucuacaccaagaagguugggaaagcaccuaaauccuuaug

SEQ ID NO: 57088 - RNA, 46 nt, Mus musculus
guguauguuaguacacacuuacauaggcgacaauucugccacagaa

SEQ ID NO: 57089 - RNA, 46 nt, Mus musculus
uguuggacagugaggccaugagucuuagcaagcuuuuaguacagua

SEQ ID NO: 57090 - RNA, 46 nt, Mus musculus
agcaugugcgggcagacaucuguucauugugguggacaggaagcag

SEQ ID NO: 57091 - RNA, 43 nt, Mus musculus
ccaggaugaaagcaaggagcuggagaccugccgaggccaugau

SEQ ID NO: 57092 - RNA, 46 nt, Mus musculus
gaacacaggccaggaccaugguggcccucgcagucugcacauggac

SEQ ID NO: 57093 - RNA, 46 nt, Mus musculus
agacagcgguguuugaacaacacaaggagaaucgaggacagccguu

SEQ ID NO: 57094 - RNA, 46 nt, Mus musculus
gaauuuaauguuuaagguguuauuccauauuuauaucuugcugcac

SEQ ID NO: 57095 - RNA, 46 nt, Mus musculus
aauaaaaauguccuauuuuuagaaagggaaggauguagguauuuag

SEQ ID NO: 57096 - RNA, 45 nt, Mus musculus
ucaggcauuaaaaacuacuuuaagaagauuauuaucagagacgga

SEQ ID NO: 57097 - RNA, 24 nt, Mus musculus
gcaggaguggguaaggaaucuggg

SEQ ID NO: 57098 - RNA, 47 nt, Mus musculus
gagucagguuugguauuguuuugguuuugugucacucugugugugug

SEQ ID NO: 57099 - RNA, 46 nt, Mus musculus
gcuucaggcaaaaggaagaaagugagcugcugaggucugcccgcag

SEQ ID NO: 57100 - RNA, 50 nt, Mus musculus
ugcagacgccacugucgcuuuucgccgcuugcugcagccauggucaaccc

SEQ ID NO: 57101 - RNA, 42 nt, Mus musculus
gccaggguggugacgucacacaccacauggcacuggcggcag

SEQ ID NO: 57102 - RNA, 92 nt, Mus musculus
ccaagacugaauggcuggauggcaagcauguggucuucgggaaggugaaagaaggcaugaacauuguggaagccauggagcguuuugggucc

SEQ ID NO: 57103 - RNA, 103 nt, Mus musculus
aggaauggcaagaccagcaagaagaucaccauuuccgacuguggacaacucuaauuucuuuugacuugcgggcauuuuacccaucaaaccauuccuucuguag

SEQ ID NO: 57104 - RNA, 52 nt, Mus musculus
ugugugugugagugugugugugucugugaguuaauguguauguugugagugu

SEQ ID NO: 57105 - RNA, 44 nt, Mus musculus
aguaauggugauugagguuuucaucagacuuagcugggcaagaa

SEQ ID NO: 57106 - RNA, 73 nt, Mus musculus
uaguagaggaggagaugguaguagaggaggagaagguaguagaggaggagaugguaguagaggaggagaaggu

SEQ ID NO: 57107 - RNA, 45 nt, Mus musculus
augguaguagaggaggagaugguaguagaggaggagaagguagua

SEQ ID NO: 57108 - RNA, 45 nt, Mus musculus
aagguaguagaggaggagaugguaguagaggaggagaagguagua

SEQ ID NO: 57109 - RNA, 70 nt, Mus musculus
guugugaauguguggguuucuguguguguaugucucuguguguuguaugggaaugugugggugucuguaa

SEQ ID NO: 57110 - RNA, 42 nt, Mus musculus
acucacaucaguaacagugauggucacagaggaugacguuga

SEQ ID NO: 57111 - RNA, 46 nt, Mus musculus
aagcccccaaggccugaaguuggaaauuucccagccguucccauca

SEQ ID NO: 57112 - RNA, 46 nt, Mus musculus
aaugugucuccccgcucccaguuccccugaagagcaaacggcccac

SEQ ID NO: 57113 - RNA, 24 nt, Mus musculus
acaaagacaucauugaaaccaaug

SEQ ID NO: 57114 - RNA, 45 nt, Mus musculus
agcauuauuaacaugaaagucagugugugugugugcgugugugug

SEQ ID NO: 57115 - RNA, 47 nt, Mus musculus
ucuaagauauuuuaauuagcuauugaauaguaugcuccagauaaggu

SEQ ID NO: 57116 - RNA, 45 nt, Mus musculus
ccaugcaccucauucauagaagaaaauuucucauagccugcaggu

SEQ ID NO: 57117 - RNA, 45 nt, Mus musculus
ugccugcagaguccuagcuuugccauagaaauccugaccgcacga

SEQ ID NO: 57118 - RNA, 47 nt, Mus musculus
gagcguggauaaugagcuuggucuuauuucuucauacaccacacaga

SEQ ID NO: 57119 - RNA, 41 nt, Mus musculus
gccgaguauauucaugcuguucacuguuaugagggcccuga

SEQ ID NO: 57120 - RNA, 46 nt, Mus musculus
aaguuucagauagagaauaagauugguauagcuacacucaggagug

SEQ ID NO: 57121 - RNA, 46 nt, Mus musculus
ugcccuauggagagguaacaugagagggagggaguacuagccugag

SEQ ID NO: 57122 - RNA, 45 nt, Mus musculus
cucacgccuucauuauaaagauugauggcauuuuaugaccagaga

SEQ ID NO: 57123 - RNA, 74 nt, Mus musculus
aaguccuagagacaucagcgccuaguucccagagacagacugcaguuaucauucgcuuccaacucucacgucuc

SEQ ID NO: 57124 - RNA, 46 nt, Mus musculus
guaaucacuugcuuuguugauacauaauuuaauaauacagccagau

SEQ ID NO: 57125 - RNA, 41 nt, Mus musculus
ucaacuggcuuguggagugucugcauagacuuacugggagg

SEQ ID NO: 57126 - RNA, 45 nt, Mus musculus
aucaucucuuuugucuaauccuguuuuccacauggggucacugga

SEQ ID NO: 57127 - RNA, 40 nt, Mus musculus
uuguuucauuucaguuuauauauauauauacgcuuuagag

SEQ ID NO: 57128 - RNA, 46 nt, Mus musculus
gccagcugcaggcaaagccagcuucuuagagucacaaaaugaagaa

SEQ ID NO: 57129 - RNA, 42 nt, Mus musculus
gugguugggauaucacagcuuugugcugugcgacccccaggu

SEQ ID NO: 57130 - RNA, 45 nt, Mus musculus
aggaaggccgcaccuccugaacauccaaaaacagagccaccaacc

SEQ ID NO: 57131 - RNA, 46 nt, Mus musculus
uugauguuaacaaaaacuguauuuuuacuacagacuaccaguacag

SEQ ID NO: 57132 - RNA, 47 nt, Mus musculus
ugcauaauuacagcgggagccuguaaucucagcgcuugggaaacaga

SEQ ID NO: 57133 - RNA, 45 nt, Mus musculus
agacauuuuacagugaauauuugaauguggaguuugccuggauuu

SEQ ID NO: 57134 - RNA, 50 nt, Mus musculus
cauggagaauaugcaggacaacuuucuagaaucaagggagacuacagaga

SEQ ID NO: 57135 - RNA, 46 nt, Mus musculus
cucugucuugaaacaaacaaacaagcaaacaaagaagcuggcagaa

SEQ ID NO: 57136 - RNA, 46 nt, Mus musculus
gggugggauuauuuuuauguucuuugugauaaacuuuggagccuac

SEQ ID NO: 57137 - RNA, 47 nt, Mus musculus
uuucucaccuuguucccuuucucucugaucuuguucugaguccaaag

SEQ ID NO: 57138 - RNA, 41 nt, Mus musculus
uguguguguguguaccuguguguguguaccuguguguguac

SEQ ID NO: 57139 - RNA, 50 nt, Mus musculus
uuuggaaaugcaggcagcacuagucauuauuaaaauauagacggagggag

SEQ ID NO: 57140 - RNA, 47 nt, Mus musculus
ggugugugauguguguucaccaaugcaggaacggucagaggacaguu

SEQ ID NO: 57141 - RNA, 45 nt, Mus musculus
uguuguucaaaaaauuaaaaagaaaaacaaaacacaaaacagcac

SEQ ID NO: 57142 - RNA, 45 nt, Mus musculus
uggggugaauacugaguuaauggagugguggauuacaugccaggu

SEQ ID NO: 57143 - RNA, 45 nt, Mus musculus
cuauuuuugcauaaaccagccagcuuccauaucaaaucugucaca

SEQ ID NO: 57144 - RNA, 46 nt, Mus musculus
uguaaugugaagucauagcuacaaauggugacuacuuuaggcugag

SEQ ID NO: 57145 - RNA, 46 nt, Mus musculus
ccaugaagcaguucuugcuguacuuggaugaggccaacgccuuggg

SEQ ID NO: 57146 - RNA, 109 nt, Mus musculus
gccuuuucucuuacccagaagugagagcgcugguguugagcacuugggaaucccagccacagacacuugagagaggccagcucagugucucgugggguuuauacuuguu

SEQ ID NO: 57147 - RNA, 61 nt, Mus musculus
uucauucagaugaaagccccuaacugauuugguuggaccauuaaaaaaaaaauauguguac

SEQ ID NO: 57148 - RNA, 46 nt, Mus musculus
gucugaccuguguguguguagcucccucccacacaaauacggaaau

SEQ ID NO: 57149 - RNA, 46 nt, Mus musculus
auaccauuuuauauuaaaacacaaaacuuuggaucuuggaaguggg

SEQ ID NO: 57150 - RNA, 45 nt, Mus musculus
cucucuugccuccccggccaccaccucgaccccgguugcccccag

SEQ ID NO: 57151 - RNA, 41 nt, Mus musculus
uuacaauuccacccacccccccuugcacagccuggcuuccu

SEQ ID NO: 57152 - RNA, 47 nt, Mus musculus
ccauuugaacucaagcucucagaaaaagaaaagaacaagaggaggaa

SEQ ID NO: 57153 - RNA, 44 nt, Mus musculus
ucccagcaaccacaugguggcucacaaccaccuguaacggauuu

SEQ ID NO: 57154 - RNA, 46 nt, Mus musculus
aaaagagggagagaaggaauauguuugguggagguguaguuagcug

SEQ ID NO: 57155 - RNA, 41 nt, Mus musculus
gggggggagagacagagagguaugagaggacagcgagagca

SEQ ID NO: 57156 - RNA, 46 nt, Mus musculus
ugacucugcugccuuccuccugccucgaaggcuuuugagcaccuuc

SEQ ID NO: 57157 - RNA, 45 nt, Mus musculus
aggacuuggcagggcauguguccaaguuuccagguguugcccuuc

SEQ ID NO: 57158 - RNA, 45 nt, Mus musculus
cgcaaucccacaguccucuuugugaacuccuguucacuuuccaga

SEQ ID NO: 57159 - RNA, 48 nt, Mus musculus
uaucaagugccuaccaugugccagggccuuugugagcugugagggucu

SEQ ID NO: 57160 - RNA, 54 nt, Mus musculus
uuaguaaugcaugguuuuguuuuguuuuguuuaauuaacagagcccuuguuugc

SEQ ID NO: 57161 - RNA, 46 nt, Mus musculus
ggugugucuuggcacagaccugggccugauuuuguauuacaugaag

SEQ ID NO: 57162 - RNA, 46 nt, Mus musculus
cuuauuuguuggcagggcugagguagcccguguugagacaagugaa

SEQ ID NO: 57163 - RNA, 46 nt, Mus musculus
cuggagcuacaaagguccuccugccucugccuccugagaacugaaa

SEQ ID NO: 57164 - RNA, 51 nt, Mus musculus
uccuggggacaaagaagugaacuugguccuuggagcuguuuccggaagaga

SEQ ID NO: 57165 - RNA, 52 nt, Mus musculus
uguauuagccacuuucccaucgcugagcacaguaccuggcagaaacagcuca

SEQ ID NO: 57166 - RNA, 46 nt, Mus musculus
uccaucuugaugggaagguaugguggacaguucaguucuuggauag

SEQ ID NO: 57167 - RNA, 45 nt, Mus musculus
cccucggggaggauagaccacaaggugagagauacuuagaaguua

SEQ ID NO: 57168 - RNA, 47 nt, Mus musculus
uucucaccauugaccgcccuuccccauuugcauguaaggccugucug

SEQ ID NO: 57169 - RNA, 46 nt, Mus musculus
gagcuuagaaaccacagaaguuuaauuuuuacuauucagucccaag

SEQ ID NO: 57170 - RNA, 42 nt, Mus musculus
cugaaugccccugaggcucuguguucuagcaccagugucuga

SEQ ID NO: 57171 - RNA, 45 nt, Mus musculus
uccaccuucaaguucacugcauggaagauguuaauaaaacccccu

SEQ ID NO: 57172 - RNA, 45 nt, Mus musculus
uuccuauaugccaggcucaaggaguggcacuauuagaaggugugg

SEQ ID NO: 57173 - RNA, 46 nt, Mus musculus
guacacugugugaaaaugaaaggucacagccagugaggagcugcag

SEQ ID NO: 57174 - RNA, 45 nt, Mus musculus
gucuauuaacacuugaucuuagauucacaguuuccagaaucagga

SEQ ID NO: 57175 - RNA, 45 nt, Mus musculus
ugggacccuaaagcagguaggcaaaugugugccucccugggacag

SEQ ID NO: 57176 - RNA, 45 nt, Mus musculus
gaagcagaacugggaggcuugagguagcucuagaaaacagguugg

SEQ ID NO: 57177 - RNA, 67 nt, Mus musculus
aaccccagccccaagacugggguuuuugaacaaggauuucagagacagaggaacugcagggaagaag

SEQ ID NO: 57178 - RNA, 104 nt, Mus musculus
gcucuggcaguaagucaauggguaggaugaaagagaaaagccacugaagauggauugaagaacagaacggaugggcuguccauguugaauuuggagaauaggca

SEQ ID NO: 57179 - RNA, 84 nt, Mus musculus
gaccaaggaagcugguuaggggcaacuggggggcaaaguggcuuucuaccucauaaaucccaggaggagaggggacaagcaagu

SEQ ID NO: 57180 - RNA, 46 nt, Mus musculus
uggcuuuauuccaguugaaucuuuaccauuguguuuuugugccuag

SEQ ID NO: 57181 - RNA, 46 nt, Mus musculus
agcaugcuucucuugauuguuuauaaugucaauuuugcagcaaaau

SEQ ID NO: 57182 - RNA, 49 nt, Mus musculus
cagggcucaacuguguaguugucgugacucuuguggagugaagguuuug

SEQ ID NO: 57183 - RNA, 44 nt, Mus musculus
aaacaagcaugguggacaugcauguaauaccuguuuucuggagg

SEQ ID NO: 57184 - RNA, 46 nt, Mus musculus
auaugucaaaaugacaacaaaaugaaaguaacugcucaguauucag

SEQ ID NO: 57185 - RNA, 47 nt, Mus musculus
guuaauuuuauaaacauauuaaugacuuuucugcauuauugcugaga

SEQ ID NO: 57186 - RNA, 46 nt, Mus musculus
acagugugaaaagcucccagagaagguagguccagagaacaagcag

SEQ ID NO: 57187 - RNA, 46 nt, Mus musculus
uugaggguaaguaauuccauggaguuuuacgggguuuuaaaugcug

SEQ ID NO: 57188 - RNA, 45 nt, Mus musculus
cagcuauagaaugaaaacuguccaggauguuagaagcaucauuua

SEQ ID NO: 57189 - RNA, 42 nt, Mus musculus
cacuggcuaugggggcaggcacagagggaagagaauggagca

SEQ ID NO: 57190 - RNA, 42 nt, Mus musculus
uccuaaacccaccuauguggagacaugugugaaugacaggau

SEQ ID NO: 57191 - RNA, 46 nt, Mus musculus
auaugugucccauguaaaugcucaccaaaaggugacuucagcggag

SEQ ID NO: 57192 - RNA, 42 nt, Mus musculus
ucuccagcuccuggcccuccgccaccuugaagaggcccccgg

SEQ ID NO: 57193 - RNA, 89 nt, Mus musculus
guguguguauguauguauguguauguauguguguugugugugugagguguguguaugaguguauguauguauguguguguguaugugua

SEQ ID NO: 57194 - RNA, 46 nt, Mus musculus
aggcucuucugggaagcacugaaccuugccucaaaaauaaaaauag

SEQ ID NO: 57195 - RNA, 45 nt, Mus musculus
gaagucaggacaggaacucaaacaaggcaggaaccuggaggcagg

SEQ ID NO: 57196 - RNA, 46 nt, Mus musculus
gcaugaggguguguguguguguguguguguguguguguauaggugu

SEQ ID NO: 57197 - RNA, 46 nt, Mus musculus
ucgggaccuuaacaauuccauuggcaaaugaugcuuugggaucuac

SEQ ID NO: 57198 - RNA, 42 nt, Mus musculus
gcagggacccucagcgucuggaagcacgguuuuugggagcca

SEQ ID NO: 57199 - RNA, 45 nt, Mus musculus
augcuugugugugggauaucuugauucuuucauacuugccuuuaa

SEQ ID NO: 57200 - RNA, 46 nt, Mus musculus
gcccucgaugcaaauguaugcuacauaguaaucgugugugugugug

SEQ ID NO: 57201 - RNA, 64 nt, Mus musculus
uggcccagaucuugagagaccauuuuaaaacgccaaagaaacacagggggugucacacccaagu

SEQ ID NO: 57202 - RNA, 46 nt, Mus musculus
cuauuuaacggcucaguaaauauucugaccacaaagcuacaaugag

SEQ ID NO: 57203 - RNA, 42 nt, Mus musculus
aagcuggguggugauggcacacgccuuuaaucccagcacuca

SEQ ID NO: 57204 - RNA, 46 nt, Mus musculus
caaagucaugaaacaacagccaaugacggauaaacucuuuggaguu

SEQ ID NO: 57205 - RNA, 45 nt, Mus musculus
ucagagcagccugucuccccuauuuacucugcaaguccgugacau

SEQ ID NO: 57206 - RNA, 25 nt, Mus musculus
gcuugaggaggagcagaggccaaca

SEQ ID NO: 57207 - RNA, 42 nt, Mus musculus
aaaaacauacaaaaccaaacccuuugcugcgcccacccucca

SEQ ID NO: 57208 - RNA, 46 nt, Mus musculus
uacacuccuuauuguuucugcugcacuaauugccaggggugggaga

SEQ ID NO: 57209 - RNA, 46 nt, Mus musculus
uaaagagaccucuucuucagcacuugaguccauuuuugugucagau

SEQ ID NO: 57210 - RNA, 45 nt, Mus musculus
aagacuuuuuuccugacaguauuauguaauuuuuagcguggguag

SEQ ID NO: 57211 - RNA, 46 nt, Mus musculus
guguaaaacaguagacgugugacguuuaugaguaaugcuggcucug

SEQ ID NO: 57212 - RNA, 46 nt, Mus musculus
cacuugaggugauaguuuuaaaaaaaacaaacaaacaguaccagua

SEQ ID NO: 57213 - RNA, 46 nt, Mus musculus
gccuuuuuauauugccugccaaaauuugaaguauuagaacaaagug

SEQ ID NO: 57214 - RNA, 46 nt, Mus musculus
cugaacucuucacccaaugaugaccugaccaugccugccugcugau

SEQ ID NO: 57215 - RNA, 46 nt, Mus musculus
acaagucggguuuuucaaauuauuuuuugugggagugggcucuucu

SEQ ID NO: 57216 - RNA, 42 nt, Mus musculus
auaaacauuuauugaacaaaagaaacuuuguuuggcccagag

SEQ ID NO: 57217 - RNA, 42 nt, Mus musculus
guacuuagaguucuuugagguauagaguuuuaaauggcagga

SEQ ID NO: 57218 - RNA, 46 nt, Mus musculus
uuuacagguggcuucuuuuaaaauauaaaaauauaaagcaggaaug

SEQ ID NO: 57219 - RNA, 46 nt, Mus musculus
aagauuauuauuagcauucauuugaugcaaggaagcagcccgagga

SEQ ID NO: 57220 - RNA, 46 nt, Mus musculus
gccaagugugagcauaucaaccauuguaucagagucgcauagagau

SEQ ID NO: 57221 - RNA, 46 nt, Mus musculus
gcacuucagugaauaugugacuaguaaagcucagacacgucugguu

SEQ ID NO: 57222 - RNA, 82 nt, Mus musculus
aaaggcuaagaauucaagaacggucuuaaccgaacccucaucagaucugaauuuaacaaaugcuuagucucagcagccuccg

SEQ ID NO: 57223 - RNA, 28 nt, Mus musculus
uuaaucuacacacccuaugaauaccccu

SEQ ID NO: 57224 - RNA, 46 nt, Mus musculus
cguacaccuacgccagcuggcccuaccauaaugccuuugaucagac

SEQ ID NO: 57225 - RNA, 45 nt, Mus musculus
aaauggucaugcucauuuuuuacagugguuuuauuuuugcauuuu

SEQ ID NO: 57226 - RNA, 46 nt, Mus musculus
uuuagauuguguauguacuaaaugacagacacugcugucagcugaa

SEQ ID NO: 57227 - RNA, 45 nt, Mus musculus
uggaguuagucuggucuauugcuuuacaagauaugugugaaagag

SEQ ID NO: 57228 - RNA, 46 nt, Mus musculus
caaaacagcauagauuucugugagugucaucagacgagucugcauu

SEQ ID NO: 57229 - RNA, 45 nt, Mus musculus
acauugguauugaagccucugauguguugcuguuuagccucugga

SEQ ID NO: 57230 - RNA, 45 nt, Mus musculus
auuauuuacauguggguuugaauguuuaaaauucuucugguuaga

SEQ ID NO: 57231 - RNA, 46 nt, Mus musculus
guuuagauagcuuauaacucaagauuggaguuguuaacaaauagag

SEQ ID NO: 57232 - RNA, 36 nt, Mus musculus
aacaucuaaccaaaaugcaugcaguucaugauaaga

SEQ ID NO: 57233 - RNA, 46 nt, Mus musculus
gaaaaguacuaacuucugacuggagaaauucaugguaccaagaaac

SEQ ID NO: 57234 - RNA, 24 nt, Mus musculus
aagacuaagaagaaaguggaacua

SEQ ID NO: 57235 - RNA, 45 nt, Mus musculus
uuuccuucucaaguuuguuuuagucugcgucuuaucacaacagaa

SEQ ID NO: 57236 - RNA, 46 nt, Mus musculus
uguuuauauuaguaauuagaucacacaaauuucauaaggcccuuaa

SEQ ID NO: 57237 - RNA, 86 nt, Mus musculus
aggcacuagguugccauagcagauauuacugugugaagauacauuaaacagagcuuauauagggagaaauaaugccuuguguuagg

SEQ ID NO: 57238 - RNA, 44 nt, Mus musculus
augccuuuuauuuacauuguuagaaacaaagaaacuggauuugg

SEQ ID NO: 57239 - RNA, 47 nt, Mus musculus
uggcuagauacacaaaaauuguuuggacaagaguaaaggauguugga

SEQ ID NO: 57240 - RNA, 45 nt, Mus musculus
aauugggaaauagguuaaggcauugugucuguauucugaaguagg

SEQ ID NO: 57241 - RNA, 46 nt, Mus musculus
uucugcaaaguucccugagcacagaaauaagagauuagacggagac

SEQ ID NO: 57242 - RNA, 37 nt, Mus musculus
uuaaugccuguuaacuucugacuacauagcagcaaau

SEQ ID NO: 57243 - RNA, 24 nt, Mus musculus
gacucaaaccagauucucuagaag

SEQ ID NO: 57244 - RNA, 44 nt, Mus musculus
gggguguguguguguguguguggguguguguguguguguagaca

SEQ ID NO: 57245 - RNA, 46 nt, Mus musculus
uacacaacaaagaauaaaugaaguguaggaaagaaaugucuuaaga

SEQ ID NO: 57246 - RNA, 57 nt, Mus musculus
augcuuucugcacaaaucugacuauaugaguucaaccccaggaaaccuauaguggag

SEQ ID NO: 57247 - RNA, 45 nt, Mus musculus
acauaaauuuaaaaagaaauaauaauaaaagaaacaucacauaga

SEQ ID NO: 57248 - RNA, 46 nt, Mus musculus
cagauaauaguuaauaaauucauauauuuauaagugacccccauca

SEQ ID NO: 57249 - RNA, 39 nt, Mus musculus
cugucccuaagauucugauaaacuaauguagggagagau

SEQ ID NO: 57250 - RNA, 45 nt, Mus musculus
gcucacugauagagccuuuccuagaauucaucaaacccugggugu

SEQ ID NO: 57251 - RNA, 71 nt, Mus musculus
aaauaauagagaguacauaacaguugaagaaagggaauggagguguuaggcuguuguagauauugaaguag

SEQ ID NO: 57252 - RNA, 45 nt, Mus musculus
auggggguugugauaaacuguuuguucuuaguauugccuguagau

SEQ ID NO: 57253 - RNA, 45 nt, Mus musculus
uggaagugucugugauauagauugaucaguguggcuggaaaagag

SEQ ID NO: 57254 - RNA, 45 nt, Mus musculus
agugugugaacaacagcaucucagauaguuugccuuuugggagau

SEQ ID NO: 57255 - RNA, 46 nt, Mus musculus
gguugcuguuugaaguggugcauucuguucuagucaaagcugaggu

SEQ ID NO: 57256 - RNA, 45 nt, Mus musculus
ucucucucucucucucucauuguauuucuucccucagcccaguuc

SEQ ID NO: 57257 - RNA, 45 nt, Mus musculus
ucaguagucugugccauuuauaccucaccuccuacagguuccaga

SEQ ID NO: 57258 - RNA, 46 nt, Mus musculus
gaaaggagggaaccuuaguugaggaaugccuccauaagauccagau

SEQ ID NO: 57259 - RNA, 46 nt, Mus musculus
uccugacauggaaugaaauguuuuuagucaugaaggaggcucagga

SEQ ID NO: 57260 - RNA, 46 nt, Mus musculus
gagcaaccuacugccacacauaaaaacacagagugagaauggagau

SEQ ID NO: 57261 - RNA, 48 nt, Mus musculus
auggauauuagauaaugaauuuccagaaauuagaaacaagauugacug

SEQ ID NO: 57262 - RNA, 45 nt, Mus musculus
gucuucuuugaaggucugauagaacucuguacuaaugguaucugg

SEQ ID NO: 57263 - RNA, 46 nt, Mus musculus
uucuuuugugauuggguuaccucacucauaauuauauccuccagau

SEQ ID NO: 57264 - RNA, 46 nt, Mus musculus
uauaucaccaaauauguacucaauacucaaaguucaugucccauga

SEQ ID NO: 57265 - RNA, 45 nt, Mus musculus
ccacccuauauauugauucguggucucccauuuguuggcagaagc

SEQ ID NO: 57266 - RNA, 46 nt, Mus musculus
aaucaauccauugaugcugaacuauuuguuuuaaauauuguuagga

SEQ ID NO: 57267 - RNA, 45 nt, Mus musculus
acuauuacugcuauuacuauuaauuauaauuauuuuguguguaug

SEQ ID NO: 57268 - RNA, 46 nt, Mus musculus
gcuuuuuaucaucuuuuuuuuucccccuuuuucggauagcugaggu

SEQ ID NO: 57269 - RNA, 48 nt, Mus musculus
ggauguaaaauaaugguccgaggcaaaggcucaaugagggauaaaaag

SEQ ID NO: 57270 - RNA, 46 nt, Mus musculus
aauuuaaaggauuuaaaaguuacaguggauuuuaaaggaugcagcu

SEQ ID NO: 57271 - RNA, 46 nt, Mus musculus
aauauuaaggggucaacccugaaaaaguacaugugagcacuaaaug

SEQ ID NO: 57272 - RNA, 42 nt, Mus musculus
ugaaccuuugacuuuugaggccacccuagucuacugagugau

SEQ ID NO: 57273 - RNA, 45 nt, Mus musculus
agucuugaguuuuggguaggaauaaaggagcaaggcaacugagac

SEQ ID NO: 57274 - RNA, 83 nt, Mus musculus
uaacgcauuuaaaauuuuuacuuuuaacagaaauuagcagaguacggaaagacauguacaaugacacguuaaauggcaguaca

SEQ ID NO: 57275 - RNA, 41 nt, Mus musculus
aaguuggguggauagggagguugaaucugggaggaggaagg

SEQ ID NO: 57276 - RNA, 46 nt, Mus musculus
aaaguagcuauucauguagcuauuauggucauauaccuguacagua

SEQ ID NO: 57277 - RNA, 46 nt, Mus musculus
caccaguguccuugccagcacuguuuucuugaugacagccauuuga

SEQ ID NO: 57278 - RNA, 46 nt, Mus musculus
ucaaguccuccagcccaugcaauuuccuccuuuagagccucuaauu

SEQ ID NO: 57279 - RNA, 48 nt, Mus musculus
gacaugaacuaugaggaugacuuugccuguuuugauagcaggaggaac

SEQ ID NO: 57280 - RNA, 44 nt, Mus musculus
guuaaauagauguuugaaaaguuugcacuuaaucuggucugaga

SEQ ID NO: 57281 - RNA, 45 nt, Mus musculus
uucaaaauaauuuguucuauugaauucauaaguuuacccauagag

SEQ ID NO: 57282 - RNA, 61 nt, Mus musculus
guuucugauuccauagaaaguauccaguccauacuagcugaacauccauuuuauuccagac

SEQ ID NO: 57283 - RNA, 42 nt, Mus musculus
gccccuagcaaaggggaaugccagggcaggagcuggugggug

SEQ ID NO: 57284 - RNA, 80 nt, Mus musculus
uuuaguaagcuauggcaacuuuaagacuuagagccaggauuaauauucuaguuaugugaacucuucuguaccuggucaga

SEQ ID NO: 57285 - RNA, 46 nt, Mus musculus
aacauaacccaucuuaccaucacugagauuugcacugagggcagag

SEQ ID NO: 57286 - RNA, 46 nt, Mus musculus
auugcaucuuuuucacugaaaguuucauuuaauuaaguguuaaguc

SEQ ID NO: 57287 - RNA, 45 nt, Mus musculus
caagguccgagguucaauuuccaguacuggguuggaugaguaaau

SEQ ID NO: 57288 - RNA, 45 nt, Mus musculus
accuaaacagagacuaaagccugguacuagaaagacuacuuuaga

SEQ ID NO: 57289 - RNA, 46 nt, Mus musculus
ugugugugugugugugugucucugugugugugugucucugugugug

SEQ ID NO: 57290 - RNA, 45 nt, Mus musculus
gucuuuaagagacuauagguugacuauuuaauguaacuagcagau

SEQ ID NO: 57291 - RNA, 98 nt, Mus musculus
cuuuuauuguaccuuuuuaaguagcuuuuaccuuaaacccagcagagauuaggagaacaaaucuuuuaaaaugagaagugugugugugugugucugug

SEQ ID NO: 57292 - RNA, 46 nt, Mus musculus
uugagucaccauaugagugauaggaaucacaucuguguccccugga

SEQ ID NO: 57293 - RNA, 46 nt, Mus musculus
augaguacacuauagcugucagacaaaccagaagagggcaucagau

SEQ ID NO: 57294 - RNA, 49 nt, Mus musculus
cucauuauguagccagaguuguuagccacucaaauggcgaccuuuuaua

SEQ ID NO: 57295 - RNA, 45 nt, Mus musculus
aaaaaaaaagccucagcuggguguagugucucaacccugucucga

SEQ ID NO: 57296 - RNA, 45 nt, Mus musculus
uccgguucuaaugcuccuguuuucuugcuuuccccuccaaccagu

SEQ ID NO: 57297 - RNA, 46 nt, Mus musculus
aagaagagauuuacaacauauuuccacacacugaaaaaacuguuag

SEQ ID NO: 57298 - RNA, 46 nt, Mus musculus
cuucaaugucauauucuuuauccaguuucaaaauuuccucauagau

SEQ ID NO: 57299 - RNA, 44 nt, Mus musculus
uuaagagcauacuuaggaaaaauaauacagacuuuugggggcug

SEQ ID NO: 57300 - RNA, 46 nt, Mus musculus
guaucauuacugucauuuuuaugagcagaauuugucaaauucaggu

SEQ ID NO: 57301 - RNA, 45 nt, Mus musculus
uuguucuguagguguuuaauauuuauuuuacuuuauuaccauuga

SEQ ID NO: 57302 - RNA, 46 nt, Mus musculus
uaaacaauaaguuacuauaguuugucauuuucauguggcucuauua

SEQ ID NO: 57303 - RNA, 46 nt, Mus musculus
uguacuguuaaacaauagcacaauuaaguuuauaguagaaauaggg

SEQ ID NO: 57304 - RNA, 47 nt, Mus musculus
aacgaguuaaaugcaaaacauuuuuaaaaaauaaacauuuuguaauu

SEQ ID NO: 57305 - RNA, 42 nt, Mus musculus
uagggauuacauuuuccuuugacuguaauacuuggcagaaaa

SEQ ID NO: 57306 - RNA, 45 nt, Mus musculus
aaauucuggcuuuuuaagugcaccaucauaauuuucuugguagau

SEQ ID NO: 57307 - RNA, 46 nt, Mus musculus
auuuuuagaugacuucauuugucacuauucacaaaugugauuaggg

SEQ ID NO: 57308 - RNA, 45 nt, Mus musculus
uuauuguuggguugguauauuuguuaguguuaaauugcccuggag

SEQ ID NO: 57309 - RNA, 45 nt, Mus musculus
aggaucuugagaagaaugucgaaaaauuuuagagauagcugggga

SEQ ID NO: 57310 - RNA, 52 nt, Mus musculus
gcguuugcagggcggggagcuggaaguuugaaaggacggggauaaaauagag

SEQ ID NO: 57311 - RNA, 44 nt, Mus musculus
ggaguacgaaauaccgcgaggacagaccugaacggaauccgagu

SEQ ID NO: 57312 - RNA, 38 nt, Mus musculus
gcggagccuggaauauggucggggaaauggaaacgaag

SEQ ID NO: 57313 - RNA, 42 nt, Mus musculus
cggccggguuucccgccccgcgaggugggcgccgcgccagaa

SEQ ID NO: 57314 - RNA, 55 nt, Mus musculus
caaaaauaaauaaauaaaugacaggcagagggccaggacaggggcuuucuauggc

SEQ ID NO: 57315 - RNA, 45 nt, Mus musculus
ggcaauccuggcagccccaaguuuuacauaagaggaaaccccuga

SEQ ID NO: 57316 - RNA, 42 nt, Mus musculus
guggcauuuacauacccaaaagcaaaguaccccgcagaauuu

SEQ ID NO: 57317 - RNA, 48 nt, Mus musculus
gggugacuuauuacagacaccgugaaacgcggugggccaguguuggug

SEQ ID NO: 57318 - RNA, 97 nt, Mus musculus
gaacugguccuugaugcacacuuagugagcugcaguauucuauucuucgcuuugcauuuugugagggcacacacacaugcacagguccccgagugcc

SEQ ID NO: 57319 - RNA, 88 nt, Mus musculus
ccauggacagccaagcaccuccaaccaaauaagacuucagcucgaugaugcgucugucauuuugccuuuaacaaaacugcuucaaagg

SEQ ID NO: 57320 - RNA, 43 nt, Mus musculus
agguggaaagcucacagccccugagaaacccacagcgcaaggu

SEQ ID NO: 57321 - RNA, 79 nt, Mus musculus
ggucagcaaggaggaggagacagaugagaaugagacagaauggcugauggaagagauccaggugccagccccaagacua

SEQ ID NO: 57322 - RNA, 31 nt, Mus musculus
ugcuggccuuacugcugcauaagaaggagag

SEQ ID NO: 57323 - RNA, 24 nt, Mus musculus
gucggccuguuccugacugcuuua

SEQ ID NO: 57324 - RNA, 140 nt, Mus musculus
ucuggaugugguguuuaccucuuccuccaagugugggaaagauaagaccaagucuguuucuuccaccaucuucuuccacugugacccucuggugaaggaugggaucccagaguucagccacgagaccgcugacugccagu

SEQ ID NO: 57325 - RNA, 48 nt, Mus musculus
uuacccugcaugcgcuggugccaacaucugccaggugaagcccaauga

SEQ ID NO: 57326 - RNA, 45 nt, Mus musculus
gaccauggugaacggaacgcucaccaacccugugaccggcaagag

SEQ ID NO: 57327 - RNA, 23 nt, Mus musculus
agguucuggguguugcaggcagu

SEQ ID NO: 57328 - RNA, 51 nt, Mus musculus
cuuguggugggaauaagacugcaucgucuguaaucgaauugaccugugcga

SEQ ID NO: 57329 - RNA, 51 nt, Mus musculus
ggucaaguccagguuuuggggcuuguucauacacaaaaauuggaagucaua

SEQ ID NO: 57330 - RNA, 67 nt, Mus musculus
ggaagacaaaaguugucugcccuccaaagaagauggagugcaaguuuguucagaagcauaagaccua

SEQ ID NO: 57331 - RNA, 94 nt, Mus musculus
augucugcgaucauauuuacgugugaugaaagugaagauauugggagaccacaaguguucagugaagaucgugggugugaggugacauuugagu

SEQ ID NO: 57332 - RNA, 46 nt, Mus musculus
acggaugauggcgagcccugugucuuccccuucauuuacaaaggga

SEQ ID NO: 57333 - RNA, 81 nt, Mus musculus
ucuaccugaacuuugagagcagcacucauugcuuagccgacagauauaugaacuacaccucacucaucacauuucacugca

SEQ ID NO: 57334 - RNA, 45 nt, Mus musculus
ugcaggugccucaguaugcaaaguuccuguggacgggcccccuau

SEQ ID NO: 57335 - RNA, 52 nt, Mus musculus
augaaagugaggaugacaccucugacaccaccccugacuucuauaucaacau

SEQ ID NO: 57336 - RNA, 50 nt, Mus musculus
guguacugugcggaauggaagcucgauuauugaccuguccccucucaucc

SEQ ID NO: 57337 - RNA, 45 nt, Mus musculus
uguaugagaauggguccccaugcccuucccugucagaccugaggu

SEQ ID NO: 57338 - RNA, 60 nt, Mus musculus
cuacagcgagaaggggcuggucuucaugagcaucugugaggagaaugagaacuguggccc

SEQ ID NO: 57339 - RNA, 46 nt, Mus musculus
cuguucaggacugugaguacaccuucuccuggcccaccccuucugc

SEQ ID NO: 57340 - RNA, 52 nt, Mus musculus
ugugacuguccugcaguauguggauggugacuugugcccagacaaaauucgg

SEQ ID NO: 57341 - RNA, 83 nt, Mus musculus
augcggcuggcaacuccauugaccucuccucacugucaagguacagugacaacugggaggcugugaccaggacaggggccacu

SEQ ID NO: 57342 - RNA, 45 nt, Mus musculus
agcaggacuccuuagccagaagcugacuuucgaaaacggacuguu

SEQ ID NO: 57343 - RNA, 59 nt, Mus musculus
cagggcaaggcaguuggaagucauggcacuugccaggagaaggggguuggaaaagagga

SEQ ID NO: 57344 - RNA, 46 nt, Mus musculus
ucugcucugcccaugacggauccaaggcagucucaucaugccagga

SEQ ID NO: 57345 - RNA, 46 nt, Mus musculus
caccaucgucaguguuggcgaguacaccuacuacuugcgggucugc

SEQ ID NO: 57346 - RNA, 46 nt, Mus musculus
guguuuguguggcgaacaguggaggccugcccugugaucagagagg

SEQ ID NO: 57347 - RNA, 71 nt, Mus musculus
gaaaugggucucucagcauccuguacgugaauggggacagauguggggaccagcgcuucuccaccaggauc

SEQ ID NO: 57348 - RNA, 45 nt, Mus musculus
cuugagcgcccugagcauggucaggaagccauggacugccgugga

SEQ ID NO: 57349 - RNA, 45 nt, Mus musculus
agugacuggugaggccuaggaguugguaggcuggguuucagugag

SEQ ID NO: 57350 - RNA, 55 nt, Mus musculus
cacagcauucaucauccguuuuauuugcaacgaugacauuuacccaggagccccc

SEQ ID NO: 57351 - RNA, 45 nt, Mus musculus
aucugauggaaugauaaacuugugcgagaugugaauucauucuga

SEQ ID NO: 57352 - RNA, 46 nt, Mus musculus
agauagaagauauuaaggaccuaaggccacaaaggccggucgggau

SEQ ID NO: 57353 - RNA, 31 nt, Mus musculus
uuccugcugccaccuuuuuccucuuccucgu

SEQ ID NO: 57354 - RNA, 54 nt, Mus musculus
gauggccagcucaccaccuacagcaccaggauccaucuugucuguggucgagga

SEQ ID NO: 57355 - RNA, 102 nt, Mus musculus
guauccaucaguaacuugggaguugcaaagauaggcccugugguggaggagaguggcagccuccucuuagaguaugugaacggcucugcuugcaccaccagu

SEQ ID NO: 57356 - RNA, 92 nt, Mus musculus
ugguaugcuauggaaaacucccgggaacauguuacacggaggaaauacuaccucaaugugugucggccucugaauccugugccaggcugcga

SEQ ID NO: 57357 - RNA, 42 nt, Mus musculus
uuaggaagaggacaacucuaccuacaacuuccggugguacac

SEQ ID NO: 57358 - RNA, 46 nt, Mus musculus
gauuaccuuccucugugaccgugacgcuggagugggcuucccagaa

SEQ ID NO: 57359 - RNA, 42 nt, Mus musculus
uaagucuuggaacuuggggcugaguaguacuaagcucaccua

SEQ ID NO: 57360 - RNA, 82 nt, Mus musculus
auuugucacuccucacgaagaagaauggugcauauaaaguugagacagagaaguaugacuucuacauaaauguuuguggccc

SEQ ID NO: 57361 - RNA, 56 nt, Mus musculus
aggugaucuagaaagugcuccagugcuaagagcugcaagaucugauggcugcuucu

SEQ ID NO: 57362 - RNA, 32 nt, Mus musculus
cucuuacacugauggugaugacuguggcagug

SEQ ID NO: 57363 - RNA, 46 nt, Mus musculus
aaggccaggaacuguccugaagaugcugcugugugcgcugugggug

SEQ ID NO: 57364 - RNA, 45 nt, Mus musculus
gcagccaggcagaaucagaaaaguauuucuucaucaacgucuguc

SEQ ID NO: 57365 - RNA, 45 nt, Mus musculus
ugcaaauggcugaucacauugcaacucccauuaggaagcagagag

SEQ ID NO: 57366 - RNA, 96 nt, Mus musculus
ugagguggacugcaccuacuucuucacaugggacacuaaauacgccugcaucaaagagaaggaagaccuccucugcggggccaucaauggcaagaa

SEQ ID NO: 57367 - RNA, 46 nt, Mus musculus
cagaggaugagugucauaaacuuugagugcaacaaaacugcaggug

SEQ ID NO: 57368 - RNA, 46 nt, Mus musculus
uugauaagugcacaucugcuaggacuauggguuuguaaauguauug

SEQ ID NO: 57369 - RNA, 63 nt, Mus musculus
auaacaaagaggcugcuguuugucaagagaaaaaggcggauuccacucaagucaaaauagcag

SEQ ID NO: 57370 - RNA, 53 nt, Mus musculus
cccucagcagugagcagcaugauauuacuauugaccuuagucccuuggcccaa

SEQ ID NO: 57371 - RNA, 50 nt, Mus musculus
uggucacagcccugcagugacaguaacauuugugugcccaucugagcgga

SEQ ID NO: 57372 - RNA, 45 nt, Mus musculus
aauaacugguaaauuaauacugguaaauacaacuaauacugagaa

SEQ ID NO: 57373 - RNA, 44 nt, Mus musculus
gguggucucauccagagugagccucagaacgugaagguggagau

SEQ ID NO: 57374 - RNA, 46 nt, Mus musculus
cucaaguuuccuggagcuuugggcugggaggagcaagcaucuggag

SEQ ID NO: 57375 - RNA, 45 nt, Mus musculus
gcaguagccucgagugaccauugcuguguguggaagcaggcggcu

SEQ ID NO: 57376 - RNA, 49 nt, Mus musculus
gauccugacacgucucuguucaucaacguguguagagacauagguaaga

SEQ ID NO: 57377 - RNA, 80 nt, Mus musculus
gaacuagaaaagauccuuguaagucaguggauguuuguagcugcaggaaguggucuaggacugggaaagaagagggaugu

SEQ ID NO: 57378 - RNA, 45 nt, Mus musculus
ggacauggcguucugaucugguaacaggcaaagucagcugucagg

SEQ ID NO: 57379 - RNA, 46 nt, Mus musculus
ggcaaaggacagccagggaugacuccuggaacaggacaguaggauc

SEQ ID NO: 57380 - RNA, 46 nt, Mus musculus
uuuauuauauguaaguacacuguagcuuucuucagacaccccagaa

SEQ ID NO: 57381 - RNA, 45 nt, Mus musculus
acugugugcauuacuuugaauggaggacuacugcagccugcaaga

SEQ ID NO: 57382 - RNA, 45 nt, Mus musculus
ugcguguuuaacauuccuggcuugccuagugcuuaucugugagaa

SEQ ID NO: 57383 - RNA, 27 nt, Mus musculus
gggggggggggggggggcagcgcacac

SEQ ID NO: 57384 - RNA, 42 nt, Mus musculus
caucucuccuguaacauggcacuuuugagcguuggcccugau

SEQ ID NO: 57385 - RNA, 41 nt, Mus musculus
cuaggaaccuggaggcaggagcugaugcagaggccgguggu

SEQ ID NO: 57386 - RNA, 46 nt, Mus musculus
gugggaugggucugagacacacccuauuuggaucucagggagaggu

SEQ ID NO: 57387 - RNA, 42 nt, Mus musculus
uguuuucaagggacuguagguugucauauuguggcccaggag

SEQ ID NO: 57388 - RNA, 46 nt, Mus musculus
acacaugggaagcuguugacuccaaaaacaaugcaguuuauaagau

SEQ ID NO: 57389 - RNA, 45 nt, Mus musculus
ucccaggaagaguagaggauugaggaugauguacuuggggcagaa

SEQ ID NO: 57390 - RNA, 42 nt, Mus musculus
aaugaacuuaggccgacacacauugagggaaaugcccagccg

SEQ ID NO: 57391 - RNA, 86 nt, Mus musculus
gcaguuaaaaugccagcccucccuguguccagggccauaaaggaagcacauuggguccccaaagaauuggggccuugcuagcaaga

SEQ ID NO: 57392 - RNA, 46 nt, Mus musculus
ugccuacgugguuuuugugaagaaauagcauguguagccucugaua

SEQ ID NO: 57393 - RNA, 42 nt, Mus musculus
agguucucuuugcccaguggaguuucuugcugagccccuggu

SEQ ID NO: 57394 - RNA, 46 nt, Mus musculus
guuucaagucuccaaaauggggagguuggugugcuccuugacagac

SEQ ID NO: 57395 - RNA, 42 nt, Mus musculus
cccagcaacuacaugguggcucacaaccauccauaacgagau

SEQ ID NO: 57396 - RNA, 45 nt, Mus musculus
uagaagaaguuacuugggucucucaagaugugggaugcuggugua

SEQ ID NO: 57397 - RNA, 45 nt, Mus musculus
uacuggaacagcacgguacacagccugcuuacucuuugaagagac

SEQ ID NO: 57398 - RNA, 46 nt, Mus musculus
ggacguuccugagccugggcaguugguucuuggacuugugggagaa

SEQ ID NO: 57399 - RNA, 46 nt, Mus musculus
aacugaaacaggggcuacauuuucccuguugaaaaaaaacccagau

SEQ ID NO: 57400 - RNA, 45 nt, Mus musculus
cccaguuuagaguuuauauuuuaguagaguagaauuugucaagga

SEQ ID NO: 57401 - RNA, 46 nt, Mus musculus
uggaggaagggugccccuuaaacaauaguaggcccaggggggaaca

SEQ ID NO: 57402 - RNA, 72 nt, Mus musculus
cagagaguuuuguucucucaccuggaguuaauaauuuguaggacuuguuaguguaagaaugagcugaccaga

SEQ ID NO: 57403 - RNA, 62 nt, Mus musculus
agacggggcugagccaaacuugauguuucuaaugguaguccaggcucuuuaguccuuuguau

SEQ ID NO: 57404 - RNA, 45 nt, Mus musculus
auuaguuuggagacaggccuccucugggcucuuuagggugaaggg

SEQ ID NO: 57405 - RNA, 45 nt, Mus musculus
uugacaaugucucuggccguuuccgugcccaccauguugcccucc

SEQ ID NO: 57406 - RNA, 46 nt, Mus musculus
gauguuuggauaagcacaugaucaaaaucuaggcaagcggcaagga

SEQ ID NO: 57407 - RNA, 45 nt, Mus musculus
augauggacgaacagaggaggaccaugaagucugcaauggcgaga

SEQ ID NO: 57408 - RNA, 44 nt, Mus musculus
cagguuacagcagacuuggaugaagaggaucaaauuagagaaga

SEQ ID NO: 57409 - RNA, 45 nt, Mus musculus
cccucucaaccaguuccgugccggccgugcagcccgacguggaga

SEQ ID NO: 57410 - RNA, 41 nt, Mus musculus
gaaguagggggcugcgggacgcugggucaacuagagacagu

SEQ ID NO: 57411 - RNA, 44 nt, Mus musculus
ugcgcgcucuccacgcuccaccaaccgcaaggucugccgggaaa

SEQ ID NO: 57412 - RNA, 43 nt, Mus musculus
caacuggcccaaaagaacuuuuaacaauguuggcaauagaagc

SEQ ID NO: 57413 - RNA, 65 nt, Mus musculus
caucuccaacuucuuugucuugcaggucagccagcucacacagaacuuuggcugcgggauguucu

SEQ ID NO: 57414 - RNA, 96 nt, Mus musculus
aaucuuacuugcaggcaagacgauagccacuaauaacugauguuggaugaauuuucuguuugacuagcucaucugcauuuuucagaagcuccgcug

SEQ ID NO: 57415 - RNA, 44 nt, Mus musculus
ccaauaauuuuggaugacauggaugucuuagcagcauugaucag

SEQ ID NO: 57416 - RNA, 47 nt, Mus musculus
gggcuuucagaauauuaacagaauugacuggauagcgaggcuggccu

SEQ ID NO: 57417 - RNA, 45 nt, Mus musculus
gagugacucugauuuguaaauaacagaaccccacuuacccugaga

SEQ ID NO: 57418 - RNA, 49 nt, Mus musculus
aagucaagacaagcaauuuuugcauuaacuauucucuugggcaugccua

SEQ ID NO: 57419 - RNA, 49 nt, Mus musculus
ucugucuaauuugguccaauuucucagggucuguaauaaccaccuguac

SEQ ID NO: 57420 - RNA, 55 nt, Mus musculus
uaucaucaaugccaccagugguuagaauaacauuggcaccaguugccaggaucuu

SEQ ID NO: 57421 - RNA, 67 nt, Mus musculus
uucaggucucguuuuaaaacucuccuaacagccauggcaccagcuuccacaaaauacuugagauaca

SEQ ID NO: 57422 - RNA, 49 nt, Mus musculus
ucgucacuucaaaaguuucuucgccuuccaaauuggccagcguagacag

SEQ ID NO: 57423 - RNA, 52 nt, Mus musculus
acacaugaaaucauuugcuccucguaagaugauugaagcagauguacgagcc

SEQ ID NO: 57424 - RNA, 68 nt, Mus musculus
auauggacagggcagcuucuacagcaccuccaccugggaccacagauuucaacuccaaaacucucuuc

SEQ ID NO: 57425 - RNA, 47 nt, Mus musculus
caagcagagaucuugcaaacucugcaauagcaagcuguucccgagau

SEQ ID NO: 57426 - RNA, 54 nt, Mus musculus
ggguucacuugagccucauugugaaaagcucuuaacuuggcaaccaggucggug

SEQ ID NO: 57427 - RNA, 45 nt, Mus musculus
cugcuugcuuguugucucgugguuucccauggaccaaaucaagac

SEQ ID NO: 57428 - RNA, 46 nt, Mus musculus
aggacaggaacccagguggucagcuugcuguacuuuaaugugagac

SEQ ID NO: 57429 - RNA, 44 nt, Mus musculus
ucuagugaccuugcugcacacccuggagagagugggcgggaccc

SEQ ID NO: 57430 - RNA, 44 nt, Mus musculus
gugguuuccagguuacccuggucuaacagaaauguaggcuaguc

SEQ ID NO: 57431 - RNA, 46 nt, Mus musculus
agccaugggcaagcugaaaccuuacuuucuuacugaugggacagga

SEQ ID NO: 57432 - RNA, 27 nt, Mus musculus
acacaugugugugaauacccuuggagg

SEQ ID NO: 57433 - RNA, 45 nt, Mus musculus
caagaaacaaaaaugggcaggugauagaggaauagauggcuaaga

SEQ ID NO: 57434 - RNA, 46 nt, Mus musculus
cucagccuuugaauuagucaggcauauuaaaauuaacuggugugug

SEQ ID NO: 57435 - RNA, 45 nt, Mus musculus
ggcucgaaaccauccguaacaaaaaaaucugaugcccucuucugg

SEQ ID NO: 57436 - RNA, 32 nt, Mus musculus
gauuuagaagguguugagccaggaguaccaga

SEQ ID NO: 57437 - RNA, 25 nt, Mus musculus
cacaugcacccacacuuauggaggu

SEQ ID NO: 57438 - RNA, 46 nt, Mus musculus
gacuccaccauugugguagcuggaggcauggagaauaugagcaagg

SEQ ID NO: 57439 - RNA, 42 nt, Mus musculus
agagggcagggaugagaugggagaaagggcauaggacuagga

SEQ ID NO: 57440 - RNA, 46 nt, Mus musculus
aguaggguggguaaagauaaaggacaggaguuaaaugaacccggag

SEQ ID NO: 57441 - RNA, 32 nt, Mus musculus
caggggcguuugaaccaaccauaguuaaagug

SEQ ID NO: 57442 - RNA, 45 nt, Mus musculus
uuugaguuagggucucaccauauagccucaaaaucguuuuguaga

SEQ ID NO: 57443 - RNA, 46 nt, Mus musculus
gauaaacauggaaguuaugaaaaugcuguucacucuggagcccuug

SEQ ID NO: 57444 - RNA, 37 nt, Mus musculus
ccguagccuugggugucucacauuaaaguacagcaag

SEQ ID NO: 57445 - RNA, 46 nt, Mus musculus
aggacaggaacccagguggacagcuugcuguacuuuaaugugagac

SEQ ID NO: 57446 - RNA, 45 nt, Mus musculus
gaggauggcccaaggcaauggcuccuccaucgauguugaccuaua

SEQ ID NO: 57447 - RNA, 46 nt, Mus musculus
ggauauguauguguguguguguguguguguguguguguguguuaaa

SEQ ID NO: 57448 - RNA, 42 nt, Mus musculus
cauauucucaucaaucuuuuuaaagcuaguguuugcaggcau

SEQ ID NO: 57449 - RNA, 46 nt, Mus musculus
uauuauauguaaguacacuauaguuguccucagacacuccaguuag

SEQ ID NO: 57450 - RNA, 45 nt, Mus musculus
guugugagccaccaugugguugcugggauuugaacuccugacauu

SEQ ID NO: 57451 - RNA, 46 nt, Mus musculus
uuucgugaaugaauguauguauguauguauguuugagggugccugg

SEQ ID NO: 57452 - RNA, 45 nt, Mus musculus
aucacucaccgaaaaggcuuguaaaggagcugugacuucagccag

SEQ ID NO: 57453 - RNA, 45 nt, Mus musculus
uuuuaccucagucgcagacaggacaaggcugagagcuagcagaga

SEQ ID NO: 57454 - RNA, 46 nt, Mus musculus
aggaaagccuuacccuuggacccgacuccaccuaugaccccuagac

SEQ ID NO: 57455 - RNA, 42 nt, Mus musculus
ucauucucaugccuuuugcaggcucccucuggccacccccca

SEQ ID NO: 57456 - RNA, 46 nt, Mus musculus
ucuucuggagugucugaagacaacuacagugugcuuacauauaaua

SEQ ID NO: 57457 - RNA, 48 nt, Mus musculus
uuuucacugaauggcugaauugcuacuuacucuguaguauauacaaag

SEQ ID NO: 57458 - RNA, 35 nt, Mus musculus
auuacuuugaacauugcuaaaaggacauuuugugu

SEQ ID NO: 57459 - RNA, 48 nt, Mus musculus
guucagaauggcuuggacucaaauguaaauguacagggugcaguuuug

SEQ ID NO: 57460 - RNA, 46 nt, Mus musculus
acacaucacucaaaugacacagacuccagucaugacccucaagagg

SEQ ID NO: 57461 - RNA, 45 nt, Mus musculus
uucagggaaugguaauaaggccuccaacagcucagaggagagaac

SEQ ID NO: 57462 - RNA, 46 nt, Mus musculus
uucagcuccaaguaccagcaggacuacaucuucugaaccuguagau

SEQ ID NO: 57463 - RNA, 45 nt, Mus musculus
gucuuuuaaaagauacauucuuguauagaaguuauaugugccaga

SEQ ID NO: 57464 - RNA, 46 nt, Mus musculus
auuauugaaaacuaaacuguucuguggcacucauaaucuggcagau

SEQ ID NO: 57465 - RNA, 41 nt, Mus musculus
caugucuuucucuccaccaugugcauauggaggccagaaga

SEQ ID NO: 57466 - RNA, 46 nt, Mus musculus
cugaugccccuuguguuuuaaguauuuccuguuacugggauuauuu

SEQ ID NO: 57467 - RNA, 46 nt, Mus musculus
uguuugugcuuuaguggacugacugugggcagggugggcuggagga

SEQ ID NO: 57468 - RNA, 52 nt, Mus musculus
uuguauucaauauuuuacuuuggggggcuauggagagcagaucaacacuuug

SEQ ID NO: 57469 - RNA, 46 nt, Mus musculus
ucgaauuccugauauuaaauuaaaugugccuugaaauaguuggguu

SEQ ID NO: 57470 - RNA, 42 nt, Mus musculus
aaggacuuacuuaugcuaagaaccaacuaauagccgugagac

SEQ ID NO: 57471 - RNA, 46 nt, Mus musculus
aggugaacuggaacagacuaaagacaaacuggaacaagcccaaaau

SEQ ID NO: 57472 - RNA, 46 nt, Mus musculus
ccaguaccucaagcaaguucagcagccgaguguggcccaacugaga

SEQ ID NO: 57473 - RNA, 24 nt, Mus musculus
cuacacccuuaacuuuagggagac

SEQ ID NO: 57474 - RNA, 46 nt, Mus musculus
auuuagaaguggaaauugugugaaauuuaaccuuucugugggaguu

SEQ ID NO: 57475 - RNA, 46 nt, Mus musculus; identical to SEQ ID NO: 57474

SEQ ID NO: 57476 - RNA, 45 nt, Mus musculus
acacacagaaacccugucuugaaaaacuaaaaaaaagggggaggg

SEQ ID NO: 57477 - RNA, 45 nt, Mus musculus
ggcagugguggcacacgccuuuaaacccagcacucaggaggcaga

SEQ ID NO: 57478 - RNA, 45 nt, Mus musculus
aaagugcuaacuguugggauuuaguuugagucaguguugugagau

SEQ ID NO: 57479 - RNA, 46 nt, Mus musculus
gacagcaggcaccuuuagcugcuuagucaucuugccagcccuaaaa

SEQ ID NO: 57480 - RNA, 47 nt, Mus musculus
aggacaacuugugggaguugguucucuuuccaucauguggauccugg

SEQ ID NO: 57481 - RNA, 46 nt, Mus musculus
aauggaguaauuaaagcaggugauaauuucagauaguuaaacagaa

SEQ ID NO: 57482 - RNA, 47 nt, Mus musculus
ggucucauguuuauacugugugacugugaaagagauggaauuuagaa

SEQ ID NO: 57483 - RNA, 36 nt, Mus musculus
cuggcuagccugaaggacuccuuauguagaccagac

SEQ ID NO: 57484 - RNA, 45 nt, Mus musculus
auuauucuucuaucuacaauucaaaggugaggcuuugcaggcagc

SEQ ID NO: 57485 - RNA, 47 nt, Mus musculus
cuguaaaaggaguuacugaugguuauaagccacuauguaagugcccg

SEQ ID NO: 57486 - RNA, 52 nt, Mus musculus
ccaucaccuuuugagauggguuuuagguuuuuguuuuguuuuguguugcguu

SEQ ID NO: 57487 - RNA, 78 nt, Mus musculus
ggagaugcaagagugcaccgugagugucuuuaaauagugauaauagcaaauauaaguguacuguuuuuaaaggguaca

SEQ ID NO: 57488 - RNA, 77 nt, Mus musculus
gaaaaacuaaagcagcaacagcaggagucugcacgcagggagaacauucuugucaugcggcuagcaaccaaagagca

SEQ ID NO: 57489 - RNA, 49 nt, Mus musculus
aauaacuuguguccaaaacugaaaacuuaaaggcguuaaaggcggugaa

SEQ ID NO: 57490 - RNA, 46 nt, Mus musculus
acaauaugaagcauauguucaagcuuuggagggaaaguacacagau

SEQ ID NO: 57491 - RNA, 50 nt, Mus musculus
gagugaaacagacuucaaaguuauggcacgggaugaguuaauucuaaggu

SEQ ID NO: 57492 - RNA, 42 nt, Mus musculus
guuuuaauuuuuaauuuuuuguguaucuguauuuugggaaug

SEQ ID NO: 57493 - RNA, 46 nt, Mus musculus
uuucuacuugcugcugaagaauauugaauauauggcuggaucaguu

SEQ ID NO: 57494 - RNA, 45 nt, Mus musculus
gaggccugacuuacacuuuuuuaaaaauaauauaaccacgaugau

SEQ ID NO: 57495 - RNA, 44 nt, Mus musculus
cagccaguuguccuaaccgcugagccaucucucuaggcccuaaa

SEQ ID NO: 57496 - RNA, 75 nt, Mus musculus
guguagaacuugaaacucuccagccucugccuccugcgugcuacugaacgauguaugcugugcuuuucugggguu

SEQ ID NO: 57497 - RNA, 61 nt, Mus musculus
aaagaauuacuuauuuagguguaugaguacacuguagcuguccugagacgcaccagaagag

SEQ ID NO: 57498 - RNA, 46 nt, Mus musculus
aauaacagaucugcagcacuuuguacaccaagcaacacuggcauuu

SEQ ID NO: 57499 - RNA, 46 nt, Mus musculus
uuuccuuuuuuuaaauuucauuuacauuuccaaugcuaucccaaaa

SEQ ID NO: 57500 - RNA, 46 nt, Mus musculus
aaaucccagcaaccacaugguagcucacaaccacccauaaagagau

SEQ ID NO: 57501 - RNA, 45 nt, Mus musculus
guuaauuuuauuguuuggaaagauagguggaagucacagaucagu

SEQ ID NO: 57502 - RNA, 45 nt, Mus musculus
ugaccccaaaggacuaagaauacacuguaagcugguuguaaagau

SEQ ID NO: 57503 - RNA, 42 nt, Mus musculus
guucaccuguggacuuccauuuuuacauaagugcaugcauug

SEQ ID NO: 57504 - RNA, 48 nt, Mus musculus
cggcuucuaagucccccucccccgcccccaacuuaaaacgaggggcgc

SEQ ID NO: 57505 - RNA, 46 nt, Mus musculus
guugaaauacuauacuucuccacuagaugccccucgucagccagau

SEQ ID NO: 57506 - RNA, 46 nt, Mus musculus
cacaccucucaguggguacccgaggagcaggucugacugaggaacu

SEQ ID NO: 57507 - RNA, 46 nt, Mus musculus
uuuauacugaagguaguaagcgugcucccacacgucaauccccagc

SEQ ID NO: 57508 - RNA, 46 nt, Mus musculus
ccgcucaaggccaccuguaacuucuccagcucuaagggacccagac

SEQ ID NO: 57509 - RNA, 35 nt, Mus musculus
aagaaguauuuucaauuaggggaaaaaaaaaaaag

SEQ ID NO: 57510 - RNA, 45 nt, Mus musculus
agagaaaguauucacauaaguaucagacuaacagugggccucagg

SEQ ID NO: 57511 - RNA, 39 nt, Mus musculus
aguaaguaguucugaggcuuuguuuuucgugugugugug

SEQ ID NO: 57512 - RNA, 46 nt, Mus musculus
uuuuccaaucacacaguucuccgauccuaucacacaguucuccgau

SEQ ID NO: 57513 - RNA, 46 nt, Mus musculus
uuuuccaaucacacaguucuccgauccuaucacacaguucuccaau

SEQ ID NO: 57514 - RNA, 46 nt, Mus musculus
uuuuccaaucacacaguucucagauccuaucacacaguucucagau

SEQ ID NO: 57515 - RNA, 46 nt, Mus musculus
uuuuccaaucacacaguucucagauccuaucacacaguucucagcu

SEQ ID NO: 57516 - RNA, 46 nt, Mus musculus; identical to SEQ ID NO: 57513

SEQ ID NO: 57517 - RNA, 46 nt, Mus musculus
aacauuugauuucauuuucccaguuucuaaagauguuggaccccuu

SEQ ID NO: 57518 - RNA, 42 nt, Mus musculus
uugcugugguuuaaggaaacuccacuuguaauaggccacauu

SEQ ID NO: 57519 - RNA, 46 nt, Mus musculus
auacgcgugacaucucuccuaaggaugggcucuguuaacugggaga

SEQ ID NO: 57520 - RNA, 45 nt, Mus musculus
uuuccuuuaguugcaagauguuaguuccaacuuugagguggguaa

SEQ ID NO: 57521 - RNA, 31 nt, Mus musculus
aagucucuaagacagcuccuuagagaggagc

SEQ ID NO: 57522 - RNA, 45 nt, Mus musculus
guuucgaaagcuuaugaaaucuuugggaggcgaggcccggcugga

SEQ ID NO: 57523 - RNA, 46 nt, Mus musculus
gugacugagcagaugcaguggcauuuacccgugguuccugcuagug

SEQ ID NO: 57524 - RNA, 46 nt, Mus musculus
ugucacuugcagccacauaccuacauguacuuaagaaccuuaagga

SEQ ID NO: 57525 - RNA, 46 nt, Mus musculus
gucacaguucaggacagugacccaucccuucccaaaucagccaaaa

SEQ ID NO: 57526 - RNA, 42 nt, Mus musculus
cgggagcaaaugaucucucuuuccucccucuuuuccagacug

SEQ ID NO: 57527 - RNA, 46 nt, Mus musculus
cagaauugcuguuuuuuucucccucuucauuacacaaggcaagaaa

SEQ ID NO: 57528 - RNA, 44 nt, Mus musculus
cgccagcagcuagugauucucugucccagcauucucagugcuaa

SEQ ID NO: 57529 - RNA, 42 nt, Mus musculus
ccuguaccaaugaaaauaacuuuuugcaguuuguuggcccag

SEQ ID NO: 57530 - RNA, 46 nt, Mus musculus
cagagguuaugugcagauucagcucaucuaccuagauaaugccugg

SEQ ID NO: 57531 - RNA, 46 nt, Mus musculus
acagugacaaaaaaaauucacuguuuugcauaugugaaugacccau

SEQ ID NO: 57532 - RNA, 46 nt, Mus musculus
gaauaaggguucuuuucuccaccugcuuucuaacacauacugucag

SEQ ID NO: 57533 - RNA, 45 nt, Mus musculus
ucaaguaucuucuccuuuucaggucuccccuuuggaagcccccua

SEQ ID NO: 57534 - RNA, 85 nt, Mus musculus
uuuuucuuuuuuuaaaaaagauuuauuuuauucauaugagugcaauguagcugucuucagccacaccagaagaaggcauuggauc

SEQ ID NO: 57535 - RNA, 45 nt, Mus musculus
gucagugcuuuuaaccguugagccaucucuccagccuggacccuc

SEQ ID NO: 57536 - RNA, 70 nt, Mus musculus
auucugaucauguuuucccuucuccgacuccucucagauccucccuaccuccccacccacccaaauccac

SEQ ID NO: 57537 - RNA, 63 nt, Mus musculus
caugaauaggacaaaacagaccuuuuuauuauuuuaaacagagaaucucagugcucacucgug

SEQ ID NO: 57538 - RNA, 60 nt, Mus musculus
ucaucuuuuccuuucuuagaguaaauuuugauaaaaagauagucauacaagcacaggcag

SEQ ID NO: 57539 - RNA, 46 nt, Mus musculus
cauaggcaguauuugauugugauuagcagauucuuacuguaugcag

SEQ ID NO: 57540 - RNA, 46 nt, Mus musculus
auauacagggcaggcuuagcgguaagcugaugagacuuccguccac

SEQ ID NO: 57541 - RNA, 45 nt, Mus musculus
uuauacauacaccucuaugguaaaguuuaauuuauagauugggaa

SEQ ID NO: 57542 - RNA, 45 nt, Mus musculus
ugugauaggauuggagaacugugugauuggagaacugugugauag

SEQ ID NO: 57543 - RNA, 96 nt, Mus musculus
cugugugauuggagaacugugugauaggauuggagaacugugugauaggauuggagaacugugugauaggauuggagaacugugugauaggauugg

SEQ ID NO: 57544 - RNA, 60 nt, Mus musculus
agaacugugugauaggaucggggaacugugugauuggagaacugugugauaggauuggag

SEQ ID NO: 57545 - RNA, 46 nt, Mus musculus
acugucuggaaaacaaaaacaaacaaaaaagaaacagagcuaugag

SEQ ID NO: 57546 - RNA, 103 nt, Mus musculus
guggccuaagugaguuaagguaauacaguuaauguggaaggagaaaaggaagguuaugaagaaguagauuuagacucuacgagagauacgaacaugucugaga

SEQ ID NO: 57547 - RNA, 45 nt, Mus musculus
gcaaugacacuguuaaccagaguagaaaguauacaugguacauag

SEQ ID NO: 57548 - RNA, 48 nt, Mus musculus
uaagaguaaugggagccagggauucagggugaccgugucagggagaua

SEQ ID NO: 57549 - RNA, 45 nt, Mus musculus
auugggguaacacugaagacagguuucugcacuguaccuuucuga

SEQ ID NO: 57550 - RNA, 45 nt, Mus musculus
uuaaugaguuuuguagaauaaaauuaguucauuauuuuuaaauca

SEQ ID NO: 57551 - RNA, 46 nt, Mus musculus
aagcuacacaagagcaggaauuauuuugugugcccagugcccagag

SEQ ID NO: 57552 - RNA, 46 nt, Mus musculus
ggggguacugguuaguucauauuguuguuccaccuauagggugcuu

SEQ ID NO: 57553 - RNA, 24 nt, Mus musculus
caugccauguguuggggagggcag

SEQ ID NO: 57554 - RNA, 46 nt, Mus musculus
ccugacacugacugagaauccaguucaguguugauucugucccaag

SEQ ID NO: 57555 - RNA, 42 nt, Mus musculus
cauuuggugauguaaacagugaaacaagaagauaggcaggag

SEQ ID NO: 57556 - RNA, 42 nt, Mus musculus
cuagcacagccaccacucaagaugugauugaaacacuggcag

SEQ ID NO: 57557 - RNA, 44 nt, Mus musculus
ucuagcuccuccuaacauuagcaauugugagauuuuuacugaga

SEQ ID NO: 57558 - RNA, 45 nt, Mus musculus
ucaaaguccaauuuugaaccaaugaauuuuauuggggucauuuag

SEQ ID NO: 57559 - RNA, 46 nt, Mus musculus
gacauugaugagaaaccucuaguuguacaguugaauuggaacaaag

SEQ ID NO: 57560 - RNA, 46 nt, Mus musculus
gaacuucaaaagaacucucucaaagaaagaaaagaaggaaaaaaag

SEQ ID NO: 57561 - RNA, 46 nt, Mus musculus
guauuuagcuuuuuucaucauaccuuauauucaguuuucugcccau

SEQ ID NO: 57562 - RNA, 46 nt, Mus musculus
ucuaacccugaaguugucaugaaacggcggcggcagcaaaaacugg

SEQ ID NO: 57563 - RNA, 42 nt, Mus musculus
ucuugaacccagaaaaugcuaaauauauacaaaagacaagag

SEQ ID NO: 57564 - RNA, 45 nt, Mus musculus
auuggcucuagagugagcagcaaugucagauguaaauggguggca

SEQ ID NO: 57565 - RNA, 46 nt, Mus musculus
cuguugugauccucuguugaaagacuugaagaaacuugggugugaa

SEQ ID NO: 57566 - RNA, 45 nt, Mus musculus
aaaugaguggcacaaagagaggcugaggauauaagugaaggucag

SEQ ID NO: 57567 - RNA, 46 nt, Mus musculus
uugacgaugaugaauguccuuuacaaaucuucagggaauggccaag

SEQ ID NO: 57568 - RNA, 42 nt, Mus musculus
gugugugugugugugugagagagagagagagagggagggagg

SEQ ID NO: 57569 - RNA, 48 nt, Mus musculus
ugaagaggagaccaccggacuacaucccaaagaaaaugaagaaacaug

SEQ ID NO: 57570 - RNA, 45 nt, Mus musculus
uuuaguuaauguacuagaaacaaauugaaauuaacucuuccugga

SEQ ID NO: 57571 - RNA, 45 nt, Mus musculus
uaaugacugcuuccaugguuugcuuaauuuuuacuugucugucag

SEQ ID NO: 57572 - RNA, 46 nt, Mus musculus
acuugguuaccuucaggcaacauuuaucgagcuccuauguaagcag

SEQ ID NO: 57573 - RNA, 44 nt, Mus musculus
cauauccaaaaugaggaaacauuguuuuuguccuaaggguggua

SEQ ID NO: 57574 - RNA, 46 nt, Mus musculus
guaugucacaaucugagggaaaauugcauuaugaaacuuggcuagg

SEQ ID NO: 57575 - RNA, 57 nt, Mus musculus
gauggcucugacuccagagacaagccaaaguuauaccgccuucaauuaagugugacu

SEQ ID NO: 57576 - RNA, 46 nt, Mus musculus
ugacaugguuuuacacuauuagagagaaauccacuuaagaaaccag

SEQ ID NO: 57577 - RNA, 51 nt, Mus musculus
aucucaccaacauggauggaguggucacugugacacccagaaguauggaug

SEQ ID NO: 57578 - RNA, 80 nt, Mus musculus
aguuuguggaccccauccaggaccacguucuuuccaagagaucuguggauggaggccugauggucaagggcccaagacau

SEQ ID NO: 57579 - RNA, 70 nt, Mus musculus
gagcuguucaggagacaaccuuugaauugggaggagauguccacagugggacagcauugccggcaagcag

SEQ ID NO: 57580 - RNA, 45 nt, Mus musculus
uguuuucucugccuuuuauugaaagcaaaucagagccagauuuag

SEQ ID NO: 57581 - RNA, 78 nt, Mus musculus
agugacaggguguccucugccucuagcacagcugagcgagggauggugaagccgaugauccgacuggaccaggagcag

SEQ ID NO: 57582 - RNA, 46 nt, Mus musculus
ucuuuuuauucaccuucccaugcuuggcagaggugauacugaggag

SEQ ID NO: 57583 - RNA, 47 nt, Mus musculus
ggacucaggaugcuacugggccugaacugauacugccugccagcauu

SEQ ID NO: 57584 - RNA, 46 nt, Mus musculus
auauguguuauacauggcaugccgguauguauuguccagccagcac

SEQ ID NO: 57585 - RNA, 46 nt, Mus musculus
ucuucauaguuaauucaugggaauggacccuuucaccuucauguag

SEQ ID NO: 57586 - RNA, 45 nt, Mus musculus
auggguuuugaguugaaguucauaccaccaugccugaguaccaga

SEQ ID NO: 57587 - RNA, 46 nt, Mus musculus
gagagcuguguuacagaugcuaccaucuuaagucaauaccugagag

SEQ ID NO: 57588 - RNA, 46 nt, Mus musculus
gcaaagaagaugcuauggaggagaacuguuuccuuccugcagccag

SEQ ID NO: 57589 - RNA, 46 nt, Mus musculus
aguugcccauguuccucuaaucccucuuaauuguuuaucaugccag

SEQ ID NO: 57590 - RNA, 46 nt, Mus musculus
uuguggggagaccuagccaggagcuugcuuggcuuccugugccaag

SEQ ID NO: 57591 - RNA, 46 nt, Mus musculus
gauggcucagccauuaaaggcuaggcucacaaccaaaauauaagaa

SEQ ID NO: 57592 - RNA, 45 nt, Mus musculus
ugaggaaggagccugagauaaucacugugacucugaagaagcaga

SEQ ID NO: 57593 - RNA, 45 nt, Mus musculus
ccaagguaggacugaaggagcacaggagcaucuuuccuaucugag

SEQ ID NO: 57594 - RNA, 42 nt, Mus musculus
aagacuugguagucacagugagaaaagcaaauaugggcacaa

SEQ ID NO: 57595 - RNA, 46 nt, Mus musculus
auguugguccaugcuuguaaucccagcuuuuagcaggcaggaucag

SEQ ID NO: 57596 - RNA, 44 nt, Mus musculus
uuaguguaagugagagagggcuuugacuaggguauaguaugaua

SEQ ID NO: 57597 - RNA, 45 nt, Mus musculus
cugcacucauuuugcaaugaaagauccuaguagcagagguggcag

SEQ ID NO: 57598 - RNA, 45 nt, Mus musculus
ccagcucgaggcuguuguccuggagauaacaugugguucucuguu

SEQ ID NO: 57599 - RNA, 49 nt, Mus musculus
agacagaaaagauggauggugugguaaauauuuguuguguugguggugu

SEQ ID NO: 57600 - RNA, 45 nt, Mus musculus
ucuaagaaaggcacagagcagaccugaugugagcguugugcugug

SEQ ID NO: 57601 - RNA, 45 nt, Mus musculus
acuguaaauauuuaucuagauauuauucucauuuuuggcaaucag

SEQ ID NO: 57602 - RNA, 46 nt, Mus musculus
uuguuaguaauguugaugacgaauaaacuacaauacaugccauaaa

SEQ ID NO: 57603 - RNA, 31 nt, Mus musculus
uucgugauuuuaaaaaguguucuuauuguag

SEQ ID NO: 57604 - RNA, 46 nt, Mus musculus
guuaguuauuauugcuaaauguuuuucuugcuagagaugacgguag

SEQ ID NO: 57605 - RNA, 42 nt, Mus musculus
uacguuaagucgguugucaaaggaggugcugcagauguggug

SEQ ID NO: 57606 - RNA, 88 nt, Mus musculus
agcccuggagggaaggguccauauacaucuggaacagcagcuaagauaacaucugucuccacuggaaaccucugcacugaggucugag

SEQ ID NO: 57607 - RNA, 45 nt, Mus musculus
cagaccugaagccuauccuaucccuacucagacauacaccagaga

SEQ ID NO: 57608 - RNA, 44 nt, Mus musculus
agagccaguggccaaauuaugaggaaaaaccacaugugcacaca

SEQ ID NO: 57609 - RNA, 72 nt, Mus musculus
gagcaugugacuucaugaugcucuuaugugauguguggauugugugagcaugugacuucaugaugcucuuau

SEQ ID NO: 57610 - RNA, 99 nt, Mus musculus
gugauguguggauugugugagcaugugacuucaugaugcucuuaugugauguguggauugugugagcaugugacuucaugaugcucuuaugugaugugu

SEQ ID NO: 57611 - RNA, 71 nt, Mus musculus
ggauugugugagcaugugacuucaugaugcucuuaugugauguguggauugugugagcaugugacuucaug

SEQ ID NO: 57612 - RNA, 50 nt, Mus musculus
ggaagaaaagguuuaccaacuugagcggcaucgaguagaggcaggcaugg

SEQ ID NO: 57613 - RNA, 27 nt, Mus musculus
aguuaccccugcuuccacucugaccaa

SEQ ID NO: 57614 - RNA, 46 nt, Mus musculus
gagagaggagcaccagaggugguaugagaaagagaaggcccgccug

SEQ ID NO: 57615 - RNA, 64 nt, Mus musculus
uuaugcuggaguggcaguuccagaagagacuacaggaguccaaacagaaggaugaggaugauga

SEQ ID NO: 57616 - RNA, 46 nt, Mus musculus
gaaagaguagcuguuucagacaucuuacuucaagggcaugaugcag

SEQ ID NO: 57617 - RNA, 71 nt, Mus musculus
augaggagcgcaggcgccagcaacaguuggaagagaugcggaaacgagaagcagaagaucgaguaagacaa

SEQ ID NO: 57618 - RNA, 52 nt, Mus musculus
gaggaagauggacgccaucaggaggaggagcgaguaaagagagaugcugaag

SEQ ID NO: 57619 - RNA, 53 nt, Mus musculus
cucaugggcaccuuccucuugccacccuuaagccgcagcagccccccugccag

SEQ ID NO: 57620 - RNA, 46 nt, Mus musculus
uuggagaauugguaugcaauauucuucaaucauucugaaagcccaa

SEQ ID NO: 57621 - RNA, 29 nt, Mus musculus
cuggagccccugaaaaucugacauuuaaa

SEQ ID NO: 57622 - RNA, 46 nt, Mus musculus
agagaggucugcccuuggcgggagcuuugugggggcgagccugaag

SEQ ID NO: 57623 - RNA, 46 nt, Mus musculus
ccuguuucuguuagcuuuuggggagacucuuggacucauagggcag

SEQ ID NO: 57624 - RNA, 46 nt, Mus musculus
ggagcacacuggcagccuucaggugucauaaucauacaucccagag

SEQ ID NO: 57625 - RNA, 53 nt, Mus musculus
ugugaaaccuguagugaaguagacuuggccgucccuggacagugaggucagau

SEQ ID NO: 57626 - RNA, 46 nt, Mus musculus
aaacugcuguuguuuuucauuucuacuguauuuuaguugcagccua

SEQ ID NO: 57627 - RNA, 46 nt, Mus musculus
cucauauacguuaaugaaacauuguuuuuuuuuuuuugccaaagau

SEQ ID NO: 57628 - RNA, 42 nt, Mus musculus
ucuagauggaguuauuuguguugaaaucucugagggugaguu

SEQ ID NO: 57629 - RNA, 46 nt, Mus musculus
cccucuggugggguaguucacaguccccuuucuaguaauggcaacu

SEQ ID NO: 57630 - RNA, 87 nt, Mus musculus
cuugauuuauuuuauuuuguuuuuguuuugcuuuaagcugcaugaucucccagcaggaaguacugccucucucacuucacacgagcu

SEQ ID NO: 57631 - RNA, 45 nt, Mus musculus
augcuuaaggaaacaucauuuguuuuuuccagacacacccauuaa

SEQ ID NO: 57632 - RNA, 46 nt, Mus musculus
agguuccauucuaucaugacauaaauccuuguauuucaaacagcag

SEQ ID NO: 57633 - RNA, 45 nt, Mus musculus
acaaguauguaguauauaauuucuagaaauaagcauaugacaagg

SEQ ID NO: 57634 - RNA, 45 nt, Mus musculus
gcugcuuuugccaaauuugguaaugcauuuccuuaagguuccagg

SEQ ID NO: 57635 - RNA, 47 nt, Mus musculus
acgcaguucuuacuuggccacaguuaaagcugacucgacagagacaa

SEQ ID NO: 57636 - RNA, 64 nt, Mus musculus
gcuguucuauaaugacacacaaauccugugaggcugaacaggaagaaagaucaggugaacucgg

SEQ ID NO: 57637 - RNA, 51 nt, Mus musculus
uuuacauguaaauguaauuacuugcaguauuuauguguauauggagucgaa

SEQ ID NO: 57638 - RNA, 42 nt, Mus musculus
cuggaaaacauuuggaugagauaugaggcucaccguggagcg

SEQ ID NO: 57639 - RNA, 46 nt, Mus musculus
ucuccuuugaagacacuuggacuuggugcugaugaaggagguguag

SEQ ID NO: 57640 - RNA, 108 nt, Mus musculus
cuucuuagacacaucaguccaucuuggcacuuguggcuuuucugucauuuggcauuuccuguuucuugaccuuaacugaguggaucuacaccuccuucaucagcacca

SEQ ID NO: 57641 - RNA, 46 nt, Mus musculus
aaaggaagggaaaggguagaaaggaggaaggaaagaagauggagug

SEQ ID NO: 57642 - RNA, 41 nt, Mus musculus
aagaagaaaggaaggaaggaaggaagggagggaggaaggaa

SEQ ID NO: 57643 - RNA, 102 nt, Mus musculus
cuuagugcaugaaggaaagcaagucauggcugacucaggaccaauuuaugaccaaaccuacgcugguggacggcugggccuguuugucuucucccaagagau

SEQ ID NO: 57644 - RNA, 45 nt, Mus musculus
cuauagaucccuuuuggguugucuggaugucacucuaugguagau

SEQ ID NO: 57645 - RNA, 45 nt, Mus musculus
ugccuacagguggcaccugauucacaggccuaagacaggcuacau

SEQ ID NO: 57646 - RNA, 44 nt, Mus musculus
ggugugucacucaaagugguaaacuccacgacugguacuggcga

SEQ ID NO: 57647 - RNA, 46 nt, Mus musculus
uguggacuucaguggcacuuucuaugucaacacugaccgggaugau

SEQ ID NO: 57648 - RNA, 42 nt, Mus musculus
cccggucaguguugacauagaaagugccacugaaguccacag

SEQ ID NO: 57649 - RNA, 72 nt, Mus musculus
ggaucccaaggggaccacacaaauugaucccaacuggguaauucgucaccaaggcaaagagcuggugcagac

SEQ ID NO: 57650 - RNA, 50 nt, Mus musculus
ugacuuugacaaugauaaugucccagauauugaugaugugugcccugaga

SEQ ID NO: 57651 - RNA, 72 nt, Mus musculus
gaugguguuccagaugacagggacaacugucggcuuguguucaacccagaccaggaagacucggacgguggg

SEQ ID NO: 57652 - RNA, 53 nt, Mus musculus
guugucccugucaucuggaacaccaucauugucaucaucagagucgcaggcau

SEQ ID NO: 57653 - RNA, 92 nt, Mus musculus
cagugugacaacaaugaggacauagaugaugacggccaccagaacaaccaagacaacugcccauacaucuccaacuccaaccaggcugacca

SEQ ID NO: 57654 - RNA, 51 nt, Mus musculus
aucuauguccucauuguugucacacuggucuccaacgagaucauuguccug

SEQ ID NO: 57655 - RNA, 47 nt, Mus musculus
ucuggguugugcaucagaggacaauugucacaguggucacccacgcc

SEQ ID NO: 57656 - RNA, 46 nt, Mus musculus
cgagacaauuguccauaugucuacaacacugaccagagagauacgg

SEQ ID NO: 57657 - RNA, 46 nt, Mus musculus
aacaauggcgagggggaugccugcucuguggacauugacggagacg

SEQ ID NO: 57658 - RNA, 68 nt, Mus musculus
cauuguugucugugucgaucugugcuggguugugcacauaggggcaguugucacagcggucuccaacc

SEQ ID NO: 57659 - RNA, 71 nt, Mus musculus
ucucuucaauccccgucaauuagacuaugacaaggaugagguuggagaccgcugugacaacugccccuaug

SEQ ID NO: 57660 - RNA, 83 nt, Mus musculus
cccaaacugccaaauuccgggcaggaggauuuugauaaggauggaaucggagaugcuugugacgaggacgaugacaaugacgg

SEQ ID NO: 57661 - RNA, 46 nt, Mus musculus
ccauccuuaucaaaauccuccugcccggaauuuggcaguuuggggc

SEQ ID NO: 57662 - RNA, 46 nt, Mus musculus
cagcaugcgugcaagcucaguccucaccggccagcaggucucaaag

SEQ ID NO: 57663 - RNA, 45 nt, Mus musculus
guagacagaguagagaggcuuuuaugcuguugcaugucuaucaaa

SEQ ID NO: 57664 - RNA, 49 nt, Mus musculus
cuggcccaacaacaaccuggugugugcuacuaaugccaccuaccacugc

SEQ ID NO: 57665 - RNA, 53 nt, Mus musculus
gguagguggcauuaguagcacacaccagguuguuguugggccagccauccagg

SEQ ID NO: 57666 - RNA, 69 nt, Mus musculus
accugggccacuuuagugaccccauguacaagugugagugccagauuggcuacgcaggugaugggcuca

SEQ ID NO: 57667 - RNA, 47 nt, Mus musculus
augagguugguaccucugccuuggguagcugggugucuuaugaagau

SEQ ID NO: 57668 - RNA, 41 nt, Mus musculus
cagaugggugcuuauccaacccguguuuuccuggagccaag

SEQ ID NO: 57669 - RNA, 46 nt, Mus musculus
uguguuuguguguguguguguguguguguguguguguggcaucuug

SEQ ID NO: 57670 - RNA, 42 nt, Mus musculus
cgugagcgcucacguguuugcaacagcccugagccccaguau

SEQ ID NO: 57671 - RNA, 67 nt, Mus musculus
ccagauggguggcaagaacugcaagggcagcggccgggaaaccaaacccugucagcgugauccgugc

SEQ ID NO: 57672 - RNA, 64 nt, Mus musculus
caugcuccgugacuuguggaguuggcaaugucacccgcauacgucucugcaacucaccagugcc

SEQ ID NO: 57673 - RNA, 42 nt, Mus musculus
caagucacggagcaugaagaccagggugaccagugacuccag

SEQ ID NO: 57674 - RNA, 71 nt, Mus musculus
gucuugugaugucaccagcaacaccugccugggccccuccauucagacaaggacaugcagccugggcaaau

SEQ ID NO: 57675 - RNA, 42 nt, Mus musculus
gaauggaggggcccaggcagguguugcuggugacaucacaag

SEQ ID NO: 57676 - RNA, 74 nt, Mus musculus
gagggcuggucuccgugggcagaguggaccgaguguucugucaccuguggcucugggacccagcagagaggccg

SEQ ID NO: 57677 - RNA, 51 nt, Mus musculus
aaaacagucugccaucagaucaccugcucaccugcaacuugugccaaccca

SEQ ID NO: 57678 - RNA, 78 nt, Mus musculus
cagccugugugcaggagggccgaaucuuugcagaaaaugaaaccuggguuguggauaguuguaccacaugcaccugca

SEQ ID NO: 57679 - RNA, 49 nt, Mus musculus
augugguacaacuauccacaacccagguuucauuuucugcaaagauucg

SEQ ID NO: 57680 - RNA, 59 nt, Mus musculus
uagugauaaccaguuccuuuuggagcucauugggggcccucugaagacaagaaacaugu

SEQ ID NO: 57681 - RNA, 73 nt, Mus musculus
aggaguugagcaacaugaugaaugagcucucuggacugcacgucauggugaaccagcugagcaagaaccugga

SEQ ID NO: 57682 - RNA, 75 nt, Mus musculus
ugagcccucacaucaccacagaucucgugguccaggguguggagaaggcacaggagguguguacgcacuccugcg

SEQ ID NO: 57683 - RNA, 46 nt, Mus musculus
cuugcugcagaauguccaucucguguuugcagauucuguggaagau

SEQ ID NO: 57684 - RNA, 45 nt, Mus musculus
guguguguacgugugugugugugugugugugugugugugugugau

SEQ ID NO: 57685 - RNA, 45 nt, Mus musculus
cacccuggaagaaccauucuaugagcagcuagaaguagacaggag

SEQ ID NO: 57686 - RNA, 45 nt, Mus musculus
ggcccaggggacacuuuggaccucaacuacuggguagaaggcaau

SEQ ID NO: 57687 - RNA, 64 nt, Mus musculus
cgguuugacuacauccccccagugaacacagaugaucucaacaggauugucaagcuugcaagga

SEQ ID NO: 57688 - RNA, 45 nt, Mus musculus
gucaaggacacuucauuugaccuuuucagcaucagcaacauuaac

SEQ ID NO: 57689 - RNA, 46 nt, Mus musculus
cuucaaccacgagguugguuuucuccuaagugucacagguggagac

SEQ ID NO: 57690 - RNA, 42 nt, Mus musculus
cgccaguacucugucuguccugagggggacuagcugcggcag

SEQ ID NO: 57691 - RNA, 46 nt, Mus musculus
cugcagccucccuggccaggccucuccucuccugccgcagcuaguc

SEQ ID NO: 57692 - RNA, 42 nt, Mus musculus
cauucuagcuccaguuucaauaagagaccuugucucagggaa

SEQ ID NO: 57693 - RNA, 45 nt, Mus musculus
cucuccagauuugauuaugauagaauaaccauaaaauccagccag

SEQ ID NO: 57694 - RNA, 46 nt, Mus musculus
agccuuuauaauuuccagaauauucuagaggaacuguaaccaagag

SEQ ID NO: 57695 - RNA, 33 nt, Mus musculus
agaccagaacagccauccuaguuguaccagaga

SEQ ID NO: 57696 - RNA, 46 nt, Mus musculus
uaucccgaaagucucccauauccccccacuccccuacccacccacu

SEQ ID NO: 57697 - RNA, 46 nt, Mus musculus
cugccugguauggaguuugugucugcgcuuucugcuguguccagau

SEQ ID NO: 57698 - RNA, 42 nt, Mus musculus
ggguggucaaguuguccaccaacagcagagcagcgugggugg

SEQ ID NO: 57699 - RNA, 46 nt, Mus musculus
agugaaaauugcuguaucuucugagacuacuucuuuuuugggggga

SEQ ID NO: 57700 - RNA, 44 nt, Mus musculus
guguccucaacucgcuugagccccacucucaguugcugcccaag

SEQ ID NO: 57701 - RNA, 46 nt, Mus musculus
guugacaugucuguccacauguguuccugacaucuuuccguugcug

SEQ ID NO: 57702 - RNA, 42 nt, Mus musculus
cucuuacuauaaguaaaauauugcaccuaucauaagagaacu

SEQ ID NO: 57703 - RNA, 42 nt, Mus musculus
uucaugguguugcaaaagcaucaacauuuucugaagccagaa

SEQ ID NO: 57704 - RNA, 81 nt, Mus musculus
gcguguaaaauaagugccuuuaaaacccagaaagauuaacuaugaguagcaugcuuauaggaagauguugaugguaauagg

SEQ ID NO: 57705 - RNA, 42 nt, Mus musculus
cccagcauggugguacacaucuguaaucccaacacucgggag

SEQ ID NO: 57706 - RNA, 42 nt, Mus musculus
ugagugcuuuucugacuccccacccccaccccgcccccauag

SEQ ID NO: 57707 - RNA, 96 nt, Mus musculus
cucagauucacugagaaggggacagugucagaacugaagguaccacagagggagggaggaggguggcuggcggaauguacuaccaccagcaaggga

SEQ ID NO: 57708 - RNA, 42 nt, Mus musculus
cccagugaguaccuucuggacucagaucuugccuguggaguu

SEQ ID NO: 57709 - RNA, 43 nt, Mus musculus
acacccaccgggagauuccggugaacaggaugggggcaggcag

SEQ ID NO: 57710 - RNA, 45 nt, Mus musculus
ucacacagccagaaaggugccaacuuuugugucgugcuaucagaa

SEQ ID NO: 57711 - RNA, 42 nt, Mus musculus
uccuuccacaagaaucuucagcuuaaucaagaggacccaaga

SEQ ID NO: 57712 - RNA, 41 nt, Mus musculus
cugguuugggaagaaggauauggcauggggagaggggcuug

SEQ ID NO: 57713 - RNA, 46 nt, Mus musculus
gcagugccuggcagggcaugucugcacacuggugcucaggguagau

SEQ ID NO: 57714 - RNA, 46 nt, Mus musculus
caggcauuucucucuccagcugugcuaccuacucacaugcccaugc

SEQ ID NO: 57715 - RNA, 28 nt, Mus musculus
agaaagcaaaauggagaagcaaacugua

SEQ ID NO: 57716 - RNA, 50 nt, Mus musculus
uucucuuaaauaaaauuccaaggauauagccccgaugaaugcugcugaga

SEQ ID NO: 57717 - RNA, 65 nt, Mus musculus
cagagucugucuacucuacuucaaaggacaccaaguaccagucgguguauguucugucugcagaa

SEQ ID NO: 57718 - RNA, 48 nt, Mus musculus
uaagguccgauaccccacuguggacuauaaccucguucgagaccucaa

SEQ ID NO: 57719 - RNA, 45 nt, Mus musculus
gggagagacagaaaccaugaacaaccuagccaauugccagcgcga

SEQ ID NO: 57720 - RNA, 45 nt, Mus musculus
ccaucugcacaggucauggcgcucagcucacagaccuugccauag

SEQ ID NO: 57721 - RNA, 46 nt, Mus musculus
gcacacucaucuacuuccagcucacaguuggcaccuguauacccag

SEQ ID NO: 57722 - RNA, 23 nt, Mus musculus
cagccuuccuggcaguuacacug

SEQ ID NO: 57723 - RNA, 46 nt, Mus musculus
gucucugggcuggagcuccaaccuauguuuuuauuuguuugcagca

SEQ ID NO: 57724 - RNA, 45 nt, Mus musculus
uagggaaaggggagaagaugcuugauaaccggaaguguggaggag

SEQ ID NO: 57725 - RNA, 54 nt, Mus musculus
uacaggaaauuguauuuuaaaaaggggggagaguacuugauggagcaagguggg

SEQ ID NO: 57726 - RNA, 46 nt, Mus musculus
ccuacuuaccugaaaggucgaaugcuucccuccccuacccccaaag

SEQ ID NO: 57727 - RNA, 45 nt, Mus musculus
uggcggaaaggcgucucucggcuccaggugugcuaucagggccag

SEQ ID NO: 57728 - RNA, 41 nt, Mus musculus
gagcggguuuugcgcugggggagggaggcgaaggggcgagg

SEQ ID NO: 57729 - RNA, 46 nt, Mus musculus
ggguguaccugacagguguccucacuguagguguugcuguccuguu

SEQ ID NO: 57730 - RNA, 45 nt, Mus musculus
uggcuagggggcugauggcgucuaaaggcgugucaucccccuccc

SEQ ID NO: 57731 - RNA, 42 nt, Mus musculus
ggaggaggaggaggaggaggaggaggaggaggaggagccugu

SEQ ID NO: 57732 - RNA, 28 nt, Mus musculus
uaucuugagcuccaggccagcccuggca

SEQ ID NO: 57733 - RNA, 46 nt, Mus musculus
uauagagccaugggcagcugaggacugaagggcacugacagagcag

SEQ ID NO: 57734 - RNA, 42 nt, Mus musculus
gagggggggagaaagaaagaaagaaggaaggaaggaaggaag

SEQ ID NO: 57735 - RNA, 44 nt, Mus musculus
gaggcaccauguaccaggcucagaggagccauccaccauggaga

SEQ ID NO: 57736 - RNA, 45 nt, Mus musculus
cuuucuuccuuccuuucuuucuaagauuuauuuauugggcaucag

SEQ ID NO: 57737 - RNA, 42 nt, Mus musculus
ugcacaaaauucuccaggaacuaaaaaaaaaugagacugggg

SEQ ID NO: 57738 - RNA, 38 nt, Mus musculus
ucugccuaucugagugcugugauuccaugugccaccag

SEQ ID NO: 57739 - RNA, 46 nt, Mus musculus
gcuguuaccuucuucaucaaguccuccaaugauguuguaaacauag

SEQ ID NO: 57740 - RNA, 43 nt, Mus musculus
accuaccuugagucuuccccaaucuauaaguaacugaaaggag

SEQ ID NO: 57741 - RNA, 41 nt, Mus musculus
acagacacacacacagagagaaagagagagagagagagcgc

SEQ ID NO: 57742 - RNA, 46 nt, Mus musculus
gugggagaguuuuacccaggccugcagccgcccguuuuguccccag

SEQ ID NO: 57743 - RNA, 46 nt, Mus musculus
cgagauuaacauaaaaacgcaugcugcuuuauuuacacacugucgg

SEQ ID NO: 57744 - RNA, 71 nt, Mus musculus
aguccaaugaugccuuacggcacaggacuuacuccacagccuauucagaacaccaacagucucucuauuuu

SEQ ID NO: 57745 - RNA, 46 nt, Mus musculus
cucccaccguguugccuugcuguucagcaagacuuugagucacaag

SEQ ID NO: 57746 - RNA, 46 nt, Mus musculus
augucauuguucccagcuuuguacuauaauuucauuaguugugugu

SEQ ID NO: 57747 - RNA, 46 nt, Mus musculus
uguuguuuuucuaguuuguaacucuuaggaguuauuuuugugccag

SEQ ID NO: 57748 - RNA, 46 nt, Mus musculus
gucuuuuucuucccagccuuuccuguuuccccaggguaacguccag

SEQ ID NO: 57749 - RNA, 46 nt, Mus musculus
uugggcuugccaacaucagucaauagcccccacccccaccccccag

SEQ ID NO: 57750 - RNA, 46 nt, Mus musculus
gacagugguuuaaagugagaagggaucuugcaaccacuuagcccag

SEQ ID NO: 57751 - RNA, 46 nt, Mus musculus
caagugagugccuagcuggguacauucacguccacacugccuagag

SEQ ID NO: 57752 - RNA, 46 nt, Mus musculus
ccucugaucuaucucuccaguccuucauuauugugucagucacaag

SEQ ID NO: 57753 - RNA, 46 nt, Mus musculus
uuccuguaacuucagaauaauccuccauuuccacaaccucaggcaa

SEQ ID NO: 57754 - RNA, 80 nt, Mus musculus
gcagugacauccugcgacugaucaaggaacuggcuaaauaugaauacauggaaggucaagucauuuuaacugagaaagau

SEQ ID NO: 57755 - RNA, 46 nt, Mus musculus
acuccuccgauguccugguuuacguuaccagcaaugauaccacagu

SEQ ID NO: 57756 - RNA, 45 nt, Mus musculus
ucuccauucccucugacuguuuugaaaguauaaaauuaaaauuag

SEQ ID NO: 57757 - RNA, 41 nt, Mus musculus
aagcaggcuuaagugauuuguccugugugcugcuggguacu

SEQ ID NO: 57758 - RNA, 42 nt, Mus musculus
caggguccuguguauagaaacacccuuagcaggaugccaaag

SEQ ID NO: 57759 - RNA, 46 nt, Mus musculus
gaugcuguccucuuuccccuggaugguuugagcuccuuugucaaag

SEQ ID NO: 57760 - RNA, 46 nt, Mus musculus
ugaguuucgggaugaugauuccaccaaagguucuuuuguuguugag

SEQ ID NO: 57761 - RNA, 42 nt, Mus musculus
cuuucagcaagauagucacuuuuacuauacuaauccugccaa

SEQ ID NO: 57762 - RNA, 46 nt, Mus musculus
uaugauuauuuguuucuauuuagaggaauuucuucuauagcccaga

SEQ ID NO: 57763 - RNA, 45 nt, Mus musculus
cuguccaaugccugaagagaagcauauaaauucuuccaggaugag

SEQ ID NO: 57764 - RNA, 45 nt, Mus musculus
ccaacuuugaaaaugguguauucacagcaaccaaagggaguggga

SEQ ID NO: 57765 - RNA, 37 nt, Mus musculus
agcuguaacauauugagcugcucuauuuggaggagag

SEQ ID NO: 57766 - RNA, 46 nt, Mus musculus
gaauugguuguguuccuucuguuucuacuuugugaacuagauugaa

SEQ ID NO: 57767 - RNA, 45 nt, Mus musculus
cugauucuauggucaauuuuggugaugauaccaugagguacugag

SEQ ID NO: 57768 - RNA, 45 nt, Mus musculus
guuucguguuugcaccaaaauguuggguccuguuuaugcauccag

SEQ ID NO: 57769 - RNA, 43 nt, Mus musculus
gugcacagcuagcagccaaggucugcucagggacuggcucagg

SEQ ID NO: 57770 - RNA, 46 nt, Mus musculus
aguugucuucaagaaugagucccugaggucaguuuucagugaguaa

SEQ ID NO: 57771 - RNA, 42 nt, Mus musculus
uucaaggucuauuacaagcuacuuuuuuaauuuugacgggga

SEQ ID NO: 57772 - RNA, 44 nt, Mus musculus
aaucuccuguauuucuuuacgggagauauuuauuuccuccuuaa

SEQ ID NO: 57773 - RNA, 46 nt, Mus musculus
gcuuuucagauggguuaggguauccagcguuuacuguauugggaga

SEQ ID NO: 57774 - RNA, 46 nt, Mus musculus
gugagucugguaaugucagaacuucuggaagucaugcugugagaug

SEQ ID NO: 57775 - RNA, 45 nt, Mus musculus
auacccaagauauaagauacaauuucuaaaacacaugaaacucaa

SEQ ID NO: 57776 - RNA, 55 nt, Mus musculus
auggcaaaacuugaggaaagccuuggaagauuugaggggguaaauuugcagugag

SEQ ID NO: 57777 - RNA, 45 nt, Mus musculus
ucucucccacucucccuuucuccccgucucccccucuccccuucu

SEQ ID NO: 57778 - RNA, 57 nt, Mus musculus
cauaaugaacugagcaucugcagagacauauaaaccauuuugaucaccugaauucac

SEQ ID NO: 57779 - RNA, 45 nt, Mus musculus
aaacauaauagaaguaggaaggagaaaaaaauuucuaccuuguuc

SEQ ID NO: 57780 - RNA, 42 nt, Mus musculus
aguuccugauuacacagaaaccacuccaucuccaagggggag

SEQ ID NO: 57781 - RNA, 45 nt, Mus musculus
uuuguuuguuuguuuguuuguuuuguuuuguuuuugguugggaga

SEQ ID NO: 57782 - RNA, 45 nt, Mus musculus
accagauauaccaaaaagcacaccacuccaagggguuccacauga

SEQ ID NO: 57783 - RNA, 45 nt, Mus musculus
guucauaggugccaaaagaccaggcugggcuuacagagauguuuu

SEQ ID NO: 57784 - RNA, 44 nt, Mus musculus
cuaucuauccagugcuugccugugagcaucugcaacugucucau

SEQ ID NO: 57785 - RNA, 46 nt, Mus musculus
agacaauauguuuaucuucagugucaugaaagaauacauacuggag

SEQ ID NO: 57786 - RNA, 47 nt, Mus musculus
uuugcaugucccagauaccuucaaauccauaaaagaacacauacugg

SEQ ID NO: 57787 - RNA, 45 nt, Mus musculus
caugucacagauaccuucaaauccauaaaagaacacauacuggag

SEQ ID NO: 57788 - RNA, 46 nt, Mus musculus
caugucgcaguaaucuucaaauccauaaaagaacacauacuggaga

SEQ ID NO: 57789 - RNA, 46 nt, Mus musculus
augucacaguacuccaugaauucauaaaagaacacauacuggagag

SEQ ID NO: 57790 - RNA, 46 nt, Mus musculus; identical to SEQ ID NO: 57789

SEQ ID NO: 57791 - RNA, 51 nt, Mus musculus
uagagaaguggagggauguguacugugguccagauauaaagugggagauga

SEQ ID NO: 57792 - RNA, 46 nt, Mus musculus
cccagugcaaauggacaacgaaugaucaaugcaguaccagcggcag

SEQ ID NO: 57793 - RNA, 46 nt, Mus musculus
agcaggggcaagcauuucaggaaucugagaaucuaggaguaugggu

SEQ ID NO: 57794 - RNA, 81 nt, Mus musculus
ugaaaaugaaggccauuuuccauuauguguugacagaaaaggcuaguuagacauugguggacuguaaccuuaauaagcaga

SEQ ID NO: 57795 - RNA, 47 nt, Mus musculus
gcuggguacagugaaggaaggucaggcaaguucugaaagugcgacau

SEQ ID NO: 57796 - RNA, 46 nt, Mus musculus
aguucuucucuuggcauuuagcauuuugguugucauucauuucgag

SEQ ID NO: 57797 - RNA, 46 nt, Mus musculus
acugucuuuucccuuauacaagcuuugcaauuuugugaggccccau

SEQ ID NO: 57798 - RNA, 49 nt, Mus musculus
ucuuuccacuggaugguuugagcuccuuugucaaagaucaagugagcau

SEQ ID NO: 57799 - RNA, 46 nt, Mus musculus
auuucuuucucauucuguuuaucguuuguguagagaaaggccucug

SEQ ID NO: 57800 - RNA, 46 nt, Mus musculus
gaggauuauuuguuucucuuuagaggaauuucuucuauagcccagg

SEQ ID NO: 57801 - RNA, 45 nt, Mus musculus; identical to SEQ ID NO: 57763

SEQ ID NO: 57802 - RNA, 45 nt, Mus musculus; identical to SEQ ID NO: 57764

SEQ ID NO: 57803 - RNA, 43 nt, Mus musculus
accuccuguuaaccacuccuuguuuucacauuuauggccacau

SEQ ID NO: 57804 - RNA, 46 nt, Mus musculus
uagaaugaauugguuguguuccaucuguuucuauuuugugaacuag

SEQ ID NO: 57805 - RNA, 45 nt, Mus musculus; identical to SEQ ID NO: 57767

SEQ ID NO: 57806 - RNA, 45 nt, Mus musculus
uugacuucucccacuauuauuguugacgugcaacgggugcguaaa

SEQ ID NO: 57807 - RNA, 44 nt, Mus musculus
uuuccuguuugcaccaaaauguuggguccuguuuaugcauccag

SEQ ID NO: 57808 - RNA, 43 nt, Mus musculus
gugcacagcuagcagccaaggucugcucagggacuggcucaga

SEQ ID NO: 57809 - RNA, 26 nt, Mus musculus
aucaagaccaagcaagaaaagccgag

SEQ ID NO: 57810 - RNA, 46 nt, Mus musculus
aaauauuggcuaaccacucaaaaaauuugucacaaccuuagcucag

SEQ ID NO: 57811 - RNA, 45 nt, Mus musculus
aguugucuucaagaaugagucccugaggugaguuuucagugacug

SEQ ID NO: 57812 - RNA, 46 nt, Mus musculus
uguuaugugaaguuguugucucugacuggugcuugucccuccugag

SEQ ID NO: 57813 - RNA, 46 nt, Mus musculus
gguaaugucagaacuucugggagucaugcugugagaugugugcaug

SEQ ID NO: 57814 - RNA, 46 nt, Mus musculus
aacucgcgcaauauguacucacugauaaguggauaauagcccagaa

SEQ ID NO: 57815 - RNA, 44 nt, Mus musculus
gagauagggugguauuccuguggcugagaaagccuggggucuca

SEQ ID NO: 57816 - RNA, 42 nt, Mus musculus
uuuacuccagguuuuaguuuuguuuaucuuaugaaucagcau

SEQ ID NO: 57817 - RNA, 45 nt, Mus musculus
agauuguaacuuugggccaugugauaaaugcucuuuccaucacag

SEQ ID NO: 57818 - RNA, 41 nt, Mus musculus
acaauacacuucgaaagcauaaaauaacacauacuggagag

SEQ ID NO: 57819 - RNA, 43 nt, Mus musculus
ucauagauaccuucaaauccauaaaagaacacauacuggagag

SEQ ID NO: 57820 - RNA, 41 nt, Mus musculus
uuuuucaggggaaaugguagaauauaugggugugauguuag

SEQ ID NO: 57821 - RNA, 46 nt, Mus musculus
cccagugcaaauggacaaugaaugaucaaugcaguaucagcggcag

SEQ ID NO: 57822 - RNA, 50 nt, Mus musculus
uuucaggaaucugagaaucuaggaguauggguuucuuaaucaagaugaag

SEQ ID NO: 57823 - RNA, 72 nt, Mus musculus
augaaggccauuuuccauuauguguugacagaaaaggcuaguuagacauugguggacuguaaccuuaauaag

SEQ ID NO: 57824 - RNA, 47 nt, Mus musculus
accauauguaauaaacuuaccaaugugaacauaauuuucagcauacu

SEQ ID NO: 57825 - RNA, 41 nt, Mus musculus
ucaagaagaacgaagaccaaauuguggacaguucgccccuu

SEQ ID NO: 57826 - RNA, 46 nt, Mus musculus
acuuucagggcagcaucuacacuauuagcuuaucaaaugcagacag

SEQ ID NO: 57827 - RNA, 45 nt, Mus musculus
acuuggggauccagcuucuaugcagggggacccuuuagguaucag

SEQ ID NO: 57828 - RNA, 46 nt, Mus musculus
aaggggaaggcaugcacaagugcuacugaaauacaaaucucuacag

SEQ ID NO: 57829 - RNA, 46 nt, Mus musculus
augauuguuguuuccugauauuaugauguugguguuguuaaugugu

SEQ ID NO: 57830 - RNA, 46 nt, Mus musculus
guuaaggcaagggacacuaucaauaggacaaaccagcagcccaagg

SEQ ID NO: 57831 - RNA, 45 nt, Mus musculus
aggcucuacacagaaacugacacagauauagacaccuacagccaa

SEQ ID NO: 57832 - RNA, 61 nt, Mus musculus
guagggggaauacccaggguggcuccuacccacucagaggauauggggaggaagaggaaga

SEQ ID NO: 57833 - RNA, 45 nt, Mus musculus
ccaucaaggugggagcauggcaggauccagucaggcauggcgcag

SEQ ID NO: 57834 - RNA, 42 nt, Mus musculus
aaaaaaaaaaaaaaaaaaguuuuccaagcaaaaggucccaag

SEQ ID NO: 57835 - RNA, 45 nt, Mus musculus
uggugcgggaaggggucaggaucagguauggaaagagacagaaga

SEQ ID NO: 57836 - RNA, 46 nt, Mus musculus
augcagauauucacaaccaaccauuagacugagucuggagcccaca

SEQ ID NO: 57837 - RNA, 42 nt, Mus musculus
gucuugguccucucaguggggugucaugguuauguguuccag

SEQ ID NO: 57838 - RNA, 46 nt, Mus musculus
aggagcaacuccaggcugaccacguuuucaucugcuuccccaagaa

SEQ ID NO: 57839 - RNA, 30 nt, Mus musculus
ucccagcuggaccucugccugagggcagua

SEQ ID NO: 57840 - RNA, 43 nt, Mus musculus
ugcgaacggcgagcagcggcggcggcgcgggaagugcagcgga

SEQ ID NO: 57841 - RNA, 46 nt, Mus musculus
uguguugucucauaggaaauucuggaaucaugacagauguggccac

SEQ ID NO: 57842 - RNA, 48 nt, Mus musculus
uuagcauccuaaggagggcuaggaugauggggcugaaggagucucuag

SEQ ID NO: 57843 - RNA, 45 nt, Mus musculus
ccugccgaguugggggcuuggauaauaagaugaauaugaaggcag

SEQ ID NO: 57844 - RNA, 58 nt, Mus musculus
agaacaccuacuugugauugucacaaggauaaugggguuacuguagagauggaagguu

SEQ ID NO: 57845 - RNA, 41 nt, Mus musculus
uggaaaaggcaaauuccaugucauuccaccccuagaugaag

SEQ ID NO: 57846 - RNA, 45 nt, Mus musculus
cccauaaacauuaaauagauagaugauggauagauacauaggcag

SEQ ID NO: 57847 - RNA, 46 nt, Mus musculus
uuauuuggguccauaguucaucaugauggggaagacaugauagcag

SEQ ID NO: 57848 - RNA, 45 nt, Mus musculus
gucuagggauuccaacucauccuaagcuaucucaccugccccaaa

SEQ ID NO: 57849 - RNA, 46 nt, Mus musculus
ccuugguccugugaaggcucuaugccucagaguaagggaaugucag

SEQ ID NO: 57850 - RNA, 65 nt, Mus musculus
cuuguauggggaaaagcucaugaauuugaaagaaagcaaggaaggguauaugggaggguuuggaa

SEQ ID NO: 57851 - RNA, 45 nt, Mus musculus
aucucuaagcaagccugugaaagacuuguacaauaaaacguuaag

SEQ ID NO: 57852 - RNA, 42 nt, Mus musculus
augaagaaaauaccuaauuuuaaaaaaaggaaaaaaaaaaac

SEQ ID NO: 57853 - RNA, 45 nt, Mus musculus
aucucuaagcaagccugugaaagacuuguacaauaaaauguuaag

SEQ ID NO: 57854 - RNA, 46 nt, Mus musculus
uuuauuauauguagcugucuucagacacuccagaagagggagucag

SEQ ID NO: 57855 - RNA, 46 nt, Mus musculus
uaaaggcgugcgacaccacugccugaccugugaauguuuuaauuag

SEQ ID NO: 57856 - RNA, 81 nt, Mus musculus
ggcuguguugcauaauaggauaugaaaugugaguugccugguucauguauuauuuuaagccuuuguagccaaguuaaguag

SEQ ID NO: 57857 - RNA, 84 nt, Mus musculus
agcacauucauucauuucucagugucuugacaaaaauaggguagucgauaaguguauuggaggauuggggaagcaaggaaagga

SEQ ID NO: 57858 - RNA, 59 nt, Mus musculus
uuucuaagauccuaaagacucaccuaggcagcagacuuaacauucuggacucaauggau

SEQ ID NO: 57859 - RNA, 47 nt, Mus musculus
uaccauuucuugacuuguugcauguuuaauguucaccaccacccccc

SEQ ID NO: 57860 - RNA, 42 nt, Mus musculus
aaacgcugucuucuagacagguaguugaaucuguuggaaacc

SEQ ID NO: 57861 - RNA, 46 nt, Mus musculus
ccuucuguguuucuaucuaaauuaugguaugcauaaugcuaaauag

SEQ ID NO: 57862 - RNA, 46 nt, Mus musculus
auacaaauaacuuacucugauaguugacaaaguacuuauuaaggag

SEQ ID NO: 57863 - RNA, 92 nt, Mus musculus
aacuuccuuucgaaaucugaaaaacaagcgcgauuaccacaagcacaggcacaauguuucuuggcuuuacuuaucucggcucucggccauga

SEQ ID NO: 57864 - RNA, 45 nt, Mus musculus
gauuuuacauuucucaaaagaaaaagaaaaaauauguagcccauu

SEQ ID NO: 57865 - RNA, 48 nt, Mus musculus
gaaauuuccaguuccaaagccaauugauuauaaucgccaugcagugau

SEQ ID NO: 57866 - RNA, 45 nt, Mus musculus
gcuguaaggaagaugugcgauaggacauaauagugauaagcagac

SEQ ID NO: 57867 - RNA, 60 nt, Mus musculus
gauacaucauguugaagacccugcaucaguauaugaugaagcuauggaacugauagucaa

SEQ ID NO: 57868 - RNA, 65 nt, Mus musculus
acugggaaaccauggacugauucauggagauuucaaugaauucaaucucauguuggacaaagaug

SEQ ID NO: 57869 - RNA, 56 nt, Mus musculus
gagauguuaaaugcauucgagaauucuucaugaaacguuuuagcuaugaaagugag

SEQ ID NO: 57870 - RNA, 45 nt, Mus musculus
uacgguuucaauugcuguaauaaaacacugugaccaaaagcagcu

SEQ ID NO: 57871 - RNA, 116 nt, Mus musculus
aggaaggaggauucucuugauguugaggucucugccagugguuacacaaaggaaaugcaagcagaugaugaacugcuacauccaguaggcccagaugauaaaauuacugaaacaga

SEQ ID NO: 57872 - RNA, 48 nt, Mus musculus
guuuucugaugaagaaauguuagaaaaagccaaaguguggaggucaga

SEQ ID NO: 57873 - RNA, 34 nt, Mus musculus
cucgucuacagacagcaaacaaauaaaggauggc

SEQ ID NO: 57874 - RNA, 46 nt, Mus musculus
ucugauugccuugucaucagugaacagggaguucaggccuuucagg

SEQ ID NO: 57875 - RNA, 42 nt, Mus musculus
cuggaaauccuugcacuagcacuggggggcuagaggccugag

SEQ ID NO: 57876 - RNA, 105 nt, Mus musculus
ggucccuugggcaucuuacauuuguauccaagcaguuuacaaaagggauauuuucuagacaggacagggagcagaauauucuagcccagcugagguucuggcaug

SEQ ID NO: 57877 - RNA, 77 nt, Mus musculus
uaagccagccucucuuuagaccuacccagaaggaagagucaguguggagaugaccgcaccccacaaagcagcccccu

SEQ ID NO: 57878 - RNA, 46 nt, Mus musculus
guuacuaaagcuaguuuuuagagauaauuuccucauagugaacaaa

SEQ ID NO: 57879 - RNA, 45 nt, Mus musculus
aucugugaagcauguaauacauuaaaagauaaaguuuugagccag

SEQ ID NO: 57880 - RNA, 60 nt, Mus musculus
agcagcggagggaaaacaugcagaauauuaaaucgaguuuggaagcagccagcuuuuggg

SEQ ID NO: 57881 - RNA, 46 nt, Mus musculus
ugauauguauuauuuuuuuagaugcuauaauuuuauuuuuagccag

SEQ ID NO: 57882 - RNA, 46 nt, Mus musculus
auguucagacucugccuuaaacagguagaaaaaugacuugccucag

SEQ ID NO: 57883 - RNA, 45 nt, Mus musculus
uggugugauucaucccucaagcgcauucuaauucagucaguggaa

SEQ ID NO: 57884 - RNA, 47 nt, Mus musculus
acagaauguuuauuuuguaauacguuuuucuuauguccaaagcagau

SEQ ID NO: 57885 - RNA, 74 nt, Mus musculus
ggauuugguuaaauagacagacugagaaagacaggauguaaaagaggaagucaugcagaaaauuugggagacag

SEQ ID NO: 57886 - RNA, 23 nt, Mus musculus
acaacuuguaggaaaauggggcu

SEQ ID NO: 57887 - RNA, 46 nt, Mus musculus
guaugacuccaguuaagggucacuaggacauucuucuauagcccaa

SEQ ID NO: 57888 - RNA, 35 nt, Mus musculus
auagaguuuauucaggaccuggggaaggaaguuaa

SEQ ID NO: 57889 - RNA, 45 nt, Mus musculus
auaaaauuaucuuaaaauuuaaaacuccugcccagaccccaggga

SEQ ID NO: 57890 - RNA, 45 nt, Mus musculus
aggaaaggaaaggaaaggaaaggaaaggaaaggaagagaccccca

SEQ ID NO: 57891 - RNA, 45 nt, Mus musculus
auaugaaauaaugguauaggaucauagaaaguaugcuuagaaggc

SEQ ID NO: 57892 - RNA, 73 nt, Mus musculus
caaacacauuggaaugaguuugauccuaagacuggggcugguuggggggauagugugguacaagaauggagau

SEQ ID NO: 57893 - RNA, 46 nt, Mus musculus
cugaauuuacugaagaggaauaaaguuaggaaggggaaaaggaugg

SEQ ID NO: 57894 - RNA, 47 nt, Mus musculus
ucagugguccucugggugaguggaagcagcuuggagggcuugugggu

SEQ ID NO: 57895 - RNA, 42 nt, Mus musculus
aucauacccccacuaccaccaccaccaccaccaccaccacuu

SEQ ID NO: 57896 - RNA, 46 nt, Mus musculus
gugaguuacaggacagccaggaauauacagagaaacccugucaaga

SEQ ID NO: 57897 - RNA, 42 nt, Mus musculus
auacuccucgggcucuagaaagucaucugcuaccccgagguc

SEQ ID NO: 57898 - RNA, 42 nt, Mus musculus
accggaugccugaucauuuuucagauccacauuagccaggga

SEQ ID NO: 57899 - RNA, 63 nt, Mus musculus
cuaucguuugugcgggcagugccaggugaugcgguacuagagagugccgcgggugacagaaua

SEQ ID NO: 57900 - RNA, 47 nt, Mus musculus
gcgccugguggaaaggaaaaagaaagcagggucuggagaugcuggca

SEQ ID NO: 57901 - RNA, 48 nt, Mus musculus
uuugucuuagagguacagaaggcccggauaaaggucagagacaggaga

SEQ ID NO: 57902 - RNA, 92 nt, Mus musculus
ggguuaggaguauuuguccagaagugggacaaaugacuguuucuagauagagaggagacagaugugacccauaggcaaauggcggcuuauag

SEQ ID NO: 57903 - RNA, 73 nt, Mus musculus
ccagacuucaaugcuuugauagcugggccuucauaguaagugucaggaggaggaauuggccaaauaaaggaau

SEQ ID NO: 57904 - RNA, 44 nt, Mus musculus
caccaugcuggagcuggcaaagucccuucagaaagugugaauaa

SEQ ID NO: 57905 - RNA, 45 nt, Mus musculus
aauacuguugguguuuacugauccuuuauaguccuuauacagcca

SEQ ID NO: 57906 - RNA, 46 nt, Mus musculus
auaacuugcuaucacaagugcuguuaaucuacucacucagcaacag

SEQ ID NO: 57907 - RNA, 48 nt, Mus musculus
auugacuucuaaacauuaauguugcacaaggaagaaccugggagaagg

SEQ ID NO: 57908 - RNA, 45 nt, Mus musculus
uuuaucauacaggucuuuuauuugcuuaguuagaguuacuccaag

SEQ ID NO: 57909 - RNA, 45 nt, Mus musculus
aaaugugcuggaaauggcaguaggggccuguaaggggagcaguga

SEQ ID NO: 57910 - RNA, 43 nt, Mus musculus
uggaacaauacaaagggcccuggacuguggagagugaggcaau

SEQ ID NO: 57911 - RNA, 46 nt, Mus musculus
uaaaagcaauggcauugaagaguuuuccuucagagaaauccagcag

SEQ ID NO: 57912 - RNA, 46 nt, Mus musculus
ugacaaagucuucaguuauacuucuucuuuagcauaucaucggcag

SEQ ID NO: 57913 - RNA, 46 nt, Mus musculus
aguguucguucaaaccuaacucaccaucagguaauccauacuggag

SEQ ID NO: 57914 - RNA, 46 nt, Mus musculus
acuugugucaugcaugugaggcccuaaguucaauguucagcagcac

SEQ ID NO: 57915 - RNA, 45 nt, Mus musculus
gggugaaagagccucuuaauauugucccauuaaagagagggccac

SEQ ID NO: 57916 - RNA, 45 nt, Mus musculus
cauucuguaguagugacuuagucuaugaagggcaaacccaaacua

SEQ ID NO: 57917 - RNA, 30 nt, Mus musculus
acaggcauuugguuguuaugagaggucuua

SEQ ID NO: 57918 - RNA, 41 nt, Mus musculus
aguuuggguaugugaacacaguauauggcucuuuuugggua

SEQ ID NO: 57919 - RNA, 46 nt, Mus musculus
agauuggugguugucuuuuucuuuaaaaauauuuacuuguauuuau

SEQ ID NO: 57920 - RNA, 70 nt, Mus musculus
aagaaaagguuuaccaacuugagcgguaucgaguagaggcaggcauggaucgaaagugugacagugauau

SEQ ID NO: 57921 - RNA, 45 nt, Mus musculus
guggcugcugcagagcagaaaaagagagaggagcaccagaggugg

SEQ ID NO: 57922 - RNA, 47 nt, Mus musculus
uuccagaagagacuacaggaguccaaacagaaggaugaggaugauga

SEQ ID NO: 57923 - RNA, 59 nt, Mus musculus
gagcaaaugaggaguggucccugaaacgucaguggcccuggaugucgugacugcuaaag

SEQ ID NO: 57924 - RNA, 40 nt, Mus musculus
aagugagcuaaaagcaaaucuucagcagacccagaagaga

SEQ ID NO: 57925 - RNA, 45 nt, Mus musculus
uguaaaucacagacccuugaaggcugucaggccauuguuguggga

SEQ ID NO: 57926 - RNA, 45 nt, Mus musculus
auauaaaugacaugaaacaaauauuauaaacaagacuaagaggag

SEQ ID NO: 57927 - RNA, 45 nt, Mus musculus
ugcguacaccacuguacuagagagagagagagagagagagagaga

SEQ ID NO: 57928 - RNA, 42 nt, Mus musculus
caggguccuaccagauauaguucuggucuagacuggcugcaa

SEQ ID NO: 57929 - RNA, 45 nt, Mus musculus
cgcccagaaauagaggauggaagaugugguacauuggcugggugu

SEQ ID NO: 57930 - RNA, 27 nt, Mus musculus
cugagcugggguugggguugaggggua

SEQ ID NO: 57931 - RNA, 41 nt, Mus musculus
gcaguuuagcagcuggcagaggcagcagcgggggauggggg

SEQ ID NO: 57932 - RNA, 46 nt, Mus musculus
aguccugagagucucucacuacccaggucucugauacauucuggag

SEQ ID NO: 57933 - RNA, 42 nt, Mus musculus
cuaaagaccacaaucuggcuauucauuguuauucaaagagaa

SEQ ID NO: 57934 - RNA, 45 nt, Mus musculus
uaguagccaaaaucugggagggcaagugaaugagcaggacaacag

SEQ ID NO: 57935 - RNA, 46 nt, Mus musculus
cucuuagaagacauugugacucauuagaccugaauauggggaguua

SEQ ID NO: 57936 - RNA, 46 nt, Mus musculus
gugugacagauccuuugcccacugugcaucauuaagauggcaucag

SEQ ID NO: 57937 - RNA, 46 nt, Mus musculus
acucuuaaaacucaucauaaaauucauaccagagagaaaccuuaca

SEQ ID NO: 57938 - RNA, 46 nt, Mus musculus
acauaucagagaguucauacuggaaagagaccguauagauguacag

SEQ ID NO: 57939 - RNA, 45 nt, Mus musculus
guucucaaaucuuagaguccaucagcgaguucauacuggagagag

SEQ ID NO: 57940 - RNA, 46 nt, Mus musculus
guggauaucaagucuuagaagacaucagaaaauucauacuggagag

SEQ ID NO: 57941 - RNA, 46 nt, Mus musculus
ucuuugaugagggaagaagccuacauuuauuuguugguacaaggaa

SEQ ID NO: 57942 - RNA, 45 nt, Mus musculus
ggccuugaacacagaguuccccuguuccugccuucugagugcuug

SEQ ID NO: 57943 - RNA, 64 nt, Mus musculus
cacagagaccuccugagugccugaauuaaaggcauaugccaccacugcccagcucauaagguuc

SEQ ID NO: 57944 - RNA, 54 nt, Mus musculus
ugauaguuacgcaagguaaaggcucaacuaacuugauagaaaugugcuaauaag

SEQ ID NO: 57945 - RNA, 45 nt, Mus musculus
aauaacuuuccaaaaauaauauuuuauauggcugcauauguguca

SEQ ID NO: 57946 - RNA, 45 nt, Mus musculus
aauuuauuugaccaaaauguagaaaaagugauacuauuacguaug

SEQ ID NO: 57947 - RNA, 94 nt, Mus musculus
cugccucuuccagauucugcagggcuauggccagcugcuccugagccagguccaguuccuccuccagcaguuggaugcagcgguugagagcggc

SEQ ID NO: 57948 - RNA, 45 nt, Mus musculus
gacaauuucuuuacccgaaaagacagucuuaauguccaccagaga

SEQ ID NO: 57949 - RNA, 42 nt, Mus musculus
caggaugucgacuaagcauuuuagaauagagucaggugagac

SEQ ID NO: 57950 - RNA, 45 nt, Mus musculus
uguagcuuuucaaauacauggucacugacaucacggagcaauaua

SEQ ID NO: 57951 - RNA, 27 nt, Mus musculus
uacuccuuucuucuauuuuuuuuuaau

SEQ ID NO: 57952 - RNA, 45 nt, Mus musculus
gaaggucuagaauggucugugcuuucucaaaauucuaccuguagu

SEQ ID NO: 57953 - RNA, 41 nt, Mus musculus
guagcaaagggaucauggauauuuuggagguauugggguag

SEQ ID NO: 57954 - RNA, 32 nt, Mus musculus
cguguguuggaauuuggaugagaaaugccuug

SEQ ID NO: 57955 - RNA, 47 nt, Mus musculus
uuuaucuagccgaaauaauuagccaauacaaaugugucaagcugcaa

SEQ ID NO: 57956 - RNA, 41 nt, Mus musculus
gccagggccaagaagccggaauggguggguaggggagcagg

SEQ ID NO: 57957 - RNA, 46 nt, Mus musculus
uugguccugugcaggcucaaugacccaggguaggggaaugcuaggg

SEQ ID NO: 57958 - RNA, 45 nt, Mus musculus
aaauaaggcuauuuuuuaaucugauguugauuucccuuuggaguu

SEQ ID NO: 57959 - RNA, 46 nt, Mus musculus
caauaccaacccuaaugaaaacaaauuaguaccaggauugugagau

SEQ ID NO: 57960 - RNA, 41 nt, Mus musculus
gcuugaucaggaccccagaggcagcuugacuuccaggagcu

SEQ ID NO: 57961 - RNA, 46 nt, Mus musculus
uaaaccuaucuuagaauuccuuagagaaaucauacaggaggcaaac

SEQ ID NO: 57962 - RNA, 46 nt, Mus musculus
gucacuuugggcaugaccuuuaacacacucaucauagcggccugga

SEQ ID NO: 57963 - RNA, 42 nt, Mus musculus
gcaaaaagcagucuuagaagucaucagagaauucaugcagga

SEQ ID NO: 57964 - RNA, 45 nt, Mus musculus
ucaaaaaugcagucuuguuauucauaugagaauucauacaggaga

SEQ ID NO: 57965 - RNA, 46 nt, Mus musculus
uaucuacuacucgcaaauuagaaaacaucagagaagucacacagga

SEQ ID NO: 57966 - RNA, 45 nt, Mus musculus
ggagucccagugccugagcaauauacauagguauuugaagcagau

SEQ ID NO: 57967 - RNA, 45 nt, Mus musculus
aguuggaagauauauguauguuguuacagcacuuagaugugagaa

SEQ ID NO: 57968 - RNA, 37 nt, Mus musculus
cugauuuuuggugcauauuuucaucuguuuagagugu

SEQ ID NO: 57969 - RNA, 46 nt, Mus musculus
gacuugaccuuucuuauggaauuuuuauaauuuuugaaguugagaa

SEQ ID NO: 57970 - RNA, 46 nt, Mus musculus
ucccacauggaggcugacagacauccauaacuuaauuuccagagag

SEQ ID NO: 57971 - RNA, 46 nt, Mus musculus
uuguaguccugucugucuuugaacuguagaauuuccaaucucugau

SEQ ID NO: 57972 - RNA, 45 nt, Mus musculus
uauguugggugaccagaaggaggaaagggcuagcaaguuuggggu

SEQ ID NO: 57973 - RNA, 45 nt, Mus musculus
gcucccccuguggcuggaagaugucuuccaaauaaggguacagga

SEQ ID NO: 57974 - RNA, 45 nt, Mus musculus
aacuacuuggaugaugggauaggcuuucccuuaaaggccucccug

SEQ ID NO: 57975 - RNA, 44 nt, Mus musculus
ccaagcuccuggcauucuagaugcuccuccccaaagccacacug

SEQ ID NO: 57976 - RNA, 47 nt, Mus musculus
cauguucccagagacaguugccuuacaccacagagcccccaacucca

SEQ ID NO: 57977 - RNA, 48 nt, Mus musculus
aucugggguguguuuuccacauggugaggauacucccaagaucuggag

SEQ ID NO: 57978 - RNA, 46 nt, Mus musculus
auucaccaacauagauggaagaaccgcagccugguggcccuggaau

SEQ ID NO: 57979 - RNA, 46 nt, Mus musculus
gucucauccuuugcugccaucaguugcuggguaaagccucucagau

SEQ ID NO: 57980 - RNA, 49 nt, Mus musculus
aguacuuugacucaggagacuacaacauggccaaagccaagaugaagaa

SEQ ID NO: 57981 - RNA, 46 nt, Mus musculus
gacuguggauuugcacauaucuagacacugauaucacugagcaaua

SEQ ID NO: 57982 - RNA, 46 nt, Mus musculus
ugucaguacuccugguagaacaguucucucugagaagaauuuaggu

SEQ ID NO: 57983 - RNA, 46 nt, Mus musculus
ugaaggucugaaagaauucugcacuaaaaccaucuggcccuggguu

SEQ ID NO: 57984 - RNA, 25 nt, Mus musculus
cuucucauuugauuguuccccucua

SEQ ID NO: 57985 - RNA, 45 nt, Mus musculus
uaauuugugguucuuugucuucuauagccaaugaagucucuuaga

SEQ ID NO: 57986 - RNA, 45 nt, Mus musculus
aucacaaaaaugcucacugaacauagggaguaguguuguagguag

SEQ ID NO: 57987 - RNA, 41 nt, Mus musculus
caaccaugggaguccguuugugagcucaaugacaagacaga

SEQ ID NO: 57988 - RNA, 45 nt, Mus musculus
cacuuaagggauuaccuagaugguagggugagaacauugguuggg

SEQ ID NO: 57989 - RNA, 46 nt, Mus musculus
ggcaacacuagggagcauggucuuguugggguugauagguacaaag

SEQ ID NO: 57990 - RNA, 46 nt, Mus musculus
gaauguguaucagaugccuuaauauagucaugcaaacgagggugaa

SEQ ID NO: 57991 - RNA, 46 nt, Mus musculus
augagugggagggaccagucuuuauggggcagggauaguaugaaga

SEQ ID NO: 57992 - RNA, 42 nt, Mus musculus
ugacuguugcuuccuguuauuuuuguuguuagagguggaacu

SEQ ID NO: 57993 - RNA, 42 nt, Mus musculus
cgucccuggaacuucccaggucagaggagcugcggggcagga

SEQ ID NO: 57994 - RNA, 46 nt, Mus musculus
agccuaugucuuuuuauuggggaguugagaccauugauguuaagag

SEQ ID NO: 57995 - RNA, 45 nt, Mus musculus
cugugguuuagguaucagaguaauaguggcuucauauaaugaguu

SEQ ID NO: 57996 - RNA, 46 nt, Mus musculus
ucaucagaggaauggauacuuuccccuaucuuaucaacccccuaca

SEQ ID NO: 57997 - RNA, 42 nt, Mus musculus
aaaucauugugagaacuuccuucauuggaaagccugggagaa

SEQ ID NO: 57998 - RNA, 42 nt, Mus musculus
guaaugaagggcuuugaggcaauuggagacaauggggcauua

SEQ ID NO: 57999 - RNA, 46 nt, Mus musculus
uuuguggugguuagagcaaguuggauuuccaccgauacugucaguu

SEQ ID NO: 58000 - RNA, 46 nt, Mus musculus
uucgaaugagaauaugcuagcuaugugucaaagucacgucacauau

SEQ ID NO: 58001 - RNA, 46 nt, Mus musculus
ugugugauaaaguuaauuuuaugugaacuuuugccuguuugaugau

SEQ ID NO: 58002 - RNA, 45 nt, Mus musculus
uagugauggaguuucaaucgaucuuugaguaggagugguggagau

SEQ ID NO: 58003 - RNA, 46 nt, Mus musculus
uccucaaauaauucauaaugaggacaaaauggagaagccagaagaa

SEQ ID NO: 58004 - RNA, 46 nt, Mus musculus
gacaaaucuuuuaccaggacaaacuaucuuagaacuugacagagau

SEQ ID NO: 58005 - RNA, 46 nt, Mus musculus
gugacaaauccuuuacuagcagcucauaugucagaauacaucagag

SEQ ID NO: 58006 - RNA, 46 nt, Mus musculus
ccggaaagaccaccuuagaauucaucagagaauucauacaggagag

SEQ ID NO: 58007 - RNA, 45 nt, Mus musculus
agucaucagagaauucauucagaaaagaagccuuacaaaugcagu

SEQ ID NO: 58008 - RNA, 46 nt, Mus musculus
cauccucaggacuuaaaauacaucagagaauucauacuggagagag

SEQ ID NO: 58009 - RNA, 46 nt, Mus musculus
gguuuuuggaaaugcagauuuuaaguagagaaagaacuguugguug

SEQ ID NO: 58010 - RNA, 47 nt, Mus musculus
gggauugcuuuaaguuucucuccauuuaauuugauauuugcuguugg

SEQ ID NO: 58011 - RNA, 48 nt, Mus musculus
cuuguagacaggacagauuuuuggucaaagguuuuauggguguguuag

SEQ ID NO: 58012 - RNA, 88 nt, Mus musculus
ccuccuucagcuccaucuaauguuuggcuaugauucucugccucaguuuccaucaguugcuagguggaagccucucagaggaccguca

SEQ ID NO: 58013 - RNA, 42 nt, Mus musculus
auuuggcuaugacuccagucccugcaagagaagcuuccagua

SEQ ID NO: 58014 - RNA, 54 nt, Mus musculus
uucuauucagaaacagugaguacccuuuugcccuagagagauuacuccagcccc

SEQ ID NO: 58015 - RNA, 46 nt, Mus musculus
aucugcauuuuuuaugugcacuguauuuauuuaugaagcccauuga

SEQ ID NO: 58016 - RNA, 85 nt, Mus musculus
acuuuguucucuucuuaucuuucggagguggaaggcuacccuacuccauguuuuuccuuucccuguagcuauguuuuauauaggu

SEQ ID NO: 58017 - RNA, 47 nt, Mus musculus
cuucaauucugauucauucauguaugacuuuccauagcccugcauaa

SEQ ID NO: 58018 - RNA, 67 nt, Mus musculus
cuccuuuaggcagaucuccuaagguuugcuuuaggaaaggagaauuccguauagucccguccucaga

SEQ ID NO: 58019 - RNA, 75 nt, Mus musculus
uuugggcauugaaguaaagccagcuuuguaugaugacuuucuaguguuccucuucuuuguguuuuagguaauaau

SEQ ID NO: 58020 - RNA, 44 nt, Mus musculus
ccagugaaucaacuaagaacccuggauggugaagagagaggaga

SEQ ID NO: 58021 - RNA, 45 nt, Mus musculus
gggcugcucagccugagccucaaccagcagccagcagccccagag

SEQ ID NO: 58022 - RNA, 45 nt, Mus musculus
ugucugcuggccagggcuguugugucaaucacuggcaacugagcg

SEQ ID NO: 58023 - RNA, 44 nt, Mus musculus
aggucuguggagggggcccagcccucacccucuggcaccucagg

SEQ ID NO: 58024 - RNA, 48 nt, Mus musculus
uccguauagccaaagagguccagaccaucgaagucuacaagcaugagg

SEQ ID NO: 58025 - RNA, 42 nt, Mus musculus
uuuccuuaccccaaagccguacagcuccauccucaccgccag

SEQ ID NO: 58026 - RNA, 46 nt, Mus musculus
ugagguauugucuggcggugaggauggagcuguacggcuuuggggu

SEQ ID NO: 58027 - RNA, 42 nt, Mus musculus
gcaauggauguagucuguguggccccggagggcccgcugcag

SEQ ID NO: 58028 - RNA, 44 nt, Mus musculus
ccccaguuuccagauccauacugugcagcugacaaucuccccca

SEQ ID NO: 58029 - RNA, 46 nt, Mus musculus
ggccagagaggguuccuggugagaaccuuuuucugagggguggggg

SEQ ID NO: 58030 - RNA, 46 nt, Mus musculus
gaaacccugucucaaaaugugugugugugugugugugugugugugu

SEQ ID NO: 58031 - RNA, 42 nt, Mus musculus
cagaacuauccagccacgccggauccccucccccaccgcgcc

SEQ ID NO: 58032 - RNA, 42 nt, Mus musculus
guucccugggggaaagacuggagaagaauagaggcagggaug

SEQ ID NO: 58033 - RNA, 46 nt, Mus musculus
ugagugguggcagggcuucgggaaaagucacaggggggcugcagua

SEQ ID NO: 58034 - RNA, 46 nt, Mus musculus
ggcagugccaccuccuaccagguccaggucgccuggagccaaagau

SEQ ID NO: 58035 - RNA, 41 nt, Mus musculus
uguugucagaaagaagauagggagggacacaggccaucaau

SEQ ID NO: 58036 - RNA, 46 nt, Mus musculus
ucucccaaggggggugauauuuauuguggggauaauguuuggaggg

SEQ ID NO: 58037 - RNA, 45 nt, Mus musculus
ccucaaucugggucacaaagcgacccauacuaaggaacugcagca

SEQ ID NO: 58038 - RNA, 48 nt, Mus musculus
gaggaggguuguagacguaggauauaggaaaucagggaagacugacug

SEQ ID NO: 58039 - RNA, 42 nt, Mus musculus
cacguuauucgagccgacugacccugaccucagcccccagaa

SEQ ID NO: 58040 - RNA, 47 nt, Mus musculus
ucaaaagugagagccagaguagagagagaacguauauuugagggcag

SEQ ID NO: 58041 - RNA, 45 nt, Mus musculus
gacuggacguccgcagacaaagcugaccgagcacucgguaaguag

SEQ ID NO: 58042 - RNA, 45 nt, Mus musculus
cuacacagcccccucaaccucaucauggccucuacuggucugcaa

SEQ ID NO: 58043 - RNA, 40 nt, Mus musculus
cucaaaaacccgccugccucugccucccgagugcugggau

SEQ ID NO: 58044 - RNA, 41 nt, Mus musculus
gaagcugggggucaggcuccagcaucauggcgaggacagaa

SEQ ID NO: 58045 - RNA, 46 nt, Mus musculus
aggaauaugaugaguucaaggacaacaguaaucuauacaguaaguu

SEQ ID NO: 58046 - RNA, 44 nt, Mus musculus
ggccuggaggcugcagccaacuggcaggaugcaccagcccgugc

SEQ ID NO: 58047 - RNA, 41 nt, Mus musculus
cgcauuacuuuuuauuagacacggaaguuucaggggagagg

SEQ ID NO: 58048 - RNA, 46 nt, Mus musculus
cucugacaguugaguccugccaacuuaccaagccuccagcccagaa

SEQ ID NO: 58049 - RNA, 42 nt, Mus musculus
ucgucuccuggacugggcuagcucgccgccgcaccugcaguu

SEQ ID NO: 58050 - RNA, 45 nt, Mus musculus
uucccagcgcugcagcuccacugagaaggaagcccaggcgcagag

SEQ ID NO: 58051 - RNA, 46 nt, Mus musculus
acacagguuuaaguugggaaagaacgcagggugccaagucugccag

SEQ ID NO: 58052 - RNA, 45 nt, Mus musculus
gcagaagaggcccagggagaagacagguaaagaagagaggcccag

SEQ ID NO: 58053 - RNA, 46 nt, Mus musculus
agccccagcuagccccaguggcucugucucuuccuguugccuguag

SEQ ID NO: 58054 - RNA, 41 nt, Mus musculus
cuggccuccacagguaccaagcacagacucaauggacagca

SEQ ID NO: 58055 - RNA, 26 nt, Mus musculus
gaugggcuccuagaagaagaggcaca

SEQ ID NO: 58056 - RNA, 42 nt, Mus musculus
gagcugggcggccuuccccuguggcgcuuuuuccuguccagg

SEQ ID NO: 58057 - RNA, 42 nt, Mus musculus
aucugucggcuugggucucucuuuaucccuggccgggaccag

SEQ ID NO: 58058 - RNA, 44 nt, Mus musculus
gcucacaaccauccguaauaagaucuggcgccuucuucuggaau

SEQ ID NO: 58059 - RNA, 34 nt, Mus musculus
gcuacauagaaaaacccugucuugaaacaaacaa

SEQ ID NO: 58060 - RNA, 45 nt, Mus musculus
aaggaaugaauuagaacacagccuaaauagaucugcgucauguga

SEQ ID NO: 58061 - RNA, 83 nt, Mus musculus
aaggaagaugggcgaauguguggucccggauuuagagguguuaagaucgguacaggagucgaguggguugauggagagaucag

SEQ ID NO: 58062 - RNA, 24 nt, Mus musculus
cggcggcugagccacccgauccuu

SEQ ID NO: 58063 - RNA, 42 nt, Mus musculus
ggcggcuucaggcuccgagggauacgaaaacuuaagcagcag

SEQ ID NO: 58064 - RNA, 46 nt, Mus musculus
uuucggaggccaggauuuaaaccguucguccucguuaguaucagag

SEQ ID NO: 58065 - RNA, 45 nt, Mus musculus
gucuuaaaaagugaggauaauaaaaccgcgaaaguauucagccug

SEQ ID NO: 58066 - RNA, 68 nt, Mus musculus
aggccuggauguauacuguagcuuguauguuucauggugccuaugcagucaguagugucucagcucug

SEQ ID NO: 58067 - RNA, 61 nt, Mus musculus
aguucucuguauuuuuuacucagcguccuuuuccuugaucauugcuguucucucggucgcu

SEQ ID NO: 58068 - RNA, 46 nt, Mus musculus
guugugguuucccuuuuaguguuucaagcauuguuuuuggcugcug

SEQ ID NO: 58069 - RNA, 84 nt, Mus musculus
ugugggaggauuuuugugugaaauggugaaaauaugagugguuagaaggacuguuaggugagaaagcaauauaagcccuagauu

SEQ ID NO: 58070 - RNA, 44 nt, Mus musculus
aaaucuaagaaaugcaaaaccuuuuuuacagcccccccccucua

SEQ ID NO: 58071 - RNA, 46 nt, Mus musculus
gauuuaccuuucuugcuuuuaguuuccucuuguguuaacuguugag

SEQ ID NO: 58072 - RNA, 41 nt, Mus musculus
cccccccccccccgcacuuuggugacauguccccaucccca

SEQ ID NO: 58073 - RNA, 42 nt, Mus musculus
acaaccauggcuacaaaaaaaaaaaauccuagucuggggaug

SEQ ID NO: 58074 - RNA, 45 nt, Mus musculus
aauacaguccaaaaaacuggagcuugagaguuuagugaugcugag

SEQ ID NO: 58075 - RNA, 49 nt, Mus musculus
uuugaacauuucuagguauuuguagagaaaguaugaggacaguuggaac

SEQ ID NO: 58076 - RNA, 46 nt, Mus musculus
auacuucacuuggggaagcuuauacuucacauggggaaggugagcc

SEQ ID NO: 58077 - RNA, 46 nt, Mus musculus
cuacagguaaccaaauccuccaaauaccauaacacacaccauggau

SEQ ID NO: 58078 - RNA, 46 nt, Mus musculus
caugguguguguuaugguauuuggaggauuugguuaccuguaguag

SEQ ID NO: 58079 - RNA, 46 nt, Mus musculus
guucucucaaaucucuucacacuaucccuuuacuguuuggccacaa

SEQ ID NO: 58080 - RNA, 47 nt, Mus musculus
gcuuagaauuugaaaguacauugugaggacuuguaaguagaugcuga

SEQ ID NO: 58081 - RNA, 69 nt, Mus musculus
uguuguacuaagggcuaaguaagagagccagggaugugggagaugugguaaguaguuagauuggagcca

SEQ ID NO: 58082 - RNA, 45 nt, Mus musculus
cccuggugcggggccgccguggugagcggccugacuacaagggag

SEQ ID NO: 58083 - RNA, 48 nt, Mus musculus
cacgagcgcaagcggcgcguggagcugcgaugccucgagcuggaggaa

SEQ ID NO: 58084 - RNA, 75 nt, Mus musculus
gguggggagauuccaagcacugagugcuuaguuuggguguuaggugggauguguggaaagaaacuagagcuggug

SEQ ID NO: 58085 - RNA, 46 nt, Mus musculus
uuaauucuccagaaaguuuccuugacaucccacuaugcacugaccc

SEQ ID NO: 58086 - RNA, 50 nt, Mus musculus
aacaugaaugaacaaaagcaugcugugugggaaaggagcauaagguagaa

SEQ ID NO: 58087 - RNA, 45 nt, Mus musculus
uagguggauugaaggauuguggcuguggaaguggcaaaggcagaa

SEQ ID NO: 58088 - RNA, 50 nt, Mus musculus
ggauaccacugcucaaaguuugaaaaccacugcucuaaacaguuuucugc

SEQ ID NO: 58089 - RNA, 58 nt, Mus musculus
aguggauuuuaaacaugcuacacaauucaggugccaagagaggagggcuugcuggugg

SEQ ID NO: 58090 - RNA, 68 nt, Mus musculus
uguguagcauguuuaaaauccacuguucuagagagcauaguguagagaaggaaggagugucguggaga

SEQ ID NO: 58091 - RNA, 62 nt, Mus musculus
aagaugaggaaaacuuaggaacaauuugagugacagugaguacaaaauauugugugcaugga

SEQ ID NO: 58092 - RNA, 58 nt, Mus musculus
acagcaaauucaggaaaaaguggcgaccuuucgacucauguugcuggaaaaggaugug

SEQ ID NO: 58093 - RNA, 42 nt, Mus musculus
uauguggauggcaguucuuuugauccucagagacgugcucga

SEQ ID NO: 58094 - RNA, 42 nt, Mus musculus
aacuaccuacugcagagcaagguggccucaacucacagagau

SEQ ID NO: 58095 - RNA, 57 nt, Mus musculus
gagaccagcaguucucgcucaccaacuccaaagcaaaagaagaagaaaaagaagaaa

SEQ ID NO: 58096 - RNA, 42 nt, Mus musculus
uaggucuccuacuccaaagagcaaacgcaaaucaaaggacaa

SEQ ID NO: 58097 - RNA, 41 nt, Mus musculus
gagagagagggagagagggagagagggagagagagggagga

SEQ ID NO: 58098 - RNA, 46 nt, Mus musculus
aucauucccucucccuccauuccucauggaccaccccuuaccgacu

SEQ ID NO: 58099 - RNA, 46 nt, Mus musculus
ucccugcccucuaggagcugacaggcuaaagcaacaggauggacag

SEQ ID NO: 58100 - RNA, 45 nt, Mus musculus
uuuauuuuauuuuauuuuuauuuuuuguuuguuacgauguauaug

SEQ ID NO: 58101 - RNA, 42 nt, Mus musculus
cuuugcccagucaaggcuguuguaugaauuuuagcagcagca

SEQ ID NO: 58102 - RNA, 54 nt, Mus musculus
auacaacaaccuaguagcccagcucccucuacaaagcaaucuagcaguccuuau

SEQ ID NO: 58103 - RNA, 45 nt, Mus musculus
acaagcagcuauagaaagcaguuacauguguggggguguauguga

SEQ ID NO: 58104 - RNA, 44 nt, Mus musculus
guaguucuggcccugugcugcuccuuuccggagaggggcuaggu

SEQ ID NO: 58105 - RNA, 57 nt, Mus musculus
aagccucagaugagggguuaacuggcuccugacuggacgggauugcugcaagggguc

SEQ ID NO: 58106 - RNA, 45 nt, Mus musculus
ccugagaaaccuccccagucuacuuccucagaaaguugcccacca

SEQ ID NO: 58107 - RNA, 50 nt, Mus musculus
agaagaaaucucucgacgggacccaggagcugguguggguuuaagacuuu

SEQ ID NO: 58108 - RNA, 52 nt, Mus musculus
cgcucgcauggcagagcaaagcgggauaaaucucauucucauaccccaucuc

SEQ ID NO: 58109 - RNA, 54 nt, Mus musculus
cugaggggaccgggaccuggagugaccucucuugguggggguucuagaucgaga

SEQ ID NO: 58110 - RNA, 69 nt, Mus musculus
ccuugaacggccacgccucuggggacuucuagauuuuccccaccucugugcagaucuugaccuucucca

SEQ ID NO: 58111 - RNA, 98 nt, Mus musculus
ucaagaucugcacagagguggggaaaaucuagaaguccccagaggcguggccguucaaggucuccucagaggccagguugguccaggagcagaaauac

SEQ ID NO: 58112 - RNA, 73 nt, Mus musculus
ccagagaagaggcaggucuaggucagcaaggcgaggcagaucacauucuagaucuccagcuacuaggggcaga

SEQ ID NO: 58113 - RNA, 45 nt, Mus musculus
gguguucuggaccgagaccuaccccuucuagcugguguucuagau

SEQ ID NO: 58114 - RNA, 55 nt, Mus musculus
gagaaguggcaggucaagaucuagaacaccagccaggagagggaggucccggucu

SEQ ID NO: 58115 - RNA, 72 nt, Mus musculus
cgugaccucccucuccuggcuggcguucuagaccgagaucgagcgcuucuucuggcuggcguucuagaccgg

SEQ ID NO: 58116 - RNA, 46 nt, Mus musculus
ucuagagugagaucuuccacgucucacaagacuucuacuucgagau

SEQ ID NO: 58117 - RNA, 65 nt, Mus musculus
gucuugugagacguggaagaucucacucuagaacaccacaaagaagaggacgaucuggcucaucc

SEQ ID NO: 58118 - RNA, 49 nt, Mus musculus
cagauccaacucaagcccagaaaugaaaaaaucucacguuuccucaaga

SEQ ID NO: 58119 - RNA, 46 nt, Mus musculus
uuguuuaggacauggagaggaaccugaaaggcuucgccucaaagau

SEQ ID NO: 58120 - RNA, 50 nt, Mus musculus
cguucugguucuucaccaccuaaacaaaagucaaaaacaccaccaagaca

SEQ ID NO: 58121 - RNA, 46 nt, Mus musculus
cagaauggcucugucucugugguguugcagugcauucaucagccug

SEQ ID NO: 58122 - RNA, 46 nt, Mus musculus
uucuccucgagugaaaucuagcacaccuccaagacagagcccaucu

SEQ ID NO: 58123 - RNA, 46 nt, Mus musculus
ugauaucacugucuucacuuuggguuguggagaugacgaccuagau

SEQ ID NO: 58124 - RNA, 46 nt, Mus musculus
ggggcaaggagauauugaucugcuuuuccucugagguguccuagau

SEQ ID NO: 58125 - RNA, 62 nt, Mus musculus
cuaguagagugacaucuaggacaccucagaggaaaagcagaucaauaucuccuugccccaag

SEQ ID NO: 58126 - RNA, 46 nt, Mus musculus
aucugguggagucuggagcaugcuuuuuagauauggagauguagau

SEQ ID NO: 58127 - RNA, 45 nt, Mus musculus
ggaucuacaucuccauaucuaaaaagcaugcuccagacuccacca

SEQ ID NO: 58128 - RNA, 46 nt, Mus musculus
uacuacuagguguuacaccuggacagaggugaaaagauccagagcu

SEQ ID NO: 58129 - RNA, 45 nt, Mus musculus
ucuggaucuuuucaccucuguccagguguaacaccuaguaguaua

SEQ ID NO: 58130 - RNA, 74 nt, Mus musculus
aaaucccaaacaucuccuaaggguagccuuuccagaucuucaucuccagucacugagcugacagccagaucacc

SEQ ID NO: 58131 - RNA, 45 nt, Mus musculus
uuuuacuggugaucuggcugucagcucagugacuggagaugaaga

SEQ ID NO: 58132 - RNA, 45 nt, Mus musculus
acucuaggugugacuuucaguacuguggaagacucaggccuaucc

SEQ ID NO: 58133 - RNA, 46 nt, Mus musculus
uugaaggcugugacuggcuuuggucaagagcagacaauacagcagg

SEQ ID NO: 58134 - RNA, 62 nt, Mus musculus
acuacuucuggggauaacucagaacugcuucgccuggaagaccuugacuguucuuucauguc

SEQ ID NO: 58135 - RNA, 46 nt, Mus musculus
gaaggagucccagacccaucucuaaguccuggagaagacccagacc

SEQ ID NO: 58136 - RNA, 49 nt, Mus musculus
ccuggaggggguuugagguguaucuuucaucccaggagaggacccagau

SEQ ID NO: 58137 - RNA, 69 nt, Mus musculus
uccagaaccaaaagcauugccucagacuccuagagcccgaagucauucuccaucauccccagagcgcaa

SEQ ID NO: 58138 - RNA, 46 nt, Mus musculus
aucuccagagguugacagcaaaucucgacacucacccaggcucagu

SEQ ID NO: 58139 - RNA, 47 nt, Mus musculus
cccugaaggaagcaguaguucugagucuucuccagaacacgccccca

SEQ ID NO: 58140 - RNA, 56 nt, Mus musculus
aggcuagagucucucguagaagccggucugccuccucaucaccagaaauccgcucc

SEQ ID NO: 58141 - RNA, 65 nt, Mus musculus
ucguggacuccaaagaucccgaucccgcucacggagagagaaaaccagaacaacccgacgcagag

SEQ ID NO: 58142 - RNA, 52 nt, Mus musculus
gaaugguaaccagagccaccccuccgucuccgaguaacucgugaucuagacc

SEQ ID NO: 58143 - RNA, 46 nt, Mus musculus
ucggagacggagggguggcucugguuaccauucaagaucaccuacc

SEQ ID NO: 58144 - RNA, 88 nt, Mus musculus
uguucuggaccuggaccgccgaugaguagcuggugaggcucgagaucuagagcgcuuccaaggagcuggugauguucuugaucgagau

SEQ ID NO: 58145 - RNA, 47 nt, Mus musculus
ugaccuugaccgucuccuacucacaggugagguccgagaucuggacc

SEQ ID NO: 58146 - RNA, 47 nt, Mus musculus
gagcauccccagugagucgaaggcgauccagguccagaacaccacca

SEQ ID NO: 58147 - RNA, 77 nt, Mus musculus
gaucuugaacgacgacgaguuacuggugguguucuggaccuggaucgccuucgacucacuggggaugcucuugaucg

SEQ ID NO: 58148 - RNA, 26 nt, Mus musculus
agaacuucaccuguuacuagaagaag

SEQ ID NO: 58149 - RNA, 46 nt, Mus musculus
cagugguguccgagaccuagaucgucuucgaauugcuggcggaguu

SEQ ID NO: 58150 - RNA, 46 nt, Mus musculus
gcuuuagccguccuagcaugucaccaacuccucuugaccgauguag

SEQ ID NO: 58151 - RNA, 46 nt, Mus musculus
augaucuugggugaucaggaauccgaggaccuggaccauccaucau

SEQ ID NO: 58152 - RNA, 46 nt, Mus musculus
auugcacuugccuugacagccaucagucuugguacugcccggccac

SEQ ID NO: 58153 - RNA, 44 nt, Mus musculus
cuggggcuguucuaaggcucaugagagguacaggugcuggaacc

SEQ ID NO: 58154 - RNA, 45 nt, Mus musculus
ccagcccuagaacagcaguggcuccuucagcugugaaccuugcag

SEQ ID NO: 58155 - RNA, 46 nt, Mus musculus
ccuccaacugcugcaaauuaccccuccaguuccagaacaccccagg

SEQ ID NO: 58156 - RNA, 42 nt, Mus musculus
gccugggguguucuggaacuggagggguaauuugcagcaguu

SEQ ID NO: 58157 - RNA, 45 nt, Mus musculus
uuuaaugcuugaucgagccagguccagaacaccaccaucugcccc

SEQ ID NO: 58158 - RNA, 42 nt, Mus musculus
ugcgaagaagccugaaccauucuugaagcaggggaaggagcc

SEQ ID NO: 58159 - RNA, 41 nt, Mus musculus
guugcagagcagccaauguagaaggcugcugggccccagua

SEQ ID NO: 58160 - RNA, 76 nt, Mus musculus
ccuccucuucaucaucuucaucgucauccuccucuuccucuggcuccaguucuagugauucagaggguuccagccu

SEQ ID NO: 58161 - RNA, 49 nt, Mus musculus
gagcuggaaggcuggaacccucugaaucacuagaacuggagccagagga

SEQ ID NO: 58162 - RNA, 42 nt, Mus musculus
gcugggaguagaaagaauguugggcgggggcuuuguggggag

SEQ ID NO: 58163 - RNA, 50 nt, Mus musculus
ggacagaacuagaggaaauggacuuaauuuuacagcaggagggauggcag

SEQ ID NO: 58164 - RNA, 97 nt, Mus musculus
gccccaccccagucccaaaggaggcuauuagagagggacguccucaggaaccaaccccggccaaaaggaagaggcgcucuagcagcuccaguuccag

SEQ ID NO: 58165 - RNA, 60 nt, Mus musculus
gaagaagaggaggaggaagaugaggaggaggaggaagaggaagaagaggaagaggaggag

SEQ ID NO: 58166 - RNA, 57 nt, Mus musculus
ucuucuuccuccucuucuuccuccucuuccuccucccccuccccugcuaagccuggc

SEQ ID NO: 58167 - RNA, 48 nt, Mus musculus
ggguaaugccugagggccaggcuuagcaggggagggggaggaggaaga

SEQ ID NO: 58168 - RNA, 54 nt, Mus musculus
ccucaggcauuacccaaaccugcaagccccaagaagccacccccuggcgagagg

SEQ ID NO: 58169 - RNA, 46 nt, Mus musculus
acagacguccacacgaggcaccccagcaggaaccucacccaggguc

SEQ ID NO: 58170 - RNA, 45 nt, Mus musculus
ggaaguaaccagaugugcguuuuagaaagaucccucuggcuacgu

SEQ ID NO: 58171 - RNA, 46 nt, Mus musculus
aauagacucccuucgggauucccgaucccucaguuacucacccguu

SEQ ID NO: 58172 - RNA, 46 nt, Mus musculus
cagucacucuccuggucacaagaggaaggagacaccuaguccccgu

SEQ ID NO: 58173 - RNA, 27 nt, Mus musculus
ugccuucccuugaaccuuggcagcauc

SEQ ID NO: 58174 - RNA, 28 nt, Mus musculus
aaaaaaaaagggugggugggagaggacg

SEQ ID NO: 58175 - RNA, 44 nt, Mus musculus
gagucuagggagggaggggcacagcucaggacaucuaggccuca

SEQ ID NO: 58176 - RNA, 46 nt, Mus musculus
uguaaucuuuccugaaagaggaaggagcugaaguugguuggcccug

SEQ ID NO: 58177 - RNA, 45 nt, Mus musculus
acaguaaaagcaacuuuuucugucaaauaaaaaugagaaaugcag

SEQ ID NO: 58178 - RNA, 73 nt, Mus musculus
ugucuaccugauugacuuuucuguucccucuuguucacagaacucuuaaccccaaguaaagacuacagaccaa

SEQ ID NO: 58179 - RNA, 45 nt, Mus musculus
augaacaagcugugcagugagggccuaggccuacccccuagagac

SEQ ID NO: 58180 - RNA, 33 nt, Mus musculus
acaccuucgaagcucuccgcaucgagcccuuuu

SEQ ID NO: 58181 - RNA, 46 nt, Mus musculus
gagguugauacuugccagacaagcacaaagcuggggguuggggguc

SEQ ID NO: 58182 - RNA, 46 nt, Mus musculus
auaccucccaggauauuuaucgugauaaaaggauauuugcagcaag

SEQ ID NO: 58183 - RNA, 29 nt, Mus musculus
aggccccagccacagugggccuggccuuc

SEQ ID NO: 58184 - RNA, 47 nt, Mus musculus
uccggcgccacaagaccaccaucuuuacggacgccaaggagucgagc

SEQ ID NO: 58185 - RNA, 45 nt, Mus musculus
caggaggacccuuggucugcaacauggauggucucugguaucaga

SEQ ID NO: 58186 - RNA, 46 nt, Mus musculus
ucaucugugagaaaucauuuauagccuuuaauuacccagccuauaa

SEQ ID NO: 58187 - RNA, 45 nt, Mus musculus
gugugugugugugcacaugugugcauaugugugcucaccugagug

SEQ ID NO: 58188 - RNA, 46 nt, Mus musculus
ugacaguguaaucauaaacauaaacauguuuauaaacauccuauug

SEQ ID NO: 58189 - RNA, 45 nt, Mus musculus
ggcucuaucuugagucuguuuaacaguguaugagauuccugggau

SEQ ID NO: 58190 - RNA, 45 nt, Mus musculus
guuucucuggccuguaguuagggagaguacaggaaggaucccaga

SEQ ID NO: 58191 - RNA, 46 nt, Mus musculus
ccuagcuggcuuagugcuuuuaugaaagagcagggaaguuuugggu

SEQ ID NO: 58192 - RNA, 44 nt, Mus musculus
gcaccagcccaggugcugggugaccggcuggggaguccuucagg

SEQ ID NO: 58193 - RNA, 46 nt, Mus musculus
ugguugguugguugguugguugguugauugguugguugguuuugag

SEQ ID NO: 58194 - RNA, 42 nt, Mus musculus
accagacugggggucaugggggaguaugggaaacucggaggu

SEQ ID NO: 58195 - RNA, 58 nt, Mus musculus
uggagcagcuccugucucccaacuauauaguaaucauuaguagacuguugccuugugg

SEQ ID NO: 58196 - RNA, 45 nt, Mus musculus
caguguccuagugcccauugucugucgcccccgccuugccccuac

SEQ ID NO: 58197 - RNA, 89 nt, Mus musculus
cugauccucaucuuugcggaggugcuuggccucuacggucucaucguggcccuaauccucuccacaaaguaguccuuuuccaccaucag

SEQ ID NO: 58198 - RNA, 46 nt, Mus musculus
aucaucgccaucuacggccuggugguggcaguacuuaucgcuaacu

SEQ ID NO: 58199 - RNA, 46 nt, Mus musculus
uccugcaacuccaaauuucuccacaguucuuuuucugcacccagcu

SEQ ID NO: 58200 - RNA, 62 nt, Mus musculus
aauuuuugucacucauucauaaauuaauccagcaaaucuuucuugaguccauacuguuuccc

SEQ ID NO: 58201 - RNA, 44 nt, Mus musculus
aggagcacuuuaguggauggcugcuggggaucugggcuuugagg

SEQ ID NO: 58202 - RNA, 43 nt, Mus musculus
ggggguggggcggcaguguggcugccaucuuaguccugggaag

SEQ ID NO: 58203 - RNA, 42 nt, Mus musculus
ccugcuugcagacauggcugacaucaagaacaaccccgaaua

SEQ ID NO: 58204 - RNA, 46 nt, Mus musculus
uagaggaggccuuaaccuuaccgaccaaucauuagccaccccaaga

SEQ ID NO: 58205 - RNA, 46 nt, Mus musculus
auggacuucuuggacugagaagugucucccagaacagaacccagaa

SEQ ID NO: 58206 - RNA, 42 nt, Mus musculus
aaaauagccuuuaucacaagggacacgaagugugcaugagag

SEQ ID NO: 58207 - RNA, 46 nt, Mus musculus
cauaaccaucuuuaaugggaucugaugcccucuucuggugugucug

SEQ ID NO: 58208 - RNA, 47 nt, Mus musculus
cuguucucuuccuccuuccccucccccucucccugccccauuacuca

SEQ ID NO: 58209 - RNA, 46 nt, Mus musculus
uucuuccgucuguuaaaaccacacaaaugucagucacaugccaauc

SEQ ID NO: 58210 - RNA, 41 nt, Mus musculus
ugggugagcaugucaccaggagaggggagucggggugccug

SEQ ID NO: 58211 - RNA, 85 nt, Mus musculus
ccaagaucccagcccauacacgcuaugcccugcaaugccgcuucagcccugauuccacgugcguguacgguccugggggaaaggg

SEQ ID NO: 58212 - RNA, 45 nt, Mus musculus
auuacaucagagagcuagccuugccuugaggcuagggggccagac

SEQ ID NO: 58213 - RNA, 45 nt, Mus musculus
cugugggcaggcuauucugcaaucaguuagucuuagugcaagagg

SEQ ID NO: 58214 - RNA, 46 nt, Mus musculus
aacccuuccccauuuuucuucugacuccauuuuugcagguaugaac

SEQ ID NO: 58215 - RNA, 46 nt, Mus musculus
cuccuacaugaaauaaacugcacacgcacaucuggcccguggaguu

SEQ ID NO: 58216 - RNA, 42 nt, Mus musculus
cguccugggagaacacccucagcucuguccuuaggcacaguc

SEQ ID NO: 58217 - RNA, 45 nt, Mus musculus
uucuggguauguugauuuugcuagcugaauguauuacggguagag

SEQ ID NO: 58218 - RNA, 30 nt, Mus musculus
caugcaauagcagaguucugaggucccagg

SEQ ID NO: 58219 - RNA, 46 nt, Mus musculus
cccgcucagccccuucuccucagacaucaacaacaugccccugcaa

SEQ ID NO: 58220 - RNA, 46 nt, Mus musculus
gugccuuuguuaacccagggcugggcagaaaucuuaguccgcagac

SEQ ID NO: 58221 - RNA, 45 nt, Mus musculus
aagcccgagaagcccccugcaggagcccagcuuccaacagcagag

SEQ ID NO: 58222 - RNA, 41 nt, Mus musculus
cgugcccauuaucccucaccuaccucucaguuugccccagu

SEQ ID NO: 58223 - RNA, 46 nt, Mus musculus
auccuagcacacaugugaggcagacaaaggaagcaccggccaaacu

SEQ ID NO: 58224 - RNA, 45 nt, Mus musculus
guacacggucgcugcugggccuggacucuggggaccugcagggug

SEQ ID NO: 58225 - RNA, 44 nt, Mus musculus
ggagaguuccuccuggcaggggguaggaccaaaaccuggcuggu

SEQ ID NO: 58226 - RNA, 60 nt, Mus musculus
ggagcucacagaaacaugucuggacaugauggcccgauauguguucuccaauuucacugc

SEQ ID NO: 58227 - RNA, 63 nt, Mus musculus
aggugacucggcaugguccuucccuuaguccugaccucaaaccuaggcaugguuucucccucu

SEQ ID NO: 58228 - RNA, 44 nt, Mus musculus
ggugggcauggccaggguggaaaggcaaugcugugagggccaca

SEQ ID NO: 58229 - RNA, 49 nt, Mus musculus
gcuaacagcauuaauaucuuaucacaacuauuuggacaagaccagacag

SEQ ID NO: 58230 - RNA, 45 nt, Mus musculus
gagcuagucugaggaagauguaaguuguacugagaagauggagga

SEQ ID NO: 58231 - RNA, 24 nt, Mus musculus
cauguccucucuguggcuguggcc

SEQ ID NO: 58232 - RNA, 44 nt, Mus musculus
agguggacggacacuccugucuuaggagcaucuaccaggugagu

SEQ ID NO: 58233 - RNA, 41 nt, Mus musculus
cgugagauucagcccuuacugccucugugacugcauguaug

SEQ ID NO: 58234 - RNA, 45 nt, Mus musculus
uucagguagcggagccucuauuauccccuugucuccagggcacug

SEQ ID NO: 58235 - RNA, 45 nt, Mus musculus
gucauaugagauuguucuguccauaacaagacucaucaagaagua

SEQ ID NO: 58236 - RNA, 32 nt, Mus musculus
ccaggaggauaggugaguguguaugugccagg

SEQ ID NO: 58237 - RNA, 42 nt, Mus musculus
ccaggaggacaggugagugcaugugugugugccaggaggaca

SEQ ID NO: 58238 - RNA, 46 nt, Mus musculus
gagugcaugugugccaggggacaggugaguguguuaugugccagga

SEQ ID NO: 58239 - RNA, 46 nt, Mus musculus; identical to SEQ ID NO: 58238

SEQ ID NO: 58240 - RNA, 45 nt, Mus musculus
uggugaaugcggccucaacaaucgcauccgaaugauagggcagau

SEQ ID NO: 58241 - RNA, 45 nt, Mus musculus
acagcccaggcaugaacucaggggugcggauggugacucgcaguc

SEQ ID NO: 58242 - RNA, 43 nt, Mus musculus
acggagaacacagaaaacgcauguggccuaugaagcggcuaau

SEQ ID NO: 58243 - RNA, 27 nt, Mus musculus
cagacaaccgccauccugcagcagcgc

SEQ ID NO: 58244 - RNA, 45 nt, Mus musculus
cagaaagcucuagaaugggugaggcaaauugaugucgugguggag

SEQ ID NO: 58245 - RNA, 25 nt, Mus musculus
cuuguuggcacugaagaacagugag

SEQ ID NO: 58246 - RNA, 42 nt, Mus musculus
agcggaugggagcagggauuggaacacagcuggagccacccu

SEQ ID NO: 58247 - RNA, 44 nt, Mus musculus
agguggaccaagaagaugaccaagaccccagaagagacacguaa

SEQ ID NO: 58248 - RNA, 66 nt, Mus musculus
gaucuugcuaugaccaccgcagcacccaguggacaagacaaggguucauggggucauggguugguu

SEQ ID NO: 58249 - RNA, 79 nt, Mus musculus
ucuggguggugugugaccacccuccagucugcugaggcuuggggagcucuggagaggcccaagguccgagcaggaagag

SEQ ID NO: 58250 - RNA, 46 nt, Mus musculus
cucgagccuucuccuuggccucagcugcugugggacucagguggag

SEQ ID NO: 58251 - RNA, 42 nt, Mus musculus
guagagcuuucgagcauagccacgucugucccaucacaccaa

SEQ ID NO: 58252 - RNA, 46 nt, Mus musculus
accagcagcauagagagcgguuacugcaguagguaaagagcccuaa

SEQ ID NO: 58253 - RNA, 44 nt, Mus musculus
agccugggagugaagagauggcuucucuagcacaugccaccaca

SEQ ID NO: 58254 - RNA, 28 nt, Mus musculus
uccucugagauccaggagugaaggcuua

SEQ ID NO: 58255 - RNA, 44 nt, Mus musculus
agcacgcagcucccgccgccccgcuccggcgcugccaccgccuc

SEQ ID NO: 58256 - RNA, 44 nt, Mus musculus
gcauguaugcauguuuuccagaagaugauguuggauuccccuag

SEQ ID NO: 58257 - RNA, 46 nt, Mus musculus
uuggcagcuucagggaguuuccucggacugcucuugugccugccuu

SEQ ID NO: 58258 - RNA, 46 nt, Mus musculus
uucaaaauacccuccugggcuaagccuagaccucacuggugaccuu

SEQ ID NO: 58259 - RNA, 42 nt, Mus musculus
gauguagggcaguagcaaagaggcagcugggcaagggcuuga

SEQ ID NO: 58260 - RNA, 41 nt, Mus musculus
agcaguucacccaugccuuccgcaccgagaucgaccucaag

SEQ ID NO: 58261 - RNA, 45 nt, Mus musculus
gcagauugaccuucaguuuagcuuugcaccacggcacucacgccg

SEQ ID NO: 58262 - RNA, 45 nt, Mus musculus
guggucuggacagcaguucuuuuguccuauugguugacccgggaa

SEQ ID NO: 58263 - RNA, 42 nt, Mus musculus
acuccuguggucaguacauagccugucacuuucccgggucaa

SEQ ID NO: 58264 - RNA, 45 nt, Mus musculus
cuugcuguugagcagccacagaggcccggauagcagcugccacuu

SEQ ID NO: 58265 - RNA, 45 nt, Mus musculus
guggcagcugcuauccgggccucuguggcugcucaacagcaagag

SEQ ID NO: 58266 - RNA, 48 nt, Mus musculus
guaugaucagggggcaacaguggggaugauguggccccaggcuucuca

SEQ ID NO: 58267 - RNA, 46 nt, Mus musculus
caccgugguacucuugaagggcacaccaccuccacccccaccccca

SEQ ID NO: 58268 - RNA, 42 nt, Mus musculus
uagagaagccaggggguggcuugcugaugggaggcaccaggc

SEQ ID NO: 58269 - RNA, 33 nt, Mus musculus
ugcagucgugagaagccucccaacuccagaucu

SEQ ID NO: 58270 - RNA, 45 nt, Mus musculus
ccagucccucccuagucuaucuucuauccccuuuuaaggcccaga

SEQ ID NO: 58271 - RNA, 44 nt, Mus musculus
cagcgguuccgccuaggcaccgauaugucucucuuugccacaga

SEQ ID NO: 58272 - RNA, 34 nt, Mus musculus
ugcugcucugcagguguuuucuauugcgguguuc

SEQ ID NO: 58273 - RNA, 41 nt, Mus musculus
acuaauaaugaaaaucuaaaaauuaugcuagacaugucaaa

SEQ ID NO: 58274 - RNA, 50 nt, Mus musculus
uaguaugagguucaaggugaaaagaucagaauacugagaguagagugcca

SEQ ID NO: 58275 - RNA, 42 nt, Mus musculus
uuccaccaaaccgcugucucguuucugggaguggggcaagaa

SEQ ID NO: 58276 - RNA, 46 nt, Mus musculus
gaguuuguagugugcagagccggaugggugagagggaguugugugg

SEQ ID NO: 58277 - RNA, 46 nt, Mus musculus
ccugaacaaguccucagccaccuugcugagcugugauaaucgcaag

SEQ ID NO: 58278 - RNA, 45 nt, Mus musculus
uggugugcacuuggacaccuggcaugggacacugacauucuucaa

SEQ ID NO: 58279 - RNA, 46 nt, Mus musculus
ccccuauccaccucugcugcgagccaugauccucgcugaacggcag

SEQ ID NO: 58280 - RNA, 41 nt, Mus musculus
ggacucgaaugcgccccugggacuacccugcaaaacaggag

SEQ ID NO: 58281 - RNA, 45 nt, Mus musculus
ucgucauagcagugaaugaggcgcucgaacucgcgguagauggag

SEQ ID NO: 58282 - RNA, 46 nt, Mus musculus
acuguuuaugagcagggucaagaagucuaaagcuuucuaaaggcag

SEQ ID NO: 58283 - RNA, 46 nt, Mus musculus
uugucuuuaagaguuucuguuugugugugucuccuccagcccacag

SEQ ID NO: 58284 - RNA, 45 nt, Mus musculus
acacaaggacaagaaagacccuggaacccuucuguuaauggccca

SEQ ID NO: 58285 - RNA, 45 nt, Mus musculus
auugaaccucagcuuccuccugaacagguggagguauaggccccc

SEQ ID NO: 58286 - RNA, 97 nt, Mus musculus
guggcagugacuggggacccaaauaugucacuggucuuccccccugguggauucaaacguugucgaguuugcacaggagucgauucaucaaagaucc

SEQ ID NO: 58287 - RNA, 47 nt, Mus musculus
ggugugaucuuugccagcugcagauaguuuaaaucugggacucuaga

SEQ ID NO: 58288 - RNA, 45 nt, Mus musculus
uauuaggcuugcuugaagaaauaccuucuucuggacuuccgaaaa

SEQ ID NO: 58289 - RNA, 45 nt, Mus musculus
uugccagcuuggcuguccgcgcccuggaacaugucggccgccgcc

SEQ ID NO: 58290 - RNA, 42 nt, Mus musculus
ccuuggaugccccuaacccagguagaccaacacagcccggag

SEQ ID NO: 58291 - RNA, 45 nt, Mus musculus
acaaacaaacaaacaaaacaacaacagcaacaacaacagggccag

SEQ ID NO: 58292 - RNA, 44 nt, Mus musculus
gguuuuccugugucgccauggauaccuuggaacuugcucuguag

SEQ ID NO: 58293 - RNA, 42 nt, Mus musculus
uaacccuagauuaucuggcugauaauagucaucggaggcuag

SEQ ID NO: 58294 - RNA, 42 nt, Mus musculus
uggaggugauguuucuacaagccuuuucaaagggacggccag

SEQ ID NO: 58295 - RNA, 42 nt, Mus musculus
gcugagcgggucccccccgcagacagagaaaccaacccacua

SEQ ID NO: 58296 - RNA, 80 nt, Mus musculus
ugacuggaguuaccuggucuccgaguugggaagugacacccggggugcuuuuaaaaaaggaggguaccgggccauggcag

SEQ ID NO: 58297 - RNA, 42 nt, Mus musculus
acgcuguuugucuuuuuagguaucuaaaggaguuuaggacag

SEQ ID NO: 58298 - RNA, 45 nt, Mus musculus
caggcagucauggugccgggaaggagcugaguguucuacauccag

SEQ ID NO: 58299 - RNA, 45 nt, Mus musculus
gguuuucgauguguguuucagauucgggcugagcacuuugcggag

SEQ ID NO: 58300 - RNA, 46 nt, Mus musculus
ugggugcugauaaguuguggcuuauuguaacacuauagguuugggg

SEQ ID NO: 58301 - RNA, 44 nt, Mus musculus
ugaacucaagaccagccuaggcuagauacuaaaacuguuucaua

SEQ ID NO: 58302 - RNA, 45 nt, Mus musculus
guugugagccaccaugugguugcugggauuugaacuuugggccuu

SEQ ID NO: 58303 - RNA, 42 nt, Mus musculus
augugucucacacuuucuccucaugcauugauacggaggcug

SEQ ID NO: 58304 - RNA, 47 nt, Mus musculus
gcuuuauuguagaaaggcagggggaaagagagaagguagggagugag

SEQ ID NO: 58305 - RNA, 47 nt, Mus musculus
cuagugcaggggcuguugucaugcccucccugagccuuuugaguggg

SEQ ID NO: 58306 - RNA, 42 nt, Mus musculus
caguuugugugacauugacguaguccugagguugcugggcag

SEQ ID NO: 58307 - RNA, 45 nt, Mus musculus
guuuauaguaagggcgugucuuaaagcuuaaaaauaaagggcuag

SEQ ID NO: 58308 - RNA, 46 nt, Mus musculus
uuuauuuauuauauguaaguacacuguagcugacuucagacacccc

SEQ ID NO: 58309 - RNA, 45 nt, Mus musculus
cugaugggugugagccaucauaugguugcugggauuugaacucag

SEQ ID NO: 58310 - RNA, 46 nt, Mus musculus
agguauguacauuccuagugguacugaacuuaggugaagucuggag

SEQ ID NO: 58311 - RNA, 46 nt, Mus musculus
gauucuuugacacuagaaaaugaggcuaggugagaaauggaacuag

SEQ ID NO: 58312 - RNA, 45 nt, Mus musculus
acacagccuuuucuacuuuagaagaaaucucuuccucaucaucag

SEQ ID NO: 58313 - RNA, 46 nt, Mus musculus
uaaaccugggucauugagcuaccccuccaucccccaaugccuauau

SEQ ID NO: 58314 - RNA, 46 nt, Mus musculus
ugucuccacccaauagccaaccugacccauaagcucccaaccccau

SEQ ID NO: 58315 - RNA, 42 nt, Mus musculus
gcccguguggcagacagugaccggcagcuggcccugcagagg

SEQ ID NO: 58316 - RNA, 72 nt, Mus musculus
gcucugacgagccaugcgacaaccacugaaacccagaaucuuguguuuauuaugcacaucagagacagccug

SEQ ID NO: 58317 - RNA, 46 nt, Mus musculus
uaaugaaaaacacagcaaaagagucagacauucagaggaguccaag

SEQ ID NO: 58318 - RNA, 44 nt, Mus musculus
auuuuaaaggaaauggaucuucaacauuccacagcuagcccacu

SEQ ID NO: 58319 - RNA, 41 nt, Mus musculus
cugaagaggugggcgcugcgcugcguggugaguuuggagca

SEQ ID NO: 58320 - RNA, 46 nt, Mus musculus
uccuccggccuugcggguguggccuuuugaacaaggccugguggug

SEQ ID NO: 58321 - RNA, 42 nt, Mus musculus
gugaugagugugaggaaccaggaccuggugcuaauggaggag

SEQ ID NO: 58322 - RNA, 48 nt, Mus musculus
aaugcuggccaacuuuggaucugaggcucauaagcaacagcccagguu

SEQ ID NO: 58323 - RNA, 42 nt, Mus musculus
acucugcucagaggaccucugcucuauuuccauuggggugag

SEQ ID NO: 58324 - RNA, 46 nt, Mus musculus
uccaaauggcccaucagugcccacaccaccuguucuaugcccacag

SEQ ID NO: 58325 - RNA, 46 nt, Mus musculus
acagccagggcuacacagagaaacccugucuccaaaaaccaaagca

SEQ ID NO: 58326 - RNA, 45 nt, Mus musculus
cuuuuaaaagauacaaacucagaaacucaauagcagaggguccag

SEQ ID NO: 58327 - RNA, 42 nt, Mus musculus
gagguuaggaacacuaacuguucuuccagaggaucggggcuc

SEQ ID NO: 58328 - RNA, 46 nt, Mus musculus
ugaccugccuugaacucuggugggaugaaagaugccacccccaccc

SEQ ID NO: 58329 - RNA, 44 nt, Mus musculus
ccagccauaccuugcaugaaucucagcuggcccaugagccccuc

SEQ ID NO: 58330 - RNA, 72 nt, Mus musculus
ccuggcuuccgugguguuccugucuuugugaacaugugugagcauuucuacugguaguucuacagaacagug

SEQ ID NO: 58331 - RNA, 46 nt, Mus musculus
ggauagucaucuuugaaaagcauccguagcuugaacaagccuccuu

SEQ ID NO: 58332 - RNA, 45 nt, Mus musculus
cccuuggagcaaguguagcauuacaccccucaaccggccccucag

SEQ ID NO: 58333 - RNA, 34 nt, Mus musculus
gaagccgcacagggguuucagguggaacuaaggu

SEQ ID NO: 58334 - RNA, 45 nt, Mus musculus
gucccacaagguaaaacagagaggcaguuucaauagcuuccacuc

SEQ ID NO: 58335 - RNA, 46 nt, Mus musculus
ccaagacccacuguauacuguuggaagucagcuccacccagggccc

SEQ ID NO: 58336 - RNA, 45 nt, Mus musculus
ccccacccuacaugcaaauugcagacaaauccucccagccccgag

SEQ ID NO: 58337 - RNA, 41 nt, Mus musculus
cuuggggauuccauccucaauccacuugagaagccugugag

SEQ ID NO: 58338 - RNA, 42 nt, Mus musculus
uuggacguguggucaucaggaaaguggcagucccgagcagag

SEQ ID NO: 58339 - RNA, 46 nt, Mus musculus
cugguaggugaggggcuuucgggcagguaguucagggaagcggcag

SEQ ID NO: 58340 - RNA, 41 nt, Mus musculus
ccugcuggcugcuggggaaagugauucguggcacauggcug

SEQ ID NO: 58341 - RNA, 46 nt, Mus musculus
ggaugucauugucggucuucucacagagggcaaccagugcacccgg

SEQ ID NO: 58342 - RNA, 42 nt, Mus musculus
acguccccccaacucugcccuccaggcuggugcagcggcucc

SEQ ID NO: 58343 - RNA, 41 nt, Mus musculus
gcacauguggucgcaaggcaugcaggguauugcgugguaga

SEQ ID NO: 58344 - RNA, 42 nt, Mus musculus
auugguugcuaaggaugauguugggacucugagucagcacaa

SEQ ID NO: 58345 - RNA, 62 nt, Mus musculus
ugcaggccccauggucaaacgacccagguuggacguggugaagaagcugaacuuugagccag

SEQ ID NO: 58346 - RNA, 45 nt, Mus musculus
aaacugauccucagaauuccccgacuuuaagugcucaguccccaa

SEQ ID NO: 58347 - RNA, 44 nt, Mus musculus
cccugcccugcagggucgccaggaaaugucaaccgcaauacuag

SEQ ID NO: 58348 - RNA, 46 nt, Mus musculus
ggcagucaaagcuucacagagagaaaagaaagaaagaaaaaaagaa

SEQ ID NO: 58349 - RNA, 46 nt, Mus musculus
cugcuuacccagucuucuuuuuuaaaggauggaucccuugcuaguc

SEQ ID NO: 58350 - RNA, 46 nt, Mus musculus
aggggucaggcguacaggccuccacgcgcucugccuguguggggau

SEQ ID NO: 58351 - RNA, 23 nt, Mus musculus
acuguggggcccugggggauccu

SEQ ID NO: 58352 - RNA, 45 nt, Mus musculus
gccuagacguggccugagggccgggcugggagccauugggagaag

SEQ ID NO: 58353 - RNA, 46 nt, Mus musculus
acugcaaaucccucccacaggaaggaguuuguggugucaccuccca

SEQ ID NO: 58354 - RNA, 42 nt, Mus musculus
gacagcacagcacuguuugcguugacucgggugggggauuag

SEQ ID NO: 58355 - RNA, 41 nt, Mus musculus
uccuaacuaccaccgggcuaucuggccucgugcaacugcaa

SEQ ID NO: 58356 - RNA, 41 nt, Mus musculus
ugcacgcccgcccuccaccaugccacagccgccgccaucac

SEQ ID NO: 58357 - RNA, 44 nt, Mus musculus
auaugcccucacuggcuuccccacuucauucugcucucugccuc

SEQ ID NO: 58358 - RNA, 79 nt, Mus musculus
uggagcccuccaaaggguaugaggcgccacaggccacugccaaagccauggcccccugaggagcccaacuccccaugcc

SEQ ID NO: 58359 - RNA, 43 nt, Mus musculus
guaucuccuucuuucccccuggccuacagauccuugggcccug

SEQ ID NO: 58360 - RNA, 46 nt, Mus musculus
cagggcuaucaggccuugggaucagcccacccauuugagccccuac

SEQ ID NO: 58361 - RNA, 48 nt, Mus musculus
gaguaaacuaauucccagagagccagagggagagagagagagagagag

SEQ ID NO: 58362 - RNA, 42 nt, Mus musculus
accuuccuuggcuagccagacaggcaacuggcaagcccacug

SEQ ID NO: 58363 - RNA, 46 nt, Mus musculus
aggcaggacauggggccucaauaguccucuacccagccguucucag

SEQ ID NO: 58364 - RNA, 84 nt, Mus musculus
augcaggguucccgcaucagcucaaagcuaaucuugccacacaaguagucagggauaucucgcuucuauagcacaaggggaaaa

SEQ ID NO: 58365 - RNA, 73 nt, Mus musculus
acucuguccaccagggcacucaugucaugcaugggccaacagauccaccaaaggcuggggcacuuuucaugcc

SEQ ID NO: 58366 - RNA, 45 nt, Mus musculus
caggcuaauaaaguugagaaacugcccuuucggguguuggugauu

SEQ ID NO: 58367 - RNA, 45 nt, Mus musculus
ggauggcggcccugccgaugagaguggcccacggccugugcagua

SEQ ID NO: 58368 - RNA, 41 nt, Mus musculus
gaggucugacccagacugcuggaagccugccugguggggau

SEQ ID NO: 58369 - RNA, 42 nt, Mus musculus
ggggacaacacggacaggcuuguggcaauauuugggucagug

SEQ ID NO: 58370 - RNA, 42 nt, Mus musculus
aagaucucuccccagagcaacguggacuuugaccugacccuc

SEQ ID NO: 58371 - RNA, 46 nt, Mus musculus
uucuggaggaacuaggccaggccaguggcuugguccuggagaggau

SEQ ID NO: 58372 - RNA, 45 nt, Mus musculus
uuucacaggggaggaagcuuugaaaaaggcagcuaccucucccag

SEQ ID NO: 58373 - RNA, 42 nt, Mus musculus
uacucaguaggaaugcuaaugagaguugcacaggggccuuga

SEQ ID NO: 58374 - RNA, 46 nt, Mus musculus
cuucgugcucauccaucugaccucggagaccaaccugcugccagau

SEQ ID NO: 58375 - RNA, 46 nt, Mus musculus
ugcagccucccuugggccucccuccccuccuaucccaccccaagua

SEQ ID NO: 58376 - RNA, 76 nt, Mus musculus
cacugaccaggagccacccaggguaccacucuucagccccuucucacccacccuacagaacaacccuguacccaga

SEQ ID NO: 58377 - RNA, 44 nt, Mus musculus
agaagaagaaagagaagaaagaggagaagaagaagaaaaggagc

SEQ ID NO: 58378 - RNA, 46 nt, Mus musculus
guaugugugugaguguguguguaugugugagugugugugugugugu

SEQ ID NO: 58379 - RNA, 42 nt, Mus musculus
agcaagccgagugcuggcuagcuucacacaauugucagaguu

SEQ ID NO: 58380 - RNA, 46 nt, Mus musculus
gggaaaaagaagaauucaccaaaguagcaaaaaccagauacaauuc

SEQ ID NO: 58381 - RNA, 45 nt, Mus musculus
cuauaaaguagcaaagaagaaacaaaaagaaauuagauucugaga

SEQ ID NO: 58382 - RNA, 46 nt, Mus musculus
ugguugugagccaccaugugguugcugggauuugaacucuccggac

SEQ ID NO: 58383 - RNA, 45 nt, Mus musculus
cugcuucaccacaugcuaauuaugcugguguacucugggcuagau

SEQ ID NO: 58384 - RNA, 46 nt, Mus musculus
augguccuuuauaaaauuacccagaggagggccuugugugguagau

SEQ ID NO: 58385 - RNA, 41 nt, Mus musculus
ucaggggugugugugugugugugugugugugugguuacaug

SEQ ID NO: 58386 - RNA, 44 nt, Mus musculus
aggguauagugaaauauugagagccaucgagaaugggaggaggu

SEQ ID NO: 58387 - RNA, 101 nt, Mus musculus
gugcccugaauacagcccagaaggacuauaggagccucaguugagguugccacacaggcagaggggaaaguauagauguggaucucacagaucucaggcac

SEQ ID NO: 58388 - RNA, 46 nt, Mus musculus
gccuacccugaggccccaggauuucuccucuaggaugggcagaguc

SEQ ID NO: 58389 - RNA, 46 nt, Mus musculus
auauauauauauauauguauaauauaucaauacuggagccccgccu

SEQ ID NO: 58390 - RNA, 66 nt, Mus musculus
auuguacauuuuggggaaagccuuguguguaaaucaguguaaacuuggaggagagauuuuucuauc

SEQ ID NO: 58391 - RNA, 44 nt, Mus musculus
ggacccagggccuccaagccacacagcuauucuuuggccagacc

SEQ ID NO: 58392 - RNA, 43 nt, Mus musculus
gggccccuuucugcuaugcgcccuauuaggaagagagagagag

SEQ ID NO: 58393 - RNA, 45 nt, Mus musculus
aggagaucaauuuccgccugcaggacuacauugacaggaucauug

SEQ ID NO: 58394 - RNA, 46 nt, Mus musculus
aaaucccagcaaccacaugguggcucacaaccaucugugauaagau

SEQ ID NO: 58395 - RNA, 31 nt, Mus musculus
uuugcaagcucugccucuccuccgcccacau

SEQ ID NO: 58396 - RNA, 45 nt, Mus musculus
gcuuccuaugucucagguaucgugcuggugguugaugguggaagc

SEQ ID NO: 58397 - RNA, 45 nt, Mus musculus
agcauuuuucaaauccuauuccaagacuugggaccaagacagaga

SEQ ID NO: 58398 - RNA, 45 nt, Mus musculus
ggcauguacugaaauuucuacuuuaaaaaaacaaugggaagagag

SEQ ID NO: 58399 - RNA, 44 nt, Mus musculus
uuuaugaaguuucuucuaguagaacaaagcccugucuauucaga

SEQ ID NO: 58400 - RNA, 46 nt, Mus musculus
ucgagugggaagggcuggaggcugggaguugcgggagggucuguga

SEQ ID NO: 58401 - RNA, 46 nt, Mus musculus; identical to SEQ ID NO: 51045

SEQ ID NO: 58402 - RNA, 68 nt, Mus musculus
ggcuuugaucccuuuaugaaccuugugauugacgaguguguggagauggcaaccagugggcaacagaa

SEQ ID NO: 58403 - RNA, 42 nt, Mus musculus
caaagcccacccucccgagcugaagaaguuuauggacaagaa

SEQ ID NO: 58404 - RNA, 26 nt, Mus musculus
uauaguuugaaaugaaaggcaguguu

SEQ ID NO: 58405 - RNA, 48 nt, Mus musculus
aaaagcagucugcuuuagacuacccauagggauccaggaaucuagaga

SEQ ID NO: 58406 - RNA, 46 nt, Mus musculus
gguucagaggaguugaggugggaggagccuuugcuguggcccugag

SEQ ID NO: 58407 - RNA, 46 nt, Mus musculus
uugaugcuggacaacaccucagucaacaucucccacccugccccug

SEQ ID NO: 58408 - RNA, 42 nt, Mus musculus
gauaagggauuccugugguccccuuccuuuggaaagccguga

SEQ ID NO: 58409 - RNA, 45 nt, Mus musculus
gaauauagaagucaaauccauaggccucaucgaugagauccaggg

SEQ ID NO: 58410 - RNA, 61 nt, Mus musculus
aucccucgcuucagguccaugccaaacuuggagcccagguccuccuuaggggucuggcaga

SEQ ID NO: 58411 - RNA, 45 nt, Mus musculus
acacagagaaacccugucucgaaaaaccaaaaaagaaaggaagaa

SEQ ID NO: 58412 - RNA, 45 nt, Mus musculus
gcauuugguuagccuuccaccucugaaugaaaugaaagguagcag

SEQ ID NO: 58413 - RNA, 45 nt, Mus musculus
aucuugucccagauaguccugagguuggcuuugucuuccugagag

SEQ ID NO: 58414 - RNA, 46 nt, Mus musculus
cggucaagucauuguugugacugcuuaggaacucaguggaacucag

SEQ ID NO: 58415 - RNA, 41 nt, Mus musculus
ccaugagccucucccagaguuauugcauugcuccucccaca

SEQ ID NO: 58416 - RNA, 45 nt, Mus musculus
gugcugaagcgcacguucacugagcccgcgauguggccggcguug

SEQ ID NO: 58417 - RNA, 46 nt, Mus musculus
cuuguguucucuugaugcccuugccaggaugagccgaccaugugug

SEQ ID NO: 58418 - RNA, 42 nt, Mus musculus
accaaguccacccacuuagggggccuggcgcuggaccugggc

SEQ ID NO: 58419 - RNA, 41 nt, Mus musculus
ucuaucaccuucagucuacaggcuuccuuugaaauguccga

SEQ ID NO: 58420 - RNA, 46 nt, Mus musculus
aggguggccgaaaccucugauuaucaucaccauuugauggcugggg

SEQ ID NO: 58421 - RNA, 44 nt, Mus musculus
gcuaucuuuggggaagauaguauggacuagucacuaaguucuca

SEQ ID NO: 58422 - RNA, 45 nt, Mus musculus
gcaggggcuucuuagacgcgggcauguagacaaaugugaguugga

SEQ ID NO: 58423 - RNA, 42 nt, Mus musculus
agggggguuuuaauguuaguuuuuggcccaaguacuaagggg

SEQ ID NO: 58424 - RNA, 42 nt, Mus musculus
ggaggaggagggggagaggaagaggaggaggaagaggaggaa

SEQ ID NO: 58425 - RNA, 97 nt, Mus musculus
aguucucaguguuacacagagaaaucuugucuugaaaaccauaaguaaauaaauuagauaaauaauaaaauaaaaaauaagaauaagaacacccaga

SEQ ID NO: 58426 - RNA, 45 nt, Mus musculus
cauuugucugugcauuugucugucgauuucuaccagaggccagca

SEQ ID NO: 58427 - RNA, 46 nt, Mus musculus
uugaagaucagaugaggcaauaugaguuaagacucaagcucaguag

SEQ ID NO: 58428 - RNA, 45 nt, Mus musculus
uuuuauccagacccagccagacucgcccuucaguuacuucccaag

SEQ ID NO: 58429 - RNA, 46 nt, Mus musculus
gcugagcaggggcagugaaggcccuggaggggugaaaacaguuagg

SEQ ID NO: 58430 - RNA, 47 nt, Mus musculus
gaaaaauuaucgcuuugguuccucgucaggcuccaguccccauucag

SEQ ID NO: 58431 - RNA, 87 nt, Mus musculus
gcauuuguuaaugguguucccuggguggugggcaggauuaagcaagauagaaacaaucaggugucuaaguaguaguaccuggcccag

SEQ ID NO: 58432 - RNA, 41 nt, Mus musculus
cagcgguggagucaggcaguacacauguaacugcaagcaga

SEQ ID NO: 58433 - RNA, 45 nt, Mus musculus
uguguguguauauaugugugugugugugugugugugugugugcac

SEQ ID NO: 58434 - RNA, 46 nt, Mus musculus
uguucauuggcugaaaggcuaagacuaagaaacucccaggugagac

SEQ ID NO: 58435 - RNA, 41 nt, Mus musculus
acccuuuccuccacauucucugaggcagaauggcuaagacu

SEQ ID NO: 58436 - RNA, 41 nt, Mus musculus
ucuagcaugcacuguaaguggaaaguccaccccuggcccug

SEQ ID NO: 58437 - RNA, 42 nt, Mus musculus
uuacuugaacaucuaauaugucauugcaauaccacaggggag

SEQ ID NO: 58438 - RNA, 42 nt, Mus musculus
gugagccacagacccugguaaggaguccgaugauugccagga

SEQ ID NO: 58439 - RNA, 45 nt, Mus musculus
acauacguuuaucauuuuaaaguguguguguguguaugugugugu

SEQ ID NO: 58440 - RNA, 46 nt, Mus musculus
aaaauggggcacaagguaauauuuugauaaacugucagauuaccag

SEQ ID NO: 58441 - RNA, 98 nt, Mus musculus
gaacagcaggacuucuguuaucuguaucuuccucucuauuggccagcaucccugguccccauccacgaguguucaacauagcccagcccccguaucca

SEQ ID NO: 58442 - RNA, 41 nt, Mus musculus
cgacgggccacauagaaccacgggguccugugugagggugc

SEQ ID NO: 58443 - RNA, 75 nt, Mus musculus
ugaggugggugcacuguuugggggugcuguguuucuagggggaaugugaaguaguuuugagcacugagacucuga

SEQ ID NO: 58444 - RNA, 45 nt, Mus musculus
ucccgcugaauaauggagccggcugccgcuucgagggccaguuca

SEQ ID NO: 58445 - RNA, 45 nt, Mus musculus
gauaauagagucagacagugaagcggaugcuucgguggggcugca

SEQ ID NO: 58446 - RNA, 46 nt, Mus musculus
uucuccagcucagcgugugcuagugugacucagaccccuguggugg

SEQ ID NO: 58447 - RNA, 66 nt, Mus musculus
gguucccggcaacuuccauguguccacacacagugccacagcgcagccacagaacccggacaugac

SEQ ID NO: 58448 - RNA, 24 nt, Mus musculus
uggggagcagggaauuggguuugu

SEQ ID NO: 58449 - RNA, 41 nt, Mus musculus
agguccagaauguucacggggcuuucaaugcucuuggggga

SEQ ID NO: 58450 - RNA, 45 nt, Mus musculus
ucagaccgaguucaaagcccacuuuccucuuccacgucacccuca

SEQ ID NO: 58451 - RNA, 54 nt, Mus musculus
cauuaucccugccaucugguuccgcuaugaccucagccccaucacagucaagua

SEQ ID NO: 58452 - RNA, 45 nt, Mus musculus
uacauauggccaaguacuccugcaucuaaaguaaaaacaacagag

SEQ ID NO: 58453 - RNA, 63 nt, Mus musculus
aaggggucuuuuggagagcugugugcagggcagguggacggaauggggcagaaugagggggaa

SEQ ID NO: 58454 - RNA, 63 nt, Mus musculus
ggucucacacucaggucucuaaagucgguucuacagggugagagggauaggaaagcaggcagu

SEQ ID NO: 58455 - RNA, 64 nt, Mus musculus
ugcaggauauuugcuguggaaggcccucauagaaaaaccaagaaaacaaauacaauaggcuuag

SEQ ID NO: 58456 - RNA, 46 nt, Mus musculus
gcaaauggacuuucacaauuuagcuaguacagcugcuccuccaugu

SEQ ID NO: 58457 - RNA, 46 nt, Mus musculus
cugggcauguaacacaugccuuucaucccaacacuuugaaagcaga

SEQ ID NO: 58458 - RNA, 46 nt, Mus musculus
gaacauuguccugcaguggagaaauggugguuacagacaugccuuu

SEQ ID NO: 58459 - RNA, 46 nt, Mus musculus
caacacaaaucaaaggcuuuaugcuauucauuuagauggggcauuu

SEQ ID NO: 58460 - RNA, 46 nt, Mus musculus
uucacugucgccggcauucuggacuccuguaucuucacagccucag

SEQ ID NO: 58461 - RNA, 46 nt, Mus musculus
agcuaccucucuccccauguuuuagauaaauuaacacugccuggag

SEQ ID NO: 58462 - RNA, 45 nt, Mus musculus
acagauaagcuuucagacaggcuuugacaaucuuuaagcccccau

SEQ ID NO: 58463 - RNA, 42 nt, Mus musculus
uuuauaugaguugauucuuauuguguauguaaacugccccug

SEQ ID NO: 58464 - RNA, 45 nt, Mus musculus
cgccucuggccuguuguucuuguaaagguauucuuaaggggacau

SEQ ID NO: 58465 - RNA, 42 nt, Mus musculus
uugguggucuguguuccagacagguggcaucccaggguagau

SEQ ID NO: 58466 - RNA, 46 nt, Mus musculus
uacaguagcaaguuccuuucccugaugagccauccccuccaccccc

SEQ ID NO: 58467 - RNA, 45 nt, Mus musculus
ucugggaacuuuucagaagguguauaaaugccagggccccaagag

SEQ ID NO: 58468 - RNA, 42 nt, Mus musculus
cucgcagaaaccauugggccucucuggcuuuacucagcacag

SEQ ID NO: 58469 - RNA, 42 nt, Mus musculus
ugccgacauuccccuugucccaguuucauuucagggagggag

SEQ ID NO: 58470 - RNA, 46 nt, Mus musculus
agggcccugggggaggggucucacguccccuggggaaacgauggag

SEQ ID NO: 58471 - RNA, 42 nt, Mus musculus
agagcuaugagggcagcagcggcuacaacuuccggcccacag

SEQ ID NO: 58472 - RNA, 46 nt, Mus musculus
gcuuuugagauaauuuuuuaagacuauuuaaccccugggauuagag

SEQ ID NO: 58473 - RNA, 42 nt, Mus musculus
gauuccagacuguaugacuguaauaaagauaaauaaaccuag

SEQ ID NO: 58474 - RNA, 43 nt, Mus musculus
gggugcucugugucuggaaauaaacugugcaaugcccccaaca

SEQ ID NO: 58475 - RNA, 58 nt, Mus musculus
uuuuucucugucuugcacaacauaggggugagaaguuuugauuaagccaaauguaucg

SEQ ID NO: 58476 - RNA, 78 nt, Mus musculus
ccaagaccaacuguaggagacugcaugaccuacuucacccccaccucaucguccauuuccccaacccuaccccccaca

SEQ ID NO: 58477 - RNA, 46 nt, Mus musculus
gggucaucaauaccccaacauugcauggugcuacugaaccccaucc

SEQ ID NO: 58478 - RNA, 48 nt, Mus musculus
gccuggcuggacuaaaccucucucccuaccccacccccuaccccccac

SEQ ID NO: 58479 - RNA, 45 nt, Mus musculus
ggugugguucuguugggccaauucgugguacacagauucuucaga

SEQ ID NO: 58480 - RNA, 63 nt, Mus musculus
ugggccaggugaccugcuuuuuggcugauaucauacugcaucauuacaucgccagauggaucg

SEQ ID NO: 58481 - RNA, 55 nt, Mus musculus
ggcuuuggcuaccgucuggcccuguacgucuaccagcgugguuugaccggcuucc

SEQ ID NO: 58482 - RNA, 46 nt, Mus musculus
agcuucagcccacagccgggaaugccuacgaacucuucaccaagau

SEQ ID NO: 58483 - RNA, 46 nt, Mus musculus
cagcaucuugggucaggugggucggcagcuugcucucaucggagau

SEQ ID NO: 58484 - RNA, 59 nt, Mus musculus
cagggggcggccgccccugccaaccccgagauggacaacuugccccuggaacccaacag

SEQ ID NO: 58485 - RNA, 44 nt, Mus musculus
aacgaauuccaggucagccugggcuugagugaggcagacuaaga

SEQ ID NO: 58486 - RNA, 44 nt, Mus musculus
aggaccaggucccccgaaggugggcugcgaugaguccccguccc

SEQ ID NO: 58487 - RNA, 41 nt, Mus musculus
cccugagacuuugucucaaaaauaaaaaauucugggccagu

SEQ ID NO: 58488 - RNA, 46 nt, Mus musculus
gccgugaagauucgaccuuccagaauucuuguccuucugggcagau

SEQ ID NO: 58489 - RNA, 45 nt, Mus musculus
aguggccuguccguggaagaguacaagcugauccuguccacaggu

SEQ ID NO: 58490 - RNA, 45 nt, Mus musculus
cgagagcuuagcacgacugcauucaaacuacuacaagcacaaggu

SEQ ID NO: 58491 - RNA, 46 nt, Mus musculus
cgugcuaagcucucguacaucugaucacaggccucggguucugcaa

SEQ ID NO: 58492 - RNA, 45 nt, Mus musculus
aaaugcuggugucccagcuuccagaguauuugugcuagucuguga

SEQ ID NO: 58493 - RNA, 46 nt, Mus musculus
aacugcccagccaccugcacuaggggucagaucuuaccaggaagca

SEQ ID NO: 58494 - RNA, 24 nt, Mus musculus
ugaccggaggggaggagggugggc

SEQ ID NO: 58495 - RNA, 46 nt, Mus musculus
ucguccacuggccauuccucacagagcuuaaggaaacgccgguagc

SEQ ID NO: 58496 - RNA, 45 nt, Mus musculus
cuaucccgagccucugaucauagugggggccagcggcaaaguaag

SEQ ID NO: 58497 - RNA, 47 nt, Mus musculus
cugugcaacuccacagggugccacggaggagaaagaggaagaggagg

SEQ ID NO: 58498 - RNA, 44 nt, Mus musculus; identical to SEQ ID NO: 41822

SEQ ID NO: 58499 - RNA, 68 nt, Mus musculus
auagaguacuaugccauguuggcuaaaacugggguccaucacuacaguggcaauaauauugaacuggg

SEQ ID NO: 58500 - RNA, 46 nt, Mus musculus
cagcugccaaccccaguaguucaauaccaaugcaagucuccaagcu

SEQ ID NO: 58501 - RNA, 45 nt, Mus musculus
auuugcaguuacuugaauaaaaaacaaauagccuuuucuggacag

SEQ ID NO: 58502 - RNA, 62 nt, Mus musculus
agacagaugcuccuguaccuaucugggugagugguggaguguggacggucaugucuugaugu

SEQ ID NO: 58503 - RNA, 42 nt, Mus musculus
cgguccacccugggagcgggagcacaggaaccucagccccgc

SEQ ID NO: 58504 - RNA, 26 nt, Mus musculus
cugcacauacauuaccuguaacagag

SEQ ID NO: 58505 - RNA, 46 nt, Mus musculus
cuuaaagccaaacacuaaugaccccgagguaaccagacaggcccag

SEQ ID NO: 58506 - RNA, 44 nt, Mus musculus
gcccaagcacaugagggaggccguccggagguugaaguccaagg

SEQ ID NO: 58507 - RNA, 46 nt, Mus musculus
aauacuuuauaacuuccuuuuuuaugucuuucuguauuggugaggu

SEQ ID NO: 58508 - RNA, 46 nt, Mus musculus
uugugauugccaugucuggcauuucuaagguuuuugucggggaggu

SEQ ID NO: 58509 - RNA, 66 nt, Mus musculus
aaauaaaauaaauaaaauuuguauucuaguauugggaaagaucucgugauccaguagagaaaggau

SEQ ID NO: 58510 - RNA, 49 nt, Mus musculus
gacaaauaaauuugaaaaucugaagcacaaagguuagaaacacgcguag

SEQ ID NO: 58511 - RNA, 46 nt, Mus musculus
acuccauucaaaacgcauagauucaauacgggauaggcgcggagau

SEQ ID NO: 58512 - RNA, 44 nt, Mus musculus
gaugcucacagccauccauuagacggagcacagggcccccaaug

SEQ ID NO: 58513 - RNA, 42 nt, Mus musculus
ggauccaucccauaaaccaccaccaaacccacuauggcagau

SEQ ID NO: 58514 - RNA, 46 nt, Mus musculus
ccagacugaagaaacagauguuugucagucaccaucuggcugcuag

SEQ ID NO: 58515 - RNA, 45 nt, Mus musculus
aggcuagccuuaaauucagaggcccucaugccucuuccuucugag

SEQ ID NO: 58516 - RNA, 33 nt, Mus musculus
aagauuaaaccuaaaagauucucugaaggaugg

SEQ ID NO: 58517 - RNA, 46 nt, Mus musculus
uuugggacauguugcaccaagcaccauggggacuugagguuugcag

SEQ ID NO: 58518 - RNA, 41 nt, Mus musculus
gcagccucgagccgugcagccggcuccggcaccuugccgac

SEQ ID NO: 58519 - RNA, 42 nt, Mus musculus
cgcuggaagaugucgcaggagaggcccacguucuaccggcag

SEQ ID NO: 58520 - RNA, 46 nt, Mus musculus
caugcuggucuuccagagacaaccacuguuuaguuccuugccugac

SEQ ID NO: 58521 - RNA, 42 nt, Mus musculus
aggggaaaaucuuuguggugaauuuaaggaaauacaaacggg

SEQ ID NO: 58522 - RNA, 45 nt, Mus musculus
uuggcaagagggugugugugugugugugugugugugugugugugu

SEQ ID NO: 58523 - RNA, 42 nt, Mus musculus
guugaguuccguuucccacucaugaugagcacuacaccccag

SEQ ID NO: 58524 - RNA, 44 nt, Mus musculus
ugccuuuguaaagaccaacuucugugcugaaaaaguaagccaag

SEQ ID NO: 58525 - RNA, 46 nt, Mus musculus
gcacaagagagauaaaucauggcagggacuugaccuaugcccugua

SEQ ID NO: 58526 - RNA, 42 nt, Mus musculus
uuuuuuuguuuguuuguuuguuguugaaggguuuugcugcca

SEQ ID NO: 58527 - RNA, 46 nt, Mus musculus
caguugcuccuuuguugucauaaguucuuuagcuuaguauugguag

SEQ ID NO: 58528 - RNA, 46 nt, Mus musculus
uuuggacuagcuggccagcuagccuagccaaguuagugagguccag

SEQ ID NO: 58529 - RNA, 46 nt, Mus musculus
cgguggaaggcaccuaaggucaaccucugaccuacacacaugcaca

SEQ ID NO: 58530 - RNA, 45 nt, Mus musculus
gcccucuucuggugcaucugaagacagcuacaguguacaguguau

SEQ ID NO: 58531 - RNA, 29 nt, Mus musculus
gcuucugaaacuuguucuuuugcccucag

SEQ ID NO: 58532 - RNA, 45 nt, Mus musculus
uguacuuugaacccuauuuuguuuguaucugugccgauguuuuga

SEQ ID NO: 58533 - RNA, 47 nt, Mus musculus
acuacuacucccagcuucagugugugugugugugugugugugagaga

SEQ ID NO: 58534 - RNA, 46 nt, Mus musculus
guuguggggugggugcggguaggcgagaaggaacuagcagcagcag

SEQ ID NO: 58535 - RNA, 41 nt, Mus musculus
ccugggauugggucaacucaucugaaacuuagacagcggua

SEQ ID NO: 58536 - RNA, 45 nt, Mus musculus
auuccuugaguuuaaaauagucauuuauuauuuugaaauugcacg

SEQ ID NO: 58537 - RNA, 44 nt, Mus musculus
agaguguuggcugagggcaucuggggugcacagauccacagaag

SEQ ID NO: 58538 - RNA, 46 nt, Mus musculus
ccuuugcuagcuucuguucucucaaggaaagggagggagagaaggg

SEQ ID NO: 58539 - RNA, 41 nt, Mus musculus
uccuacuguuugugcuucagucucugggaauuguccagcac

SEQ ID NO: 58540 - RNA, 68 nt, Mus musculus
gggcaucguguggcaguuaagaagcugucgagaccguuucaguccaucauucacgccaaaaggaccua

SEQ ID NO: 58541 - RNA, 45 nt, Mus musculus
acggggggaaugagaaaagaucagaauacuuacacuuaauguaga

SEQ ID NO: 58542 - RNA, 45 nt, Mus musculus
cacgcacucacgcacacacaugcaggcacauaggggcaggggaga

SEQ ID NO: 58543 - RNA, 46 nt, Mus musculus
uguguucacacccgcaaggucacuggaggaauucaaugacguguga

SEQ ID NO: 58544 - RNA, 45 nt, Mus musculus
ccuauucugguuucuugggggagggauacauaaagugaauauuau

SEQ ID NO: 58545 - RNA, 48 nt, Mus musculus
uguggcccauucagagccaaugaugaguccuuacaaaaguuacacaga

SEQ ID NO: 58546 - RNA, 46 nt, Mus musculus
aacuuuuuacaaaguauguaagugcuagggccucaaugcuagguug

SEQ ID NO: 58547 - RNA, 44 nt, Mus musculus
uauagaaaagggaaaaacaagugaaugccaaagauggagcagga

SEQ ID NO: 58548 - RNA, 44 nt, Mus musculus
caaccacauuagcucaccugcaaaugcaaguuuaggaagcaagu

SEQ ID NO: 58549 - RNA, 45 nt, Mus musculus
auuuaaagcccagugugcaacugagagccaauaaggaaguagcca

SEQ ID NO: 58550 - RNA, 46 nt, Mus musculus
ucugccuuuucuuaauuacuuuuggauagagcccauagugguggag

SEQ ID NO: 58551 - RNA, 41 nt, Mus musculus
cuccaccauaaauacugcuuucggucaacuaguagcccagg

SEQ ID NO: 58552 - RNA, 44 nt, Mus musculus
guuugaucucaagcacuguugucuugcugugaaaaaacaacuua

SEQ ID NO: 58553 - RNA, 49 nt, Mus musculus
gugaagugccagaagcugaccgacgaccacguucaguuucucaucuacc

SEQ ID NO: 58554 - RNA, 42 nt, Mus musculus
cuuuugcaguauauacauucggcugacauaauucacagggua

SEQ ID NO: 58555 - RNA, 42 nt, Mus musculus; identical to SEQ ID NO: 52336

SEQ ID NO: 58556 - RNA, 45 nt, Mus musculus
ggguuucugucucacaagguuuaacuauuuuauauacacuggcug

SEQ ID NO: 58557 - RNA, 45 nt, Mus musculus
cuggucuuucgaagauucuaugccccaguacaggggaaugccagg

SEQ ID NO: 58558 - RNA, 45 nt, Mus musculus
aaggugcacguguguggcuccgcagguucuagcagugggcgugac

SEQ ID NO: 58559 - RNA, 45 nt, Mus musculus
accacagugaugacauaguaaccuccauaguuucaaaagguuuga

SEQ ID NO: 58560 - RNA, 57 nt, Mus musculus
ucggcacacugaugaugagaugacaggcuacguggcuaccaggugguaccgagcccc

SEQ ID NO: 58561 - RNA, 45 nt, Mus musculus
ccaguggauauuugguccgugggcugcaucauggcugagcuguug

SEQ ID NO: 58562 - RNA, 42 nt, Mus musculus
gguggccaggaagcagagagggaacgagagaagguuggggag

SEQ ID NO: 58563 - RNA, 46 nt, Mus musculus
ggguggcagcuuugccuuagcuccuaaggaggguuuucuuccauaa

SEQ ID NO: 58564 - RNA, 62 nt, Mus musculus
ucaaaaaagcuuguccagaaagacuucuuguuagaacagcccuuggaagggacagugggaaa

SEQ ID NO: 58565 - RNA, 46 nt, Mus musculus
gauauugaucaguugaagcucauuuuaagacucguuggaaccccag

SEQ ID NO: 58566 - RNA, 47 nt, Mus musculus
guaugcuaauaaaacugagaguugagauuccaguucauuccaagaga

SEQ ID NO: 58567 - RNA, 45 nt, Mus musculus
cauggaggccauaagaaggugacucuguuuuacuuuagccauggu

SEQ ID NO: 58568 - RNA, 24 nt, Mus musculus
auacaguaccuacauccgggugag

SEQ ID NO: 58569 - RNA, 47 nt, Mus musculus
caguguagacaaggacacggggucugaauacagagaaugcaggacag

SEQ ID NO: 58570 - RNA, 46 nt, Mus musculus
uccccucucucaguaugcagagcauuguugaguguggaguuuucag

SEQ ID NO: 58571 - RNA, 42 nt, Mus musculus
guguuuuuacaggcaagaaacuacauucagucucuggcccag

SEQ ID NO: 58572 - RNA, 46 nt, Mus musculus
gcuccuuuacuaucuuucucaaaaggguuguuagacacaaaccaag

SEQ ID NO: 58573 - RNA, 46 nt, Mus musculus
uuugagcacuuugugcuauauaaggacccauauuuaagcuuugugu

SEQ ID NO: 58574 - RNA, 45 nt, Mus musculus
caggguuccaucuuacacagagcuucagacauguaauugucagau

SEQ ID NO: 58575 - RNA, 79 nt, Mus musculus
ggggugauggugacagugacagugauggcugugaggguggaggaggaaagagaggagggaagagaaaaaggaggaggga

SEQ ID NO: 58576 - RNA, 41 nt, Mus musculus
aggaggaggagggagagcagagaagaggaagaaguagggga

SEQ ID NO: 58577 - RNA, 42 nt, Mus musculus
uccccaagccccugucccuuaccaaaacaucucucugcccug

SEQ ID NO: 58578 - RNA, 44 nt, Mus musculus
ugaggucucauguggggugucugggucuccucaucagggucagg

SEQ ID NO: 58579 - RNA, 45 nt, Mus musculus
uucaaaucccagcaaccgcaugguggcucacaaccauccucguaa

SEQ ID NO: 58580 - RNA, 41 nt, Mus musculus
ggaggaggaggacggaggacgugugugugugugugugugug

SEQ ID NO: 58581 - RNA, 46 nt, Mus musculus
auuuuaacuauucaacuuuugaauaaacugugaaaacgauaaucga

SEQ ID NO: 58582 - RNA, 71 nt, Mus musculus
uccccguguguuugcaggaguguguggugagcaugggagaauaagaauagugguagagucugugugguggg

SEQ ID NO: 58583 - RNA, 45 nt, Mus musculus
guaccagccaacgcccugugcuguggugaugauaugccaccugcc

SEQ ID NO: 58584 - RNA, 47 nt, Mus musculus
cuccacggugcaccgggaagcugauaggacagagacaagcauuuuuc

SEQ ID NO: 58585 - RNA, 45 nt, Mus musculus
aacuucgaugaauuuccagagucugauauucuuaagcccacaggu

SEQ ID NO: 58586 - RNA, 29 nt, Mus musculus
ggcaccaucuguggauuacgauuucggaa

SEQ ID NO: 58587 - RNA, 71 nt, Mus musculus
ugugaaugggaacauagaaucggagccccuggaguugaagaaauaaaaaauaaucuuuuuuuugaaggugu

SEQ ID NO: 58588 - RNA, 46 nt, Mus musculus
agaaagugaugaacuggaaggaaacuuugaccuuuccuccagaagu

SEQ ID NO: 58589 - RNA, 50 nt, Mus musculus
uuuaugugugugaauacaccguagcugucuuuagacacccuagaagaggg

SEQ ID NO: 58590 - RNA, 46 nt, Mus musculus
uucauacaugaagacuaaacaugaguuguacuuuguaagggugguc

SEQ ID NO: 58591 - RNA, 46 nt, Mus musculus
ucucauauaguaaaaaauuagaacaagacacaguuauaaggaagaa

SEQ ID NO: 58592 - RNA, 46 nt, Mus musculus
aaucccagcaaccacaugguggcucacaaacauccguaacaaaaaa

SEQ ID NO: 58593 - RNA, 45 nt, Mus musculus
gugucagcaguucuguucuguaaggaugcauauaaagagccaggc

SEQ ID NO: 58594 - RNA, 46 nt, Mus musculus
aucugccugccucugccuucugagugcugggaucaaagguguacac

SEQ ID NO: 58595 - RNA, 49 nt, Mus musculus
cagaagaggagacucaguuuuauauagcagagacaguauuagccauaga

SEQ ID NO: 58596 - RNA, 46 nt, Mus musculus
uaggauaugaaucuuacuuuccucuugcuuuaugaugcugguauua

SEQ ID NO: 58597 - RNA, 46 nt, Mus musculus
ggauaagcuaaaccucuaccuaaucauggaguuccugccuggaggu

SEQ ID NO: 58598 - RNA, 51 nt, Mus musculus
ggccacauucgugcggagcgugacauucuaguggaggcagacaguuugugg

SEQ ID NO: 58599 - RNA, 46 nt, Mus musculus
agaaccuaugugguguuucaugccuauaaucuuugauuuuggagau

SEQ ID NO: 58600 - RNA, 45 nt, Mus musculus
cccaguguaaauguuuuuuuucauccugcaguguagugcccagca

SEQ ID NO: 58601 - RNA, 41 nt, Mus musculus
guuuuuuguacuccuuggauggggauguagaacuggcgagu

SEQ ID NO: 58602 - RNA, 45 nt, Mus musculus
uaaaauagauaaaauuuuuaaaaaacuacaaguaagacccgugaa

SEQ ID NO: 58603 - RNA, 46 nt, Mus musculus
auaucuaguauguccuccaucuaaggacaguaaauuaaauggaguu

SEQ ID NO: 58604 - RNA, 46 nt, Mus musculus
uaaacaacaguacucaggggagaacugcauauuaucgugaagagac

SEQ ID NO: 58605 - RNA, 44 nt, Mus musculus
acaaaagaaguuagaaaaggugauggaagaagaaggccugaaag

SEQ ID NO: 58606 - RNA, 46 nt, Mus musculus
uggcugugagccaccaugugguugcugggauuugaacuucggaccu

SEQ ID NO: 58607 - RNA, 46 nt, Mus musculus
gaggaacuacuuacuacauggugagguuugucuaaauucuggagau

SEQ ID NO: 58608 - RNA, 46 nt, Mus musculus
caguugggugcucuuacccacugagccaucucaccagcccgugucu

SEQ ID NO: 58609 - RNA, 46 nt, Mus musculus
agaaaagggaccgagcuggaggacagggaaaaguggcagaagaguc

SEQ ID NO: 58610 - RNA, 44 nt, Mus musculus
uuuguuuaaaaugcuaccucacuuuucaucaucucagugccugg

SEQ ID NO: 58611 - RNA, 42 nt, Mus musculus
auguaugaacauaaaguucgacuccuguucccuugggccaag

SEQ ID NO: 58612 - RNA, 45 nt, Mus musculus
gcccgcggcugcagccgccaucgcccgggauuaauggcggcagag

SEQ ID NO: 58613 - RNA, 47 nt, Mus musculus
uguguaugauugucugugcacugugugcuugccgggugccuauagag

SEQ ID NO: 58614 - RNA, 24 nt, Mus musculus
gagguagauuguuggcuccaguuc

SEQ ID NO: 58615 - RNA, 41 nt, Mus musculus
ugaagggaguggccaaguacaguccucagaaauuacggcug

SEQ ID NO: 58616 - RNA, 45 nt, Mus musculus
ggaggaggggaaagagaaggaauaagaaaaggaggagggagaaga

SEQ ID NO: 58617 - RNA, 48 nt, Mus musculus
gcacuugccuacugugugugauacccagggcuccaccccagcaccucu

SEQ ID NO: 58618 - RNA, 46 nt, Mus musculus
ccacacauacaauauaguuguuucuuucuuuaauuauuauuuagau

SEQ ID NO: 58619 - RNA, 45 nt, Mus musculus
uaaccuccugaguucaagugauaccuuuaaaagucaggcugggag

SEQ ID NO: 58620 - RNA, 45 nt, Mus musculus
gaaagguuuuagccggggugugguggcgcacgccgauaaucccag

SEQ ID NO: 58621 - RNA, 46 nt, Mus musculus
cuguucgaugguuggcugugagcaccugcaucuguauuggucagga

SEQ ID NO: 58622 - RNA, 41 nt, Mus musculus
uguucaucaccaaaggaagucaggacaggaauucaagcagg

SEQ ID NO: 58623 - RNA, 46 nt, Mus musculus
gggccaggaacucaugguuagcaagagaaaucgaguugagcaagau

SEQ ID NO: 58624 - RNA, 41 nt, Mus musculus
ccucugugucucaaaacaaaacaaaaacgcauaggcgauag

SEQ ID NO: 58625 - RNA, 42 nt, Mus musculus
cuuugcucgguugaccaggcugcuuuggaaagcuuugggcag

SEQ ID NO: 58626 - RNA, 46 nt, Mus musculus
gcugaguggugaagaguuacaaguacuuagguuaggugccccagaa

SEQ ID NO: 58627 - RNA, 42 nt, Mus musculus
ugugaugcggcacauccucugugcgagaugcaaggggaaggu

SEQ ID NO: 58628 - RNA, 46 nt, Mus musculus
agaguuugacccaucccucuuggcuuccauucuccacaccccuguc

SEQ ID NO: 58629 - RNA, 41 nt, Mus musculus
caaacucuuggcaggucuuggcagagguagagaagcccccu

SEQ ID NO: 58630 - RNA, 45 nt, Mus musculus
uuuaguacuaauuaucauuacaauuaugauuuugaucuugaagag

SEQ ID NO: 58631 - RNA, 46 nt, Mus musculus
aaaauauaaguggaguaaaaaguaaaagaccauuaaaaccugaauc

SEQ ID NO: 58632 - RNA, 45 nt, Mus musculus
agagagagagagagagagagagagagacuaggaagauugccugaa

SEQ ID NO: 58633 - RNA, 46 nt, Mus musculus
ucucuccagcccucaagaagagauuuaaugaguguuugcaugugug

SEQ ID NO: 58634 - RNA, 44 nt, Mus musculus
aagugggggaaaauccaagaaaacaaaagacaaaaacgggguug

SEQ ID NO: 58635 - RNA, 45 nt, Mus musculus
cucuggaaguagacacagguuaugugugccgcuacuaccucuggg

SEQ ID NO: 58636 - RNA, 42 nt, Mus musculus
aaaaaaaaaaaaaaucaaacugaacaauggcaagcuacauaa

SEQ ID NO: 58637 - RNA, 46 nt, Mus musculus
uauguccucgcuccccagugcuagcugucauuguuauuauuuugag

SEQ ID NO: 58638 - RNA, 45 nt, Mus musculus
gcuggaaaaaccagcuaauuauaucuccaaagacccagggcaaga

SEQ ID NO: 58639 - RNA, 41 nt, Mus musculus
gcccgggcaaggccggcagagaguuguggcuauggggcuca

SEQ ID NO: 58640 - RNA, 36 nt, Mus musculus
cuugccuaacauguaugaagccaggaguuggauccc

SEQ ID NO: 58641 - RNA, 42 nt, Mus musculus
ugcggggucacgucuguaauaacagcgcccagugggggguga

SEQ ID NO: 58642 - RNA, 82 nt, Mus musculus
cuucccgggcuggcaggguggacaggacccgcccagacucccuguccccgagggcgcgccgccgagcggggaccggacaccg

SEQ ID NO: 58643 - RNA, 42 nt, Mus musculus
agaucagguaaucuggagucuagacaccucccagccccagac

SEQ ID NO: 58644 - RNA, 61 nt, Mus musculus
ggggggaggcaguagccuggggggaggcagcagccuggggggaggcaguagccugggggag

SEQ ID NO: 58645 - RNA, 53 nt, Mus musculus
ggaggaggcagcagccugggaggaggcaguagccugggaggaggcagcagccu

SEQ ID NO: 58646 - RNA, 46 nt, Mus musculus
cacaacaccuccuggucagagggacagggcucuagagaggguagau

SEQ ID NO: 58647 - RNA, 45 nt, Mus musculus
aaauaauaauuaagacacacagagugagggcuaaggccgaagaug

SEQ ID NO: 58648 - RNA, 46 nt, Mus musculus
uuuguuuuguuuuguucuuuuuuuaaauaacuuuaaguuuggagac

SEQ ID NO: 58649 - RNA, 44 nt, Mus musculus
aucagccauugcucaguguccugugagcucccuuagcccccaag

SEQ ID NO: 58650 - RNA, 46 nt, Mus musculus
uggagcaccaaguuccuauuugcaaucauuccguuucagccuguag

SEQ ID NO: 58651 - RNA, 41 nt, Mus musculus
uuuccuagcuacugcagccuacagaucaaagcucuggccaa

SEQ ID NO: 58652 - RNA, 43 nt, Mus musculus
cacuucuuugagaacaaaggagaaaucagaaugugcugguggg

SEQ ID NO: 58653 - RNA, 42 nt, Mus musculus
agugagccuaggcaggcagagauccgcaaagaaugccuccag

SEQ ID NO: 58654 - RNA, 47 nt, Mus musculus
uugggauggccgccagucagaccguugggugaagcuggaccuaaaga

SEQ ID NO: 58655 - RNA, 45 nt, Mus musculus
ggacacacugcucuguguggagauugugcaugaacugaaagggga

SEQ ID NO: 58656 - RNA, 41 nt, Mus musculus
augccacaguugcuuagauuauugaggucauuuuuguguaa

SEQ ID NO: 58657 - RNA, 45 nt, Mus musculus
uugcugagaaauuugugaaagcagucucuaagcccagccggccag

SEQ ID NO: 58658 - RNA, 45 nt, Mus musculus
ggcccugucaacaguaagcauuaagaugaaaguuccaggcaggag

SEQ ID NO: 58659 - RNA, 42 nt, Mus musculus
cacagggugaaggagguguaucggcuagaagagauggagaag

SEQ ID NO: 58660 - RNA, 55 nt, Mus musculus
accaugggauuuagcaagagcaauaacaggaaguucuucuacaauaagaaaaccc

SEQ ID NO: 58661 - RNA, 88 nt, Mus musculus
aucucucaacuugagucauugacagaacccaguauaaaagcaccuaucuggggaccugcuagugguuucuugguccugcaccaccuag

SEQ ID NO: 58662 - RNA, 45 nt, Mus musculus
uuccacaugcgugacucccagaagccccaggauccagacaagcug

SEQ ID NO: 58663 - RNA, 41 nt, Mus musculus
guggucuuuucuucaccccaauccuggaguuuguccuggca

SEQ ID NO: 58664 - RNA, 46 nt, Mus musculus
ucauguggcucugugcugggcugcuguuguccacagugcuguguaa

SEQ ID NO: 58665 - RNA, 45 nt, Mus musculus
aggcgucuccuuccaggcacugucgcaucccaaaacccggcccug

SEQ ID NO: 58666 - RNA, 41 nt, Mus musculus
cuggcagccggcuuugggcugaguagaggugggaugggaca

SEQ ID NO: 58667 - RNA, 42 nt, Mus musculus
gcaagaaaagaccagaaaauggaccuuacacaaaguccccag

SEQ ID NO: 58668 - RNA, 45 nt, Mus musculus
agcuaugagcuuuaggaucagaauaaggagacaggucucgggaag

SEQ ID NO: 58669 - RNA, 42 nt, Mus musculus
ugugaaugaaugacaggcuccuuaagauugcuugugccucag

SEQ ID NO: 58670 - RNA, 45 nt, Mus musculus
agcaucagugcacauucaauacucaagacccgcugggggcaacag

SEQ ID NO: 58671 - RNA, 45 nt, Mus musculus
uggaaaugaaagcaggaagaaggggauagauuuaaaugguugggg

SEQ ID NO: 58672 - RNA, 46 nt, Mus musculus
ucucuagcugauagaccgcauguaguuagguguacauacagcagac

SEQ ID NO: 58673 - RNA, 46 nt, Mus musculus
cuccagcauugcagggacucucuuaagauggaggacaggccaccug

SEQ ID NO: 58674 - RNA, 46 nt, Mus musculus
ccuccuaggugugucucacuauaggagaucgcugugauccggguag

SEQ ID NO: 58675 - RNA, 46 nt, Mus musculus
ugcacauauuuugcauuugauuucuacggaguugaaauguugagag

SEQ ID NO: 58676 - RNA, 52 nt, Mus musculus
uuaauggauucucagaggugauuugaagacucaacaacuggaggacaaaacc

SEQ ID NO: 58677 - RNA, 64 nt, Mus musculus
agaauucaaggacuaacuuuacuuuucugggaauacggaggaggaagggauuagacaaugggcc

SEQ ID NO: 58678 - RNA, 45 nt, Mus musculus
gguacuccugagagcaauucggaaucaugcugacaaggacacaga

SEQ ID NO: 58679 - RNA, 46 nt, Mus musculus
uuuugccaaccuaauuuucaaguagcaauuuaucuuaugaccuuga

SEQ ID NO: 58680 - RNA, 101 nt, Mus musculus
gaauccuaacaaaauagcaacgauuauuuaguuucgggagaaugugccuuugagguaugggggacagcgggaacaaagcggcguggaaaagaaacagcgug

SEQ ID NO: 58681 - RNA, 46 nt, Mus musculus
cagcucagugugagacaacccaugagcuggaacaguuaaguagauc

SEQ ID NO: 58682 - RNA, 54 nt, Mus musculus
auugggauugccguuccugaugucuacagugccuguaagagauuugaagaacua

SEQ ID NO: 58683 - RNA, 46 nt, Mus musculus
gguggcugcguaggcagucccaagccaggguccacggccugcaguu

SEQ ID NO: 58684 - RNA, 46 nt, Mus musculus
uaaaagaacagaaccauucaaauguccauauagaauagaaggagau

SEQ ID NO: 58685 - RNA, 41 nt, Mus musculus
caugugagucccucaggaucacccuuaauuugggagggagu

SEQ ID NO: 58686 - RNA, 47 nt, Mus musculus
guccacagccucugcucuaguggcauaaaugcuguugugugcacaag

SEQ ID NO: 58687 - RNA, 45 nt, Mus musculus
uuuagagagugcauggaucuauuuaauuaaaaucggccccugaga

SEQ ID NO: 58688 - RNA, 45 nt, Mus musculus
uuagcuguuagggucgaggaaugcauuaggaaugcauugagcaga

SEQ ID NO: 58689 - RNA, 45 nt, Mus musculus
caaauaaggagacuuagacccagguacuugaguaacuugcccaga

SEQ ID NO: 58690 - RNA, 46 nt, Mus musculus
ugugagccaccaugugguugcugggacuugaacucaggaccacugg

SEQ ID NO: 58691 - RNA, 41 nt, Mus musculus
aaugaaugaaugaaugaaugaacuagaaaucucagggagau

SEQ ID NO: 58692 - RNA, 42 nt, Mus musculus
gauugaaugugggcuuuaugcagaccucuaggaggggcagau

SEQ ID NO: 58693 - RNA, 45 nt, Mus musculus
acacccaaggacucuguuggguugccuggaccacuuaacuuggca

SEQ ID NO: 58694 - RNA, 59 nt, Mus musculus
aaguuaguggugaggcaccuggcaguacauguauguauggugggggugugggggacgga

SEQ ID NO: 58695 - RNA, 42 nt, Mus musculus
gagaaagaaaagaaaccaggagggagggaaaaaagcugggag

SEQ ID NO: 58696 - RNA, 45 nt, Mus musculus
ugcuuuccuuuagaggagcuccuuacuuugagguguagcugugag

SEQ ID NO: 58697 - RNA, 46 nt, Mus musculus
uuccucacagaccccucuugggccccucuccuuugucuuccucuag

SEQ ID NO: 58698 - RNA, 59 nt, Mus musculus; identical to SEQ ID NO: 58694

SEQ ID NO: 58699 - RNA, 42 nt, Mus musculus; identical to SEQ ID NO: 58695

SEQ ID NO: 58700 - RNA, 45 nt, Mus musculus
ggugcugaaaacuaggcaucccuuauguaaugagggcugucaguu

SEQ ID NO: 58701 - RNA, 42 nt, Mus musculus
gggggaaacuccacauuaaagcucccacuggguugccuagac

SEQ ID NO: 58702 - RNA, 46 nt, Mus musculus
ucccagacccgggggagcuauauuuagcguaggcaaguuugcagag

SEQ ID NO: 58703 - RNA, 91 nt, Mus musculus
ggaacagaguaagggcugaaaucuacucuucuucuauccucgucagucuuugaauaccuaaaucaccaaacuuuacaagucacuuacccuc

SEQ ID NO: 58704 - RNA, 46 nt, Mus musculus
gagacucucccagggaguagaggaggagaacaaagaucaacuagau

SEQ ID NO: 58705 - RNA, 42 nt, Mus musculus
aguuuugggaguggggcauaguuuguuucaucacucugagaa

SEQ ID NO: 58706 - RNA, 48 nt, Mus musculus
ugauauuggaugcgaacagcacggugaauaucgccucacagauacggu

SEQ ID NO: 58707 - RNA, 45 nt, Mus musculus
guggcguaagcauagaaugaugucggccuaaggcaguuccaugau

SEQ ID NO: 58708 - RNA, 42 nt, Mus musculus
cguguacuacuaugucaacaaugacaccuacacaggggagug

SEQ ID NO: 58709 - RNA, 27 nt, Mus musculus
gcaaacuuuaagggaagaucaucagac

SEQ ID NO: 58710 - RNA, 46 nt, Mus musculus
gugagagagaaugaagagaggagaggagaguaagagagaacaagga

SEQ ID NO: 58711 - RNA, 45 nt, Mus musculus
ggaugguuguaagccaccaagugguugcugggauuugaacucagg

SEQ ID NO: 58712 - RNA, 45 nt, Mus musculus
acgacacggacaugggaaagcacgacugcccaacggggacacaua

SEQ ID NO: 58713 - RNA, 41 nt, Mus musculus
ucacucaaaccaccacacuguuguuuggaacaacccugaga

SEQ ID NO: 58714 - RNA, 45 nt, Mus musculus
gccacacuggcggcgcugaguccaggaagucgcuugaaaggugaa

SEQ ID NO: 58715 - RNA, 45 nt, Mus musculus
cagauggauaauggauaaauggauuacagagagauaggcguuaag

SEQ ID NO: 58716 - RNA, 46 nt, Mus musculus
guuuugaaagguagcaggggcuuucagugaaacucaugucacccag

SEQ ID NO: 58717 - RNA, 46 nt, Mus musculus
aaccuggaggcuagccagcauggaccuagacaugccccagguauag

SEQ ID NO: 58718 - RNA, 44 nt, Mus musculus
caucauggcgggaagcaugguggcaugcagguagaugugguccu

SEQ ID NO: 58719 - RNA, 45 nt, Mus musculus
acaaaagaagucagggaguuuucuccuacuuacagaaacgaagag

SEQ ID NO: 58720 - RNA, 41 nt, Mus musculus
cuuuguuuacuacugcuaagacgugugaaguuucagcagaa

SEQ ID NO: 58721 - RNA, 44 nt, Mus musculus
caaagggggaaggguuuaugucacuuacauuauauuaacagugu

SEQ ID NO: 58722 - RNA, 46 nt, Mus musculus
gguggagugaacgcagagugaaagaugacucgucucagugggccag

SEQ ID NO: 58723 - RNA, 41 nt, Mus musculus
aagagguggcagugcacaccuuugaucccagcacuugggag

SEQ ID NO: 58724 - RNA, 42 nt, Mus musculus
aaagaacuguuuucaaaggcagugucuguccccuacccccag

SEQ ID NO: 58725 - RNA, 46 nt, Mus musculus
auuuucccagcacaacuuccacucucacuucuacccccacccccau

SEQ ID NO: 58726 - RNA, 45 nt, Mus musculus
cccauauaggaccaaagugugauccuaugaaagacgcaagcuuac

SEQ ID NO: 58727 - RNA, 41 nt, Mus musculus
uuuaggcuucauagacacauccuuaaucauccuugccugca

SEQ ID NO: 58728 - RNA, 46 nt, Mus musculus
cagggaguaugugugugugugugugugugugugugugguguguaug

SEQ ID NO: 58729 - RNA, 90 nt, Mus musculus
guauguguggcauguguauguguguauacuguguuugugauguguguguaugugguguguauguguguuguguguguauguguggugggu

SEQ ID NO: 58730 - RNA, 45 nt, Mus musculus
guguggugugugugugguauguguauauguguguguaguguguau

SEQ ID NO: 58731 - RNA, 44 nt, Mus musculus
uguaguguguguguaagugugguguguguauguauguguggugu

SEQ ID NO: 58732 - RNA, 45 nt, Mus musculus
guguaguguguauugugguguguguauauuuguguaguguauaug

SEQ ID NO: 58733 - RNA, 46 nt, Mus musculus
augugugguguauguauaugugugauguguguguauguguauguag

SEQ ID NO: 58734 - RNA, 41 nt, Mus musculus
gucccaaagacugugacacaccaggaaaaggcaagccacaa

SEQ ID NO: 58735 - RNA, 42 nt, Mus musculus
uggcuuggaguucacauucagaugcacaugagaaaccccccc

SEQ ID NO: 58736 - RNA, 46 nt, Mus musculus
gugguuuaaggcagacaucuggguugacaccuggguagaugggagg

SEQ ID NO: 58737 - RNA, 45 nt, Mus musculus
uaacagguugaucuaggccagagguucaaccuuccuaaugcugag

SEQ ID NO: 58738 - RNA, 41 nt, Mus musculus
gaggagaggagaggagagaaagggaagaagggaggggagaa

SEQ ID NO: 58739 - RNA, 41 nt, Mus musculus
agcaaguguuccuaaccuccgaaagauuucuuuagccccua

SEQ ID NO: 58740 - RNA, 41 nt, Mus musculus
agaggagcugagaauucuacaucuucaucugaagacugcca

SEQ ID NO: 58741 - RNA, 46 nt, Mus musculus
ucaaaucccaacaaccacaugguggcucacaaucacccauaaugag

SEQ ID NO: 58742 - RNA, 29 nt, Mus musculus
guauaucucugcgguggugugggugugag

SEQ ID NO: 58743 - RNA, 45 nt, Mus musculus
augggugaauaaaggauagaugaacagauagauggaugauggaua

SEQ ID NO: 58744 - RNA, 45 nt, Mus musculus
agauagauagaggaucgaagaugaauggaugcuggaagggugcua

SEQ ID NO: 58745 - RNA, 44 nt, Mus musculus
gcauugcacacgcauacauacauacauacauacaugcaggcaga

SEQ ID NO: 58746 - RNA, 36 nt, Mus musculus
ugcccgucuugaggcaaacugauugacaguagguga

SEQ ID NO: 58747 - RNA, 50 nt, Mus musculus
uacuccaaaaaugcugaaucccauuaaacagacagggauacagagaagga

SEQ ID NO: 58748 - RNA, 46 nt, Mus musculus
gucaagguguugaaguuacugugugacaggcaaacacugcaccacu

SEQ ID NO: 58749 - RNA, 51 nt, Mus musculus
aagacagagagcuuaacaucuggggccccggaaaacaccacagagaagaac

SEQ ID NO: 58750 - RNA, 42 nt, Mus musculus
aagaaagaaagaaagagagagagagagagagagagagaauag

SEQ ID NO: 58751 - RNA, 46 nt, Mus musculus
gugaguacacuguaguugucuucagacacaccagaagggcauucag

SEQ ID NO: 58752 - RNA, 64 nt, Mus musculus
acuguaccaguuagagcagaugaauuguggccugugaguggacagagccaagcgaggcuuccca

SEQ ID NO: 58753 - RNA, 44 nt, Mus musculus
caaggauggucacgcccagacgaccccugaugaccugcuacaga

SEQ ID NO: 58754 - RNA, 90 nt, Mus musculus
ccccaggcugugcuccuggaggcaaggguguucccgggagaacugguuucuguagugaggcugucuacagagucagagaagagugcaaag

SEQ ID NO: 58755 - RNA, 46 nt, Mus musculus
aagugugcucaaaggugagauguuaaauaugaucucgggggugugg

SEQ ID NO: 58756 - RNA, 46 nt, Mus musculus
uguaguuuugccggaaguagaaguuagacauauuaaccagagccac

SEQ ID NO: 58757 - RNA, 53 nt, Mus musculus
ccugucuuaaggauuguacaucugcucaucuggagaauguuuggucccacuuc

SEQ ID NO: 58758 - RNA, 82 nt, Mus musculus
gaagaaauggaccaagccuguagaagacagcaaagaagccagguccaagcccgugacauccaggccacaguccagugagaug

SEQ ID NO: 58759 - RNA, 46 nt, Mus musculus
gugaaggaagaacaccaacgggggaaaccgagaccagacaagacag

SEQ ID NO: 58760 - RNA, 45 nt, Mus musculus
gcccacuagugggccagugcccacaacgcaaauacaagaggccag

SEQ ID NO: 58761 - RNA, 46 nt, Mus musculus
aaaaagcagagagucuccuggcaggccugugccacaaucucgggaa

SEQ ID NO: 58762 - RNA, 44 nt, Mus musculus
gagccgacugacaccaccaccuacaagaaccugcagcaccauga

SEQ ID NO: 58763 - RNA, 45 nt, Mus musculus
cacuacccugugccaguggccacccuguguuauuggcaagcagca

SEQ ID NO: 58764 - RNA, 46 nt, Mus musculus
uaauaaccgaccaacacagacacguaaaaccugcucgucugcuaaa

SEQ ID NO: 58765 - RNA, 46 nt, Mus musculus
ugaggagcuccuacacacacacccuucccccaccccaccccccagg

SEQ ID NO: 58766 - RNA, 63 nt, Mus musculus
acugggaggugguggagccuuuaauagguagagccuaggggaaggaaguuagcucaccccauc

SEQ ID NO: 58767 - RNA, 46 nt, Mus musculus
cuccucaugcagcaaggaccugguaccuccaggacagcggugucca

SEQ ID NO: 58768 - RNA, 46 nt, Mus musculus
acagggcccagcuugcccaacuguguggguugauuagugcauggua

SEQ ID NO: 58769 - RNA, 44 nt, Mus musculus
uuaacaugggacaagcuuacucaagacucaggaaagggagagaa

SEQ ID NO: 58770 - RNA, 25 nt, Mus musculus
uacaacacuggcuuuccuucccuca

SEQ ID NO: 58771 - RNA, 45 nt, Mus musculus
cagguuaauacugcugcggugagauuuggugguggaagucgcccg

SEQ ID NO: 58772 - RNA, 28 nt, Mus musculus
agcugcccccacuucagggaugccccag

SEQ ID NO: 58773 - RNA, 42 nt, Mus musculus
augcgcagcagacgccacaggggacaugccagccuggagaag

SEQ ID NO: 58774 - RNA, 42 nt, Mus musculus
guggugcuguaacuggagcagccugaagaacagagaggcgga

SEQ ID NO: 58775 - RNA, 48 nt, Mus musculus
ccggucgaugccgagggccugcaugaucccuagcaccuguucguugua

SEQ ID NO: 58776 - RNA, 45 nt, Mus musculus
gggucauccugcugcaggagaguggggucggccugcauccaccgg

SEQ ID NO: 58777 - RNA, 42 nt, Mus musculus
ccuccaguacccgcugucucagcguaggcagguugggcccgu

SEQ ID NO: 58778 - RNA, 42 nt, Mus musculus
ucgccuggcuuguagaaauucccaaauccaaaaucugugagg

SEQ ID NO: 58779 - RNA, 42 nt, Mus musculus
cauuuccucagugguaagagccuaccuaacccggugggcaag

SEQ ID NO: 58780 - RNA, 45 nt, Mus musculus
aauugugacaaucaacuccacaggacugaaucagcacagggggcc

SEQ ID NO: 58781 - RNA, 42 nt, Mus musculus
ccagcaugguggggacagaugugacacuugugcugacaggag

SEQ ID NO: 58782 - RNA, 45 nt, Mus musculus
cuuucuccucuucccagaauacucaauccaccacaucggccagau

SEQ ID NO: 58783 - RNA, 46 nt, Mus musculus
auaacaaacauuaauaaaaacaauuaagucuaaaaagaagccagau

SEQ ID NO: 58784 - RNA, 46 nt, Mus musculus
gugugcucuccagcauugagagagagagagagagagagagagagag

SEQ ID NO: 58785 - RNA, 42 nt, Mus musculus
aguauuuuuguuucguuuuguuuuuaaauuggagccccuggu

SEQ ID NO: 58786 - RNA, 46 nt, Mus musculus
agugugugacuguggcuguacuguauagugaacauaguuggcauau

SEQ ID NO: 58787 - RNA, 41 nt, Mus musculus
gcaaaaauguugacucuccauccauaguguuaggggcagcc

SEQ ID NO: 58788 - RNA, 73 nt, Mus musculus
aaaggaggagaagauucacucaccaaucauucgcagcgagccuuucagcaccucacuucgaccagagcccccc

SEQ ID NO: 58789 - RNA, 46 nt, Mus musculus
ccucuccgcuuaugauacauuccccucagaugccacaguuccagag

SEQ ID NO: 58790 - RNA, 42 nt, Mus musculus
ugguaaacaaguugggaguuagagaauaguuuggggaauagc

SEQ ID NO: 58791 - RNA, 42 nt, Mus musculus
gcccuuuucugcucauauucagcagcccccaccacccccagg

SEQ ID NO: 58792 - RNA, 46 nt, Mus musculus
acagccaucucggcccaguaaccgagcugcugcucugcccccaaag

SEQ ID NO: 58793 - RNA, 41 nt, Mus musculus
ucaucauuaauccugugggguuuggagaacauggauggagg

SEQ ID NO: 58794 - RNA, 46 nt, Mus musculus
caugccacagcagacugccccagcgaugaaguccucgcccccaccc

SEQ ID NO: 58795 - RNA, 42 nt, Mus musculus
cagccagccccagcuccugugccccagcagccgcccccaccu

SEQ ID NO: 58796 - RNA, 45 nt, Mus musculus
uaugugcuucacugguaucuccuccuucagugauagcugccugag

SEQ ID NO: 58797 - RNA, 42 nt, Mus musculus
agccugucuaagguuguucagcaaccccccccaccccccaau

SEQ ID NO: 58798 - RNA, 46 nt, Mus musculus
ucuguguaaguaagaaaacaauguucaauguuauuagacacuagga

SEQ ID NO: 58799 - RNA, 48 nt, Mus musculus
caccguaucuuggcuaugugccucccuugccccucccaacacccuguc

SEQ ID NO: 58800 - RNA, 42 nt, Mus musculus
cugugugugucucuaucuucaagauagcuccuuuugccaaau

SEQ ID NO: 58801 - RNA, 46 nt, Mus musculus
uguggguguuccuuaauagcuccaggguaaagaggaaugcguggug

SEQ ID NO: 58802 - RNA, 46 nt, Mus musculus
ucuggagucaccccuauaguguaccucagcugccuggccuagagug

SEQ ID NO: 58803 - RNA, 44 nt, Mus musculus
acccugaccccacacacaaguauuuuugagccacugcccccaua

SEQ ID NO: 58804 - RNA, 45 nt, Mus musculus
gucaagcuuuacauuugccuuuccucuguuuucucucuuucuuuu

SEQ ID NO: 58805 - RNA, 81 nt, Mus musculus
uaaugaugggaacagauugcuuuaccagaaguguacuuuucuuuauuguucucagaggagcaggugcucacauugaccuca

SEQ ID NO: 58806 - RNA, 42 nt, Mus musculus
guguuggggucccaucaaccuuggguugcaauauccccaguc

SEQ ID NO: 58807 - RNA, 47 nt, Mus musculus
aggugggaauacacuguggcgagcagcagcugccuggguugguaucc

SEQ ID NO: 58808 - RNA, 53 nt, Mus musculus
agcagcugccuggguugguaguugggaauacacuguggcgagcagcagcuguc

SEQ ID NO: 58809 - RNA, 97 nt, Mus musculus
auggguugguaguugggaauacacuguggcgagcagcagcugccuggguugguaguugggaauacacuguggcgagcagcagcugccuggguuggua

SEQ ID NO: 58810 - RNA, 132 nt, Mus musculus
ggugggaauacacuguggcgagcagcagcugucuggguugguaguugggaauacacuguggcgaguagcagcugucuggguugguaguugggaauacacuguggcgagcagcagcugucuggguugguaguu

SEQ ID NO: 58811 - RNA, 61 nt, Mus musculus
uuugagacccugaagccaucuacacuacgagaguuggagcgauaugucaccuccuguuugc

SEQ ID NO: 58812 - RNA, 45 nt, Mus musculus
ccacauaugaaucagaagaggaggauaaguguaagcccaugucuu

SEQ ID NO: 58813 - RNA, 73 nt, Mus musculus
aaaauaaaaaaagcaaaaccaaggaacuuccucccaaaaagacaaagaaaaauaacagcagcaacagcaaugu

SEQ ID NO: 58814 - RNA, 95 nt, Mus musculus
ccucucacagccccagcagaacaaaccaaagaaaaaggagaaggacaagaaggaaaagaaaaaggaaaagcacaaaaagaaagaagaaguggagg

SEQ ID NO: 58815 - RNA, 42 nt, Mus musculus
gcuggucucagagucugugugugugugugugugugugugugu

SEQ ID NO: 58816 - RNA, 46 nt, Mus musculus
uuucaugcccucaggugcuuucuugcacccaauaucuccagagcca

SEQ ID NO: 58817 - RNA, 46 nt, Mus musculus
gugucauggagauccugcagcuuuggaucagcaggacuggcccaag

SEQ ID NO: 58818 - RNA, 42 nt, Mus musculus
cacaaaauaaguuuuuuuaaaaagauucauuucaggccagau

SEQ ID NO: 58819 - RNA, 45 nt, Mus musculus
ugaguggcugguucugucugucugccuguucguaucccccaaccc

SEQ ID NO: 58820 - RNA, 47 nt, Mus musculus
ccaucaauaauguauuacacacacacacacacacacacacagagaga

SEQ ID NO: 58821 - RNA, 42 nt, Mus musculus
agacuuggcagcuauaucuccguaucugucucaugccgagaa

SEQ ID NO: 58822 - RNA, 46 nt, Mus musculus
cagccugugcagagucacccgcccaucauugcgaccaccccccagc

SEQ ID NO: 58823 - RNA, 46 nt, Mus musculus
cagccacuucagacuccuucaccgguacccccccagccaccacccc

SEQ ID NO: 58824 - RNA, 41 nt, Mus musculus
accaaacacaacucaagcaucaacuucuccgcagacccaga

SEQ ID NO: 58825 - RNA, 46 nt, Mus musculus
acagauggcuacaauuguccacuagucccuaguggcucugagaguu

SEQ ID NO: 58826 - RNA, 46 nt, Mus musculus
uuggugugccaugugacuacuuuguguuggaaguuagaaugcagcu

SEQ ID NO: 58827 - RNA, 44 nt, Mus musculus
ccuaaaaccuuaauccuugcaacuuggccuccucacugcugaga

SEQ ID NO: 58828 - RNA, 46 nt, Mus musculus
cucaguagaaccucccccuuccuccucauaugauuccuggaaagcg

SEQ ID NO: 58829 - RNA, 44 nt, Mus musculus
aaugaacugccuacagaagaaacugagaucaugauaguccaggc

SEQ ID NO: 58830 - RNA, 46 nt, Mus musculus
accaacccuuucaaauagaacgacucuggagggagacacuauacag

SEQ ID NO: 58831 - RNA, 42 nt, Mus musculus
aauugugcauaggauuggguguuucuuuuguggggaggaggg

SEQ ID NO: 58832 - RNA, 42 nt, Mus musculus
aaauagggauacuucuaaggagcccaaggacaggguugcugg

SEQ ID NO: 58833 - RNA, 45 nt, Mus musculus
caggcaucacuaauuugacucagugggguguuuaaaaaaggaaga

SEQ ID NO: 58834 - RNA, 47 nt, Mus musculus
ugauacuuacaaggaagggauguuuuaacgcccccgaagagaagggg

SEQ ID NO: 58835 - RNA, 46 nt, Mus musculus
uucuaauuuuaucacauuuagcagccuuuuaaaaauaaagggagac

SEQ ID NO: 58836 - RNA, 46 nt, Mus musculus
acacuuucuaauccuuccuaaacagucuaccaacuagggaccagac

SEQ ID NO: 58837 - RNA, 29 nt, Mus musculus
agguauggcguuggaacaguggcuaagag

SEQ ID NO: 58838 - RNA, 70 nt, Mus musculus
ccagccagcaaaugcagccagcaccaauccuccacccccagagaccuccaacccuaacaagcccaagaga

SEQ ID NO: 58839 - RNA, 44 nt, Mus musculus
cuacggagagcggcccugggacaagauugagaaaucugccagua

SEQ ID NO: 58840 - RNA, 46 nt, Mus musculus
ccucugccuccugagugcugggauuaaauaaaggugugcgccacca

SEQ ID NO: 58841 - RNA, 42 nt, Mus musculus
uuucuucuggaacagauuuagaaucaggguauucauuggggu

SEQ ID NO: 58842 - RNA, 46 nt, Mus musculus
ucagaaacugaaugucugaugggcacaguggccacacgggcaaguu

SEQ ID NO: 58843 - RNA, 46 nt, Mus musculus
aauguauuuuuuccuauggaccuggggcuagccacauuggccagaa

SEQ ID NO: 58844 - RNA, 46 nt, Mus musculus
caguuaucagugucucuuacuucuuucuuuuuguuccuggggagau

SEQ ID NO: 58845 - RNA, 45 nt, Mus musculus
augcaugcauguuugggagucucuuaaacaacccuaaugaacagc

SEQ ID NO: 58846 - RNA, 46 nt, Mus musculus
gcauuucaguugguugguauuuuuaguuuugaaaauggucuguguu

SEQ ID NO: 58847 - RNA, 45 nt, Mus musculus
guauguauguguauguguguguguguguauguaugugugugugug

SEQ ID NO: 58848 - RNA, 47 nt, Mus musculus
augggaggugccagaaacuugacagguuuuauguaugugguggguag

SEQ ID NO: 58849 - RNA, 47 nt, Mus musculus
caaaaauauucauauacauaaaugaaauauuuuuaagagccuaaaaa

SEQ ID NO: 58850 - RNA, 87 nt, Mus musculus
ggcaaggagaggagagagauugccuuucuuggagucacuuaagagaccaggggcaggaggcuaagcuggucaagguucaguucccag

SEQ ID NO: 58851 - RNA, 61 nt, Mus musculus
cauuaauuuuguguuacuucccucuccauccuguauaguuggaguucaugaugagaaguaa

SEQ ID NO: 58852 - RNA, 46 nt, Mus musculus
cuuggcccuugggaaguggcacuguuaggagguguugccuuguaag

SEQ ID NO: 58853 - RNA, 45 nt, Mus musculus
ugauuagaaugccuuccugcccucaggcauccggagagcuggaaa

SEQ ID NO: 58854 - RNA, 46 nt, Mus musculus
gcucuugaauuauuuuugagucuuacucaauguuuucccauuggaa

SEQ ID NO: 58855 - RNA, 46 nt, Mus musculus
uuguuuuccccccauuugucuaauuaaauugacaauagccuaagac

SEQ ID NO: 58856 - RNA, 45 nt, Mus musculus
aacuuuuauugguuaucucuuuuacuuuaguguauuugggagaug

SEQ ID NO: 58857 - RNA, 50 nt, Mus musculus
aggaaaaaggaacaauagaaacaugaaaaguauugcauuggauagagcag

SEQ ID NO: 58858 - RNA, 42 nt, Mus musculus
aaaaauacgucauuaauauggcugugagaaugacugccagau

SEQ ID NO: 58859 - RNA, 45 nt, Mus musculus
aaugaaacucuugauuuuguuucuagauauuuguuuccuugagua

SEQ ID NO: 58860 - RNA, 46 nt, Mus musculus
cagucugugaggcaagauacauacugggccaaugguacuucuggau

SEQ ID NO: 58861 - RNA, 46 nt, Mus musculus
ccggagaucucaaaauauaaauaacacuugguacuuacuguagaga

SEQ ID NO: 58862 - RNA, 45 nt, Mus musculus
uucagcagucuagagacuuucuccaagcuuuuauuacagcaucag

SEQ ID NO: 58863 - RNA, 63 nt, Mus musculus
gucucuauuggucaagauuugucuaaguaguugcauguaaagaacaagaagacaaaauuagau

SEQ ID NO: 58864 - RNA, 51 nt, Mus musculus
gccacaugcucuaguagggaugugauuuugacagcugcagauaauuucuga

SEQ ID NO: 58865 - RNA, 48 nt, Mus musculus
uuuaaucccauggauuaauccaugggauauaggacugcuucagauugu

SEQ ID NO: 58866 - RNA, 45 nt, Mus musculus
agccaacaagauagcuguguuccaguuuuguucaaaacuacuagu

SEQ ID NO: 58867 - RNA, 26 nt, Mus musculus
acuaucucacucagcaaagagauagg

SEQ ID NO: 58868 - RNA, 47 nt, Mus musculus
auuauuauaucuaaauacacuguagcugucuucauaugcaccagaag

SEQ ID NO: 58869 - RNA, 41 nt, Mus musculus
gcugccuguguucuuaaccucugagccaucuugagcccauc

SEQ ID NO: 58870 - RNA, 46 nt, Mus musculus
auuuguaccaggcacacacaugguacacacacgugcaggcaggcag

SEQ ID NO: 58871 - RNA, 56 nt, Mus musculus
ggggaaagagagaagguagaaagagggagagaccggccauggccaagaggagagaa

SEQ ID NO: 58872 - RNA, 60 nt, Mus musculus
cagcuggccuugaugaacagagacagucugugguuuuagagcuucauuguagaaaggcag

SEQ ID NO: 58873 - RNA, 45 nt, Mus musculus
cagguguugaacauucauuucucaugauccauguuugugggugug

SEQ ID NO: 58874 - RNA, 45 nt, Mus musculus
agaauugugcgaaugagcugcaggugggaguaguagcugacauuu

SEQ ID NO: 58875 - RNA, 46 nt, Mus musculus
acaucaugucccagaaucuacucguguuguuaccaaaaaaccaugg

SEQ ID NO: 58876 - RNA, 46 nt, Mus musculus
ccaacucaaagauccucuugccucugccucccaagugcugggauua

SEQ ID NO: 58877 - RNA, 91 nt, Mus musculus
cauauuuuuacuuuuuuucaaagauuuauuucuuaauuaugcaucuauguauggauaugauuauaugcaugugaaugcagugcccuuggaa

SEQ ID NO: 58878 - RNA, 42 nt, Mus musculus
acaggauccuuggaaauuguagccuguugugagccaccauau

SEQ ID NO: 58879 - RNA, 42 nt, Mus musculus
cagucuuuagcuuuuauugcccagcuaaaauggggagaagau

SEQ ID NO: 58880 - RNA, 45 nt, Mus musculus
aacauaugauccaguuauuauaagauauaucuagauugggcagau

SEQ ID NO: 58881 - RNA, 45 nt, Mus musculus
cugcuuuuuccucugaacaugaagauguucuguaggggccacuuc

SEQ ID NO: 58882 - RNA, 46 nt, Mus musculus
aggagggaaguaguuaauaacguaagacuggccuauagugacagaa

SEQ ID NO: 58883 - RNA, 45 nt, Mus musculus
guucuaccucagccuucugaauagugagaacuauaggugccuacc

SEQ ID NO: 58884 - RNA, 43 nt, Mus musculus
aaaauggauuggaauugugguagguuuaaagaugugggcaggg

SEQ ID NO: 58885 - RNA, 46 nt, Mus musculus
gcuagugagagaucaugucaaaaaagcccaaccaaaagguggguug

SEQ ID NO: 58886 - RNA, 46 nt, Mus musculus
cagccuagaagggaaagcacacuaccuucuaggaagcuagggagau

SEQ ID NO: 58887 - RNA, 45 nt, Mus musculus
gugcauugccugccaauaaacaguuaccacagcuuggcucaguaa

SEQ ID NO: 58888 - RNA, 46 nt, Mus musculus
auuuauuuacuuuuuauuuuauuuuauuuuauuuuucgagacaggg

SEQ ID NO: 58889 - RNA, 42 nt, Mus musculus
aaagguaauacuuuucuuuguguuguuucaguguggccagag

SEQ ID NO: 58890 - RNA, 45 nt, Mus musculus
uuuacauuuuauuuauuugagugcaugagugccacaguguggaag

SEQ ID NO: 58891 - RNA, 46 nt, Mus musculus
uuuggcagagggagucauuaaaaauacauaaaauucaucaccagaa

SEQ ID NO: 58892 - RNA, 42 nt, Mus musculus
guucucagaaguuaguaagaggugccgagguucuggggagag

SEQ ID NO: 58893 - RNA, 47 nt, Mus musculus
uugguuacaugagaccauaucaagagaaaaugaccagaagaacugaa

SEQ ID NO: 58894 - RNA, 46 nt, Mus musculus
uuccaacuuugcuuagagggagagacagggucuucaguacccagua

SEQ ID NO: 58895 - RNA, 82 nt, Mus musculus
auauauuucaagauuauaacuuaacauuuuuguaaucccaagaaugaaugaaguuuugaauuaccaguguucucucguaggc

SEQ ID NO: 58896 - RNA, 46 nt, Mus musculus
uaccauaaacuuaaauaauucauacuucuagaauuggggcagaaug

SEQ ID NO: 58897 - RNA, 46 nt, Mus musculus
aaguucuuggacagugguuauguccuugaacauacaagguaaagga

SEQ ID NO: 58898 - RNA, 46 nt, Mus musculus
gucauacuguauuuuugcuaaagcaucagcuuuaaagcagcucuag

SEQ ID NO: 58899 - RNA, 46 nt, Mus musculus
cucuggguuggaucauuguccauuugucaggcacaagggggcaaau

SEQ ID NO: 58900 - RNA, 23 nt, Mus musculus
aggucaagaagugguuucuucca

SEQ ID NO: 58901 - RNA, 29 nt, Mus musculus
uacaugccuguauuuccaauacuagagag

SEQ ID NO: 58902 - RNA, 47 nt, Mus musculus
acuccguuucuuguguauaaaauagaguaaaaguuagguuguauaga

SEQ ID NO: 58903 - RNA, 45 nt, Mus musculus
auacaggugaaccuuugguaaaguuaaguacuuaaagcaccgugu

SEQ ID NO: 58904 - RNA, 42 nt, Mus musculus
ugaauuggacccucaauuaaggguggguuuuaagagccuugc

SEQ ID NO: 58905 - RNA, 44 nt, Mus musculus
guccaagucauagaucaguuugauacaaguguauaggcgaaagu

SEQ ID NO: 58906 - RNA, 46 nt, Mus musculus
agccaacguugaccuugaacguuggaauuacaagugugccccacca

SEQ ID NO: 58907 - RNA, 121 nt, Mus musculus
ucaggaaaaagguuuguguauaaguauuuauauggacauggauuaauuuuaugggccagauaucuaggagugauuugauaggccagaugguaauuuuuuuaaaaucauuuuugaagaugua

SEQ ID NO: 58908 - RNA, 49 nt, Mus musculus
aagauagaauagugcugccuauaauaacuccuucuguauaaggucaaga

SEQ ID NO: 58909 - RNA, 46 nt, Mus musculus
gcuguuucaacccugaccugcagaaaauauuuuaaaagggagaagu

SEQ ID NO: 58910 - RNA, 42 nt, Mus musculus
uagaaggaaaguuugucauugaaauuuacuaauggagcuggg

SEQ ID NO: 58911 - RNA, 45 nt, Mus musculus
cacaguuaaaaauuguaaugucuaaguuugaaagaaccugugaga

SEQ ID NO: 58912 - RNA, 46 nt, Mus musculus
gaguauguuuauuaauauuugugcacacaugcauucuccccuggag

SEQ ID NO: 58913 - RNA, 46 nt, Mus musculus
caauaauuuacaagaacauuauuuuauucacuuuaauuuggaugga

SEQ ID NO: 58914 - RNA, 45 nt, Mus musculus
auuggaaaauuuuuaugaauggagaugucaacuucccuuggaauu

SEQ ID NO: 58915 - RNA, 42 nt, Mus musculus
uggcuucuuacuugcaggagugugucgguuuaggguggggau

SEQ ID NO: 58916 - RNA, 42 nt, Mus musculus
cgucugcuguuggcauagcugcuucguuucuggccucagcag

SEQ ID NO: 58917 - RNA, 42 nt, Mus musculus
uuuucuccuguaacagaaaaguccccucgagacacugaggag

SEQ ID NO: 58918 - RNA, 45 nt, Mus musculus
agcuguuagagguuccugguguaccaggaugagaacccagaggag

SEQ ID NO: 58919 - RNA, 46 nt, Mus musculus
gacccuaggauuaucuaggcagucagagaucugcagagacuuccag

SEQ ID NO: 58920 - RNA, 58 nt, Mus musculus
gcauaccguuuucagacagaucuccgucacugucagcacgggccaguuuggcaucagg

SEQ ID NO: 58921 - RNA, 46 nt, Mus musculus
augcccucuucuggaaugucugaaaacagcuacaguguacuuacau

SEQ ID NO: 58922 - RNA, 41 nt, Mus musculus
cgcuuuagccccgccccuggagccgccauuuuguggcgucu

SEQ ID NO: 58923 - RNA, 45 nt, Mus musculus
uucgcucagaacgcaugcguucaacgugcugucugcuacuggaag

SEQ ID NO: 58924 - RNA, 45 nt, Mus musculus
gcacuucuaggggcccgcccucaccacagcacaaacgaagaccuc

SEQ ID NO: 58925 - RNA, 54 nt, Mus musculus
uacaacaccgccaccuccgccaccaccagaagaggaggagagcccuguacccuu

SEQ ID NO: 58926 - RNA, 41 nt, Mus musculus
auucucaacaacaagcucauuagcaagaagcuggagcgaua

SEQ ID NO: 58927 - RNA, 45 nt, Mus musculus
caaggcuggccugaucucacuauguaguccaugcuggucucucag

SEQ ID NO: 58928 - RNA, 45 nt, Mus musculus
ugaaagggaauugguucucucucuccagcaugagugucccagagc

SEQ ID NO: 58929 - RNA, 37 nt, Mus musculus
gaaggccgugacucugucucuaacauaaacugggcag

SEQ ID NO: 58930 - RNA, 45 nt, Mus musculus
uugggucagaucuuggucucuguagauuuguuggaucagaccauc

SEQ ID NO: 58931 - RNA, 45 nt, Mus musculus
guccgguauuugcagagagaacacacaaacuggauccugccacag

SEQ ID NO: 58932 - RNA, 42 nt, Mus musculus
ggguaggcuggggcugguaggguugggagcagaaggggauag

SEQ ID NO: 58933 - RNA, 38 nt, Mus musculus
gaagccuggggucuagggccugggcuggaacaggccgc

SEQ ID NO: 58934 - RNA, 42 nt, Mus musculus
cagagcaggugguggcucccaagggaggucagagggcggcga

SEQ ID NO: 58935 - RNA, 46 nt, Mus musculus
cagucuguucugguagcuuugcugucuggcucaucaggacugccac

SEQ ID NO: 58936 - RNA, 46 nt, Mus musculus
gccaaauccaaagccaaaucgggagccaccagagaaggcaccccca

SEQ ID NO: 58937 - RNA, 56 nt, Mus musculus
uguucugggagaagagggagggcagccgggaggcaccaggcaugcacuggccccgg

SEQ ID NO: 58938 - RNA, 46 nt, Mus musculus
uuaacaaagggaagcacagugaccuaauuaggagcucagcauuggg

SEQ ID NO: 58939 - RNA, 24 nt, Mus musculus
aaagagaaggagaugaccacagua

SEQ ID NO: 58940 - RNA, 42 nt, Mus musculus; identical to SEQ ID NO: 27136

SEQ ID NO: 58941 - RNA, 41 nt, Mus musculus
gagggagacagagagggagggacagagagagagagggacag

SEQ ID NO: 58942 - RNA, 46 nt, Mus musculus
ggccuuggcaagcuaggccaacacuacaucacuaagcugucccuag

SEQ ID NO: 58943 - RNA, 66 nt, Mus musculus
ccuggaaaacuucagaauuuugagcaugggcagaaacuggagaguagagcagggaguagagcaggg

SEQ ID NO: 58944 - RNA, 42 nt, Mus musculus
auaauggagcccacuaaugcaucuucaggacagagggcaaaa

SEQ ID NO: 58945 - RNA, 41 nt, Mus musculus
ugagaagacauuggauaacaaugguuacaugagaauguugg

SEQ ID NO: 58946 - RNA, 41 nt, Mus musculus
gaagaagaagaagaaauaguaguaguaguaguaguggggag

SEQ ID NO: 58947 - RNA, 42 nt, Mus musculus
caagaaguagaggaaaaagaggaugaggaggagaaggaagaa

SEQ ID NO: 58948 - RNA, 44 nt, Mus musculus
ucugugugucugugugucuguguguguguguggugugugugugu

SEQ ID NO: 58949 - RNA, 46 nt, Mus musculus
gauuuacacccagagucugaaguaggugacuuacuacuugauagag

SEQ ID NO: 58950 - RNA, 42 nt, Mus musculus
ccagccaaaagagauggacaucuuggaaagucuggcccauuu

SEQ ID NO: 58951 - RNA, 42 nt, Mus musculus
aagauaugaccuuuucuacaaaauuguauaugggacccuggu

SEQ ID NO: 58952 - RNA, 26 nt, Mus musculus
uucaaggcugagacagggacucacuc

SEQ ID NO: 58953 - RNA, 42 nt, Mus musculus
caacgugugugugugugugugugucugugugucugugugucu

SEQ ID NO: 58954 - RNA, 46 nt, Mus musculus
agacucuccuugaugcacauggucaggaaggguagcugggccaggu

SEQ ID NO: 58955 - RNA, 45 nt, Mus musculus
aggcaggaugcggaagcgcagcagagucagcgccagugccaccuu

SEQ ID NO: 58956 - RNA, 44 nt, Mus musculus
uccgcauccugccggaugacaaggagccgcgccggaagccagag

SEQ ID NO: 58957 - RNA, 45 nt, Mus musculus
uucuuucggcucccucaucuguaaugaucccugguccucugagag

SEQ ID NO: 58958 - RNA, 46 nt, Mus musculus
gugccaucuucuuuggcaugacuagccucucccuuacccagcaggc

SEQ ID NO: 58959 - RNA, 45 nt, Mus musculus
agaauuuuaugcaugcacauaaugcauuuugaucaagcccacaca

SEQ ID NO: 58960 - RNA, 46 nt, Mus musculus
agguauauuugacuuuuugucuggucgcuuguuucuugggcuuuug

SEQ ID NO: 58961 - RNA, 44 nt, Mus musculus
caucuaauuuacagcucucuuccuuccucugcuuucuggguguu

SEQ ID NO: 58962 - RNA, 46 nt, Mus musculus
gcuugcugugugugugugugugugugugugugugugugcgugugug

SEQ ID NO: 58963 - RNA, 46 nt, Mus musculus
auugaaaaauuuuaguuuaucuauugaugggcacuuaggcugagau

SEQ ID NO: 58964 - RNA, 45 nt, Mus musculus
guauuaguuuaauaggugauaucuuuuuguauuuaauaaguagau

SEQ ID NO: 58965 - RNA, 46 nt, Mus musculus
uauuaguggaaaccucuaugaacaccauuugguucaaugaacagac

SEQ ID NO: 58966 - RNA, 61 nt, Mus musculus
gaccucuuugugugcaauuacugugggaaaaccuuacgucauuacagcucucuucaaauuc

SEQ ID NO: 58967 - RNA, 45 nt, Mus musculus
aguacuuacacuguagagagaaucuauaaaacugagcguugugac

SEQ ID NO: 58968 - RNA, 46 nt, Mus musculus
aggaauaugggaaggaauuauacaauauggaauauggggcccccuc

SEQ ID NO: 58969 - RNA, 42 nt, Mus musculus
cugcucaggaguagcaccauccaaagugaucugggcccuucc

SEQ ID NO: 58970 - RNA, 41 nt, Mus musculus
gaucaggaacuaacuaaguaggacagggaccuggaagcagg

SEQ ID NO: 58971 - RNA, 64 nt, Mus musculus
accauugugauaacaguaccaagauuuacuaccaccucagauuggagccucuggcuuugcccuc

SEQ ID NO: 58972 - RNA, 42 nt, Mus musculus
ucuacaggaacucagacucucaaauggugccuggccccagcu

SEQ ID NO: 58973 - RNA, 42 nt, Mus musculus
acauucuccaaggcuaaccucagucuagaccccucauaagug

SEQ ID NO: 58974 - RNA, 45 nt, Mus musculus
cuauuuguugauuuuucuucaguaucauaagacauagggacaaaa

SEQ ID NO: 58975 - RNA, 42 nt, Mus musculus
ugugagccaccauguguuugcugggauuugaacucacgaccu

SEQ ID NO: 58976 - RNA, 81 nt, Mus musculus
uaugugugguguguguguguguguguguguguguguguguuuccugcaugcuccagcuugcauguuuagaggucagagaaa

SEQ ID NO: 58977 - RNA, 46 nt, Mus musculus
uaaauauuuuuuauaaaugugaagaagagagaacugggugggaguc

SEQ ID NO: 58978 - RNA, 46 nt, Mus musculus
ugcaugugugaaugugugucacauaugugcacugccugccccaccc

SEQ ID NO: 58979 - RNA, 44 nt, Mus musculus
uaggauugauuuuaaaaaacaaaaacccaugaaauagccagagu

SEQ ID NO: 58980 - RNA, 42 nt, Mus musculus
guggaagcauggaggcaugcaggcagauguggugcuggagag

SEQ ID NO: 58981 - RNA, 42 nt, Mus musculus
agccuuugugccuuguaaguuguaguaaacauguccccuuaa

SEQ ID NO: 58982 - RNA, 46 nt, Mus musculus
aaccaaacaaacaaacaaacauaaaacccaaaaucaaaaaccaaaa

SEQ ID NO: 58983 - RNA, 46 nt, Mus musculus
cugccuccauccauugcuggaugaagccuccagcuaguuaccagag

SEQ ID NO: 58984 - RNA, 46 nt, Mus musculus
uuuuuacagaauuuagaaaacauuucuuaauaaaguggcuccaugu

SEQ ID NO: 58985 - RNA, 46 nt, Mus musculus
acuuuccaaguccuccuaacauuguccgacucauagaaagggagag

SEQ ID NO: 58986 - RNA, 33 nt, Mus musculus
gccuucuggagugcuggcaaauaguagcucuuu

SEQ ID NO: 58987 - RNA, 42 nt, Mus musculus
uucuagucauuucuccucaccccaaaaaugcccuacccccau

SEQ ID NO: 58988 - RNA, 46 nt, Mus musculus
ccacugauuucuguucccuucucggcaggguaagggugggacucca

SEQ ID NO: 58989 - RNA, 42 nt, Mus musculus
aaaccccuccuuucauaacuaggauuugggaaccuggcaaga

SEQ ID NO: 58990 - RNA, 45 nt, Mus musculus
gaauauacaaauaauuccugaaaaucaaagacaugugguccaaga

SEQ ID NO: 58991 - RNA, 45 nt, Mus musculus
aaaggugauuugguugaauguuauuugaaaaagcaaauaacaaga

SEQ ID NO: 58992 - RNA, 79 nt, Mus musculus
uuuuaggagguguggccuuguugaaguagguguggcuuuguuggaggaagugugucacuguguagguaggcuuugaaga

SEQ ID NO: 58993 - RNA, 48 nt, Mus musculus
uuuaaugaaauuuugcuuuguauguaguccaggcuugucuugaaacag

SEQ ID NO: 58994 - RNA, 45 nt, Mus musculus
gcucugccugaccagaacucacuguauagaccaugccggccacaa

SEQ ID NO: 58995 - RNA, 36 nt, Mus musculus
ugcccaaucuaggcgcacagcuuguaaucauauuaa

SEQ ID NO: 58996 - RNA, 41 nt, Mus musculus
agggguguguaugugugugugugugagagagagagagagag

SEQ ID NO: 58997 - RNA, 41 nt, Mus musculus
ugcuuggaggugauggaaacuuagugauuggggggcugcug

SEQ ID NO: 58998 - RNA, 41 nt, Mus musculus
uuggaggcucauaagugcaugauaaugcagggggcggcaga

SEQ ID NO: 58999 - RNA, 46 nt, Mus musculus
gcuacuuacagacugaaaagauugcuaaacaaguauacggcacaag

SEQ ID NO: 59000 - RNA, 42 nt, Mus musculus
agugcccacagaauccugaagagggcauuggaucugcuggaa

SEQ ID NO: 59001 - RNA, 42 nt, Mus musculus
aaaaauaaauaaauauaaguaggccagguggugguagcagau

SEQ ID NO: 59002 - RNA, 62 nt, Mus musculus
uguguauauguauacauauugucuccacagugcagcacuccugcaugcggaagggcuagaaa

SEQ ID NO: 59003 - RNA, 45 nt, Mus musculus
uuuauacauaauuuacauucuuuagcuguuuucuaguaaguagau

SEQ ID NO: 59004 - RNA, 46 nt, Mus musculus
cuuagcaagcaccuuuacucauugagccuuaucaucagccccaaau

SEQ ID NO: 59005 - RNA, 46 nt, Mus musculus
auguuccacauaccuucacaaacaugaaagaauucacacuggagag

SEQ ID NO: 59006 - RNA, 42 nt, Mus musculus
augaaagaagucauacccgagaaaaacuuuaugcguguaagc

SEQ ID NO: 59007 - RNA, 68 nt, Mus musculus
aauuccagucaccuuaucaaacauuauaaaauucauaccagagagaagacauuugcauguaaauauug

SEQ ID NO: 59008 - RNA, 46 nt, Mus musculus
gaaauguauggaaaagccuauuaagcauaagaaauauuggaaagau

SEQ ID NO: 59009 - RNA, 47 nt, Mus musculus
gaauuugaacgugguauucaguauagagaaaugcaccaacagauuca

SEQ ID NO: 59010 - RNA, 46 nt, Mus musculus
uaaggguuccacuucuccuuuagucuauuacccagcagagguagug

SEQ ID NO: 59011 - RNA, 44 nt, Mus musculus
aauaaccagugguuguauauuucuggaguaacuacucaggaaga

SEQ ID NO: 59012 - RNA, 45 nt, Mus musculus
caguuagccugccugcuggaguuagaggaacuuuagagaagaaga

SEQ ID NO: 59013 - RNA, 42 nt, Mus musculus
agauccuaucccccagauuuagacuuuucauggugaccaagu

SEQ ID NO: 59014 - RNA, 46 nt, Mus musculus
uccuuguguuggaguuuuucaucuguuauccuuuguagggcuggau

SEQ ID NO: 59015 - RNA, 41 nt, Mus musculus
cuuuuuguuguuauugaagaccagccuuaguccuuggugau

SEQ ID NO: 59016 - RNA, 80 nt, Mus musculus
uucauucucaguccguuuaucauuugaauauaggaaggcugcugauuuauuugaguuaauuuuacauccagccccuuugc

SEQ ID NO: 59017 - RNA, 45 nt, Mus musculus
gcaagauggccauuuugacuauauuaauccugccaacccaugagc

SEQ ID NO: 59018 - RNA, 42 nt, Mus musculus
uggcacuauuaggagguguagccuuguuggaguggguguggc

SEQ ID NO: 59019 - RNA, 85 nt, Mus musculus
agcuuuuuuggcucuaaauugaagaugaacuuggaggguaaccagaggaaaauuuaaucgaguuuuugagguugagagggggaaa

SEQ ID NO: 59020 - RNA, 45 nt, Mus musculus
cugaccuagggaucccagccugauuuuagccacuucuugcaccag

SEQ ID NO: 59021 - RNA, 46 nt, Mus musculus
uccccacgccuguguugguugagccagucuggcaacugucugaggc

SEQ ID NO: 59022 - RNA, 45 nt, Mus musculus
gugacugugugggugggcaguggguacggagaugcugugcuagau

SEQ ID NO: 59023 - RNA, 45 nt, Mus musculus
cuccugcaugcuggggaaacucucagugcagcucagcgcggagca

SEQ ID NO: 59024 - RNA, 44 nt, Mus musculus
auuagaacuagcucuguagaacaggcuggccauaaacucagaga

SEQ ID NO: 59025 - RNA, 46 nt, Mus musculus
gagauaguguuuacuauguacccuggcuggaccuugucacuuagau

SEQ ID NO: 59026 - RNA, 46 nt, Mus musculus
ucaggagcaggaaguggggugcacaagcguggguugagcugcggau

SEQ ID NO: 59027 - RNA, 46 nt, Mus musculus
uuguugaagccccagucuaagugaguugaugaccacaaggguagau

SEQ ID NO: 59028 - RNA, 46 nt, Mus musculus
uaucuccgaggucacccuuaaggagcauuaucauaaagacacagag

SEQ ID NO: 59029 - RNA, 42 nt, Mus musculus
ucagggacuguuugcuuuccucagagaugaacucgcugagag

SEQ ID NO: 59030 - RNA, 45 nt, Mus musculus
cucacugucaccccaaguagaggaacugcccuccacaguccagau

SEQ ID NO: 59031 - RNA, 85 nt, Mus musculus
aaaaaggacuggggagaaccggugaucaggcagagggcaaagagaggucaagggggagcaguggcacaaagcacaaagguugaag

SEQ ID NO: 59032 - RNA, 48 nt, Mus musculus
aaggaauaaguaguuagguccuguuagagguuagacacagcuuaggug

SEQ ID NO: 59033 - RNA, 45 nt, Mus musculus
cugcaguggcuucuugggaaaaguacuggauucagauggcaaggg

SEQ ID NO: 59034 - RNA, 41 nt, Mus musculus
ggagcccgcacuagcagagggcagggagcauucagacacug

SEQ ID NO: 59035 - RNA, 45 nt, Mus musculus
guugcugcggcucuccugaagcuuuggauauugauggggccaggu

SEQ ID NO: 59036 - RNA, 45 nt, Mus musculus
gugcaauauguugagguuguugagcuuggaagugggucccaguag

SEQ ID NO: 59037 - RNA, 46 nt, Mus musculus
uacugggacccacuuccaagcucaacaaccucaacauauugcacag

SEQ ID NO: 59038 - RNA, 44 nt, Mus musculus
aaggauacuuagaaugaggacuuucuuuagccuuacacccaugu

SEQ ID NO: 59039 - RNA, 45 nt, Mus musculus
guaugaugcuguggaggccacagaugacucuaguaucagccccag

SEQ ID NO: 59040 - RNA, 46 nt, Mus musculus
cccaguaagacaggggaagggaagcucagcuggaaucccaacagau

SEQ ID NO: 59041 - RNA, 63 nt, Mus musculus
gaggcagaugagagaagcaggugcaguacagguucuaggcaggaaccagguaucugcuggagu

SEQ ID NO: 59042 - RNA, 41 nt, Mus musculus
ugguggccacaccuuuaaucccaguacucgaggaggaggua

SEQ ID NO: 59043 - RNA, 46 nt, Mus musculus
acuuuucagccuuuauuuuccucaccaaagugaaccuuacccacag

SEQ ID NO: 59044 - RNA, 46 nt, Mus musculus
agaccccaagcugcugaaacagaucaggaaggcagaaaaggcugag

SEQ ID NO: 59045 - RNA, 46 nt, Mus musculus
uucugggcucugccuccugccuacaccaccauagccagugccagca

SEQ ID NO: 59046 - RNA, 44 nt, Mus musculus
ugaguggaaggaaccugcuucuccuguuuuccagacuucagaga

SEQ ID NO: 59047 - RNA, 45 nt, Mus musculus
ggccucuccuguccugccugcucaagagaagcuaaaagccccuug

SEQ ID NO: 59048 - RNA, 42 nt, Mus musculus
gcucccacccuccaagugagcuccgccugccagcccaauggc

SEQ ID NO: 59049 - RNA, 45 nt, Mus musculus
cugggauuaaaggcgugcgccaccacugcccggcuugcccugcac

SEQ ID NO: 59050 - RNA, 99 nt, Mus musculus
agcaaaucgcugaccgugcagcccacgaugaguccccuggcaacaacgugguggacaucagugugccacccaccaccgauggacagagacccaacaagc

SEQ ID NO: 59051 - RNA, 47 nt, Mus musculus
cuaggguacacagcuugcucacgacauccucccuguugcagaaaucu

SEQ ID NO: 59052 - RNA, 42 nt, Mus musculus
uuggcugugccugggaaccuccaagagcccaaccccgaauuc

SEQ ID NO: 59053 - RNA, 88 nt, Mus musculus
uuccagaaaagaacaacuuguccuucauugagaccucagccuuggauuccaccaauguagaggaagcauucaagaacauccucacagg

SEQ ID NO: 59054 - RNA, 46 nt, Mus musculus
aacucuucagauccugaguuggcaggugggcagguaugguccugga

SEQ ID NO: 59055 - RNA, 45 nt, Mus musculus
agacuggacagguucagagaaacaucuagaaguccggcacccacc

SEQ ID NO: 59056 - RNA, 48 nt, Mus musculus
ccugcgccaccuucgggcugugcccacugaugaggcccgugccuuugc

SEQ ID NO: 59057 - RNA, 51 nt, Mus musculus
ugggugcacugcugguauaugacauugccaagcacuugacauaugagaacg

SEQ ID NO: 59058 - RNA, 42 nt, Mus musculus
uugcuaagacccacccagauugccucuuugugacccccaacc

SEQ ID NO: 59059 - RNA, 89 nt, Mus musculus
gaccuagagauagcagggguguguggauauaugucaugggagcuuggaaggguauguaggggcugaacuagagcauggaaaauuugaga

SEQ ID NO: 59060 - RNA, 46 nt, Mus musculus
accugcugucacgcuucaccagaaacgaauucaaccuagagagcaa

SEQ ID NO: 59061 - RNA, 46 nt, Mus musculus
uagcuugcagcagcucuaacauggguaguguggcaccacugaagca

SEQ ID NO: 59062 - RNA, 48 nt, Mus musculus
uguauuaggggcagagcgggagcccauguagcuggcuagagcaugugg

SEQ ID NO: 59063 - RNA, 45 nt, Mus musculus
aaacagccucuuuuuguucucucucuuaguaaucaguuuguggau

SEQ ID NO: 59064 - RNA, 42 nt, Mus musculus
auuuguuuuccuccauaaauaguuucuucagccccaggagug

SEQ ID NO: 59065 - RNA, 46 nt, Mus musculus
cacuuuagaggcagaguacguuuuggaaagguuuuggagaccagag

SEQ ID NO: 59066 - RNA, 45 nt, Mus musculus
ggagccuggaucaugugcaggaacccuauauuauggugcuuugga

SEQ ID NO: 59067 - RNA, 46 nt, Mus musculus
agaagccccggcagcgcccgcaccgcacccgagcccgcccccucga

SEQ ID NO: 59068 - RNA, 46 nt, Mus musculus
gcuacaagcaaggcuaaguuguauacugaaaaacuauuuccgaaag

SEQ ID NO: 59069 - RNA, 49 nt, Mus musculus
guuacugacuaguggugaaugcccaucacucaagagguagaagcaggca

SEQ ID NO: 59070 - RNA, 23 nt, Mus musculus
aaguguguugaagugagaguggc

SEQ ID NO: 59071 - RNA, 40 nt, Mus musculus
ccagcaucuuugucauugugggggccagggguuccagcgu

SEQ ID NO: 59072 - RNA, 45 nt, Mus musculus
aggaggccagucuagacucagaauccugaacagugaugaccagga

SEQ ID NO: 59073 - RNA, 46 nt, Mus musculus
ucucugcuggugacuccacguggccgguucagcugcugauucagag

SEQ ID NO: 59074 - RNA, 46 nt, Mus musculus
cagcagcucaggccccaggcuuuucaccccucgaagaaccccagcc

SEQ ID NO: 59075 - RNA, 46 nt, Mus musculus
ucaauaggaaguucagcuucagaaaacaaaguagggagucagaaga

SEQ ID NO: 59076 - RNA, 45 nt, Mus musculus
guguccauugcaccuggcuagccuuggcauugacaucacccauac

SEQ ID NO: 59077 - RNA, 42 nt, Mus musculus
caaggauaagaaaauuaaaucaucucuuaagaguccggucag

SEQ ID NO: 59078 - RNA, 46 nt, Mus musculus
cuuacccgaugcgacuccacgcgauggcuugggguuguggggcagg

SEQ ID NO: 59079 - RNA, 42 nt, Mus musculus
uauccuagucuacggcuucacucucaaaagaacgcccccucc

SEQ ID NO: 59080 - RNA, 46 nt, Mus musculus
acgcuuggcagggaaauggaagucaugccuuucaguaggaccuggu

SEQ ID NO: 59081 - RNA, 42 nt, Mus musculus
acuuauccacaaugugccacaucuggaggaccgaccccacug

SEQ ID NO: 59082 - RNA, 46 nt, Mus musculus
acugcugggagacugauucucacuggcccugcuggagguaugggaa

SEQ ID NO: 59083 - RNA, 43 nt, Mus musculus
cccacaggggccaaacagaguugccgaaacccugucuguagcu

SEQ ID NO: 59084 - RNA, 41 nt, Mus musculus
cuuagaaggaaaaugaaagugaaaggggaagaaaagacuug

SEQ ID NO: 59085 - RNA, 25 nt, Mus musculus
acgagcaggagcagaggcuucaugg

SEQ ID NO: 59086 - RNA, 46 nt, Mus musculus
cuacacacaggccggaaggcacaaacuagcaaaguagugaacgacu

SEQ ID NO: 59087 - RNA, 42 nt, Mus musculus
uggaagccagaaggucccauucccaguccacgggccccaggg

SEQ ID NO: 59088 - RNA, 41 nt, Mus musculus
uaccugccaccuccagggugacgucagcacugcgccccgau

SEQ ID NO: 59089 - RNA, 33 nt, Mus musculus
uccucgauggagggcccugagaagccuggcaaa

SEQ ID NO: 59090 - RNA, 58 nt, Mus musculus
uugaguuccugggaauggucaggcuggcagcuguggccuucuccuuugagacuucagg

SEQ ID NO: 59091 - RNA, 44 nt, Mus musculus
gggcuacacagagaaacccugucucaaaaagccaaggcaggagg

SEQ ID NO: 59092 - RNA, 46 nt, Mus musculus
ggcgugggagcaggcuggggcugucauuucccaccggccagacaug

SEQ ID NO: 59093 - RNA, 44 nt, Mus musculus
gcuacuggagucaucugggccagagaugaggguggcuuccacag

SEQ ID NO: 59094 - RNA, 46 nt, Mus musculus
gaaacucccuauuuguagaucaggcuggcauggaaaugucagagau

SEQ ID NO: 59095 - RNA, 46 nt, Mus musculus
gccgagacccaccaggcccggagaugguaaagguggaccaggcaaa

SEQ ID NO: 59096 - RNA, 41 nt, Mus musculus
gaccuaggugggagucccugaggaaggcugggggagggaga

SEQ ID NO: 59097 - RNA, 45 nt, Mus musculus
agugaggcggggaggaagagaccgagggacccagagacaccgaaa

SEQ ID NO: 59098 - RNA, 46 nt, Mus musculus
caaaaaacgaggagggagacagggaccaagauacaacugcccagug

SEQ ID NO: 59099 - RNA, 46 nt, Mus musculus
uccccccaggcugcccgaagccuguggauagggcuggacugcagag

SEQ ID NO: 59100 - RNA, 42 nt, Mus musculus
agagagggaaauccaccacccagccccacccccacacuccuc

SEQ ID NO: 59101 - RNA, 84 nt, Mus musculus
aaaggcuccugggaaagccugaccccgugggagggggucaggagggagggaugaggcuaacccugagccaauaaaauguaaaca

SEQ ID NO: 59102 - RNA, 28 nt, Mus musculus
gagcugggggaggcucgggccacaguag

SEQ ID NO: 59103 - RNA, 39 nt, Mus musculus
agcucgaagcacagcuaacggaaaacaauaucgugaagg

SEQ ID NO: 59104 - RNA, 57 nt, Mus musculus
gcuuucuccuucaccauggcugaacugauccaaaagaagcugcagggagagguagag

SEQ ID NO: 59105 - RNA, 41 nt, Mus musculus
ggaagcuuggaagcuggugagcggcaugaauggggagagga

SEQ ID NO: 59106 - RNA, 45 nt, Mus musculus
acacacugugucaaauuggcuggugcuacccacuaccccuuggau

SEQ ID NO: 59107 - RNA, 76 nt, Mus musculus
gucagagcugauacaaagaggggggccuucggagcaauggcagaagggcaaagaggcccaggaagagacaacagcu

SEQ ID NO: 59108 - RNA, 47 nt, Mus musculus
cacucgcuccaccucauccuccgugaguucuccagcccucuugguga

SEQ ID NO: 59109 - RNA, 46 nt, Mus musculus
cuuaaauuauaaagaaccgacuccuaacacuuaaagcaguuuggag

SEQ ID NO: 59110 - RNA, 47 nt, Mus musculus
guugaguacucgcaaaaugugcuggaacuucucagggaucacuagag

SEQ ID NO: 59111 - RNA, 24 nt, Mus musculus
uaccauggcggcggcacagacggc

SEQ ID NO: 59112 - RNA, 46 nt, Mus musculus
ucagcacaugguggcugucaaccaucugcaacuucaguucccaggg

SEQ ID NO: 59113 - RNA, 44 nt, Mus musculus
gaguggagggcacaggaauguuuggacaucacugucccaccagc

SEQ ID NO: 59114 - RNA, 46 nt, Mus musculus
uauuucauuuuaugaaccuaccaugcccagugggucacagccucau

SEQ ID NO: 59115 - RNA, 42 nt, Mus musculus
caagcuguaacauuugcugugcauucgcugugugcuaggaag

SEQ ID NO: 59116 - RNA, 46 nt, Mus musculus
uaccagcuuuuuccggcagguagggcacuccuuguuccugggugug

SEQ ID NO: 59117 - RNA, 45 nt, Mus musculus
aggcacuccuugguggucauuguguucuucagcauguccaggcag

SEQ ID NO: 59118 - RNA, 45 nt, Mus musculus
gaguggcucuaacaacgucuguuugggaagcaagggagcaagauc

SEQ ID NO: 59119 - RNA, 42 nt, Mus musculus
caugauguaauaauauccaugauccagagaccagggugagga

SEQ ID NO: 59120 - RNA, 46 nt, Mus musculus
ggagaaaauuuguuccccgucaaauucgugugugaacuguccagaa

SEQ ID NO: 59121 - RNA, 44 nt, Mus musculus
acgccauguuugguaucagggauuaauagauuugggguuggugg

SEQ ID NO: 59122 - RNA, 45 nt, Mus musculus
uugaguugagguuggaaaagaaaaggaucuauuuagccucgaaca

SEQ ID NO: 59123 - RNA, 46 nt, Mus musculus
uucccuuucugggguacuaagccuguaacuuuaacauggucaagau

SEQ ID NO: 59124 - RNA, 46 nt, Mus musculus
gugggcgaggagaccgcugucuguguauagcugcagcuacugaggu

SEQ ID NO: 59125 - RNA, 46 nt, Mus musculus
uuuuaauuuauuuuuauuuauguauauuaguguuuugccugcaugu

SEQ ID NO: 59126 - RNA, 42 nt, Mus musculus
aggagucaacuccagauuguggugggcuguggagggggaggg

SEQ ID NO: 59127 - RNA, 42 nt, Mus musculus
agcccacaguguugggcuugcaagcacacuagacugagagaa

SEQ ID NO: 59128 - RNA, 42 nt, Mus musculus
agcuuugccaacgaggagggugaggcccagaaguucaggcag

SEQ ID NO: 59129 - RNA, 42 nt, Mus musculus
ccggacuccuugcucuccacucaguggcucguuggcacccuc

SEQ ID NO: 59130 - RNA, 41 nt, Mus musculus
ugaguguguauguguguguauuugagugagucugugugucu

SEQ ID NO: 59131 - RNA, 46 nt, Mus musculus
gugaguacguaugugugugccuguguauguauguguguauguaugu

SEQ ID NO: 59132 - RNA, 59 nt, Mus musculus
gguguccuugggaggccugcuuuuuucugaagggcaaucgaggagagguaggggguuga

SEQ ID NO: 59133 - RNA, 46 nt, Mus musculus
uggcguugugauagaaugagaagaaacgcccaaaguguacagagag

SEQ ID NO: 59134 - RNA, 42 nt, Mus musculus
gcuagcccugaagaaccaacguggagauuaaggcaugggaag

SEQ ID NO: 59135 - RNA, 42 nt, Mus musculus
uuaaauucccaaacucuccuuuacucuuaugucccgucccac

SEQ ID NO: 59136 - RNA, 41 nt, Mus musculus
acgaccuuggccgcagagcuauugcuuaugcuacccacaga

SEQ ID NO: 59137 - RNA, 44 nt, Mus musculus; identical to SEQ ID NO: 43207

SEQ ID NO: 59138 - RNA, 87 nt, Mus musculus
agccccagagagcugaaccuaugagggagaggaagaagaagagaagaagagugacuagggagccugcagcagcaggaguccccagac

SEQ ID NO: 59139 - RNA, 41 nt, Mus musculus; identical to SEQ ID NO: 43209

SEQ ID NO: 59140 - RNA, 45 nt, Mus musculus
uacccccuccucgucccaguucugugaggacuguggugcccacuu

SEQ ID NO: 59141 - RNA, 42 nt, Mus musculus
cgaguugccacacugagucagagggagaacagaaggcaagaa

SEQ ID NO: 59142 - RNA, 25 nt, Mus musculus
gugaugaaguguaauaccuuguggu

SEQ ID NO: 59143 - RNA, 44 nt, Mus musculus
ccacagccccgaacagugaguuucuggggggcgagacgggcccg

SEQ ID NO: 59144 - RNA, 42 nt, Mus musculus
cgucacuuccggucucccccaaccuggcaccaagggccacuu

SEQ ID NO: 59145 - RNA, 41 nt, Mus musculus
ccagggucuucaccaguaccuccaggcugucaggcuccucc

SEQ ID NO: 59146 - RNA, 41 nt, Mus musculus
ggaagccacucuggccaccaggcugcagaggaguagaguaa

SEQ ID NO: 59147 - RNA, 44 nt, Mus musculus
aagggugggucaggcaaagggcuggggcagaaagcugcagagua

SEQ ID NO: 59148 - RNA, 41 nt, Mus musculus
uaagaaaaagagagagagagagagagagagagagaguuaac

SEQ ID NO: 59149 - RNA, 82 nt, Mus musculus
cagcaaccaaccacaugguggcucacaaccauccguaacgagauccaacucccucuucuggugugucugaagacagcuacag

SEQ ID NO: 59150 - RNA, 42 nt, Mus musculus
guggcucagcugaaguagaagcacuagggagcagcucccagu

SEQ ID NO: 59151 - RNA, 42 nt, Mus musculus
agcagcagcagcagcaacagcagggagacagagacaugggag

SEQ ID NO: 59152 - RNA, 46 nt, Mus musculus
acagcagaacugcugggggguggcggaggcagaggaagucccggag

SEQ ID NO: 59153 - RNA, 42 nt, Mus musculus
cauugccuggaggccaggguagugggcggggucccgggggag

SEQ ID NO: 59154 - RNA, 44 nt, Mus musculus
gcuugagcccccacugucugagcguucccggggaaccaggccua

SEQ ID NO: 59155 - RNA, 45 nt, Mus musculus
ugcaaccacccccacucaccagagugggaacuggagccaccccug

SEQ ID NO: 59156 - RNA, 62 nt, Mus musculus
uucagguucuuucucugguguugggguagguguugguggcagagcuggagcugcaggaauuu

SEQ ID NO: 59157 - RNA, 45 nt, Mus musculus
cucugucucugaaggccgagcauucucuguccaggcugucuuggg

SEQ ID NO: 59158 - RNA, 44 nt, Mus musculus
gcaggcgucugugaagccggcaguggcugcgauuccggcggcug

SEQ ID NO: 59159 - RNA, 48 nt, Mus musculus
uugagcgaggaauacuucuuuccauccuuccccuuggcagucggcccc

SEQ ID NO: 59160 - RNA, 45 nt, Mus musculus
cuaccucgacaacacccuguaaccaugggccaggcagcagaggcc

SEQ ID NO: 59161 - RNA, 29 nt, Mus musculus
agaaagcagggagggaagcaggaacggcu

SEQ ID NO: 59162 - RNA, 42 nt, Mus musculus
cgcgcucggcuccucccgucucccucgcucacuccgcggcug

SEQ ID NO: 59163 - RNA, 46 nt, Mus musculus
agaaacaaagaaagagggaaaguaagcgaaaacagguucaagagau

SEQ ID NO: 59164 - RNA, 42 nt, Mus musculus
ugagagaggaaauuaaaaaacaaacaaacaaacaaaacgaga

SEQ ID NO: 59165 - RNA, 41 nt, Mus musculus
cguagggaguggggcugggaugaagggguggagccgagaga

SEQ ID NO: 59166 - RNA, 26 nt, Mus musculus
auaaaauaaaaaauuggggaaggggg

SEQ ID NO: 59167 - RNA, 25 nt, Mus musculus
aaucccagaguggggggagguggga

SEQ ID NO: 59168 - RNA, 41 nt, Mus musculus
ucaggagagguaacccgguaggugaaucucuagaggaagug

SEQ ID NO: 59169 - RNA, 82 nt, Mus musculus
caggguucaggauuaggagaaguggucagaaugaggcaguacagguggaagaggggccuccugagacccggaaacaguaggg

SEQ ID NO: 59170 - RNA, 42 nt, Mus musculus
acaaccaguaaguagggaccccuccguucggaaaggggaggg

SEQ ID NO: 59171 - RNA, 97 nt, Mus musculus
gauccccaauaccucugagccugguccgauuccaggcccaccuggaggcccuuggaagcuuagccagguucgaggauccacccagcccggcuccagc

SEQ ID NO: 59172 - RNA, 52 nt, Mus musculus
ugcaaagucuccacgccaacuugggggacuaggcccaguccaaccugagguc

SEQ ID NO: 59173 - RNA, 41 nt, Mus musculus
aauggaggcagucaucuggggagaugcaagucagccuugag

SEQ ID NO: 59174 - RNA, 46 nt, Mus musculus
gucacccuauucugaagaaguuuuaaggcugcagaauugaccagac

SEQ ID NO: 59175 - RNA, 45 nt, Mus musculus
agaacgcccagggugagccccacgucggccuggguguaccccaag

SEQ ID NO: 59176 - RNA, 91 nt, Mus musculus
ucauuguugucggcuuccuccacccacuucuccagcaggggccgcagcuuacacauguucuuaaggcugagcugcaaggccucgaagcgac

SEQ ID NO: 59177 - RNA, 27 nt, Mus musculus
gguucucaaugcuaguucgcuuucucu

SEQ ID NO: 59178 - RNA, 42 nt, Mus musculus
ucuagcccaagcugauuggcgaugugagugaucugcuguagg

SEQ ID NO: 59179 - RNA, 45 nt, Mus musculus
agagauggacaucagaucauaagcucugggaugcugcagucagcg

SEQ ID NO: 59180 - RNA, 45 nt, Mus musculus
ccaaaguggggaccugggggcagaggaaaggauacagcccccccu

SEQ ID NO: 59181 - RNA, 107 nt, Mus musculus
ugcgugaucuggguguggcgucuagacugggugcuagguguaaggggcguggcaagagggcggaucucgcgcuggguaaggggcguucggggagagucaguuggggg

SEQ ID NO: 59182 - RNA, 46 nt, Mus musculus
aggaucaucucccucuucccucucccccucucucagaaucugacag

SEQ ID NO: 59183 - RNA, 42 nt, Mus musculus
gaccugggcuucagacguucccuugguccaaucuccggccag

SEQ ID NO: 59184 - RNA, 42 nt, Mus musculus
aguacugggauuaaaggugugcgccaccacgccuggugucaa

SEQ ID NO: 59185 - RNA, 47 nt, Mus musculus
auuuaguuuuauuuauaggaguacauuguacuccuauacacaccgga

SEQ ID NO: 59186 - RNA, 45 nt, Mus musculus
gccccuaaagaacucuuaaccucugcuccaacucuccagcccuaa

SEQ ID NO: 59187 - RNA, 41 nt, Mus musculus
ucucacggcagcuccaagaguugcggcggcuggaggaggaa

SEQ ID NO: 59188 - RNA, 77 nt, Mus musculus
cugaggccgagggccugcgcaccgccuuggccggagcugaaaugguucggaagaaccuggaagaggcgaagcacaag

SEQ ID NO: 59189 - RNA, 45 nt, Mus musculus
cuugccuagcauucagguaucucugcuuucaaucccuggcaccag

SEQ ID NO: 59190 - RNA, 42 nt, Mus musculus
caugaaugaguucuuaugcagugaacacacagcagccagcac

SEQ ID NO: 59191 - RNA, 45 nt, Mus musculus
aacccuccuucagauccacugcugagcuagagcugccagggggaa

SEQ ID NO: 59192 - RNA, 42 nt, Mus musculus
aggcaauggcgacccuucucccggaucuacagacacccacga

SEQ ID NO: 59193 - RNA, 45 nt, Mus musculus
auggaccaugaaucucaggaggagccagaccuugacccaccccag

SEQ ID NO: 59194 - RNA, 47 nt, Mus musculus
cuggccuacaaagcaagaccuugugucaaaaaaagaagaaaaagaaa

SEQ ID NO: 59195 - RNA, 30 nt, Mus musculus
acaccagguguuccuuucuuagacccacga

SEQ ID NO: 59196 - RNA, 45 nt, Mus musculus
aggaggcuauugggggcggagagcaugcaaggggaggcccagaga

SEQ ID NO: 59197 - RNA, 42 nt, Mus musculus
aaaagggagccaugcugugcugggguagcaaaggggccaggu

SEQ ID NO: 59198 - RNA, 42 nt, Mus musculus
agcaggucggaaagugccacgauucgagaaugaggaggagau

SEQ ID NO: 59199 - RNA, 45 nt, Mus musculus
ggggcucuguaguauauagcccagagcuguugccagccuguccua

SEQ ID NO: 59200 - RNA, 42 nt, Mus musculus
agauguuucugggccccugccuccugcuuacaguccccagua

SEQ ID NO: 59201 - RNA, 46 nt, Mus musculus
ucacaaggagguaguauuguaugaaauccccaccgggccaggugaa

SEQ ID NO: 59202 - RNA, 23 nt, Mus musculus
uugucaaugcuuaggugaacuug

SEQ ID NO: 59203 - RNA, 74 nt, Mus musculus
aguugagcgagaagcggagugaaaggaaagucggggagaugugaggagcucagaggcgugggucucagugagag

SEQ ID NO: 59204 - RNA, 53 nt, Mus musculus
uguagcuaccacauugguuuuucuauaaucacgcgggguuuguacauuuuuug

SEQ ID NO: 59205 - RNA, 47 nt, Mus musculus
ucccaaugggagccauccaggggaagcuggacucgaaaaccagagaa

SEQ ID NO: 59206 - RNA, 49 nt, Mus musculus
ggaggugcugaugcucugcaggucccagcccuuugggcagcuuacagau

SEQ ID NO: 59207 - RNA, 42 nt, Mus musculus
ugaggaagggaggaagaagaagaggaggagagggccagagua

SEQ ID NO: 59208 - RNA, 46 nt, Mus musculus
augugggauggagcaaucagagcuuccccacgggcuacguggagau

SEQ ID NO: 59209 - RNA, 41 nt, Mus musculus
gcaucagagcaccuuuccagucagcaaggugucagggagag

SEQ ID NO: 59210 - RNA, 43 nt, Mus musculus
ggccgccaugcugggggucugggcaaagaguucucccgaagcu

SEQ ID NO: 59211 - RNA, 46 nt, Mus musculus
gacccaucuccccagugugugugugugugugugugugugugugugu

SEQ ID NO: 59212 - RNA, 42 nt, Mus musculus
ggugucaggagagucuuucuguucccaggauagaggccagca

SEQ ID NO: 59213 - RNA, 42 nt, Mus musculus
cuggcuuuguguucugcucugucucuccccccgcccccuccc

SEQ ID NO: 59214 - RNA, 46 nt, Mus musculus
ucucuuccuuggccaucauaccccaggccucauuuuccuauuugau

SEQ ID NO: 59215 - RNA, 46 nt, Mus musculus
cucuccuuucuccaugaugaacaaagaacugcaaaagcugccugag

SEQ ID NO: 59216 - RNA, 41 nt, Mus musculus
aagaaugcgcugcucuggaagaggaagggaaggagagcugg

SEQ ID NO: 59217 - RNA, 41 nt, Mus musculus
gcguuugaacacuucucgcgggcaccgaaaacgcagccgaa

SEQ ID NO: 59218 - RNA, 95 nt, Mus musculus
agggguguauguaauauuuauucuaacuuaugcaggggugcgagauaugccucccugcuguaacacagauauuuauuacgauuuauagggucggu

SEQ ID NO: 59219 - RNA, 46 nt, Mus musculus
gcugcaggagucuuggguccauggauugucagagggcggcugucug

SEQ ID NO: 59220 - RNA, 46 nt, Mus musculus
uugggaguguucagagaccaagaccaagaccuugccgcacccccaa

SEQ ID NO: 59221 - RNA, 45 nt, Mus musculus
acagggaagacacuuccaauggcagauuuggcucaggacagcugg

SEQ ID NO: 59222 - RNA, 46 nt, Mus musculus
aaaagauaccaguaggaagcacaggguaacaaccagaaugucagaa

SEQ ID NO: 59223 - RNA, 45 nt, Mus musculus
cccaaugagaaaacagaacaaaacaaauacaagacagaggcagca

SEQ ID NO: 59224 - RNA, 46 nt, Mus musculus
agcuucggugaacuccaucucguccaugcccucacccguauaccag

SEQ ID NO: 59225 - RNA, 42 nt, Mus musculus
gagaugcgcuugaagagcuccuggauggcugugcuguuucca

SEQ ID NO: 59226 - RNA, 45 nt, Mus musculus
ccucacugugccugaacuuacccagcaggucuucgaugccaagaa

SEQ ID NO: 59227 - RNA, 77 nt, Mus musculus
aaugcugaccuucgaaagcuggcugucaacauggugccauucccacgucuccacuucuucaugccuggcuuugcccc

SEQ ID NO: 59228 - RNA, 45 nt, Mus musculus
ugcaucgacaacgaggcccucuacgacaucugcuuccguacccuc

SEQ ID NO: 59229 - RNA, 45 nt, Mus musculus
uggaggcacuggcucuggcaugggcacccugcucaucagcaagau

SEQ ID NO: 59230 - RNA, 36 nt, Mus musculus
gccagagccagugccuccacccagugagugggucag

SEQ ID NO: 59231 - RNA, 47 nt, Mus musculus
gggagcugaguugguugacucugucuuggauguggugcggaaggagg

SEQ ID NO: 59232 - RNA, 45 nt, Mus musculus
ccugggacuauggacuccguucgcucagguccuuuuggccagauc

SEQ ID NO: 59233 - RNA, 46 nt, Mus musculus
cagcacuugagagguagacgaucuaugggaguuccagggcagccag

SEQ ID NO: 59234 - RNA, 73 nt, Mus musculus
auuuauucccuguccccuguauuggacagugagcccagaugaaugcaucacuggcugcccuggaacucccaua

SEQ ID NO: 59235 - RNA, 42 nt, Mus musculus
uguggcuucauuauaguacacagagauucgguccagcugcag

SEQ ID NO: 59236 - RNA, 47 nt, Mus musculus
ugcagcuggaccgaaucucuguguacuauaaugaagccacaggugag

SEQ ID NO: 59237 - RNA, 46 nt, Mus musculus
gggucgaugccauguucaucgcuuaucaccucccagaacugcacag

SEQ ID NO: 59238 - RNA, 45 nt, Mus musculus
ucucacauauuugaaaagcucacuuucauaccgcucacacccuaa

SEQ ID NO: 59239 - RNA, 48 nt, Mus musculus
cagacugaaaggauggaccggagcccgggaggcugcagcagcgagaug

SEQ ID NO: 59240 - RNA, 46 nt, Mus musculus
guuguaagccaccaugugguagcuaggaauugaacucaggaccucu

SEQ ID NO: 59241 - RNA, 46 nt, Mus musculus
acuguagaccaggcuggccucgaauuuaaaaauccaccugccucug

SEQ ID NO: 59242 - RNA, 45 nt, Mus musculus
ggguugacucagggcucccugcucucccaaaggauaugcgcugca

SEQ ID NO: 59243 - RNA, 46 nt, Mus musculus
ucucccccugcguaccgggggaggcagucuugacugaauccgcuca

SEQ ID NO: 59244 - RNA, 45 nt, Mus musculus
cuacagucucccuagaugccugguauuuccacaggcaaccaagaa

SEQ ID NO: 59245 - RNA, 45 nt, Mus musculus
gaccucucuacuaacuuggaagccauagguccccuacccccagua

SEQ ID NO: 59246 - RNA, 29 nt, Mus musculus
acaucccccuacagcucccuuccccgauc

SEQ ID NO: 59247 - RNA, 72 nt, Mus musculus
guccccuucggcccuuuguuccagagcaggagcugcuucgcucccugcgucucugucccccacacccuacug

SEQ ID NO: 59248 - RNA, 80 nt, Mus musculus
gaacagggccccucggcgugccacaccuccagcccacccaccuccacguucuagcagccugggcaacucaccggaucggg

SEQ ID NO: 59249 - RNA, 45 nt, Mus musculus
agaugugggaaaaauagaguuaugauuggacccaaaacaauagga

SEQ ID NO: 59250 - RNA, 45 nt, Mus musculus
ugaaaccaaagcuugggaucuggaggggugaggugaggugggagg

SEQ ID NO: 59251 - RNA, 46 nt, Mus musculus
guucccgcagccauauuguauuuugugucaaauaaagccuuuaagu

SEQ ID NO: 59252 - RNA, 46 nt, Mus musculus
caucgauggacucuauguccaaguuauugguugguucauccugugg

SEQ ID NO: 59253 - RNA, 42 nt, Mus musculus
uucuuccucaucuccccguuggucugcaaggacaagcaagag

SEQ ID NO: 59254 - RNA, 45 nt, Mus musculus
cuuccuuuguuugcuuuuccgcuugcuugguggacuugcccccag

SEQ ID NO: 59255 - RNA, 46 nt, Mus musculus
ugagucuaggaaguagauaaugggauggggacagggaaaaaggcag

SEQ ID NO: 59256 - RNA, 47 nt, Mus musculus
cagcaccaccugcagggcccccucucaccuuggcuuucccuuuugau

SEQ ID NO: 59257 - RNA, 45 nt, Mus musculus
gcaauuuuuccucuuccccagcuuguuuguccucuacugccagcu

SEQ ID NO: 59258 - RNA, 47 nt, Mus musculus
acccaaguacacuguagucuucagacacaccagaaaagggcaucaga

SEQ ID NO: 59259 - RNA, 42 nt, Mus musculus
ccuuacuauuucuuugacacuucuuacaaaagucacugccag

SEQ ID NO: 59260 - RNA, 45 nt, Mus musculus
cucgcugucagggaacucgccuuguagaccaggcuggccucgaac

SEQ ID NO: 59261 - RNA, 43 nt, Mus musculus
ucgggcggcuguugcuugggacccuucggcaucgcggcggcag

SEQ ID NO: 59262 - RNA, 42 nt, Mus musculus
uuuuaacuuuuuuuuauauuaguaauaaacacaguggaaacc

SEQ ID NO: 59263 - RNA, 46 nt, Mus musculus
aacaggcccuacggaagugggucaggaggugugcacacaagaggag

SEQ ID NO: 59264 - RNA, 45 nt, Mus musculus
caagaaacagcaccaaagguuuccuguugagcagucuuuuggcag

SEQ ID NO: 59265 - RNA, 46 nt, Mus musculus
aagcacugacacauccaccccuuucaucaucucuccuauuugaggu

SEQ ID NO: 59266 - RNA, 46 nt, Mus musculus
ugcucugcauucuauuacauuuuaggauuuuugagggggucagaaa

SEQ ID NO: 59267 - RNA, 41 nt, Mus musculus
ucagugauugagcaagguguggaucaugcugaggcccugug

SEQ ID NO: 59268 - RNA, 27 nt, Mus musculus
uggguuucucgccucuuuguaaaagcu

SEQ ID NO: 59269 - RNA, 45 nt, Mus musculus
ugggguacguggaaucacuggcauguuguggaugcagcacuguga

SEQ ID NO: 59270 - RNA, 46 nt, Mus musculus
gaucgggaagacaauuugugaccacacuuccacugguuaggucaac

SEQ ID NO: 59271 - RNA, 42 nt, Mus musculus
aggauagaaugaaaugcgggggaggaggugccaacggaagga

SEQ ID NO: 59272 - RNA, 47 nt, Mus musculus
agcagcaacaucucgcacugucugagcgggacgagccuggagaugag

SEQ ID NO: 59273 - RNA, 42 nt, Mus musculus
agcucggcggagggcgggccggggcuccggggccaugccgag

SEQ ID NO: 59274 - RNA, 41 nt, Mus musculus
cccgcgugggcugccacgguggggguuucccgcagcggcgg

SEQ ID NO: 59275 - RNA, 42 nt, Mus musculus
ccgcaggcucaaccagcaaccuucccagggccuggggcccag

SEQ ID NO: 59276 - RNA, 27 nt, Mus musculus
cccucuggucacuuuccccuuccaaau

SEQ ID NO: 59277 - RNA, 46 nt, Mus musculus
caagcugugcuugcauauacugucugcauauauugucucuggagau

SEQ ID NO: 59278 - RNA, 91 nt, Mus musculus
ugcuguacacuuuuugcaacugguuugacaucacauuucagcuccaacuuugcacccugagaacacuuaaauguuucugcagguccguuuu

SEQ ID NO: 59279 - RNA, 45 nt, Mus musculus
cauaucuuucuuuucugcucaucuacuaaacagcugugcccuacu

SEQ ID NO: 59280 - RNA, 47 nt, Mus musculus
gcacucaacacguggagucuccccaagcacagcucugugagaagugu

SEQ ID NO: 59281 - RNA, 46 nt, Mus musculus; identical to SEQ ID NO: 37033

SEQ ID NO: 59282 - RNA, 97 nt, Mus musculus
cagaagaucauuaauguuuggugaccauauagguuguaacaguggguugcuuauuuguagguauuaucguuaaauacagggacaguuuccaggcaca

SEQ ID NO: 59283 - RNA, 46 nt, Mus musculus
ucucaccacguauuugcagauucaggacugcagaccuucccuagau

SEQ ID NO: 59284 - RNA, 45 nt, Mus musculus; identical to SEQ ID NO: 37035

SEQ ID NO: 59285 - RNA, 49 nt, Mus musculus
gugaauucuugacccuauacauuuguccacaaguucuaguggcaggagu

SEQ ID NO: 59286 - RNA, 46 nt, Mus musculus
ucaauaugguguuggaagaugucacagaauuugaaauuacaccaga

SEQ ID NO: 59287 - RNA, 46 nt, Mus musculus
ugccaaacauagcugaccuccccaaagagaacauucagacucaggc

SEQ ID NO: 59288 - RNA, 46 nt, Mus musculus
uggacaguacagaccugucugacaugccagcggagccagagauucc

SEQ ID NO: 59289 - RNA, 46 nt, Mus musculus
agucaaggcacaaagguaagaguagaguggacaaaguccuguugag

SEQ ID NO: 59290 - RNA, 46 nt, Mus musculus
cucaagacuggaaccacggagacaccaagauauucuagcaggccag

SEQ ID NO: 59291 - RNA, 42 nt, Mus musculus
ucuaaugaauuauauuccuuagcaguauguuuuuggggccag

SEQ ID NO: 59292 - RNA, 42 nt, Mus musculus
aaaauauccauacacacacacacacacacacacacagaauaa

SEQ ID NO: 59293 - RNA, 46 nt, Mus musculus
uguuaauuuaaaaaguaccucuucuuguauaucuaauguguguaag

SEQ ID NO: 59294 - RNA, 26 nt, Mus musculus
ugaggaccagagugagggagcauacg

SEQ ID NO: 59295 - RNA, 45 nt, Mus musculus
uguauuagccagggguucucuagagcuacagaaccuagugaaugu

SEQ ID NO: 59296 - RNA, 85 nt, Mus musculus
cuauaauuaaucgugaugacuuacaggcuaacccaacaaugggcagcuguggaugggaaguccaagaaucuaguaguugcgcagu

SEQ ID NO: 59297 - RNA, 48 nt, Mus musculus
ccgggcugacuuugaacucagagaacuccuugccccagucugggauug

SEQ ID NO: 59298 - RNA, 106 nt, Mus musculus
caccacagcugacauuagcgaaacgcuuucccuggcuggagcuggaguguagaaaaccggucuaguucggugcuuugcugccccugcaucuaggaugccaggagga

SEQ ID NO: 59299 - RNA, 67 nt, Mus musculus
cugcuucuuucucuuugaagaccuugcuuaaguuucucugggagagcagauggagcuuauggauaga

SEQ ID NO: 59300 - RNA, 73 nt, Mus musculus
cuccagacuugcacauuggccuccuuguuguguuuuauaaaaagauaaggagagaaggaguguguuuggugga

SEQ ID NO: 59301 - RNA, 49 nt, Mus musculus
guuuauucagggaauggggaggggauuugagaggguaguagagacggag

SEQ ID NO: 59302 - RNA, 62 nt, Mus musculus
gccaugagcacguggggagagaggaggaggcgaguggugagagagggggaagaggcaggaca

SEQ ID NO: 59303 - RNA, 47 nt, Mus musculus
guuguuuuuggaagugucauaaaccugucauggugaagauuuuugug

SEQ ID NO: 59304 - RNA, 45 nt, Mus musculus
gucugcucaucucaacaaacugacacggaccaaaguaugcguacc

SEQ ID NO: 59305 - RNA, 42 nt, Mus musculus
uuaaucuuguaucuuugagaauuuucuaucaucugcccccug

SEQ ID NO: 59306 - RNA, 42 nt, Mus musculus
caggugagaucaguggcagggacagcgugaaaugguggugcg

SEQ ID NO: 59307 - RNA, 46 nt, Mus musculus
cuauccagccaguuugcccuuggauuuccucaaccuccaaucccag

SEQ ID NO: 59308 - RNA, 46 nt, Mus musculus
ggcuggcuuucagguuuagagguucaguccauuaucaucaaggugu

SEQ ID NO: 59309 - RNA, 48 nt, Mus musculus
auucuagguaaaauguauuucuagguauugggagcugacacuuaggag

SEQ ID NO: 59310 - RNA, 37 nt, Mus musculus
aagagauguaggcauuguuucauuugcuuaucuuggg

SEQ ID NO: 59311 - RNA, 45 nt, Mus musculus
ugaugacaauacuagcuuuguccccagcccuggauuugacacaga

SEQ ID NO: 59312 - RNA, 46 nt, Mus musculus
aacacaaaaaucccuuaaagaguuacaggaaaacacaucaaacagg

SEQ ID NO: 59313 - RNA, 46 nt, Mus musculus
ccucuuuacuuacuauguuccauuguguuuucuccucuguccccug

SEQ ID NO: 59314 - RNA, 44 nt, Mus musculus
aaggaacucgggagcuccaagcacugcaggagaguuggcaggca

SEQ ID NO: 59315 - RNA, 45 nt, Mus musculus
cgcacagccuagugggaaucucuggauaaagcacaccaacaccag

SEQ ID NO: 59316 - RNA, 42 nt, Mus musculus
ggauaaccagggcuacaaagagagccccugucuugaccccca

SEQ ID NO: 59317 - RNA, 45 nt, Mus musculus
uaauaggcaggaagagaggagaaagagauacaucagcaugccaca

SEQ ID NO: 59318 - RNA, 25 nt, Mus musculus
gauguuugugaguuugaggccccuu

SEQ ID NO: 59319 - RNA, 45 nt, Mus musculus
gaaacugaaguacaaagguggggaaugacuuguuaguugcuacaa

SEQ ID NO: 59320 - RNA, 77 nt, Mus musculus
aacaaaggcuuagcuuaagauuggcauuuaaaaugggauaggagagccaggggugugguggcacaugccuuuaaucc

SEQ ID NO: 59321 - RNA, 46 nt, Mus musculus
gaaggaaaucuguguggguguggcagaaaaaaaugucuaaugccca

SEQ ID NO: 59322 - RNA, 53 nt, Mus musculus
uauagucgcgauuccgugauuugggccaacugcuggagauaaaaaagaucacu

SEQ ID NO: 59323 - RNA, 80 nt, Mus musculus
agaauacccauccaccaaaccagaaaauaaaggcaguuauaaagcagugugagaguguuaucauggaaagacagaacuaa

SEQ ID NO: 59324 - RNA, 61 nt, Mus musculus
cugggaaggagcagagaugggggggcaguuuuauccaaggccaagcugugucugagagaac

SEQ ID NO: 59325 - RNA, 45 nt, Mus musculus
ggaugcccagccuuguguguuuugaagcaagaaaauagcccagug

SEQ ID NO: 59326 - RNA, 46 nt, Mus musculus
uucuugcuuggcaaccugacugaaucuggaaugaacaaccauccag

SEQ ID NO: 59327 - RNA, 46 nt, Mus musculus
gucugauuugaagaagguuaaucuacuuguagugcauaccuuugag

SEQ ID NO: 59328 - RNA, 46 nt, Mus musculus
uccugcugucacuuugucucuucucguguuaugcacacaugcugag

SEQ ID NO: 59329 - RNA, 42 nt, Mus musculus
aaugcagaggaaugauaaugagcaggguuugguuagaggcag

SEQ ID NO: 59330 - RNA, 46 nt, Mus musculus
uaggaguuuaaggaagcaggaaguaaaguacuagauauagggcaga

SEQ ID NO: 59331 - RNA, 46 nt, Mus musculus
gcuuaguccuggcucugccucaucaaacaaaacacuagcuuugugg

SEQ ID NO: 59332 - RNA, 45 nt, Mus musculus
acauguacauaggagcuuuuauucaacuuaaaucuaaagacccac

SEQ ID NO: 59333 - RNA, 46 nt, Mus musculus
ucagcaauguguuaaauugagaacacuggguuuuccuuaagagcaa

SEQ ID NO: 59334 - RNA, 46 nt, Mus musculus
cagcauuguaugucuuuuccuugugguauauauauauaggcugcag

SEQ ID NO: 59335 - RNA, 45 nt, Mus musculus
aagugagggaaggugugauuuccuguguagagggcagcagggggu

SEQ ID NO: 59336 - RNA, 25 nt, Mus musculus
gcucagguccacaaaguaccucuag

SEQ ID NO: 59337 - RNA, 45 nt, Mus musculus
aagcagaguggagucccacuuggguacacagaguaauggggguau

SEQ ID NO: 59338 - RNA, 42 nt, Mus musculus
ugagaagggugacauuauguuaguaaugggauacacaggcuc

SEQ ID NO: 59339 - RNA, 42 nt, Mus musculus
ucggcaugagaccuccauugagcccucuagguaacaaggcag

SEQ ID NO: 59340 - RNA, 46 nt, Mus musculus
agaugguagugagcugccauguggaugccuguaaucaaaccuaggu

SEQ ID NO: 59341 - RNA, 46 nt, Mus musculus
uuuauuuuauuuaauguuccacuagacugucaguucucuaagggag

SEQ ID NO: 59342 - RNA, 42 nt, Mus musculus
guuuucuucccuugcaggacaccaaggacuucgccaacaagu

SEQ ID NO: 59343 - RNA, 87 nt, Mus musculus
gggcuucacauggggaaagguauacugggaaguagaguuggagagagaaggcuggucagaggaugaagaagagggggaggaggaaga

SEQ ID NO: 59344 - RNA, 35 nt, Mus musculus
aagacgaaucacugggggaagaggaagaggaggaa

SEQ ID NO: 59345 - RNA, 50 nt, Mus musculus
ucugugaagaggaaaggggaccucucccugcgaccagaagauggugugug

SEQ ID NO: 59346 - RNA, 46 nt, Mus musculus
ucgcccuggauuaugaagguggcacugugacauucaccaaugcaga

SEQ ID NO: 59347 - RNA, 57 nt, Mus musculus
ccuaccuuuccuggugucuuaaaucacuuuuccuuaccccacaagaguuaaauaugc

SEQ ID NO: 59348 - RNA, 45 nt, Mus musculus
aucuguaaguaagaaugguuuccaaaaugauggacuuuucauuag

SEQ ID NO: 59349 - RNA, 45 nt, Mus musculus
cuggcucccauaaggaucaucuguguacuuauuaagagacaggag

SEQ ID NO: 59350 - RNA, 45 nt, Mus musculus
uguaucaccauuuagggcaagaauuggguuggguggcacuaugga

SEQ ID NO: 59351 - RNA, 45 nt, Mus musculus
uacaugcacaugcaugcucuccugagcacaagugugcaugcaugu

SEQ ID NO: 59352 - RNA, 45 nt, Mus musculus
agagcuccugaaguacaauggcuggugaggcaaggcuguguagga

SEQ ID NO: 59353 - RNA, 45 nt, Mus musculus
ucguguguacauguguaugauguguauguguccuuggaagucaga

SEQ ID NO: 59354 - RNA, 57 nt, Mus musculus
uggagacaauuacaucugccacacccaccagaagagggugcgcagguucugugaggc

SEQ ID NO: 59355 - RNA, 41 nt, Mus musculus
aguccgaucuggguaaccgaggcagcccgggagagggguag

SEQ ID NO: 59356 - RNA, 45 nt, Mus musculus
gcgguggccgcauccccaccauggguugccuggauccccacggag

SEQ ID NO: 59357 - RNA, 42 nt, Mus musculus
gaauuuuaaauaagaauuuuaagaaagggaggaagcggggag

SEQ ID NO: 59358 - RNA, 46 nt, Mus musculus
ugagaaagggagguaggacaggcuggaagaaauugacucggucagg

SEQ ID NO: 59359 - RNA, 45 nt, Mus musculus
gcacaaauccccaccuguuucagugaccuugucuguaacaccuau

SEQ ID NO: 59360 - RNA, 46 nt, Mus musculus
cgagaaagcgggaugagacacccuuuccuuuuucugagccucagag

SEQ ID NO: 59361 - RNA, 51 nt, Mus musculus
gaugccuccuugguccccuccggcuaccaugcuuuguucucagaauaagau

SEQ ID NO: 59362 - RNA, 46 nt, Mus musculus
ugggcuuagcgaggugagacugagaacaggaaucugucagcgagag

SEQ ID NO: 59363 - RNA, 46 nt, Mus musculus
cacugucauauguucgcguuguggcuucuccaucgaugugcgaggu

SEQ ID NO: 59364 - RNA, 46 nt, Mus musculus
uuaauaauaaacacuccucuuucccagcucucauccgccauggagc

SEQ ID NO: 59365 - RNA, 44 nt, Mus musculus
cucagugcuuaagggcacuggcugaucuucuggaggcccugagu

SEQ ID NO: 59366 - RNA, 45 nt, Mus musculus
gguuuuccugagauauuucaagcccuggauacaaaugugccaauu

SEQ ID NO: 59367 - RNA, 35 nt, Mus musculus
gaucucaguccccguuucugccaauguucacagau

SEQ ID NO: 59368 - RNA, 46 nt, Mus musculus
uaaagccuaacaaccugaguuuggaacccugagcacacauggagaa

SEQ ID NO: 59369 - RNA, 45 nt, Mus musculus
uuaaaauuuagcucaucacugaagaacaagcaugugggagguuag

SEQ ID NO: 59370 - RNA, 46 nt, Mus musculus
cacagcuacacagugaguuccagcccagucuaggguacagugugag

SEQ ID NO: 59371 - RNA, 41 nt, Mus musculus
gccccugaaguguagaggucaagaggugagacaaguggcca

SEQ ID NO: 59372 - RNA, 46 nt, Mus musculus
gaauagauugaguaacucauccuuuuccaucugugggaauaaaaag

SEQ ID NO: 59373 - RNA, 46 nt, Mus musculus
acugccaggucaggaugauguuagcaggguagaagcccagggccca

SEQ ID NO: 59374 - RNA, 45 nt, Mus musculus
gcgcagcugugucgccugcgacccaggagugcagguccgggcuua

SEQ ID NO: 59375 - RNA, 46 nt, Mus musculus
ccuggucugcuguucccaauacucuggccccaucugcuucacccac

SEQ ID NO: 59376 - RNA, 41 nt, Mus musculus
guaggugacagaaggggagcagggcgugggguucaggauga

SEQ ID NO: 59377 - RNA, 42 nt, Mus musculus
ccaggucucaggcagccaaagcacaaacauaguuggggaggg

SEQ ID NO: 59378 - RNA, 46 nt, Mus musculus
gguaacacaucucaaguggcugucugccaaggucagaaauuuagau

SEQ ID NO: 59379 - RNA, 80 nt, Mus musculus
gccacacaaagggcugggcgcgcguuccagccucgaccagaacgcagcggcgugaaacccaggaaggggcccuugccaga

SEQ ID NO: 59380 - RNA, 51 nt, Mus musculus
ccuuuccaccgcggagccaggcggcuucucccacccaggugucgggcccuc

SEQ ID NO: 59381 - RNA, 46 nt, Mus musculus
acgcacaaucugacaagaaaugcccgccggcuuugcccggucagcc

SEQ ID NO: 59382 - RNA, 46 nt, Mus musculus
acgucucucaacccugagugcacuccuccaacuaaagcccauucau

SEQ ID NO: 59383 - RNA, 46 nt, Mus musculus
gucugucugucuuccuuccguuuguuuuaauguggagacugaagau

SEQ ID NO: 59384 - RNA, 41 nt, Mus musculus
ugcggcuuuguggauuugugacugccagccuccgggaccuc

SEQ ID NO: 59385 - RNA, 45 nt, Mus musculus
accucagacugaucccggaaacacuuuccacacucagggcaugaa

SEQ ID NO: 59386 - RNA, 41 nt, Mus musculus
gguucucagagaaauaagguaggagaaaaugagaggcaggg

SEQ ID NO: 59387 - RNA, 60 nt, Mus musculus
ccacaggguguuuucuauagucagacuaacaugguaaaaaagauguggaagucaaaaauu

SEQ ID NO: 59388 - RNA, 46 nt, Mus musculus
ugguuggucuuggagggaggugagguucgggauaacuauuauggag

SEQ ID NO: 59389 - RNA, 45 nt, Mus musculus
gguuuacauaguaaguucuaaggcugcauaaugagaugucucaag

SEQ ID NO: 59390 - RNA, 46 nt, Mus musculus
augugcaaaggaucucuuuaaccacuuuuuauaauucagaagauga

SEQ ID NO: 59391 - RNA, 42 nt, Mus musculus
gagcauggagcauugggggaaaggcagaaauggucugaagag

SEQ ID NO: 59392 - RNA, 46 nt, Mus musculus
ccccaccucccuggaaaaaacuacccuccccccccaccccccguag

SEQ ID NO: 59393 - RNA, 45 nt, Mus musculus
aaaauuggggcagaaugaccagaacagugauaauucaagggcaga

SEQ ID NO: 59394 - RNA, 51 nt, Mus musculus
cguauauaauauucaagcucuacaaaacucagcugcacccgacccccuuua

SEQ ID NO: 59395 - RNA, 50 nt, Mus musculus
cuguuguccuuugaauaauugaagaaaacacgaguccugaccccuagccc

SEQ ID NO: 59396 - RNA, 46 nt, Mus musculus
gugggagggggcuggggaucaggccugggaagcugggcgccccugg

SEQ ID NO: 59397 - RNA, 42 nt, Mus musculus
uccucuguagacccuuucucccaucaccuuucuuccagccuu

SEQ ID NO: 59398 - RNA, 45 nt, Mus musculus
agcucugggaaagacuaauaaugguuaagaggugggcugaggcac

SEQ ID NO: 59399 - RNA, 46 nt, Mus musculus
cacggguugggguaaaugguugcgugugggguuuuuguaagagcag

SEQ ID NO: 59400 - RNA, 96 nt, Mus musculus
gagcugcugaauggaguggaaaagaagaggguaaaggggcaggcagauggauaagagacaaaugacaaguguguggguuugguaguugacccggag

SEQ ID NO: 59401 - RNA, 46 nt, Mus musculus
acucuugauguuucuuauccccacccaagacacuggaugaccugga

SEQ ID NO: 59402 - RNA, 46 nt, Mus musculus
uccacugcccauucacugaacauuucuuugcacuaagcacuuggag

SEQ ID NO: 59403 - RNA, 46 nt, Mus musculus
caucgugggacuuuucuaugagaccgaagcccggaaaguuuuuugu

SEQ ID NO: 59404 - RNA, 48 nt, Mus musculus
gauuuccuugggcgagagagaaaaauuguggagcauacaguaggcuuc

SEQ ID NO: 59405 - RNA, 41 nt, Mus musculus
cacugucuugauuuagagguccaggguagcccugugugugg

SEQ ID NO: 59406 - RNA, 46 nt, Mus musculus
aauuuaaauguagcugucaccaugaccccuaccaccaccaccccag

SEQ ID NO: 59407 - RNA, 42 nt, Mus musculus
cagugucugagccagaacugaggccucucccccugcgcccac

SEQ ID NO: 59408 - RNA, 46 nt, Mus musculus
uggccguucaggagugcgccuggaggacuuuaacuacaacaaccag

SEQ ID NO: 59409 - RNA, 45 nt, Mus musculus
aucuguccaucauaagagggagaacaggcagaaauuguuuaaagc

SEQ ID NO: 59410 - RNA, 46 nt, Mus musculus
cuaaacuuuuccaagaauaggagagcuuuggucuuuuugcugugag

SEQ ID NO: 59411 - RNA, 46 nt, Mus musculus
agggucuagaauggaaaugaggcguggcuuucuuuacacagaggag

SEQ ID NO: 59412 - RNA, 45 nt, Mus musculus
cacaucacccuccucccacacucccaauuguguuucuuccuccag

SEQ ID NO: 59413 - RNA, 46 nt, Mus musculus
ggucuuccuacauuaucagggcuuucucuccauuucucagcauuag

SEQ ID NO: 59414 - RNA, 46 nt, Mus musculus
gguuggaggcuguuuccaguggauagugggugcacauuugaucaaa

SEQ ID NO: 59415 - RNA, 46 nt, Mus musculus
accaaguaacccugaguagcugagcugagagaccugcuuagugcca

SEQ ID NO: 59416 - RNA, 46 nt, Mus musculus
gagcauccaagccuacacaaugcuguaucaacaaaacccaacaaga

SEQ ID NO: 59417 - RNA, 47 nt, Mus musculus
auuaaaaaaaaaaaacaaaguuaaaagguugcauuacuuacaggucu

SEQ ID NO: 59418 - RNA, 42 nt, Mus musculus
gcugaagagacauacuauggcugcaguggugauuaagguuga

SEQ ID NO: 59419 - RNA, 46 nt, Mus musculus
ccauuacagucaggaggaugcacucuguuguacccagggacaugaa

SEQ ID NO: 59420 - RNA, 46 nt, Mus musculus
gggacacagguuguggugaagcagagguccaagaaggagagguuag

SEQ ID NO: 59421 - RNA, 46 nt, Mus musculus
aagccauuucaauaucagggccguugccauaugacuccggagagug

SEQ ID NO: 59422 - RNA, 46 nt, Mus musculus; identical to SEQ ID NO: 59419

SEQ ID NO: 59423 - RNA, 46 nt, Mus musculus; identical to SEQ ID NO: 59420

SEQ ID NO: 59424 - RNA, 40 nt, Mus musculus
agaccugagcuccuggacugcaguggacauggugucucag

SEQ ID NO: 59425 - RNA, 46 nt, Mus musculus
ucagaacauuugaaucugucccagaauggaaggagaaaacacccug

SEQ ID NO: 59426 - RNA, 45 nt, Mus musculus
auaacauccauguccugggucugguccuccccaucucuuugccag

SEQ ID NO: 59427 - RNA, 46 nt, Mus musculus
ugaguguggucagagaaucuaaccucagagaggguacaggcugcag

SEQ ID NO: 59428 - RNA, 45 nt, Mus musculus
gaucuuuucuccuauucugagauagauucugaacugagacuugga

SEQ ID NO: 59429 - RNA, 24 nt, Mus musculus
uaaaggucugugccagggcaaggg

SEQ ID NO: 59430 - RNA, 45 nt, Mus musculus
uuuugcuuggggugagguggccauucucacagugaugucauauga

SEQ ID NO: 59431 - RNA, 45 nt, Mus musculus
ggaaccacaaaauuuaucacuucaucugugaaguuccugccauga

SEQ ID NO: 59432 - RNA, 45 nt, Mus musculus
gcagccucauuuugggauguaucgccacaagcaagugccaggaca

SEQ ID NO: 59433 - RNA, 45 nt, Mus musculus
ugcuuugacuuguggaauuaucuaauguauuaauguaagccuuga

SEQ ID NO: 59434 - RNA, 46 nt, Mus musculus
agauaggaauaagaaggaaaacuggauuaacagaaauaaccagcuc

SEQ ID NO: 59435 - RNA, 45 nt, Mus musculus
gcuaaaaacucccuauugcauaaaauaguucauuugguguugaaa

SEQ ID NO: 59436 - RNA, 46 nt, Mus musculus
gcugguuucucuuuaaucaaucgaaaguagauugaagcuauagaaa

SEQ ID NO: 59437 - RNA, 46 nt, Mus musculus
uagagacuuuauauuagaauuacagauauuuaugaaacuugaagau

SEQ ID NO: 59438 - RNA, 46 nt, Mus musculus
gucugcuucuaguguuuuucaaacaacugauacaaaaagcaaaagg

SEQ ID NO: 59439 - RNA, 61 nt, Mus musculus
caacacacacuugaagaucuuucugcaagaguagaugcaguuaaggaagaaaaucugaagc

SEQ ID NO: 59440 - RNA, 45 nt, Mus musculus
ugggaaccacaaaauuuaucacuucaucugugaaguuccugccau

SEQ ID NO: 59441 - RNA, 44 nt, Mus musculus
ccaugucggacagcgaucuaggcgaggaugaggggcuccuguca

SEQ ID NO: 59442 - RNA, 46 nt, Mus musculus
uauccaaguacggaucacugccaaacaucaggaccauucuguccag

SEQ ID NO: 59443 - RNA, 51 nt, Mus musculus
gugcacauuccaaccuauucaaaggacaaaggaaaugcccagcagauguca

SEQ ID NO: 59444 - RNA, 41 nt, Mus musculus
cuucugaaggacuuggauguucuucaugauucagccccagu

SEQ ID NO: 59445 - RNA, 42 nt, Mus musculus
gaugugucaaaaaugcugaaaauggaaaaggcacaggaaaga

SEQ ID NO: 59446 - RNA, 41 nt, Mus musculus
uggauagggaugugcagguggggagaagagucugggaagag

SEQ ID NO: 59447 - RNA, 54 nt, Mus musculus
gacccaugacuugaggagugggagaggaaacuauggucagauguauugcaugag

SEQ ID NO: 59448 - RNA, 45 nt, Mus musculus
uuugugccuagucugauuacaucuuauuaccucauguuugguuga

SEQ ID NO: 59449 - RNA, 42 nt, Mus musculus
gaagcaacugugaagagucgaggaagcgauaaagcggcugac

SEQ ID NO: 59450 - RNA, 45 nt, Mus musculus
aagaauuugaucuuucaacagcaagugacauaaccuuggccaaga

SEQ ID NO: 59451 - RNA, 57 nt, Mus musculus
cugcaggcgcuuuucugccuccucugcugccucccauggguccauccuuuucacugg

SEQ ID NO: 59452 - RNA, 42 nt, Mus musculus
gagagaggaaggacuggaaaggccagggcgauuucaaucgag

SEQ ID NO: 59453 - RNA, 45 nt, Mus musculus
uuggcauuaaauuguauuugguugauaauaauuuccuucguguua

SEQ ID NO: 59454 - RNA, 44 nt, Mus musculus
cugauguugaccacaaguuaggguaucugauaaagaugcugaaa

SEQ ID NO: 59455 - RNA, 41 nt, Mus musculus
acccagugcucuaagcaaagggugauagaacuugaccgcua

SEQ ID NO: 59456 - RNA, 46 nt, Mus musculus
cauuacaagcacaaugacagaguucaaccaaucguagcuguggccg

SEQ ID NO: 59457 - RNA, 41 nt, Mus musculus
uguagaauucuugucuccuuaaauggaaggaggaggaggag

SEQ ID NO: 59458 - RNA, 44 nt, Mus musculus
gccgcuagaagcgccgcugcgcucgcucggcgcccgaagcugua

SEQ ID NO: 59459 - RNA, 45 nt, Mus musculus
uauggggggaggcgauuuuggaauccccaaaagauugugguugag

SEQ ID NO: 59460 - RNA, 45 nt, Mus musculus
acaugugaggacagaaacggcugccuucccaggguggcggguaga

SEQ ID NO: 59461 - RNA, 46 nt, Mus musculus
cucuucaaaaggugacuucagcuaaggaguucauuaaucaaguaga

SEQ ID NO: 59462 - RNA, 46 nt, Mus musculus
gugcccuuaaaccuacagguuaacaaaggaauagcaguguuaggag

SEQ ID NO: 59463 - RNA, 46 nt, Mus musculus
gcucuuugucuacuugcucuugccuugcuagcacauccauucccuc

SEQ ID NO: 59464 - RNA, 45 nt, Mus musculus
uaaaucauuccaacaaaucaucuugagaggggacuguugggggga

SEQ ID NO: 59465 - RNA, 46 nt, Mus musculus
ggaccuccuagaaugaaguggugcauucaggcuaucgcuguaguau

SEQ ID NO: 59466 - RNA, 42 nt, Mus musculus
aaguaaagaugcuaggucaucaguuuucucagugcuggcaag

SEQ ID NO: 59467 - RNA, 44 nt, Mus musculus
ggccugaggaaaagcagauucucuuugggaacagugucccaccu

SEQ ID NO: 59468 - RNA, 45 nt, Mus musculus
aucccccagacccugaaugcacaggucucauguuaugucucagag

SEQ ID NO: 59469 - RNA, 45 nt, Mus musculus
gagcuaaguuuugggagccaauugcucaagaucaaaaggaaacag

SEQ ID NO: 59470 - RNA, 46 nt, Mus musculus
uggcuuggucccucuggugauugaccuuuacuguuaccuugacuag

SEQ ID NO: 59471 - RNA, 46 nt, Mus musculus
auacuguccccaauacagugacauugaaaacugauaggacugacua

SEQ ID NO: 59472 - RNA, 71 nt, Mus musculus
agggcggauaggacuacauggagaaauccuguaggacgagugggagaaaaugaagaaaauugauaggcuuu

SEQ ID NO: 59473 - RNA, 46 nt, Mus musculus
uugacugcucacauuguaucuacaguccaaauaugaacagggagaa

SEQ ID NO: 59474 - RNA, 46 nt, Mus musculus
uccuggcucucacagaaaacugaaaaauccuucuaaaucccaccaa

SEQ ID NO: 59475 - RNA, 46 nt, Mus musculus
ggaaguuaaaguucaugggacuuuuuuccccaugcuguguucucag

SEQ ID NO: 59476 - RNA, 45 nt, Mus musculus
agucuuccgccaguguuccaacaguccaaggguguccuugaccaa

SEQ ID NO: 59477 - RNA, 46 nt, Mus musculus
guguguguauagcauucuggcuucaacuccaaauuaacacaaggag

SEQ ID NO: 59478 - RNA, 46 nt, Mus musculus
aagcgcccucugaggaucuuuugagaagccaauucagagugaguug

SEQ ID NO: 59479 - RNA, 46 nt, Mus musculus
uggacauggaguuacaggugguuaugaaccaccaugucagugccag

SEQ ID NO: 59480 - RNA, 46 nt, Mus musculus
uuauaaaacuaguuaaagugacuaaacaacaaaagaauccagucgu

SEQ ID NO: 59481 - RNA, 46 nt, Mus musculus
gggauuucaggcagcgaaacuuuugaggaacgauuagacugagcag

SEQ ID NO: 59482 - RNA, 46 nt, Mus musculus
uaaacacaguuuucuacguaauuauaaauucaaugucagugucagg

SEQ ID NO: 59483 - RNA, 46 nt, Mus musculus
aacaaugccagaucuuucuuccccuucucucccucgaugcccaggu

SEQ ID NO: 59484 - RNA, 46 nt, Mus musculus
acaauagucccucuuuacuuuucuuucuuuuucuuuugugugugug

SEQ ID NO: 59485 - RNA, 42 nt, Mus musculus
ugacagucugaguucgauccccagaucucacaagguggcaag

SEQ ID NO: 59486 - RNA, 42 nt, Mus musculus
acagauucagguuauauauacaauacacuugccugggcucag

SEQ ID NO: 59487 - RNA, 46 nt, Mus musculus
cauccucagcuacauaaaguguucaaggucagccauuguaucaaaa

SEQ ID NO: 59488 - RNA, 46 nt, Mus musculus
ugggggagggaacggggaggaaggaaaaaagggaugagaagaaaag

SEQ ID NO: 59489 - RNA, 46 nt, Mus musculus
aaacacucuugaccaccgagccaucucuccaguccagaugaccuag

SEQ ID NO: 59490 - RNA, 45 nt, Mus musculus
uuagaccuggguguagguuuuaaucauacugacacaugcacauac

SEQ ID NO: 59491 - RNA, 42 nt, Mus musculus
uguaaagugaaagaagaagaagaagaagaagaagaagaagaa

SEQ ID NO: 59492 - RNA, 42 nt, Mus musculus
aaggcucguucaaggucauccagaaaacagauucacucccaa

SEQ ID NO: 59493 - RNA, 46 nt, Mus musculus
gucaccacuguggagccccagccuucaccuacuucgcugccgagac

SEQ ID NO: 59494 - RNA, 45 nt, Mus musculus
ggggggaggggaggaacaaaauacuauuuuuacugccaaaaacaa

SEQ ID NO: 59495 - RNA, 45 nt, Mus musculus
gugugugugugugugagugugcauguguguguguacgugcgggug

SEQ ID NO: 59496 - RNA, 41 nt, Mus musculus
guguggcaagcuuugaugguggcugccagagaguagcaguc

SEQ ID NO: 59497 - RNA, 45 nt, Mus musculus
ucauacucagcucauucuugauuuucuggauucuuuugaccaaga

SEQ ID NO: 59498 - RNA, 61 nt, Mus musculus
cauuucagucuuggguaccugagaauagucggucuagugagaugugaggggaaguuuggaa

SEQ ID NO: 59499 - RNA, 45 nt, Mus musculus
gcaaucaccacuuacggguuuaauaaacccacuggggcugggaga

SEQ ID NO: 59500 - RNA, 50 nt, Mus musculus
gaggaggugggaaggaugagacugaccuggaagcguuagauugucuguga

SEQ ID NO: 59501 - RNA, 42 nt, Mus musculus
agugccuugggggaagugauguugucacccuagcugggauca

SEQ ID NO: 59502 - RNA, 46 nt, Mus musculus
uuacuggagagacccgaagccaaggauccaagcccucccgccccag

SEQ ID NO: 59503 - RNA, 46 nt, Mus musculus
uccgagcugcaacuggcugggcuaccaccaccacuucaucacccga

SEQ ID NO: 59504 - RNA, 28 nt, Mus musculus
aagaggugacugggcuuuguggguguua

SEQ ID NO: 59505 - RNA, 45 nt, Mus musculus
ggcuggacugugggaaguauggaagugggaaaaggaagugggcag

SEQ ID NO: 59506 - RNA, 42 nt, Mus musculus
uuggcccuaacuuacaacucccaucacgcccccccacccccg

SEQ ID NO: 59507 - RNA, 46 nt, Mus musculus
aucucugugaguuuaaggccagccuggucuacagagugagauccug

SEQ ID NO: 59508 - RNA, 45 nt, Mus musculus
aaggcucccaacugaaccuuugcaguuauucuaauaugacacuaa

SEQ ID NO: 59509 - RNA, 45 nt, Mus musculus
aggacugcggaggggcuucgggugacucuccaccugcucccaagg

SEQ ID NO: 59510 - RNA, 46 nt, Mus musculus
aagcauggugguacacgcugucaccccagcuauuuggaaggaagaa

SEQ ID NO: 59511 - RNA, 41 nt, Mus musculus
gcgcaaacucacugugccgccccaugaagcgugcccccucc

SEQ ID NO: 59512 - RNA, 42 nt, Mus musculus
gacucuacgccaggcuauugccauccuccucuccugccuccu

SEQ ID NO: 59513 - RNA, 44 nt, Mus musculus
guggucuucacugcccuccuacucagagucuaugcccggggccg

SEQ ID NO: 59514 - RNA, 81 nt, Mus musculus
guagaugcgguuggaguggguuuggggauccucaagugagaaaccagaggagagcagagcaguuucaaacagcagcaccac

SEQ ID NO: 59515 - RNA, 46 nt, Mus musculus
ggccaucauguagcccauuguagaguugucucgcagugccugggcc

SEQ ID NO: 59516 - RNA, 46 nt, Mus musculus
ggugcuugucacaaugcagcagggugaagacacaagccuauuggag

SEQ ID NO: 59517 - RNA, 46 nt, Mus musculus
acauuagauggaauaauuacuguuuagucugugugugccuggucug

SEQ ID NO: 59518 - RNA, 53 nt, Mus musculus
uccauuuucuucuucucuuccucguccucugguagcuccaggcccuccuuagu

SEQ ID NO: 59519 - RNA, 46 nt, Mus musculus
cagucauauacaccaccucgaagccccgcuuccgcacucgcuccac

SEQ ID NO: 59520 - RNA, 45 nt, Mus musculus
ucaucucaucuccagacugagaggugugauagcgaaggagcucag

SEQ ID NO: 59521 - RNA, 46 nt, Mus musculus
gaaggccucauagaacuucuuguaguucuccuuguccucagccagc

SEQ ID NO: 59522 - RNA, 46 nt, Mus musculus
cuugcggaugaccuucaggaucuugcucugcugcagcaucucccgg

SEQ ID NO: 59523 - RNA, 45 nt, Mus musculus
ucgccauacuccuccugcgugaugucauccggguuucugguccag

SEQ ID NO: 59524 - RNA, 45 nt, Mus musculus
uuguuuucuuuuucuugucuuugccgcugucaucuuccucaucgg

SEQ ID NO: 59525 - RNA, 48 nt, Mus musculus
ucaccuuucucuuccucugccucaucaucacugaucuccuucucccgu

SEQ ID NO: 59526 - RNA, 46 nt, Mus musculus
gcaccagcaaggcccagugccauuagccugcuccaacacugccaag

SEQ ID NO: 59527 - RNA, 63 nt, Mus musculus
cacauagagggugaugggauagccuaugaacugcgaauguuucuucaccacuuccuugacccu

SEQ ID NO: 59528 - RNA, 40 nt, Mus musculus
cucaccauggucugcccggacggugaaggagccacccgca

SEQ ID NO: 59529 - RNA, 61 nt, Mus musculus
ucacaaccacuuucucugcaacuagauaggccgaguagaauccgacaccaaacugcccgau

SEQ ID NO: 59530 - RNA, 95 nt, Mus musculus
ccuccaugaacgccuucgugccagacuuagcaaugguucccagguuauuaaugaggucagccuuggucaugccaaugccuguguccaccaaaguc

SEQ ID NO: 59531 - RNA, 42 nt, Mus musculus
aaggguccgucaggcucucauaucgaaucuuguccagggccu

SEQ ID NO: 59532 - RNA, 48 nt, Mus musculus
aaaggucuccaccuccuccucuccauggugcacuuccucaggcaucua

SEQ ID NO: 59533 - RNA, 46 nt, Mus musculus
aaaaggcaguaaaaugacaagggcuggggacauggaacaggcacag

SEQ ID NO: 59534 - RNA, 46 nt, Mus musculus
ucucuuggcccuggagucucuugugcuuggaguaagcgggcaucag

SEQ ID NO: 59535 - RNA, 42 nt, Mus musculus
agcccuugccauucugacccugaauuccaaguccacccgcag

SEQ ID NO: 59536 - RNA, 46 nt, Mus musculus
cagaugguugugagccaccguuguggcugcugggaauugaacucag

SEQ ID NO: 59537 - RNA, 41 nt, Mus musculus
guaaccgugaagaugaagcagacagacagagccgggacaca

SEQ ID NO: 59538 - RNA, 46 nt, Mus musculus
aaagggaagugguauaagguagaaacagcaaaaggagaaagaaggg

SEQ ID NO: 59539 - RNA, 46 nt, Mus musculus
ggaagguaaaauuccgagggaagguuauacaaggacaggaggucag

SEQ ID NO: 59540 - RNA, 45 nt, Mus musculus
aagcaguuuauaagcuuggaaaccgaaggguggggagcaaucgag

SEQ ID NO: 59541 - RNA, 47 nt, Mus musculus
aaaagagaaaaggggucagggacagugacaacagugacagagcaggc

SEQ ID NO: 59542 - RNA, 41 nt, Mus musculus
gauguuggcaggacggugagagccaaagguaccugggcguu

SEQ ID NO: 59543 - RNA, 46 nt, Mus musculus
gaacccagacgcuggagguguuuuguuuucucucuccugcccucag

SEQ ID NO: 59544 - RNA, 46 nt, Mus musculus
uucuucaggccuaaugccauugcuaaaaaaauaaguuacuggaaag

SEQ ID NO: 59545 - RNA, 46 nt, Mus musculus
uuauguauuuguguguuuacaccacacagagcaaguguacauggag

SEQ ID NO: 59546 - RNA, 42 nt, Mus musculus
ugggggucgcugccaaggccagagcugaccagucucuggcac

SEQ ID NO: 59547 - RNA, 45 nt, Mus musculus
ccacucuggaggccucuccagaauccgguggcuguugcuggcuga

SEQ ID NO: 59548 - RNA, 45 nt, Mus musculus
gguuagaacuggugagcaggagggcaagaaguucaggcuucaggu

SEQ ID NO: 59549 - RNA, 46 nt, Mus musculus
cagggguugaccccggggggaggggggcauggcugacacuggaaaa

SEQ ID NO: 59550 - RNA, 54 nt, Mus musculus
agagccaagguggguaccuggaaccauggcuggaggccuggggaaagcaagauc

SEQ ID NO: 59551 - RNA, 68 nt, Mus musculus
agggguguggagggaauacccccagaucagccucaccacccaguaguguggccaggaaaggguuaaug

SEQ ID NO: 59552 - RNA, 46 nt, Mus musculus
aaauccccagguuuaaauaccuuaaugaaagcaggggaugggguag

SEQ ID NO: 59553 - RNA, 42 nt, Mus musculus
agacuuccagucaugcgaggacagccucauagagaaugagau

SEQ ID NO: 59554 - RNA, 89 nt, Mus musculus
ugccacgucugcuuuggacacuucaaauaccucagugcccacaacuacaagguauggggcaggagaaaagugguggaguacggccgaga

SEQ ID NO: 59555 - RNA, 46 nt, Mus musculus
ccggcagccuccccuucgucuccccuucccccaugacgaccaccag

SEQ ID NO: 59556 - RNA, 41 nt, Mus musculus
ggaccuaauguggggguagugcggggacagcaaagcaggug

SEQ ID NO: 59557 - RNA, 45 nt, Mus musculus
auauauagcgauggguggacauaggugauuaagagguccuugagu

SEQ ID NO: 59558 - RNA, 42 nt, Mus musculus
cucucagaacucaaggaccucuuaaucaccuauguccaccca

SEQ ID NO: 59559 - RNA, 46 nt, Mus musculus
gacuuagggacucgcugguucuuguacacacacacacacacucaca

SEQ ID NO: 59560 - RNA, 42 nt, Mus musculus
ugagaucuuagauugacagcucaagauguuaaugcagcagau

SEQ ID NO: 59561 - RNA, 42 nt, Mus musculus
cgcuacugcuguggugcuucucggcccugcuccccaccauug

SEQ ID NO: 59562 - RNA, 42 nt, Mus musculus
ucguguguacguucagagccucuggucuccaggccgcccaga

SEQ ID NO: 59563 - RNA, 44 nt, Mus musculus
ugacguugaacuuguccaugguggugaugaugauggccggggug

SEQ ID NO: 59564 - RNA, 42 nt, Mus musculus
gcgcugccuggucaucaaugugguccucuucauucugcucuu

SEQ ID NO: 59565 - RNA, 46 nt, Mus musculus
ucaccaauagauguucugagggucaggggcguaggucacgguccag

SEQ ID NO: 59566 - RNA, 46 nt, Mus musculus
gaagcacugcauaucuccaacuggaccgugaccuacgccccugacc

SEQ ID NO: 59567 - RNA, 42 nt, Mus musculus
cucacauucagcuaugcaaucccacuuugugaccccacaguc

SEQ ID NO: 59568 - RNA, 42 nt, Mus musculus
ccaggccaagcgugucucggggacugccugccucugccccag

SEQ ID NO: 59569 - RNA, 46 nt, Mus musculus
gucaagcggacucuuuucaucaauggaaucuccaaauaugcagagu

SEQ ID NO: 59570 - RNA, 46 nt, Mus musculus
uagaggugugucuccucaugcuguagacggugagcagcagguagag

SEQ ID NO: 59571 - RNA, 46 nt, Mus musculus
cccucauccccacucauauacuuucauuuuuuucagugcuagagau

SEQ ID NO: 59572 - RNA, 46 nt, Mus musculus
ugacaagguaccccugccagacagaggugucugauggcccccagac

SEQ ID NO: 59573 - RNA, 45 nt, Mus musculus
gguccaucaggucugaagggaugcucagucagcauuaacccccag

SEQ ID NO: 59574 - RNA, 46 nt, Mus musculus
uggguaggggaugagcccagcugacugacuuacccuuugcccagga

SEQ ID NO: 59575 - RNA, 41 nt, Mus musculus
guacgugugugcaccacaugcaugccuggugccugcagaga

SEQ ID NO: 59576 - RNA, 45 nt, Mus musculus
uauguggaggagguuaacagaauuaaaaacucuaagcgcauuuga

SEQ ID NO: 59577 - RNA, 46 nt, Mus musculus
cuauucuuuuguuuuaaaagauuuaguauuuauuuuauguguagua

SEQ ID NO: 59578 - RNA, 46 nt, Mus musculus
uguuaccucucugggagagccauccugguguuucuuuguuacagau

SEQ ID NO: 59579 - RNA, 46 nt, Mus musculus
cucagcaucugugugucuuaauuuauacaccaagacacagacagac

SEQ ID NO: 59580 - RNA, 42 nt, Mus musculus
uuauuaauaacagcgguuuuuguguuuuauguuguuugagau

SEQ ID NO: 59581 - RNA, 46 nt, Mus musculus
uaguuuaaugcagguaaauagccuggcacucugccugacaguugau

SEQ ID NO: 59582 - RNA, 46 nt, Mus musculus
guaagguuaggaguaguaugguugaugauauccaaaaugagcccag

SEQ ID NO: 59583 - RNA, 45 nt, Mus musculus
cacagaugaagggaacagaagcguggagugggagauugcucagag

SEQ ID NO: 59584 - RNA, 45 nt, Mus musculus
cuaagauggacuggacaagccacccccauauaacaccacuucaug

SEQ ID NO: 59585 - RNA, 44 nt, Mus musculus
cugggucucaggguugaggagcagguuuucccagguggcaaagu

SEQ ID NO: 59586 - RNA, 44 nt, Mus musculus
uguauauugaaaccuuauuucaaaggaaugugugguggggacaa

SEQ ID NO: 59587 - RNA, 45 nt, Mus musculus
acacacacacacacacacacaaguacaaauaagagagagcgagag

SEQ ID NO: 59588 - RNA, 68 nt, Mus musculus
acacuuucucuuuucucugccuccgugaggggcuugcggguccugccccauugcucugugccuuggga

SEQ ID NO: 59589 - RNA, 59 nt, Mus musculus
gggacagaauuagugguuucaauggucugaucacacaagguccuccugggcuguaccca

SEQ ID NO: 59590 - RNA, 48 nt, Mus musculus
ggugcuuuuguagacuaucauggggauccacaaagcaugccauguccu

SEQ ID NO: 59591 - RNA, 42 nt, Mus musculus
gaagaggaacaguguaguaugggugugugauuagggggccag

SEQ ID NO: 59592 - RNA, 42 nt, Mus musculus
uggggugggguugggggaaaggaugggggugcucucucucag

SEQ ID NO: 59593 - RNA, 42 nt, Mus musculus
ucuggcuuuguucugucuuucuuuggucugcaguggguagag

SEQ ID NO: 59594 - RNA, 45 nt, Mus musculus
ccuguugcugagcuuccucccacucuccaccccgucugggcccag

SEQ ID NO: 59595 - RNA, 31 nt, Mus musculus
ugcucuccuucugucgugggugcagccuggg

SEQ ID NO: 59596 - RNA, 42 nt, Mus musculus
ccugccaaagguaugggaaagggcugguuccaggcugccccu

SEQ ID NO: 59597 - RNA, 46 nt, Mus musculus
gcaagggccucagagacccaaacggcagugacagcaaagcccccuc

SEQ ID NO: 59598 - RNA, 42 nt, Mus musculus
accuuggcaugguggagguacagcaguaaagccaggguccag

SEQ ID NO: 59599 - RNA, 42 nt, Mus musculus
uuccacaauccgaagugauuugagggagugaagaaccaaccu

SEQ ID NO: 59600 - RNA, 42 nt, Mus musculus
gccgccgcucagcucgcccccagugccgcggccucgcugcag

SEQ ID NO: 59601 - RNA, 44 nt, Mus musculus
accaggcauaugacauggguccccuugggaaaucaggcugaugu

SEQ ID NO: 59602 - RNA, 56 nt, Mus musculus
auccuugcucaccgccuggggcucauccccauccucgcugauccucgucucuuuga

SEQ ID NO: 59603 - RNA, 48 nt, Mus musculus
gacaggaacguuuacuguguggguggaaggggaaauuuagaaagaaga

SEQ ID NO: 59604 - RNA, 41 nt, Mus musculus
gucagacacggugguugcucucggugggauaauggaccaca

SEQ ID NO: 59605 - RNA, 44 nt, Mus musculus
ugggaaaacagguacuggaaagguaauguggagacacaggaggu

SEQ ID NO: 59606 - RNA, 45 nt, Mus musculus
cacacaccccucccugugcaauguucucaucaguaccugccccag

SEQ ID NO: 59607 - RNA, 45 nt, Mus musculus
gcccuacugagugcaugggcuagugugacugauguaggcuaaaug

SEQ ID NO: 59608 - RNA, 46 nt, Mus musculus
aggaagggagaugcuuagaaacugagcagaguggaaacugauccag

SEQ ID NO: 59609 - RNA, 45 nt, Mus musculus
uacacagagaaacccugucucaagagagagagagagagagagaga

SEQ ID NO: 59610 - RNA, 46 nt, Mus musculus
ucagggccagcuagggcuacaugagaugccaucgcaacaauaaaag

SEQ ID NO: 59611 - RNA, 45 nt, Mus musculus
gcucugguugguaggggagggugucguuggugcugcugaccucua

SEQ ID NO: 59612 - RNA, 46 nt, Mus musculus
ggcccaaaugacuuguuaccuuggagaauaaauauuucaaaggaaa

SEQ ID NO: 59613 - RNA, 25 nt, Mus musculus
gccugcugccugauaaagagggcac

SEQ ID NO: 59614 - RNA, 41 nt, Mus musculus
gggccacuccacagccccaccgccuuccccgcaccgugagc

SEQ ID NO: 59615 - RNA, 46 nt, Mus musculus
ccucagagaauucuaucaccuuccuaccaggguauaaugggugugg

SEQ ID NO: 59616 - RNA, 45 nt, Mus musculus
ggagcugaccaacaagcuacuggaugccaggaacaccaucaauaa

SEQ ID NO: 59617 - RNA, 42 nt, Mus musculus
ucaggcuaagaggggggugcccaugacauuagcuggcugggc

SEQ ID NO: 59618 - RNA, 49 nt, Mus musculus
cggaccaaccaggaacuggaggacaagcugcacgcacugguacugugcu

SEQ ID NO: 59619 - RNA, 42 nt, Mus musculus
aagagccucaggucccccugacuuuauuuaguaacccagauc

SEQ ID NO: 59620 - RNA, 45 nt, Mus musculus
ggagcuggaaauaggacaagacugccuagaacuggaguuaggaca

SEQ ID NO: 59621 - RNA, 68 nt, Mus musculus
ccuuccaggaugagcagugcugccccugcuaagaaaccuuaccguaaggcgccuccagagcaccgaga

SEQ ID NO: 59622 - RNA, 46 nt, Mus musculus
uggcucccacuggaagagagcaccuauauggcugcucaccuaccag

SEQ ID NO: 59623 - RNA, 41 nt, Mus musculus
gauuccaggagagcagaacagagagcugccagcgaacagac

SEQ ID NO: 59624 - RNA, 42 nt, Mus musculus
ggguguggcgaggacacaaagagcagaugagacucuaaggau

SEQ ID NO: 59625 - RNA, 46 nt, Mus musculus
ccugggaagaacaagguccauuuggaccuggugguccccagcuggg

SEQ ID NO: 59626 - RNA, 42 nt, Mus musculus
cuccguagaccagaccuggaacucagaaaucugccugccuuu

SEQ ID NO: 59627 - RNA, 46 nt, Mus musculus
ccagugugaggaggagaagugcuaucccagagcagcuugugaggau

SEQ ID NO: 59628 - RNA, 98 nt, Mus musculus
cacuccacccgaacgaaauguggucaacagagugcacuccccacagagugagcacuggaaaagagacucuuaacaaaguuccagaggaggaggagagc

SEQ ID NO: 59629 - RNA, 46 nt, Mus musculus
aagaaaggaaagaaaggaaggaaggaaagaaagaaaggaaagaaag

SEQ ID NO: 59630 - RNA, 44 nt, Mus musculus
gccuggccccauaaugaacucuauuuguugugacacugacagac

SEQ ID NO: 59631 - RNA, 45 nt, Mus musculus
gugccaccuuuuaagcugcguaaggcgaugucaggaugcugaggc

SEQ ID NO: 59632 - RNA, 45 nt, Mus musculus
uaugcucgucggaucccugcgauuggcccugugauugauggagga

SEQ ID NO: 59633 - RNA, 104 nt, Mus musculus
uuccuugguuguggccugggggagcugugucccaggugagggaaagucgggcuaggacucagaugagcuuccaugggcaggggucagugugaccuggggaaagu

SEQ ID NO: 59634 - RNA, 45 nt, Mus musculus
gggagucacaaucaacuuucugaugggguucaccgacguuuaggu

SEQ ID NO: 59635 - RNA, 47 nt, Mus musculus
cugcuuggaaagaagagguagcaacuugccccagcccaaccccagag

SEQ ID NO: 59636 - RNA, 42 nt, Mus musculus
ggguugggcuggggcaaguugcuaccucuucuuuccaagcag

SEQ ID NO: 59637 - RNA, 45 nt, Mus musculus
ggaggggagauggcucucguagucgggaagggguaggagugagau

SEQ ID NO: 59638 - RNA, 45 nt, Mus musculus
ggaggagcaaucgcucacggauugaaaaaguuacuucucucagag

SEQ ID NO: 59639 - RNA, 42 nt, Mus musculus
gggcugccaccaaauuccaggcucccuccccuccgcccccau

SEQ ID NO: 59640 - RNA, 46 nt, Mus musculus
ggccugccccgcggcaagauggcugccugaaggagaggccccggca

SEQ ID NO: 59641 - RNA, 42 nt, Mus musculus
gccggggccucuccuucaggcagccaucuugccgcggggcag

SEQ ID NO: 59642 - RNA, 46 nt, Mus musculus
agacuguagacaugcuuaagaagaaggugucccagcgggaacaagu

SEQ ID NO: 59643 - RNA, 46 nt, Mus musculus
uacacacaaacauauauauaaugcuuuuaaagagacuauucaagau

SEQ ID NO: 59644 - RNA, 26 nt, Mus musculus
guggcacagcuggaaucagagcugag

SEQ ID NO: 59645 - RNA, 42 nt, Mus musculus
uuuuuaguuguguggguguggguuuggauguauguaucugug

SEQ ID NO: 59646 - RNA, 45 nt, Mus musculus
cuuauuucaccugucagacaaguauccguacaccacagcccccag

SEQ ID NO: 59647 - RNA, 47 nt, Mus musculus
acguggauguaacuuuguucaggccucucugcugacacaccagaucc

SEQ ID NO: 59648 - RNA, 55 nt, Mus musculus
agacaagaagcgcagaacaggcugcauuggggccaaacacagaaucagcaaggag

SEQ ID NO: 59649 - RNA, 87 nt, Mus musculus
gagaagauugccguucacugcacaguccgcggagccaaggcagaggaaauucuggagaaaggucugaaggugcgggaguaugaguug

SEQ ID NO: 59650 - RNA, 60 nt, Mus musculus
ucuccuuuuccccuugaucuugcgccaugguggagaacaggaagcacaaaauaacuuuua

SEQ ID NO: 59651 - RNA, 24 nt, Mus musculus
uuacuuuuaucugucccaggaccu

SEQ ID NO: 59652 - RNA, 41 nt, Mus musculus
aguccacugaggcaggggcccucgacaagucugugcugggg

SEQ ID NO: 59653 - RNA, 32 nt, Mus musculus
agcuaggagagaucccuggaagacugcgcuua

SEQ ID NO: 59654 - RNA, 60 nt, Mus musculus
uccuggaucggcugaacggcgaugcaggggaucaaggagcccagaacaacuuuauuccug

SEQ ID NO: 59655 - RNA, 25 nt, Mus musculus
agccucggccagcacaguuccgccc

SEQ ID NO: 59656 - RNA, 46 nt, Mus musculus
gcugcggcccgggaugcggguacggaugcuggagaauuacgaggag

SEQ ID NO: 59657 - RNA, 42 nt, Mus musculus
gaagacaucgaggaugugauugauauugaagaguuacaggag

SEQ ID NO: 59658 - RNA, 29 nt, Mus musculus
ucuuugccgagccuuacgugguacccgag

SEQ ID NO: 59659 - RNA, 42 nt, Mus musculus
cucuuuucucugauguuccggcuccagaugguccugggucag

SEQ ID NO: 59660 - RNA, 45 nt, Mus musculus
ugggagaggcacugaagccccuuugucaggagcccuguguguccc

SEQ ID NO: 59661 - RNA, 45 nt, Mus musculus
accauacguugaaaacuaggggaaaaaaaucauugcaugcagcag

SEQ ID NO: 59662 - RNA, 42 nt, Mus musculus
cuccaucucucaagggcuaggaucauagaugugugccaccau

SEQ ID NO: 59663 - RNA, 41 nt, Mus musculus
aagaaggaggagggagaggaggaaggggagggagaggauga

SEQ ID NO: 59664 - RNA, 42 nt, Mus musculus
aaugcuggaauuugaagcuaugaccuguaugggacugcuaga

SEQ ID NO: 59665 - RNA, 42 nt, Mus musculus
gaguuagagggcucugguguggaccuugaaguggugggagga

SEQ ID NO: 59666 - RNA, 42 nt, Mus musculus
cgcugagagaaguggacgaguggguuccgaagagaaucagga

SEQ ID NO: 59667 - RNA, 41 nt, Mus musculus
uuaaugguccgcgaaaggguuaggggaaaauggccuggaga

SEQ ID NO: 59668 - RNA, 74 nt, Mus musculus
ggcgacgcccauugccuacggcuggggccgcgcgggaggggcugagaaggcugagcuggggguggggagggagc

SEQ ID NO: 59669 - RNA, 46 nt, Mus musculus
guucuucacugcuccaauccccaguuccuucuguaggacccugaug

SEQ ID NO: 59670 - RNA, 45 nt, Mus musculus
cucuucuuguucagggucuugauugaggggcugguacgaguagcc

SEQ ID NO: 59671 - RNA, 42 nt, Mus musculus
uucauccucacucuccaauggagggucuggcagaugaagccc

SEQ ID NO: 59672 - RNA, 45 nt, Mus musculus
gcagaaggcagcucucuuucuacacagucccccucacgagcuccg

SEQ ID NO: 59673 - RNA, 48 nt, Mus musculus
gaagggggacauagccucccugggagggaagaaauccaagaagaagcg

SEQ ID NO: 59674 - RNA, 45 nt, Mus musculus
ccugacugaauuccucugugccaaccacgugcugaagggaaagga

SEQ ID NO: 59675 - RNA, 45 nt, Mus musculus
aagguggugauggauauccccuaugagcuguggaacgagaccuca

SEQ ID NO: 59676 - RNA, 42 nt, Mus musculus
ucagcuugcccucuuaagaaccaagacuaccagcccagagau

SEQ ID NO: 59677 - RNA, 42 nt, Mus musculus
augcacagccaccaacguaaaacaugcaacauacacagagau

SEQ ID NO: 59678 - RNA, 46 nt, Mus musculus
aaucuaugacauauauaucacugcuuaugcagggggcauuggaguu

SEQ ID NO: 59679 - RNA, 48 nt, Mus musculus
auccuggacgggaagggcucuggagucaaguacaccaagucgugagug

SEQ ID NO: 59680 - RNA, 42 nt, Mus musculus
ucuaaaauuuuguuugcauuuacuuguauuuguugggcagcu

SEQ ID NO: 59681 - RNA, 81 nt, Mus musculus
gagguggggguggagggaaggcuucauacaggaagccugcugcgaaaugaagaguuggccagggaaagcauggcgugcaga

SEQ ID NO: 59682 - RNA, 42 nt, Mus musculus
cggauaaccuggagaucccugcuuuugggcgaauccgggggu

SEQ ID NO: 59683 - RNA, 49 nt, Mus musculus
cccagggcuacacauagagaaaauguuaaagauaaacaaaaagcuggac

SEQ ID NO: 59684 - RNA, 51 nt, Mus musculus
guuugccugggccugguguguauaccuuuaguugcagcgcuugggaggcag

SEQ ID NO: 59685 - RNA, 44 nt, Mus musculus
gcugcaacuaaagguauacacaccaggcccaggcaaacacuagu

SEQ ID NO: 59686 - RNA, 45 nt, Mus musculus
gugguggcgcacgccuuuaaucccagcaccuaggaggaggaggca

SEQ ID NO: 59687 - RNA, 42 nt, Mus musculus
gcuuguugcccacccaacauuaaacaccaagauagaaggcag

SEQ ID NO: 59688 - RNA, 46 nt, Mus musculus
uauuguuaaucuuugcuuggccacguuucaagaugagcucccggac

SEQ ID NO: 59689 - RNA, 45 nt, Mus musculus
ucaaguugugguuacuacuuuagaaaggguaucacuagggggcug

SEQ ID NO: 59690 - RNA, 42 nt, Mus musculus
uacacugcagcugucuuuacacacaccugaagagggagucag

SEQ ID NO: 59691 - RNA, 46 nt, Mus musculus
uagcggcaaggaaauucuaguaaaauccagaaaggggcuaucacag

SEQ ID NO: 59692 - RNA, 46 nt, Mus musculus
ggagucuaaaaacagauuauuuuuuuuaauggccaauugcugcagu

SEQ ID NO: 59693 - RNA, 45 nt, Mus musculus
ugcagggugguggggaggaaucugugcuugugguguuguggggga

SEQ ID NO: 59694 - RNA, 46 nt, Mus musculus
cuuggacuuggccaugugguaacccacggcucccgcagcgccugag

SEQ ID NO: 59695 - RNA, 46 nt, Mus musculus
gcaugugcguguuguguuucagcugccccuccucccaggccccaaa

SEQ ID NO: 59696 - RNA, 45 nt, Mus musculus
uagacugucucccaucccaaaauguuccgugucaugcuguuuuag

SEQ ID NO: 59697 - RNA, 46 nt, Mus musculus
uccuuuuuuaaguaacaucuguaacagucaugcagcuaugacccag

SEQ ID NO: 59698 - RNA, 46 nt, Mus musculus
gaggggccaucaaaucaaugucacucaaguuccuggccagccagac

SEQ ID NO: 59699 - RNA, 27 nt, Mus musculus
aggaguucguagagccaggacgccuga

SEQ ID NO: 59700 - RNA, 46 nt, Mus musculus
guggacaaaggucaggcucuggaagguuacgcuguauaugagagac

SEQ ID NO: 59701 - RNA, 45 nt, Mus musculus
aacaagaccaucucacagggguggggagggaagaggaagaggagg

SEQ ID NO: 59702 - RNA, 45 nt, Mus musculus
caucauuggaagauauuuggaacaaaauaaaacuugaggaagagg

SEQ ID NO: 59703 - RNA, 45 nt, Mus musculus
gcgucccugacgugccagguacaaacaaagguaaugguagccauc

SEQ ID NO: 59704 - RNA, 43 nt, Mus musculus
aaccucguaggcaaguuugaguuuucuuuccuuugaugcagau

SEQ ID NO: 59705 - RNA, 46 nt, Mus musculus
aaucugucugcccacaugcuagguugguguuuacuucagccaagaa

SEQ ID NO: 59706 - RNA, 44 nt, Mus musculus
auaagcuuuuauuuguuguuguucaacugacugagaaccucagg

SEQ ID NO: 59707 - RNA, 46 nt, Mus musculus
gacggucacugugacacugccuguggcagggaauguggucaacuca

SEQ ID NO: 59708 - RNA, 46 nt, Mus musculus
aguauaugcacauaaccuccacacagagagacagacagagagagaa

SEQ ID NO: 59709 - RNA, 46 nt, Mus musculus
aaaacagucagguggauaggaauaaaucuucauuuggggauguaaa

SEQ ID NO: 59710 - RNA, 27 nt, Mus musculus
uacgacugugcuguguaauccucuuuu

SEQ ID NO: 59711 - RNA, 46 nt, Mus musculus
gauuuauaugauaccauuauugguuaggaggggccuagcuagaagu

SEQ ID NO: 59712 - RNA, 42 nt, Mus musculus
uuggauggacuguaguaguacaggcuuuuaaucccagcaauc

SEQ ID NO: 59713 - RNA, 46 nt, Mus musculus
cugcauuuaaucugagacgaugcagacuuaggacauuuagccaaga

SEQ ID NO: 59714 - RNA, 44 nt, Mus musculus
augggcaggaaaugcuauggaagagaaugucucagaggccagaa

SEQ ID NO: 59715 - RNA, 42 nt, Mus musculus
ucaaaggcccuagcugggugugugugugugaugccaggucag

SEQ ID NO: 59716 - RNA, 46 nt, Mus musculus
caggcgguaggugauggcgguggucacagugagccaggccagguag

SEQ ID NO: 59717 - RNA, 46 nt, Mus musculus
gggccuggguggaagcauugaaaggauguagccaugcuuucucaag

SEQ ID NO: 59718 - RNA, 45 nt, Mus musculus
uagaaguuuccucugaauugaaacauucuuuuccuggaaggauga

SEQ ID NO: 59719 - RNA, 45 nt, Mus musculus
acauuugcucagugcaagaaaggcaugcgauacauaugcagcuag

SEQ ID NO: 59720 - RNA, 41 nt, Mus musculus
gccaaagaaugaaccacagaauccuggugcaaacucagcca

SEQ ID NO: 59721 - RNA, 46 nt, Mus musculus
ccugaauggcaaaaaccauggaguugggagcauuuagccggcccag

SEQ ID NO: 59722 - RNA, 46 nt, Mus musculus
uguacaguuacuaaaacagcuaauuauuucuuucuuccccuaugaa

SEQ ID NO: 59723 - RNA, 46 nt, Mus musculus
uaauuauuuuagguauuuucauuauaugaaaucuaccaugugucag

SEQ ID NO: 59724 - RNA, 45 nt, Mus musculus
aaggagaacaguucaccgguguuuaguuuuauauugaggugcuca

SEQ ID NO: 59725 - RNA, 46 nt, Mus musculus
cucuggaacccccuucuauugcagcacuuacaaguucacagccaau

SEQ ID NO: 59726 - RNA, 42 nt, Mus musculus
uuacugucugguggggaaagaaggccuauagguggccagggu

SEQ ID NO: 59727 - RNA, 41 nt, Mus musculus
guuuuuaaaaggaguaguaacuugguaguauaaggcaggug

SEQ ID NO: 59728 - RNA, 47 nt, Mus musculus
aaacaaaacacuaaaggugagagaaagggggaagaacggaaagauga

SEQ ID NO: 59729 - RNA, 26 nt, Mus musculus
uacuucaaaaaaggaaaaaaauagaa

SEQ ID NO: 59730 - RNA, 44 nt, Mus musculus
aguacuuuaaucccauaaggauuuaaugaaguaaagaaguaaaa

SEQ ID NO: 59731 - RNA, 46 nt, Mus musculus
gaacuuagccagggcugauugcugacaccccaguuuugagaggcag

SEQ ID NO: 59732 - RNA, 46 nt, Mus musculus
ugggaaggggaaauggauuuuagagguagaguagaguucugugggg

SEQ ID NO: 59733 - RNA, 46 nt, Mus musculus
aguugagggggauaaaagucauugcaguacugugaccaagagccac

SEQ ID NO: 59734 - RNA, 45 nt, Mus musculus
uaccccaguauaggggaaugccaggaccaggaaugggaguaggug

SEQ ID NO: 59735 - RNA, 45 nt, Mus musculus
uaaauaaauaaauaaauaaauaaauaaauaaauaaauccaguauc

SEQ ID NO: 59736 - RNA, 46 nt, Mus musculus
gcuagagcagcagcaagacaacugcaagagacagagaggcuacaaa

SEQ ID NO: 59737 - RNA, 26 nt, Mus musculus
agagagacagaacagacugggagcug

SEQ ID NO: 59738 - RNA, 41 nt, Mus musculus
gaaggaaggaagaaagaaggaaagaaggaaagaaggaaaga

SEQ ID NO: 59739 - RNA, 45 nt, Mus musculus
ggaggcaggaugauugugaguuucaggccacagucuuuaagaggg

SEQ ID NO: 59740 - RNA, 46 nt, Mus musculus
augcauucaccucagcguccuccaucaugcccuuugaugaaaggaa

SEQ ID NO: 59741 - RNA, 45 nt, Mus musculus
ucuaucuaucuaucuaucauccaucuauagagaggagugagcuga

SEQ ID NO: 59742 - RNA, 46 nt, Mus musculus
ggaagacagaagagguuccagcuaaguugggagugguaaaggccag

SEQ ID NO: 59743 - RNA, 46 nt, Mus musculus
guauuuauaaccacaggcaaaguucuaacaaauucuaauucaagag

SEQ ID NO: 59744 - RNA, 42 nt, Mus musculus
cacaggaaccaauaccuccauccaguguaguaggggguaaac

SEQ ID NO: 59745 - RNA, 45 nt, Mus musculus
aggguuacgguuacuucucuacaucuacuuccuuuaacuuccaga

SEQ ID NO: 59746 - RNA, 46 nt, Mus musculus
aaaagaggaguccaaccacgugcaaggauugaauguggauggggug

SEQ ID NO: 59747 - RNA, 24 nt, Mus musculus
aaagcugacaacacagaagaccug

SEQ ID NO: 59748 - RNA, 42 nt, Mus musculus
aagcaugcauagagaucagaggacagcuucuuuugguggggg

SEQ ID NO: 59749 - RNA, 46 nt, Mus musculus
auaucuuaucuaacccuuuauuuuuaccaauguguauauacgauag

SEQ ID NO: 59750 - RNA, 45 nt, Mus musculus
uagaaugcugugaaauugcagaggagugggaggggagcacugcag

SEQ ID NO: 59751 - RNA, 46 nt, Mus musculus
gauccagcuuuauucagcauuacuaccaguuauuugauaacgacag

SEQ ID NO: 59752 - RNA, 42 nt, Mus musculus
uucagcauagcaucacggcgcaggaccaccagccuacaccag

SEQ ID NO: 59753 - RNA, 117 nt, Mus musculus
cugacaaguugcucuaguaacccaaagaagugaaggagaaagcagcuaccucaccaaccgcccagauauugauuuguucagauguuucaaugccucaugauacaauaaaaccacaaa

SEQ ID NO: 59754 - RNA, 44 nt, Mus musculus
gaagagaagcgcccugcaucagcccaguccaccccgagcagcau

SEQ ID NO: 59755 - RNA, 46 nt, Mus musculus
aaaucugauucugguuuugcuauucagguuuacaaaggugccccca

SEQ ID NO: 59756 - RNA, 41 nt, Mus musculus
ccuuuuggggcccuccuucuaccucaaggccuuuccccaca

SEQ ID NO: 59757 - RNA, 46 nt, Mus musculus
cugccaugaagcucucaggaguucagggucauccacagucacauag

SEQ ID NO: 59758 - RNA, 63 nt, Mus musculus
ucugagggcgaaagcgaacaugugaaugaaugagagucacaaacgaagacuuagugugugagg

SEQ ID NO: 59759 - RNA, 45 nt, Mus musculus
uccccagcagcagaaauaaagaaacuuaagaagaaggaacaccag

SEQ ID NO: 59760 - RNA, 47 nt, Mus musculus
ugaggaccgcuucuucgcuuguucgcuggacaggaagcgaaaauguc

SEQ ID NO: 59761 - RNA, 42 nt, Mus musculus
accgcugcguccguccgucgcuuugugccgggcgagggggag

SEQ ID NO: 59762 - RNA, 44 nt, Mus musculus
ggccaacagggauaaguguaaucagggguucccuucagcguaaa

SEQ ID NO: 59763 - RNA, 42 nt, Mus musculus
gccgccuuucuucaccugucaagcaugcccgcaggccaugau

SEQ ID NO: 59764 - RNA, 45 nt, Mus musculus
gcuagugaggcuagugcgcuagcuaaaggcagagcccuugauggu

SEQ ID NO: 59765 - RNA, 45 nt, Mus musculus
aggcagacacagaagaggaugaagaggaugacacagacuguauga

SEQ ID NO: 59766 - RNA, 42 nt, Mus musculus
ugcuuccccucagccuuguagagcugcugagggagaugggaa

SEQ ID NO: 59767 - RNA, 47 nt, Mus musculus
ccugcaaggcagauagaaugucaccuaggaugcaauaccccuaugau

SEQ ID NO: 59768 - RNA, 46 nt, Mus musculus
uaaagguaccuuccccaucuaacagaaugaaaacaaaggcacuaag

SEQ ID NO: 59769 - RNA, 42 nt, Mus musculus
gcucaaagggcagccagucguucuguagcgccucgcgcacaa

SEQ ID NO: 59770 - RNA, 46 nt, Mus musculus
cucauacucccaguuuuucuuuuguguagcaauacgcuugcccaag

SEQ ID NO: 59771 - RNA, 46 nt, Mus musculus
cccucccaauguccaggagguagaaucuagucccugcuucuccaag

SEQ ID NO: 59772 - RNA, 46 nt, Mus musculus
guauguaucuuuaaucccuaacaauguagguaagguuaguuuguag

SEQ ID NO: 59773 - RNA, 48 nt, Mus musculus
gacuucgagaacaggagagggaggagaaggagcggcgcaaggagcggg

SEQ ID NO: 59774 - RNA, 46 nt, Mus musculus
cccccucagguucugagucagaggaggauggugugccucggccucg

SEQ ID NO: 59775 - RNA, 45 nt, Mus musculus
uugcccaggcuuccuugcagacucugagccuggcaguugggacuu

SEQ ID NO: 59776 - RNA, 54 nt, Mus musculus
ccaggcucagagucugcaaggaagccugggcaaaaggagaagagagggcggcca

SEQ ID NO: 59777 - RNA, 42 nt, Mus musculus
ccuuacuaugggagucccuccugggccacauguggcugucag

SEQ ID NO: 59778 - RNA, 51 nt, Mus musculus
caccugugaauggugaggccacaucccagaagggggagaacauggaagaca

SEQ ID NO: 59779 - RNA, 26 nt, Mus musculus
uguaaugaaaaagaaacagcuuuuau

SEQ ID NO: 59780 - RNA, 46 nt, Mus musculus
ggcucagggcauguucgaaggcccgcuggcggaagcuaggggccag

SEQ ID NO: 59781 - RNA, 49 nt, Mus musculus
aauaaauaaauaaguagccaccuuagugguggcucuguggggucaggac

SEQ ID NO: 59782 - RNA, 48 nt, Mus musculus
ugcacaggucacacugugucacuccgcagaacucucugagcccgguca

SEQ ID NO: 59783 - RNA, 71 nt, Mus musculus
ccaaagccgcauuugagagagagagugaugucccccugaaaagugaggaguuugaagugaccaagacagca

SEQ ID NO: 59784 - RNA, 42 nt, Mus musculus
cuacuucacacaguucaaggcugaguugcgaggugcugagau

SEQ ID NO: 59785 - RNA, 51 nt, Mus musculus
ucccugaccccagagcugucauccgucccuuccccacucccugaccccaga

SEQ ID NO: 59786 - RNA, 101 nt, Mus musculus
cagagcugucauccgucccuuccccacucccugaccccagagcugucauccgucccuuccccacucccugaccccagagcugucauccgucccuuccccac

SEQ ID NO: 59787 - RNA, 45 nt, Mus musculus
aaggaagcuccaguaugugugcuggcaccacagcacugggcagag

SEQ ID NO: 59788 - RNA, 46 nt, Mus musculus
cagcaauggcagaugagccuggggacaagugaagacagccagcacu

SEQ ID NO: 59789 - RNA, 45 nt, Mus musculus
aguuuacauguacauucaccuacgcuucccaaggagggaccaacg

SEQ ID NO: 59790 - RNA, 46 nt, Mus musculus
ggcuauacaggucgcacguggguuacucacugaacccggacuagag

SEQ ID NO: 59791 - RNA, 46 nt, Mus musculus
ccggauggcgcuguccgcgucuccagugcugaaacauaauuaguua

SEQ ID NO: 59792 - RNA, 52 nt, Mus musculus
ucccuuucgggaaauguaguuuuuucgcuuuucugauuccaguaucauucgg

SEQ ID NO: 59793 - RNA, 58 nt, Mus musculus
gacuccaggaccucagccucucauuauucaccaugcccagaugguucagcuggguguc

SEQ ID NO: 59794 - RNA, 46 nt, Mus musculus
agccuccaugcuucccucagccuccauccuucccucagccuccauc

SEQ ID NO: 59795 - RNA, 45 nt, Mus musculus
aaagguggcaaacaccuucaagacacagaagcuccaggcacagcg

SEQ ID NO: 59796 - RNA, 45 nt, Mus musculus
cugacucccucuucuggaguaucugaagauagcuacaguguacuu

SEQ ID NO: 59797 - RNA, 46 nt, Mus musculus
guaaugaauagugauagcacuagucugucauccugugucagcacug

SEQ ID NO: 59798 - RNA, 23 nt, Mus musculus
cgcagccaggugaacgaccuuca

SEQ ID NO: 59799 - RNA, 46 nt, Mus musculus
ucacuuucccagaugcggucccagcuuccaggagaacggccacaca

SEQ ID NO: 59800 - RNA, 45 nt, Mus musculus
guccuuugguggaaucuuuccauccaccucauagguccuagagau

SEQ ID NO: 59801 - RNA, 45 nt, Mus musculus
gaccagcgguguccaaucagucaugggcucacgugugggacagau

SEQ ID NO: 59802 - RNA, 48 nt, Mus musculus
cacgccccagccucucauuuggggggcuccaccccugaucacaccccc

SEQ ID NO: 59803 - RNA, 45 nt, Mus musculus
caugugacaguucucaccguccucaccucuacugggcaagaaggu

SEQ ID NO: 59804 - RNA, 42 nt, Mus musculus
cccugucucucugagacagugucauuuagcucaggcugaauu

SEQ ID NO: 59805 - RNA, 46 nt, Mus musculus
ggucucauguagcccaggcuagccucagacccacuagguggcugag

SEQ ID NO: 59806 - RNA, 42 nt, Mus musculus
cugccucccgagugcugggguuaaaggcaugugccaccacgc

SEQ ID NO: 59807 - RNA, 46 nt, Mus musculus
acugcugcugagaccaugucuagcaaugguacagaugcgccugccg

SEQ ID NO: 59808 - RNA, 44 nt, Mus musculus
cagaucaacugugcugcuuccuguguuccuggcuuucccuggag

SEQ ID NO: 59809 - RNA, 45 nt, Mus musculus
ggggcuuuucuggcuuucuuugcagagaaaguaaucuggugggcg

SEQ ID NO: 59810 - RNA, 45 nt, Mus musculus
agggcggaacuuaaacggcggggcuccaggggucuggccugggcg

SEQ ID NO: 59811 - RNA, 64 nt, Mus musculus
uuccgggaggccagggucugugucccgaggggaaguuagggcagccagcugugggugggguuca

SEQ ID NO: 59812 - RNA, 42 nt, Mus musculus
ggugucuugcucuaaguacgcgcgcgggaggcacgggucugg

SEQ ID NO: 59813 - RNA, 116 nt, Mus musculus
ggaguuggcgaguuccaguuacugggacuuaagacuacguggaaugaaugaaugaaugaaugaaugaaugaaugaaugaguagcugcuggcacuuuucagcccgaccagggucuuu

SEQ ID NO: 59814 - RNA, 46 nt, Mus musculus
cagaguguuuuggcaauucacauucaaguguccccacucgccgguu

SEQ ID NO: 59815 - RNA, 45 nt, Mus musculus
gggcgaggguacucuacuuccccuccuccuuccuggcaggcccca

SEQ ID NO: 59816 - RNA, 42 nt, Mus musculus
acccacaccgugaacucucuguccagguugaccaaggugcag

SEQ ID NO: 59817 - RNA, 74 nt, Mus musculus
aguuguagucauucucuguguagccaaggauaacccugagcuuguuucuccuugagauggaaugacagguuugu

SEQ ID NO: 59818 - RNA, 46 nt, Mus musculus
ccccugcccugggguuuuuagucucagucuuagaaguuagccagga

SEQ ID NO: 59819 - RNA, 87 nt, Mus musculus
gcucuuagacugucuguccucuugugauagauggucccaggggugaccagagccugggcucacaugguuuccugaauuuccuaacca

SEQ ID NO: 59820 - RNA, 46 nt, Mus musculus
gucuggccucuguauucccaucuaccccuuccccaugcuaggccuu

SEQ ID NO: 59821 - RNA, 45 nt, Mus musculus
cacagugaaucagacaagucguccacgcauggugaaggggcagcu

SEQ ID NO: 59822 - RNA, 46 nt, Mus musculus
uaacguggacuaccccaggaaacgcggcuucugguaugauguugag

SEQ ID NO: 59823 - RNA, 46 nt, Mus musculus
agcggcccauccugccgguucugcaaggaugaugaaaacaaaccau

SEQ ID NO: 59824 - RNA, 45 nt, Mus musculus
cuacucauugguccuggcugguggcuaugaggaugauguggugag

SEQ ID NO: 59825 - RNA, 36 nt, Mus musculus
gaggugcaaggucacucucucaaucuguuucaguca

SEQ ID NO: 59826 - RNA, 46 nt, Mus musculus
uuucugccagagaaagagaugccacgagguauaaccuaaagcacaa

SEQ ID NO: 59827 - RNA, 45 nt, Mus musculus
guccucaccuaaugugucaaggcuuacucacccuuaugcugcgag

SEQ ID NO: 59828 - RNA, 49 nt, Mus musculus
cucuggcaacaagcguacagcaggccaguccucugaccagaagcucacu

SEQ ID NO: 59829 - RNA, 47 nt, Mus musculus
guggcagagggugaggggacauagguuccuauuaacucuugcccaga

SEQ ID NO: 59830 - RNA, 46 nt, Mus musculus
accacuugugucuaguaucaggccccaagagggcaucaggucccgu

SEQ ID NO: 59831 - RNA, 44 nt, Mus musculus
guuauuguaacgcaucuucuaggguagguccaaagaggccagac

SEQ ID NO: 59832 - RNA, 93 nt, Mus musculus
cuggcacucaauugccacuccccaaucaaugagaaaggugcggaggcugaagacuggcgccaagggaagccagugcgugugguccggaacaug

SEQ ID NO: 59833 - RNA, 46 nt, Mus musculus
cgggagggcaaggaccgcacucgacagcuggggcucacuaugcagg

SEQ ID NO: 59834 - RNA, 41 nt, Mus musculus
uauagcgggauguacagaaacgugugggugcacacaugugu

SEQ ID NO: 59835 - RNA, 46 nt, Mus musculus
ccgggcgugguggcgcacgcccuuaaucccagcacucgggaggcag

SEQ ID NO: 59836 - RNA, 46 nt, Mus musculus
guauuuauuuacuuauuuauuuaauguaaguacacuguagcugucc

SEQ ID NO: 59837 - RNA, 54 nt, Mus musculus
uguuuuucaucccuccacccccuuucuauaacaaagccugcgauuuauugucca

SEQ ID NO: 59838 - RNA, 48 nt, Mus musculus
guucuccccacaccagcugccuagaaaccaucugcacccaucuuugaa

SEQ ID NO: 59839 - RNA, 56 nt, Mus musculus
caggugugucucauggaaacuaaaccauuuacuacaggcagacuggacagcacagu

SEQ ID NO: 59840 - RNA, 44 nt, Mus musculus
guuagauuguuaacauauugcaauaaaauaaaauucuggccggg

SEQ ID NO: 59841 - RNA, 45 nt, Mus musculus
uugugguguagaggugugggcugugauguacuuccugaugguugu

SEQ ID NO: 59842 - RNA, 46 nt, Mus musculus
ugggaaaugauuaguuuggauuuuaaauguuuuuuauaacguucau

SEQ ID NO: 59843 - RNA, 42 nt, Mus musculus
ugccgucugggccuggcgcuuaguagccaagaaugcacauaa

SEQ ID NO: 59844 - RNA, 44 nt, Mus musculus
ucugaauugcuugccagcagggucacacugggccaacaguugca

SEQ ID NO: 59845 - RNA, 45 nt, Mus musculus
ucugcugacaguaagauccacucucugcacugagagcccccagag

SEQ ID NO: 59846 - RNA, 45 nt, Mus musculus
cauggcaugugcacucacauacaagaugaacaaaugaaaauguaa

SEQ ID NO: 59847 - RNA, 42 nt, Mus musculus
guuccacugcucuaugcuagcagcugcuucuguuggccccag

SEQ ID NO: 59848 - RNA, 46 nt, Mus musculus
guauauguauguguauggugugucuguguaagaauaugugugugag

SEQ ID NO: 59849 - RNA, 46 nt, Mus musculus
guggguaucuguaagaaugugagcauguauguguguguguaugugu

SEQ ID NO: 59850 - RNA, 45 nt, Mus musculus
ccagcauguacucugguggcucucuuaggggcagucuuaggugca

SEQ ID NO: 59851 - RNA, 41 nt, Mus musculus
ugugcuggcuuguggacaguuauguguaaccgcuguuccaa

SEQ ID NO: 59852 - RNA, 47 nt, Mus musculus
gaauuugagaagggaguagagucagagaaagacagagaagagagagg

SEQ ID NO: 59853 - RNA, 42 nt, Mus musculus
caggaccugccucucggauucucuccugugaaccuuucccag

SEQ ID NO: 59854 - RNA, 46 nt, Mus musculus
gggauucccuggugggaaugggcagaccucacucagugccagccag

SEQ ID NO: 59855 - RNA, 46 nt, Mus musculus
uggggggguggggguggucaguuccuuggucuguuuucgcacugug

SEQ ID NO: 59856 - RNA, 46 nt, Mus musculus
aguugaaccuacagugacauccuaggcuaugguguguauguguugg

SEQ ID NO: 59857 - RNA, 31 nt, Mus musculus
ucguucauagauucagagcccuugcuccgug

SEQ ID NO: 59858 - RNA, 42 nt, Mus musculus
cacagccuucuugugguacagcuggccacuguuagguagagg

SEQ ID NO: 59859 - RNA, 72 nt, Mus musculus
ggagcugagaguaguaggguuggcagcggcagguauagugucacuucuuucuggcuacuuccuggugaugac

SEQ ID NO: 59860 - RNA, 46 nt, Mus musculus
ucucaggcucuacgggcaaaugucccucucuuucaugacccagcag

SEQ ID NO: 59861 - RNA, 46 nt, Mus musculus
guggaagccccucccccagaguuggcacgaggcaacaagacaucag

SEQ ID NO: 59862 - RNA, 46 nt, Mus musculus
ccuggagugccucgcgcaccuccaucaaggccaagcuccugcgcag

SEQ ID NO: 59863 - RNA, 23 nt, Mus musculus
uguacaguggcccucccugcucu

SEQ ID NO: 59864 - RNA, 46 nt, Mus musculus
auuuacauucuagacaaauuagugugaaggagagcagacccuggag

SEQ ID NO: 59865 - RNA, 46 nt, Mus musculus
ggaaaagaacucaaaugacacucaggauauccccucugaugggugu

SEQ ID NO: 59866 - RNA, 41 nt, Mus musculus
gcugggaggagugccaacugugaagaccagagccacccuca

SEQ ID NO: 59867 - RNA, 46 nt, Mus musculus
aggcuuggugugccacagaagggagccagacuuucuagcaggacag

SEQ ID NO: 59868 - RNA, 46 nt, Mus musculus
ugggagacaggagugaauguguguguauguguguugugaggaguag

SEQ ID NO: 59869 - RNA, 41 nt, Mus musculus
agagugugugcaugugugcgugugugugugugauguggaug

SEQ ID NO: 59870 - RNA, 46 nt, Mus musculus
ucucuaagcugaagguggagaucaaaaagagccggcgucaccccuu

SEQ ID NO: 59871 - RNA, 46 nt, Mus musculus
uccuguucucaggagaggaugaugucacugauccugaggccuugag

SEQ ID NO: 59872 - RNA, 41 nt, Mus musculus
guugucugugcaugggugagugugugugugugugugugugu

SEQ ID NO: 59873 - RNA, 43 nt, Mus musculus
auagggagccaacugcagccuagcugugcucccaccucagcag

SEQ ID NO: 59874 - RNA, 46 nt, Mus musculus
cagucacugagcacuggcacaccacaggagcccagcuucucuggag

SEQ ID NO: 59875 - RNA, 51 nt, Mus musculus
ggccuggagcacccuucuagauccugcccacuccugucccacuguagguaa

SEQ ID NO: 59876 - RNA, 45 nt, Mus musculus
gugcuaaggggcauccuagagccuccugugacagaugcuagccaa

SEQ ID NO: 59877 - RNA, 74 nt, Mus musculus
ggcaggagaaagcaggugacaccuucacuugaagcccuggucaagugacacaggacgcagacuucacaggccca

SEQ ID NO: 59878 - RNA, 88 nt, Mus musculus
agcuggaaacuuagggacugggccucugcugagugcccgauggcggccgugcccauguguacuuggaaauucuauuuauauuguaaag

SEQ ID NO: 59879 - RNA, 45 nt, Mus musculus
ugugggcucugcaguggcugcagguggccccacacaugccccaca

SEQ ID NO: 59880 - RNA, 45 nt, Mus musculus
ccagaugaaggacuucauauuuuugccucauucucuggccuccag

SEQ ID NO: 59881 - RNA, 45 nt, Mus musculus
cccagaaggaaauaauguuuuaauuaagaguuguacaggcugcag

SEQ ID NO: 59882 - RNA, 45 nt, Mus musculus
uccugggaguccagucguacuucagguaagccauucaugggaggc

SEQ ID NO: 59883 - RNA, 42 nt, Mus musculus
cucaucuaagaggucggugggaugagcagcccugggccacua

SEQ ID NO: 59884 - RNA, 42 nt, Mus musculus
ucccaggauucugcgcggugccguucuuccugucccggccgc

SEQ ID NO: 59885 - RNA, 41 nt, Mus musculus
aaaaacgucaguaagccgagacacagccggcgacgcggggu

SEQ ID NO: 59886 - RNA, 41 nt, Mus musculus
guucgugggcccggucguugauugggcgucugagacuggga

SEQ ID NO: 59887 - RNA, 43 nt, Mus musculus
caagagaaagcgggaggagcugagcaacgugcuggcagccaug

SEQ ID NO: 59888 - RNA, 45 nt, Mus musculus
uacccggaucccaucuaaacaucacaacaagugaaaacucaagau

SEQ ID NO: 59889 - RNA, 45 nt, Mus musculus
cuuccgccuuuacagccauugcgccccggcgccccagggaccucc

SEQ ID NO: 59890 - RNA, 45 nt, Mus musculus
aucaugcaggccagacuggagacaggagaaucaagaccucaaggc

SEQ ID NO: 59891 - RNA, 83 nt, Mus musculus
acaaaacaaaacaaaacaaaaauaacaaaaacaucuuccagaggcuagauugggguguagcccugucaucccagcacucgggc

SEQ ID NO: 59892 - RNA, 84 nt, Mus musculus
aacagcccuuccacauuaccuggguucaacucucaggccccacacgggcaccucacaacugucugcagcuccaauuccagagaa

SEQ ID NO: 59893 - RNA, 42 nt, Mus musculus
ccugccuugccccccaaguucugggcucaaaggcaugcacca

SEQ ID NO: 59894 - RNA, 44 nt, Mus musculus
uugagugagacgcuguaagcggagccgauuaugccugugggagg

SEQ ID NO: 59895 - RNA, 45 nt, Mus musculus
ggggccuccagcaaguaaccaccagacaaggcaggacccccagcc

SEQ ID NO: 59896 - RNA, 47 nt, Mus musculus
agaaaagggacaugaaggugggaggaggcugugccaggaguguuggg

SEQ ID NO: 59897 - RNA, 46 nt, Mus musculus
ggauuuauugaacaauguaguuuagggcauugugaacacugagaua

SEQ ID NO: 59898 - RNA, 46 nt, Mus musculus
aacugcgacgcgagcuuucccgcucauccccauagugguggagcag

SEQ ID NO: 59899 - RNA, 42 nt, Mus musculus
ccaccuucaaccugaggauaccucugcucuccccaccugcag

SEQ ID NO: 59900 - RNA, 45 nt, Mus musculus
augggaaagauugucagaguaaguguaucuuaugaaacuugggag

SEQ ID NO: 59901 - RNA, 42 nt, Mus musculus
cagacugaaacuuccucugcugggcccaagaacaaccccuag

SEQ ID NO: 59902 - RNA, 55 nt, Mus musculus
gcgagcuaaggggacgcccacugggacauagugagggggcgggguccucggaggg

SEQ ID NO: 59903 - RNA, 45 nt, Mus musculus
acaagauuagaaauaaaaagcagacuugggagagggagugccagc

SEQ ID NO: 59904 - RNA, 79 nt, Mus musculus
ggccugguacguugucaucuguugaagaugagauaaacugagaaaaaaaugagaacaaaacaaaaaaauuguauggcag

SEQ ID NO: 59905 - RNA, 46 nt, Mus musculus
ugcccugcccaucucucucugucucucuuucucccugcccccgcuc

SEQ ID NO: 59906 - RNA, 46 nt, Mus musculus
aaaaaagaaaaagaaaaaagaaaaagaaaaaaaaaagaaaaaaaga

SEQ ID NO: 59907 - RNA, 48 nt, Mus musculus
cuauucuuguuuuuaauaaacuuuuuaaaaggaaagaaacagucacua

SEQ ID NO: 59908 - RNA, 45 nt, Mus musculus
ucuuuccuuuuaaaaaguuuauuaaaaacaagaauagggccccag

SEQ ID NO: 59909 - RNA, 61 nt, Mus musculus
cagccuuagaaaauagcaagaauuuaaccucugccccgccccccaaaaaaguuuaaaaauu

SEQ ID NO: 59910 - RNA, 45 nt, Mus musculus
aggaucccaauuuuggaaaggaaaaagaugagacacacagaguga

SEQ ID NO: 59911 - RNA, 45 nt, Mus musculus
auuuucacagaugaaguucauauccauuugcuucauuugccugca

SEQ ID NO: 59912 - RNA, 42 nt, Mus musculus
acuggccagacugcuccuugguggaggagaagcaggaggaag

SEQ ID NO: 59913 - RNA, 46 nt, Mus musculus
agaagccagagguguggaagagggcacacaggggagaaguugccag

SEQ ID NO: 59914 - RNA, 46 nt, Mus musculus
aggcggcccuggcucugcugggaugaaggggagcccacugagggga

SEQ ID NO: 59915 - RNA, 42 nt, Mus musculus
cccagcaguucagaguuccaccuuugcggccggugcccccag

SEQ ID NO: 59916 - RNA, 42 nt, Mus musculus
cccacuaaggcaggauggacgguggccggggguuggaaggag

SEQ ID NO: 59917 - RNA, 41 nt, Mus musculus
cacagccaccucccacccagcagggacagcagcaggcaagu

SEQ ID NO: 59918 - RNA, 46 nt, Mus musculus
cuggggcacccccacagcaggacuacaccaaggccugggaggagua

SEQ ID NO: 59919 - RNA, 41 nt, Mus musculus
ugugcagguggggcugcaggggcuggggcagggccuggcac

SEQ ID NO: 59920 - RNA, 46 nt, Mus musculus
cgugaggggcagguggcugccacuggggguagguauugccccagcc

SEQ ID NO: 59921 - RNA, 46 nt, Mus musculus
guccaacugggcagaggggacccugagggaaaaagugacagcugca

SEQ ID NO: 59922 - RNA, 44 nt, Mus musculus
acccaggcauucaguugguguagucauuggccggaguggagaga

SEQ ID NO: 59923 - RNA, 23 nt, Mus musculus
auugcaggagcgggcugggguga

SEQ ID NO: 59924 - RNA, 46 nt, Mus musculus
ccaugccauccggaacccuauacucuucugucauugagguccugug

SEQ ID NO: 59925 - RNA, 34 nt, Mus musculus
uuggcuuugggggccaaaagagacagcuggaaga

SEQ ID NO: 59926 - RNA, 44 nt, Mus musculus
aggcacccccuuaggacccaugggguucuagaaacugaggcaga

SEQ ID NO: 59927 - RNA, 45 nt, Mus musculus
ucagaaugcaaacccuauaucuugaauggaaauaacgggugcaag

SEQ ID NO: 59928 - RNA, 23 nt, Mus musculus
cuaauagagaagaccuggugcaa

SEQ ID NO: 59929 - RNA, 45 nt, Mus musculus
ugguacccaagagaaaccguccagugcaaagucuaguuuucggag

SEQ ID NO: 59930 - RNA, 45 nt, Mus musculus
uggguaugguggaucaggaguucaaacccaucuuuggcuguauag

SEQ ID NO: 59931 - RNA, 45 nt, Mus musculus
gaggauaccgcggaugccagacauccagcagguacuucgugcccc

SEQ ID NO: 59932 - RNA, 46 nt, Mus musculus
auauaauucacuagauagcauuaguaaacugcugggcagcugcuag

SEQ ID NO: 59933 - RNA, 42 nt, Mus musculus
ccucccuguccccugccccccgccaaccccgugcccccaggu

SEQ ID NO: 59934 - RNA, 41 nt, Mus musculus
aagaacacguaaagccccucucuaccccacccucgccuucc

SEQ ID NO: 59935 - RNA, 45 nt, Mus musculus
cuaccccaggggaacacaggcacucauccgagagacagccaccca

SEQ ID NO: 59936 - RNA, 46 nt, Mus musculus
ugcugaucaggccagaggcucagagaccguuaacucuucaugaguc

SEQ ID NO: 59937 - RNA, 55 nt, Mus musculus
uugacuaagucuccacuucuggccgggagcaggguaucggggaagugaggggugg

SEQ ID NO: 59938 - RNA, 47 nt, Mus musculus
uucagguaggaccuacagcggcauucagccgaggauuagagaucagc

SEQ ID NO: 59939 - RNA, 42 nt, Mus musculus
gcuccagacacacucggauaccgaggcucucagccaccagcu

SEQ ID NO: 59940 - RNA, 24 nt, Mus musculus
gccaugugguuccgaaggugagcu

SEQ ID NO: 59941 - RNA, 45 nt, Mus musculus
ggcggguggcccggcguucguccauguccugcagcuucuggagag

SEQ ID NO: 59942 - RNA, 45 nt, Mus musculus
ggucagacacauaggcuaagggggacaggcagguagaugagaggu

SEQ ID NO: 59943 - RNA, 42 nt, Mus musculus
cgaggauguagucggagaaggauggacggacaggacacagga

SEQ ID NO: 59944 - RNA, 41 nt, Mus musculus
cuaaccuaaagagacuugaggacccagggguuggggagguc

SEQ ID NO: 59945 - RNA, 48 nt, Mus musculus
guccacaggaagacaugcaccaccguugccuucacacagguuaacucg

SEQ ID NO: 59946 - RNA, 23 nt, Mus musculus
aacuguggggcaagcuuagaggg

SEQ ID NO: 59947 - RNA, 41 nt, Mus musculus
ugacauugaaaacauacagguaaacugaaguucacuuagua

SEQ ID NO: 59948 - RNA, 46 nt, Mus musculus
uccucuguaaguauuaauuaaaagccuggaaauuuuaaugacagag

SEQ ID NO: 59949 - RNA, 46 nt, Mus musculus
acuuaauaucaucaaaucauaguuuccucuucuauuaaaugaguaa

SEQ ID NO: 59950 - RNA, 44 nt, Mus musculus
uguugauaggauuauucuuucuuaguuuguguucuuacugugaa

SEQ ID NO: 59951 - RNA, 87 nt, Mus musculus
agccaaggcaacucuuaccaaagaaagcauuuaauuaggcgcugcuugcaacuuuaggagacgggggagagaaaggggcgcagacag

SEQ ID NO: 59952 - RNA, 47 nt, Mus musculus
cacacacacacacacacagagaaagagagagagagagagagcgagag

SEQ ID NO: 59953 - RNA, 46 nt, Mus musculus
aaagagggcuuauuucugauauugagguuuuugguuuuuuugugag

SEQ ID NO: 59954 - RNA, 44 nt, Mus musculus
aguugugaacugcccagugugggugcugggaauugaacuugggu

SEQ ID NO: 59955 - RNA, 32 nt, Mus musculus
cuugaagaaauguugggugagcgaagcuggca

SEQ ID NO: 59956 - RNA, 44 nt, Mus musculus
cugcaguggguguugggggagagguuauggugggaagaggagag

SEQ ID NO: 59957 - RNA, 45 nt, Mus musculus
agacauuguaacuaaagcuagguggugauuaucccagcucucagg

SEQ ID NO: 59958 - RNA, 46 nt, Mus musculus
aucaugcaaauaaggauaauuuccccauauaaucauaauauugagg

SEQ ID NO: 59959 - RNA, 49 nt, Mus musculus
ucaaauucacggucucuuuuuaaauugauuguuaauguaugugugugug

SEQ ID NO: 59960 - RNA, 45 nt, Mus musculus
uuugccgugccuguugcuguccuugcuuagcuuacauuuggguag

SEQ ID NO: 59961 - RNA, 65 nt, Mus musculus
acuuccugauccuuuggcucauacaguccuucugccccacguccacaauguucccugagccuuag

SEQ ID NO: 59962 - RNA, 45 nt, Mus musculus
guuuuccuguugaggugcagggacuacacuuacauguggguauag

SEQ ID NO: 59963 - RNA, 44 nt, Mus musculus
uguuagauggucuuuggcuuuuggagggagcuuugucagcccag

SEQ ID NO: 59964 - RNA, 45 nt, Mus musculus
auucucagcugcccauaggcuuaaggucagucuaggcuaugggag

SEQ ID NO: 59965 - RNA, 60 nt, Mus musculus
aguucuaguuuccuccuguugcugugauaaacaucaaggccagaagcaacuuguaggagg

SEQ ID NO: 59966 - RNA, 56 nt, Mus musculus
gaaaagacuuaucagccuucagguggcccucuaucauugagagaagucagggcaag

SEQ ID NO: 59967 - RNA, 45 nt, Mus musculus
uuuuuaugugacucuaggcugugucacauuugacaguuaugggag

SEQ ID NO: 59968 - RNA, 45 nt, Mus musculus
guaaaauuaauaccaaauacuaaguacuaauaaguuaauggcaau

SEQ ID NO: 59969 - RNA, 44 nt, Mus musculus
uggacaugagcagcauuacuaccugggaugagguccugaacuga

SEQ ID NO: 59970 - RNA, 44 nt, Mus musculus
ugugcuguguguguauaagagaguuuguguuguguguguaugug

SEQ ID NO: 59971 - RNA, 45 nt, Mus musculus
uucaggagagacagcucgguaauucuccugacauuaacuugacgc

SEQ ID NO: 59972 - RNA, 45 nt, Mus musculus
uggaagaauacauaguuuaagguuaaagcugugcauuagcucagg

SEQ ID NO: 59973 - RNA, 40 nt, Mus musculus
aacuacgguugcuggagacagugaagaaauuuauggcucu

SEQ ID NO: 59974 - RNA, 44 nt, Mus musculus
cucuaaaggaucuuucugugugugguguacacauguaugcacag

SEQ ID NO: 59975 - RNA, 45 nt, Mus musculus
guuuaaggagcugagauuuagaugguagaaguuagcuuuaaagga

SEQ ID NO: 59976 - RNA, 46 nt, Mus musculus
uggacccuugcacaggcucaccaugaugaucaaggacaagcagcaa

SEQ ID NO: 59977 - RNA, 46 nt, Mus musculus
uuaaaauccagcuaucgacaauuaauaaaagaaaugaauucugcca

SEQ ID NO: 59978 - RNA, 79 nt, Mus musculus
aguuauauucuuuaaagacacugaaaacagaauuagugacuuguugcucaaggggaggaaaaggcuuaauuuauacaag

SEQ ID NO: 59979 - RNA, 46 nt, Mus musculus
gcaguagguaauguuagacaguaaugagaagauuaauaaauagcag

SEQ ID NO: 59980 - RNA, 46 nt, Mus musculus
ucacaguuaacaacagacguguuaucagagugaaauuccagcagac

SEQ ID NO: 59981 - RNA, 45 nt, Mus musculus
ugcccaggcugucagcccacccguguuccuagcacaggcccccag

SEQ ID NO: 59982 - RNA, 45 nt, Mus musculus
aacuccgagagccacagaggugcuuggcucaaggugcugauuaca

SEQ ID NO: 59983 - RNA, 42 nt, Mus musculus
uuuaagauuauuugugauauggauuuauauauaagcuguuaa

SEQ ID NO: 59984 - RNA, 42 nt, Mus musculus
gaucuuuccauaccguauuucauugaucaguuagugucagaa

SEQ ID NO: 59985 - RNA, 42 nt, Mus musculus
ugacaaugcugaagaagccccauaaaccaucacguggaaaug

SEQ ID NO: 59986 - RNA, 46 nt, Mus musculus
cuagccauaccccugcacacacacacacacauacauaggcacacaa

SEQ ID NO: 59987 - RNA, 45 nt, Mus musculus
gagucaguagcagacagggaggaucgcacacuguaugcacugaga

SEQ ID NO: 59988 - RNA, 46 nt, Mus musculus
uuucuggcuauuaauaaaugaaggugcucugauuguuagccaaggg

SEQ ID NO: 59989 - RNA, 46 nt, Mus musculus
gguaucugcaguaugcuauuugugugccuauuuaauuuauuuuaua

SEQ ID NO: 59990 - RNA, 46 nt, Mus musculus
agaucccuugguuacaguacaaugaggucaaugagagcagcagcga

SEQ ID NO: 59991 - RNA, 45 nt, Mus musculus
gugaagauucuaugcccuaguauaggggaaugccagggccaggaa

SEQ ID NO: 59992 - RNA, 47 nt, Mus musculus
guucuugcaguuacguguguguguguguguguguguguguguggaga

SEQ ID NO: 59993 - RNA, 42 nt, Mus musculus
gagaaugacccugagcugcagagugauaguaguggccccgag

SEQ ID NO: 59994 - RNA, 46 nt, Mus musculus
auugaaaagaaaaaaagagucuuuagcaguuuuucuuuggcaagug

SEQ ID NO: 59995 - RNA, 106 nt, Mus musculus
cgacugcauguuccuaacuccaacuuacucaagaguuacacaaagggagacagaacggaaucguguaacaucagaaaauggagcuacagcuucaggacggcaagaa

SEQ ID NO: 59996 - RNA, 46 nt, Mus musculus
uugguuuuaauaggcacgaggcuaagcagagaagcguucagagaug

SEQ ID NO: 59997 - RNA, 54 nt, Mus musculus
cugaagauggcguuguuagaaagaggcgacaagacgauacugaucagggaagac

SEQ ID NO: 59998 - RNA, 46 nt, Mus musculus
agaagggguuaggccgugcagucuuugagcuggaaaauggagaggc

SEQ ID NO: 59999 - RNA, 41 nt, Mus musculus
accuuagaaagcaauacaaaccuucauaaucgcacugagac

SEQ ID NO: 60000 - RNA, 45 nt, Mus musculus
ggccuaaaccagcaggaggauaucagacuaucacaggcaggagau

SEQ ID NO: 60001 - RNA, 42 nt, Mus musculus
acgcugccauauaugucacaguacacugaaaaagagccauca

SEQ ID NO: 60002 - RNA, 46 nt, Mus musculus
uaaagagaaggggaagaagaaaauaauugugaauugcuauagagag

SEQ ID NO: 60003 - RNA, 46 nt, Mus musculus
aaaaaagguauauguauuauagggggaaaauuaagacuguccagau

SEQ ID NO: 60004 - RNA, 42 nt, Mus musculus
acaacaacuagucuagugacguuaacucaugagcgcagagug

SEQ ID NO: 60005 - RNA, 32 nt, Mus musculus
cuguucucgcucuggagccgcugcacaucucg

SEQ ID NO: 60006 - RNA, 41 nt, Mus musculus
gaaaaugaaguuaagucgccaguucaccguguuuggcagcg

SEQ ID NO: 60007 - RNA, 41 nt, Mus musculus
uuaaagcugccagaggccgcccagaucccugaacgcaccga

SEQ ID NO: 60008 - RNA, 45 nt, Mus musculus
gaugggacaaagacagaaccuggguuauuuuguauguaugguuga

SEQ ID NO: 60009 - RNA, 45 nt, Mus musculus
ggagguguggugcagugacugacaugugacugaggaaggugccag

SEQ ID NO: 60010 - RNA, 65 nt, Mus musculus
cugagagggcauuuaagguaucuuuuagggagacaguugaagcauuguacaaagggaaaaaaaua

SEQ ID NO: 60011 - RNA, 94 nt, Mus musculus
gagagucggcaagaaggagcugacuuggagcugggauacaauuagggcaaggcuaaguugggaaagauuguugcgugcaucccgguguuaacgg

SEQ ID NO: 60012 - RNA, 62 nt, Mus musculus
guaagaagcuacaguggauauuacagcaggcuguuaucugggcaaggcauggauggcuaaac

SEQ ID NO: 60013 - RNA, 73 nt, Mus musculus
guggagggagagagguuuauugauucaacaaguauguuggagauagauaggaauuagguauggaggcauccug

SEQ ID NO: 60014 - RNA, 46 nt, Mus musculus
guggaugagcuuauccaguauagagacgucguagacguuguagcua

SEQ ID NO: 60015 - RNA, 45 nt, Mus musculus
ugggcagucuuuagugagauggacaaaaucugaaugcaaugggcc

SEQ ID NO: 60016 - RNA, 46 nt, Mus musculus
aagauugaccauuuggagcguuugcucgcugagaacaacgagauca

SEQ ID NO: 60017 - RNA, 44 nt, Mus musculus
uguuuguuugcuucacagagugggagucagccccgggaugugca

SEQ ID NO: 60018 - RNA, 78 nt, Mus musculus
uagauguuggauguuuacgaucugauuccuuuugauaauccagaugguggaguuuggaagcaaggauuugacauuaag

SEQ ID NO: 60019 - RNA, 69 nt, Mus musculus
uaugaagcggaugagugggaccaugagccccugcaaguguuuguggugccucacucccauaaugaccca

SEQ ID NO: 60020 - RNA, 34 nt, Mus musculus
cagcugcaagaggagccgccuucagcuauucuua

SEQ ID NO: 60021 - RNA, 46 nt, Mus musculus
auuaaggucaccaagaaaacauucuucgauaacaagccagcccuag

SEQ ID NO: 60022 - RNA, 46 nt, Mus musculus
cucccagugucaaagcugaguuuugcagguggccagcaaucgggag

SEQ ID NO: 60023 - RNA, 45 nt, Mus musculus
uugucuagcucaaaugcgaaugguuugggggaccaaucuccacgu

SEQ ID NO: 60024 - RNA, 95 nt, Mus musculus
aguauauuuuuaauaacaugguccuaaagcugaaagaagacucaagcaggaaguuuauguggucugagaucucuuaccuugcaaaauggugggau

SEQ ID NO: 60025 - RNA, 45 nt, Mus musculus
gguugaugaagaggagcaacggugaacuugcuugguaucauguag

SEQ ID NO: 60026 - RNA, 46 nt, Mus musculus
uugaggacaacggucagauccguguggccucuggaauguggcaaag

SEQ ID NO: 60027 - RNA, 46 nt, Mus musculus
cauuuuaucauugcaaacuccucacuaaaaugcaacacgcacaccg

SEQ ID NO: 60028 - RNA, 46 nt, Mus musculus
ucucccucucuguguaugugugugugguguaugggugagugugcag

SEQ ID NO: 60029 - RNA, 46 nt, Mus musculus
gguucuugcucauuuauggcugcggguuccuaccuguuaggaugaa

SEQ ID NO: 60030 - RNA, 24 nt, Mus musculus
ccugccaggaaagcuggccuuccu

SEQ ID NO: 60031 - RNA, 67 nt, Mus musculus
aucccucacaccugugggccugauccuaaaauaugcugccaguuugauuuuaaacggcuuccuggag

SEQ ID NO: 60032 - RNA, 42 nt, Mus musculus
ugcucguugccccugugcuuuacugaugugacuggcugccag

SEQ ID NO: 60033 - RNA, 46 nt, Mus musculus
ucuggaugagcaaguuacucuuggguaccaugaauuuaaugccaac

SEQ ID NO: 60034 - RNA, 46 nt, Mus musculus
ggaguggcuacuucacguccagaccuuucuacaaacgaauggacag

SEQ ID NO: 60035 - RNA, 45 nt, Mus musculus
uugaaauuguauaugugugugugugugugugugugugugugugug

SEQ ID NO: 60036 - RNA, 46 nt, Mus musculus
uaaauuucuuucaucaccucauuacacaacacugacagaagccaga

SEQ ID NO: 60037 - RNA, 63 nt, Mus musculus
ucagcaucaugaugccaucacaggaaccgcgaaagacugggugguuguggacuaugguaccag

SEQ ID NO: 60038 - RNA, 45 nt, Mus musculus
auguuguaguugcgguagugagaggaagcuagaugaaggggagca

SEQ ID NO: 60039 - RNA, 46 nt, Mus musculus
uguugacuaacaggcagggaaccagcuguuuaaacaacaggcauga

SEQ ID NO: 60040 - RNA, 46 nt, Mus musculus
acaugacaugaaaacaacuagacaucacugcugauucuuaggggag

SEQ ID NO: 60041 - RNA, 45 nt, Mus musculus
ucugcauuucuucucauuuuaaaggacaaaaagcuguaccaguca

SEQ ID NO: 60042 - RNA, 42 nt, Mus musculus
uguaacuuaguuaucauuaguaucuuuuaugaauuuggggac

SEQ ID NO: 60043 - RNA, 58 nt, Mus musculus
caggauacgaagcaaaguucacaagauucucugccccaaaaaauuauaauacaacuga

SEQ ID NO: 60044 - RNA, 46 nt, Mus musculus
uuuuguauucuuuguaaaucuucuaaaauguucuugaacuuagcag

SEQ ID NO: 60045 - RNA, 45 nt, Mus musculus
ccuaaaaaaaaaaucuaaauggcuaggcaguaucaaaaaggggga

SEQ ID NO: 60046 - RNA, 46 nt, Mus musculus
aaguagacagaagcaaauuaaacaaaggggacuaacagggguguag

SEQ ID NO: 60047 - RNA, 46 nt, Mus musculus
cauagaacuuuuaaagaauugagcaaguuuacuuacugugccauag

SEQ ID NO: 60048 - RNA, 43 nt, Mus musculus
ggucuucaagacccccaaccuuucaguuucagcuugucugcag

SEQ ID NO: 60049 - RNA, 49 nt, Mus musculus
aacuagcaaguguaauuguaugcuaaugccugaguucaaaaccuauauu

SEQ ID NO: 60050 - RNA, 46 nt, Mus musculus
guauggcugacauacccagcccuuuacccugaauuuuccagcccag

SEQ ID NO: 60051 - RNA, 46 nt, Mus musculus
acuggccucaagguauguuaaaaacucuggcucugagauccagcag

SEQ ID NO: 60052 - RNA, 45 nt, Mus musculus
guuagguagaaaaauaguauuaaaaacuuauuaauggagaugaga

SEQ ID NO: 60053 - RNA, 46 nt, Mus musculus
gcucugcuuuuccuuuuaauugucuacaguuccaugguuccccaag

SEQ ID NO: 60054 - RNA, 46 nt, Mus musculus
uccaccccguccugaggacuguccuaugaagaaggaguacugcaca

SEQ ID NO: 60055 - RNA, 46 nt, Mus musculus
gguagccugcacagcuccuuccgguacugugaaagcuaucccagag

SEQ ID NO: 60056 - RNA, 88 nt, Mus musculus
cggguaaacuccgccacagugaaagugcugucugauucgggaaaaccgguggagguucaagucagugcaguuuggaacgacaugagga

SEQ ID NO: 60057 - RNA, 45 nt, Mus musculus
ucuuuucuagcucauauaccaccacugggacugaaaguguuuaag

SEQ ID NO: 60058 - RNA, 33 nt, Mus musculus
uagagaaucccuuccuggcgauuugguuugacc

SEQ ID NO: 60059 - RNA, 45 nt, Mus musculus
gagauaggaugagacuauguagcccaggcuugccuugaacucauu

SEQ ID NO: 60060 - RNA, 50 nt, Mus musculus
augaacugaagguccaguuccugugguacggaaccaccaacaaaagggac

SEQ ID NO: 60061 - RNA, 41 nt, Mus musculus
auuaaagguuggcaguuuguacuggaaaguuagauguguca

SEQ ID NO: 60062 - RNA, 96 nt, Mus musculus
gcccuuugucagagugacacguggaaggaucuacucagaugugaccuguuuccucgaacacguuacucacaaaguccgccuguacaacauucaggg

SEQ ID NO: 60063 - RNA, 46 nt, Mus musculus
cugagucggggaccuccagcccugggguccaccccuuuguaaccaa

SEQ ID NO: 60064 - RNA, 45 nt, Mus musculus
gccaagaagcaggaguugguggguuggagagcagggcagggggaa

SEQ ID NO: 60065 - RNA, 46 nt, Mus musculus
aaagaaaauaucuaaugaaaaaaaguugccugccuccagccaccag

SEQ ID NO: 60066 - RNA, 48 nt, Mus musculus
uggaaguuucuaauauuguaaacaucaggaaugugcauaaccgugaga

SEQ ID NO: 60067 - RNA, 57 nt, Mus musculus
agccuagaaggaccaugagcaaauugccucuucaagccaacguuuacccgaugugca

SEQ ID NO: 60068 - RNA, 62 nt, Mus musculus
ucugcucagucucuaggugcuuccagcauggcuucugguauguauuguuaauauuccacgcc

SEQ ID NO: 60069 - RNA, 93 nt, Mus musculus
cucauuaguugcuauaccuuaagaaugagacaaguaguuaacacaggccuuuaugagagcuacauaagaugaguauccucagguaauaagcag

SEQ ID NO: 60070 - RNA, 46 nt, Mus musculus
cagcucucuugauuuuaagcuguagugaguugacaucaugguaguu

SEQ ID NO: 60071 - RNA, 47 nt, Mus musculus
uuuguuucgaauccuccucgagaagagaagcgcugugaacaugguag

SEQ ID NO: 60072 - RNA, 42 nt, Mus musculus
gcaggaaaacaccagggucaggggaacagauuuggcuuggag

SEQ ID NO: 60073 - RNA, 48 nt, Mus musculus
accuaacaugaaaaaaggauuuaagauuaacaaaggcaaacucaguaa

SEQ ID NO: 60074 - RNA, 44 nt, Mus musculus
gguuucugagaggcuguaaggacagugagaggaagcucucggca

SEQ ID NO: 60075 - RNA, 37 nt, Mus musculus
uaaggccaguuggcaccacccaugugaaagucccauu

SEQ ID NO: 60076 - RNA, 46 nt, Mus musculus
agacugcugacuuagcuuagucugugucagacauaccugccccaag

SEQ ID NO: 60077 - RNA, 77 nt, Mus musculus
aaggcucugaaagacagggacacccaguaaagcagcaguugauccuaaugaugcuuacaauaugcgacugugaggag

SEQ ID NO: 60078 - RNA, 46 nt, Mus musculus
cucuggcauggaaccagaaccgaaggcacgaggcuguuucugugug

SEQ ID NO: 60079 - RNA, 32 nt, Mus musculus
ugcggaccauccuuucuuaucuucucuuacag

SEQ ID NO: 60080 - RNA, 47 nt, Mus musculus
acguuccguauccgcuugcguuggaccugacccagacuugagcagag

SEQ ID NO: 60081 - RNA, 45 nt, Mus musculus
ccacagcuaccguuaucaguaugaacugagguaacaaaaaugaag

SEQ ID NO: 60082 - RNA, 46 nt, Mus musculus
agaaagaaaaaucagaaguugguagguaacagcuuaauggccaaag

SEQ ID NO: 60083 - RNA, 45 nt, Mus musculus
gucguucaccaguagaaaaagagguguauuuucauuacuugacaa

SEQ ID NO: 60084 - RNA, 46 nt, Mus musculus
auaagucuuguuaaaucuuauuacuguccauauuacuguuugggag

SEQ ID NO: 60085 - RNA, 44 nt, Mus musculus
acuauuugaauguacugagaugucagaaaacgaaacaagggaga

SEQ ID NO: 60086 - RNA, 37 nt, Mus musculus
gcuuuuuaaaguuauuuucacauuacaacacugggga

SEQ ID NO: 60087 - RNA, 46 nt, Mus musculus
uuugcuguacucgugcugaaguguuuucacaguccuuugucuagaa

SEQ ID NO: 60088 - RNA, 46 nt, Mus musculus
uuuugcucauugaaaucaacagguuuugauauuuuucucuuggaag

SEQ ID NO: 60089 - RNA, 78 nt, Mus musculus
ggaguauauccagcgaaacuugccugaagggguggccauggaagugacaaagacgcagauacagcaguugccagaaca

SEQ ID NO: 60090 - RNA, 24 nt, Mus musculus
gaccagaccuacgauaaccacuuc

SEQ ID NO: 60091 - RNA, 46 nt, Mus musculus
uuaagacaaaauuuggauaucauauuauuaugguugaagggagaaa

SEQ ID NO: 60092 - RNA, 42 nt, Mus musculus
gaaucauggaagccauggaaaaguuaaagucugggaugagag

SEQ ID NO: 60093 - RNA, 41 nt, Mus musculus
cucugggagugacagugcugacaagaagucucaggguccug

SEQ ID NO: 60094 - RNA, 42 nt, Mus musculus
cccauuuuauagaaaugugccccacaguucuguuucucagcc

SEQ ID NO: 60095 - RNA, 46 nt, Mus musculus
cugucccaugguauuuaacauaaaaaaaauaaaacuguuaacagau

SEQ ID NO: 60096 - RNA, 42 nt, Mus musculus
guguaaauuuucuccuuuaccuuugcuaauaucauggcagaa

SEQ ID NO: 60097 - RNA, 46 nt, Mus musculus
uaaaaacaaacuguucggcuacuggacaaauuguauauuaucagau

SEQ ID NO: 60098 - RNA, 46 nt, Mus musculus
aucuuguugccgguuauuuuuuauuuaucucguuugaucuuauaac

SEQ ID NO: 60099 - RNA, 46 nt, Mus musculus
uauggaaccuagcaaagcuguuccacugaaugcauccaaacaagac

SEQ ID NO: 60100 - RNA, 41 nt, Mus musculus
cauuugacugcaugcagucagaccauuagaaaugacccaga

SEQ ID NO: 60101 - RNA, 63 nt, Mus musculus
uaagugugucagcaggagaaacuccgaauaaauugaaguaagcagcucuguaacuuugaagua

SEQ ID NO: 60102 - RNA, 67 nt, Mus musculus
uaugaaguaaagguuuuucuuuuagagauagauuuaguuggacauuggggaagaguaugauaaagaa

SEQ ID NO: 60103 - RNA, 46 nt, Mus musculus
ucgaggacgauaauaugaauuuguuugguuaaugauauagcaagaa

SEQ ID NO: 60104 - RNA, 45 nt, Mus musculus
uugaaucuugugugaauuagcuucgcaaauacauaguaaguaaua

SEQ ID NO: 60105 - RNA, 55 nt, Mus musculus
gaauaggggaugucuguugaauuuauuauuuugugcccaacuuuuugaguuauuu

SEQ ID NO: 60106 - RNA, 45 nt, Mus musculus
uuuuugugaaauagcucuaaaauauaugaauuauaaucaggguga

SEQ ID NO: 60107 - RNA, 45 nt, Mus musculus
uaggaagacccuauaaauuaaaauaauugagguuuugggaucaug

SEQ ID NO: 60108 - RNA, 46 nt, Mus musculus
uuccuaauuuuaccuucaauucuacauugugaacuaacugccagaa

SEQ ID NO: 60109 - RNA, 41 nt, Mus musculus
cacaugaugagacauuguguggaugucguuuuguggguagg

SEQ ID NO: 60110 - RNA, 46 nt, Mus musculus
uaguaggccuuucagguugguucuucuuagcacuuuaacccaagua

SEQ ID NO: 60111 - RNA, 46 nt, Mus musculus
guugacacauccuuuuaaagugaaucugagucauaauugccaagag

SEQ ID NO: 60112 - RNA, 46 nt, Mus musculus
uuuuggauuuuuuuuuguuuguuuguuuguuaaauuucggggaaug

SEQ ID NO: 60113 - RNA, 44 nt, Mus musculus
gccugaaauacuguucuuuagaaaccauuuagacaugcuaaagu

SEQ ID NO: 60114 - RNA, 45 nt, Mus musculus
uaaguucaugguacagacaauuuuugcuccaccaaacauuucaga

SEQ ID NO: 60115 - RNA, 46 nt, Mus musculus
guuaauuacaaaaggcucaggaaaaauggauuaugucauuacagau

SEQ ID NO: 60116 - RNA, 45 nt, Mus musculus
cuuuuguugugacuccaguuaaucuuuucucugucugccccuuac

SEQ ID NO: 60117 - RNA, 45 nt, Mus musculus
gcuggugcugcugcugcuuauaaugucaaacaaggggcgaggccu

SEQ ID NO: 60118 - RNA, 46 nt, Mus musculus
uuuuuguguuuaugaaugcuuugcuaguaaauauaagcccagagcu

SEQ ID NO: 60119 - RNA, 45 nt, Mus musculus
caucugacagcacagcauugauaaaaaggaauuggaguguguagg

SEQ ID NO: 60120 - RNA, 45 nt, Mus musculus
uauuugauauuguaaucuagauauacuuuaaagaauaguaguaga

SEQ ID NO: 60121 - RNA, 45 nt, Mus musculus
ugaaaaacccacuuaacaccauguucacagauuccacagcuugag

SEQ ID NO: 60122 - RNA, 46 nt, Mus musculus
ugccauagugagaaccugagucuggauucccagcaacuggguuaaa

SEQ ID NO: 60123 - RNA, 57 nt, Mus musculus
uggcauuggugggacaaaguggaaagagaauccagaguuggagcuagcuugggcuac

SEQ ID NO: 60124 - RNA, 44 nt, Mus musculus
agauugguuuuuuuuuuuuuguaccuuuuguacagucagugaga

SEQ ID NO: 60125 - RNA, 45 nt, Mus musculus
uuguagauaacuaaugagaaugugcuguaaguguguaugugugga

SEQ ID NO: 60126 - RNA, 46 nt, Mus musculus
acagaugucuggaugagacugauaacauuuucuuuuggguauaugg

SEQ ID NO: 60127 - RNA, 49 nt, Mus musculus
gcugcaacgauuguggcaagaggugggcauugguguuggagauaauaga

SEQ ID NO: 60128 - RNA, 46 nt, Mus musculus
aaaugguguguguauaugguauuuuuuuuuaauuggguggagagac

SEQ ID NO: 60129 - RNA, 31 nt, Mus musculus
accuagaagaagaaaggaguacguaaguaca

SEQ ID NO: 60130 - RNA, 46 nt, Mus musculus
aguguuggaacuacaaucgugaacauuugucuuugugggggcaguu

SEQ ID NO: 60131 - RNA, 47 nt, Mus musculus
ugcaugcugugucaagguuguucaggauuguuugugaaggucagagg

SEQ ID NO: 60132 - RNA, 87 nt, Mus musculus
uaccaagcuucgggaacaucuuugaauagcaacauaucauuaagauaagcacaagcacugaauacuacaguucuuuuaggggggagu

SEQ ID NO: 60133 - RNA, 46 nt, Mus musculus
uuuauuguuuuuuguagcauuuuacuuuuccuagauguugacagua

SEQ ID NO: 60134 - RNA, 46 nt, Mus musculus
ggaguagcaugucuguggaagcuuuuaagggaaaaaggcuccuuuc

SEQ ID NO: 60135 - RNA, 46 nt, Mus musculus
auguguuaccaaaaaaaugaucccaauacuacugaaaagggcaggu

SEQ ID NO: 60136 - RNA, 45 nt, Mus musculus
auguguguacauauguaugugcauguauauguguugugugugugc

SEQ ID NO: 60137 - RNA, 46 nt, Mus musculus
aacuauucagagauucccuccugggcuguacagagaggggccuucc

SEQ ID NO: 60138 - RNA, 41 nt, Mus musculus
uucccgaacuuccucaaccuuaaaaaaaagggggggggggc

SEQ ID NO: 60139 - RNA, 93 nt, Mus musculus
agucacacaauuucccuuuggauucuacauuuucuggccagcagagaccaugacuauaccaaaaccauacaauccauaaaaugaugcugaucg

SEQ ID NO: 60140 - RNA, 46 nt, Mus musculus
uuagacaagacaggcaaaacaucaagcaugaaacaguggcccagag

SEQ ID NO: 60141 - RNA, 45 nt, Mus musculus
uggauauggggugugugugugugugugugugugugugugugugug

SEQ ID NO: 60142 - RNA, 45 nt, Mus musculus
auuaucaucaagugggaacauggcagcauccaggcaggcguggug

SEQ ID NO: 60143 - RNA, 46 nt, Mus musculus
aaggcuauaagaaggauccacgggggacuggugagauggcucagug

SEQ ID NO: 60144 - RNA, 46 nt, Mus musculus
gaaaaccaggugccaauauggguaccaucauuuaagacagugagag

SEQ ID NO: 60145 - RNA, 46 nt, Mus musculus
acaagggagaaaaacaggaucugccagaagauggcgggcuguggca

SEQ ID NO: 60146 - RNA, 46 nt, Mus musculus
agcucuuccuugguucccaucuagauuuaauuuagauuguggagac

SEQ ID NO: 60147 - RNA, 45 nt, Mus musculus
aggauucaagcuggggagaagggaaaaggaagccuagcugcuaga

SEQ ID NO: 60148 - RNA, 30 nt, Mus musculus
uauccaguguggacagaaaacuuagagaag

SEQ ID NO: 60149 - RNA, 47 nt, Mus musculus
aggaggaacguuguccuuuuuaagggaaaggaaguugggucccaguc

SEQ ID NO: 60150 - RNA, 46 nt, Mus musculus
aaguucgguugcaagaugguuacaauaacuuuuuugggggggaaag

SEQ ID NO: 60151 - RNA, 46 nt, Mus musculus
gcccugcuccaguuccuguccugacuuccuuuggugaugaacagca

SEQ ID NO: 60152 - RNA, 45 nt, Mus musculus
caaacuuacucuuuauacugucagcacaagcuagagucaccagag

SEQ ID NO: 60153 - RNA, 46 nt, Mus musculus
auugucuugcuacugacugguguaauaaagauagccaauaccuggg

SEQ ID NO: 60154 - RNA, 45 nt, Mus musculus
caaauugaauguaacuccguuauagacacuucaagcaaccuacag

SEQ ID NO: 60155 - RNA, 53 nt, Mus musculus
auauugaccagauucaaacucgaacaaauagaaaaggcauuuuugaggcaaga

SEQ ID NO: 60156 - RNA, 45 nt, Mus musculus
cagaggaaccagguucagugcccacacaguggaucacacccaucu

SEQ ID NO: 60157 - RNA, 43 nt, Mus musculus
uuuauucuuucuucuggucaugguguuuugucacagcaguagg

SEQ ID NO: 60158 - RNA, 49 nt, Mus musculus
gaccaggcuggucucaaacucagacagacagacagacagacagacagac

SEQ ID NO: 60159 - RNA, 46 nt, Mus musculus
cgccaccacgcccggcuaacucuggguuuuuuuucaggguagaguu

SEQ ID NO: 60160 - RNA, 42 nt, Mus musculus
ccauuucaugaaggugccugugcagaccggaggguggcagau

SEQ ID NO: 60161 - RNA, 46 nt, Mus musculus
ggguccgggcuaaaccuuuauucuacagcucccgcaacagccgcgc

SEQ ID NO: 60162 - RNA, 41 nt, Mus musculus
ccugaagaaucugugguacggcgauaaaaauaaagugguca

SEQ ID NO: 60163 - RNA, 46 nt, Mus musculus
aaggagggcauuuuaggaugacuuucaaaacaaaguuagccucuuu

SEQ ID NO: 60164 - RNA, 44 nt, Mus musculus
uuaaggacauggggaagggaguuaagaggguaguagaggcagca

SEQ ID NO: 60165 - RNA, 46 nt, Mus musculus
gaaguagaggccggccauaagcaaugaguacauggagacaugggga

SEQ ID NO: 60166 - RNA, 42 nt, Mus musculus
uggggucacacacacacacaaagaaauaaauaacggcaaguc

SEQ ID NO: 60167 - RNA, 46 nt, Mus musculus
ggcccccagaggcacccccuuccaccucaccauacugcaccuauac

SEQ ID NO: 60168 - RNA, 81 nt, Mus musculus
gugaagagaggagagaggggggaggggaaugggagagaaggggcagagagggaaaaguguaagagggaaagagagcaagag

SEQ ID NO: 60169 - RNA, 46 nt, Mus musculus
accucacagcccugagggcacuucaccagucuuacagcucugagau

SEQ ID NO: 60170 - RNA, 46 nt, Mus musculus
gauuggaacucuuuggcuuggcuucauucuucucucgcccgccuau

SEQ ID NO: 60171 - RNA, 46 nt, Mus musculus
cuauuaagccuagacuguguucuuuaaguuuucuugguccccaccc

SEQ ID NO: 60172 - RNA, 44 nt, Mus musculus
gcugugaccugcuuuuaagaaugaaaagguucaauagagaaaga

SEQ ID NO: 60173 - RNA, 43 nt, Mus musculus
ugcuucgcuugcuguuucaacgaaaaucuacaaaacugaaguu

SEQ ID NO: 60174 - RNA, 50 nt, Mus musculus
cagugucuaguguacgcacacugggaggcguaguacuucuaauacgaaga

SEQ ID NO: 60175 - RNA, 45 nt, Mus musculus
cuacaaucacgugacaauuuccuuucgcacuuuguaacccaaguc

SEQ ID NO: 60176 - RNA, 47 nt, Mus musculus
cgaguuauccaauagcauccuuucucuacaaccagagccugagaucc

SEQ ID NO: 60177 - RNA, 46 nt, Mus musculus
cuucccauaagaguuaaguuuaacauggaagccuagaacagcacgc

SEQ ID NO: 60178 - RNA, 45 nt, Mus musculus
cuucugcgaagccagugccaaggacaauuucaauguggacgagau

SEQ ID NO: 60179 - RNA, 53 nt, Mus musculus
uccugguuggaaauaagcuggacugugagacagacagagaaaucucaaggcag

SEQ ID NO: 60180 - RNA, 42 nt, Mus musculus
ggcgcuccugcucccucccacccccucaccuagccuccagag

SEQ ID NO: 60181 - RNA, 41 nt, Mus musculus
aaaaaaaaaaaguggccagguaaccaucauccuggggcugg

SEQ ID NO: 60182 - RNA, 42 nt, Mus musculus
auuuaacagcauuaccucagccuauuacagaagugccaaggg

SEQ ID NO: 60183 - RNA, 46 nt, Mus musculus
ucuguacugauguacaguagguaguuaguugauaacccguugaaug

SEQ ID NO: 60184 - RNA, 48 nt, Mus musculus
cacagguaccaggcacauacaggguccauauacacacaugcagcaaaa

SEQ ID NO: 60185 - RNA, 46 nt, Mus musculus
cauuacaaugaaaacuccucuucccggaggcaaagagagacagaga

SEQ ID NO: 60186 - RNA, 47 nt, Mus musculus
uggggucugaagccucaggcaccacauucagguucacagacagacau

SEQ ID NO: 60187 - RNA, 46 nt, Mus musculus
aggugucaggcuccucuuuuauuauuucuuugauaaaaguagagau

SEQ ID NO: 60188 - RNA, 34 nt, Mus musculus
uuaaaagcuauaucugaauguucuagucccuuuu

SEQ ID NO: 60189 - RNA, 42 nt, Mus musculus
ucuguucaucucagaugucaucugaccaaugcugccucaggu

SEQ ID NO: 60190 - RNA, 28 nt, Mus musculus
cgggagagaugaugucacuggcccauuc

SEQ ID NO: 60191 - RNA, 70 nt, Mus musculus
ccugcuaaaacaggcagguuuuucaagcuaguugagaaggaguggagagcacauucaggcccagcaugau

SEQ ID NO: 60192 - RNA, 46 nt, Mus musculus
gauuccucugugcacacacucgguucuucucaguggcugagcagau

SEQ ID NO: 60193 - RNA, 60 nt, Mus musculus
accuggguccuccucuuugagaacaagagccgcccuuagccacauuucggcccugguuca

SEQ ID NO: 60194 - RNA, 45 nt, Mus musculus
gccugcagcacaugugugcaucaugcacacaguuuuugccgggau

SEQ ID NO: 60195 - RNA, 46 nt, Mus musculus
uggcaaugaaauaacacacauuagccucuuagaguagaaccuagaa

SEQ ID NO: 60196 - RNA, 45 nt, Mus musculus
gguuauaucuaccuguuuucuuccuguuguauauagcuuggaugu

SEQ ID NO: 60197 - RNA, 46 nt, Mus musculus
gagacugagacagagacaggaugaugaugaagaaguagggacgauc

SEQ ID NO: 60198 - RNA, 46 nt, Mus musculus
aggcaccaggcauucauguggugcacagacguacaugcaagcaaaa

SEQ ID NO: 60199 - RNA, 45 nt, Mus musculus
acuuauauauaauaaauaaauaaaucuuugaaaaaaaguauagcu

SEQ ID NO: 60200 - RNA, 46 nt, Mus musculus
uaucuuuauuguuaugauuaauaaucggugcauagugggcauaaaa

SEQ ID NO: 60201 - RNA, 46 nt, Mus musculus
aagaaguuuguugcagagacaguucgcgcuaaagcuacacucgggu

SEQ ID NO: 60202 - RNA, 46 nt, Mus musculus
ccuguguguacauguguguuguuuuccuggaauuuaccugaaagaa

SEQ ID NO: 60203 - RNA, 45 nt, Mus musculus
uggagauuuaaggaaauggcugaauggcuguuuaacauguggagu

SEQ ID NO: 60204 - RNA, 45 nt, Mus musculus
aaugggucugcaauggagagcgguaaaaggagaaugucugucuua

SEQ ID NO: 60205 - RNA, 45 nt, Mus musculus
cuuaaucucaauccaggguuucugcccugccuuggcuauuuaguu

SEQ ID NO: 60206 - RNA, 45 nt, Mus musculus
gagauuugucuguguuucugcagauaaugaauaaccaccccagau

SEQ ID NO: 60207 - RNA, 45 nt, Mus musculus
uuaaugcgaaagugagaccugaggagacugcuguuuaaaugggag

SEQ ID NO: 60208 - RNA, 42 nt, Mus musculus
uggggguguucgcggcggguuggcuagugugugcucgugcag

SEQ ID NO: 60209 - RNA, 42 nt, Mus musculus
aagggaagguggcccgucgcuggcgggcacagcucaggggag

SEQ ID NO: 60210 - RNA, 46 nt, Mus musculus
guugggcuaugucuuguccuacaccuacuuacacacauacuggcaa

SEQ ID NO: 60211 - RNA, 44 nt, Mus musculus
gauugcccugugaccuccuuugaaaaagaauuacacacucacca

SEQ ID NO: 60212 - RNA, 46 nt, Mus musculus
guucucagaagcgcgaugugucuaguccggaugaaaguaacggcca

SEQ ID NO: 60213 - RNA, 45 nt, Mus musculus
aaccacucucaggguucaggaagcaauuuugaaagagcuggggag

SEQ ID NO: 60214 - RNA, 47 nt, Mus musculus
cccgaauccaaagaucugggcucucagaccccucaggccuuaaccuu

SEQ ID NO: 60215 - RNA, 46 nt, Mus musculus
cccuacagcugcgaggugugcggaaagucauucauccgcgccccag

SEQ ID NO: 60216 - RNA, 41 nt, Mus musculus
cuguagcuagaggugauggguuaggaacacugggccuggga

SEQ ID NO: 60217 - RNA, 46 nt, Mus musculus
ccaaacaguuugcuuuuuuuaucuuuugguuugugugugcgugugc

SEQ ID NO: 60218 - RNA, 46 nt, Mus musculus
ugguugcaguuuucaauagaagcugauugcccugucauagccauaa

SEQ ID NO: 60219 - RNA, 42 nt, Mus musculus
uaugguagcaaauguuauauuuguacuucguggcaccagggg

SEQ ID NO: 60220 - RNA, 45 nt, Mus musculus
gauuuggaaagcauaaagggaguguucaacuuuauagacuaugag

SEQ ID NO: 60221 - RNA, 46 nt, Mus musculus
uagucuggaggacaugaaguucuugucuguaguuuuauagguuaag

SEQ ID NO: 60222 - RNA, 45 nt, Mus musculus
ccucucaaaaagcuugcccaggcaaaguacuuagguucugucugg

SEQ ID NO: 60223 - RNA, 47 nt, Mus musculus
cucuaauccacaagcaaccccuuuucaaaaauggauggaugaguuga

SEQ ID NO: 60224 - RNA, 46 nt, Mus musculus
acacacuggaaaacaaagcccgugggcucagagagcugaugccuag

SEQ ID NO: 60225 - RNA, 46 nt, Mus musculus
gaaccuuggacuuuaagaacgcuuggagucauugaaccacacccaa

SEQ ID NO: 60226 - RNA, 46 nt, Mus musculus
uaaauaaaugauguucuggauaugucaugcauguaacuuuggagaa

SEQ ID NO: 60227 - RNA, 45 nt, Mus musculus
gaggugcgagggcgucuaaaguauugcacagucuuggaacauaaa

SEQ ID NO: 60228 - RNA, 46 nt, Mus musculus
acuagaagcuggaauccacuaaaauccugguugaggucugguggag

SEQ ID NO: 60229 - RNA, 45 nt, Mus musculus
agagagaaaggcccauccuucaaugcagucacagugguauggcag

SEQ ID NO: 60230 - RNA, 89 nt, Mus musculus
auugcagcuucaauagagcuagcuucugaaaucuuggccccacggcgggaaaucgugaacugauuuggaucuuugccauccuuucucag

SEQ ID NO: 60231 - RNA, 46 nt, Mus musculus
gguuuuuuuaagacugucaauuagauaugaaccuaaaugcuaccca

SEQ ID NO: 60232 - RNA, 45 nt, Mus musculus
cucauugaggugcuauuggagcggaaugccucccacgggggucua

SEQ ID NO: 60233 - RNA, 43 nt, Mus musculus
auguuucggggucucucacagaauaacauccacccaacucucu

SEQ ID NO: 60234 - RNA, 46 nt, Mus musculus
ccgugggcaaaugucuauucccccgggcuaaagcucugaguuccgg

SEQ ID NO: 60235 - RNA, 41 nt, Mus musculus
cggauguggcgccgaccucaccuccggugcaccucagguac

SEQ ID NO: 60236 - RNA, 72 nt, Mus musculus
aguuucacuguaauucugagaccuuuccagucaccgguagccuuggcaaugucaucgccaacuuucuucgga

SEQ ID NO: 60237 - RNA, 42 nt, Mus musculus
guggaagcuauuaggaccaauuauaaugacagauauggcgag

SEQ ID NO: 60238 - RNA, 45 nt, Mus musculus
aaaacccuugaacgccaagugcaguuaagcagauaaagggauaaa

SEQ ID NO: 60239 - RNA, 46 nt, Mus musculus
guaauaguggaaauuuaaguagcguuuaguggggcuuagagaccag

SEQ ID NO: 60240 - RNA, 48 nt, Mus musculus
ggguuaggaaugggagucagcuuagagaauugaaagugaaaggcaaag

SEQ ID NO: 60241 - RNA, 46 nt, Mus musculus
cucacacauagccuucaugugugauuuugcagagaugugaguguaa

SEQ ID NO: 60242 - RNA, 46 nt, Mus musculus
gugcagggagcagaguuagaggauggcaugguuccuggccuguaag

SEQ ID NO: 60243 - RNA, 45 nt, Mus musculus
cauaauagauccuuagaagccugauaagggcuggagagaugguug

SEQ ID NO: 60244 - RNA, 79 nt, Mus musculus
acugaaccguuauuccagcuccucugacauuucguugaaucucuuauuuuguaaucugugagggaaaggaguaagcaau

SEQ ID NO: 60245 - RNA, 45 nt, Mus musculus
ucaucacacuggggaucacaggaccccauguuuuguugcuuuaag

SEQ ID NO: 60246 - RNA, 45 nt, Mus musculus
uggcugucacacaagcucuagguucagugagagacccugucucaa

SEQ ID NO: 60247 - RNA, 46 nt, Mus musculus
uucugaaaucuguuaaccuaguugauuuggguuuuaaaggcaugag

SEQ ID NO: 60248 - RNA, 46 nt, Mus musculus
uugugugagcaucacuuuuaggacuuugaguugacuguacugguau

SEQ ID NO: 60249 - RNA, 42 nt, Mus musculus
guaaaaggaugcuggcucuuaacuuuuucuauaggcaccugu

SEQ ID NO: 60250 - RNA, 46 nt, Mus musculus
uuaaugguaagucuauaccaugaaauacugugcagcaauaaaauag

SEQ ID NO: 60251 - RNA, 46 nt, Mus musculus
cacaaacauauaugauaauauuguuguacugauuaugaguagguag

SEQ ID NO: 60252 - RNA, 46 nt, Mus musculus
uuucacuuccacauugucuuccacauggugauaauaaugucagcaa

SEQ ID NO: 60253 - RNA, 46 nt, Mus musculus
guauauaugugaccuuuaaauuuagaagagauguuucuggggccag

SEQ ID NO: 60254 - RNA, 41 nt, Mus musculus
uauauugguggugagcugguaaacuaaacuuucagcugcag

SEQ ID NO: 60255 - RNA, 41 nt, Mus musculus
acaccuuggaaucagaggcaguuuucacucagaguucugug

SEQ ID NO: 60256 - RNA, 45 nt, Mus musculus
cugagcuaccacuaaauucuaggucuuuggugucacauaccacag

SEQ ID NO: 60257 - RNA, 46 nt, Mus musculus
uaagguuguuuugucugcauguaugucuguguacucacagaagcca

SEQ ID NO: 60258 - RNA, 45 nt, Mus musculus
ccgcacauggaguggacguggggcggguucccagaguccaccaag

SEQ ID NO: 60259 - RNA, 90 nt, Mus musculus
gaacgguaugacuaucauccaaggacagcuacgauuacaccaucagagaacacacauuucaggguaauucccagugaagacagccucaua

SEQ ID NO: 60260 - RNA, 57 nt, Mus musculus
cuguugaagauacuaccuguaccauagugaaacccaaaccuagagcccuguguaagc

SEQ ID NO: 60261 - RNA, 46 nt, Mus musculus
cccagcccaucagcagaggcucccucagaacccaaaccagcugcua

SEQ ID NO: 60262 - RNA, 41 nt, Mus musculus
cccauuguggcuucucuugcucucuaauuuccucccugccc

SEQ ID NO: 60263 - RNA, 45 nt, Mus musculus
gauagauagauagauagauagauagauagacagacagacggacag

SEQ ID NO: 60264 - RNA, 46 nt, Mus musculus
gaguuugcagaaaacccuggccuuaucgacaacccaaaccucguga

SEQ ID NO: 60265 - RNA, 45 nt, Mus musculus
cgaggggucacaggaguuggaagaaagcaucaaaguugaccccau

SEQ ID NO: 60266 - RNA, 45 nt, Mus musculus
uaacaaugagucaucucauuguuuuaauuuuuuuguugagacaag

SEQ ID NO: 60267 - RNA, 45 nt, Mus musculus
ugccuuggccaccugaguagcuaagauguauuggucugcacuaga

SEQ ID NO: 60268 - RNA, 45 nt, Mus musculus
cccaggacugugaacagaaggauguccccccacccuccaccccag

SEQ ID NO: 60269 - RNA, 45 nt, Mus musculus
auuuuuauuacuaccucauaacuauaauuuuugaacugcuaugaa

SEQ ID NO: 60270 - RNA, 45 nt, Mus musculus
cuucuguggaguuguguacugggcaccacgcagcugcacaucuaa

SEQ ID NO: 60271 - RNA, 46 nt, Mus musculus
ucuuucuguccacgugucuguuagcgcgacacucgucccugcacau

SEQ ID NO: 60272 - RNA, 46 nt, Mus musculus
uaggauaaugaauguaacucuuauuuaaaggagucuccuugcugag

SEQ ID NO: 60273 - RNA, 46 nt, Mus musculus
cucagagguuaagagcauugacugcucuucugaagguccugaguuc

SEQ ID NO: 60274 - RNA, 41 nt, Mus musculus
aaaaggagaccugggauccagcugaagagaauccauguaga

SEQ ID NO: 60275 - RNA, 46 nt, Mus musculus
aacagcuggaauuauguaagguuuggugacauuaaauagcucagau

SEQ ID NO: 60276 - RNA, 42 nt, Mus musculus
ccgggcggugguagcacaggccuuuaaucccagcacucggga

SEQ ID NO: 60277 - RNA, 44 nt, Mus musculus
uugauaggaagugaacauaggguuauuaagaaaaaaaccacaga

SEQ ID NO: 60278 - RNA, 46 nt, Mus musculus
gcuugaauauuguauacaggauuaaauaaagucaaccauaggucaa

SEQ ID NO: 60279 - RNA, 46 nt, Mus musculus
ucgaucuugaggggaaagaggacccaguuuuuauaggcccucgggg

SEQ ID NO: 60280 - RNA, 45 nt, Mus musculus
agagagaaucucuuauguacuguguggaagcaucaccuguuagcu

SEQ ID NO: 60281 - RNA, 42 nt, Mus musculus
gaggagggagaggagggggagaggagaggaggggagaggaga

SEQ ID NO: 60282 - RNA, 43 nt, Mus musculus
aaagaagggauggagagggagaggaggagagaaggaaggaggg

SEQ ID NO: 60283 - RNA, 45 nt, Mus musculus
auuacaaagacacacaauuagcuuauuagaauauaugccaagaug

SEQ ID NO: 60284 - RNA, 46 nt, Mus musculus
ugugugugugagagaaagagagacagacagacagagacagaaagag

SEQ ID NO: 60285 - RNA, 41 nt, Mus musculus
ucuguaaugagaucugaugcccucuucuggugugucaaaag

SEQ ID NO: 60286 - RNA, 46 nt, Mus musculus
cccugucucgaaaaaaaccaaaaaaaaaaaaaaaagagagagagag

SEQ ID NO: 60287 - RNA, 42 nt, Mus musculus
auacuugucucaaaagauuuuaaaaaacaacaagaagaagaa

SEQ ID NO: 60288 - RNA, 46 nt, Mus musculus
aaggaaggggagagagaaaaggagaaggggggagggaaaaggagau

SEQ ID NO: 60289 - RNA, 47 nt, Mus musculus
aucugucgauaaagcugaucagccaauggcuaagcagaggagauuau

SEQ ID NO: 60290 - RNA, 46 nt, Mus musculus
ucuuuuacaaaaaagaauuaaugaggugauuuuuuucugacagguu

SEQ ID NO: 60291 - RNA, 46 nt, Mus musculus
cuccccauccauucccauccacccucccaaaauaaagugcccuccc

SEQ ID NO: 60292 - RNA, 46 nt, Mus musculus
auugcuuuuaaaaugugaauucccugaguucuucuaaagcgaaggu

SEQ ID NO: 60293 - RNA, 46 nt, Mus musculus
uugcuaauacagguaucauuguacucacguauauauaaccaaagaa

SEQ ID NO: 60294 - RNA, 42 nt, Mus musculus
gguucauacuuguaaucccagcauguggaagugggggcagga

SEQ ID NO: 60295 - RNA, 46 nt, Mus musculus
guaagccacagugugguuguugugaaucaaauucagggccucugaa

SEQ ID NO: 60296 - RNA, 46 nt, Mus musculus
aagcgaaguaggcuugacuguccggcgagaaggcgcaggggacccc

SEQ ID NO: 60297 - RNA, 46 nt, Mus musculus
gcaaaacgucacauauuuuaggauaccuuuuacaccgguuccagau

SEQ ID NO: 60298 - RNA, 46 nt, Mus musculus
gucccaacaucagacagggucagacuuccagguuuuauuaccagag

SEQ ID NO: 60299 - RNA, 47 nt, Mus musculus
ugagaucugacgcccucuucuggagugucugaaggcagcuacagugu

SEQ ID NO: 60300 - RNA, 47 nt, Mus musculus
aaaguguacuuacauguaauaauaaauaaaucuuaaaaaaaaaaagu

SEQ ID NO: 60301 - RNA, 46 nt, Mus musculus
gugagcugcuaugugggugcugggaauugaaccugggucccuugga

SEQ ID NO: 60302 - RNA, 48 nt, Mus musculus
aaugcuaccaacugccgugccaagagccaacaggucagccugguccuu

SEQ ID NO: 60303 - RNA, 42 nt, Mus musculus
caguuuucauggaauggaauggaaagcuuucuacauagagcu

SEQ ID NO: 60304 - RNA, 41 nt, Mus musculus
aguacaaagagaaauguaacauaagaacaaacacguaagau

SEQ ID NO: 60305 - RNA, 46 nt, Mus musculus
ucacacugccgugaaaccagaaaaacuccuaaaucugcccccauau

SEQ ID NO: 60306 - RNA, 46 nt, Mus musculus
gcgcgcgcacacacacgcacgcgcacacacacacacacacacacac

SEQ ID NO: 60307 - RNA, 46 nt, Mus musculus
ugauacacagggaacugacgcugcuauugucuccuuuccauuugcu

SEQ ID NO: 60308 - RNA, 45 nt, Mus musculus
uuugaccuggagcacccuuguacuccaaguuaaaucagaucuaga

SEQ ID NO: 60309 - RNA, 36 nt, Mus musculus
uccugagguuucauacccaacacccaaccugcagau

SEQ ID NO: 60310 - RNA, 46 nt, Mus musculus
cucgaugguagccuacagaauggaaacaucacuaaguuagccagac

SEQ ID NO: 60311 - RNA, 89 nt, Mus musculus
ucucugggagaagccagauccaacucuggguuauagagaagaagaucaguguuccaggucagagacagaggcauuucagagaagcagag

SEQ ID NO: 60312 - RNA, 46 nt, Mus musculus
agaguuucuggaaaguuuugacucugcuuuccaucagcugguagag

SEQ ID NO: 60313 - RNA, 40 nt, Mus musculus
ccuuuaccuucuucauacaccaauuuugccuucuguccgg

SEQ ID NO: 60314 - RNA, 42 nt, Mus musculus
aguagccaggcaugguagugcaugccucuaaucccagcacuu

SEQ ID NO: 60315 - RNA, 61 nt, Mus musculus
acucuggaagacaacagcagaacagugcugagaccaagugugcacuggucagugaguagcu

SEQ ID NO: 60316 - RNA, 46 nt, Mus musculus
cuucgucccaauuauccugguggaaauagcaaagaaaggaauuugu

SEQ ID NO: 60317 - RNA, 43 nt, Mus musculus
ggaugcuauaggcagcacugggcaaggcaagccaggccucucg

SEQ ID NO: 60318 - RNA, 42 nt, Mus musculus
gcacucaggacaggaaggaagugugggaauugccugucaacu

SEQ ID NO: 60319 - RNA, 35 nt, Mus musculus
uugaaagauaaacagauacccuagcccugccaaga

SEQ ID NO: 60320 - RNA, 46 nt, Mus musculus
cccuucccgcuucggcugggcagccugcucugccccgguggaaguc

SEQ ID NO: 60321 - RNA, 45 nt, Mus musculus
ucugacuggggccucaguucccacagguaugucaacggggaagaa

SEQ ID NO: 60322 - RNA, 46 nt, Mus musculus
ugucacaauguucaguuggcuggguaacgaugaucgccgcaagaag

SEQ ID NO: 60323 - RNA, 54 nt, Mus musculus
ucacaaaaacggccagugccagcuuaaccugcugaacuccauagguagggggug

SEQ ID NO: 60324 - RNA, 53 nt, Mus musculus
guagagccucaggccaccauuucugaaaucaagacccuuuucaccaagacaca

SEQ ID NO: 60325 - RNA, 47 nt, Mus musculus
acugauugucauuuuaaauaguccuacccauucaacagaguacugga

SEQ ID NO: 60326 - RNA, 42 nt, Mus musculus
auuaccugauaaaguuaaagacauuuccuuuagcacugggaa

SEQ ID NO: 60327 - RNA, 46 nt, Mus musculus
cuuuguuuuguuuuguuagaggcaguauugaaugguguuugcagau

SEQ ID NO: 60328 - RNA, 51 nt, Mus musculus
aaugacuaucugggucuuuuguauuucagagagcgagcgagcgaaagagag

SEQ ID NO: 60329 - RNA, 73 nt, Mus musculus
uuacuuuuaaccuuuuaaagucauugcuguguggaaggcagguggagaggaagguggucagugccauagugca

SEQ ID NO: 60330 - RNA, 46 nt, Mus musculus
acaauguaacuuuggcuggcuggaacuuacuauaugcaacccagau

SEQ ID NO: 60331 - RNA, 42 nt, Mus musculus
aaaaaaaccauaaagaaaaaaauguaugaugguccgccucag

SEQ ID NO: 60332 - RNA, 46 nt, Mus musculus
agaguuccugggauaucgaugggagagccacuaaaagaaggaaaaa

SEQ ID NO: 60333 - RNA, 42 nt, Mus musculus
cucuuucugucaucuggacaggaccagcaagcgcacccccag

SEQ ID NO: 60334 - RNA, 44 nt, Mus musculus
auagcuuuaaccggacaauccauaagaagucaagagggagugag

SEQ ID NO: 60335 - RNA, 42 nt, Mus musculus
cucuuuuucgugacgccuccuaggcgcucggcugugucaaaa

SEQ ID NO: 60336 - RNA, 41 nt, Mus musculus
aaacgcauggccacggaaguagccgcugaugcucuugguga

SEQ ID NO: 60337 - RNA, 52 nt, Mus musculus
cauggcagagugcgccugcuguugaguaaggggcauuccuguuacagacuaa

SEQ ID NO: 60338 - RNA, 45 nt, Mus musculus
agaagguaagaagcccaggaccaaagcacccaagauucagcgucu

SEQ ID NO: 60339 - RNA, 48 nt, Mus musculus
aacacaaacgccgacguauugcucugaagaagcaacgcacuaagaaga

SEQ ID NO: 60340 - RNA, 50 nt, Mus musculus
cuguuguuguugcuguuguuguugcuguuguuguugcuguuguugcugcu

SEQ ID NO: 60341 - RNA, 46 nt, Mus musculus
aauaaauaaauaaaucuuuuaaaaaaaugguucaugagggcuagag

SEQ ID NO: 60342 - RNA, 44 nt, Mus musculus
gaacauggccuggagaaaacgcaaguucuaaguggucucauaga

SEQ ID NO: 60343 - RNA, 42 nt, Mus musculus
guucccagcacggggcagaggaggagggcguugcggggugga

SEQ ID NO: 60344 - RNA, 30 nt, Mus musculus
uccgaguggcuggugcugcgggauggcugc

SEQ ID NO: 60345 - RNA, 46 nt, Mus musculus
uaaacucaugcacagagauaaauuguaucgaagugcacuuagccaa

SEQ ID NO: 60346 - RNA, 46 nt, Mus musculus
guccaagccuuuaaucccagcacuugggagucagaggcagguggau

SEQ ID NO: 60347 - RNA, 45 nt, Mus musculus
auuuaccugcuguauacaggaaggaaauguucaccuuaguguuaa

SEQ ID NO: 60348 - RNA, 44 nt, Mus musculus
aggagucagaucucguuacagaugguugugagccaccacguggu

SEQ ID NO: 60349 - RNA, 45 nt, Mus musculus
agggagaggaagagaaagagaacacacaccauugaacuucuggag

SEQ ID NO: 60350 - RNA, 46 nt, Mus musculus
cauuuauauuucuuuuuauuuuacuuuucaaaaauagggucccaaa

SEQ ID NO: 60351 - RNA, 45 nt, Mus musculus
ugaagcccugguuucaguguucagggaaaauucaagguagaaagg

SEQ ID NO: 60352 - RNA, 46 nt, Mus musculus
uuaaaaacacugaaacaguagcuuaauaucaugagaagagacgaag

SEQ ID NO: 60353 - RNA, 31 nt, Mus musculus
uaugccagguggugauaacauuuaaguuagu

SEQ ID NO: 60354 - RNA, 45 nt, Mus musculus
acuguuucuuuaagccugccuuuuuuguuauuuacaguauuugga

SEQ ID NO: 60355 - RNA, 41 nt, Mus musculus
uaauuucugugagugcuucuauuuauuauguguccaggcuu

SEQ ID NO: 60356 - RNA, 47 nt, Mus musculus
gguugugaggcaccaugugguugcugguauuugaacucaggaccuuu

SEQ ID NO: 60357 - RNA, 23 nt, Mus musculus
auaguucuuuacuaggucaggua

SEQ ID NO: 60358 - RNA, 27 nt, Mus musculus
gauaacacugugaugaguguuguauug

SEQ ID NO: 60359 - RNA, 41 nt, Mus musculus
uauuuuagcuuauaauuugaggcuacagcucauaggggaca

SEQ ID NO: 60360 - RNA, 46 nt, Mus musculus
uggauucguuuuggacagcuauauagaaauguauuuuucuggucag

SEQ ID NO: 60361 - RNA, 45 nt, Mus musculus
gcugagcaugggugcuuuccagaucuuuauaauaaagaggcaguu

SEQ ID NO: 60362 - RNA, 46 nt, Mus musculus
ucaaaucccagcaaccacaugggggcucacaaccauccauaaugaa

SEQ ID NO: 60363 - RNA, 45 nt, Mus musculus
gggaagaucugcauaugggacgucuccaaacucaugaaggugcac

SEQ ID NO: 60364 - RNA, 42 nt, Mus musculus
aagacucuucuaguugcucagacauaccgaaacuggaaggag

SEQ ID NO: 60365 - RNA, 27 nt, Mus musculus
ugauuugcuggaggauucagacaguga

SEQ ID NO: 60366 - RNA, 23 nt, Mus musculus
uauugucuuugaauagaauuaaa

SEQ ID NO: 60367 - RNA, 46 nt, Mus musculus
ugcuucuuuugagcagggucucaguguaucucagcacucacuguag

SEQ ID NO: 60368 - RNA, 35 nt, Mus musculus
gaacuuggggcaaaccccucccuaacgaacucuaa

SEQ ID NO: 60369 - RNA, 64 nt, Mus musculus
aguucuuuacaagaugaacuauaccacucgaauagugacuuuagaagaggagcccgugaaaauc

SEQ ID NO: 60370 - RNA, 58 nt, Mus musculus
caacauaucaaagauccccaggacacaauuaccucgcucauuuugcuuccaccagaua

SEQ ID NO: 60371 - RNA, 46 nt, Mus musculus
cagcagcaaagaaggcacccgcagcaucugcaccagcagcaccacg

SEQ ID NO: 60372 - RNA, 42 nt, Mus musculus
gcuuuugggauagccccuguuucaguuguucaacacccgcau

SEQ ID NO: 60373 - RNA, 42 nt, Mus musculus
ucccccagauacaagugacacugcugaagaacaaagcuccag

SEQ ID NO: 60374 - RNA, 46 nt, Mus musculus
cgucccugguugauuugaaugaagaaaugcaccacauggauguaga

SEQ ID NO: 60375 - RNA, 46 nt, Mus musculus
ggaccuaucaggucaugcugggauguugacguugacaagccccaaa

SEQ ID NO: 60376 - RNA, 46 nt, Mus musculus
ccaagguguaggcacuacuauauaugagaagaaaccaaaccggaag

SEQ ID NO: 60377 - RNA, 48 nt, Mus musculus
aauuucaugagaagcuucuuaacacgcuuuguagacgaucagaugaug

SEQ ID NO: 60378 - RNA, 42 nt, Mus musculus
guuacuuaacagucuugcucaaucuucagcuguaaacccuga

SEQ ID NO: 60379 - RNA, 43 nt, Mus musculus
ucugucuacugguauuuuguacugcugaauuauguuaaggacg

SEQ ID NO: 60380 - RNA, 46 nt, Mus musculus
aaaguauuuauuuugugguaugcauucuaaacaugaauagugugag

SEQ ID NO: 60381 - RNA, 32 nt, Mus musculus
ucuggaaguauagccagauccuaacuguugag

SEQ ID NO: 60382 - RNA, 46 nt, Mus musculus
uaguaaaucucuuguuacuuuuacaugaaauucuuuugucugccag

SEQ ID NO: 60383 - RNA, 45 nt, Mus musculus
cuuggcgucuuuaucaauugacauauggacauuaggggaagaagu

SEQ ID NO: 60384 - RNA, 46 nt, Mus musculus
cuggcucauaaugcagugcagaggcucaaaguagccauaggugcaa

SEQ ID NO: 60385 - RNA, 46 nt, Mus musculus
ccugugaagaacuguuuaaacacuugugcaucagugggaccccaaa

SEQ ID NO: 60386 - RNA, 47 nt, Mus musculus
ggaacuguauaauucagagcagcuucucaucuucccacaagauaggu

SEQ ID NO: 60387 - RNA, 46 nt, Mus musculus
gcuacaguguacuuacauauaauaaauaauaaaaaaaaaaaaaacu

SEQ ID NO: 60388 - RNA, 46 nt, Mus musculus
uuauguuacucuccugcauuggacagcgaucacuuaguaacagugg

SEQ ID NO: 60389 - RNA, 67 nt, Mus musculus
aaguuuacuaaaccucuuggacaauuuauugucaccucuucagccagaguuaagcaugcacagaagg

SEQ ID NO: 60390 - RNA, 46 nt, Mus musculus
uuucagugacgccacacuuguuccugaucuggcuauugacuuggag

SEQ ID NO: 60391 - RNA, 109 nt, Mus musculus
ugucuugauaggaauuuuauuuagucagucaguaugucuguaguuuucaucccugcacccauacuucaauacuuucagaagugagauuauggcaagggaauuuguggag

SEQ ID NO: 60392 - RNA, 48 nt, Mus musculus
uuuuugaauuggaaauucuuaacauuauuacuuaacuuuuaguaggcu

SEQ ID NO: 60393 - RNA, 52 nt, Mus musculus
uauuucugcaaucauuauaauuaccaaugauuuuaauacaagauuugaggca

SEQ ID NO: 60394 - RNA, 84 nt, Mus musculus
aauccauacaauuauguacuuugauauauuaauaauuuugggaugguggacgaauacucucaaauguggggaauuuauuuuaug

SEQ ID NO: 60395 - RNA, 46 nt, Mus musculus
aaguuuuaacuuuuauuuuuauuguuugauauuaucaaggaggagu

SEQ ID NO: 60396 - RNA, 46 nt, Mus musculus
uguuaggaauaggaaaacauuugaaaauuaugaauaaaacaaucag

SEQ ID NO: 60397 - RNA, 47 nt, Mus musculus
cuauacacauagugagacccuauuucaaaauaacagcaaagaagauc

SEQ ID NO: 60398 - RNA, 82 nt, Mus musculus
ccaggggucugucuggguuaguugagacuucugguuuuccuaugagauugcccuccucuucagcuccuucaguccuuucccu

SEQ ID NO: 60399 - RNA, 41 nt, Mus musculus
aaacugaaaaucaaaggcaaaagacaccguuaacaggacaa

SEQ ID NO: 60400 - RNA, 46 nt, Mus musculus
cagguaaccaauggaguuuuauuaacaauaaucugcauacucagaa

SEQ ID NO: 60401 - RNA, 46 nt, Mus musculus
gcaacuuaaccuacuaaaggcaaaacagaaggcuuugguggaacag

SEQ ID NO: 60402 - RNA, 46 nt, Mus musculus
uauuugccaggccuagccucacaagagacagcuauaucaggguccu

SEQ ID NO: 60403 - RNA, 45 nt, Mus musculus
aaaagagagcccugagauugagccucuuccauuuacucuggccca

SEQ ID NO: 60404 - RNA, 42 nt, Mus musculus
aauaaaaagaaaguugcuaggugacucaaguacacggugcag

SEQ ID NO: 60405 - RNA, 42 nt, Mus musculus
uccuuuagauauugaucuagaaaaggauccucuugcagccaa

SEQ ID NO: 60406 - RNA, 42 nt, Mus musculus
ugauuaugguaccuauaauuauaauccuuacauuggaggccu

SEQ ID NO: 60407 - RNA, 42 nt, Mus musculus
uuugauugauuauuguuuucuauaauggucucauguugcaaa

SEQ ID NO: 60408 - RNA, 45 nt, Mus musculus
uuaaccuuaauugugugugugugugugugugugugugugugugug

SEQ ID NO: 60409 - RNA, 85 nt, Mus musculus
gaguauuaacuuuucagauaucuccuccucccuuuuguagcuuuagaugcucgucuagaaguuggucuugaacagcaagcagaac

SEQ ID NO: 60410 - RNA, 54 nt, Mus musculus
caacuggaacagaugacucacuucuggggaauuuacagccagcaaaccagaaca

SEQ ID NO: 60411 - RNA, 46 nt, Mus musculus
ggcacugugcacucggaguaacuucuuacacuucuccagcugcuau

SEQ ID NO: 60412 - RNA, 46 nt, Mus musculus
gaaauaccacuagaaguaugucaggacccacagacuuguuggggag

SEQ ID NO: 60413 - RNA, 42 nt, Mus musculus
cuagcuugguauccaaauacuuugcuccggacguggugccuu

SEQ ID NO: 60414 - RNA, 46 nt, Mus musculus
cuccccacaccugaucucuagcacuuccuuauugaugagaaagaag

SEQ ID NO: 60415 - RNA, 46 nt, Mus musculus
uuguaauuugggaaguguuacaaagacauuuggucauugaagcaag

SEQ ID NO: 60416 - RNA, 46 nt, Mus musculus
accucuugaugcccaagugaagcuguuagaguuuacucuggagcag

SEQ ID NO: 60417 - RNA, 43 nt, Mus musculus
cuuguuaacauuuuaguacagcugccucuuucaagcaauaggg

SEQ ID NO: 60418 - RNA, 46 nt, Mus musculus
aaacaugagaacuuccaugguggguuagaugccauaucaguuggag

SEQ ID NO: 60419 - RNA, 46 nt, Mus musculus
agaaguaugguaucaacuauuaugaaauuucuugauucuggaccaa

SEQ ID NO: 60420 - RNA, 46 nt, Mus musculus
acuuugaaaacaaggauccuggccucugagccugacaaugcagaag

SEQ ID NO: 60421 - RNA, 47 nt, Mus musculus
ccuacugcccagccagcugaggugcuccugcaagccacaccgcccca

SEQ ID NO: 60422 - RNA, 46 nt, Mus musculus
cagacacuauggcagauaccaacaggagcuugcugacagaagccug

SEQ ID NO: 60423 - RNA, 42 nt, Mus musculus
cgaagguccgaaguucaaaucccagcaaccauccauaaugag

SEQ ID NO: 60424 - RNA, 46 nt, Mus musculus
uguuugaaaguggauagauuuugccugugagaauuuggaacucaag

SEQ ID NO: 60425 - RNA, 46 nt, Mus musculus
aacaaccaaucuuaaaacuaugcuauguucaugacaguuuugguag

SEQ ID NO: 60426 - RNA, 46 nt, Mus musculus
ccuuaggugaauauuuccauauuuaugauuauuuuaauugugggag

SEQ ID NO: 60427 - RNA, 46 nt, Mus musculus
auuauucauccuagccagaggugauggugcacaucucuaaugccag

SEQ ID NO: 60428 - RNA, 45 nt, Mus musculus
uaguauugugucuguuucuguaguuuacugcuuuagaguugauga

SEQ ID NO: 60429 - RNA, 46 nt, Mus musculus
cuuacucagaaagcauugcccagucaguagauaauucccaggacaa

SEQ ID NO: 60430 - RNA, 42 nt, Mus musculus
cagcagaccuaguggcucccauccuuagguuuuugacagaag

SEQ ID NO: 60431 - RNA, 45 nt, Mus musculus
ggaggaugagaaggugacaauguuucuucagucaccuugcccagu

SEQ ID NO: 60432 - RNA, 42 nt, Mus musculus
gugugugugugugucuugcucaaaugucugucugugugccug

SEQ ID NO: 60433 - RNA, 74 nt, Mus musculus
aacuagccaugucauccaacacccaauguuuggagcaggccauaaguuucguacucugcauuugccagucucaa

SEQ ID NO: 60434 - RNA, 44 nt, Mus musculus
uucagguaagcaagacuuaaguuuuaaguuuucuuuaaccccag

SEQ ID NO: 60435 - RNA, 45 nt, Mus musculus
auuucucuagagauggacuuaugagaagaacacauucugccccug

SEQ ID NO: 60436 - RNA, 104 nt, Mus musculus
ugugugugaaacuacucaccuacuguagagugucuggaguccgagcaggaccacaggagccugggaauuaggucucagcaucagcguaaggcugaguaucacag

SEQ ID NO: 60437 - RNA, 45 nt, Mus musculus
augacacaauugucuuauaaaauugcaguucuucccugcagcuau

SEQ ID NO: 60438 - RNA, 45 nt, Mus musculus
caaguuugguuuuguucuuuauuuuuuauuuggauauggcaguuu

SEQ ID NO: 60439 - RNA, 59 nt, Mus musculus
aaguaucacagcuaaacuuauuagugagcaaaaagaugauaaagaaaagaagaaccaug

SEQ ID NO: 60440 - RNA, 52 nt, Mus musculus
ggcauccacaccaccucgcccaccauccaggagaggaagaaccauucccgau

SEQ ID NO: 60441 - RNA, 45 nt, Mus musculus
auccaaguuugucaaaaacagauucuuucaaaagacugcacccug

SEQ ID NO: 60442 - RNA, 46 nt, Mus musculus
gcccaguacugaacugucucuuuuucuuuaggugagugcuccagug

SEQ ID NO: 60443 - RNA, 42 nt, Mus musculus
ugggacccuuuaauauaguuccucauguugucacaaccccag

SEQ ID NO: 60444 - RNA, 45 nt, Mus musculus
cgaaaaucuaaacuuaauugaugagaauauaaaguauaaagugag

SEQ ID NO: 60445 - RNA, 46 nt, Mus musculus
cccaagugcuaggccugcagacauguguuacaauuuaugcuuggac

SEQ ID NO: 60446 - RNA, 42 nt, Mus musculus
ugugucugugucugucugucugucugucugugucucucuggu

SEQ ID NO: 60447 - RNA, 42 nt, Mus musculus
aagaggagcaugugaccugccuuuugcagguacgcuugugag

SEQ ID NO: 60448 - RNA, 42 nt, Mus musculus
uaggcugcccuugaacucugaucuuccuuucuucaccuccaa

SEQ ID NO: 60449 - RNA, 75 nt, Mus musculus
gcccucggugcuucuggagcuccucagucaguccugccucaucccagccauguccuccuaccugcgcaacgacuc

SEQ ID NO: 60450 - RNA, 45 nt, Mus musculus
uauuagucacaccuuccuugucucaucccugucucucucacauug

SEQ ID NO: 60451 - RNA, 63 nt, Mus musculus
ugguuuguuuugauacugaguuuuaaauauacuuacuggcccuuuucuaucuuuuaagaaacu

SEQ ID NO: 60452 - RNA, 46 nt, Mus musculus
caaaggguuuacaaaagucucuuuguaaccuaccccuuggcuauuu

SEQ ID NO: 60453 - RNA, 57 nt, Mus musculus
caguuaaaagcaguuuuguugcucuuaaagcacucacauucaguucccagcacccau

SEQ ID NO: 60454 - RNA, 46 nt, Mus musculus
cuaacaacccuuaaaguguuagaaagccuuuaccuuuuagugcuag

SEQ ID NO: 60455 - RNA, 46 nt, Mus musculus
uuccuucuucugucucuuucaugauguucucugaagcucaggcgag

SEQ ID NO: 60456 - RNA, 41 nt, Mus musculus
uggugccgcuguuguugccucuuucuacagagaauggugaa

SEQ ID NO: 60457 - RNA, 46 nt, Mus musculus
uuagcuaaaaugaagaccugugucgauaccuacaccaaccgccuaa

SEQ ID NO: 60458 - RNA, 46 nt, Mus musculus
cauacuuacauacauauauacaaugcaauucaguucagcucuaaag

SEQ ID NO: 60459 - RNA, 46 nt, Mus musculus
gcagagaaaauuguacaagacuaagagaagggaaagagaugcugag

SEQ ID NO: 60460 - RNA, 46 nt, Mus musculus
agauucaagaugugccaccacacccagcaaauuucaauagcucuag

SEQ ID NO: 60461 - RNA, 45 nt, Mus musculus
uccauguacauguauacaaauacucauaagauaaaugaagaugga

SEQ ID NO: 60462 - RNA, 46 nt, Mus musculus
uuaguagcucacuauuuaagcuuaaugagaauuaguuauaauuggg

SEQ ID NO: 60463 - RNA, 46 nt, Mus musculus
ucaaaucccagcacccacaugguggcucacagccaucuguaauggg

SEQ ID NO: 60464 - RNA, 63 nt, Mus musculus
uagaaaaaagaaagaggaaggaaggaaggaaggaaggaaggaaggaaggaaggaaggaaggaa

SEQ ID NO: 60465 - RNA, 46 nt, Mus musculus
uggggaggcagaggcaggugauucuuuugaguuugaggccagccug

SEQ ID NO: 60466 - RNA, 45 nt, Mus musculus
cuaaaagggaaaaugugaaagccggagucaagccggacgcgccug

SEQ ID NO: 60467 - RNA, 46 nt, Mus musculus
cgaugggaaauuggguuuuaaaguaaauuaccacuacaugucucag

SEQ ID NO: 60468 - RNA, 46 nt, Mus musculus
cuuaagguuuguuuaagcauccugaauacauggcauggaagaccag

SEQ ID NO: 60469 - RNA, 46 nt, Mus musculus
agagaaacccugucucgaaaaaccaaaaaaaaaaaaagaaaaaucu

SEQ ID NO: 60470 - RNA, 42 nt, Mus musculus
gugcagccucgguuggccuugagcuuacccuaauagccauga

SEQ ID NO: 60471 - RNA, 46 nt, Mus musculus
gacauuagaaucugaaguuagguauccuuaccauaguagaauugag

SEQ ID NO: 60472 - RNA, 28 nt, Mus musculus
gugcagggccacagcaggugcugaagac

SEQ ID NO: 60473 - RNA, 45 nt, Mus musculus
cuuccuacauacacuuuaauaaaaguuaaacagacauagccccuc

SEQ ID NO: 60474 - RNA, 46 nt, Mus musculus
acauuuuuaaguaauaaaucugccauaaaaugcacuauagcuggag

SEQ ID NO: 60475 - RNA, 42 nt, Mus musculus
accugacugugccguuuuguuuuguuuuuucaggcucgcgag

SEQ ID NO: 60476 - RNA, 28 nt, Mus musculus
aaagaacacaaagagacagccaagaaga

SEQ ID NO: 60477 - RNA, 25 nt, Mus musculus
gcuggcccugcgagaugaacucgag

SEQ ID NO: 60478 - RNA, 46 nt, Mus musculus
ucauggggugcccuuguccauaauaguaguuuccaacauccccguc

SEQ ID NO: 60479 - RNA, 42 nt, Mus musculus
ugugguacuuggucaucuccucagcauuggcuuugugaggac

SEQ ID NO: 60480 - RNA, 46 nt, Mus musculus
gaagccagaugcuucagacuucuuugcauggugcaggcccccagcc

SEQ ID NO: 60481 - RNA, 46 nt, Mus musculus
aguccagcagcgagcaacauuccggaugguguagccaccuccuccc

SEQ ID NO: 60482 - RNA, 68 nt, Mus musculus
uauaaauacacagaggaauagaaaauauaaaaucugagaaguugagggaaagugaggaacuuggggag

SEQ ID NO: 60483 - RNA, 46 nt, Mus musculus
caaauuuuagcauuugucaugaaaauuaauugaaaagcaaacagau

SEQ ID NO: 60484 - RNA, 46 nt, Mus musculus
augauacuucucauuuguugacuuauuuuguuguuccuguuggggg

SEQ ID NO: 60485 - RNA, 41 nt, Mus musculus
accugagggcuauuuucccacuccuggauagcgguugcagg

SEQ ID NO: 60486 - RNA, 42 nt, Mus musculus
ggccaggcccggacuuccaugggcagcagcagcggcagggaa

SEQ ID NO: 60487 - RNA, 46 nt, Mus musculus
uaaucauguaacaugauuaugaauaguguggaucuaggaauggugg

SEQ ID NO: 60488 - RNA, 44 nt, Mus musculus
cuguucccucagaauaacuggauuuauaaaauuagauaguagug

SEQ ID NO: 60489 - RNA, 45 nt, Mus musculus
uacagacacacauagauauacacauaccagauagcagugcacaga

SEQ ID NO: 60490 - RNA, 45 nt, Mus musculus
auacagacauguaccacauacauaaacacacacacacacacacca

SEQ ID NO: 60491 - RNA, 46 nt, Mus musculus
ugugagccaaguaaguagcugugggagagcauuccaagcugaggaa

SEQ ID NO: 60492 - RNA, 46 nt, Mus musculus
aagauuuuaguuuguuuacuuagcgaauaaaauaaugcuugcagcu

SEQ ID NO: 60493 - RNA, 46 nt, Mus musculus
aggacauuucauucagacuaucacaguaacuugcaugagcauggau

SEQ ID NO: 60494 - RNA, 45 nt, Mus musculus
ucuucaacaggugaauccauaaaugugaaaauguaaagaaauaag

SEQ ID NO: 60495 - RNA, 42 nt, Mus musculus
gucuucuacgucugccuuuuuguggucauuauuagcaaaggu

SEQ ID NO: 60496 - RNA, 45 nt, Mus musculus
gugauuguuauaaaggguagaggauaagugacaaugauagaagau

SEQ ID NO: 60497 - RNA, 45 nt, Mus musculus
uuggcugggacacugcauucgggaaucucugcuuacugcccaggg

SEQ ID NO: 60498 - RNA, 46 nt, Mus musculus
aacuugacgcgcaaguaaucugagaacacccaggacaggaacuaag

SEQ ID NO: 60499 - RNA, 45 nt, Mus musculus
aggugugcccuguccucgcccugaaaccuuaaaaccgcccuugag

SEQ ID NO: 60500 - RNA, 45 nt, Mus musculus
ugauuuagcagaguacugggaaaucgaggaacacagcugucccuu

SEQ ID NO: 60501 - RNA, 46 nt, Mus musculus
ucaggaucuggggacugggaaguggucugaaggcuuaggaacgcac

SEQ ID NO: 60502 - RNA, 46 nt, Mus musculus
accuucucagaauuucugugguuuaucacacuccuuaggcauggag

SEQ ID NO: 60503 - RNA, 46 nt, Mus musculus
cacugagacuggggguggagguuuuucuuuauagauguggcaacag

SEQ ID NO: 60504 - RNA, 46 nt, Mus musculus
agauuucuguugccacaucuauaaagaaaaaccuccacccccaguc

SEQ ID NO: 60505 - RNA, 46 nt, Mus musculus
gcucggaucauggaaccgcuggcgaggaagaucuuuaaaggagugc

SEQ ID NO: 60506 - RNA, 46 nt, Mus musculus
cacaagcucagcugcuagcacuccuuuaaagaucuuccucgccagc

SEQ ID NO: 60507 - RNA, 46 nt, Mus musculus
augcacucaauguuggugacauuucugggcaaaaauguuucuugag

SEQ ID NO: 60508 - RNA, 83 nt, Mus musculus
cagacacuccuagucugcagguacaauaacagccucgcuccccuccugcccauaaaaacguccgauaccuucagucucaagaa

SEQ ID NO: 60509 - RNA, 46 nt, Mus musculus
agcuguucucaucuaaguaauaggugugaguccuuacugugugguc

SEQ ID NO: 60510 - RNA, 45 nt, Mus musculus
uugcuagucaaccauuuuuccucaucuuucucucuaacuccauac

SEQ ID NO: 60511 - RNA, 80 nt, Mus musculus
agcucaagugggaagcugagcgagaugacuggcugcacaacagagaugugaaaaguaucaucaagaaaaagaaaaauuuc

SEQ ID NO: 60512 - RNA, 46 nt, Mus musculus
guuugaaaccuuugaggggagacgacagaugagucuguacccggga

SEQ ID NO: 60513 - RNA, 46 nt, Mus musculus
gcuccaaguuugauacuauuggcaugaacgccauggcuaacagaga

SEQ ID NO: 60514 - RNA, 42 nt, Mus musculus
uaggacaaaagaaaaagaagaaaaguuucaaugacuccagcc

SEQ ID NO: 60515 - RNA, 42 nt, Mus musculus
auuacaccacuacucccagguuuuuaaauggcugcugcagau

SEQ ID NO: 60516 - RNA, 45 nt, Mus musculus
uugcugacgccaaccccaaagccaauacuaagaaaagcaagagaa

SEQ ID NO: 60517 - RNA, 86 nt, Mus musculus
aaguuucucucggaaguaugaacgaugaagacuuugagauugaugaagauggaggaacguucauggaugugucagaugaugaaagu

SEQ ID NO: 60518 - RNA, 63 nt, Mus musculus
cuaaggcugacuuggaagacucagagaguagugacggcgaacuuggagaccuggaugacgaug

SEQ ID NO: 60519 - RNA, 46 nt, Mus musculus
agucuuucccagauuauuauaguucauuagaagaggaggccuagaa

SEQ ID NO: 60520 - RNA, 44 nt, Mus musculus
aacugcuucccaccugggaaggaugauauugauuuugccaggua

SEQ ID NO: 60521 - RNA, 53 nt, Mus musculus
aaaaguugcuguuguuaaagacaaacagaaacgcagugcagaugaagaaagua

SEQ ID NO: 60522 - RNA, 46 nt, Mus musculus
cugcagugaacagcaaggaguuccuugcaaaagaagaaagccagau

SEQ ID NO: 60523 - RNA, 46 nt, Mus musculus
uggcuacugccgacaccugcagucaaucacaucuuugcccacacau

SEQ ID NO: 60524 - RNA, 44 nt, Mus musculus
cuucagggguuagcucagggguuaaaaauacuucacugggagaa

SEQ ID NO: 60525 - RNA, 46 nt, Mus musculus
aguacacuguagcuguccucagacacaccagaaaagggcaucaggu

SEQ ID NO: 60526 - RNA, 46 nt, Mus musculus
auccacuugcauaccugguucccaaggccagaagaggcugucagau

SEQ ID NO: 60527 - RNA, 46 nt, Mus musculus
ggcucggucuuuauuuuguuaacagcucacuguguagcccuggcua

SEQ ID NO: 60528 - RNA, 46 nt, Mus musculus
uaaaguguccaccugcucccucacuuugucgucaccuaucugggag

SEQ ID NO: 60529 - RNA, 46 nt, Mus musculus
gugcgauuuuaacaggggugaacagagcauacccuuacucccagau

SEQ ID NO: 60530 - RNA, 45 nt, Mus musculus
gguuuagaaagcaaauugcauaauacugagcuuuggggcugauau

SEQ ID NO: 60531 - RNA, 149 nt, Mus musculus
gcgggcccugguagcugcccaugagcugcucugugauaaacccgaggaggaaaaggcucuucuugugcaggugauaaauaagcugggagauccucagaacagaauugcuacgaaagccucccaucuguuagaaguguuacuucggaagc

SEQ ID NO: 60532 - RNA, 54 nt, Mus musculus
ugggaggcuuucguagcaauucuguucugaggaucucccagcuuauuuaucacc

SEQ ID NO: 60533 - RNA, 95 nt, Mus musculus
acugauacugugguauuaugaacaccaauugaaacacuugguagcagaauucguccagguccucgagacuuuaagucaugauuccuugguaacca

SEQ ID NO: 60534 - RNA, 45 nt, Mus musculus
caagcagcagugccucauggcguuggacacguucaaggaguugcu

SEQ ID NO: 60535 - RNA, 46 nt, Mus musculus
cauccugucagcuagugucccugaugacacgauggccuucauccag

SEQ ID NO: 60536 - RNA, 119 nt, Mus musculus
ucaaagucuuugauugaagaagaugaaccagagaaaaaggaaaacaccagcaaaaaagaagcaaaacuacugaagguggagaauaaaaaacaaaaagcaacagaaggaaaaaagacauc

SEQ ID NO: 60537 - RNA, 47 nt, Mus musculus
uaugcuggcuacuuuggaugaaaaugaggaagugguggaugggggca

SEQ ID NO: 60538 - RNA, 32 nt, Mus musculus
agcccuggcgucccaaacaggugacagaagau

SEQ ID NO: 60539 - RNA, 26 nt, Mus musculus
cuuggcaaggaacgccacagguuccu

SEQ ID NO: 60540 - RNA, 45 nt, Mus musculus
gaagacuuuccaaacugucucuguaauuguuuucauacaguaguu

SEQ ID NO: 60541 - RNA, 47 nt, Mus musculus
auuuaaacccaggccuauauccccaaucccuuuacccgucccagcca

SEQ ID NO: 60542 - RNA, 45 nt, Mus musculus
uaaaaauguucuugaggugacagaaacagcaggggugcccgguug

SEQ ID NO: 60543 - RNA, 23 nt, Mus musculus
gugaagauugggcuaugugacca

SEQ ID NO: 60544 - RNA, 42 nt, Mus musculus
uucucaggagcaaaggcuacaaccguucucuagacauguggu

SEQ ID NO: 60545 - RNA, 42 nt, Mus musculus
ugugacuuuggguuugcccgcaucauuggugagaagucguuc

SEQ ID NO: 60546 - RNA, 42 nt, Mus musculus
caagauguccgggucagaagccuaugucuuccagccucaaga

SEQ ID NO: 60547 - RNA, 46 nt, Mus musculus
guccagcuaaccucaaaugggcagccgugaguaggaaguccaagaa

SEQ ID NO: 60548 - RNA, 46 nt, Mus musculus
aaucuauauguguagauaguuuaaagaugaacuuuaacaugcuuua

SEQ ID NO: 60549 - RNA, 36 nt, Mus musculus
cuuggugcucacugacuaggcaguuggccagcagcc

SEQ ID NO: 60550 - RNA, 42 nt, Mus musculus
uaagcuuauaggcagugugugagccaaucccaagccccuaaa

SEQ ID NO: 60551 - RNA, 46 nt, Mus musculus
uucaggagaaugucguaaguaauaauuacaucccaugugcgcagac

SEQ ID NO: 60552 - RNA, 45 nt, Mus musculus
acuauuugaaaugaagaauuugcuuauauuagugcuguccugugu

SEQ ID NO: 60553 - RNA, 46 nt, Mus musculus
aagaucacaacacaauaaaaacguuaaauaauaugaaaagagagau

SEQ ID NO: 60554 - RNA, 46 nt, Mus musculus
augaaucaaacuauuuaaaugguuucacguuaaugcagugggagaa

SEQ ID NO: 60555 - RNA, 45 nt, Mus musculus
auaucccgcugaugaggguggugcaguccaucaagcacacaaaga

SEQ ID NO: 60556 - RNA, 44 nt, Mus musculus
cuccaaaucaucuggcuggaagauucuuucuguuccauccauca

SEQ ID NO: 60557 - RNA, 44 nt, Mus musculus
uagagccgugcagcguggggacugaugcagacaugcccauggau

SEQ ID NO: 60558 - RNA, 46 nt, Mus musculus
uuuugugauaauuugacauacuaagccuuucuucauuuauagaggu

SEQ ID NO: 60559 - RNA, 46 nt, Mus musculus
caguucugagugccauuaccuuagaagggagauuuaauaggcagaa

SEQ ID NO: 60560 - RNA, 45 nt, Mus musculus
aaggcugagcaguccaggaugcuagcagagucugaguuuagugag

SEQ ID NO: 60561 - RNA, 46 nt, Mus musculus
acuugggccuccaggacccagcgguguugcauauugauuuccagau

SEQ ID NO: 60562 - RNA, 46 nt, Mus musculus
gccuaagacuugaguucuuagagcaagacacuguuuuugagugacg

SEQ ID NO: 60563 - RNA, 43 nt, Mus musculus
uguaagauuauuagauuaugcgugaaguaugaggaggaggaga

SEQ ID NO: 60564 - RNA, 44 nt, Mus musculus
aaaauuguucuuguaguuaguuuuuaaaaagaaaggggggaaau

SEQ ID NO: 60565 - RNA, 27 nt, Mus musculus
aagucccucacacauuugcuguccacu

SEQ ID NO: 60566 - RNA, 47 nt, Mus musculus
ugacagaacuuacuuguucuagucacauacucaccaagagcccagua

SEQ ID NO: 60567 - RNA, 37 nt, Mus musculus
ugcuaaaugugccucucauacaagugugugugugugu

SEQ ID NO: 60568 - RNA, 46 nt, Mus musculus
cuggagacagagugcuuaaauggcuuuccagaguuauagggcagaa

SEQ ID NO: 60569 - RNA, 46 nt, Mus musculus
aaaacgaggaauaaauuucgaaaaauaaauacauaaacaaguagau

SEQ ID NO: 60570 - RNA, 45 nt, Mus musculus
aucauaaacgaugugccuucaagauuccaaauaacugcaguggag

SEQ ID NO: 60571 - RNA, 30 nt, Mus musculus
aaauuccggacgguuacugugucggaagcg

SEQ ID NO: 60572 - RNA, 46 nt, Mus musculus
accacugcaccagucauccagugauugucagauuuauacaugagua

SEQ ID NO: 60573 - RNA, 45 nt, Mus musculus
uaaguugagcacgugaacuggagaccugcggagaccugcggggaa

SEQ ID NO: 60574 - RNA, 46 nt, Mus musculus
aaucuuucugagauauauauauauauauauauaugugugugugugu

SEQ ID NO: 60575 - RNA, 45 nt, Mus musculus
uuuuuaaaggacuacagacuaggaacugugugugcaacuggagua

SEQ ID NO: 60576 - RNA, 42 nt, Mus musculus
uuggggagaaacacacugaccacacuaaacacuggggcagau

SEQ ID NO: 60577 - RNA, 45 nt, Mus musculus
ucaccagacugauuuauaaagauagcugugcacuuuccccaucga

SEQ ID NO: 60578 - RNA, 42 nt, Mus musculus
uuguauaugugcagucucuuuccccccacuuccagcccuaac

SEQ ID NO: 60579 - RNA, 60 nt, Mus musculus
caagugcuucuaaccauagagccaucuauuuaguccccuaaauacuauuuuuuaaaagac

SEQ ID NO: 60580 - RNA, 42 nt, Mus musculus
acacaguagucuggggugcaucugaaacaaugugcaugagau

SEQ ID NO: 60581 - RNA, 45 nt, Mus musculus
cuugaugagcagagacagucuaugauuuuagagcuuuauuauaga

SEQ ID NO: 60582 - RNA, 91 nt, Mus musculus
uucuucaaaaccauuuaaaaagcauugacaacuaauuuuauagaucaaagaaaggcagaugucugcaaauaauuccccuccaucagcccag

SEQ ID NO: 60583 - RNA, 106 nt, Mus musculus
auaccgacagcaauaggaucuuuugaguauucaacucggaguaacagaauuugucaucaacggcaugaauggcucagccgaggaaauagagcagcuuucaucuaaa

SEQ ID NO: 60584 - RNA, 47 nt, Mus musculus
ucugaaaugaaaagcaaaagacaagagcagauuuagaagaagugaag

SEQ ID NO: 60585 - RNA, 47 nt, Mus musculus
cugaaggcauagauuaucugaaacuacuuuuaaucaggaagauuuca

SEQ ID NO: 60586 - RNA, 59 nt, Mus musculus
uuuuuauuuuuacuucaucacagggaaguucagucccaagauggaaaugaguuccuaug

SEQ ID NO: 60587 - RNA, 45 nt, Mus musculus
gccugugugagggugucagauugcccugggacuggaguuauagau

SEQ ID NO: 60588 - RNA, 47 nt, Mus musculus
aguagagggggcuacuuuguuuauuauauuuagaaccuagugaaagg

SEQ ID NO: 60589 - RNA, 42 nt, Mus musculus
uucuuggaauuuuccuaucaaaauuacaaaggaaggggagug

SEQ ID NO: 60590 - RNA, 46 nt, Mus musculus
cauggcuccucuuggaccugugcuggaguuccuggaaguauuuugg

SEQ ID NO: 60591 - RNA, 42 nt, Mus musculus
aaacaugaguuucaguuauggccugaccauuaagcccaaguc

SEQ ID NO: 60592 - RNA, 54 nt, Mus musculus
caccaccgccaacaccuuuguuuuagguuacuacauccccaagaauacggucgu

SEQ ID NO: 60593 - RNA, 45 nt, Mus musculus
ucaauauuaaagucaaaucguggaaacauauugggacuagugaga

SEQ ID NO: 60594 - RNA, 23 nt, Mus musculus
cugggcgcaggguuugagguuuc

SEQ ID NO: 60595 - RNA, 42 nt, Mus musculus
cugcgacaguggcaacggaaaccgugguccucgcccccaggu

SEQ ID NO: 60596 - RNA, 45 nt, Mus musculus
aauagaaacagcuaaaaaccuuaaaacagucuuuaggcuucacag

SEQ ID NO: 60597 - RNA, 41 nt, Mus musculus
agaacacugcucagugacauggugacuaugaaggugucaga

SEQ ID NO: 60598 - RNA, 46 nt, Mus musculus
uucugagugaagcugaucuugaucuacgaagagacacagaccuuga

SEQ ID NO: 60599 - RNA, 45 nt, Mus musculus
aaaauaaaccuugcaaguuugcaggucgacccucuuuggcccaug

SEQ ID NO: 60600 - RNA, 46 nt, Mus musculus
acucaaauuuucugcccuuuaaagaauaaggugaagcuagguguag

SEQ ID NO: 60601 - RNA, 44 nt, Mus musculus
uuaugcugaucaccucaaggucuaggaggaucuuaauugucgga

SEQ ID NO: 60602 - RNA, 46 nt, Mus musculus
uccuggaggauuucuggcaauccacacaguucuuaagggcccauag

SEQ ID NO: 60603 - RNA, 45 nt, Mus musculus
ggcucacaaccauccguaaaaagaucugacucccucuucuggauu

SEQ ID NO: 60604 - RNA, 42 nt, Mus musculus
ucuagaucugggcaacugguaaccaugagcgaauggaugaag

SEQ ID NO: 60605 - RNA, 103 nt, Mus musculus
gcagacuguggaaaccauaagugaaggggaccacagaguacgcgagaagcugaugcauguguuugcaucuggagacuguaaaggauacagccccgaggaucug

SEQ ID NO: 60606 - RNA, 47 nt, Mus musculus
caugaggguuauaggugugugugcguauuuuaagguuuuguucagau

SEQ ID NO: 60607 - RNA, 41 nt, Mus musculus
gcuggcacaccggugcucgcuccggucuuguacauuuaagc

SEQ ID NO: 60608 - RNA, 42 nt, Mus musculus
aaguuuguuguagucaacaaagaugaaaaaggaguuggagau

SEQ ID NO: 60609 - RNA, 44 nt, Mus musculus
agcaguggcaguggaguggaucaaccugagcuuagagugcuaca

SEQ ID NO: 60610 - RNA, 50 nt, Mus musculus
aaucccagcaaccacaugguggcucacauccaccuguaaugagaucugau

SEQ ID NO: 60611 - RNA, 45 nt, Mus musculus
uguauaaggcccugacugggacagaggcucagggccccuggugcu

SEQ ID NO: 60612 - RNA, 46 nt, Mus musculus
auguggugguaccuggguaucuaguucuuacggaauaaucucaagu

SEQ ID NO: 60613 - RNA, 44 nt, Mus musculus
cuuccugaguuccucuaagcugggauaguuuccuagcccccaga

SEQ ID NO: 60614 - RNA, 77 nt, Mus musculus
aggcaucugccaucaccaccacugacacaggagauggaccuccauuccauugcugggccuccuguuccuccacgaca

SEQ ID NO: 60615 - RNA, 73 nt, Mus musculus
cgccuucuucccaaacagcccauccccuuuuacaccgccacccccccaaacccccucuccucauggcacgaga

SEQ ID NO: 60616 - RNA, 45 nt, Mus musculus
caacccacauccaaagccuauucaccacgcuauucaauaucagau

SEQ ID NO: 60617 - RNA, 46 nt, Mus musculus
ccaagggcacugaugaagugccuguccccccuccuguacccccucg

SEQ ID NO: 60618 - RNA, 79 nt, Mus musculus
gucggauuccugaaagugagacggaaagcacagcaucugcaccaaacuccccucggaccccacugacgccgcccccugc

SEQ ID NO: 60619 - RNA, 85 nt, Mus musculus
ccugguguucguccaucaaauccaagaccaggaaccaugagacaucccacaccucugcagcaggagccaagaaaaauuagcuaca

SEQ ID NO: 60620 - RNA, 45 nt, Mus musculus
agagauauguaugucgacuccagugaggcacucugacaucacugu

SEQ ID NO: 60621 - RNA, 46 nt, Mus musculus
agcggucacaguaaacugcuaaugucugugacucacagccagauuu

SEQ ID NO: 60622 - RNA, 46 nt, Mus musculus
uuuuuaauaguucuuuuauuuuguaguaauuucuuagugccuagcc

SEQ ID NO: 60623 - RNA, 46 nt, Mus musculus
cagcugccauuuacucacuggaucaccaagagagagggggcgaggu

SEQ ID NO: 60624 - RNA, 47 nt, Mus musculus
aaauacagaagcccuuucuuaccuccccacaguuacugcagcuauca

SEQ ID NO: 60625 - RNA, 43 nt, Mus musculus
aagucacacaaagacagcuagaguugucugugagaucagagau

SEQ ID NO: 60626 - RNA, 41 nt, Mus musculus
cuucuuuagugcucucauuccccuuucuuguaaacucagua

SEQ ID NO: 60627 - RNA, 46 nt, Mus musculus
uuaagccagagccuuaacugaaacugugguuacccuugauacaggc

SEQ ID NO: 60628 - RNA, 23 nt, Mus musculus
ucacugaauguuccuugccaaug

SEQ ID NO: 60629 - RNA, 42 nt, Mus musculus
uguguguguguguguguguguguguguguggugugcggcgcg

SEQ ID NO: 60630 - RNA, 45 nt, Mus musculus
cuugccauauuaaaugccaaauguaaauucaaaguagggccagaa

SEQ ID NO: 60631 - RNA, 45 nt, Mus musculus
uucaaaaaaucuacauuuagauuugagucuguaucuugcaugagu

SEQ ID NO: 60632 - RNA, 42 nt, Mus musculus
gcaggaaaauuacucaguuggauuauuuuaaauuuggcagug

SEQ ID NO: 60633 - RNA, 42 nt, Mus musculus
ccuggagaggaugcuggacguaacggugcugcaggaggagaa

SEQ ID NO: 60634 - RNA, 46 nt, Mus musculus
acauugauggcugggaggggaaggacauuggacaguguugcaauga

SEQ ID NO: 60635 - RNA, 46 nt, Mus musculus
agugagucugcaugucgguuuuacagccagcagaugaaggggaaac

SEQ ID NO: 60636 - RNA, 50 nt, Mus musculus
agcacucauagggugcacuuucagacauucaggcaaacacugacacaugu

SEQ ID NO: 60637 - RNA, 46 nt, Mus musculus
uugaacucugagauggaaagguacaguugguucccuggcaccugca

SEQ ID NO: 60638 - RNA, 46 nt, Mus musculus
acaccaccuuugauucuucucucuuccuuacuggcagcacucauga

SEQ ID NO: 60639 - RNA, 25 nt, Mus musculus
aggauggaaagagagauggcuuagc

SEQ ID NO: 60640 - RNA, 24 nt, Mus musculus
caugggaagagagaaccagugucc

SEQ ID NO: 60641 - RNA, 46 nt, Mus musculus
uagaagcagugaauuuguauaccaguaaaaguucuccaacugauca

SEQ ID NO: 60642 - RNA, 42 nt, Mus musculus
augaaacagaauggaauuacaguuuugacauauggcacagau

SEQ ID NO: 60643 - RNA, 47 nt, Mus musculus
uaucccauccacauuaaccuucgccauccuuauucccagaaagccag

SEQ ID NO: 60644 - RNA, 56 nt, Mus musculus
aaagccagucagugguaaauacauuuuacaguuuauucacgugauccacacacagg

SEQ ID NO: 60645 - RNA, 67 nt, Mus musculus
gggaagucacuuuugcuaaugaguuuaaguugucuuuugcagagaugaccuuaguuuaaguguacug

SEQ ID NO: 60646 - RNA, 54 nt, Mus musculus
aucucauugcauacaaaccauacuucaaaauuaacagaauaaaaauaguaauca

SEQ ID NO: 60647 - RNA, 49 nt, Mus musculus
guuuuuuaagacaagaaaacauugugaauagugacuguuaggagguuac

SEQ ID NO: 60648 - RNA, 42 nt, Mus musculus
auguggguucuaggaccuuaacuuagguccucugggagagca

SEQ ID NO: 60649 - RNA, 46 nt, Mus musculus
auguaagugaaaaugaaaucacauaauaaucaauuuaucucagggg

SEQ ID NO: 60650 - RNA, 46 nt, Mus musculus
aggagaacaaacuuauuaugauuugguaaaagcauucauggcagaa

SEQ ID NO: 60651 - RNA, 46 nt, Mus musculus
gguuucuguuuacauaguagcaguauuagaauacauuucugcagau

SEQ ID NO: 60652 - RNA, 46 nt, Mus musculus
auaauagcacuuaggaggcaggggcaagaggauuagguuuccagau

SEQ ID NO: 60653 - RNA, 56 nt, Mus musculus
caagguacaggcugaacagagagggaguuaaugauuggcacuggagaaauagccua

SEQ ID NO: 60654 - RNA, 47 nt, Mus musculus
ucuguguaauguuacuaccuuggccucugcuauugaaaccuagauga

SEQ ID NO: 60655 - RNA, 46 nt, Mus musculus
ugagaaucauccuagcucuagguggguguagguggaucucugagau

SEQ ID NO: 60656 - RNA, 58 nt, Mus musculus
guggucugaggcuggagagguguggucugaggcuggagagguguggucugaggcugga

SEQ ID NO: 60657 - RNA, 131 nt, Mus musculus
ggcuggagagguguggucugaggcuggagagguguggucugagagcugaugugagagguguggucugaggcuggagagguguggucugaggcuggagagguguggucugagagcugaugugagaggugugg

SEQ ID NO: 60658 - RNA, 45 nt, Mus musculus
aaauuaaucuuguuaaauuuccagugggauuggagguacccaggg

SEQ ID NO: 60659 - RNA, 46 nt, Mus musculus
agaagccucacuuuggccaacgaagaggaagaauaaggccuaaggu

SEQ ID NO: 60660 - RNA, 42 nt, Mus musculus
aguggauaugucuggagagaggacuuguuuuuaagccaggga

SEQ ID NO: 60661 - RNA, 46 nt, Mus musculus
aauguugccaauucuguaaggggauacucaaaacugacccccacca

SEQ ID NO: 60662 - RNA, 46 nt, Mus musculus
aaaacaaccagauugguuuuuguuuucauuugccuuaccuguagaa

SEQ ID NO: 60663 - RNA, 64 nt, Mus musculus
ccccauuacagcggugaugcacaugccacuguauucagauugguucuuuugaagugucugagaa

SEQ ID NO: 60664 - RNA, 28 nt, Mus musculus
ugguuucucguuaacaacguuagcaguc

SEQ ID NO: 60665 - RNA, 43 nt, Mus musculus
cugggcaucugagccaagugagcagaaccaugccgccccagua

SEQ ID NO: 60666 - RNA, 90 nt, Mus musculus
gcucacuuggcucagaugcccaggaggcaggguccacugcugggaggaugauaugcguuagggaugaaucacauugaucuuacagaggag

SEQ ID NO: 60667 - RNA, 68 nt, Mus musculus
ugucuaucuacggucacuacaguuccaucuccucuguaagaucaaugugauucaucccuaacgcauau

SEQ ID NO: 60668 - RNA, 46 nt, Mus musculus
uagagugaaauagcgcccucuguagaaaucgguggauacguggugu

SEQ ID NO: 60669 - RNA, 45 nt, Mus musculus
ucucgagcuacccagcucagaaacugcuauuuuagucaccugaag

SEQ ID NO: 60670 - RNA, 72 nt, Mus musculus
aagagagagagagggggagagggagagggagagggagagggagagagagagagagagagggagagggagagg

SEQ ID NO: 60671 - RNA, 46 nt, Mus musculus
aagucgcuguaacuaaaauggaaaaguaugaaaagcuagcuaagau

SEQ ID NO: 60672 - RNA, 65 nt, Mus musculus
guauggauaugauauaaaucugagguguauaugucuguguagaaggcgguaaauuuggaacggau

SEQ ID NO: 60673 - RNA, 42 nt, Mus musculus
uuuaggcugcccgagcugcaccuuaaagauggcgccugccag

SEQ ID NO: 60674 - RNA, 45 nt, Mus musculus
ccugggagcaggggauauugaagggaggcaugagggcagugugga

SEQ ID NO: 60675 - RNA, 38 nt, Mus musculus
ggcgcuagaagcuagccagcaaguucuggagcaguuga

SEQ ID NO: 60676 - RNA, 46 nt, Mus musculus
auugaccaacgcuggucuugccgcagcugucaugcaguugcaaaag

SEQ ID NO: 60677 - RNA, 46 nt, Mus musculus
auauucuuggguguggucauauuacaaaaugggaugcuggcaauga

SEQ ID NO: 60678 - RNA, 42 nt, Mus musculus
cuagauucuguuucuuauaauuuauuguggcaugagacagau

SEQ ID NO: 60679 - RNA, 45 nt, Mus musculus
aguugguugaguugguuggucacacugaggauacauucugucaga

SEQ ID NO: 60680 - RNA, 45 nt, Mus musculus
aaaucccagcaaccacaugauggcucacaaccauccauaacaaga

SEQ ID NO: 60681 - RNA, 46 nt, Mus musculus
gaaugacuaagaucaaaaacucagaugagagcagaugcuggcgugg

SEQ ID NO: 60682 - RNA, 46 nt, Mus musculus
ggaagauuuccugaacagaacacccauggcuuaugcccuaagauaa

SEQ ID NO: 60683 - RNA, 46 nt, Mus musculus
aaaaaaauguaggugaagguuaaaaaaauuaaaaauaggaacagaa

SEQ ID NO: 60684 - RNA, 46 nt, Mus musculus
cauaauuccaccuucuaacuacaaaaauaacaggaagccaacaguc

SEQ ID NO: 60685 - RNA, 41 nt, Mus musculus
acccaguugucccaccauagcaaguccuagauaccccaaua

SEQ ID NO: 60686 - RNA, 46 nt, Mus musculus
aggagugcugauauaccuaagaucaaaggcucacagacccacagga

SEQ ID NO: 60687 - RNA, 46 nt, Mus musculus
uucacagauaagaccacaaauuuuguuccaauaacuugccaaagag

SEQ ID NO: 60688 - RNA, 46 nt, Mus musculus
aguaaggccaggagcaaacuguguuugucaauacaagcauaaacag

SEQ ID NO: 60689 - RNA, 46 nt, Mus musculus
gcuuguugccauuuucucaugaaccuuauguucucuggugggguuu

SEQ ID NO: 60690 - RNA, 45 nt, Mus musculus
gaaaguucagccaggaguagugaugcaucccuguggccccagaac

SEQ ID NO: 60691 - RNA, 46 nt, Mus musculus
ugcauaauuaaaaauaaaauauuaaaaagcaugcgugcguacagag

SEQ ID NO: 60692 - RNA, 46 nt, Mus musculus
augugacacagcucacaacuacguguaacuccaauuccaagggauc

SEQ ID NO: 60693 - RNA, 46 nt, Mus musculus
agagggcgagacuucaaccaagugguucgguuugagacggucaauc

SEQ ID NO: 60694 - RNA, 42 nt, Mus musculus
cguguccacuccggauguuugagaugcugguggucccugagc

SEQ ID NO: 60695 - RNA, 42 nt, Mus musculus
cugugcccuaaguagagggugauuuccuagagaggugcagua

SEQ ID NO: 60696 - RNA, 46 nt, Mus musculus
uuggcuacauggagaguuuaaagcaagucugagcaccuuagcaaga

SEQ ID NO: 60697 - RNA, 62 nt, Mus musculus
cccucuuuuggccucugcaggcaccaggcaugcauuuaguauacagauuuauaugcaggcaa

SEQ ID NO: 60698 - RNA, 46 nt, Mus musculus
cuuccuugcuuggcccuaaguuuuuauggccacugugccucaagau

SEQ ID NO: 60699 - RNA, 46 nt, Mus musculus
guaauauuuucuagugauuauaaaagggauauaauaaaaaagagau

SEQ ID NO: 60700 - RNA, 46 nt, Mus musculus
gaaggcaagaaaagguccugucaguggccacaguaacaagacaacu

SEQ ID NO: 60701 - RNA, 46 nt, Mus musculus
uuuguucuacauuauauaucugcauguacuugauaaguacauuuca

SEQ ID NO: 60702 - RNA, 46 nt, Mus musculus
ucagaacuguguuuuagaaauauauguuuguggaauagugggagau

SEQ ID NO: 60703 - RNA, 46 nt, Mus musculus
uagcugcccuucagugaagcucugaauuucauuugacucauuuucu

SEQ ID NO: 60704 - RNA, 46 nt, Mus musculus
augucccuugaaaauccacugugccacauccuggauaaacccagac

SEQ ID NO: 60705 - RNA, 44 nt, Mus musculus
uuggucuuugguuugugguggugguuguugauuugguuggggag

SEQ ID NO: 60706 - RNA, 46 nt, Mus musculus
gagcccggcaaagccaucccacguuccaccuagaccaccuccgccc

SEQ ID NO: 60707 - RNA, 46 nt, Mus musculus
uuuucuauguuauuucagccuaaauccaucuucauaccacaggaua

SEQ ID NO: 60708 - RNA, 46 nt, Mus musculus
gggugagcagcaguuucagguucacaguuugcuucccugcugugau

SEQ ID NO: 60709 - RNA, 46 nt, Mus musculus
gugugaauugguucugguuaauaacgaaagacaaugcagcccaaca

SEQ ID NO: 60710 - RNA, 47 nt, Mus musculus
uaguuuagacuguuauuucucucaucacugugaucuaaacaccagua

SEQ ID NO: 60711 - RNA, 73 nt, Mus musculus
ccacaucacguagggaauucucucaucaauguguuaauuuaaggcgguaaaagucagucugcaaugcuaauug

SEQ ID NO: 60712 - RNA, 75 nt, Mus musculus
cauaaucagcuucagauugggguaacaaccugagugggcuagacagaaacuuaguucaggacuaagcucuauaua

SEQ ID NO: 60713 - RNA, 42 nt, Mus musculus
uguaguucuagcagcucaguaauaguuuuacaucaggaacgu

SEQ ID NO: 60714 - RNA, 46 nt, Mus musculus
gaugugaguccuagaaaucccugcucugcccugcagcugccuuguc

SEQ ID NO: 60715 - RNA, 46 nt, Mus musculus
uuugcccaugcaccaccagagagcagccgugaggugagcgaguguc

SEQ ID NO: 60716 - RNA, 45 nt, Mus musculus
uauacacacggccauucuagaugccacacacaagucaagccaaga

SEQ ID NO: 60717 - RNA, 45 nt, Mus musculus
ucugggcuuguacuaguucacugcauaccucacuucugcaguagu

SEQ ID NO: 60718 - RNA, 45 nt, Mus musculus
gaggggaaaggcagcuugguucuuacaugguugguggauaguaca

SEQ ID NO: 60719 - RNA, 45 nt, Mus musculus
uguuccacugcguccagcuaaagccccauguuaauugucaggaga

SEQ ID NO: 60720 - RNA, 48 nt, Mus musculus
cauagugaauccuagggcgucccgaaccucagaaucagagccuguagu

SEQ ID NO: 60721 - RNA, 46 nt, Mus musculus
cuaucuuuccauuucauaggaaaucuucaccuaguaaacaugagau

SEQ ID NO: 60722 - RNA, 46 nt, Mus musculus
cauauguaauuugaauaaguaauuuaucccuaaguuaacgguagag

SEQ ID NO: 60723 - RNA, 46 nt, Mus musculus
uucccauuacaagucagaucuacucaaauguaaaauugcagcagua

SEQ ID NO: 60724 - RNA, 45 nt, Mus musculus
uugauaaauuagaagaaaauaaugguuaauacauacugugggagu

SEQ ID NO: 60725 - RNA, 46 nt, Mus musculus
agaauaauugcccgugaugaucaaggcccugguucaacccccacua

SEQ ID NO: 60726 - RNA, 46 nt, Mus musculus
ccaacauaaaaugcacagacuacaccuuaccauaucaaaaggagaa

SEQ ID NO: 60727 - RNA, 42 nt, Mus musculus
aaggcaacuuuuauaaaagacagcauuucauugggggcuugc

SEQ ID NO: 60728 - RNA, 46 nt, Mus musculus
guucuguacuguaaaacauucauugucucacagaggccgugaaggu

SEQ ID NO: 60729 - RNA, 46 nt, Mus musculus
guaaaguuaaaaucaaauuuuuuaguaauuauguuauagaccaguu

SEQ ID NO: 60730 - RNA, 60 nt, Mus musculus
guuccucucacuaccaccacaccccauggacauccaucucaacaccuaauuacccgguag

SEQ ID NO: 60731 - RNA, 42 nt, Mus musculus
uguguaggguguuuuaugauuauguaugaaguuugccauaca

SEQ ID NO: 60732 - RNA, 45 nt, Mus musculus
gagaggaaaggguuuguuuuuauuucaucuuuguaggccaucauu

SEQ ID NO: 60733 - RNA, 45 nt, Mus musculus
caccagugugcgccuccggcccguuauuaugagacgcugugcaga

SEQ ID NO: 60734 - RNA, 42 nt, Mus musculus
ccacccagaaacaccugcacagaggugacacugcccacauag

SEQ ID NO: 60735 - RNA, 41 nt, Mus musculus
gauuaaaaaccucaggaccugggguugggauuuagcucagu

SEQ ID NO: 60736 - RNA, 46 nt, Mus musculus
gucucaguucuaacagaagggaagaacagaggaaaacugagucaaa

SEQ ID NO: 60737 - RNA, 46 nt, Mus musculus
uaaaaccaugauucucuccuguggaaauaaaaacaagccagcaugu

SEQ ID NO: 60738 - RNA, 30 nt, Mus musculus
acguaacucugugugugugugcgugugugu

SEQ ID NO: 60739 - RNA, 26 nt, Mus musculus
uuuucacuuaugguuugcucuuagag

SEQ ID NO: 60740 - RNA, 46 nt, Mus musculus
ggaagugucauuuacgaaauguguuagcagucauauuguguuagca

SEQ ID NO: 60741 - RNA, 45 nt, Mus musculus
cuguucaccacugcaccagaaccuaaguggcuggcggcagucagu

SEQ ID NO: 60742 - RNA, 46 nt, Mus musculus
auaucagaucagcaagguauaaaauaaaaauauaaucauguuaguu

SEQ ID NO: 60743 - RNA, 46 nt, Mus musculus
gaguuuaccaaauccagagacucccuaucccaucucugccccagac

SEQ ID NO: 60744 - RNA, 45 nt, Mus musculus
uaaaugacuguaaguuauaauauaagugaagaucagccugcagau

SEQ ID NO: 60745 - RNA, 45 nt, Mus musculus
caauguauaaaccacacaaagcuuauuguuguuaaaucuguggga

SEQ ID NO: 60746 - RNA, 48 nt, Mus musculus
acaguuaccuuugaagcguaccuuugauuuugaaacuuacuagauacc

SEQ ID NO: 60747 - RNA, 42 nt, Mus musculus
cccacaccuguuacaggcucuguucucacaugacccacaugc

SEQ ID NO: 60748 - RNA, 42 nt, Mus musculus
gguagggcagaugacugaccaauagccuggccggguguagau

SEQ ID NO: 60749 - RNA, 46 nt, Mus musculus
gugugugugugugugugugugugugugugucccaaaaccccuagac

SEQ ID NO: 60750 - RNA, 46 nt, Mus musculus
acauucccauugguucuauagcaaugagucauguucuagcggggau

SEQ ID NO: 60751 - RNA, 43 nt, Mus musculus
guguguguguguguguguguaauguuguguaugugucgcaucu

SEQ ID NO: 60752 - RNA, 41 nt, Mus musculus
gccuccacagacaccaggaacaaaccauagaacacaugcag

SEQ ID NO: 60753 - RNA, 46 nt, Mus musculus
uuucugguauuuucccuguacaucuauguuaauuuuuacugcaguu

SEQ ID NO: 60754 - RNA, 45 nt, Mus musculus
uuuuuuguaaugaaaguaggaaaauagaauuaaagcagagguaga

SEQ ID NO: 60755 - RNA, 42 nt, Mus musculus
cacagugacugggcagucacgcugucauuucuagccccacag

SEQ ID NO: 60756 - RNA, 47 nt, Mus musculus
cacaccacaccacaccacaccacaccaguuuguguugaaucagaucu

SEQ ID NO: 60757 - RNA, 48 nt, Mus musculus
ugaccagccuuguuuuguccauuccugguuacccuccaagcacacaca

SEQ ID NO: 60758 - RNA, 49 nt, Mus musculus
aaaguaaaguacuucaguagagccuggcauucugcacugaguacggacu

SEQ ID NO: 60759 - RNA, 42 nt, Mus musculus
gacaggcauguguagccauacucgauaccugugcccugcuuu

SEQ ID NO: 60760 - RNA, 46 nt, Mus musculus
aacaagugagacuuuugaacaggucugauuagagauucacugaguc

SEQ ID NO: 60761 - RNA, 52 nt, Mus musculus
cccaagcugaugugcuugccugcuaggccagugagacgggaggggaaaugag

SEQ ID NO: 60762 - RNA, 42 nt, Mus musculus
auauggcuuuccaauaaaacaggccuguaguggcacccaggg

SEQ ID NO: 60763 - RNA, 46 nt, Mus musculus
guguagacagcucuccuccccacccaucucaaacgagcccucagua

SEQ ID NO: 60764 - RNA, 46 nt, Mus musculus
gguauaaccaaauauggggcucauacaugacuuaaucccagcaccc

SEQ ID NO: 60765 - RNA, 41 nt, Mus musculus
ugcucucuucccuuacgccaugaaguaggcucugguuagaa

SEQ ID NO: 60766 - RNA, 46 nt, Mus musculus
gagauugccugucccuuccaaguccuccucagugucaggguuggag

SEQ ID NO: 60767 - RNA, 46 nt, Mus musculus
cugaacagaaacuuaagagggagggagaggaaaaaggagggcagga

SEQ ID NO: 60768 - RNA, 46 nt, Mus musculus
gacuuuuucuuuguguuuuaaugaccuugaagguggcagguuagau

SEQ ID NO: 60769 - RNA, 46 nt, Mus musculus
gaaagcugcccucuugggccauuucucaggaagugcuguguggagu

SEQ ID NO: 60770 - RNA, 46 nt, Mus musculus
auuagacaugauaaagaaaaggaccauugaagauguuccaacagaa

SEQ ID NO: 60771 - RNA, 45 nt, Mus musculus
aaaguaugguuuagaguuaguggguaaguagaagaacguuguauu

SEQ ID NO: 60772 - RNA, 90 nt, Mus musculus
uuguuccuuugugaaggccagcuggcuguauugguguggaucuauuucuggguacguauauuagugugcaacccuguaacaaauaccagu

SEQ ID NO: 60773 - RNA, 42 nt, Mus musculus
ugagauagaugaugcuucagaaagcuaagaugcaggugagua

SEQ ID NO: 60774 - RNA, 46 nt, Mus musculus
gcuuauucugcugauacuacagcaaaaagggaaucaugggauacuc

SEQ ID NO: 60775 - RNA, 41 nt, Mus musculus
cucugggccuguggaggugcagucuaucugucguggcugug

SEQ ID NO: 60776 - RNA, 46 nt, Mus musculus
guuucagggacccugggacugugcuccaagguuauuugaaguaagc

SEQ ID NO: 60777 - RNA, 47 nt, Mus musculus
uggcugaaauacaugaagaagaucuggucucacaaguguggaguugg

SEQ ID NO: 60778 - RNA, 71 nt, Mus musculus
agaaguguccuguaguauucugacagucacaacaguggaucugaggggaagggcaaaaacacuugugagac

SEQ ID NO: 60779 - RNA, 46 nt, Mus musculus
uaaagcagggccagaccuguugaaagccaggggauguggguuagag

SEQ ID NO: 60780 - RNA, 46 nt, Mus musculus
uaagauuuagguaucauggaggaggcagggaagagagugggcagcc

SEQ ID NO: 60781 - RNA, 45 nt, Mus musculus
cguaaaguugggcauucggauccgaaggccuaagcaaggcucaga

SEQ ID NO: 60782 - RNA, 48 nt, Mus musculus
ugauguaagcauucuucauguucucggugagaauguagugagcauaga

SEQ ID NO: 60783 - RNA, 45 nt, Mus musculus
ggguacugugagacagauacaugaagcuaugauugggccccgaga

SEQ ID NO: 60784 - RNA, 47 nt, Mus musculus
ucuuuucuuuuucauuuacuccucccuuccuugcugccagggugauc

SEQ ID NO: 60785 - RNA, 47 nt, Mus musculus
gcacaugaauauucggacuuuaaaagguuuccuaucaugauguccag

SEQ ID NO: 60786 - RNA, 46 nt, Mus musculus
cuucugggcugaggcucaggcuugcuugaguuagaucuacagaaca

SEQ ID NO: 60787 - RNA, 46 nt, Mus musculus
aaacagcagaguuucacuucauuccagucguauucuguguagagag

SEQ ID NO: 60788 - RNA, 41 nt, Mus musculus
cagccacguguugaugaacuaaagacaggaauggacccaga

SEQ ID NO: 60789 - RNA, 46 nt, Mus musculus
aucgcuucuaaaugugggaggauaaaucguucuucccuggccagua

SEQ ID NO: 60790 - RNA, 48 nt, Mus musculus
uuuuccuuuucuuuuucuuucuugugugugugugagagucgaguaucu

SEQ ID NO: 60791 - RNA, 51 nt, Mus musculus
ucauguuuuguaaaaagagauggguuuuuggaggcaagacagcaacuucga

SEQ ID NO: 60792 - RNA, 46 nt, Mus musculus
aaaaagcagagacagcuuccugaagcgggugaaggagaacaaccag

SEQ ID NO: 60793 - RNA, 44 nt, Mus musculus
gugcccgcuagaggucaccauaaggagucauuugcucugcuucu

SEQ ID NO: 60794 - RNA, 45 nt, Mus musculus
gggauuuugggguuucuuuauucuuuccauucauauguacaugug

SEQ ID NO: 60795 - RNA, 46 nt, Mus musculus
uuguaaaaucauauuugcauguguagcuccucccuacugccccuag

SEQ ID NO: 60796 - RNA, 42 nt, Mus musculus
gaccaggagccaagaggaaagccugggggaaggggcgggggg

SEQ ID NO: 60797 - RNA, 52 nt, Mus musculus
cagcagccacuugguagcucauaaccaccauaaugagaucuacccucuucug

SEQ ID NO: 60798 - RNA, 45 nt, Mus musculus
uauuauuguuguugcuguuauuauucuuauuucuucaucgugugu

SEQ ID NO: 60799 - RNA, 42 nt, Mus musculus
aggcuggacaucuaucugcauuuuccuguucuucaagcccuc

SEQ ID NO: 60800 - RNA, 42 nt, Mus musculus
cuugggccuggcagaauggcucccgcaaagaaggguggcgag

SEQ ID NO: 60801 - RNA, 47 nt, Mus musculus
cgcugguaacuuacgugccuguuaccacauucaaaaaucuacagacg

SEQ ID NO: 60802 - RNA, 43 nt, Mus musculus
cugcuuggagggaugcgcgccaguggcacaaagccgggcagag

SEQ ID NO: 60803 - RNA, 41 nt, Mus musculus
cggggcagcagggacuucaggcgacggcguggggggcuaga

SEQ ID NO: 60804 - RNA, 42 nt, Mus musculus
caaucaauacugagaacguaaggacgguuuuaccacuuagcc

SEQ ID NO: 60805 - RNA, 46 nt, Mus musculus
gagagaggggaggaagaggaggagaggggcgaugaggaccaggagg

SEQ ID NO: 60806 - RNA, 42 nt, Mus musculus
uguauccugauuucgguuuguucuagggauggaguagaagaa

SEQ ID NO: 60807 - RNA, 41 nt, Mus musculus
gggcacacacagagauucugacacugugugccaggccagcu

SEQ ID NO: 60808 - RNA, 96 nt, Mus musculus
ugagaacugguauaaacucuauaagggguagaggagaaagaccggccguguguuggguaggaaagaucuguggguguugggaaauuguucugguag

SEQ ID NO: 60809 - RNA, 46 nt, Mus musculus
ugcuaaugguguuuaacacaagugcaauucuaucauggucugaguc

SEQ ID NO: 60810 - RNA, 41 nt, Mus musculus
augugugagagugagugugugugugugugugugugugugug

SEQ ID NO: 60811 - RNA, 42 nt, Mus musculus
ccuuacagggacugaauacuccgggugggaaggucuggguac

SEQ ID NO: 60812 - RNA, 95 nt, Mus musculus
cgucggacucuuagaaaguugagaaaggaacucaaauagaugacaccagaaggaagaaagacuggggauacaaugugagaaaugagagagagaga

SEQ ID NO: 60813 - RNA, 44 nt, Mus musculus
ccgcuuugggcuuaaaucuggacaaggaaacuaggggaucgaga

SEQ ID NO: 60814 - RNA, 42 nt, Mus musculus
uucggcagaucccaguuuaccucgcacacccgacuugcccau

SEQ ID NO: 60815 - RNA, 41 nt, Mus musculus
aagagaguugggaguuaucccgcguagaaaggacccaaaga

SEQ ID NO: 60816 - RNA, 45 nt, Mus musculus
ucccaggcaguguuuacagccccacuagugaggcugagcuuagag

SEQ ID NO: 60817 - RNA, 46 nt, Mus musculus
agucugguguagucauugagcaaagcuagacucugacuguccuuua

SEQ ID NO: 60818 - RNA, 45 nt, Mus musculus
accagccugagguaaugauaguaaucggucaaucaacugaacugg

SEQ ID NO: 60819 - RNA, 41 nt, Mus musculus
gggaaaaggaacugggucagaggguuggagugggggcaggg

SEQ ID NO: 60820 - RNA, 44 nt, Mus musculus
uaaaaaagaucguggacuuaaggugguuugacuggggagggaaa

SEQ ID NO: 60821 - RNA, 46 nt, Mus musculus
ugguucaaauuaccagaaguuccugcuuuggaauuuagcaucaggu

SEQ ID NO: 60822 - RNA, 45 nt, Mus musculus
ggggauuggcagccacuggauucuacaaggcaaggaggcgagaga

SEQ ID NO: 60823 - RNA, 45 nt, Mus musculus
ugauugucuuucuaauuucgaguguucucagcuuucugugcaggg

SEQ ID NO: 60824 - RNA, 41 nt, Mus musculus
gggggacaaugugugagauuggaaagccugaaaugcagcag

SEQ ID NO: 60825 - RNA, 42 nt, Mus musculus
gcagcuuuggggguuuacuugcauucuuuugggggggcauca

SEQ ID NO: 60826 - RNA, 46 nt, Mus musculus
auaggaaauagaacuuaaugauguagaaaaauacccagccagagaa

SEQ ID NO: 60827 - RNA, 46 nt, Mus musculus
gguuaaauugugugagcgccaucuucaacagucucuaaccguauga

SEQ ID NO: 60828 - RNA, 46 nt, Mus musculus
agaauuaaacucugauacguauacaguaugagacucacaacaagau

SEQ ID NO: 60829 - RNA, 41 nt, Mus musculus
caaccugugaucccagccuuggaaaaauggaagcagugggu

SEQ ID NO: 60830 - RNA, 46 nt, Mus musculus
cccauaagcccuguacacaucaagacacacacucauacacauagau

SEQ ID NO: 60831 - RNA, 42 nt, Mus musculus
cccuaccacagugccaagugauaaauaaaaucaucaccaacc

SEQ ID NO: 60832 - RNA, 42 nt, Mus musculus
uggguuugagccugugaaaaggcuacuguugucuacuguuag

SEQ ID NO: 60833 - RNA, 46 nt, Mus musculus
augacgauuccuuaggaaaaaauguuugaagagaauuuuggcuuug

SEQ ID NO: 60834 - RNA, 45 nt, Mus musculus
aggcugacucuccagcuuucuauggaggaaacacugcuggcagaa

SEQ ID NO: 60835 - RNA, 46 nt, Mus musculus
agaauauuauuuugccaaacuucuauagaugaucagaggcccaaag

SEQ ID NO: 60836 - RNA, 48 nt, Mus musculus
ugaagauagacauuaauaacccagauaucaaacucagaguagauucag

SEQ ID NO: 60837 - RNA, 46 nt, Mus musculus
uguggggaguggggcaaaggucgauacuagacuaauuaauguagau

SEQ ID NO: 60838 - RNA, 45 nt, Mus musculus
acaagaaggguuccugguugagcugcuguaccuuuuccuguugga

SEQ ID NO: 60839 - RNA, 61 nt, Mus musculus
aauuauagacaauugugagcugccaucugggugaugugaauuggaccugaguccuuuggaa

SEQ ID NO: 60840 - RNA, 55 nt, Mus musculus
caguguuuugccuguauguaugucuguaugagggugucagauccucuggaacugg

SEQ ID NO: 60841 - RNA, 41 nt, Mus musculus
ucuucuuuguuagacuuugagccccuagauaaggcauuugg

SEQ ID NO: 60842 - RNA, 45 nt, Mus musculus
uuccugagcagaaagguagaggaagucauuagcaaaggccaugau

SEQ ID NO: 60843 - RNA, 46 nt, Mus musculus
cugcugugcugccccaaaucuagaaacuguccucacacagcaaguc

SEQ ID NO: 60844 - RNA, 46 nt, Mus musculus
acccucccuuggguaccaccccacccugggacaucuagccucagca

SEQ ID NO: 60845 - RNA, 46 nt, Mus musculus
gugaccugucuuuucauuuccugaugguguccuuuucagaacagaa

SEQ ID NO: 60846 - RNA, 43 nt, Mus musculus
cagagucuaaagcacccugcacaugcuucuuugccaucugugu

SEQ ID NO: 60847 - RNA, 45 nt, Mus musculus
aaaguuucuguguugacauaaguuuucaguucauuuggauaagga

SEQ ID NO: 60848 - RNA, 46 nt, Mus musculus
cagaguacucaauuuauuuugucaauaagguaauuuaccaacagau

SEQ ID NO: 60849 - RNA, 72 nt, Mus musculus
uauuacugaguuuuuagaaaagaggcacgaguauuugcagugcagagcaucagagauuguucucgcucaggu

SEQ ID NO: 60850 - RNA, 46 nt, Mus musculus
gguaugcuuauuauuuuuaaaaaugugcccuuaaaaaucaagagau

SEQ ID NO: 60851 - RNA, 45 nt, Mus musculus
ugguccuucuuagugacagaaggauagaaaaauuagggggaaaga

SEQ ID NO: 60852 - RNA, 85 nt, Mus musculus
gucauuuccauggaugaggaaguacaucugucacucauagcugaguugcuuagauggcuaaucauaauuauuuucugugugucag

SEQ ID NO: 60853 - RNA, 45 nt, Mus musculus
cagaaaacuaauuaaaaacuaagccaucauaaagugucucugaga

SEQ ID NO: 60854 - RNA, 24 nt, Mus musculus
gggaaagggugggaaaagccacug

SEQ ID NO: 60855 - RNA, 45 nt, Mus musculus
uguuggcaucacgugcauuugcucagaucucuuuggaaugguggg

SEQ ID NO: 60856 - RNA, 46 nt, Mus musculus
aacaagugggagcuuauuuuauaaaugugccuuuguggccguagcu

SEQ ID NO: 60857 - RNA, 46 nt, Mus musculus
cuccuguuuaauuccuuucccucuucucccagaaaggccagcaugg

SEQ ID NO: 60858 - RNA, 46 nt, Mus musculus
auauauaaaaaaugugcaaauccugacucuuaugaccuguguaggg

SEQ ID NO: 60859 - RNA, 46 nt, Mus musculus
uucugauuugauuacaccacaaaaaugucauaucuuuuagccgauc

SEQ ID NO: 60860 - RNA, 95 nt, Mus musculus
auuuauagucgguaucauaauguuugccgaacgucaucguuuagauaaaauuagugauucuccuguagucauccuacugaaauaugcauguggau

SEQ ID NO: 60861 - RNA, 60 nt, Mus musculus
gagccgaucauuauuuguagcauaaaauuugcaaagaugagaguuaacacaaauuuaggc

SEQ ID NO: 60862 - RNA, 30 nt, Mus musculus
ggccggcccugggguaccuugcaaagcacu

SEQ ID NO: 60863 - RNA, 55 nt, Mus musculus
agucuaauaguuuuacuccucucaguaccacaacucagugcagaucaucacagcc

SEQ ID NO: 60864 - RNA, 57 nt, Mus musculus
ucuucucgcuaggagaagaaaaucauuuuggaccaauaggcuuuggagaagacacuu

SEQ ID NO: 60865 - RNA, 44 nt, Mus musculus
caucucauaagaaguuggggaguagccaaacuuugagccauaau

SEQ ID NO: 60866 - RNA, 46 nt, Mus musculus
uugcaguaucuuucugguacuccuagaauaccagaauccaaaugag

SEQ ID NO: 60867 - RNA, 46 nt, Mus musculus
ccauuuacacacauacacacacacacacacacacacacacagagag

SEQ ID NO: 60868 - RNA, 64 nt, Mus musculus
ucuuaaagaagcucggaacuagaauauuuucaaguaugaauuggagaagggaaaaguuggagau

SEQ ID NO: 60869 - RNA, 47 nt, Mus musculus
ucugggauucgcugaaugagaagggaacauggagagacagucacaga

SEQ ID NO: 60870 - RNA, 46 nt, Mus musculus
agaaguugcucaguauugacauagaacggguuuaaagugcacauuc

SEQ ID NO: 60871 - RNA, 45 nt, Mus musculus
aaacaaacuugggugccugagauaauggcugcuuuaagugaagcg

SEQ ID NO: 60872 - RNA, 48 nt, Mus musculus
ugugugcacugagagcuaccuuacaggagguaauagagaagggggaga

SEQ ID NO: 60873 - RNA, 45 nt, Mus musculus
gauccugcauauuccucauagggguguagaucagcacagccucuu

SEQ ID NO: 60874 - RNA, 45 nt, Mus musculus
guuuugucgcagugauaaaaaucugaccaaacaagaugaaagaaa

SEQ ID NO: 60875 - RNA, 45 nt, Mus musculus
cagcaggcaucugcuuucauacaguguuucugucuuugugugaga

SEQ ID NO: 60876 - RNA, 45 nt, Mus musculus
aaaaaaugggagaaacaugagugaauagaaacuaggacaaaaaga

SEQ ID NO: 60877 - RNA, 44 nt, Mus musculus
aagaugucuucacugugguuuguaaagcccugggugccccgagg

SEQ ID NO: 60878 - RNA, 46 nt, Mus musculus
uacaacuuuaucacuuacaacuuuaucacuuaaaauggccccaaau

SEQ ID NO: 60879 - RNA, 46 nt, Mus musculus
uuccuucaugcggugaugguaaacugucagguugaaucgucuagag

SEQ ID NO: 60880 - RNA, 46 nt, Mus musculus
ccaaguugugcuaaagauuucauuuuacuggagaaggaggaaaagg

SEQ ID NO: 60881 - RNA, 46 nt, Mus musculus
ugcaggaauugaagaaagagauguuccugccucguuucacccagaa

SEQ ID NO: 60882 - RNA, 27 nt, Mus musculus
ucaaaggugagacugaaugcuuggcua

SEQ ID NO: 60883 - RNA, 46 nt, Mus musculus
guugggaauguaugugugaaugcaggucccaagaaggccaggagaa

SEQ ID NO: 60884 - RNA, 46 nt, Mus musculus
ucuguugcauguaauacucugggacuugcuuuuuccucaugcagau

SEQ ID NO: 60885 - RNA, 45 nt, Mus musculus
gagaccuucuuacauauaauucucaguaggugcugcugcuuucag

SEQ ID NO: 60886 - RNA, 46 nt, Mus musculus
ugugcaguuuauuuggggucaaacucugugaugaagaaagagagau

SEQ ID NO: 60887 - RNA, 52 nt, Mus musculus
aucaacacaaaccgaacugccaagaucucuuuuuggggauuaugaaggggga

SEQ ID NO: 60888 - RNA, 46 nt, Mus musculus
uuagcuuguagaauauaggauacucacacuugagugacaugcagca

SEQ ID NO: 60889 - RNA, 46 nt, Mus musculus
uucaucagguaccuacagugcuguaauucuagacaugaccuuggau

SEQ ID NO: 60890 - RNA, 42 nt, Mus musculus
gcaaagcacaguguaguugcugaggagugcugggaacuagag

SEQ ID NO: 60891 - RNA, 46 nt, Mus musculus
cucugagauaaggguacuaguuuuuacuuuaucauccugugcagau

SEQ ID NO: 60892 - RNA, 42 nt, Mus musculus
cuccuucaggucugggagaaaaaaaaugauuuucaggcuaaa

SEQ ID NO: 60893 - RNA, 45 nt, Mus musculus
uguagugugugcuagguuguagugugugcuggguuguagugugug

SEQ ID NO: 60894 - RNA, 45 nt, Mus musculus
guacacagagaugcugucucugugaucuuaagccacucacauuga

SEQ ID NO: 60895 - RNA, 46 nt, Mus musculus
ggucuugucuucacugaucuuugcuucucugagagaggcacagcuu

SEQ ID NO: 60896 - RNA, 45 nt, Mus musculus
aaaaaacuuguggugaugugcugcaguuucuuucugcuucugugg

SEQ ID NO: 60897 - RNA, 42 nt, Mus musculus
guuuauguaccuucuuccagagauuaacaauuauagggaauu

SEQ ID NO: 60898 - RNA, 46 nt, Mus musculus
ucugaaagccuuuucuccugaaggcgccacagcauaauguccaccu

SEQ ID NO: 60899 - RNA, 46 nt, Mus musculus
auuuauuuaaaaauaaaguacuuuauguaaaauauaaugccaagau

SEQ ID NO: 60900 - RNA, 46 nt, Mus musculus
cacggggcuguggggaugagagggcuuccuguaugucuggucagaa

SEQ ID NO: 60901 - RNA, 46 nt, Mus musculus
aggggguaggggauguggaguggaacgcagacaaagacauugagau

SEQ ID NO: 60902 - RNA, 46 nt, Mus musculus
gauuaugcaacuaacaugauuagcaagugaacucuuggggcuuauu

SEQ ID NO: 60903 - RNA, 45 nt, Mus musculus
ggcggugcuguuaaggauguuuugcuaucuuugggaugucuuaga

SEQ ID NO: 60904 - RNA, 46 nt, Mus musculus
acaaaaauuaauguuucacagucuuagagguauggaaguagaagau

SEQ ID NO: 60905 - RNA, 46 nt, Mus musculus
agcaguagcuagucucauagccucagacaaggauguggugagagua

SEQ ID NO: 60906 - RNA, 46 nt, Mus musculus
gcccuugagcuaaucuucuugccucaaagcucacuuguguugagau

SEQ ID NO: 60907 - RNA, 44 nt, Mus musculus
uaugaaccuguguguauauagcuaaagcagcugcguggcucaga

SEQ ID NO: 60908 - RNA, 46 nt, Mus musculus
guuauuuagacagaaucaaguauggaggcaagagaugaugguaguu

SEQ ID NO: 60909 - RNA, 46 nt, Mus musculus
gauuugaaaaauccuuuugcuuuuuaagcacaaagcuaaaggagca

SEQ ID NO: 60910 - RNA, 46 nt, Mus musculus
ucucucugugagagagagagagagagagagagagagagagagagag

SEQ ID NO: 60911 - RNA, 46 nt, Mus musculus
acaucugggagauaaagauuacuccauauuuaugggaaacugagac

SEQ ID NO: 60912 - RNA, 45 nt, Mus musculus
acagcuguuacugcagagcauuuccagcucugucacuauggagau

SEQ ID NO: 60913 - RNA, 46 nt, Mus musculus
gacuggacccagaguccuuccugugcaugcauuuccuucagcagau

SEQ ID NO: 60914 - RNA, 45 nt, Mus musculus
uauucucuggagccuuacucuuuagccuggacuugaacuugcagu

SEQ ID NO: 60915 - RNA, 45 nt, Mus musculus
gaaggagagagaagaagaagaagaagaagaagaaaaagaagaaga

SEQ ID NO: 60916 - RNA, 41 nt, Mus musculus
gaggugaugaauagcaguuguagcaggggguuugggcaaga

SEQ ID NO: 60917 - RNA, 45 nt, Mus musculus
uaauuucagggauguugccaagaagguucauaguagaauccagaa

SEQ ID NO: 60918 - RNA, 46 nt, Mus musculus
uaauccuccuucauguuaccuguaucagugccauugcugggcagau

SEQ ID NO: 60919 - RNA, 52 nt, Mus musculus
uaagggagaaagaacuuacuuugcuuucaauuccagguuauugcccauuauu

SEQ ID NO: 60920 - RNA, 45 nt, Mus musculus
caugugaucaugaaggaaaugauaccauacuguacucucggugau

SEQ ID NO: 60921 - RNA, 46 nt, Mus musculus
uugaguuuuauuuuuugaauauuuugaguuuuuauuuuauuaugag

SEQ ID NO: 60922 - RNA, 46 nt, Mus musculus
uccuccuguuucagccuucaaaguguugggauuauaggcaucagua

SEQ ID NO: 60923 - RNA, 45 nt, Mus musculus
uggcuuuuuuaguuugaguuacuauuugaauagguaaugcaugag

SEQ ID NO: 60924 - RNA, 46 nt, Mus musculus
ucagugguguaggcuagaacgaggcuugcuguggggaugggagaau

SEQ ID NO: 60925 - RNA, 46 nt, Mus musculus
cagcaaacuuugauguguuacagauauaugugcaauugcccaggau

SEQ ID NO: 60926 - RNA, 45 nt, Mus musculus
cagagaguauauaaaugauagagcccugauaagugaaguuggggu

SEQ ID NO: 60927 - RNA, 48 nt, Mus musculus
uguggagacccccucaacaagcgccuguggaaaugugugcaagaagga

SEQ ID NO: 60928 - RNA, 46 nt, Mus musculus
cuauuguugaugcagauuuggaagagaaaagccacaaguugcagac

SEQ ID NO: 60929 - RNA, 46 nt, Mus musculus
acaugggagggacgguuucuuucuccuuacacugagugggacagaa

SEQ ID NO: 60930 - RNA, 46 nt, Mus musculus
aacagguggaugacgaaucaaaagauguggcuguuaaggaggaguu

SEQ ID NO: 60931 - RNA, 45 nt, Mus musculus
cugacaguauguauuaugcucgucaggucagagaaggagaguaga

SEQ ID NO: 60932 - RNA, 46 nt, Mus musculus
gauuugguuggcauuuaggaacguaaaugcuuuuuacuguuaagau

SEQ ID NO: 60933 - RNA, 45 nt, Mus musculus
guagggguaaacauagucagaacuuguaauccuccugcccucaga

SEQ ID NO: 60934 - RNA, 46 nt, Mus musculus
cuaguuguagcuccuaacccauuuagcauugcuacuguguauaggg

SEQ ID NO: 60935 - RNA, 45 nt, Mus musculus
gcacuauuaggagguguggccuuguuggauaagauggucuugcug

SEQ ID NO: 60936 - RNA, 46 nt, Mus musculus
auacauagcauuuucucuggaaagaaucucaaggacaaagauagau

SEQ ID NO: 60937 - RNA, 30 nt, Mus musculus
uccugaucuuagauucuuccauuugcagau

SEQ ID NO: 60938 - RNA, 42 nt, Mus musculus
gaugacucauggaacacaaagggauuuuccuugggcccagaa

SEQ ID NO: 60939 - RNA, 45 nt, Mus musculus
cuguuccaagcacagucaucagguaguggcugcaaacuugcuggg

SEQ ID NO: 60940 - RNA, 47 nt, Mus musculus
gacagucaggugaguggaagggagaagggugauuugccaugagauag

SEQ ID NO: 60941 - RNA, 41 nt, Mus musculus
agagucagggugaccaggacuccuggcuggauucauugauc

SEQ ID NO: 60942 - RNA, 46 nt, Mus musculus
aagucuugcuguccagggggauguccaugugggaugggugcuggau

SEQ ID NO: 60943 - RNA, 45 nt, Mus musculus
uaauaaugguggugguggugauggugaugauggugguggugguga

SEQ ID NO: 60944 - RNA, 47 nt, Mus musculus
gauccaaagcuccaguagacuugcucagagaggagccaccugggguc

SEQ ID NO: 60945 - RNA, 46 nt, Mus musculus
uuuacauguaugguauauguguguauaguaugucugugugguauaa

SEQ ID NO: 60946 - RNA, 46 nt, Mus musculus
uguguguguggucuguguaguauauacguggucuaugugugguagu

SEQ ID NO: 60947 - RNA, 45 nt, Mus musculus
uucaugugguguuuguguguaugauguguaucuggugugucugug

SEQ ID NO: 60948 - RNA, 46 nt, Mus musculus
gaggcguggccuuguuggaggaagugugucacuauggggguggacu

SEQ ID NO: 60949 - RNA, 46 nt, Mus musculus
caauuaccaccacgaucaguuucagaaccauucaagaccccaaggg

SEQ ID NO: 60950 - RNA, 41 nt, Mus musculus
gcauggguagaguaaggagugaggguagguuggcaugagua

SEQ ID NO: 60951 - RNA, 44 nt, Mus musculus
cggucccuugcuugugaaagggaccagaguauagaaaggggagg

SEQ ID NO: 60952 - RNA, 26 nt, Mus musculus
guuggucucaaacucaccguguaaua

SEQ ID NO: 60953 - RNA, 45 nt, Mus musculus
ugccucugccuccugagugcugggugcgccaccacguccggcuuu

SEQ ID NO: 60954 - RNA, 50 nt, Mus musculus
ccccacgcaacgcgaagauggcaacccgugugacuuugacuggagagaag

SEQ ID NO: 60955 - RNA, 56 nt, Mus musculus
accucacacucugcauaguguuccugaugaccugcaagcccccgcuguacaugggu

SEQ ID NO: 60956 - RNA, 62 nt, Mus musculus
ccugaguauaucaaguacuucaaugauaaaaccauugaugaggagcuggagcgagacaagag

SEQ ID NO: 60957 - RNA, 98 nt, Mus musculus
cucccaucuaugcggacuugucccucaaguacaacuguucagggcuaaauuuugggaagguagauguuggacgcuacacugacguuagcacacgguac

SEQ ID NO: 60958 - RNA, 55 nt, Mus musculus
gcucccuacccugauucuguuccaaggcggcaaggaggucauucgucggccgcag

SEQ ID NO: 60959 - RNA, 53 nt, Mus musculus
uggagacaugucagaagagaagccuguggacccugcucccacuacugugccag

SEQ ID NO: 60960 - RNA, 41 nt, Mus musculus
uugcuuccucuccugucaauuucaggaaccuuugaggccca

SEQ ID NO: 60961 - RNA, 45 nt, Mus musculus
cugugugagaauacagagagccaggaagaacaaaacaguguaauu

SEQ ID NO: 60962 - RNA, 46 nt, Mus musculus
cccuucuuggugaugucuguggaggggguaauuguaccugugagau

SEQ ID NO: 60963 - RNA, 46 nt, Mus musculus
cacaugccaguaguucacuaacuagccuuuccucaaacagccagac

SEQ ID NO: 60964 - RNA, 27 nt, Mus musculus
ugccuggggaacagaauacugaccaca

SEQ ID NO: 60965 - RNA, 45 nt, Mus musculus
gcauucuacagucggauuccugagaacucgggauacccaccgccc

SEQ ID NO: 60966 - RNA, 27 nt, Mus musculus
cagucauguggcuucuuccucacccca

SEQ ID NO: 60967 - RNA, 66 nt, Mus musculus
caagggucacaugugcacaaaggaaagagccaacggucuacugcagugacuuugcaaacucagcgu

SEQ ID NO: 60968 - RNA, 46 nt, Mus musculus
uaauguugagcacugaaaacuguucaggggcccuauaaagugacag

SEQ ID NO: 60969 - RNA, 42 nt, Mus musculus
caggggagaggggagaggggagaaaagggaagaggggagaaa

SEQ ID NO: 60970 - RNA, 48 nt, Mus musculus
uuggccaucucuggaacacagcuucuuugugcucucagaaaacgcuuc

SEQ ID NO: 60971 - RNA, 24 nt, Mus musculus
agaaaaacccaacuaagggagagg

SEQ ID NO: 60972 - RNA, 46 nt, Mus musculus
aguugggaauuuacauucaaagcaaucacauuugacaacaccccag

SEQ ID NO: 60973 - RNA, 46 nt, Mus musculus
ugaguaaaguacaaagacagugagugagucacaacaggcauugcag

SEQ ID NO: 60974 - RNA, 45 nt, Mus musculus
aggugucuggaaaagugagaguuuugaauagguucaauguauuug

SEQ ID NO: 60975 - RNA, 46 nt, Mus musculus
ugacucccugagguggauggggaaggcgcuguguucacgugcuagc

SEQ ID NO: 60976 - RNA, 44 nt, Mus musculus
uucucucuuccugugguccgccacgggguguuugcaguugggag

SEQ ID NO: 60977 - RNA, 42 nt, Mus musculus
gggcugagggagaugugucugaggaugcuaugaaugcaggaa

SEQ ID NO: 60978 - RNA, 46 nt, Mus musculus
cuagccccacagccucuccgaggaggccuucccagugugccaguac

SEQ ID NO: 60979 - RNA, 42 nt, Mus musculus
gaggacgcgcugcuggcggcccgcgagguguucaagacccag

SEQ ID NO: 60980 - RNA, 45 nt, Mus musculus
uguagaccaggcuggccucgaacucagaaauccaccugccuucca

SEQ ID NO: 60981 - RNA, 45 nt, Mus musculus
guaaaaagaccaagaaacaguucucuggguucuagcuagugccag

SEQ ID NO: 60982 - RNA, 53 nt, Mus musculus
uauagagaaacccugucucaacaccguccccacccuccacccccaacgcugua

SEQ ID NO: 60983 - RNA, 41 nt, Mus musculus
uucgccaguaucgaguugaaguuuauaagaauaaagcugga

SEQ ID NO: 60984 - RNA, 45 nt, Mus musculus
auccuggagcuccuugugaagaccaggcugaccuugaacucaaag

SEQ ID NO: 60985 - RNA, 44 nt, Mus musculus
uuaucaggaucucaaccgguuacugaaaggcaaaaaaggagaac

SEQ ID NO: 60986 - RNA, 46 nt, Mus musculus
aaagugacuaugcauggcaguuaaucccagcacucgggaggcagag

SEQ ID NO: 60987 - RNA, 46 nt, Mus musculus
cuucagccaguacaugaaguuggacauggcagcaguuagagcccuc

SEQ ID NO: 60988 - RNA, 42 nt, Mus musculus
aaauuuggucuuagcuuagaaacauuugugugggggcuggag

SEQ ID NO: 60989 - RNA, 31 nt, Mus musculus
aucaagcagccgcucauggauaggaacagga

SEQ ID NO: 60990 - RNA, 46 nt, Mus musculus
ugaguauacgguagcugucuucagacacaccagaagagggcaucag

SEQ ID NO: 60991 - RNA, 46 nt, Mus musculus
ggaagcuuuugucgaggauucagaacugaggcagaguuuacaggag

SEQ ID NO: 60992 - RNA, 46 nt, Mus musculus
caaauuuaaauucagcuucaugaugacagaacacaaauugaguuuu

SEQ ID NO: 60993 - RNA, 69 nt, Mus musculus
ccggcuaaguguguaagauggagagagagccggcuaagcguguaagauggagagaaagccggcuaagcg

SEQ ID NO: 60994 - RNA, 45 nt, Mus musculus
cggcuaaguguguaagguggagagagagccggcuaaguguguaag

SEQ ID NO: 60995 - RNA, 48 nt, Mus musculus
agagagcuggcuaagcguguaagauggagagaaagccggcuaagcgug

SEQ ID NO: 60996 - RNA, 94 nt, Mus musculus
gccaagcguguaagguggagagcgagccggcuaagcguguaagguggagagcgagccggcuaagcguguaagguggagagcgagccggcuaagc

SEQ ID NO: 60997 - RNA, 77 nt, Mus musculus
gcguguaagguggagagagagccggcuaagcguguaagguggagagagagccggcuaagcguguaagauggagagag

SEQ ID NO: 60998 - RNA, 46 nt, Mus musculus
gagccggcuaagcguguaagguggagagagagcuggcuaagcgugu

SEQ ID NO: 60999 - RNA, 42 nt, Mus musculus
cucagggaaggaggcugaggguggucaugaagauuccaggag

SEQ ID NO: 61000 - RNA, 46 nt, Mus musculus
uucaaaauuucaagaaaugauagaaacaacuuuagauauggaucag

SEQ ID NO: 61001 - RNA, 43 nt, Mus musculus
uuguguggcaccucuguggccacuugauguaaacugaagugac

SEQ ID NO: 61002 - RNA, 46 nt, Mus musculus
ggacaguaaagaagggagggguccuuuagguccacaaugguaaagu

SEQ ID NO: 61003 - RNA, 57 nt, Mus musculus
acuggaucuguaggauagggacaggggagucugagguagagaucugugaggcaacua

SEQ ID NO: 61004 - RNA, 46 nt, Mus musculus
gucaagcacuggacacagaagugcaacuccccaaaaacuugaacag

SEQ ID NO: 61005 - RNA, 42 nt, Mus musculus
cccaugggaaguggcacuauuaggagguauggcuguguugga

SEQ ID NO: 61006 - RNA, 42 nt, Mus musculus
cuccugccuccagguuccugccguuuuaguucuuguccugau

SEQ ID NO: 61007 - RNA, 46 nt, Mus musculus
cggcucagcuucucucuagcucagcuuacucucuuaugugccucag

SEQ ID NO: 61008 - RNA, 45 nt, Mus musculus
ugauccuaaccugagugaacuaagagaagucauggauggccugga

SEQ ID NO: 61009 - RNA, 46 nt, Mus musculus
gcaguuaggcaacaaaagaaagucaaaggaauggauacaaauugga

SEQ ID NO: 61010 - RNA, 46 nt, Mus musculus
cuccaaauaaccaagauauaauucauagaccacaugaagcucaaga

SEQ ID NO: 61011 - RNA, 45 nt, Mus musculus
uuuccccuuagaaggagaacaaaauccucacaggagcaaauauga

SEQ ID NO: 61012 - RNA, 80 nt, Mus musculus
agaugcucgcagccaaccauuggacugagcaugggguccccaauagaggaguuaagagaaaggacugaaggaguugaagg

SEQ ID NO: 61013 - RNA, 46 nt, Mus musculus
ccuaugggguauuuagguaaaagaaauuggaaugauuggccacaug

SEQ ID NO: 61014 - RNA, 72 nt, Mus musculus
agcugauuccuguguuguguuguugcugauuccuguguuguguuguugcugauuccuguguuguguuguugc

SEQ ID NO: 61015 - RNA, 79 nt, Mus musculus
guguuguguuguaguugauuccuguguuguugcugauuccuguguuguguuguugcugauuccuguguuguguuguugc

SEQ ID NO: 61016 - RNA, 45 nt, Mus musculus
guuguugcugauuccuguguuguagcugauucuuguguuguguug

SEQ ID NO: 61017 - RNA, 42 nt, Mus musculus
uguguuguguuguaguugauuccuguguuguugcugauuccu

SEQ ID NO: 61018 - RNA, 45 nt, Mus musculus; identical to SEQ ID NO: 61016

SEQ ID NO: 61019 - RNA, 45 nt, Mus musculus
uucuugccccagaccuuaaccugcuuugaaacagaaacgcaucag

SEQ ID NO: 61020 - RNA, 45 nt, Mus musculus
acaaguauugcugaagaagcaugagaaggacaggcucugcucagg

SEQ ID NO: 61021 - RNA, 43 nt, Mus musculus
ccaccacgcccggcuacaaaacauaguuuuauaauaggaugag

SEQ ID NO: 61022 - RNA, 32 nt, Mus musculus
uaaguaaauuguacauuuuccaaaagaaaugu

SEQ ID NO: 61023 - RNA, 34 nt, Mus musculus
gaaguguccauuguggauugcauccuugcucgag

SEQ ID NO: 61024 - RNA, 44 nt, Mus musculus
ggauagcuggaccgcaaagacagacccuaucucaaaaagccaga

SEQ ID NO: 61025 - RNA, 45 nt, Mus musculus
gaugugacgaagccgagccggcugcaaagagacgcugccuggaaa

SEQ ID NO: 61026 - RNA, 46 nt, Mus musculus
ccugugggauucuaguauuuacuuuuuggucauucuuacuggcuca

SEQ ID NO: 61027 - RNA, 46 nt, Mus musculus
gaucugcaacucuaaucugccugccuuugccuccaaggaugcuggg

SEQ ID NO: 61028 - RNA, 52 nt, Mus musculus
ucggaggagagcaucuccgcgaagcugaagcaacugaaagccgagguggucg

SEQ ID NO: 61029 - RNA, 46 nt, Mus musculus
gcuugaaaacauuaccgucuguagcugggugcuguuuaaaugggga

SEQ ID NO: 61030 - RNA, 46 nt, Mus musculus
ggcauggauuucaacugauagccacuacaagcauggagucccuugg

SEQ ID NO: 61031 - RNA, 45 nt, Mus musculus
uuuuuucuuuauuuacuuuacaucccacugcugccacccccuucu

SEQ ID NO: 61032 - RNA, 45 nt, Mus musculus
agcaucccucagucucuaccugucacagaguaugaccugauuaua

SEQ ID NO: 61033 - RNA, 41 nt, Mus musculus
acgucugcacgguaacccgcggcucccgcagcgccugagac

SEQ ID NO: 61034 - RNA, 41 nt, Mus musculus
ggaaauuuuccagagaguauauaaaguccugauaggugggu

SEQ ID NO: 61035 - RNA, 43 nt, Mus musculus
cauguguguauauguauguguaugucucuaugugugugugugu

SEQ ID NO: 61036 - RNA, 42 nt, Mus musculus
ggagcuccaauuuucgaaaacgcccuguaaucaaccuggcag

SEQ ID NO: 61037 - RNA, 36 nt, Mus musculus
caaagaauuggaauuucuccaggaauuuuuuggugg

SEQ ID NO: 61038 - RNA, 41 nt, Mus musculus
ucuggcccggcccggcccucgccucugguucgcggcggcug

SEQ ID NO: 61039 - RNA, 42 nt, Mus musculus
gggcugccccggggguguggaaccgaggcgagcacggguccc

SEQ ID NO: 61040 - RNA, 46 nt, Mus musculus
aagcucucacuguggagcccuggcuguccuggaacuugcuauguag

SEQ ID NO: 61041 - RNA, 49 nt, Mus musculus
caacugagacaguacaaggaguuaaaccguacuaaaagucagauuaaga

SEQ ID NO: 61042 - RNA, 46 nt, Mus musculus
ugugaggugugaaguugaauagaaagaucuguuuuuauaaguaaag

SEQ ID NO: 61043 - RNA, 46 nt, Mus musculus
aauuuucuguuacauaaagcaacaaacaaacaaacaaccugggcaa

SEQ ID NO: 61044 - RNA, 46 nt, Mus musculus
gugcgcgugugugugcugcaccugugcuauguguuugugugugugu

SEQ ID NO: 61045 - RNA, 48 nt, Mus musculus
cuguuucuuaguugaucuagcauuuaaggaucuaguaaagaggcuuag

SEQ ID NO: 61046 - RNA, 46 nt, Mus musculus
uaauuuugauuaguaauuacuagccaccccuuauggaauagugcag

SEQ ID NO: 61047 - RNA, 46 nt, Mus musculus
cccaaugauaguaacuaucugguagggucguuacaaaguucaugag

SEQ ID NO: 61048 - RNA, 46 nt, Mus musculus
uaagucugugaguugcuguggugugugugugugugugugugugugu

SEQ ID NO: 61049 - RNA, 46 nt, Mus musculus
uuaaguuuaaauuauaaaauaaauacauuaaagaaaacuuggaaag

SEQ ID NO: 61050 - RNA, 46 nt, Mus musculus
agaaaggagaucugggaggcuccuuccccagcaccucacaagccag

SEQ ID NO: 61051 - RNA, 43 nt, Mus musculus
auuuaccuuagccaauaaugaauguagggaauacgaaauuggc

SEQ ID NO: 61052 - RNA, 46 nt, Mus musculus
cagauaagagagcugagaccccgggagcugagaagguugcaggacu

SEQ ID NO: 61053 - RNA, 41 nt, Mus musculus
gaacuggcuucaugagagcaguaaccuucuaacaaaccuca

SEQ ID NO: 61054 - RNA, 61 nt, Mus musculus
cauccuuuggaccaucgugcuaccagaacccagaaaaaaaaucagcaacuucaaagccccc

SEQ ID NO: 61055 - RNA, 42 nt, Mus musculus
cugucuuauauacuuugaaauuguugugauaccauggccgau

SEQ ID NO: 61056 - RNA, 42 nt, Mus musculus
gcucauuaacauggcaaccauaucucucuucucaggcaucac

SEQ ID NO: 61057 - RNA, 42 nt, Mus musculus
aaacuagcugagggcaguuuuggguuguugaacaaggagaag

SEQ ID NO: 61058 - RNA, 46 nt, Mus musculus
uuuucagaggccaggaaugagaaguucacagucuagcacuggacag

SEQ ID NO: 61059 - RNA, 81 nt, Mus musculus
gccaaccauuggacugaguagggguccucaguggaggacuuacagaaaggacugaaagaagugaagggguuugcaacccau

SEQ ID NO: 61060 - RNA, 41 nt, Mus musculus
acuauuugggauuuaggaguguugcuacauucaggggcaga

SEQ ID NO: 61061 - RNA, 46 nt, Mus musculus
uuauuauucaaaacuuuuaagauggaucuuugcauuucaccccuuu

SEQ ID NO: 61062 - RNA, 45 nt, Mus musculus
uccaggcacuucauuucuuacagacagauuuuauguuaggacaaa

SEQ ID NO: 61063 - RNA, 42 nt, Mus musculus
auuuaauuaauucccaaagaauaacugaaaacacagggucag

SEQ ID NO: 61064 - RNA, 41 nt, Mus musculus
auuuagauuuauuaugugagcuggagaaaacaaagcuguaa

SEQ ID NO: 61065 - RNA, 42 nt, Mus musculus
cuuaguagucagcauaaaaacaacauuccuuaccuaaggcag

SEQ ID NO: 61066 - RNA, 45 nt, Mus musculus
aggagucccaagucauaggcagagauguaaagucuuagucccaau

SEQ ID NO: 61067 - RNA, 46 nt, Mus musculus
uauccuuaucaaacaagaguuuuaaggaagugguuggagccaggag

SEQ ID NO: 61068 - RNA, 40 nt, Mus musculus
cucugcucucaagcaaagccaagugcaaacucuccaaggu

SEQ ID NO: 61069 - RNA, 42 nt, Mus musculus
agaucuaggaguuguaggagaauaagaaauaaacuucuggag

SEQ ID NO: 61070 - RNA, 46 nt, Mus musculus
uuagucuuuggaaauuuuccacacugaucuucauuguagcugcagg

SEQ ID NO: 61071 - RNA, 46 nt, Mus musculus
agaggcuuuuuaaaaaacacaaaacuaacagucucauauagcccag

SEQ ID NO: 61072 - RNA, 45 nt, Mus musculus
ggcaaauuuuguaccaagacuacauucccagccuuccuuggcaag

SEQ ID NO: 61073 - RNA, 80 nt, Mus musculus
ugugggugauagauagucuagacugacacagcauuuuugagacaggauuuuuuuuuauuguguucaaggcuagucuggaa

SEQ ID NO: 61074 - RNA, 96 nt, Mus musculus
uucaugauucuugugcuccuguuggaauacccugugugaggucauuuuguaaacccugugaaguagcauacaccuaaucuaaacuccagaggcaga

SEQ ID NO: 61075 - RNA, 54 nt, Mus musculus
aagcaagcaaacaaaauacauaguacuggggcuggagagagagagagagagaga

SEQ ID NO: 61076 - RNA, 93 nt, Mus musculus
cagucaguaagaugcuuccuuacaaagcccugagcaggagcccuagaacccauacgaaaaagccaggugccuauaauuccaguucuagggagg

SEQ ID NO: 61077 - RNA, 51 nt, Mus musculus
uucuagaccaaugagauauucugucucaaaaauuacccccaaacaaaaacc

SEQ ID NO: 61078 - RNA, 45 nt, Mus musculus
aaagaaaucuaauuguagccuuaauacucauucaaggaaaaugag

SEQ ID NO: 61079 - RNA, 46 nt, Mus musculus
cuguucuagcauguggggauucugucuccauauaaacugggaauag

SEQ ID NO: 61080 - RNA, 46 nt, Mus musculus
gagaucugagaaagcgcgguuaaggcugugcaaaaguauugauaaa

SEQ ID NO: 61081 - RNA, 46 nt, Mus musculus
cgcacaugcacacacauauuugcaaaauaauuuuuuacagguuauu

SEQ ID NO: 61082 - RNA, 46 nt, Mus musculus
augcgucccaggguuaaucugacccuggcugaauuugaggcagauu

SEQ ID NO: 61083 - RNA, 46 nt, Mus musculus
aauccgcaccugccuugguucccugauaaguacugcgaaggcacag

SEQ ID NO: 61084 - RNA, 46 nt, Mus musculus
ggggagggggccacuuguuucuuucuaagucuguuuugguugcuuu

SEQ ID NO: 61085 - RNA, 46 nt, Mus musculus
cuuaggaucaugccuaauuguaaaucugacauaaauggccccacaa

SEQ ID NO: 61086 - RNA, 46 nt, Mus musculus
uaguuacuggcaucuuucucacaugcuucucuccugacacacugca

SEQ ID NO: 61087 - RNA, 46 nt, Mus musculus
gucuuuguuuucagguuacucuuuguuacagcaugagcauagccuu

SEQ ID NO: 61088 - RNA, 47 nt, Mus musculus
uaauuccuccugcaauaguuaucuuugaaauguuuuuaccucgcagu

SEQ ID NO: 61089 - RNA, 46 nt, Mus musculus
auuaaggaaaauacagagauaaauaucuucagggauuucaaaauau

SEQ ID NO: 61090 - RNA, 46 nt, Mus musculus
gauacuaauacuauaacucacauauauauuuuuuuacaguggugag

SEQ ID NO: 61091 - RNA, 45 nt, Mus musculus
aaagagaugguagaguucaguggauagcagggaauugugaagcag

SEQ ID NO: 61092 - RNA, 35 nt, Mus musculus
uuuugcuuucaaauuuagaacgaaacauugccuag

SEQ ID NO: 61093 - RNA, 46 nt, Mus musculus
cauacuagauggucaguuagauacauguuagcauuagcguaguuca

SEQ ID NO: 61094 - RNA, 45 nt, Mus musculus
uggacagcagcuuaaugccuuuugaaaacuauauaaagcgacuuu

SEQ ID NO: 61095 - RNA, 45 nt, Mus musculus
cugccauuuuucaagaauauucuuugcaucuaacugccagugcca

SEQ ID NO: 61096 - RNA, 46 nt, Mus musculus
guauuauguugccaucauauaguguauaaaauguaaaauugccaau

SEQ ID NO: 61097 - RNA, 46 nt, Mus musculus
uagguguugcugauggauuuuugcccauaaaaauauuccuuaagau

SEQ ID NO: 61098 - RNA, 47 nt, Mus musculus
ggcaauuuuguagaacuuuuguuuaguuagugagagagagagagaga

SEQ ID NO: 61099 - RNA, 46 nt, Mus musculus
ggaguucucuuaaagagaucaucaccauacuauguaaaugcgaaug

SEQ ID NO: 61100 - RNA, 56 nt, Mus musculus
acucuucagcugaggaacggugguaccgguaaguguaaagaaauuaauguaaaucu

SEQ ID NO: 61101 - RNA, 54 nt, Mus musculus
ugcuuaaagaaagggguuuaaaaauuucagaaagcacagugagcgguuuuuuga

SEQ ID NO: 61102 - RNA, 48 nt, Mus musculus; identical to SEQ ID NO: 54286

SEQ ID NO: 61103 - RNA, 49 nt, Mus musculus; identical to SEQ ID NO: 54287

SEQ ID NO: 61104 - RNA, 41 nt, Mus musculus
cccgcaucgcguccacgugccucuaugauguguggagaaug

SEQ ID NO: 61105 - RNA, 45 nt, Mus musculus
gugcuuuuugcccaagugauucagagggaaggaucaccuggcuga

SEQ ID NO: 61106 - RNA, 42 nt, Mus musculus
ggugcucauggcugcucagcucaaggucagauguuugcccag

SEQ ID NO: 61107 - RNA, 46 nt, Mus musculus
cccagaccuucccacaaugccuauaucaagugagaagccagcccag

SEQ ID NO: 61108 - RNA, 45 nt, Mus musculus
gcgugacguuuccugacgguaggagaggcugucgagaguggcggc

SEQ ID NO: 61109 - RNA, 70 nt, Mus musculus
acagcaauauggccguguccuggaacuagaaagcgaggguuuguuuccgaaaggauggaggccaggaccu

SEQ ID NO: 61110 - RNA, 42 nt, Mus musculus
caguaaacgacaccacugcacacgaaaacacagccgccaaaa

SEQ ID NO: 61111 - RNA, 42 nt, Mus musculus
caucaucuccucccgcuacaaacguugcagagccgggcagau

SEQ ID NO: 61112 - RNA, 26 nt, Mus musculus
agcaccuggccugcuguagugguaga

SEQ ID NO: 61113 - RNA, 46 nt, Mus musculus
gaaagggagagcagccagugucucaguucugagucuaguucuaggu

SEQ ID NO: 61114 - RNA, 42 nt, Mus musculus
uggucgucaacauaguuuguacacaacagauacauggcagau

SEQ ID NO: 61115 - RNA, 46 nt, Mus musculus
uauguacacacacacacacacacacacacacacacagagguuuuuu

SEQ ID NO: 61116 - RNA, 46 nt, Mus musculus
aucaugugcucacagugcucaaggaggccagaagagggugucagau

SEQ ID NO: 61117 - RNA, 45 nt, Mus musculus
cugaggaaaacaaagacauagaguaggcccugcagaauguguuca

SEQ ID NO: 61118 - RNA, 46 nt, Mus musculus
ucucacacucaccaugucucaacuucggagcuugcuugaggucccu

SEQ ID NO: 61119 - RNA, 46 nt, Mus musculus
gcuugcgugcugugaagggaccucaagcaagcuccgaaguugagac

SEQ ID NO: 61120 - RNA, 46 nt, Mus musculus
uuuuucuguacuaagacaacugugguuuuucuccaccuugccauug

SEQ ID NO: 61121 - RNA, 45 nt, Mus musculus
uuaaacguauuguguuaugguauuaacaaauauaaaauguuagaa

SEQ ID NO: 61122 - RNA, 33 nt, Mus musculus
acagggaauuuacaauggaucuucauaccaaga

SEQ ID NO: 61123 - RNA, 47 nt, Mus musculus
auuaugaaauggccucucgccugcggcguucccaguacugaccucau

SEQ ID NO: 61124 - RNA, 42 nt, Mus musculus
guggaugcuuccugagccaguccgaagaacauacuuagagcc

SEQ ID NO: 61125 - RNA, 46 nt, Mus musculus
cucaucagucuggcugagcuggcuguguuuauuuauuaugcggugu

SEQ ID NO: 61126 - RNA, 42 nt, Mus musculus
aucagggcaagaguuacuaacagaaaccccagaucugugcgu

SEQ ID NO: 61127 - RNA, 45 nt, Mus musculus
uugguuaaguugugcuugagauccgaaaauaauuuggcauaccca

SEQ ID NO: 61128 - RNA, 46 nt, Mus musculus
gcauguaauguguuguguguacagugugguauguggcaggugugua

SEQ ID NO: 61129 - RNA, 46 nt, Mus musculus
auguguaauguguuguguguacagugugguauguggcaggugugug

SEQ ID NO: 61130 - RNA, 41 nt, Mus musculus
guacauguaaaagugucuucaacaucuagagcaggagggag

SEQ ID NO: 61131 - RNA, 45 nt, Mus musculus
auuggcaaaccucugucuccaaaaauauuuacauuaugauucaua

SEQ ID NO: 61132 - RNA, 46 nt, Mus musculus
aagcauuaggaagguugagaaccacugacuuagucuagugcuguag

SEQ ID NO: 61133 - RNA, 42 nt, Mus musculus
uaacuuaaacagugaucucugguuucaaaaagauaccccauc

SEQ ID NO: 61134 - RNA, 45 nt, Mus musculus
gcuuuuuauaucauucauucuaagcucaaguaugcuuugguggca

SEQ ID NO: 61135 - RNA, 45 nt, Mus musculus
uuuguauccuuugcuuaugagagaacaagucucacucacucacuc

SEQ ID NO: 61136 - RNA, 45 nt, Mus musculus
cuuugaaaaguuccgaacuccuuuauauauauggcucccuggauu

SEQ ID NO: 61137 - RNA, 83 nt, Mus musculus
ugugcucuuuauguuaugaauaaauugaaauuuugauagcuugcuagaagagauggaaaaauauucuaaucuguaaaaggaag

SEQ ID NO: 61138 - RNA, 42 nt, Mus musculus
guugccagagaguuagcaggguggaguggaacuuggugucag

SEQ ID NO: 61139 - RNA, 77 nt, Mus musculus
ucagcccgagucaggccuccucuggccugcugugacccccuucucccagcauagaggacuccccuggcaucauccca

SEQ ID NO: 61140 - RNA, 45 nt, Mus musculus
acaaagcucgaaguucaucucccucauagccucccucccccaaag

SEQ ID NO: 61141 - RNA, 54 nt, Mus musculus
cucuucucuugcucgucucggguggucgugcccucucuguaccugcucauucac

SEQ ID NO: 61142 - RNA, 62 nt, Mus musculus
cucuccccacccgugccugcugugcucucugucaugccacugucuauggagaacugccacaa

SEQ ID NO: 61143 - RNA, 46 nt, Mus musculus
ccugcccugcaggaagugguacugugugugccuccaugggcuggau

SEQ ID NO: 61144 - RNA, 52 nt, Mus musculus
guuugugaguugcucauuccauugaggagagcagcauagguaagaugaagag

SEQ ID NO: 61145 - RNA, 46 nt, Mus musculus
uucucuuacuuuauuauauaaaguugcaagccuucacucuguccag

SEQ ID NO: 61146 - RNA, 45 nt, Mus musculus
ggcuaguuuugugucaacuuaacacacaaaugaguuaucagaaag

SEQ ID NO: 61147 - RNA, 97 nt, Mus musculus
ggauauagacaugugccugguccugcaggauguaagcaaugggggucucagggaagggagcaacaaugacaaauuugggaucaggagacuggaagga

SEQ ID NO: 61148 - RNA, 42 nt, Mus musculus
cuccagauucaaaugggaacaguagaacauauaacauugcaa

SEQ ID NO: 61149 - RNA, 46 nt, Mus musculus
uuuuggcaauuucgcuuucaauaaaaauuccauaaacauucgacag

SEQ ID NO: 61150 - RNA, 45 nt, Mus musculus
uacccacccauguaauucuaaaagaaauuaaaaugcauacuugag

SEQ ID NO: 61151 - RNA, 25 nt, Mus musculus
uggcuguguuuauccugccugggcu

SEQ ID NO: 61152 - RNA, 46 nt, Mus musculus
ucaguguuuaggguuacauuuaaacauaguugguuugggaaaauga

SEQ ID NO: 61153 - RNA, 49 nt, Mus musculus
augcauaacugaauuuauuugcaauucucaguuugauuugagguaacag

SEQ ID NO: 61154 - RNA, 46 nt, Mus musculus
uucuccuuugucugaguauagaaguuuuaagauguaucauggguau

SEQ ID NO: 61155 - RNA, 45 nt, Mus musculus
aaugauuguguugcuuuuaugauugaaagaagcacuccacaaauu

SEQ ID NO: 61156 - RNA, 46 nt, Mus musculus
uuuauagccucugaaaaaugagaaaaaaauugugaacaggacagau

SEQ ID NO: 61157 - RNA, 46 nt, Mus musculus
ucgagacugaacaggcucuuucuauuauaucauuagcucaugagau

SEQ ID NO: 61158 - RNA, 45 nt, Mus musculus
uauuuuuauuacuuuuuaaaaugauuuaugugucaugcccacaga

SEQ ID NO: 61159 - RNA, 46 nt, Mus musculus
gccugaacucaacagagauccaccugccuuugcuuccugggugccg

SEQ ID NO: 61160 - RNA, 46 nt, Mus musculus
ucagcccugaaagaagccaaagaaaaugcaucucgagaccguaaac

SEQ ID NO: 61161 - RNA, 35 nt, Mus musculus
uaggguuaugcaagacagacgagaacaagcaagac

SEQ ID NO: 61162 - RNA, 46 nt, Mus musculus
caaggcucuugaguugaagucccagcucugcagugaggguggggag

SEQ ID NO: 61163 - RNA, 42 nt, Mus musculus
uuugguuuuugcuuuuguuucucccuucccuugcccccauua

SEQ ID NO: 61164 - RNA, 50 nt, Mus musculus
ggagcaggaacggcuaaggguggagcaugagaggcugaaggcuacagacc

SEQ ID NO: 61165 - RNA, 46 nt, Mus musculus
agcucaagcccaauauagcacacacacuuggaauucuaggcugagg

SEQ ID NO: 61166 - RNA, 45 nt, Mus musculus
guuuaaaaaaaauaaagaauguaagugauagcaaauuuugggaga

SEQ ID NO: 61167 - RNA, 59 nt, Mus musculus
uugagcagcagauccagagucacagagaaacccaccaaaaacaaaucaguaguuugcga

SEQ ID NO: 61168 - RNA, 46 nt, Mus musculus
auccaccucaguguggcuuugaaauauuuuuuaaaauuaaggaguu

SEQ ID NO: 61169 - RNA, 46 nt, Mus musculus
aaaagcaugaagccaaaaucaagucacugacugaguaccuucagaa

SEQ ID NO: 61170 - RNA, 28 nt, Mus musculus
gcagaacugcagggacuaauaaaugugu

SEQ ID NO: 61171 - RNA, 90 nt, Mus musculus
gaaguaaagaccauggugaaacgcugcaaacagcuagaaagcacacagacugagagcaacaaaaaaauggaagaaaaugagaaagaguua

SEQ ID NO: 61172 - RNA, 46 nt, Mus musculus
uacugugacuucuaugacuucaguuauauuuucuagcuugggaaaa

SEQ ID NO: 61173 - RNA, 58 nt, Mus musculus
agugugggagaggggacuuccgccaaaucuaaggaacugauuauaaaucuggaauuca

SEQ ID NO: 61174 - RNA, 24 nt, Mus musculus
aggaauugcuguggggaauaacga

SEQ ID NO: 61175 - RNA, 45 nt, Mus musculus
augacuaaguagucuaucuguucuguuuucauucuaucaggcaac

SEQ ID NO: 61176 - RNA, 45 nt, Mus musculus
acacccaggucucacuuucucuugucuuuauauacaaagccuagg

SEQ ID NO: 61177 - RNA, 45 nt, Mus musculus
cucaggaaguugaagacaaaacaaaggaauaugaauugcuuagug

SEQ ID NO: 61178 - RNA, 57 nt, Mus musculus
cuucuggcaucaaccagaagggaucaagauaauaugcaagcugaacugaaucgccuc

SEQ ID NO: 61179 - RNA, 44 nt, Mus musculus
aacaaagccaauugguagagaaauugaagacacaaaugcuggau

SEQ ID NO: 61180 - RNA, 45 nt, Mus musculus
aagaagaacuugcuaaauuguauaaacaacuugaugacaagguag

SEQ ID NO: 61181 - RNA, 46 nt, Mus musculus
gagacagugccuauugaugagcaguuugacaaagagaaagcuaauu

SEQ ID NO: 61182 - RNA, 46 nt, Mus musculus
uauacauuuacauauacuuauauguaaaauguagaugggaguagau

SEQ ID NO: 61183 - RNA, 46 nt, Mus musculus
uaagaacacagucugugucaauguagaguuaacugcggagcagugg

SEQ ID NO: 61184 - RNA, 46 nt, Mus musculus
agaacguuucguguguaguccagaugaagucauggauaccauagau

SEQ ID NO: 61185 - RNA, 44 nt, Mus musculus
augauccagaaggcaugggaauuauuccaagaauagugcaagau

SEQ ID NO: 61186 - RNA, 45 nt, Mus musculus
ccacuuaauaaaugaacuaaccagaaaugaaugauacuccaaaua

SEQ ID NO: 61187 - RNA, 46 nt, Mus musculus
auagaacauauucuuucugcauucuacauugaaaauguuggcagug

SEQ ID NO: 61188 - RNA, 46 nt, Mus musculus
guuacuuuacccauugagccaucucccuacucccccacccccacau

SEQ ID NO: 61189 - RNA, 45 nt, Mus musculus
ccugcacuccuuaccggguuucaacuccacuauuaguccccaaau

SEQ ID NO: 61190 - RNA, 83 nt, Mus musculus
gaugagugaaaacauuuuagccugaagauaguacugaaguucucuagaggguguguuaaugugaagguuuucaaaguugaguu

SEQ ID NO: 61191 - RNA, 46 nt, Mus musculus
auuuaguauauuguuugagcuacuuaauuuagaaauagggcagaga

SEQ ID NO: 61192 - RNA, 99 nt, Mus musculus
auuagauucauguuaauacagucuaucuugacagaaauugauuaugguaaucugagaggaagcaauacuccuuuguaguggaaaauguaacugagcuga

SEQ ID NO: 61193 - RNA, 137 nt, Mus musculus
uggauuuagauugggccaaauaagugucagaaagaucuagaauuucauucuuuaccguguuuuaacauuguaggaaagauagcuauagccgagacauaguguuguaaagaccuuacaauggggcuugaaucaccauu

SEQ ID NO: 61194 - RNA, 82 nt, Mus musculus
cauguaauaagugggaaauuggagccuguaaaaagaacuaguggcuuuucuuugaaauuagaguucucucuaaugucauaag

SEQ ID NO: 61195 - RNA, 45 nt, Mus musculus
ucuggacacucccccaccuggggcucuggaggcugcaucccagga

SEQ ID NO: 61196 - RNA, 55 nt, Mus musculus
guuugcggguucagacgaccagggaggaaggagcaguguucaggagacuccgcga

SEQ ID NO: 61197 - RNA, 45 nt, Mus musculus
uccucgcgaccccugccucuuggcuccccucgcuuaccccaagac

SEQ ID NO: 61198 - RNA, 44 nt, Mus musculus
augaacuugcccaucucgacagcaggcagccggcacccagcaga

SEQ ID NO: 61199 - RNA, 42 nt, Mus musculus
ucgacuuucuguucccugcgcccaggcaggucacgggcagcc

SEQ ID NO: 61200 - RNA, 55 nt, Mus musculus
agcugguuaaugaauggucacugaagaucagaaaggaaaugagaguuguugauag

SEQ ID NO: 61201 - RNA, 45 nt, Mus musculus
gccaagaagggccaaaaggaagucugugugguucuggccaaggag

SEQ ID NO: 61202 - RNA, 25 nt, Mus musculus
cugagaguagcugguucucugcaga

SEQ ID NO: 61203 - RNA, 42 nt, Mus musculus
uuucaucaucucuuuggacagcucccgcaugguggccuggau

SEQ ID NO: 61204 - RNA, 46 nt, Mus musculus
aauccucuuugaaaucacagcaggaaccuugggcaaagcacccagu

SEQ ID NO: 61205 - RNA, 42 nt, Mus musculus
ugucaacuguacccgccucuguugugaaacuugcccgcugaa

SEQ ID NO: 61206 - RNA, 45 nt, Mus musculus
uguguguggcaaauauauguuuguuuaauucuguaucucuuaugc

SEQ ID NO: 61207 - RNA, 30 nt, Mus musculus
gacgaccguguucucuuguacccugggaga

SEQ ID NO: 61208 - RNA, 31 nt, Mus musculus
acggugcccugauccagcaccagcaauggga

SEQ ID NO: 61209 - RNA, 48 nt, Mus musculus
ggacaggaguuagcugccagagugaauaugcucaauucagugagcggu

SEQ ID NO: 61210 - RNA, 46 nt, Mus musculus
cugugucugcuauuugaacucaugcaguuuuugccuuccaccugau

SEQ ID NO: 61211 - RNA, 42 nt, Mus musculus
gaaaaggucaaugaucucagacuccuuaaugggcagggagaa

SEQ ID NO: 61212 - RNA, 45 nt, Mus musculus
aaggaaaaaagacaccgucaauaagacaaaaagaccaccaacaga

SEQ ID NO: 61213 - RNA, 45 nt, Mus musculus
aagcugagccaucaaagccagccauccugucauggggggugacca

SEQ ID NO: 61214 - RNA, 46 nt, Mus musculus
acugccauuaagagaaggauuugggggcccagccccacccccagcc

SEQ ID NO: 61215 - RNA, 41 nt, Mus musculus
cccacaaaacagaggucccacaaguuagagaauaugggaaa

SEQ ID NO: 61216 - RNA, 45 nt, Mus musculus
ucucuccauagcccuggcuguccuggaacucacucuguuguagau

SEQ ID NO: 61217 - RNA, 42 nt, Mus musculus
caugggaggagcaggcuugagaaauguauacagaccccuugg

SEQ ID NO: 61218 - RNA, 31 nt, Mus musculus
cuguccucagagcucagccugauuccagaag

SEQ ID NO: 61219 - RNA, 46 nt, Mus musculus
uuaaggcccucucuccccuucuuggcccuucccacccaggguagau

SEQ ID NO: 61220 - RNA, 42 nt, Mus musculus
ccccucagcucuaugcguagaaagaaaacuccagccuauaau

SEQ ID NO: 61221 - RNA, 46 nt, Mus musculus
aaacucuucuauugagugcaguaaaaggguuagagguagcuaucaa

SEQ ID NO: 61222 - RNA, 46 nt, Mus musculus
gguuuugauuccucagagcagagaguauaguuuguaaccaccaugg

SEQ ID NO: 61223 - RNA, 47 nt, Mus musculus
uucuuucauggaggaaacagacucuaauccuggagaaggaaaugaag

SEQ ID NO: 61224 - RNA, 45 nt, Mus musculus
aggcugccuucagcccgccuccacacuuggugggugcacgcagag

SEQ ID NO: 61225 - RNA, 42 nt, Mus musculus
ugccaagguggucuccagccaucaucuccuaacuggggcacu

SEQ ID NO: 61226 - RNA, 45 nt, Mus musculus
ccaucucucgucucugugaggacaaguacaaggaccugaggaaac

SEQ ID NO: 61227 - RNA, 46 nt, Mus musculus
gaauucucuuuguugagucugugugugguuagguaucagggcgaau

SEQ ID NO: 61228 - RNA, 46 nt, Mus musculus
aucaggaucagauaaaccauuuaaacaaccccauaaaccccaaaga

SEQ ID NO: 61229 - RNA, 46 nt, Mus musculus
ugauagaaauagagacauugauagcaguucuauugagggcuuagaa

SEQ ID NO: 61230 - RNA, 45 nt, Mus musculus
uguccucacaaauggacaagauugagccauagacacacagagaga

SEQ ID NO: 61231 - RNA, 46 nt, Mus musculus
gauuauuuugaugagcauacacuaaauauauguucuuuugugagau

SEQ ID NO: 61232 - RNA, 46 nt, Mus musculus
aggugugggaugaccaagcuguguggaauguggauuacugccagau

SEQ ID NO: 61233 - RNA, 46 nt, Mus musculus
ccuguuuguuuuguuuauguguuuguuuaucuguuuguuuucuaau

SEQ ID NO: 61234 - RNA, 41 nt, Mus musculus
augcaaauaauauauauuuuaauauagauugguggguuuaa

SEQ ID NO: 61235 - RNA, 67 nt, Mus musculus
cuguuuccuaacaggaauuuguccuacaaaacaaaaaaugagcagcaggguugauaguuucuggaaa

SEQ ID NO: 61236 - RNA, 61 nt, Mus musculus
uguuuagauaauccuuacugauccagaaugaccguagguuccaagaugaagcgcaugcacg

SEQ ID NO: 61237 - RNA, 42 nt, Mus musculus
uggugcuauaucuccccacacuacacuuuaauggccuggggu

SEQ ID NO: 61238 - RNA, 46 nt, Mus musculus
caagacagcuguccacuaguggucuccauaccaaccccuagccuga

SEQ ID NO: 61239 - RNA, 41 nt, Mus musculus
ugcagagcacugaggauagaaucuuuccauuuugaccacau

SEQ ID NO: 61240 - RNA, 46 nt, Mus musculus
cauuuauuugcuaauuuaauugaacaucaaaacuguugcuucagau

SEQ ID NO: 61241 - RNA, 45 nt, Mus musculus
ugugugcacucagaugcacacacacgaugagacaugccggaaaca

SEQ ID NO: 61242 - RNA, 42 nt, Mus musculus
aagaaaaggcggggaggggggcaggggaaugugggccugaaa

SEQ ID NO: 61243 - RNA, 42 nt, Mus musculus
gaugugugugugugugugugagagagagagagagauuuagug

SEQ ID NO: 61244 - RNA, 41 nt, Mus musculus
uggccaggagccucagguccuugucuuaaaauggacuuaga

SEQ ID NO: 61245 - RNA, 45 nt, Mus musculus
ugcuccaccaucuuccuagaugacagcacagucagccagccaaac

SEQ ID NO: 61246 - RNA, 46 nt, Mus musculus
cugggucuacgggcgagaaaaacauaucccccuuuuuaaccgagga

SEQ ID NO: 61247 - RNA, 45 nt, Mus musculus
auuccaguccuccggggugaggcaauaucuagcaagccccucgac

SEQ ID NO: 61248 - RNA, 46 nt, Mus musculus
guuaauguaccuucuguuucuuuuuuguggaauaguuugaggagaa

SEQ ID NO: 61249 - RNA, 40 nt, Mus musculus
uuaggucauucucagccauuugguauuccucaguugagaa

SEQ ID NO: 61250 - RNA, 82 nt, Mus musculus
cauagcuacuauggguauaauaacaggaaguucugggggccaaaccaaagggacagaaaauaccuucaagguacaugugugc

SEQ ID NO: 61251 - RNA, 41 nt, Mus musculus
ugaacaaacauauacaugaaucuaugccuaaauggggaaaa

SEQ ID NO: 61252 - RNA, 46 nt, Mus musculus
gggauuaaagugucaacccuucucaagauuucuuacguaggaagaa

SEQ ID NO: 61253 - RNA, 46 nt, Mus musculus
ccuccugcuauugaacaacugaggcauaaagaaacauguagcagau

SEQ ID NO: 61254 - RNA, 55 nt, Mus musculus
auuaaccauguaaguaaaacugccuccccauuuuuuauaaugauuguauaguaga

SEQ ID NO: 61255 - RNA, 46 nt, Mus musculus
uggugauaguuggcuguguuucugaagaaauccucuggcccuaggu

SEQ ID NO: 61256 - RNA, 62 nt, Mus musculus
cauggaauucaauccuucagaccauccucgggccagcacaauauuccucagcaaaucucaga

SEQ ID NO: 61257 - RNA, 41 nt, Mus musculus
uagacuacuaaguuacugagcuaaguagagaagccccugau

SEQ ID NO: 61258 - RNA, 23 nt, Mus musculus
ugaaugcaaaccuugcccaucug

SEQ ID NO: 61259 - RNA, 44 nt, Mus musculus
ggucauaacuauaaaccuuguucaccacugugugugcaucugau

SEQ ID NO: 61260 - RNA, 45 nt, Mus musculus
cagaggcuucagacucugaaguuuaaaggcagcuggagcagcaga

SEQ ID NO: 61261 - RNA, 45 nt, Mus musculus
auugcuccugucuaaaggaaauacauggacaaauaauggagcaga

SEQ ID NO: 61262 - RNA, 45 nt, Mus musculus
aagcauccacagugagugagugacuuagugacugagugaauagaa

SEQ ID NO: 61263 - RNA, 45 nt, Mus musculus
ucuggaugugugugugugugugugugugugagagagagagagaga

SEQ ID NO: 61264 - RNA, 46 nt, Mus musculus
cagauuuguuuugccccagauaccauuuuccaauggggggaaaaag

SEQ ID NO: 61265 - RNA, 45 nt, Mus musculus
gugauuucccugccccacaggaauuuuucagacuuaguguuugga

SEQ ID NO: 61266 - RNA, 46 nt, Mus musculus
caacuugggaggaagggagggaucugggagggaaaguggcggggga

SEQ ID NO: 61267 - RNA, 46 nt, Mus musculus
guaaguaagcacuuacggcugacaaggcaguuaacagucaaacagg

SEQ ID NO: 61268 - RNA, 73 nt, Mus musculus
aggacaauuaaugaagaagauggccauaaauuugaaagagaucaagaacagguauaugggagaguuuggagug

SEQ ID NO: 61269 - RNA, 45 nt, Mus musculus
cagagggaggaauugcugugccaguaguaguuguguugaggaauu

SEQ ID NO: 61270 - RNA, 46 nt, Mus musculus
aggagguagaaacucgggaccagagucuaucuagauauaaauaugu

SEQ ID NO: 61271 - RNA, 45 nt, Mus musculus
uagucuaacaguuauagagaugaauaagaggauaauaauaggaga

SEQ ID NO: 61272 - RNA, 46 nt, Mus musculus
ugaagucauucagaggucaagaaaauaagacuucuuaccacugaua

SEQ ID NO: 61273 - RNA, 41 nt, Mus musculus
gaggacacuggcugcaaucugcagcacaucagcgaccggga

SEQ ID NO: 61274 - RNA, 46 nt, Mus musculus
ggaacacaacuucgugcugcgugucguccagccccaagcuccggag

SEQ ID NO: 61275 - RNA, 45 nt, Mus musculus
aucaauacuguuuauuuuauuuuauuaccaaauuacccccagaua

SEQ ID NO: 61276 - RNA, 44 nt, Mus musculus
ucucaacgccccgagggguuugggguucccucggcggcuggggu

SEQ ID NO: 61277 - RNA, 46 nt, Mus musculus
ugagagaacauaaggaacuccgccaacccugugaggcauuggggau

SEQ ID NO: 61278 - RNA, 46 nt, Mus musculus
caacuagguuuguuuucuuuuugucuguaugucaaaguuguucugu

SEQ ID NO: 61279 - RNA, 52 nt, Mus musculus
aggugucuaugucuaugugugucugggagagauguaugugugucuggguauc

SEQ ID NO: 61280 - RNA, 45 nt, Mus musculus
uccucaucugggauucuuccuagaagcuuggauucaguuuugaau

SEQ ID NO: 61281 - RNA, 42 nt, Mus musculus
aagucaucaucugcucucagccuuacuuuguucaucugugaa

SEQ ID NO: 61282 - RNA, 45 nt, Mus musculus
guuaguuuguuaguggaguucuggagugaaaaugaaugcagacaa

SEQ ID NO: 61283 - RNA, 46 nt, Mus musculus
uguugggcucccugccuguuaacagaggcaggagcuagcaugggag

SEQ ID NO: 61284 - RNA, 24 nt, Mus musculus
ugugugugugugucucggugggua

SEQ ID NO: 61285 - RNA, 26 nt, Mus musculus
guuguuguuguugcugauuuguuuaa

SEQ ID NO: 61286 - RNA, 45 nt, Mus musculus
ugauuccagcauauaacccugaguauacaaaaggggggagaggga

SEQ ID NO: 61287 - RNA, 30 nt, Mus musculus
gugagggaagaagagaagagggagaggcag

SEQ ID NO: 61288 - RNA, 42 nt, Mus musculus
auaacucauggggggagaggggaauggagagaaaaggggcag

SEQ ID NO: 61289 - RNA, 46 nt, Mus musculus
acacagagaacaaagggauaaccaggucuuaggcacaacugaguag

SEQ ID NO: 61290 - RNA, 42 nt, Mus musculus
ucuaugugucucucuccgugugugugugugugugugugugug

SEQ ID NO: 61291 - RNA, 45 nt, Mus musculus
cuauaugauaagaucuaguugcuccagggaagcaggcuucuucug

SEQ ID NO: 61292 - RNA, 38 nt, Mus musculus
uuuucuauugaagaccacccuuaauuuguagugaucug

SEQ ID NO: 61293 - RNA, 43 nt, Mus musculus
ccaucuguaacaagaucugacucccucuucuggagugccugaa

SEQ ID NO: 61294 - RNA, 45 nt, Mus musculus
gugacaaauauucagcuagggaguggugugggguauuccuuuaga

SEQ ID NO: 61295 - RNA, 42 nt, Mus musculus
ccagucagaauggcuaagaucaaaaauucaggugacaggcgu

SEQ ID NO: 61296 - RNA, 44 nt, Mus musculus
ggguuggaaagcaggaggagcggggagggaauagaggauuuuug

SEQ ID NO: 61297 - RNA, 46 nt, Mus musculus
uggcucacaaccaccuguaaugagaucugacacccucuucugauac

SEQ ID NO: 61298 - RNA, 46 nt, Mus musculus
acaggcacaaagguagauaggagacuuugaaaucucugcaccugag

SEQ ID NO: 61299 - RNA, 44 nt, Mus musculus
uuuuaguuuaacuaccugugcagguuggauaauaguacauauuu

SEQ ID NO: 61300 - RNA, 24 nt, Mus musculus
ugaagggaaauuaaggagcagaga

SEQ ID NO: 61301 - RNA, 46 nt, Mus musculus
auucaggaggggacacaguguaccaaauguaaaaauaacugggcac

SEQ ID NO: 61302 - RNA, 46 nt, Mus musculus
gaagaaggagaaggagaaggagaaggagaaggagaagaagaaaaag

SEQ ID NO: 61303 - RNA, 41 nt, Mus musculus
auacauccuccacucuagacucauuagucagugagccuaca

SEQ ID NO: 61304 - RNA, 42 nt, Mus musculus
gauguagguggauauguauacauguguguaguaucaauggag

SEQ ID NO: 61305 - RNA, 46 nt, Mus musculus
caucucaccagacuuaugacaacaaacucacugcuguggaaaguga

SEQ ID NO: 61306 - RNA, 85 nt, Mus musculus
gaucuccgucaacaacuucaggagaucacagaaaaaaccagcaagaacaaagauacgcuggagaaguugcaagcaaauggggacu

SEQ ID NO: 61307 - RNA, 46 nt, Mus musculus
aaugacacccuagaggauaugaauagccagcucagcucauucacag

SEQ ID NO: 61308 - RNA, 50 nt, Mus musculus
ugaacaucauuagcaacaucagcuacacagcccaucaccugaggacacug

SEQ ID NO: 61309 - RNA, 84 nt, Mus musculus
uccgcuuggauucuauuucucucaggaugcagcaagacaugaugaggucaaaguuagacacugaaguggccaacuuaucagugg

SEQ ID NO: 61310 - RNA, 46 nt, Mus musculus
gacuccaagcacggucagcucaucaagaacuuuaccauucuacaag

SEQ ID NO: 61311 - RNA, 70 nt, Mus musculus
cuauguguguguguguaucugucuguauaugucuauguggguguuugugugugucugugugugcguccgu

SEQ ID NO: 61312 - RNA, 42 nt, Mus musculus
gagcaucuucuggacauaugccccagagagguaucgcuggag

SEQ ID NO: 61313 - RNA, 45 nt, Mus musculus
guaaucccagcauccucauuaagaugcagaaaacagggcgagcaa

SEQ ID NO: 61314 - RNA, 48 nt, Mus musculus
gaggaucucagggaccaccugguccaacuggcaacaagggacagaaag

SEQ ID NO: 61315 - RNA, 43 nt, Mus musculus
agcaauggagccauuggcucugcagaaugaaccaaccccagca

SEQ ID NO: 61316 - RNA, 46 nt, Mus musculus
ucugugaagacaaaucuucccaucucguuuucauaaacucaagaga

SEQ ID NO: 61317 - RNA, 43 nt, Mus musculus
gguccugugaaaguucuaugccccaguauaggggaaugccugg

SEQ ID NO: 61318 - RNA, 46 nt, Mus musculus
aacucccaagaaucaaaccaauucuagaaaaaguuagaggggggag

SEQ ID NO: 61319 - RNA, 48 nt, Mus musculus
aagcauaccguggggagagaaagccauuggaucggccucacagacuca

SEQ ID NO: 61320 - RNA, 42 nt, Mus musculus
auagagagacaugucuuuaaaaagaauaagaaaagggaggag

SEQ ID NO: 61321 - RNA, 54 nt, Mus musculus
ccagauaacuggggcaguggccaugggccaggagaagacugugcuggcuugauu

SEQ ID NO: 61322 - RNA, 47 nt, Mus musculus
ggaaugacuuccagugugaugaaaucaauaacuucauuugugagaag

SEQ ID NO: 61323 - RNA, 46 nt, Mus musculus
ggcuuggcaggaaacugguuccacaccuaccauuuucaauucugag

SEQ ID NO: 61324 - RNA, 42 nt, Mus musculus
caguaccaucauccauauuauaacagcaugauauaauagcag

SEQ ID NO: 61325 - RNA, 45 nt, Mus musculus
uaguuauucaaaauaaauggacaccuacugcacaauaacccaagg

SEQ ID NO: 61326 - RNA, 46 nt, Mus musculus
ucucagccauuaaccauagaauuuaugcaaaguauaucuuuccaaa

SEQ ID NO: 61327 - RNA, 46 nt, Mus musculus
aaucauuuuccuuuuuuuaauguaccuauaugauacauaaagccaa

SEQ ID NO: 61328 - RNA, 45 nt, Mus musculus
caaauguacacuggauauacuuauaccugucucacagagucauug

SEQ ID NO: 61329 - RNA, 46 nt, Mus musculus
agacaggcugacaagcaugucuugaaucccacuagggacauuccac

SEQ ID NO: 61330 - RNA, 45 nt, Mus musculus
uacaguuuguuuguuuucaaguguuuuaaucauauaucaguacuu

SEQ ID NO: 61331 - RNA, 46 nt, Mus musculus
gucuacaaauagaaauaaaguuugccagaaauagagaagaagauag

SEQ ID NO: 61332 - RNA, 46 nt, Mus musculus
aagacuaaguacauugggguagacugcuagcagaaaaacuaggcag

SEQ ID NO: 61333 - RNA, 46 nt, Mus musculus
ugugaaagaauuauauauuauguaauaauaagaaucaaauguagag

SEQ ID NO: 61334 - RNA, 46 nt, Mus musculus
uuugcauacacacauacauagauguauguauaguacacauacauag

SEQ ID NO: 61335 - RNA, 46 nt, Mus musculus
ucuucugucuuauucauuucugaacauuguuagaucuccucagaag

SEQ ID NO: 61336 - RNA, 46 nt, Mus musculus
agagaauguaggggaagaacucaaggcaggaaccuaaacguaggag

SEQ ID NO: 61337 - RNA, 43 nt, Mus musculus
caaauaugagauauaccguuggggagauugccaggccagcaga

SEQ ID NO: 61338 - RNA, 46 nt, Mus musculus
uugaucacuacuucccuuuccuauuccaggaucuugaugugcccua

SEQ ID NO: 61339 - RNA, 49 nt, Mus musculus
ucuuuuccucuuaagcuuugucugcuaauauccaucaguggaucuugcc

SEQ ID NO: 61340 - RNA, 99 nt, Mus musculus
ggcaucauggcaauuuucuuacuuuuucuauguuuauuaauggugauccuuccauaaggggaaaguugucuucuugcuggcauguuaguuuaguuaccu

SEQ ID NO: 61341 - RNA, 48 nt, Mus musculus
ugaaaugucccuagaaauggaacaagguaaaggucaccuaccccagaa

SEQ ID NO: 61342 - RNA, 59 nt, Mus musculus
caugcuagcucauuugguugucucucuguccugguaauggagaccucaacaugcuggac

SEQ ID NO: 61343 - RNA, 65 nt, Mus musculus
ucagaaugguaguuaaagcuaaucuggacccuaaauaaaagccaggaucugaaucuacgauacac

SEQ ID NO: 61344 - RNA, 53 nt, Mus musculus
uuauugugagacgcucggcaggcagaacaaagaaagcuaaauaauuuggccuu

SEQ ID NO: 61345 - RNA, 42 nt, Mus musculus
auagagaggaagggauggauguagaagaaggugaaaugggag

SEQ ID NO: 61346 - RNA, 47 nt, Mus musculus
acccuuuaaugagauaucaaauacugaaacgaagauacagacaggag

SEQ ID NO: 61347 - RNA, 46 nt, Mus musculus
gccuucuaaauuauggacaaauacuuugaacuguuugagcagccca

SEQ ID NO: 61348 - RNA, 46 nt, Mus musculus
ucaguacauuaugucaguacacucaccaugaguaccaggaccauag

SEQ ID NO: 61349 - RNA, 64 nt, Mus musculus
uugcuucagacauggaagaguacuauucugacagcccaggaagauuuugguuuucugguccccc

SEQ ID NO: 61350 - RNA, 46 nt, Mus musculus
cauacugucaguuguaaaugaaagaauuucuauaauugcugcccag

SEQ ID NO: 61351 - RNA, 42 nt, Mus musculus
gauaacucauuaucuuagaaccuacuacuuuugcccagaguu

SEQ ID NO: 61352 - RNA, 46 nt, Mus musculus
ggcacuuggcuaucuuugucuauuguaaauuauuuuaugaauggag

SEQ ID NO: 61353 - RNA, 45 nt, Mus musculus
gucuacugguacaggccuauaauucuagcugcuuaggaggcugag

SEQ ID NO: 61354 - RNA, 41 nt, Mus musculus
agcaccacagauaauaaaugaaacugauucuguaaagccag

SEQ ID NO: 61355 - RNA, 46 nt, Mus musculus
aaagcauuaacuuaguugggucagaugcacaaagaagacaugaagg

SEQ ID NO: 61356 - RNA, 46 nt, Mus musculus
uuuuaaaaguuauaaauuagaugauacucaagccuccaggaaaaag

SEQ ID NO: 61357 - RNA, 46 nt, Mus musculus
agaaauaaauaucuucauagaucagaaaaaaacaaauuaugcccag

SEQ ID NO: 61358 - RNA, 46 nt, Mus musculus
aaacacucuaauuaaaacuccaaaguuuaggggacucaaguuaaag

SEQ ID NO: 61359 - RNA, 46 nt, Mus musculus
auaauuaugauggagcuaugugaagcggcuggguuagggauaaaag

SEQ ID NO: 61360 - RNA, 46 nt, Mus musculus
gaauuguugagcagcuaaguauaugauucuggagguuuggaacaag

SEQ ID NO: 61361 - RNA, 51 nt, Mus musculus
uuuuuaaguggcaaauaauguauacaauauaugagaucagcuggaaagugu

SEQ ID NO: 61362 - RNA, 53 nt, Mus musculus
guggaggcacuaagaaaggaguggggggauguagaagauugagaaagcaggaa

SEQ ID NO: 61363 - RNA, 45 nt, Mus musculus
ucuuucagggaggcuauuuaauaucaacaaaauagaacuugggaa

SEQ ID NO: 61364 - RNA, 45 nt, Mus musculus
cucauuuuauuucaauaucucaagggacaggucaaauucaaaagg

SEQ ID NO: 61365 - RNA, 45 nt, Mus musculus
ugguagacugauuuuguaguaucuucaauccagagugauugcuca

SEQ ID NO: 61366 - RNA, 25 nt, Mus musculus
agacuucuuaggcaaagggcccaac

SEQ ID NO: 61367 - RNA, 46 nt, Mus musculus
gaaccugaguaugguucccugguuuaaggagagacacugccugcaa

SEQ ID NO: 61368 - RNA, 88 nt, Mus musculus
ggagugcaaagguacauagggagggagggagggaguggggaggaagggaggaaggagagaggggagaaaggaaggaaggaaaagaaga

SEQ ID NO: 61369 - RNA, 46 nt, Mus musculus
augccaacuuuggaggaguucuuugaagaagcuauugaacaagcag

SEQ ID NO: 61370 - RNA, 45 nt, Mus musculus
aaguuacugcaggaauuuagaguaagacagcagguguggaggcag

SEQ ID NO: 61371 - RNA, 46 nt, Mus musculus
ggagaagcccucacuucuuucagccaaccaaccagcaguuuaagag

SEQ ID NO: 61372 - RNA, 46 nt, Mus musculus
cgacagaaaacugauaaugcccaucauuaccauacuguuacaacag

SEQ ID NO: 61373 - RNA, 42 nt, Mus musculus
cuugguaacaaaaucuuaucacuguuuaauaaaaaagaaaag

SEQ ID NO: 61374 - RNA, 46 nt, Mus musculus
uagagugcaguucaagcaagaacacuuaacaguggucugcccaguc

SEQ ID NO: 61375 - RNA, 46 nt, Mus musculus
cacacuugauuauacacuuauuauugugucucuaauguacuguggu

SEQ ID NO: 61376 - RNA, 46 nt, Mus musculus
aaaaugagaacagaaccaagccacuugugcaucuucaaucuuaaga

SEQ ID NO: 61377 - RNA, 46 nt, Mus musculus
gguggagacuggcacauugcuuauguucuacuuuaugggccucgaa

SEQ ID NO: 61378 - RNA, 42 nt, Mus musculus
aucaaauuugaugaugauaaggucagcauuguaaccccagaa

SEQ ID NO: 61379 - RNA, 42 nt, Mus musculus
auuggcuccaauaauuguggcuacuaugacuuacaagcagug

SEQ ID NO: 61380 - RNA, 46 nt, Mus musculus
uucauuagcauuucccauuugucuauggagauuuucauuaacuguu

SEQ ID NO: 61381 - RNA, 46 nt, Mus musculus
uuuuguaauuucaaaaaaguuacuaugugaaauuaagcucccaauu

SEQ ID NO: 61382 - RNA, 42 nt, Mus musculus
cgauuuuuuuauaaagagaaagaaucugugaacgccaaaguu

SEQ ID NO: 61383 - RNA, 45 nt, Mus musculus
aguaacacuagguaccuccccuaguauucaggcaacccaguagga

SEQ ID NO: 61384 - RNA, 46 nt, Mus musculus
uuaauucuucuuagauuuaaaauuaaccuaauugaugcuggcaggc

SEQ ID NO: 61385 - RNA, 46 nt, Mus musculus
uccugcaacagaaacuagaagccauagaggaugauucugguagaga

SEQ ID NO: 61386 - RNA, 46 nt, Mus musculus
uguauauuugucacacaggcccaaguguuucuuuaaacauucagau

SEQ ID NO: 61387 - RNA, 45 nt, Mus musculus
aaguuuauauuaucuuuguguuuauauguaaauguggguacacac

SEQ ID NO: 61388 - RNA, 45 nt, Mus musculus
guugagccaggacucagccuuagguguuacucaucuggagccauu

SEQ ID NO: 61389 - RNA, 45 nt, Mus musculus
uccuggcuuuuaaauuuaaauagccauuuaagguccauuguaaga

SEQ ID NO: 61390 - RNA, 45 nt, Mus musculus
caaugacuuacuuaguuuaucuuagacaaguuaaugcuggaagua

SEQ ID NO: 61391 - RNA, 46 nt, Mus musculus
uagaaaagucauauuuuaccauagugacuuugucaugaguggagau

SEQ ID NO: 61392 - RNA, 46 nt, Mus musculus
aaaaaaaagguuucgucacuauaguuuugaaaguuagaagcgauga

SEQ ID NO: 61393 - RNA, 61 nt, Mus musculus
cgaguuguuuaauuuugugaauaguaugucuacagcacauuaaaaguuauuuuaauguagg

SEQ ID NO: 61394 - RNA, 46 nt, Mus musculus
ggcucacaaccaucccuaaugagaucugacuccuucuucuggagug

SEQ ID NO: 61395 - RNA, 45 nt, Mus musculus
auuuugugugugugugugugugugugugugugugugcggugguug

SEQ ID NO: 61396 - RNA, 42 nt, Mus musculus
gucaguguucuuuaaucuuugagccaucucuccagcccgggu

SEQ ID NO: 61397 - RNA, 46 nt, Mus musculus
uuaauuuuguuugaaaauacauagguguuuagaccaauuaggagag

SEQ ID NO: 61398 - RNA, 46 nt, Mus musculus
accaaaauaaaucucaaggucccuuuuuaaauguguauuuccaguu

SEQ ID NO: 61399 - RNA, 46 nt, Mus musculus
uuugaagguguagaauugaauacugaugaaccuccaaugguguuca

SEQ ID NO: 61400 - RNA, 46 nt, Mus musculus
gccaccguucuuuuaguguuuaaagaucuugacuuugaaugccuca

SEQ ID NO: 61401 - RNA, 42 nt, Mus musculus
accaucauuauuucuagagucuucauucucaagcuggcacuc

SEQ ID NO: 61402 - RNA, 46 nt, Mus musculus
aguuucuugaguagcugaaauuacaggcacaugucacaucucagau

SEQ ID NO: 61403 - RNA, 46 nt, Mus musculus
cacaugcaaccuuucugacuuggcccguauuaucuagcuuucaguu

SEQ ID NO: 61404 - RNA, 33 nt, Mus musculus
cucugcagaauaguuucugucgcugcccuagag

SEQ ID NO: 61405 - RNA, 42 nt, Mus musculus
gaguugcuucguauuccucggcugcccuugucagacccagcc

SEQ ID NO: 61406 - RNA, 46 nt, Mus musculus
cccugugcuuucuguauacucaaauaauauuuauuguuucucagau

SEQ ID NO: 61407 - RNA, 45 nt, Mus musculus
ccuacaucaugcccagacccucaagccucacuagaagggccccug

SEQ ID NO: 61408 - RNA, 45 nt, Mus musculus
uguuuaauugacauuggaauaagauagagguauuacauuacagau

SEQ ID NO: 61409 - RNA, 42 nt, Mus musculus
caaggaaacaaugugcuguacauaaguacacaggaggcagau

SEQ ID NO: 61410 - RNA, 115 nt, Mus musculus
uuaaauucuggcguggauuaucaagggguccuggccugccuggauggcuacaugaauauagcccuggaacagacagaggaguauguaaauggacagcugaagaauaaguacggag

SEQ ID NO: 61411 - RNA, 46 nt, Mus musculus
ugaugggagcaaaguauucacagcaucgugugacaagacagccaag

SEQ ID NO: 61412 - RNA, 41 nt, Mus musculus
cauuggauggcauuugaaggugaaguuaucuuuggccggau

SEQ ID NO: 61413 - RNA, 59 nt, Mus musculus
ugccauucacuacaucaacccuccaaauccggccaaagauaacuucaccuucaaaugcc

SEQ ID NO: 61414 - RNA, 45 nt, Mus musculus
ucucccuucuggcccgacuguucacagaauucaggcuccagagau

SEQ ID NO: 61415 - RNA, 46 nt, Mus musculus
aacagucgggccagaagggagaacugcgucgcuaggaugaagcucg

SEQ ID NO: 61416 - RNA, 26 nt, Mus musculus
gaugaugaagaugagggaagcaggag

SEQ ID NO: 61417 - RNA, 48 nt, Mus musculus
gugagcuauguccuaaucaggaugggauuuucaaggagauggaugcug

SEQ ID NO: 61418 - RNA, 46 nt, Mus musculus
uccuauuguaaaaugucauugcaagagagagagagagagagagaga

SEQ ID NO: 61419 - RNA, 46 nt, Mus musculus
uaaguaaggauaucuuuccaguggacaacucagauacuaguucuag

SEQ ID NO: 61420 - RNA, 45 nt, Mus musculus
gcuggacauggugacucaagccuauagucccagcucugagaaggc

SEQ ID NO: 61421 - RNA, 42 nt, Mus musculus
ggcugcuaaaguuagaugaugaguuucuggcaagugcggagu

SEQ ID NO: 61422 - RNA, 44 nt, Mus musculus
auaggcucauccuugguuucggcguuauagccauugccugcagu

SEQ ID NO: 61423 - RNA, 45 nt, Mus musculus
ucugaucauuauuucccgggguaauucgaaacccggacggauugg

SEQ ID NO: 61424 - RNA, 48 nt, Mus musculus
auguggugacuuuaacaagagucuaacaggcaggcaggcaggcaggca

SEQ ID NO: 61425 - RNA, 25 nt, Mus musculus
cgaucucaguagagcugguccagca

SEQ ID NO: 61426 - RNA, 57 nt, Mus musculus
uauaaaacaaagccaucaaaacaggaaagagacuuguaaggaggaggagcaagacaa

SEQ ID NO: 61427 - RNA, 42 nt, Mus musculus
acaaauccuuaugaacuagacgccaaccacacagccccagau

SEQ ID NO: 61428 - RNA, 46 nt, Mus musculus
caauaaauuaacuuuguacauuuuuauauuaaaaaaaaaaaaagac

SEQ ID NO: 61429 - RNA, 46 nt, Mus musculus
auggaucugaaagcaacaaucgccagccccuacugucguaccagua

SEQ ID NO: 61430 - RNA, 42 nt, Mus musculus
aaauuuuugagauauuuuacuucaggauguacuuagccaugg

SEQ ID NO: 61431 - RNA, 42 nt, Mus musculus
cauucaccaugaguaccaaaggaagccgagugagccgggcgg

SEQ ID NO: 61432 - RNA, 45 nt, Mus musculus
cacaccauacuuaagaccuccgcugacuauacugaugccaugaag

SEQ ID NO: 61433 - RNA, 45 nt, Mus musculus
ucucccacaauguuaacagcugaaccguaagcagcauguccccug

SEQ ID NO: 61434 - RNA, 52 nt, Mus musculus
ggacaugcugcuuacgguucagcuguuaacauugugggagaugacacuuaca

SEQ ID NO: 61435 - RNA, 46 nt, Mus musculus
gucacccauuggccacagggacagggacaggauaucuggcccagaa

SEQ ID NO: 61436 - RNA, 46 nt, Mus musculus
augaaauuccugcccauguuccuuucugauaaccccaaccccaagu

SEQ ID NO: 61437 - RNA, 61 nt, Mus musculus
gaaaucaaagauggguaugugaaaaaugaaacuauuaaagaauuggaagaaaacauaggac

SEQ ID NO: 61438 - RNA, 46 nt, Mus musculus
ccugguccauagagcgaguuuuagguuagccagggauacagagaga

SEQ ID NO: 61439 - RNA, 44 nt, Mus musculus
cacugcuagagaggccagauagcuuuuguucccucgaucccugc

SEQ ID NO: 61440 - RNA, 41 nt, Mus musculus
ccaaauauauacuauuauaauuugauacaugguggggaaug

SEQ ID NO: 61441 - RNA, 32 nt, Mus musculus
ucuggucagccccucacagucaggcccgcuug

SEQ ID NO: 61442 - RNA, 45 nt, Mus musculus
ugacccacuuggugcagcauuugaugacugucugaggcgcauguu

SEQ ID NO: 61443 - RNA, 49 nt, Mus musculus
auugaguacauguucaauaaagacaacggacaagcgccauuuaccauca

SEQ ID NO: 61444 - RNA, 46 nt, Mus musculus
accaacucccaacaaaagaccuauuuaaaaaaugacccagccagau

SEQ ID NO: 61445 - RNA, 26 nt, Mus musculus
ugagggaagaggagaacggaaacaga

SEQ ID NO: 61446 - RNA, 46 nt, Mus musculus
ccugucuugaaaaacaaaacaaaacaaaaaaauagugacagcagag

SEQ ID NO: 61447 - RNA, 45 nt, Mus musculus
agacacaggagaauaaaacaaauguaaaggaauuagaguacuuug

SEQ ID NO: 61448 - RNA, 42 nt, Mus musculus
acuggagauaagagguacaacuguaaauauucuggcccacca

SEQ ID NO: 61449 - RNA, 41 nt, Mus musculus
ggguuuagcuuagugaggaaaugagucuugggaggggcagu

SEQ ID NO: 61450 - RNA, 46 nt, Mus musculus
aagucuggugugugugugugugugugugugugugugagagagagag

SEQ ID NO: 61451 - RNA, 46 nt, Mus musculus
ccaggugugccuugaauucacuccaguccuguuucagcccccuaaa

SEQ ID NO: 61452 - RNA, 45 nt, Mus musculus
ccuggacgcacugggaggggcaggagagcuuaacucggggucaga

SEQ ID NO: 61453 - RNA, 46 nt, Mus musculus
cgacagcuugaaagcaguggagaaauacuggacaccccucggaggg

SEQ ID NO: 61454 - RNA, 45 nt, Mus musculus
accuugcaggagccugugugugccgcucaugcuacagccaggauc

SEQ ID NO: 61455 - RNA, 46 nt, Mus musculus
ucagaagaaacccaaugacaugcucaaaggauuuaacugaggggag

SEQ ID NO: 61456 - RNA, 46 nt, Mus musculus
caucaggcuuagccuggggaaucuuguggaagaguuggggauagaa

SEQ ID NO: 61457 - RNA, 45 nt, Mus musculus
agagauugaaguagccaccuccuguagccaggcaggacauccaga

SEQ ID NO: 61458 - RNA, 46 nt, Mus musculus
gauaauaaggagguaccaaagguagaugugcaaaucucucucagaa

SEQ ID NO: 61459 - RNA, 42 nt, Mus musculus
uuggagggaaauggauggaacuugagaauauuacccugagug

SEQ ID NO: 61460 - RNA, 44 nt, Mus musculus
aaggcaaaagaugcugucaacaggaaaaucagcagccuacagau

SEQ ID NO: 61461 - RNA, 41 nt, Mus musculus
uacaaauuuacuguuguaaauaccuguguuuuccagugguc

SEQ ID NO: 61462 - RNA, 46 nt, Mus musculus
cuacuuccucuucagccauggugcucaggaucugcgacaccagcuc

SEQ ID NO: 61463 - RNA, 46 nt, Mus musculus
ccuuuguguggacagauuguuuguauuggugguucuggggaucaaa

SEQ ID NO: 61464 - RNA, 42 nt, Mus musculus
cuggaauccuagcacuagggagacagaaagaggcaggcagau

SEQ ID NO: 61465 - RNA, 44 nt, Mus musculus
uaaauuuauagcagaacaguuacuuagugaauuuauuaagcucu

SEQ ID NO: 61466 - RNA, 46 nt, Mus musculus
aagagaaagacuccccaagaccuccgucuuccaugcgcccccacuc

SEQ ID NO: 61467 - RNA, 46 nt, Mus musculus
aaagaagcaaaguguacuguugucaacauacuguaaucagaggagg

SEQ ID NO: 61468 - RNA, 46 nt, Mus musculus
uucaugugauaaauaugcaaagcgguacacuacacacugggcagaa

SEQ ID NO: 61469 - RNA, 42 nt, Mus musculus
agccugaaaggugugagcagcuggguguguguucgcggagcu

SEQ ID NO: 61470 - RNA, 46 nt, Mus musculus
gggucaaggucagcaguaugggggcuauagaccaacacagccagga

SEQ ID NO: 61471 - RNA, 42 nt, Mus musculus
ugcaucuuagagggaaaagccaaaaucguuaauuaggcagac

SEQ ID NO: 61472 - RNA, 46 nt, Mus musculus
aaaaagacuaaaacauuuaaaaaugcuuuuuugcuccguggaaauu

SEQ ID NO: 61473 - RNA, 46 nt, Mus musculus
aauaggauguaaggguuuuuuguccucagugaggauuaucacaguu

SEQ ID NO: 61474 - RNA, 46 nt, Mus musculus
ucuccaacucaggaaauaugaauuuuaugaacuuuuaugugcagaa

SEQ ID NO: 61475 - RNA, 46 nt, Mus musculus
aacuuugucuuauuuuaaaccuuucuauugaaaauaggcaccuuau

SEQ ID NO: 61476 - RNA, 46 nt, Mus musculus
ucaguguuccuuguuugaucacacacucgcguauuauguuguaaga

SEQ ID NO: 61477 - RNA, 46 nt, Mus musculus
uuuugcaugaaauugaaguuuauaaaauucaguugaucuguuuaug

SEQ ID NO: 61478 - RNA, 42 nt, Mus musculus
cuuauuacaggccuuuuccugguaguuuuaggauagggagac

SEQ ID NO: 61479 - RNA, 42 nt, Mus musculus
cuucuguuuacaauaauaaaaauuggagagaagagaaaagaa

SEQ ID NO: 61480 - RNA, 45 nt, Mus musculus
aagauguaagaagccuagaacauggacuaggagacacugccagac

SEQ ID NO: 61481 - RNA, 42 nt, Mus musculus
uucccguacuggccucacuacuaugaaauuaagggagcaauc

SEQ ID NO: 61482 - RNA, 44 nt, Mus musculus
gcaagugugagugguuuccaacugccuuuagguuuugugacuuu

SEQ ID NO: 61483 - RNA, 41 nt, Mus musculus
ucucagugcguucaacaccguggguuugagaaaagggacga

SEQ ID NO: 61484 - RNA, 45 nt, Mus musculus
ggaugccugugcacauguguaugucugcuaccuuuggaggucaga

SEQ ID NO: 61485 - RNA, 46 nt, Mus musculus
uucaggaccaaaaguucaguccuugguacugccccgccccaagucu

SEQ ID NO: 61486 - RNA, 53 nt, Mus musculus
uuuauaacaguaagccauauuuaaauauuuucccuguguagacggcagagauc

SEQ ID NO: 61487 - RNA, 46 nt, Mus musculus
ccucaaauuugauugauacaaaaaaaaaaaaucagaucacucagag

SEQ ID NO: 61488 - RNA, 46 nt, Mus musculus
agugggggugccucugcaccccuagcuagcuacuuagcauggagug

SEQ ID NO: 61489 - RNA, 41 nt, Mus musculus
uugugagccaccaugugguugcugggauuugaacaggcucu

SEQ ID NO: 61490 - RNA, 45 nt, Mus musculus
cuguccccgcccucuccgagaacucucugucuguggcccauagau

SEQ ID NO: 61491 - RNA, 44 nt, Mus musculus
guuuagaacauuagccugcucuccagauuacagugaggccuaag

SEQ ID NO: 61492 - RNA, 47 nt, Mus musculus
aagggagagcacugagccacgagauaagguaggcugcuuuagaagau

SEQ ID NO: 61493 - RNA, 41 nt, Mus musculus
ggcccuccacccccuccccgcucucacaacaugccuucaga

SEQ ID NO: 61494 - RNA, 71 nt, Mus musculus
acuugagcaugggaguugaugaggccuuugcaucuguggcauuuccaggagaggugaagggacggugcagg

SEQ ID NO: 61495 - RNA, 45 nt, Mus musculus
ccaaacaaacaccuuacggauuaaagauuugcucuggccacaagc

SEQ ID NO: 61496 - RNA, 46 nt, Mus musculus
uuuuagaaauacugcguguauuaaaaauacauuuuaagcagcagau

SEQ ID NO: 61497 - RNA, 46 nt, Mus musculus
aguacagauuaaaacaucaguaugugccugaucuucugggcgaggg

SEQ ID NO: 61498 - RNA, 41 nt, Mus musculus
aggaagucaggccgggaacucaagcgggcaggaaccuggag

SEQ ID NO: 61499 - RNA, 73 nt, Mus musculus
gggcuauacagagaaacccugacucaaaaaagggguugggggaggcaguuugguuauuuuugucuucagugca

SEQ ID NO: 61500 - RNA, 46 nt, Mus musculus
ugguggcacauccuaacucccagcacucaggaggcagaggcuagaa

SEQ ID NO: 61501 - RNA, 45 nt, Mus musculus
ucucucucugucucucugucccugugugugugugucccugugugu

SEQ ID NO: 61502 - RNA, 46 nt, Mus musculus
cauuauacuguuaccccuccuaccaagcccuccuuccuacccagac

SEQ ID NO: 61503 - RNA, 46 nt, Mus musculus
guuuagagaaguaauuuuuuucuuuuuuucuuguuggccaaggauc

SEQ ID NO: 61504 - RNA, 45 nt, Mus musculus
cugugugaaaccaccaucacuuugagagaguugacgccccucucg

SEQ ID NO: 61505 - RNA, 46 nt, Mus musculus
gaagugaucucucugaagugagugauaaacccuaguagaaucagau

SEQ ID NO: 61506 - RNA, 49 nt, Mus musculus
uccugaugggagcuaucauguauacccaaauaaugaccgacagacacac

SEQ ID NO: 61507 - RNA, 45 nt, Mus musculus
ugcacuacugcuuccuuagaaagccaagugcucucccuguccucc

SEQ ID NO: 61508 - RNA, 61 nt, Mus musculus
ucaguugguuugagaacauuuuaaucaccccagagagaagcauauguuuauuggccaucau

SEQ ID NO: 61509 - RNA, 88 nt, Mus musculus
uacuuguuacuuugucuuugaguuauuuauuucaaaaugugcauuucagucuuuuaaaauguacuuguagagucaugguacugucacc

SEQ ID NO: 61510 - RNA, 50 nt, Mus musculus
ugaaaacaaccaucuuauucaguguauaauggacuaucagaacaaaggga

SEQ ID NO: 61511 - RNA, 45 nt, Mus musculus
ugugugugugugugugugugugugugugugugagugagaugauua

SEQ ID NO: 61512 - RNA, 41 nt, Mus musculus
ccaugugcuguguuuuggugucugagcuggguagggguugu

SEQ ID NO: 61513 - RNA, 43 nt, Mus musculus
ugggguucuccuuuuccccuugaucuugcgccaugguggagaa

SEQ ID NO: 61514 - RNA, 46 nt, Mus musculus
cugaacccuggccuacccagcaccacauagaaguccaggccguaga

SEQ ID NO: 61515 - RNA, 42 nt, Mus musculus
uuuuucuguugcagaccggaugucuucuuccccggagcagcc

SEQ ID NO: 61516 - RNA, 53 nt, Mus musculus
ugagaaaaucauguagauaguucaguaauaaagcaaggcuuuucucaucuaga

SEQ ID NO: 61517 - RNA, 46 nt, Mus musculus
ggacgaagaaccaaacuguuuacagagauccaagcacaagggagag

SEQ ID NO: 61518 - RNA, 46 nt, Mus musculus
auacauguugugguaggugugcugggcucagugcagguguggaugg

SEQ ID NO: 61519 - RNA, 47 nt, Mus musculus
gucaucaccucccccgaccccauccacaccugcacugagcccagcac

SEQ ID NO: 61520 - RNA, 64 nt, Mus musculus
aacugagaggauuagauucgcuucugggaaguuuggaugaaagaaucauggcaugcuauagcua

SEQ ID NO: 61521 - RNA, 42 nt, Mus musculus
ccgcaugaugaagaagcuggaccucaacugugaugggcagcu

SEQ ID NO: 61522 - RNA, 63 nt, Mus musculus
caaggacaucaggauccuucugguucuuugugaaggcagccagcucuguguucaugaaggaaa

SEQ ID NO: 61523 - RNA, 46 nt, Mus musculus
cuccaaaacugaauuccuuuccuucaugaacacagagcuggcugcc

SEQ ID NO: 61524 - RNA, 50 nt, Mus musculus
ucaaugcaucucucagucucuguaggcauuuuugcuucaaguugaggagc

SEQ ID NO: 61525 - RNA, 42 nt, Mus musculus
aaacuuugugcugaugaugcaguuccuaagaagcgcaaacag

SEQ ID NO: 61526 - RNA, 46 nt, Mus musculus
uccauggguuaaagagaaaggaugcuacaaauucaccugcacacaa

SEQ ID NO: 61527 - RNA, 45 nt, Mus musculus
uaaagauacuugccgcuaagucugaugacagaauucaaugcccug

SEQ ID NO: 61528 - RNA, 42 nt, Mus musculus
guggggaugaaacccagggcuucaggcagagcaggcaggcau

SEQ ID NO: 61529 - RNA, 45 nt, Mus musculus
uaggacggaggcaauauaaaaaacauuaaauaugacagaagccca

SEQ ID NO: 61530 - RNA, 46 nt, Mus musculus
auaugcuuggccagggaauggcacuauuaggagguguggccuuguu

SEQ ID NO: 61531 - RNA, 41 nt, Mus musculus
auagucacagaagcugauugaaaauaccuaaccaaggccac

SEQ ID NO: 61532 - RNA, 46 nt, Mus musculus
gaaaaaaauuaaaagugucaaaacacaaaaacgguaaagacuggag

SEQ ID NO: 61533 - RNA, 41 nt, Mus musculus
uccggggaccucgagccucugcagugccuugucucucgcgg

SEQ ID NO: 61534 - RNA, 42 nt, Mus musculus
gccacgugugagugucggguggcgcgcccacccagcggggag

SEQ ID NO: 61535 - RNA, 52 nt, Mus musculus
gccacuuauaaagaauguguuugggcauauuauuuccaugauggcagagaga

SEQ ID NO: 61536 - RNA, 46 nt, Mus musculus
uuucaugugccaccacugcccagcuaaggaacggaacucaggucuu

SEQ ID NO: 61537 - RNA, 45 nt, Mus musculus
ucacucuaacccaggcugaccuggaacacacuauauagcccugac

SEQ ID NO: 61538 - RNA, 45 nt, Mus musculus
agcccuggugcuguguucagaagcuuuuugucuuugauguuggag

SEQ ID NO: 61539 - RNA, 45 nt, Mus musculus
uaacugauuguuaugucaacuuucugaccauguucugagcagcua

SEQ ID NO: 61540 - RNA, 46 nt, Mus musculus
uggacuguauaacaauacucugucucagaacaacaaaugccccaaa

SEQ ID NO: 61541 - RNA, 46 nt, Mus musculus
auguaaguacacuguagcugucuucagacacaccagagggcaucag

SEQ ID NO: 61542 - RNA, 45 nt, Mus musculus
acuugguaguuuuugaagcugaacuuccaauggagguuuggcaga

SEQ ID NO: 61543 - RNA, 42 nt, Mus musculus
aaccgagaauagagagucugcuagguugaccaguagggagga

SEQ ID NO: 61544 - RNA, 51 nt, Mus musculus
acccagagaaacccugucuugaaaaacuagagucagggcggugagauacuc

SEQ ID NO: 61545 - RNA, 47 nt, Mus musculus
uuuacuauaaacuacucauuaaaaccuaauagcaauaguugaaaggc

SEQ ID NO: 61546 - RNA, 46 nt, Mus musculus
uugagucuauuagacauuuaaccacgagacacagccucucagccau

SEQ ID NO: 61547 - RNA, 42 nt, Mus musculus
cugcuaacaagugacagacuuuugcaaccucucugccuccag

SEQ ID NO: 61548 - RNA, 45 nt, Mus musculus
gguaacuacugcccugucagucaaucuagguuaacuuagggcaau

SEQ ID NO: 61549 - RNA, 47 nt, Mus musculus
ucugacaccccccacacaagacacacgcaggcaaaacaccaguacac

SEQ ID NO: 61550 - RNA, 42 nt, Mus musculus
gacagcuugcugcagcagcccucaucuggcucccacugguac

SEQ ID NO: 61551 - RNA, 46 nt, Mus musculus
cuauacuguugguagaaaacggguugauuguggaucagugguaaag

SEQ ID NO: 61552 - RNA, 45 nt, Mus musculus
cccagccacagugacaaccugcugcacggucucaaccugcugugg

SEQ ID NO: 61553 - RNA, 67 nt, Mus musculus
aggcgccucuggaaaauuagcaaaucgggguggcagcgaggaaagccaacaguuugcgaagcgggga

SEQ ID NO: 61554 - RNA, 90 nt, Mus musculus
uuauaaagaauaaaacucucauugcaagaaauaagcagaugggagguggaagcaaggggggagaacaagaaggaaagacuaggaaaagau

SEQ ID NO: 61555 - RNA, 46 nt, Mus musculus
uuaguucccagagagcagggucagucuuauccugcggcccccaccc

SEQ ID NO: 61556 - RNA, 45 nt, Mus musculus
uuacaguagaaggugaugccugauguuuugcugaggucugauuug

SEQ ID NO: 61557 - RNA, 45 nt, Mus musculus
uaaauucucuuuuuagguuuugagguggauguucccaguggagaa

SEQ ID NO: 61558 - RNA, 42 nt, Mus musculus
gagagccccagaguuguaguucucuugccagugugcuguguu

SEQ ID NO: 61559 - RNA, 41 nt, Mus musculus
uguguaaaaacagacaguuguaaaagugaugguaaggcaga

SEQ ID NO: 61560 - RNA, 46 nt, Mus musculus
uuugucucuuuccuuuuucagacagcuacuuuauuucuguguuggu

SEQ ID NO: 61561 - RNA, 45 nt, Mus musculus
guugugaagguuuaagaaauuaggaggaaacaaucagcacucagg

SEQ ID NO: 61562 - RNA, 42 nt, Mus musculus
uucugggcucauuaaccaucagcguauccacacuggggagaa

SEQ ID NO: 61563 - RNA, 45 nt, Mus musculus
uacccaaggagcuacagacuuggguucgagagcaucacccagaga

SEQ ID NO: 61564 - RNA, 80 nt, Mus musculus
ucaguggaagaagauucaauacuuaucaucccaaauccagaugaagaagaaaaaauucugagagugaaacuagaggagga

SEQ ID NO: 61565 - RNA, 46 nt, Mus musculus
cuucacacagacauacaugcaagaaaaaccaccaaugcccauaaau

SEQ ID NO: 61566 - RNA, 45 nt, Mus musculus
guucuggaggaccaaccccuucacguguuccuguaguucacagau

SEQ ID NO: 61567 - RNA, 45 nt, Mus musculus
uaggagagcuuguccuaauuuucauagaugacgaugaagccccaa

SEQ ID NO: 61568 - RNA, 47 nt, Mus musculus
cgacugaacuagugugcuugauuccagguugugugugguuugaaauc

SEQ ID NO: 61569 - RNA, 49 nt, Mus musculus
acagauaguugugagcugccaugugggugcugggacuagaacuuggguc

SEQ ID NO: 61570 - RNA, 115 nt, Mus musculus
uccucaccaccaaaucaucucuccagcucuauuuguuuuaagcagcagacuguacaaccuuggaacuguucuuuauuugugcaaagacuuaagugucugacuuccucgauagaac

SEQ ID NO: 61571 - RNA, 49 nt, Mus musculus
cucauagacuuuacaguccuugauaaguacuagauuuucaguagauggg

SEQ ID NO: 61572 - RNA, 46 nt, Mus musculus
cuagcuaccugguagaguuuugcuucuggcaugacuuacugaccuu

SEQ ID NO: 61573 - RNA, 45 nt, Mus musculus
gguggggcacuggcuugauacaaggucucacuauguagccccucu

SEQ ID NO: 61574 - RNA, 68 nt, Mus musculus
uucagcccaccaagugcagagaucauacagccagaaugucugccuagcacuugagaaacaggaagccc

SEQ ID NO: 61575 - RNA, 47 nt, Mus musculus
uggucuguaugucuguccccuuagugcauacagugccuuuggagauc

SEQ ID NO: 61576 - RNA, 48 nt, Mus musculus
uuuacacucauuuauguacuacauauacuucucauacuuggguaaaau

SEQ ID NO: 61577 - RNA, 46 nt, Mus musculus
uuguucagagguuggaucucaugccugaccuguaugaagcccucag

SEQ ID NO: 61578 - RNA, 45 nt, Mus musculus
gcaauucaggaaggucccuuguauccuuuaucuaguuacucccau

SEQ ID NO: 61579 - RNA, 45 nt, Mus musculus
auacacugugauacagagacauuucagagaauuucuaccucagaa

SEQ ID NO: 61580 - RNA, 92 nt, Mus musculus
guucccuacuagggcagcaauucccuuaaaagcugagucaccuucaguccuuuauuuugcuuuuaaaucauccuuuuuucuugcccccacuc

SEQ ID NO: 61581 - RNA, 73 nt, Mus musculus
uauaaauggaauugcuuucuauaguaaguaccuaccugugaguugacuguuuccacuaagcauaauaguuacc

SEQ ID NO: 61582 - RNA, 45 nt, Mus musculus
aauuucaaguccaguguugaggauugauaaggaacuaacagugag

SEQ ID NO: 61583 - RNA, 45 nt, Mus musculus
caaaucccagcaaccacaugguggcucacaaccauccauaccgag

SEQ ID NO: 61584 - RNA, 46 nt, Mus musculus
acacaaauuaauaaauaaaaggaagaaaaaacauguaagagacaca

SEQ ID NO: 61585 - RNA, 46 nt, Mus musculus
cccguuccucuucaagauacugcuaccugccgaagcaauuccggag

SEQ ID NO: 61586 - RNA, 44 nt, Mus musculus
auuucucucucguucgccuaguuccccucucuuuucagccccag

SEQ ID NO: 61587 - RNA, 105 nt, Mus musculus
guugcugcugcuuucuuacugaaguugauggcuuaucugccuccuccuuuccuaagcacuaccagaugagcaaaucacaacaaaacccagucuucucaggugucu

SEQ ID NO: 61588 - RNA, 141 nt, Mus musculus
guguaauguccccauuuuauauaucuacuucacugacagaagcaaauaucccucaagagccaguauuugacauuuccacuucccauagaguaauauuuuuuaguacauguaaaauaugaauugcaaguaaaagagagcugc

SEQ ID NO: 61589 - RNA, 46 nt, Mus musculus
uccuguuuguagcagauucccugagaagguagaaaggcaguguuca

SEQ ID NO: 61590 - RNA, 82 nt, Mus musculus
ucagaagcauaagacacuaaaacugcguugccauuggggauggagauaguggcaagauauucuuuaaucugcaacuuaggag

SEQ ID NO: 61591 - RNA, 45 nt, Mus musculus
ugucagcugguuuucacacuggugaacggaccucaggaggggcag

SEQ ID NO: 61592 - RNA, 46 nt, Mus musculus
uuuuguuugcacauauaucuguauaucauugcacaucacugauaag

SEQ ID NO: 61593 - RNA, 45 nt, Mus musculus
gaguauggguauaugaagaguauggguuuaugaagaguaugggua

SEQ ID NO: 61594 - RNA, 45 nt, Mus musculus; identical to SEQ ID NO: 61593

SEQ ID NO: 61595 - RNA, 46 nt, Mus musculus
agaagugaggugcugugugcaggaacauucaggagcauuuuuagag

SEQ ID NO: 61596 - RNA, 45 nt, Mus musculus
caucucaguggagauccagaagucaaaacauuguagagaguagua

SEQ ID NO: 61597 - RNA, 44 nt, Mus musculus
uuguuuugcuagagaagccagaaggggaaaaaaaaugaguaagg

SEQ ID NO: 61598 - RNA, 45 nt, Mus musculus
aaaauaugagguauuugggcagcaggaguggauauuugagcugag

SEQ ID NO: 61599 - RNA, 42 nt, Mus musculus
agucuaauuuaauaccuucgugcucuaaugcuauacagggag

SEQ ID NO: 61600 - RNA, 46 nt, Mus musculus
auguauguguguauguauguguguguguguguguguguguguauau

SEQ ID NO: 61601 - RNA, 46 nt, Mus musculus
cuuggcccauaaggaguggcacuauuaggagguauggccuuguugg

SEQ ID NO: 61602 - RNA, 45 nt, Mus musculus
gccaccaugcccggccaaaguuuuauuuuuaacauuuaggcaucu

SEQ ID NO: 61603 - RNA, 46 nt, Mus musculus
uuccaucaucuuaucacaucuagagauuagauuuguuaaggcagga

SEQ ID NO: 61604 - RNA, 81 nt, Mus musculus
aaggcauaugucaccaugcucagcaccagaaugguuuuguacuaaguuauuauuuuaauaaaauuugagaaauauagggau

SEQ ID NO: 61605 - RNA, 55 nt, Mus musculus
cuuuauuagugcauuuauauuuauuucuuauuagcaagucaauuugaagacuaaa

SEQ ID NO: 61606 - RNA, 45 nt, Mus musculus
gaugauacuggaguaaaguuugucuuuagcuucucuauugcagag

SEQ ID NO: 61607 - RNA, 46 nt, Mus musculus
ugucacuuacuauugacugagugugcauuguugcaguugagcugua

SEQ ID NO: 61608 - RNA, 46 nt, Mus musculus
cuaauaaguguuagaacugaaauuugaacuuaaacauuuggcuaag

SEQ ID NO: 61609 - RNA, 58 nt, Mus musculus
agcacaguaguacuaacuacagaaauucauugcagcaaaaggacacagaaucuggagg

SEQ ID NO: 61610 - RNA, 47 nt, Mus musculus
uguagagguaucuuguaucuugcacauaccaaaauuagagucacaga

SEQ ID NO: 61611 - RNA, 45 nt, Mus musculus
uaugugaaggaugcucaaagauacuuuuuaaaaaauugcauacag

SEQ ID NO: 61612 - RNA, 46 nt, Mus musculus
ucuauauauauuuuaaaauuuuacauuugacuuaaagugccaugag

SEQ ID NO: 61613 - RNA, 46 nt, Mus musculus
guuagcaauaccuagguuagccccaucagucuacuuaaaaguucac

SEQ ID NO: 61614 - RNA, 46 nt, Mus musculus
gcgagggcgucugguguugaacugagaaggaugucagcagugggag

SEQ ID NO: 61615 - RNA, 41 nt, Mus musculus
gccaaugcauuauggccggggcagagugaaggguagaggaa

SEQ ID NO: 61616 - RNA, 45 nt, Mus musculus
gccuagaacucacucuguagaccaggcuggccucaaacucaagag

SEQ ID NO: 61617 - RNA, 46 nt, Mus musculus
uucuuucuuuuaguuaucacuguuuuucacucacugguguggagag

SEQ ID NO: 61618 - RNA, 45 nt, Mus musculus
guucaacuuaauggcaagugagaugauugcacucaacagauccuu

SEQ ID NO: 61619 - RNA, 46 nt, Mus musculus
cuacaaaguagaaucacuauuaaauccauaaauuacuuaaggccuu

SEQ ID NO: 61620 - RNA, 47 nt, Mus musculus
cacugaauuacauuuuauacauaucuaacgaagaaacaaagccaagc

SEQ ID NO: 61621 - RNA, 45 nt, Mus musculus
ccaugauuaagucauuuuaaagucaucaaauucacaacagugaca

SEQ ID NO: 61622 - RNA, 41 nt, Mus musculus
gcaguacaggggaacgccagggccaaaaaggggggugggug

SEQ ID NO: 61623 - RNA, 45 nt, Mus musculus
ggagauucucuccuggaagcuuuugcauuugucuugugauauugg

SEQ ID NO: 61624 - RNA, 38 nt, Mus musculus
cugcgaacaguccauagugucauuaaucgcucgccaag

SEQ ID NO: 61625 - RNA, 24 nt, Mus musculus
gaugcagucaugcugcacagcguc

SEQ ID NO: 61626 - RNA, 42 nt, Mus musculus
ucuagaagcuucaagacaaggcuacugugcuaaccacggagc

SEQ ID NO: 61627 - RNA, 42 nt, Mus musculus
gccuuugggccccagggaacagucacccuguaaagugcucag

SEQ ID NO: 61628 - RNA, 42 nt, Mus musculus
agggggaggagccaagggagcugugaaggggaggggcaggag

SEQ ID NO: 61629 - RNA, 44 nt, Mus musculus
aggggaggggcaggaggacucuugcaggguuuuguaagcagcga

SEQ ID NO: 61630 - RNA, 45 nt, Mus musculus
agcagucagugcuccuaaccucugagccaucucuccagcccccua

SEQ ID NO: 61631 - RNA, 45 nt, Mus musculus
acauauacagagaaagcaaugugugauguauagaaaaaaguugag

SEQ ID NO: 61632 - RNA, 46 nt, Mus musculus
guaaguagguacaguugaagauuuuaauuugcuuuuaugaccucag

SEQ ID NO: 61633 - RNA, 45 nt, Mus musculus
gcucaauuuucguugguauccuguuccccagcgagaaauggacag

SEQ ID NO: 61634 - RNA, 46 nt, Mus musculus
gcuaaauagagauugugagaaauacauucaauuuaaggagucuaag

SEQ ID NO: 61635 - RNA, 61 nt, Mus musculus
auuaauguguauuuuuuuauuacuauacuugaucacauguggcuuuauucaggaaggcaua

SEQ ID NO: 61636 - RNA, 57 nt, Mus musculus
aagagcaugcugguaaggacaugaccugagacuuagcuacauagacagaaacccuag

SEQ ID NO: 61637 - RNA, 45 nt, Mus musculus
cauucaguuuaagaacugugagauaaaaaguccaucaguacuaaa

SEQ ID NO: 61638 - RNA, 101 nt, Mus musculus
uucagaacaccuacaauggcuggaggccuuuuuucaauagacagagauuacuuucaggaaauuggaacauacgaugcuggaauggauauuuggggaggaga

SEQ ID NO: 61639 - RNA, 46 nt, Mus musculus
guuucggaaagcuacaccuuacacauuuccaggagggacagggcag

SEQ ID NO: 61640 - RNA, 85 nt, Mus musculus
gcagacaugugcuaccaaucagaacgcuaauaaaucaggcaauucuuucuuucaacagguguuacaaagguagauuauggagaua

SEQ ID NO: 61641 - RNA, 60 nt, Mus musculus
uaucaucaagacuuggccuaagacguaaacuacaaugcaaaccuuucucuugguaccuag

SEQ ID NO: 61642 - RNA, 46 nt, Mus musculus
ugccugucggagcaguugaacacaggccaucuguaauuugcugcag

SEQ ID NO: 61643 - RNA, 48 nt, Mus musculus
auauacauugcugagguaaaaguuucagagcaagggaggaaggaaugc

SEQ ID NO: 61644 - RNA, 63 nt, Mus musculus
aaucuugcaaagcaaggcauuuugcuauaaaguaauguagagaaagcggauaauagguagaga

SEQ ID NO: 61645 - RNA, 42 nt, Mus musculus
agaaaugcaaccugacccuucccuuuuuagcuaguggggcag

SEQ ID NO: 61646 - RNA, 45 nt, Mus musculus
aucagugucuagauaacauggcuagaaaagagaaugaaaagguug

SEQ ID NO: 61647 - RNA, 41 nt, Mus musculus
aguauuaggugaaggguacuuucuugcggggcugugggugc

SEQ ID NO: 61648 - RNA, 46 nt, Mus musculus
gcuuuucagguuuucuccuacacugccaacaaagaaauuagaacag

SEQ ID NO: 61649 - RNA, 45 nt, Mus musculus
cucagaaauuaacccugcagcaugugaacagcaaucagugccugg

SEQ ID NO: 61650 - RNA, 55 nt, Mus musculus
gugaagaagaguuuuccugauuagaaucaguagcuggaauauuaaauauugauag

SEQ ID NO: 61651 - RNA, 46 nt, Mus musculus
aaauuaugucaaacaggguuuaaaggaaauuaaaaagaauuaugag

SEQ ID NO: 61652 - RNA, 46 nt, Mus musculus
uggaugcuucuauuuuccucggggugcucagagugagauagugggu

SEQ ID NO: 61653 - RNA, 45 nt, Mus musculus
auucuuuaaaaaaaaaaaaauggagauuuacucugccuggucuca

SEQ ID NO: 61654 - RNA, 60 nt, Mus musculus
gucuccacagcaauaaccucugaccccugcgagucacuucacagagugcuguuuaucugg

SEQ ID NO: 61655 - RNA, 42 nt, Mus musculus
ucuucugugagcuauguuaauucugucuccaaugggcccaau

SEQ ID NO: 61656 - RNA, 65 nt, Mus musculus
guauauauugcuuugaaaaaucacaagguugguuguaacguugagagggggaaauucuagaugug

SEQ ID NO: 61657 - RNA, 48 nt, Mus musculus
acccaagacaccaacaguucacacugagcauagucaggaaauaggagg

SEQ ID NO: 61658 - RNA, 46 nt, Mus musculus
ccuagagcagcuuaaagaaguacuguuguuuguaguuccaguagau

SEQ ID NO: 61659 - RNA, 25 nt, Mus musculus
agaaacaauaauaaaccaccuggcg

SEQ ID NO: 61660 - RNA, 47 nt, Mus musculus
gaccucauccaccaccaucacgacuaccaucacauucugcaccacca

SEQ ID NO: 61661 - RNA, 23 nt, Mus musculus
cccuccagcagugauuuccugug

SEQ ID NO: 61662 - RNA, 45 nt, Mus musculus
uaaauaguugaaagugaaacacgaggaguggagagauggcccagu

SEQ ID NO: 61663 - RNA, 45 nt, Mus musculus
uuauuuuauguaagugcacuguagcugucuucagacacucgagaa

SEQ ID NO: 61664 - RNA, 45 nt, Mus musculus
gagugugacugaggaagacugauguuaaccucuauucucuauuca

SEQ ID NO: 61665 - RNA, 57 nt, Mus musculus
auauuucauguuucuuguggaacacguacucacacugaucaagcaauuuaaagauaa

SEQ ID NO: 61666 - RNA, 46 nt, Mus musculus
ugucucugcugggagucaucuuggugccacucaugaaccggguauu

SEQ ID NO: 61667 - RNA, 46 nt, Mus musculus
ucaaucaaauugaugcucgggcuugucugauucauacagcaaguga

SEQ ID NO: 61668 - RNA, 46 nt, Mus musculus
ucaauacaaccaagcugcugacaucccauggcaugagcauccaggc

SEQ ID NO: 61669 - RNA, 45 nt, Mus musculus
ggugucuaaggaugaauaauauuaauaaauagacagugggggauc

SEQ ID NO: 61670 - RNA, 46 nt, Mus musculus
aaggauguuuacaacacagucugcauggugagccaacgccuugcug

SEQ ID NO: 61671 - RNA, 42 nt, Mus musculus
gccguauuuaaugcgccuguuugguccuccuaggggugagug

SEQ ID NO: 61672 - RNA, 79 nt, Mus musculus
ucacggagaaaagccgagugggccggcugagucggcuagcuaggaagaaaagcaaugagucugugagugagcccagaaa

SEQ ID NO: 61673 - RNA, 42 nt, Mus musculus
ggguagaaggguuuacaucuuuggugcgucucccagguuuug

SEQ ID NO: 61674 - RNA, 46 nt, Mus musculus
uuuguagagacaauagagacuccaaaaccugggagacgcaccaaag

SEQ ID NO: 61675 - RNA, 46 nt, Mus musculus
cucuccuugauguuccuccuaccauucaugugcucugcugggcgag

SEQ ID NO: 61676 - RNA, 42 nt, Mus musculus
aaggaucucgcccagcagagcacaugaaugguaggaggaaca

SEQ ID NO: 61677 - RNA, 46 nt, Mus musculus
gagcaccauucccaccgcagucacacgguugcugguaaaaacaauc

SEQ ID NO: 61678 - RNA, 73 nt, Mus musculus
gaaggcuucagaaaauugcuucagaacauaggcauagauaagauuaaaagaguccauauacaccaugaccacg

SEQ ID NO: 61679 - RNA, 46 nt, Mus musculus
cagacaaggaaucauucucuccguagcgguagaauagcugcugcag

SEQ ID NO: 61680 - RNA, 42 nt, Mus musculus
caugaucuugaccuuugcccuuuggguuacaagcccccuuca

SEQ ID NO: 61681 - RNA, 46 nt, Mus musculus
ucacgugcaaagauacaauuaauuaacccugcaaaugcuccgggag

SEQ ID NO: 61682 - RNA, 41 nt, Mus musculus
gacaggaacacacacacacacacacacacacacacaagaga

SEQ ID NO: 61683 - RNA, 46 nt, Mus musculus
aaaucagaugcacugccacaaaaucaagucugauucagugcugaau

SEQ ID NO: 61684 - RNA, 46 nt, Mus musculus
cuuccacucugaauucauccuugcaaauagauauuaccggcuuuuc

SEQ ID NO: 61685 - RNA, 42 nt, Mus musculus
cuauaugguuuugugugccuccguuuaccugugcgccuagua

SEQ ID NO: 61686 - RNA, 46 nt, Mus musculus
agaagaguccgacaacuuugugaacaagcuagaccccagcaaagug

SEQ ID NO: 61687 - RNA, 41 nt, Mus musculus
gcagaguuacgagagccuucagcgaugcuuccucggcagca

SEQ ID NO: 61688 - RNA, 46 nt, Mus musculus
ggcuccucagacucucgucgguuguuucgaagcucagcccuccgau

SEQ ID NO: 61689 - RNA, 46 nt, Mus musculus
cacaacucuuccauccaccuuguguggucuugcauucauggcagca

SEQ ID NO: 61690 - RNA, 46 nt, Mus musculus
aauaccaccaacaaagaucuuuuucacaguuaagugggcaccuggu

SEQ ID NO: 61691 - RNA, 81 nt, Mus musculus
guuuagcaaaguacuggccuccaccaccauaagggccagagcuccugccuccaaagauuccucccuucaucggcccaaaau

SEQ ID NO: 61692 - RNA, 45 nt, Mus musculus
gggaaguucauuaaagacauugggcugaaaagucaccuggggaga

SEQ ID NO: 61693 - RNA, 46 nt, Mus musculus
acagggcagacacugacagcugucacagaacugcccacauccagga

SEQ ID NO: 61694 - RNA, 52 nt, Mus musculus
aucuacagcugugaccuggacaucaacgugcagcugaagaugugagagcuga

SEQ ID NO: 61695 - RNA, 42 nt, Mus musculus
gaagcgaacuuuuggacaguuuaacauuuuuaaaagcagaga

SEQ ID NO: 61696 - RNA, 46 nt, Mus musculus
uuuucagaaugucuuaucacauacaaaagugacguuacuuguaaaa

SEQ ID NO: 61697 - RNA, 45 nt, Mus musculus
ccuggccuuaccagucagaacauccuacaaggcguuuaguacaag

SEQ ID NO: 61698 - RNA, 46 nt, Mus musculus
uaauuuggauauugacacuaguuuuucucuuuaacuuuaccacaug

SEQ ID NO: 61699 - RNA, 46 nt, Mus musculus
gugguuucuucauccacaaauaauaacacuguuugguauuuaccag

SEQ ID NO: 61700 - RNA, 46 nt, Mus musculus
aaauucucuuguuucuuacuggugacacuuagcuguuagcacugag

SEQ ID NO: 61701 - RNA, 46 nt, Mus musculus
uuaauguguauuuguuaauaacacaggauacagaaagaaccagcaa

SEQ ID NO: 61702 - RNA, 45 nt, Mus musculus
cgugagggaaggagggucgggguaguuaccuggaucugaugcuug

SEQ ID NO: 61703 - RNA, 80 nt, Mus musculus
ugcugggugcaguggcuuaauuuguaugggaugagucuggagguuguggguagguuaguuggguccugauagauggcuag

SEQ ID NO: 61704 - RNA, 45 nt, Mus musculus
gacccgggauagauguagggcuuaggggagaguccauggagggga

SEQ ID NO: 61705 - RNA, 45 nt, Mus musculus
gcaaucuugcuggcauaugcaauagugucuggguuuagugguuau

SEQ ID NO: 61706 - RNA, 42 nt, Mus musculus
ccaagugcugggauuaaaggcgugcaccaccaccgcccguau

SEQ ID NO: 61707 - RNA, 45 nt, Mus musculus
ugccuccauguugaaauuaauguguuugcugugauucguuacuua

SEQ ID NO: 61708 - RNA, 46 nt, Mus musculus
augucuaccugcugucuguacucacauguaguacuacacugugcau

SEQ ID NO: 61709 - RNA, 23 nt, Mus musculus
cagguggagagggguggagccuc

SEQ ID NO: 61710 - RNA, 45 nt, Mus musculus
ucucucucacauacacacacacacacacacacacacacacacuca

SEQ ID NO: 61711 - RNA, 46 nt, Mus musculus
guuacugcggauguuccuaaccacugagcuaucuuucuagccccag

SEQ ID NO: 61712 - RNA, 46 nt, Mus musculus
aaguauuuguauauacuugauuagauaucuugagaguaggcuccaa

SEQ ID NO: 61713 - RNA, 29 nt, Mus musculus
gucucccuuuguggccugaaaugcuuggg

SEQ ID NO: 61714 - RNA, 45 nt, Mus musculus
cacauggugaaaguggauuggcuggacagauuaacauuuagagag

SEQ ID NO: 61715 - RNA, 46 nt, Mus musculus
caguuuugaguuagugaaaguuccugauccucaaaugucuauggua

SEQ ID NO: 61716 - RNA, 42 nt, Mus musculus
gagucgugugguuacaaaucauggcuugcaugcugcggucau

SEQ ID NO: 61717 - RNA, 42 nt, Mus musculus
ggauuuagagggaucuguggauaucucaaagaauagggggag

SEQ ID NO: 61718 - RNA, 45 nt, Mus musculus
cagaaaccaccauuggccacuuacuguggccugcacacuugccac

SEQ ID NO: 61719 - RNA, 46 nt, Mus musculus
agauguaauuuaaaaauaaucuaaguucaaauauucuauuagggag

SEQ ID NO: 61720 - RNA, 96 nt, Mus musculus
auucugcuagggacaguaucuauaaaggguaacggugugugucaguuaaggaguuucuaaguuucuggugguuuuuggaguuggcguagaguugag

SEQ ID NO: 61721 - RNA, 46 nt, Mus musculus
ucuucaagcacaaguuuggaucccaaauacggacauagaaagccag

SEQ ID NO: 61722 - RNA, 24 nt, Mus musculus
aacuuguaaagggauggcgcugga

SEQ ID NO: 61723 - RNA, 46 nt, Mus musculus
uccuuaagauauaagaauuguuuguaguugaaaguuaugcuguuag

SEQ ID NO: 61724 - RNA, 46 nt, Mus musculus
gcuauccuggagaaagcaggaagcugcaaauuuaaacuggcaugag

SEQ ID NO: 61725 - RNA, 45 nt, Mus musculus
guugggauuauaggggaucuuaggagguuagaauuuucagagcag

SEQ ID NO: 61726 - RNA, 42 nt, Mus musculus
uccuuagcagcucauuuacuaugucuuguagggucagaggag

SEQ ID NO: 61727 - RNA, 45 nt, Mus musculus
uggacaaggugcuccuuagacaaacgaugacacugguugaggagg

SEQ ID NO: 61728 - RNA, 45 nt, Mus musculus
ucauuggcccuuuaaacaagaaauagccauccaaaaauaaaccag

SEQ ID NO: 61729 - RNA, 55 nt, Mus musculus
ucaauaaaagagaagcuugcuuuucuguguaaguguuuuucugugagcgcugugu

SEQ ID NO: 61730 - RNA, 46 nt, Mus musculus
cuucaggcacagucuccuuauuccuuuaccugaaaauguccagcuu

SEQ ID NO: 61731 - RNA, 46 nt, Mus musculus
uacugcugugaacagaccaugaccaaagcaacucuuacaaggacaa

SEQ ID NO: 61732 - RNA, 45 nt, Mus musculus
uacagaaggagcugagaguucuaugucuuuauuuaaaggcugcua

SEQ ID NO: 61733 - RNA, 46 nt, Mus musculus
cccuuucuauuacuauggauauuacguuauagauacaugugcgcac

SEQ ID NO: 61734 - RNA, 61 nt, Mus musculus
cugcaagccagaaguuaagcauccuaucaucagcguaaacagaguaccgaguagccauggg

SEQ ID NO: 61735 - RNA, 46 nt, Mus musculus
auauaaccaaagcuuagugaauuaaauuccagcaaugaauaaguag

SEQ ID NO: 61736 - RNA, 44 nt, Mus musculus
aggaaaacuagaaagaaaggccaaggacaaagugaaaaccagag

SEQ ID NO: 61737 - RNA, 57 nt, Mus musculus
agggaccaauacucaaaccaaagaaacagaaagcacggggugguagaacaggauuag

SEQ ID NO: 61738 - RNA, 45 nt, Mus musculus
ccgccuggaccugucagaugaggaggcugugcacuacaugcagag

SEQ ID NO: 61739 - RNA, 46 nt, Mus musculus
aauucagcacuuccauucuggaagacauggcagcuagcuuguuguu

SEQ ID NO: 61740 - RNA, 46 nt, Mus musculus
aaacuaaauuauuuuuuguuuguuuuuaauuuugauaguacuggag

SEQ ID NO: 61741 - RNA, 46 nt, Mus musculus
uguacuaaagacaucaaagaaagaacaaggaagagaggguguccag

SEQ ID NO: 61742 - RNA, 67 nt, Mus musculus
uccuuaguaaaggacuuaucaagcugguuucaaagcacagagcccaaguaauuuacaccagaaacac

SEQ ID NO: 61743 - RNA, 45 nt, Mus musculus
guucgggacaaguugaacaaucuuguccuguucgacaaagcgaca

SEQ ID NO: 61744 - RNA, 48 nt, Mus musculus
aagacgacaagaagaagaaagaugccggaaagucagccaaaaaggaua

SEQ ID NO: 61745 - RNA, 42 nt, Mus musculus
ggacagcaugguccagucuggcugggugugggcacggcgggc

SEQ ID NO: 61746 - RNA, 42 nt, Mus musculus
aaacacgcucacugugguggucuuaaaagcgcggcaccuacc

SEQ ID NO: 61747 - RNA, 61 nt, Mus musculus
uggagaaguccugauuccucuuucagggauugaauuaucagauggaaaaauguuaaugacu

SEQ ID NO: 61748 - RNA, 46 nt, Mus musculus
caugaccucugacccguacaucaaaaugacaaucuuaccagagaag

SEQ ID NO: 61749 - RNA, 26 nt, Mus musculus
acgucagaggagaaacaagagaagcu

SEQ ID NO: 61750 - RNA, 45 nt, Mus musculus
ugauaucuacccagaaaaccuaaguagcaaaaagaaguuuggagg

SEQ ID NO: 61751 - RNA, 44 nt, Mus musculus
auacacauuuuuuaaagucuuuuuuuaaguggcucaagcgcauu

SEQ ID NO: 61752 - RNA, 42 nt, Mus musculus
ggcgggagggcacaggaggaagcggcggggcgguggcggccg

SEQ ID NO: 61753 - RNA, 42 nt, Mus musculus
ccucaggaucccguugguccucggcggggacaggcagccccg

SEQ ID NO: 61754 - RNA, 69 nt, Mus musculus
gaggaauggaauggagaugccuauagaggucccaaugucaucgucguaagcaggugugaaaggagagau

SEQ ID NO: 61755 - RNA, 45 nt, Mus musculus
aaggcuccugaggauggcgcacugguuuucagcaacauucauaga

SEQ ID NO: 61756 - RNA, 42 nt, Mus musculus
caaauauucaaguccuagcucaucaguuucuugugccaggaa

SEQ ID NO: 61757 - RNA, 46 nt, Mus musculus
uauuggugucaguccugacuugagcauaggcauucacaaguugaag

SEQ ID NO: 61758 - RNA, 45 nt, Mus musculus
ucaguugugugucuggugucuuacgaggccagaagugagcaucag

SEQ ID NO: 61759 - RNA, 42 nt, Mus musculus
caccggcgacgcgggcccggggcuuccuuuucaucggcccag

SEQ ID NO: 61760 - RNA, 45 nt, Mus musculus
uauucuaaccagaagguugcaaguagcuagucgaagggaagcaga

SEQ ID NO: 61761 - RNA, 36 nt, Mus musculus
ugaagaaaacuugcaguugacuuuguaauaaugugu

SEQ ID NO: 61762 - RNA, 90 nt, Mus musculus
uccuucuuaacugaugagcgacacuuccaguccuuccucacugcagucuaauagcacacguauuuacaucucucaaauuguccugagaag

SEQ ID NO: 61763 - RNA, 46 nt, Mus musculus
acuaacuguugauuguaaacaagaauaucugauaaauuagacuuag

SEQ ID NO: 61764 - RNA, 46 nt, Mus musculus
aaaaagaaaaaagaaaagaagaugcaaaaauaaaagacaucuggga

SEQ ID NO: 61765 - RNA, 45 nt, Mus musculus
aucacucucuuuguccccuacuuugccguaguuauuggcugccag

SEQ ID NO: 61766 - RNA, 46 nt, Mus musculus
gauacuacagugaggaaccuggccauggguuuuuguuuuuauggaa

SEQ ID NO: 61767 - RNA, 42 nt, Mus musculus
auggaagcguugugggguuuccuccaugguuccagagagcag

SEQ ID NO: 61768 - RNA, 46 nt, Mus musculus
uuuauugauuggaaaaucuggaauuuuuaguauuuaauuguuacag

SEQ ID NO: 61769 - RNA, 45 nt, Mus musculus
aacugcauuugacaacucuuuggcuuccuuucugugcuauuggag

SEQ ID NO: 61770 - RNA, 46 nt, Mus musculus
aagucucagaagggaaaguugcagacauuucuuggucaguggauug

SEQ ID NO: 61771 - RNA, 45 nt, Mus musculus
cuaccuagucauguuuuugagagaaauuugcuuuucuggccaaca

SEQ ID NO: 61772 - RNA, 44 nt, Mus musculus
acuacuguaacagucaagggagggugaacaacuccacagaggaa

SEQ ID NO: 61773 - RNA, 45 nt, Mus musculus
auggcaagagagagaaauacggcacauugugaagggagaggugga

SEQ ID NO: 61774 - RNA, 45 nt, Mus musculus
ucccagguaaugagucuccccacugucauuuacagagaugaucaa

SEQ ID NO: 61775 - RNA, 46 nt, Mus musculus
uuauaggaaaggaagaagaagucugacaggaugaaaagaggaguug

SEQ ID NO: 61776 - RNA, 45 nt, Mus musculus
gacaagguccuaugugggaugcccaagagaugagaagauaaagaa

SEQ ID NO: 61777 - RNA, 46 nt, Mus musculus
uuugcaaaggugugugguguggguaugcaggaaaguuuggagagag

SEQ ID NO: 61778 - RNA, 46 nt, Mus musculus
uauccagugcauucuacuugaaauucucagugcuugaaguauggaa

SEQ ID NO: 61779 - RNA, 44 nt, Mus musculus
acuuuugggagguguggcauagguguggaauuuguguggaaaua

SEQ ID NO: 61780 - RNA, 46 nt, Mus musculus
auuuuguuaacaguguuguagaaguaaguuggaaugguggcugcag

SEQ ID NO: 61781 - RNA, 46 nt, Mus musculus
cagcauucauagagaggguaaccacagggauggagugauaagggaa

SEQ ID NO: 61782 - RNA, 42 nt, Mus musculus
caccgucaccagaagauuugaauaauacaccacuuggugcag

SEQ ID NO: 61783 - RNA, 46 nt, Mus musculus
uugccuuuagacagugggcugaaagccauaaccagcguacuuguag

SEQ ID NO: 61784 - RNA, 45 nt, Mus musculus
ggaggcacagcugcuagccuucuuuguggaaguaaaguaaaacag

SEQ ID NO: 61785 - RNA, 45 nt, Mus musculus
cuccacucaaagcuuagcacacaccucuuugcagacagcagauga

SEQ ID NO: 61786 - RNA, 46 nt, Mus musculus
cccggcuucaaaagccuaguuuuaaguaauaaaaaguaaaauccag

SEQ ID NO: 61787 - RNA, 81 nt, Mus musculus
ugcguucuuugaugugagaacagaccuguugccaaagacucuaagaugguaaccugcccugggauuuaaaccaugcccuga

SEQ ID NO: 61788 - RNA, 72 nt, Mus musculus
uucuauauggagauaccagucacagauuauguuaaauauaggcagauauaaauugucuuuggaaauucaaaa

SEQ ID NO: 61789 - RNA, 46 nt, Mus musculus
uuuauuugcugaaguuauuuuuuuuaaauguaguuagaaaugagac

SEQ ID NO: 61790 - RNA, 47 nt, Mus musculus
cccccuaauagggauagaaguuccccuccuccaggauacauuccaga

SEQ ID NO: 61791 - RNA, 46 nt, Mus musculus
aggaacauauccaagaagguaccacguuuccuaucaucaccaggag

SEQ ID NO: 61792 - RNA, 46 nt, Mus musculus
ggucuccugugagcuucaguccuacugaucacuccuuaagcacuag

SEQ ID NO: 61793 - RNA, 46 nt, Mus musculus
uuuuguuugcuccuguaccugugcaccuuggacuucgaauuccccu

SEQ ID NO: 61794 - RNA, 45 nt, Mus musculus
aagcaagaacaaaagcaggacuagucagauugcuucaaccagaga

SEQ ID NO: 61795 - RNA, 45 nt, Mus musculus
cacauagaggcucacaacucucucuuaacuucauauccagggcug

SEQ ID NO: 61796 - RNA, 46 nt, Mus musculus
cucaggagaaaacacuuuccaucuuuauggaguauaugccaggggu

SEQ ID NO: 61797 - RNA, 46 nt, Mus musculus
auaggaugugcccaacucacaugggaacaggcgaacagacagcaag

SEQ ID NO: 61798 - RNA, 45 nt, Mus musculus
ucuggaggggguccauuauuugcauaguaauaugauuguccauag

SEQ ID NO: 61799 - RNA, 45 nt, Mus musculus
uucacauuuccccuaagggucagauacagaaaugaguaugcgaag

SEQ ID NO: 61800 - RNA, 45 nt, Mus musculus
uagagaugacucuucuugucuguggguuaugugagugugugugug

SEQ ID NO: 61801 - RNA, 46 nt, Mus musculus
uuagcucuguuguuuuuggaaaauacauuuuauuggauucugcaug

SEQ ID NO: 61802 - RNA, 45 nt, Mus musculus
cauucacagagcagucagagcagcggucagagggacgguguaggg

SEQ ID NO: 61803 - RNA, 46 nt, Mus musculus
ugccaucucuaguacaguuaugaaacuuaaaacaugaaggugucag

SEQ ID NO: 61804 - RNA, 54 nt, Mus musculus
aagugcuaaguauuuuauuuuuccaaagccuagaagauaacaaguuuuccagga

SEQ ID NO: 61805 - RNA, 45 nt, Mus musculus
uaaauuaauauucuucaggaaauuacaguuguggaacaugggcag

SEQ ID NO: 61806 - RNA, 46 nt, Mus musculus
uuuagcagugaugcuuaaaaugcuaggauuuuuauaugaaaaaaua

SEQ ID NO: 61807 - RNA, 41 nt, Mus musculus
ugcgugcgugcguguaugcguguguggcauuggggcagggg

SEQ ID NO: 61808 - RNA, 49 nt, Mus musculus
accaagucauuucucagagguacuaaaaguggucaagguugagcuucug

SEQ ID NO: 61809 - RNA, 46 nt, Mus musculus
cauauaauucuucaugguuuauguguuuguguauuuuaauagacag

SEQ ID NO: 61810 - RNA, 46 nt, Mus musculus
aguagacuagugugggacucugcaagccuaaaaggauuaugggcaa

SEQ ID NO: 61811 - RNA, 46 nt, Mus musculus
uugaauauuuccuuuauuuccaaaguguucauuuuucucuuacuga

SEQ ID NO: 61812 - RNA, 39 nt, Mus musculus
caaaaagaaauccaagaagaggcaguaugaagaggaaga

SEQ ID NO: 61813 - RNA, 59 nt, Mus musculus
gguggacgaguccagcaccaaaguggaugaguauggagcaaaggacuacagacagcaga

SEQ ID NO: 61814 - RNA, 46 nt, Mus musculus
gcuaaaucuuggacauucuuacaccuccaaaauucaaacgugagaa

SEQ ID NO: 61815 - RNA, 42 nt, Mus musculus
guucuccacuucaccccagccccccauaugaugacaagccag

SEQ ID NO: 61816 - RNA, 46 nt, Mus musculus
auacccugugcagagagacgugcagggauuguuuacagagcccaga

SEQ ID NO: 61817 - RNA, 52 nt, Mus musculus
ggcuaaacuuacuggccagcgaugccccccaccucccaccccaacuuaaucu

SEQ ID NO: 61818 - RNA, 46 nt, Mus musculus
gccacauuuucuuggaagccuucucuccaguuuacaaauaugccca

SEQ ID NO: 61819 - RNA, 54 nt, Mus musculus
agcuaaccgccuacucccucuaugcagcggucaguguugggcugcaaaccagug

SEQ ID NO: 61820 - RNA, 88 nt, Mus musculus
gggcagugcuguugugcucugaggggcagcucacaaucucaguagcaaguuauggcgaacacacaaacgaccugcucccuuccagcag

SEQ ID NO: 61821 - RNA, 59 nt, Mus musculus
ggucgggaugggggcuguggccaugcaggggaaaggaaaacggaaaacacagcagaggu

SEQ ID NO: 61822 - RNA, 46 nt, Mus musculus
ccucaagcacaacaggugagcacugcccucugugugccagccggga

SEQ ID NO: 61823 - RNA, 47 nt, Mus musculus
uugaaaguucccacccugauguuauccagcaucuucuucaagaccca

SEQ ID NO: 61824 - RNA, 49 nt, Mus musculus
ugacauacccaaagaccuguuugauuuuuaugagcaaauggacaaggau

SEQ ID NO: 61825 - RNA, 46 nt, Mus musculus
uuuccugauugggcccaagcucuaugaagccaacuggauggagcug

SEQ ID NO: 61826 - RNA, 46 nt, Mus musculus
gacaguccaagcuguggguuagcuacuagccaguauucagaaccac

SEQ ID NO: 61827 - RNA, 45 nt, Mus musculus
cugguggaaagcugaaaacaaaagaggguguugaacuagacguug

SEQ ID NO: 61828 - RNA, 42 nt, Mus musculus
gagacugugccgagccugugccgagacugugccgagggugau

SEQ ID NO: 61829 - RNA, 46 nt, Mus musculus
cuggcaaaagcggguauuagaugaggcuuccuuuuuggagcuggag

SEQ ID NO: 61830 - RNA, 44 nt, Mus musculus
caggcagggcuaugagguggggcuugacuacgugagugcagacc

SEQ ID NO: 61831 - RNA, 62 nt, Mus musculus
gcagcauuuauuuguguugcaagggcuguggaagcauagugccaaguguauguguugugugu

SEQ ID NO: 61832 - RNA, 85 nt, Mus musculus
auuaaacauucagauaagauuguuuaauuacacucaucuauuugagggaggggcgacacaagugugccguauuguauguguggag

SEQ ID NO: 61833 - RNA, 65 nt, Mus musculus
gaguucugaggugcuaaaagggaaacuacaguuaggauguauuguggaagaaggugugugugcac

SEQ ID NO: 61834 - RNA, 37 nt, Mus musculus
gaaggugcuggcagccaccgacuuggaugcagaggag

SEQ ID NO: 61835 - RNA, 45 nt, Mus musculus
gaaaaccagucagugugaggccuuaacugccuucguggguccuag

SEQ ID NO: 61836 - RNA, 24 nt, Mus musculus
agcuuccacacauaugacgugagu

SEQ ID NO: 61837 - RNA, 42 nt, Mus musculus
agacccuauccucccucggucauaauuuuuuuuucccacaag

SEQ ID NO: 61838 - RNA, 46 nt, Mus musculus
uagugugcaaacuagucaugcccacuguuuuucuaugauccaggaa

SEQ ID NO: 61839 - RNA, 46 nt, Mus musculus
guggauacugacagcguucuuauuauuuggcacauuuauucagaag

SEQ ID NO: 61840 - RNA, 46 nt, Mus musculus
agggaucucuuaaaguaguacuccaaaguuuggacaccaaccccug

SEQ ID NO: 61841 - RNA, 46 nt, Mus musculus
ucuuugcauuuuguuucaguggcugguagagcugcucagaaagcag

SEQ ID NO: 61842 - RNA, 46 nt, Mus musculus
aucucuacaauuuugcauccaagcaccuauuugaauaaaguccuac

SEQ ID NO: 61843 - RNA, 46 nt, Mus musculus
uuacuuuacuuacuaccaaugugaugacuacccacuauuaguagag

SEQ ID NO: 61844 - RNA, 46 nt, Mus musculus
uuccaucaggacuggggacccauuacuuccauuucauuucgcacag

SEQ ID NO: 61845 - RNA, 46 nt, Mus musculus
uuuuuaaaaacauauuuguacuuuaauaaaaauuaaaauacugaag

SEQ ID NO: 61846 - RNA, 46 nt, Mus musculus
caauaauggcagcuggaagcccguguggccauauuggacucuggga

SEQ ID NO: 61847 - RNA, 46 nt, Mus musculus
cucgaaguggcuaagaguuacagcuuagccuucaaugcagcacugc

SEQ ID NO: 61848 - RNA, 45 nt, Mus musculus
guugagauucagaauggggcauagugcuucucuuaccaagauuag

SEQ ID NO: 61849 - RNA, 46 nt, Mus musculus
aaaaugcaaaucucuccuauucauuccugcaaaauagagacccaga

SEQ ID NO: 61850 - RNA, 46 nt, Mus musculus
uuaaugagucuuucagcaaacaugucacuuacugucuuaccugaag

SEQ ID NO: 61851 - RNA, 42 nt, Mus musculus
ucccucuauucaguugucucccugcgaccacuuccuccagau

SEQ ID NO: 61852 - RNA, 46 nt, Mus musculus
agccaagugaugaaaugauagaguaugagucgccagaacaguugag

SEQ ID NO: 61853 - RNA, 48 nt, Mus musculus
ugggcuuguccccagguuugcuguacccgaacccagcagugaccccca

SEQ ID NO: 61854 - RNA, 46 nt, Mus musculus
cuugggauuuuggcucaaaagucaaauuucuaccugaaacuugaag

SEQ ID NO: 61855 - RNA, 46 nt, Mus musculus
gauuggaaugauguuggacagaaagcgugauuucgaguuggcccag

SEQ ID NO: 61856 - RNA, 46 nt, Mus musculus
ucuuucuagaagcucugcacaucgagagaacuuaaaaccaccugag

SEQ ID NO: 61857 - RNA, 45 nt, Mus musculus
auauuaaaaagaaaucaguggguucuuuuuuucuagguggcuuuu

SEQ ID NO: 61858 - RNA, 46 nt, Mus musculus
agaaaaggcauaaauaaaugcuuugcggccuuugcuugcccuggag

SEQ ID NO: 61859 - RNA, 46 nt, Mus musculus
gaucguucuccgucugaacacugggaucuucgguacugccgguaac

SEQ ID NO: 61860 - RNA, 45 nt, Mus musculus
acuuaauuuuuaugaucucugaaagcaguaaauuucacagcauuu

SEQ ID NO: 61861 - RNA, 45 nt, Mus musculus
auguuaccacuuagacuucuguaucuguaauaccuugcacggugg

SEQ ID NO: 61862 - RNA, 42 nt, Mus musculus
auaagucuuaaaaggacuugaacggaggaaguaguggcagag

SEQ ID NO: 61863 - RNA, 46 nt, Mus musculus
guucuucauugugaugauuucugccucuuaugugcccugcccccuc

SEQ ID NO: 61864 - RNA, 45 nt, Mus musculus
cuuaccaaguacuuaauuaugggaaguuagauuugugguuuucag

SEQ ID NO: 61865 - RNA, 46 nt, Mus musculus
uuauuucagaaaaaucuuccauagguuuuauaaauuuccggcagcc

SEQ ID NO: 61866 - RNA, 42 nt, Mus musculus
gucuggcaggcacaaggccguggcuucaacccuuagcacuaa

SEQ ID NO: 61867 - RNA, 46 nt, Mus musculus
uaagaagaaagggaguagucauagucaaauauuacuaagcagaugg

SEQ ID NO: 61868 - RNA, 42 nt, Mus musculus
gaguaugcaggagguggaaggcugacuuugaguugucggcag

SEQ ID NO: 61869 - RNA, 45 nt, Mus musculus
uaaaaauagauuuguuccagguuugaggagacaugcaaagcuuag

SEQ ID NO: 61870 - RNA, 41 nt, Mus musculus
guguggugaaguaaggaguaugugggguggugugugugugg

SEQ ID NO: 61871 - RNA, 76 nt, Mus musculus
guguguguguggugaaguaagggguauguggggugguguguguguggugaaguaagggguaugugggguggugugu

SEQ ID NO: 61872 - RNA, 41 nt, Mus musculus
guguguguguggugaaguaagggguaugugggguggugugu

SEQ ID NO: 61873 - RNA, 76 nt, Mus musculus; identical to SEQ ID NO: 61871

SEQ ID NO: 61874 - RNA, 50 nt, Mus musculus
cauaauaccaaauuacaaaauauauuuuagacuuuaguaacagauuuugu

SEQ ID NO: 61875 - RNA, 46 nt, Mus musculus
gcuguaaauuuuaaggauauaauuucuuaucauuuuuccuuuugag

SEQ ID NO: 61876 - RNA, 46 nt, Mus musculus
aaucuuacauucuucucuauuuaaaaauauguauuccauugccugu

SEQ ID NO: 61877 - RNA, 46 nt, Mus musculus
aacuugaaucagcuaaugauuaaagcuucuauuacacaugccccag

SEQ ID NO: 61878 - RNA, 42 nt, Mus musculus
agugucuuuaaaaauggagggcaugaagaaacaggcauuaag

SEQ ID NO: 61879 - RNA, 43 nt, Mus musculus
agaugaauuuccugugcuucugauccugggauuuugacagaag

SEQ ID NO: 61880 - RNA, 46 nt, Mus musculus
augccuguugacaguggaguggaauaacaguaucuaaggaaacgag

SEQ ID NO: 61881 - RNA, 32 nt, Mus musculus
uuggccacaaggacacaggcagugguagccaa

SEQ ID NO: 61882 - RNA, 45 nt, Mus musculus
acagucugauagguccuuuucaaggaguagucuccugccccccaa

SEQ ID NO: 61883 - RNA, 46 nt, Mus musculus
uggaccuaaaagaauaagaugcauccuaacaaagcagaggaggaaa

SEQ ID NO: 61884 - RNA, 46 nt, Mus musculus
uaggauugcaugaaauguauucccaaaguaaugcaugagcucacaa

SEQ ID NO: 61885 - RNA, 49 nt, Mus musculus
guuaaagcaaguugaggcacugaagauggagaacucaaaucuucgacaa

SEQ ID NO: 61886 - RNA, 24 nt, Mus musculus
cuuucaguguuuccucuuguaaac

SEQ ID NO: 61887 - RNA, 46 nt, Mus musculus
aauaaauuaaccuugguguugguucauucuuagucuuuaauccuag

SEQ ID NO: 61888 - RNA, 40 nt, Mus musculus
cucuagccaaccagcaucaaguaucccaagcaaagcaaag

SEQ ID NO: 61889 - RNA, 46 nt, Mus musculus
gcagcuacagggaaguauugaagaugagacuaugacuucuggacag

SEQ ID NO: 61890 - RNA, 42 nt, Mus musculus
agugaaacuacgcucaaaaaugucccuucgcuccuacggaag

SEQ ID NO: 61891 - RNA, 46 nt, Mus musculus
auucccaagaagaacauuuguaaauggaagcagagagaguacuggg

SEQ ID NO: 61892 - RNA, 46 nt, Mus musculus
ugaaucuuacucuuuguaguauaaaugucacuggcuauaggcccgg

SEQ ID NO: 61893 - RNA, 46 nt, Mus musculus
uacaugauacgugccuguaauggcuguguccagaacagcuuuagag

SEQ ID NO: 61894 - RNA, 46 nt, Mus musculus
gaggcaacacccauacagagaaaaauaaauguaauaaaagaagcag

SEQ ID NO: 61895 - RNA, 45 nt, Mus musculus
uucaguccuaacagaaaauaaguuguccccacacaccacccccuu

SEQ ID NO: 61896 - RNA, 48 nt, Mus musculus
cugacugcuaggcauuuuaauaauguucugauaagaacgaucauagaa

SEQ ID NO: 61897 - RNA, 46 nt, Mus musculus
uaguaaugaaaagggguuguuuuuaaaggaaaacucuaaagccuag

SEQ ID NO: 61898 - RNA, 46 nt, Mus musculus
augcuauuaaugaucuauucaaacagccuuauucauuguagcccaa

SEQ ID NO: 61899 - RNA, 42 nt, Mus musculus
gcuauguccagcucccaagacagcuguauauccaugcggcag

SEQ ID NO: 61900 - RNA, 46 nt, Mus musculus
cacuccacaacaucauucacucacagccugaugacaagagaggcag

SEQ ID NO: 61901 - RNA, 44 nt, Mus musculus
cgagaucugacuccccucuucuggagugucugaagacagcuaca

SEQ ID NO: 61902 - RNA, 46 nt, Mus musculus
aaguguuuugaggaauuugucuuggcgagcagauguaaauagcaaa

SEQ ID NO: 61903 - RNA, 46 nt, Mus musculus
ggugacuaugcuuuugacgccaaucgacaugaugauaguaggucag

SEQ ID NO: 61904 - RNA, 41 nt, Mus musculus
ucaaggggaaguuuagacaguucucguucugagaaagacag

SEQ ID NO: 61905 - RNA, 47 nt, Mus musculus
ucaucaaaacgaggucugcagaucacuaccacugcagcccagauagc

SEQ ID NO: 61906 - RNA, 46 nt, Mus musculus
cucugccucccacacacacucaaacacauacaacuucacuaagucg

SEQ ID NO: 61907 - RNA, 46 nt, Mus musculus
agaggccaaaugaaacccucaguugaauccuauucugaagaugaug

SEQ ID NO: 61908 - RNA, 46 nt, Mus musculus
uuacagucuuaaauauucagaugagcaguugaacucaggaaggcag

SEQ ID NO: 61909 - RNA, 51 nt, Mus musculus
ccaacuacagugaacguuauucugaggaagaacaacaugaagaagaagaag

SEQ ID NO: 61910 - RNA, 49 nt, Mus musculus
aaaaguggugcucagacacccaaaagucccccagaacacuauguccagg

SEQ ID NO: 61911 - RNA, 24 nt, Mus musculus
aagcaaaaccccuccaccuccucc

SEQ ID NO: 61912 - RNA, 46 nt, Mus musculus
gacuuauuagaugauucugaugacgaugauauugaaauauuagaag

SEQ ID NO: 61913 - RNA, 49 nt, Mus musculus
aucucaucuauaguuacaccagaccuggaugacaacaaagcagaggaag

SEQ ID NO: 61914 - RNA, 54 nt, Mus musculus
cacuaagaaaaagaagccuacuucaccaguaaagcccaugccacaaaauacuga

SEQ ID NO: 61915 - RNA, 90 nt, Mus musculus
agaaacuuucucagacaacaaagacucaaagaaaccaagcuuacaaaccaaugccaaggccuucaaugaaaagcuaccuaacaaugaaga

SEQ ID NO: 61916 - RNA, 91 nt, Mus musculus
aguuaagaaagggcaaagaaagcaaggauuccgaagccaaaguuaccugccgcccagaaccaaacucaagccagcaggcagcuaguaaguc

SEQ ID NO: 61917 - RNA, 45 nt, Mus musculus
caccugaucaagaggaaaagccauucacaagcaauaaaggcccaa

SEQ ID NO: 61918 - RNA, 51 nt, Mus musculus
uacaagcccugucucuaagaaaggcccaccccucaagacuccagccucuaa

SEQ ID NO: 61919 - RNA, 46 nt, Mus musculus
cagcaguauccccagaagugagucggcaucuaaaggacugaaucag

SEQ ID NO: 61920 - RNA, 46 nt, Mus musculus
aggccugcauuaguacgccagucuacuuucaucaaagaagccccaa

SEQ ID NO: 61921 - RNA, 29 nt, Mus musculus
aagauucaaaagacacccaugggaaacag

SEQ ID NO: 61922 - RNA, 47 nt, Mus musculus
acagaguaacccagucucuauagcagagacugcugagacguguauag

SEQ ID NO: 61923 - RNA, 46 nt, Mus musculus
aguauauuuguacaguguguuuuacauguauuuaaguagcauccau

SEQ ID NO: 61924 - RNA, 45 nt, Mus musculus
ggacugcagcaaagaaagccuaagguagcaauuucaaacaggugu

SEQ ID NO: 61925 - RNA, 42 nt, Mus musculus
gaugggcaguaagaggcuauggaaagggaaauucaggaugag

SEQ ID NO: 61926 - RNA, 46 nt, Mus musculus
aaugaaaaaauuaaacuguccaaagcuaaaggguuuacauggucag

SEQ ID NO: 61927 - RNA, 42 nt, Mus musculus
aaaguaauuuugcugcaucaaccccacaacuuugcgggagac

SEQ ID NO: 61928 - RNA, 56 nt, Mus musculus
uaggagcagaguguuaauauacaaaauacuuucuguggggaaugggcaggcaggga

SEQ ID NO: 61929 - RNA, 64 nt, Mus musculus
uuagguccuuauaaguaaaagcacguuuuucuuguuggcagaaugaaaauuacaguguagcaua

SEQ ID NO: 61930 - RNA, 46 nt, Mus musculus
acuuucaagacaaauagauaguaauucuccuccagaugacuaagau

SEQ ID NO: 61931 - RNA, 41 nt, Mus musculus
gucagagguuugggucuaaaaaucugcaguuugcaccauau

SEQ ID NO: 61932 - RNA, 45 nt, Mus musculus
aaagcauuuucauuuaaaccuaacagagugggcaguaccucaagu

SEQ ID NO: 61933 - RNA, 46 nt, Mus musculus
ucguuggauaauguugccuuggaaacuucccgcuguauuaaaaaug

SEQ ID NO: 61934 - RNA, 41 nt, Mus musculus
ucacccgccuuagucaccaccuuaucuaguagccagggagg

SEQ ID NO: 61935 - RNA, 60 nt, Mus musculus
ccguccuaucuuccucaagcacgagucccagguagacaguguggugaaggacgugaagga

SEQ ID NO: 61936 - RNA, 42 nt, Mus musculus
gcaggguaugugcgcucaccugcgugugccccacccccacac

SEQ ID NO: 61937 - RNA, 42 nt, Mus musculus
gcucccucuccugcucuuuucuuguuuugcugugguucaggg

SEQ ID NO: 61938 - RNA, 46 nt, Mus musculus
uaauugucacagcaacgcaguaagguuucucagucacuugguagau

SEQ ID NO: 61939 - RNA, 42 nt, Mus musculus
aauacuaaagaaaacaauuuccccaguauaucucccggaguu

SEQ ID NO: 61940 - RNA, 46 nt, Mus musculus
agaagaacugcaugacugaucuccucgccaagcucgaggccaagac

SEQ ID NO: 61941 - RNA, 27 nt, Mus musculus
gggggggggggggggggcagcgcagug

SEQ ID NO: 61942 - RNA, 42 nt, Mus musculus
ugcacugaacucaugguuagcaguggggauaguuaggcagcu

SEQ ID NO: 61943 - RNA, 79 nt, Mus musculus
aacaacuuuggaaagccagagcugagaaaaagaaacuacguaagaugcuacgggaguuugaagaagcguucuaucaaca

SEQ ID NO: 61944 - RNA, 42 nt, Mus musculus
gagccaccgugugggugcuagaaacugaaccaggguccuccg

SEQ ID NO: 61945 - RNA, 41 nt, Mus musculus
gaaggagaaacggcacacuuuuuugaagaaaucaagguacu

SEQ ID NO: 61946 - RNA, 45 nt, Mus musculus
auaaacuaaguaaaauuaaacaguguuaauucacagggccagaga

SEQ ID NO: 61947 - RNA, 45 nt, Mus musculus
accuaaguagccaaguaugagaaguuuucaguugagauuguggau

SEQ ID NO: 61948 - RNA, 42 nt, Mus musculus
uuuuguuuuguuuuuuguuuuuuguuuuggcuucaggugacc

SEQ ID NO: 61949 - RNA, 46 nt, Mus musculus
gaaaacgucucugcagaaaagucugcuuuacuaugaaagucaacac

SEQ ID NO: 61950 - RNA, 41 nt, Mus musculus
acuguuaccagggcucuuacaucagugaguacaggccuuug

SEQ ID NO: 61951 - RNA, 46 nt, Mus musculus
agaguacuuacuguauguuaaugcauguugcagacugucagcgaga

SEQ ID NO: 61952 - RNA, 46 nt, Mus musculus
cuccucuccaagcugacugauucaaucuggcuccucuuuguuucuc

SEQ ID NO: 61953 - RNA, 56 nt, Mus musculus
agaagacagaacaccauaucaguuggucaagaaacuucagaaaaaaaucagacaau

SEQ ID NO: 61954 - RNA, 46 nt, Mus musculus
ugugcccuuggcguuguguuauguguaugguuuguucugccugguc

SEQ ID NO: 61955 - RNA, 46 nt, Mus musculus
uuuccuuacuugugaaauagaaauauauguuugcuuaaaguuuguu

SEQ ID NO: 61956 - RNA, 46 nt, Mus musculus
gagcaaaguuuguauuauauagauugcaaaaguauuuugaggagac

SEQ ID NO: 61957 - RNA, 46 nt, Mus musculus
uaccaguuuagaacaggguauuuagcuaccuuauaaucaucgagaa

SEQ ID NO: 61958 - RNA, 45 nt, Mus musculus
ucaaagaaagaccaaaauuuguuaaaaauaaaaagugcccuagau

SEQ ID NO: 61959 - RNA, 46 nt, Mus musculus
uaaauacuguuauuuguaacugaaauaacccaaagcaugacaagac

SEQ ID NO: 61960 - RNA, 46 nt, Mus musculus
uugguguucaaggagaagcagcguguauacagauugcgcaguuaga

SEQ ID NO: 61961 - RNA, 46 nt, Mus musculus
guguacucguuuaguccuagcacuugugaggcagggguagguggga

SEQ ID NO: 61962 - RNA, 45 nt, Mus musculus
gcuguaaguucccuguggagaacugaugagaaggcacguggggag

SEQ ID NO: 61963 - RNA, 46 nt, Mus musculus
acuggccaccuugccaucccuaugaauguuuucuuaaagaggagaa

SEQ ID NO: 61964 - RNA, 53 nt, Mus musculus
uuaggccaacuaaaagauguucaguacauaucuguggggacugacugcaagag

SEQ ID NO: 61965 - RNA, 52 nt, Mus musculus
acuaaagaaaggaauaucaacagugagauauucuggaagcucaauggagagu

SEQ ID NO: 61966 - RNA, 47 nt, Mus musculus
cacacaacacaugauaucaaagguacuagagaaaaugagaccaucaa

SEQ ID NO: 61967 - RNA, 32 nt, Mus musculus
agcuagguauguucauuaacaaccaccauuuc

SEQ ID NO: 61968 - RNA, 46 nt, Mus musculus
cuacugaaaaaaacaaaaacaaaacaaaaaaaaaacaacccuagaa

SEQ ID NO: 61969 - RNA, 48 nt, Mus musculus
gcugaccuguguugcgguaaaucucccaaauaugccccggcaaugaaa

SEQ ID NO: 61970 - RNA, 47 nt, Mus musculus
gccugaauggcagaguuccuggguuugauuccuagaacugagagaga

SEQ ID NO: 61971 - RNA, 31 nt, Mus musculus
uuggcauaaugcuuuuaaaaaaagaaaaaga

SEQ ID NO: 61972 - RNA, 45 nt, Mus musculus
agauauuugaacugaggagauuuuauggauuuaauguucugauac

SEQ ID NO: 61973 - RNA, 26 nt, Mus musculus
gcaugucaugguacauguguggaggu

SEQ ID NO: 61974 - RNA, 46 nt, Mus musculus
cuguuguaccugauaagguauaugugaugguguccaguacugaguu

SEQ ID NO: 61975 - RNA, 45 nt, Mus musculus
auucuuuauacggacugcuguccucuuccacaggauguuguuaga

SEQ ID NO: 61976 - RNA, 41 nt, Mus musculus
cugcugugaguugcaucagaucugcuccuguguguguuuuu

SEQ ID NO: 61977 - RNA, 46 nt, Mus musculus
acuaacaggcugguauguagcauuaguuuccaaguugcccccaaua

SEQ ID NO: 61978 - RNA, 45 nt, Mus musculus
acaccagaagagggcauccguucccauuacagaugguugugagcu

SEQ ID NO: 61979 - RNA, 46 nt, Mus musculus
cuuuguguaguuguguucagcugugaaccgcucacugagcauagau

SEQ ID NO: 61980 - RNA, 46 nt, Mus musculus
ucugaaauagaauuucuaugcugugacagaacaccaugaccaagau

SEQ ID NO: 61981 - RNA, 58 nt, Mus musculus
agguuaaugaacuuucugaggaagaagaggaagaugaaaagcuggagcauauagaaga

SEQ ID NO: 61982 - RNA, 46 nt, Mus musculus
acacuuaauauuaaauggcuauuuaauguaccuagaaaauggagaa

SEQ ID NO: 61983 - RNA, 45 nt, Mus musculus
auaaagaagaauuguugagcagacaagacagucaaguggacagag

SEQ ID NO: 61984 - RNA, 46 nt, Mus musculus
aaugggcuuuguaaauaaugagaauccagugaggugguuugaagau

SEQ ID NO: 61985 - RNA, 45 nt, Mus musculus
augugcaugccuggugcccugauuggccggaaaaagguauuggau

SEQ ID NO: 61986 - RNA, 45 nt, Mus musculus
auuaauuuagaucuuucucggguuuagaauuuauaaguuagagau

SEQ ID NO: 61987 - RNA, 83 nt, Mus musculus
ggaagauaugaaagagcaggaaauugugagcaggauaauggcgggacuucuagaaaauuauuacgaguuuuuugagaaugaag

SEQ ID NO: 61988 - RNA, 46 nt, Mus musculus
uaauuaaaucuggggagcccagaaaggcuuuccaaaagugugagca

SEQ ID NO: 61989 - RNA, 66 nt, Mus musculus
gcagggggaucuugaauuuuaggccagucuugacuacauaggacucugucuuuaggaagaaagaaa

SEQ ID NO: 61990 - RNA, 45 nt, Mus musculus
uuuuuguaucaugucaagaacaugggaggaguuaacggucuagaa

SEQ ID NO: 61991 - RNA, 81 nt, Mus musculus
cucugccuccugagugcuggaauuaaagacgugcacuaccaccccccagcuugauuuuauauuuggaaaagggucucagcc

SEQ ID NO: 61992 - RNA, 42 nt, Mus musculus
acgcccggcuauagcaucuguuuuacagauaagcagcaaaga

SEQ ID NO: 61993 - RNA, 46 nt, Mus musculus
ucuguucuuggguuagugugaauuuguaccuuuaacgcccccuuuu

SEQ ID NO: 61994 - RNA, 42 nt, Mus musculus
aguagagaaaaugaaaggugggauaggcagaaagggcagugg

SEQ ID NO: 61995 - RNA, 46 nt, Mus musculus
acaggggguggcacaagcuuaacuggcggcucacuggcaacaguag

SEQ ID NO: 61996 - RNA, 46 nt, Mus musculus
aaucaucuguuauuggggucaugggggcuucuaagggugcagagcc

SEQ ID NO: 61997 - RNA, 46 nt, Mus musculus
ucuccaaguggguaaucaccuccuggggaggcagagucuacaggag

SEQ ID NO: 61998 - RNA, 46 nt, Mus musculus
uggguguggguggugucucucacaauguaguccuagcuggccugaa

SEQ ID NO: 61999 - RNA, 42 nt, Mus musculus
gguucugcaaagggcuugauugcucugcuaacugauacccua

SEQ ID NO: 62000 - RNA, 45 nt, Mus musculus
gcagcuacaauguacuuauauacauaaaauaaaugauucuuuuaa

SEQ ID NO: 62001 - RNA, 77 nt, Mus musculus
cagccacagcuacaaaguaagacccugucaugaaggaaugaaggagugaaggaaugaaggagugaaggaaggaagga

SEQ ID NO: 62002 - RNA, 33 nt, Mus musculus
acuacauauuauaccuagaggaagccaaaucua

SEQ ID NO: 62003 - RNA, 42 nt, Mus musculus
acuacuuugcauaaaguuguuuacauacggccccgcccccua

SEQ ID NO: 62004 - RNA, 69 nt, Mus musculus
cucugcuugucaugucucaccggauccuuucuccgccagcgggcuuacucucugaugaggauguuguag

SEQ ID NO: 62005 - RNA, 46 nt, Mus musculus
gaguuaaggccugccugguuuaccaaaugaguuccaagacagcuag

SEQ ID NO: 62006 - RNA, 46 nt, Mus musculus
gucugcauugagaauacagaaacccuugugcugcaggcacccaaag

SEQ ID NO: 62007 - RNA, 42 nt, Mus musculus
cugaccaugaaggagauggugaaggaugugcucaaagggcag

SEQ ID NO: 62008 - RNA, 42 nt, Mus musculus
gguagaggagguuggcaggaacccuggagggacauggggaaa

SEQ ID NO: 62009 - RNA, 45 nt, Mus musculus
aagauccugaaggaaucacugacaacuuucuaccaagagcagauc

SEQ ID NO: 62010 - RNA, 46 nt, Mus musculus
gcugcacaaguaucagcaaguguuaaaaccgccacccccagccaag

SEQ ID NO: 62011 - RNA, 64 nt, Mus musculus
ccaagccucugccaaaaagcggcugggagcaaaccaggaaaaccagcaaccaaaucaucaaccc

SEQ ID NO: 62012 - RNA, 46 nt, Mus musculus
gacccuggacagaaggagucaucuuccaugucgcuaaucccgugau

SEQ ID NO: 62013 - RNA, 45 nt, Mus musculus
cacacacaaagggauuuggggaugaagcuucaauagaggaaaggg

SEQ ID NO: 62014 - RNA, 46 nt, Mus musculus
ccuuaauggauguuugaguuguuuguaauauuucagaauccuagac

SEQ ID NO: 62015 - RNA, 45 nt, Mus musculus
ugugguucuuggacuuggccaugucugcacgguaacccgcggccc

SEQ ID NO: 62016 - RNA, 46 nt, Mus musculus
uauacacacauauacgcauauuugagugaucugucauugugcauaa

SEQ ID NO: 62017 - RNA, 42 nt, Mus musculus
agaguguguuuguuuuuuagaguaaguguaugugugcaugag

SEQ ID NO: 62018 - RNA, 45 nt, Mus musculus
ccuccgucuccugaguccuguagguuucugccacuacaugcagcu

SEQ ID NO: 62019 - RNA, 45 nt, Mus musculus
uggguuucaaagauucugacuugacagcuuuuaagcuuuccaguu

SEQ ID NO: 62020 - RNA, 47 nt, Mus musculus
uucguucgggacccgagauccguauagccucaucuuguuuguuagau

SEQ ID NO: 62021 - RNA, 46 nt, Mus musculus
cuaguugaguuuauaaucgcuuguaauuuuuauacuuucguuugag

SEQ ID NO: 62022 - RNA, 48 nt, Mus musculus
gugauuuuugucagagggucuaaaauauuuggggagauacaaaaaagg

SEQ ID NO: 62023 - RNA, 46 nt, Mus musculus
aagccuaccauuugaaaggcagugucaucauagcagaaagaaccag

SEQ ID NO: 62024 - RNA, 46 nt, Mus musculus
uccuucuguuccccagugccagaacuuccagaaccuucccguucag

SEQ ID NO: 62025 - RNA, 46 nt, Mus musculus
caguuuucucaauucuauaaaugguagagggaaccccaauaacuag

SEQ ID NO: 62026 - RNA, 31 nt, Mus musculus
ccauuucgaagaguuucaaugacgccugcug

SEQ ID NO: 62027 - RNA, 91 nt, Mus musculus
uguugcucacgaccagugccuuuaucuuuggcagaaacgugcacaaucccauuggcaucaaugucaaauguaacuucaaucuggggcacuc

SEQ ID NO: 62028 - RNA, 45 nt, Mus musculus
cuucacugaauguucaaaaccuugagauuuuaagugaugguggua

SEQ ID NO: 62029 - RNA, 46 nt, Mus musculus
acacuggguaauuccuaauguuuaugacucuuagaacaaaggacag

SEQ ID NO: 62030 - RNA, 47 nt, Mus musculus
aauaaguuugguaaagacgccucccagagucucaauacccagagaga

SEQ ID NO: 62031 - RNA, 45 nt, Mus musculus
uuuacucggggcucugccaaaaagaucuuguacagucugcugaac

SEQ ID NO: 62032 - RNA, 46 nt, Mus musculus
gaagcauccaugguaagguauggcaaguugaugucagucugcacag

SEQ ID NO: 62033 - RNA, 46 nt, Mus musculus
gcagcagcuguaggcucauugaucacucgaagcacauuuagcccag

SEQ ID NO: 62034 - RNA, 47 nt, Mus musculus
gugaugcuggcacauaccuuuaacccuagcaccugggagacagaggc

SEQ ID NO: 62035 - RNA, 42 nt, Mus musculus
gagacgcgcggccgcggcucugcuggcgcuuaucaugguggc

SEQ ID NO: 62036 - RNA, 71 nt, Mus musculus
gcugaugcuuagagaaaacuugaauugguguguguguaaagcauggaguugaguggggaaggucauguggg

SEQ ID NO: 62037 - RNA, 46 nt, Mus musculus
cucuuggucauaucucaagauccagcauuuucauuccugguagcaa

SEQ ID NO: 62038 - RNA, 46 nt, Mus musculus
uucuuuuaaucaccuggcaaacuuacuuauuuuuugaagccucugg

SEQ ID NO: 62039 - RNA, 49 nt, Mus musculus
guaucuuacacaguuuuuauauuacauuuuuuauacuguuugguaaaug

SEQ ID NO: 62040 - RNA, 46 nt, Mus musculus
gcagccuguaauucuuauuuuugagaccgugucucauguagcccag

SEQ ID NO: 62041 - RNA, 42 nt, Mus musculus
gugccaccagggcuaacaaagugacaauccacauggggccag

SEQ ID NO: 62042 - RNA, 46 nt, Mus musculus
cagaagagggcauuggaucccuguuacagaugguugugagccacca

SEQ ID NO: 62043 - RNA, 45 nt, Mus musculus
auuaaguaggagggaagaaagguguugguucacuacauuugggga

SEQ ID NO: 62044 - RNA, 45 nt, Mus musculus
uuuuuuguauguguguggauacaugcauaccauuugaauguggag

SEQ ID NO: 62045 - RNA, 46 nt, Mus musculus
aacaauucaguggaggagaacacauuuuacauucuguauggggaug

SEQ ID NO: 62046 - RNA, 24 nt, Mus musculus
aguguugggcaugagggagaggcc

SEQ ID NO: 62047 - RNA, 46 nt, Mus musculus
gauggucgugagccaccaugugguugcugggaauugaacucaauuc

SEQ ID NO: 62048 - RNA, 47 nt, Mus musculus
aacagccuuaucacagcuccccucucucuucuccucccauuuccacu

SEQ ID NO: 62049 - RNA, 46 nt, Mus musculus
uugcuaaucuuuuuccuuauuucuuucuauaugucaguguugcuag

SEQ ID NO: 62050 - RNA, 47 nt, Mus musculus
aagaccuaggcuagagcuucagaacaguguguauuuuaucaguagga

SEQ ID NO: 62051 - RNA, 102 nt, Mus musculus
uuaaguuugcuguuuuuuauuaauguuggccagcucuagcagauuuuauaauagauuuuggaaaggagugcucuguaaguuaauugggaaacuagaagcugc

SEQ ID NO: 62052 - RNA, 46 nt, Mus musculus
uguuuagcgauucuaaacaauaccauuaauuguaaauaaccaggag

SEQ ID NO: 62053 - RNA, 46 nt, Mus musculus
agugucaauuaaguaucuuuuaaaugucuuuguuuggggguuggag

SEQ ID NO: 62054 - RNA, 45 nt, Mus musculus
uugcuuugugaagauauugaugucucagcugguuuucccugguca

SEQ ID NO: 62055 - RNA, 50 nt, Mus musculus
accauagccucuuuaaaaugcuucaguucuagcauuucuguuggaugcca

SEQ ID NO: 62056 - RNA, 61 nt, Mus musculus
agucagggaggugcucuggguaucucuagugaaaaugcauguagcagagcaaggcagcagu

SEQ ID NO: 62057 - RNA, 45 nt, Mus musculus
ugugagccuccaugugguugcugggaguggaacuuaggaccccug

SEQ ID NO: 62058 - RNA, 47 nt, Mus musculus
uacuuacauauaauaaauaaauaaaucuuuaaaaagaguacugucag

SEQ ID NO: 62059 - RNA, 46 nt, Mus musculus
agagaguuuaauuuuguuaauuaugaaaauagcuuuccccccugaa

SEQ ID NO: 62060 - RNA, 44 nt, Mus musculus
cacgcaggcaacauaaacuucaaaugggaccccaaaagucugga

SEQ ID NO: 62061 - RNA, 98 nt, Mus musculus
cuagguuacaacccugguaaacaccaauaguaaagggccgucuaauaaaaagagaggccguucuaagaaggcccauguuuuggcugcaucuguugaac

SEQ ID NO: 62062 - RNA, 104 nt, Mus musculus
aagcaacugagaauuucuuggaaaagggggauaaaauugcaaaagagagccaguuucucaaggaggagcuugugguugcuguagaagauguucgaaaacaaggu

SEQ ID NO: 62063 - RNA, 42 nt, Mus musculus
guagcugacaccuuacauuuuugucacaagcaugaagcagag

SEQ ID NO: 62064 - RNA, 45 nt, Mus musculus
auguuucuuauguguuaaaacauccauuggaucuuuaaauggaga

SEQ ID NO: 62065 - RNA, 46 nt, Mus musculus
auuuacuuaucaauuguguuuaggucaccuucuccuucggcuucuu

SEQ ID NO: 62066 - RNA, 72 nt, Mus musculus
auauacacauaaauaaaaugacaaaaauaaguuuuaaaaaaaugagucuuuugaagcugggcuguagcuuag

SEQ ID NO: 62067 - RNA, 84 nt, Mus musculus
ugguuaaauguuuucuuagcaugcauaggauccugacuuugauccccugcagcaaggggaaaauuauacuguuguuggugguag

SEQ ID NO: 62068 - RNA, 50 nt, Mus musculus
uuuuuuaaaguuuuugugguaugugugugugagagagagagagagagagu

SEQ ID NO: 62069 - RNA, 47 nt, Mus musculus
agcacaagaacauuugcaggugcuuguagaaaauagaggacagagaa

SEQ ID NO: 62070 - RNA, 46 nt, Mus musculus
ccaccaugcucagcugaaauaacugugacuguuauaucaaccacag

SEQ ID NO: 62071 - RNA, 48 nt, Mus musculus
aaagaaacuguagugugaaccuuaaacgucugcuccaaauggcuagaa

SEQ ID NO: 62072 - RNA, 46 nt, Mus musculus
augaugcauugcagagauaaaauuucaaguuauugaaagcaaccaa

SEQ ID NO: 62073 - RNA, 46 nt, Mus musculus
aacauacuauguagucugaauucuugauuaucuuccaucuccugaa

SEQ ID NO: 62074 - RNA, 46 nt, Mus musculus
guuauucaaucuguguaaaaugccuggaaaauagauguuaaaagag

SEQ ID NO: 62075 - RNA, 39 nt, Mus musculus
gcagcuaugaggagauuuguguggaugugugggucuuuc

SEQ ID NO: 62076 - RNA, 46 nt, Mus musculus
ggaguuuccugccacuaacugaccauguagcagaggaugaccucag

SEQ ID NO: 62077 - RNA, 45 nt, Mus musculus
gaaaucuuacauuucaaaaacaaagcaacauuaacaaaaaggaga

SEQ ID NO: 62078 - RNA, 46 nt, Mus musculus
uguauaugcauacauacagauaugugugcuccaucccugucuucag

SEQ ID NO: 62079 - RNA, 46 nt, Mus musculus
auuuuugcagauaaaaagcuuauugcaauuuuacugggcuggggag

SEQ ID NO: 62080 - RNA, 41 nt, Mus musculus
caguggaggccaugccucagugaggaaggcuggaggugguu

SEQ ID NO: 62081 - RNA, 44 nt, Mus musculus
gcugacauggcagaugucuacaaauuacuuguucagcugaaagu

SEQ ID NO: 62082 - RNA, 46 nt, Mus musculus
uaauuaggugcuccucaauaccuccaaaucacucagacaaugccag

SEQ ID NO: 62083 - RNA, 51 nt, Mus musculus
cugaaaccagaaguagauaagcugaacaucauggcagcaaaaagacaacag

SEQ ID NO: 62084 - RNA, 42 nt, Mus musculus
auuaggaagguuguuagacaugauccucaguguauuaaagag

SEQ ID NO: 62085 - RNA, 46 nt, Mus musculus
caacugaaaauugucuguuaacucuaguuccaggagaucugacacc

SEQ ID NO: 62086 - RNA, 48 nt, Mus musculus
auauaucaaagacuccugugucuuuaaguuucagugaugaccagaugc

SEQ ID NO: 62087 - RNA, 42 nt, Mus musculus
caauccucuauacugcaucccaggcaugucuacaacacccug

SEQ ID NO: 62088 - RNA, 45 nt, Mus musculus
uaauuugaauuuuuuuaucauaaugcuuuuauagaugguaccuag

SEQ ID NO: 62089 - RNA, 45 nt, Mus musculus
ggaggaggucgauugagauuuccuuuguguagcuuuggcuggcca

SEQ ID NO: 62090 - RNA, 57 nt, Mus musculus
agagagaauuuauaggaaguuauugucuuucauaguugaaauuuuugaaauauggca

SEQ ID NO: 62091 - RNA, 46 nt, Mus musculus
guggaccccuugagcuucagcgaggagcgcuuuaggccgucccugg

SEQ ID NO: 62092 - RNA, 46 nt, Mus musculus
cuaagauggcugaggaauuuguuuuuaugacugaugguacccccuc

SEQ ID NO: 62093 - RNA, 46 nt, Mus musculus
aaacaaauaaguaaaaucuuuaaaaaucagaaauuaauagagucag

SEQ ID NO: 62094 - RNA, 51 nt, Mus musculus
auaaaacaucuggaaacauuucagaccaccaauaauaaucaauuuaacugg

SEQ ID NO: 62095 - RNA, 46 nt, Mus musculus
aggauuugaacgugugugugugugugugugugugugugugugugug

SEQ ID NO: 62096 - RNA, 42 nt, Mus musculus
gguuuauauagugaguaccuguacagggaguggaagguggag

SEQ ID NO: 62097 - RNA, 45 nt, Mus musculus
guaugaaacugucuguacuaagaucuguacagaagaaaggguggc

SEQ ID NO: 62098 - RNA, 46 nt, Mus musculus
agcaacuggcuaagacucuuuuucuucuucgucucaugcuacuaag

SEQ ID NO: 62099 - RNA, 46 nt, Mus musculus
guuuccauaugcacacaguagcacaacauccccuucccaugcacac

SEQ ID NO: 62100 - RNA, 47 nt, Mus musculus
gguauuucuacugcugugguagaaaguaagaucaguuuugguagaga

SEQ ID NO: 62101 - RNA, 94 nt, Mus musculus
gugagaggcaucucaauugacaaccagagagaaauaguauguaccaucgcugcccuaaguaagucucagugggcuauauagcaggagccaggug

SEQ ID NO: 62102 - RNA, 46 nt, Mus musculus
cuuauuuugaagcuuuauuuucagguauguuugaauggcuugcuua

SEQ ID NO: 62103 - RNA, 46 nt, Mus musculus
ucaaaaaacauguuuuguuaugaacacggcauaggcaaacugagag

SEQ ID NO: 62104 - RNA, 45 nt, Mus musculus
ucucuaacaggagggguuguuucaauuuuguuugugugccaugug

SEQ ID NO: 62105 - RNA, 45 nt, Mus musculus
guagaugcaauuguuuagucucaguuucuguuuaguugggaggua

SEQ ID NO: 62106 - RNA, 46 nt, Mus musculus
ggauucgugauuggcugacauuuuugguaggugguagaaacuagga

SEQ ID NO: 62107 - RNA, 42 nt, Mus musculus
cugucugaguagguauucaagccaaacagaauacaccaguaa

SEQ ID NO: 62108 - RNA, 49 nt, Mus musculus
gguuucaucuguuucagguugggguaauguauuguacgugaagaauuga

SEQ ID NO: 62109 - RNA, 46 nt, Mus musculus
uuuguuucugguuaguucuuacuacuuggucaaauuccaaccccug

SEQ ID NO: 62110 - RNA, 46 nt, Mus musculus
ugguacugguuguaugcugaacuuugaauugagauguuuauuggag

SEQ ID NO: 62111 - RNA, 46 nt, Mus musculus
uccaugcuccucaaguaucuuuugucucuuuuagaaaaacuuguag

SEQ ID NO: 62112 - RNA, 42 nt, Mus musculus
aagagcaaggcccuggguucgguccucagcucuggggggggg

SEQ ID NO: 62113 - RNA, 45 nt, Mus musculus
aaagucauagguuuuuacuuaauggcgugaaucccuuucugugua

SEQ ID NO: 62114 - RNA, 46 nt, Mus musculus
uagaaaacucagucuucaaagacaguguaugccacguugcuguuag

SEQ ID NO: 62115 - RNA, 46 nt, Mus musculus
cucucacccacucggcuucucaaacccauccuccuucuuccccaag

SEQ ID NO: 62116 - RNA, 45 nt, Mus musculus
uagcuagaauuaaucuuucaaaaaccuaagcaacuuuuuuuauag

SEQ ID NO: 62117 - RNA, 46 nt, Mus musculus
ucaaacaaaacaaaacaaaacaaaacaaaacaaacgaaaucuagag

SEQ ID NO: 62118 - RNA, 49 nt, Mus musculus
auaaaggauauaaaauagaguacaaaauucuuuagugugagagcgcccu

SEQ ID NO: 62119 - RNA, 45 nt, Mus musculus
caguauucuuuacuucuugauuuugaaaauauuuguaagguuuaa

SEQ ID NO: 62120 - RNA, 46 nt, Mus musculus
aagggggggggguuuaaauagaaguccugauacaaauaaaccauag

SEQ ID NO: 62121 - RNA, 41 nt, Mus musculus
gaggugguuaaaaugcuuuauaaaggggaugggauggggcu

SEQ ID NO: 62122 - RNA, 46 nt, Mus musculus
gguucaaaaaaaguaguuucaacauuaagaccuugaaugauggcag

SEQ ID NO: 62123 - RNA, 41 nt, Mus musculus
uccuccucuuccuucuuuguuuuguauacuccuggccgcca

SEQ ID NO: 62124 - RNA, 42 nt, Mus musculus
ugaaugcugggauuaaaggugugcacucccaccuggccccag

SEQ ID NO: 62125 - RNA, 45 nt, Mus musculus
aguaggaguuuuuggucaauuuagcuggauucacugacagucaau

SEQ ID NO: 62126 - RNA, 42 nt, Mus musculus
gcagccuucagugcucaagugggcuuggcagggaaccggcag

SEQ ID NO: 62127 - RNA, 53 nt, Mus musculus
cuaggcugccaugucuuugauuggccccacaugcuacuuuucacucagccccu

SEQ ID NO: 62128 - RNA, 41 nt, Mus musculus
gagugagugagugagugagugagugagugagugaguggaga

SEQ ID NO: 62129 - RNA, 46 nt, Mus musculus
uccagacagaagaugaccagcugauagcuggccagagcgcccgggu

SEQ ID NO: 62130 - RNA, 54 nt, Mus musculus
uccucaggagcaaaaagcaaagauugcagaacagguggccaguuuccaggaaga

SEQ ID NO: 62131 - RNA, 46 nt, Mus musculus
aaaaacaccucugacgugaucagugcugccaagaaaauugcggagg

SEQ ID NO: 62132 - RNA, 46 nt, Mus musculus
ggaugggugacaucugucccucauuacucaaaccaacauuuggcag

SEQ ID NO: 62133 - RNA, 46 nt, Mus musculus
gugcugcaggagggggcucuaugaggccugggguauaguaaccuag

SEQ ID NO: 62134 - RNA, 45 nt, Mus musculus
ugcugcuccugggggguggggggagcaugcucuacccagagggag

SEQ ID NO: 62135 - RNA, 64 nt, Mus musculus
ggaccugcuggccuaccuucagcgcaucgcucucuacugccaccagcucaacaucugcagcaaa

SEQ ID NO: 62136 - RNA, 79 nt, Mus musculus
gucaaggcugaaguacagaaccuugguggagagcuggucgucucugggguaagugucaguaaugaggcgcacuggccag

SEQ ID NO: 62137 - RNA, 45 nt, Mus musculus
gucccugauccaggcggccaagaacuugaugaaugcuguugugca

SEQ ID NO: 62138 - RNA, 72 nt, Mus musculus
ggcuuccuugaaccuuccugcugugucauggaagaugaaggccccugagaagaagccguuggugaagagaga

SEQ ID NO: 62139 - RNA, 46 nt, Mus musculus
auuugcuaaguagagaacacugucuuauuccacagggagguagcag

SEQ ID NO: 62140 - RNA, 47 nt, Mus musculus
uucuuggucacauuucugaguaggcugaagugccugcuuucuaggua

SEQ ID NO: 62141 - RNA, 50 nt, Mus musculus
aggguggcccaguguaaaucacagggcaccuuagacggucuggagaagga

SEQ ID NO: 62142 - RNA, 46 nt, Mus musculus
aucgggcucauuucuaaucgucgcaguguuuccugcuuugggccag

SEQ ID NO: 62143 - RNA, 47 nt, Mus musculus
aggaagggaauaacaccuccuccuccuguagcugugcugagaggaua

SEQ ID NO: 62144 - RNA, 45 nt, Mus musculus
uagagaggcaagaugcuuuugugauuaaacaucuuugguaauagg

SEQ ID NO: 62145 - RNA, 44 nt, Mus musculus
aaggcugaaaggagcaagaaaaagaaggaagaggaagaugagga

SEQ ID NO: 62146 - RNA, 61 nt, Mus musculus
uugucuuggaucuuggccuugacauucucgauggugucacugggcuugaccucaagaguga

SEQ ID NO: 62147 - RNA, 89 nt, Mus musculus
ucuggauguuguagucggacagggugcggccauccuccagcuguuugcccgugaauaucagccucugcuggucaggugggaugccuucc

SEQ ID NO: 62148 - RNA, 46 nt, Mus musculus
gcuuuugguggauguagcacaguuuccacacugggaaggcaguguu

SEQ ID NO: 62149 - RNA, 47 nt, Mus musculus
gcugagacuguuacuaaguaaggagcugucacacaauuacugaaagu

SEQ ID NO: 62150 - RNA, 46 nt, Mus musculus
aaguaauuucacaagaaugucuuugagguuacaaggugauggucag

SEQ ID NO: 62151 - RNA, 46 nt, Mus musculus
cauaaaccauuuuuauagcauggaugaaagccaggcuaagcaagag

SEQ ID NO: 62152 - RNA, 46 nt, Mus musculus
gaaacaucagaagaggcugccuggagauguuggaacaggaccagga

SEQ ID NO: 62153 - RNA, 23 nt, Mus musculus
aagaaagggagaggagcuggugg

SEQ ID NO: 62154 - RNA, 31 nt, Mus musculus
gcuccucaccggaaacaucuuaaagaucugg

SEQ ID NO: 62155 - RNA, 46 nt, Mus musculus
gcaggaaucacauaucugacuuccggauccaaaagcagcaggagac

SEQ ID NO: 62156 - RNA, 46 nt, Mus musculus
acauuauaaagcaagaagauauacuuaauggcaaagagaaugagau

SEQ ID NO: 62157 - RNA, 30 nt, Mus musculus
uuagggacaucuuguucacaguauacagau

SEQ ID NO: 62158 - RNA, 44 nt, Mus musculus
cauauauguguguccaccaugugugugccuagagccuguggaga

SEQ ID NO: 62159 - RNA, 45 nt, Mus musculus
gcacaugcuuuuaauuccagcauucaggagauagaggcagaaaga

SEQ ID NO: 62160 - RNA, 46 nt, Mus musculus
gacauucccugcucucuguugaccuguguggaugguaccagcagac

SEQ ID NO: 62161 - RNA, 45 nt, Mus musculus
uucgucaggaagaaaaggaggagguuaccaugaaugcccccauga

SEQ ID NO: 62162 - RNA, 46 nt, Mus musculus
uugcagacccuguuugccaugucacaggaugccaaagcuggcuuca

SEQ ID NO: 62163 - RNA, 46 nt, Mus musculus
caccuagccucgcacgaacuuggacuacuguugaaaaaccucugcu

SEQ ID NO: 62164 - RNA, 42 nt, Mus musculus
gcuggugagugacuuuuugaacaccuucaguuuggggguuag

SEQ ID NO: 62165 - RNA, 46 nt, Mus musculus
auaggucgauuccccagggcauccguuaagugcggagagccccucg

SEQ ID NO: 62166 - RNA, 43 nt, Mus musculus
cggaaaaaaaaaaagaaacaacaaaaaaaaaaauaagagagau

SEQ ID NO: 62167 - RNA, 45 nt, Mus musculus
auuuucauuuuagcaaaaaaaauugucuuauaauacuagcuaacg

SEQ ID NO: 62168 - RNA, 23 nt, Mus musculus
ggcacugcuaacucaaacaaggu

SEQ ID NO: 62169 - RNA, 46 nt, Mus musculus
uacugaguagagaggagguggaggcugguuguguggugcgguacau

SEQ ID NO: 62170 - RNA, 46 nt, Mus musculus
gccacuacuaacaugcuuucaccucgcaggcuggcugcccaguguu

SEQ ID NO: 62171 - RNA, 45 nt, Mus musculus
gucugacugcacacacacacacacacacacacacacacacacaca

SEQ ID NO: 62172 - RNA, 45 nt, Mus musculus
ucuguaggaugaggauagagacagcuauaccuagaaggcagcagu

SEQ ID NO: 62173 - RNA, 45 nt, Mus musculus
gaugaggugguccaagggcagcggcagaugcuaacagacucaagc

SEQ ID NO: 62174 - RNA, 45 nt, Mus musculus
cucuucucugcccuucucucacccuguucuucuccagccccaggu

SEQ ID NO: 62175 - RNA, 45 nt, Mus musculus
gggagagaaccccgaagcccagggacuccagauagaucuaaggau

SEQ ID NO: 62176 - RNA, 46 nt, Mus musculus
cucaggaugcuguuacuccuccacuuggccacaaagcugaccugau

SEQ ID NO: 62177 - RNA, 45 nt, Mus musculus
gcaugggggcugugugugugugugugugugugugugugugugugu

SEQ ID NO: 62178 - RNA, 45 nt, Mus musculus
aaggcuggcaccucauuucugagguuucugaggaagucagcaagg

SEQ ID NO: 62179 - RNA, 45 nt, Mus musculus
cuaagaucagaauggcauagagccauaaacaggcaaagcauggua

SEQ ID NO: 62180 - RNA, 41 nt, Mus musculus
caguaacugcuccucucugcacgaacccuagaguccucaga

SEQ ID NO: 62181 - RNA, 25 nt, Mus musculus
uugggaaaaaaaauaagccguagau

SEQ ID NO: 62182 - RNA, 42 nt, Mus musculus
gagccaccaugugguugcugggaauuaaacuugggaccucug

SEQ ID NO: 62183 - RNA, 42 nt, Mus musculus
ccacccgaccccagggcacagcacccucucuauugggcagau

SEQ ID NO: 62184 - RNA, 46 nt, Mus musculus
ccacaagccuuaggucucuacagagcuuucauaccugaccccaaga

SEQ ID NO: 62185 - RNA, 45 nt, Mus musculus
auugaacagaaaggacacaagguauaugauuuaaaagggaauaua

SEQ ID NO: 62186 - RNA, 46 nt, Mus musculus
ggaacaaacuuagaggaaguuaaauucuaccuguagugucugagag

SEQ ID NO: 62187 - RNA, 46 nt, Mus musculus
uguuggauacuucuugacugguuuauuguuugugguggccccuagu

SEQ ID NO: 62188 - RNA, 46 nt, Mus musculus
uucuucuuuucucucucucucucucuuucucucucucucucucucc

SEQ ID NO: 62189 - RNA, 24 nt, Mus musculus
agucugugauccauuuaauguuua

SEQ ID NO: 62190 - RNA, 47 nt, Mus musculus
cagacuaaaaaggguuaguugggagaaucugcaaaacguggaaaaga

SEQ ID NO: 62191 - RNA, 42 nt, Mus musculus
accagcaggaaucugucuucuucuucugcacccggagcuuag

SEQ ID NO: 62192 - RNA, 41 nt, Mus musculus
cgcugaguccuucucugcaaccaccuuuuuccccacgcugc

SEQ ID NO: 62193 - RNA, 40 nt, Mus musculus
uuaaaguucaugagcaaugauguggaaggacuuggcagga

SEQ ID NO: 62194 - RNA, 46 nt, Mus musculus
gagaagaaaguugcuggagccuaggccaugguagaugcacccaugu

SEQ ID NO: 62195 - RNA, 42 nt, Mus musculus
auuuggcaguagaagacagcagggaagaaaggagggagagaa

SEQ ID NO: 62196 - RNA, 42 nt, Mus musculus
cucacccccggggccaucaaguguccucagcuguggagagac

SEQ ID NO: 62197 - RNA, 42 nt, Mus musculus
aucugaaagcaaugucuuauguuuuaugcugugugcccagaa

SEQ ID NO: 62198 - RNA, 46 nt, Mus musculus
agauugaaggcauucccaaagcuacccaguuggucagcacacagau

SEQ ID NO: 62199 - RNA, 46 nt, Mus musculus
ggagggggagagagagagagagagagagagagagagagaggugcaa

SEQ ID NO: 62200 - RNA, 41 nt, Mus musculus
gauagggagguggaaaaggaccuaggaggacuugagggagg

SEQ ID NO: 62201 - RNA, 45 nt, Mus musculus
guuuaguuugguaaagcauuacuuuuaaagacgaagggcugaagg

SEQ ID NO: 62202 - RNA, 45 nt, Mus musculus
aggcuuucugccuccugcaugccucucauugcuuggccccaaguc

SEQ ID NO: 62203 - RNA, 46 nt, Mus musculus
ugucuucuaaacagagacagaaaggguguggaucuggauggcggcg

SEQ ID NO: 62204 - RNA, 46 nt, Mus musculus
cagagccacauagaaagacccuguuucaaaacacugagggagagag

SEQ ID NO: 62205 - RNA, 42 nt, Mus musculus
uuuuggaacaaggcagaguaaagugacuacguacaggcagau

SEQ ID NO: 62206 - RNA, 47 nt, Mus musculus
aggagaaggagaaggagaaggagaagaagaagaagaagcagcucagc

SEQ ID NO: 62207 - RNA, 46 nt, Mus musculus
agagaaacccugucucaaaauccaaagaagaagaaggaggaggagg

SEQ ID NO: 62208 - RNA, 45 nt, Mus musculus
aaugaucaagcucaauuuuggugaugacucaggaaggaaugaagg

SEQ ID NO: 62209 - RNA, 46 nt, Mus musculus
aggacuuuggaguuuggacuucacuguguugguagugacgagccuc

SEQ ID NO: 62210 - RNA, 46 nt, Mus musculus
ggucggcucuugcgguacagaugagucgaguguguacugacgaggg

SEQ ID NO: 62211 - RNA, 45 nt, Mus musculus
uuuacuuggaggggaaagggggugugagaaaagucccucuggaga

SEQ ID NO: 62212 - RNA, 47 nt, Mus musculus
ccgcugauagccuggugggaaugacccaucuaagaggaagacauuag

SEQ ID NO: 62213 - RNA, 48 nt, Mus musculus
agaagaaaaagaagugcaggaacugagaaugggugcugagagccugga

SEQ ID NO: 62214 - RNA, 45 nt, Mus musculus
uuuggguuguguuuaaaagacagaguucaaauauuucuuguuaga

SEQ ID NO: 62215 - RNA, 45 nt, Mus musculus
agcugcugcguggcaaucaccugcccaaagguacagaaugccaga

SEQ ID NO: 62216 - RNA, 46 nt, Mus musculus
uuggagcuaaucaguuaagagcacuugcugcucuucuaugggaucc

SEQ ID NO: 62217 - RNA, 41 nt, Mus musculus
gguagaggacuccuggagggauggaggagggaaagcugaga

SEQ ID NO: 62218 - RNA, 82 nt, Mus musculus
ggggagaacauucccguagauacaaaaucccgaauaaaaucauggcgugugugggaguucagaacguauuuugagacuaggg

SEQ ID NO: 62219 - RNA, 108 nt, Mus musculus
ggcagauccagauccagcugggguugucagaaaaggcuuaaagagggagaggggauagagauaagccccgauagauggguccaggugaauuuggacaguagaugguag

SEQ ID NO: 62220 - RNA, 42 nt, Mus musculus
uggagauuaaacaguaaguuauaaaguucuugaagccaugag

SEQ ID NO: 62221 - RNA, 42 nt, Mus musculus
guacucucuccuucuauaacaauuuccuuccagccccuuaaa

SEQ ID NO: 62222 - RNA, 45 nt, Mus musculus
cuccauguaugucaccugucgugaaggucucuccuaucccuagug

SEQ ID NO: 62223 - RNA, 45 nt, Mus musculus
gagagggcaacccaauagaccugacucugauccuacgguccagag

SEQ ID NO: 62224 - RNA, 46 nt, Mus musculus
ugacugccuuaccugaugcuucccucacccuccuuccugcucaguc

SEQ ID NO: 62225 - RNA, 46 nt, Mus musculus
uuuugugacccugucuuccuaaguagcuuaagcaggucuagaauug

SEQ ID NO: 62226 - RNA, 79 nt, Mus musculus
uuuuaaagagggagggguaagucuuagaccaagacauaauccacuaaucagagugaacccaaggcucauaaaugaagau

SEQ ID NO: 62227 - RNA, 98 nt, Mus musculus
ccuggaguggagcaucucucucaacucugcugucgguugaugcagcugaagggaaagauaacgcagaguugauuuguuuuuuuuguuuuugcuuuuuu

SEQ ID NO: 62228 - RNA, 46 nt, Mus musculus
uaagagccuaaguucagaauuuacccuuuuuacuuagugggcagau

SEQ ID NO: 62229 - RNA, 46 nt, Mus musculus
ggacuuggccuuggaaaucaucuuuuguguuuucuagaugggagcu

SEQ ID NO: 62230 - RNA, 44 nt, Mus musculus
agauaggcagggauugggguucaaaggccugaagacaccacgag

SEQ ID NO: 62231 - RNA, 45 nt, Mus musculus
aauacuaaguucagggguggggacaaggcuugguugccccagaga

SEQ ID NO: 62232 - RNA, 41 nt, Mus musculus
ugagcuagugugccaugcaaggcuguaagaaguugggcaga

SEQ ID NO: 62233 - RNA, 46 nt, Mus musculus
gaaaagauguaauauuuuuauuccugauuuuuuuuuuaauggaacu

SEQ ID NO: 62234 - RNA, 26 nt, Mus musculus
gcucaugauuugucaugagaauggaa

SEQ ID NO: 62235 - RNA, 42 nt, Mus musculus
cuugcucuuuuugagcagaaauuucauuauuaugggccaugu

SEQ ID NO: 62236 - RNA, 45 nt, Mus musculus
uuggaauuguggaaauauucuugcugguauuauauuuuggucuga

SEQ ID NO: 62237 - RNA, 46 nt, Mus musculus
uggcaauuugaagaacaucuaaaugaguacuuguuaggaaaccugg

SEQ ID NO: 62238 - RNA, 46 nt, Mus musculus
agagcagaaagaauaaagcuguuuguuugugaauuggggugugaga

SEQ ID NO: 62239 - RNA, 45 nt, Mus musculus
agaucuuaagauaauauauuuccagaauuagacaacauauccccu

SEQ ID NO: 62240 - RNA, 46 nt, Mus musculus
gaacaguuuccuugagucuaggcaauggagauaaaugauagcccau

SEQ ID NO: 62241 - RNA, 46 nt, Mus musculus
caaagaguauucuugugaauguguguugcuguacucagaauugcaa

SEQ ID NO: 62242 - RNA, 46 nt, Mus musculus
gaaaugagacuaucuucuacaacaugguauggauguguguggcuag

SEQ ID NO: 62243 - RNA, 45 nt, Mus musculus
caguuuugcucugagcaaacuauagaaaacuguaguacaaauaau

SEQ ID NO: 62244 - RNA, 56 nt, Mus musculus
acauugcagcuagcuuuguuagacuuuauaacauccagauagaagggaaagagaag

SEQ ID NO: 62245 - RNA, 46 nt, Mus musculus
acaaguuuagcaggguaaaguuugauaaaccaugcucaggaugcca

SEQ ID NO: 62246 - RNA, 45 nt, Mus musculus
uaaccccuuccucaccaaaagauuuuaguuuuugucuguugggaa

SEQ ID NO: 62247 - RNA, 33 nt, Mus musculus
aaguauauauuuuuagauauacagaaggaaucu

SEQ ID NO: 62248 - RNA, 45 nt, Mus musculus
cuguauucugauucauagcugaucagguagacacucaaauccuug

SEQ ID NO: 62249 - RNA, 36 nt, Mus musculus
uucuuggucauugauaccuaucaauuacuauaggga

SEQ ID NO: 62250 - RNA, 52 nt, Mus musculus
aggaaguccaugggcuuccugguccucuauccccccaccucacucccuuugu

SEQ ID NO: 62251 - RNA, 90 nt, Mus musculus
ccuaggugauuuuugucuaccguucguguuccgaaagcccaaggugcugauguuagcguguaauagauauugguguuugccuguguccuc

SEQ ID NO: 62252 - RNA, 43 nt, Mus musculus
cuaggcaagacugcaguccaacucacagaguggcuccgcccaa

SEQ ID NO: 62253 - RNA, 54 nt, Mus musculus
gaauaucccaggguagguuguguauggucagagugcagggaucgguuugggcgg

SEQ ID NO: 62254 - RNA, 45 nt, Mus musculus
cgauggguuacagagcaaauaggacccagcguggcauugagccag

SEQ ID NO: 62255 - RNA, 42 nt, Mus musculus
aaaaaaaaaaaaaaggagaggaagguuaaaugguuuauggac

SEQ ID NO: 62256 - RNA, 41 nt, Mus musculus
gaagcuaaguguuuaaacaaaccaguggguucaauggagga

SEQ ID NO: 62257 - RNA, 41 nt, Mus musculus
uacuucugagacagugguucguuacacguucuacauagagg

SEQ ID NO: 62258 - RNA, 51 nt, Mus musculus
guacugucguccgucugucuucuugucaucgugggacuucucauguuuagg

SEQ ID NO: 62259 - RNA, 45 nt, Mus musculus
gggaagucgguaauauuagcacauuuacauuauuauccucuugac

SEQ ID NO: 62260 - RNA, 45 nt, Mus musculus
uucugaagugggucacagacguggagaggagaaacauguccuagu

SEQ ID NO: 62261 - RNA, 41 nt, Mus musculus
gagucaguauauguacaacagcauccugagcuguccagagu

SEQ ID NO: 62262 - RNA, 47 nt, Mus musculus
cacaaggccuggccaccccaagcaaagaaaggaaugggaaaaagaag

SEQ ID NO: 62263 - RNA, 24 nt, Mus musculus
cugcugcuuagcaugccugcuccc

SEQ ID NO: 62264 - RNA, 47 nt, Mus musculus
agauuaauugcagaaaagaagagucuaucuucagaggagaccaaaga

SEQ ID NO: 62265 - RNA, 46 nt, Mus musculus
gcccccaaguuccccagucauugagucugaaacucugauagaagac

SEQ ID NO: 62266 - RNA, 24 nt, Mus musculus
gugaaaugaggagauaggaacuaa

SEQ ID NO: 62267 - RNA, 41 nt, Mus musculus
ggcuggugguacucguccucucccguccccucaaccccagu

SEQ ID NO: 62268 - RNA, 46 nt, Mus musculus
ucuggugcacgccucucccgccccaccagagcccugcgagcuagac

SEQ ID NO: 62269 - RNA, 41 nt, Mus musculus
gggcguggccuaagcaguugcuuccgggaggaggcgggauc

SEQ ID NO: 62270 - RNA, 26 nt, Mus musculus
ugggguaucacggauccggggugcug

SEQ ID NO: 62271 - RNA, 42 nt, Mus musculus
aaugucagugcugacaaguugcaacagaauagagguggaggg

SEQ ID NO: 62272 - RNA, 42 nt, Mus musculus
gaguuccuugguuucucccuccugacaagaguaggcaaagcu

SEQ ID NO: 62273 - RNA, 45 nt, Mus musculus
ucucagggcaaagcggucacuuguagccccaaaaccauuccaguu

SEQ ID NO: 62274 - RNA, 45 nt, Mus musculus
uggggaaaucugucccagaaaacagcuccuugucccucccucagu

SEQ ID NO: 62275 - RNA, 46 nt, Mus musculus
cuauauucugugucauguaagaaaugacaugaacucagggccccga

SEQ ID NO: 62276 - RNA, 46 nt, Mus musculus
gcugcuauggccaaaaaggcccugguagaagguagggguggaaggu

SEQ ID NO: 62277 - RNA, 95 nt, Mus musculus
ucccauuucagacuguggggucgucuuggugauaacaaucgucuuccccagcuuggacuccagguccaccuuguaaucccugugccgcagaagcu

SEQ ID NO: 62278 - RNA, 46 nt, Mus musculus
uaauggagucuuucaccacacagucacagacauugcaguaguagcu

SEQ ID NO: 62279 - RNA, 49 nt, Mus musculus
ucaccucaaaacgcuucuuuaccugauccagaguggagcguuccacgcg

SEQ ID NO: 62280 - RNA, 45 nt, Mus musculus
aagaugcccuaguacaaagaaacccaggaacaaaacuggagcuag

SEQ ID NO: 62281 - RNA, 46 nt, Mus musculus
caggaaaagggaggauguucagacaacagguuugauagaugaagag

SEQ ID NO: 62282 - RNA, 42 nt, Mus musculus
caacagcaauacagaaggcaaguucucaaugaaaggggccag

SEQ ID NO: 62283 - RNA, 45 nt, Mus musculus
ucgaagcucaucaugcucuagugagucauggccuugccuguggcc

SEQ ID NO: 62284 - RNA, 46 nt, Mus musculus
cuuaucuuuuuucuuguuugcuuugggaucagcaguggcagcugcc

SEQ ID NO: 62285 - RNA, 46 nt, Mus musculus
gcacuacagaggauuugugcugcucuccauucuccuggggaugcgg

SEQ ID NO: 62286 - RNA, 42 nt, Mus musculus
cccugguugugcaaaguggagaugauggcaccaaguacccag

SEQ ID NO: 62287 - RNA, 42 nt, Mus musculus
ugagcucccugacaggagagcugucgacuuuaaaaggucuag

SEQ ID NO: 62288 - RNA, 50 nt, Mus musculus
gaagacacgccaccugggacagugaucgcucucuucuaccuccaagacaa

SEQ ID NO: 62289 - RNA, 42 nt, Mus musculus
accuuuuccgacucuucuuacucuaucuacgucccggagaac

SEQ ID NO: 62290 - RNA, 46 nt, Mus musculus
acaagaaugauaacgccccugagauccuguacccugcccugcccac

SEQ ID NO: 62291 - RNA, 46 nt, Mus musculus
agggcuacacacuggugaggugcgcacagcaagagcccugcuggac

SEQ ID NO: 62292 - RNA, 41 nt, Mus musculus
agaagaagaagaagaagaagaagaagaagaagaagcuuaaa

SEQ ID NO: 62293 - RNA, 46 nt, Mus musculus
cuccguuuaaaauacucacuucuucaggaaacacguauaaacuagu

SEQ ID NO: 62294 - RNA, 45 nt, Mus musculus
gcaagagguccugccagaccucagcgaugacccuuugcccccgga

SEQ ID NO: 62295 - RNA, 42 nt, Mus musculus
uccuccuggcugugauucuagccauugcacuucgacugcgac

SEQ ID NO: 62296 - RNA, 23 nt, Mus musculus
uccuuucaucuuuuccaaggaua

SEQ ID NO: 62297 - RNA, 45 nt, Mus musculus
agauuaugaagaaaugaguuucuaugaaauagaaauccaagcuga

SEQ ID NO: 62298 - RNA, 58 nt, Mus musculus
caacccaccuaccuucucucauccguccuacuuuaccuacaucccagagaacaauccc

SEQ ID NO: 62299 - RNA, 80 nt, Mus musculus
gaagcugcgggucagcgcugagaagcugcacuucagcguggauucggagagcggggacuuacuggugaaggaccgcauag

SEQ ID NO: 62300 - RNA, 49 nt, Mus musculus
aacauugcccuaugccuauaaucugugcgugccgggagaucaacuuaaa

SEQ ID NO: 62301 - RNA, 46 nt, Mus musculus
cuccugcaugcugaauuuggaaauucucguggaggaaacccugaag

SEQ ID NO: 62302 - RNA, 42 nt, Mus musculus
uggaggacuugguuagucuggagucucccgccaacccggaug

SEQ ID NO: 62303 - RNA, 24 nt, Mus musculus
guuagagauuggaguggauuuuug

SEQ ID NO: 62304 - RNA, 41 nt, Mus musculus
aauucucgggcucccaauggaggagcuagagaaaguaccca

SEQ ID NO: 62305 - RNA, 45 nt, Mus musculus
ggaaucugccauagaugcagauguagggcugaacucucuccagag

SEQ ID NO: 62306 - RNA, 59 nt, Mus musculus
gcucuaaacccucgaagcggcagccuggucaccgcgggcaggauagaccgggaggagcu

SEQ ID NO: 62307 - RNA, 53 nt, Mus musculus
guguaugggguccaucaagugucaguuaaaucuagagauucugauggaagaua

SEQ ID NO: 62308 - RNA, 42 nt, Mus musculus
guuccauccaagagaaucugcccuuuaaguuagaaaagucuu

SEQ ID NO: 62309 - RNA, 42 nt, Mus musculus
cagggcgugccccuuuccucuuacguuuccaucaacucggac

SEQ ID NO: 62310 - RNA, 46 nt, Mus musculus
gggaauacauuguugcagcccagccauaggcugcuccucuucccgg

SEQ ID NO: 62311 - RNA, 42 nt, Mus musculus
uuccugcggccccaguucugccauuuggauuaacccccaaaa

SEQ ID NO: 62312 - RNA, 46 nt, Mus musculus
ucccccccaguugccuggcagugcugccaucccuccaccuccuccu

SEQ ID NO: 62313 - RNA, 46 nt, Mus musculus
ucuuccuggagguguggucccaccauccccuccucugccuccaggu

SEQ ID NO: 62314 - RNA, 46 nt, Mus musculus
ggugggggugggggagguggaauaacagugccagagucaccaggca

SEQ ID NO: 62315 - RNA, 44 nt, Mus musculus
gaucugcugcuuuucagaauccaaggcauccuuuucuccuugaa

SEQ ID NO: 62316 - RNA, 45 nt, Mus musculus
cagaauuaacagcgcggcacgaguuacaaguagaaaugaaaaaga

SEQ ID NO: 62317 - RNA, 42 nt, Mus musculus
cuguccaugucucaucccugagagggacaaucaucaggccgu

SEQ ID NO: 62318 - RNA, 42 nt, Mus musculus
auagugccacuccuugggccgagcauauacaaaccaucacag

SEQ ID NO: 62319 - RNA, 50 nt, Mus musculus
ugcugagauugaagcagccuaaucgaucacagcccagggagucagcgcca

SEQ ID NO: 62320 - RNA, 42 nt, Mus musculus
uaccuggagcacgaugcacgucggcugguagaaguccaccac

SEQ ID NO: 62321 - RNA, 42 nt, Mus musculus
ggggauggggagacagggaacaaaaggaaaaaggggguugag

SEQ ID NO: 62322 - RNA, 45 nt, Mus musculus
aguaauuuccguauuuguggaaggacacagucaugacccggucag

SEQ ID NO: 62323 - RNA, 42 nt, Mus musculus
aaugcaucaugcacacacacacacacacacacacacacagag

SEQ ID NO: 62324 - RNA, 46 nt, Mus musculus
acagaagauugugagcuaccauguggguccugggaauugaacucag

SEQ ID NO: 62325 - RNA, 44 nt, Mus musculus
aaggcgaccugcuaggcaagcuacuuuuaucaagaccccugaag

SEQ ID NO: 62326 - RNA, 46 nt, Mus musculus
caccccagcacucccaccuucggguuuauauccucuguccucagca

SEQ ID NO: 62327 - RNA, 46 nt, Mus musculus
cuggcugcugcagaucuguggcuugguagauacauguuaaggaguu

SEQ ID NO: 62328 - RNA, 45 nt, Mus musculus
gaccagacauccauguaacucagcuaaacauuuaaaguccuagac

SEQ ID NO: 62329 - RNA, 46 nt, Mus musculus
auaauuucuucaagcacauugacauccacccugaaaacacccacau

SEQ ID NO: 62330 - RNA, 46 nt, Mus musculus
gaccugaaggaagagcauggccugccaagaggacaguggugcagag

SEQ ID NO: 62331 - RNA, 46 nt, Mus musculus
gugugggggagcuggggcagauguaauggcagagaaggucucugag

SEQ ID NO: 62332 - RNA, 46 nt, Mus musculus
ggcaagugaagcuuucuagccgcuuagccaccucuccagccccacu

SEQ ID NO: 62333 - RNA, 45 nt, Mus musculus
guacugccgaggccaauuuuaugcaggaaggaacgggcccagaaa

SEQ ID NO: 62334 - RNA, 42 nt, Mus musculus
uguaucccucgguguuugggggaaacuaaggacccuggaagc

SEQ ID NO: 62335 - RNA, 45 nt, Mus musculus
cucccaguuguccccacuguaacucaaaggacggaauaccaaggu

SEQ ID NO: 62336 - RNA, 44 nt, Mus musculus
accuugguauuccguccuuugaguuacaguggggacaacuggga

SEQ ID NO: 62337 - RNA, 45 nt, Mus musculus
aggaggccauugacaaacugagcaagaggcaccaguaccacaucc

SEQ ID NO: 62338 - RNA, 46 nt, Mus musculus
gaagaguuaccugaguggaacuuugauggcucuaguaccuuucagu

SEQ ID NO: 62339 - RNA, 45 nt, Mus musculus
aacuccuaaacugagcugcaauugugguugagagagagagagaga

SEQ ID NO: 62340 - RNA, 42 nt, Mus musculus
caccuucucuuuucugcaagaugcuauagagacccagcaaag

SEQ ID NO: 62341 - RNA, 47 nt, Mus musculus
aggguauauacguguaugugugugugugugugugugugugugugugu

SEQ ID NO: 62342 - RNA, 45 nt, Mus musculus
caugagaggagauggaccgugagcauguggccaggacaggcagau

SEQ ID NO: 62343 - RNA, 41 nt, Mus musculus
gaggauggagugaagggggcucaggagagaccagggggaga

SEQ ID NO: 62344 - RNA, 41 nt, Mus musculus
aaaaagcagagagagagagagagagagagagagggaaaggg

SEQ ID NO: 62345 - RNA, 50 nt, Mus musculus
gugugugcaugcgugugagggcaugucugugugugugugugcaugcguau

SEQ ID NO: 62346 - RNA, 46 nt, Mus musculus
cucacacuugguuauaguuaacccauugauucccaguuccccagau

SEQ ID NO: 62347 - RNA, 46 nt, Mus musculus
aaauuaauauguguauacuauuuuuagaguaaauuuucacauagaa

SEQ ID NO: 62348 - RNA, 42 nt, Mus musculus
cuccucugcaaaaucaugcauuaaaacuuuguugccuuagau

SEQ ID NO: 62349 - RNA, 45 nt, Mus musculus
gucuauucauuuguguguugcuaaagagauuacaaaaaaggaaau

SEQ ID NO: 62350 - RNA, 46 nt, Mus musculus
cuuagucucaucuuuugcaauuccucuuugggauuuuucugcagac

SEQ ID NO: 62351 - RNA, 46 nt, Mus musculus
uucacuucucagugaaggaacucagcuucuucaaagggccacagcc

SEQ ID NO: 62352 - RNA, 46 nt, Mus musculus
ugagaccuuugucucaaaacaaaagaaaaagcaaacaugcucugag

SEQ ID NO: 62353 - RNA, 46 nt, Mus musculus
cugaaaugguuauuuuagcccaaccccaguuauggagcacccagau

SEQ ID NO: 62354 - RNA, 42 nt, Mus musculus
uuacugguaaguuagugauuguuggguaaaaugagagcagaa

SEQ ID NO: 62355 - RNA, 46 nt, Mus musculus
agcaaggccgauuugucccuccagacaugaugcagccacagcagac

SEQ ID NO: 62356 - RNA, 42 nt, Mus musculus
cugagccucagaugguaggagacugauguagauggcccaucc

SEQ ID NO: 62357 - RNA, 46 nt, Mus musculus
caacuucauguccucuuuuuuaugguuauuaauagcauccugaguc

SEQ ID NO: 62358 - RNA, 46 nt, Mus musculus
uuuugaccaaauaaucuuuucucuuuagacuaauuagacaucuucu

SEQ ID NO: 62359 - RNA, 46 nt, Mus musculus
uccucuauggguuagauuuuuuuucucucucaaccauaugccaggg

SEQ ID NO: 62360 - RNA, 42 nt, Mus musculus
cgugccacagcuuuucuaagcacaaagaaaaugcaggcuguu

SEQ ID NO: 62361 - RNA, 46 nt, Mus musculus
uuccuguucaggaaugcgauuuagugucauuuauccuggucuagag

SEQ ID NO: 62362 - RNA, 46 nt, Mus musculus
aaacgaaucgggggggaaaaaaguugaaccgagaggaugcugaguc

SEQ ID NO: 62363 - RNA, 46 nt, Mus musculus
uuuaucaccuggucuuuuuuacgaucucaugaauaaagggaaaaac

SEQ ID NO: 62364 - RNA, 46 nt, Mus musculus
acaaugacuggauggugguuucaggacagagucagaggggcuuaga

SEQ ID NO: 62365 - RNA, 44 nt, Mus musculus
augauuaaggagaagcugcuucaucgugcccagaugagcggagu

SEQ ID NO: 62366 - RNA, 45 nt, Mus musculus
gggcaaaccucagaaucuuuauuuaugucaauuaguggcccagua

SEQ ID NO: 62367 - RNA, 45 nt, Mus musculus
aaacagacuggacagagccuggugagcguguuaaggacggcaggu

SEQ ID NO: 62368 - RNA, 46 nt, Mus musculus
guugagcugugaaugcugcagagagcuaggguuaccacuugaagag

SEQ ID NO: 62369 - RNA, 46 nt, Mus musculus
cuugauguagacuuucuugggcugugugagcaggggugguccuggg

SEQ ID NO: 62370 - RNA, 45 nt, Mus musculus
ggccccacuggugccagacacuaaaggcccccccugcuggaagau

SEQ ID NO: 62371 - RNA, 46 nt, Mus musculus
uaaugaccaaaauuggcacauuuucauccaauuuuuauaggcagau

SEQ ID NO: 62372 - RNA, 42 nt, Mus musculus
gagugugcacucaugagguagugacagugguaccggucgauc

SEQ ID NO: 62373 - RNA, 46 nt, Mus musculus
cucuggccacauaugugggagaggauggucuuguuggaaaucagug

SEQ ID NO: 62374 - RNA, 45 nt, Mus musculus
aacccuauugugucuacucuuugagggaccuccgcagugggcaga

SEQ ID NO: 62375 - RNA, 45 nt, Mus musculus
aaaaagaaaggaagaaaaaaguaaggaagaaggaagggaggaaga

SEQ ID NO: 62376 - RNA, 42 nt, Mus musculus
cagucagauuaaaaacacacauauagaaacacucacacagac

SEQ ID NO: 62377 - RNA, 45 nt, Mus musculus
acuaugugcguuuguuaaaaaaaaaaaagaaaaaagaaaaaagaa

SEQ ID NO: 62378 - RNA, 42 nt, Mus musculus
gugguuuaucuuuguugauauucucaucuuguucaugcuuca

SEQ ID NO: 62379 - RNA, 55 nt, Mus musculus
guguaacaugggcccaccugacaccauccauagaucuucaaagcccucaccaggu

SEQ ID NO: 62380 - RNA, 42 nt, Mus musculus
gcgugugcgugugcgugugcguguguguguguguguggaggc

SEQ ID NO: 62381 - RNA, 52 nt, Mus musculus
auucacuucucaaacuggcagaaagacacacugguuagaauaugaucugaga

SEQ ID NO: 62382 - RNA, 46 nt, Mus musculus
gcucguccugacaagaggcuuuugggauagucuugugucacaagga

SEQ ID NO: 62383 - RNA, 45 nt, Mus musculus
uucccccaaauuuagaaggaaaaauaucuuaaauaguuaagaaag

SEQ ID NO: 62384 - RNA, 45 nt, Mus musculus
accccaugggcacauuucuucuuuguguguuacuuuugccucuau

SEQ ID NO: 62385 - RNA, 46 nt, Mus musculus
ccucuugaauguaugugagaggaaugguggaugaacagaaggggug

SEQ ID NO: 62386 - RNA, 48 nt, Mus musculus
aagguucagaggggaauuaagaauuauaaauacguuacagagaguuga

SEQ ID NO: 62387 - RNA, 45 nt, Mus musculus
aacaaugauguuuagccaaggcagcauucuguagcacuuacaagu

SEQ ID NO: 62388 - RNA, 60 nt, Mus musculus
acuggucuacucuuagaaagcuuaaacacagggugaacaugaguuauuguuacuaauggu

SEQ ID NO: 62389 - RNA, 45 nt, Mus musculus
gggcaaaggucaguagaacuuugggaaacucuggugggauugggu

SEQ ID NO: 62390 - RNA, 45 nt, Mus musculus
gacaaaugaaugacugauguucaagggauucaggugguccauacu

SEQ ID NO: 62391 - RNA, 45 nt, Mus musculus
auucuaauaaauagguauguaaccuuugaaguuaccaguuuuaga

SEQ ID NO: 62392 - RNA, 42 nt, Mus musculus
aggaugcugaagguucaguuuuuaugaaaauuucagugagac

SEQ ID NO: 62393 - RNA, 42 nt, Mus musculus
ugauguuaucacgaacgugaccccgcuagugggccugcaggu

SEQ ID NO: 62394 - RNA, 82 nt, Mus musculus
aagagucauggcucagucuucagaaaaggaacauggcuauccggagucacugccucacguggacacaguaugcauccaugag

SEQ ID NO: 62395 - RNA, 46 nt, Mus musculus
gugugucuggguguguguaaacaccuggguguaggugucugaggag

SEQ ID NO: 62396 - RNA, 46 nt, Mus musculus
ucaucgagaugaucuuaccgucuagcuccaguggacagccaacagc

SEQ ID NO: 62397 - RNA, 46 nt, Mus musculus
uugccaacuaguuccccacuuuccaaggugugugugugugagagag

SEQ ID NO: 62398 - RNA, 46 nt, Mus musculus
ggucuuacaaucuuuccaacccuucuuugaaugguuccucugaguc

SEQ ID NO: 62399 - RNA, 46 nt, Mus musculus
agaucaggcuucuaggaagggaaaaggaacagcugacaccccaugu

SEQ ID NO: 62400 - RNA, 46 nt, Mus musculus
auuugagugagauaauuaauaaggaguguuuaucacaggauugaug

SEQ ID NO: 62401 - RNA, 42 nt, Mus musculus
aagaugaggggcagaaugaagagggugaagaaaagaaggaag

SEQ ID NO: 62402 - RNA, 42 nt, Mus musculus
agcugaaaguccccgaauggguggacacagucaagcuggcca

SEQ ID NO: 62403 - RNA, 44 nt, Mus musculus
accuguaccuccgagguggugcugggguugguuccaugaccaag

SEQ ID NO: 62404 - RNA, 46 nt, Mus musculus
ucucgccaucaucauauuccucgcgguuccgggugucugagcagac

SEQ ID NO: 62405 - RNA, 45 nt, Mus musculus
gcuccauccacaaugaaggucacaggagcauucuucggcugggau

SEQ ID NO: 62406 - RNA, 45 nt, Mus musculus
uuuucaaucacuuuggcauucugcgcguaagagucagcaacuucc

SEQ ID NO: 62407 - RNA, 42 nt, Mus musculus
uggucaaauauguccagacaaugaccucuaccuuuccgccac

SEQ ID NO: 62408 - RNA, 46 nt, Mus musculus
aaagaaaaaaaaaacacugaauugcaauguaaaaauauuaagcuag

SEQ ID NO: 62409 - RNA, 42 nt, Mus musculus
gaacaagauguacuuucucuauucuuuauuaacuuccaguga

SEQ ID NO: 62410 - RNA, 46 nt, Mus musculus
gccugaauccuaacucuggacuccauucuaaucauucugcucaguc

SEQ ID NO: 62411 - RNA, 46 nt, Mus musculus
caauuaaaucaaccuccucaguggagaaauuuguuacuucuaaguu

SEQ ID NO: 62412 - RNA, 42 nt, Mus musculus
cagcagcauagguuguaguaccaucuguggccaccagauggg

SEQ ID NO: 62413 - RNA, 45 nt, Mus musculus
aggaacacagaaggacuuuuauacgcaaagggaguuugccagauc

SEQ ID NO: 62414 - RNA, 45 nt, Mus musculus
uuacagcccuggcuguaggcugucauaaaauuuagaacuagagaa

SEQ ID NO: 62415 - RNA, 42 nt, Mus musculus
uugguacuaaaucucuagggugauauggauaaagcgacauga

SEQ ID NO: 62416 - RNA, 46 nt, Mus musculus
ggaggucuuuggguucuggacuuugucauguccuuuccuaguagau

SEQ ID NO: 62417 - RNA, 46 nt, Mus musculus
gggauccagaugccuugaagauugucucugccaagaaccaccaguc

SEQ ID NO: 62418 - RNA, 45 nt, Mus musculus
aguccccagcaacgugaaacacacuugggacuuugggccucuaca

SEQ ID NO: 62419 - RNA, 57 nt, Mus musculus
guuccgugccaucaccgucgccagccagaccaacugcccccucuaugucaccaaggu

SEQ ID NO: 62420 - RNA, 45 nt, Mus musculus
uggaaauggggauaaccggcccagaaggccacguucugagcagac

SEQ ID NO: 62421 - RNA, 46 nt, Mus musculus
accaagucaggcaaggagauguucccagggagugggucugaaagag

SEQ ID NO: 62422 - RNA, 42 nt, Mus musculus
ugcucaaguucaugccgagaauggagauaucauugcccaggu

SEQ ID NO: 62423 - RNA, 45 nt, Mus musculus
ugguuuacauggccuacaaggauuuauaucaaguguccaacacag

SEQ ID NO: 62424 - RNA, 27 nt, Mus musculus
aggagguacagagccucagcaaggaaa

SEQ ID NO: 62425 - RNA, 47 nt, Mus musculus
ccugagucuagccugacagaggccuaugaaaaguggcgugagugggc

SEQ ID NO: 62426 - RNA, 77 nt, Mus musculus
gugaucccuggaggcauugacguccauacccacuuccagaugccuuacaagggaaugaccacaguggacgauuucuu

SEQ ID NO: 62427 - RNA, 58 nt, Mus musculus
uggagacaaucugauuguccccggaggugugaagaccaucgaggccaacgggaagaug

SEQ ID NO: 62428 - RNA, 46 nt, Mus musculus
ucaaugaugaucaguccuuuuaugcugauauuuacauggaggaugg

SEQ ID NO: 62429 - RNA, 42 nt, Mus musculus
cucucucucucucucucucugucuagcugcugcugcuuaggg

SEQ ID NO: 62430 - RNA, 49 nt, Mus musculus
ucugucugucugucucugucugucugucugucucugucugucugucucu

SEQ ID NO: 62431 - RNA, 44 nt, Mus musculus
ccauuuagaaaagggaaccagucagaggcagccaaggagccugg

SEQ ID NO: 62432 - RNA, 45 nt, Mus musculus
uuuauuuuacuuguauugaaauaauaagaugaugaacaugcaauu

SEQ ID NO: 62433 - RNA, 46 nt, Mus musculus
cagagaccaaacaaaggagucagccuaucaaguaaggugccauaga

SEQ ID NO: 62434 - RNA, 42 nt, Mus musculus
ugugaaugucuucaagccaggcugucuggcagucauuguuag

SEQ ID NO: 62435 - RNA, 53 nt, Mus musculus
ccugcagccagaaucgccaccauguccuaccagggcaagaagaacauuccgcg

SEQ ID NO: 62436 - RNA, 24 nt, Mus musculus
uggucauacaccaaagaaaacaaa

SEQ ID NO: 62437 - RNA, 23 nt, Mus musculus
guggggaggauagaagacaaggc

SEQ ID NO: 62438 - RNA, 46 nt, Mus musculus
caaacuacuugaauucauaucccaauucaucacucaguagcuuguc

SEQ ID NO: 62439 - RNA, 46 nt, Mus musculus
ugauguguagugucucugaguaugcucacaugaagucuggguagag

SEQ ID NO: 62440 - RNA, 46 nt, Mus musculus
gagaaagagaaagagaaagaaagagaaagaaagagaaagagaaaga

SEQ ID NO: 62441 - RNA, 41 nt, Mus musculus
gaggggaguuaggaggguaguagaggcagagaaaggcagag

SEQ ID NO: 62442 - RNA, 46 nt, Mus musculus
aaggacaucugaaaaggcacuuguucaucuuucagaugccugagau

SEQ ID NO: 62443 - RNA, 45 nt, Mus musculus
cugaagacagcccuacuagacuacaucaaacguugccgcccugga

SEQ ID NO: 62444 - RNA, 46 nt, Mus musculus
auauaaacaacaccagccuaccgacagggucacagaaaaccugaag

SEQ ID NO: 62445 - RNA, 81 nt, Mus musculus
caaauuuuuugaaauuguaaauaugcuucugaaggacccucagacgggaugcugccuuaaagauaugcucgcagguuagaa

SEQ ID NO: 62446 - RNA, 70 nt, Mus musculus
uacagcucuaagggauguucaauccuaauaaaguauuuggagaucuuuacccccauuugaguugaaaagc

SEQ ID NO: 62447 - RNA, 44 nt, Mus musculus
aaggcugaaaggagcaagaaaaagaaggaagaggaagaugaggg

SEQ ID NO: 62448 - RNA, 53 nt, Mus musculus
caaggaaggagucaagacugagaacaacgaucauauuaauuugaagguggcgg

SEQ ID NO: 62449 - RNA, 42 nt, Mus musculus
auucgugacccgccuuugcuuugugucuguacugcaggucug

SEQ ID NO: 62450 - RNA, 51 nt, Mus musculus
gguguucauaugcauacuucugugggaauccaaacccccguuagucaaaau

SEQ ID NO: 62451 - RNA, 45 nt, Mus musculus
uucuggguaugagaagauacaugcauccaaagauaaagggcugaa

SEQ ID NO: 62452 - RNA, 42 nt, Mus musculus
ccugggagcaauuuucacugcucucuccucuucagccagcca

SEQ ID NO: 62453 - RNA, 46 nt, Mus musculus
gaaauguucucucucuaauucucaacccuuuuucugauagcagcuu

SEQ ID NO: 62454 - RNA, 41 nt, Mus musculus
gcccccgcccuagcccagcucacagccaccuugugguuccg

SEQ ID NO: 62455 - RNA, 46 nt, Mus musculus
augccacagcauuguaagguuuaauaaaauuaaauuugcaccaaac

SEQ ID NO: 62456 - RNA, 46 nt, Mus musculus
aauuugauuuuaggguuuaaugucuuucuccccucuuugcccagaa

SEQ ID NO: 62457 - RNA, 46 nt, Mus musculus
auauccuaacaauauuuugaaauuaucucucucuaaugggugucgu

SEQ ID NO: 62458 - RNA, 46 nt, Mus musculus
cguugauaaaaaagguuuuacuguguuuuuuuuaccauggacaagu

SEQ ID NO: 62459 - RNA, 46 nt, Mus musculus
auaaugaaauucgucuuuauucaguaaacauuuguaauggguagua

SEQ ID NO: 62460 - RNA, 91 nt, Mus musculus
agagagucaauucgccugugaacuucacgaucugggccacuuggauuuagggaugacauuuuauucugaggguugaugaacugccacuuaa

SEQ ID NO: 62461 - RNA, 45 nt, Mus musculus
gcuuuauuuuuucacaucugagguuucuuucuucaguccacagaa

SEQ ID NO: 62462 - RNA, 44 nt, Mus musculus
cuggacgagaaggagauagcuaaaaauuugauacagcccauaaa

SEQ ID NO: 62463 - RNA, 45 nt, Mus musculus
gaaguuuggacaucaugaagaugcugcuuauguauugugccaaga

SEQ ID NO: 62464 - RNA, 46 nt, Mus musculus
uuagaaacaugccagugccuuuugucaguuuuaauucaugugagag

SEQ ID NO: 62465 - RNA, 46 nt, Mus musculus
uuguagaucacuaaaucugagacagaauaaacagauucuaaauaau

SEQ ID NO: 62466 - RNA, 46 nt, Mus musculus
ugguuuccauguacuuauuccuuuugcuaaaaaauacuccaaagau

SEQ ID NO: 62467 - RNA, 45 nt, Mus musculus
acuguuuuuguaguagcucacauuuaaugcagcuuuggcccacau

SEQ ID NO: 62468 - RNA, 45 nt, Mus musculus
guguugacaugcuuuuaaaauggaaucucagauugcaaccccaua

SEQ ID NO: 62469 - RNA, 58 nt, Mus musculus
aaaaagaagaacuacuuaaagcugauguggggcuggaagaguagcagauuugacuugg

SEQ ID NO: 62470 - RNA, 46 nt, Mus musculus
ucuguaugugaggaugugugugcuccuuuuuuuuuuuuugccagau

SEQ ID NO: 62471 - RNA, 46 nt, Mus musculus
uuuuucuuuuguuuuuuugagacgguuucucuguguagcccuggcu

SEQ ID NO: 62472 - RNA, 46 nt, Mus musculus
ucaguuuaaugauguccauauuauugaaagccaauugggguaaauu

SEQ ID NO: 62473 - RNA, 46 nt, Mus musculus
aggacacaaagaaaucgcucaguauuuacuugaaaagggggcagau

SEQ ID NO: 62474 - RNA, 80 nt, Mus musculus
cgcgauggcaaacuccggcuccucaccaaguugcuggcaagcaaaucgaaagcggagguuuccuccuuaaucucggagaa

SEQ ID NO: 62475 - RNA, 88 nt, Mus musculus
cuagcuuugccugguaauuggugacugaaagaacauaguaguagauauuuacaggagaaguauguugaauuuauuguuggcugguauu

SEQ ID NO: 62476 - RNA, 55 nt, Mus musculus
uuaggaaaacaccuuauaucuugaaaacugggccguauuauuuaugaacaauguc

SEQ ID NO: 62477 - RNA, 46 nt, Mus musculus
augguugaaaacuaguauccaauuuuauguguauuccgugccauca

SEQ ID NO: 62478 - RNA, 46 nt, Mus musculus
aggauacugagacugcucuuuagaaagauaagcugugugauauguu

SEQ ID NO: 62479 - RNA, 43 nt, Mus musculus
uugcuguaccagagagagagagagagagaaagagaaagagaga

SEQ ID NO: 62480 - RNA, 44 nt, Mus musculus
aggauacaucaugugaaaggggcgucaucacggguguucgggag

SEQ ID NO: 62481 - RNA, 48 nt, Mus musculus
auaauugaauguuagcgucuagauagaagaguaggggacucaggucug

SEQ ID NO: 62482 - RNA, 42 nt, Mus musculus
uaaacugauuucgugugcuuuuaaucaaauauaugacucaag

SEQ ID NO: 62483 - RNA, 85 nt, Mus musculus
cugggaccuuuuaauuuguguagcccugauggugggaauggugacugcagguucuugggaaaggcuuuuauugcuuguaugugug

SEQ ID NO: 62484 - RNA, 45 nt, Mus musculus
uucugaccauuuuaguacuuucaugaaacguauguuuggggcuca

SEQ ID NO: 62485 - RNA, 50 nt, Mus musculus
ucaccuggugagagaaugugagaaaaaccuaggucaaguuggcuugugag

SEQ ID NO: 62486 - RNA, 55 nt, Mus musculus
gaaggcugcccacuaugggugacaccauuccauuggcaagggauucugaacugua

SEQ ID NO: 62487 - RNA, 24 nt, Mus musculus
uuaauuuccuuuaagaaggguauu

SEQ ID NO: 62488 - RNA, 45 nt, Mus musculus
aggaaucgaauuuagggacguaaagguggucagaauguguucaau

SEQ ID NO: 62489 - RNA, 46 nt, Mus musculus
uugguaguguccuugaucaaauuuggaguccuguccucucagguag

SEQ ID NO: 62490 - RNA, 44 nt, Mus musculus
ucugugugugugugugugagagagagagagagagagagacucag

SEQ ID NO: 62491 - RNA, 46 nt, Mus musculus
caagauucuaauucuugauguuugccuagucuaaaauucucagggg

SEQ ID NO: 62492 - RNA, 46 nt, Mus musculus
ugagucauaaccugguuugguuugaagcaugguucuuuauaguuag

SEQ ID NO: 62493 - RNA, 46 nt, Mus musculus
uagaaaguacuuuauaaauagugguugauuugaugaguggguacag

SEQ ID NO: 62494 - RNA, 47 nt, Mus musculus
auuauauaguguuagauauguuugauuuuaaauggaaaaaagaacag

SEQ ID NO: 62495 - RNA, 46 nt, Mus musculus
uauaacuugauucaguaaacuucuucagaagucauuuuggggcagg

SEQ ID NO: 62496 - RNA, 92 nt, Mus musculus
acugggaaguaauuuugaaagauuacagaucaucccaggcgcuaagcauggaaauauucaagugggauguguagacuguucaaugcaacaag

SEQ ID NO: 62497 - RNA, 46 nt, Mus musculus
gguacuucugacugucuuuaagaaagaaaacacuauuugaugucag

SEQ ID NO: 62498 - RNA, 46 nt, Mus musculus
ucauacuucgggcccaguauuucuuagcucaacacagugcagcuga

SEQ ID NO: 62499 - RNA, 46 nt, Mus musculus
auaaaauguacuuugugcguuuguaagaagggagggaagacuguua

SEQ ID NO: 62500 - RNA, 44 nt, Mus musculus
aauuuaugaacggccuugccaucuaucucgguuaucuggauugu

SEQ ID NO: 62501 - RNA, 70 nt, Mus musculus
ccgaggucaguguuuucaccguguguuagagagcaucaccaacuugaacugucaguguuucacugugugu

SEQ ID NO: 62502 - RNA, 38 nt, Mus musculus
caccaacuugaacugucaguguuucacuguguguuaga

SEQ ID NO: 62503 - RNA, 93 nt, Mus musculus
caccaacuugaacugucaguguuucacuguguguuagagagcgucaccaacuugaacugucaguguuucacuguguguuagagagcgucacca

SEQ ID NO: 62504 - RNA, 121 nt, Mus musculus
acuugaacugucaguguuucacuguguguuagagagcgucaccaacuugaacugucaguguuucacuguguguuagagagcgucaccaacuugaacugucaguguuucacuguguguuaga

SEQ ID NO: 62505 - RNA, 46 nt, Mus musculus
ucaccaacuugaacugguuuucuuacguugaaccuuugaagauuag

SEQ ID NO: 62506 - RNA, 46 nt, Mus musculus
aaguugcgauggagcugaucacagugaagacugaaacagauagcag

SEQ ID NO: 62507 - RNA, 104 nt, Mus musculus
aauugaaugcagagagucuguugauuugagaaagaacaguagacauguuuguguaguaagcauaaucuuuacuauuuauuuaaaaaaugaugaauauaggccag

SEQ ID NO: 62508 - RNA, 48 nt, Mus musculus
gcaaaacuaucuuaacuuguuguuucaucaguguaggacaaauguugg

SEQ ID NO: 62509 - RNA, 46 nt, Mus musculus
ugcaguuaugaaguagcaaugaaaauaauuuuuaugguugggguga

SEQ ID NO: 62510 - RNA, 48 nt, Mus musculus
gguugagaaacacugugcuagaccaucaagggaauaauaaacauugua

SEQ ID NO: 62511 - RNA, 46 nt, Mus musculus
uacagauauucugaggagucacuugaagcuauagacaugcauuaag

SEQ ID NO: 62512 - RNA, 46 nt, Mus musculus
aaauuugcuuacuuuuaauuuuauugcuauggucuaugugagggag

SEQ ID NO: 62513 - RNA, 45 nt, Mus musculus
augaaaacaaaacauggcccagagaggcugagaggauggugucag

SEQ ID NO: 62514 - RNA, 46 nt, Mus musculus
ggucuuucuaaucacaaagugaugaaugauaaggcaguugcuguag

SEQ ID NO: 62515 - RNA, 46 nt, Mus musculus
uauagaaaacacaugaaggaauugaaugagcuagauguguggcuau

SEQ ID NO: 62516 - RNA, 46 nt, Mus musculus
caaacagagcagauaugcuguaaaucuugucaucugcuaggaggag

SEQ ID NO: 62517 - RNA, 46 nt, Mus musculus
aagcuaguuggcuaccagaagaacauuauuccucuucuccagagaa

SEQ ID NO: 62518 - RNA, 46 nt, Mus musculus
aguucuaccaacugggaaccaagaauucagauauuccagccuccau

SEQ ID NO: 62519 - RNA, 46 nt, Mus musculus
gcauucugugaacuuguuagaaauaaaguuacugauuugugcacag

SEQ ID NO: 62520 - RNA, 46 nt, Mus musculus
uucuuguguuauaugaggccauacuaaaaaauaaaaagguguuuag

SEQ ID NO: 62521 - RNA, 32 nt, Mus musculus
gaaggaggcgggguguaauauaaaacuagcag

SEQ ID NO: 62522 - RNA, 46 nt, Mus musculus
aucaagucaagcauggauggaggagggacuguuuuccacugauagg

SEQ ID NO: 62523 - RNA, 45 nt, Mus musculus
gaaugugaguggggagugggugguagugauggaagggagacaaga

SEQ ID NO: 62524 - RNA, 46 nt, Mus musculus
uguuggauccuugagcagacaauucauuuagaugaguuaaguacag

SEQ ID NO: 62525 - RNA, 47 nt, Mus musculus
uaaagaaaguauuacaucaaacacaaaacauuugguucacuuagauu

SEQ ID NO: 62526 - RNA, 48 nt, Mus musculus
cuucuguagaaggugccccaccuuuuccuguuucuuuaucaugggucc

SEQ ID NO: 62527 - RNA, 135 nt, Mus musculus
aguuuaauaaaacaaaguaacucaucaaguucugggcuacauccuccaaagaagacucugacucgauccaugaccagucuugcacagaaaaucuguggaaagaaaaguauauuugaccccucaguggauauggaa

SEQ ID NO: 62528 - RNA, 78 nt, Mus musculus
augaagcugaauccaaucaugagcgccgccuuagaucucucaccaucagugcuaguggaagcaccaccagagacccgc

SEQ ID NO: 62529 - RNA, 49 nt, Mus musculus
agagauagacucuguccccccgcuuccuuuguacgccuuacuugcagca

SEQ ID NO: 62530 - RNA, 55 nt, Mus musculus
uucaguucugaugucugauaaucacauguuagaaacagaugaagaaaauacucag

SEQ ID NO: 62531 - RNA, 50 nt, Mus musculus
gccuuagccgauacaauugcaacuacaagcacugauauuggagaaaguag

SEQ ID NO: 62532 - RNA, 77 nt, Mus musculus
caauacaauacaauacaacacaaaagauaagacaaaauuuaacacauucaaauaagacaaaacaaagagaaggaaag

SEQ ID NO: 62533 - RNA, 62 nt, Mus musculus
aaaaaauuacacaagaaggagauauaacugcagagacccuacccauuuacaugcucagaaau

SEQ ID NO: 62534 - RNA, 46 nt, Mus musculus
ucauuuucucuauuuucuauugaacaucuacugcugugccugcagc

SEQ ID NO: 62535 - RNA, 48 nt, Mus musculus
ggaugggagcauguguccucuucuccuuucagcucuaggacccaaucu

SEQ ID NO: 62536 - RNA, 28 nt, Mus musculus
gugcugguagugguggugugguggugug

SEQ ID NO: 62537 - RNA, 46 nt, Mus musculus
ggagcugguguuacaggcaguugugagcuuccauguaaguggugag

SEQ ID NO: 62538 - RNA, 45 nt, Mus musculus
uuuuguguuucauacuucauugggaaaaaauuacauguguacuac

SEQ ID NO: 62539 - RNA, 45 nt, Mus musculus
auagaucucaaaaagacaccaaaaugacacaguuuuuugggcaca

SEQ ID NO: 62540 - RNA, 46 nt, Mus musculus
uuaauuugaaaacuacucugauuagaugaauugaggagaguugaag

SEQ ID NO: 62541 - RNA, 46 nt, Mus musculus
cuuaacagcauagagaugguguuuaacaucaugggauucuuaggag

SEQ ID NO: 62542 - RNA, 24 nt, Mus musculus
uagcaggaaaaaguggacuggcag

SEQ ID NO: 62543 - RNA, 45 nt, Mus musculus
uuuauaagauauucaauuguauuuuccacaucuaccuucugugag

SEQ ID NO: 62544 - RNA, 46 nt, Mus musculus
uuagcauaucaauuauuuauucuacacaaacacuugugcagcagag

SEQ ID NO: 62545 - RNA, 46 nt, Mus musculus
auuuucuucuaccuuuuccccuuaaaauuauaaauuuuaagugcag

SEQ ID NO: 62546 - RNA, 46 nt, Mus musculus
uugaucaguugauuaagacagguauuugguuccaaaacuaauccag

SEQ ID NO: 62547 - RNA, 46 nt, Mus musculus
auaaaauacugguuuuguuauaucugcuuuaaaaugguaagcugag

SEQ ID NO: 62548 - RNA, 46 nt, Mus musculus
auacacucacacacacacacacacacacacacacacacacagguaa

SEQ ID NO: 62549 - RNA, 46 nt, Mus musculus
aaaauuuuuaacuugugucaagauauucaacaauauaaaaagcaag

SEQ ID NO: 62550 - RNA, 45 nt, Mus musculus
uucuuagaugugugaagcccuguguuuaaucuucaguauuggaua

SEQ ID NO: 62551 - RNA, 46 nt, Mus musculus
uacacccauuaagguagcuacuacaaaaauaacuaaauggcaguau

SEQ ID NO: 62552 - RNA, 46 nt, Mus musculus
cagguauaaacuauuuuuaaauguucuuaucauaccuacugaggag

SEQ ID NO: 62553 - RNA, 45 nt, Mus musculus
cuucugaggagaaugugucugcaggcccugcaauacuccgucaca

SEQ ID NO: 62554 - RNA, 46 nt, Mus musculus
aaaauuccuuguccuuaguuuaagguucaggaaauuguggccaacc

SEQ ID NO: 62555 - RNA, 88 nt, Mus musculus
uccaaaaaucaucucgcacuaucugugaagaggcuuuggcaguacuuggugaaacaggaagaaauucaagaaacuuuuaucagaaaua

SEQ ID NO: 62556 - RNA, 46 nt, Mus musculus
uuuucuucaugcaaaauguuuuguaauuaauaguuauuaggugaac

SEQ ID NO: 62557 - RNA, 42 nt, Mus musculus
caguaggcccugcuuugcuaaggaguggguaaggggucacag

SEQ ID NO: 62558 - RNA, 30 nt, Mus musculus
ccguggcuuggaaguacacagacgggcaga

SEQ ID NO: 62559 - RNA, 45 nt, Mus musculus
aggcauuuucucuauagagagaauuuccauaacugacauaugaga

SEQ ID NO: 62560 - RNA, 44 nt, Mus musculus
uaggaucuuucauuuccuuagucagauuuaugagagaguggggg

SEQ ID NO: 62561 - RNA, 45 nt, Mus musculus
uuucuuguugguucaauuuggacauauguaucuagaaacucauag

SEQ ID NO: 62562 - RNA, 48 nt, Mus musculus
auccguggugagcagccuuugucagucuaguuguguugaagccaagug

SEQ ID NO: 62563 - RNA, 46 nt, Mus musculus
uuuaaacagugguugcauguguaggaaaugacaagcgaauauucag

SEQ ID NO: 62564 - RNA, 46 nt, Mus musculus
acucuuagcuccacaccucccgccugcccuaaacuuuagugcccau

SEQ ID NO: 62565 - RNA, 46 nt, Mus musculus
ugggguggggcacaacggacagacacacacacacacacacacacac

SEQ ID NO: 62566 - RNA, 45 nt, Mus musculus
gcuugucugucagaagaugcauucuacucuugcugagguguuggg

SEQ ID NO: 62567 - RNA, 46 nt, Mus musculus
ucuagcucuacuccagaaaacagaauaaacuagaaaaaagggcuag

SEQ ID NO: 62568 - RNA, 46 nt, Mus musculus
auacauugggaaaucaguaaauacaucaaguaauuucuauagucag

SEQ ID NO: 62569 - RNA, 46 nt, Mus musculus
uaaugaaauauggaaaacuauuaggaauugaagagucaaagcaaag

SEQ ID NO: 62570 - RNA, 46 nt, Mus musculus
auauuggcaacgauuuuaugcuuauugaagguggucaggguucuag

SEQ ID NO: 62571 - RNA, 45 nt, Mus musculus
ccucacuguuaugccaccaccuuuccuuuccuucuccaacgccaa

SEQ ID NO: 62572 - RNA, 46 nt, Mus musculus
gaugguugugagccaccauacaguugcuugggaauugaacucagga

SEQ ID NO: 62573 - RNA, 46 nt, Mus musculus
guggccauagaugcuuuaaugacuguaaugugaaauuugcccccau

SEQ ID NO: 62574 - RNA, 42 nt, Mus musculus
gguaggaguugaaaggaccagauacaagguaacuuccaggag

SEQ ID NO: 62575 - RNA, 44 nt, Mus musculus
gcuuggcccagggaaugacacuauuucgagguauggccuuguug

SEQ ID NO: 62576 - RNA, 42 nt, Mus musculus
caguuuggagacagguugucucuuugaaccugaagcccacag

SEQ ID NO: 62577 - RNA, 44 nt, Mus musculus
cauuugaauccaucuuuaauaaagauauuuuuaguuugcacgug

SEQ ID NO: 62578 - RNA, 46 nt, Mus musculus
ucagcgcuauuaaaaguaucugguuuagacccuggaccaugagcgg

SEQ ID NO: 62579 - RNA, 48 nt, Mus musculus
agaacccaucugugacaauaucaagacgcugauaugagugacccacaa

SEQ ID NO: 62580 - RNA, 48 nt, Mus musculus
auagcucuggcagaguuugcucaccuagcugcugcaugaggucccaca

SEQ ID NO: 62581 - RNA, 46 nt, Mus musculus
aucaucugugguuucugguggaaacguuauccuucuguggugguaa

SEQ ID NO: 62582 - RNA, 46 nt, Mus musculus
cccagguuugagaggacaccagcacuguccuggaauaugggaggag

SEQ ID NO: 62583 - RNA, 46 nt, Mus musculus
caaagaucugcauagcguugaagaaaacguggcaagugccccggug

SEQ ID NO: 62584 - RNA, 46 nt, Mus musculus
aaaucccagcaaccacaugguggcucacaaccaucccuaacugaga

SEQ ID NO: 62585 - RNA, 46 nt, Mus musculus
cauagucuuuugaaaaaaaaaauguguaagugugugugugugugug

SEQ ID NO: 62586 - RNA, 46 nt, Mus musculus
auucaguguugaaggaugcuucacaugugagauuuccuauggcuag

SEQ ID NO: 62587 - RNA, 46 nt, Mus musculus
ucuggguccagugagagagucugccuuaauaaauaaagagcaacgg

SEQ ID NO: 62588 - RNA, 45 nt, Mus musculus
caugauaaguguucuuggcuauguaauguuuuacaaucucucuua

SEQ ID NO: 62589 - RNA, 46 nt, Mus musculus
cagcagccuuucuuagccuagccuuucuccgagacugacacacauu

SEQ ID NO: 62590 - RNA, 42 nt, Mus musculus
ggacccaagcccagugcuguugaaugcugaggaagcuggcag

SEQ ID NO: 62591 - RNA, 46 nt, Mus musculus
agaauggccacucauagacucauauauuuguaugcuugguccccag

SEQ ID NO: 62592 - RNA, 42 nt, Mus musculus
aguaucugauucgcaguccuccaaagugcucaugacccacaa

SEQ ID NO: 62593 - RNA, 46 nt, Mus musculus
ugagaacaaacagaaucuuuaaaaaguuucagaaacacagccucua

SEQ ID NO: 62594 - RNA, 46 nt, Mus musculus
caaauagaaaaccuuuugccucuuaagaauaauaccuuagguuugu

SEQ ID NO: 62595 - RNA, 83 nt, Mus musculus
ucucuugcguugucuugugguuacaaaauaaauccugcuagugaagaaggagagaccuaugaucaugggcacuacagcccaca

SEQ ID NO: 62596 - RNA, 46 nt, Mus musculus
ggcugacaccaaacauuauaaauguaaaauauauaauaagccaaaa

SEQ ID NO: 62597 - RNA, 45 nt, Mus musculus
agugggcuuccucuuuucuauuaaugucuggaccucuuuccccua

SEQ ID NO: 62598 - RNA, 44 nt, Mus musculus
aacuggguaggaugacuugacuggucagugcaagaauacaggag

SEQ ID NO: 62599 - RNA, 46 nt, Mus musculus
uggugggggguggaggguggggaaugaauguuaaguaggaagaaag

SEQ ID NO: 62600 - RNA, 80 nt, Mus musculus
gaaggcaucucauuuguguagcaaacagcuguggcgagguuccuccgaggcccagguggacaucuguggacaucuggcca

SEQ ID NO: 62601 - RNA, 45 nt, Mus musculus
acaaggcuuagcuuaagaauacugaggagccaaguuagaugggga

SEQ ID NO: 62602 - RNA, 41 nt, Mus musculus
acgacaaaaggaugggaacaauucucccacaggcuacaaca

SEQ ID NO: 62603 - RNA, 42 nt, Mus musculus
ccuuccaccucccaaaaaaacauuagaaucacuugggaccag

SEQ ID NO: 62604 - RNA, 46 nt, Mus musculus
ugugaccagcagcgaguuaggugaaguccagcaccgaugacuugua

SEQ ID NO: 62605 - RNA, 46 nt, Mus musculus
augacugugggagugaacaaucuuagacaucaugagcaguguccau

SEQ ID NO: 62606 - RNA, 42 nt, Mus musculus
aaggaaggaaaggagggagggaagauuauagagagggcuaaa

SEQ ID NO: 62607 - RNA, 46 nt, Mus musculus
ucauggaagcaucaggacaguuaaaggaggccauucaaacccccug

SEQ ID NO: 62608 - RNA, 45 nt, Mus musculus
cauguacuguaaaugacugaaauuguuaaucauggagagggaagg

SEQ ID NO: 62609 - RNA, 42 nt, Mus musculus
gguaggaauaugccaccaaguggaacagagaucccuggagua

SEQ ID NO: 62610 - RNA, 45 nt, Mus musculus
cugagucagaacguaggggaguccucacguugugggucuuucacu

SEQ ID NO: 62611 - RNA, 46 nt, Mus musculus
uaggcgguuacucuuugaggaacaagcuuaucugcugacgugggag

SEQ ID NO: 62612 - RNA, 46 nt, Mus musculus
gcguuacaccaacuuggcauaguuaaagucaucugagaggcuggaa

SEQ ID NO: 62613 - RNA, 55 nt, Mus musculus
cgucggggagcgcaggccuaacagccauggcgguggaaggaggaaugaagugugu

SEQ ID NO: 62614 - RNA, 47 nt, Mus musculus
gauugaucgccauugguguagcgguucagguugucuugaagcaggcu

SEQ ID NO: 62615 - RNA, 82 nt, Mus musculus
uacauuugccaucuuccugucucuuaucaugcuuguggagguggcuguggccauugcuggcuauguguuuagagaccaggug

SEQ ID NO: 62616 - RNA, 87 nt, Mus musculus
aagucagaguuuaauaaaagcuuccagcagcagaugcagaauuaccuuaaagacaacaaaacagccacuauuuuggacaaauugcag

SEQ ID NO: 62617 - RNA, 53 nt, Mus musculus
aggaauccacuauccauacccagggcugcguggagacuauagcaauauggcua

SEQ ID NO: 62618 - RNA, 48 nt, Mus musculus
uuguggaggucuugggaauuaucuucuccugcugucuggugaaaagua

SEQ ID NO: 62619 - RNA, 45 nt, Mus musculus
guggguucuccagguuuuucaauuaaacggauuauuuuuucagac

SEQ ID NO: 62620 - RNA, 54 nt, Mus musculus
uaaaggcuccucugcugcagacaagguuguggcagagauaagaaggaaaggcgg

SEQ ID NO: 62621 - RNA, 68 nt, Mus musculus
uuuguguguauucguguguguguguguguaugugaguguguaugugagugugugugugugugugugag

SEQ ID NO: 62622 - RNA, 46 nt, Mus musculus
uugucaaaaauagagguaauagugaguauuuuauagauauuuccug

SEQ ID NO: 62623 - RNA, 50 nt, Mus musculus
uugcggggcuccuuccaagugacccgggcagcaugggaccauaugaagaa

SEQ ID NO: 62624 - RNA, 50 nt, Mus musculus
caccauugcccccaacgcugggucacggaugacggagacuguguugccgg

SEQ ID NO: 62625 - RNA, 46 nt, Mus musculus
ucccagaguccagcgggugagcguucuuucaguuuguagucuccag

SEQ ID NO: 62626 - RNA, 42 nt, Mus musculus
ugccaugagagcugugaggaaaaugguggccuauuugaggua

SEQ ID NO: 62627 - RNA, 46 nt, Mus musculus
acuugugacagaucaauaaauccagcuuuuuuauuuuaaauucagc

SEQ ID NO: 62628 - RNA, 46 nt, Mus musculus
ggaaugugaauaggagaaaauaaaagacacacauuacuauccagag

SEQ ID NO: 62629 - RNA, 42 nt, Mus musculus
uuagacuguaagaggucaggagagagagagagagagagagag

SEQ ID NO: 62630 - RNA, 46 nt, Mus musculus
uuauugggcuuaaaguaaaaggacaugaaguuggguggguagggag

SEQ ID NO: 62631 - RNA, 45 nt, Mus musculus
uaaaaugugaagcaguuauugcugacauccuggauaaaggcucug

SEQ ID NO: 62632 - RNA, 42 nt, Mus musculus
ugucuuuguuguuggcucugggggcuuugguggaaaacggac

SEQ ID NO: 62633 - RNA, 46 nt, Mus musculus
guuuugggauuugugggauaaguuugauaauaucuuagcuuggcau

SEQ ID NO: 62634 - RNA, 57 nt, Mus musculus
cucugggauaaagggcuucaguuugucugggaagagguugagagguaaugauugagu

SEQ ID NO: 62635 - RNA, 56 nt, Mus musculus
uaaaggcgugcgccaccacgcccggcuaaacuuuuggauuuucaagaugaagaaaa

SEQ ID NO: 62636 - RNA, 56 nt, Mus musculus
uaaucuccagguccugaaagacaauggugaaguaacuuuccacagaagauaauuag

SEQ ID NO: 62637 - RNA, 92 nt, Mus musculus
ugcccaggccagagacuggaggggcagaggugacacccagugucagauucugagaaaguacaagcgaugcgucccaguaggggcuaagaaag

SEQ ID NO: 62638 - RNA, 90 nt, Mus musculus
gggugcagauaggaggugaaagguagaacggaagacuaagcacaagcuagggauaagcugagaaacugaggaaggaaaagaaaagugaaa

SEQ ID NO: 62639 - RNA, 45 nt, Mus musculus
ugagccauugagaggggaacacuuucucagaaugagacuuguuaa

SEQ ID NO: 62640 - RNA, 42 nt, Mus musculus
cucuggggaagcagggugugcgcaucaugaagaggucauuag

SEQ ID NO: 62641 - RNA, 44 nt, Mus musculus
uuuugccaaaccaguguauccaggacagacucuacaaacugaga

SEQ ID NO: 62642 - RNA, 44 nt, Mus musculus
aaugcugauaaucaaaugagacacuguuggcauugauuaugggg

SEQ ID NO: 62643 - RNA, 45 nt, Mus musculus
ugggguaaaacucagguuuugaaccugugguucuugcguauggug

SEQ ID NO: 62644 - RNA, 46 nt, Mus musculus
uccuugagaugagaaucugcccuucuugaagccaucugaccaucag

SEQ ID NO: 62645 - RNA, 45 nt, Mus musculus
guuuguuuguuuuugagaaagagaaagaccaugguauggguaagg

SEQ ID NO: 62646 - RNA, 30 nt, Mus musculus
aaagaaagagagagagaaagagcgagagca

SEQ ID NO: 62647 - RNA, 45 nt, Mus musculus
guuuauggucugcugucuucccugcagcugagaaaauggguccuu

SEQ ID NO: 62648 - RNA, 46 nt, Mus musculus
acccagucgauggcuauuaugggcaccucugcgaugaagacccucc

SEQ ID NO: 62649 - RNA, 46 nt, Mus musculus
uugacgccaacuccucgguccuucaugaugaauucaucgggcacag

SEQ ID NO: 62650 - RNA, 25 nt, Mus musculus
cacagaacacucagggcagaacucu

SEQ ID NO: 62651 - RNA, 91 nt, Mus musculus
aguacucccgagacugcacaugugaagaguucugcccugaguguucuguggaguucacucucgaugugaggugcaaugaagaccagacgcg

SEQ ID NO: 62652 - RNA, 35 nt, Mus musculus
auacaguguaucccaagccugaggaauggcccaag

SEQ ID NO: 62653 - RNA, 46 nt, Mus musculus
uugccguuggggucguagggagccugcgacucauccucauccagcu

SEQ ID NO: 62654 - RNA, 41 nt, Mus musculus
gagggggauguucuauguuauccacuggagguggggacagg

SEQ ID NO: 62655 - RNA, 24 nt, Mus musculus
uguagcuacauauugggaccugag

SEQ ID NO: 62656 - RNA, 23 nt, Mus musculus
gcccacugcuuaagaaagacccu

SEQ ID NO: 62657 - RNA, 42 nt, Mus musculus
aaagaaagaaagaaagaaagaaagaaaaagaaagaaggaaag

SEQ ID NO: 62658 - RNA, 45 nt, Mus musculus
gaugucgugcucuuaucaaaugccuuucaagguuaacugacugca

SEQ ID NO: 62659 - RNA, 42 nt, Mus musculus
cugaaagaaauguggaauguacucuuuaccaauggggguggg

SEQ ID NO: 62660 - RNA, 42 nt, Mus musculus
uuucgcccaccaagucugcaggguggggcugaguguguggaa

SEQ ID NO: 62661 - RNA, 42 nt, Mus musculus
cggggccucucauacgugucauaguaguuauaauagggguug

SEQ ID NO: 62662 - RNA, 46 nt, Mus musculus
aggggucgucgcccaccaugcgaucuauguggcuggguggccucag

SEQ ID NO: 62663 - RNA, 65 nt, Mus musculus
ucccauuggauugucuggcgccaggcaccaggggcggcgggcggcucgcgcggggucugcggggc

SEQ ID NO: 62664 - RNA, 46 nt, Mus musculus
acggggagcugcgcacgaaggucugggaaagcgcacagagucugga

SEQ ID NO: 62665 - RNA, 45 nt, Mus musculus
acggaacacacauccugagacacacucgacuuaaucugggccgaa

SEQ ID NO: 62666 - RNA, 46 nt, Mus musculus
cacacacacacacacacacacaauuaugcacucacauaugggguag

SEQ ID NO: 62667 - RNA, 41 nt, Mus musculus
gcugacaaacuacuuuugucugcuucacaacuauugggggg

SEQ ID NO: 62668 - RNA, 45 nt, Mus musculus
gugccagagaggugaggaguguacaccuuugaucccagcccucag

SEQ ID NO: 62669 - RNA, 41 nt, Mus musculus
cuuucccuagacagcaaaauuacuagcauaaagcugccuca

SEQ ID NO: 62670 - RNA, 45 nt, Mus musculus
uauauauauauagagagagagagagagagagagagagagacggcu

SEQ ID NO: 62671 - RNA, 46 nt, Mus musculus
ggaggacggagaggaccuguucaccagcaccgucuccacccuugag

SEQ ID NO: 62672 - RNA, 42 nt, Mus musculus
ggagggugugcccugccacgggagagccaggaagucgggaag

SEQ ID NO: 62673 - RNA, 46 nt, Mus musculus
guuguuaauugguuguugaucuaaaccccucaucuuauggauucau

SEQ ID NO: 62674 - RNA, 46 nt, Mus musculus
auaugcggggugugugugugugugugugugugugugagugagugag

SEQ ID NO: 62675 - RNA, 42 nt, Mus musculus
cuggguuuuguuuuuuguuuuuuuaaauauaaaugcugguag

SEQ ID NO: 62676 - RNA, 46 nt, Mus musculus
gaguucugugauauuugaaugaaauguucguuuuucaggccccuug

SEQ ID NO: 62677 - RNA, 45 nt, Mus musculus
cagaucccagccaccacaugguggcucacaaccacccguaaugag

SEQ ID NO: 62678 - RNA, 45 nt, Mus musculus
gagaaaucaugucuuagacaaaaacaagacuaaacaaacaaacaa

SEQ ID NO: 62679 - RNA, 45 nt, Mus musculus
caaggccauccuggucugcgacuacaggcuacacagugauaccuu

SEQ ID NO: 62680 - RNA, 45 nt, Mus musculus
gaauuuuguguguguguguguguguguauuuuaaagaaugcuuga

SEQ ID NO: 62681 - RNA, 46 nt, Mus musculus
augggcgaaugcuuauuauuauaaugagugacuuacuacaaaagag

SEQ ID NO: 62682 - RNA, 45 nt, Mus musculus
auguagaguucuacaaccccagaauuuaggagggugaggcaagag

SEQ ID NO: 62683 - RNA, 45 nt, Mus musculus
acacaaugaaagucacguaagcagcccaauccauuguccaccauu

SEQ ID NO: 62684 - RNA, 55 nt, Mus musculus
caaacucuaauggcuccaaaccuguagaaguuguccuagacgaugacagagaaga

SEQ ID NO: 62685 - RNA, 45 nt, Mus musculus
gagcucucuaguuaggucauucuguaagaaauacauacagaccag

SEQ ID NO: 62686 - RNA, 42 nt, Mus musculus
uauaaugaguaacagaucagggaugcauaacaagacccacug

SEQ ID NO: 62687 - RNA, 41 nt, Mus musculus
uguaacccuuuaacacauaguucuuccuguugugaccccua

SEQ ID NO: 62688 - RNA, 46 nt, Mus musculus
guugucucuauagaucccacccccccuaguuaccauaguuuggaag

SEQ ID NO: 62689 - RNA, 60 nt, Mus musculus
cuccugcggucaccccugucacucccaccacacucauugcuccuagaaucgaaucaaaga

SEQ ID NO: 62690 - RNA, 66 nt, Mus musculus
guaucucugcuccagucaucuuugacagauccagggacgagguguggucaacauuuacauuucuag

SEQ ID NO: 62691 - RNA, 44 nt, Mus musculus
gauuagcuuaaugucucuauuuaaaaagugaccuugagcagaaa

SEQ ID NO: 62692 - RNA, 54 nt, Mus musculus
uguuguuguuuuucuauacauaugagacguuaagacaaaaauuucuguucucca

SEQ ID NO: 62693 - RNA, 46 nt, Mus musculus
aguugaaauuuuuaaauuuuaaauuuuuugagaauuucauacugag

SEQ ID NO: 62694 - RNA, 46 nt, Mus musculus
ccggucaguuggcucaugcuuaggaaaaaaaauugacugccuguag

SEQ ID NO: 62695 - RNA, 47 nt, Mus musculus
gccaagcauuuagaaaacaauuagaaaugauccugguuagagagaug

SEQ ID NO: 62696 - RNA, 46 nt, Mus musculus
agaagaagcaaauggagauauuuuugauauagaaauugguguguca

SEQ ID NO: 62697 - RNA, 51 nt, Mus musculus
acaguuuugaaaguaauggaaguaaauggcuguuugagugacauagguagg

SEQ ID NO: 62698 - RNA, 46 nt, Mus musculus
acacuuauucaugauaaaggaacuuuguaguuggagaaagacaaga

SEQ ID NO: 62699 - RNA, 49 nt, Mus musculus
auagcaaacaagcaagcaaaacaaaaccuuguuucagaaaacuaaaggg

SEQ ID NO: 62700 - RNA, 46 nt, Mus musculus
agcaaauauuuacauguugguuacaucgugccacccgcuccagaaa

SEQ ID NO: 62701 - RNA, 46 nt, Mus musculus
cuagcauucaugaggccuuggguucaagucccagaauuagggagaa

SEQ ID NO: 62702 - RNA, 48 nt, Mus musculus
caaggucaaaguagguaaagaagauucaucauccacugaguuuguaga

SEQ ID NO: 62703 - RNA, 42 nt, Mus musculus
uuuaccacuuucuaauaccauaguuaauuuugucuggucuuc

SEQ ID NO: 62704 - RNA, 46 nt, Mus musculus
ucaagucccagccaccacaugguggcucacaaccaucuguaaugag

SEQ ID NO: 62705 - RNA, 46 nt, Mus musculus
gagcugauuuuucgacuugaauaaugaaaugaauuaaugagcccaa

SEQ ID NO: 62706 - RNA, 45 nt, Mus musculus
uagugguuugaagaaaagcaacagcaauuugagaaucuugaccag

SEQ ID NO: 62707 - RNA, 45 nt, Mus musculus
uucacaaucugaagauacaaucugugaaucuauuuugguggggcu

SEQ ID NO: 62708 - RNA, 46 nt, Mus musculus
ccuguuccuccugcuccuccugcugcuccugcuccuccugccccuc

SEQ ID NO: 62709 - RNA, 47 nt, Mus musculus
ugaugguugcuaacaagccagauaaaauucaacaagcuaaaaacgag

SEQ ID NO: 62710 - RNA, 53 nt, Mus musculus
agagagauuuugagcagaucucuaaaacaauucgaaaagaagugggaagauuu

SEQ ID NO: 62711 - RNA, 45 nt, Mus musculus
uugugucuuaaauacuugcacuaaaaaagugcacugcaaggccag

SEQ ID NO: 62712 - RNA, 45 nt, Mus musculus
aggagucuugacaagcuggaauucaggaguggucacaggccccaa

SEQ ID NO: 62713 - RNA, 46 nt, Mus musculus
ccaccaccuugagcugacguuugauguccuggaacauugucacugg

SEQ ID NO: 62714 - RNA, 32 nt, Mus musculus
caauauccaucuuagugucuggacucugagac

SEQ ID NO: 62715 - RNA, 46 nt, Mus musculus
gagguugcacaggaaguccuucagggggcugcagaugacguggaua

SEQ ID NO: 62716 - RNA, 93 nt, Mus musculus
gaugcagcgaaaaggguguggucaaggcugaaaagagcaagaaaaagaaggaagaggaagaugaggaggaggaugaagaggaugaggaagaug

SEQ ID NO: 62717 - RNA, 47 nt, Mus musculus
acaacuuugucaagcucauuuccugguaugacaaugaauacggcuau

SEQ ID NO: 62718 - RNA, 42 nt, Mus musculus
gaggcucgaugccacagagaagagggauacuagccaggugag

SEQ ID NO: 62719 - RNA, 46 nt, Mus musculus
gucaaaugcuggagugagcauggguaccccaauggagcagcuggag

SEQ ID NO: 62720 - RNA, 41 nt, Mus musculus
aauugaaaaaugaaagugcagagcuggagagauggcucagu

SEQ ID NO: 62721 - RNA, 42 nt, Mus musculus
uggacagccagggcuacacagagaaaccuguuugggaguugu

SEQ ID NO: 62722 - RNA, 41 nt, Mus musculus
uguugugcuuuuuguuguaaacugcgccacacacggggagu

SEQ ID NO: 62723 - RNA, 42 nt, Mus musculus
aaagaggaaaagaaaagagauaugaaaauaagagggcagucg

SEQ ID NO: 62724 - RNA, 46 nt, Mus musculus
auuuggauuuaggauggaaaauauaggacacccaagagaucuagaa

SEQ ID NO: 62725 - RNA, 45 nt, Mus musculus
cagggcacauaucuaauuauugguuaguuuauauagaccccacca

SEQ ID NO: 62726 - RNA, 45 nt, Mus musculus
aauuucugaaauucccucaccuccagaguuuuccauaacuagaga

SEQ ID NO: 62727 - RNA, 34 nt, Mus musculus
agcugcacacgcggaucggggucgggggccgggu

SEQ ID NO: 62728 - RNA, 46 nt, Mus musculus
cccugaguggcacuucugugccgcccuccgugucuccaucgccugc

SEQ ID NO: 62729 - RNA, 46 nt, Mus musculus
aaaacucacgaugucuucguucuuaauaacuaaguaauguccccuu

SEQ ID NO: 62730 - RNA, 45 nt, Mus musculus
guucuucuuucuccacauucucaccagcaucugcugucaccugag

SEQ ID NO: 62731 - RNA, 46 nt, Mus musculus
auagcccuacuuucauucugauaaagacucucaccaaguugccuag

SEQ ID NO: 62732 - RNA, 41 nt, Mus musculus
agggccggaaccuugaggcaggaccugaugcagaggccaca

SEQ ID NO: 62733 - RNA, 45 nt, Mus musculus
uuugacuucaccacauuuauuaauuuucauauucauauagcugaa

SEQ ID NO: 62734 - RNA, 90 nt, Mus musculus
ucaggugacuucuugugaaccaauccccuaugaauaaaggagccagucauuggacaaguaggcgggacuuccaggcuggagagaggaaga

SEQ ID NO: 62735 - RNA, 46 nt, Mus musculus
cgcccagcgauugaguuacuguuguuuccgaaguaagucuguauag

SEQ ID NO: 62736 - RNA, 46 nt, Mus musculus
aacuggauauugucguaaccucaaauaaagaagugaaaguggcugc

SEQ ID NO: 62737 - RNA, 46 nt, Mus musculus
acacuguaaugcaaugaagagauaaaggaguuguaauugaaagaag

SEQ ID NO: 62738 - RNA, 45 nt, Mus musculus
aaaaaaaaaaaaaaaaaaaaaaaaaaaaagaaagaaagaaaugua

SEQ ID NO: 62739 - RNA, 45 nt, Mus musculus
ugaguauuuuauaaggucagauaccauugcacaguagcauaugca

SEQ ID NO: 62740 - RNA, 41 nt, Mus musculus
gacagccugaggaggucgggagcgauccacgagaaacagac

SEQ ID NO: 62741 - RNA, 45 nt, Mus musculus
uacaauaauuucagaaccaauugauagugauauaugcugcccauu

SEQ ID NO: 62742 - RNA, 35 nt, Mus musculus
cuugcaacuuugugacuauaagaauaucacuuuag

SEQ ID NO: 62743 - RNA, 88 nt, Mus musculus
gcuuccgugaauccaacaguuuuuaugauuuuccuguaggcugcaguccuuuuaaaagaaaaagucuuuuuuuaaaaaauaaaggcac

SEQ ID NO: 62744 - RNA, 46 nt, Mus musculus
aauaauguuuuauuuuuuucauagcuaucuaaaaacugaagggcag

SEQ ID NO: 62745 - RNA, 46 nt, Mus musculus
gagcuguccauguucuugcccacugacacaucucuccagcacguuc

SEQ ID NO: 62746 - RNA, 46 nt, Mus musculus
uccaacauccucugcacuguaagagggaucccuucuuuugagacag

SEQ ID NO: 62747 - RNA, 45 nt, Mus musculus
cuuccaucccuacuauguguucccguuccugucuuccuuucccca

SEQ ID NO: 62748 - RNA, 46 nt, Mus musculus
ugugaggcuguguccagucgaccaacaagaggugacacccugaaag

SEQ ID NO: 62749 - RNA, 46 nt, Mus musculus
cugugccucucugccuuuauuucuuaaggauguuuucaacgggaug

SEQ ID NO: 62750 - RNA, 46 nt, Mus musculus
agguggguacgugcugaucuucaagcacuguguguguugcuuggug

SEQ ID NO: 62751 - RNA, 46 nt, Mus musculus
cucaggacuucugguggcuucuugaugcauaagaaacggggaccuu

SEQ ID NO: 62752 - RNA, 38 nt, Mus musculus
aagacgguguuuccuguucucugaaggcagguuuugca

SEQ ID NO: 62753 - RNA, 33 nt, Mus musculus
cuaguccgccuucugugggacggggagaagcaa

SEQ ID NO: 62754 - RNA, 46 nt, Mus musculus
gauuuaacauccaucucacagaguugcuugacuguuuaguuccaag

SEQ ID NO: 62755 - RNA, 46 nt, Mus musculus
uugccugauucgcucaucguuauuuuuuuuuccucuuuagcuagag

SEQ ID NO: 62756 - RNA, 46 nt, Mus musculus
aucugauguaaaaguugcuguauuaaacauaaauuauuaaguguag

SEQ ID NO: 62757 - RNA, 46 nt, Mus musculus
ggcauauuaaauagccgauugacaacaggcagacagcaucaaggag

SEQ ID NO: 62758 - RNA, 46 nt, Mus musculus
aggggucaagaugaugaguguaaauagagacaggcagucuucagag

SEQ ID NO: 62759 - RNA, 44 nt, Mus musculus
aucgcuugaaagccgcuaagacagggggagagguagcacagaga

SEQ ID NO: 62760 - RNA, 41 nt, Mus musculus
ugcuagacgucaggaaguucacaaggggcaaggccugccaa

SEQ ID NO: 62761 - RNA, 61 nt, Mus musculus
uuguaauuugugcaugaaauucauguuauuuccuggggagagaagagggccaacugagugg

SEQ ID NO: 62762 - RNA, 45 nt, Mus musculus
ccuaagaagcuucccucaaccucucccuggccuggaggaggaucc

SEQ ID NO: 62763 - RNA, 46 nt, Mus musculus
gccacuucucccaucccccaaaugguauucuuuuuaaggccagagg

SEQ ID NO: 62764 - RNA, 42 nt, Mus musculus
aaaguuucuuugaaagcuaaaaaguuuucccucugcccaacu

SEQ ID NO: 62765 - RNA, 46 nt, Mus musculus
agucuguaccuaaaguugucucccagcccccauucuaccccauuau

SEQ ID NO: 62766 - RNA, 46 nt, Mus musculus
ccccccaggugugugaguggcaagagcaagcucagaaccgucucag

SEQ ID NO: 62767 - RNA, 80 nt, Mus musculus
agauacguucaucuuaguaucucucaaugacaauguccacugauugacuggaaacguuuggaaaaacacaaaaacaaguu

SEQ ID NO: 62768 - RNA, 45 nt, Mus musculus
gacccuggaaacugcugcugugucccuuucagugcugggccuaga

SEQ ID NO: 62769 - RNA, 53 nt, Mus musculus
gcuccuauauucugaaagcuacucugagacccugugagagcugaguuagaugg

SEQ ID NO: 62770 - RNA, 25 nt, Mus musculus
gcagagggaccagagaugcuaagau

SEQ ID NO: 62771 - RNA, 48 nt, Mus musculus
ggcaagcccgagccucaaagaaugucguaucuuaaugcuagagaauga

SEQ ID NO: 62772 - RNA, 51 nt, Mus musculus
uuuccugugguaaaggcugaggcgagucaggagucugccaguguucauagu

SEQ ID NO: 62773 - RNA, 41 nt, Mus musculus
cucaguauuagcugccauaguucuucuguccuccagacagu

SEQ ID NO: 62774 - RNA, 42 nt, Mus musculus
ucuccugucccucacuguguccuaccguuccuguccuguccu

SEQ ID NO: 62775 - RNA, 41 nt, Mus musculus
uuugauccaaagaagggauuuuggugccaacugcuugaagg

SEQ ID NO: 62776 - RNA, 46 nt, Mus musculus
ccuggucuuggauggcaaacugcugcgaacagaaccugccaaaguc

SEQ ID NO: 62777 - RNA, 42 nt, Mus musculus
gcugguuagaaggucccuagaauggcaggagucucugagacu

SEQ ID NO: 62778 - RNA, 45 nt, Mus musculus
ucacagccauccguaacaagaucugacucccucuucugguguguc

SEQ ID NO: 62779 - RNA, 47 nt, Mus musculus
aguggcaccacggcgggcagcugcacuguugcccaaggccaagaucc

SEQ ID NO: 62780 - RNA, 53 nt, Mus musculus
cuaccccagcuccgagaccuucgaggagauccaguuuuuuaacggccacaacu

SEQ ID NO: 62781 - RNA, 50 nt, Mus musculus
accacggcccucuaccuguuccugggcaugcacccggaccucagcagcaa

SEQ ID NO: 62782 - RNA, 46 nt, Mus musculus
agacaugugaccgcuucccaaagcuucuuaucauuggcccccagaa

SEQ ID NO: 62783 - RNA, 42 nt, Mus musculus
gacgacuaaacacuggaagcggaagcuaggcucgggccaggg

SEQ ID NO: 62784 - RNA, 92 nt, Mus musculus
gcacuccuggaccaaccugaggcugcagacucugccccccgugcagcuggcccagaaguacuuucagaucuuuucugaggagaaggacccgc

SEQ ID NO: 62785 - RNA, 24 nt, Mus musculus
ucaugacacacuuauccaacuaug

SEQ ID NO: 62786 - RNA, 46 nt, Mus musculus
uaacgauaugaaauaagccgugugugcauuacccuccagccucaug

SEQ ID NO: 62787 - RNA, 42 nt, Mus musculus
ugcuccucaauccugugagugcucuacagcccagggcuggua

SEQ ID NO: 62788 - RNA, 46 nt, Mus musculus
gaugcaguaacuuccuggguugagcuaugcagcagaggccagaggg

SEQ ID NO: 62789 - RNA, 46 nt, Mus musculus
aguguagguugccaccacagagggcaaacauaacaaugaagcagau

SEQ ID NO: 62790 - RNA, 42 nt, Mus musculus
cuuuugaagcauaaauaggaguuuaccagucccaggggagau

SEQ ID NO: 62791 - RNA, 42 nt, Mus musculus
cagcaucccagccuuuacccugugggcccaacgugaggagug

SEQ ID NO: 62792 - RNA, 42 nt, Mus musculus
aggaggaggaggagggaggaggaagaagaagaggaggaagag

SEQ ID NO: 62793 - RNA, 27 nt, Mus musculus
uaauuaauuuauuuuuucauguuuuua

SEQ ID NO: 62794 - RNA, 46 nt, Mus musculus
ugccuuuccuuucuggcuucauccucuuaucuucuagaccgcagau

SEQ ID NO: 62795 - RNA, 46 nt, Mus musculus
gucgggcacggggaagcagcaguugucucugugaauugggccacag

SEQ ID NO: 62796 - RNA, 42 nt, Mus musculus
cggugagagcuuuguauccugauccauagguagcaggcagag

SEQ ID NO: 62797 - RNA, 45 nt, Mus musculus
caucaaaccagaguugugugucuuagucauuguucgauugcuagg

SEQ ID NO: 62798 - RNA, 44 nt, Mus musculus
uagaggggagugcuggccugguggguuacugaagaggaugagaa

SEQ ID NO: 62799 - RNA, 46 nt, Mus musculus
ugugaaugugcagugugugugugugugugugugugugugugugugu

SEQ ID NO: 62800 - RNA, 42 nt, Mus musculus
gugcaguuagacccugaagguacagaggcuaagcaggcaguc

SEQ ID NO: 62801 - RNA, 37 nt, Mus musculus
uucaaagccgucaugugauguuaaagcagcuguguga

SEQ ID NO: 62802 - RNA, 46 nt, Mus musculus
ugcucauggcugucacgaaagccgguuggcuuguuggcuuggcaag

SEQ ID NO: 62803 - RNA, 46 nt, Mus musculus
ggcguugcuucugucuucauuuuccucugcacaguuaguggcagau

SEQ ID NO: 62804 - RNA, 46 nt, Mus musculus
uguguuuucuagguccugagaggauauuuggaacaauggugauaga

SEQ ID NO: 62805 - RNA, 45 nt, Mus musculus
guuuuguuguuguuguuuguuuuucuuuugguuuugauuagagag

SEQ ID NO: 62806 - RNA, 45 nt, Mus musculus
gugcacuguagcugucuucagacacaccagaagagggcguuagau

SEQ ID NO: 62807 - RNA, 45 nt, Mus musculus
aauaacaggacuauuuggaggacuuggacauucuugacuugagau

SEQ ID NO: 62808 - RNA, 23 nt, Mus musculus
ucacaaggcagaaccagagccag

SEQ ID NO: 62809 - RNA, 67 nt, Mus musculus
ccgauaccagaaauccuaccgauaagcucaucucaaggaucaggguuuaccuuuguaauaaacaucc

SEQ ID NO: 62810 - RNA, 41 nt, Mus musculus
uccaucucaaaggcccugguagcuuauuaccaaaaauaugu

SEQ ID NO: 62811 - RNA, 41 nt, Mus musculus
ggccccuggagaugaucgagccgcgcacgcugcaguacaag

SEQ ID NO: 62812 - RNA, 42 nt, Mus musculus
acacccuggaccccuggcgcagccugaagccuugccccauca

SEQ ID NO: 62813 - RNA, 46 nt, Mus musculus
cgugcuggccaaaccagugaacccgcagggaagcugcaguaccagg

SEQ ID NO: 62814 - RNA, 46 nt, Mus musculus
agggggagagagggggagagagggagagagagagagagagagagag

SEQ ID NO: 62815 - RNA, 59 nt, Mus musculus
aggaaaaaagucccuggccaaagacucugccucgccgauccagaagaagaaaaagaaga

SEQ ID NO: 62816 - RNA, 61 nt, Mus musculus
cucaggaagcucgcuuucuucccacagaaaaaaaagacaaggagaaaaaggaaaagaagaa

SEQ ID NO: 62817 - RNA, 47 nt, Mus musculus
cggcgaguugcuggggauaaagcuugagaguggcgagcagagcgacc

SEQ ID NO: 62818 - RNA, 50 nt, Mus musculus
aagcggaaguuaucaggggaccuagaagcuggggccccaaagaacaagaa

SEQ ID NO: 62819 - RNA, 59 nt, Mus musculus
uggagcaggaacggcugaaggccacagaggccaucaaggagagugggaagaagagccag

SEQ ID NO: 62820 - RNA, 59 nt, Mus musculus
aguuucccauuuaugcaguuguaaaguacacccccucaguugucaugcauugugcaaga

SEQ ID NO: 62821 - RNA, 47 nt, Mus musculus
cugggaucucugucgauccacaaacauagcuaagcauaggagacaga

SEQ ID NO: 62822 - RNA, 46 nt, Mus musculus
ccagccuugaugggcuaaggacccauggugugucuacagacgggag

SEQ ID NO: 62823 - RNA, 26 nt, Mus musculus
agucaaaaucccaacacgcagcagac

SEQ ID NO: 62824 - RNA, 47 nt, Mus musculus
agcucccugagaagcagcagcuugccccaggcuaccccaaggccccc

SEQ ID NO: 62825 - RNA, 49 nt, Mus musculus
guggaaacacuccccaugaugccuccccagagcgcacccauccagccca

SEQ ID NO: 62826 - RNA, 45 nt, Mus musculus
gucaaccguaacaguaguccagcugucccagcuccuaccccagaa

SEQ ID NO: 62827 - RNA, 56 nt, Mus musculus
gaaugaggagcagaggcgcuacagaccuaagcacugccccugugcccagcccaccc

SEQ ID NO: 62828 - RNA, 42 nt, Mus musculus
ucugccccagacuaacuggaauaaguagauagaagcccagcu

SEQ ID NO: 62829 - RNA, 45 nt, Mus musculus
ugcugaggacacacccuccacugcacugcaccucuagccccacaa

SEQ ID NO: 62830 - RNA, 45 nt, Mus musculus
agacugggguuuauaaaccucaggucuccuagcugcauccccaga

SEQ ID NO: 62831 - RNA, 46 nt, Mus musculus
cuguuaaaaaaaaaucuaaauuuuagaauuaagucaaggcuugcau

SEQ ID NO: 62832 - RNA, 82 nt, Mus musculus
cagacaguugugaggugcucugugaaugcuaggaaucaaacccagguccucuaaccuccgagccaucucuccagcccccuua

SEQ ID NO: 62833 - RNA, 45 nt, Mus musculus
ucccacauaaauuauuauuaaauguaucagcguuugccugcaugu

SEQ ID NO: 62834 - RNA, 63 nt, Mus musculus
aagcugaggcuggcuggaacccgggguggcuacaaguuagaaagaagugggcaugugagguaa

SEQ ID NO: 62835 - RNA, 45 nt, Mus musculus
aggguccucagagagcagugaugaggaucugcccuccggccaggu

SEQ ID NO: 62836 - RNA, 45 nt, Mus musculus
ucucccagccugccagaggcaaagcgucagguccagcguccccag

SEQ ID NO: 62837 - RNA, 46 nt, Mus musculus
cuccaggaucccuugccuccagguccuccccaccaugccccuggau

SEQ ID NO: 62838 - RNA, 59 nt, Mus musculus
gcccagccagggaagacagaggacucagacagcaguagugaagagucugacagugacac

SEQ ID NO: 62839 - RNA, 41 nt, Mus musculus
cugccaaggagucuccuaaaaaaggagcccauccaggaacc

SEQ ID NO: 62840 - RNA, 42 nt, Mus musculus
ggaggacucagagagcagcaguaaagaggagucugacaguga

SEQ ID NO: 62841 - RNA, 46 nt, Mus musculus
uaaaaggcuuuacagugcugaauuugaguguguguuagugccaguu

SEQ ID NO: 62842 - RNA, 46 nt, Mus musculus
aaugacagacacggagucuaguugaaagggaaccuaaaaagcaguu

SEQ ID NO: 62843 - RNA, 44 nt, Mus musculus
auggcucaggaagacucagagagccucgaggaggacuccagcag

SEQ ID NO: 62844 - RNA, 45 nt, Mus musculus
ucaccccuggaaaggcaaggccuguggcagcccaggcagggaaac

SEQ ID NO: 62845 - RNA, 46 nt, Mus musculus
gaagacugggccugcagccacccaggccaaggcagaaaggccagag

SEQ ID NO: 62846 - RNA, 41 nt, Mus musculus
auagcagucucacaguccugcacacaugcugggcggagcag

SEQ ID NO: 62847 - RNA, 46 nt, Mus musculus
gauugaucucuuccagcuucugacccucucuugccaguguucagau

SEQ ID NO: 62848 - RNA, 45 nt, Mus musculus
aaggcagcaguuccagugaagauuccuccaucucaagcgaugaga

SEQ ID NO: 62849 - RNA, 46 nt, Mus musculus
aagaccgacaccugucaauucugcaaccgcagcuuugccaucaaaa

SEQ ID NO: 62850 - RNA, 46 nt, Mus musculus
ucggaucaggagaaggaagaggaggcagcaaccgaaagggccaaag

SEQ ID NO: 62851 - RNA, 42 nt, Mus musculus
ggaaacgaaacugaacgccagggcggagugcuggggggaggg

SEQ ID NO: 62852 - RNA, 46 nt, Mus musculus
aggcuacguccgcgcggcgcgggaaguaaaggagcagagcggccag

SEQ ID NO: 62853 - RNA, 45 nt, Mus musculus
ccaggacauauguaguucacaaaucuuuuuggauaauagaaucag

SEQ ID NO: 62854 - RNA, 46 nt, Mus musculus
gaaaacccaaaagagauuuccacauucucuugagcauuacggugug

SEQ ID NO: 62855 - RNA, 66 nt, Mus musculus
ugcugguucuccuuuggauuuugcuggaauucucccugucagaucacccuaccauugccaccuaug

SEQ ID NO: 62856 - RNA, 62 nt, Mus musculus
aaucaggccagcccuucuacugcuguccguuuuuuggguccagcaaaauaacagaagacagc

SEQ ID NO: 62857 - RNA, 58 nt, Mus musculus
gagguggacuuccuggagggggugauagcucacaucagaagccaucuguagcccggua

SEQ ID NO: 62858 - RNA, 41 nt, Mus musculus
aucugaacugagucugauaacacuuccucccucuugcccaa

SEQ ID NO: 62859 - RNA, 42 nt, Mus musculus
gaagagaaggaagaggaggaggaagaggaggaggaggagcaa

SEQ ID NO: 62860 - RNA, 43 nt, Mus musculus
aaugucuggcucuacauuaguuggggcuuucauuugucuucag

SEQ ID NO: 62861 - RNA, 34 nt, Mus musculus
cuugggcuucuacugucuguucuguaggcguguu

SEQ ID NO: 62862 - RNA, 45 nt, Mus musculus
guggacaggucagggggauaacaggaucagaugggagcuacagag

SEQ ID NO: 62863 - RNA, 46 nt, Mus musculus
ccaacuuggaguccuuacuugcuaccccagccuuauuccuugccag

SEQ ID NO: 62864 - RNA, 46 nt, Mus musculus
ggaaacuaagacucauaggcuaaggacucaaccaaggucauguaag

SEQ ID NO: 62865 - RNA, 46 nt, Mus musculus
aggacaccauggggcuuccaggagugauaccagcuuuaguccucag

SEQ ID NO: 62866 - RNA, 46 nt, Mus musculus
ugagagucuggaagcuccacagggcucuugagccccgugucccugg

SEQ ID NO: 62867 - RNA, 66 nt, Mus musculus
gcccccugggccagaguuuguucucaacaucuccagcaccuuuguucugaccugcucgggcucagc

SEQ ID NO: 62868 - RNA, 43 nt, Mus musculus
ugugggaacagaugucccaggugcccuggcaagaagcggccau

SEQ ID NO: 62869 - RNA, 45 nt, Mus musculus
ggccggagcucagugagaggaagcguaucuauaucuuugugccag

SEQ ID NO: 62870 - RNA, 56 nt, Mus musculus
caauuccgugccgagugacagacccccagcuggaggugacgcuacaugagaagaaa

SEQ ID NO: 62871 - RNA, 45 nt, Mus musculus
cuauacuugcaacgugucagugagugugaacgaccauggcgauga

SEQ ID NO: 62872 - RNA, 41 nt, Mus musculus
cgcagagaauggcuacgugcggcugcuggagacacugggag

SEQ ID NO: 62873 - RNA, 71 nt, Mus musculus
ggcagucuguucagaguucuaccugcuaugauuugcauccucauaggggaagagaaauagaaaaggaggag

SEQ ID NO: 62874 - RNA, 85 nt, Mus musculus
uuuccacagaaaacgaagaaagguuagaaaguaacaugaaacuguaguggguggggaaggagauagauggauagauagauagaua

SEQ ID NO: 62875 - RNA, 45 nt, Mus musculus
uguagaugauugauagauagauaauagauagaugauugauagaua

SEQ ID NO: 62876 - RNA, 46 nt, Mus musculus
uuccaaggaggagagccagcuagaaacgaaugugacuuucugggag

SEQ ID NO: 62877 - RNA, 45 nt, Mus musculus
uugugagugccccaccuguggauggcucugaugacucucaccccu

SEQ ID NO: 62878 - RNA, 42 nt, Mus musculus
guacguuccuaugcacacacgcaaaauaugacgucggcccag

SEQ ID NO: 62879 - RNA, 46 nt, Mus musculus
gacagccagaaguagcgagaagcaagccuuaauguccgagcugaag

SEQ ID NO: 62880 - RNA, 42 nt, Mus musculus
aagaagugggagugggugggcaggggagugggggcgggggag

SEQ ID NO: 62881 - RNA, 46 nt, Mus musculus
ucaugucaaccccaaggguggauuucagccccuggccagguggaca

SEQ ID NO: 62882 - RNA, 73 nt, Mus musculus
ucugguggacuaccugcaccggaacaaacacaccuucuugcagcgacacuccaacaagcauuguccgcccagu

SEQ ID NO: 62883 - RNA, 51 nt, Mus musculus
gcuacauggauaugagcaaggaugaaucuauagauuacgugcccauguugg

SEQ ID NO: 62884 - RNA, 57 nt, Mus musculus
acaugaaaggagacaucaaauacgcagacauugagucccccagcuacauggccccuu

SEQ ID NO: 62885 - RNA, 45 nt, Mus musculus
gggcaagaaggggagagauggaugaagguggucuccuagggccug

SEQ ID NO: 62886 - RNA, 42 nt, Mus musculus
ccucugaaguggauggccccagagagcaucuucaacagccuc

SEQ ID NO: 62887 - RNA, 42 nt, Mus musculus
ucuggacaccagcucuguucucuacacugccgugcagcccaa

SEQ ID NO: 62888 - RNA, 46 nt, Mus musculus
uccaccuugaaugaagucaacacuuccuccaccaucuccugcgaca

SEQ ID NO: 62889 - RNA, 41 nt, Mus musculus
cagcuuccuguaggaacugacaucacuccauuuugcccgaa

SEQ ID NO: 62890 - RNA, 58 nt, Mus musculus
ggugucuggcuccuggccaaacuguaaccagccuuggacaaggucuuuucauucagag

SEQ ID NO: 62891 - RNA, 44 nt, Mus musculus
gggcacaccuggccacaggaagcacccacuccuuucagccccac

SEQ ID NO: 62892 - RNA, 59 nt, Mus musculus
gaaccgagccucuucuucaagucuccaagugcaacugcccagaccuugacuuggaguga

SEQ ID NO: 62893 - RNA, 105 nt, Mus musculus
guuaccucgggccacugucaccagcagcguguggacagacaugauggacagugaggacagacgucccaugcaggacaagagacuugagaugggcaaugagaggaa

SEQ ID NO: 62894 - RNA, 47 nt, Mus musculus
agguuuacaaguacuuguaggacucgagauaacccacauuuagacac

SEQ ID NO: 62895 - RNA, 42 nt, Mus musculus
gaugcucgcuccagaggacccagacagagcugaggcagagag

SEQ ID NO: 62896 - RNA, 45 nt, Mus musculus
uacaguaccuucuggagcagugcgacauccccuuuagcccagaag

SEQ ID NO: 62897 - RNA, 45 nt, Mus musculus
gcuccagugaggugaacguagaggacuuuuggaccacaauggaga

SEQ ID NO: 62898 - RNA, 24 nt, Mus musculus
uaauucuguggagcugcaucucgu

SEQ ID NO: 62899 - RNA, 46 nt, Mus musculus
ugaugguccaaaugguauguuuaguauuauaggugacugccaaacc

SEQ ID NO: 62900 - RNA, 45 nt, Mus musculus
aggcuuuugacaugaauucuggaaggauauaaaccaccaagauua

SEQ ID NO: 62901 - RNA, 41 nt, Mus musculus
gacuagggcucaccuucuagcuucuauguggcacccucuug

SEQ ID NO: 62902 - RNA, 46 nt, Mus musculus
uaaaucuguaguucaaagcuacacagaaguguggcagcccauagac

SEQ ID NO: 62903 - RNA, 46 nt, Mus musculus
ugcuuaucaugaaauuaucaaagaauacauuuaaaacaggggagaa

SEQ ID NO: 62904 - RNA, 87 nt, Mus musculus
aaagcucaagguuguccgcacugcacagugaguuagagccaaagacaugcucaagguugucugcacugcacagugaguuagagccag

SEQ ID NO: 62905 - RNA, 88 nt, Mus musculus
uuaagagcagcacaugcucuuaacuacugaacuauauauccagccccauccccaaauguaauuaguaacaacuuuaauuaugugaguc

SEQ ID NO: 62906 - RNA, 42 nt, Mus musculus
ggcuuaaaggcaguuguaagcuacugaugugagugcuaagaa

SEQ ID NO: 62907 - RNA, 46 nt, Mus musculus
agugcaauucuuuaaagacuuacuguauuuuuauuuaugcauauau

SEQ ID NO: 62908 - RNA, 42 nt, Mus musculus
gcagagcacgaggcaagcccuccuugcuggcugcagcgagac

SEQ ID NO: 62909 - RNA, 41 nt, Mus musculus
aggacagauugcuuguaaagcauucaggcuggcgccuuaaa

SEQ ID NO: 62910 - RNA, 45 nt, Mus musculus
gaacccaucuuuagauuuucucuuaguucauguauaggaccuuuc

SEQ ID NO: 62911 - RNA, 42 nt, Mus musculus
caugucugaaacugggauggacaguauacaggagccccaucu

SEQ ID NO: 62912 - RNA, 42 nt, Mus musculus
caaguccagguuguucuuuuaccuaugucaccaggcacaaac

SEQ ID NO: 62913 - RNA, 45 nt, Mus musculus
uguguguguguguguguguguguauauguguguguguguguuguc

SEQ ID NO: 62914 - RNA, 42 nt, Mus musculus
guucugcuuacuguuuuggguuuguuuguuuugcccauaggu

SEQ ID NO: 62915 - RNA, 31 nt, Mus musculus
ugaauuuguauuuucaagaguuggagccuuu

SEQ ID NO: 62916 - RNA, 38 nt, Mus musculus
uuaauuuauuuuauguauaugaguacacuauagcuguc

SEQ ID NO: 62917 - RNA, 94 nt, Mus musculus
ugaggggccauugauacgggagaaagggcauugacauaguggagggggagaaagcgauaaugugugugugucuguguguuugaguggucacuga

SEQ ID NO: 62918 - RNA, 46 nt, Mus musculus
aagaagaaguauaaaauacauggagagaaggccaagaaacccaggu

SEQ ID NO: 62919 - RNA, 46 nt, Mus musculus
ucagcccugggugguauaagaaagcagacagaggagccaaccagua

SEQ ID NO: 62920 - RNA, 45 nt, Mus musculus
cccggauuucccuucucuuuucucaucagauaccauuucugaggu

SEQ ID NO: 62921 - RNA, 45 nt, Mus musculus
gucuguguaccacauaugugccgggugcccacaaaugccggaaag

SEQ ID NO: 62922 - RNA, 69 nt, Mus musculus
aagaaauacuuuugacagaugucagaaccccuccucuacagcacucagacacacaauguuucaccccca

SEQ ID NO: 62923 - RNA, 44 nt, Mus musculus
uuucuauguaugagggggugcugugcauacucaugugucaugga

SEQ ID NO: 62924 - RNA, 45 nt, Mus musculus
aggguaguuaaagugucucauuucagguguggccuauucuacaga

SEQ ID NO: 62925 - RNA, 51 nt, Mus musculus
aauucuggugguguuuuaauuugaacuugggcuuuaaauuaaguugaagag

SEQ ID NO: 62926 - RNA, 46 nt, Mus musculus
uuauggagaguacuugagcugagggcaaauggaggccugaggugga

SEQ ID NO: 62927 - RNA, 41 nt, Mus musculus
caggucacucuggggccguccccuuuugcagcacagugggg

SEQ ID NO: 62928 - RNA, 42 nt, Mus musculus
ucuuguuacucuagcuccagccaacacaaaaugcccccaguc

SEQ ID NO: 62929 - RNA, 70 nt, Mus musculus
ccaggccgcgguucgugaaggguggucgcggcugcugaagcucggccgcuuguuguucucgggcggccgc

SEQ ID NO: 62930 - RNA, 46 nt, Mus musculus
cgcugcugcucgccauccugagacgcgaagauggaggcggggggcc

SEQ ID NO: 62931 - RNA, 45 nt, Mus musculus
uuggugauguugaucgcuagauaaauguccccgaaagagccagau

SEQ ID NO: 62932 - RNA, 42 nt, Mus musculus
ccaaggcccagggagcauccccaaaugaugucagagcuagag

SEQ ID NO: 62933 - RNA, 46 nt, Mus musculus
uccccccaguuuguccugaaguugagaauuucugagaucaugagau

SEQ ID NO: 62934 - RNA, 46 nt, Mus musculus
aauuaaaacaauaagaaagaaaagcacaugaauuugggguugaggu

SEQ ID NO: 62935 - RNA, 46 nt, Mus musculus
ccgaucuaaagaaucuaaaucuagucuuaauuagcucucuggugca

SEQ ID NO: 62936 - RNA, 46 nt, Mus musculus
uuaagcuaaaugaauuuugaauuaagcugccaguauguauaaaccc

SEQ ID NO: 62937 - RNA, 46 nt, Mus musculus
guccacaaccacuggcuaguguacauaugaacuaaaaugucuaggu

SEQ ID NO: 62938 - RNA, 45 nt, Mus musculus
ccaaagaauaccuuucucuucagaucaagaacagccccccccccc

SEQ ID NO: 62939 - RNA, 46 nt, Mus musculus
cuaagugcauaguaaauaaaagcacugaaaaaauauccugcuagau

SEQ ID NO: 62940 - RNA, 46 nt, Mus musculus
aaagugaaugauuuaaucuuuuuacagaaaugagauaagguucuaa

SEQ ID NO: 62941 - RNA, 44 nt, Mus musculus
uguuuuuaaguauuauauuuagucuuuguaagucagcagucaau

SEQ ID NO: 62942 - RNA, 41 nt, Mus musculus
aggaggagcaucaugagaaggcuuccuguaaacuacggagg

SEQ ID NO: 62943 - RNA, 46 nt, Mus musculus
cucugguccaaagauuuauuuauuauuauauguaaguacacuguag

SEQ ID NO: 62944 - RNA, 45 nt, Mus musculus
uugugagccaccauguggcugcugggauuugaacucagggccuuc

SEQ ID NO: 62945 - RNA, 46 nt, Mus musculus
aggagcacaucuuuaaucccagcacuugaaaggcagaggcuggcag

SEQ ID NO: 62946 - RNA, 46 nt, Mus musculus
ggguccugcuuauuguucuucuugugcaccccucuaccucgagacc

SEQ ID NO: 62947 - RNA, 45 nt, Mus musculus
acacaaaucaaaaguccaguacuuuauuacugucacagaacauag

SEQ ID NO: 62948 - RNA, 35 nt, Mus musculus
cguccugagugggucagcaacagccuccaagugug

SEQ ID NO: 62949 - RNA, 46 nt, Mus musculus
ccuugaaaacucguuucccuguggcugcccuccaaauccaacggag

SEQ ID NO: 62950 - RNA, 45 nt, Mus musculus
ggccuagcauuugagaggccuuagcguuggcuccccgggccauua

SEQ ID NO: 62951 - RNA, 49 nt, Mus musculus
uuaugcuuugcuucuucuguaaccuauaaagaucaguagguuggagcug

SEQ ID NO: 62952 - RNA, 47 nt, Mus musculus
accccuggagguaucggccagcgcacaggagucaugugauagaucug

SEQ ID NO: 62953 - RNA, 45 nt, Mus musculus
uuugggaucguguguuuauuuuauuguuuuuguuuugggggguug

SEQ ID NO: 62954 - RNA, 45 nt, Mus musculus
aucguggucaucgccacgccccugcaccuggacaacagcagcaac

SEQ ID NO: 62955 - RNA, 42 nt, Mus musculus
uggccgagucccugcuccaggugggcgucacacagcgcuuua

SEQ ID NO: 62956 - RNA, 46 nt, Mus musculus
ccugcccauaagacuauuucacaacucuccuccccacccagcuuuu

SEQ ID NO: 62957 - RNA, 46 nt, Mus musculus
ugcaaacucaggaacuuuccaaggcugaagugugacgggcguaggu

SEQ ID NO: 62958 - RNA, 44 nt, Mus musculus
agaaguucaugagguagggggaugcucuuaggaaggaauugauu

SEQ ID NO: 62959 - RNA, 46 nt, Mus musculus
uuuggagaaaauggguaguuuggaacucuucaggaaagagaaaggg

SEQ ID NO: 62960 - RNA, 42 nt, Mus musculus
gacgaacuggguguaggagaggcuaggggcuacugggcacag

SEQ ID NO: 62961 - RNA, 43 nt, Mus musculus
gucccugauaacgugcacgauauugacaaugaagaagggcagc

SEQ ID NO: 62962 - RNA, 46 nt, Mus musculus
uagacaaaucugaaggaagauuccacgcccaaaaccucagccaggu

SEQ ID NO: 62963 - RNA, 46 nt, Mus musculus
uuccucuuuucaaggcaaagacuuggugagucuuaucucccccugg

SEQ ID NO: 62964 - RNA, 46 nt, Mus musculus
ugccugggguugaucugcaguuuuaagaaucucuuuccggcacauu

SEQ ID NO: 62965 - RNA, 45 nt, Mus musculus
gcacacgugguacgaacagccaugcuugucuguuugcuucugggu

SEQ ID NO: 62966 - RNA, 46 nt, Mus musculus
gucuccagaccugugccgaaaaagaaagagaaaguauagcuagcug

SEQ ID NO: 62967 - RNA, 46 nt, Mus musculus
auuugucuuaaaacuuagacuucuguuucucucuaaccuuucugag

SEQ ID NO: 62968 - RNA, 46 nt, Mus musculus
augcuucuuaauagcagguuagggguuacugucuuguaguuguagu

SEQ ID NO: 62969 - RNA, 46 nt, Mus musculus
aacuccuaggaaaggccuccagacugcugguacgagggcggaggua

SEQ ID NO: 62970 - RNA, 46 nt, Mus musculus
gaguguuucuguuucucuugucccuugccccaagagaugccccuag

SEQ ID NO: 62971 - RNA, 25 nt, Mus musculus
uaauuucaugaagcauccuccgguc

SEQ ID NO: 62972 - RNA, 45 nt, Mus musculus
guguuuagcugaucacaugagcuuauaguucuaucacacugccag

SEQ ID NO: 62973 - RNA, 46 nt, Mus musculus
cuguauaggguuaccuggccuugaacuuacagucuuccugccucag

SEQ ID NO: 62974 - RNA, 46 nt, Mus musculus
cuuuaguuuguguuacgacuguuugccugaaugcaugugcaccaca

SEQ ID NO: 62975 - RNA, 46 nt, Mus musculus
uauuguugacaguacgcuaagcugggccuaagcuugguggucccag

SEQ ID NO: 62976 - RNA, 44 nt, Mus musculus
caccccaggccaagccugauggugcugccggcauggcugcugaa

SEQ ID NO: 62977 - RNA, 46 nt, Mus musculus
agaugauugcuucugaaggaagauaauuaugaaaauaaaacccaag

SEQ ID NO: 62978 - RNA, 46 nt, Mus musculus
cgguggaagcagcacucacugcucaagcgcuugagaaaggccaaga

SEQ ID NO: 62979 - RNA, 68 nt, Mus musculus
agcauggugggcguguacaacggcaagaccuucaaccagguggagaucaaaccagagaugaucggcca

SEQ ID NO: 62980 - RNA, 46 nt, Mus musculus
guguguucuaaugggcuguaucccacuaaccaauaaaugagcagug

SEQ ID NO: 62981 - RNA, 42 nt, Mus musculus
acugguagcccugcugagucggcaaggcagugcagauggcac

SEQ ID NO: 62982 - RNA, 42 nt, Mus musculus
gaacggggcagauggggcuucccucuuuguaauuccugagua

SEQ ID NO: 62983 - RNA, 55 nt, Mus musculus
ucacuguuagucuuuuccuuauucauauaguguuuauaauucugagggguaugag

SEQ ID NO: 62984 - RNA, 42 nt, Mus musculus
uuucugauaaugggaaagucaagagaaagcuacuacccccaa

SEQ ID NO: 62985 - RNA, 46 nt, Mus musculus
uaagagggaagggauugaccccgcuccuuacuacugguauacagau

SEQ ID NO: 62986 - RNA, 51 nt, Mus musculus
gacagacaccauuaaugaaccaauccugcugugucgcuuuccuguggagau

SEQ ID NO: 62987 - RNA, 46 nt, Mus musculus
acgggagccaugaguuacugcugcuccacagagcuuugcuuuggcu

SEQ ID NO: 62988 - RNA, 46 nt, Mus musculus
cucggaugcuauugaguggcugaaggagcaugaugucaagaaagaa

SEQ ID NO: 62989 - RNA, 46 nt, Mus musculus
ccugaagucaccaguggcaagcauaguguaugagcucaacccggua

SEQ ID NO: 62990 - RNA, 23 nt, Mus musculus
cugugucuguucuucagguucac

SEQ ID NO: 62991 - RNA, 45 nt, Mus musculus
guggauguccagcucaacaaccggcacaugaugauccggggagag

SEQ ID NO: 62992 - RNA, 46 nt, Mus musculus
gacacaucuccuagugccacgucccaugguccaagcauauucagac

SEQ ID NO: 62993 - RNA, 46 nt, Mus musculus
aaaaauaaaucaucaugcuaauagucauuaguuaguuauucuaggu

SEQ ID NO: 62994 - RNA, 46 nt, Mus musculus
cagagagugaagguguuuggcuggguccacagguugcgcaggcaag

SEQ ID NO: 62995 - RNA, 46 nt, Mus musculus
ccuucuuaggaggaggagacagacaguguccugagggcugagagag

SEQ ID NO: 62996 - RNA, 32 nt, Mus musculus
gauaacuuacgaagagaaaagaaccuggagga

SEQ ID NO: 62997 - RNA, 51 nt, Mus musculus
uaagucacagaugaagaacauuaaaaagauguggcacagagaacagaugaa

SEQ ID NO: 62998 - RNA, 45 nt, Mus musculus
ccauuucccaccauuuauguggacucacaaaaggaaaaugaggua

SEQ ID NO: 62999 - RNA, 45 nt, Mus musculus
gguggggagauaaacuugcagagcaucuucucgagccuuggggau

SEQ ID NO: 63000 - RNA, 45 nt, Mus musculus
aaggucagggcuucuguucccuuggguuuuggaacagugaaagaa

SEQ ID NO: 63001 - RNA, 42 nt, Mus musculus
ggaguccucuggcuauagcuacuccacaagggagaugguuaa

SEQ ID NO: 63002 - RNA, 46 nt, Mus musculus
uucuccuugguuccauccccgguugcgucauuuccuucucggucag

SEQ ID NO: 63003 - RNA, 46 nt, Mus musculus
caguugcauuguuaagugucugagcauuacugaugagggacgagua

SEQ ID NO: 63004 - RNA, 48 nt, Mus musculus
auuugcaauucauuguguuagggggugggauagucuuaaacucggaga

SEQ ID NO: 63005 - RNA, 45 nt, Mus musculus
aagauuuaagugaccgaggcgaugucacaguugugaggcccuccc

SEQ ID NO: 63006 - RNA, 41 nt, Mus musculus
ucgccucggucacuuaaaucuuuuuauuuucaccgcugcag

SEQ ID NO: 63007 - RNA, 42 nt, Mus musculus
cugggaaugauguaaggcuuuuaauuaauuuccgcacaaccu

SEQ ID NO: 63008 - RNA, 55 nt, Mus musculus
aacgacuuaagaauuucacaucuggggcuucacuaggucccagacccuugcagcg

SEQ ID NO: 63009 - RNA, 42 nt, Mus musculus
gaggcgguggccgagggacgcacagggcuggagcaaaaccag

SEQ ID NO: 63010 - RNA, 46 nt, Mus musculus
uggggugagcaggcggcgguggugcagugucuauguccucggaggu

SEQ ID NO: 63011 - RNA, 44 nt, Mus musculus
ccugggacuuuucuugcuaaugggcgcucgguagcggaugugug

SEQ ID NO: 63012 - RNA, 41 nt, Mus musculus
cugaugggaaaggcaaagaaucacugagcuuggaccaagag

SEQ ID NO: 63013 - RNA, 46 nt, Mus musculus
guucacagcaguaaaacccuaagacagagggucgucccaguaugag

SEQ ID NO: 63014 - RNA, 40 nt, Mus musculus
acccuagcugccuggaagccaggauccugcuagcagccuu

SEQ ID NO: 63015 - RNA, 45 nt, Mus musculus
uacauauaauaaauaaauaaauaaaucuuuuaaaaaaauuuugug

SEQ ID NO: 63016 - RNA, 37 nt, Mus musculus
auaauuagauaggagccugugguccugauauuuuagg

SEQ ID NO: 63017 - RNA, 46 nt, Mus musculus
gacauaaucuuuaucuacuuucugcugaaauugcagucaucgagag

SEQ ID NO: 63018 - RNA, 41 nt, Mus musculus
cugaacaugaccagcaaacugagccaagccaugucagcaga

SEQ ID NO: 63019 - RNA, 45 nt, Mus musculus
aaaaaagauacggacagaaacccagccaaaggccaagaagggaga

SEQ ID NO: 63020 - RNA, 45 nt, Mus musculus
ggaacuuggggcacccguuuucuggaaguuucuauucguucacag

SEQ ID NO: 63021 - RNA, 46 nt, Mus musculus
gguuuuguuuucccuuucugauuguuacuugaugcuagcuggaauu

SEQ ID NO: 63022 - RNA, 35 nt, Mus musculus
uuacaacuucuuaaaucuguaugcugcccguuuua

SEQ ID NO: 63023 - RNA, 41 nt, Mus musculus
agacuugaauaaggguugcucaccugcugcucucggagaau

SEQ ID NO: 63024 - RNA, 46 nt, Mus musculus
auuuaaaugcuuuuuucaguuaaaacuucaccgugaagucacagac

SEQ ID NO: 63025 - RNA, 47 nt, Mus musculus
aaaauuuauuuuaaaacuuuaaaucuuuauuuaugaugccacuuuua

SEQ ID NO: 63026 - RNA, 45 nt, Mus musculus
guccuuuuacuucuaaauuucuuuuaaaaaaucacucagcaaggu

SEQ ID NO: 63027 - RNA, 46 nt, Mus musculus
ggggaaguacacuggucauuccuaaugcgauugcagacagucagua

SEQ ID NO: 63028 - RNA, 45 nt, Mus musculus
gucuugggaaaucuuccugagauaaaggcuacgaaagccacuguu

SEQ ID NO: 63029 - RNA, 46 nt, Mus musculus
ccuagcuugcaccgugugugcagucuugcauuuucugcuggcauuu

SEQ ID NO: 63030 - RNA, 46 nt, Mus musculus
auaauuuuuauacuuuuaauuugugaaauucauuucucccauuuug

SEQ ID NO: 63031 - RNA, 46 nt, Mus musculus
augcuuuucuccuguguucagugugcauuucauuuuuaaaggagau

SEQ ID NO: 63032 - RNA, 46 nt, Mus musculus
ucugggaucagugacuugucugagagcuuuaaucuaaaugccagga

SEQ ID NO: 63033 - RNA, 46 nt, Mus musculus
uaucuuuuucccccagaauaugaggucuaaacaagagcacccuauu

SEQ ID NO: 63034 - RNA, 46 nt, Mus musculus
gguaggcagagugcagccucugaacagaguaauggcaagucaagac

SEQ ID NO: 63035 - RNA, 48 nt, Mus musculus
cuauccacgauccacuuugugauauuuguaguggugcagacaguguug

SEQ ID NO: 63036 - RNA, 46 nt, Mus musculus
gucucuagaaccguggagggcccugaagucaucacuguagugaagu

SEQ ID NO: 63037 - RNA, 45 nt, Mus musculus
cugaaauuuucuggcuguuuuguuacuguuuugcuucgguuaggu

SEQ ID NO: 63038 - RNA, 46 nt, Mus musculus
gguacugggauuuuaucugacuugauccccuguauucuugugaguc

SEQ ID NO: 63039 - RNA, 42 nt, Mus musculus
cgagcccaccuacuacugccuguaugugcgugagggccaccc

SEQ ID NO: 63040 - RNA, 50 nt, Mus musculus
gggagagagaagcuaaguugauggcugauggccugaggaaggaaggccca

SEQ ID NO: 63041 - RNA, 46 nt, Mus musculus
gguagaagucugucugccucauuauugccugcaaaagcuagcagug

SEQ ID NO: 63042 - RNA, 57 nt, Mus musculus
acuucauggacaucaaggaacaccugcacguggugaagagagauaucgacagccucg

SEQ ID NO: 63043 - RNA, 46 nt, Mus musculus
uauaaauuaaauuguaauccuuaauugauguuuucaggggacaauu

SEQ ID NO: 63044 - RNA, 41 nt, Mus musculus
ugagcccaaguuuaaacuuuagaaaaauaugacgaggaauu

SEQ ID NO: 63045 - RNA, 25 nt, Mus musculus
gcaggaacuggacaccguugugaag

SEQ ID NO: 63046 - RNA, 96 nt, Mus musculus
cagcugaaccggcagcuggauaugauucuugaugaacagaggagguacgucucgucccugacagaggagaucuccaggagaggagcaggaaccccg

SEQ ID NO: 63047 - RNA, 46 nt, Mus musculus
gagagcauaggcgaucgggagcugagacagguguuugaaggacaga

SEQ ID NO: 63048 - RNA, 42 nt, Mus musculus
ugauagauuuauggauauguuggaaucaucuuaccccaucac

SEQ ID NO: 63049 - RNA, 73 nt, Mus musculus
gacauuucagaaaaagaaaaggaaaaguaucaagaggaguuugagcacuuccagcaagaauuagacaagaaga

SEQ ID NO: 63050 - RNA, 46 nt, Mus musculus
cgacguucuuucuuuccugacuuuccaacugaccgagccuggaaaa

SEQ ID NO: 63051 - RNA, 57 nt, Mus musculus
ugguuauccccacacaaggucauuuugggauaucagcggcaacagggggacuugcag

SEQ ID NO: 63052 - RNA, 33 nt, Mus musculus
ucaucuagagcaguuguauuucugcugggugau

SEQ ID NO: 63053 - RNA, 46 nt, Mus musculus
gagauagcucuccauuugcaacacggagaaauugaaugugggagau

SEQ ID NO: 63054 - RNA, 68 nt, Mus musculus
agcuuuagcgaguugucagagggacuuucguaauaaacccuauccuguccgggcaaagauuacguauu

SEQ ID NO: 63055 - RNA, 46 nt, Mus musculus
gaaaaauaauccugcuauaguaguuauaggcaacaauggacaaauc

SEQ ID NO: 63056 - RNA, 42 nt, Mus musculus
acccugcauauguuugguaacuaugaagagucagcgugaguc

SEQ ID NO: 63057 - RNA, 56 nt, Mus musculus
gaucagcugauacguggaaugguguuggaauauuuuuugauucuuuugacaaugau

SEQ ID NO: 63058 - RNA, 74 nt, Mus musculus
aacuguugucccucuuacguuuucucaggcaauuugguauacagaaaaucaaggcuuggacggcccuguguuug

SEQ ID NO: 63059 - RNA, 48 nt, Mus musculus
caaaagcagccuucgagaacugggaaguggaagugacauuccgaguga

SEQ ID NO: 63060 - RNA, 42 nt, Mus musculus
ccuuucauuucacacaugaacguuuggugaacccguggagua

SEQ ID NO: 63061 - RNA, 46 nt, Mus musculus
acucgagccagcuacucuugaguuucacuuguuuucucugaaaguc

SEQ ID NO: 63062 - RNA, 46 nt, Mus musculus
cuaccgagaucaguuaucuucagucucuuuuuacagagccacaagc

SEQ ID NO: 63063 - RNA, 45 nt, Mus musculus
guauauaugugcacggcaaugcacaugcauguguguuugcauguu

SEQ ID NO: 63064 - RNA, 40 nt, Mus musculus
uauguauguauguguauguauguauguauauguauguaug

SEQ ID NO: 63065 - RNA, 42 nt, Mus musculus
uggggcaaaacaaaagaugaaguggauguggaaacuguagau

SEQ ID NO: 63066 - RNA, 46 nt, Mus musculus
gggacuuggaaggcucaaggggggggaccucaguaggugcaaucau

SEQ ID NO: 63067 - RNA, 41 nt, Mus musculus
cgcggccaaagaacugaaccggaguuccaaaaaaugcgaca

SEQ ID NO: 63068 - RNA, 46 nt, Mus musculus
aaauucgaacaccaguucgagacucuggacguccagacgcagcaaa

SEQ ID NO: 63069 - RNA, 42 nt, Mus musculus
cuuugagccucagucgccuggguccgguuaauaaugccagau

SEQ ID NO: 63070 - RNA, 45 nt, Mus musculus
agguuugccuucuccagucaagacagaauucuuuuucuggcagag

SEQ ID NO: 63071 - RNA, 45 nt, Mus musculus
acgagauuagagagaaucagcuaagcaccgaggcaaggcccaggg

SEQ ID NO: 63072 - RNA, 44 nt, Mus musculus
acaaagcucucacuaauuaagagaaacguauuuucuggcacaga

SEQ ID NO: 63073 - RNA, 46 nt, Mus musculus
gugauagagagggaaguuagaggacaguguguggaaguucaccaga

SEQ ID NO: 63074 - RNA, 46 nt, Mus musculus
gcagguccucacgccugcaggcggaaacuuaccaaccgagccagcc

SEQ ID NO: 63075 - RNA, 46 nt, Mus musculus
caccuuauuuucugagucagucucucccugaaucugaaggucacca

SEQ ID NO: 63076 - RNA, 45 nt, Mus musculus
cagccaugagcaaauaauaauaaaaccgaaacacauguccaaaau

SEQ ID NO: 63077 - RNA, 46 nt, Mus musculus
acgccuuuaaucccagcacuugggaggcagaggcaggcggccuggu

SEQ ID NO: 63078 - RNA, 41 nt, Mus musculus
uuacgguaucugcuuuacgguauugcugugaauuggggaga

SEQ ID NO: 63079 - RNA, 46 nt, Mus musculus
aguuacauggcacuugcccccagacgugcucugccagcacccagga

SEQ ID NO: 63080 - RNA, 46 nt, Mus musculus
auauuucauuuguaaguaguaguuguacaaugguguugucgagauc

SEQ ID NO: 63081 - RNA, 42 nt, Mus musculus
uguguauguguguaugugugugugugagagagagagagauug

SEQ ID NO: 63082 - RNA, 45 nt, Mus musculus
guagaaaacuccagauaugaugcuaaaggguuuuuuucuauguac

SEQ ID NO: 63083 - RNA, 73 nt, Mus musculus
acauuguaaaagaacaaagcaagaauucaguccccggggcagagaagcggugaagugaugcugaggcugaagg

SEQ ID NO: 63084 - RNA, 31 nt, Mus musculus
cugaugagggguuggguugugguuggcagau

SEQ ID NO: 63085 - RNA, 44 nt, Mus musculus
cucagaggugccagggcuucccuguggguagguaaguagagagu

SEQ ID NO: 63086 - RNA, 46 nt, Mus musculus
aaaaaaaaaaaacccuuuaaaaauuuuggaacuuuagacggguggu

SEQ ID NO: 63087 - RNA, 44 nt, Mus musculus
guaauauguuaccacucauuuuaauguauguguguuugggggag

SEQ ID NO: 63088 - RNA, 42 nt, Mus musculus
ucugauggccacauagagcaauagacauggaagaggggcgcg

SEQ ID NO: 63089 - RNA, 46 nt, Mus musculus
ucagaaaugauggcaucguggcgauacacuugagggagacuuucca

SEQ ID NO: 63090 - RNA, 47 nt, Mus musculus
cauauauguguucaauuuucauauauuaauacaaauaguaaugagac

SEQ ID NO: 63091 - RNA, 48 nt, Mus musculus
ugagagucugaucuuagguauuuuaucugaggcauauuuagcauagca

SEQ ID NO: 63092 - RNA, 46 nt, Mus musculus
uuguaaaguacaagcggcaucguccauaaagguagguucuggcaga

SEQ ID NO: 63093 - RNA, 69 nt, Mus musculus
gauccugugugcucucugccacauggacagcacaaaagucaccagauuauuaacuauguccacucccag

SEQ ID NO: 63094 - RNA, 42 nt, Mus musculus
cggggggccuggcugcuguccucuguuccugguagucccaug

SEQ ID NO: 63095 - RNA, 42 nt, Mus musculus
ugggcucuggagauugaccucaggucagcagucuugccagca

SEQ ID NO: 63096 - RNA, 46 nt, Mus musculus
uuuccuaagaauuauuccuguguuuuauuagaauuguauaugagca

SEQ ID NO: 63097 - RNA, 46 nt, Mus musculus
ggugugcugacacaugucugcaguccuagcacugacgcggggguaa

SEQ ID NO: 63098 - RNA, 46 nt, Mus musculus
aagaaggaaagaagaaggggaagaaaaaucuugaaagcgugggaag

SEQ ID NO: 63099 - RNA, 46 nt, Mus musculus
ucgcucugaucuuuaguuaagcggguaagccugcaaaccugcaaga

SEQ ID NO: 63100 - RNA, 45 nt, Mus musculus
guuuucaaucaucagauguuccugggaaacugucagcccucagau

SEQ ID NO: 63101 - RNA, 46 nt, Mus musculus
auguaccagaagagggcgucagaucucauuauggaugguugugagu

SEQ ID NO: 63102 - RNA, 47 nt, Mus musculus
aagaaagaaagaaagaaagaaagaaagaaagaaagaaggcaagcaag

SEQ ID NO: 63103 - RNA, 45 nt, Mus musculus
uauuauuuauuuuauguaugugaguauacugucacucucuucagc

SEQ ID NO: 63104 - RNA, 46 nt, Mus musculus
auagaccauuaucuguuuauuaaaccaauccguccgggggugagag

SEQ ID NO: 63105 - RNA, 46 nt, Mus musculus
guuuaaauaucuaucuuuauuuaauguaugagucugugugggugua

SEQ ID NO: 63106 - RNA, 87 nt, Mus musculus
uaaguguauauguguuauuuauaaagcuauaugguagguaagcaaagaacuauuugauuuuuuuuuuuuauuuuuguuuggucuggu

SEQ ID NO: 63107 - RNA, 42 nt, Mus musculus
guccugacauuccccugcaugggaccccgggacggagcucag

SEQ ID NO: 63108 - RNA, 46 nt, Mus musculus
uggaaaaaaguuuuaucagguuaguauguauuugugugugcagggg

SEQ ID NO: 63109 - RNA, 46 nt, Mus musculus
cuuuaaguagaguuguaaauauuuauuuuuauuuauaggcacagaa

SEQ ID NO: 63110 - RNA, 42 nt, Mus musculus
aggccaaccuggucucuggagagaguccuugugguggggugu

SEQ ID NO: 63111 - RNA, 42 nt, Mus musculus
uuggcagcucaugccauuucuuccagcauucaggaggcagag

SEQ ID NO: 63112 - RNA, 42 nt, Mus musculus
acugccauuccuaauguauuuuuauacuuuuuggcagcauua

SEQ ID NO: 63113 - RNA, 64 nt, Mus musculus
ugauguauuguuuuuuaacauguguaugaaauguagaaagauguaaaggaaauaaauuaggagc

SEQ ID NO: 63114 - RNA, 46 nt, Mus musculus
agaaaaucuaaaugcuggaaaucuaauucagagauaacaagccaac

SEQ ID NO: 63115 - RNA, 45 nt, Mus musculus
cugcaaggagaauugcaugggaauuuucuucuuuuucuuuacaga

SEQ ID NO: 63116 - RNA, 46 nt, Mus musculus
cuacacuguuaauuuuuugugaaaauguaaauguaauuacccagac

SEQ ID NO: 63117 - RNA, 47 nt, Mus musculus
cuuuaaagauaagagaaaaauagaggugguggaggagagaucagaca

SEQ ID NO: 63118 - RNA, 45 nt, Mus musculus
ucgagaggauagaaaggcuacgacggcucagaaggugcagcagau

SEQ ID NO: 63119 - RNA, 45 nt, Mus musculus
gguugugagccaccauguuguugcugggauuugaacucagggccu

SEQ ID NO: 63120 - RNA, 45 nt, Mus musculus
cuuaacuccagcuuuuuugggauccaagguccuuauggugguuug

SEQ ID NO: 63121 - RNA, 48 nt, Mus musculus
aagauuuaucuccuauuugugaucauucacagaacagagugaugguug

SEQ ID NO: 63122 - RNA, 54 nt, Mus musculus
gucagaucucauuacuaaugguugugagccaccaugugguugcugggauuugaa

SEQ ID NO: 63123 - RNA, 45 nt, Mus musculus
gugaaacaauuauuacugaauaugagaaaguaucgaaugggacuu

SEQ ID NO: 63124 - RNA, 46 nt, Mus musculus
ccuaaucauaucugggugucugugugcauauuucucaccccccccc

SEQ ID NO: 63125 - RNA, 46 nt, Mus musculus
uuuuauggauacaccacccaucaauuaaaaagccuauggcuuaggc

SEQ ID NO: 63126 - RNA, 46 nt, Mus musculus
cuguaaccccuugcuugauagaggcaagagaagcaaguccauagag

SEQ ID NO: 63127 - RNA, 42 nt, Mus musculus
guuagaagaaagcauugagucccugaaacuggaguugcagau

SEQ ID NO: 63128 - RNA, 46 nt, Mus musculus
ugaaaccagaaccauaucucacuuccauuauaccaccuggccagau

SEQ ID NO: 63129 - RNA, 46 nt, Mus musculus
cccaucauaugggugcugggacucaaacccaggucuuuugcaagaa

SEQ ID NO: 63130 - RNA, 46 nt, Mus musculus
gcuacaguguacuuacauauauuaaauuaauaaaaagaaagaaaga

SEQ ID NO: 63131 - RNA, 45 nt, Mus musculus
ucaggaaacagaagcaggaagaucccugugaguuccaggccagau

SEQ ID NO: 63132 - RNA, 47 nt, Mus musculus
aggccaaguagaagggugagucaguuuugccuaaagguaggauggaa

SEQ ID NO: 63133 - RNA, 45 nt, Mus musculus
guuuguuugcuuguuuucgaaauaaguuuguaguguucaguaaga

SEQ ID NO: 63134 - RNA, 24 nt, Mus musculus
uaggugauauguugggaguauucc

SEQ ID NO: 63135 - RNA, 31 nt, Mus musculus
aggcuggccuugagcuacagagauccucacu

SEQ ID NO: 63136 - RNA, 46 nt, Mus musculus
cugggcuacaugaggcccuagcuuaaaaaagaaaaagccaagagac

SEQ ID NO: 63137 - RNA, 45 nt, Mus musculus
ugccugcuuagugaaugccaggguccuuuguuuuuguugagaauu

SEQ ID NO: 63138 - RNA, 61 nt, Mus musculus
gaccuccucuuaaaauaaaaggcauaaaugaacauuuuaaaguuuuggagaauaagaucaa

SEQ ID NO: 63139 - RNA, 48 nt, Mus musculus
ugaaugguaaugugugcuuucaauucaacucuugggcagcuagggcag

SEQ ID NO: 63140 - RNA, 46 nt, Mus musculus
ugugucuccuacuuauaauucuaguacuugggagaccagggcagga

SEQ ID NO: 63141 - RNA, 45 nt, Mus musculus
ccucagcuucccaaaugcugggguuacaguuguaagccaccacag

SEQ ID NO: 63142 - RNA, 45 nt, Mus musculus
cuccauucuauuacugcuuucuuccuuucucuuacuauccaaguu

SEQ ID NO: 63143 - RNA, 41 nt, Mus musculus
aaaacagaaaccgaaacagauacagagauguaagcccaugu

SEQ ID NO: 63144 - RNA, 36 nt, Mus musculus
uuguaaacuagaaaaucaaauuagaaaccuucaguu

SEQ ID NO: 63145 - RNA, 46 nt, Mus musculus
uaggguuuuuguuacugugaugaaacaccaugaccaaaaccaaguu

SEQ ID NO: 63146 - RNA, 58 nt, Mus musculus
guagggagacugaaaugccucccuagacugggacauuagagagagauagacagacaga

SEQ ID NO: 63147 - RNA, 46 nt, Mus musculus
guucuuggaaauguguguauccacuuauccccgugagccucuagaa

SEQ ID NO: 63148 - RNA, 46 nt, Mus musculus
caccucccaagccugacaguuuguuugauccuugguacccacauga

SEQ ID NO: 63149 - RNA, 46 nt, Mus musculus
acauacauacauacauacauacauacauacauacauagagguggga

SEQ ID NO: 63150 - RNA, 45 nt, Mus musculus
cugugcucugucaccagagaauaaccuuaccuauucagcucauuc

SEQ ID NO: 63151 - RNA, 46 nt, Mus musculus
gaagcggcggccuaagcuccugagggaucggggaucgccagucuuu

SEQ ID NO: 63152 - RNA, 45 nt, Mus musculus
cguggaugagguccuugugguccgccgcgaugcugcgcgccacaa

SEQ ID NO: 63153 - RNA, 43 nt, Mus musculus
uucuucccauacagcugcuguucggucaaaagaacaggaagcc

SEQ ID NO: 63154 - RNA, 46 nt, Mus musculus
acagcuacaguguacuuacauauaacaauaaauaaauaaauaaaua

SEQ ID NO: 63155 - RNA, 95 nt, Mus musculus
agcuuacacgagaccucgugcugcagagaccacuggcugagguucaucacaucgggagccucguagacccuuacuauaccaucugcugaacaggu

SEQ ID NO: 63156 - RNA, 42 nt, Mus musculus
ucaucacuucccacagcgaucauggggggaugagcacgagag

SEQ ID NO: 63157 - RNA, 46 nt, Mus musculus
cgcgauaucauggacggggucugugacugucauaagagucucagcu

SEQ ID NO: 63158 - RNA, 46 nt, Mus musculus
gaaaauucuuacaucuuugguugcuacugccaggauguggaaagau

SEQ ID NO: 63159 - RNA, 46 nt, Mus musculus
aucaaacugagccacaauauggauuucaaauuuuguuggaccacca

SEQ ID NO: 63160 - RNA, 33 nt, Mus musculus
uuuaccaacugagccaucuccacagcuccagcc

SEQ ID NO: 63161 - RNA, 46 nt, Mus musculus
ucacagaucuaacauagaugguuauuggcacaauaagaaaacagau

SEQ ID NO: 63162 - RNA, 46 nt, Mus musculus
gaaauaaugaagacaggaacaaaacaccaaaacaaaaacaacagag

SEQ ID NO: 63163 - RNA, 42 nt, Mus musculus
agaaggagcugagaguucuacaucuugaucuacaggcagcag

SEQ ID NO: 63164 - RNA, 45 nt, Mus musculus
augauuaugaauuaucuuguauucaaauaauuuuaaguuacucag

SEQ ID NO: 63165 - RNA, 45 nt, Mus musculus
auuacgacucagcuuucagggugaugagugaguucuugccuuaga

SEQ ID NO: 63166 - RNA, 46 nt, Mus musculus
cugggaaauagguuugguggcaaauaacuuuuaucuauugauucau

SEQ ID NO: 63167 - RNA, 46 nt, Mus musculus
cagucuugaagguuucuguuuaacucugcauuuuacuauuggcaag

SEQ ID NO: 63168 - RNA, 44 nt, Mus musculus
agagugagaggcccggguuagugagaggauuauuauuaguggga

SEQ ID NO: 63169 - RNA, 46 nt, Mus musculus
acagaaaaccuaucuugaaaacagcaacaacaacaacaacaacaaa

SEQ ID NO: 63170 - RNA, 46 nt, Mus musculus
ggggaacucugugccacagaagcccacauacuuauccaguccccag

SEQ ID NO: 63171 - RNA, 46 nt, Mus musculus
auuguucaagaguuacagaaacugaaacucaaacuuugaugguaga

SEQ ID NO: 63172 - RNA, 46 nt, Mus musculus
aacacaaaaacaaaagcaaaccaaucaaaacaacaacaaugaagag

SEQ ID NO: 63173 - RNA, 46 nt, Mus musculus
ccugggugcgggaauggaggaagaguuuauguuacacacccugcua

SEQ ID NO: 63174 - RNA, 45 nt, Mus musculus
acacacacaugaugagagagagagagagagagagagagagagaga

SEQ ID NO: 63175 - RNA, 47 nt, Mus musculus
ugccuuaaaaacaaaggaguaguuuuccucugguaauguggagauuc

SEQ ID NO: 63176 - RNA, 42 nt, Mus musculus
uaaacugcgcaugcccuuugguguuagcuggaccuugggucu

SEQ ID NO: 63177 - RNA, 42 nt, Mus musculus
uuccagggaugauguaugaagcaggaggacaggagucgccag

SEQ ID NO: 63178 - RNA, 44 nt, Mus musculus
aggauucggacuucaaggccagcaugggcuccaugcaagaaggu

SEQ ID NO: 63179 - RNA, 42 nt, Mus musculus
acuuacaguuuugucuugugaugugauggacagagagggcug

SEQ ID NO: 63180 - RNA, 48 nt, Mus musculus
aggagagcauguggacuuuaugaguccgauucaaagacuagugacagu

SEQ ID NO: 63181 - RNA, 46 nt, Mus musculus
agaguaguacauggugcuaaccacugagccaucuccccagcucuag

SEQ ID NO: 63182 - RNA, 23 nt, Mus musculus
acccagugagugcugggguaaag

SEQ ID NO: 63183 - RNA, 42 nt, Mus musculus
acgcccggcuggucuaucuuuauuuuuaaaggucuguacuug

SEQ ID NO: 63184 - RNA, 46 nt, Mus musculus
aacaguaccagaucucucuggagcuauaauuacaagcaacuaugaa

SEQ ID NO: 63185 - RNA, 46 nt, Mus musculus
gcgacaguuaauuaccauuuauugagaaaaucacuuggcacaucag

SEQ ID NO: 63186 - RNA, 46 nt, Mus musculus
auggcaguuaucuacgccuuucauuaggagaguucuuugcagaaag

SEQ ID NO: 63187 - RNA, 86 nt, Mus musculus
aguguuccugguaaaggaaaaccaugugugugaggcccagagaacagguaucaagugguucaucgaaggcagaaagagcuaaugug

SEQ ID NO: 63188 - RNA, 73 nt, Mus musculus
aggggccagggugaggauaagugggguaggagauuggugguaucucaguugaacuuccgggaaggacuuggag

SEQ ID NO: 63189 - RNA, 46 nt, Mus musculus
gcuagggaugcgggaggggagaaaaaagaaggaaaagagacagcag

SEQ ID NO: 63190 - RNA, 46 nt, Mus musculus
aggagagagaaccuguugcguuaauaaaaucugauuugucaagaag

SEQ ID NO: 63191 - RNA, 46 nt, Mus musculus
uauaggagacuuaaaugaacagucccagguacagcuaagugaagga

SEQ ID NO: 63192 - RNA, 48 nt, Mus musculus
agaaauucccagguggaugaagaugacauuacacuaacugccagcaga

SEQ ID NO: 63193 - RNA, 48 nt, Mus musculus
agcacugauccugcccagcuuguuaccaugaugaaagcacucagaaau

SEQ ID NO: 63194 - RNA, 48 nt, Mus musculus
aacggcagacuguucaagacaggaguauggugaacguuugugcuacua

SEQ ID NO: 63195 - RNA, 45 nt, Mus musculus
ggcuguggguuagccuguggggcauuuucuuaauuagugauugau

SEQ ID NO: 63196 - RNA, 45 nt, Mus musculus
cacauuuuggauaggcugugaagagguaaaaaauggucccaaugu

SEQ ID NO: 63197 - RNA, 45 nt, Mus musculus
gauaaaugaggccacaguggccuguuuuauaauuaacugaauaaa

SEQ ID NO: 63198 - RNA, 47 nt, Mus musculus
uaugagucaaaacuccuguuuggugugccaagguuuuaaaguuggag

SEQ ID NO: 63199 - RNA, 46 nt, Mus musculus
gaugguauguuuuaagaguugcacuaucucaauguuuaacauaugg

SEQ ID NO: 63200 - RNA, 45 nt, Mus musculus
cuuuaaucauaauaauuacuaugacaacaauauuaguagcuacau

SEQ ID NO: 63201 - RNA, 46 nt, Mus musculus
ugcaugggucaaugaagagaauguccaugguuugagcaacucagga

SEQ ID NO: 63202 - RNA, 46 nt, Mus musculus
uacagagcugcaagcugguuauuacagagcugagggagagaaugga

SEQ ID NO: 63203 - RNA, 41 nt, Mus musculus
uuacucguuagccuccugccuccgguccuugcuugguggga

SEQ ID NO: 63204 - RNA, 45 nt, Mus musculus
uccgugagaucaugccugaccaugagcuagcagccacaaacagag

SEQ ID NO: 63205 - RNA, 42 nt, Mus musculus
acuucccuuauuuugguguucauuguuucaacaauuuaacag

SEQ ID NO: 63206 - RNA, 42 nt, Mus musculus
uuugugugaccauuagguaaauccuuuagaauguacaaacag

SEQ ID NO: 63207 - RNA, 44 nt, Mus musculus
cuacagauuacuucuuuuuccucccaauuuacacaugugcccca

SEQ ID NO: 63208 - RNA, 46 nt, Mus musculus
ucaaaucccagcaaccacaugguggcucacaaccauccgucaugag

SEQ ID NO: 63209 - RNA, 46 nt, Mus musculus
uggugccggguuuccccacacaguaacgcuuugcuccagccccaaa

SEQ ID NO: 63210 - RNA, 46 nt, Mus musculus
gcccuuugcuaugagacccuguaaggcaaaaagaaaauuacauggu

SEQ ID NO: 63211 - RNA, 45 nt, Mus musculus
ggccagguuuaagaggucucgggugggaacaagaaugcuuugggg

SEQ ID NO: 63212 - RNA, 44 nt, Mus musculus
gcaaugccuuaaugguucuauuaauucaauaauuuagucccaau

SEQ ID NO: 63213 - RNA, 42 nt, Mus musculus
ugucgauugaugagguuuugcugucaguucaaguaacgagaa

SEQ ID NO: 63214 - RNA, 48 nt, Mus musculus
cugggcagaggcuuccagaaaauacuccuccaugccagcaaguagauc

SEQ ID NO: 63215 - RNA, 53 nt, Mus musculus
ucaucuuagaggaaaagcacucugaggaugauggagguucggcaaagagaagc

SEQ ID NO: 63216 - RNA, 46 nt, Mus musculus
uggaaagaaagaauacuuggcaaguuaguaacacuuuguuaccagg

SEQ ID NO: 63217 - RNA, 45 nt, Mus musculus
ccugucuuaaaguugauauauaaaauaaagaauuaauuagaugcu

SEQ ID NO: 63218 - RNA, 46 nt, Mus musculus
cuacuguggaauuuuuauagaaugcuuaggauuuuacuaaaugcag

SEQ ID NO: 63219 - RNA, 60 nt, Mus musculus
gacaucacuguuuuggaccugggauguggaaaagguggagauuugcucaaguggaggaag

SEQ ID NO: 63220 - RNA, 46 nt, Mus musculus
gucugagcaccugaguucaauccccagagcccacaugaaggaggag

SEQ ID NO: 63221 - RNA, 42 nt, Mus musculus
ccuauuggguaucaccuucuuucuguuugauggaucgcagga

SEQ ID NO: 63222 - RNA, 46 nt, Mus musculus
ggaaauuauccuuuauuuggcugcaaauaugacuuuaacuuggaag

SEQ ID NO: 63223 - RNA, 46 nt, Mus musculus
uucucuuuaaauaacuuuccuaagggaagggagccaacggcuuuga

SEQ ID NO: 63224 - RNA, 46 nt, Mus musculus
uuuguauuucaguauagcuuugaaauugcccauggaauagccuagu

SEQ ID NO: 63225 - RNA, 45 nt, Mus musculus
ggcgaaauuucacuuugugcuuuuugaagacaaacagccgaggaa

SEQ ID NO: 63226 - RNA, 65 nt, Mus musculus
gaguuugaggcuauccugggcuacaauguaagacuaucccaaaacaagggaagaaaguagagagc

SEQ ID NO: 63227 - RNA, 42 nt, Mus musculus
cacuaauagaaguguaggccagugcugggcugaauccuggag

SEQ ID NO: 63228 - RNA, 46 nt, Mus musculus
ggggggaaccaaagagaguggcucacauugugggggagcugaggag

SEQ ID NO: 63229 - RNA, 46 nt, Mus musculus
agggaaggacagugugggucaauaguuuuaccaggaaaaugcaugg

SEQ ID NO: 63230 - RNA, 83 nt, Mus musculus
ucuaaaaaauguugagguuuagcuucuugccauuuaauugagaaaauaaacaauaauggaauuaacuuauugaaaagcccgug

SEQ ID NO: 63231 - RNA, 53 nt, Mus musculus
uuuccccuuuuuuugcguauaacuugcuuuuguuucuagugacuugucuugga

SEQ ID NO: 63232 - RNA, 93 nt, Mus musculus
aguuuccuuaauaaaagaaguauguauguucauaccgucuaugcaagaagggcuagcucagauaaccguagagucuuaugugugccuuaugca

SEQ ID NO: 63233 - RNA, 45 nt, Mus musculus
aggaggcaggagggaacugaaaggacagcuuuuaagucacaugga

SEQ ID NO: 63234 - RNA, 63 nt, Mus musculus
gcaagcugaaucuggcuaugccugggaaaguucacugagggggguaguaggaccggaagcagg

SEQ ID NO: 63235 - RNA, 63 nt, Mus musculus
agauagccauauggugcaggaugacagugaguggauacgguaagagguagacacauggguaag

SEQ ID NO: 63236 - RNA, 48 nt, Mus musculus
uuuaguuaaacccagaugucacuucaaaaggaaacuguaugagaaagg

SEQ ID NO: 63237 - RNA, 75 nt, Mus musculus
auacugcagucauugcuugcuuccccuuucccuuuuauuacauagauagaaaguaucagugugcuuguaacuuac

SEQ ID NO: 63238 - RNA, 46 nt, Mus musculus
cucauucugugguaccaguuggccuggaauucauuuuguagagcag

SEQ ID NO: 63239 - RNA, 46 nt, Mus musculus
gagaaagaagcaaagcaguggauuguuuuccguguuuacucuguua

SEQ ID NO: 63240 - RNA, 33 nt, Mus musculus
acucuaaacuugccucugaaaaggugggugacu

SEQ ID NO: 63241 - RNA, 49 nt, Mus musculus
aaguauaugaugauaagacaagcuagaccaguuccagggaagguugcgg

SEQ ID NO: 63242 - RNA, 46 nt, Mus musculus
uguuucaguuuuuaccucccuuucccaacuacuacuaggcagugag

SEQ ID NO: 63243 - RNA, 46 nt, Mus musculus
uccugggcuuccacagaagugugaugcagaggaauuuaguucguag

SEQ ID NO: 63244 - RNA, 52 nt, Mus musculus
gccuucuagaguucaguaggagaaacaaacaaauucugccagacauuuuacg

SEQ ID NO: 63245 - RNA, 51 nt, Mus musculus
ugucugugacagguuagcauaauguguguacauagggaugaguugucuuga

SEQ ID NO: 63246 - RNA, 45 nt, Mus musculus
caggcucauuuuauuccuggggaaguuccagaaaguauuuugaug

SEQ ID NO: 63247 - RNA, 45 nt, Mus musculus
agagucacucauaaguaguggacccugucugauaacugaguggca

SEQ ID NO: 63248 - RNA, 45 nt, Mus musculus
ucccacagugaacuguggguguaagagggguccugucuacagaag

SEQ ID NO: 63249 - RNA, 44 nt, Mus musculus
cguuggccgccuggauuccaagcugagcuuucguuucccguagg

SEQ ID NO: 63250 - RNA, 46 nt, Mus musculus
gcaaauauuaauauuuguaauaaguagaaaacaucuucaucaagaa

SEQ ID NO: 63251 - RNA, 138 nt, Mus musculus
guggauuuacuucuaagaaucugaacuuggaaauauucauaggcccgauuuuauaugaaaacaaaaggggaagacacuaagauauauccugaaguaguacguggauccucagaccagaaaaauuuuuaacauucagaa

SEQ ID NO: 63252 - RNA, 46 nt, Mus musculus
cucugcuguuacuuacaccgagaaggugaacauuagccauacguua

SEQ ID NO: 63253 - RNA, 51 nt, Mus musculus
uuaucccgccugagagaccuggucgaugauaccagugggagacagucacca

SEQ ID NO: 63254 - RNA, 46 nt, Mus musculus
ucauuccuuugacagaaauuagggugaaauuuaguaguucccaggu

SEQ ID NO: 63255 - RNA, 46 nt, Mus musculus
ucugcuucguguagcagaugaauuuucaaaauacagaaccauagaa

SEQ ID NO: 63256 - RNA, 44 nt, Mus musculus
auuacaauuacacuccuaaaguguuacuuuuucugcucccaagc

SEQ ID NO: 63257 - RNA, 70 nt, Mus musculus
accauuggaggaccaacacuugagcuguaggaucauucuacauucaaaguuucaucagacuucaccagaa

SEQ ID NO: 63258 - RNA, 50 nt, Mus musculus
guagaauuaggagaggcugggcaucucaggagccuacugagacuaaaaga

SEQ ID NO: 63259 - RNA, 50 nt, Mus musculus
aggaaaguuuuaauaagaauaaaacuacagagccugaagaagagauuaag

SEQ ID NO: 63260 - RNA, 46 nt, Mus musculus
ggaagucucagcacuugagaguuuuauuuaauugcucaccucagac

SEQ ID NO: 63261 - RNA, 46 nt, Mus musculus
acauaaaaccagagcuaaagaauaguuaaaaaaaaaaaaagaagaa

SEQ ID NO: 63262 - RNA, 45 nt, Mus musculus
aagacaaagucagaacaguacuaaauauaaagaaagggaggcaaa

SEQ ID NO: 63263 - RNA, 69 nt, Mus musculus
uguguguguaugugucacagugagguaacauaaaggcagaaaaagaagagguaucugggggagauugga

SEQ ID NO: 63264 - RNA, 49 nt, Mus musculus
aggauguggaagugcuaacaggucagaaauuacucacagauagauaggu

SEQ ID NO: 63265 - RNA, 48 nt, Mus musculus
aagaggacaccccauuauaacaucaacaauacuaagucaucagagaua

SEQ ID NO: 63266 - RNA, 41 nt, Mus musculus
uugcacguggcuaugagccacaagauguggcugcuggagaa

SEQ ID NO: 63267 - RNA, 46 nt, Mus musculus
gcaaggcgguccaggaucagacagaauaaaaaaggaagccauaaag

SEQ ID NO: 63268 - RNA, 45 nt, Mus musculus
ccuaaagaaucauccuucacggaggacagugcagagcgcaggcuc

SEQ ID NO: 63269 - RNA, 41 nt, Mus musculus
guggaagacaggauucaucagacauuaagaauaguccaagu

SEQ ID NO: 63270 - RNA, 46 nt, Mus musculus
cuguucucugcugcuuacugugauuguauuaauguaagagguguau

SEQ ID NO: 63271 - RNA, 42 nt, Mus musculus
uauuauuuuguuuucuaaaguuauuuacuuuuggcuaaaguu

SEQ ID NO: 63272 - RNA, 38 nt, Mus musculus
uuguuccguuauucuuuagagaaaaacaaauagcagag

SEQ ID NO: 63273 - RNA, 42 nt, Mus musculus
guccgguuugggcagggcuugggcuguccgccgcccggaguc

SEQ ID NO: 63274 - RNA, 45 nt, Mus musculus
uccuauccaaaggauggcuagcaucaauaguaacuauggcuucgg

SEQ ID NO: 63275 - RNA, 46 nt, Mus musculus
ucuguauacuuugcucagguagaaaacaaggugugaaagcccucag

SEQ ID NO: 63276 - RNA, 46 nt, Mus musculus
cccagucuuggcauucguggcuugucagggcccucggucuccauga

SEQ ID NO: 63277 - RNA, 44 nt, Mus musculus
gcgggcggcgacaacagcagcagcgacggccgguccuccuccuc

SEQ ID NO: 63278 - RNA, 46 nt, Mus musculus
caugcccugggcaucguccccuccguacagcaccccugccgccgcg

SEQ ID NO: 63279 - RNA, 43 nt, Mus musculus
cgcuugcucuccguucagggcggcagcggcggccccgccgccg

SEQ ID NO: 63280 - RNA, 42 nt, Mus musculus
ccgccgcugccgcccugaacggagagcaagcggcccugcuga

SEQ ID NO: 63281 - RNA, 47 nt, Mus musculus
gucggucugucugucugggcacggcccugggcgugggugggagacgg

SEQ ID NO: 63282 - RNA, 42 nt, Mus musculus
aagcagcucuaaggcaggccgauugcuuuuuaccggccacuc

SEQ ID NO: 63283 - RNA, 45 nt, Mus musculus
auagguccuuugucugaacaaugugggaggagucugucuggggaa

SEQ ID NO: 63284 - RNA, 45 nt, Mus musculus
auugaacaacaugaagaaaguguggaggagaccugcuagguggug

SEQ ID NO: 63285 - RNA, 43 nt, Mus musculus
guguguguguguguguguguguaucugugugucuggugucuag

SEQ ID NO: 63286 - RNA, 46 nt, Mus musculus
cugcucagacuaggcuggcaggaccacacccccagggaucugucug

SEQ ID NO: 63287 - RNA, 46 nt, Mus musculus
ggauauuaaaacuaguacagcauuuugauaucuucaggugacagaa

SEQ ID NO: 63288 - RNA, 85 nt, Mus musculus
uauauuuuccaauuuaaagaagaagaagaagaagaggaggaggaggaggaggaggaagaagaagaggaggaggaggagagccauu

SEQ ID NO: 63289 - RNA, 46 nt, Mus musculus
uaggcuuaucuccuuuccauguuuacuaguuaguauccaccaagag

SEQ ID NO: 63290 - RNA, 41 nt, Mus musculus
gacaccuguucguggugaagaacccauuuuuguugucacug

SEQ ID NO: 63291 - RNA, 46 nt, Mus musculus
aguuacuccucuuccaauggugguuccaccucuagcucaccuccag

SEQ ID NO: 63292 - RNA, 26 nt, Mus musculus
uaggaauucacaaucaaagacaacug

SEQ ID NO: 63293 - RNA, 49 nt, Mus musculus
ucuaaaaaccacaaacuaagaaugauaaauuaucaauauaguuuaguau

SEQ ID NO: 63294 - RNA, 46 nt, Mus musculus
aagucauagggauuauaaauucaauuugaguaaaguuuaaaaccau

SEQ ID NO: 63295 - RNA, 45 nt, Mus musculus
ugcuguguugacuucuuacggagagucccgagacugcuauaaaga

SEQ ID NO: 63296 - RNA, 46 nt, Mus musculus
agccugggcuacaggagacccugccucaacaaagaaagcccucaaa

SEQ ID NO: 63297 - RNA, 45 nt, Mus musculus
gccagguaugcugcaugccucuagucccagcacuuggcagguaga

SEQ ID NO: 63298 - RNA, 46 nt, Mus musculus
uucuucguuucuuuuuuauuaaaucuuuuuuuucauguauguugau

SEQ ID NO: 63299 - RNA, 46 nt, Mus musculus
uuucguuggggacagacaugcuggcuauacuguagugcccacagcc

SEQ ID NO: 63300 - RNA, 45 nt, Mus musculus
ggacguguaugacuggccagagucuucacugacaccuccucagau

SEQ ID NO: 63301 - RNA, 46 nt, Mus musculus
gugagagcugcagagauguacgccagaaaacccacaggcugcaggg

SEQ ID NO: 63302 - RNA, 45 nt, Mus musculus
agcucugcaggaaacacguuuccaaacuaaaauccgaagcccaga

SEQ ID NO: 63303 - RNA, 46 nt, Mus musculus
uaaagucacuugucuguuccaugauuacagauagauaacaaauaaa

SEQ ID NO: 63304 - RNA, 96 nt, Mus musculus
agucaaaacaccaggcuuaagugucuucacucacgacacagcccacuaacagagaaggagaggagaagcuguaagaggaaagagaccccggggaag

SEQ ID NO: 63305 - RNA, 46 nt, Mus musculus
cuucugcaguugaguagcaauaaugaucuaaugggugaguggagau

SEQ ID NO: 63306 - RNA, 46 nt, Mus musculus
cuuuugucagccaugcauaaaagugcugcaaagcauagacccaggc

SEQ ID NO: 63307 - RNA, 70 nt, Mus musculus
ggacugcuagcauagauagcaaccaggaaccauaugcccaugcggccccagagagcauaccugcgacuuu

SEQ ID NO: 63308 - RNA, 46 nt, Mus musculus
ugcuauggggaagucaagaaacugauacucacugcacaggcaagag

SEQ ID NO: 63309 - RNA, 76 nt, Mus musculus
ugccaaucucauaguucuaucaaugguggaaaguggucucucagaagaggaggcgcagagaaagaucuggauguuu

SEQ ID NO: 63310 - RNA, 45 nt, Mus musculus
gagagacugacaaagaaucuacuuacguauaauuucuacagggag

SEQ ID NO: 63311 - RNA, 95 nt, Mus musculus
cuacagggacagcugcaguugcucugucuggucuucuugcggcccaaagaguuauuaauaaaccagucucagaacacaaaaucuuauuucuugga

SEQ ID NO: 63312 - RNA, 47 nt, Mus musculus
acacacucauucaguuugaagacuuuggaaaucauaaugcauucagg

SEQ ID NO: 63313 - RNA, 47 nt, Mus musculus
gccugugguguaugugugugugugucuguggggugugugugugugug

SEQ ID NO: 63314 - RNA, 45 nt, Mus musculus
cagguugccaggcuugcuuggcaagcacuuuaccuggacccuagu

SEQ ID NO: 63315 - RNA, 45 nt, Mus musculus
ugauuucuggaaggaagucuguauucacggcuccuaaacccucac

SEQ ID NO: 63316 - RNA, 93 nt, Mus musculus
aaagauccguuuuauaugggcuuguaucagaagcgagaucguucccagcucuaugaugaucugauggacgaguuuaugaaggcgauuacugac

SEQ ID NO: 63317 - RNA, 70 nt, Mus musculus
ccugugcagggauacagcccgagaagugccugcccgugugcaucgacgugggcacugauaacauggugag

SEQ ID NO: 63318 - RNA, 82 nt, Mus musculus
gauggagagaggauccugggccuuggcgaucugggugucuauggaauggggauuccaguagggaagcugugccuguauacag

SEQ ID NO: 63319 - RNA, 46 nt, Mus musculus
ugugugugugugugugucucugugugugugugugugucugugugug

SEQ ID NO: 63320 - RNA, 45 nt, Mus musculus
aguugaauacacaagaagucauacaguagugugggugcagaacac

SEQ ID NO: 63321 - RNA, 44 nt, Mus musculus
uguugcagcacuugagaaacugaggcggaaggagcaggagcaga

SEQ ID NO: 63322 - RNA, 47 nt, Mus musculus
uaaaauauggaagggcuaaugucaagcugagaaagccuguccuguca

SEQ ID NO: 63323 - RNA, 78 nt, Mus musculus
aaauagucucacacguugaauauguucauaguugcacagaagagagucccgagauacugccacagcaaguuugcagag

SEQ ID NO: 63324 - RNA, 53 nt, Mus musculus
gcuggccugugaggagugucagugucgcgacaggacaagagaguugcacugag

SEQ ID NO: 63325 - RNA, 52 nt, Mus musculus
guguaaaguguguuguuguuaacaaagcaucaaaaugagaaaggacaaggaa

SEQ ID NO: 63326 - RNA, 45 nt, Mus musculus
uguagaaaaacugcacauguggaaucuauccugaaagcaugagag

SEQ ID NO: 63327 - RNA, 46 nt, Mus musculus
auuuuacuuguguguaugugugucugucugucugucggugggucug

SEQ ID NO: 63328 - RNA, 41 nt, Mus musculus
uccuccugucaguaguuuagcucccuguuugucggcuaucu

SEQ ID NO: 63329 - RNA, 42 nt, Mus musculus
gugugugugugugugugugugcugggaauugaacccaggucc

SEQ ID NO: 63330 - RNA, 45 nt, Mus musculus
uccaagaaggaaacccuguucacagguucuucucucugccuucau

SEQ ID NO: 63331 - RNA, 42 nt, Mus musculus
ggugcagagugcagcccuacuccucaaaaaaggggggaagau

SEQ ID NO: 63332 - RNA, 42 nt, Mus musculus
agccagaucagaaauccagacaguaacuguuaagugggguga

SEQ ID NO: 63333 - RNA, 41 nt, Mus musculus
gaacagccaggggaaggguggcaagcacuugggcaggaggu

SEQ ID NO: 63334 - RNA, 45 nt, Mus musculus
gcuuucuggcuuaccaaucguggcuguugaugagcagugugcaga

SEQ ID NO: 63335 - RNA, 41 nt, Mus musculus
ggggaacgccagggccaaaaagggggaguggggggggugug

SEQ ID NO: 63336 - RNA, 46 nt, Mus musculus
gcugaggagccuggacugccgaagaagccccccagagagcagagga

SEQ ID NO: 63337 - RNA, 50 nt, Mus musculus
agauuuacuaacuugauuuucaaaauuccucuuacaacugagaucuucau

SEQ ID NO: 63338 - RNA, 69 nt, Mus musculus
cgagcuagggggaugaagaagagacgcuggaguuaagcccagccuuacacguuugacucugagaagcaa

SEQ ID NO: 63339 - RNA, 86 nt, Mus musculus
ugagucugcgauagcuuagugacacaauaguagcgacuaacagacgacacuaggguacagggaagaugacugguguuuccaggcuc

SEQ ID NO: 63340 - RNA, 45 nt, Mus musculus
ucucugcuuccuucuguguuggaucucuuauuuucccggucuggu

SEQ ID NO: 63341 - RNA, 45 nt, Mus musculus
cucacccacuuuguuccuggauguucuuuccauacugccccguuu

SEQ ID NO: 63342 - RNA, 42 nt, Mus musculus
cucccugucuuccccagucuccucacuccuucaggccguucu

SEQ ID NO: 63343 - RNA, 45 nt, Mus musculus
gauuggucagugaguuuuccucucuccuggaacucaugguguaga

SEQ ID NO: 63344 - RNA, 36 nt, Mus musculus
agguccucaucugaaaguggcucagguguugcugua

SEQ ID NO: 63345 - RNA, 44 nt, Mus musculus
ugacccugacuuuccuguagagagcaaacuugaggggugggagu

SEQ ID NO: 63346 - RNA, 41 nt, Mus musculus
cgagagcccggcgccgaguuagcacucaccucuggccgcuu

SEQ ID NO: 63347 - RNA, 46 nt, Mus musculus
uugcggauaugcauucccuugauggccugggcaguuucccgggugu

SEQ ID NO: 63348 - RNA, 44 nt, Mus musculus
uaccaacuccaccauuauaccgccggaauggcacacauugcuuc

SEQ ID NO: 63349 - RNA, 48 nt, Mus musculus
aaagagacagaaauguagucuaggaaaugugucaucuuagaaaggaac

SEQ ID NO: 63350 - RNA, 46 nt, Mus musculus
caacaguauaggaccaucagcaggaccggacagagaggggcacgua

SEQ ID NO: 63351 - RNA, 86 nt, Mus musculus
ccggcucauuccgcuccaaacucgcccgcuccaugcccccagcucuuccgauuucccccugcucccgcugggucuccgccgacccc

SEQ ID NO: 63352 - RNA, 74 nt, Mus musculus
ccccggggggcugucagcgcgggggagggcggcgcggcggcgggcuccggcgggucgcaagcucucgcccccga

SEQ ID NO: 63353 - RNA, 46 nt, Mus musculus
uagagucucuggucuuuccuccugcguucccgggggcccagguccu

SEQ ID NO: 63354 - RNA, 46 nt, Mus musculus
caaugaaaaaacacaccaccuccucgcaccucggaggucuggaggg

SEQ ID NO: 63355 - RNA, 45 nt, Mus musculus
aggaaugccugagauccggccaccugaacacuuugcacagcagga

SEQ ID NO: 63356 - RNA, 45 nt, Mus musculus
acucaggcauucuuuuagcccaacuguuugucuuagcuguggggg

SEQ ID NO: 63357 - RNA, 46 nt, Mus musculus
ucuacucaccaguugguuugagaaaauccauuggguaucuggagua

SEQ ID NO: 63358 - RNA, 45 nt, Mus musculus
cuuuuucuuguuuuguuugaagcaaaacauuuggggugagcagcc

SEQ ID NO: 63359 - RNA, 46 nt, Mus musculus
aaacuccucaaccucaacccgggaaagaacaucuacauccgcaggu

SEQ ID NO: 63360 - RNA, 43 nt, Mus musculus
aagcucggcacacacacaacacaguucccaggugacuccagau

SEQ ID NO: 63361 - RNA, 46 nt, Mus musculus
cuuuuccugcucaguucucauuagaagcuuugaauaaacaauaccc

SEQ ID NO: 63362 - RNA, 46 nt, Mus musculus
gccaccaaaagcuaaguccuuaaagcaaaggaacuagccagccccu

SEQ ID NO: 63363 - RNA, 42 nt, Mus musculus
cugagccaucagaacaagggcaucaaaagagaggacccggau

SEQ ID NO: 63364 - RNA, 45 nt, Mus musculus
uuuauucauuuacuuuuggcaacugaacaucuggagcccccagau

SEQ ID NO: 63365 - RNA, 34 nt, Mus musculus
cuuucucuugucacucauucgucuccuuuagaaa

SEQ ID NO: 63366 - RNA, 41 nt, Mus musculus
gggacagaacaaacugggcaaugcuggagccugaggcccgu

SEQ ID NO: 63367 - RNA, 46 nt, Mus musculus
uggcaccagacaccaaggguagggggaagggaaugugaaggaggaa

SEQ ID NO: 63368 - RNA, 41 nt, Mus musculus
acccaaaguguguggaacuugggucaagaaacccggacagg

SEQ ID NO: 63369 - RNA, 42 nt, Mus musculus
uccugccucucucccacuccaguaagucuggugggcccugaa

SEQ ID NO: 63370 - RNA, 42 nt, Mus musculus
ccccgcugggcugcaggaacgcugugguuuguggcggcaggg

SEQ ID NO: 63371 - RNA, 42 nt, Mus musculus
cucucucucucuguaugacagcagcagccuguacaaagaagg

SEQ ID NO: 63372 - RNA, 46 nt, Mus musculus
caggagcagauggccaaaaaagacagacucgacaauggcagcgggu

SEQ ID NO: 63373 - RNA, 45 nt, Mus musculus
aagguucgcugcagcagguaccuuuacacccugguuaucacagac

SEQ ID NO: 63374 - RNA, 45 nt, Mus musculus
guguguguaguguuugugugugugugugugugugugugugugugu

SEQ ID NO: 63375 - RNA, 45 nt, Mus musculus
ccuugaugaacuuccagcucaacugguaauauaggaagugucagg

SEQ ID NO: 63376 - RNA, 42 nt, Mus musculus
agaaggcaagaucauugaguccaaauucacacagaugcucag

SEQ ID NO: 63377 - RNA, 44 nt, Mus musculus
guacuaggagcguucaggaguguacccacgaggguggggcgcau

SEQ ID NO: 63378 - RNA, 60 nt, Mus musculus
aacucccugagacucuaguggugccuacguguuugaugguaacagauggacaguuuucag

SEQ ID NO: 63379 - RNA, 46 nt, Mus musculus
gguaguuauuuguauaaaaguguuugggcuacagugagaaggugag

SEQ ID NO: 63380 - RNA, 46 nt, Mus musculus
ucuguuaaaagggguuaaaaaaaaaguguuuugccuaagaacccaa

SEQ ID NO: 63381 - RNA, 46 nt, Mus musculus
auuagaaggauuaggagguguggccuucuuagaggaagugugucag

SEQ ID NO: 63382 - RNA, 46 nt, Mus musculus
cucacagaucaacacuuuaaaacucauacaagugcaauguucucag

SEQ ID NO: 63383 - RNA, 45 nt, Mus musculus
caauucuuucaacguugcuguccaggccguugacauccccuucaa

SEQ ID NO: 63384 - RNA, 46 nt, Mus musculus
ucagccauuguguggcuaggaaccagugcacuuggcguucacagau

SEQ ID NO: 63385 - RNA, 30 nt, Mus musculus
uuguuaaaggcaaagagccgagccccaauu

SEQ ID NO: 63386 - RNA, 44 nt, Mus musculus
ccagccgcgcuccucugcucgccgcugggagucgucugaggaga

SEQ ID NO: 63387 - RNA, 42 nt, Mus musculus
ggagccgagcugucuuuggcccccgagggaaaguggggagcg

SEQ ID NO: 63388 - RNA, 46 nt, Mus musculus
caucucaggaaaccuuuaccuuugcuuucacaagucgcugggcaaa

SEQ ID NO: 63389 - RNA, 87 nt, Mus musculus
cuuggcugccuggaagaaccuuaucucuacauagauacagccagugagucuacacuagacaaggcaaccagagaccaaagagaagaa

SEQ ID NO: 63390 - RNA, 46 nt, Mus musculus
uauaauuuccaggacagcugcagaggagccaaggacauaauaagca

SEQ ID NO: 63391 - RNA, 46 nt, Mus musculus
auuugucauugccuugaacaaaucuagcagcaaaguggaaccagag

SEQ ID NO: 63392 - RNA, 42 nt, Mus musculus
ccugccuguaauccuagcauucaggaggcaaaggcaggagau

SEQ ID NO: 63393 - RNA, 64 nt, Mus musculus
ggucaacagacgugucagcucccagaauccucuccucgagaauggaggacaucucagcugugcc

SEQ ID NO: 63394 - RNA, 42 nt, Mus musculus
auuuuggugccucgggcuacaacuuauuuaucagcacaugag

SEQ ID NO: 63395 - RNA, 41 nt, Mus musculus
gucugucaccaauaaucagcucacgcugaccccggccaaug

SEQ ID NO: 63396 - RNA, 42 nt, Mus musculus
cuucauggcucugguuugggcagcagauccgacacgggacac

SEQ ID NO: 63397 - RNA, 46 nt, Mus musculus
aguuugucaagauaaccccguacacccgcauagauaacagccaccu

SEQ ID NO: 63398 - RNA, 58 nt, Mus musculus
agaaacaaaacuucuauugaaucauggauugaagaaaaggcuaacgaucgcauucagu

SEQ ID NO: 63399 - RNA, 77 nt, Mus musculus
auuaccaacugagugaagucuucauuuuuccuuaugauaugggaaguaaguggaagaacuuuaaacagguguuuaca

SEQ ID NO: 63400 - RNA, 46 nt, Mus musculus
guugacauuuccuucauaaucuucuagagacuguaaaacuugucag

SEQ ID NO: 63401 - RNA, 44 nt, Mus musculus
aucaagccuuggguguucuggaaguaguggcgccacagcggccg

SEQ ID NO: 63402 - RNA, 36 nt, Mus musculus
uguuggcaaacaccaagagaacagcaucucggagcu

SEQ ID NO: 63403 - RNA, 45 nt, Mus musculus
gcugauuagacagccaaucuaguccuucauagagcccguccccgc

SEQ ID NO: 63404 - RNA, 45 nt, Mus musculus
cuucuggcacucaggaccacagagucgcacguaugccacaugaga

SEQ ID NO: 63405 - RNA, 42 nt, Mus musculus
ugucaaggacgggcuccuccccagccgccaucuggcuaccaa

SEQ ID NO: 63406 - RNA, 46 nt, Mus musculus
ccauccccuucaccugaacaccuaacucuaacacaucuaccccgag

SEQ ID NO: 63407 - RNA, 44 nt, Mus musculus
uagccagcacagaggcagucaugguagaaaggucugggggagua

SEQ ID NO: 63408 - RNA, 38 nt, Mus musculus
cgagaugucacuccugaccacaagcucaacaggccagg

SEQ ID NO: 63409 - RNA, 44 nt, Mus musculus
acagccacgguguacucauauacauaaauaagucagagagagag

SEQ ID NO: 63410 - RNA, 42 nt, Mus musculus
ucaguccacaucucugcccugcucaggagaacacaugcccag

SEQ ID NO: 63411 - RNA, 46 nt, Mus musculus
caagacggacaaaaagcucuaguaccagucaugucaacaggagcag

SEQ ID NO: 63412 - RNA, 46 nt, Mus musculus
agucuauaggugaacgacagauuaggagauggcuguuggaggccag

SEQ ID NO: 63413 - RNA, 45 nt, Mus musculus
ccucaaauuacccaacuccugcauaaauuagcauuuccuaaggag

SEQ ID NO: 63414 - RNA, 46 nt, Mus musculus
caaucugcuuucucuaaauagcaggucagcaaggauuugggugcag

SEQ ID NO: 63415 - RNA, 46 nt, Mus musculus
uuaaauaaauaaauaaauaaaucuuaaaaaaaaaagauucaccuug

SEQ ID NO: 63416 - RNA, 45 nt, Mus musculus
uucugggcaagguccaagaugagcaccagcaucuaggcagcaagu

SEQ ID NO: 63417 - RNA, 42 nt, Mus musculus
agaaagacuggcuuggugaagaugcaggguacuaugccagac

SEQ ID NO: 63418 - RNA, 42 nt, Mus musculus
cccagcaaccacauggggguucacaaccaucuguaaugggau

SEQ ID NO: 63419 - RNA, 41 nt, Mus musculus
aaggugauggugguuagcaagaugaacaaagaugcagagau

SEQ ID NO: 63420 - RNA, 42 nt, Mus musculus
gauuguuuugccaggcuacugaagguuuaaguccgggcaguu

SEQ ID NO: 63421 - RNA, 45 nt, Mus musculus
aagaccuggauguguugugugugcauagacuguaagggcccgggg

SEQ ID NO: 63422 - RNA, 46 nt, Mus musculus
accacgaggcgcugaauaagcaaauaauggaguacaaacgcaagaa

SEQ ID NO: 63423 - RNA, 46 nt, Mus musculus
cauagcucccuugaguuuauucaucuuccuguuccuuccuggugua

SEQ ID NO: 63424 - RNA, 45 nt, Mus musculus
cccagguggauaucgcugguuggcagcgcggccucggugcuggcg

SEQ ID NO: 63425 - RNA, 46 nt, Mus musculus
gguuuucaaguggcagcgacuggaacuaucuacuucccccgaaaga

SEQ ID NO: 63426 - RNA, 45 nt, Mus musculus
uccaagauuggcagggcuggagcagagagccaaauauaaucucuc

SEQ ID NO: 63427 - RNA, 45 nt, Mus musculus
ccgagugcugggauuaaaggcgugcgccaccacgcccgaccucuu

SEQ ID NO: 63428 - RNA, 45 nt, Mus musculus
uuuuuucucuuuauucuucucucauaaauuauaucccaaccacag

SEQ ID NO: 63429 - RNA, 46 nt, Mus musculus
agaaaaggaagagagagaaagaaagaaagggaaaggaaaggaaagg

SEQ ID NO: 63430 - RNA, 24 nt, Mus musculus
cugcugagccuuuguggcucugag

SEQ ID NO: 63431 - RNA, 44 nt, Mus musculus
acaacacaguuucucaaguuacacuccacacaacuagggcccaa

SEQ ID NO: 63432 - RNA, 46 nt, Mus musculus
acuuucucccgucucccugcucucuacacagcaguuuucagcgcua

SEQ ID NO: 63433 - RNA, 45 nt, Mus musculus
ucggugcccgcugccaugacaggucuuacacagcuccguccgggg

SEQ ID NO: 63434 - RNA, 44 nt, Mus musculus
cgcaaccuaugaccucagaucugcuucaacaauuuaaaccccag

SEQ ID NO: 63435 - RNA, 46 nt, Mus musculus
cuagaacuacugugccaugcagcccgagagaacauuucagccccgg

SEQ ID NO: 63436 - RNA, 45 nt, Mus musculus
ugcaacuuacuccaauauuagcauagccucugugaaucccugugg

SEQ ID NO: 63437 - RNA, 57 nt, Mus musculus
ugauaacuuuuuucuuaguggguuuucugaggcuaacaguacagauuuuuaacuuac

SEQ ID NO: 63438 - RNA, 24 nt, Mus musculus
agugggcuggcugggguggagccc

SEQ ID NO: 63439 - RNA, 41 nt, Mus musculus
cauuucguggccgcccuguguggccuugcccaggggugcuc

SEQ ID NO: 63440 - RNA, 46 nt, Mus musculus
cagaaacaaaaauuagcuuccuuagauaagcgaaccccuuagguag

SEQ ID NO: 63441 - RNA, 45 nt, Mus musculus
gagucccuagaauugcuucuguuggauugcucucaucagcccaca

SEQ ID NO: 63442 - RNA, 46 nt, Mus musculus
cgcuguuugcucugugagaagaaaacaugcugcucauagugcccag

SEQ ID NO: 63443 - RNA, 41 nt, Mus musculus
uccagcaccuaagcuuccacuccaggggugggaauggcuca

SEQ ID NO: 63444 - RNA, 42 nt, Mus musculus
caggacaaggaugaggugaggggguauuuuaagagcagugau

SEQ ID NO: 63445 - RNA, 45 nt, Mus musculus
agccucaagauggugcucauguggacaaguggugacaccuucaag

SEQ ID NO: 63446 - RNA, 46 nt, Mus musculus
gaugggaauguaguuuuccagucuacggacaaguuccaacugugag

SEQ ID NO: 63447 - RNA, 45 nt, Mus musculus
agugcagucgguguuucugacaagaaccaacuucugugggcccag

SEQ ID NO: 63448 - RNA, 42 nt, Mus musculus
caccccuaggaauuuucuggaaggauuuuaaccuaucuggag

SEQ ID NO: 63449 - RNA, 42 nt, Mus musculus
uguugggucacacgagacaaggaugggaggaagcccugguca

SEQ ID NO: 63450 - RNA, 46 nt, Mus musculus
aagcuaacagcaugcuugucaagaguuauagaaagccucacaagac

SEQ ID NO: 63451 - RNA, 46 nt, Mus musculus
ugucugaccucagcuuaucugaccugacuucgagaugcccccaugc

SEQ ID NO: 63452 - RNA, 55 nt, Mus musculus
aggaagcgcacgcugugagaggagccuuggggagagccuuaaccggccgugagug

SEQ ID NO: 63453 - RNA, 58 nt, Mus musculus
gcucuucagcuugaccuccccucagacguggccacugagacccugacuuccuugggga

SEQ ID NO: 63454 - RNA, 34 nt, Mus musculus
ucacccagcauugcacugcgugaacagcuacuga

SEQ ID NO: 63455 - RNA, 46 nt, Mus musculus
guuuauaaaauggagacuuucgucaccuugcuuaugcuugcuucac

SEQ ID NO: 63456 - RNA, 41 nt, Mus musculus
gaguuuguccauguuguggccaucuccuucacagcgcugau

SEQ ID NO: 63457 - RNA, 41 nt, Mus musculus
ggggacagcaucacgugagguguauaccugcgucagucagg

SEQ ID NO: 63458 - RNA, 23 nt, Mus musculus
gaucugcucauguaugcacaaca

SEQ ID NO: 63459 - RNA, 46 nt, Mus musculus
uggccaugggcacaucuggggcugcaguguucuccaaccagaggag

SEQ ID NO: 63460 - RNA, 46 nt, Mus musculus
ggagagagaagaggcuaucaauuugaauagaagaaugguaaggguu

SEQ ID NO: 63461 - RNA, 42 nt, Mus musculus
caguucagacacaucggcaggcugcucauggugcacggacgg

SEQ ID NO: 63462 - RNA, 45 nt, Mus musculus
cggagggaaugacgugagcaugauccaggcugcugacugugggau

SEQ ID NO: 63463 - RNA, 56 nt, Mus musculus
ggcccacaucgugacccuguuacgccagcauaccagaaagcgcaccugugccaucg

SEQ ID NO: 63464 - RNA, 46 nt, Mus musculus
aaccaguguuucaggugugugcacuuggacacaugguaccugagaa

SEQ ID NO: 63465 - RNA, 46 nt, Mus musculus
uuaccauucauuaaacacaaaaaguaaauuuacauacuaaugagau

SEQ ID NO: 63466 - RNA, 42 nt, Mus musculus
acugcuaaacucuuguugaauccaacuagcacagugccccuu

SEQ ID NO: 63467 - RNA, 40 nt, Mus musculus
gggcucugaaagucgcugcuguuguagaaagccuggagag

SEQ ID NO: 63468 - RNA, 42 nt, Mus musculus
cgcaauguccaccauuguccaguacaaugauuggcuagaaga

SEQ ID NO: 63469 - RNA, 69 nt, Mus musculus
cuugaccuacugcauccuacagauguuccccuucaccuccgagagcaagcggaugggcaucauagucag

SEQ ID NO: 63470 - RNA, 41 nt, Mus musculus
gucuuuauggugcagaauggucugcaguaaacggugugugu

SEQ ID NO: 63471 - RNA, 46 nt, Mus musculus
auagcauugcauuuggauuuaccaaagaacuaauguauguggagug

SEQ ID NO: 63472 - RNA, 46 nt, Mus musculus
agauacagcugucuuugccuugcuuagccauuuauaugcaagaauc

SEQ ID NO: 63473 - RNA, 46 nt, Mus musculus
uacagugugucaaaauagggugugugugugugugugugugugugug

SEQ ID NO: 63474 - RNA, 45 nt, Mus musculus
auagccgagagcuaugugcuggacaguuggaaagaugcugugagg

SEQ ID NO: 63475 - RNA, 141 nt, Mus musculus
gcagugaaagccauugcccuuugucauaaugucacuccuguguaugaggcucgggcuggcaucacuggggagacugaguuugcugaagcagaccaagacuuuagugaugagaaccgcaccuaccaggccuccagccccgau

SEQ ID NO: 63476 - RNA, 59 nt, Mus musculus
agugggcacaacccaagcucugcuccacugagaagaagccaguccucaacgccuaaagu

SEQ ID NO: 63477 - RNA, 46 nt, Mus musculus
gccaucuucucucagugcacccaccguggugagcuaauaugcugau

SEQ ID NO: 63478 - RNA, 42 nt, Mus musculus
ggacgaaauccaaagucacguccugaauuccuaccugcaggu

SEQ ID NO: 63479 - RNA, 52 nt, Mus musculus
caaagaugcucagaagcaauauacaauagauaacacuguagaacuuaagaaa

SEQ ID NO: 63480 - RNA, 45 nt, Mus musculus
gggacacuuuaguuuuugaucuagugggcaaugcuagucagugau

SEQ ID NO: 63481 - RNA, 42 nt, Mus musculus
gguauaauuagguuugauuggagugcacguuuccgguaagau

SEQ ID NO: 63482 - RNA, 79 nt, Mus musculus
uucagucccuggaacuaccaagaagaagagggcuuugggagaggacagugaagugcuuauuagcaaguagcauacacag

SEQ ID NO: 63483 - RNA, 23 nt, Mus musculus
gugaagucucgaugccccaaagu

SEQ ID NO: 63484 - RNA, 42 nt, Mus musculus
acccugacucaaaaagaguagagaauaaagguuggccaaucu

SEQ ID NO: 63485 - RNA, 45 nt, Mus musculus
aaaggaaaggaaaaaggaaaggaaaggaaaaaaaaggaaaggaaa

SEQ ID NO: 63486 - RNA, 45 nt, Mus musculus
acauaacuguacguuguuauaaaauucuuucgauuugcaaaaagg

SEQ ID NO: 63487 - RNA, 46 nt, Mus musculus
gugggagaggauguacuuaauccuguagaaacuugaugcccccagg

SEQ ID NO: 63488 - RNA, 46 nt, Mus musculus
uugaugcuggcugcucugccugcaguauagcaucagaguaagagau

SEQ ID NO: 63489 - RNA, 33 nt, Mus musculus
agguccccacuguuuaaggaggaucugcuagau

SEQ ID NO: 63490 - RNA, 46 nt, Mus musculus
agaacaugauuaguuuugcuagaguuagagaaaaguaccccuuugu

SEQ ID NO: 63491 - RNA, 46 nt, Mus musculus
cauuuucauguauucugaucacgacacuagagaugggugccaacuu

SEQ ID NO: 63492 - RNA, 46 nt, Mus musculus
acucgguuuugugugugugugucucccuagucuuaaaacaugggug

SEQ ID NO: 63493 - RNA, 46 nt, Mus musculus
cucuuauuaacuucuaguuaauagcuacuuaagcugaugugugggu

SEQ ID NO: 63494 - RNA, 71 nt, Mus musculus
aaugcaaaaauaccacuuaaaugcacuuaaaauagccaucaguucaguaacuacacaauaaggccgucuga

SEQ ID NO: 63495 - RNA, 46 nt, Mus musculus
gcugggucuaccuucuuaaagaauccaauaugaucagcccaggaau

SEQ ID NO: 63496 - RNA, 46 nt, Mus musculus
aaagcugguagagggcaucugagaagacugaccacagugcuaagug

SEQ ID NO: 63497 - RNA, 45 nt, Mus musculus
auauaaguucauagucuucagaacauaugauugcugacugcagga

SEQ ID NO: 63498 - RNA, 46 nt, Mus musculus
aacagcugguccgguagcggaguugacagagaacuuggucagagau

SEQ ID NO: 63499 - RNA, 46 nt, Mus musculus
caggaaagaauaaaggacauugaucaucuuccacaagacaucuauu

SEQ ID NO: 63500 - RNA, 59 nt, Mus musculus
ccaggaucccagagcagggagaagucauguuaauuaaaggagcuaaaggaagagggaga

SEQ ID NO: 63501 - RNA, 121 nt, Mus musculus
aauucaguaguugccguagguuuucaagacagaaauucagguuaauguucuuagugucagagaagcuuaaggggcaccgcaggauggaugugggugccaugcugcagggacugagcucagg

SEQ ID NO: 63502 - RNA, 44 nt, Mus musculus
agaaaaagacagccgagugacgaggguguugaaucugcaagaga

SEQ ID NO: 63503 - RNA, 46 nt, Mus musculus
aaaaaguggaauuccaaagaauguuugguucaaaagauaagcagag

SEQ ID NO: 63504 - RNA, 46 nt, Mus musculus
aauauggucauuucaacauuaaugauaauaaauuaaauugacaaaa

SEQ ID NO: 63505 - RNA, 46 nt, Mus musculus
uaggggccuacaucuuucuauaaauauaaaucguuuguccaagaga

SEQ ID NO: 63506 - RNA, 46 nt, Mus musculus
ggguucugacugguucuaaugacuugucuguauacuguuucccagg

SEQ ID NO: 63507 - RNA, 46 nt, Mus musculus
cacacacacacacacacacacacacacagagagagagggcagggcg

SEQ ID NO: 63508 - RNA, 45 nt, Mus musculus
uggugaguuuuagcaguuacuuuauuuuuccuguugauuagaggu

SEQ ID NO: 63509 - RNA, 27 nt, Mus musculus
uuugugaucaagcaaauuuauuaacaa

SEQ ID NO: 63510 - RNA, 57 nt, Mus musculus
cccugugguacuagcuauacaacagguauaaaaggaaguuuauuuuggggcaugaga

SEQ ID NO: 63511 - RNA, 42 nt, Mus musculus
guugugagccaccaugugguugcuggaauuugaacccuggac

SEQ ID NO: 63512 - RNA, 44 nt, Mus musculus
gucaaaggagugggcccacagcuauaugucuauccacccccagg

SEQ ID NO: 63513 - RNA, 44 nt, Mus musculus
gagagagaaaguaacagaauagauauggccagaaucagggaagu

SEQ ID NO: 63514 - RNA, 46 nt, Mus musculus
auaaaaacaaacucaaaaaugaaaauuaagcaaaaaacuaauaagg

SEQ ID NO: 63515 - RNA, 46 nt, Mus musculus
acaaguuugcaaauauggauauuuguaguucucuaaccuaacagau

SEQ ID NO: 63516 - RNA, 45 nt, Mus musculus
uauuuguuuucacuuugccuugccuucugugguguuggggaucga

SEQ ID NO: 63517 - RNA, 46 nt, Mus musculus
agcaggguagagaccaaagccuuuuggcagaaagauuagaagagau

SEQ ID NO: 63518 - RNA, 46 nt, Mus musculus
caaguuuaaugaccaaagaucugauauuauaaauucacagucaagg

SEQ ID NO: 63519 - RNA, 47 nt, Mus musculus
uucucauccacuuuauuucuauagaaagauuuaucuugccaucaguu

SEQ ID NO: 63520 - RNA, 46 nt, Mus musculus
ugcuuuagaaccaauuuucaucaaucucuuauaaaugccaauagcc

SEQ ID NO: 63521 - RNA, 46 nt, Mus musculus
cuuacauuccaauuaaucaauuguuccauccguuucuuaaucagau

SEQ ID NO: 63522 - RNA, 48 nt, Mus musculus
aauacagcacgguaagucaauccauggcauucuauugacuaaguauua

SEQ ID NO: 63523 - RNA, 55 nt, Mus musculus
uucugauuuuugguuuguuuguuuuuuacuaacaguuuguuguguuucaaguuua

SEQ ID NO: 63524 - RNA, 42 nt, Mus musculus
agcaaaacuuuuuugugugaucuuaaguaauuuacucaagau

SEQ ID NO: 63525 - RNA, 46 nt, Mus musculus
auuuauuuauuuauuuuugguuugguuuuuguuuguuugaggagga

SEQ ID NO: 63526 - RNA, 46 nt, Mus musculus
uguuugaaugcuuguucuacacuugauagaacuguuuaggagagau

SEQ ID NO: 63527 - RNA, 71 nt, Mus musculus
aagaccucccucacagaugcucaaguuuguuucuuugcacucuccaguuccauuucuuucuugcucuaggu

SEQ ID NO: 63528 - RNA, 46 nt, Mus musculus
aaacagagauauguagaauagggggcuacauuguuggugucaaaga

SEQ ID NO: 63529 - RNA, 44 nt, Mus musculus
cugucaauauagaaacagacccacuggguugucacuuguccuaa

SEQ ID NO: 63530 - RNA, 45 nt, Mus musculus
gaacacauggggaguagaagggaaggcaagauuuacuuuuaagaa

SEQ ID NO: 63531 - RNA, 46 nt, Mus musculus
aagugagcuccaaguuuaguuagagauccugccucaaaaauaagau

SEQ ID NO: 63532 - RNA, 41 nt, Mus musculus
ugccguguguuuuauuugcauuugcuagugauuguugagau

SEQ ID NO: 63533 - RNA, 46 nt, Mus musculus
ugacacaaagcuguaugaagugcucuguuaaaaugcuguuauagau

SEQ ID NO: 63534 - RNA, 42 nt, Mus musculus
gcacgugaagcgauugaugaauuucgacguuuucagcgagac

SEQ ID NO: 63535 - RNA, 46 nt, Mus musculus
uguauuuguucaccaauugcauggcuggugccuguggaggccagaa

SEQ ID NO: 63536 - RNA, 45 nt, Mus musculus
guuuauaauuaggaagaacacauggguuuauugcuaaagugaggu

SEQ ID NO: 63537 - RNA, 45 nt, Mus musculus
uaccauaggucugguuaguucacacauuguuuuaaggcaguuuga

SEQ ID NO: 63538 - RNA, 46 nt, Mus musculus
auguauacauuucauguuauacaaauguaacugacugaagagagau

SEQ ID NO: 63539 - RNA, 46 nt, Mus musculus
ugaauguuaaaguuuuugauccauuugaagucaauguuuggcagag

SEQ ID NO: 63540 - RNA, 43 nt, Mus musculus
aggaaacagguuucuaugggaugguaauaaaauauaauaagau

SEQ ID NO: 63541 - RNA, 42 nt, Mus musculus
cuguuguauguacuugugugcauguauguggaaaccagagau

SEQ ID NO: 63542 - RNA, 46 nt, Mus musculus
caaaacaaguuuauuaagaaucacauguacaauuugcaagggagaa

SEQ ID NO: 63543 - RNA, 45 nt, Mus musculus
uuguuacuguaauaaauucacaaauaaagacaucacacagcuaga

SEQ ID NO: 63544 - RNA, 50 nt, Mus musculus
ccaugcuuccagggcaugagcuggcuguccugcaggagaguguggguggg

SEQ ID NO: 63545 - RNA, 63 nt, Mus musculus
uagguuucuuagucauggcugaaaagaagaaaauagaaaacagaagaaaggguaaaagaagau

SEQ ID NO: 63546 - RNA, 108 nt, Mus musculus
ccagguuuuuuguauacaguacuaguauggacaauguugauacaucagugaacaaagcuagacaaaagcuuauccuaauagaccuucaauugucagggagaacacagc

SEQ ID NO: 63547 - RNA, 73 nt, Mus musculus
cuaaggcaugagagcagaaaggaagcaguagggaguggguagagguguauaggguaggggaggaccauagagg

SEQ ID NO: 63548 - RNA, 99 nt, Mus musculus
aguaaguuuuaaaauagaacugcaaagacuaugaaaccaggaaggaucccacaagugggacagagauguguuggggaaugucgggagaccaguggggca

SEQ ID NO: 63549 - RNA, 55 nt, Mus musculus
aacuuacuguuuugaaaggauuuauucuuuagagguguggugauugguaagacaa

SEQ ID NO: 63550 - RNA, 39 nt, Mus musculus
cuaaaagcucgaacaguauggcuuggauguccagagaag

SEQ ID NO: 63551 - RNA, 46 nt, Mus musculus
aagggaggggggugugggaggagggauuucuaaggcuggaccuggg

SEQ ID NO: 63552 - RNA, 45 nt, Mus musculus
ugauuauuuuaugagacauuuuaaugauuaaaaccuggggaaauu

SEQ ID NO: 63553 - RNA, 41 nt, Mus musculus
ugauuaccacacauuaccucgagcuaggauaacacggagaa

SEQ ID NO: 63554 - RNA, 46 nt, Mus musculus
uauuuuauuggugaauuacgucuuuuaaauuacauuagucccagcu

SEQ ID NO: 63555 - RNA, 42 nt, Mus musculus
agugcuaagauaaugcuauucuacuuguuucaggcccagagu

SEQ ID NO: 63556 - RNA, 42 nt, Mus musculus
cucuagcccuccguugggggcccuguguuccauccaauagau

SEQ ID NO: 63557 - RNA, 45 nt, Mus musculus
agaccuggcuggccgugaauuuacagagauccaccugccccugcc

SEQ ID NO: 63558 - RNA, 46 nt, Mus musculus
gaacaagaaauguaacugucuagcagaacaaagggaacugagagga

SEQ ID NO: 63559 - RNA, 45 nt, Mus musculus
ccucugagaaaaaugccaucaucuguugauaauuauauccucaag

SEQ ID NO: 63560 - RNA, 42 nt, Mus musculus
aaugcauugcagacauucggguggcacacuaguuguugccag

SEQ ID NO: 63561 - RNA, 46 nt, Mus musculus
ccaggcugccauggaacguuugcuggagcuguacgcucguggggac

SEQ ID NO: 63562 - RNA, 46 nt, Mus musculus
accacacccugucagcaguaagcugugaccaacaggacagugacag

SEQ ID NO: 63563 - RNA, 42 nt, Mus musculus
ugcuauuagaaccggaguggauucuggaagagaaagcuauag

SEQ ID NO: 63564 - RNA, 42 nt, Mus musculus
acaucaaacguucucaaugaaugggaaugcaauuaggagcgc

SEQ ID NO: 63565 - RNA, 46 nt, Mus musculus
ggaaaugucacgguaaauagcugccaaauuauggaucaugccgaag

SEQ ID NO: 63566 - RNA, 46 nt, Mus musculus
gaauauacuaaauucagauauguaaaaguaaaauucgcauacccag

SEQ ID NO: 63567 - RNA, 45 nt, Mus musculus
cguuuuacuuuuuucuguggauccuuguuaccaccuccaggagca

SEQ ID NO: 63568 - RNA, 48 nt, Mus musculus
uaaagugauagucuuugucagccuuuaguucacagccgaaaagguagu

SEQ ID NO: 63569 - RNA, 41 nt, Mus musculus
cagagccgcagccuaaagguuggaggggguccggugggguc

SEQ ID NO: 63570 - RNA, 41 nt, Mus musculus
uguaaagguggccagggaggguagguuucagaagccgggag

SEQ ID NO: 63571 - RNA, 46 nt, Mus musculus
agcagaaacaagucuagcugguuugagaaacaaaaggggugcagug

SEQ ID NO: 63572 - RNA, 46 nt, Mus musculus
ggggacugaagugacugccuggcuccucuggauggcagguuucaag

SEQ ID NO: 63573 - RNA, 44 nt, Mus musculus
uaaaacacuccuggaguuuuaagagaaagaagaagaaacagagu

SEQ ID NO: 63574 - RNA, 45 nt, Mus musculus
ugguuuacagguuuaaaaguugucuauuaucaaggugggaacaag

SEQ ID NO: 63575 - RNA, 46 nt, Mus musculus
auuuauuuagcaagaaaccaaaguaguuaaaaguaaacaaaguaag

SEQ ID NO: 63576 - RNA, 46 nt, Mus musculus
cacaaaucaaagaacugagcuuggaaucgaaauguuggcuaggaag

SEQ ID NO: 63577 - RNA, 46 nt, Mus musculus
auggauuaaagaauaguuuggggagauaagauaauaagagguguag

SEQ ID NO: 63578 - RNA, 23 nt, Mus musculus
gauuaugagugcacuuuaccucu

SEQ ID NO: 63579 - RNA, 46 nt, Mus musculus
guguacaugaguacuagugaaggaagccagaaaaaaguuguuagau

SEQ ID NO: 63580 - RNA, 45 nt, Mus musculus
ugcaggaacacaaggaauggggaucuuuuugugaaaauauuaggu

SEQ ID NO: 63581 - RNA, 46 nt, Mus musculus
aaggaccggacccccggaaagcaaaggaggauaguaccaagcaagu

SEQ ID NO: 63582 - RNA, 46 nt, Mus musculus
ccgccugaguguguggauuacaaaccuuuagaaguugcgguccuga

SEQ ID NO: 63583 - RNA, 24 nt, Mus musculus
ucucugcauggugacagugagaca

SEQ ID NO: 63584 - RNA, 45 nt, Mus musculus
uuucuaucuuggcagacuuuaaaggauuuuaggaugugugcugug

SEQ ID NO: 63585 - RNA, 51 nt, Mus musculus
guguagugugcauaguguguaguguguaguauguaguauguauguguagug

SEQ ID NO: 63586 - RNA, 53 nt, Mus musculus
uaaauacacagaggaauagaaaauauaaaaucugagaaguugagggaaaguga

SEQ ID NO: 63587 - RNA, 46 nt, Mus musculus
uaaguccagcaccgagcaacauuccggaugguguagccaccuccuc

SEQ ID NO: 63588 - RNA, 46 nt, Mus musculus; identical to SEQ ID NO: 41050

SEQ ID NO: 63589 - RNA, 42 nt, Mus musculus
agugugguacuuggucauuuccucagcauuggcuuugugagg

SEQ ID NO: 63590 - RNA, 45 nt, Mus musculus
gcuucauggggugcccuuguccauaauaguaguuuccaacguccc

SEQ ID NO: 63591 - RNA, 45 nt, Mus musculus
ugcagaauucaaaugagugcaaaagaaacuuuguggcggucuaug

SEQ ID NO: 63592 - RNA, 46 nt, Mus musculus
uuaauaaggcuuauaagauuagguuuuaguuguugggcccagagau

SEQ ID NO: 63593 - RNA, 47 nt, Mus musculus
uguaguuaaguugacaaccagaaauagccaucacagauaugaaaaau

SEQ ID NO: 63594 - RNA, 46 nt, Mus musculus
caugucaagauccaugucagaagcccgugucuuucagcuucaagau

SEQ ID NO: 63595 - RNA, 46 nt, Mus musculus
ugcauuguauuugugucaagaugauagcuauaauaauagugggagg

SEQ ID NO: 63596 - RNA, 42 nt, Mus musculus
agguugcugaugcuccagugguaauccaaaaacagaagaaga

SEQ ID NO: 63597 - RNA, 45 nt, Mus musculus
gcauuauguaugacaugggccauucaaguuuaaagaaccagagga

SEQ ID NO: 63598 - RNA, 45 nt, Mus musculus
augugccugugcuuuuguauguauauggcuaugcugguuuggagg

SEQ ID NO: 63599 - RNA, 46 nt, Mus musculus
ggcaguguggacagagcauugagggggagacuucacagguucgcaa

SEQ ID NO: 63600 - RNA, 44 nt, Mus musculus
cugaggauuagacacaugcgcaggguuggucucuuugugugugc

SEQ ID NO: 63601 - RNA, 44 nt, Mus musculus
caguuauuuuacuugaucuggcuguuuguaaaggauuuguagaa

SEQ ID NO: 63602 - RNA, 40 nt, Mus musculus
uuuuguacaauuggcuagauacaaauuuauucauuaacag

SEQ ID NO: 63603 - RNA, 47 nt, Mus musculus
cuucauaaauaagucuggcaacucaaagggcuguagaauugcagaug

SEQ ID NO: 63604 - RNA, 46 nt, Mus musculus
uuaaucuauauuggccuugaaguucuaggcacuuuaauagcuugag

SEQ ID NO: 63605 - RNA, 42 nt, Mus musculus
ugacacauauuauauaaauauuaauccuuguagacuccugag

SEQ ID NO: 63606 - RNA, 46 nt, Mus musculus
uguauauacauacuuuuuuucugccucagaagaugugguuccugag

SEQ ID NO: 63607 - RNA, 45 nt, Mus musculus
ugaacugaaaccugccucaugcagguuuauggauagaauguguca

SEQ ID NO: 63608 - RNA, 45 nt, Mus musculus
gggaucaaagucucaugcugaaaauagaaacuuuauaucauuuug

SEQ ID NO: 63609 - RNA, 46 nt, Mus musculus
cagaacuaccuuacuauggaugguuuucuccuguaugaacuuggag

SEQ ID NO: 63610 - RNA, 46 nt, Mus musculus
ugaucaguguagcgaaagagaaggcuaacuaacaacugauggugau

SEQ ID NO: 63611 - RNA, 62 nt, Mus musculus
gaaaugcuccaagagauggaagaccaugucugcaaaggaaaagucgaaguuugaagauuugg

SEQ ID NO: 63612 - RNA, 46 nt, Mus musculus
aaucacccaaagaucaaaauugaacacccuggccugucuauuggag

SEQ ID NO: 63613 - RNA, 47 nt, Mus musculus
ugcauaccgugccaaggacaaaagugaagcaggaaagaaggguccug

SEQ ID NO: 63614 - RNA, 46 nt, Mus musculus
gaagaagaggaggaugaagaauaaguggcuguccuaaaguguggag

SEQ ID NO: 63615 - RNA, 42 nt, Mus musculus
uucuaaauauuuaaugguuucuuuaauuucuuaugguagcaa

SEQ ID NO: 63616 - RNA, 46 nt, Mus musculus
ugugucuccucucaugguuacauggucaugaaauggaaaugcaguu

SEQ ID NO: 63617 - RNA, 46 nt, Mus musculus
ccauagcaguuauugaugagaaaaacacaucacuugagcauaccag

SEQ ID NO: 63618 - RNA, 42 nt, Mus musculus
aagucaauuauucaggaaguugcuagagauuucagagaccac

SEQ ID NO: 63619 - RNA, 46 nt, Mus musculus
ugaugguuuugauagcaguuuuucuacuuugauaucuaauuuugag

SEQ ID NO: 63620 - RNA, 45 nt, Mus musculus
cugugaacaaucacaguuuuccaaccaucaagaaauguauugaga

SEQ ID NO: 63621 - RNA, 45 nt, Mus musculus
uggaccagcuucaacaagccacaaagaucaugaauaaaggcagag

SEQ ID NO: 63622 - RNA, 46 nt, Mus musculus
guugacauuaauuuauugaaacugaguucaauagcagugaggggaa

SEQ ID NO: 63623 - RNA, 47 nt, Mus musculus
ggugucaucaguaucaugugcuauggaaucuauacagcugacacaga

SEQ ID NO: 63624 - RNA, 49 nt, Mus musculus
ccagcaguggagggucucuagcaccuacugugcaagagcccaaagaugu

SEQ ID NO: 63625 - RNA, 42 nt, Mus musculus
gagaacauauucuuuguauuuugcuaauaacaacugcaugaa

SEQ ID NO: 63626 - RNA, 46 nt, Mus musculus
auguuuggaacaaagugaugaacaguuuguccaaaacaaagccaga

SEQ ID NO: 63627 - RNA, 46 nt, Mus musculus
guauaucuguagagcaagagaauugcuaauuauagucuguguccaa

SEQ ID NO: 63628 - RNA, 68 nt, Mus musculus
aagccuuauugcaggagaaaaaaccugaagucuguacagaugccucauuaaugauaaugugugguaag

SEQ ID NO: 63629 - RNA, 46 nt, Mus musculus
uuauuguuuaucacuaccaaauguuaaauguaucuugucuggucaa

SEQ ID NO: 63630 - RNA, 46 nt, Mus musculus
acagacaaauauauacaaaaaaauauauacauuuuuuaucaguguu

SEQ ID NO: 63631 - RNA, 42 nt, Mus musculus
acucagcuauucuuauguagaaauuguuaaaacaagugugag

SEQ ID NO: 63632 - RNA, 46 nt, Mus musculus
uuacuacuaacuuguuuaauugugauacucugcuuuaugacaccag

SEQ ID NO: 63633 - RNA, 59 nt, Mus musculus; identical to SEQ ID NO: 57923

SEQ ID NO: 63634 - RNA, 42 nt, Mus musculus
agguaacaggaaguuacaaaagcaaagagaaggacaggguaa

SEQ ID NO: 63635 - RNA, 78 nt, Mus musculus
aucuucagcagacucaggagaaauagaugacaguggcaaauagagagguuaacaguaaagagaagugaaaauagagau

SEQ ID NO: 63636 - RNA, 45 nt, Mus musculus
aaaaaacaaccuuggauggccuuggaugccauuaagacugcccug

SEQ ID NO: 63637 - RNA, 46 nt, Mus musculus
cucauacucgaaaugaucugaaagaucagaucagccuuggccugag

SEQ ID NO: 63638 - RNA, 42 nt, Mus musculus
gggaggccagguucucuuuacucaucuucaaagccgguugga

SEQ ID NO: 63639 - RNA, 42 nt, Mus musculus
cuagaaucgugcuuugugaauagaaucagcucaguggugacc

SEQ ID NO: 63640 - RNA, 46 nt, Mus musculus
gguuuuugcccucaaggucauguugcaguugacacagcccguaaga

SEQ ID NO: 63641 - RNA, 45 nt, Mus musculus
augauuuaaaaaauaaauauaauugggauuuuuaacaagugagaa

SEQ ID NO: 63642 - RNA, 48 nt, Mus musculus
acaacaccgugcagcacagaugugugugacagugacuacagcaccagu

SEQ ID NO: 63643 - RNA, 41 nt, Mus musculus
gucugagugcuuucuagagacuuggauagcuugcccuggua

SEQ ID NO: 63644 - RNA, 53 nt, Mus musculus
ccccacgaguauguugguggagccccucaugugccucucaacuucauagcccc

SEQ ID NO: 63645 - RNA, 42 nt, Mus musculus
cucccucuucgucaugggcggggucuacuuugucugccagcg

SEQ ID NO: 63646 - RNA, 46 nt, Mus musculus
uagaggcugucaguggagacaggaaggaauuggaauucagagagau

SEQ ID NO: 63647 - RNA, 46 nt, Mus musculus
gugucugugugugugugugugugacucuguguguauggugugugac

SEQ ID NO: 63648 - RNA, 50 nt, Mus musculus
guguaugugacugugugugugugugugacugugugugugugugugacucu

SEQ ID NO: 63649 - RNA, 41 nt, Mus musculus
ggcucuccacuuaggagcaugugcuuagccuaccgugagau

SEQ ID NO: 63650 - RNA, 42 nt, Mus musculus
uugccaaucaggcugugcuaucuguccggugaccccaaagau

SEQ ID NO: 63651 - RNA, 47 nt, Mus musculus
cagugcugggcaggcaccucuacuggaucgaccgccagcagcagaug

SEQ ID NO: 63652 - RNA, 42 nt, Mus musculus
uagugccuuguuagugagagacccuuggacaggugcccacga

SEQ ID NO: 63653 - RNA, 46 nt, Mus musculus
acagcccuccaugcugaccucucccagccaaagccugagcccagac

SEQ ID NO: 63654 - RNA, 44 nt, Mus musculus
uccaccuucuugcuguucagccagaaauuugccaucagccggau

SEQ ID NO: 63655 - RNA, 41 nt, Mus musculus
uggccccaguacuugagagauagaggcucuuaguguuugag

SEQ ID NO: 63656 - RNA, 92 nt, Mus musculus
gagcgcauggugauagcugacgaucugcccuacccguuuggccugacucaauauagcgauuacaucuacuggacugacuggaaccugcauag

SEQ ID NO: 63657 - RNA, 61 nt, Mus musculus
ggaugcauggaugcauggauggauggauggauggauggaugcauggaugcauggauggaug

SEQ ID NO: 63658 - RNA, 54 nt, Mus musculus
aggauugugcgggccuucauggaugggaccaauuguaugacacugguagacaag

SEQ ID NO: 63659 - RNA, 111 nt, Mus musculus
ggaauggcuguggacuggaugggcaagaaccucuauugggcggacacagggaccaacaggauugagguggcccggcuggaugggcaguuccggcaggugcuuguguggaga

SEQ ID NO: 63660 - RNA, 41 nt, Mus musculus
gacccucacauggcccuuucuuuccucaucuucgcagacga

SEQ ID NO: 63661 - RNA, 46 nt, Mus musculus
cuauuuguaugugugugcaacacaugugugcagugcccuuggaggu

SEQ ID NO: 63662 - RNA, 46 nt, Mus musculus
ggugcaugacuguagcacuaguacuugggggucugaggcaagagaa

SEQ ID NO: 63663 - RNA, 46 nt, Mus musculus
gcuccguuuugguuuuaguuaagagacucugugccaugaguaaggu

SEQ ID NO: 63664 - RNA, 45 nt, Mus musculus
gauggaaauggagggugcagccaucugugcuucuucaccccacgu

SEQ ID NO: 63665 - RNA, 46 nt, Mus musculus
ucuacuggaccgacuggcagagacgcaguauugaaaggguccacaa

SEQ ID NO: 63666 - RNA, 46 nt, Mus musculus
caugcuugcaaaguuuaguuugaucaauaggacuagggauguagcu

SEQ ID NO: 63667 - RNA, 46 nt, Mus musculus
ggggggagaaccccaaaaucgaaugcgccaaccuagaugggagaga

SEQ ID NO: 63668 - RNA, 46 nt, Mus musculus
gaagauggugacaaggagcacuggggucauuugaagcuguggguga

SEQ ID NO: 63669 - RNA, 92 nt, Mus musculus
cccaggcuuuuggugcagcccauugugaggccuuguaagccagagaguuugaagggguuauguguagagguccagaagugggggcagcaguu

SEQ ID NO: 63670 - RNA, 42 nt, Mus musculus
cgaaagauccugguaucugaggaccuggacgaaccgcgagcc

SEQ ID NO: 63671 - RNA, 46 nt, Mus musculus
cguaccuagauggcucaggugcgcagacacuugugaacacugagau

SEQ ID NO: 63672 - RNA, 46 nt, Mus musculus
gccauugacuacgauccccuggagggcuacguguacuggaccgacg

SEQ ID NO: 63673 - RNA, 45 nt, Mus musculus
ugucagccccuguacagugcagggguuaauggaauuuguugagaa

SEQ ID NO: 63674 - RNA, 46 nt, Mus musculus
cuuuaauuugcccaggcuuaaagccauucuuucugugucaccugug

SEQ ID NO: 63675 - RNA, 45 nt, Mus musculus
aaauuggaucucaugguccaggagacugcgugguaagccuguaug

SEQ ID NO: 63676 - RNA, 41 nt, Mus musculus
agggaaaaggagagggagcuugggaagugaugggcauggag

SEQ ID NO: 63677 - RNA, 46 nt, Mus musculus
gucuuaccucucuguuaacacuucuaugcaaauggaggucccagau

SEQ ID NO: 63678 - RNA, 46 nt, Mus musculus
gccuuucuacuccugugccugccccacuggugugcaguugcaggac

SEQ ID NO: 63679 - RNA, 50 nt, Mus musculus
ggcugaaggcccuccaugggggguggucugagugcgguuagguaggacua

SEQ ID NO: 63680 - RNA, 41 nt, Mus musculus
gagcuugugugugugugugugugugugugugcgcgugugcg

SEQ ID NO: 63681 - RNA, 42 nt, Mus musculus
ccacgccugcaacaaguggacaggggagcagaggaaggagau

SEQ ID NO: 63682 - RNA, 27 nt, Mus musculus
gccucacucacccuuuugcccugacac

SEQ ID NO: 63683 - RNA, 42 nt, Mus musculus
aguggguggcaagucccugggcuaauuccaggccuguaggag

SEQ ID NO: 63684 - RNA, 42 nt, Mus musculus
ggaagugguuuugugugugugugugugugugugugugugugu

SEQ ID NO: 63685 - RNA, 45 nt, Mus musculus
ugagccaccauaugguugcugggauuugaacucuggaucuucgga

SEQ ID NO: 63686 - RNA, 46 nt, Mus musculus
acucccagaacuuucuuuuucuccuccugagcuuuccuuugcagcu

SEQ ID NO: 63687 - RNA, 45 nt, Mus musculus
uccuuuccuuuccuuuccuuuccuuuccuuuccucccgagugcug

SEQ ID NO: 63688 - RNA, 46 nt, Mus musculus
cucuagccuggggagcacuugccacuagcagcuuccaggacagcau

SEQ ID NO: 63689 - RNA, 46 nt, Mus musculus
aggauuuuucuacauagcccgggcuguccuagaacuauauagagua

SEQ ID NO: 63690 - RNA, 46 nt, Mus musculus
uuuugugacucaguggguccagagaccuguggauggauggagagau

SEQ ID NO: 63691 - RNA, 42 nt, Mus musculus
uguuuugcuuucuagaggcagauagugggauggucuggggac

SEQ ID NO: 63692 - RNA, 41 nt, Mus musculus
gaccaccaugugguugcugggauuugaacucaggcgggugc

SEQ ID NO: 63693 - RNA, 42 nt, Mus musculus
gggcaguuugcgagcacucuacggacauucgagaguaggcga

SEQ ID NO: 63694 - RNA, 46 nt, Mus musculus
gcuuagaaguccaacucuuaaaaacuuguauuacuuacaccccgac

SEQ ID NO: 63695 - RNA, 46 nt, Mus musculus
cauguauuguacaacaugagcaugaaaugccuacagaggccagaag

SEQ ID NO: 63696 - RNA, 46 nt, Mus musculus
gggggcucucacauacacacacccacacagauagacaugcuugugu

SEQ ID NO: 63697 - RNA, 42 nt, Mus musculus
ggacucccaaaguggucaugaugcacaggaugagaauugcag

SEQ ID NO: 63698 - RNA, 45 nt, Mus musculus
acuccgaguccugccaaaagcacacccacugacacauccagcaag

SEQ ID NO: 63699 - RNA, 46 nt, Mus musculus
caauuucagagcugugccagaugcuagacacauuuaauagcuguca

SEQ ID NO: 63700 - RNA, 46 nt, Mus musculus
acuuggcccucgauguaugaaaucuugaccagaauuaaaagcaaag

SEQ ID NO: 63701 - RNA, 45 nt, Mus musculus
ucuggguguggggagaaguggaccaaaaugagagucaguuuacag

SEQ ID NO: 63702 - RNA, 45 nt, Mus musculus
ggagaggagguuucaccuucacgaccauacaaacacgcgcccaug

SEQ ID NO: 63703 - RNA, 45 nt, Mus musculus
acagauaaggguucuuauugagcaggucaggaguuuuaacuggga

SEQ ID NO: 63704 - RNA, 46 nt, Mus musculus
gaagaaugcagauauggaaaauggauuuuaaaagacacccccccca

SEQ ID NO: 63705 - RNA, 45 nt, Mus musculus
ccccgaaguaauuggaugcuuccuaaagauuagaaguaucaguga

SEQ ID NO: 63706 - RNA, 46 nt, Mus musculus
caggucuacacagagaaacacugucuccaaccccucuuccccccag

SEQ ID NO: 63707 - RNA, 45 nt, Mus musculus
aaaucccagcaacuacaugguggcucacagccaucuguaauggga

SEQ ID NO: 63708 - RNA, 46 nt, Mus musculus
aucgaggccugcagaaugaaucauuucauuugauuuauaggacaag

SEQ ID NO: 63709 - RNA, 42 nt, Mus musculus
cuuggccaccuggcucagccuuguggccccuuuagcccauaa

SEQ ID NO: 63710 - RNA, 44 nt, Mus musculus
gaacggggugucaccgcugaccuuaugaagucugggaucuagcg

SEQ ID NO: 63711 - RNA, 46 nt, Mus musculus
cguggaaucuauauccaagaauggaaucugugagcugacggguggg

SEQ ID NO: 63712 - RNA, 67 nt, Mus musculus
acagugccugcccugcugagguugaccccccgcuccacccagacucccuaacccaaaucauaccugg

SEQ ID NO: 63713 - RNA, 45 nt, Mus musculus
uuuccagacaacugaucucauuauauaaaauagacugugccccaa

SEQ ID NO: 63714 - RNA, 46 nt, Mus musculus
cugugcucuggguacagcuuuuggagacuuauaaaggugaugggau

SEQ ID NO: 63715 - RNA, 42 nt, Mus musculus
ggaaagcacggacacccaggagacgagagaaaaggggcccag

SEQ ID NO: 63716 - RNA, 45 nt, Mus musculus
uguacagggaccagagcgccaccuaaaggaaagaccuggcuuaga

SEQ ID NO: 63717 - RNA, 46 nt, Mus musculus
ggccaucaggcagcaugucccagacguccgggacacagugggggau

SEQ ID NO: 63718 - RNA, 26 nt, Mus musculus
caaccaggcgacuagaacgcagcgug

SEQ ID NO: 63719 - RNA, 43 nt, Mus musculus
gagaggaaauaggugagaagggcagaaauguggggggauggag

SEQ ID NO: 63720 - RNA, 64 nt, Mus musculus
guguuuguggugcguggggcuggggccuacaucuguggagaagagacggcacuuauugaaucca

SEQ ID NO: 63721 - RNA, 48 nt, Mus musculus
guggugaaugcugacgagggagagccaggcaccuguaaggaccgagag

SEQ ID NO: 63722 - RNA, 46 nt, Mus musculus
uagggcacagaagaucaacugccuugaggcuucucugaguguagac

SEQ ID NO: 63723 - RNA, 48 nt, Mus musculus
aagaacugaauugacucucaagggaagcccagggagagauguuggauu

SEQ ID NO: 63724 - RNA, 46 nt, Mus musculus
gugaaccauuccaguccacaccucuccuuuaucucagaccccaaau

SEQ ID NO: 63725 - RNA, 46 nt, Mus musculus
uucuuccucgcagcccuaccggguaucagggucuucgccccauuuc

SEQ ID NO: 63726 - RNA, 46 nt, Mus musculus
ggauauggcgauacugccgggcaaugcgucugaauaggucuuccag

SEQ ID NO: 63727 - RNA, 46 nt, Mus musculus
ugaggacacagcgaagagaucuacucucagagcauccugggagagu

SEQ ID NO: 63728 - RNA, 46 nt, Mus musculus
cuaacauuaucuuggaaugcgaagacccagccccaccauggcacag

SEQ ID NO: 63729 - RNA, 46 nt, Mus musculus
ugaaugaaaaauauuuaaaaaaaaaaaacaguaaauaagagucaga

SEQ ID NO: 63730 - RNA, 46 nt, Mus musculus
agauagguuaacagugaagagaaguaaaaauagagauaaaagagau

SEQ ID NO: 63731 - RNA, 47 nt, Mus musculus
gagaaggacaggauaaguugguaaaaaaguuaguguaaguagauaag

SEQ ID NO: 63732 - RNA, 46 nt, Mus musculus
ggucugaugucuguguucugaugucuguguucugaugucuguguuc

SEQ ID NO: 63733 - RNA, 46 nt, Mus musculus
uggagcuguccugggaaagagaaugguggagggguggaaagggcaa

SEQ ID NO: 63734 - RNA, 46 nt, Mus musculus
agagacacacagaaagggcagagagacacaaagacacagagacaaa

SEQ ID NO: 63735 - RNA, 45 nt, Mus musculus
gugaagguugggaagcacucuaggagguaggugaagauuucaaag

SEQ ID NO: 63736 - RNA, 45 nt, Mus musculus
agcacagccgaaauagaaagugcuuucaaggggaugaugcuagag

SEQ ID NO: 63737 - RNA, 42 nt, Mus musculus
ucgagagcugagaccagaagagaucgaagguaauggguucag

SEQ ID NO: 63738 - RNA, 45 nt, Mus musculus
ccuuggguggaagggguggagagggucggugagauugugggucug

SEQ ID NO: 63739 - RNA, 42 nt, Mus musculus
gucccgagguccaagaggcggggccucggcagcgggccaguc

SEQ ID NO: 63740 - RNA, 41 nt, Mus musculus
caaacugaggcugagccaggcucgucuagcaggccccggau

SEQ ID NO: 63741 - RNA, 45 nt, Mus musculus
gcuccggaguuagaauucuccggggcccggccugggguuccgccc

SEQ ID NO: 63742 - RNA, 45 nt, Mus musculus
gccccggagaauucuaacuccggagccucugccuagagaccccag

SEQ ID NO: 63743 - RNA, 44 nt, Mus musculus
ggggcucaagggaugcuguaaauaucgacaaggucugguucaga

SEQ ID NO: 63744 - RNA, 42 nt, Mus musculus
aaccagaccuugucgauauuuacagcaucccuugagccccag

SEQ ID NO: 63745 - RNA, 46 nt, Mus musculus
agagauaaacucaagguguaucuagggacugagguuaaccccugca

SEQ ID NO: 63746 - RNA, 45 nt, Mus musculus
cauauuuuuguuuuauguguauguagaugugccaugugugagcag

SEQ ID NO: 63747 - RNA, 45 nt, Mus musculus
uucaguaccagccauguggaggguauuccauaaguguuucuugag

SEQ ID NO: 63748 - RNA, 41 nt, Mus musculus
cacacauaugauuguggaggggaaggacggggggggggggg

SEQ ID NO: 63749 - RNA, 46 nt, Mus musculus
uccagugccaucuucuuugugccgggcauccugcuguuagucccag

SEQ ID NO: 63750 - RNA, 42 nt, Mus musculus
gccugaacuaucaagggaguucuaggucagucacagggccac

SEQ ID NO: 63751 - RNA, 41 nt, Mus musculus
aagugaaccaggaacccaacuuccaaagaucccagcccaga

SEQ ID NO: 63752 - RNA, 46 nt, Mus musculus
ugcuccaaggccacuuugaggaccuggcaguauccucgaccccugu

SEQ ID NO: 63753 - RNA, 47 nt, Mus musculus
ugcacaguccccgggacugagcugcggccuugcuagaccaaccaacc

SEQ ID NO: 63754 - RNA, 45 nt, Mus musculus
ggcaguuugugccacuucuuggcccguggcuacugauggauuguu

SEQ ID NO: 63755 - RNA, 42 nt, Mus musculus
gaacaccuucccgucagcuagaaagauggcccgcaugggccg

SEQ ID NO: 63756 - RNA, 44 nt, Mus musculus
guaccuuuaugguuugcgcaagcaaaaacuaaggaugugggagg

SEQ ID NO: 63757 - RNA, 46 nt, Mus musculus
ucauccuuagcucuguagugagcuuaggcucggggccagccuggaa

SEQ ID NO: 63758 - RNA, 42 nt, Mus musculus
cuccggaugcuggucaaggagcagggagaacguaucagccgc

SEQ ID NO: 63759 - RNA, 46 nt, Mus musculus
ccacagccuggggcccagguuggaagcaccaccugacuuuuggaag

SEQ ID NO: 63760 - RNA, 51 nt, Mus musculus
ggaccaucuccucgaccugcccaacccacugcccccucaccagaaaaagca

SEQ ID NO: 63761 - RNA, 46 nt, Mus musculus
ccacugaagccacuggcaguggcucccaacccccaucccauuagaa

SEQ ID NO: 63762 - RNA, 46 nt, Mus musculus
aagaagggacggggccgcucagggcguuaggagaauagaggaagag

SEQ ID NO: 63763 - RNA, 46 nt, Mus musculus
agcccaagcugcguucucccagacgccuuaacagcaguccccgcac

SEQ ID NO: 63764 - RNA, 31 nt, Mus musculus
gccuucuccagccgcccuucacugcagagaa

SEQ ID NO: 63765 - RNA, 42 nt, Mus musculus
cggcggggccauggcggccguauuugauuuagacuuggagac

SEQ ID NO: 63766 - RNA, 42 nt, Mus musculus
cuucugccccagaucguuuguacagaaaucaugcugccaugg

SEQ ID NO: 63767 - RNA, 42 nt, Mus musculus
uugcccagguucuuuuggcccaaagucuagagcccuggcaau

SEQ ID NO: 63768 - RNA, 42 nt, Mus musculus
gagauacagcacuucuccacagacuucuccacaauugccaga

SEQ ID NO: 63769 - RNA, 106 nt, Mus musculus
cagaaaaggguggaaggauggacuugucagaaggaggggcagaagcagaagcacaauggggguaggcgaauaugggugaauggggugucccgagccuugugcggua

SEQ ID NO: 63770 - RNA, 45 nt, Mus musculus
aagggcaaccacagacugucgagacuucagggcaggccaaggccc

SEQ ID NO: 63771 - RNA, 46 nt, Mus musculus
uguagacugggaaggggcaaguagggcuuaggacccagcagugaga

SEQ ID NO: 63772 - RNA, 46 nt, Mus musculus
uggcauccucaaugaaucgaugugucuccuuccaguggggcagaag

SEQ ID NO: 63773 - RNA, 83 nt, Mus musculus
caccaacaggugcucagagccaccaaggcaggggcugcagccaccaagagggagucuuguuucuauuuauaauaaaauuguug

SEQ ID NO: 63774 - RNA, 43 nt, Mus musculus
gcugggugucgggggguggggggcagugcggagcggcuggagg

SEQ ID NO: 63775 - RNA, 42 nt, Mus musculus
gccgagucuuuguugggauguugcagcggagguugggccgcu

SEQ ID NO: 63776 - RNA, 60 nt, Mus musculus
acggcccagucaucgaaugugacaucgugaaagauuaugccuuuguacacauggagcggg

SEQ ID NO: 63777 - RNA, 41 nt, Mus musculus
ugagaguuuuuacccucugcugcuuucgaggauggcuggug

SEQ ID NO: 63778 - RNA, 46 nt, Mus musculus
ccagugugggcaagaaugagagaauggcuacuguauuaggaaacag

SEQ ID NO: 63779 - RNA, 50 nt, Mus musculus
uugugguuccaauucaaacugcauucacugcugccuguggagaggagaca

SEQ ID NO: 63780 - RNA, 44 nt, Mus musculus
gagauguaggugacaugauaaugcuccauugcuuugucacuaga

SEQ ID NO: 63781 - RNA, 46 nt, Mus musculus
uaaguuacugaaauuuuacaauauuuaccagaaaaucagcccagaa

SEQ ID NO: 63782 - RNA, 60 nt, Mus musculus
uccauugaacuacagugauuuuacuugaugucugcccugcacuagucaugcuuuuagugu

SEQ ID NO: 63783 - RNA, 46 nt, Mus musculus
gugccaccaugcccggcuacaagucuacuuuuaagggggaaaaaaa

SEQ ID NO: 63784 - RNA, 28 nt, Mus musculus
uaaccaugccagucuagaaagggaacac

SEQ ID NO: 63785 - RNA, 45 nt, Mus musculus
gauacuuucauucacaccaucuaucuauugacagcaucaguggua

SEQ ID NO: 63786 - RNA, 45 nt, Mus musculus
aaacccugucccaaaacaaaaguguucuaauuuaggaccccagcu

SEQ ID NO: 63787 - RNA, 51 nt, Mus musculus
ugucucugcuuugaucucugagugcugggauuaaaggugagcaccaccaca

SEQ ID NO: 63788 - RNA, 46 nt, Mus musculus
acauaauuucucuacaguugcccaaaagaacugugagcacccauuc

SEQ ID NO: 63789 - RNA, 44 nt, Mus musculus
auaccuacuguaagaggcuauguucaaacaguucugcguaugag

SEQ ID NO: 63790 - RNA, 46 nt, Mus musculus
uauccaccauguuucuagauuucaacuccuuuucucauacgcagaa

SEQ ID NO: 63791 - RNA, 46 nt, Mus musculus
ugcuaccuuuuacugugacuguuacuaccuccaaaucaagcuagac

SEQ ID NO: 63792 - RNA, 45 nt, Mus musculus
agacucucuccuaguugugucuccacagcuuauuuccuuccccaa

SEQ ID NO: 63793 - RNA, 42 nt, Mus musculus
acaucaauuuuuuuaaaaggauugcugaaugaaggggcccag

SEQ ID NO: 63794 - RNA, 45 nt, Mus musculus
gaaugcauguacaguugucaacuagccggcuucggacugccccug

SEQ ID NO: 63795 - RNA, 46 nt, Mus musculus
ugcugccgcuuccucuuccuauuauggaagggacaggagcccacua

SEQ ID NO: 63796 - RNA, 45 nt, Mus musculus
uuuugcuuuuugauaagguccuguuuggugauuuggcuccucagu

SEQ ID NO: 63797 - RNA, 46 nt, Mus musculus
ggcaaaguacugaugcucucugagucuuaguuuuccuggaugagaa

SEQ ID NO: 63798 - RNA, 44 nt, Mus musculus
uaaaauaaggacuucauagaauacaaacaugaaaacaugcaaua

SEQ ID NO: 63799 - RNA, 41 nt, Mus musculus
ccuuugaauguucccuuauaacacaaaacuaucucagagaa

SEQ ID NO: 63800 - RNA, 42 nt, Mus musculus
acaccaagcuccucuacuuaauacagacacagggccaaaucu

SEQ ID NO: 63801 - RNA, 46 nt, Mus musculus
aagauaucagauuaacagucacuuucuuucuuuuaagaguugggau

SEQ ID NO: 63802 - RNA, 46 nt, Mus musculus
aauagguacagcuaggaaccuacuuaagcuaaaugcugcucaagau

SEQ ID NO: 63803 - RNA, 42 nt, Mus musculus
ggucauauaugagaacuugguccucgcgguccccuuugccag

SEQ ID NO: 63804 - RNA, 46 nt, Mus musculus
uaagaaaagcaagauuaagaggggcuucuacuguacaggaaaaggg

SEQ ID NO: 63805 - RNA, 55 nt, Mus musculus
uugccacuacauggucauuuuaaagggaaaggagaugcugcaggaaggcagggag

SEQ ID NO: 63806 - RNA, 46 nt, Mus musculus
auuaguguacacacacccacacacauucagguacucauacccuuag

SEQ ID NO: 63807 - RNA, 46 nt, Mus musculus
gguacgccaccaguauggguacugggaguugaaccuguccccucug

SEQ ID NO: 63808 - RNA, 42 nt, Mus musculus
uagggccauccuggggauggggcaccacaggaagggagagag

SEQ ID NO: 63809 - RNA, 45 nt, Mus musculus
agcugcccgcagguaaucauuauaggagcccgaauagcgugcgua

SEQ ID NO: 63810 - RNA, 42 nt, Mus musculus
augagacaguugagggcagggcuccagguaggccuaggggag

SEQ ID NO: 63811 - RNA, 46 nt, Mus musculus
cccacugaccugaagaacccagguugguuccuugaccuggauagua

SEQ ID NO: 63812 - RNA, 59 nt, Mus musculus
gggacccuacuuucguccgucguucuguugauaaaccaaggucuuuuugugcagggccc

SEQ ID NO: 63813 - RNA, 50 nt, Mus musculus
gaaggauccuuaaacucacuccuuuguucugguuuuggugggauggaugu

SEQ ID NO: 63814 - RNA, 41 nt, Mus musculus
cagccuucugccacccuggcagcuccuuaccgcacucaguc

SEQ ID NO: 63815 - RNA, 48 nt, Mus musculus
uauggagcccaggcagcgucuuacagugcccagcccucagccucuuac

SEQ ID NO: 63816 - RNA, 41 nt, Mus musculus
gcugguuaccauaggaagcaagggaggagcccugagcccca

SEQ ID NO: 63817 - RNA, 46 nt, Mus musculus
agcuuccucgcuuggcccauaugguggaguccagcccucagccuca

SEQ ID NO: 63818 - RNA, 50 nt, Mus musculus
ucagcccauggcagcucaggcagcuucuuaccgugcucagcccucugucu

SEQ ID NO: 63819 - RNA, 96 nt, Mus musculus
cuuuggucgcgaccgcagcccccugcgccguucaccuccucgagccucuuauguggcgccucugacggcccagccagccaccuaccgggcccaacc

SEQ ID NO: 63820 - RNA, 47 nt, Mus musculus
ggaacugguggcuucucugccaccuucgacuaccagcaggcuuuugg

SEQ ID NO: 63821 - RNA, 46 nt, Mus musculus
cucugucugcugcuuuaucagacuacgcguuuguucacauggagaa

SEQ ID NO: 63822 - RNA, 41 nt, Mus musculus
ggaaaguaaugugaaaggggaagguuacacuggagggauuu

SEQ ID NO: 63823 - RNA, 46 nt, Mus musculus
acuucucaggauaaagaccgaugaaacaaagggccauggaagaguu

SEQ ID NO: 63824 - RNA, 46 nt, Mus musculus
cuuuaaaguuuuuuuccuauguuguaagugauuagaguucucagau

SEQ ID NO: 63825 - RNA, 46 nt, Mus musculus
cagagauuggauccuagcuguugaaucccuuaaaguagccacaggu

SEQ ID NO: 63826 - RNA, 46 nt, Mus musculus
guauccgguagggaggcacagaugggcaauggucuccuaagaggag

SEQ ID NO: 63827 - RNA, 85 nt, Mus musculus
gaagcccaguggcgauugacugucuuugcaagaaauaugauacgagcacagaagauucaggcccuggaccgcggcacagcucagu

SEQ ID NO: 63828 - RNA, 45 nt, Mus musculus
gcaggaagaugaguccagccaaguccauaaaugaucuugccccgc

SEQ ID NO: 63829 - RNA, 46 nt, Mus musculus
ccguggugaacugagaguugcuggcucaggaccuauguugucacag

SEQ ID NO: 63830 - RNA, 41 nt, Mus musculus
ggaggcuuaugagugccacguguuaucuauggcaggcccca

SEQ ID NO: 63831 - RNA, 43 nt, Mus musculus
acagguuuccccauggcauggggacaguggaguacaggcagca

SEQ ID NO: 63832 - RNA, 46 nt, Mus musculus
ucuccagccagguccaguagcucauguccuuaaucccagcacucag

SEQ ID NO: 63833 - RNA, 40 nt, Mus musculus
gagggagagagagagagagagagagagagagggagauugg

SEQ ID NO: 63834 - RNA, 46 nt, Mus musculus
cuccaucagcuucucauuuuccugguucacagcuaagaccuugcag

SEQ ID NO: 63835 - RNA, 48 nt, Mus musculus
cuaaaaaaacauaagaccuugaaaagaaagaaggggauagaguaggag

SEQ ID NO: 63836 - RNA, 45 nt, Mus musculus
ugccaccucgaaggcaguguucagguuuccaauugggucauccua

SEQ ID NO: 63837 - RNA, 45 nt, Mus musculus
uagguggaauuuucuugauguaggcucacauuggaucagagcagu

SEQ ID NO: 63838 - RNA, 46 nt, Mus musculus
ucaaaucccagcaaccacaugguagcucacaaccaucuuuaucagg

SEQ ID NO: 63839 - RNA, 42 nt, Mus musculus
aagagacugccagcuguuguggugggaacacacagacuguga

SEQ ID NO: 63840 - RNA, 46 nt, Mus musculus
gggccucaauuuccuccauugucaagccaguagagggauccaccca

SEQ ID NO: 63841 - RNA, 45 nt, Mus musculus
uggccagggagauugcagaacaagguuaacaggaacaguggaaag

SEQ ID NO: 63842 - RNA, 42 nt, Mus musculus
acagugggauaagcuaugauaacugcaggaaagcacccagcc

SEQ ID NO: 63843 - RNA, 44 nt, Mus musculus
agagcuggguuuaucuagacagccuggcuugugccaccccagga

SEQ ID NO: 63844 - RNA, 41 nt, Mus musculus
cugaagggaggggcuccaaaaacagcaggaagugccagagu

SEQ ID NO: 63845 - RNA, 45 nt, Mus musculus
acaggcuacuggggacggguuuccaauacccucaauggaucgcag

SEQ ID NO: 63846 - RNA, 45 nt, Mus musculus
uguucuuguagaaagugcuacaccguaaagacaaguuuccucaug

SEQ ID NO: 63847 - RNA, 46 nt, Mus musculus
uugucccaucccugcacccagaauccugacaguggccacauagcag

SEQ ID NO: 63848 - RNA, 44 nt, Mus musculus
gaugcccgcaggaaugccagagccagcaaaggugaggacgucca

SEQ ID NO: 63849 - RNA, 46 nt, Mus musculus
uaagcucuggauuuagcaacucuauauccagccucucuauacagaa

SEQ ID NO: 63850 - RNA, 42 nt, Mus musculus
accaagcacugggcacugggaaagacugacagaaacacacag

SEQ ID NO: 63851 - RNA, 42 nt, Mus musculus
aagccagccgcaccucauagugggacuucccuuccuggccaa

SEQ ID NO: 63852 - RNA, 46 nt, Mus musculus
ugggggaaaaaaauagagcaggguuugaaggauggugagaccaaag

SEQ ID NO: 63853 - RNA, 24 nt, Mus musculus
cagaagaucaaauuaaugucacug

SEQ ID NO: 63854 - RNA, 46 nt, Mus musculus
cauuccaugcaguucucuguggugccaaguggcuucaguucaagag

SEQ ID NO: 63855 - RNA, 45 nt, Mus musculus
caagaagucaggcacacgugaccaugcacacgugaccucagcacu

SEQ ID NO: 63856 - RNA, 46 nt, Mus musculus
ucaucucccaguguggaaaggcaaggaacugaugcugggggccugg

SEQ ID NO: 63857 - RNA, 46 nt, Mus musculus
uggcacacaccuuuaauuccaguacucaggaggcagaggcaggugg

SEQ ID NO: 63858 - RNA, 45 nt, Mus musculus
gggccaaguguucccugcauaccucagcuguaacagcaggugcua

SEQ ID NO: 63859 - RNA, 46 nt, Mus musculus
uucuuuuuguugauuuugggggcaaccaugguugcucccucgugag

SEQ ID NO: 63860 - RNA, 45 nt, Mus musculus
guggcuucccuccuccucuuaggacagagagcugccuucacccag

SEQ ID NO: 63861 - RNA, 46 nt, Mus musculus
caggacaagacaggaugcaagagcccuggcuccccgggugcuggag

SEQ ID NO: 63862 - RNA, 45 nt, Mus musculus
uccuuucccccaaauggugagguugcugggauaccaaggagggag

SEQ ID NO: 63863 - RNA, 42 nt, Mus musculus
gccuagacuggcacagcauacccaagaacuccuacggcagag

SEQ ID NO: 63864 - RNA, 41 nt, Mus musculus
ucuacugcgccccgggacugccgcggcgggaugggcccggc

SEQ ID NO: 63865 - RNA, 46 nt, Mus musculus
gagcgcaaaguucaauuaauucuuaaauuccguaauuggucuuuag

SEQ ID NO: 63866 - RNA, 45 nt, Mus musculus
uaaaaauggcagggaugugugcuguagauuuguuuuucugucuuu

SEQ ID NO: 63867 - RNA, 47 nt, Mus musculus
ugggcagcccacuguuucuuacuuuuugaaggcagcugcugggaucg

SEQ ID NO: 63868 - RNA, 63 nt, Mus musculus
gcaggccuggugaguuugaagcacguauaugagauugccugugucaaagcuaaggaugaugcu

SEQ ID NO: 63869 - RNA, 46 nt, Mus musculus
uaugcauauuaagcuucauugugacauuuucauacaugucuagcag

SEQ ID NO: 63870 - RNA, 49 nt, Mus musculus
uugaggacucugagggaggugacauggaaacugcccaggaaaaggaggg

SEQ ID NO: 63871 - RNA, 46 nt, Mus musculus
uuagagcacaguuuuccuggaugguuuaaauccuuaaaguauguag

SEQ ID NO: 63872 - RNA, 46 nt, Mus musculus
agaggccacagguuagguaggacuuuaagacagagucaaggcagag

SEQ ID NO: 63873 - RNA, 32 nt, Mus musculus
agcuguguuuuuggcugcucagaaagaggcag

SEQ ID NO: 63874 - RNA, 45 nt, Mus musculus
uugccugcauauaugugagugcacugugugcaugcuuggugucug

SEQ ID NO: 63875 - RNA, 46 nt, Mus musculus
cacauccaccugacuuuggccugcccuauaggcccaacuucccaca

SEQ ID NO: 63876 - RNA, 43 nt, Mus musculus
gcucuccauccugugggaaguugggccuauagggcaggccaaa

SEQ ID NO: 63877 - RNA, 39 nt, Mus musculus
gguagugugggucgaguggcagagaucaccaugggccgu

SEQ ID NO: 63878 - RNA, 49 nt, Mus musculus
gccacucgacccacacuaccuucugcccacaagaccucuguuauuucag

SEQ ID NO: 63879 - RNA, 80 nt, Mus musculus
uaauuggccuugauuuuggggaucuggugcucagagaacacagcuggagguguggcaggggccauggcagguggguggac

SEQ ID NO: 63880 - RNA, 46 nt, Mus musculus
accucggccacucacccagcacggucuccuccguaccagcccccca

SEQ ID NO: 63881 - RNA, 72 nt, Mus musculus
aucuggagacauaggggccugguggggagggaagacuuggggauaguugguugagauaauggggggcuggua

SEQ ID NO: 63882 - RNA, 75 nt, Mus musculus
uugaugggcuuuagaagugguauccccaggaucaaggugaggggggacuggaggcaaauaagugauagugugggu

SEQ ID NO: 63883 - RNA, 107 nt, Mus musculus
ugauccuggggauaccacuucuaaagcccaucaacacccuuugcucccagaugcuccagguaucagaacccaggccccccagcuuucugucucagcucuccagcccc

SEQ ID NO: 63884 - RNA, 48 nt, Mus musculus
gggagaagaagggaaggcugggggcugguuggcagcaggcacaggagu

SEQ ID NO: 63885 - RNA, 49 nt, Mus musculus
uccccuccccccucagaggcccacuaaccagaccucaucuaucagcccu

SEQ ID NO: 63886 - RNA, 45 nt, Mus musculus
uuugggacugggaacuccuucccuugggacuagaggggcucugga

SEQ ID NO: 63887 - RNA, 46 nt, Mus musculus
gccacagcugcccucggugcccuccacagcagcuccaacagcccug

SEQ ID NO: 63888 - RNA, 46 nt, Mus musculus
accuguagaaccagugugugauggggugcagaugccccuuuguggg

SEQ ID NO: 63889 - RNA, 88 nt, Mus musculus
uuuggacacauggcugagaccacaccaaggacuuaugggggcugcccagcugacagaggagguucuguucuuugagcccagcauccau

SEQ ID NO: 63890 - RNA, 46 nt, Mus musculus
cucaaggggugggugcugggaucuucuccaauaaauggggugccaa

SEQ ID NO: 63891 - RNA, 46 nt, Mus musculus
cuggggcuggguauccgcccaguuggcuggaauaaccaccacuugu

SEQ ID NO: 63892 - RNA, 45 nt, Mus musculus
agagaggguugagaucugaugaucagucagguuauccgcgagugg

SEQ ID NO: 63893 - RNA, 42 nt, Mus musculus
ggccugugggaggacccgaccggcccgcggggagggggcgcg

SEQ ID NO: 63894 - RNA, 60 nt, Mus musculus
gccgggagacccagucaagccggacagugaggagcgguugcaggucggccuagaggagga

SEQ ID NO: 63895 - RNA, 42 nt, Mus musculus
cgagugccuuuggauugugguggugucauuggggggccucag

SEQ ID NO: 63896 - RNA, 42 nt, Mus musculus
acggcuguccuggggcugagcuuuccguuucuuuugcuguag

SEQ ID NO: 63897 - RNA, 61 nt, Mus musculus
ccucuucgaucuucuucuuccucagcucaaugaguucaggggucuccaucccagcuggcac

SEQ ID NO: 63898 - RNA, 49 nt, Mus musculus
ggaugagaauccuccgggagugaugaggccgcugugcaggaagaagcaa

SEQ ID NO: 63899 - RNA, 45 nt, Mus musculus
acucacuguccaccucuggccggccuccaggugcacaggcaccag

SEQ ID NO: 63900 - RNA, 42 nt, Mus musculus
ugggguagggaggagguguggguaggauguagaguaguugga

SEQ ID NO: 63901 - RNA, 46 nt, Mus musculus
auaaagguccccauggauggugaguuucggcuuggucugccacuug

SEQ ID NO: 63902 - RNA, 46 nt, Mus musculus
ugaaagccucaaaaauccucuugaagaagaugaaauugggcucgua

SEQ ID NO: 63903 - RNA, 45 nt, Mus musculus
cuuuccuuuccuuuccuuuccccuuucccuuucccuuuccuuucc

SEQ ID NO: 63904 - RNA, 45 nt, Mus musculus
uggagccugggcugcgcaggagcuucaggccagauuggcagagau

SEQ ID NO: 63905 - RNA, 42 nt, Mus musculus
ucaggaaaguugguaacugcugccacggaacugcagggggag

SEQ ID NO: 63906 - RNA, 35 nt, Mus musculus
cuuggcauuggcaccacauguauccuucagccauu

SEQ ID NO: 63907 - RNA, 42 nt, Mus musculus
ccgcccugaggccccgccccgcuccgagcgccccgcccccuc

SEQ ID NO: 63908 - RNA, 24 nt, Mus musculus
ggcaacccuuaagcugugggcacu

SEQ ID NO: 63909 - RNA, 46 nt, Mus musculus
guggcaggugugguacgggcaucaaauaccagccagggguccauau

SEQ ID NO: 63910 - RNA, 45 nt, Mus musculus
ucuucucuuccuugucccaagaaggcugagcuccuuagcccugag

SEQ ID NO: 63911 - RNA, 45 nt, Mus musculus
agugguggggagcagcaucaaagagggccgccgagggccccgccc

SEQ ID NO: 63912 - RNA, 42 nt, Mus musculus
ucuguccuggccaccucuguccccacuauacuuagccugcau

SEQ ID NO: 63913 - RNA, 43 nt, Mus musculus
cacguucuguguggucggggaaccuauguacccgguggccaag

SEQ ID NO: 63914 - RNA, 42 nt, Mus musculus
agcuugaacccaguuuucucucccagaacgcugagcccccac

SEQ ID NO: 63915 - RNA, 45 nt, Mus musculus
gugagugggcagugguggcucacaccuuaaauuucagcacugggg

SEQ ID NO: 63916 - RNA, 41 nt, Mus musculus
gccucauugucucccuucuucuaucccaaccuagaucagcc

SEQ ID NO: 63917 - RNA, 45 nt, Mus musculus
gagaccgacaaauuggaggaugagaaaucggggcugcagcgagag

SEQ ID NO: 63918 - RNA, 42 nt, Mus musculus
gguucuggcagcaccagcggugcuagcagcccaccagccccc

SEQ ID NO: 63919 - RNA, 45 nt, Mus musculus
auugauccagcaggccuggaccauacccuugccccaaaccagcag

SEQ ID NO: 63920 - RNA, 46 nt, Mus musculus
aaaaagcugcaguaccugagcuuuggggacuuugccuucugugcag

SEQ ID NO: 63921 - RNA, 46 nt, Mus musculus
ccuugcccuccaggagacucaggcuucucuguugaacugcccugug

SEQ ID NO: 63922 - RNA, 45 nt, Mus musculus
aagcuagaagacucauaagguuuauggaaacuaaauaguccucag

SEQ ID NO: 63923 - RNA, 48 nt, Mus musculus
cuaccagugcaccugcccugaugguuaccgaaaaauuggacccgaaug

SEQ ID NO: 63924 - RNA, 41 nt, Mus musculus
uuuguaaaacaggacauuaauauuccuccagguuggcagaa

SEQ ID NO: 63925 - RNA, 36 nt, Mus musculus
cucuguacugagacucacggucuuugugggagccua

SEQ ID NO: 63926 - RNA, 39 nt, Mus musculus
ucugcuuaaaggaacuaugaugugaaggacaauaaaggg

SEQ ID NO: 63927 - RNA, 44 nt, Mus musculus
cacagucugccccacaucuccuaccaggaucuccuugcccuccu

SEQ ID NO: 63928 - RNA, 52 nt, Mus musculus
uuggucucauagguugcaucauagagugcauagcggcaguccuugucuggca

SEQ ID NO: 63929 - RNA, 83 nt, Mus musculus
accugucagcuucuucuugauggcauccuuggagcuggcauagaucauuuugcucuugaggggugcauucucgggggcccuaa

SEQ ID NO: 63930 - RNA, 50 nt, Mus musculus
guuagcuuguaauucaugcuugauuccuacagggugaaaagagagcagug

SEQ ID NO: 63931 - RNA, 46 nt, Mus musculus
ugcaacacccaagagcaggucuggggcuguuaagaugcuccaggca

SEQ ID NO: 63932 - RNA, 53 nt, Mus musculus
ggauguuuggcaacuggggugaagggauagcccucccccugcugggauccccc

SEQ ID NO: 63933 - RNA, 41 nt, Mus musculus
cggaguaggggugucguuaaaaaaaaaaauacaggcucccc

SEQ ID NO: 63934 - RNA, 45 nt, Mus musculus
ggcugugagccaccaugugguugcugggauuugaacuucagaccu

SEQ ID NO: 63935 - RNA, 45 nt, Mus musculus
agacuacaaaaacaucuucccagaccugcuuaaacuggcugcaga

SEQ ID NO: 63936 - RNA, 41 nt, Mus musculus
aucuucaguuccuccuggcccggcgcgguucgcucugguaa

SEQ ID NO: 63937 - RNA, 41 nt, Mus musculus
guagggguguugaucugaucuaauuagcuuggaguggccga

SEQ ID NO: 63938 - RNA, 42 nt, Mus musculus
gugccaccccgcccgggccgcgaggccaccucacccgcagcg

SEQ ID NO: 63939 - RNA, 42 nt, Mus musculus
gcccggaccuguugggccaguuuuaugucaucgcccacagag

SEQ ID NO: 63940 - RNA, 45 nt, Mus musculus
guuacuggucccaaaccaucuuggagauccugauggggcugaagu

SEQ ID NO: 63941 - RNA, 41 nt, Mus musculus
guagaagggaagaccggaacuccugagaaaccccugucaga

SEQ ID NO: 63942 - RNA, 42 nt, Mus musculus
aagugagaggcaggcaggcagcccagcuccacagcccuucuu

SEQ ID NO: 63943 - RNA, 42 nt, Mus musculus
ucaccagcaaccccagugcccagcgagacagccccagccucg

SEQ ID NO: 63944 - RNA, 42 nt, Mus musculus
ggggccggaaguggcaguggagggagggaagauggcggaggu

SEQ ID NO: 63945 - RNA, 45 nt, Mus musculus
ucagcgggcaguauuccuggcgagagaagcacagauaccaccaag

SEQ ID NO: 63946 - RNA, 44 nt, Mus musculus
agauggaugguuggauagaugagagagagagagagggagggaga

SEQ ID NO: 63947 - RNA, 45 nt, Mus musculus
ugggaggauccacaaguguaguuuucauucuaguggccuaguccu

SEQ ID NO: 63948 - RNA, 45 nt, Mus musculus
gagcaagcccaaaagauggcccuguuaagcuuagucauaucugag

SEQ ID NO: 63949 - RNA, 45 nt, Mus musculus
ggcaaacuguagagucaggagggcaggcuagaugcucagccacaa

SEQ ID NO: 63950 - RNA, 25 nt, Mus musculus
gccugcuccuggccucuaagcaucu

SEQ ID NO: 63951 - RNA, 41 nt, Mus musculus
cagugagacccuggaggaugaguggcaguccaucucagaga

SEQ ID NO: 63952 - RNA, 46 nt, Mus musculus
ccauccugcccagaaccuugucucugcggaauuccaucaguaagag

SEQ ID NO: 63953 - RNA, 46 nt, Mus musculus
cugcccaacaccacuccagaccuccuccuugucaccacugccaacc

SEQ ID NO: 63954 - RNA, 24 nt, Mus musculus
agucaggaugccuggagcucucuu

SEQ ID NO: 63955 - RNA, 46 nt, Mus musculus
ggggcacaaagcucaccucucauuugccuaccuuuaacccccagcu

SEQ ID NO: 63956 - RNA, 42 nt, Mus musculus
acagaacaccagaacuucuuugggcuggaugaggcgcugggu

SEQ ID NO: 63957 - RNA, 43 nt, Mus musculus
gggagugcccuucccucuggcucaucuucauaacccuccagga

SEQ ID NO: 63958 - RNA, 46 nt, Mus musculus
uaggucccuggggccuuggguguuucagccuuacauccugugagac

SEQ ID NO: 63959 - RNA, 46 nt, Mus musculus
cauggucccuacuucuccuuucuaggaggccugggccaacuugggg

SEQ ID NO: 63960 - RNA, 46 nt, Mus musculus
uugugaugcucgauggagaccuugggccugggaggucaggggccac

SEQ ID NO: 63961 - RNA, 42 nt, Mus musculus
acacacacacacacacacacacacacacagagugagcgagca

SEQ ID NO: 63962 - RNA, 45 nt, Mus musculus
caaacaggcccuggaucucgcguuuccagccuuccugcauggaau

SEQ ID NO: 63963 - RNA, 49 nt, Mus musculus
uaaggguccaggagugggugaacuaugggcaucagguguuguuugugag

SEQ ID NO: 63964 - RNA, 41 nt, Mus musculus
uccauggguuacaaaggccaaagcuccuaggagucagcugu

SEQ ID NO: 63965 - RNA, 45 nt, Mus musculus
cagcaugcacgagagacagcauuuagagccagagaagcagggagc

SEQ ID NO: 63966 - RNA, 44 nt, Mus musculus
gcaggaacagggacagauagaugggagggccgcugagguggaga

SEQ ID NO: 63967 - RNA, 24 nt, Mus musculus
ugcaggauggccuagugguuaaga

SEQ ID NO: 63968 - RNA, 42 nt, Mus musculus
cguaccugacaagcucaucgucaugacguaccugugccagau

SEQ ID NO: 63969 - RNA, 46 nt, Mus musculus
aaaguuuuggggauaguagaggccaaaucuuggacuuuggggcagc

SEQ ID NO: 63970 - RNA, 62 nt, Mus musculus
cagacuuggaggcuaagauggaagagucugggaggaaaauggagauuugggagaccccagag

SEQ ID NO: 63971 - RNA, 50 nt, Mus musculus
cagaagaaggugggaggcacugggauaucacagagagagguuagagaggc

SEQ ID NO: 63972 - RNA, 83 nt, Mus musculus
agaucccuggagacagaggaaggagauuuagggguucuagagguagauacugggauagcagaggcuaagaucuuagggauacc

SEQ ID NO: 63973 - RNA, 61 nt, Mus musculus
gauaucagcagguuguggaguacuuuugauagaagcaaagauaccagaauccaagauugac

SEQ ID NO: 63974 - RNA, 46 nt, Mus musculus
cguucagacagucccaucagauggccagggggugaaaucuagagau

SEQ ID NO: 63975 - RNA, 42 nt, Mus musculus
uggcccuggggcuccugagguccggacucgaggcccccaguc

SEQ ID NO: 63976 - RNA, 86 nt, Mus musculus
gaugacaugcagagucuggccagccucaugagugugaagccuagugacgugggaaaccuggaugacuuugcugagagugaugagga

SEQ ID NO: 63977 - RNA, 42 nt, Mus musculus
gggcaagagggagucccaagccugagaagagauccggcagag

SEQ ID NO: 63978 - RNA, 42 nt, Mus musculus
ccuuagucuacagugccugcucuuuuaccgguaccaccucac

SEQ ID NO: 63979 - RNA, 45 nt, Mus musculus
cugucugaugacgaggagccuccugaugccagccugcccccagac

SEQ ID NO: 63980 - RNA, 46 nt, Mus musculus
gcaacagcaccaggcaggaaacagaguggagcauuggggauaagag

SEQ ID NO: 63981 - RNA, 42 nt, Mus musculus
ggaggugcucaguuugaagagggagcguacaagggguuggag

SEQ ID NO: 63982 - RNA, 49 nt, Mus musculus
caaagaagguucuggaacauggccucaaacguaagacagggaguagaaa

SEQ ID NO: 63983 - RNA, 42 nt, Mus musculus
uucaggugcaccgcaucgaggggccgaacgcugaaggcccag

SEQ ID NO: 63984 - RNA, 42 nt, Mus musculus
gcccggcugggaaaggguaccauauccucaccucccaccaga

SEQ ID NO: 63985 - RNA, 81 nt, Mus musculus
gaaagcgacuucucccucuuccugcaccccgacgggccacccaaaccccagcagcuuccugaaagccccagccgagcacca

SEQ ID NO: 63986 - RNA, 47 nt, Mus musculus
gugagugaggagcgaucggugcagcagagccaccccacuaccaccac

SEQ ID NO: 63987 - RNA, 43 nt, Mus musculus
uccccaccuaccuuccaccgguuccugccagacuugcccccau

SEQ ID NO: 63988 - RNA, 46 nt, Mus musculus
guguaggaaguaugaaucauugguggaggagggagaaaccacagag

SEQ ID NO: 63989 - RNA, 45 nt, Mus musculus
agcagcaugggaagagagggucccucuuguuuggugaguguggau

SEQ ID NO: 63990 - RNA, 45 nt, Mus musculus
ucuguccccagggucaucgguuggugggcgguaggaagugccaag

SEQ ID NO: 63991 - RNA, 46 nt, Mus musculus
gaaugcuguugcucucugggagcugguuggggagaccacugcgaaa

SEQ ID NO: 63992 - RNA, 45 nt, Mus musculus
agccgaauuucacagccuguguccugaugggaaaggcuacacuca

SEQ ID NO: 63993 - RNA, 45 nt, Mus musculus
gcagaguacagucccgcacagcgccagugucugagcccggaggag

SEQ ID NO: 63994 - RNA, 45 nt, Mus musculus
cacgccccagagagacgugaagugugcuggggccagcgaggagag

SEQ ID NO: 63995 - RNA, 46 nt, Mus musculus
gacccaaggauccuucagggcccacaaaucuccuucccacacccca

SEQ ID NO: 63996 - RNA, 46 nt, Mus musculus
ugucugcuuuauccccaagggugauuccuagaaacuucgacaucag

SEQ ID NO: 63997 - RNA, 46 nt, Mus musculus
caacuacaauuaaguaccauuuuggucaaaguucuagcaaucuggg

SEQ ID NO: 63998 - RNA, 46 nt, Mus musculus
ggagcacagcagucaagugcaggugcuaaaaucagacuccauuuag

SEQ ID NO: 63999 - RNA, 44 nt, Mus musculus
cacauauaagugcucugugggccacagagauggcucagccccaa

SEQ ID NO: 64000 - RNA, 46 nt, Mus musculus
cucccagcuuggaaacacuggcaaguucagauguuggccugcuaca

SEQ ID NO: 64001 - RNA, 44 nt, Mus musculus
gcaccugcccacccccuacaagcugacuucaacgauggccuccu

SEQ ID NO: 64002 - RNA, 45 nt, Mus musculus
ucacgucccgcccucugugaaucaacaccaucccuccccgcccag

SEQ ID NO: 64003 - RNA, 46 nt, Mus musculus
caggggcaagguuuuaagugaccccuuaaccucagagugaggggca

SEQ ID NO: 64004 - RNA, 45 nt, Mus musculus
ucugagcccugaacuggccacugccuccccaccacuagccccaag

SEQ ID NO: 64005 - RNA, 46 nt, Mus musculus
cagguucagucucacuguuuucagaggaagggagccacaugucuuu

SEQ ID NO: 64006 - RNA, 42 nt, Mus musculus
guaaccacacguguccugugugcccaugguauagccucaggu

SEQ ID NO: 64007 - RNA, 44 nt, Mus musculus
uccuucggagagagguggcuugagccgcuguggcuggccucagg

SEQ ID NO: 64008 - RNA, 42 nt, Mus musculus
guggguagagcugugcuccagcccuuucuacagccugccucu

SEQ ID NO: 64009 - RNA, 46 nt, Mus musculus
auacagcuguuagcuuuguacuugggagguaaaggcaagaucagaa

SEQ ID NO: 64010 - RNA, 45 nt, Mus musculus
gcgugguguguagccggauucagcaucucucuaccauugacuaug

SEQ ID NO: 64011 - RNA, 46 nt, Mus musculus
gaugagcggccucauugaguacugcauugagcugagccaggcugcc

SEQ ID NO: 64012 - RNA, 46 nt, Mus musculus
gcagagcccuaggcugcugucauggugcccagcugugcugucagau

SEQ ID NO: 64013 - RNA, 42 nt, Mus musculus
ucauccccaggcuccugaccugugagcacacaggggucuaau

SEQ ID NO: 64014 - RNA, 45 nt, Mus musculus
ucaggagaggaugcggugaaugguaacccugcacuuuagguagau

SEQ ID NO: 64015 - RNA, 45 nt, Mus musculus
ccggccugcaugcuccccaugcuuuugcucuuugugcuuggagag

SEQ ID NO: 64016 - RNA, 46 nt, Mus musculus
gcacuugccaaagcuaaggaagcaaacccugagucucaacugaggu

SEQ ID NO: 64017 - RNA, 45 nt, Mus musculus
uuuugagacagccuuugucugguuguccugaaacuuacuccaaag

SEQ ID NO: 64018 - RNA, 45 nt, Mus musculus
ucucccucuggucuucaaaaaaauugaauacacuaaccugcagau

SEQ ID NO: 64019 - RNA, 46 nt, Mus musculus
ugcgcuuucaggagcugucgugggaucacacuuccccugaggagga

SEQ ID NO: 64020 - RNA, 44 nt, Mus musculus
gucuuacgacagcuucucuuuccucaucuccugcaccucagagc

SEQ ID NO: 64021 - RNA, 45 nt, Mus musculus
ucaguuccgaaggaauguuuuuuucccaaggcgccgagagcucca

SEQ ID NO: 64022 - RNA, 46 nt, Mus musculus
gcccccggcaucccacauacacagcaccucccuccccugggcagau

SEQ ID NO: 64023 - RNA, 46 nt, Mus musculus
uccucauuccucuaaaaccuauggcaucaaauggaagcggccuacg

SEQ ID NO: 64024 - RNA, 45 nt, Mus musculus
guguugcgggggagauaagggagagccuagagggagcgggguaag

SEQ ID NO: 64025 - RNA, 45 nt, Mus musculus
caaagaguaagggccucugggccaccaggucaagcgggaucagga

SEQ ID NO: 64026 - RNA, 46 nt, Mus musculus
gaacugguguuugagguaguaggcaugagccaccacugccccgguu

SEQ ID NO: 64027 - RNA, 44 nt, Mus musculus
cucagcugcccgaagaacaccuugcccaucaccuugcccaagag

SEQ ID NO: 64028 - RNA, 27 nt, Mus musculus
gaugacuucagcccucgcuuuguggcg

SEQ ID NO: 64029 - RNA, 42 nt, Mus musculus
ccaccucuucaaugagucucacuuacagacgaugcggcagug

SEQ ID NO: 64030 - RNA, 45 nt, Mus musculus
gacgaagaggaaguccaggauacccaggagaaacaugagagcugu

SEQ ID NO: 64031 - RNA, 42 nt, Mus musculus
uguacauggccuucaugaccaucaugaucaaggugcacacau

SEQ ID NO: 64032 - RNA, 46 nt, Mus musculus
ucaccaccaccuccugagccugcugaccaaggaccaccccccgccc

SEQ ID NO: 64033 - RNA, 41 nt, Mus musculus
ugagaaauagacaaaugaugagugguaagcagggccugcca

SEQ ID NO: 64034 - RNA, 45 nt, Mus musculus
uguucccacuguggcccccaaugggucccuuuccaccugucccgc

SEQ ID NO: 64035 - RNA, 46 nt, Mus musculus
cagcaccuggaggcccggcugcagagucugcgcaacauacacacac

SEQ ID NO: 64036 - RNA, 42 nt, Mus musculus
cuagucacgugacaugugcagaggccugguaggaagccggag

SEQ ID NO: 64037 - RNA, 42 nt, Mus musculus
cucuacagugguaucugcugccccuuccaccagcgcccccag

SEQ ID NO: 64038 - RNA, 46 nt, Mus musculus
aggaauugguggggaagcucccggagacgggguaggagccucagag

SEQ ID NO: 64039 - RNA, 46 nt, Mus musculus
agggccaggucugggcagugucagugggcaacaggggacuccagcu

SEQ ID NO: 64040 - RNA, 46 nt, Mus musculus
gagaaggcuuaccagagauucagcuucuacuuugaaggccccaguu

SEQ ID NO: 64041 - RNA, 46 nt, Mus musculus
ccacccuccugccaagacugguaccagucucuuuccucuagcccag

SEQ ID NO: 64042 - RNA, 45 nt, Mus musculus
ccacagguuggagguggccugccuuggguucuggggagcaguggu

SEQ ID NO: 64043 - RNA, 25 nt, Mus musculus
ucugaauuugaaugcuugaccccag

SEQ ID NO: 64044 - RNA, 42 nt, Mus musculus
ugugaagacaaaaugcagaccuuucacuucuggcgcccaccu

SEQ ID NO: 64045 - RNA, 34 nt, Mus musculus
acaguacagcaaaaagacauggacgggaguggau

SEQ ID NO: 64046 - RNA, 89 nt, Mus musculus
uccccugucaaucaaaagcugauggccagugagcugaggcaggacuagaaggcgggacaucugacagggagauucacccuggacuugga

SEQ ID NO: 64047 - RNA, 77 nt, Mus musculus
cccgcggacgccgcugcugcuaccgcgaagauggagucaagaaagaggaagaagugggggcgcgcacguccucaccg

SEQ ID NO: 64048 - RNA, 42 nt, Mus musculus
uacgaucuaaagucccuagaaggcacaaguauacuaucagag

SEQ ID NO: 64049 - RNA, 45 nt, Mus musculus
gcuguaugugggugaugcccucugguaugaggugagacuggauug

SEQ ID NO: 64050 - RNA, 45 nt, Mus musculus
gucaucucuccagccccaaacucugacuuauaaagaagaugacaa

SEQ ID NO: 64051 - RNA, 46 nt, Mus musculus
uuaauagaacaagaggguuuuuaauauaaaaucuugagagagagag

SEQ ID NO: 64052 - RNA, 42 nt, Mus musculus
gcagaagaggagggagugcugacagcagcacagcggggaguu

SEQ ID NO: 64053 - RNA, 46 nt, Mus musculus
ccuugaucgacuuuugugaaccauuguuccccggcaaagcagagau

SEQ ID NO: 64054 - RNA, 46 nt, Mus musculus
cacuaacccagagagcccuaggaccacaucugagcagaauuaaaga

SEQ ID NO: 64055 - RNA, 46 nt, Mus musculus
cuuuaauagcaaaaugcuccuucagcaugcagaaacuggguuaggu

SEQ ID NO: 64056 - RNA, 59 nt, Mus musculus
aagaaagaguagaaugagcaaacguaaagaugggccacuugagcuuguccagugugaag

SEQ ID NO: 64057 - RNA, 61 nt, Mus musculus
cuugacucaaaaacacaaacaaauaacucccuccccaaaaaaagaaagaaaaagggagcag

SEQ ID NO: 64058 - RNA, 45 nt, Mus musculus
cugccaugcucggguguucuguuggaaacagcaguguauuccaga

SEQ ID NO: 64059 - RNA, 45 nt, Mus musculus
uagggacccggaguagggagaaaaggaauggcccugggcaucagc

SEQ ID NO: 64060 - RNA, 46 nt, Mus musculus
uaucagugucugggaagcuuuccugauaguguucuuguauguaggu

SEQ ID NO: 64061 - RNA, 47 nt, Mus musculus
ugugagcacauaucccaugggaugcaugaugacaugaagguggggag

SEQ ID NO: 64062 - RNA, 47 nt, Mus musculus
ccaugcuaaggcauuaugcuagaauuugguguugggacuggugugag

SEQ ID NO: 64063 - RNA, 44 nt, Mus musculus
gaagugggagagggggaggcgcggagagagcaggugguuucacu

SEQ ID NO: 64064 - RNA, 46 nt, Mus musculus
caaauugccaguuugauuuguuauucugauguguguggugcuggag

SEQ ID NO: 64065 - RNA, 45 nt, Mus musculus
ccuagaacuugcuuugaagaccaggcaggccucaaacucaccgag

SEQ ID NO: 64066 - RNA, 44 nt, Mus musculus
acaacaacaaaaaaaagaacacagugaggaacacucggggucag

SEQ ID NO: 64067 - RNA, 46 nt, Mus musculus
guuccggcuagaacgcucccuggaaucucucccccaguugugaaag

SEQ ID NO: 64068 - RNA, 42 nt, Mus musculus
acccuucgagaagaaucugaccggggagcaggcggggcccaa

SEQ ID NO: 64069 - RNA, 44 nt, Mus musculus
ucggagugcugguguacacggacccuggugauaucaaugacggg

SEQ ID NO: 64070 - RNA, 46 nt, Mus musculus
uacgugaucuacggaaaccaccgggacagcuggguacauggggcgg

SEQ ID NO: 64071 - RNA, 46 nt, Mus musculus
ugcuuuuaugacuguuuaccaugugcaugcaguacuguuggagaac

SEQ ID NO: 64072 - RNA, 48 nt, Mus musculus
acaggagauggaugagggagaagggggagguguauuuauucuggagga

SEQ ID NO: 64073 - RNA, 45 nt, Mus musculus
gaauauaaucuaacaguuuuuagcaaggcagagggaauuagggag

SEQ ID NO: 64074 - RNA, 45 nt, Mus musculus
gucgaugccaggcagcaggucuuccccugugacagcacugcagcc

SEQ ID NO: 64075 - RNA, 45 nt, Mus musculus
uccagggccuggggacagaaaggaccgguggaaccagcaggccuc

SEQ ID NO: 64076 - RNA, 45 nt, Mus musculus
ugacaguccugcaugcgcuggcggucggcgcuguccaccacccag

SEQ ID NO: 64077 - RNA, 34 nt, Mus musculus
gcuucaucuucuucagaauggucagaagccccau

SEQ ID NO: 64078 - RNA, 45 nt, Mus musculus
gugaggugugcuggguaguggucuuuaucaucucugccuuuggua

SEQ ID NO: 64079 - RNA, 42 nt, Mus musculus
ccaaguuuguucccauuccaccccacccucacgcccccauca

SEQ ID NO: 64080 - RNA, 51 nt, Mus musculus
ggagcacuccuguggggacaguuggacaguuguguggggugagucaggauu

SEQ ID NO: 64081 - RNA, 44 nt, Mus musculus
agaugcugagcugggacugacaguggcuaagaugccuggucugg

SEQ ID NO: 64082 - RNA, 67 nt, Mus musculus
ggugugaagggcuggggagcagggucugcauuucggaguagauuggagagcuaugggagacccugac

SEQ ID NO: 64083 - RNA, 41 nt, Mus musculus
gaagugaguguguaccccaauaccacauugagguuuggaga

SEQ ID NO: 64084 - RNA, 45 nt, Mus musculus
gcucgggcccggcgguccccgagaugucacgauggcuguggccau

SEQ ID NO: 64085 - RNA, 44 nt, Mus musculus
agguguuacuuuaaaaaaaaaaaugucaccaucaucauacggag

SEQ ID NO: 64086 - RNA, 46 nt, Mus musculus
caggagagguguagagguuuagcuucaggcuagcugggguggggga

SEQ ID NO: 64087 - RNA, 46 nt, Mus musculus
ucuaagaaauaaaacaauaagauaaguaaaucuuuaaaaaagaaag

SEQ ID NO: 64088 - RNA, 47 nt, Mus musculus
cccuuuuuaucccagggacacggaugugacucugggggagcaauggu

SEQ ID NO: 64089 - RNA, 42 nt, Mus musculus
uuucuaccucaguaaguggagugccggaagggguggcuggag

SEQ ID NO: 64090 - RNA, 33 nt, Mus musculus
cuggaagcugaaaaggccaaacucuaccaucga

SEQ ID NO: 64091 - RNA, 43 nt, Mus musculus
auacgagaauuagaaguauuuugaguaucuuuaagucccaaga

SEQ ID NO: 64092 - RNA, 46 nt, Mus musculus
ugagccguacuccaucagucuggaaugucuacauauuuggguggug

SEQ ID NO: 64093 - RNA, 41 nt, Mus musculus
uggguaggaggagcagccuuggcucuugacuugaaggaaca

SEQ ID NO: 64094 - RNA, 42 nt, Mus musculus
agcagccgugugguacuacgggaggucuccuucaucuggcac

SEQ ID NO: 64095 - RNA, 42 nt, Mus musculus
caagaggcucugcugccggcaugggugagcucccagccccug

SEQ ID NO: 64096 - RNA, 88 nt, Mus musculus
uaguucaagaacacaaaagcaaccugaauagggcccggggaaagcuacuuagcaagauucuguuuuaacaaaaaaauuaagggaagag

SEQ ID NO: 64097 - RNA, 57 nt, Mus musculus
aaacuggacuggcaccaggcagugguggcacaggccuuuaaccccaguacuugggag

SEQ ID NO: 64098 - RNA, 45 nt, Mus musculus
cucccugcuaccugggcccacacugcugccuuguuccagaaugag

SEQ ID NO: 64099 - RNA, 45 nt, Mus musculus
uuuucauggugaagggucaugaccuguaugcuggucucuaguagu

SEQ ID NO: 64100 - RNA, 45 nt, Mus musculus
caauugacgugaccuagcggggaguuuucaccaaggcggugccag

SEQ ID NO: 64101 - RNA, 46 nt, Mus musculus
cgagggaguacaggacaccgggaagaggaauaucgguaaggaagga

SEQ ID NO: 64102 - RNA, 46 nt, Mus musculus
gucugagcaccaucuagcacgugugggcuuccggacacccccaagu

SEQ ID NO: 64103 - RNA, 46 nt, Mus musculus
ucggccaguacagcaccggcaagaccaccuucauccgccaccugau

SEQ ID NO: 64104 - RNA, 46 nt, Mus musculus
gagccauugcccccagccggccuuugucuccgagagcccccgccag

SEQ ID NO: 64105 - RNA, 45 nt, Mus musculus
guaacacuguggcuccugaaaugaccagacccauagucuaggaua

SEQ ID NO: 64106 - RNA, 42 nt, Mus musculus
gagacucaccaucauaacuugggguguggagccacaggagac

SEQ ID NO: 64107 - RNA, 45 nt, Mus musculus
ccuagaauacacagggcucugaguucaauccccaguacugccaca

SEQ ID NO: 64108 - RNA, 42 nt, Mus musculus
acauauauacagacucauuaacguguauacacacacagaagg

SEQ ID NO: 64109 - RNA, 45 nt, Mus musculus
ggauacgugaccugcuggaguggcccagaugccuccugaguguag

SEQ ID NO: 64110 - RNA, 47 nt, Mus musculus
aaaaucacgaggacaagauccguguggugcugaacaaggcugaucag

SEQ ID NO: 64111 - RNA, 46 nt, Mus musculus
ucauguggucccuggggaagaucaucaacacccccgagguggucag

SEQ ID NO: 64112 - RNA, 46 nt, Mus musculus
uguucuuucugaggcuuaugccuuaccuagaucagagagugcggag

SEQ ID NO: 64113 - RNA, 59 nt, Mus musculus
gguccaugccuacaucaucagcucccucaagaaggagaugcccaauguuuucgggaaag

SEQ ID NO: 64114 - RNA, 45 nt, Mus musculus
auggugcgccaggaggagucccugaugcccucacaggcugugaag

SEQ ID NO: 64115 - RNA, 74 nt, Mus musculus
uggcaaggacaagcccaccuaugaugagaucuucuacacacugucuccugucaacggcaagaucacaggugcua

SEQ ID NO: 64116 - RNA, 42 nt, Mus musculus
gaggcagccuucuuucuugccucuucugucugacagccccac

SEQ ID NO: 64117 - RNA, 42 nt, Mus musculus
ccucugcugugcuguggggugcacaccuuacucuguccacau

SEQ ID NO: 64118 - RNA, 41 nt, Mus musculus
uagcccuugcggagguggugguagggcaaacagacugugau

SEQ ID NO: 64119 - RNA, 48 nt, Mus musculus
cagaggggcaguggccagaucuuugccaugaagaugcugcauaagugg

SEQ ID NO: 64120 - RNA, 41 nt, Mus musculus
aacggcauaggaucuccugagggucagucucaagaggccca

SEQ ID NO: 64121 - RNA, 45 nt, Mus musculus
uacuaagauggcugaggagcuggaguccuugaggaaugugggcac

SEQ ID NO: 64122 - RNA, 41 nt, Mus musculus
uaugagggcuuccugucggugagcuguggcugagggcugag

SEQ ID NO: 64123 - RNA, 46 nt, Mus musculus
guucucagccaccccugucuuggccccagaugucauucaugcccaa

SEQ ID NO: 64124 - RNA, 42 nt, Mus musculus
ggagcugcagcggcugcuacuggaugcacguccaaggccccg

SEQ ID NO: 64125 - RNA, 41 nt, Mus musculus
gggccuaggugaggcacugggugccguggagcucagccuca

SEQ ID NO: 64126 - RNA, 90 nt, Mus musculus
gggucaggcugggauaugggcucugauugacagggaaggauagaaaagggggagcgaggcaagugagagaggggagaaggcggcgacgga

SEQ ID NO: 64127 - RNA, 60 nt, Mus musculus
gaggugauguaaucagaagauggaugcuaacccgaaaagaggagagaaggacaaaacaug

SEQ ID NO: 64128 - RNA, 46 nt, Mus musculus
gcaggacuguugcuagcuuauccguccagaaaaaaugguuccuagg

SEQ ID NO: 64129 - RNA, 45 nt, Mus musculus
cuggaagcuucgaucuaccaaguguauuaggggaacauagggggc

SEQ ID NO: 64130 - RNA, 49 nt, Mus musculus
uuaaacgccauauuccuggaagggauaggcucugaugcuccaagaugug

SEQ ID NO: 64131 - RNA, 23 nt, Mus musculus
uguggccaaaagacguucuuuca

SEQ ID NO: 64132 - RNA, 45 nt, Mus musculus
uguaaagaaaugcuuuauuuacaauuguuuuaaauuuaguaucau

SEQ ID NO: 64133 - RNA, 46 nt, Mus musculus
acagccagggcuacacagagaaacccugucucgaaaaaacuuaaaa

SEQ ID NO: 64134 - RNA, 44 nt, Mus musculus
caguuggggcugaaacagccaccaugcauuguggcaagggugag

SEQ ID NO: 64135 - RNA, 44 nt, Mus musculus
gcacacagcaaccucuacauccucacgggucaccagagcagcua

SEQ ID NO: 64136 - RNA, 49 nt, Mus musculus
ugccaccuccagccucugcugggguuccagagggcagaccuaauucuga

SEQ ID NO: 64137 - RNA, 41 nt, Mus musculus
gagccugguggcaggagcccaucaggaaagguuuaggggua

SEQ ID NO: 64138 - RNA, 46 nt, Mus musculus
cuguuuuguuuuuuugagacaguuucacuauguagcucuggcugau

SEQ ID NO: 64139 - RNA, 59 nt, Mus musculus
ggacugucuaaagagcagaacacacacacacacagagagagagagagagagagagagag

SEQ ID NO: 64140 - RNA, 46 nt, Mus musculus
ggacugucuaaagagcagaacacacacacacacagagagagagaga

SEQ ID NO: 64141 - RNA, 46 nt, Mus musculus
augcaaaaauacaaggauguaauaugaauugcauaaggggcuucac

SEQ ID NO: 64142 - RNA, 46 nt, Mus musculus
gaaagagcaaaugucugggcagaaaauacaauugagugguagaacc

SEQ ID NO: 64143 - RNA, 45 nt, Mus musculus
gugcuguuuuaaaaggcuuuuucucugggccuguaaucugagaag

SEQ ID NO: 64144 - RNA, 44 nt, Mus musculus
ugauuccaggcaugccuacaguuauacccccuggacugacucgg

SEQ ID NO: 64145 - RNA, 97 nt, Mus musculus
uucaccauaaugucaugguucccuuucccuaaaauugugguuucguuuuuuuauagguacaaaauaguuuaagcaaaaaguggcucggaaagcauuu

SEQ ID NO: 64146 - RNA, 46 nt, Mus musculus
cuguccacaguagaauuaaaccucaaaauuacuuaaaauccaaggu

SEQ ID NO: 64147 - RNA, 49 nt, Mus musculus
uagcagucuuuccugguuuauucuucagugcuggauguuuauucacguu

SEQ ID NO: 64148 - RNA, 42 nt, Mus musculus
agguagugcacaucuuuaacccagucacugaggcaaaggcag

SEQ ID NO: 64149 - RNA, 45 nt, Mus musculus
acaaagguaugugguuugcucaguauuugaguaaaggugcaggua

SEQ ID NO: 64150 - RNA, 45 nt, Mus musculus
aaugccguugguuugggguaccaaucguaagcaaguguuggugga

SEQ ID NO: 64151 - RNA, 46 nt, Mus musculus
ccuaacccugaggacagguugggaaacaguuuuaaccagcugacag

SEQ ID NO: 64152 - RNA, 45 nt, Mus musculus
ugugguccagagguuucucuuuaauagauccuuccccggucacau

SEQ ID NO: 64153 - RNA, 73 nt, Mus musculus
uccccugaaccaaucuacaacagcgaggggaagcggcuuaacacucgagaguuccguacccgcaaaaagcuug

SEQ ID NO: 64154 - RNA, 49 nt, Mus musculus
cccuuauuacagagaugguugcucucaacccagacuuuaaaccaccugc

SEQ ID NO: 64155 - RNA, 51 nt, Mus musculus
caacacgugugagcgauaaaguaaugaucccccaagacgaauauccagaaa

SEQ ID NO: 64156 - RNA, 64 nt, Mus musculus
agagggaacacccugaagaacauugagaaggaaugcaacgccaagaucaugauucgggggaaag

SEQ ID NO: 64157 - RNA, 51 nt, Mus musculus
gaucagugaaagaagggaaaguugggcguaaagauggucagauguugccag

SEQ ID NO: 64158 - RNA, 45 nt, Mus musculus
gaucagaaacauccugaagcaggguauugagaccccagaggacca

SEQ ID NO: 64159 - RNA, 48 nt, Mus musculus
ccaaaaacuuaugcucugacuauaaauguuuccauuggguguguuauu

SEQ ID NO: 64160 - RNA, 46 nt, Mus musculus
uuccuauggagguuagaagagggcuuuagaucgccuagaccuggag

SEQ ID NO: 64161 - RNA, 47 nt, Mus musculus
cugcugagucaucucuucagccccauagagauaggauugauagaacg

SEQ ID NO: 64162 - RNA, 46 nt, Mus musculus
ucugaagacagcuauaguauacauaaaaauaaaaaaaaagagagag

SEQ ID NO: 64163 - RNA, 46 nt, Mus musculus
gaauauuugucccuuauggcugagcuaggggaagcuccugucccug

SEQ ID NO: 64164 - RNA, 82 nt, Mus musculus
ggcucuaccucugggccugccaccacgccccuggcuagugcaccaagaccugcugcuccugccagcaacccaccaccaccgg

SEQ ID NO: 64165 - RNA, 43 nt, Mus musculus
gcccacccuggaugaauucugguccuucagagaaucggcccua

SEQ ID NO: 64166 - RNA, 45 nt, Mus musculus
ggcauggugggcaucccaugcagcacaacccaaauggaccaccac

SEQ ID NO: 64167 - RNA, 41 nt, Mus musculus
gaaugucuuggggaggagagcugauguuuggcgugguugug

SEQ ID NO: 64168 - RNA, 25 nt, Mus musculus
ggcauuggugacaaagggcuuacuu

SEQ ID NO: 64169 - RNA, 42 nt, Mus musculus
gugugcacgcaugugugugugugcacgcacugggcugggcca

SEQ ID NO: 64170 - RNA, 46 nt, Mus musculus
auguuuuauuuugaccccagauguccagauguuuugcagugucugg

SEQ ID NO: 64171 - RNA, 42 nt, Mus musculus
cuuuuuuucuguguuugauucaacacugcacuaagggggaaa

SEQ ID NO: 64172 - RNA, 42 nt, Mus musculus
ggcgggagcgcacggagguggcgcuggccgggcaggguucgg

SEQ ID NO: 64173 - RNA, 42 nt, Mus musculus
uaaaugauucucaaggucacccagcaaggaaguaacagucag

SEQ ID NO: 64174 - RNA, 42 nt, Mus musculus
guaagggcgaggucccuuuccuugggacaagguuuuggcgag

SEQ ID NO: 64175 - RNA, 42 nt, Mus musculus
ugaaauccaacccuccgccuccaucaauacugccugccccca

SEQ ID NO: 64176 - RNA, 45 nt, Mus musculus
ggggcacuacgcaugcuacaccauaugugcuuaauaaaugucugu

SEQ ID NO: 64177 - RNA, 46 nt, Mus musculus
uuuuugguuuuuuuggagacaggguuucucuguauagcccuggcug

SEQ ID NO: 64178 - RNA, 46 nt, Mus musculus
gggacggucacaucucccaggaggaguuucagaucauccggggcaa

SEQ ID NO: 64179 - RNA, 46 nt, Mus musculus
uuuauuauuauuguccccacauuacaaaaauuuauguaagaacaag

SEQ ID NO: 64180 - RNA, 42 nt, Mus musculus
cugucgccacugcaaagcucuggugagcgccccacugcccag

SEQ ID NO: 64181 - RNA, 46 nt, Mus musculus
cuuuucccugccucgcccaggcaggcgcagcucucggccuccaggu

SEQ ID NO: 64182 - RNA, 46 nt, Mus musculus
cagaaagugcccaaagaacuuccaacuuucugaggauaggguggag

SEQ ID NO: 64183 - RNA, 45 nt, Mus musculus
cuccccaaugccacauugggugugagccuguguauuugaggggug

SEQ ID NO: 64184 - RNA, 46 nt, Mus musculus
cuagcgaguggacccaauguauauugaaguguucuauuuccuuagg

SEQ ID NO: 64185 - RNA, 50 nt, Mus musculus
uagacccuccucccguggccacccgaucccccuucgugcccccacccccc

SEQ ID NO: 64186 - RNA, 42 nt, Mus musculus
uugcgcccuccgccccagcccccaaccugcccgcgggcaaaa

SEQ ID NO: 64187 - RNA, 47 nt, Mus musculus
gauggggugggugagaugcugugugugugugugugugugugugugug

SEQ ID NO: 64188 - RNA, 46 nt, Mus musculus
ccugcacuagggcacggugacccccagugaaccccccaaccccccg

SEQ ID NO: 64189 - RNA, 38 nt, Mus musculus
ggguucucucaaguuagggcucaccaaagacaagacac

SEQ ID NO: 64190 - RNA, 42 nt, Mus musculus
cuagagaaaaugaccacucugcccaaccauuagccaccagua

SEQ ID NO: 64191 - RNA, 42 nt, Mus musculus
aaaguuauuuccacauaagccugacaagaauucaacccccag

SEQ ID NO: 64192 - RNA, 46 nt, Mus musculus
uguuccuaaguacccaguugccauggagaagaaaucaggagcccgu

SEQ ID NO: 64193 - RNA, 53 nt, Mus musculus
gcaaaguggagcuuggggcucccucgcccgaucccaaugcugccccaucagga

SEQ ID NO: 64194 - RNA, 46 nt, Mus musculus
cccuaggaauugcccuccccuccacacccacuuccagacagagcag

SEQ ID NO: 64195 - RNA, 46 nt, Mus musculus
aagggcgcuucucccuggacggggaagccuggcaaggugugucgga

SEQ ID NO: 64196 - RNA, 45 nt, Mus musculus
gagcccggcagagcccaugcagacuccuugcuucacacugcagua

SEQ ID NO: 64197 - RNA, 46 nt, Mus musculus
aggugaccaaugcuuguuagggacagccuguguggaguggggggug

SEQ ID NO: 64198 - RNA, 42 nt, Mus musculus
guacuucaaggaggcugagguucgaguguaugggggcgagau

SEQ ID NO: 64199 - RNA, 45 nt, Mus musculus
gcucuaugccaugaaggugcuacgcaaggcggcguuggugcagcg

SEQ ID NO: 64200 - RNA, 45 nt, Mus musculus
ucggccaucgcaggcuguaccuucccccuuuccuugccuucagaa

SEQ ID NO: 64201 - RNA, 62 nt, Mus musculus
auacggccuuggaaggcuucuccuugggguaccuggggagaccuugaagagaguugcaaugg

SEQ ID NO: 64202 - RNA, 46 nt, Mus musculus
uuaggaugggcggauguaagggagaagaggaggagacuugaagaga

SEQ ID NO: 64203 - RNA, 42 nt, Mus musculus
agaaucagcggggggaacagaggaggaggaggaggaggagga

SEQ ID NO: 64204 - RNA, 47 nt, Mus musculus
aaggccaagggagcgcaggugguggccugucugagcguuaaugacgu

SEQ ID NO: 64205 - RNA, 45 nt, Mus musculus
accgggaaagaaggugaacuuggcagagcuguucaagggcaagaa

SEQ ID NO: 64206 - RNA, 46 nt, Mus musculus
gaucuuuuccacuucuguuuccacucuauguaugcucaccccgauc

SEQ ID NO: 64207 - RNA, 44 nt, Mus musculus
ggccgacuuaggggaccuuuuggggggcuuggcggcagccgaga

SEQ ID NO: 64208 - RNA, 67 nt, Mus musculus
agccacgcgugcccacgccccgcacaugggagcuuaggagauugugggugagcaguuucauguuguc

SEQ ID NO: 64209 - RNA, 42 nt, Mus musculus
ggcacccugcaaugcccagaaucuggucgucuuuuccccauc

SEQ ID NO: 64210 - RNA, 51 nt, Mus musculus
acgugucaugugugacccccaaacuccccccagugacucaccgaccaccgu

SEQ ID NO: 64211 - RNA, 46 nt, Mus musculus
ucuguguuaguuuggggaauuuugggucuccuaggugcgaugugaa

SEQ ID NO: 64212 - RNA, 46 nt, Mus musculus
guuacaaccuggcagcucuggccuuggccccucggagccggcuaga

SEQ ID NO: 64213 - RNA, 46 nt, Mus musculus
agggcccagggcccagguuacccgugcccacccccacccccacccc

SEQ ID NO: 64214 - RNA, 46 nt, Mus musculus
gcccagggagggacacccccaacccccauuucauuugcccugggua

SEQ ID NO: 64215 - RNA, 42 nt, Mus musculus
ugaucuagggcaugucgggauuucuaguuucagagccaccaa

SEQ ID NO: 64216 - RNA, 46 nt, Mus musculus
uuguccaagaccccguccccagucccgguuuaugccuucaccugua

SEQ ID NO: 64217 - RNA, 38 nt, Mus musculus
ccucagcagcccugguagaagaugcugggugcuugggu

SEQ ID NO: 64218 - RNA, 42 nt, Mus musculus
gcaauaagacacuuaacaacagagucuggagaaaggcaucag

SEQ ID NO: 64219 - RNA, 41 nt, Mus musculus
caaaucuguaggcaacacaggcagaucaguaaagggucuua

SEQ ID NO: 64220 - RNA, 45 nt, Mus musculus
gcuggcugugcccuguggucccaaacucaagaucagugguaccag

SEQ ID NO: 64221 - RNA, 45 nt, Mus musculus
uaccgccaggcacugcuguggggcugccgcuguguggagcuggau

SEQ ID NO: 64222 - RNA, 42 nt, Mus musculus
ucuacaggcuacucccguacauugaaacaaauaugccaucag

SEQ ID NO: 64223 - RNA, 46 nt, Mus musculus
uccaggaacuguuuguucgucucguacuucucaaugagcagccgag

SEQ ID NO: 64224 - RNA, 45 nt, Mus musculus
uucugguugauaaaguccaugagcugcuccagagugagguacggc

SEQ ID NO: 64225 - RNA, 46 nt, Mus musculus
cuacgcccugaaacuaaaacucccucuccaugcuccccaacccccu

SEQ ID NO: 64226 - RNA, 41 nt, Mus musculus
ccugaguugaggcccuagggagcaaggagcccaggggguag

SEQ ID NO: 64227 - RNA, 41 nt, Mus musculus
caagaagagcccaauugaccacagcuacugucuugcggggg

SEQ ID NO: 64228 - RNA, 41 nt, Mus musculus
ggagacugguagagacucugccuuagugugugugugugugu

SEQ ID NO: 64229 - RNA, 41 nt, Mus musculus
cagcuuccguuugccuucggcccccguggcugcugccaggg

SEQ ID NO: 64230 - RNA, 42 nt, Mus musculus
agccccuuuacgcaaaguccaaacccuaucugauugcaccgg

SEQ ID NO: 64231 - RNA, 41 nt, Mus musculus
cucuccagggggaguucucggucuaccgcgaccccaggcgc

SEQ ID NO: 64232 - RNA, 36 nt, Mus musculus
guuaugauaacugugacacacacacacacucacacu

SEQ ID NO: 64233 - RNA, 38 nt, Mus musculus
gcucucuaaaagguccagguccuggggcagugaccucc

SEQ ID NO: 64234 - RNA, 54 nt, Mus musculus
gugguuaagagcacuggcugcucucccagaugacucagauucaguucccagcac

SEQ ID NO: 64235 - RNA, 59 nt, Mus musculus
ccuccaacugagugccaagacucccugaauguaccaccauguccagucccagcccucuu

SEQ ID NO: 64236 - RNA, 46 nt, Mus musculus
aaagcucugcagauuggaaaaagccuucuuuaguuccacuccggga

SEQ ID NO: 64237 - RNA, 42 nt, Mus musculus
ccuccccagcugacaucauccaucccacuccagccccaggau

SEQ ID NO: 64238 - RNA, 49 nt, Mus musculus
cuggagugggauggaugaugucagcuggggaggaugcucccgggguaga

SEQ ID NO: 64239 - RNA, 38 nt, Mus musculus
ggugggaagagucuucccaggagcuaggguuagagcag

SEQ ID NO: 64240 - RNA, 45 nt, Mus musculus
ccuggucccuacuaaguaagguacaagcccaugccugguaccccc

SEQ ID NO: 64241 - RNA, 46 nt, Mus musculus
cugggggagaugucccuggaagaacacagccaaugugaaugcaggu

SEQ ID NO: 64242 - RNA, 46 nt, Mus musculus
agaaaaccugucucaaaaaaccauaaaaaaaaauaaaagaaaagaa

SEQ ID NO: 64243 - RNA, 46 nt, Mus musculus
ccgcuuuguggagcugaaugaggcauaucgagugcucagucgugag

SEQ ID NO: 64244 - RNA, 55 nt, Mus musculus
caggucugacagguaauaagacccuauuuuguaaagaaagagagagagagaaaga

SEQ ID NO: 64245 - RNA, 26 nt, Mus musculus
ucccuguugcuccagcugccccugcg

SEQ ID NO: 64246 - RNA, 41 nt, Mus musculus
uaagccuuucuucucccccccucugcccagugcugcucgcc

SEQ ID NO: 64247 - RNA, 44 nt, Mus musculus
uuggaggccuauucuauucuguggggugucaaucuaggggguag

SEQ ID NO: 64248 - RNA, 44 nt, Mus musculus
gggaggcagaggcaggcggauuucugaggccagccugaucuaca

SEQ ID NO: 64249 - RNA, 46 nt, Mus musculus
ccucaccuugagugccagcugaaacuccaggagcuugguguagcag

SEQ ID NO: 64250 - RNA, 45 nt, Mus musculus
acuaugaggggaaacacaauucuuuaggcacaugucucuugcucu

SEQ ID NO: 64251 - RNA, 46 nt, Mus musculus
ggauggugugagccaccaugugguugcugggauuugaacucuggac

SEQ ID NO: 64252 - RNA, 46 nt, Mus musculus
ggguggggguguugcugccucuuccucuucauccaugcugcccaga

SEQ ID NO: 64253 - RNA, 41 nt, Mus musculus
ggaguacaagcucagagauggcauuugccuagcaugggcaa

SEQ ID NO: 64254 - RNA, 46 nt, Mus musculus
ugagcucccuguagguggggucacugagcagcgaccuuguccuggg

SEQ ID NO: 64255 - RNA, 44 nt, Mus musculus
cucauaggccuucugguagucuccuuucuuggcguaggcugcag

SEQ ID NO: 64256 - RNA, 45 nt, Mus musculus
cguugaaucgaauucguccgcuccgcguucccaaccgcacgcgcc

SEQ ID NO: 64257 - RNA, 46 nt, Mus musculus
auuucaucugccacuaugcugccccaauauucacuaccagcuccug

SEQ ID NO: 64258 - RNA, 45 nt, Mus musculus
agguaggccucccaguacagacagaaacuugugugggcagcuucu

SEQ ID NO: 64259 - RNA, 97 nt, Mus musculus
uguuauagaguugggacaggguguagugcuguguuauagaguugggacaggguguagugcuguguuauagaguugggacaggguguagugcuguguu

SEQ ID NO: 64260 - RNA, 124 nt, Mus musculus
auagaguugggacaggguguagugcuguguuauagaguugggacaggguguagugcuguguuauagaguugggacaggguguagugcuguguuauagaguugggacaggguguagugcuguguu

SEQ ID NO: 64261 - RNA, 94 nt, Mus musculus
auagaguugggacaggguguagugcuguguuauagaguugggacaggguguagugcuguguuauagaguugggacaggguguagugcuguguua

SEQ ID NO: 64262 - RNA, 45 nt, Mus musculus
gcaaaguucuuccuucuuugaguucucauuuccucaucuuuugga

SEQ ID NO: 64263 - RNA, 61 nt, Mus musculus
uagaccacuuuugccagcccaccuugaucauguugccugcauuccuggcuggccuuccccg

SEQ ID NO: 64264 - RNA, 46 nt, Mus musculus
gcuugguccuggguugcuguaauuuauuugugugugugugugagag

SEQ ID NO: 64265 - RNA, 47 nt, Mus musculus
caugguggcucacaaccaucugugagaucugacgcccucuucuggag

SEQ ID NO: 64266 - RNA, 42 nt, Mus musculus
cagauggucaugaggugcugggaauccagccccaguccuuug

SEQ ID NO: 64267 - RNA, 45 nt, Mus musculus
guggcucacaaccauccguaaugagaucugacacccucuccuggu

SEQ ID NO: 64268 - RNA, 54 nt, Mus musculus
cagcauccccccuccccccggacaggcacaggcagagugacagacagggaagcg

SEQ ID NO: 64269 - RNA, 42 nt, Mus musculus
cuacgagaggcaggaggucagcguggcuaggguccgggaggu

SEQ ID NO: 64270 - RNA, 46 nt, Mus musculus
gcgaggaggugaggcccagaagggaaggaggagcugagacccagac

SEQ ID NO: 64271 - RNA, 46 nt, Mus musculus
agccgccuggccugccuguccaucacacuaguucgacuucgggucu

SEQ ID NO: 64272 - RNA, 45 nt, Mus musculus
cucaucaucuucuucuagggcuguggcugguacaggagccccucg

SEQ ID NO: 64273 - RNA, 41 nt, Mus musculus
ucagcagcggggguggcugggaaagcgaggugggcggugga

SEQ ID NO: 64274 - RNA, 42 nt, Mus musculus
agaggccaagcccucugcaggcaggcaggcaaggaggcagcc

SEQ ID NO: 64275 - RNA, 42 nt, Mus musculus
ucaagaagccacuuuccaacaggcauuuaagagagagggcag

SEQ ID NO: 64276 - RNA, 32 nt, Mus musculus
gcagggcuaccugucucaaaaaggaggaggaa

SEQ ID NO: 64277 - RNA, 45 nt, Mus musculus
ucagugguguacugguucuaccaugagccuaaugaugggccccug

SEQ ID NO: 64278 - RNA, 46 nt, Mus musculus
caggaacccaaauagaaaccagcauuuuuaaugucugcugccucac

SEQ ID NO: 64279 - RNA, 46 nt, Mus musculus
aaaagaaagaaagaagaaagaaagaaagaaagagagagagagagag

SEQ ID NO: 64280 - RNA, 42 nt, Mus musculus
ggaagcgccuggggaccgggaaccggggaccgggaccuggag

SEQ ID NO: 64281 - RNA, 47 nt, Mus musculus
aaagaaaaaucacuuuggauccuccuaaacaaagauucuagaagaug

SEQ ID NO: 64282 - RNA, 52 nt, Mus musculus
cacggagacgagacagagaaguggggaugggcagaggagagcgcugcgugca

SEQ ID NO: 64283 - RNA, 46 nt, Mus musculus; identical to SEQ ID NO: 59045

SEQ ID NO: 64284 - RNA, 43 nt, Mus musculus
gaguuugggaugaggauacagggccagcuggucaacuggccag

SEQ ID NO: 64285 - RNA, 42 nt, Mus musculus
ucuggccaguugaccagcuggcccuguauccucaucccaaac

SEQ ID NO: 64286 - RNA, 45 nt, Mus musculus
acaggauagggagguugguaggauggacagggccagccagaggug

SEQ ID NO: 64287 - RNA, 45 nt, Mus musculus; identical to SEQ ID NO: 59047

SEQ ID NO: 64288 - RNA, 45 nt, Mus musculus; identical to SEQ ID NO: 59049

SEQ ID NO: 64289 - RNA, 83 nt, Mus musculus
ugcagcccacgaugaguccccuggcaacaacgugguggacaucagugugccacccaccaccgauggacagagacccaacaagc

SEQ ID NO: 64290 - RNA, 98 nt, Mus musculus
gagaccucagccuuggauuccaccaauguagaggaagcauucaagaacauccucacagaaaucuaccguauugugucacagaagcaaaucgcugaccg

SEQ ID NO: 64291 - RNA, 73 nt, Mus musculus
ccugcgccaccuucgggcugugcccacugaugaggcccgugccuuugcagaaaagaacaacuuguccuucauu

SEQ ID NO: 64292 - RNA, 53 nt, Mus musculus
agugggugcacugcugguauaugacauugccaagcacuugacauaugagaacg

SEQ ID NO: 64293 - RNA, 46 nt, Mus musculus; identical to SEQ ID NO: 59060

SEQ ID NO: 64294 - RNA, 23 nt, Mus musculus
gcgcccgcuggcgugaagccaca

SEQ ID NO: 64295 - RNA, 42 nt, Mus musculus
auucuagauuuauucaacauaccucuggguuggggggggugg

SEQ ID NO: 64296 - RNA, 46 nt, Mus musculus
gaggguuuuuucgguuuuguuuuuuuaaacaaagacucguagagau

SEQ ID NO: 64297 - RNA, 42 nt, Mus musculus
aucaccaugcucugcccucccaggaagugaacgcacccaugg

SEQ ID NO: 64298 - RNA, 42 nt, Mus musculus
agaaugccuuacuccaucuucucaaguuccuuugccccugua

SEQ ID NO: 64299 - RNA, 47 nt, Mus musculus
ggcauccaagaguccuucauuucucaaacccugccugcccuauugug

SEQ ID NO: 64300 - RNA, 55 nt, Mus musculus
agaacucucagcucugaauaacuuacagaacucccagaaugccaccugagaaaug

SEQ ID NO: 64301 - RNA, 45 nt, Mus musculus
aagauugaaucagauuacuagaauuaaucagaccauaguggggug

SEQ ID NO: 64302 - RNA, 46 nt, Mus musculus
caaaaaaaaggcagaauaagcacgugaagcaagaagugcaucaguu

SEQ ID NO: 64303 - RNA, 46 nt, Mus musculus
uuggugcuguuuuuaauggaauuacccuucugauucucgguaaggu

SEQ ID NO: 64304 - RNA, 46 nt, Mus musculus
caguaggucgguaggaaacuguuaaagaaagagaaaaagagaagga

SEQ ID NO: 64305 - RNA, 45 nt, Mus musculus
uguagucacacuggcucuggguuaugaguuuguucugucacagau

SEQ ID NO: 64306 - RNA, 46 nt, Mus musculus
gucuaacaauaaguagacuaucaacagaaaguucaagaaugcagua

SEQ ID NO: 64307 - RNA, 46 nt, Mus musculus
cauaaacgcauuguuacauuuuuaacaucauuaugggcugccaauu

SEQ ID NO: 64308 - RNA, 45 nt, Mus musculus
uuucuugagguuuuuuccuauuuuaaaauuuucuuuggggcuaga

SEQ ID NO: 64309 - RNA, 41 nt, Mus musculus
gcaaaacccaucugcaagucuuuacccauugcugcaaaaca

SEQ ID NO: 64310 - RNA, 45 nt, Mus musculus
cuuggaggaguaugugcugagguaaugguaaauaugugguagaga

SEQ ID NO: 64311 - RNA, 46 nt, Mus musculus
aauguagaaguuggacaugauggcauuuagcguugaggcaggagca

SEQ ID NO: 64312 - RNA, 46 nt, Mus musculus
uguaagauaaguacuccuaauggcuaagccaucucucaccccagau

SEQ ID NO: 64313 - RNA, 46 nt, Mus musculus
ucagugauuuaaacaguguuaguucuuauucuauaggucagaaaug

SEQ ID NO: 64314 - RNA, 45 nt, Mus musculus
agauauuauaaaacccuaguaauaaagacagcagugauguugaaa

SEQ ID NO: 64315 - RNA, 47 nt, Mus musculus
uuuuuuaauuaagaugugcuagaaacuacagauuacugcagaggaaa

SEQ ID NO: 64316 - RNA, 42 nt, Mus musculus
gugcuccagcuugguggcuuagagacuuguuacagaagacca

SEQ ID NO: 64317 - RNA, 46 nt, Mus musculus
auucccagcaaccacaugguggcucacaaccaucuaugauccgaug

SEQ ID NO: 64318 - RNA, 42 nt, Mus musculus
cuccacagcucuggccuccacagguaacuugcacucacuugg

SEQ ID NO: 64319 - RNA, 60 nt, Mus musculus
auggcucauaaacuaagaacacuugcugcuccuacagaagaucuaaguuugauucccagu

SEQ ID NO: 64320 - RNA, 46 nt, Mus musculus
aucaaaacuaacuuuguuaaaaccagaaaaauaauucaguuuggaa

SEQ ID NO: 64321 - RNA, 46 nt, Mus musculus
ucugaaaccaaaaauauuaaaagcaaauacagugaagacagcagag

SEQ ID NO: 64322 - RNA, 41 nt, Mus musculus
uguauagauuacauuguuccuauagaauaacuacccccccc

SEQ ID NO: 64323 - RNA, 45 nt, Mus musculus
guucccacugccuagguuacagcuuuacuguucuaaagcucagau

SEQ ID NO: 64324 - RNA, 46 nt, Mus musculus
caucugaaauuccaugucuauaaaaugguaggcuaugcugucuuug

SEQ ID NO: 64325 - RNA, 23 nt, Mus musculus
acaugaaacccuagaggagguag

SEQ ID NO: 64326 - RNA, 46 nt, Mus musculus
ugaagauguugccuucuuuggcuccacgagggaaagucuguuagua

SEQ ID NO: 64327 - RNA, 46 nt, Mus musculus
cugcuuaauguuuucacacuauaaaccuuuuacuuccagccuaauu

SEQ ID NO: 64328 - RNA, 45 nt, Mus musculus
uaguagacauuuucuuauuuauacaauaacccaaaucuguuugau

SEQ ID NO: 64329 - RNA, 46 nt, Mus musculus; identical to SEQ ID NO: 64327

SEQ ID NO: 64330 - RNA, 45 nt, Mus musculus
agugucuggaauaggaaguugcaacacugaacuuuggggcaaagc

SEQ ID NO: 64331 - RNA, 46 nt, Mus musculus
uauaacuacugcaccugugauacagaugaucaaauaaguagcucca

SEQ ID NO: 64332 - RNA, 41 nt, Mus musculus
auuaucagguuucagggacauaugcauguaucaaggaagga

SEQ ID NO: 64333 - RNA, 46 nt, Mus musculus
uacauaaaauaaauaaauauuuuuuuaaaggauuuaaaagucaguu

SEQ ID NO: 64334 - RNA, 46 nt, Mus musculus
aaaaaaguuuuaaaaaaggauuuagggcuggagagauggcucagcg

SEQ ID NO: 64335 - RNA, 46 nt, Mus musculus
ucuugcaaacagcacacaugcaccacaguagaacaaaaauaaggaa

SEQ ID NO: 64336 - RNA, 38 nt, Mus musculus
agcaggaggaucuucugugaauuccaagccagccagaa

SEQ ID NO: 64337 - RNA, 45 nt, Mus musculus
aaaaagauguuauguauauguuacuuuuuuuauauguugacagau

SEQ ID NO: 64338 - RNA, 46 nt, Mus musculus
gaccucugcuuacucuggucaacucugcucacucuggcccaaagau

SEQ ID NO: 64339 - RNA, 46 nt, Mus musculus
ugggauucaaaaguauguuccaucauucaugguuugugugagagag

SEQ ID NO: 64340 - RNA, 43 nt, Mus musculus
ugagccaccaugugguugcugggauuugaacuucaggccuuca

SEQ ID NO: 64341 - RNA, 41 nt, Mus musculus
acaccacacacacacacauucaagaucauaaagccagaaaa

SEQ ID NO: 64342 - RNA, 61 nt, Mus musculus
ugauauucuugcucuaaaccuaucauuucaguccaaccagaaagaaaaaaagucagacccu

SEQ ID NO: 64343 - RNA, 46 nt, Mus musculus
uuucuuucuuucuuccuuuuuccuccuccaaacccaagccugagaa

SEQ ID NO: 64344 - RNA, 54 nt, Mus musculus
auaacacacaaccuuuauauuuacaauaagccuuaagcagcacaacaaaugagc

SEQ ID NO: 64345 - RNA, 45 nt, Mus musculus
gauuugaguuccauaccugggacucacauaguagaaagaaggaag

SEQ ID NO: 64346 - RNA, 45 nt, Mus musculus
guuaaguuaguagacuagcuagaaucaaggaguuuaaggcucaga

SEQ ID NO: 64347 - RNA, 45 nt, Mus musculus
aacggcugagcauauuaaggcucuuucuaagggauuuugggagau

SEQ ID NO: 64348 - RNA, 46 nt, Mus musculus
caaacccagcaaccacacgguggcucacaaccauccguaacgagau

SEQ ID NO: 64349 - RNA, 46 nt, Mus musculus
agauguguuugccuuguacuuuccuaacaguauaaauugccuagua

SEQ ID NO: 64350 - RNA, 45 nt, Mus musculus
agacucugagguagaugaggcgugaugagaauagcaugggaagau

SEQ ID NO: 64351 - RNA, 45 nt, Mus musculus
ggcauuugaggaacaggcuaagggggaggggagcgaaggaccgag

SEQ ID NO: 64352 - RNA, 32 nt, Mus musculus
uacagccauggcggagucgucagcggccacuc

SEQ ID NO: 64353 - RNA, 42 nt, Mus musculus
acuucggagagccagcugcuggauuauucuguguccccuccc

SEQ ID NO: 64354 - RNA, 42 nt, Mus musculus
caaagaaccugcacuccugaugaguuccaugggcagcuucag

SEQ ID NO: 64355 - RNA, 26 nt, Mus musculus
ugccauaauaauuuucuuaguguuua

SEQ ID NO: 64356 - RNA, 46 nt, Mus musculus
caacaacaaagaaaccaaaaccagacuaaaacaagaagaaacuaag

SEQ ID NO: 64357 - RNA, 46 nt, Mus musculus
auccucuggagcccggcgugguggcgcacgccuuuaaucccagcac

SEQ ID NO: 64358 - RNA, 46 nt, Mus musculus
uuaaacucacucauucuaggacugggcaguaccauguaccugcugg

SEQ ID NO: 64359 - RNA, 46 nt, Mus musculus
gugcuguaauauccauguguagaaaaauuucuaauuuaccugucag

SEQ ID NO: 64360 - RNA, 46 nt, Mus musculus
uuccaaaguacacaucugcacacugagacaauacaugacaccagag

SEQ ID NO: 64361 - RNA, 46 nt, Mus musculus
gcagaucugguagcucaugccuguaauccuaacagauaucugggag

SEQ ID NO: 64362 - RNA, 46 nt, Mus musculus
gagauaaggcugggaaagugcagaggacuugaauggaguaauugag

SEQ ID NO: 64363 - RNA, 45 nt, Mus musculus
aucuaggaagaaagaaauaaagaaagaaagaaagaaagagagaaa

SEQ ID NO: 64364 - RNA, 26 nt, Mus musculus
ucuaaaagccuuuuuaucuguuaguc

SEQ ID NO: 64365 - RNA, 46 nt, Mus musculus
agugcagguuguuuugguucauaaagaacaacauuccuuugagcua

SEQ ID NO: 64366 - RNA, 45 nt, Mus musculus
uacagugugcuuauuuaaacccuuuacuaaguggaaagcuugaug

SEQ ID NO: 64367 - RNA, 45 nt, Mus musculus
acauauguaacugguaucugugaauauauaauugauauaugugaa

SEQ ID NO: 64368 - RNA, 45 nt, Mus musculus
agauaaccagccacauggcagacauagaauaguauaaaugggcua

SEQ ID NO: 64369 - RNA, 58 nt, Mus musculus
ucaccuuuuguuuuucuuuuccuuuaagguugcaguuguucugauggauacccagggg

SEQ ID NO: 64370 - RNA, 44 nt, Mus musculus
guguguggaaucuagacaguaagagggugugucugagugcagga

SEQ ID NO: 64371 - RNA, 42 nt, Mus musculus
aaccagguguaguagugcaugccuuuuaccacagcacucaag

SEQ ID NO: 64372 - RNA, 42 nt, Mus musculus
uuguguuuugagacagggucucugugcguccagggcagccaa

SEQ ID NO: 64373 - RNA, 42 nt, Mus musculus
gagauuggaguuucccuuaugaauauaacuauggacugcaag

SEQ ID NO: 64374 - RNA, 41 nt, Mus musculus
cuccgaugucaccuguuuucucuuaccacauccagggcucc

SEQ ID NO: 64375 - RNA, 46 nt, Mus musculus
gcccagcuagggcucuuucuaagaaacagcuuuugcuuuauaagag

SEQ ID NO: 64376 - RNA, 46 nt, Mus musculus
aaguaaaaauaucuuccuggggaaaaguaccauguuacacagccaa

SEQ ID NO: 64377 - RNA, 42 nt, Mus musculus
accuaaaaacugggagaaaauuuuuuagaguuaaguagggag

SEQ ID NO: 64378 - RNA, 62 nt, Mus musculus
caaacgaaugaauaguggcuuccuguuuauucuaagggauaguguaugggugcagcgaaggc

SEQ ID NO: 64379 - RNA, 46 nt, Mus musculus
ucuaauaccauauguacuaaauccaucuaaauuaauggagaaggag

SEQ ID NO: 64380 - RNA, 46 nt, Mus musculus
ggcauauauuaaaauuuaccaaggagaagaucugccucacccgaag

SEQ ID NO: 64381 - RNA, 48 nt, Mus musculus
acugcugaagccaauaauuuggcagcugcagccucugccaaagauauu

SEQ ID NO: 64382 - RNA, 81 nt, Mus musculus
gagaaaccuuauuugucuccagauauuuuagaagagaagcaccuagaauucaaacaacuugcucuggaccacuuuaagaag

SEQ ID NO: 64383 - RNA, 41 nt, Mus musculus
uagcacuccuuaccuggggguacaucagauauuccgggcag

SEQ ID NO: 64384 - RNA, 56 nt, Mus musculus
gcugaggcugaggcuguggugaugugcuucugaaguaagauuugaaagaauuucau

SEQ ID NO: 64385 - RNA, 47 nt, Mus musculus
uuguugggagaccaccugcugauaaaaaaucucaauagcaucuuaau

SEQ ID NO: 64386 - RNA, 45 nt, Mus musculus
uaugucacuguacauuuaugccacaaaaauagucauuuucaacag

SEQ ID NO: 64387 - RNA, 46 nt, Mus musculus
aaaccuucugaagguauagaagccuugauuuuggagauaaugugag

SEQ ID NO: 64388 - RNA, 45 nt, Mus musculus
ggcaaagccuaguguaccuuuuauguacauggaguaugagaggaa

SEQ ID NO: 64389 - RNA, 41 nt, Mus musculus
uccugggacauguauauaaaguuucuuugaggguuggccug

SEQ ID NO: 64390 - RNA, 42 nt, Mus musculus
acaauuuucaacacaaaaugccuuuuuaugacuggcuggaaa

SEQ ID NO: 64391 - RNA, 45 nt, Mus musculus
uucauuaaaaauaacucacuuuaggaaaagcuaguuguugccaag

SEQ ID NO: 64392 - RNA, 37 nt, Mus musculus
ugccaggggcuagcucuaugcaccagguguagcgcuu

SEQ ID NO: 64393 - RNA, 85 nt, Mus musculus
cagagaucaacuugucucugcgaaucccgaaaccuuuaacacacagaaaacccuaauguauuaaauaccuaaugaauaaaaagga

SEQ ID NO: 64394 - RNA, 46 nt, Mus musculus
aaggaacugauaucauguacacaggcacacuugacugcuagcggaa

SEQ ID NO: 64395 - RNA, 42 nt, Mus musculus
gcuuuaaugugucaguacagggcauuaucaucuaccaagcug

SEQ ID NO: 64396 - RNA, 73 nt, Mus musculus
aucggauuuguagaucuuaaccaggcagucaccaaggccuuugaauucccuuucagcuccagcuuuacccaca

SEQ ID NO: 64397 - RNA, 46 nt, Mus musculus
gaaagggaauucaaaggccuuggugacugccugguuaagaucuaca

SEQ ID NO: 64398 - RNA, 46 nt, Mus musculus
cgguacaggcaaaaucaagaggguacacaaagcacaaggauguagc

SEQ ID NO: 64399 - RNA, 45 nt, Mus musculus
cacccaggcucucaacuuugccuucaaagauaaauacaagcagau

SEQ ID NO: 64400 - RNA, 41 nt, Mus musculus
gauucaggcucagguuuuccagcuucagggagguguccucc

SEQ ID NO: 64401 - RNA, 50 nt, Mus musculus
cuuaugccagcagggagguuggaggccccuagccuggcugaccggcccga

SEQ ID NO: 64402 - RNA, 45 nt, Mus musculus
accuucacugucauguugaggcuuacaggucuugggaugugaaag

SEQ ID NO: 64403 - RNA, 29 nt, Mus musculus
gcuaaaaacaggagucccuggcagaguga

SEQ ID NO: 64404 - RNA, 45 nt, Mus musculus
cucaaugcagaaagggcacucaccaucagcuuucccacaucccgg

SEQ ID NO: 64405 - RNA, 42 nt, Mus musculus
gaggaggcagugaaugcucugugcuggggcacuggcggcgag

SEQ ID NO: 64406 - RNA, 41 nt, Mus musculus
cuuccaucauuccuuucucugcuggcagaucuuggugggcu

SEQ ID NO: 64407 - RNA, 44 nt, Mus musculus
cucagcauuaaaguaccucacgguucuguccgcacagcccacca

SEQ ID NO: 64408 - RNA, 44 nt, Mus musculus; identical to SEQ ID NO: 56477

SEQ ID NO: 64409 - RNA, 46 nt, Mus musculus
aucuugacaaaagagauacaaucuaaaaagcagauacugagcagag

SEQ ID NO: 64410 - RNA, 46 nt, Mus musculus
aagaggcguccucugacccaguaagguuuaccugucccggugguug

SEQ ID NO: 64411 - RNA, 46 nt, Mus musculus
ccacauguggcaaccacauguguaugugugggaucuuggcgcaucc

SEQ ID NO: 64412 - RNA, 46 nt, Mus musculus
aaguaugggaccuacaggggucugaggagccuguauucagggccaa

SEQ ID NO: 64413 - RNA, 46 nt, Mus musculus
uuuuagguccgugucuaugauccagucuccccccagcgccggccag

SEQ ID NO: 64414 - RNA, 46 nt, Mus musculus
gaguaagggucauagcugucaguggguacucuccauagguggccuc

SEQ ID NO: 64415 - RNA, 62 nt, Mus musculus
uagggaacacucaugggcagcuggcagaaauugauuuucggcaaggugaguggaccaugggu

SEQ ID NO: 64416 - RNA, 46 nt, Mus musculus
acugggcugucugaaggggcuugcagguaguguucgugggcugcag

SEQ ID NO: 64417 - RNA, 46 nt, Mus musculus
uuacagguuuaucucaagucucaacugaacugccuucuccugucag

SEQ ID NO: 64418 - RNA, 45 nt, Mus musculus
uaucccggccugacaggagaaggcaguucaguugagacuugagau

SEQ ID NO: 64419 - RNA, 46 nt, Mus musculus
cccugacuccugaauguccuucuugaucaucaggaugagccccaag

SEQ ID NO: 64420 - RNA, 46 nt, Mus musculus
cucuuuggaggcagcugccaagcggaagcucccagauuuggaccag

SEQ ID NO: 64421 - RNA, 44 nt, Mus musculus
gguccggcuuccacugcuuacaaguccuucgaggaggcggcaac

SEQ ID NO: 64422 - RNA, 57 nt, Mus musculus
ccugcuggcggcuccgcguaagcgaauaccucgcuguccaaucaggaaaggucuugu

SEQ ID NO: 64423 - RNA, 40 nt, Mus musculus
gccucccccuccgcccuccgaaguguguccaccucuggag

SEQ ID NO: 64424 - RNA, 44 nt, Mus musculus
ccugggcuaacugcaaaggucugccuggaaguucagggccgcag

SEQ ID NO: 64425 - RNA, 45 nt, Mus musculus
cuccaaagucugucaaauacgggaaagggccuggggauuugcuag

SEQ ID NO: 64426 - RNA, 34 nt, Mus musculus
uccccuccccucccgacaccauguccugccggga

SEQ ID NO: 64427 - RNA, 47 nt, Mus musculus
ggcucugcacgcagcccgacagugcagugaauuuacccucauggcca

SEQ ID NO: 64428 - RNA, 46 nt, Mus musculus
gcauugggaaagaucucagcaauacauuugccaagcuggagaagcu

SEQ ID NO: 64429 - RNA, 47 nt, Mus musculus
uggcaaagcgcaagucccucuuugaugauaaagcaguagaaauugag

SEQ ID NO: 64430 - RNA, 41 nt, Mus musculus
uugugauuugccagcuacagauaguuucugugauuguguga

SEQ ID NO: 64431 - RNA, 45 nt, Mus musculus
cuaguacacuguagcugucuucagacagaccagaagagggcguca

SEQ ID NO: 64432 - RNA, 46 nt, Mus musculus
gaguaugcugucacugucuucagacacaccagaagagggcguugga

SEQ ID NO: 64433 - RNA, 42 nt, Mus musculus
aauauuagaaauucuguguaaaaauuugcuucuuugaugcau

SEQ ID NO: 64434 - RNA, 46 nt, Mus musculus
uaccaggauaucaauagccucaacaaacaaauugcucagcuucaag

SEQ ID NO: 64435 - RNA, 45 nt, Mus musculus
cccuguuucaagaaacaaaacccaaaacuagcaacuuucccuagc

SEQ ID NO: 64436 - RNA, 41 nt, Mus musculus
caccuuguuccucuacggccuugucacccggugccucggau

SEQ ID NO: 64437 - RNA, 46 nt, Mus musculus
gcauacuuuucccuuuguuacuccauaaguacuucuugccccagac

SEQ ID NO: 64438 - RNA, 46 nt, Mus musculus
uuuaauuccagcacuuaggaggcagagccagguggaucucugaguu

SEQ ID NO: 64439 - RNA, 46 nt, Mus musculus
auucuugcaaaggacaugggguagaagggcucgaucugccagagac

SEQ ID NO: 64440 - RNA, 45 nt, Mus musculus
auagucaccucuguaucgaucauagaaauuacgguagcccugagg

SEQ ID NO: 64441 - RNA, 44 nt, Mus musculus
uaguucuuuuccuauccagcugcaggguacagaauaggcagcuc

SEQ ID NO: 64442 - RNA, 46 nt, Mus musculus
gaaagguaaaggcauuugaagaauaaagucauucagagccucagag

SEQ ID NO: 64443 - RNA, 85 nt, Mus musculus
gaccuccucugaacucaucgcccccucccagacccgcccuuagauuggaaauuguaguagaucacuucuacccgcauuuacccgg

SEQ ID NO: 64444 - RNA, 46 nt, Mus musculus
agacccccguuaacagcacuaugaguauuggucaagcacgcaagau

SEQ ID NO: 64445 - RNA, 49 nt, Mus musculus
caggguuuggugcccccuccccacugacccuacaucccuggcugccgcu

SEQ ID NO: 64446 - RNA, 28 nt, Mus musculus
gugaucuagaagcugaucaccuguagag

SEQ ID NO: 64447 - RNA, 29 nt, Mus musculus
ucccuuggggcuggagagauggcccauug

SEQ ID NO: 64448 - RNA, 46 nt, Mus musculus
uccugaguucaaccacaugguggcucacaaccaucuguaaugggau

SEQ ID NO: 64449 - RNA, 44 nt, Mus musculus
agaccugcagagagaagcgguggcggggccagacagcaccccac

SEQ ID NO: 64450 - RNA, 27 nt, Mus musculus
uugggaaagcaacggggcuccacagaa

SEQ ID NO: 64451 - RNA, 46 nt, Mus musculus
uguggggcuuguugccaccuggcaaccagaggcacagccaagccag

SEQ ID NO: 64452 - RNA, 46 nt, Mus musculus
ucccuguuggggguuagaaaaaguagcaauuauuccuuggaggucu

SEQ ID NO: 64453 - RNA, 45 nt, Mus musculus
ucucaaaaagaguaaaacagaagcaaaacaaacaaaagguggggc

SEQ ID NO: 64454 - RNA, 46 nt, Mus musculus
gccuguuggcugauuugccaacaccuaucauucucaaagggacuuu

SEQ ID NO: 64455 - RNA, 41 nt, Mus musculus
uaaugguacacagacuuuaaucucagcacuuuggaggcaga

SEQ ID NO: 64456 - RNA, 42 nt, Mus musculus
ggggaccugcggggaccagaaggaagaccgcaagggucagcc

SEQ ID NO: 64457 - RNA, 45 nt, Mus musculus
auccaucgcagccucgaugcccugguucccugugagggccagagc

SEQ ID NO: 64458 - RNA, 55 nt, Mus musculus
cucugagggcguggguucucgucccaggacauggcugaggggagucuccagaggc

SEQ ID NO: 64459 - RNA, 45 nt, Mus musculus
ucuccucuucagucaaaaugggucugcuuucuccagcagcagacc

SEQ ID NO: 64460 - RNA, 52 nt, Mus musculus
cgcagcccggcgcaucucaucuuccugcaguuucugucgugcaacugacagc

SEQ ID NO: 64461 - RNA, 45 nt, Mus musculus
acaggaccugggucuguugcugguggggaugaccgagaacccaca

SEQ ID NO: 64462 - RNA, 63 nt, Mus musculus
cauggagucgggagauacaccaggacucucuccaagucacugggaacugcgguugggggaacg

SEQ ID NO: 64463 - RNA, 46 nt, Mus musculus
aacguggccuggaggagaaacuggacaguuagcggggauggcaggu

SEQ ID NO: 64464 - RNA, 46 nt, Mus musculus
cucuugugaccccaggagaacuacagaagcagucgaugcugcaggu

SEQ ID NO: 64465 - RNA, 44 nt, Mus musculus
ugccuauggaguuagucuagcuggguaguuugcuugcuccaggg

SEQ ID NO: 64466 - RNA, 31 nt, Mus musculus
cuuugaaaacaauaauaauggagaugaaauu

SEQ ID NO: 64467 - RNA, 42 nt, Mus musculus
agcccuagcauccuuagguuccucacagcucuccagggauaa

SEQ ID NO: 64468 - RNA, 46 nt, Mus musculus
gcagaacuaaccugggguagcaugcacccuuaucuucaagcuuccu

SEQ ID NO: 64469 - RNA, 46 nt, Mus musculus
gugagucuugauuuugucuuuauaugcgagggaacuacugggaacu

SEQ ID NO: 64470 - RNA, 42 nt, Mus musculus
agaggaaaaugccgggaagcaaagggaaacaaagacgcaguu

SEQ ID NO: 64471 - RNA, 45 nt, Mus musculus
agcaaagugagaaaacacuaggaacuagcgugcuaggcuuuggag

SEQ ID NO: 64472 - RNA, 42 nt, Mus musculus
ugaccuaaccugacuaagaaaaacaaugaaagaaagggggaa

SEQ ID NO: 64473 - RNA, 54 nt, Mus musculus
uuaggggucugucuggggauuacacuugcuguggauagaagcaacuuuaagacc

SEQ ID NO: 64474 - RNA, 90 nt, Mus musculus
ggcuguguaagaaagauaauuuuaaguagagucaccuaaggauauugagaugcucucuaaccuuacuucccaacucuugcauuugacaga

SEQ ID NO: 64475 - RNA, 42 nt, Mus musculus
cuucauggaucagauggacuguaagagcaucaggaccaagcu

SEQ ID NO: 64476 - RNA, 55 nt, Mus musculus
uccugaugcucuuacaguccaucugauccaugaagucaccaaggucaggcaagac

SEQ ID NO: 64477 - RNA, 46 nt, Mus musculus
cuuccauguuggucuuuguacaauuguguuugcagugcccauggag

SEQ ID NO: 64478 - RNA, 71 nt, Mus musculus
ggugugcgucaccaucacugucauauuuuuguaagagcagaaaacuuuguauguauaguaaaaggaucaca

SEQ ID NO: 64479 - RNA, 49 nt, Mus musculus
uguugagaaccauggcuucagagaaguugggcgauguaacaugggugag

SEQ ID NO: 64480 - RNA, 45 nt, Mus musculus
uuugaauuucuaaccuucuuauuuucauuuucugaaugcugggau

SEQ ID NO: 64481 - RNA, 45 nt, Mus musculus
uauaguauaggaaacuggggcaugccuguaaucucaacacuuggg

SEQ ID NO: 64482 - RNA, 45 nt, Mus musculus
cuagcaggcaugguggugcauaccuuuaauacugagaggcagaga

SEQ ID NO: 64483 - RNA, 68 nt, Mus musculus
ugugcuggagcuccagggccuucagaagaacaugacucggaucaggaucgaugagcuagagccccggc

SEQ ID NO: 64484 - RNA, 50 nt, Mus musculus
ucuucuuuccaagugccggguuacagaugugugcuccuauaccaaggcuu

SEQ ID NO: 64485 - RNA, 46 nt, Mus musculus
ugcugaacccaaggaccuaaguucaaucuucuacacucaacaugag

SEQ ID NO: 64486 - RNA, 111 nt, Mus musculus
cuuucagucucuggccgugaugacaacaguguggagcuaacaguggcugagggacccuacaaaaucauuuugacagcacagccauuccgccuugaccugcuagaagaucga

SEQ ID NO: 64487 - RNA, 42 nt, Mus musculus
ucagccacuguuagcuccacacuguugucaucacggccagag

SEQ ID NO: 64488 - RNA, 52 nt, Mus musculus
uccugcucagugucaaugcccgaggacuuauggccuuugagcaccagagggc

SEQ ID NO: 64489 - RNA, 45 nt, Mus musculus
gggaacuuacugugguagugccuagaaaugucacaaagucuggua

SEQ ID NO: 64490 - RNA, 42 nt, Mus musculus
ucucccacccuccugccccaucuggcuguucugcacccaguc

SEQ ID NO: 64491 - RNA, 41 nt, Mus musculus
gguaaagacagaucuggguugcaauuuucucuuucuuguac

SEQ ID NO: 64492 - RNA, 46 nt, Mus musculus
ggaucugcuuucuccuuccccuucucacaucaucacauuccccuag

SEQ ID NO: 64493 - RNA, 41 nt, Mus musculus
accgagcgcgagacuaacuuuauccgagaaacuggggcggg

SEQ ID NO: 64494 - RNA, 67 nt, Mus musculus
ccuccugcccgccccaguuucucggauaaaguuagucucgcgcucgguagcgugugggauaagauca

SEQ ID NO: 64495 - RNA, 45 nt, Mus musculus
acccaggaaaaggcugagaaggaugagccaggagccugggaggag

SEQ ID NO: 64496 - RNA, 42 nt, Mus musculus
aaacagaagcucuguaaaucauccuuuucuuucaggccccac

SEQ ID NO: 64497 - RNA, 45 nt, Mus musculus
gaauggaacauguguaugggaucccugagcaugcugacagccuga

SEQ ID NO: 64498 - RNA, 41 nt, Mus musculus
cgcacagagaaacccugucucgaaaaacugaaggggagaaa

SEQ ID NO: 64499 - RNA, 64 nt, Mus musculus
ugucagagaguggcauuauugauguuuuccuaaugcuuggcccuucgguuuuugaugucuuuag

SEQ ID NO: 64500 - RNA, 59 nt, Mus musculus
cacaacaugccuugugaugucauuugguuggacauugaacaugcugauggcaagcggua

SEQ ID NO: 64501 - RNA, 46 nt, Mus musculus
agcacauggcgacugcugaugggcuaauacagcgcucugggggcau

SEQ ID NO: 64502 - RNA, 29 nt, Mus musculus
aagaaagcccuacucaggacaaagggacg

SEQ ID NO: 64503 - RNA, 44 nt, Mus musculus
gaguaagcaaauacagagguguaacacaaaauuaugaagaccag

SEQ ID NO: 64504 - RNA, 46 nt, Mus musculus
cgagagccauggcuguuagcgucucaauaccaagaugcaauccgag

SEQ ID NO: 64505 - RNA, 46 nt, Mus musculus
caaacaaacaaaagacaaacaaacaaacaaacaaaaacaagagaga

SEQ ID NO: 64506 - RNA, 90 nt, Mus musculus
cucuggguacaguauccugaggauaugucuaccuucaguauagaggaucaguucaugcuuggugagaaaugggaggacagcugguaggag

SEQ ID NO: 64507 - RNA, 59 nt, Mus musculus
ucuuggccaggcaaauagaccugcacuccgugggccccagcauccgauacagggugaau

SEQ ID NO: 64508 - RNA, 49 nt, Mus musculus
ugacauucagagcuaucagaagcaucaugggccccagaccuuguaucug

SEQ ID NO: 64509 - RNA, 50 nt, Mus musculus
uauugcguaaaccuggugucagcguggcauccgacuggaguauucaucuu

SEQ ID NO: 64510 - RNA, 45 nt, Mus musculus
acucagaacaaguuccuuggguuaucgaagaugaauacuccaguc

SEQ ID NO: 64511 - RNA, 46 nt, Mus musculus
agcccugucaucuugcccagauguugacagaaucugggucguagaa

SEQ ID NO: 64512 - RNA, 45 nt, Mus musculus
gaugacagggcuguccuagggcucugaauuccacuugugaccuag

SEQ ID NO: 64513 - RNA, 42 nt, Mus musculus
ggcuugaauagauggggucuaaggagaagguagggacccuaa

SEQ ID NO: 64514 - RNA, 43 nt, Mus musculus
uccuuuucuucuucccuguucccuccuauccaaaaugcccauc

SEQ ID NO: 64515 - RNA, 46 nt, Mus musculus
uccacacaauuaggagggcaagguuauuaaacuucuuuugccccuc

SEQ ID NO: 64516 - RNA, 130 nt, Mus musculus
gguuucacugaaucacggucaccuguauuuauugcugggaagaagacugaggguggggggagacgaucauguguacccagggguggcuucaagcccugguaagcggguugagggaggacucaggaaccag

SEQ ID NO: 64517 - RNA, 45 nt, Mus musculus
acuuccucuggguucccaacugugacaaguuuugauaaaaaggag

SEQ ID NO: 64518 - RNA, 42 nt, Mus musculus
cuagagacaugaggauucagauggaaaucaagguguuggggg

SEQ ID NO: 64519 - RNA, 46 nt, Mus musculus
gguuucuagucaggagggcugaugguaguagaggaacaucaagcag

SEQ ID NO: 64520 - RNA, 45 nt, Mus musculus
accuucggccgauccggagaacaaggcccagcgcucggcucaggu

SEQ ID NO: 64521 - RNA, 61 nt, Mus musculus
uugcucuccgaccugagccgagcgcugggccuuguucuccggaucggccgaagguguuccg

SEQ ID NO: 64522 - RNA, 45 nt, Mus musculus
aggagcuggaaccucacuccggucaggcaggaaucgagcucguuc

SEQ ID NO: 64523 - RNA, 44 nt, Mus musculus
cggcggcgggaacggccauggcggcuaacauguaccggguggga

SEQ ID NO: 64524 - RNA, 46 nt, Mus musculus
ucggugcugccgcaaaguaagccgcaaaggagacaagggaggagga

SEQ ID NO: 64525 - RNA, 46 nt, Mus musculus
cccuagaaaccaugcucuccgaccguacggcuugugaaccccagau

SEQ ID NO: 64526 - RNA, 46 nt, Mus musculus
cacugucagcaaagcugacccacugcaccaccugagcugccgccuc

SEQ ID NO: 64527 - RNA, 46 nt, Mus musculus
uuguuguggugcauaaugcccaagguggggaacacccagguacuag

SEQ ID NO: 64528 - RNA, 73 nt, Mus musculus
guaauaucagccagugucacucgcucgcccacuagaaaaguucgagucuucaagugaguguccagcagcccca

SEQ ID NO: 64529 - RNA, 46 nt, Mus musculus
uuuuguucucacuggacuguaauucugaaccagaauggguccagag

SEQ ID NO: 64530 - RNA, 42 nt, Mus musculus
ucaaaacaggaguggguagaaggguaaaucauggagacagau

SEQ ID NO: 64531 - RNA, 42 nt, Mus musculus
accgguugguauuggggaaggccuggcgaaaagaaggcucua

SEQ ID NO: 64532 - RNA, 46 nt, Mus musculus
gucaguuacugggugacacccacguucucugggugaacaaggcuau

SEQ ID NO: 64533 - RNA, 42 nt, Mus musculus; identical to SEQ ID NO: 55066

SEQ ID NO: 64534 - RNA, 44 nt, Mus musculus; identical to SEQ ID NO: 55067

SEQ ID NO: 64535 - RNA, 42 nt, Mus musculus
ggaggcacaggcaggucuauagacugccuuugagccacagga

SEQ ID NO: 64536 - RNA, 46 nt, Mus musculus
auuucuucagacuccauguucccccuugcucccaaauagugcagau

SEQ ID NO: 64537 - RNA, 42 nt, Mus musculus
auucggagaacagccaccucaaaucuuuauuuacacccaggu

SEQ ID NO: 64538 - RNA, 50 nt, Mus musculus
aauggaguggagccuugacaacguagugucccugguaugugugugugugu

SEQ ID NO: 64539 - RNA, 25 nt, Mus musculus
gggcaggccuguaucuggucuguag

SEQ ID NO: 64540 - RNA, 91 nt, Mus musculus
cacaggacuugcuucuggguguuuguuugccuuauggguguuucucugugguuucccaugugucucauccuauauguauauuugcgucuug

SEQ ID NO: 64541 - RNA, 62 nt, Mus musculus
ggcuuggcuuagcagacagagaagagagagagagauagagagagagagaggagagaaugaga

SEQ ID NO: 64542 - RNA, 46 nt, Mus musculus
guucaggccacccuuaaacucuugaucuccuggcuuucccucuuga

SEQ ID NO: 64543 - RNA, 46 nt, Mus musculus
ugguccucagugcuuucggcaucuaaggacccuuguuccagggcuc

SEQ ID NO: 64544 - RNA, 46 nt, Mus musculus
cacugggguggaugccaccauccaugcuuagagaacagucucacau

SEQ ID NO: 64545 - RNA, 44 nt, Mus musculus
ccuagguugugugaccaagauucgcaaagaaagagagagagaga

SEQ ID NO: 64546 - RNA, 41 nt, Mus musculus
gaacuccccugcggcccgcacugggguggucaaggagggug

SEQ ID NO: 64547 - RNA, 42 nt, Mus musculus
accaucuacuuugacaaccugcagucuggugaggugacccag

SEQ ID NO: 64548 - RNA, 46 nt, Mus musculus
gcagagcggggaugaugaggacuaccagcgcaucuacaccacgaag

SEQ ID NO: 64549 - RNA, 57 nt, Mus musculus
aucaagccacgccugaggucggaggauggaguagaaggggaccuuggggagacccag

SEQ ID NO: 64550 - RNA, 46 nt, Mus musculus
ugaaaucuccaacacagauguggaaacccagccagggaaaacggug

SEQ ID NO: 64551 - RNA, 41 nt, Mus musculus
ugcuggccacucaaaauuccaggucacugugccuggggcaa

SEQ ID NO: 64552 - RNA, 45 nt, Mus musculus
cuuggggcuggcucaguagagguacaggccccaucccuccagagu

SEQ ID NO: 64553 - RNA, 42 nt, Mus musculus
cacuugaaggugacuuaggccugaaagguaccaagcugcaag

SEQ ID NO: 64554 - RNA, 46 nt, Mus musculus
ccugugcuuccaaaaucgagggcagcaucacugguccuagugugga

SEQ ID NO: 64555 - RNA, 51 nt, Mus musculus
cucuggggauguaagucugccugagauugcuacuggugggcucgaagggaa

SEQ ID NO: 64556 - RNA, 56 nt, Mus musculus
cugcuccugaggugaaaggugauguuaaaggcccucagauggcaguuaaaggcucc

SEQ ID NO: 64557 - RNA, 89 nt, Mus musculus
ugcaccuaaagggaaaggggguguagaugucauucuccccaauguagaaggaaaagccaaaggucuugaaguugaugucaaaggcccca

SEQ ID NO: 64558 - RNA, 83 nt, Mus musculus
aaauggacaucagugcuccagauguagaaguccaugguccagaauggaauuugaagaugcccaaguucagugucccaggaguc

SEQ ID NO: 64559 - RNA, 72 nt, Mus musculus
aaguaagugucaagacuccaaagauuucuaugccugauguggaucugcauaucaaagggccaaaggugaagg

SEQ ID NO: 64560 - RNA, 100 nt, Mus musculus
gacauugacaccccacaaguggauguucauggcccagaccugaagauucccaagaugaaaaugcccaaauucagugugccaggguucaaagcagagggcc

SEQ ID NO: 64561 - RNA, 60 nt, Mus musculus
gaccuugacauuucugggacuaagguggaagucagugcuccagauguaagcauugaagga

SEQ ID NO: 64562 - RNA, 58 nt, Mus musculus
cuccaugccagauguggacuuacacuuaaaaggccccaauguaaagggagaauaugau

SEQ ID NO: 64563 - RNA, 45 nt, Mus musculus
aauguggauguucaagguccugaauugcauaugaagaugcccaag

SEQ ID NO: 64564 - RNA, 79 nt, Mus musculus
ccugaaggaaagcugaaggguccuaagcugaagaugccugagaugaacaucaaggccccaaagauauccaugccugaug

SEQ ID NO: 64565 - RNA, 86 nt, Mus musculus
uggauuugcauaugaaaggccccaaaguuaaaggagaauaugaugucacaaugccaaagcuggaaggagacuugaaaggccccaaa

SEQ ID NO: 64566 - RNA, 74 nt, Mus musculus
uuucuguaccaaagcuagauauuagugcuccagaucugaaccuugagggaccagaagggaaguugaaaggcccc

SEQ ID NO: 64567 - RNA, 46 nt, Mus musculus
aaggugucucuaccagauguggaucuggaucucaaaggacccaaaa

SEQ ID NO: 64568 - RNA, 47 nt, Mus musculus
cagauguggacauuaaagguccaaauguagauauuaaagcaccagaa

SEQ ID NO: 64569 - RNA, 46 nt, Mus musculus
ccuaaacuugacauugaaaccucagaugugagccuugagggaccag

SEQ ID NO: 64570 - RNA, 77 nt, Mus musculus
gucaagggggacauggaugugacagugcccaagauagaaggugaaaugaaagugccagauguggauaucaaaggccc

SEQ ID NO: 64571 - RNA, 72 nt, Mus musculus
uaaaguggacaucagugccccagauguggauguacaaggcccagacuggcaccugaagaugcccaagaugaa

SEQ ID NO: 64572 - RNA, 48 nt, Mus musculus
gguccagaugcaaagcugaagggccccaaguucaagaugccugagaug

SEQ ID NO: 64573 - RNA, 94 nt, Mus musculus
auauggacgugcagggcccagacuggcaccugaagaugcccaagaugaaaaugcccaaguucagcaugccuggcuucaaagcagagggcccaga

SEQ ID NO: 64574 - RNA, 42 nt, Mus musculus
auauugaggccccagaugugagcaucgagggaccagaaggga

SEQ ID NO: 64575 - RNA, 63 nt, Mus musculus
ugccugauguggacuugaauauuaaggggcccaaaggaaaagcagauguggaugcaucauugc

SEQ ID NO: 64576 - RNA, 44 nt, Mus musculus
ggcuucaaaggagaagguccagaaguagacauccccaaggccaa

SEQ ID NO: 64577 - RNA, 95 nt, Mus musculus
uaaaagguccaaaauuuaagaugccagaaaugaacauaaagccucagaagauauccaugccagauguuagcuugaauuugaaaggcccuaaggua

SEQ ID NO: 64578 - RNA, 48 nt, Mus musculus
agcuccugcuguugacaucaaagguccuaaaguagaggcaccagaugu

SEQ ID NO: 64579 - RNA, 46 nt, Mus musculus
acccaagguggacauugauguuccagaugugaauauugaagggcca

SEQ ID NO: 64580 - RNA, 69 nt, Mus musculus
guugggcuuaauuugaaaggaccuaaacugaaaagugguguagauguuucucuuccaaaaguagaggga

SEQ ID NO: 64581 - RNA, 47 nt, Mus musculus
gaaaggccccaaagucaagggggauauggaugugacaaugcccaaga

SEQ ID NO: 64582 - RNA, 65 nt, Mus musculus
uggacaucaaaggccccaaaguggacaucaaugccccagauguagaugugcguggcccagacugg

SEQ ID NO: 64583 - RNA, 64 nt, Mus musculus
cugacauugaugucucaggacccaaaguggacauugauguuccugacuuagauauugagggucc

SEQ ID NO: 64584 - RNA, 47 nt, Mus musculus
cagaggcccucaaguugacaucaaagggaccaauguggaugugaaag

SEQ ID NO: 64585 - RNA, 61 nt, Mus musculus
caaagucaagggggacauggaugugacagugccaaaauuagagggagaauuaaaaggccca

SEQ ID NO: 64586 - RNA, 64 nt, Mus musculus
ccccaaagucaagggggacauggaugugacagugccaaaauuagagggagaauuaaaaggccca

SEQ ID NO: 64587 - RNA, 59 nt, Mus musculus
ccccaaagucaagggugacguggaugugacagugccaaaauuagagggagaauuaaaag

SEQ ID NO: 64588 - RNA, 76 nt, Mus musculus
gaaaggccccaaagucaagggggacauggaugugacagugcccaagauagaaggugagaugaaagugccagaugug

SEQ ID NO: 64589 - RNA, 62 nt, Mus musculus
aaaguggacaucaaugccccagauguggaugugcguggcccagacuggcaccugaagaugcc

SEQ ID NO: 64590 - RNA, 65 nt, Mus musculus
gguggacauugauguuccagaugugaauauugaagggccagaagggaagcugaagggccccaaau

SEQ ID NO: 64591 - RNA, 53 nt, Mus musculus
uaaaggguccuaaaaucaaaggagauauugacguuucagucccuaagauugaa

SEQ ID NO: 64592 - RNA, 70 nt, Mus musculus
gaaguugcuguugaaggcccagaagguaaauggaaaagccccaaguucaagaugccagacaugcacuuca

SEQ ID NO: 64593 - RNA, 141 nt, Mus musculus
aaacucccaaaaucuccaugccagacauugaucuucacuuaaagaguccaaagauaaagggggagguggauguagauguucccaaauuggaaggagaccucaaagggccaaauguggacaugagcaggccagacauugaga

SEQ ID NO: 64594 - RNA, 48 nt, Mus musculus
augccugacuuugauuugcaucuuaaggguccuaaagugaagggugau

SEQ ID NO: 64595 - RNA, 147 nt, Mus musculus
gacgugcagggcccagacuggcaccugaagaugcccaaaaugaaaaugcccaaguucagcaugccuggcuucaaagcagagggcccagaaguggaugugaacuugcccaaggcugacauugaugucucaggacccaagguggacauu

SEQ ID NO: 64596 - RNA, 173 nt, Mus musculus
gauguuccugaugugaacauugaagggccagaugcaaaacugaagggccccaaguucaagaugccugagaugaacaucaaggcccccaagaucuccaugccugacauugacuuaaaccugaaaggccccaaagugaagggugauguggaugugucucugcccaaaguggaagg

SEQ ID NO: 64597 - RNA, 58 nt, Mus musculus
uguuccagauguggauguccauggcccagacuggcaccugaagaugcccaaaauaaaa

SEQ ID NO: 64598 - RNA, 136 nt, Mus musculus
agguccagaugcaaagcugaagggccccaaguucaagaugccugagaugaacaucaaggcuccaaagaucuccaugccagauuuacaucuuaagggucccaaagugaagggugauguagauguuucccugcccaaa

SEQ ID NO: 64599 - RNA, 168 nt, Mus musculus
guggaaggugaccucaaaggcccagauguugacaucaaaggucccaaaauggacaucaaugcuccagauauggacgugcagggcccagacuggcaccugaagaugcccaaaaugaaaaugcccaaguucagcaugccuggcuucaaagcagaggguccagaaguagau

SEQ ID NO: 64600 - RNA, 85 nt, Mus musculus
ggccagaugcaaaacugaaaggccccaaguucaagaugccugagaugaacaucaaggcccccaagaucuccaugccugacauuga

SEQ ID NO: 64601 - RNA, 116 nt, Mus musculus
cuuaaaccugaaaggccccaaagugaagggugauguggauaugucucugcccaaaguggaaggugagauuaaaguuccugaaguugacaucaaaggccccaaaguggacauugaug

SEQ ID NO: 64602 - RNA, 89 nt, Mus musculus
uuccagauguggauguucauggcccagacuggcaccugaagaugcccaaggugaaaaugcccaaguucagcaugccuggcuucaaggga

SEQ ID NO: 64603 - RNA, 84 nt, Mus musculus
guuuaagaugccagaggugaacauaaaggcuccuaagaucuccaugccagauuugaaucuuaaucuuaaaggccccaaugugaa

SEQ ID NO: 64604 - RNA, 46 nt, Mus musculus
ccuucucuugacauaaagagcccaaaauuagauguaaaugcuccag

SEQ ID NO: 64605 - RNA, 45 nt, Mus musculus
ggucccaaacugaaaaugccugacaugcauguaagcaugcccaag

SEQ ID NO: 64606 - RNA, 42 nt, Mus musculus
aagggagauguugauaucucuggacccaaacuggagggugac

SEQ ID NO: 64607 - RNA, 46 nt, Mus musculus
uccaaaguucaaacaccugaaguggaugucaaacuuaaaaagccag

SEQ ID NO: 64608 - RNA, 45 nt, Mus musculus
ugaaggguccuaaagucaaaggagaccuagaugcagcaggcccaa

SEQ ID NO: 64609 - RNA, 56 nt, Mus musculus
aaguggacauuaaagcaccagauguucaacuuaaugcaccagauguggauguucau

SEQ ID NO: 64610 - RNA, 45 nt, Mus musculus
uggcuguggauuuaccaaaaggagacauuaauauagaagguccca

SEQ ID NO: 64611 - RNA, 82 nt, Mus musculus
gccccaaauuuaagaugccugagaugaacaucaaagccccuaagaucuccaugccugauauugacuuaaaccugaaaggucc

SEQ ID NO: 64612 - RNA, 75 nt, Mus musculus
uggacauugauguuccagauguggauguucauggcccagacuggcaccugaagaugcccaaggugaaaaugccca

SEQ ID NO: 64613 - RNA, 136 nt, Mus musculus
augcaaaacugaagggccccaaguucaagaugccugagaugaacaucaaggcuccaaagaucuccaugccugauauugacuuaaaccugaaaggccccaaagugaagggugauguggaugugucucugcccaaagu

SEQ ID NO: 64614 - RNA, 65 nt, Mus musculus
cauugauguuccagauguggauguucauggcccagacuggcaccugaagaugcccaaaauaaaaa

SEQ ID NO: 64615 - RNA, 99 nt, Mus musculus
uugauguuccagaugugaauauugaagggccagaugcaaaacugaaaggccccaaguucaagaugccugagaugaacaucaaggcccccaagaucucca

SEQ ID NO: 64616 - RNA, 111 nt, Mus musculus
ugccugacauugacuuaaaccugaaaggccccaaagugaagggugauguggaugugucucugcccaaaguggaaggugagauuaaaguuccugaaguugacaucaaagacc

SEQ ID NO: 64617 - RNA, 58 nt, Mus musculus; identical to SEQ ID NO: 64597

SEQ ID NO: 64618 - RNA, 135 nt, Mus musculus
gguccagaugcaaagcugaagggccccaaguucaagaugccugagaugaacaucaaggcuccaaagaucuccaugccagauuuacaucuuaagggucccaaagugaagggugauguagauguuucccugcccaaa

SEQ ID NO: 64619 - RNA, 175 nt, Mus musculus
guggaaggugaccucaaaggcccagauguugacaucaaaggucccaaaauggacaucaaugcuccagauauggacgugcagggcccagacuggcaccugaagaugcccaaaaugaaaaugcccaaguucagcaugccuggcuucaaagcagagggcccagaaguggaugugaacc

SEQ ID NO: 64620 - RNA, 77 nt, Mus musculus
aggaccagaugcaaaacugaagggucccaaguucaagaugccugagaugaacaucaaggcccccaagaucuccaugc

SEQ ID NO: 64621 - RNA, 78 nt, Mus musculus
cugacauugacuuaaaccugaaaggccccaaagugaagggugauguggauaugucucugcccaaaguggaaggugaga

SEQ ID NO: 64622 - RNA, 101 nt, Mus musculus
aguggacauugauguuccagauguggauguucauggcccagacuggcacuugaagaugcccaaggugaaaaugcccaaguucagcaugccuggcuucaagg

SEQ ID NO: 64623 - RNA, 50 nt, Mus musculus
aagguccagaugcaaagcugaaggguccuaaguucaagaugccugagaug

SEQ ID NO: 64624 - RNA, 49 nt, Mus musculus
gcccagagguugacaucaaaggucccaaaauggacaucagugcccccga

SEQ ID NO: 64625 - RNA, 58 nt, Mus musculus
agguggacauugaaggcccuaauguuaauauugaaggaccagaagggaaacugaaggg

SEQ ID NO: 64626 - RNA, 64 nt, Mus musculus
cugaaguugauaucaaaggucccaaaguggacaucagugccccagauauggauguucauggccc

SEQ ID NO: 64627 - RNA, 71 nt, Mus musculus
agauuggcaccugaagaugcccaagaugaaaaugccuaaguucagcaugccuggcuucaaagcagagggcc

SEQ ID NO: 64628 - RNA, 57 nt, Mus musculus
gaccagaugcaaagcugaagggucccaaguucaagaugccugagaugaacauaaaag

SEQ ID NO: 64629 - RNA, 117 nt, Mus musculus
ugacuuugauuugcaucugaaaggucccaaagugaagggugauguggaugcuuccuugccuaaaauggaaggugaauuaaaggguccugguauugauauaaagugccccacugugga

SEQ ID NO: 64630 - RNA, 92 nt, Mus musculus
uauugacacuccugaugucaauauugaaguuccagaaggaaaauuaaaaggacccaaauuuaaaaugccagacaugcauaucaaagcuccca

SEQ ID NO: 64631 - RNA, 87 nt, Mus musculus
ccuugcacucccuaauguugaaggugaucuuaaagggccagaaauagacauugaggguccugaaggaaaacucaaaggccccaaauu

SEQ ID NO: 64632 - RNA, 46 nt, Mus musculus
caaaucucaaugagugacauugauuugaaugugaaagggccuaaga

SEQ ID NO: 64633 - RNA, 46 nt, Mus musculus
ccuaaacuggacauugacacuccugauauugacauucaugguccag

SEQ ID NO: 64634 - RNA, 68 nt, Mus musculus
cugaaguugauaucaaaggucccaaaguggacaucagugccccagauguggauguucauggcccagac

SEQ ID NO: 64635 - RNA, 87 nt, Mus musculus
ugucucaggacccaagguggacauugauguuccugaugugaacauugaagggccagaugcaaaacugaagggccccaaguucaagau

SEQ ID NO: 64636 - RNA, 105 nt, Mus musculus
gccugagaugaacaucaaggcucccaagaucuccaugccugauauugacuuaaaccugaaaggccccaaagugaagggugauguggaugugucucugccuaaagu

SEQ ID NO: 64637 - RNA, 75 nt, Mus musculus; identical to SEQ ID NO: 64612

SEQ ID NO: 64638 - RNA, 46 nt, Mus musculus
cccaagguggacauugauguuccagauguuaauguugaggguccag

SEQ ID NO: 64639 - RNA, 46 nt, Mus musculus
gguacucucaaaggaccugaaauagauaugaaagguccaggucugg

SEQ ID NO: 64640 - RNA, 63 nt, Mus musculus
uauugaggggccggauguuaaaguuccgaaauuuaagaaacccaaguuuggauuuggugcaaa

SEQ ID NO: 64641 - RNA, 102 nt, Mus musculus
aagccccaaagcugacaucaagacacccacaguugaugugacugucccugaagcagagcugaauguugauucuccugaaauaaacauugguggcaagagcaa

SEQ ID NO: 64642 - RNA, 74 nt, Mus musculus
uuaagucaccuaaauuuaaagcagaggcuccccuaccuagccccaagcuggagggugaaaucaagguaccagau

SEQ ID NO: 64643 - RNA, 46 nt, Mus musculus
cagggauuaauguggaagcuccugauauucauaugaaggcucccaa

SEQ ID NO: 64644 - RNA, 47 nt, Mus musculus
gcuaaaaucaaagcacccucuuuuaguguuucugcuccucaagucuc

SEQ ID NO: 64645 - RNA, 46 nt, Mus musculus
aaaaucaaguucccuaaguuuuccuugcccaagaucagugccccag

SEQ ID NO: 64646 - RNA, 44 nt, Mus musculus
cggcgcucagaugcccucucuugaaggaggguugagcacaucag

SEQ ID NO: 64647 - RNA, 46 nt, Mus musculus
aggucuugaccucaaagguguugguggaaaaguacauauaggagca

SEQ ID NO: 64648 - RNA, 61 nt, Mus musculus
ccacaacagcacucaguguuggggcaccagauguaacacugaagggaccaagucuacaggg

SEQ ID NO: 64649 - RNA, 56 nt, Mus musculus
ccgacuuggacauuaacaucaaggggccacaaguuuguggagaacuaaagggauca

SEQ ID NO: 64650 - RNA, 72 nt, Mus musculus
gacuuuaacuuggaaggaccaaaagugaaggggagccucggggcugcgggugaauugaaaggcccagcgauu

SEQ ID NO: 64651 - RNA, 50 nt, Mus musculus
ucugggugugaugugaaacucucaucagggcagauuucuggucccgaaau

SEQ ID NO: 64652 - RNA, 46 nt, Mus musculus
ucagauuuuggugucagcuugaagggccccaaagucaaaggaggug

SEQ ID NO: 64653 - RNA, 46 nt, Mus musculus
ggauacaucuaaacuugcugggaaccuucauuucucaggaccaaag

SEQ ID NO: 64654 - RNA, 49 nt, Mus musculus
cuucccuaaaguggaggccaaugugcaggcuggugcuggagaaggcaag

SEQ ID NO: 64655 - RNA, 61 nt, Mus musculus
ugagagggaguucucagcgccuuccaccccaacugggacuuuggaguuugcagguggagac

SEQ ID NO: 64656 - RNA, 112 nt, Mus musculus
gcuaaaggcaagcauggaaagcugaaguuugguaccuuugguggcuugggaucaaagagcaaaggucauuaugagguuacugggagugaugaugaggcaggcaaguuacagg

SEQ ID NO: 64657 - RNA, 29 nt, Mus musculus
ugagguagaacugucaguuuccacaaaga

SEQ ID NO: 64658 - RNA, 45 nt, Mus musculus
gggacucugcagcuagguaaagaguucuaaguucaucuggcccac

SEQ ID NO: 64659 - RNA, 48 nt, Mus musculus
cuuuucuuuuuccuuuuucuuucuuucuuuuuuuuuuugcauugaacg

SEQ ID NO: 64660 - RNA, 46 nt, Mus musculus
uuugugaguaagggagggugggauaaaagguggcagagggagcaag

SEQ ID NO: 64661 - RNA, 45 nt, Mus musculus
uuaucuucucucuuucccuuaccuccaccccuaccccauccccag

SEQ ID NO: 64662 - RNA, 42 nt, Mus musculus
acucugagaauggugggcuacugguagcugcuguggggggag

SEQ ID NO: 64663 - RNA, 46 nt, Mus musculus
auauauugcagagagagagaagagagagagaagagagagagaagag

SEQ ID NO: 64664 - RNA, 77 nt, Mus musculus
agagagggagagagagagagagaagagagagagagagagagagagagagagagagagagagagagagagagaggccg

SEQ ID NO: 64665 - RNA, 42 nt, Mus musculus
ugcugcaaacaggaagagcaaguguucaaucuccagccccua

SEQ ID NO: 64666 - RNA, 45 nt, Mus musculus
uuuaaauaucaaguuucagggcagccagggauacacagugaguga

SEQ ID NO: 64667 - RNA, 45 nt, Mus musculus
aaaaaaaaaagcuuuaacauguaggcagaggguugguuugaugag

SEQ ID NO: 64668 - RNA, 46 nt, Mus musculus
ccuuucuuccauuuaguuuagcgccagcugcuaguuuccuguguag

SEQ ID NO: 64669 - RNA, 45 nt, Mus musculus
acacagagaaacccugucucaaaaaacaaacaaacaaaaaaacua

SEQ ID NO: 64670 - RNA, 45 nt, Mus musculus
agagagagaaccgauuagcacauguccugggucuuguugggggug

SEQ ID NO: 64671 - RNA, 45 nt, Mus musculus
cagagaaacccugucucgaaaaaccaaaaaaaaaaaaagaagauc

SEQ ID NO: 64672 - RNA, 46 nt, Mus musculus
auuuucuugguggcuuaaucugugagauuguaaucugaaagcagag

SEQ ID NO: 64673 - RNA, 41 nt, Mus musculus
guuaggcaccacacauugaguaacgcuacugcaaggggcua

SEQ ID NO: 64674 - RNA, 46 nt, Mus musculus
caucaccagauaauagauugguugcaaaaaaugauagggucaugug

SEQ ID NO: 64675 - RNA, 26 nt, Mus musculus
cugugggagucugucaagaaagaccg

SEQ ID NO: 64676 - RNA, 42 nt, Mus musculus
cuaucuauagcucuagcucaaaacagagugaucuagcccaac

SEQ ID NO: 64677 - RNA, 45 nt, Mus musculus
uagaugagagcuacuguaagaggaacgaggucuggcugccaaggu

SEQ ID NO: 64678 - RNA, 82 nt, Mus musculus
ucugcagguucacgccgcccgagcugacgucccagcaggccucauugaugaggucuuugagagccuccagcaccuucuucag

SEQ ID NO: 64679 - RNA, 50 nt, Mus musculus
augcuggugagguucacgcccauggcuagguugcggucgcagcgguaggu

SEQ ID NO: 64680 - RNA, 49 nt, Mus musculus
gaaagaaaaggggcgaaaaagagagagaaaaggaaaagggagaaaaggc

SEQ ID NO: 64681 - RNA, 44 nt, Mus musculus
uuccagugacucagagcuuaguaaagaugaugaagcugaccuag

SEQ ID NO: 64682 - RNA, 45 nt, Mus musculus
augauccggauuggccauauagagccaacccgaugaaaaagggag

SEQ ID NO: 64683 - RNA, 45 nt, Mus musculus
ggcuuuggaaaaaaauagaaaggugcauagaaaaggccaggcugc

SEQ ID NO: 64684 - RNA, 46 nt, Mus musculus
uguuggccuccuaggauauucagcagcugguccugucaccuuccag

SEQ ID NO: 64685 - RNA, 42 nt, Mus musculus
ucaacaaaaagaaugagugugucucugcuaaacaugcuacag

SEQ ID NO: 64686 - RNA, 61 nt, Mus musculus
uacaauaaucuguuguuuguggaaaaucauugcaaauguggaauguaugggaaggucaugg

SEQ ID NO: 64687 - RNA, 46 nt, Mus musculus
gaaaccuuacaaauguagugaaugugacaaaugcuuuacccaacaa

SEQ ID NO: 64688 - RNA, 45 nt, Mus musculus
ucugagaauccaucagagaauucauacaggagagaaaccuuacaa

SEQ ID NO: 64689 - RNA, 47 nt, Mus musculus
aaccaaaaaucccaucuuaauauucaucagagaauucauacaggaaa

SEQ ID NO: 64690 - RNA, 46 nt, Mus musculus
uagaauaacaguuaauacuuacaggcuagaaacuuaaugcaugcau

SEQ ID NO: 64691 - RNA, 47 nt, Mus musculus
agcuuuucaugauacccuuuuacuuguucacccucaaauauuacaag

SEQ ID NO: 64692 - RNA, 46 nt, Mus musculus
aaguacucuccuauuauccuguaacuaacuccaauaaagcugaaag

SEQ ID NO: 64693 - RNA, 45 nt, Mus musculus
ucucaaacucuuuggacaaauuacucaagcuuuauuuucugccag

SEQ ID NO: 64694 - RNA, 46 nt, Mus musculus
uucuuugguucuggcauguacugaagaccagcugagacauccagcc

SEQ ID NO: 64695 - RNA, 42 nt, Mus musculus
ugagaucugacgcccucuucuggagggucugaagacagcuac

SEQ ID NO: 64696 - RNA, 42 nt, Mus musculus
gucucccuugcccuacauggucccuuuucacuucccugguuu

SEQ ID NO: 64697 - RNA, 45 nt, Mus musculus
agaugugagcauauaaccuggaguagcuacagaaaccagggaagu

SEQ ID NO: 64698 - RNA, 25 nt, Mus musculus
aacuguaagaagugugacaagcaga

SEQ ID NO: 64699 - RNA, 45 nt, Mus musculus
cuucaguccaguggucggguguaaguaccugcuucugucucagug

SEQ ID NO: 64700 - RNA, 41 nt, Mus musculus
ugggauucacagccccaccaaccaggcugaggagggcccua

SEQ ID NO: 64701 - RNA, 45 nt, Mus musculus
uccugcaucucccugaggacaaccaagaaucugucaagccaguag

SEQ ID NO: 64702 - RNA, 25 nt, Mus musculus
accucuaccuuagcaugcagcaugg

SEQ ID NO: 64703 - RNA, 42 nt, Mus musculus
uuggucucucuugaguucuugggggucugcuacuguccugag

SEQ ID NO: 64704 - RNA, 46 nt, Mus musculus
uguuaauuucuaaaacaccauuaaaagacagcugauuguacagcag

SEQ ID NO: 64705 - RNA, 42 nt, Mus musculus
cccuuucaggcaauccacacgucugaacuacuuucgccacug

SEQ ID NO: 64706 - RNA, 112 nt, Mus musculus
uggguauguuaccuggaguaacuguagaaacuagggagguaaaaagguacuggaggggagugagauacagagaagagacuagcaggcuaaacaugauuacaugggaagaugg

SEQ ID NO: 64707 - RNA, 47 nt, Mus musculus
gagagggagcugggcuugguggcacacaccuuuaauuccagcacuca

SEQ ID NO: 64708 - RNA, 46 nt, Mus musculus
auacauauauauaauuugaauaaaauuuucccacucgcacugccag

SEQ ID NO: 64709 - RNA, 45 nt, Mus musculus
gaguuccaagacauccaggcuauacagagaaaccccaucucuaag

SEQ ID NO: 64710 - RNA, 46 nt, Mus musculus
uccugcagcccccaggaggcccgagcaaucuugagcuuggaaacag

SEQ ID NO: 64711 - RNA, 45 nt, Mus musculus
agaccucugaaacccucccuaaagccaaaauguccuaugaaugga

SEQ ID NO: 64712 - RNA, 46 nt, Mus musculus
cuccaagauacccaugcacauacaaaucuaggucaaagucaccaag

SEQ ID NO: 64713 - RNA, 46 nt, Mus musculus
acugaugcugagcuaaaguugaugaacaaauucccuuuggaaagug

SEQ ID NO: 64714 - RNA, 44 nt, Mus musculus
gaggaugauuuucaauucucacaggauaucccuaaacucuaggc

SEQ ID NO: 64715 - RNA, 41 nt, Mus musculus
gaaguugcaaagggcucaggcucgaagcggccggcgggggu

SEQ ID NO: 64716 - RNA, 45 nt, Mus musculus
uggcgcacuugcgagggagacgcgguggucaugguggcggcgggg

SEQ ID NO: 64717 - RNA, 45 nt, Mus musculus
cuggagcaggaugcauaaccaaacagagaagcuuguaggccacgu

SEQ ID NO: 64718 - RNA, 46 nt, Mus musculus
cugcagcuucaucaguuucucggcaugcucccucuccucaugagau

SEQ ID NO: 64719 - RNA, 46 nt, Mus musculus
caacucaugcuaugaauacucucccacagggaugaagcuggcacca

SEQ ID NO: 64720 - RNA, 42 nt, Mus musculus
uacugguacccuguaguuauaaacacuugugagcugccugau

SEQ ID NO: 64721 - RNA, 42 nt, Mus musculus
ggugacaguggcaguauacagcuuuuuccuugcaugcuugau

SEQ ID NO: 64722 - RNA, 46 nt, Mus musculus
ggcauggggaggggaguuaagaggguaggagagagagagagagaga

SEQ ID NO: 64723 - RNA, 42 nt, Mus musculus
gugcauauauauauauauauauauauagagagagagagagag

SEQ ID NO: 64724 - RNA, 46 nt, Mus musculus
acacacacaccacacacacacacacacacacaccccacacacacac

SEQ ID NO: 64725 - RNA, 41 nt, Mus musculus
cugguaucagagauguuuuguugaauaacuucuugugggau

SEQ ID NO: 64726 - RNA, 23 nt, Mus musculus
ccuggggccaccacgcccggcac

SEQ ID NO: 64727 - RNA, 46 nt, Mus musculus
gguggcaaucaggggucuuccuccgcccgccccaccggccccgccc

SEQ ID NO: 64728 - RNA, 48 nt, Mus musculus
ccacuugucgccugguaggucaugcuggcggaucugcucccagcggaa

SEQ ID NO: 64729 - RNA, 42 nt, Mus musculus
gucuguggaauaaauagaucucagggaagaaugggcccccag

SEQ ID NO: 64730 - RNA, 45 nt, Mus musculus
ccugugggccagugugugugugugugugugugugugugugugugu

SEQ ID NO: 64731 - RNA, 45 nt, Mus musculus
gcagugucacagcacccuaaaaaaaggccuucagcuccgggcuua

SEQ ID NO: 64732 - RNA, 46 nt, Mus musculus
agugaaacugcgauguguuuggucaagacauagccaaaucucaggc

SEQ ID NO: 64733 - RNA, 46 nt, Mus musculus
uuacuuucuucccccucugugugugugugugugugugugugugugu

SEQ ID NO: 64734 - RNA, 99 nt, Mus musculus
ugucuguuccccuucaggaugccuuccacgccuuccaccaagaucuccauuuugugcgcaaguuccugaaaccccuguugauuggagagcuagccccag

SEQ ID NO: 64735 - RNA, 45 nt, Mus musculus
ucaacagggguuucaggaacuugcgcacaaaauggagaucuuggu

SEQ ID NO: 64736 - RNA, 42 nt, Mus musculus
ccaacaucuuccacaaagacccagaugugacugucgcaccug

SEQ ID NO: 64737 - RNA, 46 nt, Mus musculus
cuagaaucuagaguugccuuugaccuuggccucagccagcccccug

SEQ ID NO: 64738 - RNA, 45 nt, Mus musculus
caguauggcaagaagaaacgcagauaccugcccuacaaccaccag

SEQ ID NO: 64739 - RNA, 47 nt, Mus musculus
gaacuuugaaguugaaaaucuggcguacaugcuggugugcaugcagu

SEQ ID NO: 64740 - RNA, 47 nt, Mus musculus
auggugccacugggacacugcuccucuuuguugcugucagguaugcc

SEQ ID NO: 64741 - RNA, 47 nt, Mus musculus
cugguucguguggaucacgcagaugaaccacauccccaaggagauug

SEQ ID NO: 64742 - RNA, 47 nt, Mus musculus
cucuucauugacugguucagcgggcaccucaauuuccagauugagca

SEQ ID NO: 64743 - RNA, 46 nt, Mus musculus
uguaggccgugcuuggcgcagaacgccuugaccaggggggccaccc

SEQ ID NO: 64744 - RNA, 42 nt, Mus musculus
uggccccccuggucaaggcguucugcgccaagcacggccuac

SEQ ID NO: 64745 - RNA, 46 nt, Mus musculus
gcguacagaagaucaguacaggaguaagcauggagccuucgaagag

SEQ ID NO: 64746 - RNA, 46 nt, Mus musculus
uggauuuuuacaugggugcuggggauucgaacucagguccucauca

SEQ ID NO: 64747 - RNA, 82 nt, Mus musculus
ucaccacccauaagggugcugccuucauugauggagguaugcauccagccagaugucgccagacuucuucagggaccugaga

SEQ ID NO: 64748 - RNA, 42 nt, Mus musculus
ggcgacaucuggcuggaugcauaccuccaucaaugaaggcag

SEQ ID NO: 64749 - RNA, 45 nt, Mus musculus
gggggugaggaugacugucaaucuugcccagugacucggugacug

SEQ ID NO: 64750 - RNA, 80 nt, Mus musculus
guccugcuggcuuuccucaguccucagcauuuucuggucagcaauccuauggccauggcacauguccaacaggaccaggg

SEQ ID NO: 64751 - RNA, 102 nt, Mus musculus
uggagggaacauacuuaaaaugacacggugagcauagcauguuuuccuagagcaagaacuggaaggaaaacuuguuauuuuuauauaaaaagcaacccagac

SEQ ID NO: 64752 - RNA, 46 nt, Mus musculus
caaagugucgcuuucaacgcgaugagaaauaaaaaggaugcccuag

SEQ ID NO: 64753 - RNA, 48 nt, Mus musculus
uuaugcguaugaccccaugccucugggcuaaacuguuuuguucucuga

SEQ ID NO: 64754 - RNA, 46 nt, Mus musculus
uuguaguccaagguacuuaacagaaggaucacaaguucaaaggcag

SEQ ID NO: 64755 - RNA, 46 nt, Mus musculus
ucgccgagucaagcucuaacacacacacaccacuacuucuugccuc

SEQ ID NO: 64756 - RNA, 37 nt, Mus musculus
gaaguccccuuuccuauccaaacuuugaugauccuag

SEQ ID NO: 64757 - RNA, 81 nt, Mus musculus
gugggaggggggacgucggcuauagcaggaggggacccacgcuaugucauucugaggucuaacuggacuaaccaaccaaua

SEQ ID NO: 64758 - RNA, 28 nt, Mus musculus
aggaguguagagggaagaggaggcugag

SEQ ID NO: 64759 - RNA, 46 nt, Mus musculus
uucaaugacugguucagcgggcaccucaauuuccagauugagcacc

SEQ ID NO: 64760 - RNA, 45 nt, Mus musculus
cugguuugugugggucacacagaugaaccaccuugucauggagau

SEQ ID NO: 64761 - RNA, 44 nt, Mus musculus
cauaggcccuuaguggauguucuuagccuuuuaaagccccauca

SEQ ID NO: 64762 - RNA, 45 nt, Mus musculus
aaauuuguaggugugcuuacaugugugugcauguggaggccagau

SEQ ID NO: 64763 - RNA, 46 nt, Mus musculus
acgccuagugccagccagaggcacagcuugucucccagaaagagau

SEQ ID NO: 64764 - RNA, 46 nt, Mus musculus
gucuuaagcaggaacagauaaacugugagcuugaauuugaugggaa

SEQ ID NO: 64765 - RNA, 45 nt, Mus musculus
agaagcugccaucaacauuuuguaacuagaaccacuagggcagaa

SEQ ID NO: 64766 - RNA, 45 nt, Mus musculus
uuucucagugcuacaaaagcaaaaaccuaacaugaagccaucgaa

SEQ ID NO: 64767 - RNA, 31 nt, Mus musculus
cucccacuccucacuccuuucagccucccga

SEQ ID NO: 64768 - RNA, 32 nt, Mus musculus
gcacauuucuaauacccccucccccaucacuc

SEQ ID NO: 64769 - RNA, 45 nt, Mus musculus
gucacaaccacagucacagucccugucauaaucacagccacaguc

SEQ ID NO: 64770 - RNA, 42 nt, Mus musculus
gauuugggugugaaacagucugcuuuuacauucucuggaguc

SEQ ID NO: 64771 - RNA, 43 nt, Mus musculus
ugucugugucugugugugucugugucugugugucugugucugu

SEQ ID NO: 64772 - RNA, 46 nt, Mus musculus
uguccuuggcgaguggcagccccuugagguaugaaucguguugauu

SEQ ID NO: 64773 - RNA, 53 nt, Mus musculus
acauuuccaacaccaugccaagcccaacaucuuccacaaggacccggacauaa

SEQ ID NO: 64774 - RNA, 46 nt, Mus musculus
cugggccaccaacugugucuuccaccgggcuucacaucacugagau

SEQ ID NO: 64775 - RNA, 45 nt, Mus musculus
ucugagggauggugugugugugugugugugugugugugugugugu

SEQ ID NO: 64776 - RNA, 43 nt, Mus musculus
uaggcccaagcuggauggcugcaacaugacuauggccaccuuu

SEQ ID NO: 64777 - RNA, 46 nt, Mus musculus
gugaggccugacaucccugagcaucauuugaacauccccaccucuc

SEQ ID NO: 64778 - RNA, 48 nt, Mus musculus
ccucuucaaaaccaaccaccuguucuucuuucuccuccugucccacau

SEQ ID NO: 64779 - RNA, 47 nt, Mus musculus
caaaauuguaaacuuacuaaaacauuagugugugugugagagagaga

SEQ ID NO: 64780 - RNA, 77 nt, Mus musculus
gaccuggacuucgugggcaaguucuugaagccccugcugauuggugagcuggccccagaggagcccagccuggaccg

SEQ ID NO: 64781 - RNA, 42 nt, Mus musculus
agccuugucuugugaagcagguguggucaccacaggcuagau

SEQ ID NO: 64782 - RNA, 45 nt, Mus musculus
ugacagcugccagaaaaccagccagaagugugagugccuauagug

SEQ ID NO: 64783 - RNA, 43 nt, Mus musculus
ggcucugcccacucaguuccuggggugugaccauggacaagug

SEQ ID NO: 64784 - RNA, 46 nt, Mus musculus
acucaguuuucuccaaaugucuauguucagaucuaacccagcagau

SEQ ID NO: 64785 - RNA, 45 nt, Mus musculus
ccggggggccaccgugucaucggacacuauucgggagaagaugcu

SEQ ID NO: 64786 - RNA, 45 nt, Mus musculus
ccggguagacuggcagcauggggaagggagguaaccagggagagg

SEQ ID NO: 64787 - RNA, 82 nt, Mus musculus
uccugagggaaggcagggguacuggcuagcuagugaaggcgaggaggagcgaaagcgaggggaggaggcacggugggaggag

SEQ ID NO: 64788 - RNA, 42 nt, Mus musculus
gaguauggucugccucagcucacaugugacucaggggccaag

SEQ ID NO: 64789 - RNA, 42 nt, Mus musculus
aacugcuuccgcaaggaccccgauaucaacaugcacccccuc

SEQ ID NO: 64790 - RNA, 42 nt, Mus musculus
ucugcugcugacuugcguuuguuuccucacagcucgggaggg

SEQ ID NO: 64791 - RNA, 45 nt, Mus musculus
gcugcuggggcugaaaggcuuccugggccuuuucuucauugucag

SEQ ID NO: 64792 - RNA, 26 nt, Mus musculus
gcaucaaguaugaguccaagccccug

SEQ ID NO: 64793 - RNA, 45 nt, Mus musculus
cagggcaacucugguuggacgcuuaccuucaccaauagcagcagc

SEQ ID NO: 64794 - RNA, 46 nt, Mus musculus
cuguugaagcaggaauucaaaacuguuauuucuucuacuuuggcag

SEQ ID NO: 64795 - RNA, 45 nt, Mus musculus
cuggcacacgcaauucuugggucucauuccauccagguuccagag

SEQ ID NO: 64796 - RNA, 46 nt, Mus musculus
cacugaacacuauucccauaguuuccuuuugcuccccagccuguaa

SEQ ID NO: 64797 - RNA, 42 nt, Mus musculus
uuccagcauuguauagcacaguuccaugucacaaacaggaag

SEQ ID NO: 64798 - RNA, 66 nt, Mus musculus
aagaaggcaaagugcagugcguguuuguggucaagaugaggguguuaagggauguuggagucuggu

SEQ ID NO: 64799 - RNA, 48 nt, Mus musculus
ucuucagaauaggugcagaccccuccccgugcccguucccugccaccc

SEQ ID NO: 64800 - RNA, 49 nt, Mus musculus
gaauguuacagagguaaagugaggcaucucaaauccacugacagauaag

SEQ ID NO: 64801 - RNA, 32 nt, Mus musculus
uuguuuuauagguuuguggagacaggauuugu

SEQ ID NO: 64802 - RNA, 59 nt, Mus musculus
cuaaacuaaccacuuguuaccagggcaaucccagccaggcuguaggggauuuuagaggg

SEQ ID NO: 64803 - RNA, 27 nt, Mus musculus
ucuggguccaguacuucuggcuccagg

SEQ ID NO: 64804 - RNA, 45 nt, Mus musculus
cagccgccucacgaucuccucgaugcucuuauguuucuggaugag

SEQ ID NO: 64805 - RNA, 46 nt, Mus musculus
ugguacgguagaacaugcccaucagguggcugguggucucacccuc

SEQ ID NO: 64806 - RNA, 46 nt, Mus musculus
guuaguguguccacaccauaagaaaguccugucaagggcuggugag

SEQ ID NO: 64807 - RNA, 46 nt, Mus musculus
auucuccauacauucaaccuguacuuuuugaguaccuauugugugu

SEQ ID NO: 64808 - RNA, 45 nt, Mus musculus
aucaacugugugggaaagaauguggguaggaccugggugguagau

SEQ ID NO: 64809 - RNA, 46 nt, Mus musculus
gucagaguguccuauggacacauggguucucuguuauugguggcag

SEQ ID NO: 64810 - RNA, 42 nt, Mus musculus
uucuuugccugucuccacagcucaccagacccacagccucag

SEQ ID NO: 64811 - RNA, 42 nt, Mus musculus
caugauggugcaccccugcaacuccagcucucaccagccuga

SEQ ID NO: 64812 - RNA, 46 nt, Mus musculus
aagacaaagugauaucacucacuugaugccagucaucuucagggau

SEQ ID NO: 64813 - RNA, 42 nt, Mus musculus
gagagagagagagagagagagagagagaacaugugugcaagu

SEQ ID NO: 64814 - RNA, 46 nt, Mus musculus
cuucucaccuauuaacauguuuuaaaaguugugugugacagaagga

SEQ ID NO: 64815 - RNA, 46 nt, Mus musculus
gucaagucaccugagaagagagucucaacugagagguugcccagau

SEQ ID NO: 64816 - RNA, 41 nt, Mus musculus
uguguauguauguguauaugugugucuguuuuugugugugu

SEQ ID NO: 64817 - RNA, 25 nt, Mus musculus
aggguagagugaggaguggggcaga

SEQ ID NO: 64818 - RNA, 46 nt, Mus musculus
ccaucuauucccaccaugugagaauguucuagaauccagcccuuug

SEQ ID NO: 64819 - RNA, 46 nt, Mus musculus
gccccuuauuuaugggaaccacuucauucuacuguuggguacagaa

SEQ ID NO: 64820 - RNA, 34 nt, Mus musculus
gcacccuggcccgcaaagaagccgggggacgucg

SEQ ID NO: 64821 - RNA, 89 nt, Mus musculus
auggggggccauguggguauuaggggcaaguuugagcgggcagaggaagaagcugggaaggaagaaaaugaggccaaagaagaggagga

SEQ ID NO: 64822 - RNA, 42 nt, Mus musculus
ccuuugcccacaccaguuccugcccucccauccagcccuguc

SEQ ID NO: 64823 - RNA, 46 nt, Mus musculus
ggagcaggcacuggcugugacagacgacaaggucucagugcuggau

SEQ ID NO: 64824 - RNA, 46 nt, Mus musculus
ucagucacccugauuaaaaagcuaccuugcugucaugcccagagau

SEQ ID NO: 64825 - RNA, 46 nt, Mus musculus
cuuuucucaaugcugagacaaaaugccuggcaaaagcagcuuagga

SEQ ID NO: 64826 - RNA, 46 nt, Mus musculus
acauccauuaaguggaauuuguaguaauagaauuuaauccaaagaa

SEQ ID NO: 64827 - RNA, 27 nt, Mus musculus
uuuucuuccugcucccagccacacuac

SEQ ID NO: 64828 - RNA, 59 nt, Mus musculus
cugcuucugggucucacggaccuccuugcagcccccuugcccuuuccuugccuuguguc

SEQ ID NO: 64829 - RNA, 44 nt, Mus musculus
gggagccaccuggaagccaaggugagagggcuggagcgccagau

SEQ ID NO: 64830 - RNA, 44 nt, Mus musculus
auacauaaaaacugggcaugguguauauguccguagccucuagc

SEQ ID NO: 64831 - RNA, 46 nt, Mus musculus
cuggucaacagaagaaggagaccucagcugauauuuugacccagau

SEQ ID NO: 64832 - RNA, 46 nt, Mus musculus
acaguggauuuuagguuuggcugggaugucugccgugggccagggg

SEQ ID NO: 64833 - RNA, 46 nt, Mus musculus
caggagaacaggugacuacugauugaguugauuccaauggcuagag

SEQ ID NO: 64834 - RNA, 44 nt, Mus musculus
gguauguucccauaggcagagagcaggucuuaccaaggcagugu

SEQ ID NO: 64835 - RNA, 63 nt, Mus musculus
gccagcagagggcaccaaguuaguucuugccccuguagugauuuauagcgagaaaggaaaaag

SEQ ID NO: 64836 - RNA, 64 nt, Mus musculus
gggcaauccagagugaggauugcagauccacaggacugcagugaguagugaaggaaccgugggg

SEQ ID NO: 64837 - RNA, 44 nt, Mus musculus
gaggguuggugaguucacagagaaacucuugggaaggaagaccu

SEQ ID NO: 64838 - RNA, 41 nt, Mus musculus
uuacuauguagcccacugcucccuagaaguguauccgguaa

SEQ ID NO: 64839 - RNA, 42 nt, Mus musculus
ucuguauuccccguacgaauacacaggauuacaaagggccaa

SEQ ID NO: 64840 - RNA, 41 nt, Mus musculus
ugcugaguugugguaggugaccauagaagcuggagcgguga

SEQ ID NO: 64841 - RNA, 46 nt, Mus musculus
cuagcucaugaucaugaaccucuaaugaggacauuuuugguucuga

SEQ ID NO: 64842 - RNA, 45 nt, Mus musculus
accugccggcgccucuguuucuccuccuccaggugucgggcgaag

SEQ ID NO: 64843 - RNA, 42 nt, Mus musculus
cuccaacuggcgcucuggggagcuaggugccuggaccgucag

SEQ ID NO: 64844 - RNA, 45 nt, Mus musculus
gguggacagggcgauccggggcucgucucuggcugagguccggga

SEQ ID NO: 64845 - RNA, 41 nt, Mus musculus
uggacagggcgauccggggcucgucuccggcugagguccgg

SEQ ID NO: 64846 - RNA, 46 nt, Mus musculus
augcccucuucuggugugucugaacacagcgacuauguacucacau

SEQ ID NO: 64847 - RNA, 45 nt, Mus musculus
ggugggaggauacacucagaggagaaggggaggggaaauggagaa

SEQ ID NO: 64848 - RNA, 42 nt, Mus musculus
ugggcuaguucccaggcauccuaccacugauguguggcccau

SEQ ID NO: 64849 - RNA, 45 nt, Mus musculus
uaaauaaggugcugugugugcuuagaagugcauacuaacuugcag

SEQ ID NO: 64850 - RNA, 42 nt, Mus musculus
cuccaucccugaaagguccaagcuuaaauuuguugaaagagu

SEQ ID NO: 64851 - RNA, 45 nt, Mus musculus
uuuugaaaugaugcgcuugacaaucaaccgcuuuauggaucccaa

SEQ ID NO: 64852 - RNA, 45 nt, Mus musculus
ucgaucacuaugugacaccugugaagacuggcugccuaguaguag

SEQ ID NO: 64853 - RNA, 46 nt, Mus musculus
gcugugagccguaagacucuagagaggaugcaccaaaaucaaagag

SEQ ID NO: 64854 - RNA, 46 nt, Mus musculus
guccugagggucuuugcugguucuuggauccuaacuaagcacauga

SEQ ID NO: 64855 - RNA, 46 nt, Mus musculus
agcugggacacaaguagaugaggcuuccacauccauacugcaggag

SEQ ID NO: 64856 - RNA, 46 nt, Mus musculus
ggccaggaagaaguacauagggguguggagacaccgauugguccag

SEQ ID NO: 64857 - RNA, 47 nt, Mus musculus
agauguggugacuuuaacaagagucuaacaggcaggcgggcgggcag

SEQ ID NO: 64858 - RNA, 42 nt, Mus musculus
aggaccuccacgaccccgaacaccaccucuucuuaggcccau

SEQ ID NO: 64859 - RNA, 46 nt, Mus musculus
caggguucugguagcacgucccccacguaguccuccucguggcaag

SEQ ID NO: 64860 - RNA, 46 nt, Mus musculus
uugagcaacuccuacucuuggggccaaacagacuccggauuuguag

SEQ ID NO: 64861 - RNA, 46 nt, Mus musculus
gcaauagugguacccaccuuuaaucccagcaucugggaggcagaag

SEQ ID NO: 64862 - RNA, 46 nt, Mus musculus
aaaaaaaccagaagcaggugucagauccugggagcuagaguaccag

SEQ ID NO: 64863 - RNA, 45 nt, Mus musculus
aguuggaagagaagcuaccuguggcagcugaugaacaaacaggca

SEQ ID NO: 64864 - RNA, 32 nt, Mus musculus
ugccuugccucagaggccccugcagggcccag

SEQ ID NO: 64865 - RNA, 46 nt, Mus musculus
uuugcuuagaaguaggguuuuucauugaguucugugucucuaccag

SEQ ID NO: 64866 - RNA, 45 nt, Mus musculus
gggccacccuuuuccuccuaauguuccuccuguacuuaguccccu

SEQ ID NO: 64867 - RNA, 46 nt, Mus musculus
acagguaagccuacaguuugcugaacccauaaagaauccugcuguc

SEQ ID NO: 64868 - RNA, 45 nt, Mus musculus
cuggcugccaugaauccuaaguugcuacaagggcgcguugggcag

SEQ ID NO: 64869 - RNA, 46 nt, Mus musculus
cacagcagcaucccccuggcccaggaccucaccuacaaaaccucag

SEQ ID NO: 64870 - RNA, 66 nt, Mus musculus
ccaauguuuagagcagacacaacucaccuucauccacagcaccggcgccuguugcaucagaggcag

SEQ ID NO: 64871 - RNA, 46 nt, Mus musculus
cucaaugguacuggagauagaggagggcaccaguccagucaucaag

SEQ ID NO: 64872 - RNA, 42 nt, Mus musculus
aaagaaaaacaaguucgggauaagagaagaaaaacccuuguu

SEQ ID NO: 64873 - RNA, 45 nt, Mus musculus
uugauguggaggauuaugaaaggcgcuaucuccuaagucuagaag

SEQ ID NO: 64874 - RNA, 46 nt, Mus musculus
aauauguagcauguaugacaaccugaggggcaaauugccuggacaa

SEQ ID NO: 64875 - RNA, 43 nt, Mus musculus
gcaagcagcugacauucucauggcaacugccaggaaccucccu

SEQ ID NO: 64876 - RNA, 45 nt, Mus musculus
uugugugguaacucaugccugauuuccccgcacuauggggacuaa

SEQ ID NO: 64877 - RNA, 53 nt, Mus musculus
uacauguauuguauaacaguaaagcccuccguuacaaccagcugucuuuguac

SEQ ID NO: 64878 - RNA, 46 nt, Mus musculus
accagcugcuccccagugacagucccuagcuuccuucuaccaucua

SEQ ID NO: 64879 - RNA, 46 nt, Mus musculus
ucucaagaagaaagaccaucucuuucaauggcugcuucacucagau

SEQ ID NO: 64880 - RNA, 46 nt, Mus musculus
acccucagcugugguaagaagacaaggggaaagacuguccagagag

SEQ ID NO: 64881 - RNA, 42 nt, Mus musculus
gagguuaagaagaacauuuuaacgcucaagaggcagguucga

SEQ ID NO: 64882 - RNA, 66 nt, Mus musculus
uugauuguaacuaguauuuucagaaagauggcuggcuucaaugaaacauuaaaauauagcccaaac

SEQ ID NO: 64883 - RNA, 42 nt, Mus musculus
ucggccuagcugcaggagaccccuuuaugcccccaucgccac

SEQ ID NO: 64884 - RNA, 36 nt, Mus musculus
gaaguagaggaagggcacagggaggugaauguggag

SEQ ID NO: 64885 - RNA, 45 nt, Mus musculus
uuuuucuaacagcaaacucaggaacaacagaucugggggaggggu

SEQ ID NO: 64886 - RNA, 45 nt, Mus musculus
aaccugaaaaagagcaaggaugguauauggaaguagggguuggag

SEQ ID NO: 64887 - RNA, 45 nt, Mus musculus
guggagaaugcccucuggcgucccucugcagaaugcaugcguaga

SEQ ID NO: 64888 - RNA, 46 nt, Mus musculus
uaugcacgcuguguugcucaguuuuuccuguuuacuuuuuuuggau

SEQ ID NO: 64889 - RNA, 46 nt, Mus musculus
ccucuggccaacaggucagugggaauuaauacucugcuagagccag

SEQ ID NO: 64890 - RNA, 46 nt, Mus musculus
uaaccaccuuuuguaucugcugagccaauucacgagugggugccag

SEQ ID NO: 64891 - RNA, 46 nt, Mus musculus
ucgaugacaccuuccggcuccaucccgucggggccauugucucugg

SEQ ID NO: 64892 - RNA, 88 nt, Mus musculus
ccuugcuucucagugggguaggcaaaagucaccugagcugcagaguguguugauccuccuugucaaguacaaauaaaaaggcauugca

SEQ ID NO: 64893 - RNA, 54 nt, Mus musculus
caagacucccaucuuagcugagcccugacuguccagaucagguggcugcguagg

SEQ ID NO: 64894 - RNA, 53 nt, Mus musculus
aagcaacucugaaaaaggaagcacuccgccaggaucaggucuagaggagagcu

SEQ ID NO: 64895 - RNA, 47 nt, Mus musculus
aacagaaccugggaugggacuauccagaaucgugacggcuggcagca

SEQ ID NO: 64896 - RNA, 42 nt, Mus musculus
acagcuaagaacucccaaugagaggguagcaagggggcgggg

SEQ ID NO: 64897 - RNA, 46 nt, Mus musculus
cagccagacauagcgguggagaccugugccacugggaggcccggag

SEQ ID NO: 64898 - RNA, 54 nt, Mus musculus
gccuugauccugggaaacucuacacccugguccucacagaccccgaugcuccca

SEQ ID NO: 64899 - RNA, 45 nt, Mus musculus
agaugaccccuaaaaaguccacaggcugugguagagcccccucgc

SEQ ID NO: 64900 - RNA, 41 nt, Mus musculus
ggagggagggagggagggagagagagagagagagagcgaga

SEQ ID NO: 64901 - RNA, 48 nt, Mus musculus
ugcccuccgcggcagagaggaaaaaaaaugguauucgagucggugguc

SEQ ID NO: 64902 - RNA, 45 nt, Mus musculus
cacccucucggucugggaccauugucucagucucucgacaggcgc

SEQ ID NO: 64903 - RNA, 45 nt, Mus musculus
gagagguuguggcgcaggcuguucugccagcgcugcgugugcucg

SEQ ID NO: 64904 - RNA, 46 nt, Mus musculus
cagcaucuucucagccgaaugcuggauggccauggcggucagugag

SEQ ID NO: 64905 - RNA, 42 nt, Mus musculus
uguucuuuuccuccacaauuuugaauaaaauucugcccaauc

SEQ ID NO: 64906 - RNA, 46 nt, Mus musculus
aguaguaguaguaguaguaguaguaguaguaguagcaguagcagca

SEQ ID NO: 64907 - RNA, 41 nt, Mus musculus
aggcagagugcugccagugaggagggccaggauuucccagg

SEQ ID NO: 64908 - RNA, 69 nt, Mus musculus
uaaguguaacauugguuuuagcuuucaccugggcuucggcacccucuuauuaccuugcauguuaaaaaa

SEQ ID NO: 64909 - RNA, 59 nt, Mus musculus
aaaaaagaggaucucugugcauuuacucggaaacaaggaagggaaagcauuguguaccc

SEQ ID NO: 64910 - RNA, 45 nt, Mus musculus
auccucuggcucucuucccuggggcaggagagcuugugggaggga

SEQ ID NO: 64911 - RNA, 67 nt, Mus musculus
ucugcugaaucaaugggaagggcucuaucuaucgccgauucaguuauaugaucuuaaaagaauaagu

SEQ ID NO: 64912 - RNA, 53 nt, Mus musculus
auagugaaguugcauccuuuuaaacaaaagcuuggccucuugaauauggacuu

SEQ ID NO: 64913 - RNA, 46 nt, Mus musculus
uggcacauaaucuuuucaguaagaucucuugagaucuggaggguag

SEQ ID NO: 64914 - RNA, 46 nt, Mus musculus
uguuuugaaggaaauaagauugaggccccuuacagacaauguacag

SEQ ID NO: 64915 - RNA, 52 nt, Mus musculus
ucugaagaggaccucuucucucagguguaugaagaugucaagcaggaacuag

SEQ ID NO: 64916 - RNA, 45 nt, Mus musculus
uuuguuacaucucauagugguuugaauguuaaacucauagcagga

SEQ ID NO: 64917 - RNA, 46 nt, Mus musculus
gauggagaaaaccacccaaaucuggcugagugagaagaaaagcaag

SEQ ID NO: 64918 - RNA, 44 nt, Mus musculus
agcccugcgccucagcuagccagggcggccguucuaacgucuca

SEQ ID NO: 64919 - RNA, 46 nt, Mus musculus
uucaaagcccagcaaccacaugguggcucacaaccauccguaauga

SEQ ID NO: 64920 - RNA, 45 nt, Mus musculus
aacaccacacagauggagugcagcaaguucccgggauggauucag

SEQ ID NO: 64921 - RNA, 46 nt, Mus musculus
gggaugcaguauguccugcaggacaguggcagcucgucuguauguu

SEQ ID NO: 64922 - RNA, 44 nt, Mus musculus
uccugacuguuaccuagcaccaaaagaccauugucgucuaggcc

SEQ ID NO: 64923 - RNA, 46 nt, Mus musculus
guccaaguuuguauguauauuucuguauguauacauauacuccaag

SEQ ID NO: 64924 - RNA, 46 nt, Mus musculus
agagugcacuuaagcacaugcuguaccacacccugcccaaacccuu

SEQ ID NO: 64925 - RNA, 52 nt, Mus musculus
caccuaucagcuguaccagcaaauacagcuucaccagccccacuccccugcc

SEQ ID NO: 64926 - RNA, 46 nt, Mus musculus
cagaagcaugccuagcauuguuucuuguucuuauugaaacgcagag

SEQ ID NO: 64927 - RNA, 45 nt, Mus musculus
aaggggaugcauguuacugaaagucuguuugagguucagugagaa

SEQ ID NO: 64928 - RNA, 46 nt, Mus musculus
ccagguuagggugcugccuuucagguaccauuucacuuuuaauauu

SEQ ID NO: 64929 - RNA, 46 nt, Mus musculus
ucagugcacugcaguuaggaaaugccuuaguaaauuuugguugcau

SEQ ID NO: 64930 - RNA, 45 nt, Mus musculus
uaaacagucauaagagcagaacgguaguuaaccaacagaugggag

SEQ ID NO: 64931 - RNA, 46 nt, Mus musculus
uuguacauaaaguaucacuuuaugucccguaaauacauauugccag

SEQ ID NO: 64932 - RNA, 45 nt, Mus musculus; identical to SEQ ID NO: 44342

SEQ ID NO: 64933 - RNA, 48 nt, Mus musculus; identical to SEQ ID NO: 44343

SEQ ID NO: 64934 - RNA, 46 nt, Mus musculus
gggaaagcuuuuucuuuucaccccugaguauaauguuaacuguggg

SEQ ID NO: 64935 - RNA, 46 nt, Mus musculus
guggcucuuauaucagcaauccuagcauucaggagaaagaggcagg

SEQ ID NO: 64936 - RNA, 45 nt, Mus musculus
ccaaaucaguauuuuaaauguucauaauucuagaauaacaccuca

SEQ ID NO: 64937 - RNA, 46 nt, Mus musculus
ucagccaagugucaccgugcugauaccacaaaacaaaguauauuau

SEQ ID NO: 64938 - RNA, 46 nt, Mus musculus; identical to SEQ ID NO: 44344

SEQ ID NO: 64939 - RNA, 45 nt, Mus musculus
guuagcuucaguuguagaagacuuguaucggauuggaaguuacau

SEQ ID NO: 64940 - RNA, 46 nt, Mus musculus
gugaaaagcuucacacugcaacugagagucacuguccucuccuggg

SEQ ID NO: 64941 - RNA, 147 nt, Mus musculus
uagacacgauuuaauuggagcugccuuacaauacagguucagagguuuaguccacuaucguuaaggcauuggcagcauccaggcagaaauggggauggaggggcugagagucccaccucuuuuuccaaaggcagcuagagaagacua

SEQ ID NO: 64942 - RNA, 41 nt, Mus musculus
uacagagaaacccugucucaaaaaaccaaaaagaaagaaaa

SEQ ID NO: 64943 - RNA, 46 nt, Mus musculus
uaguuuaaaccaaaucaguaaacauauuuguugucauuggcccuca

SEQ ID NO: 64944 - RNA, 42 nt, Mus musculus
uuagcaaccagaaaaugcuucacuuccaugcccacuggccag

SEQ ID NO: 64945 - RNA, 45 nt, Mus musculus
ccccauacccacaugguggcagcucacaaccauguguaacuagag

SEQ ID NO: 64946 - RNA, 45 nt, Mus musculus
uguucauuugguggaaauucuuaucacuauauacaaggggggaau

SEQ ID NO: 64947 - RNA, 41 nt, Mus musculus
cacuccuugcucacuuggcucuguguguuugugugugcgug

SEQ ID NO: 64948 - RNA, 48 nt, Mus musculus
cccaugccagcugggaagcagagggagcuggagguggacaaggccaga

SEQ ID NO: 64949 - RNA, 25 nt, Mus musculus
cuucuccucccccgccgcccuccca

SEQ ID NO: 64950 - RNA, 45 nt, Mus musculus
uucuuuuaguuguucuaaauuguuuuguggcuggaaccgguauua

SEQ ID NO: 64951 - RNA, 45 nt, Mus musculus
auuguggauugaaggugaggcuguucucugauccugcauuagaaa

SEQ ID NO: 64952 - RNA, 46 nt, Mus musculus
uauuacuuuacuacauuaaguuuuggcuuagaaaaauuuggggcuu

SEQ ID NO: 64953 - RNA, 45 nt, Mus musculus
gcauacauacacacauacaugcauacauacguacauaaaaggcag

SEQ ID NO: 64954 - RNA, 45 nt, Mus musculus
gccacuguuaauguuguguucucauuuccuugaaauugaggguua

SEQ ID NO: 64955 - RNA, 46 nt, Mus musculus
cuguggcugccuugccuguaacucaacaaaugacagaaaugagcau

SEQ ID NO: 64956 - RNA, 46 nt, Mus musculus
agcccaguucuucucaaagugaagaaaaagcuccugaguugcccaa

SEQ ID NO: 64957 - RNA, 45 nt, Mus musculus
aaucagaaaagaaaauccaguuguuguggcugaaaaaauccagag

SEQ ID NO: 64958 - RNA, 45 nt, Mus musculus
cauugaugcuauauuguauuauguaaauaauaaaagcaguguaca

SEQ ID NO: 64959 - RNA, 44 nt, Mus musculus
ugcuuuacuguuuuuuuguuuguuggacugaaccaaaagucuca

SEQ ID NO: 64960 - RNA, 42 nt, Mus musculus
aaacaacaccaaacauugaaacaaguccuuaugagcggcuaa

SEQ ID NO: 64961 - RNA, 48 nt, Mus musculus
auagugcccgauggaaaauaguuaagaaauggcugagaagauuggugg

SEQ ID NO: 64962 - RNA, 45 nt, Mus musculus
auuaggugacauacagacucugugcugugcuauuauaagagguua

SEQ ID NO: 64963 - RNA, 46 nt, Mus musculus
aaaacaacaacaacaagaauuaaaaagaaaaaaaaaaaagcaagag

SEQ ID NO: 64964 - RNA, 47 nt, Mus musculus
ugcaguugccagcaaggggcagagccagaucucccacuucugcagau

SEQ ID NO: 64965 - RNA, 74 nt, Mus musculus
aauuguucuuucuuuuaccagucuuuuuaucaaaaaaccaggaacuauuacagaagaguagaaaagaaaauacc

SEQ ID NO: 64966 - RNA, 46 nt, Mus musculus
uguauucaguaguguuccaaaaagacuguuguuuuucugucuggag

SEQ ID NO: 64967 - RNA, 46 nt, Mus musculus
auuuuaauggaauaugaaaucauauucuuuuucuguggaagcaagg

SEQ ID NO: 64968 - RNA, 46 nt, Mus musculus
ccaacauggccacauuuccuaagccuccuuagaaauuaccaccaag

SEQ ID NO: 64969 - RNA, 46 nt, Mus musculus
ucagacucuucugagacucaagauaagcacuuaauuguaagcccua

SEQ ID NO: 64970 - RNA, 46 nt, Mus musculus
cccaggagagguauugcuggauccuccgguagugcuauggaaucag

SEQ ID NO: 64971 - RNA, 46 nt, Mus musculus
cagauagcugaguccugagaagaguacaaugcauuuagucauuugg

SEQ ID NO: 64972 - RNA, 45 nt, Mus musculus
guugauuuaaagguucaagcccccaagcugaaauaucucgaggua

SEQ ID NO: 64973 - RNA, 45 nt, Mus musculus
gucaucaugggaucaugugugugugugugugugugugugugugug

SEQ ID NO: 64974 - RNA, 45 nt, Mus musculus
ugacucuccacuaguuuuguucucuauuuuaguaguauauccgua

SEQ ID NO: 64975 - RNA, 46 nt, Mus musculus
uuucuuuucucaaacugauguguaagguguuuuugaguaucaggag

SEQ ID NO: 64976 - RNA, 46 nt, Mus musculus
cucauagcaaaauucuguguggagggaacucugaaaucaguugcag

SEQ ID NO: 64977 - RNA, 46 nt, Mus musculus
ucaccacuuauuagaaucucccauucaaaucuaauacaacugucag

SEQ ID NO: 64978 - RNA, 46 nt, Mus musculus
ugugagacaacuacuuaacauuuucauucaguuauuuaaaggacag

SEQ ID NO: 64979 - RNA, 23 nt, Mus musculus
auugucuuggccauaggccacca

SEQ ID NO: 64980 - RNA, 46 nt, Mus musculus
cucuguguguguguguguguguguguguuugugugugugugagugu

SEQ ID NO: 64981 - RNA, 45 nt, Mus musculus
ugcagaagucuuaagggcucuuaccaguaaaaagaaaauuuagag

SEQ ID NO: 64982 - RNA, 45 nt, Mus musculus
aaauggccacuaaacccaaauacaaacaaauuauauauaucccua

SEQ ID NO: 64983 - RNA, 45 nt, Mus musculus
auuagcaucuaaauucuucucuggucuccuaggaaguucugugua

SEQ ID NO: 64984 - RNA, 44 nt, Mus musculus
ggaaacgaguguugcuggggacccaagcaaacuaacaauacuaa

SEQ ID NO: 64985 - RNA, 46 nt, Mus musculus
auuauuugcuaaaucaggcaaaauagagacuggaaauuggcguaag

SEQ ID NO: 64986 - RNA, 42 nt, Mus musculus
agucugcugcugggcuaauugcuaaguuuuuucauccgugag

SEQ ID NO: 64987 - RNA, 45 nt, Mus musculus
cuuuuucccccuuucuuugugaaucauugggauaaaaucauggag

SEQ ID NO: 64988 - RNA, 41 nt, Mus musculus
uuuauugcacuucuagaccagaccaggcaaggcacucggag

SEQ ID NO: 64989 - RNA, 46 nt, Mus musculus
ugcugcaaagacuugcaauuugagacaaucuagauugagccaccaa

SEQ ID NO: 64990 - RNA, 46 nt, Mus musculus
ugugagacaccuaacauuaucucuuuaagccaaaccaaacuaccaa

SEQ ID NO: 64991 - RNA, 45 nt, Mus musculus
auguguauauauauaaauacauguccuauuauacuuugagcacac

SEQ ID NO: 64992 - RNA, 46 nt, Mus musculus
acagauugcagcucaaggggcauuccccaacccccuuccacagcug

SEQ ID NO: 64993 - RNA, 45 nt, Mus musculus
ggaagcucacuggaccacuagauucuuguucuuuauuuuguagca

SEQ ID NO: 64994 - RNA, 42 nt, Mus musculus
uuuaugggaaauuccagaaguuaacauacugucugaggccag

SEQ ID NO: 64995 - RNA, 42 nt, Mus musculus
cacuccccugcuuuccugcaaccucaaaacggaaacggccac

SEQ ID NO: 64996 - RNA, 26 nt, Mus musculus
auguagagaaagcauaguccaaaaga

SEQ ID NO: 64997 - RNA, 45 nt, Mus musculus
uacauaugcacacacacacacagagagagacagacagagagugag

SEQ ID NO: 64998 - RNA, 92 nt, Mus musculus
uuuccauuagucaaaauguugagagagagagagacagagacagagacaaagggagagagaaagagagaccggcagacagacagagaugagag

SEQ ID NO: 64999 - RNA, 68 nt, Mus musculus
augccuucgagaaggacuuuucccggggccuuaaugugagggucauugaucaagacacagccagaguu

SEQ ID NO: 65000 - RNA, 41 nt, Mus musculus
ugccucaccauuuaauuaaaacaaacaaaauaaaacagaag

SEQ ID NO: 65001 - RNA, 45 nt, Mus musculus
gugcccacagaggccagaagagggugucagaucccauggaacuag

SEQ ID NO: 65002 - RNA, 29 nt, Mus musculus
gcagccagugcuauuaaccucucagcccu

SEQ ID NO: 65003 - RNA, 46 nt, Mus musculus
gccaucugucuggcagagauuauguuuaguguuuuuccacccccca

SEQ ID NO: 65004 - RNA, 45 nt, Mus musculus
gagcugagguuggacuucucacccgcaacauugugauccaaggag

SEQ ID NO: 65005 - RNA, 42 nt, Mus musculus
ucaguccaucuuucuuauguggaauugaaacacaugggccag

SEQ ID NO: 65006 - RNA, 46 nt, Mus musculus
gccuucucuuaccaaagauauccuuuuccuuucuguagaagcccag

SEQ ID NO: 65007 - RNA, 46 nt, Mus musculus
cagggcuguuucaacuuucuggauugcccaccccaacaaccaccug

SEQ ID NO: 65008 - RNA, 46 nt, Mus musculus
uccgcuggggauauuuuauaacaacaggguucauucaaauuuuaag

SEQ ID NO: 65009 - RNA, 42 nt, Mus musculus
gcucaggguucugguggccgguucuucagaucuucagcccac

SEQ ID NO: 65010 - RNA, 24 nt, Mus musculus
uagacaagauagcuggugcucugc

SEQ ID NO: 65011 - RNA, 42 nt, Mus musculus
uuuucuccucauuguacaccuaggcuuaaccuucagggggag

SEQ ID NO: 65012 - RNA, 41 nt, Mus musculus
gccaaaaaaaacaaacaaacaaacaaacaaaaaaaaccccu

SEQ ID NO: 65013 - RNA, 46 nt, Mus musculus
uauuuuugucauugcuaugaccaaauauuuuacaggaagcaacugg

SEQ ID NO: 65014 - RNA, 46 nt, Mus musculus
gaauagacagugcuuuuaaccacugagccaucuugcuagccccuaa

SEQ ID NO: 65015 - RNA, 42 nt, Mus musculus
ugggauaugcugggaggggugggagguugguggauagcggag

SEQ ID NO: 65016 - RNA, 46 nt, Mus musculus
gguugugagccaccaugugguugcugggauuugaacuucggacuuu

SEQ ID NO: 65017 - RNA, 48 nt, Mus musculus
ggcucauugcuuuuaagaacaaugacaacggagccugggucagaggag

SEQ ID NO: 65018 - RNA, 46 nt, Mus musculus
uacucuguggcugaccugcgccucuagacuuuuauguaacucgcuu

SEQ ID NO: 65019 - RNA, 73 nt, Mus musculus
ugaugggagcuucccaagcgaugaaggguccagucaggaggugacagagucccucuuugucggggagaguagg

SEQ ID NO: 65020 - RNA, 81 nt, Mus musculus
aauuacggcuuucaagguggccaaaacaaguacaugggcacagggggaaucgaucagaagccucggacgcuacccaggaac

SEQ ID NO: 65021 - RNA, 45 nt, Mus musculus
aguggauucuccccaccccccuuaauguguuuucuuuccugagac

SEQ ID NO: 65022 - RNA, 47 nt, Mus musculus
guuuccugcaauccaugaugcuggguuuucagaaauagccacuggaa

SEQ ID NO: 65023 - RNA, 45 nt, Mus musculus
uccccucugcuccuccaugcuccccuuccccuccccucuccccca

SEQ ID NO: 65024 - RNA, 46 nt, Mus musculus
aauccgaggcuuucagauuuacgaugggccuauucaucucacaaag

SEQ ID NO: 65025 - RNA, 46 nt, Mus musculus
gugacaugagaugaugucuucaacaggauaaugacuuagaguggag

SEQ ID NO: 65026 - RNA, 46 nt, Mus musculus
ggaaagccuggccccugguuugaggauugugagcuggacggcgaua

SEQ ID NO: 65027 - RNA, 42 nt, Mus musculus
ucaauguuacuaaguggaaugcagugaucuguagcgggaccu

SEQ ID NO: 65028 - RNA, 46 nt, Mus musculus
ggauggaggaagaucuuacggagcugaggcuucaauuauccagaaa

SEQ ID NO: 65029 - RNA, 84 nt, Mus musculus
gugggaauucucauuccucugaacagauggggaaaagaacagucauagaggaaggagcaggucguggaagggucaagacgugga

SEQ ID NO: 65030 - RNA, 41 nt, Mus musculus
cauguuaaggcauuguaaauaguuguuacaaaacgguggca

SEQ ID NO: 65031 - RNA, 46 nt, Mus musculus
aaaauucagacaagaagaaaauggagauaauccuaaccccgacuaa

SEQ ID NO: 65032 - RNA, 47 nt, Mus musculus
guguguaugugcaagagugugugugugugugugugugugugugugug

SEQ ID NO: 65033 - RNA, 45 nt, Mus musculus
caugagcuaacaucggcauggcaugcgugggaaagacaagguucg

SEQ ID NO: 65034 - RNA, 46 nt, Mus musculus
ccaugcucacggggcucugucaaggcuguggaacccaccagguaag

SEQ ID NO: 65035 - RNA, 46 nt, Mus musculus
ucagucuaccuccuaaugccuucacauugggggcuagagucucaag

SEQ ID NO: 65036 - RNA, 42 nt, Mus musculus
auacauuacuucugggaccagucacagguuugucacccccuu

SEQ ID NO: 65037 - RNA, 72 nt, Mus musculus
aacugccauauggagauagggaggggggaauuugugucuuagaugucagagugagcacaggaaagaaggcaa

SEQ ID NO: 65038 - RNA, 45 nt, Mus musculus
uggagggcagagggaacaaacuguaaaagagagugcacagcccaa

SEQ ID NO: 65039 - RNA, 46 nt, Mus musculus
aagggaauuugaacagugagcuggauuucuuuguccauauccacaa

SEQ ID NO: 65040 - RNA, 92 nt, Mus musculus
agugugcccuuccgggugaaggaaaagcggauguuccuuucugcagacgucagucacauggaagaauauuucaaggcuagcauccccccaag

SEQ ID NO: 65041 - RNA, 46 nt, Mus musculus
guacaggaacauguuuauaauguuuauaaucucagcagagacagag

SEQ ID NO: 65042 - RNA, 46 nt, Mus musculus
gaagagaccuugaccuguuacagcaggcuuugaaagugcuuuagag

SEQ ID NO: 65043 - RNA, 46 nt, Mus musculus
aacuuauuuaauuuauggcauuuuaagacaacacuguuaacccgau

SEQ ID NO: 65044 - RNA, 46 nt, Mus musculus
uggggcucauuucuguacagcccacgaggguuuuaugugaugcuag

SEQ ID NO: 65045 - RNA, 46 nt, Mus musculus
agaagaaaggacucugggucucccagugcugcuucuacuggcccuu

SEQ ID NO: 65046 - RNA, 46 nt, Mus musculus
uuuuucuuucauucuuuuuuuuuuucuuuuuuuuuuguacagugag

SEQ ID NO: 65047 - RNA, 47 nt, Mus musculus
aaggguugccaucuuguccagaaaagaggaggcucugcggcgcgcug

SEQ ID NO: 65048 - RNA, 43 nt, Mus musculus
uccaacgcccacuacagugaucuuguuguucgggacggcagcc

SEQ ID NO: 65049 - RNA, 45 nt, Mus musculus
cggucacauuggagguuuguguucuacagccuagagacuggcagu

SEQ ID NO: 65050 - RNA, 32 nt, Mus musculus
aguaucucacgggggucugagagaugugaaga

SEQ ID NO: 65051 - RNA, 45 nt, Mus musculus
ugggagcguuuuugacuaggcaacuuggauccauuccuuuccaga

SEQ ID NO: 65052 - RNA, 42 nt, Mus musculus
caaucccuucauggagaguuaggcaacugguucugaccaugu

SEQ ID NO: 65053 - RNA, 46 nt, Mus musculus
ggaggccuggagacuauaucagguuaguacagauguaauuuaagga

SEQ ID NO: 65054 - RNA, 45 nt, Mus musculus
caaguagcaaauaauugcucagaaagauaaacaguugacggagau

SEQ ID NO: 65055 - RNA, 46 nt, Mus musculus
acgaacacagcuuuccccaguaggcccuuuaugugcucugggugag

SEQ ID NO: 65056 - RNA, 46 nt, Mus musculus
gccaauuggagggggccuggauugugacgugaugggauucugcgaa

SEQ ID NO: 65057 - RNA, 45 nt, Mus musculus
ccuggcucgcaguuggcuuucucugggacuccgacacguuugcag

SEQ ID NO: 65058 - RNA, 43 nt, Mus musculus
ucguccgaggccagggcagggcuagccgaagcuccgcagccac

SEQ ID NO: 65059 - RNA, 44 nt, Mus musculus
uggcagcgcgcccagcccacucucccuccuccacucuggagugg

SEQ ID NO: 65060 - RNA, 53 nt, Mus musculus
ugugggaaagucuauggaaaauccucccaucuuaaagcccauuacagagugca

SEQ ID NO: 65061 - RNA, 46 nt, Mus musculus
ucuuugccaagauccaggucaaaaacuugugucuuccagccucaag

SEQ ID NO: 65062 - RNA, 46 nt, Mus musculus
cugcuucgacuugcacaucacaguccaucuucaaaggaacucccag

SEQ ID NO: 65063 - RNA, 41 nt, Mus musculus
cugaacagugugugugcuccaucuccuaacguuagccccaa

SEQ ID NO: 65064 - RNA, 46 nt, Mus musculus
guguacuuacauacaugaaauaaauaaauaaaucuuugggggcugg

SEQ ID NO: 65065 - RNA, 46 nt, Mus musculus
ucaaaucccagcaaccacaugaugacucacaaccaucuguaaugau

SEQ ID NO: 65066 - RNA, 46 nt, Mus musculus
guaagacacaaaauccugguauuuuauuuauaagcuguaagccuag

SEQ ID NO: 65067 - RNA, 46 nt, Mus musculus
aaggaagcuuaggugcaguuccugcagagaggacacagcggauaau

SEQ ID NO: 65068 - RNA, 46 nt, Mus musculus
ccacugguacagcucgagacacugguaaaggaaauauguugguaga

SEQ ID NO: 65069 - RNA, 46 nt, Mus musculus
aacauaaggggucaauacaacucacuaagauuauuaaauuacggag

SEQ ID NO: 65070 - RNA, 45 nt, Mus musculus
uaguaucuugccgugcuagauauccaguacuagugagaugaugag

SEQ ID NO: 65071 - RNA, 46 nt, Mus musculus
guuugaauucauuggaaaccaaguaaaacaauaguuagaaaaguag

SEQ ID NO: 65072 - RNA, 45 nt, Mus musculus
guuuucggugguggugaugguuauccacagugugguaaugaaggc

SEQ ID NO: 65073 - RNA, 46 nt, Mus musculus
gucuucuacuaaacacugggcguccaugcaugucucagaccacagu

SEQ ID NO: 65074 - RNA, 47 nt, Mus musculus
agugcuguaccgcagcacaacucuuugaaaagugagccaaaagauga

SEQ ID NO: 65075 - RNA, 46 nt, Mus musculus
gugaaucuuccccagcuccuagaagaagagguggaauucugcacag

SEQ ID NO: 65076 - RNA, 42 nt, Mus musculus
ugagacgugauccacaacgugaggcaacugauggaggcacca

SEQ ID NO: 65077 - RNA, 43 nt, Mus musculus
cucugcaucugggauauuuauauuguaucuuuggaaaugggag

SEQ ID NO: 65078 - RNA, 42 nt, Mus musculus
agccggaggccucauaucacugaggcuuuuugugcuagaguc

SEQ ID NO: 65079 - RNA, 46 nt, Mus musculus
uguagauauauuuuauuuauauauauuuauauuuauauauagagau

SEQ ID NO: 65080 - RNA, 46 nt, Mus musculus
aucuuaacagggugaauggacagguacaaggaccucauuuggagau

SEQ ID NO: 65081 - RNA, 36 nt, Mus musculus
caucccaguucgacagugcagcaccuugauugacac

SEQ ID NO: 65082 - RNA, 46 nt, Mus musculus
agagaagaaccaaguaagaaguuaaaacuguggauugggggccggg

SEQ ID NO: 65083 - RNA, 42 nt, Mus musculus
agagagagagacagagagagacagagagacagagacauagac

SEQ ID NO: 65084 - RNA, 74 nt, Mus musculus
gcgacugacuccaaguguuuucuugagaguggagcucgggauuggcagugaggagugaaaucuaucuggcagau

SEQ ID NO: 65085 - RNA, 46 nt, Mus musculus
uauaugugugugguauguguguguguguguguguguauguguagua

SEQ ID NO: 65086 - RNA, 45 nt, Mus musculus
guucucaguaauguggaaaugauuuagaauauauagaagaauaga

SEQ ID NO: 65087 - RNA, 45 nt, Mus musculus
uugacauccacauaugcccuauggcauguguguguaggcacacuc

SEQ ID NO: 65088 - RNA, 46 nt, Mus musculus
auggaaaguaaaacauugcuaauuaaguccaaucuuaucuugagaa

SEQ ID NO: 65089 - RNA, 46 nt, Mus musculus
auuagccaccauaagguuggagcaagaguucccauuuggggcccgc

SEQ ID NO: 65090 - RNA, 46 nt, Mus musculus
ucugugggcugaauccuauaacuuccccaugcugaccuugcccugg

SEQ ID NO: 65091 - RNA, 46 nt, Mus musculus
cccuacucucuugaauaccaucaauaaaguucgcugcaccccaaga

SEQ ID NO: 65092 - RNA, 42 nt, Mus musculus
gcacacugaagggcaucuugggcuacacugaggaccagguug

SEQ ID NO: 65093 - RNA, 45 nt, Mus musculus
auuccgcagcuacugcggcuuuuaaaaaccucuggggucucugag

SEQ ID NO: 65094 - RNA, 46 nt, Mus musculus
augggcagcgcauuucccaaagcccgaagcagcuuuuugcccaggu

SEQ ID NO: 65095 - RNA, 46 nt, Mus musculus
uucuguucccuggacagugucagaaccauaaaacgugugccuuaag

SEQ ID NO: 65096 - RNA, 45 nt, Mus musculus
ggcaauuggccaguagucuuuagguguuuaaaaaagucuugccau

SEQ ID NO: 65097 - RNA, 47 nt, Mus musculus
acccugcuguggaaaugugauggagaugaagacugugcggauggcag

SEQ ID NO: 65098 - RNA, 46 nt, Mus musculus
uccccuaacauuccagagguuaauuaacugcuauaaaaaugacaag

SEQ ID NO: 65099 - RNA, 45 nt, Mus musculus
gguuugucucuucuggaguucacguugaagucugauuuuugauag

SEQ ID NO: 65100 - RNA, 46 nt, Mus musculus
uguguuccuaacagauggcagugugacggggauccugauugcgaag

SEQ ID NO: 65101 - RNA, 50 nt, Mus musculus
gauccaguguggcucuggcgagugcauucacaaaaaauggcggugugacg

SEQ ID NO: 65102 - RNA, 46 nt, Mus musculus
gugcagaagcggggaaugcauagacaugagcaaaguaugugaccag

SEQ ID NO: 65103 - RNA, 68 nt, Mus musculus
aaagaccuaguuauagguuaugagugugauugugcagcuggguuugaacugauagauaggaaaaccug

SEQ ID NO: 65104 - RNA, 42 nt, Mus musculus
cuaauuucccuccuagauauugaugaaugccaaaacccgggg

SEQ ID NO: 65105 - RNA, 46 nt, Mus musculus
ggauuugauagacguccucuggugacggaggacauccaauggccua

SEQ ID NO: 65106 - RNA, 45 nt, Mus musculus
gcucuggaugugguuaccaaguaucuguaacccuugagccccuag

SEQ ID NO: 65107 - RNA, 45 nt, Mus musculus
ugauuuauaacaauaucaaauguauaguuaugaacuaguuaugaa

SEQ ID NO: 65108 - RNA, 46 nt, Mus musculus
ucaccacaacaugaggaacuauauuaaagacucguggcauuaggaa

SEQ ID NO: 65109 - RNA, 46 nt, Mus musculus
uuuaacuugggcacuugccuugauuccuuuuauuauuggaagucag

SEQ ID NO: 65110 - RNA, 48 nt, Mus musculus
uaagacucgcuuuucagucauggauccugcagaaaucugagacccacc

SEQ ID NO: 65111 - RNA, 89 nt, Mus musculus
gcaucgcauugcuaaagagaacugauuuccuagcauucuucccuaguaaaaucuuucccaauagaacaguauguucccuuaaacccaaa

SEQ ID NO: 65112 - RNA, 46 nt, Mus musculus
cuguggcaaagcaaacaaauuaaaaaaaaaaaaucauacacccuuu

SEQ ID NO: 65113 - RNA, 42 nt, Mus musculus
uucccuguugugugucuguguugacccugggacaagugugag

SEQ ID NO: 65114 - RNA, 46 nt, Mus musculus
uggcuuaagaacacaugaugucucagaaggcccaugcgcacaccag

SEQ ID NO: 65115 - RNA, 42 nt, Mus musculus
aucgggcuguuauccagagcagggagauauaaaaagggaggu

SEQ ID NO: 65116 - RNA, 62 nt, Mus musculus
guaacauguagccuagugcauggccagucggggagggaucuucagagaaaacaacuguccag

SEQ ID NO: 65117 - RNA, 45 nt, Mus musculus
aucuuggcacucguuucucccuuuaguagggugguccucucaagu

SEQ ID NO: 65118 - RNA, 45 nt, Mus musculus
cuauauccaaaugucuaauuacacuguuuuuuaaagggggggucg

SEQ ID NO: 65119 - RNA, 46 nt, Mus musculus
ucaauauaaauaacaaauuauugaccauggccaaaauccuggagug

SEQ ID NO: 65120 - RNA, 44 nt, Mus musculus
auauggcuuuaauguuagaguugcucucuaggccuucauugaga

SEQ ID NO: 65121 - RNA, 45 nt, Mus musculus
aacaaaacuaaauuagauccagaguaacaacaacaaaaugagaga

SEQ ID NO: 65122 - RNA, 46 nt, Mus musculus
cuuuauguucuguguuaguggcaugcuugcccuucuucgugugugu

SEQ ID NO: 65123 - RNA, 46 nt, Mus musculus
uuuacaaaugcuguuuaagaggcaacaucuaugggagugggcaggu

SEQ ID NO: 65124 - RNA, 35 nt, Mus musculus
aucagucugcacaauucugauuuuauaugaauccc

SEQ ID NO: 65125 - RNA, 46 nt, Mus musculus
ugauuaugguguugaaccacaacagaaaaguaacuaauacagaaau

SEQ ID NO: 65126 - RNA, 46 nt, Mus musculus
caacagacaggcacaucuguugagcaaacuguaauugcccaaaguc

SEQ ID NO: 65127 - RNA, 46 nt, Mus musculus
ccauucauuacugacacaaaccccucccagaauuuguccucaaacc

SEQ ID NO: 65128 - RNA, 46 nt, Mus musculus
cugaguauuguaucgucugaucaacacuuugccugaagguagaguu

SEQ ID NO: 65129 - RNA, 25 nt, Mus musculus
guggcaucaugacagucguccugag

SEQ ID NO: 65130 - RNA, 45 nt, Mus musculus
caaaguggcugugguaagccaagaugcagaaaauaagucugagau

SEQ ID NO: 65131 - RNA, 42 nt, Mus musculus
uuugaaagucauugugugugugugugugugugugugugugug

SEQ ID NO: 65132 - RNA, 45 nt, Mus musculus
ggccaugucugcacgguaacccgcggcucccgcagcgccugagac

SEQ ID NO: 65133 - RNA, 46 nt, Mus musculus
ucguaucuuugugaccggguuucuugaugccguuucugugccauuu

SEQ ID NO: 65134 - RNA, 46 nt, Mus musculus
cuaaguggaucaaggaccuccacauaaaaccagagacucugaaauu

SEQ ID NO: 65135 - RNA, 45 nt, Mus musculus
ggaccuggauaagggauaauagcagcagaugugucagcuuagaga

SEQ ID NO: 65136 - RNA, 46 nt, Mus musculus
gugauacucaagcuuaacuuucacacauauucacaugcacccagac

SEQ ID NO: 65137 - RNA, 51 nt, Mus musculus
guuccaggccgguggggaagccuggggagagggggagaggggguaggggga

SEQ ID NO: 65138 - RNA, 46 nt, Mus musculus
uuuagaaauuuaauauauuauucaguagucauuuuuccuuccagau

SEQ ID NO: 65139 - RNA, 48 nt, Mus musculus
ucauugugaacaugacacauagacauaucacuuuaaaccacagauaaa

SEQ ID NO: 65140 - RNA, 45 nt, Mus musculus
acuugcuggcucauugacagcucacuuccuuguacagccccagaa

SEQ ID NO: 65141 - RNA, 49 nt, Mus musculus
uuaggggaagaaaagauuuauuuaauuuacauuuccagaucagagucca

SEQ ID NO: 65142 - RNA, 53 nt, Mus musculus
uuguucuaguuuccuuucuguugcugugauaaaacacuguaaccaaaaagagc

SEQ ID NO: 65143 - RNA, 46 nt, Mus musculus
cauuguuucagcgauuucuccaggucauucugguagagggagcaug

SEQ ID NO: 65144 - RNA, 42 nt, Mus musculus
agaggguuaggaaaucaaacaaaaauagguagcaggggaaug

SEQ ID NO: 65145 - RNA, 48 nt, Mus musculus
cuauggguugagcacaguucugcacuagauccuggaggaggaugagga

SEQ ID NO: 65146 - RNA, 46 nt, Mus musculus
cuccugacaugacuaggagacacagccucacaguaaauucccagau

SEQ ID NO: 65147 - RNA, 42 nt, Mus musculus
ucucucugugucucucugucucugacucugucuuugucucug

SEQ ID NO: 65148 - RNA, 30 nt, Mus musculus
ccaggccuaagcuuguuaagaggaagggga

SEQ ID NO: 65149 - RNA, 42 nt, Mus musculus
auuuauuugacaaauuauuuccauauuuauauugcuagaaga

SEQ ID NO: 65150 - RNA, 45 nt, Mus musculus
aaaucagaaaaugugaaguuuuggaaauucuucgugguagaaauu

SEQ ID NO: 65151 - RNA, 46 nt, Mus musculus
caugugaugguuuuacacauguauaauaauugaaguuauagcaaga

SEQ ID NO: 65152 - RNA, 46 nt, Mus musculus
gacuacccaagauacaguuugcaaaacacauaaaacucaagaagaa

SEQ ID NO: 65153 - RNA, 46 nt, Mus musculus
ugucuuauuguucuaguuagaacuccaagcacuauauugaacagag

SEQ ID NO: 65154 - RNA, 46 nt, Mus musculus
uuucuugaguuccuuauauauuuuggauauuagcccucuaucacag

SEQ ID NO: 65155 - RNA, 41 nt, Mus musculus
guggcacaguucugcagguuuaucauucuagagguugaagu

SEQ ID NO: 65156 - RNA, 46 nt, Mus musculus
uaaaaaaugaauuugccauuuguagcucauuugaaaggugucuguu

SEQ ID NO: 65157 - RNA, 46 nt, Mus musculus
aagaaacauaacaaagagccacaaguaaauaaaaaagcuugcagac

SEQ ID NO: 65158 - RNA, 46 nt, Mus musculus
aggguuauuuuauauacccuaaacuguaccuauuuaacaugugugg

SEQ ID NO: 65159 - RNA, 45 nt, Mus musculus
agacagcauguauuacacuggccugauuaaaauuguucacaagag

SEQ ID NO: 65160 - RNA, 45 nt, Mus musculus
agugaaggggaaaaaagaaugagugaaaucacuaaauuuuaagau

SEQ ID NO: 65161 - RNA, 46 nt, Mus musculus
cuuuuagcuagucaccacucguuugaauugggguccuuugcccaga

SEQ ID NO: 65162 - RNA, 50 nt, Mus musculus
ucagugcaugaggaacugaggcaaggccaugggaaugugugagggggaga

SEQ ID NO: 65163 - RNA, 45 nt, Mus musculus
uuugccuucugauguuggaauugagaguuuuuuaaccugggaguu

SEQ ID NO: 65164 - RNA, 45 nt, Mus musculus
uaccuauaggaugugugacuaaggcuaggccugagacuuggagau

SEQ ID NO: 65165 - RNA, 46 nt, Mus musculus
uauucuuguucauccauuuuggcaauguauucuuacggagcucgga

SEQ ID NO: 65166 - RNA, 74 nt, Mus musculus
gucuguagucccagaugcucagaaggcugagugugaggauugauuauuugagcagaauggugaguuucugugug

SEQ ID NO: 65167 - RNA, 47 nt, Mus musculus
uguggaugcauucaccuaaacacuggacugagcgcggggaccccagu

SEQ ID NO: 65168 - RNA, 42 nt, Mus musculus
ggauugcuccugucuaaaaggaauacaggacaaagaguggau

SEQ ID NO: 65169 - RNA, 41 nt, Mus musculus
aggaaucauuaggcagcccaaaaagcuucacagugucagcg

SEQ ID NO: 65170 - RNA, 45 nt, Mus musculus
agaccagccuuaguccauaaaaaaagaauaaaccaaacauucaaa

SEQ ID NO: 65171 - RNA, 46 nt, Mus musculus
augauacaucaaugcauaaaaaguugaauacauguagccaccaaaa

SEQ ID NO: 65172 - RNA, 45 nt, Mus musculus
ugaaaauauugcuuguuggcaacaugaaaaauguuggauggagac

SEQ ID NO: 65173 - RNA, 45 nt, Mus musculus
uagaaauccaugcagggaacuuuguagcagcugauaauuuaaaga

SEQ ID NO: 65174 - RNA, 46 nt, Mus musculus
ucaugagaagcuugaauuuggguuuguuggaucaguagucucagua

SEQ ID NO: 65175 - RNA, 46 nt, Mus musculus
gggacucccaauaguucaaauaaaagaucacaagaugccacaugaa

SEQ ID NO: 65176 - RNA, 46 nt, Mus musculus
cagugauggccgacuaggccaucuuuugauacauaugcauuuugau

SEQ ID NO: 65177 - RNA, 41 nt, Mus musculus
guguauguguguguguguguguaugugugugugugugaauc

SEQ ID NO: 65178 - RNA, 45 nt, Mus musculus
uauguguguguguguguguguguauguauguguguauguaugugu

SEQ ID NO: 65179 - RNA, 46 nt, Mus musculus
uguauguguguguguguguguauguguguguauguguguguaugug

SEQ ID NO: 65180 - RNA, 52 nt, Mus musculus
uguguguguauauguguguguauauguguguguguguauguguguguguaug

SEQ ID NO: 65181 - RNA, 46 nt, Mus musculus
caccccccacuccgugugugugugugugugugugugugugugugug

SEQ ID NO: 65182 - RNA, 46 nt, Mus musculus
ccuaaaggggccacaacuuuccugaccagcaauuucaacuggagau

SEQ ID NO: 65183 - RNA, 46 nt, Mus musculus
gaguugauugacaggguuccccaaaugacagcaaaaugcucuugau

SEQ ID NO: 65184 - RNA, 46 nt, Mus musculus
gaagcaguaacagauugagaaacacaauucaaguggggcaauuuuu

SEQ ID NO: 65185 - RNA, 46 nt, Mus musculus
aagagggaauggaggaaaggaagcaaguuuguauauuggucaguaa

SEQ ID NO: 65186 - RNA, 45 nt, Mus musculus
ucuucucuucucuucucuucucuucuccuuuuccugccugccugc

SEQ ID NO: 65187 - RNA, 46 nt, Mus musculus
ggggagagggagagagagagaggagagagagagaggaaaaggagag

SEQ ID NO: 65188 - RNA, 26 nt, Mus musculus
acuugcacucacaagguugacauagg

SEQ ID NO: 65189 - RNA, 24 nt, Mus musculus
caugugaggaucuuugauuguaua

SEQ ID NO: 65190 - RNA, 46 nt, Mus musculus
accaccuuaccagaguaagaaguuaccauagaauauagcaagaggg

SEQ ID NO: 65191 - RNA, 44 nt, Mus musculus
gcaaugagguugaagaguuccuugguaauaauaaagcagaugaa

SEQ ID NO: 65192 - RNA, 40 nt, Mus musculus
aagucagggagguagggcacugacagaaauguuuccagcg

SEQ ID NO: 65193 - RNA, 46 nt, Mus musculus
acauuggaaagcuuaaaaaucguacauacauauuuaauaugaagaa

SEQ ID NO: 65194 - RNA, 46 nt, Mus musculus
aaaauacauuuuaaauacccaaauuaaacuuuugugcaaaggagaa

SEQ ID NO: 65195 - RNA, 46 nt, Mus musculus
aaauauauguuccuuuucacuauuauuuaugagugugugcgugugu

SEQ ID NO: 65196 - RNA, 46 nt, Mus musculus
cccuggaacuugcucuguagaccagacuggccuugaacucagagau

SEQ ID NO: 65197 - RNA, 40 nt, Mus musculus
aauuagauuuuagaaacucgguaucauuguccuuuccuag

SEQ ID NO: 65198 - RNA, 24 nt, Mus musculus
uaauuuugcuaaugauaugaauug

SEQ ID NO: 65199 - RNA, 46 nt, Mus musculus
caacuuaguagaguacuuacuagacuguugaaucuguuguguauaa

SEQ ID NO: 65200 - RNA, 30 nt, Mus musculus
guaagugacuuguuuguugaaccuguuacu

SEQ ID NO: 65201 - RNA, 46 nt, Mus musculus
uuugauuaaugaaaagggagugagccuaaggacagaagcccauguu

SEQ ID NO: 65202 - RNA, 45 nt, Mus musculus
cugagcacauuaaaauuaggaaauuuguuuuugcuugcuggcuaa

SEQ ID NO: 65203 - RNA, 46 nt, Mus musculus
gacucaaucugccuaucuucugacaucuaugcaacuucaaagagau

SEQ ID NO: 65204 - RNA, 45 nt, Mus musculus
guuaaauauaugaacuggaauaaauucagaaagaaucacccuauu

SEQ ID NO: 65205 - RNA, 46 nt, Mus musculus
aacuugaaacguguguauauuucacuuucuuuguggcuguuaagau

SEQ ID NO: 65206 - RNA, 46 nt, Mus musculus
ggguuugugugugugugugugugugugugugugugugcuugugauu

SEQ ID NO: 65207 - RNA, 44 nt, Mus musculus
gcuccagugagagaggagacgggggaagagggagaaagaggaga

SEQ ID NO: 65208 - RNA, 25 nt, Mus musculus
uguacccgugcuucaucaucacggu

SEQ ID NO: 65209 - RNA, 45 nt, Mus musculus
ugucucuagugcagcuacugcuuuucaaguacaaaggaaacagca

SEQ ID NO: 65210 - RNA, 48 nt, Mus musculus
uuuuaaccagauuugaacagaagaauggccaccugacccagguagaag

SEQ ID NO: 65211 - RNA, 42 nt, Mus musculus
cugccuuccggucgcacaugguuaccguagagcagaggccag

SEQ ID NO: 65212 - RNA, 42 nt, Mus musculus
cccggacuuccagaagcggaugucggagagccucuggcccag

SEQ ID NO: 65213 - RNA, 41 nt, Mus musculus
ggcuaacaacagcuuugauugguggacucugccagccuccu

SEQ ID NO: 65214 - RNA, 60 nt, Mus musculus
uucucugauagaggaaguuuuggaaauggugcuguuggucagcaucggggagcaugugga

SEQ ID NO: 65215 - RNA, 50 nt, Mus musculus
ucaaggcugaaaagagcaagaaaaagaaggaggaggaagaugacgaggag

SEQ ID NO: 65216 - RNA, 45 nt, Mus musculus
augaagaagaagaugaugaugaugaauaaguugguucuagcgcag

SEQ ID NO: 65217 - RNA, 24 nt, Mus musculus
auagagauagccuagugguuaaaa

SEQ ID NO: 65218 - RNA, 48 nt, Mus musculus
agaccauuuucccuuuuguucagucuuagaguccuuaucaaaggugca

SEQ ID NO: 65219 - RNA, 46 nt, Mus musculus
uugugagccaccauguggcugggauuugaacucgggaccuucagaa

SEQ ID NO: 65220 - RNA, 46 nt, Mus musculus
ccuaccauguuccauuuguguuuauugaugucucuauguccaguag

SEQ ID NO: 65221 - RNA, 45 nt, Mus musculus
uaaacauucccauaguauauuuuaaauuuuuaucccagcaaucag

SEQ ID NO: 65222 - RNA, 46 nt, Mus musculus
acugauauacaggcaagcaccuagaacuccucuggcaggcauggau

SEQ ID NO: 65223 - RNA, 46 nt, Mus musculus
uugucucuauguuucacucuguauguguccuaauguguaccugucu

SEQ ID NO: 65224 - RNA, 45 nt, Mus musculus
uagaaacuucaaaagcuauuguaguguuaacaaauugaauugcag

SEQ ID NO: 65225 - RNA, 46 nt, Mus musculus
gucacuauguguggcugcugaaguugaaaacuuuuaagacugguag

SEQ ID NO: 65226 - RNA, 86 nt, Mus musculus
cucuuccauaucuucuucagucacaccacacugacaccccauuugucuuuaauuuguugccucaauauuuguacuuucuagccuag

SEQ ID NO: 65227 - RNA, 41 nt, Mus musculus
aauauaccacuguuuuccuuccucuuguugcuauguguuca

SEQ ID NO: 65228 - RNA, 31 nt, Mus musculus
uuuuaaauaauuacuuugugugucuguauag

SEQ ID NO: 65229 - RNA, 48 nt, Mus musculus
gaccgaccucaggagcacaguuaaagagcccagcauucugcuguuuca

SEQ ID NO: 65230 - RNA, 46 nt, Mus musculus
cccucuguuuugcuuacucuaacacaguggacuugcauagcccaaa

SEQ ID NO: 65231 - RNA, 46 nt, Mus musculus
ugugguggagaaggaagugugggucuuacaaccuugaaaggauuaa

SEQ ID NO: 65232 - RNA, 46 nt, Mus musculus
gagauuuuaauuuuuuuuaaaguuuucagcuauugauaaacuugga

SEQ ID NO: 65233 - RNA, 42 nt, Mus musculus
guggaggcucagagggagaauguuugauuuuaugagagucag

SEQ ID NO: 65234 - RNA, 45 nt, Mus musculus
cugucuucagacacacacuagaagagggcaucagaucccauuaca

SEQ ID NO: 65235 - RNA, 45 nt, Mus musculus
uguaauguaccuugcaugaagaugcugaguuuuaguggcaagcca

SEQ ID NO: 65236 - RNA, 76 nt, Mus musculus
aucaaucagaaaacucuuauauaccauuugauuugaagccuggaacacauguaggagaguucuaaacaaacagaaa

SEQ ID NO: 65237 - RNA, 44 nt, Mus musculus
aaucagggguugaaaauuuuuaguguuuagagcuaagggcauaa

SEQ ID NO: 65238 - RNA, 46 nt, Mus musculus
agaaggacacaucugucccaacacuaccagaaguaacuuggaccag

SEQ ID NO: 65239 - RNA, 45 nt, Mus musculus
agugaggacagguagcgcuagcaagaaccaaauggcgggaggcaa

SEQ ID NO: 65240 - RNA, 46 nt, Mus musculus
uaaacaaagaaagaauauuaaaagcaguaagggaaaaaaagucaag

SEQ ID NO: 65241 - RNA, 28 nt, Mus musculus
agaacuugaugaaggagaauacuggaga

SEQ ID NO: 65242 - RNA, 46 nt, Mus musculus
uucuguuucacauaggucccacuacaagauuuuaaagaaacgugaa

SEQ ID NO: 65243 - RNA, 41 nt, Mus musculus
ggacagcucaucaugaugcagagggacaggucaggcccgca

SEQ ID NO: 65244 - RNA, 46 nt, Mus musculus
aggggagagugguguguugugacuuaggcaccaagaacauacauaa

SEQ ID NO: 65245 - RNA, 46 nt, Mus musculus
gaacuuucaaaugcuccuuuuaaucuuauuauuaaauugcccccag

SEQ ID NO: 65246 - RNA, 41 nt, Mus musculus
ugaaugugcugagaacauguauauugacaugaugcugugga

SEQ ID NO: 65247 - RNA, 41 nt, Mus musculus
auguuaaagucucagucagcugacccuuuuauuaccccuga

SEQ ID NO: 65248 - RNA, 57 nt, Mus musculus
uuugaauuauagcagaugacagcuaauuuuucccccuuuacucagcccuggauauaa

SEQ ID NO: 65249 - RNA, 58 nt, Mus musculus
gccauuuuuaaacaucauuaagccacaacugcagaagcucagugagauaacagaagaa

SEQ ID NO: 65250 - RNA, 47 nt, Mus musculus
uaacaacguggucagccggaaagaagaggacacaacacaggcggaug

SEQ ID NO: 65251 - RNA, 46 nt, Mus musculus
uuuguuggcccagcuguaaaguaguggucaucccacugaucaugag

SEQ ID NO: 65252 - RNA, 45 nt, Mus musculus
gaucaugucauuugcaaccagauaucauuuuagcucugcacuuca

SEQ ID NO: 65253 - RNA, 46 nt, Mus musculus
ugaagaccuuuaccagauagaaucugggcugcguuugacggauaaa

SEQ ID NO: 65254 - RNA, 46 nt, Mus musculus
uaaaaugagaacaaaaaugaaaaaacaccuugaacugcuaugacag

SEQ ID NO: 65255 - RNA, 46 nt, Mus musculus
cucaaaagauaguuucaaggucuaaguaaugcaucccccagaagag

SEQ ID NO: 65256 - RNA, 45 nt, Mus musculus
ugcuucaagugucuggcuccugcuguguguguauucucugucagg

SEQ ID NO: 65257 - RNA, 57 nt, Mus musculus
guauuuguuaauuuuuagaucccgcauaagggcagcagucagacuuaauggugcuuu

SEQ ID NO: 65258 - RNA, 41 nt, Mus musculus
ccagagcacugaauugccagcauagcugcugagguggaaga

SEQ ID NO: 65259 - RNA, 58 nt, Mus musculus
uccugucauuuaccuggggaagagaacauuuuuuucagcuacauuuucuucuuacauu

SEQ ID NO: 65260 - RNA, 29 nt, Mus musculus
gcauggcgguucuggauagaagugcaggu

SEQ ID NO: 65261 - RNA, 46 nt, Mus musculus
cuuucuauguucgaacccacaaaggaucaacacuuucccagugguc

SEQ ID NO: 65262 - RNA, 46 nt, Mus musculus
gguaacuugguaacugcugauauaauuuaccuaucuccagcccugc

SEQ ID NO: 65263 - RNA, 45 nt, Mus musculus
auuuauucaggacaugggaggggaguuaagaggguaguagaggca

SEQ ID NO: 65264 - RNA, 58 nt, Mus musculus
agagacagcgccaauggggaggaggacucuuaagcacauaguggagcuuagaaaucuu

SEQ ID NO: 65265 - RNA, 46 nt, Mus musculus
gaggucucuccaagaaacccugcucauuucagacuuguguccaaag

SEQ ID NO: 65266 - RNA, 46 nt, Mus musculus
agauaccaagggaagccacagaguggggcauccuccucacagugag

SEQ ID NO: 65267 - RNA, 75 nt, Mus musculus
augucucacguaacaccucacauuccugagaucaacgacacaauccgagcucacugugaggaggaugccccacuc

SEQ ID NO: 65268 - RNA, 91 nt, Mus musculus
ucagcacgugaguagaacuuuucauaacuuagaaggaagcguaguaaaaagagacucuggaauauggaucaauggguuugauuauacugga

SEQ ID NO: 65269 - RNA, 62 nt, Mus musculus
ccuugucugcaguggagccuuuuucccauauaguucuaaucccgagaguccaaagccaaaga

SEQ ID NO: 65270 - RNA, 56 nt, Mus musculus
aacagcacaaagaaaaccauucugacucuaauacuggugugcgcggucaccuuccu

SEQ ID NO: 65271 - RNA, 41 nt, Mus musculus
uuuagccgggcaugguggcgcacgccuuuaaucccagcgcu

SEQ ID NO: 65272 - RNA, 23 nt, Mus musculus
ugccagcguagcugaaagguucg

SEQ ID NO: 65273 - RNA, 46 nt, Mus musculus
aaauagcacuuaucagcuaaagguuuaaacacaaaaacuugaagag

SEQ ID NO: 65274 - RNA, 79 nt, Mus musculus
aacuagagggguggggucaguguuugugcacugucagguuaaugugccaagaaaauguaggaugauaugguggcccaca

SEQ ID NO: 65275 - RNA, 73 nt, Mus musculus
ccuguuuuacugucuauacacgugaugccugagaugcacuggauucugugaaauuaugucgcucauaccuugu

SEQ ID NO: 65276 - RNA, 78 nt, Mus musculus
uccuauccugggaagaagcgggucggagaucccccccgacguugugcuggccuccauccuggcugucugugugaugau

SEQ ID NO: 65277 - RNA, 44 nt, Mus musculus
gcuucuucccaggauaggagugaacaucucaaacacagcccaga

SEQ ID NO: 65278 - RNA, 90 nt, Mus musculus
ucacgucuuuaaaaggaaccuuaaauuuuguaaggaagugucaagaauagagaaaggugggacagcaucagaggugaugaaguggcagga

SEQ ID NO: 65279 - RNA, 25 nt, Mus musculus
gcucuaauaagcaagcugcagccug

SEQ ID NO: 65280 - RNA, 31 nt, Mus musculus
uuuauguccccuuuugaaauguucucugggc

SEQ ID NO: 65281 - RNA, 45 nt, Mus musculus
uuuaacaacggugacaacagaggcuauggauuugaaagagagcaa

SEQ ID NO: 65282 - RNA, 46 nt, Mus musculus
uaacuacuuuuauauugccguuugccuguauggaacugcaacaguc

SEQ ID NO: 65283 - RNA, 45 nt, Mus musculus
aguggggaggaaggagagcaggagcagggaccucaucugggagau

SEQ ID NO: 65284 - RNA, 45 nt, Mus musculus
aauguauccacugacuuuguggucuuagugucucaugguuauaau

SEQ ID NO: 65285 - RNA, 38 nt, Mus musculus
gccuuugcuucuccuucauaauauuuuuuuuuaaagau

SEQ ID NO: 65286 - RNA, 45 nt, Mus musculus
gcugccaaaccuagcauccugaguuugaucccugggacccacaug

SEQ ID NO: 65287 - RNA, 61 nt, Mus musculus
gugcugucaggcuggaacggaagcagugcuuucagaaauagaaggggacgagguugaaaua

SEQ ID NO: 65288 - RNA, 44 nt, Mus musculus
ccgaagcccaaaucccugccaccuuccuaagccucaggugggcc

SEQ ID NO: 65289 - RNA, 42 nt, Mus musculus
uggauacaucuaucacaccaaguaugacacagcggacaggau

SEQ ID NO: 65290 - RNA, 46 nt, Mus musculus
ugugaccacgaacaaaguaccuggaauguucccaaaaucccuguag

SEQ ID NO: 65291 - RNA, 46 nt, Mus musculus
guucaaacccagcaaccacaugguggcucacaaccauccaugagau

SEQ ID NO: 65292 - RNA, 45 nt, Mus musculus
agcucucaggcacacacuucaaccguuaagauaagcucaacacua

SEQ ID NO: 65293 - RNA, 42 nt, Mus musculus
auuuggacuaaaccaugagacuggaugauaucggggcaccag

SEQ ID NO: 65294 - RNA, 45 nt, Mus musculus
gacuuuauuuuaggaaaguguguguaugugagagagacagacaga

SEQ ID NO: 65295 - RNA, 46 nt, Mus musculus
ugacuugccaggagucuuaauagugaguaguguuuugggugagagg

SEQ ID NO: 65296 - RNA, 42 nt, Mus musculus
cagaggcagcuuuggccaaagcuuuguguguggcgggggcag

SEQ ID NO: 65297 - RNA, 45 nt, Mus musculus
ugugggcaugucugugggcaucuucucuguggauuagugauagau

SEQ ID NO: 65298 - RNA, 45 nt, Mus musculus
gagaguuuuucuuguaagguuuuauacuugguaugugacagugga

SEQ ID NO: 65299 - RNA, 42 nt, Mus musculus
uuggaacacaaguucuuucccuccgacaccagcagccuccag

SEQ ID NO: 65300 - RNA, 46 nt, Mus musculus
uaaagacugugggauguuuaaaguuacuuagaccuuggggaugaau

SEQ ID NO: 65301 - RNA, 45 nt, Mus musculus
ccauggccucucacagugccgagccucagcuguucugcgugaccc

SEQ ID NO: 65302 - RNA, 39 nt, Mus musculus
ucuacacuguucucaacauuaucuucaaaacuucuauac

SEQ ID NO: 65303 - RNA, 45 nt, Mus musculus
gagcccaugcagcacgcugugguguuccucuuuaauggcgcagag

SEQ ID NO: 65304 - RNA, 41 nt, Mus musculus
uaggugcuguaguguuuaugauuuugaaagaaugugguagg

SEQ ID NO: 65305 - RNA, 42 nt, Mus musculus
aaagaaagagaaagagagagagagagagagagagagaaagag

SEQ ID NO: 65306 - RNA, 46 nt, Mus musculus
agaggaagcagugcagccgcggagagaaccaaggaggagggcugag

SEQ ID NO: 65307 - RNA, 42 nt, Mus musculus
uguuugauaacauggggaacacaaaucauuucaaagaggcga

SEQ ID NO: 65308 - RNA, 46 nt, Mus musculus
cuuguuuuuaaaacuucaauguaggggauucacuucgauuugacag

SEQ ID NO: 65309 - RNA, 46 nt, Mus musculus
gauuaucuggaacacauaacggccauuggccccaggacuacaggaa

SEQ ID NO: 65310 - RNA, 42 nt, Mus musculus
ggcuuccucggcucccucuuucgcuuucuugggguggccaga

SEQ ID NO: 65311 - RNA, 73 nt, Mus musculus
gcggccgcgucgcaccggcagagagaggccucagcgcaggaggaugcgaagggcgucgggaggauguggggga

SEQ ID NO: 65312 - RNA, 46 nt, Mus musculus
acuagucacauaucaguguauguguauuacaaaacagcuaucaauu

SEQ ID NO: 65313 - RNA, 46 nt, Mus musculus
uuccuugguaauacuguguuuguuacagugagggacggaugcuaga

SEQ ID NO: 65314 - RNA, 42 nt, Mus musculus
guucucccacacugguuaucguggcuuccgcugcaugaagau

SEQ ID NO: 65315 - RNA, 46 nt, Mus musculus
ggaaaaacuauugaaugcauuagccauguuggacuugccguuggga

SEQ ID NO: 65316 - RNA, 41 nt, Mus musculus
ugaucaauccaagcugcauggugcggaggcaagccgaggag

SEQ ID NO: 65317 - RNA, 46 nt, Mus musculus
ucaaaugcaaagcaacucuuuggauaagcagggaaagguuccagau

SEQ ID NO: 65318 - RNA, 45 nt, Mus musculus
uuguuguuguuguugaugaugaugaugauggugauggugauggug

SEQ ID NO: 65319 - RNA, 41 nt, Mus musculus
ugaaaccagagaacaaauucuggccaaccauugcccggauc

SEQ ID NO: 65320 - RNA, 46 nt, Mus musculus
gccuguggcagggacucucaugauugagcccaccgagucagaagac

SEQ ID NO: 65321 - RNA, 46 nt, Mus musculus
gcuucugugcugcauauguguucugugugcaugugagugugugggu

SEQ ID NO: 65322 - RNA, 45 nt, Mus musculus
uuccugcugggguuguagugcccaggguagcuggaaacucagagg

SEQ ID NO: 65323 - RNA, 46 nt, Mus musculus
ggauuacagacauggccucuugccacacccagaaaagaugguagau

SEQ ID NO: 65324 - RNA, 46 nt, Mus musculus
ccaggcuggugggcuuuuaaagcaaacaaggguaaaagagauaggu

SEQ ID NO: 65325 - RNA, 45 nt, Mus musculus
cuauuagaagaccagugcucgucuuaaucauauuuaccagcagua

SEQ ID NO: 65326 - RNA, 45 nt, Mus musculus
aaaaggaaguaaauaaccaggagcccugggaggguggucuccaga

SEQ ID NO: 65327 - RNA, 45 nt, Mus musculus
auauuuauuuauuuuauguaugugaguacacuguagcugcuuuca

SEQ ID NO: 65328 - RNA, 42 nt, Mus musculus
ccuuacccaacccccugccuccaccuccccagaugccgagau

SEQ ID NO: 65329 - RNA, 41 nt, Mus musculus
ccagucucagucugggcaauauguccucagggggagagaga

SEQ ID NO: 65330 - RNA, 46 nt, Mus musculus
acagcuaucacucagaaacuaaucuuguccgguauaugaagaaacu

SEQ ID NO: 65331 - RNA, 46 nt, Mus musculus
ucagcuucuuaccagggcuugggucaguucuaggauggugugagac

SEQ ID NO: 65332 - RNA, 41 nt, Mus musculus
ggcugccauguucgccauuuaccauggaucccaggggcuga

SEQ ID NO: 65333 - RNA, 45 nt, Mus musculus
ugcucauucagucgccaccuacugacgagcauguacacuagagau

SEQ ID NO: 65334 - RNA, 60 nt, Mus musculus
gaaggaaguguaucgccucgcucuccagaccagagaacaacacauccggagagacaaagc

SEQ ID NO: 65335 - RNA, 63 nt, Mus musculus
cuuugcugucaaagaaaaccuggugaggaugaugccuggaaggauggugggggugacaaggua

SEQ ID NO: 65336 - RNA, 84 nt, Mus musculus
cugugcuacugaccuuuuagcucuguguauuuugaggccaccuggagaguuuggaguggacauugcccugggcaacucccagag

SEQ ID NO: 65337 - RNA, 45 nt, Mus musculus
ggggugcuugucgagcugaaguuaccccacgaaauggauuucagu

SEQ ID NO: 65338 - RNA, 46 nt, Mus musculus
ccuuuauaccuaauaucuguccuuuucuuuuuaucauaguguagau

SEQ ID NO: 65339 - RNA, 46 nt, Mus musculus
gggucacccaguacacuccguaucagccagaggugucccaggggag

SEQ ID NO: 65340 - RNA, 45 nt, Mus musculus
aaauaguaauugacaaaaaauauagagguugagagacagccaguu

SEQ ID NO: 65341 - RNA, 42 nt, Mus musculus
ugauugagagagagagagagagagagagaggaaaagaguaua

SEQ ID NO: 65342 - RNA, 24 nt, Mus musculus
cucauagguaguaggaagccgcag

SEQ ID NO: 65343 - RNA, 45 nt, Mus musculus
ugaaauccucgagacucugcaugccauugcaagcaagaaccagau

SEQ ID NO: 65344 - RNA, 41 nt, Mus musculus
agaaugaagaagaguccugagcaucugggaauggguccgcg

SEQ ID NO: 65345 - RNA, 46 nt, Mus musculus
ugaggaguuaugguggcuugcuaauuggaaucuggucugaccagau

SEQ ID NO: 65346 - RNA, 94 nt, Mus musculus
gcugcgcagugacuucgugggaacgagggacuucccugguggacugaggaggugugggaaagaugaccacguggaggggaauagucggguagag

SEQ ID NO: 65347 - RNA, 47 nt, Mus musculus
gaagacugaacacagagacagugagauggcagugcaaauccgggaaa

SEQ ID NO: 65348 - RNA, 45 nt, Mus musculus
cuucagcuuaauuccacucagaugaauuuuucucuucagccacaa

SEQ ID NO: 65349 - RNA, 42 nt, Mus musculus
augcaaacucaggccaucugacuccauugccaacccccacuc

SEQ ID NO: 65350 - RNA, 46 nt, Mus musculus
gugguuuuuuuguuuguuuguuguuguuuuuuuauguggcauugac

SEQ ID NO: 65351 - RNA, 42 nt, Mus musculus
gagggccggaaagcgcugcugacccucgugggcuggggaggu

SEQ ID NO: 65352 - RNA, 46 nt, Mus musculus
aaaggggagaagggauggagagcuagggguguaagcgguacagaga

SEQ ID NO: 65353 - RNA, 41 nt, Mus musculus
agagggaggcugcagagagccaucauuguaaacacggccaa

SEQ ID NO: 65354 - RNA, 44 nt, Mus musculus
gcccgaaggaguccacagaagagaaguuggugccuggagggagg

SEQ ID NO: 65355 - RNA, 45 nt, Mus musculus; identical to SEQ ID NO: 44659

SEQ ID NO: 65356 - RNA, 46 nt, Mus musculus; identical to SEQ ID NO: 44660

SEQ ID NO: 65357 - RNA, 43 nt, Mus musculus
aucaguaaggggcuuuuaacagcuagcugaggaauugggagga

SEQ ID NO: 65358 - RNA, 45 nt, Mus musculus
gagguucuucgaucauugugagaaguucuuaacugauguggaaag

SEQ ID NO: 65359 - RNA, 42 nt, Mus musculus
uaauucagguagcuuuuuucaccuguucauuugaccuggcaa

SEQ ID NO: 65360 - RNA, 46 nt, Mus musculus
ggguguagaaagggagggugggacaguguucuggauuguccgggau

SEQ ID NO: 65361 - RNA, 41 nt, Mus musculus
uuuggaaccuuguauuucaucugcaggaguguuuuugugga

SEQ ID NO: 65362 - RNA, 45 nt, Mus musculus
ccuucugcccucuucuguuccuccucccguccgcuuuccgcccac

SEQ ID NO: 65363 - RNA, 45 nt, Mus musculus
cuauuucaggacauuuuucuacaccuggacaaagcaguggagcag

SEQ ID NO: 65364 - RNA, 46 nt, Mus musculus
uguuaaauugguuuucaacaaaagaugccaaggcaauauggugaag

SEQ ID NO: 65365 - RNA, 93 nt, Mus musculus
gguauagaccuggguaaugacgaguaugugguauagaccuggguaaugauggagugugugguauagaccuggguaaugacgaguaugugguau

SEQ ID NO: 65366 - RNA, 80 nt, Mus musculus
agaccuggguaaugauggagugugugguauagaccuggguaaugauggaguaugugguauagaccuggguaaugacgagu

SEQ ID NO: 65367 - RNA, 106 nt, Mus musculus
guauagaccuggguaaugacggaguaugugguauagaccuggguaaugacggaguaugugguauagaccuggguaaugauggaguaugugguauagaccuggguaa

SEQ ID NO: 65368 - RNA, 185 nt, Mus musculus
ugauggaguaugugguauagaccuggguaaugauggaguaugugguauagaccuggguaaugauggaguaugugguauagaccuggguaaugauggagugugugguauagaccuggguaaugauggagugugugguauagaccuggguaaugacggaguaugugguauagaccuggguaaugaug

SEQ ID NO: 65369 - RNA, 151 nt, Mus musculus
gaguaugugguauagaccuggguaaugauggaguaugugguauagaccuggguaaugauggaguaugugguauagaccuggguaaugacggaguaugugguauagaccuggguaaugacggaguaugugguauagaccuggguaaugaugg

SEQ ID NO: 65370 - RNA, 120 nt, Mus musculus
agugugugguauagaccuggguaaugauggaguaugugguauagaccuggguaaugauggaguaugugguauagaccuggguaaugacgaguaugugguauagaccuggguaaugaugga

SEQ ID NO: 65371 - RNA, 52 nt, Mus musculus
gaguaugugguauagaccuggguaaugauggagugugugguauagaccuggg

SEQ ID NO: 65372 - RNA, 62 nt, Mus musculus
ggccucugcccuccacccuccacccuccaccacagccugcagacgcuaaacagucagccugg

SEQ ID NO: 65373 - RNA, 47 nt, Mus musculus
ucauuuucauuccaggcuuacauugccaaauguguacuucuccagag

SEQ ID NO: 65374 - RNA, 47 nt, Mus musculus
gugugcacauugugaaauuuguccgaagugccaucugauaguccuag

SEQ ID NO: 65375 - RNA, 45 nt, Mus musculus
uugucaggagggugaaugugacuaagcccucugaacaugagccag

SEQ ID NO: 65376 - RNA, 46 nt, Mus musculus
gucagagccuuuaucaaaacugugagcauacuuuuaaugacugcug

SEQ ID NO: 65377 - RNA, 45 nt, Mus musculus
aauaguaaaacucagagggucacaaaaaacaaugcaaacaaaaag

SEQ ID NO: 65378 - RNA, 46 nt, Mus musculus
aagguuuagagggagugagagaagacuagggggugauaauggccag

SEQ ID NO: 65379 - RNA, 46 nt, Mus musculus
ucggcucuguggugagacccaaucucuaaagucaaagcaaggacag

SEQ ID NO: 65380 - RNA, 47 nt, Mus musculus
ggagccucugaccgcuuacaauuucgaggagcaaguuaaucgcaagu

SEQ ID NO: 65381 - RNA, 47 nt, Mus musculus
ucaaaccuaaucuucgugcuuuaccacugugacaacgcgcagagccc

SEQ ID NO: 65382 - RNA, 80 nt, Mus musculus
aaaaacuaauucaaugaagcagcugucccucccaguguuugcagagcugagauuuuccuaaugaccuaagaagauacuga

SEQ ID NO: 65383 - RNA, 45 nt, Mus musculus
aggucagcgaaagcagcucccagaagcucauguauugggucgcca

SEQ ID NO: 65384 - RNA, 42 nt, Mus musculus
cagaagcccacguaagugaugauagaaaaggugacugggaag

SEQ ID NO: 65385 - RNA, 45 nt, Mus musculus
ugcaggaauauuacuugauauuggcucauacagacaggcagaaug

SEQ ID NO: 65386 - RNA, 46 nt, Mus musculus
cuucaguuucaucagaccucaauaacaaaauuuuucaggccaagcc

SEQ ID NO: 65387 - RNA, 46 nt, Mus musculus
uacucaguucucaucccuuugccuuagaggacugucuagcccagag

SEQ ID NO: 65388 - RNA, 46 nt, Mus musculus
ugcauaugugcugugcauauaugugccuaagugugugugggcugug

SEQ ID NO: 65389 - RNA, 56 nt, Mus musculus
uuuuaugugcaagaaaaugaugacgucgaagguguacauugcucucugguuaauaa

SEQ ID NO: 65390 - RNA, 52 nt, Mus musculus
ugcuuaauuucuguaaaauccuuguguuuuccuugccuaggucauuuguauu

SEQ ID NO: 65391 - RNA, 46 nt, Mus musculus
ugggguuuggaugcccccuggaaacuguaugaugaaauaaucaguc

SEQ ID NO: 65392 - RNA, 78 nt, Mus musculus
uuuccucccucguacaacauaaaaaacaugcgucuacccacugcuuuguggagcgggggccgggacuggcuggcagac

SEQ ID NO: 65393 - RNA, 46 nt, Mus musculus
uguccuauuuaucaguaguucaguccuuuucauucacagggaucug

SEQ ID NO: 65394 - RNA, 42 nt, Mus musculus
caaccaucuguaaugggauccaaugccuucuucugguauguc

SEQ ID NO: 65395 - RNA, 27 nt, Mus musculus
cuuccugcuauguggcuucaaugagaa

SEQ ID NO: 65396 - RNA, 46 nt, Mus musculus
ggccaagaacaaaucuauuaugugggucauucucaaggcugcacca

SEQ ID NO: 65397 - RNA, 49 nt, Mus musculus
cagaauagaguuuauuuagggcaugggaaggggaguugagaagggagua

SEQ ID NO: 65398 - RNA, 42 nt, Mus musculus
ugcggacaagccaaguguccccccaagcgugaaucaucagau

SEQ ID NO: 65399 - RNA, 45 nt, Mus musculus
gaggaacacucgguccugacaggagauggcuauauucugaguauu

SEQ ID NO: 65400 - RNA, 46 nt, Mus musculus
auuucugaacugcucagcccacacccagcuuuucccagcagcacag

SEQ ID NO: 65401 - RNA, 46 nt, Mus musculus
ugucugugugugugcuuuuucaaaggaaccaauccuucgccagcag

SEQ ID NO: 65402 - RNA, 46 nt, Mus musculus
gcugugugaaucuguucaugggaacuaccacaaauguaugucaggu

SEQ ID NO: 65403 - RNA, 46 nt, Mus musculus
ugaggucaaccgggaaucucuggaagcgauccuuccacagcugaag

SEQ ID NO: 65404 - RNA, 42 nt, Mus musculus
cgacuggucaccuggggaaacuacgccuggaucuacuaucac

SEQ ID NO: 65405 - RNA, 46 nt, Mus musculus
cccagagugcuccucugggauggccaucgccauguuccgccuagaa

SEQ ID NO: 65406 - RNA, 51 nt, Mus musculus
ucaucgauuucccggaaguagagagaugcuaucagauggucaucaguaagg

SEQ ID NO: 65407 - RNA, 42 nt, Mus musculus
cccuggaguguuuguugcaauuucccagaaaugaaaggucaa

SEQ ID NO: 65408 - RNA, 46 nt, Mus musculus
uuuauucucuugaucuacuauaucuucucaaaagacagggcccuag

SEQ ID NO: 65409 - RNA, 47 nt, Mus musculus
uggccuagaggaaacacuagagcugaagacacaggaaauuauagauc

SEQ ID NO: 65410 - RNA, 46 nt, Mus musculus
aaaucccagcaaccacaugguggcucacaaccaucugucacaaaaa

SEQ ID NO: 65411 - RNA, 43 nt, Mus musculus
accgcaggguuugaggcgacuaaggaaaacucaugagagagau

SEQ ID NO: 65412 - RNA, 42 nt, Mus musculus
aagcccagggcgccagggaugccgagacugaaggggaggaug

SEQ ID NO: 65413 - RNA, 45 nt, Mus musculus
gucuuucagcagaacagacugugaauccaaaacuugcacacagcc

SEQ ID NO: 65414 - RNA, 47 nt, Mus musculus
cuugaaauguauauguuuuuccagaauuggucagaccauaugugaag

SEQ ID NO: 65415 - RNA, 27 nt, Mus musculus
cgagaagaggaaggcauggggugagug

SEQ ID NO: 65416 - RNA, 46 nt, Mus musculus
agcuggggaggugguauaauuguaaagugcuuguccagcaacaaaa

SEQ ID NO: 65417 - RNA, 46 nt, Mus musculus
cagcaauguauuuuuguuagcacuuuccuccuucucuugaucagau

SEQ ID NO: 65418 - RNA, 46 nt, Mus musculus
uacuaauauugaaaaacaaaagaaaacagauaaaggcccgggagau

SEQ ID NO: 65419 - RNA, 41 nt, Mus musculus
acugagcaugguaaccuaugacuuuaaucccagcacucaga

SEQ ID NO: 65420 - RNA, 45 nt, Mus musculus
cuuccuggggaucaacaagagauguaauauacaaaugagcaaguu

SEQ ID NO: 65421 - RNA, 46 nt, Mus musculus
aacauuuuaaagaauggaaguucgacauaagcauaaaguagaagau

SEQ ID NO: 65422 - RNA, 46 nt, Mus musculus
aggacuaacuagugcuggccagaaaggucagaagaaaguaucagau

SEQ ID NO: 65423 - RNA, 36 nt, Mus musculus
guaaacuagcaaugagugcuucaaggggugucgugg

SEQ ID NO: 65424 - RNA, 42 nt, Mus musculus
aaaaauuauugaacaaucuccauagugaacauggaugcagag

SEQ ID NO: 65425 - RNA, 45 nt, Mus musculus
auaaaucuagaaaaaaaagccagagagagagacaggcaggcaggc

SEQ ID NO: 65426 - RNA, 41 nt, Mus musculus
gaaagcaggagugggugggugagcacccucauagaagcagg

SEQ ID NO: 65427 - RNA, 45 nt, Mus musculus
uagauguaauuuaaaaaacaagucauuugcuagugggaaagagau

SEQ ID NO: 65428 - RNA, 44 nt, Mus musculus
aaagggagucaaaaguccugucaagggcacucauggccucagca

SEQ ID NO: 65429 - RNA, 46 nt, Mus musculus
gcacaaauugcgguugaauaagggaaaagcuggaagaagcugagga

SEQ ID NO: 65430 - RNA, 46 nt, Mus musculus
acacagcugagaaguaauuuugaaaaguaauuuucaacaaggagau

SEQ ID NO: 65431 - RNA, 45 nt, Mus musculus
uguacauuuucuguugacacuucacaagagucaagaacuacagau

SEQ ID NO: 65432 - RNA, 45 nt, Mus musculus
uuggggaucuuaauugugacuggugugggacaaccagggugcuuc

SEQ ID NO: 65433 - RNA, 54 nt, Mus musculus
cagagauacugaugaaaacaucugagauacagaugaaagagggggcggggagag

SEQ ID NO: 65434 - RNA, 45 nt, Mus musculus
uugguuugguuugguuugguuuaguuugaguugaguuugaguugg

SEQ ID NO: 65435 - RNA, 45 nt, Mus musculus
aaauuaucuaaauuauguggugaauacucuuuagaaagcagagug

SEQ ID NO: 65436 - RNA, 45 nt, Mus musculus
agugaccauguuaauauuccuauugaaaacacucaccuuuggaaa

SEQ ID NO: 65437 - RNA, 46 nt, Mus musculus
cuggggugaguaguauguggugugugugugugugugugugugugug

SEQ ID NO: 65438 - RNA, 26 nt, Mus musculus
cagaaccagcagcugcagcagcagca

SEQ ID NO: 65439 - RNA, 93 nt, Mus musculus
uuauuuuuauuuuuuaaagcaucucagcucugauuuaagagcagaagaaaaaguggaaacaaauagauuuauaucaaguaugggaaaauugua

SEQ ID NO: 65440 - RNA, 42 nt, Mus musculus
aaaaugggucaggggucaggguaagaagaaucugaagcagcu

SEQ ID NO: 65441 - RNA, 42 nt, Mus musculus
cucggcgccccggcgguccauggaccggaacccugggcggac

SEQ ID NO: 65442 - RNA, 42 nt, Mus musculus
uggcgucgcugucaaccccuuuacuacauuguccggggagga

SEQ ID NO: 65443 - RNA, 45 nt, Mus musculus
gguggugggggaguuggaaagagaaacgaaacccaggcuuuaaaa

SEQ ID NO: 65444 - RNA, 42 nt, Mus musculus
cuucccugauggaucuuugaugcccaccucccagccccagua

SEQ ID NO: 65445 - RNA, 46 nt, Mus musculus
cucaaaacuccaggccuacccugaacuuuggauacugcuacuagag

SEQ ID NO: 65446 - RNA, 46 nt, Mus musculus
cacagcgcuccucgucucacaacucuuacauucuuucugcccccau

SEQ ID NO: 65447 - RNA, 46 nt, Mus musculus
uaucuagcaugcauggcacuggauaaacagaguauggcagaggcag

SEQ ID NO: 65448 - RNA, 46 nt, Mus musculus
gcuuacacuauagcuauacagaugguugugagccuucaugugguug

SEQ ID NO: 65449 - RNA, 46 nt, Mus musculus
agcaaagauaaagaaaucauuuaaaaauaaauccaaggagcuggag

SEQ ID NO: 65450 - RNA, 46 nt, Mus musculus
ggcuuaaaaauauuuuuaauauuaaccuuaccaauaacaaagaggu

SEQ ID NO: 65451 - RNA, 45 nt, Mus musculus
gagaaacccugucucgaaaaaaaaaaaaccaaaaaaaaaaaaaaa

SEQ ID NO: 65452 - RNA, 46 nt, Mus musculus
aauuaagauaaaagacaagacaagaauuaugucaggaaauaucuag

SEQ ID NO: 65453 - RNA, 46 nt, Mus musculus
auagauucauggaaaaauuagauaauuauucaaauacuuuacucag

SEQ ID NO: 65454 - RNA, 44 nt, Mus musculus
ucucccguuaccaggugguccaaggaugggcaggcuggggcaaa

SEQ ID NO: 65455 - RNA, 41 nt, Mus musculus
gcgugguggcacauauguaauuccaguuucagaaggcccaa

SEQ ID NO: 65456 - RNA, 46 nt, Mus musculus
gaccuggaacucucauaaugcugggguuaaaggugugacccaauac

SEQ ID NO: 65457 - RNA, 41 nt, Mus musculus
auaauacuaugauccuggcacaaaaaaaaaauguagaccag

SEQ ID NO: 65458 - RNA, 46 nt, Mus musculus
agucugucacauuucuaacagcagaggaaacaaucaccacagugag

SEQ ID NO: 65459 - RNA, 47 nt, Mus musculus
guaaguuaauaauauucugucuuuucaauaaaaaugcauauagagga

SEQ ID NO: 65460 - RNA, 46 nt, Mus musculus
ucccagguuguaggccauaaagaagggcuggauguuauggagcgag

SEQ ID NO: 65461 - RNA, 45 nt, Mus musculus
auuuaauguuacuuguuucaaguaguauacagaugagagcuaacu

SEQ ID NO: 65462 - RNA, 46 nt, Mus musculus
cagacaagaauguaaagauaaaacuguacaaacauuaaaaguggac

SEQ ID NO: 65463 - RNA, 46 nt, Mus musculus
cauugguguaauugauuguaugcuacaaaggagccucuguuaacag

SEQ ID NO: 65464 - RNA, 46 nt, Mus musculus
ugauuaucugaacaaaagagauuuuguuuucuuuuccuaaacccau

SEQ ID NO: 65465 - RNA, 26 nt, Mus musculus
uggugagaacacauucaaagaccaac

SEQ ID NO: 65466 - RNA, 46 nt, Mus musculus
aagaagucuggacuguaaccuugaagacaggaugugacccccacau

SEQ ID NO: 65467 - RNA, 44 nt, Mus musculus
gaccuuucauugcuucucuuagaggaacagcauggaucccggga

SEQ ID NO: 65468 - RNA, 44 nt, Mus musculus
uauuguaacauguguuugguggaagggcgauguugggagacggu

SEQ ID NO: 65469 - RNA, 46 nt, Mus musculus
gcccacgccuuuaaucccagcacucaggaggcagaggcagacagau

SEQ ID NO: 65470 - RNA, 39 nt, Mus musculus
uuuccccugcugaguacuuaaaagcucugaacagcagaa

SEQ ID NO: 65471 - RNA, 46 nt, Mus musculus
cuccaaaaacaaacaaacaaaaacaaaacaaaagcuagccccagag

SEQ ID NO: 65472 - RNA, 45 nt, Mus musculus
uucaugaacuugcccaucucgacagcaggcagcaggcacccagca

SEQ ID NO: 65473 - RNA, 46 nt, Mus musculus
cuugguggcaagccccuucaucugcuuagcccucucaccagccuag

SEQ ID NO: 65474 - RNA, 45 nt, Mus musculus
gacgacaauaauuauugaaaccuuuauuuauuaagcuucacugag

SEQ ID NO: 65475 - RNA, 44 nt, Mus musculus
auccccuuaaagcaguaaccauaagguaguauaagaguccagag

SEQ ID NO: 65476 - RNA, 45 nt, Mus musculus
uucuuggucagggaaaggagaaccuugcucuauaaaaggugguga

SEQ ID NO: 65477 - RNA, 41 nt, Mus musculus
ggccaugguccuggggguggcaagaaggaugacaaggacaa

SEQ ID NO: 65478 - RNA, 72 nt, Mus musculus
ucuucucauggaggaggaauucauuagaaaucaggaacagaugaaaccauuagaagaaaagcaagaagagga

SEQ ID NO: 65479 - RNA, 45 nt, Mus musculus
acaccauugggaccaaaagauaugauucaaacucuggaggugaga

SEQ ID NO: 65480 - RNA, 46 nt, Mus musculus
aacuuuggauccagcacuuaucaggccaggccccauugacagaaag

SEQ ID NO: 65481 - RNA, 48 nt, Mus musculus
gccuuacggggacgcagaaugaaaguaacaaaugaagacuacaaaaaa

SEQ ID NO: 65482 - RNA, 45 nt, Mus musculus
ucuucuuuugaaugugcucugcauucuaugacucguuugggcagu

SEQ ID NO: 65483 - RNA, 45 nt, Mus musculus
uucaaguucaagacgaucucaggagacuucaccaaggcacauaaa

SEQ ID NO: 65484 - RNA, 45 nt, Mus musculus
gccagccgggaaggggcggagugaacccaacaugaaccccaagcu

SEQ ID NO: 65485 - RNA, 46 nt, Mus musculus
cuuagcagucaaguuacaaaggaagugagaaggaaggcagggagau

SEQ ID NO: 65486 - RNA, 46 nt, Mus musculus
aacuugacuuacaucguacgaucaucccagccaagacaucagagaa

SEQ ID NO: 65487 - RNA, 61 nt, Mus musculus
gaugccuuacucgggccaggcacuggcgcuagagauggagucugucuuugucuacaccauc

SEQ ID NO: 65488 - RNA, 45 nt, Mus musculus
aagcccaagagacagagagaucuugggucaaauaugguggugagu

SEQ ID NO: 65489 - RNA, 46 nt, Mus musculus
cuaccugcgugugaucaucuggaauaccaaggacguuaucuuggau

SEQ ID NO: 65490 - RNA, 41 nt, Mus musculus
uuaggggaaacuucagauguggguggaugucuuccccaaga

SEQ ID NO: 65491 - RNA, 46 nt, Mus musculus
ugcggugugccugauguauagucgaggccugagccuagagauuagu

SEQ ID NO: 65492 - RNA, 45 nt, Mus musculus
ccauauucucaggacucaggggcuggucccugagcacguggagac

SEQ ID NO: 65493 - RNA, 53 nt, Mus musculus
uugcauuccagaggccaacaaaauccugcaccagcaccuuggagcccccgaag

SEQ ID NO: 65494 - RNA, 46 nt, Mus musculus
guugcuucaaaacguugcaagauucaaaggcuucccgccaccaguu

SEQ ID NO: 65495 - RNA, 49 nt, Mus musculus
caggggagggaaaguauuccuuaauuaaccaaagcacccaagauaccag

SEQ ID NO: 65496 - RNA, 41 nt, Mus musculus
aaaaauaaccuugggcaagaaaguaauugaagaccgagacc

SEQ ID NO: 65497 - RNA, 42 nt, Mus musculus
gggucucaaauccuccccaccccagccuccuacuaagaccac

SEQ ID NO: 65498 - RNA, 42 nt, Mus musculus
cuucuaaaaagcuuuccacuuauaaccccguucaccugagaa

SEQ ID NO: 65499 - RNA, 46 nt, Mus musculus
ggaagccugugguuggccaaugcaccauugaccaccuggaccgcuu

SEQ ID NO: 65500 - RNA, 46 nt, Mus musculus
ucuuugauccuuugaaguuuauugucagaauugugaggugucagau

SEQ ID NO: 65501 - RNA, 46 nt, Mus musculus
gauggcuccaaccuucccauccuccccucucaaagagcaccaaacu

SEQ ID NO: 65502 - RNA, 46 nt, Mus musculus
ggacaucacaccuaagcuucucuggcauccuguuaugaauggagac

SEQ ID NO: 65503 - RNA, 46 nt, Mus musculus
cauacgcccaugucuccuuccuccaucgaagcaaaaccacugagau

SEQ ID NO: 65504 - RNA, 42 nt, Mus musculus
acuaaguauaaauauggaagguauuaaaaugcacugcaguaa

SEQ ID NO: 65505 - RNA, 46 nt, Mus musculus
ucgccugacucuuaccuguuuaaaauccauuuuaagaccccccccu

SEQ ID NO: 65506 - RNA, 45 nt, Mus musculus
agauggcuugguugauuacgaugaugauaugaugguggugguggu

SEQ ID NO: 65507 - RNA, 33 nt, Mus musculus
gaaaagauguaucacacucacaggcggcggaga

SEQ ID NO: 65508 - RNA, 42 nt, Mus musculus
aaaaguugaguaccucuuagccaaauugcugggggcccagaa

SEQ ID NO: 65509 - RNA, 45 nt, Mus musculus
gagugggaggaugacgcauggauauaugacauaaaucgagcagug

SEQ ID NO: 65510 - RNA, 46 nt, Mus musculus
ugucagcuucuaaaugcauaaagguguugugauaaucucgccagau

SEQ ID NO: 65511 - RNA, 46 nt, Mus musculus
aaaccagauaauacggucuccacuuugcaaacaaggaaccugagac

SEQ ID NO: 65512 - RNA, 46 nt, Mus musculus
agacacuagcucaccacaaaggccaucagugcucagugggcaagau

SEQ ID NO: 65513 - RNA, 47 nt, Mus musculus
acccaccacucugggaagucucaccucuaucccaugguucagagcau

SEQ ID NO: 65514 - RNA, 46 nt, Mus musculus
gcuuacuugugccuugggcaacucguuuucucaguagggucaacau

SEQ ID NO: 65515 - RNA, 46 nt, Mus musculus
cuugccgugcacauccuaguuucaugguuccuagugaugaccauuu

SEQ ID NO: 65516 - RNA, 46 nt, Mus musculus
uucacaugugcacguccacgaauaccuucuuuuauccuguccuagu

SEQ ID NO: 65517 - RNA, 46 nt, Mus musculus
agaaaaaaccaaugggcccaaagugccuguggagcugcgcgugaac

SEQ ID NO: 65518 - RNA, 46 nt, Mus musculus
gccucacgggaaugacuagcaucuugacuuuuuaguugguucagau

SEQ ID NO: 65519 - RNA, 46 nt, Mus musculus
uggguggcucaaccauggaugucucaaacagaaagggcaagaaguu

SEQ ID NO: 65520 - RNA, 46 nt, Mus musculus
auaagcaauacauuucuuccauugaugcuaguggguguuuagggag

SEQ ID NO: 65521 - RNA, 84 nt, Mus musculus
uggccguucuauaucuagauaccguucuagaucucucugacaugaauaguagcaugacaccaucauuugcuuucugacgugaac

SEQ ID NO: 65522 - RNA, 41 nt, Mus musculus
ccuggauuuaaauauuaaaccaugugugaccuugggcaagc

SEQ ID NO: 65523 - RNA, 46 nt, Mus musculus
ccaccuuguuggaaaucgaggaguggcuugauaaacugaugcagcu

SEQ ID NO: 65524 - RNA, 46 nt, Mus musculus
aacgucacgguucuggauacucagauccgaaaguugcgguccaggu

SEQ ID NO: 65525 - RNA, 35 nt, Mus musculus
acagggaaggucgaaaagaaaagagcauggacuac

SEQ ID NO: 65526 - RNA, 57 nt, Mus musculus
ccugcaaaccaguuggcggagguguggcugaagcugauagaugaaguuauagaagac

SEQ ID NO: 65527 - RNA, 41 nt, Mus musculus
cccaucacuugguuucaucgugcugacagccccagggagug

SEQ ID NO: 65528 - RNA, 24 nt, Mus musculus
uacugaaccuuaugucuauuccua

SEQ ID NO: 65529 - RNA, 45 nt, Mus musculus
ccacccacgauuugugauccauucaauugaauaaaggccauggua

SEQ ID NO: 65530 - RNA, 49 nt, Mus musculus
cagaaagagaaugguagcugccaggggcuggagggagggagaaauggag

SEQ ID NO: 65531 - RNA, 45 nt, Mus musculus
ggguucauuuuggcuuacaguucaagaguacguuccaucauggua

SEQ ID NO: 65532 - RNA, 48 nt, Mus musculus
ggguuugucccaacauucggaccuuguuauuugaaccuuuacggaagc

SEQ ID NO: 65533 - RNA, 46 nt, Mus musculus
ccagcacccuucugaaauguaaaacacaagcacagaaaauagagau

SEQ ID NO: 65534 - RNA, 46 nt, Mus musculus
aucuuaaggugucaaaaagaaagacaauuauaaaucucggggagaa

SEQ ID NO: 65535 - RNA, 46 nt, Mus musculus
gacugaugaugcaggacugcgaccccagcugcagaggagacuaaga

SEQ ID NO: 65536 - RNA, 46 nt, Mus musculus
uagagggaggaaggaggaaggaggaagaaggaaagugaagggggua

SEQ ID NO: 65537 - RNA, 45 nt, Mus musculus
uccaugugugaaaaaauaaaacuaacaguauaugacuggugaguu

SEQ ID NO: 65538 - RNA, 46 nt, Mus musculus
uaacuguucaguaaacucaguuccuguuacagucaccuguuagauc

SEQ ID NO: 65539 - RNA, 41 nt, Mus musculus
agccuccuuucagggaagggaagccuguguggcugggggga

SEQ ID NO: 65540 - RNA, 45 nt, Mus musculus
caacuguuugucccuacuguauuaugagacauguuugcugagaga

SEQ ID NO: 65541 - RNA, 46 nt, Mus musculus
agucucaguacaauagggacaaacauagucauugcgucuuggacuu

SEQ ID NO: 65542 - RNA, 45 nt, Mus musculus
aaagucagcauguuuguccugggaaccggagacgaacccccugug

SEQ ID NO: 65543 - RNA, 30 nt, Mus musculus
cggagagucucucgugaguaacgccaggau

SEQ ID NO: 65544 - RNA, 42 nt, Mus musculus
gacuauuuacauguucauuuugggcaugugguagcagcauug

SEQ ID NO: 65545 - RNA, 46 nt, Mus musculus
agauagauagauagauagggauggauggauggauggauggauggau

SEQ ID NO: 65546 - RNA, 50 nt, Mus musculus
aacauaaggcccguggugaaaguucacaucuguggucagacgcaccgcac

SEQ ID NO: 65547 - RNA, 70 nt, Mus musculus
caccugaggaucccuuugcaucgcacacuggacgagcuuugguaacaacaccacuuugugcuugcagauc

SEQ ID NO: 65548 - RNA, 46 nt, Mus musculus
ucugggacagugucagaagcucagcuggcucggaggaucaccaaag

SEQ ID NO: 65549 - RNA, 45 nt, Mus musculus
cugagaaccuaggagaguacugaagaaaugaaggggguaccaggc

SEQ ID NO: 65550 - RNA, 45 nt, Mus musculus
ugguagcaauaggaaaaugguaaauauugaccaaaggguuggcag

SEQ ID NO: 65551 - RNA, 46 nt, Mus musculus
uggaagaaugcuuuugaggagcccuuaggucaagauagcagaagau

SEQ ID NO: 65552 - RNA, 46 nt, Mus musculus
cacauccaaaugauccgagcgggaccagugugccaggcaugggagg

SEQ ID NO: 65553 - RNA, 41 nt, Mus musculus
gauuccuagauuuccugggaucaugauuaaugugggggggg

SEQ ID NO: 65554 - RNA, 47 nt, Mus musculus
auauauugucugacauagaaucagaauucaaaggucccggcaguugg

SEQ ID NO: 65555 - RNA, 45 nt, Mus musculus
gugccuaugaugugugugugugugugugugugugugugugugagu

SEQ ID NO: 65556 - RNA, 44 nt, Mus musculus
aguguguauguauaccugugugugugcaugugugugccugugac

SEQ ID NO: 65557 - RNA, 46 nt, Mus musculus
ucuuaucaucuuggccuguuuacaguaucacauuaguaauagagau

SEQ ID NO: 65558 - RNA, 23 nt, Mus musculus
gccuuaaccuuguuguguggggc

SEQ ID NO: 65559 - RNA, 42 nt, Mus musculus
gcauguguguguagugugugugugugugugugugugguguau

SEQ ID NO: 65560 - RNA, 42 nt, Mus musculus
guguguguaugugguguguguguguguguauauguggucugu

SEQ ID NO: 65561 - RNA, 46 nt, Mus musculus
uguauguguauguguggugugugugaguauguguguguguguggug

SEQ ID NO: 65562 - RNA, 42 nt, Mus musculus
uguguguauguguguguguguguguguauguguggugugugu

SEQ ID NO: 65563 - RNA, 45 nt, Mus musculus
agagucauagucuuuuaagauugauuuuuuuauuauuuguguggg

SEQ ID NO: 65564 - RNA, 39 nt, Mus musculus
ucagcccaccuccuggaaugacaggaagcauggccaacu

SEQ ID NO: 65565 - RNA, 42 nt, Mus musculus
ugccacuaacaucccuaaaacaaaauuugggaagccggaucc

SEQ ID NO: 65566 - RNA, 47 nt, Mus musculus
cauuuguuacugaaucuaguggaugagaaaccauguaaggaauuuca

SEQ ID NO: 65567 - RNA, 56 nt, Mus musculus
cagaugugucuuuauuggucuuuaucggucacaucagggucuugauuagcgucuug

SEQ ID NO: 65568 - RNA, 42 nt, Mus musculus
gggccacucauuuacccugucaaacucaggggcggagcaaug

SEQ ID NO: 65569 - RNA, 45 nt, Mus musculus
ggacuacgacaccuucgcucugcaguacuccugccgccugcagaa

SEQ ID NO: 65570 - RNA, 45 nt, Mus musculus
uuggcauccucuagcccacccaauaggaaaacaguggggcuaaga

SEQ ID NO: 65571 - RNA, 45 nt, Mus musculus
caguuuccuccuugugcaaaguagacagaaucacaacaugcagau

SEQ ID NO: 65572 - RNA, 48 nt, Mus musculus
cccaaugcuaauauaagaucuggacaggagagggcccccuugcucuag

SEQ ID NO: 65573 - RNA, 82 nt, Mus musculus
ucuugauuauaguagcugccuuauaggauuaugagaaaaauugagaucguuuauuuagcaauuugacuaaugcccgccgugu

SEQ ID NO: 65574 - RNA, 46 nt, Mus musculus
guugggguagugugaacaccugccugcauauucauaacagucagau

SEQ ID NO: 65575 - RNA, 78 nt, Mus musculus
gucucuuuuagagcaacugaaagcgaaguggucaagaauucagauguaaauuuauagucgcuuguagccuguuaagaa

SEQ ID NO: 65576 - RNA, 45 nt, Mus musculus
ccucaugugugugucugugugugucugugugugugugugugugug

SEQ ID NO: 65577 - RNA, 46 nt, Mus musculus
aguuuccccaaaccucaaauaaaauuugaaucuaaagucuuuagca

SEQ ID NO: 65578 - RNA, 45 nt, Mus musculus
auuccuuuggaaugaggaggaugaagcagauaugacuugguaauu

SEQ ID NO: 65579 - RNA, 44 nt, Mus musculus
caaaucccagcaaccacaugguggcuuacaaccaucccguaacg

SEQ ID NO: 65580 - RNA, 45 nt, Mus musculus
accaaguuuguaaacgacuauauuuuguacuaugguggcaaaaga

SEQ ID NO: 65581 - RNA, 41 nt, Mus musculus
cucauuauagguguuugugagccaccaugugauugcuagga

SEQ ID NO: 65582 - RNA, 34 nt, Mus musculus
aaaggaaaagggaaagaaaaagaaaaagaaaaaa

SEQ ID NO: 65583 - RNA, 49 nt, Mus musculus
ggcuagugaggauccucccucaaaagaaaugauuuaugaauagaauuug

SEQ ID NO: 65584 - RNA, 42 nt, Mus musculus
uaggauauaggacgcccagguucaguccccagugcuguguaa

SEQ ID NO: 65585 - RNA, 46 nt, Mus musculus
gagcaaucagugcccuuaaccacugagccaucucuccagcccugug

SEQ ID NO: 65586 - RNA, 47 nt, Mus musculus
agggauggaugaagcugcccgagauaaaaagaaauguggcgucggag

SEQ ID NO: 65587 - RNA, 45 nt, Mus musculus
ggcagcagaugcccuauucucgagauuuucuuaauuccagucagu

SEQ ID NO: 65588 - RNA, 66 nt, Mus musculus
ggacucuugggggcgaacuugccagacagagaagagcggaagggaagggguguguaaggagggccg

SEQ ID NO: 65589 - RNA, 46 nt, Mus musculus
cuagccaaauaguagcagaaccuagauuagaguuaaucacugagau

SEQ ID NO: 65590 - RNA, 46 nt, Mus musculus
aaugcauugaggaugcacucaucugugugugcauaugugaagguca

SEQ ID NO: 65591 - RNA, 46 nt, Mus musculus
ggaaagcauuaacaucuuauuuaaaauguuaaaucaagaguuugag

SEQ ID NO: 65592 - RNA, 46 nt, Mus musculus
ugggaacaaauggaaucuaugaacaaauuaagaaaaaaacguugac

SEQ ID NO: 65593 - RNA, 42 nt, Mus musculus
gcuuauagauaugagagccaccaaacagcugggccacaauga

SEQ ID NO: 65594 - RNA, 46 nt, Mus musculus
cacauugcuuaaucuauagauguuuuuguauauuuagcccgcugcc

SEQ ID NO: 65595 - RNA, 55 nt, Mus musculus
gggauauuguggauggcuugcugcucuuuaauggcugccccuuaggugggaaggu

SEQ ID NO: 65596 - RNA, 45 nt, Mus musculus
cagaggcuuuuguuagcaucauugugccccuccgccuaauccugc

SEQ ID NO: 65597 - RNA, 45 nt, Mus musculus
gaucucuugggauguggggcagaaaacaacauggacuaggcagcu

SEQ ID NO: 65598 - RNA, 46 nt, Mus musculus
guguggguguaugcaagugugcuugugugugugugugugugugugu

SEQ ID NO: 65599 - RNA, 46 nt, Mus musculus
ggggaugggaaaauuguuaaaggaacuacaaaugugggcaacaugg

SEQ ID NO: 65600 - RNA, 45 nt, Mus musculus
uaugacaaucuugucauucauuccaaacuugcacucaggcaugcc

SEQ ID NO: 65601 - RNA, 46 nt, Mus musculus
ucucugaguucuguggguagccaaaguccagaaucucauccagcag

SEQ ID NO: 65602 - RNA, 46 nt, Mus musculus
aucaugguggcagcucagucucugugacccauugcucugagaacag

SEQ ID NO: 65603 - RNA, 42 nt, Mus musculus
gccuggccacucucggaucccaagauguccgccugcccccua

SEQ ID NO: 65604 - RNA, 45 nt, Mus musculus
ccagugugugaagaggucuugcacccgccgaacaacucgggacca

SEQ ID NO: 65605 - RNA, 46 nt, Mus musculus
cgggcggcuccgcaggcacggcuggacaccggccggggacccaguc

SEQ ID NO: 65606 - RNA, 45 nt, Mus musculus
caccgcaggcuccguuuguucggccaucucuggagccaaggaccc

SEQ ID NO: 65607 - RNA, 45 nt, Mus musculus
ccccaaagacaaaacccaaagaacgcaaaccacuaaaacaagggu

SEQ ID NO: 65608 - RNA, 46 nt, Mus musculus
auacaaauauucaaagucaugcuacacagcaagucaggcagcagcc

SEQ ID NO: 65609 - RNA, 73 nt, Mus musculus
ugcuguuguuccauuuuagucaacaaaaauuuugaguagauauugcuuuuuucaagcaaaugcugaagucugc

SEQ ID NO: 65610 - RNA, 33 nt, Mus musculus
uuuaaugaccguuuuuuuuucuccaacuucucu

SEQ ID NO: 65611 - RNA, 46 nt, Mus musculus
agaugucuuuuuauagugaaugaacaaaugcaugacuggcuaagau

SEQ ID NO: 65612 - RNA, 45 nt, Mus musculus
uagaauucccuugccagcaccuccucuacucuagcucugggagau

SEQ ID NO: 65613 - RNA, 46 nt, Mus musculus
uugaauccuuauuuuucugaauaucuucuacacaaagacucguagu

SEQ ID NO: 65614 - RNA, 41 nt, Mus musculus
aucuuacuucuggaguaaaucuuuuaaauucagccauccag

SEQ ID NO: 65615 - RNA, 24 nt, Mus musculus
ucaggguuaggguuagguaccugu

SEQ ID NO: 65616 - RNA, 72 nt, Mus musculus
ccuuuaaucgcagcacucaggagacagagauuugaacucaggcagaucccugaauucaaggccagccuaguc

SEQ ID NO: 65617 - RNA, 44 nt, Mus musculus
acaugugccaugacacaggaagggaggaagaaaagcaaacugca

SEQ ID NO: 65618 - RNA, 42 nt, Mus musculus
aguuauacuugauaguguauuugacaaacugagccaccaaga

SEQ ID NO: 65619 - RNA, 46 nt, Mus musculus
uuaggggggacuucaagagcaacaucagacuucagucuucucagua

SEQ ID NO: 65620 - RNA, 42 nt, Mus musculus
ugaauacacauauaacuaaaaaugaaacguaagccaggagug

SEQ ID NO: 65621 - RNA, 46 nt, Mus musculus
aauauaaacauaaauauaaacauugucaagugauacaauggccuac

SEQ ID NO: 65622 - RNA, 46 nt, Mus musculus
auuaugaaguuuucuacuuaacugcucccacaggggccacugagau

SEQ ID NO: 65623 - RNA, 46 nt, Mus musculus
gaagcacaaaauuaccucguaauaaucauuacagagcuauagagau

SEQ ID NO: 65624 - RNA, 101 nt, Mus musculus
ggacuagaggugauggcucaugcuuguaaucccaacacuuggggcgggggaagagggagagaaggagagaggagaggggaggggagaggagaggggaggag

SEQ ID NO: 65625 - RNA, 46 nt, Mus musculus
ggaucccuaugguugaauuaggggaaggauuaaagaagcuggagag

SEQ ID NO: 65626 - RNA, 50 nt, Mus musculus
gggaccuggguggaagagaaagggaaaaaggggaacaagaucagguaugg

SEQ ID NO: 65627 - RNA, 45 nt, Mus musculus
auaaauaaauuuugggccaauaaauauagcucaguggguaaagau

SEQ ID NO: 65628 - RNA, 46 nt, Mus musculus
augugucugcgcaugccauagaucccccuggaacuggaguugagga

SEQ ID NO: 65629 - RNA, 45 nt, Mus musculus
cuggacuaccucguggggcuucaguggaagaggaugcgguuaggc

SEQ ID NO: 65630 - RNA, 42 nt, Mus musculus
gggggauauagagacugaaguggccaccuccuguagccagau

SEQ ID NO: 65631 - RNA, 45 nt, Mus musculus
ugcggagccgccaagaccaguuaggaugucgggacgcacagagag

SEQ ID NO: 65632 - RNA, 42 nt, Mus musculus
ccgcgcgcccgaggggcagcggaacuccggggaaaggggcgg

SEQ ID NO: 65633 - RNA, 46 nt, Mus musculus
aacagaugcaacuucaaaguuuagaaaacaaaaguuaagggucagu

SEQ ID NO: 65634 - RNA, 45 nt, Mus musculus
guggcauuguccaggcauuaaguugugugccuuuguuccugggag

SEQ ID NO: 65635 - RNA, 29 nt, Mus musculus
ucauauguuggugguggugcccucuccuc

SEQ ID NO: 65636 - RNA, 46 nt, Mus musculus
uauucuacccaauacagucuaaagauaauaccaauuagacacugag

SEQ ID NO: 65637 - RNA, 48 nt, Mus musculus
uuacacucuagauuuuuaaauuagugauugguuguugugcauucagaa

SEQ ID NO: 65638 - RNA, 45 nt, Mus musculus
cccuaagaaauuauuuuaaacuaggagguauggcucagugccuau

SEQ ID NO: 65639 - RNA, 43 nt, Mus musculus
aaaccauaaaaauauuagaagaagacacuuaaaacaugaggag

SEQ ID NO: 65640 - RNA, 42 nt, Mus musculus
cagucuuguagguugauggcaugguucaggaaccaauagcag

SEQ ID NO: 65641 - RNA, 46 nt, Mus musculus
cauguuguuagaugaagccuccuuuaaaccugaguguucuuaacag

SEQ ID NO: 65642 - RNA, 46 nt, Mus musculus
acaugaaguugaaaaauacagacuauuauuucagaguaaaccacag

SEQ ID NO: 65643 - RNA, 46 nt, Mus musculus
gcguuuaauauagugagcaaaacacagacuaaaucugaagaccaga

SEQ ID NO: 65644 - RNA, 46 nt, Mus musculus
agauaacaauuccugcuaacuacagugcuaaguuuaugggcuucaa

SEQ ID NO: 65645 - RNA, 46 nt, Mus musculus
ugaaaaggaagcagcuuucauaucugaaaagaauaauacgcuucag

SEQ ID NO: 65646 - RNA, 45 nt, Mus musculus
uuaccugcugaauccuccaacucuuuugaguucucuaaccaagga

SEQ ID NO: 65647 - RNA, 46 nt, Mus musculus
caaaauucagguccuguauauguucagaauccauuucuaaccucag

SEQ ID NO: 65648 - RNA, 41 nt, Mus musculus
gaaaaagucaacauugaauagaaaagguaaagaaagggcua

SEQ ID NO: 65649 - RNA, 41 nt, Mus musculus
gugguagaguuuuugacaaucaagaugugugggcuggccau

SEQ ID NO: 65650 - RNA, 46 nt, Mus musculus
uccuauuuuccagugauccccuugcacagaacuaugcuuaucugau

SEQ ID NO: 65651 - RNA, 46 nt, Mus musculus; identical to SEQ ID NO: 27494

SEQ ID NO: 65652 - RNA, 43 nt, Mus musculus; identical to SEQ ID NO: 27495

SEQ ID NO: 65653 - RNA, 46 nt, Mus musculus
cagcucucuuaagacuuucaacuaugaucagucuugcuaguaagag

SEQ ID NO: 65654 - RNA, 41 nt, Mus musculus
caguacugugaaaucacaaaacacuaaacaguucuagguga

SEQ ID NO: 65655 - RNA, 45 nt, Mus musculus
uuauuagcauucuuauuucugaaagagcagaaucagcaggcacga

SEQ ID NO: 65656 - RNA, 45 nt, Mus musculus
uauucugaaguuuagauguugcuugauaaaacuuugcuacagcag

SEQ ID NO: 65657 - RNA, 46 nt, Mus musculus
ccugguucuaagccuuucugauccuuuuacauuuuauugccccaug

SEQ ID NO: 65658 - RNA, 39 nt, Mus musculus
uuuugaaaaugagaauuaaaucuaauguuuauuuggcag

SEQ ID NO: 65659 - RNA, 45 nt, Mus musculus
auccuauauugauagucaaaauuaguacauucugaucuaggaaag

SEQ ID NO: 65660 - RNA, 45 nt, Mus musculus
cuuggaaaaucaacuuguacacacuguugaaaaacccucagggac

SEQ ID NO: 65661 - RNA, 46 nt, Mus musculus
ucacucaauucagguacuuugaugcuauucuuaaaccuaacaguga

SEQ ID NO: 65662 - RNA, 41 nt, Mus musculus
ccagcuguaauguuguguaugguaguucucacuggaugcua

SEQ ID NO: 65663 - RNA, 46 nt, Mus musculus
aaaaaaaaaaaaaaaaaaggaaggaaggaaggaaggaaggaaaaac

SEQ ID NO: 65664 - RNA, 42 nt, Mus musculus
auggggguaaauacugauucucagagaaauaaaggccaagug

SEQ ID NO: 65665 - RNA, 41 nt, Mus musculus
cugaaauguuuccuggugauauucucggauauucucgggga

SEQ ID NO: 65666 - RNA, 42 nt, Mus musculus
cgccaguccaaagucuggcugcaguggaagagguggcugaga

SEQ ID NO: 65667 - RNA, 42 nt, Mus musculus
ggccuagaacugucugaacaugaccaaagcaccagcacugag

SEQ ID NO: 65668 - RNA, 46 nt, Mus musculus
ugaucccagugagccaaacuccgacucaccugaagagaauguggau

SEQ ID NO: 65669 - RNA, 41 nt, Mus musculus
uuggugucauuacaaggcagacuguuaaaaauaugcuggca

SEQ ID NO: 65670 - RNA, 42 nt, Mus musculus
uuggacacugcaaaaaugacuucagaaaagcaaggcacacag

SEQ ID NO: 65671 - RNA, 46 nt, Mus musculus
gacucggugguggaggagcagcccaaguucauaggauggugugcag

SEQ ID NO: 65672 - RNA, 45 nt, Mus musculus
agccaacggcaagagcaaggagcaagucugacaagcugaaggaga

SEQ ID NO: 65673 - RNA, 41 nt, Mus musculus
agccauccucccaccaacuugccuacuccagccagcacccg

SEQ ID NO: 65674 - RNA, 38 nt, Mus musculus
ggacugaguaaagaagagagagagagagagagagagag

SEQ ID NO: 65675 - RNA, 41 nt, Mus musculus
ggcaugucugugaagauguucccagagcgguuuggcugagg

SEQ ID NO: 65676 - RNA, 45 nt, Mus musculus
uugugguguguguguguguguguguguguguguguguguaggggg

SEQ ID NO: 65677 - RNA, 45 nt, Mus musculus
gguacagaagcuuucugaauauggugcuacaauugcagagcagag

SEQ ID NO: 65678 - RNA, 85 nt, Mus musculus
gcuggggcugggacuagggcugggacugggacuaggcuaacuggagaccuuaugaucauuuuggcaggaagaucugucccaggcc

SEQ ID NO: 65679 - RNA, 45 nt, Mus musculus
gccauuccacagaaagccuggauaggucugcccuucacccuggag

SEQ ID NO: 65680 - RNA, 45 nt, Mus musculus
uuggcuauucuauaaagggauccugucugaugucuaaggggggag

SEQ ID NO: 65681 - RNA, 42 nt, Mus musculus
caacuucucuucugucaaaaguuggugagucgggcuggugag

SEQ ID NO: 65682 - RNA, 50 nt, Mus musculus
ugguggcucacaaccauccauaacaagaucugacucccucucuucuggug

SEQ ID NO: 65683 - RNA, 42 nt, Mus musculus
agcuucaaacuacugggacaaguagcuagucauugccuccag

SEQ ID NO: 65684 - RNA, 76 nt, Mus musculus
uuuauccauuugagacuucauaagaauuuaaaacuuuggacacagaucagaccagagcuauuagaggauuaguagg

SEQ ID NO: 65685 - RNA, 41 nt, Mus musculus
cauaguaaguggggguuaaggaaggaugcuuuugggcugga

SEQ ID NO: 65686 - RNA, 41 nt, Mus musculus
uuggccauagggaguggcacuauuaggagguguggccuuuu

SEQ ID NO: 65687 - RNA, 45 nt, Mus musculus
cauagugagaccaugucuuuaaaaaguaauuacaaagacuuacaa

SEQ ID NO: 65688 - RNA, 82 nt, Mus musculus
gaaggaucuggccucaagauuuaauucauuauuagcagugggaugagucagcucacuaguacucacuaaaugaaagcagaug

SEQ ID NO: 65689 - RNA, 45 nt, Mus musculus
ucucuuccuuagaaguagcaguuuggggacuggaaggaaugcgau

SEQ ID NO: 65690 - RNA, 51 nt, Mus musculus
gucaaagacaagcauagaguauuuccuucuggaaagguaaccuuaucagag

SEQ ID NO: 65691 - RNA, 49 nt, Mus musculus
cucacaaccauccguaacgagaucugacgcccucuucuggggugucuga

SEQ ID NO: 65692 - RNA, 24 nt, Mus musculus
ggagcaggauugguggcgcccuuu

SEQ ID NO: 65693 - RNA, 47 nt, Mus musculus
agaguaaucagugccuuuuaaguaugagccaucucuuuagcccccac

SEQ ID NO: 65694 - RNA, 46 nt, Mus musculus
ccugacaacccucuccauccagguuaccuaauauauucugcaucag

SEQ ID NO: 65695 - RNA, 45 nt, Mus musculus
cuucucccuugccagguguuugaacccuuucuacaccaaagcaga

SEQ ID NO: 65696 - RNA, 40 nt, Mus musculus
ggaauggguaauggugugugugcaggagggaagagggaag

SEQ ID NO: 65697 - RNA, 44 nt, Mus musculus
ccagucgaccccuuuccaagugaugaaugggagccaggguuaag

SEQ ID NO: 65698 - RNA, 44 nt, Mus musculus
ucugggagcccugguaagggucucccaguguacacuggcgcguu

SEQ ID NO: 65699 - RNA, 46 nt, Mus musculus
uucaacaaccugguuauuaaugguuuauaugcucuugaaaggucug

SEQ ID NO: 65700 - RNA, 44 nt, Mus musculus
uaggaaccacacgaacuguaaugcaagggggaaauguguuguag

SEQ ID NO: 65701 - RNA, 45 nt, Mus musculus
gcguuugaucucuucaaccugguccuguccuacaagaggcuggag

SEQ ID NO: 65702 - RNA, 45 nt, Mus musculus
accuuuagguguauucaggucuacuuguguuccagcgcuaugcag

SEQ ID NO: 65703 - RNA, 51 nt, Mus musculus
caucaggacuguaguuggauaagcuccucuuagggacugcuggaaagacac

SEQ ID NO: 65704 - RNA, 46 nt, Mus musculus
cugccucugccucccaagcgcuggaauuaaaggcgugcgccaccac

SEQ ID NO: 65705 - RNA, 46 nt, Mus musculus
cuuaaaacaaaguaugauacauucucagaauuguagaaguaaagag

SEQ ID NO: 65706 - RNA, 46 nt, Mus musculus
uugccugggccucaacaucuuguuccucacuuugaacgaggguaag

SEQ ID NO: 65707 - RNA, 51 nt, Mus musculus
cuaauuuaggggucauuugucaacaagacacgggguaaugggaucaggagg

SEQ ID NO: 65708 - RNA, 47 nt, Mus musculus
gcccuacugggcuaccuucaggaggugugccggggacagcugccaga

SEQ ID NO: 65709 - RNA, 45 nt, Mus musculus
cccugcuaagcucuagaaguagcuguguuucugagccuuuuggua

SEQ ID NO: 65710 - RNA, 42 nt, Mus musculus
gaggcugagccagaugaggaguucaaagaugcaauugaggug

SEQ ID NO: 65711 - RNA, 55 nt, Mus musculus
ucacccauuucaguugugagugcuguagacuuccucagguugauaaugguguagg

SEQ ID NO: 65712 - RNA, 44 nt, Mus musculus
uuguguguuucaguguuuagugaguucuaagucugugagucugu

SEQ ID NO: 65713 - RNA, 45 nt, Mus musculus
gggacuacugcuguugguccagcaagugacaguuugucugugcag

SEQ ID NO: 65714 - RNA, 46 nt, Mus musculus
ccccagaacccaucucucaucucuccuccauccgccccaacugcca

SEQ ID NO: 65715 - RNA, 42 nt, Mus musculus
ccagaggagaccaccugguugaaucuuauuucauuaccccag

SEQ ID NO: 65716 - RNA, 45 nt, Mus musculus
ccuuuccuaaaugcuguguauguuuguuguaaaugaaaccuguag

SEQ ID NO: 65717 - RNA, 60 nt, Mus musculus
cuagcccuuaucucauggaacaugcggccaggugaguggagcagagagacugcaagccuu

SEQ ID NO: 65718 - RNA, 45 nt, Mus musculus
aagccugauguguugcgucuguagucucaguguuccuauagcaag

SEQ ID NO: 65719 - RNA, 45 nt, Mus musculus
uuacguaucuaugccuggaagcaaguaagcguuucuuggguggaa

SEQ ID NO: 65720 - RNA, 46 nt, Mus musculus
ccuggugaaccagagaagugccugucaauauuugguuagaguggag

SEQ ID NO: 65721 - RNA, 46 nt, Mus musculus
cacagcaguagcaauaauuuaucgucguugggauacagggauugag

SEQ ID NO: 65722 - RNA, 45 nt, Mus musculus
agcagguugggcagccgcaugcgcuuguagcccaccgugugacag

SEQ ID NO: 65723 - RNA, 46 nt, Mus musculus
aggugccauaaauaauagguuccgugugaguauggaugcauuagau

SEQ ID NO: 65724 - RNA, 49 nt, Mus musculus
ggcaacccaaauucaauuaccugauuaaucaugaucacguaggagauac

SEQ ID NO: 65725 - RNA, 30 nt, Mus musculus
agaaaacguuaauuacccauuucaaagaag

SEQ ID NO: 65726 - RNA, 46 nt, Mus musculus
agggugaaaaaugcucaauaacgaugugagucggaucuggaauggg

SEQ ID NO: 65727 - RNA, 50 nt, Mus musculus
uucaaaucccagcaaucacaugguggcucacaaacauccguaacgaaauc

SEQ ID NO: 65728 - RNA, 42 nt, Mus musculus
cacuacaaagaggaggccauauuguuccugagcggugcaggg

SEQ ID NO: 65729 - RNA, 42 nt, Mus musculus
acaaugucauauagacauaagcugcugguauucuuggcauga

SEQ ID NO: 65730 - RNA, 45 nt, Mus musculus
aggagccagcaggcagcagaugguucaguguuguuugugcuuagg

SEQ ID NO: 65731 - RNA, 44 nt, Mus musculus
uguugagguagggcgugggcagggcagguccuaccuguggccau

SEQ ID NO: 65732 - RNA, 24 nt, Mus musculus
cccaacaggaggcagccuucuucc

SEQ ID NO: 65733 - RNA, 45 nt, Mus musculus
cauggacuaaccauucuaggugaacauguuaauuagggcugagug

SEQ ID NO: 65734 - RNA, 46 nt, Mus musculus
acugaugcucucagcagggaaccaaccggaacugaaagcgcuagaa

SEQ ID NO: 65735 - RNA, 45 nt, Mus musculus
augguagcuuuagcgucucguggucaacuggaacugggaaugaaa

SEQ ID NO: 65736 - RNA, 41 nt, Mus musculus
ggaugcagugccuuggaaugcgagcagccuggggggaggug

SEQ ID NO: 65737 - RNA, 35 nt, Mus musculus
cuguucucucuuucucuuuuauccccgccccagca

SEQ ID NO: 65738 - RNA, 44 nt, Mus musculus
guucuuuuucuuucuuucuuucuuucuccccccuccccccuugu

SEQ ID NO: 65739 - RNA, 42 nt, Mus musculus
gguggcucacaacugccuguaacuccaguuccagggggaucu

SEQ ID NO: 65740 - RNA, 45 nt, Mus musculus
uaaccuguugccuuaaggaagaccuucccuucccugacucugcag

SEQ ID NO: 65741 - RNA, 45 nt, Mus musculus
ccgucacugcccaaccagagcugugcacuggaauaaagcaucaag

SEQ ID NO: 65742 - RNA, 45 nt, Mus musculus
cauagggauuucuaguccuccauacuuaucuaaaauagucccaga

SEQ ID NO: 65743 - RNA, 25 nt, Mus musculus
cugggcugggucggugggcuggggc

SEQ ID NO: 65744 - RNA, 45 nt, Mus musculus
cccuuggugcuaaagcauccauccccucccccacccccugcagag

SEQ ID NO: 65745 - RNA, 69 nt, Mus musculus
aaauuaccuucaaacagauuuuguguucuuuggcccuucaaauacugguguuacauuguugcugcagau

SEQ ID NO: 65746 - RNA, 46 nt, Mus musculus
cuaaaggguugugccaaacauuuuauuaagaaaguaaagcccagau

SEQ ID NO: 65747 - RNA, 46 nt, Mus musculus
uuccuggaauauugugcugcacagguagaccugaaucugcccagcu

SEQ ID NO: 65748 - RNA, 46 nt, Mus musculus
cugacuacaggauagacccagcugucuggcacucaaacggucucug

SEQ ID NO: 65749 - RNA, 44 nt, Mus musculus
caaagcaaguuugguugaaaauaucaacacaaaauacuaguagu

SEQ ID NO: 65750 - RNA, 42 nt, Mus musculus
gagaugguuaagggugcuuguugcacuuucagggggucagag

SEQ ID NO: 65751 - RNA, 46 nt, Mus musculus
uugcacaaguagcaaaaauucgauuucaacagaaagugauggagaa

SEQ ID NO: 65752 - RNA, 42 nt, Mus musculus
acugcucuacuauggcuugugcugguuuguuuacaugugcuu

SEQ ID NO: 65753 - RNA, 48 nt, Mus musculus
cucauagcugcacagaaacaaaaggugguggagaaagaagcugagacg

SEQ ID NO: 65754 - RNA, 42 nt, Mus musculus
cugugcguguuacaaaacccaaaaucccagaagccauaagaa

SEQ ID NO: 65755 - RNA, 45 nt, Mus musculus
aguuguagauuugcuagugggauccuuguguaaguuaguggagaa

SEQ ID NO: 65756 - RNA, 45 nt, Mus musculus
uaccuaaguugguguuuaauuuauaaaauauaguuacggguuuac

SEQ ID NO: 65757 - RNA, 46 nt, Mus musculus
ucuccugagccuuagguguaggaauuacuuuguaaaugucucaguc

SEQ ID NO: 65758 - RNA, 46 nt, Mus musculus
cuaggaguuucugagucuuuaaaaucuuuuaaauuuaggcugagua

SEQ ID NO: 65759 - RNA, 46 nt, Mus musculus
ggucauguuaaaguucauaucacuuguacagacacagauaggagaa

SEQ ID NO: 65760 - RNA, 46 nt, Mus musculus
aguucaaggguagcuuugguucauccaggacugcgugggaagggag

SEQ ID NO: 65761 - RNA, 42 nt, Mus musculus
uauugcuuaagcaaacguugguauuuacucagaugggaagug

SEQ ID NO: 65762 - RNA, 62 nt, Mus musculus
caggcuaucauaucauguugccuuucauuacaacauucagaucugugcaggugagugacucc

SEQ ID NO: 65763 - RNA, 45 nt, Mus musculus
ggugggguugguggcgauccuccuguacgccuccauccacaagau

SEQ ID NO: 65764 - RNA, 42 nt, Mus musculus
gaucaaggccgcccucagucgggaccuaacgcuuggggaguc

SEQ ID NO: 65765 - RNA, 41 nt, Mus musculus
acaggcauagucagcaauaagguuggcaagccugccgggag

SEQ ID NO: 65766 - RNA, 42 nt, Mus musculus
gcaaagcaggcaggcuguaaaucucggcagcuacuagaagga

SEQ ID NO: 65767 - RNA, 46 nt, Mus musculus
cuccagacguacuccagcuugggcgggggccccuccucauccugau

SEQ ID NO: 65768 - RNA, 41 nt, Mus musculus
gagacagagaggagagagagagacagagaggagagagagga

SEQ ID NO: 65769 - RNA, 42 nt, Mus musculus
gagacagagagagagacagagacagagagagagagaggagag

SEQ ID NO: 65770 - RNA, 46 nt, Mus musculus
aauaacuuuagaacuuauagugaaccacagcaaucaaacuagggac

SEQ ID NO: 65771 - RNA, 45 nt, Mus musculus
ucuuucucucuuucucucucucucucucucucucucucccucccu

SEQ ID NO: 65772 - RNA, 42 nt, Mus musculus
caugaaacaggguuccuuucaagguaucugaugggggcagag

SEQ ID NO: 65773 - RNA, 67 nt, Mus musculus
cgcccuucucuuugacagccggguguuugcgcacaagcagccaacccacgugagagaagaagaagcc

SEQ ID NO: 65774 - RNA, 41 nt, Mus musculus
agagcaggagcuccauuguucuuacucauagagggaugagg

SEQ ID NO: 65775 - RNA, 44 nt, Mus musculus
guaggggcgauacccguagaggugggcggcacuguucaccagcc

SEQ ID NO: 65776 - RNA, 42 nt, Mus musculus
guggagcugcugcugcugcugcugcugguggugaugguggug

SEQ ID NO: 65777 - RNA, 41 nt, Mus musculus
uuuuauguauguauguauguauguauguauguagugugugu

SEQ ID NO: 65778 - RNA, 49 nt, Mus musculus
acguggugaaguugaugugccagcgguacucacuggcagaguagucgua

SEQ ID NO: 65779 - RNA, 45 nt, Mus musculus
guuuuuaaaaauuaguagcaaugugugugugugugugugugugug

SEQ ID NO: 65780 - RNA, 46 nt, Mus musculus
aauggggagagaaacucagcaggauagaauugcuaggaucccagua

SEQ ID NO: 65781 - RNA, 42 nt, Mus musculus
gugcuguugccaacgguggggagcgggcuuggaaggugagug

SEQ ID NO: 65782 - RNA, 45 nt, Mus musculus
gggagaaacggauauaccuguuucuccaaggaauuaggaaauaga

SEQ ID NO: 65783 - RNA, 42 nt, Mus musculus
aguuggcguccccaugaaagguugaagaauuuaucgcaagau

SEQ ID NO: 65784 - RNA, 42 nt, Mus musculus
cuccuggacaccgguggcugcaagcugcgauuuuggcguccu

SEQ ID NO: 65785 - RNA, 47 nt, Mus musculus
gauaaaaaaucaaaaacuggcuggccagggcagccgcgggcggagau

SEQ ID NO: 65786 - RNA, 54 nt, Mus musculus
uugaucaauauaacgaaccuaaggauauacaggacauuaauaccccacugccag

SEQ ID NO: 65787 - RNA, 47 nt, Mus musculus
acgugaccccagcauccgacgccaagaugccggcccacauacugcaa

SEQ ID NO: 65788 - RNA, 46 nt, Mus musculus
ccgggugauaaccggauuuuuacucaguacaguugauugucccaac

SEQ ID NO: 65789 - RNA, 41 nt, Mus musculus
cucuggcgcuuacucagccaccaccacaaucacagcgccac

SEQ ID NO: 65790 - RNA, 108 nt, Mus musculus
uugaaaagaguucucaccacuggggagcagauguucgcccugaacuaaaagaugaucuauaugaccccaccuaucaggaugaugaggggcccccgcccaagcuggagu

SEQ ID NO: 65791 - RNA, 61 nt, Mus musculus
acgucuggaggaacaucauucucauggcccugcugcauuugggagccuuguacgggaucac

SEQ ID NO: 65792 - RNA, 46 nt, Mus musculus
uucuuguuggaccagcuggacugggcaaagaaccucgugguguuaa

SEQ ID NO: 65793 - RNA, 46 nt, Mus musculus
gacgaaggcuccuguauauccaaguucaaagguguaugguaccacg

SEQ ID NO: 65794 - RNA, 46 nt, Mus musculus
caaaacucagaugaugggguagaggggugugugugugugugugugu

SEQ ID NO: 65795 - RNA, 46 nt, Mus musculus
ccagcuuugagcaucuaacauucugcaaggacaggaccauggccag

SEQ ID NO: 65796 - RNA, 45 nt, Mus musculus
cgcccugggcaucacagccggggcucaucgccuguggagccacag

SEQ ID NO: 65797 - RNA, 46 nt, Mus musculus
cuuguauguucuguggcuccacaggcgaugagccccggcugugaug

SEQ ID NO: 65798 - RNA, 75 nt, Mus musculus
uguaugaaugggcccgagaucaccgcgcccaccacaaguucucagaaacacacgccgacccucacaauucccgcc

SEQ ID NO: 65799 - RNA, 67 nt, Mus musculus
cgcccuucucuuugacagccggguguuugcgcacaagcagccaacccacgugagagaaaaagaagcc

SEQ ID NO: 65800 - RNA, 45 nt, Mus musculus
gcugucaaagagaagggcggaaaacuggacaugucugaccugaaa

SEQ ID NO: 65801 - RNA, 46 nt, Mus musculus
agagacauggaggguuccagguuccagggagaggccuugccggcag

SEQ ID NO: 65802 - RNA, 46 nt, Mus musculus
agcgugggcaggacgaagcacaucagcaggaggccgggcuuguagu

SEQ ID NO: 65803 - RNA, 46 nt, Mus musculus
cuggcuggugaacagugccgcccaccucuacggauaucgccccuac

SEQ ID NO: 65804 - RNA, 48 nt, Mus musculus
cuugucguaggggcgauauccguagaggugggcggcacuguucaccag

SEQ ID NO: 65805 - RNA, 45 nt, Mus musculus
cagaggaaugaugaugaugcgauuuuugauauuucccacugugag

SEQ ID NO: 65806 - RNA, 46 nt, Mus musculus
ucagauuggugcuuguauaucuugguacaacacucaauuuagccag

SEQ ID NO: 65807 - RNA, 46 nt, Mus musculus
cuuacccagugggcuccucagacuuaggggaaucagggcugcaggu

SEQ ID NO: 65808 - RNA, 70 nt, Mus musculus
ccacaacuaccaccacgccuuccccuacgacuacucugccagugaguaccgcuggcacaucaacuucacc

SEQ ID NO: 65809 - RNA, 86 nt, Mus musculus
uaagccaggcccaggagagccaugcaaucgaugaagaacguggugaaguugaugugccagcgguacucacuggcagaguagucgua

SEQ ID NO: 65810 - RNA, 51 nt, Mus musculus
ugcagcuuccgucuccaguucucuuaauccuggccaagacagcagcccugg

SEQ ID NO: 65811 - RNA, 32 nt, Mus musculus
caggauuaagagaacuggagacggaagcugca

SEQ ID NO: 65812 - RNA, 54 nt, Mus musculus
acgucagucaucauuuuagcaucuggguggcaauacucaguaguuaauuaacag

SEQ ID NO: 65813 - RNA, 45 nt, Mus musculus
ugacugacguuaacccauucugguacaguauuguaaaacggacaa

SEQ ID NO: 65814 - RNA, 45 nt, Mus musculus
gacaacgggaaaagaaacuagaagggaagaugagcuuagcauaga

SEQ ID NO: 65815 - RNA, 44 nt, Mus musculus
cugaugaccucguuucucauugcuucucccaagccagccgccgc

SEQ ID NO: 65816 - RNA, 44 nt, Mus musculus
acucuggaaggugaacacugaccuauagcugagcggcggcuggc

SEQ ID NO: 65817 - RNA, 45 nt, Mus musculus
aucuugagagauuucuccuguuauuuuuagcccaggcuuugccag

SEQ ID NO: 65818 - RNA, 47 nt, Mus musculus
uuauuuggcagggagccuauaaaagagguaaaucuuaaggggccaag

SEQ ID NO: 65819 - RNA, 50 nt, Mus musculus
uaaaauacaguaacacaucaguaucucaguguaguuuaggcugaagauuu

SEQ ID NO: 65820 - RNA, 68 nt, Mus musculus
ucuuuuccuuuaaugacaaggacccggggccaggugugguggcuugcaucuuaaauugcaggacugga

SEQ ID NO: 65821 - RNA, 46 nt, Mus musculus
caguccugcaauuuaagaugcaagccaccacaccuggccccggguc

SEQ ID NO: 65822 - RNA, 46 nt, Mus musculus
caguuagcaggacaugcagagcaagggacccucgagugaggcaugu

SEQ ID NO: 65823 - RNA, 46 nt, Mus musculus
uacaucuaacaguggaaggauuucaagaguugaacuugagucacag

SEQ ID NO: 65824 - RNA, 56 nt, Mus musculus
ggggacuucacggcuuugggguguucuaguggagcagguuagguuuuuuuuagccc

SEQ ID NO: 65825 - RNA, 88 nt, Mus musculus
aacccaccccaaaacacaaaaaauggguaggggaaaagaggcaggugugguagagcugagagauuucaaccauguaucccaggcagag

SEQ ID NO: 65826 - RNA, 46 nt, Mus musculus
gccugggauacaugguugaaaucucucagcucuaccacaccugccu

SEQ ID NO: 65827 - RNA, 40 nt, Mus musculus
cgucucuaccuacugcagauagagguuguaucucugagug

SEQ ID NO: 65828 - RNA, 42 nt, Mus musculus
cugacacucucuucagcucuaaagaaaaaguuuggccaacuu

SEQ ID NO: 65829 - RNA, 41 nt, Mus musculus
ugggaagcacagcacucgagguuguguucuuaagugccucu

SEQ ID NO: 65830 - RNA, 46 nt, Mus musculus
agagcugagaugccaugaauuucacagaaaggcucucgugcagcag

SEQ ID NO: 65831 - RNA, 46 nt, Mus musculus
agagaauucuugggcgaauccaagguauuugcugagcuguggcccu

SEQ ID NO: 65832 - RNA, 63 nt, Mus musculus
agaaacacugcuaucaagauuuuuaaagcucaaaccaagugacacuuuuaauaagagacuaag

SEQ ID NO: 65833 - RNA, 87 nt, Mus musculus
guuagcuggacauggaucugcaggauugccucuggggaccucguuuugggaacuuuucuuggggcuguuuugcucaagugcccguag

SEQ ID NO: 65834 - RNA, 50 nt, Mus musculus
uuucuuccugguuugcuaguguucuugagugucuucuuuaguugaaauag

SEQ ID NO: 65835 - RNA, 45 nt, Mus musculus
cacucugacgauaaugaguucacuccuuggauaaggauguuaaug

SEQ ID NO: 65836 - RNA, 46 nt, Mus musculus
auuuaaguuuccaacccaugacuuaugggacagauucaaaccguag

SEQ ID NO: 65837 - RNA, 42 nt, Mus musculus
guaggucaggaauauuaucccaguuucacagaauacugaguc

SEQ ID NO: 65838 - RNA, 45 nt, Mus musculus
gugccuaugucccagaugacguuguuaaucuacaucauucucaga

SEQ ID NO: 65839 - RNA, 46 nt, Mus musculus
aaauaacuacaguugcacauaauaaaggaaaaaucccacccaagga

SEQ ID NO: 65840 - RNA, 45 nt, Mus musculus
ucaaaucccagcaaccacgugguggcucacagccaucuguaauga

SEQ ID NO: 65841 - RNA, 46 nt, Mus musculus
ccacaugaugguauaguauagaagagaguuuauuuagggcaugggg

SEQ ID NO: 65842 - RNA, 46 nt, Mus musculus
ucuugcuaaaugugucaaacaaagacauguuuuguauugugugugu

SEQ ID NO: 65843 - RNA, 42 nt, Mus musculus
cuggaccucucccgggcaggcacuggcagagggccaggacug

SEQ ID NO: 65844 - RNA, 45 nt, Mus musculus
ggaaagagagaagguagaaaagagagagaagaaaggcuagagaau

SEQ ID NO: 65845 - RNA, 45 nt, Mus musculus
gggcuauacaaagaaacccugucucgaaaaaaaaaaaaaaaaaaa

SEQ ID NO: 65846 - RNA, 46 nt, Mus musculus
aauuccagcaaccacaaccaucuauaaugagaucugaugcccucuc

SEQ ID NO: 65847 - RNA, 48 nt, Mus musculus
auggugugguagggcaaaguggguaggucugagggucagucaacgggg

SEQ ID NO: 65848 - RNA, 42 nt, Mus musculus
gacaccaggucagcucuccuugcuguagcccauggcggggau

SEQ ID NO: 65849 - RNA, 46 nt, Mus musculus
aaaucugggaaugcaaacuuugaaaagguaucuaccacagcuuuag

SEQ ID NO: 65850 - RNA, 46 nt, Mus musculus
cuccagacguacuccagcuugggcgggggucccuccucauccuggu

SEQ ID NO: 65851 - RNA, 41 nt, Mus musculus
cuuucugagauacugauaacuagacggggaacagagccucg

SEQ ID NO: 65852 - RNA, 46 nt, Mus musculus
aaugucucuuuuugauuuugucccacuaggacaucaggagccuuug

SEQ ID NO: 65853 - RNA, 42 nt, Mus musculus
uucucaggugccucacagaauaccuagucacugggugcagag

SEQ ID NO: 65854 - RNA, 75 nt, Mus musculus; identical to SEQ ID NO: 65798

SEQ ID NO: 65855 - RNA, 67 nt, Mus musculus
ugcccuucucuuugacagccggauguuugcgcacaagcagccaacccacgugagagaagaagaagcc

SEQ ID NO: 65856 - RNA, 41 nt, Mus musculus
ucugucagugaguaccgcuggcacaucaacuucaccacguu

SEQ ID NO: 65857 - RNA, 46 nt, Mus musculus
aaaaacguggugaaguugaugugccagcgguacucacugacagagu

SEQ ID NO: 65858 - RNA, 41 nt, Mus musculus
ugggggagcagaggaaggaagauuuaggaaucucaggagca

SEQ ID NO: 65859 - RNA, 41 nt, Mus musculus
accccaaggcagguuagcuggaauucucagcagcugcccag

SEQ ID NO: 65860 - RNA, 46 nt, Mus musculus
aaagaauuauugcuuugugguuacaaugaaucuguagagaaagacg

SEQ ID NO: 65861 - RNA, 27 nt, Mus musculus
gcagguuaaugaccauggcgacgccca

SEQ ID NO: 65862 - RNA, 46 nt, Mus musculus
acagacacugucacccaacaauagucaaauuccuccaacccagucu

SEQ ID NO: 65863 - RNA, 46 nt, Mus musculus
gaauagagaacacaccuauuugauagagccgugguuaggauuugag

SEQ ID NO: 65864 - RNA, 42 nt, Mus musculus
aaggggaacagacaaagguugacuggaaagcuaugggggcag

SEQ ID NO: 65865 - RNA, 46 nt, Mus musculus
cucuacagagaauaugauaaguuucuggaauuuugguggcugcugg

SEQ ID NO: 65866 - RNA, 42 nt, Mus musculus
acggagaagacaaacagaggaaacaaugggagaaggaggcag

SEQ ID NO: 65867 - RNA, 42 nt, Mus musculus
ggggaggggcgacgggcggggcuggggccugagggucccacc

SEQ ID NO: 65868 - RNA, 41 nt, Mus musculus
gggagucgggaggcuucgcuggagaagcugagcaagggaag

SEQ ID NO: 65869 - RNA, 47 nt, Mus musculus
ggucaccacgugccuuucuguaucaaaugcaaauuccauggagagug

SEQ ID NO: 65870 - RNA, 46 nt, Mus musculus
uuccugcggaaguucagaccaacaagaccccgagggcagcccagga

SEQ ID NO: 65871 - RNA, 24 nt, Mus musculus
ccccccccccaacccuggagcucc

SEQ ID NO: 65872 - RNA, 46 nt, Mus musculus
uuguagccucggcugcgcaaugaaucugugaugcacuggguugggg

SEQ ID NO: 65873 - RNA, 46 nt, Mus musculus
ccuguccccccaccccguguauguguguguguguguguguguaugu

SEQ ID NO: 65874 - RNA, 24 nt, Mus musculus
uaagcugucuuacacaugcgcauc

SEQ ID NO: 65875 - RNA, 41 nt, Mus musculus
uccagaucuuaccuucagcacagcuucucuuucccgaacac

SEQ ID NO: 65876 - RNA, 42 nt, Mus musculus
acagagacaucaaaaaguuggaaggaaauggaauugggagga

SEQ ID NO: 65877 - RNA, 42 nt, Mus musculus
gagcaccggugggccugggcugcucacaugugucuuggagac

SEQ ID NO: 65878 - RNA, 47 nt, Mus musculus
ccugcagagcccuaccugagaagaagaggaagguugggcagauaacg

SEQ ID NO: 65879 - RNA, 126 nt, Mus musculus
uccucccagucuccugccaggggguuaccacacggggcuggggcuggaaagagauagcaagguggcaauugagagggugcccugaaucuaggauaggugagacaagggugccccaggaggaagagu

SEQ ID NO: 65880 - RNA, 55 nt, Mus musculus
gccuuacaugugaaugagaggaggagggaggcugacuccagggcugcggaggaag

SEQ ID NO: 65881 - RNA, 45 nt, Mus musculus
uuccaggguucaugguguuuaaggguaucaggcaguggggaguca

SEQ ID NO: 65882 - RNA, 45 nt, Mus musculus
agucccggcaaccacaugguggcucacaaccaucuguaagaagau

SEQ ID NO: 65883 - RNA, 42 nt, Mus musculus
cucugcccuccacuucaaagcuccacgcucccgcccccagcu

SEQ ID NO: 65884 - RNA, 45 nt, Mus musculus
ccuucagcagacgauucaggucugggaagcggcuccaacggacac

SEQ ID NO: 65885 - RNA, 45 nt, Mus musculus
aauagcauugaaggacugauugacccacugccagaacaccacagu

SEQ ID NO: 65886 - RNA, 41 nt, Mus musculus
uguccccucccuguaccccaccucacaggaauagccccagg

SEQ ID NO: 65887 - RNA, 45 nt, Mus musculus
aacacaggagggauggguuuugugacuugcucuuugaaaccagag

SEQ ID NO: 65888 - RNA, 42 nt, Mus musculus
gucucacccauaaccaggcuugcuguuaggugggcaggagac

SEQ ID NO: 65889 - RNA, 46 nt, Mus musculus
ugaagggaaugcuugcucugccuguguuguguggcuuucugauugg

SEQ ID NO: 65890 - RNA, 46 nt, Mus musculus
gcuuagcauauaugaagccuuggguucuuccagagacgggguagau

SEQ ID NO: 65891 - RNA, 46 nt, Mus musculus
gcacaugccuuuuaaucccagcacucacugccauaggcaagcagau

SEQ ID NO: 65892 - RNA, 33 nt, Mus musculus
gaaggaaauuaaaagucaacuguaauaggccga

SEQ ID NO: 65893 - RNA, 42 nt, Mus musculus
ggcggccggccccgccggccggcccggauuuauugcuucgaa

SEQ ID NO: 65894 - RNA, 42 nt, Mus musculus
cgggaggugcagaggaggucccagcuccccuuagcgguccga

SEQ ID NO: 65895 - RNA, 42 nt, Mus musculus
cucacggaccagcgggccagcagccaggacugcucagaggau

SEQ ID NO: 65896 - RNA, 46 nt, Mus musculus
guuggagaaacgcuuucuauaccagaaguaccuguccccggcagau

SEQ ID NO: 65897 - RNA, 42 nt, Mus musculus
ccuggguaggguggaguccggccauuggaaagggguggagaa

SEQ ID NO: 65898 - RNA, 42 nt, Mus musculus
cuggaggggccuggcagccggcgugggcagaggcagggggua

SEQ ID NO: 65899 - RNA, 42 nt, Mus musculus
ccgccgcggcggcuccuggcccgggguccuggcggcggcagu

SEQ ID NO: 65900 - RNA, 42 nt, Mus musculus
aguggggaaaaaguaauguuaagauuucuuccuugggaccug

SEQ ID NO: 65901 - RNA, 45 nt, Mus musculus
aacuggguacagaguaugaagcagguggaaggagccagcauguga

SEQ ID NO: 65902 - RNA, 43 nt, Mus musculus
aaggacuagaagcccagagucaugggcagccagaagccagcag

SEQ ID NO: 65903 - RNA, 46 nt, Mus musculus
guuaaggccugacuauaggauucugagaggagcuccuugcccuguc

SEQ ID NO: 65904 - RNA, 23 nt, Mus musculus
gucucgucugugugugugaugug

SEQ ID NO: 65905 - RNA, 46 nt, Mus musculus
cccucuuagcugugccucgcuuuguagguuacgcuugcccugagug

SEQ ID NO: 65906 - RNA, 46 nt, Mus musculus
caaggugucaagguggggccuggacaagugcugcccacccccacgg

SEQ ID NO: 65907 - RNA, 42 nt, Mus musculus
agcagaaauaccugggugugugccggcucccagggcccggga

SEQ ID NO: 65908 - RNA, 46 nt, Mus musculus
gugggaaagggcucugcaagaauccuaccucuccuggggccaaaga

SEQ ID NO: 65909 - RNA, 46 nt, Mus musculus
cugggcugcuguguguggcuuguggcucuuaccgacgggggaagau

SEQ ID NO: 65910 - RNA, 46 nt, Mus musculus
uccuggaccgcaugcccagggaggaggcugcggaaauugagcagac

SEQ ID NO: 65911 - RNA, 64 nt, Mus musculus
ugggaguuagugagcgugaagcccugacccauuuuagaccgaggaaugagggaccagcaugccc

SEQ ID NO: 65912 - RNA, 45 nt, Mus musculus
acaaggaugccagaguucacauuggucccccuccuguccccagaa

SEQ ID NO: 65913 - RNA, 23 nt, Mus musculus
cagaugugguaccaucaggucau

SEQ ID NO: 65914 - RNA, 42 nt, Mus musculus
ucuaucuucaaaagcacuugcaaagauucccaaaagggaggu

SEQ ID NO: 65915 - RNA, 46 nt, Mus musculus
aacugaaacccaggaagguuuuagaccaaacccagguuuugcagau

SEQ ID NO: 65916 - RNA, 100 nt, Mus musculus
uauuaaauagagguugggaucuuagaaaggcaaggauagccccaugccugccaucucugcacucaggaggucaaggcaggagacucaggaaggaaugaag

SEQ ID NO: 65917 - RNA, 95 nt, Mus musculus
gaggugaaaauaauuuucucuuuggauaaucacuaaauagaagaggugauauucuagccccuaaggaauuuuuaauaguuacuugguaaguggag

SEQ ID NO: 65918 - RNA, 41 nt, Mus musculus
ugcacagcauccggggccagauacagggaaaauaggcugua

SEQ ID NO: 65919 - RNA, 46 nt, Mus musculus
ggauggugcacuauuuguucccagacgggaaggaaauggcagaaga

SEQ ID NO: 65920 - RNA, 44 nt, Mus musculus
gcagugguucucgccucuagggcccauacuggugauguccccag

SEQ ID NO: 65921 - RNA, 46 nt, Mus musculus
cuuuggcagcagcgagcuuuaauccauuacauguuucucuuugcag

SEQ ID NO: 65922 - RNA, 50 nt, Mus musculus
augcccugggagccuugggccaguggcagcuugaagugggagagccagug

SEQ ID NO: 65923 - RNA, 46 nt, Mus musculus
aaaucuccccuacccgaaggauguguauagugugucuguggcccag

SEQ ID NO: 65924 - RNA, 41 nt, Mus musculus
aggguggugggcgccuguuuacugugugcggagaggagugg

SEQ ID NO: 65925 - RNA, 45 nt, Mus musculus
cucucuguggucugcugggugaaggcaguggguggucagguuuga

SEQ ID NO: 65926 - RNA, 59 nt, Mus musculus
cagaagccaaaggaggucauggcggcugagucagaguuacagaaggaguuaaagaaggu

SEQ ID NO: 65927 - RNA, 44 nt, Mus musculus
ccuugcaccuccagugaggaggaaacugugagacuuccggcgug

SEQ ID NO: 65928 - RNA, 44 nt, Mus musculus
caaaagggaaguuuaaacauccagcuaucuuggaaacagcacag

SEQ ID NO: 65929 - RNA, 41 nt, Mus musculus
ucaugaggcuccucccacuccaugacacauuuccuguccag

SEQ ID NO: 65930 - RNA, 45 nt, Mus musculus
cagagucugguuccagaaaaggccgugugcuaaagucagcgcgua

SEQ ID NO: 65931 - RNA, 46 nt, Mus musculus
gacgaugaguuguuggagacuguguguuggagcuggacucugaaga

SEQ ID NO: 65932 - RNA, 46 nt, Mus musculus
uccaccugagaagggaaggaguuaagacgaaaaggugccuuggggu

SEQ ID NO: 65933 - RNA, 24 nt, Mus musculus
gccuggcgcggcgggaggcgggua

SEQ ID NO: 65934 - RNA, 47 nt, Mus musculus
gaugugggaggagacaaaaacaaagggaaaaaaugggaacuauagcu

SEQ ID NO: 65935 - RNA, 46 nt, Mus musculus
agucuugggaguggaggguaguagagccugugauaugcaggcccug

SEQ ID NO: 65936 - RNA, 46 nt, Mus musculus
gugcauuuugauugcauguaugugugugcuagugugucuggugcag

SEQ ID NO: 65937 - RNA, 45 nt, Mus musculus
uugacuuuuaaugugaaaugagcaagaguuuacaaaaauggacaa

SEQ ID NO: 65938 - RNA, 46 nt, Mus musculus
uacauacuucuaggauauacucucugcuaagaagauauuuucuggg

SEQ ID NO: 65939 - RNA, 45 nt, Mus musculus
gaagacauacacacaaacacaauaaaaauaaaucuuaaaagggca

SEQ ID NO: 65940 - RNA, 46 nt, Mus musculus
uuauuuaucuuuauuuuaugugaauuggugucuuucuugccugcau

SEQ ID NO: 65941 - RNA, 46 nt, Mus musculus
auaucagcauggaccuguaaucucaggucuugagaggagucaagag

SEQ ID NO: 65942 - RNA, 46 nt, Mus musculus
ccagccuaagcuguaagaagagaccuaucucaaaugaaacaggcag

SEQ ID NO: 65943 - RNA, 46 nt, Mus musculus
cauauaugcauguaauauaugaauguauguauauaaaauaacugag

SEQ ID NO: 65944 - RNA, 24 nt, Mus musculus
cucagcucaccuggacagagauug

SEQ ID NO: 65945 - RNA, 46 nt, Mus musculus
ggcucaaguaauaacauaaaacuggauuguguguggacuaaggaag

SEQ ID NO: 65946 - RNA, 41 nt, Mus musculus
caggagucaggucuaguuuggguuuucccuuucaguagugu

SEQ ID NO: 65947 - RNA, 45 nt, Mus musculus
cacaauagaacacugguacaccccuauaauccuaaugccugggag

SEQ ID NO: 65948 - RNA, 44 nt, Mus musculus
agcgcuauuagaaggcaaggucucguuggagaaagugugguuuu

SEQ ID NO: 65949 - RNA, 46 nt, Mus musculus
auaaaauagguuguuuuuguuuuuaaaagaaaaugaggcguggcag

SEQ ID NO: 65950 - RNA, 45 nt, Mus musculus
cuucucccucuaacucaguuguucucaaccuuccuaaugcuguga

SEQ ID NO: 65951 - RNA, 45 nt, Mus musculus
aggccugcccuuuucugaagggaaaggagaaggaauggaugggag

SEQ ID NO: 65952 - RNA, 42 nt, Mus musculus
uuaaaacuuucauucucucuuccaaguccaaaguacuaagca

SEQ ID NO: 65953 - RNA, 28 nt, Mus musculus
acaucagaugcuauuacagaugauugug

SEQ ID NO: 65954 - RNA, 42 nt, Mus musculus
ggcagagguaggcagaucuaugaguuugaggccagccagcac

SEQ ID NO: 65955 - RNA, 24 nt, Mus musculus
gaauaggggaacugagaguauagu

SEQ ID NO: 65956 - RNA, 42 nt, Mus musculus
auaaaaucuggcuguaggguauuucuuaauuagugauugaug

SEQ ID NO: 65957 - RNA, 45 nt, Mus musculus
gcaugggcccagaccggaaggaaccugugucacugguugggcgga

SEQ ID NO: 65958 - RNA, 44 nt, Mus musculus
guugacaaagugggaagagguguuuuucaugcuuucuguuccca

SEQ ID NO: 65959 - RNA, 42 nt, Mus musculus
auaccucugugcaucuguauuaaugcuggaugauuggggcac

SEQ ID NO: 65960 - RNA, 46 nt, Mus musculus
cuuucugucugucucugucucugucucugucucuguguguguguga

SEQ ID NO: 65961 - RNA, 46 nt, Mus musculus
aaacuauuggucaaguaaagaugccuacagccugaaucugggcaga

SEQ ID NO: 65962 - RNA, 45 nt, Mus musculus
accaucuguaaugggagccaaugccuucuucuggugucugaagac

SEQ ID NO: 65963 - RNA, 42 nt, Mus musculus
uguauguaugagugcaggcacagagucggcagagggcaucag

SEQ ID NO: 65964 - RNA, 46 nt, Mus musculus
auggaugguugugagccacuaugugguugcuggaauuugaacucag

SEQ ID NO: 65965 - RNA, 45 nt, Mus musculus
uaguuucucuuggauaaacagguaagaguagaaucaucgccucau

SEQ ID NO: 65966 - RNA, 39 nt, Mus musculus
uuuuaaauacagggucccuuguaacuacagcuggcuuca

SEQ ID NO: 65967 - RNA, 45 nt, Mus musculus
aaaguggcaacguaaggcacaaacaguccaguaaacaaagagugc

SEQ ID NO: 65968 - RNA, 42 nt, Mus musculus
gaggaggaagaggaagggaggggaggagaaagggaggaagag

SEQ ID NO: 65969 - RNA, 45 nt, Mus musculus
aagaaggacucccucauuuggagcccaggaaaccuuucuguccua

SEQ ID NO: 65970 - RNA, 46 nt, Mus musculus
caggucagugagagaccuguuuaaggcaauaaaacagagcaauaag

SEQ ID NO: 65971 - RNA, 46 nt, Mus musculus
acugcauuugcugacaguggcucuugagucagcgccuguggcccag

SEQ ID NO: 65972 - RNA, 46 nt, Mus musculus
gugcuucuuacucuucgagagcaugcgggaacaccucaaguuccag

SEQ ID NO: 65973 - RNA, 42 nt, Mus musculus
uacacuggguuuccauaucaccaccaccaccaccacccccca

SEQ ID NO: 65974 - RNA, 45 nt, Mus musculus
gagucucauugucaggccaaaguccucaacacccucaaccagcaa

SEQ ID NO: 65975 - RNA, 81 nt, Mus musculus
cucgguuagacaaaaaaaugauuggagaguuugugagugaccgcaaaaacauggaccuguuggagaguuuugugaggugag

SEQ ID NO: 65976 - RNA, 42 nt, Mus musculus
ccaacccccacccccuggguuccaauggaaagcaucacagag

SEQ ID NO: 65977 - RNA, 45 nt, Mus musculus
cuaaaaggugugaauggaggcaaggacuuugagcaagacauccug

SEQ ID NO: 65978 - RNA, 63 nt, Mus musculus
agcgauguguuugacaaucucaucaucucucugugcaaauucacagcucuaaguagugaggug

SEQ ID NO: 65979 - RNA, 47 nt, Mus musculus
aaccuucccaguguauuuggaagcaacccuaaagcccacauagcagc

SEQ ID NO: 65980 - RNA, 46 nt, Mus musculus
cuggaagaauaucauggaggccauguugcagcuuuuccgagcccaa

SEQ ID NO: 65981 - RNA, 43 nt, Mus musculus
guagggcugcuacgccuagccauccggcuacuccggagagaag

SEQ ID NO: 65982 - RNA, 45 nt, Mus musculus
uccaggcuguacaagguagcacacaccuuuaaucccagcagucag

SEQ ID NO: 65983 - RNA, 45 nt, Mus musculus
uuuugguggacauagagagcuuauucuaaaauaggguggaagaug

SEQ ID NO: 65984 - RNA, 42 nt, Mus musculus
agccacuuaugcaacagacccaauguauaaagacauggguag

SEQ ID NO: 65985 - RNA, 46 nt, Mus musculus
uacacagaccauggcaggccuggcaagauacaccgaucggccacag

SEQ ID NO: 65986 - RNA, 45 nt, Mus musculus
gaccccaugccugcggaaccgcacagucaaaaaccucuggccucu

SEQ ID NO: 65987 - RNA, 84 nt, Mus musculus
cccagcagcagcucccccggaucgcccauggccucuagccccagcaaacugaguccugcccaagagggaccucccccacugacc

SEQ ID NO: 65988 - RNA, 43 nt, Mus musculus
auugaggccaccuccccagugccucuccuagccacaccccgcc

SEQ ID NO: 65989 - RNA, 46 nt, Mus musculus
gccuggauggcauccccgaauaugaugauuuugaauucagccccuc

SEQ ID NO: 65990 - RNA, 62 nt, Mus musculus
cuuggagaacagagccaggaugagccugaccaugggggguggagcguggggguggaggugcc

SEQ ID NO: 65991 - RNA, 42 nt, Mus musculus
gcuuuccuucgagcuagcgauggcuccuucuccuugccccug

SEQ ID NO: 65992 - RNA, 39 nt, Mus musculus
gccauuguguuccggacaccgcccuaucacaagaugaag

SEQ ID NO: 65993 - RNA, 41 nt, Mus musculus
aaggaggaagugcagaggaagcggagaaaggccuugcccac

SEQ ID NO: 65994 - RNA, 45 nt, Mus musculus
ggguuauggaggcgcuggaggaggugaggaggugcaaguggcagg

SEQ ID NO: 65995 - RNA, 41 nt, Mus musculus
ggaucuguuaguugacuguggagcugaaguggaggccccag

SEQ ID NO: 65996 - RNA, 42 nt, Mus musculus
gacagugccuaugggagccagucaguggagcaggaggcagag

SEQ ID NO: 65997 - RNA, 42 nt, Mus musculus
ggucaaauaaaggggaagaccccuccccaacuuacgguacag

SEQ ID NO: 65998 - RNA, 46 nt, Mus musculus
ucccccuauuccuccccaagggcucaccucucucuuugcagagaca

SEQ ID NO: 65999 - RNA, 60 nt, Mus musculus
gggaaacaagguugugacugaaguuaguguggaagaggaggucacaggcgugucuggggu

SEQ ID NO: 66000 - RNA, 46 nt, Mus musculus
guucugugauaggguucaggaccuucagaggaaggaaggugugguu

SEQ ID NO: 66001 - RNA, 42 nt, Mus musculus
cagagcgagcgagcgagcgagcguucgaggagggcaugggug

SEQ ID NO: 66002 - RNA, 47 nt, Mus musculus
cuugagguguuugugcuuuggguguagucuggguauuugugugugau

SEQ ID NO: 66003 - RNA, 44 nt, Mus musculus
ggaaaugggcuggaggagagacagaaugguuucauggaguucgg

SEQ ID NO: 66004 - RNA, 46 nt, Mus musculus
ucugucucuggggugacagguggcuuugugaguagagcagcugggg

SEQ ID NO: 66005 - RNA, 41 nt, Mus musculus
uucaaugagauccugccaaagccugauucugaggagcugau

SEQ ID NO: 66006 - RNA, 48 nt, Mus musculus
uuuacugcccccagcaaggaccagggguggggaagacagauggugagg

SEQ ID NO: 66007 - RNA, 41 nt, Mus musculus
ucuuuggcucagggggacaccugguccuccccccgggaagu

SEQ ID NO: 66008 - RNA, 46 nt, Mus musculus
agcaugugcuuuuccaucauacacauauuuguuaugacugugauug

SEQ ID NO: 66009 - RNA, 44 nt, Mus musculus
cucuuugugugcuauuauuuggugaugugugugugugugugugu

SEQ ID NO: 66010 - RNA, 25 nt, Mus musculus
guguggggaggagagaauguguguc

SEQ ID NO: 66011 - RNA, 41 nt, Mus musculus
caucuggacccuacgugugguucagaugauggacgagagag

SEQ ID NO: 66012 - RNA, 45 nt, Mus musculus
ggagcaguccggaggggagcaagaaccaggagcugucagguaccg

SEQ ID NO: 66013 - RNA, 45 nt, Mus musculus
uguaggagcuagacuaauaggcaaccgcagagcuacagaccccag

SEQ ID NO: 66014 - RNA, 46 nt, Mus musculus
gguugugagccaccaugugguugcugggaacugaacuugggaccuc

SEQ ID NO: 66015 - RNA, 60 nt, Mus musculus
gacaggagauagcuucaggguuaauguacaagccccagccacauccaggggcccugagac

SEQ ID NO: 66016 - RNA, 57 nt, Mus musculus
uacacucguguccaccugggaaccagguagggauuaggaccacacugggcauuugag

SEQ ID NO: 66017 - RNA, 46 nt, Mus musculus
cgaucuaggcugggcuggccccaccccaccccuccccacccgagug

SEQ ID NO: 66018 - RNA, 46 nt, Mus musculus
ggugacggccugaggccugggguugacuacuaacugaccccuuaca

SEQ ID NO: 66019 - RNA, 92 nt, Mus musculus
ccugugugugugaaugaguguguggguauguaugagugugugcgacuaucgagugccguguggcccagagauccugggcccagagaggacau

SEQ ID NO: 66020 - RNA, 45 nt, Mus musculus
gcuucccuggacaccuuuaagaagaugugggucucuaagaaagaa

SEQ ID NO: 66021 - RNA, 45 nt, Mus musculus
ggcuacugagugaagugaagaaacuagcuccaaaagacgugaaga

SEQ ID NO: 66022 - RNA, 45 nt, Mus musculus
agcuugcuaccuguccauaaacccccagaaggaugagacacugga

SEQ ID NO: 66023 - RNA, 41 nt, Mus musculus
gcaggagcccuggaaggugacaucuucauuggccccaaagc

SEQ ID NO: 66024 - RNA, 46 nt, Mus musculus
uuuaaucccagcacuugggaggcagaggcagccagaucucugaguu

SEQ ID NO: 66025 - RNA, 45 nt, Mus musculus
acacagagaaacccuguccaaaaaaaaagagagagagacuggagg

SEQ ID NO: 66026 - RNA, 46 nt, Mus musculus
cagguagggggaggacaugggaaccagaugugguaguaguuuagaa

SEQ ID NO: 66027 - RNA, 46 nt, Mus musculus
uaaaaagcagacaacuuggaaaaucaauucuuaaaaauauucagau

SEQ ID NO: 66028 - RNA, 41 nt, Mus musculus
uacagcuggggacccaccgagcccggagcuccgguccccgc

SEQ ID NO: 66029 - RNA, 45 nt, Mus musculus
uccaauucuccgccauggcggcugcgggcagggggcccggguaga

SEQ ID NO: 66030 - RNA, 24 nt, Mus musculus
ucggcggcuucuccacgugcaggg

SEQ ID NO: 66031 - RNA, 46 nt, Mus musculus
gguuuuuaauugcuaaacagugacucauuuagauugguccccuccu

SEQ ID NO: 66032 - RNA, 46 nt, Mus musculus
ugugcguguguuccauaagcacacacaacagacacacaccacggag

SEQ ID NO: 66033 - RNA, 46 nt, Mus musculus
aucucugaaguuguagagcuaacgagugauacaucccagguaaugg

SEQ ID NO: 66034 - RNA, 41 nt, Mus musculus
ggagagguccgacaaccuggcuacagucauccggccaaugg

SEQ ID NO: 66035 - RNA, 41 nt, Mus musculus
cagggaaggcugucgagugcuugcgcuuuucggccccagag

SEQ ID NO: 66036 - RNA, 46 nt, Mus musculus
aggagagaggaggguggaaagggccggucucugaaugcauaauucc

SEQ ID NO: 66037 - RNA, 46 nt, Mus musculus
ugucaucaaaucauuccauucauagaaucggauggaggauggagaa

SEQ ID NO: 66038 - RNA, 42 nt, Mus musculus
uuacaaugggcugagcugggaggagggcagagacugguuagg

SEQ ID NO: 66039 - RNA, 45 nt, Mus musculus
augcuuggucacagggaguggcgcuauuaggagguguggccuugu

SEQ ID NO: 66040 - RNA, 46 nt, Mus musculus
cagaaugaucuucuggcagcuucuggcggcuucuacagacccagga

SEQ ID NO: 66041 - RNA, 49 nt, Mus musculus
gugucuguggugugugugugugugugugucuguggugugugugugugug

SEQ ID NO: 66042 - RNA, 46 nt, Mus musculus
ugugugcgugugugugugacagugugugagugugugugugugugug

SEQ ID NO: 66043 - RNA, 90 nt, Mus musculus
acaggagaaggagaaagaggagaagggggagggaggaggaagagaaggaagcagaggaagaggaggaggaagagaaaaggaggaagagaa

SEQ ID NO: 66044 - RNA, 50 nt, Mus musculus
cacaaaagaaaggagaaaagagagaggagaaaagaggaggaagaagagga

SEQ ID NO: 66045 - RNA, 45 nt, Mus musculus
agagcgagcgcgagagggagagagagagagagagagagagagaga

SEQ ID NO: 66046 - RNA, 46 nt, Mus musculus
guucacaaaaaaggaagaguauuguguuuauggaauacaaaguaag

SEQ ID NO: 66047 - RNA, 42 nt, Mus musculus
gcccugcaauacugcccugaggcgcgaggccucggguccuug

SEQ ID NO: 66048 - RNA, 42 nt, Mus musculus
ggcggggagaugagggccacuguccuccucugcaugccaagu

SEQ ID NO: 66049 - RNA, 42 nt, Mus musculus
ggcggcugcacagcggccggcgagaacgaggagaccgugauc

SEQ ID NO: 66050 - RNA, 42 nt, Mus musculus
gugagcgagcggacccgggucaagcugcggguguacgggcag

SEQ ID NO: 66051 - RNA, 42 nt, Mus musculus
ugccgcaguuuugcacgaugcgcagcuccaucggguccagag

SEQ ID NO: 66052 - RNA, 46 nt, Mus musculus
uuggggcacgauuucuccgaagaugacgaugccaaugguggagacc

SEQ ID NO: 66053 - RNA, 46 nt, Mus musculus
accggauaagaagcggggaaugucaucaucaugaaaaacuugguga

SEQ ID NO: 66054 - RNA, 45 nt, Mus musculus
ggaagagcugaacaucauccaaggggcgcuggagcuccgcaccaa

SEQ ID NO: 66055 - RNA, 42 nt, Mus musculus
cuggaggaggccaucuuugucaggccuugugaagggcagcaa

SEQ ID NO: 66056 - RNA, 41 nt, Mus musculus
agcugugagcugccaugugggugcugggaauugaaccagau

SEQ ID NO: 66057 - RNA, 42 nt, Mus musculus
auugggcagcuggaaagugaccugaggaacacaaaaagcgag

SEQ ID NO: 66058 - RNA, 41 nt, Mus musculus
aggaggaagaagaggaggaggaagaggccucuaaggaaguc

SEQ ID NO: 66059 - RNA, 46 nt, Mus musculus
agagacacugggggaagcgguaauaucuacgaagaaaacuggaaag

SEQ ID NO: 66060 - RNA, 68 nt, Mus musculus
agcugaaacggaaaccuauguuuauccacuggaccccgccaggccccagccauagaaccuuacuguag

SEQ ID NO: 66061 - RNA, 68 nt, Mus musculus
augccuaaaagcauacaaucacugcagaggacaagcuagugcuccagacaccgcuccccagcccccuc

SEQ ID NO: 66062 - RNA, 53 nt, Mus musculus
auuagcugcaugcuggccaucccugugauuuguguaacucaccccugcccauu

SEQ ID NO: 66063 - RNA, 50 nt, Mus musculus
ucuguagcuuuaaaaaaaaaaaaaagaaaaagauuaaugauaacggcagu

SEQ ID NO: 66064 - RNA, 47 nt, Mus musculus
auaauuacccugcgcugugcuuuagcgcugaccuuagaccucguagu

SEQ ID NO: 66065 - RNA, 86 nt, Mus musculus
uuaggauagguccucaagaggccuugcuuuuuuaaguaugcuauguauaggacauuuuaucaccagacacaaugcuaccacccaaa

SEQ ID NO: 66066 - RNA, 33 nt, Mus musculus
gcucuggaacugucuguccuguccccgcccacu

SEQ ID NO: 66067 - RNA, 43 nt, Mus musculus
auagccagggauauacagagaaacccugcauugaagagggggg

SEQ ID NO: 66068 - RNA, 42 nt, Mus musculus
augguagcucacaccugugaucccaguauuccaggggcugag

SEQ ID NO: 66069 - RNA, 45 nt, Mus musculus
caagccuaucuccaaagaguaaaaaggaaaagagaggaggagagg

SEQ ID NO: 66070 - RNA, 46 nt, Mus musculus
aaaaccaaucagggcaugguggcacaugccuuuaaucccagcacua

SEQ ID NO: 66071 - RNA, 46 nt, Mus musculus
gccuauauuccaacuuacacaagucagcugugacaucugagcccaa

SEQ ID NO: 66072 - RNA, 41 nt, Mus musculus
ucgaagcggccucucaagcggcccaggcugcgcucgggcuc

SEQ ID NO: 66073 - RNA, 46 nt, Mus musculus
uuaggcuucuauuuuggggugaaggcgccaucuuugcaggcaagau

SEQ ID NO: 66074 - RNA, 46 nt, Mus musculus
cuguuagcaagucugcccaggaugcgggcucgcuuugucuggccca

SEQ ID NO: 66075 - RNA, 46 nt, Mus musculus
cguggcggguaggacugggucaggcgaucauggcagccggcggugu

SEQ ID NO: 66076 - RNA, 45 nt, Mus musculus
ugaccucauagggcuggcugcuauagaccacugggguggagguua

SEQ ID NO: 66077 - RNA, 45 nt, Mus musculus
auuagaauuuaagaaaccuuuuucuuucgugaaggaaggggcugg

SEQ ID NO: 66078 - RNA, 46 nt, Mus musculus
caaguucugcaggguuaccagaggcaguagagagagggacuugcua

SEQ ID NO: 66079 - RNA, 46 nt, Mus musculus
uuuauuuuaaacucugugugugugugugugugugugugugugugug

SEQ ID NO: 66080 - RNA, 48 nt, Mus musculus
uggaaaguugucaacaugugggucagggaccagaauggagacgcuugu

SEQ ID NO: 66081 - RNA, 46 nt, Mus musculus
gaagcuuccagagaugucuuuuagguaggugugggaaggcugagag

SEQ ID NO: 66082 - RNA, 46 nt, Mus musculus
cuccaaugccuuagagugcccccccgcaccccccccaccccccggu

SEQ ID NO: 66083 - RNA, 46 nt, Mus musculus
gguuuguuucugaaggacaggcaggcuggcagaugaggagugagac

SEQ ID NO: 66084 - RNA, 46 nt, Mus musculus
guaggccugcugcucugacccaucuugugugaauuucuauacagau

SEQ ID NO: 66085 - RNA, 45 nt, Mus musculus
agaacauccacucccguucuccuguuuugcagucagcugcucaua

SEQ ID NO: 66086 - RNA, 46 nt, Mus musculus
gagaguauuuuacuggcauuuauacccuucgcuuccccugcaaggc

SEQ ID NO: 66087 - RNA, 65 nt, Mus musculus
ggaagggccuggggcucugacccaccuagaggaaaaccagaucgaacuaaaaggaaaaaaagugg

SEQ ID NO: 66088 - RNA, 45 nt, Mus musculus
aguggcugucaggugagaggaccuucgacguagccgucugccagg

SEQ ID NO: 66089 - RNA, 49 nt, Mus musculus
auuauuucuucauuaaugcacuuuaagguggaauggaaagcaaccugga

SEQ ID NO: 66090 - RNA, 45 nt, Mus musculus
cccgcaguguccuuccaggacuccccucaugccaggaguggaugc

SEQ ID NO: 66091 - RNA, 42 nt, Mus musculus
gugcacaucuucagucgcagugcaccugugaugaggcaggag

SEQ ID NO: 66092 - RNA, 41 nt, Mus musculus
acagacagggaugccccgggggucacaacagugagggguga

SEQ ID NO: 66093 - RNA, 46 nt, Mus musculus
cuguguguaugugugcuguguuaaguacguggucuguguaugcugu

SEQ ID NO: 66094 - RNA, 42 nt, Mus musculus
gacaauagucuagagucacagaacagcuccagccauccccug

SEQ ID NO: 66095 - RNA, 45 nt, Mus musculus
ugaauuauaauuugagacuuuuagaaaucacaugggcagcauugg

SEQ ID NO: 66096 - RNA, 46 nt, Mus musculus
ggcaaaugucccagccuggugcagacugagguggggugggguggau

SEQ ID NO: 66097 - RNA, 47 nt, Mus musculus
uaaagugugacagacauuucugauaucuucguuuuuaggcccagaau

SEQ ID NO: 66098 - RNA, 25 nt, Mus musculus
uuuuuucagaauuuauuuauugaau

SEQ ID NO: 66099 - RNA, 46 nt, Mus musculus
uguagauauuuagcucuuuuaaaauaaaugacuucaucuuugaaag

SEQ ID NO: 66100 - RNA, 46 nt, Mus musculus
uuagaggcauugaauuacuuacaugacaauaaaaucauccaccgag

SEQ ID NO: 66101 - RNA, 46 nt, Mus musculus
aagggaaauuuagcaaucuuuuggaaagaugcgagaaagaagaugg

SEQ ID NO: 66102 - RNA, 76 nt, Mus musculus
gugaugguggauucucacuggucugaggagcggcaggugaagucgguggugaugguggauucucacugggcugagg

SEQ ID NO: 66103 - RNA, 114 nt, Mus musculus
cggcaggugaagucgguggugaugguggauucucccugggcugaggagcggcaggugaagucgguggugaugguggauucucccuggucugaggaacggcaggugaagucggug

SEQ ID NO: 66104 - RNA, 45 nt, Mus musculus
auauuaauauucaauacaugugaugguacacaccuauaauccuau

SEQ ID NO: 66105 - RNA, 45 nt, Mus musculus
accuccaucuccccuacaggggcgagcaggugggugggaggugag

SEQ ID NO: 66106 - RNA, 45 nt, Mus musculus
aggaaacaaacacuggguuauugcuuaugguuuacagaagaucug

SEQ ID NO: 66107 - RNA, 42 nt, Mus musculus
aacccucucuaaugaauggcacaugcacuccauaggcugaag

SEQ ID NO: 66108 - RNA, 45 nt, Mus musculus
caacgccucuucucaugaaauccuguaaguacacacaggauuuac

SEQ ID NO: 66109 - RNA, 46 nt, Mus musculus
aaauccuucuucaguuucaauagaucuucauuuucuccauuuccag

SEQ ID NO: 66110 - RNA, 42 nt, Mus musculus
uggguggggcuggggucgggacggcgggcaggggucggggag

SEQ ID NO: 66111 - RNA, 42 nt, Mus musculus
uccgccagcgagggggaggggagagaagccggccucgggcag

SEQ ID NO: 66112 - RNA, 45 nt, Mus musculus
cacggugaggagguggacagaagaauguauagaaaggcacauugg

SEQ ID NO: 66113 - RNA, 46 nt, Mus musculus
aacauggcaacauccauagacacaguuguggaucaaacauggagag

SEQ ID NO: 66114 - RNA, 44 nt, Mus musculus
acuaagguguguuugggaauuucagguaucagggugagggugga

SEQ ID NO: 66115 - RNA, 45 nt, Mus musculus
gaaaauauugucuaauugcucccugggggggaaaaaggccuagua

SEQ ID NO: 66116 - RNA, 45 nt, Mus musculus
uagggaauggagggugacagugagagagaagagagggauccacuc

SEQ ID NO: 66117 - RNA, 46 nt, Mus musculus
ccuggcauugucgugcaggagagaggagaguuccuaaggccaucag

SEQ ID NO: 66118 - RNA, 45 nt, Mus musculus
gcaaggugcaggccagccaagacuauauaauaagacccuggagag

SEQ ID NO: 66119 - RNA, 47 nt, Mus musculus
aggggccaccguaucccggcuaccccuucaucaugauccccgaccug

SEQ ID NO: 66120 - RNA, 46 nt, Mus musculus
gcagagaaggcugaggcagccccaaagggaauuuuuacagccccag

SEQ ID NO: 66121 - RNA, 46 nt, Mus musculus
ucuuuugggaauacauccggguuccagagaugggguggguguggug

SEQ ID NO: 66122 - RNA, 42 nt, Mus musculus
cgaaucuggcgcucugaacguccaggcuucgcggcggcccgg

SEQ ID NO: 66123 - RNA, 46 nt, Mus musculus
aaucaggcuuugucuuugacauagccugauguucugccgcagccag

SEQ ID NO: 66124 - RNA, 45 nt, Mus musculus
gucuuugaaaaguguaacacuuucuaagaagaaaggguccaggaa

SEQ ID NO: 66125 - RNA, 45 nt, Mus musculus
cagagagugugaggaguuggcagucuccucaggugguuggcugug

SEQ ID NO: 66126 - RNA, 41 nt, Mus musculus
ugcaaaauuuugcaauugcacaaaauuucucaagugggaaa

SEQ ID NO: 66127 - RNA, 46 nt, Mus musculus
uuaagugaguuaucuagaauagucaaaaaucauagagauagggggg

SEQ ID NO: 66128 - RNA, 46 nt, Mus musculus
uggcuuugugucugggauuuucagguuugcaagcugaggaggucag

SEQ ID NO: 66129 - RNA, 46 nt, Mus musculus
uugcaucagaguucucuuuuaaaggcugaauauuuuguuacugucg

SEQ ID NO: 66130 - RNA, 27 nt, Mus musculus
gacacaccuucuccagcaaggccccac

SEQ ID NO: 66131 - RNA, 46 nt, Mus musculus
aaaauagguguauauucuaagacucagagcuaaaaaaugagaagag

SEQ ID NO: 66132 - RNA, 46 nt, Mus musculus
gaaaaagaaaaagaaaaggagaggcuggccaugaccccauggagag

SEQ ID NO: 66133 - RNA, 45 nt, Mus musculus
uguauaauaaugcaguucuauaacaaagcacgagagaaagugcag

SEQ ID NO: 66134 - RNA, 46 nt, Mus musculus
uagagccauguucacuuacauuucuacaagcacacacacagagaga

SEQ ID NO: 66135 - RNA, 46 nt, Mus musculus
gaaacaccaaauccucaagagacugaaggccucagggaguuuagag

SEQ ID NO: 66136 - RNA, 46 nt, Mus musculus
uccucuucagagcaaacaaaacccagaagcuucacgucaaaaggag

SEQ ID NO: 66137 - RNA, 46 nt, Mus musculus
auuacaguauaaguccugucauuacccaauauagauagaaacagag

SEQ ID NO: 66138 - RNA, 45 nt, Mus musculus
ccucccaagugcuggaauuaaaggcaugcgccaccauugcccagc

SEQ ID NO: 66139 - RNA, 42 nt, Mus musculus
gaaaaguaaaacaggcauaucaucacuccagcaggugggcac

SEQ ID NO: 66140 - RNA, 46 nt, Mus musculus
uaaaguacuaaguagccccagaaaucuuauuuaacauuagggacaa

SEQ ID NO: 66141 - RNA, 46 nt, Mus musculus
cuguucaacucuuuacugaaccaaucagaaggugucuuagguagga

SEQ ID NO: 66142 - RNA, 46 nt, Mus musculus
cuuuugaucuccuuuuaaagugauaaagcagagacugaguccccag

SEQ ID NO: 66143 - RNA, 46 nt, Mus musculus
agggcugccuaagucuccuugucagaaggcucgucgauauuuauag

SEQ ID NO: 66144 - RNA, 42 nt, Mus musculus
ggcauaaauuuaaaaaucaaggugucaacuucucuguguuac

SEQ ID NO: 66145 - RNA, 41 nt, Mus musculus
caaugcgaagcuucagcauccacuugggguugcaugggacg

SEQ ID NO: 66146 - RNA, 45 nt, Mus musculus
acuggcagucuggccugggcagcccucucuuuucuauaacuccag

SEQ ID NO: 66147 - RNA, 46 nt, Mus musculus
uuguuuugucugucucugguauugcuuggcacauggagaaagggag

SEQ ID NO: 66148 - RNA, 42 nt, Mus musculus
ucgucguguuucuuuauuacugcagugcagacagcagcgcau

SEQ ID NO: 66149 - RNA, 41 nt, Mus musculus
cuuuaaccccguaagaaacagcacuggaagggauccuggag

SEQ ID NO: 66150 - RNA, 42 nt, Mus musculus
uacuaagacuacaagguuucagaagcauugucugagccccac

SEQ ID NO: 66151 - RNA, 45 nt, Mus musculus
aaaaaaaaaaaaaucugaagugaaaacuugcugacuuccguuauu

SEQ ID NO: 66152 - RNA, 46 nt, Mus musculus
caaagaugggggucuauuuagaguccuuucauuuaccaguuuccuu

SEQ ID NO: 66153 - RNA, 87 nt, Mus musculus
gcugucugccccacugccuacucugucgucucccaaacuugcaaggucacauauuucauuccuucauguaguaacuuaucaguccag

SEQ ID NO: 66154 - RNA, 75 nt, Mus musculus
aggauuuucugugcccuuaauuucagugacuauccacaguuuuuucuuggcaggaguauguguagacaucccagu

SEQ ID NO: 66155 - RNA, 42 nt, Mus musculus
agaaaauuuagucuuaaauuuggaagaagaaaccccccccuu

SEQ ID NO: 66156 - RNA, 42 nt, Mus musculus
aguucugaguuuacugacaaauagacaggaaagcuggcugua

SEQ ID NO: 66157 - RNA, 46 nt, Mus musculus
gcucaugaguucaaagccagccuggaaacaucuuaaaaccccauca

SEQ ID NO: 66158 - RNA, 45 nt, Mus musculus
agauauucuccuucaagguagaauaucaggagagagugugugagu

SEQ ID NO: 66159 - RNA, 46 nt, Mus musculus
gguugugggccaccaugugggugcuaggaacugaaccugggucuuc

SEQ ID NO: 66160 - RNA, 42 nt, Mus musculus
uuugaucaaugaccuccagaaagacauugaaggcagcaggaa

SEQ ID NO: 66161 - RNA, 46 nt, Mus musculus
gaaaucugaaauucagaauuuacuggacaaggugaaaaucacagau

SEQ ID NO: 66162 - RNA, 45 nt, Mus musculus
aagaggacauuuaaggagggcauggaugagcuacggacauugaga

SEQ ID NO: 66163 - RNA, 44 nt, Mus musculus
agauaaacucaaagaaacaacuacaaaacuaacccaggcaaagg

SEQ ID NO: 66164 - RNA, 44 nt, Mus musculus
cugagagaguacaucuggguccuuggguaucagaaagggugagc

SEQ ID NO: 66165 - RNA, 46 nt, Mus musculus
aaaagaaaaaccaauaaaaauaugugaagguuuucagacuugagac

SEQ ID NO: 66166 - RNA, 62 nt, Mus musculus
cuuacucaccugugucugggcuugucauuccugcugcuagaaagguuugcugggggaaaggc

SEQ ID NO: 66167 - RNA, 50 nt, Mus musculus
gaagaggcccgucaggaaaaggaggcaaugguaaugaaguaugugagagg

SEQ ID NO: 66168 - RNA, 63 nt, Mus musculus
cauguauuuaaauagaaagcacagcaaccaaaguaaggaauaaggaaggacuggaaacacagc

SEQ ID NO: 66169 - RNA, 41 nt, Mus musculus
gauaguucuaggaguucaagaguaggacugucucccagaga

SEQ ID NO: 66170 - RNA, 46 nt, Mus musculus
ugauaaguuuaacuguuccaaauauagcacauuuucugcccaaaua

SEQ ID NO: 66171 - RNA, 69 nt, Mus musculus
aagacaguuuaagagaagaacugagaaaaaggacagaaacagagaagcagcauaugaacacaauaaagc

SEQ ID NO: 66172 - RNA, 42 nt, Mus musculus
gaauaccaaagaaacaaguuaaggaugugggugugcucagug

SEQ ID NO: 66173 - RNA, 42 nt, Mus musculus
guggaucuaagcuccucuaucuacuuucuggauccuggaaaa

SEQ ID NO: 66174 - RNA, 46 nt, Mus musculus
aaaugaaaagucacgaauuaaguucagaagcuuacaauuuagagaa

SEQ ID NO: 66175 - RNA, 46 nt, Mus musculus
acucugacagaauuuuaugucagacuaaugaacacuguagucagau

SEQ ID NO: 66176 - RNA, 46 nt, Mus musculus
cuuagucuaauuuuuuaaauuugauuucuuagauguaaaugaagau

SEQ ID NO: 66177 - RNA, 46 nt, Mus musculus
ggagaacaauugcuuaauagauuaauagauuccgaaagcagcggga

SEQ ID NO: 66178 - RNA, 46 nt, Mus musculus
aacuuguuacaauauucacaucuugauuguuauuuagagaggagac

SEQ ID NO: 66179 - RNA, 45 nt, Mus musculus; identical to SEQ ID NO: 55063

SEQ ID NO: 66180 - RNA, 68 nt, Mus musculus; identical to SEQ ID NO: 55065

SEQ ID NO: 66181 - RNA, 96 nt, Mus musculus
uaucuuuuuuaggcuggcucucugcaaacuucuuagcaucaaacugagccaucuucucacacagcuucaccucccccaagauagcccugaacugag

SEQ ID NO: 66182 - RNA, 44 nt, Mus musculus; identical to SEQ ID NO: 55067

SEQ ID NO: 66183 - RNA, 73 nt, Mus musculus
acgcuuaaacucauccaacacaaagguacucuugggcaggugagcgaaaggguccuuggccuugggcucagca

SEQ ID NO: 66184 - RNA, 46 nt, Mus musculus
aauaagauuugagggguugucauccuaaaguucucaauguccaagg

SEQ ID NO: 66185 - RNA, 45 nt, Mus musculus
uauggaaguuuuaguggugcccaagcaugcuccugcacugaugca

SEQ ID NO: 66186 - RNA, 83 nt, Mus musculus
ugaaggccugcuaugcuauugggcccaucuaguggaugcugguaaugaacaacugagagaaauauaugaacuuaaccccuauu

SEQ ID NO: 66187 - RNA, 41 nt, Mus musculus
gugugaugucucacugucauuuuuuuuuucuuuccuccugg

SEQ ID NO: 66188 - RNA, 59 nt, Mus musculus
ugaaacccuagaaaaucugucuuuagaccagcacucgaaaaagaugaacaaguacgcag

SEQ ID NO: 66189 - RNA, 45 nt, Mus musculus
gauacaaggaaaaagucaguucuuucugcugcuuuagcuaaaucg

SEQ ID NO: 66190 - RNA, 46 nt, Mus musculus
ugaaccaggaacagaucuuguagaaccuucaccaaaacacacaccc

SEQ ID NO: 66191 - RNA, 42 nt, Mus musculus
ggugacauuacuauucauuucaaguauuugaaggaaggagaa

SEQ ID NO: 66192 - RNA, 46 nt, Mus musculus
acccucagaugugggaauccucagagguucuauaucgcaacaaggu

SEQ ID NO: 66193 - RNA, 42 nt, Mus musculus
aaaacagagaccuagauucugaauucgaagacuuggcgagug

SEQ ID NO: 66194 - RNA, 47 nt, Mus musculus
gagauaguuaaagguacuugugacuuaacuuaaagaccaguggucag

SEQ ID NO: 66195 - RNA, 45 nt, Mus musculus
agugcucucagacagaagcaguagaaguuauuaagcuacgugagu

SEQ ID NO: 66196 - RNA, 45 nt, Mus musculus
aaauuguagcucauuuggauuuacaaaagucuuaguaauaggaga

SEQ ID NO: 66197 - RNA, 46 nt, Mus musculus
cugauggguaugcugggcaugucauaaucgaaacuguggccccaaa

SEQ ID NO: 66198 - RNA, 45 nt, Mus musculus
guucuuggggaaagcgagaaaauaauguguuaaagaggugacaaa

SEQ ID NO: 66199 - RNA, 46 nt, Mus musculus
uaagaaacaauaugagguguggucugucaagagaaagaggucagca

SEQ ID NO: 66200 - RNA, 46 nt, Mus musculus
aaugucagucuuuuaugaaaacuuugcuuuaguucagcuugauaac

SEQ ID NO: 66201 - RNA, 46 nt, Mus musculus
acaaaccaccauuccaguuuccaccacauaugucuauccuucaguc

SEQ ID NO: 66202 - RNA, 46 nt, Mus musculus
cugacuauucagugcauccuucaauuuaaaaauggguagcaaagau

SEQ ID NO: 66203 - RNA, 42 nt, Mus musculus
uuaucaucaaggugagaagcaugaugucaugcaggcagacau

SEQ ID NO: 66204 - RNA, 45 nt, Mus musculus
guuggauggugcuuguauuagucaggauucucuagagucacagaa

SEQ ID NO: 66205 - RNA, 45 nt, Mus musculus
accacgcaaaaguugaguauggcuucaugaacuuaaaacccagca

SEQ ID NO: 66206 - RNA, 44 nt, Mus musculus
augcaaugggcgugugaaguuaguaauaguuacauugcaucagu

SEQ ID NO: 66207 - RNA, 46 nt, Mus musculus
uuauacauuuuaauauauacuuaauauacuaacguaacacacauuu

SEQ ID NO: 66208 - RNA, 46 nt, Mus musculus
ugaaauguuucauuguggaggaggaggaggagggggaaggggagga

SEQ ID NO: 66209 - RNA, 44 nt, Mus musculus
uaauguaguauauacauaauuuauuucuuggucuaaugagauga

SEQ ID NO: 66210 - RNA, 46 nt, Mus musculus
ucaagaagaucaucaagcgcaagcacacccugcccaguuacaagau

SEQ ID NO: 66211 - RNA, 42 nt, Mus musculus
ggggggacaggagcauuggggagaacaagugagaccccgugg

SEQ ID NO: 66212 - RNA, 46 nt, Mus musculus
aaaagggacacaccacauuaaccgguggagaauugcuaccaagcag

SEQ ID NO: 66213 - RNA, 58 nt, Mus musculus
aacccuacaaaacaaaaacaaacugcacacacauccaccgagaaagggagagagggaa

SEQ ID NO: 66214 - RNA, 76 nt, Mus musculus
augcaacccucgucuaaagaggcagcugagugagugagagagacagagacugggagggagagagaggaaugagaga

SEQ ID NO: 66215 - RNA, 42 nt, Mus musculus
cagugaacugccaugggcaguucuucuauaguaggccccagg

SEQ ID NO: 66216 - RNA, 46 nt, Mus musculus
caugcugucuaaggcccaggccgagugacauuuccaugcugcggug

SEQ ID NO: 66217 - RNA, 24 nt, Mus musculus
uuuuguuuugggccacccccuccc

SEQ ID NO: 66218 - RNA, 46 nt, Mus musculus
uguacacaaaauaguuuguacaugggaaaaguccuaacugcaaugg

SEQ ID NO: 66219 - RNA, 66 nt, Mus musculus
acagccacuugauggaaaugcagcuuaaauucuggcauaguagagacagaaaauuuguuggaugcg

SEQ ID NO: 66220 - RNA, 46 nt, Mus musculus
uaacuaguuccaaaguucaggaacuauuuauuaugcucuuauaggu

SEQ ID NO: 66221 - RNA, 42 nt, Mus musculus
ccugguaaguucggcuucgcgaggcgcgacuuggcggcagga

SEQ ID NO: 66222 - RNA, 46 nt, Mus musculus
caguggacacucaaauauacgcaaaaagauaggaaaggcuggggag

SEQ ID NO: 66223 - RNA, 46 nt, Mus musculus
agaugccggccuauuuccagaggccggaaaaugcccucaagcgcgc

SEQ ID NO: 66224 - RNA, 46 nt, Mus musculus
aaggcggaggggaacuagcgcgagcuuccacgcgccucgccagcag

SEQ ID NO: 66225 - RNA, 42 nt, Mus musculus
cgugauucccucgcggcggcagcgccgccgcccgagccccgg

SEQ ID NO: 66226 - RNA, 45 nt, Mus musculus
uguggaagcauuuucuuugaaugauacaacuaagcagcauuuaga

SEQ ID NO: 66227 - RNA, 44 nt, Mus musculus
uauauuuggggauuucuguuauauauucuuuuuaggaguuugua

SEQ ID NO: 66228 - RNA, 46 nt, Mus musculus
gaugcugggcauuuuuccaguucaaugacacaccauccuauaauag

SEQ ID NO: 66229 - RNA, 41 nt, Mus musculus
guuauuuuaagccuucaaugcuugaagacccuugggcuggc

SEQ ID NO: 66230 - RNA, 42 nt, Mus musculus
guucggcuacuccccagggcagcagcagaccuacccccaggg

SEQ ID NO: 66231 - RNA, 41 nt, Mus musculus
aacccuggggguaggucugcugcugcccuggggaguagccg

SEQ ID NO: 66232 - RNA, 41 nt, Mus musculus
aaggaucuagcaguuaguugcucaguuccacacagcaagca

SEQ ID NO: 66233 - RNA, 45 nt, Mus musculus
gggccaagaagugggaguggguggguaggggaguuggggcggggg

SEQ ID NO: 66234 - RNA, 41 nt, Mus musculus
ugagaucugauacucucuucuggagugucugaagacagcua

SEQ ID NO: 66235 - RNA, 45 nt, Mus musculus
acuuacuaagcauuuacuuucugagauguauuucugagcuugugg

SEQ ID NO: 66236 - RNA, 47 nt, Mus musculus
aggagggauaacauacauaacuagcacagguagacacagaggaagca

SEQ ID NO: 66237 - RNA, 46 nt, Mus musculus
ugggcaacuggucugcacagcaccugguucacaccaugcccugcag

SEQ ID NO: 66238 - RNA, 46 nt, Mus musculus
auucguucaucugugcacugauccucacaacaccccugugaaguag

SEQ ID NO: 66239 - RNA, 46 nt, Mus musculus
uuaguucccauuuuaaggaagaaccugaguuacagaauggugaaag

SEQ ID NO: 66240 - RNA, 46 nt, Mus musculus
cuuauuuuguuuacucugccuaucaggguuuucaagauaccucaac

SEQ ID NO: 66241 - RNA, 46 nt, Mus musculus
gcagugaaaauguaagagacaaagacacaaaugcaauugugccuag

SEQ ID NO: 66242 - RNA, 45 nt, Mus musculus
cacuucuggcuggaaggccacaggggaacgagaguuacagggcag

SEQ ID NO: 66243 - RNA, 45 nt, Mus musculus
aacauuguuccuucuccaucgauauugaggaggaaaaagcuauag

SEQ ID NO: 66244 - RNA, 44 nt, Mus musculus
gaaucaaguguguacagcaagagucaguucuuaacuaggaaccc

SEQ ID NO: 66245 - RNA, 42 nt, Mus musculus; identical to SEQ ID NO: 30890

SEQ ID NO: 66246 - RNA, 45 nt, Mus musculus
cguguggauuuagaaaagcacccaggaagguugaaccucgaagau

SEQ ID NO: 66247 - RNA, 42 nt, Mus musculus
ugguuggauaguauauggccacaaaaggaggaaaccucggaa

SEQ ID NO: 66248 - RNA, 47 nt, Mus musculus
agccucuagugaaaaucuggcacgaaauaaggacuaauggccccaag

SEQ ID NO: 66249 - RNA, 45 nt, Mus musculus
gucagagcugaugcuaacuaaaugucaucaaaaccugggcuaugu

SEQ ID NO: 66250 - RNA, 46 nt, Mus musculus
ggacaaacagaaagagaaacagagagagcaagagaaggacaaacag

SEQ ID NO: 66251 - RNA, 62 nt, Mus musculus
ucacucauguggccaccacccacacauacccugaggaugaagguguauuugcuuuauaggug

SEQ ID NO: 66252 - RNA, 46 nt, Mus musculus
acacacauauauccauauauggauauagauagauauauaucaggag

SEQ ID NO: 66253 - RNA, 42 nt, Mus musculus
uuuggguuccuuaauaugcaugcacacuuggaguaguugcag

SEQ ID NO: 66254 - RNA, 45 nt, Mus musculus
agacuacagcuguguuucccuccauuucuggaaauucuauuacag

SEQ ID NO: 66255 - RNA, 59 nt, Mus musculus
gguggguuggugagcagggggaggggagaagggauaggggguuuucggaggggaaacca

SEQ ID NO: 66256 - RNA, 50 nt, Mus musculus
gccagggaaacaagcccagcucagggcugcaaccugcuggagaggaagug

SEQ ID NO: 66257 - RNA, 42 nt, Mus musculus
acaauucuuugugcacuuccuguuucacaguuaauggcugag

SEQ ID NO: 66258 - RNA, 41 nt, Mus musculus
ugucuguuugcucagcuaauauggaaacuugaguccagcau

SEQ ID NO: 66259 - RNA, 51 nt, Mus musculus
gcuuaguaaaccccuuaagacauagcuggcuaggacuguauagaaaaggag

SEQ ID NO: 66260 - RNA, 46 nt, Mus musculus
uugggaagccuuauuuuccuugacuucugggaagguaggggugagg

SEQ ID NO: 66261 - RNA, 33 nt, Mus musculus
cucugauccucugggauagcagcaagcccucuu

SEQ ID NO: 66262 - RNA, 45 nt, Mus musculus
ccauuauuauuucagaaucaucaaaggaaauguguagcgauggca

SEQ ID NO: 66263 - RNA, 45 nt, Mus musculus
ugucuuaugaaguagaccuggccugaaaggauuuucagacuuugc

SEQ ID NO: 66264 - RNA, 47 nt, Mus musculus
uaacuaaguggcaacuuguuguucacagaaaaacccaugagguagcc

SEQ ID NO: 66265 - RNA, 46 nt, Mus musculus
uguucccgaggguuuaguuagagacaggcguccuccaaagaugcag

SEQ ID NO: 66266 - RNA, 46 nt, Mus musculus
auguccagaaaaacacauaauugcaaccauuguuucuggcuugcaa

SEQ ID NO: 66267 - RNA, 42 nt, Mus musculus
aaugugcugaugggguacccgucuaggcaugugacaguggag

SEQ ID NO: 66268 - RNA, 41 nt, Mus musculus
agggaaaagguuuguuuguuuguuuuaaugugucugggcuu

SEQ ID NO: 66269 - RNA, 45 nt, Mus musculus
uaagagaugggugugugugugugugugugugugugugugugugcu

SEQ ID NO: 66270 - RNA, 45 nt, Mus musculus
ugggacuuugaucugauuagauuaguagcacauugguuugucuaa

SEQ ID NO: 66271 - RNA, 46 nt, Mus musculus
aaagagguagaggaagaagggucauuguaagcuuaaagccagccag

SEQ ID NO: 66272 - RNA, 35 nt, Mus musculus
aagagaaagacuauuucuuaauuuuaagucucuga

SEQ ID NO: 66273 - RNA, 25 nt, Mus musculus
gacgagaccaagugauaaagcagaa

SEQ ID NO: 66274 - RNA, 48 nt, Mus musculus
caagaaaaugccccagaguuugugaaggugaaaggcaaucucaggaga

SEQ ID NO: 66275 - RNA, 53 nt, Mus musculus
agacaccucuacaguacuguucuugggccaaaguccugaggaagagaauccag

SEQ ID NO: 66276 - RNA, 84 nt, Mus musculus
uugcaauucccauucgccaaaugaaagacaucgaccagcacacaagauaccauggaccuguguuuagaccaagaaagccacaaa

SEQ ID NO: 66277 - RNA, 45 nt, Mus musculus
acauuuugaauauuuuagacuugagcuuugaacaucuccggcgga

SEQ ID NO: 66278 - RNA, 46 nt, Mus musculus
acugugucaccuugugggguuggugcuucccacauuucuugcagaa

SEQ ID NO: 66279 - RNA, 46 nt, Mus musculus
gguugugagccaccaugugguugcugggauuugaacucuuacugag

SEQ ID NO: 66280 - RNA, 45 nt, Mus musculus
acaccagccgcucuaucauccgaaaugucaaaggccccguucgag

SEQ ID NO: 66281 - RNA, 42 nt, Mus musculus
agcccaucaagcuggcuaggguaaccaaagugcugggcagga

SEQ ID NO: 66282 - RNA, 37 nt, Mus musculus
ccgugucggucauaccugugcugcaaagaacccugca

SEQ ID NO: 66283 - RNA, 45 nt, Mus musculus
uuacuacugugaaauuccugugagugaaggacugcuaguggcaga

SEQ ID NO: 66284 - RNA, 46 nt, Mus musculus
agcagucagugcucuuaaccacugagccaucucuacagcccgagaa

SEQ ID NO: 66285 - RNA, 46 nt, Mus musculus
guugaagguuuaaaaaaucgaaaagcuaaagaacauggcuguugag

SEQ ID NO: 66286 - RNA, 45 nt, Mus musculus
augagugaauagaacauguuugcuacuuguaauauuugcauaugg

SEQ ID NO: 66287 - RNA, 44 nt, Mus musculus
aggagaggggucguuuaaugguuuguuugcaguuaaggguauag

SEQ ID NO: 66288 - RNA, 45 nt, Mus musculus
guuuagggaggaaagaaaaaucuuugcgggauaguuuagcaaaag

SEQ ID NO: 66289 - RNA, 45 nt, Mus musculus
aaagucacaagucacaauaccaaccugaguagcaaggagcguaga

SEQ ID NO: 66290 - RNA, 42 nt, Mus musculus
agcaggggagggggagggaaaaagagaggagggggauaccgg

SEQ ID NO: 66291 - RNA, 45 nt, Mus musculus
agcugagccuuugccugcuccgcuccagaugcugaguccccaggg

SEQ ID NO: 66292 - RNA, 45 nt, Mus musculus
cucauccuuggucaucccccggaccacuguucuuucuuggagcau

SEQ ID NO: 66293 - RNA, 41 nt, Mus musculus
gguuaaaacggaggaggggguacaggggcuggcuccagagg

SEQ ID NO: 66294 - RNA, 45 nt, Mus musculus
uuacucaucuaucacaguuuaaaacaccggaggaaagcugcccaa

SEQ ID NO: 66295 - RNA, 46 nt, Mus musculus
ggcaguggaauguuaaggacuuaacaucgauaauguugauagagau

SEQ ID NO: 66296 - RNA, 53 nt, Mus musculus
auagugcagccaacuuguggguguguuugggcaguaccagauaauaggcagag

SEQ ID NO: 66297 - RNA, 46 nt, Mus musculus
uuuuuuugcuucuaaaaugggagauaguggguauaaacugugagga

SEQ ID NO: 66298 - RNA, 24 nt, Mus musculus
guuugagcugaaauguuaaagucu

SEQ ID NO: 66299 - RNA, 46 nt, Mus musculus
gugagcagagugccaggaugaccgccauggacaacgccagcaagaa

SEQ ID NO: 66300 - RNA, 45 nt, Mus musculus
aagagaagcccaucuucucucugaauaccauugcgacugcuggua

SEQ ID NO: 66301 - RNA, 47 nt, Mus musculus
uucuggauaugaauuugaugaaggcucuaucauuuuuaaucaguuca

SEQ ID NO: 66302 - RNA, 46 nt, Mus musculus
ggacucauucugaucaguuuuuggugucauucaaagaugugggacg

SEQ ID NO: 66303 - RNA, 48 nt, Mus musculus
ccucacagcagcugggaaagaaguuaugauuguuggaguuggugaaaa

SEQ ID NO: 66304 - RNA, 53 nt, Mus musculus
gauagagggcuuuguggugcuauucacuccucaguggcuaaacagaugaagaa

SEQ ID NO: 66305 - RNA, 47 nt, Mus musculus
uuccaaaggacauuuuacaugaagaaaaaaauagagcccagaacuca

SEQ ID NO: 66306 - RNA, 85 nt, Mus musculus
cagccucacauguguacguacacagacacaaauacauacaggcacaugaagacagacagacagacagacaaggauugccacagau

SEQ ID NO: 66307 - RNA, 63 nt, Mus musculus
ccuguaggcccaacaccuaggacaauaaacacuugcuaaacauagaagggaaugagaguaaaa

SEQ ID NO: 66308 - RNA, 42 nt, Mus musculus
auagaauagaauagaauagaauagaauagaauagauggagag

SEQ ID NO: 66309 - RNA, 41 nt, Mus musculus
caagccaugagacaggcauaauacagaguuuauuggugagg

SEQ ID NO: 66310 - RNA, 44 nt, Mus musculus
cuccaggucccugccauggcucccuguguuguguuuuauaaaau

SEQ ID NO: 66311 - RNA, 46 nt, Mus musculus
caagucuugcuucuugauggcuacugacuaguuugugcauuuagau

SEQ ID NO: 66312 - RNA, 42 nt, Mus musculus
augguuuuaggucgugcacuagaaguggauucugugguagca

SEQ ID NO: 66313 - RNA, 46 nt, Mus musculus
agggcugaggguaggaaaaaagacauggaguagaaggacgauugau

SEQ ID NO: 66314 - RNA, 42 nt, Mus musculus
caccccuuccugaggcucuggcaguuaaggguugcugaggga

SEQ ID NO: 66315 - RNA, 45 nt, Mus musculus
ccuggucauggggcagaauuuuuaaacuauuuuugugccugaguu

SEQ ID NO: 66316 - RNA, 42 nt, Mus musculus
uggggcugccucuugggcucccagguuacucaguggccugua

SEQ ID NO: 66317 - RNA, 46 nt, Mus musculus
ccauuucugacuggggaguuggaaggaagguaagaggcaaggggga

SEQ ID NO: 66318 - RNA, 46 nt, Mus musculus
cauggauuuggggguugcuucuugucugcugggagguggugcagau

SEQ ID NO: 66319 - RNA, 46 nt, Mus musculus
cccuucaccaccuacaggcaggagaccuggccuggggucaugagaa

SEQ ID NO: 66320 - RNA, 45 nt, Mus musculus
cacuccugacaagacccacucaagagacccaggagccacuaagau

SEQ ID NO: 66321 - RNA, 46 nt, Mus musculus
gcugggaugauuguccauccuuuuuugugacuuuacaacugaagau

SEQ ID NO: 66322 - RNA, 46 nt, Mus musculus
guggcggucugaguggccgcuccuuguccacugcaauguuacaguc

SEQ ID NO: 66323 - RNA, 46 nt, Mus musculus
aaggcuguaccccaguguugcacaccccaauuuauaagccaagaga

SEQ ID NO: 66324 - RNA, 89 nt, Mus musculus
uaacaguugcauucucaguugugucuccuucagccaguagauauuuguggagugccugcccugcaccaguuggcacuucuuaggugaua

SEQ ID NO: 66325 - RNA, 47 nt, Mus musculus
caaaaggaguuccagagaaugugugugugugugugugugugugugug

SEQ ID NO: 66326 - RNA, 100 nt, Mus musculus
acuaguugaaauaguucuuucauuaagcaaagaauuuguagcaauaugcuaagacuccaaaguagugaggcaauuaaauacgauagauaugaacuaugua

SEQ ID NO: 66327 - RNA, 86 nt, Mus musculus
uuccuuguuuuuaugguacagaggauuauuaaggcgcuccagcacugaacuaggguuuuguaaccuagguuagagaacugccaaga

SEQ ID NO: 66328 - RNA, 45 nt, Mus musculus
ccucugugcaaaauaaaauaguuguauauuagaaugcccagggaa

SEQ ID NO: 66329 - RNA, 50 nt, Mus musculus
uacaaucucugcaaggucauaaaacugucccaaggucccucgguaggagg

SEQ ID NO: 66330 - RNA, 47 nt, Mus musculus
gcuggucgccuuggugcuaaagggguuuaaaaaaaucugccgaugag

SEQ ID NO: 66331 - RNA, 45 nt, Mus musculus
uaaaguauagcugauaaggaaacaacauagggagaguugccuggg

SEQ ID NO: 66332 - RNA, 46 nt, Mus musculus
gguuauguguacacacacacacacacacacacacacacacuaagua

SEQ ID NO: 66333 - RNA, 46 nt, Mus musculus
ccaaacaaacaaacaaacaaaaaaaccaacaaaaauaagaaaaaga

SEQ ID NO: 66334 - RNA, 42 nt, Mus musculus
guggucaaagccacgucacuagagacaauccugccucccgau

SEQ ID NO: 66335 - RNA, 47 nt, Mus musculus
gugggaggaagaagaggaagggaaggaggaggaagaagaggaggagg

SEQ ID NO: 66336 - RNA, 42 nt, Mus musculus
uuaugcgcaugcucugccacugugccacacccccagccccau

SEQ ID NO: 66337 - RNA, 26 nt, Mus musculus
gauggagucucccucucucccccaag

SEQ ID NO: 66338 - RNA, 67 nt, Mus musculus
ugcaagcaugaggacugccuucagaauaacuggaaaucugcuagagagagagggagggaaagaggga

SEQ ID NO: 66339 - RNA, 52 nt, Mus musculus
ggggagagaggcuaagagggugagaaagagaggggggagagaaagggagaaa

SEQ ID NO: 66340 - RNA, 46 nt, Mus musculus
gacacuuuuauuugcaaaguauuuauuaagcaccugucagcugugu

SEQ ID NO: 66341 - RNA, 45 nt, Mus musculus
gagcaucuuagugagauugaucucaagauaaaaaaguaaggcucg

SEQ ID NO: 66342 - RNA, 41 nt, Mus musculus
ucuguucacuugauuuuucuuuucucucuuucuguggcccc

SEQ ID NO: 66343 - RNA, 46 nt, Mus musculus
cugaaaaaggagagagagagagagagagagaaagagagagagagag

SEQ ID NO: 66344 - RNA, 46 nt, Mus musculus
uaaaggugacuuugagccucuuucccaccucuuucugaaggaucag

SEQ ID NO: 66345 - RNA, 46 nt, Mus musculus
accugagaccaccuuggguuaauaaaagaagcaguugcggguguag

SEQ ID NO: 66346 - RNA, 83 nt, Mus musculus
ucccuagggaaccacgugugggaauuucgcugggauguuaggaucagggagggugacuaaaaaucucaguauguaguuguuuu

SEQ ID NO: 66347 - RNA, 46 nt, Mus musculus
uuucuuguguacacucauccugccccuuuucagaaugucuaacagg

SEQ ID NO: 66348 - RNA, 36 nt, Mus musculus
gcugguuugguuacuuccccaaacucaugagcaaag

SEQ ID NO: 66349 - RNA, 42 nt, Mus musculus
cuccuucuuuuuuuuuuuuuccuuaggugcagacuuugaauc

SEQ ID NO: 66350 - RNA, 45 nt, Mus musculus
augcgaacaugccuaauaacuuagugauagggagaugguggcaga

SEQ ID NO: 66351 - RNA, 46 nt, Mus musculus
aauugaagaggggacugaguacugaaugcgggaacucccucaagug

SEQ ID NO: 66352 - RNA, 45 nt, Mus musculus
aaaaugaacuuucccucucccgcagcuaccguuuguccaguagau

SEQ ID NO: 66353 - RNA, 44 nt, Mus musculus
aagacugauagaccuggagcacacugcacaggcagcucaacaga

SEQ ID NO: 66354 - RNA, 44 nt, Mus musculus
ggaugcccacuaauuccuaaggcaccaacguucugugaaucuac

SEQ ID NO: 66355 - RNA, 46 nt, Mus musculus
cuugcaucaugguccagauggcuucuguggcccacuucagcagagg

SEQ ID NO: 66356 - RNA, 28 nt, Mus musculus
uggaacaccgagguccuggauuugagau

SEQ ID NO: 66357 - RNA, 46 nt, Mus musculus
uuaugcuauggaucuggcuggagcccagaguucuguaguuggaagg

SEQ ID NO: 66358 - RNA, 46 nt, Mus musculus
auaguaagcaucuuaguggagguaguaauuuguuauuagccaagau

SEQ ID NO: 66359 - RNA, 42 nt, Mus musculus
cgcccuucucugucgcaucccccacaaugaucuugccgccac

SEQ ID NO: 66360 - RNA, 45 nt, Mus musculus
gucuuucucuacaagagacgucgguggggcgauggcagcuccucc

SEQ ID NO: 66361 - RNA, 46 nt, Mus musculus
accaauugaaauugguuauaaaaccaugcuguaucaaucagccuaa

SEQ ID NO: 66362 - RNA, 45 nt, Mus musculus
cuccgcucucgcucauaaucuucauccucaucagaaucagggucu

SEQ ID NO: 66363 - RNA, 46 nt, Mus musculus
aucuaacuuuggauaauauggcauaugauuucaggagcugggaggg

SEQ ID NO: 66364 - RNA, 46 nt, Mus musculus
gaagccagguauaguggcccaagccuuuaaccccagcacccgggag

SEQ ID NO: 66365 - RNA, 30 nt, Mus musculus
uggcgcuucaccacuuucucauagucauug

SEQ ID NO: 66366 - RNA, 45 nt, Mus musculus
ugagguggugugucugcaaucugccggucaucugaggagccgccu

SEQ ID NO: 66367 - RNA, 47 nt, Mus musculus
ugagugagcgccgccuucuucaccuggagcugggacugcaggagcuu

SEQ ID NO: 66368 - RNA, 46 nt, Mus musculus
ccgagacgauugugcccaugggccacggcggcggcagcgcggagcc

SEQ ID NO: 66369 - RNA, 45 nt, Mus musculus
caggagcacuugcagucuuucccagccugcuaacaaaccccaaac

SEQ ID NO: 66370 - RNA, 46 nt, Mus musculus
agcuacugaacugcccacugugacucccgcacuaagagccauaggg

SEQ ID NO: 66371 - RNA, 46 nt, Mus musculus
gcuuucaaaccuuugucaaaacaagaacccugcaccucccuuagac

SEQ ID NO: 66372 - RNA, 45 nt, Mus musculus
ugcuugggcacucaccaacauugcuucuggaacaucugaacagac

SEQ ID NO: 66373 - RNA, 45 nt, Mus musculus
aaacgucagcuccuuuccugaugaugcuacuucuccgcuacagga

SEQ ID NO: 66374 - RNA, 42 nt, Mus musculus
cuguuacauuagcauauugcauuauuuauuauggccccagcu

SEQ ID NO: 66375 - RNA, 45 nt, Mus musculus
uccccagggacgugugcccuuuucguuugaucuaguagcccauug

SEQ ID NO: 66376 - RNA, 35 nt, Mus musculus
uuaggauuuuggcauccaaaaguguagcaccagaa

SEQ ID NO: 66377 - RNA, 45 nt, Mus musculus
uggccuuccucagacccucugaauccuuugcauggagcaggcaga

SEQ ID NO: 66378 - RNA, 42 nt, Mus musculus
caaguguuccuggucuaugacaucuaaggaagacccccugcu

SEQ ID NO: 66379 - RNA, 101 nt, Mus musculus
uucagcaaaugugagcacauggaauucagcaccauauaaaacagauaguguaaauggaauuuuuaaauguuauuuaauaacuauuauuacuaauaugaccc

SEQ ID NO: 66380 - RNA, 62 nt, Mus musculus
gguugggauacucaugugaucacagcacacaggaggcuuggggagaggagaagcacggguua

SEQ ID NO: 66381 - RNA, 46 nt, Mus musculus
uacaacuaucuaauuauauuuaaaaaguaauuuaagaaaaugagag

SEQ ID NO: 66382 - RNA, 46 nt, Mus musculus
uuaguagauacugcauugaaucuacaaaucacucugggcaguauga

SEQ ID NO: 66383 - RNA, 27 nt, Mus musculus
gcaugcaacacggcuuuaucagcacac

SEQ ID NO: 66384 - RNA, 45 nt, Mus musculus
ugggccaucucgaugguguuauuuaagcucaauugcaugccaaga

SEQ ID NO: 66385 - RNA, 46 nt, Mus musculus
auuguuuucuucuguaguuauagaguucuuuuucguacguugaagu

SEQ ID NO: 66386 - RNA, 45 nt, Mus musculus
uaugagacauuugauuuguuucuaugacuugacagugcaccugac

SEQ ID NO: 66387 - RNA, 45 nt, Mus musculus
ucuggggcugguaguggaaaugaccauaguucuuuuuguuaagac

SEQ ID NO: 66388 - RNA, 46 nt, Mus musculus
acuuaagaauaguaacauaacgcuuuguuuauauuaucggccaacu

SEQ ID NO: 66389 - RNA, 48 nt, Mus musculus
cugaugcccucuucuggagugucugaacccagcucuaguauacuacau

SEQ ID NO: 66390 - RNA, 34 nt, Mus musculus
uuuaggauuauaaaacacuccagggggcugguga

SEQ ID NO: 66391 - RNA, 63 nt, Mus musculus
caaagauaaagucuuucuuuacagacuaauaggugagccaaagugaggaagagcuagucgagg

SEQ ID NO: 66392 - RNA, 46 nt, Mus musculus
uuuauagucuuuaauguuuaguauucugaggaaaaauagcccuuau

SEQ ID NO: 66393 - RNA, 45 nt, Mus musculus
ugcagagcaggcuacucuguguggugacccauuuaccaccacagu

SEQ ID NO: 66394 - RNA, 39 nt, Mus musculus
uuguugcucugauaaaauaaccugaccaaagaaacuaga

SEQ ID NO: 66395 - RNA, 46 nt, Mus musculus
guguguguguguguguguguguaugugugugugugucuuuggguua

SEQ ID NO: 66396 - RNA, 46 nt, Mus musculus
auuucccucguuuacacuuccaaugcuaucccaaaagucccccaua

SEQ ID NO: 66397 - RNA, 23 nt, Mus musculus
ggcucuuagguuuggggguuguu

SEQ ID NO: 66398 - RNA, 45 nt, Mus musculus
ggagaggaaucacaauuuguaagcuguggcacauagcauagacaa

SEQ ID NO: 66399 - RNA, 45 nt, Mus musculus
augcgcaagagggcuuugggggaaacauacacauuauguuuagac

SEQ ID NO: 66400 - RNA, 45 nt, Mus musculus
ggacacggaugcaggucagcacuguagcucucacuaaggccggac

SEQ ID NO: 66401 - RNA, 48 nt, Mus musculus
uagguguauauagcaacaaguaaaggaaaagaggcaauuaauugaaga

SEQ ID NO: 66402 - RNA, 46 nt, Mus musculus
uuuuguagauucuuccucaagacccaugacuucacuagccagguag

SEQ ID NO: 66403 - RNA, 45 nt, Mus musculus
auuguaguagaagcugaaauaaaacaggauggugaccauagaaug

SEQ ID NO: 66404 - RNA, 46 nt, Mus musculus
uucugcguaguaaggaccauuuggugcauguagagccuuuauagau

SEQ ID NO: 66405 - RNA, 46 nt, Mus musculus
gucuuggaccaguauucaauguggggaaacaaauuuggagucuugc

SEQ ID NO: 66406 - RNA, 46 nt, Mus musculus
guuuuuguuuuccauggcuaaauuuuacuuuuuagaacuugaagau

SEQ ID NO: 66407 - RNA, 45 nt, Mus musculus
acauugccauuuuaaguauguucauucuguggaaagaucccuaga

SEQ ID NO: 66408 - RNA, 46 nt, Mus musculus
gaaaagaauucauuuuggaauugauaaugacauuuaaagacaaaug

SEQ ID NO: 66409 - RNA, 33 nt, Mus musculus
cucaguaauggccugugguuugugugcugaugg

SEQ ID NO: 66410 - RNA, 46 nt, Mus musculus
accccaucccuccuguuuucuuuuuuugccuuauugaguugugaug

SEQ ID NO: 66411 - RNA, 46 nt, Mus musculus
ucuuuugacuguggggaaagacuuugaauaaaacuacucaggagau

SEQ ID NO: 66412 - RNA, 46 nt, Mus musculus
uaaauuucugcagaugaccaguagugguauucucuguauaacagau

SEQ ID NO: 66413 - RNA, 46 nt, Mus musculus
gcuagacaagaaaagaauaaagacauuugcugagugcaugccagua

SEQ ID NO: 66414 - RNA, 42 nt, Mus musculus
ugugugugugaaauugugugugugugugugugugugugugug

SEQ ID NO: 66415 - RNA, 25 nt, Mus musculus
ucuuccuucaagcauaugaaaguag

SEQ ID NO: 66416 - RNA, 45 nt, Mus musculus
aguggaacugaaagugaacauuuuaaaaauaaaacaacugcggcu

SEQ ID NO: 66417 - RNA, 42 nt, Mus musculus
gccugggaaaugugguguuuaagaggaacugcagugacaugg

SEQ ID NO: 66418 - RNA, 46 nt, Mus musculus
auccccaacaagcuguccuucuacaucucagaaucagcauccagac

SEQ ID NO: 66419 - RNA, 45 nt, Mus musculus
uguugccaagccugacccugaguuuaacccucaguacuucuaggc

SEQ ID NO: 66420 - RNA, 46 nt, Mus musculus
guuuuuuguuuugugaugaggcaggccaucuugauuaaaauuagau

SEQ ID NO: 66421 - RNA, 46 nt, Mus musculus
aaucagauggucccugcuguagcccccgagggaagguggagcagau

SEQ ID NO: 66422 - RNA, 44 nt, Mus musculus
acugaaagguuuggagcaaaagagacagagguucuggauucagg

SEQ ID NO: 66423 - RNA, 47 nt, Mus musculus
guuuuuuggauggguggugggaggguggagaucuaggugaguaauac

SEQ ID NO: 66424 - RNA, 81 nt, Mus musculus
gacugcaaugugugauacaaagagggugccacuguuaagaucauuacaucuccagccuucgagugagcuuuaaguuaucgu

SEQ ID NO: 66425 - RNA, 46 nt, Mus musculus
cgcgacccacagguugagaaccauugcucuaaauggcuuuugauga

SEQ ID NO: 66426 - RNA, 45 nt, Mus musculus
gugagcgcgggcaggcaguggggagggcggagaaggugcugacaa

SEQ ID NO: 66427 - RNA, 49 nt, Mus musculus
guggcugugaaucguaggagcgcuggggucucuggggucccggagcaag

SEQ ID NO: 66428 - RNA, 68 nt, Mus musculus
uuuuuccagccgcagcaagccagcccaccuucgaagccaugucuaccaggucuguguccucguccucc

SEQ ID NO: 66429 - RNA, 41 nt, Mus musculus
ccggcucgaugugccggagccaccgaacauccugcgguagg

SEQ ID NO: 66430 - RNA, 71 nt, Mus musculus
gagcuaugugaccacguccacacgcaccuacagucugggcagcgcacugcgccccagcacuagccgcagcc

SEQ ID NO: 66431 - RNA, 41 nt, Mus musculus
cgguccucggcagugcgccugcggagcagcgugccgggcgu

SEQ ID NO: 66432 - RNA, 45 nt, Mus musculus
gucggccagcgagaaguccaccgagucuugaagcagccgcacgcc

SEQ ID NO: 66433 - RNA, 42 nt, Mus musculus
uucaagaacacccgcaccaacgagaagguagaacugcaggag

SEQ ID NO: 66434 - RNA, 103 nt, Mus musculus
ccaccucgacacgggccuugucguuggugagcugauccaccugccggcgcagcucccgcaucuccuccucguacaggucgcccaggcgcgacuugcccuggcc

SEQ ID NO: 66435 - RNA, 46 nt, Mus musculus
caagggccagggcaagucgcgccugggcgaccuguacgaggaggag

SEQ ID NO: 66436 - RNA, 46 nt, Mus musculus
cgagguggagcgggacaaccuggccgaggacaucaugcggcugcga

SEQ ID NO: 66437 - RNA, 46 nt, Mus musculus
ccugucugaaugacugcagggugcuuucggcuuccucucucuggag

SEQ ID NO: 66438 - RNA, 45 nt, Mus musculus
auaggauguugacaaugcuucucuggcacgucuugaccuugaacg

SEQ ID NO: 66439 - RNA, 47 nt, Mus musculus
aaaaggcaauuucuuccugcaaggauuccacuuuccguucaagguca

SEQ ID NO: 66440 - RNA, 45 nt, Mus musculus
gagauccaggagcugcaggcccagauucaggaacagcauguccag

SEQ ID NO: 66441 - RNA, 43 nt, Mus musculus
cgaucuggacaugcuguuccugaaucugggccugcagcuccug

SEQ ID NO: 66442 - RNA, 71 nt, Mus musculus
cugaccucacugcugcccugcgugaugugcgccagcaguaugaaagcguggcugccaagaaccuccaggag

SEQ ID NO: 66443 - RNA, 42 nt, Mus musculus
caacaauggcgguccaagcuuuaagccagcuucugaguagag

SEQ ID NO: 66444 - RNA, 48 nt, Mus musculus
cugaccucucugaggcugccaaccggaacaacgaugcccugcgccagg

SEQ ID NO: 66445 - RNA, 46 nt, Mus musculus
cuuggccuggcgcagggcaucguuguuccgguuggcagccucagag

SEQ ID NO: 66446 - RNA, 111 nt, Mus musculus
cagaacgagucccuggagcgccagaugcgugagauggaagagaauuuugcccuugaagcugcuaacuaccaggacacuauuggccgccugcaggaugagauccaaaacaug

SEQ ID NO: 66447 - RNA, 46 nt, Mus musculus
ccuucgugaauaccaagaucugcucaauguuaagauggcccuggac

SEQ ID NO: 66448 - RNA, 45 nt, Mus musculus
ggauuucucugccucugccaaccuuuucuucccugaaccugagag

SEQ ID NO: 66449 - RNA, 54 nt, Mus musculus
gaugaccuugaauaaaaauugcacacacuuggugcaacagugcaguaccagcaa

SEQ ID NO: 66450 - RNA, 96 nt, Mus musculus
aacagcuuucaagugccuuuacugcaguuuuucaggagcgcaagauagauuuggaauagaaagaagcucagcacuuaacaacugacaccccaaaag

SEQ ID NO: 66451 - RNA, 42 nt, Mus musculus
gucugggacaucagaagcaugugcugcaacacaccugcugac

SEQ ID NO: 66452 - RNA, 46 nt, Mus musculus
ugggacguggacaucagccccuucagccuguacuuugccaguggau

SEQ ID NO: 66453 - RNA, 46 nt, Mus musculus
ccagauucagugagagaccuuaucccaaaaaugaaagcugcgagua

SEQ ID NO: 66454 - RNA, 42 nt, Mus musculus
uagggacgugcgugcuggaaugccuguagccaggguccaguu

SEQ ID NO: 66455 - RNA, 41 nt, Mus musculus
gaccgccugaggaaccucagcuggcgcgguccucugacuga

SEQ ID NO: 66456 - RNA, 46 nt, Mus musculus
agaaugacuaaaguuaagggcugacaccaucaacuguugccaagau

SEQ ID NO: 66457 - RNA, 42 nt, Mus musculus
uguaagagauaccgaugaaaacaugagagaucugggcaagac

SEQ ID NO: 66458 - RNA, 44 nt, Mus musculus
aggacagggaagcaggaguggguggauaugugagcagggggagg

SEQ ID NO: 66459 - RNA, 46 nt, Mus musculus
gaacuuggggguggagggugagggagugggaaggaggagaugggga

SEQ ID NO: 66460 - RNA, 46 nt, Mus musculus
uauaggaagguucauucauuucaggcagugucagauuucuccaggc

SEQ ID NO: 66461 - RNA, 46 nt, Mus musculus
uaaaaugaccagcagugggggagggcagauucaggcaggcagugga

SEQ ID NO: 66462 - RNA, 46 nt, Mus musculus
ccaaagacuuaaaaccuccucuucaaagaguucuugguggccaggc

SEQ ID NO: 66463 - RNA, 45 nt, Mus musculus
ugaaugcuguaccuuguaagaaccagaacuuuccuuggcacagaa

SEQ ID NO: 66464 - RNA, 46 nt, Mus musculus
cuuuucccuaaccuugguuuaaaaugucagaaaagaaagggagaag

SEQ ID NO: 66465 - RNA, 45 nt, Mus musculus
cuacagacacauaagguacacauagacgacuuccuuuuagggcaa

SEQ ID NO: 66466 - RNA, 41 nt, Mus musculus
aacugaacuauuugcuuuugaaggaaauaguggagggaagg

SEQ ID NO: 66467 - RNA, 46 nt, Mus musculus
aaaauuaaauauauuuuccugucuuuuuugcaagauuacuuuacag

SEQ ID NO: 66468 - RNA, 46 nt, Mus musculus
gaacuauuugcucuauuucaaauaagcuguuaauuuuaucaaugag

SEQ ID NO: 66469 - RNA, 45 nt, Mus musculus
ccagcccugugagguaagacgcggccucagucacugcccccugcg

SEQ ID NO: 66470 - RNA, 45 nt, Mus musculus
ucaacgaggcgcuagcaccauggagcuuuccgucauucgggccag

SEQ ID NO: 66471 - RNA, 46 nt, Mus musculus
caauuuuaauuaaucuuuuaaaacaccgcugucacgucgcuugcag

SEQ ID NO: 66472 - RNA, 45 nt, Mus musculus
aguccuauuucaggcucaacuacccaauauguuuacuucagccaa

SEQ ID NO: 66473 - RNA, 30 nt, Mus musculus
ugcuaccauagcuuccacuuccaccaccag

SEQ ID NO: 66474 - RNA, 46 nt, Mus musculus
uuuccuccacaaccaaaaguuccuccaggacccauaaagcugccag

SEQ ID NO: 66475 - RNA, 39 nt, Mus musculus
cugccgagcuggauaaugaugcgggauuucaccccuagu

SEQ ID NO: 66476 - RNA, 44 nt, Mus musculus
cgcccgugcuggagugaucagagaauccggagguguucuguagg

SEQ ID NO: 66477 - RNA, 45 nt, Mus musculus
aacuuggugcuuuccugccuccaggaugcaaguugcagcugcugc

SEQ ID NO: 66478 - RNA, 45 nt, Mus musculus
agcagguuggagucuguuuauuggugguaaauguuuuucugaaga

SEQ ID NO: 66479 - RNA, 45 nt, Mus musculus
gaagcugcaaaauagacaccauuuuuaaaaaucuuugggagagag

SEQ ID NO: 66480 - RNA, 45 nt, Mus musculus
ucccggugcaggcucugguccccguacacagucuugcugacagcu

SEQ ID NO: 66481 - RNA, 46 nt, Mus musculus
guuaaguguauauucacauucagcaucugccccauggccagcaauu

SEQ ID NO: 66482 - RNA, 46 nt, Mus musculus
cacaacugacacgcgccauuucccccaacuugucagguccucagac

SEQ ID NO: 66483 - RNA, 46 nt, Mus musculus
uuacagagaaguggaucacagacaacacccugggcacugagaucac

SEQ ID NO: 66484 - RNA, 57 nt, Mus musculus
cuccaguauggagacgaaaccaaacagcugcggaugccgaaugaagucacaagcaca

SEQ ID NO: 66485 - RNA, 46 nt, Mus musculus
gugccuuuccccagcagcucaccaugaagaugcuggagucgcccag

SEQ ID NO: 66486 - RNA, 42 nt, Mus musculus
ggucauugaccacuguauugaaugucuagcguuugugcucag

SEQ ID NO: 66487 - RNA, 27 nt, Mus musculus
ucgugauuaucuggcuguaaggaggag

SEQ ID NO: 66488 - RNA, 46 nt, Mus musculus
ccuaccugcugacucucucucccuuuugcauuaaccuagccccugu

SEQ ID NO: 66489 - RNA, 24 nt, Mus musculus
gggguuacaggugacccuugcaga

SEQ ID NO: 66490 - RNA, 45 nt, Mus musculus
uuugucaccaucuuccucaggcagaccaguccaauguguggccau

SEQ ID NO: 66491 - RNA, 46 nt, Mus musculus
uaccugccaaggaaaccugucgcccuugaacuuuaagacuggagaa

SEQ ID NO: 66492 - RNA, 41 nt, Mus musculus
cagucuuaaaguucaagggcgacagguuuccuuggcaggua

SEQ ID NO: 66493 - RNA, 46 nt, Mus musculus
gcaugagaggauucaccuuaguagacuuuacuucuucguauugugg

SEQ ID NO: 66494 - RNA, 42 nt, Mus musculus
ggggaggggaaggaggugggguagaaggagguggauccagaa

SEQ ID NO: 66495 - RNA, 46 nt, Mus musculus
uucaaaaaccuccacaagaaacaggacccuaggcgaugggugugga

SEQ ID NO: 66496 - RNA, 42 nt, Mus musculus
ccaggcagaauuuaccaccagaaccugacauuuagaggagag

SEQ ID NO: 66497 - RNA, 41 nt, Mus musculus
acucgguaggaggcaggcuuccgggccaaaaacccaggaga

SEQ ID NO: 66498 - RNA, 42 nt, Mus musculus
aaggggugggagguggaagugaaggggugcaacgaagggagg

SEQ ID NO: 66499 - RNA, 42 nt, Mus musculus
ccaugcucagcacuuuagcuguuaaucucuaaggaccagaac

SEQ ID NO: 66500 - RNA, 41 nt, Mus musculus
uuugggcaucccauacacggauguguagaaaggcagggggg

SEQ ID NO: 66501 - RNA, 49 nt, Mus musculus
gagcgauuuuuagaagaggaaggaaaaacaguguuaaacuugucugcau

SEQ ID NO: 66502 - RNA, 42 nt, Mus musculus
agguugcagacaaagugcuugaugugguuaaaagauaccaag

SEQ ID NO: 66503 - RNA, 46 nt, Mus musculus
uguaguugagggauuggcuucugaugguggccucuuuguuccugag

SEQ ID NO: 66504 - RNA, 46 nt, Mus musculus
gagaacggaguuagugauuuccagaaagcagagauaauuggcaguc

SEQ ID NO: 66505 - RNA, 31 nt, Mus musculus
acggacaguuaauggcaaauuuauaccauca

SEQ ID NO: 66506 - RNA, 46 nt, Mus musculus
ugcuggucgagaagcugcagcaagaguuuguugccgacuggugcuc

SEQ ID NO: 66507 - RNA, 45 nt, Mus musculus
ccccuccucgaccgcuucgcccggagauggaagcgcgcacacaga

SEQ ID NO: 66508 - RNA, 46 nt, Mus musculus
cugcacggucuguucccgagacuuauugcucugcaacaucauguug

SEQ ID NO: 66509 - RNA, 46 nt, Mus musculus
auauuuggaauuuuaugauauacuucaguuucugguuuccgguugu

SEQ ID NO: 66510 - RNA, 45 nt, Mus musculus
guuucugucucacaagguuuaacuauuuuauauacacuggcugua

SEQ ID NO: 66511 - RNA, 46 nt, Mus musculus
agguuucucaaaccacuuuucaugaaccagugaauauucaagagaa

SEQ ID NO: 66512 - RNA, 23 nt, Mus musculus
uuaugauucagaaaauuacagcu

SEQ ID NO: 66513 - RNA, 42 nt, Mus musculus
acgaccuggcuguguggagccucucggaacacgugccgccuc

SEQ ID NO: 66514 - RNA, 41 nt, Mus musculus
acccgggaagugggacuagucgcggggccagaagugcggag

SEQ ID NO: 66515 - RNA, 39 nt, Mus musculus
ggaaaggguguuguagcgacgcaaagugaugcuagccag

SEQ ID NO: 66516 - RNA, 35 nt, Mus musculus
uuuucacuuuggguuuuggagaccuuuccggccac

SEQ ID NO: 66517 - RNA, 46 nt, Mus musculus
gcccagaguagccuagaacuuacugucaagcuaagcauggccccag

SEQ ID NO: 66518 - RNA, 45 nt, Mus musculus
acucagaguggugagaaauacagugauccuuuuaaacuuggcugg

SEQ ID NO: 66519 - RNA, 42 nt, Mus musculus
acaacugugagcccgaugcuggacaggacuguauagggaggg

SEQ ID NO: 66520 - RNA, 44 nt, Mus musculus
gugugugugugucuguguguucauuuuuauucuuaaucccccag

SEQ ID NO: 66521 - RNA, 46 nt, Mus musculus
uuccccauaguuuuauuuuccaagcacaucacacauuuugccccua

SEQ ID NO: 66522 - RNA, 46 nt, Mus musculus
guaaacauuauuauguuccuuuuauuccuaauuucuucagggcuuu

SEQ ID NO: 66523 - RNA, 49 nt, Mus musculus
uaacgauaaauuaucucuccccaccucauaguaaguuucucacaguuaa

SEQ ID NO: 66524 - RNA, 44 nt, Mus musculus
acacacuuccugaccugugcuucauccuagcugucugcccccuu

SEQ ID NO: 66525 - RNA, 46 nt, Mus musculus
ucauccaaaguaaggcaagcacucuaccacugagcuguagcccccu

SEQ ID NO: 66526 - RNA, 58 nt, Mus musculus
ugucaaagcagaggcucuauugggggacguuuauaucaugaauaagagaaagaaaaca

SEQ ID NO: 66527 - RNA, 46 nt, Mus musculus
uaaauuccuagguucaaucucugguauuaccuuccccugcccccaa

SEQ ID NO: 66528 - RNA, 46 nt, Mus musculus
cauaugaccaaagacauucauucaaaggaaauuaggcaugccaaag

SEQ ID NO: 66529 - RNA, 42 nt, Mus musculus
aagcuggccaacaaccaauguucuccuugcuuuagccucugg

SEQ ID NO: 66530 - RNA, 45 nt, Mus musculus
uaaucuuuuuauuauuuuuuauguuuauggauguuuugucugccu

SEQ ID NO: 66531 - RNA, 44 nt, Mus musculus
agcaaccacaugguggcucacaaccauccguaacagagaucuga

SEQ ID NO: 66532 - RNA, 46 nt, Mus musculus
auauauauauauauuugacuucuuccuuuccaauuuguacccccuu

SEQ ID NO: 66533 - RNA, 46 nt, Mus musculus
gcauaguuuccuuccuuguguuuguguuuucccuuuauuauccuuu

SEQ ID NO: 66534 - RNA, 27 nt, Mus musculus
aagguguacuuccuguaagcugccaac

SEQ ID NO: 66535 - RNA, 46 nt, Mus musculus
accucaaacucacagcucugccuccugacuaaagaugugugccaag

SEQ ID NO: 66536 - RNA, 46 nt, Mus musculus
aggagagucucaacaauuauaaauacuugcguguuauacugggaaa

SEQ ID NO: 66537 - RNA, 45 nt, Mus musculus
ccagaaaugaaugcuaugauaaugagacgguucaguuugccagga

SEQ ID NO: 66538 - RNA, 45 nt, Mus musculus
ucucugaccuuuaauccuauggugaaacaaagacaaaccacuuga

SEQ ID NO: 66539 - RNA, 46 nt, Mus musculus
uuuaaccuuuguuauuuuugaaguacuaugucauuagcaaucagau

SEQ ID NO: 66540 - RNA, 46 nt, Mus musculus
auuauguaugcuagugcauaugcaugcacacccucccaccccuuua

SEQ ID NO: 66541 - RNA, 46 nt, Mus musculus
ccauuacauguuucagugcagcauggucacuaacauugugucagac

SEQ ID NO: 66542 - RNA, 46 nt, Mus musculus
acucacaccuugcuaaguuuaugaccagccuaaaacuucuggggau

SEQ ID NO: 66543 - RNA, 45 nt, Mus musculus
uuuuucuuuucauguagguuauuacuccgucauacugugggauua

SEQ ID NO: 66544 - RNA, 41 nt, Mus musculus
gggcggaggcagcagcuguaccuuuaauccuagcacuuggg

SEQ ID NO: 66545 - RNA, 77 nt, Mus musculus
auuuuuucaguauauuuuaaagcuucgauaaacuauggagaucauaaucaccauacugugauuuuuguugcagagcu

SEQ ID NO: 66546 - RNA, 41 nt, Mus musculus
auuagaguuuuauuacuguuuuaaaaaaugucucagccagu

SEQ ID NO: 66547 - RNA, 46 nt, Mus musculus
ugaauguuuuaaucccagccgcauugguggccaaauaaguacaguu

SEQ ID NO: 66548 - RNA, 45 nt, Mus musculus
gucaccauuuuccuucuuacugagaagcuaaucuuaccuugaaga

SEQ ID NO: 66549 - RNA, 45 nt, Mus musculus
uagguucuguggggacaaaaacuugaagaggguagcaggguuugu

SEQ ID NO: 66550 - RNA, 46 nt, Mus musculus
auguuacaguaaauuaaaaaguuccccaaauaauguaaugcuaggu

SEQ ID NO: 66551 - RNA, 42 nt, Mus musculus
uaguaaguucagggcugauuucuuacaaauaaagcuggcaau

SEQ ID NO: 66552 - RNA, 46 nt, Mus musculus
ggcacaaugaccaggcagauuucucgacacaacucuaccacuucuu

SEQ ID NO: 66553 - RNA, 46 nt, Mus musculus
ccauuacaacaagcucucaaggggagauuuucaucagugcugaagc

SEQ ID NO: 66554 - RNA, 46 nt, Mus musculus
agauuauuuuucaaaacauuuauguauacugaggaaaaggagaggg

SEQ ID NO: 66555 - RNA, 46 nt, Mus musculus
aaguugggaaggacuagacugaaugcuaauacaaagaauucuagau

SEQ ID NO: 66556 - RNA, 79 nt, Mus musculus
caaaaacuggcaguuauuacauccagucaaaggacugggcugaagguggagauaggaaguggaacauggaaaggaaaua

SEQ ID NO: 66557 - RNA, 46 nt, Mus musculus
aacuaggcacgauggcacacaucuguaauucuagcacuugggagau

SEQ ID NO: 66558 - RNA, 46 nt, Mus musculus
auggcucagcaguuaagagguccugaguucaauucccagcaaccac

SEQ ID NO: 66559 - RNA, 46 nt, Mus musculus
ugugucugucugugugucugugugucugugugucugugugucugug

SEQ ID NO: 66560 - RNA, 30 nt, Mus musculus
uuuucuacaaagaguuucugagacugagug

SEQ ID NO: 66561 - RNA, 40 nt, Mus musculus
cucugguagaauucuugaccaacaugugcagccccgaguu

SEQ ID NO: 66562 - RNA, 46 nt, Mus musculus
caaagaaagaacuggccucauugacuuuugaagcuuacugcuagaa

SEQ ID NO: 66563 - RNA, 44 nt, Mus musculus
ugucuguuauauauauuuagcauuuauuuggaagucaugcggaa

SEQ ID NO: 66564 - RNA, 47 nt, Mus musculus
auguuuuuuuaugcgcagccacaguguuucacagugagcauagggaa

SEQ ID NO: 66565 - RNA, 46 nt, Mus musculus
agacccuaucucagaagagauacuacuaguuccaggaggcagaagg

SEQ ID NO: 66566 - RNA, 42 nt, Mus musculus
gugggggcauggcaguauccaggcaggcauggcgcaggagga

SEQ ID NO: 66567 - RNA, 42 nt, Mus musculus
gaauacaucaagaacucacaaaauaaucgcacccgcaaauau

SEQ ID NO: 66568 - RNA, 46 nt, Mus musculus
cugugggagggagucagauccacuggaacuugaguuacagauaguu

SEQ ID NO: 66569 - RNA, 42 nt, Mus musculus
uuuaccuuacccugucaccuucaaaacaacuuagccaaagau

SEQ ID NO: 66570 - RNA, 46 nt, Mus musculus
gccaggcuugguggcuagugcuuguaaucccauaaguuaagaggca

SEQ ID NO: 66571 - RNA, 46 nt, Mus musculus
uauuaaaacaaacaaaacccauaagcaacuguauagacuagcaaug

SEQ ID NO: 66572 - RNA, 42 nt, Mus musculus
gauaccaaaucaaagaaaggccuugcacaugcugccaccacu

SEQ ID NO: 66573 - RNA, 46 nt, Mus musculus
caugaaaaacuugggauuuuuauucuaauguauucaacuuguagau

SEQ ID NO: 66574 - RNA, 46 nt, Mus musculus
gcuuuagaguucaugcuuccaucagcugugguuuuaaucaacagau

SEQ ID NO: 66575 - RNA, 46 nt, Mus musculus
uaagcuuauaaaauaucuugcaaauuuucacauauuuccaagagau

SEQ ID NO: 66576 - RNA, 46 nt, Mus musculus
cuuagugaggaggauacauaucugcuaagaaaugucacuaggagau

SEQ ID NO: 66577 - RNA, 46 nt, Mus musculus
uccuucucuugccauaauaaaaugggaaaaugaucuaccuguaggu

SEQ ID NO: 66578 - RNA, 45 nt, Mus musculus
aggaaaggaaaggaaaggaaaggaaaggaaaggaaaggcuuguau

SEQ ID NO: 66579 - RNA, 58 nt, Mus musculus
aaaauuauguaguaucaguacugauuaguaaaugggugagauaaggacaaauuacagg

SEQ ID NO: 66580 - RNA, 46 nt, Mus musculus
uaggagccuucacucucuucuauaccuguuauucuuagguuugguc

SEQ ID NO: 66581 - RNA, 48 nt, Mus musculus
ugucacugaggugcauuucuugugugcagcaaauuguuggguccuguu

SEQ ID NO: 66582 - RNA, 48 nt, Mus musculus
ugcucauccuuuuacaguuuuuccuuuauugcucuuucccagaucuuu

SEQ ID NO: 66583 - RNA, 93 nt, Mus musculus
uauccuuuucuuuaaauuuugaucauauucugucuuagcuucuuguccuccuccuuuuugauuauuaguuuggucucuugauuauccuagagu

SEQ ID NO: 66584 - RNA, 42 nt, Mus musculus
ucugggauuaaagucuugcaccacugugccuggcccuggcuu

SEQ ID NO: 66585 - RNA, 46 nt, Mus musculus
guucccuguguugcuugucugccuuucuuuauccuuuccccccugc

SEQ ID NO: 66586 - RNA, 46 nt, Mus musculus
cucuugugaaaacaugaacuuuuuaccucggagcccacccccuccc

SEQ ID NO: 66587 - RNA, 46 nt, Mus musculus; identical to SEQ ID NO: 66586

SEQ ID NO: 66588 - RNA, 46 nt, Mus musculus
acaaauggggaccccuggacggcucagucagcuccggggccgaagg

SEQ ID NO: 66589 - RNA, 45 nt, Mus musculus
ccuguauccagccagaguuucggugcgcuggguggguggaugcga

SEQ ID NO: 66590 - RNA, 41 nt, Mus musculus
uugugagccaccaugugguugcugggauuugaacagaccuu

SEQ ID NO: 66591 - RNA, 41 nt, Mus musculus
acucacagagauuugcuugccucugcuccuguacccccaag

SEQ ID NO: 66592 - RNA, 42 nt, Mus musculus
cuugacuauuagcuggcugugugggcaaaaguggggagaggg

SEQ ID NO: 66593 - RNA, 45 nt, Mus musculus
agucacuuuaaaaaagcaaucuguuggaauucuggccugcucaac

SEQ ID NO: 66594 - RNA, 46 nt, Mus musculus
cacuaguucaucuuggguguguguauuuguguugggagggagagau

SEQ ID NO: 66595 - RNA, 45 nt, Mus musculus
caaucauguauuaaaccuacugcugacccaaugugcugcgcagau

SEQ ID NO: 66596 - RNA, 45 nt, Mus musculus
auccucuugucagcuuccaggugccaugcagcugccauacccagc

SEQ ID NO: 66597 - RNA, 57 nt, Mus musculus
uuaccagaaccugacccggguggcggacuacugugaaaacaacuauauacaggugag

SEQ ID NO: 66598 - RNA, 46 nt, Mus musculus
uuaaugcgagaggaagcgaugcggagggguggaaaauggcagagcu

SEQ ID NO: 66599 - RNA, 61 nt, Mus musculus
agagaaaagggggaggaagaaugggaugagaaauuuggacaggagacugaggaggacaaca

SEQ ID NO: 66600 - RNA, 47 nt, Mus musculus
cccuuguagaacuguguggcucaauguauauguugcuugccccauuu

SEQ ID NO: 66601 - RNA, 46 nt, Mus musculus
uaugugcauauguauauaauucaagggaaauuuuugagcuccagau

SEQ ID NO: 66602 - RNA, 45 nt, Mus musculus
ucugacaugcauacuaucauucauauauguauaugcauaccaaug

SEQ ID NO: 66603 - RNA, 41 nt, Mus musculus
uguauuuucuguuauuauuguguauaaauuuaugucugaga

SEQ ID NO: 66604 - RNA, 124 nt, Mus musculus
uucgccgggcuccucacuaucccgagguguacucaaagguccggccaaaacucuugauuaucccggcggcggggaaggguugucucuucuucucacaccggcucuggcagacacaggcgcuugg

SEQ ID NO: 66605 - RNA, 49 nt, Mus musculus
uggagggucacgggccaaaucacuaaguuccuuauuaauccguuucagc

SEQ ID NO: 66606 - RNA, 52 nt, Mus musculus
uuuggaugauaaauucuuguuggaaaugcaaccuuaggugguuugaaggggu

SEQ ID NO: 66607 - RNA, 46 nt, Mus musculus
cauaaacuguuauuacaguuucucuacugacuuugaaaaguuugaa

SEQ ID NO: 66608 - RNA, 44 nt, Mus musculus
ggcugugugcccccuccuccagggccagcacuggcuuucacagg

SEQ ID NO: 66609 - RNA, 54 nt, Mus musculus
ucccauugcuuuaucugguagggauaucuuagcuagagcaaaaaauggaacagg

SEQ ID NO: 66610 - RNA, 45 nt, Mus musculus
gaguuaguuccuccaucagguuuaucucguaggguuuuugcagau

SEQ ID NO: 66611 - RNA, 42 nt, Mus musculus
aaaaaagugcacugccucaauacacuuuucuccaggcuucag

SEQ ID NO: 66612 - RNA, 49 nt, Mus musculus
auaagauuguuauucagaaauaccauacugugaauggccacaacuguga

SEQ ID NO: 66613 - RNA, 61 nt, Mus musculus
aagagauggcuagugcuucauccagccagagaggucgcagugguucuggaaacuuuggugg

SEQ ID NO: 66614 - RNA, 48 nt, Mus musculus
guggcuauaauggauuuggcaauaauggaagcaauuuuggagguggug

SEQ ID NO: 66615 - RNA, 28 nt, Mus musculus
cucuggcccuuauggugguggaggccag

SEQ ID NO: 66616 - RNA, 79 nt, Mus musculus
acaaagcuuagcaggagaggagagccagagaagugacagggaagcuacagguuacaacagauuugugaacucagccaag

SEQ ID NO: 66617 - RNA, 46 nt, Mus musculus
uguauuugugacuaauuguauaacagguuauuuuaguuucuguucu

SEQ ID NO: 66618 - RNA, 46 nt, Mus musculus
accugucgcuugccucugggaggauuugcugagcucaugggaagua

SEQ ID NO: 66619 - RNA, 46 nt, Mus musculus
auuggagguuaugcuguguggcaugcaagagguugacuuggcagac

SEQ ID NO: 66620 - RNA, 43 nt, Mus musculus
aaacaaagaugaauguauugguuuaaugacagaauggcgcuuu

SEQ ID NO: 66621 - RNA, 44 nt, Mus musculus
caccaggaagcaggaacugaaaagggaaguugugcucuccagcc

SEQ ID NO: 66622 - RNA, 44 nt, Mus musculus
ccuugguggagaccccacaggaacccaugcaggucacccggaua

SEQ ID NO: 66623 - RNA, 45 nt, Mus musculus
uuccuaaaagccauguaguaugggaaaugccuggcauugggaaga

SEQ ID NO: 66624 - RNA, 84 nt, Mus musculus
uucauagaauagcugugguuucacaggaccccagagguagcaacccuuguugguuuaugguacaauuggaagcaaaacaagcac

SEQ ID NO: 66625 - RNA, 45 nt, Mus musculus
acucauguacauacaacaaauaaucuuuaaaaacaaccccaaaaa

SEQ ID NO: 66626 - RNA, 45 nt, Mus musculus
gacagcuaagguguacucauauauaauaaauaaauaaaucuuuaa

SEQ ID NO: 66627 - RNA, 45 nt, Mus musculus
ccuuccagccccagcccaugauccugggcacuuucugcaguuggg

SEQ ID NO: 66628 - RNA, 43 nt, Mus musculus
uguccaagguccgcugcacugugcaccugcugggcccccaccu

SEQ ID NO: 66629 - RNA, 46 nt, Mus musculus
cuccagccugugcaugaguguuuuauugugccuggugcucccagag

SEQ ID NO: 66630 - RNA, 44 nt, Mus musculus
guuuccugacugccgugacucaaggccuggugcggggagcugac

SEQ ID NO: 66631 - RNA, 51 nt, Mus musculus
cccuacccccgaggagagcaagggagggacuagaggaccggguaucgaagg

SEQ ID NO: 66632 - RNA, 46 nt, Mus musculus
ucccucccuugcucuccucggggguagggguguuacuccucggcua

SEQ ID NO: 66633 - RNA, 71 nt, Mus musculus
gcaaggggguaagauaaagaacgcgguguagaggcacagaaaagaucccagccuagaaggggucucgauca

SEQ ID NO: 66634 - RNA, 93 nt, Mus musculus
cacaagagcaaagcagaacagagaagaaggaggcaagcgacagggaaaugugaccagcuagagggugggccucacccgagcggagugauguag

SEQ ID NO: 66635 - RNA, 69 nt, Mus musculus
gaaguguaaaguggcugacaguucagggaggugggacagcugagacuggugggacagcuaagaaagugg

SEQ ID NO: 66636 - RNA, 46 nt, Mus musculus
acuuuacacuucuggucuccuccccuaacuccaccucccaacccca

SEQ ID NO: 66637 - RNA, 44 nt, Mus musculus
ucuccuuuucgcccuccacauugcuuugcuuucagucaugcaga

SEQ ID NO: 66638 - RNA, 46 nt, Mus musculus
uagguagaccagacaugggcgagaccaaaacccuuaaaguccccag

SEQ ID NO: 66639 - RNA, 41 nt, Mus musculus
uaguaccuugugacacucgcaccuugugacauucacaccau

SEQ ID NO: 66640 - RNA, 42 nt, Mus musculus
acuucagggcaguaggacuauucugugggguuuaugggucug

SEQ ID NO: 66641 - RNA, 45 nt, Mus musculus
acaguguacuuacaauaaauaaauaaauaaaucuuaaaaaaaaaa

SEQ ID NO: 66642 - RNA, 48 nt, Mus musculus
gcuugagggcacacaggaaguggugacacuagaagcgauuagagagga

SEQ ID NO: 66643 - RNA, 45 nt, Mus musculus
uggcagucugggaacuaacccuaagcuuucugaccuaggauagaa

SEQ ID NO: 66644 - RNA, 46 nt, Mus musculus
guggcgcuugggucugcgcacuccuugaauaacuacuccaggcgaa

SEQ ID NO: 66645 - RNA, 42 nt, Mus musculus
ggccacuaugaagagucaggacgcugcaaccuccuugcccag

SEQ ID NO: 66646 - RNA, 46 nt, Mus musculus
agaaccaggagcuaggaaagcacaaaagcauggaucaggccuagga

SEQ ID NO: 66647 - RNA, 72 nt, Mus musculus
cuucaaccgagagacaaagguagggacacuaugugggccagguagaggaagaguaagagaaggggccgccuu

SEQ ID NO: 66648 - RNA, 42 nt, Mus musculus
gaacuccaucucauccaugccuucacccguguaccaguguag

SEQ ID NO: 66649 - RNA, 46 nt, Mus musculus
acccgcagucaguuggaccuuccuccuaaagcugcuuucggccaag

SEQ ID NO: 66650 - RNA, 44 nt, Mus musculus
agacugcacacuaggcuggggaacucccauucuacuggccuaga

SEQ ID NO: 66651 - RNA, 46 nt, Mus musculus
gacugcaaggggcagccggugacagcuuggagggcaaccccccucc

SEQ ID NO: 66652 - RNA, 42 nt, Mus musculus
aaugccacgcaggguagggccagaagccacagugggcaagaa

SEQ ID NO: 66653 - RNA, 24 nt, Mus musculus
cuuuaacaagaaacagaccagaga

SEQ ID NO: 66654 - RNA, 45 nt, Mus musculus
cugcacaguguagaggaacuaguguauaucacuagcacuuugaca

SEQ ID NO: 66655 - RNA, 46 nt, Mus musculus
aaguagcgagcgguacucauugauaaagaggucuuugcugccauag

SEQ ID NO: 66656 - RNA, 48 nt, Mus musculus
guuucaguuccugggcucggagucugaggcaggaccaugaggcgggaa

SEQ ID NO: 66657 - RNA, 46 nt, Mus musculus
ucccugguccagagaacccacugggacacacacacacacacacaca

SEQ ID NO: 66658 - RNA, 45 nt, Mus musculus
ugucaccccucaaguacucaaagggacucaucuaggggcacagau

SEQ ID NO: 66659 - RNA, 45 nt, Mus musculus
ggcacgccuuuaaucuuagcacuugggaggcagaggcagguggau

SEQ ID NO: 66660 - RNA, 42 nt, Mus musculus
cauacuauagagaauaaugcugguagagaugagggcacugag

SEQ ID NO: 66661 - RNA, 46 nt, Mus musculus
gccgcucuuccucaaugacagagaaagugccuggagguuccucccg

SEQ ID NO: 66662 - RNA, 41 nt, Mus musculus
agcucaucaugcagguugguggggcccuacggaguccagga

SEQ ID NO: 66663 - RNA, 45 nt, Mus musculus
ugucuauuguugacgccuacagggaaugugaagggaggaucaggg

SEQ ID NO: 66664 - RNA, 86 nt, Mus musculus
agugaauggggugggaagggucgugggaggauugugcagcaggagagaaagagagauagagguggaagucagguugcagagagcag

SEQ ID NO: 66665 - RNA, 42 nt, Mus musculus
cugggcaggugggcgccuccgggggccucacaccacggugcu

SEQ ID NO: 66666 - RNA, 42 nt, Mus musculus
ggaugcagggauggggauaggaauagguggggcauucagggg

SEQ ID NO: 66667 - RNA, 41 nt, Mus musculus
auacaguaucuaguuagcagcugucagccaggccaggggug

SEQ ID NO: 66668 - RNA, 46 nt, Mus musculus
aagggggccuugucuuggccuuccucuugucucaauucccucuuug

SEQ ID NO: 66669 - RNA, 30 nt, Mus musculus
acguggagguggagacuagagcggcggcgg

SEQ ID NO: 66670 - RNA, 42 nt, Mus musculus
cccgccgugcucacucaccugugucaucugcccuguccccag

SEQ ID NO: 66671 - RNA, 45 nt, Mus musculus
uuaacuggcuuuugucaccuucacgggcuuuguucacugucacca

SEQ ID NO: 66672 - RNA, 30 nt, Mus musculus
gccgccaauggcaggcugugucccgggaug

SEQ ID NO: 66673 - RNA, 42 nt, Mus musculus
caagcagauccugccacaccagaugacaacugcagggcccgu

SEQ ID NO: 66674 - RNA, 42 nt, Mus musculus
gugguagccgaccccaugcagccaccacccauugcggaggag

SEQ ID NO: 66675 - RNA, 45 nt, Mus musculus
ccaggagcaggaacucuugcugacagccagcgacgaugccacuau

SEQ ID NO: 66676 - RNA, 55 nt, Mus musculus
guucaccacgcauuguucguguucugcaggcuccacgcccucgcccccgcccucg

SEQ ID NO: 66677 - RNA, 47 nt, Mus musculus
agcucauagcagcaaugccuuaggaggggcagccugaccccaacaca

SEQ ID NO: 66678 - RNA, 42 nt, Mus musculus
guucuuaggguccuauaggccagcuacaauauacccugccag

SEQ ID NO: 66679 - RNA, 46 nt, Mus musculus
cucuacccuucuccaucacaccagagggcaaagacaccagauagag

SEQ ID NO: 66680 - RNA, 67 nt, Mus musculus
agagcuggcuggccacccagaguggcuucaaaaacaaucugacagagaagggaaaaucugaguaucu

SEQ ID NO: 66681 - RNA, 46 nt, Mus musculus
gagcauagcugccccagugaguagcacuacucccaggcagggcuag

SEQ ID NO: 66682 - RNA, 42 nt, Mus musculus
uguuccuuugaagacucugacuguggcuucuccccagggggc

SEQ ID NO: 66683 - RNA, 41 nt, Mus musculus
accaaucuggggcccauacaggcgguaccagaagcugagac

SEQ ID NO: 66684 - RNA, 46 nt, Mus musculus
guggugaccugugugugcccccugagcagcugugugauuuccagaa

SEQ ID NO: 66685 - RNA, 42 nt, Mus musculus
uccaggugagcugcccaaggcccugcccuggcuugcccagga

SEQ ID NO: 66686 - RNA, 45 nt, Mus musculus
gacagaauaguccuugguccuugcugagcccucccuguccucaga

SEQ ID NO: 66687 - RNA, 45 nt, Mus musculus
gagaacagcaaggauucuuuagucacuccugaagacugcucagug

SEQ ID NO: 66688 - RNA, 45 nt, Mus musculus
gcaaaacaaaaacuguucugagauaucaugugcugugugguuggu

SEQ ID NO: 66689 - RNA, 42 nt, Mus musculus
agugucaggcgagcugcaaaggaauggcuaugacugugagug

SEQ ID NO: 66690 - RNA, 81 nt, Mus musculus
cugauucgaguccacuuagcagagccuucuggggauccggcgaaggagugcaaggaaaucgugcguggcuacaaaugggcu

SEQ ID NO: 66691 - RNA, 23 nt, Mus musculus
cgaagcgcucgaucucugggccc

SEQ ID NO: 66692 - RNA, 42 nt, Mus musculus
ccacaaaguccugggcucagauccagguacggggucaggcaa

SEQ ID NO: 66693 - RNA, 45 nt, Mus musculus
gugcucgaaguaaggacaucgggcuuugguuaacauggauuucug

SEQ ID NO: 66694 - RNA, 42 nt, Mus musculus
ccucuggcuccucgguguagaagaauugggugggaccuggag

SEQ ID NO: 66695 - RNA, 42 nt, Mus musculus
cucagcgcaggauacgagggcucccggcgcggcgaccccucc

SEQ ID NO: 66696 - RNA, 45 nt, Mus musculus
auaguccccaccuccaggguggcggcugccaggggccccaccccc

SEQ ID NO: 66697 - RNA, 42 nt, Mus musculus
guaccucuuugcuuuucuucuucuuuuucuucuucuccuuag

SEQ ID NO: 66698 - RNA, 45 nt, Mus musculus
acugcuuuccuuaggucccaucuccucuaggcccagcccaaagag

SEQ ID NO: 66699 - RNA, 44 nt, Mus musculus
uucaucacuuucaaagucugggucauccaugacgaaggacagca

SEQ ID NO: 66700 - RNA, 42 nt, Mus musculus
auggccuccaaagaggguacaggagauggugcugagggacag

SEQ ID NO: 66701 - RNA, 23 nt, Mus musculus
gagcucuuuaaacaagaaggcaa

SEQ ID NO: 66702 - RNA, 80 nt, Mus musculus
guggggauguauucuuccacaaacuucuugcccugcagucgaugccacagagcugucuugcccguguuccugucaccccg

SEQ ID NO: 66703 - RNA, 45 nt, Mus musculus
acgauggccucagagaucagccugccucugccuccugagugcugc

SEQ ID NO: 66704 - RNA, 44 nt, Mus musculus
aaaagaaaccucuguaacgucuaucgauuaaaaccuuucccuuc

SEQ ID NO: 66705 - RNA, 34 nt, Mus musculus
aacguuugcaugcgcucagccagguagauaagcu

SEQ ID NO: 66706 - RNA, 45 nt, Mus musculus
gugccaaaggcugucagcuucuucagggagaggcagggagaggca

SEQ ID NO: 66707 - RNA, 25 nt, Mus musculus
ccaaguacagcucauuccagguauc

SEQ ID NO: 66708 - RNA, 80 nt, Mus musculus
ucagggcagcccaggaaagaugggaccugccggcagcaaagguaagagggaauucucacaugggucuaucugccuaagau

SEQ ID NO: 66709 - RNA, 46 nt, Mus musculus
agugugggcacacacauaccugcauaugccugcacauguggcagca

SEQ ID NO: 66710 - RNA, 42 nt, Mus musculus
cucgccucccugcgaagcggucgccgugucuuucgcccccag

SEQ ID NO: 66711 - RNA, 30 nt, Mus musculus
caggucugcgauggagaagcuaucaccguc

SEQ ID NO: 66712 - RNA, 42 nt, Mus musculus
cgccgacguggagccugcuacgccuccagacugcaccugcaa

SEQ ID NO: 66713 - RNA, 41 nt, Mus musculus
gagcuagaggaugagagagaagcagggaaaagaacaaggga

SEQ ID NO: 66714 - RNA, 46 nt, Mus musculus
guauggagcgcccuggggacagauuugggacuuuuuguuggggagc

SEQ ID NO: 66715 - RNA, 41 nt, Mus musculus
caguuugaaugucuugguggcuuaaaucucauuggcagagg

SEQ ID NO: 66716 - RNA, 46 nt, Mus musculus
ugauuucauucuaucuguguccaguaccacauguguaaagccaguu

SEQ ID NO: 66717 - RNA, 46 nt, Mus musculus
ucucuggccucccuucaccccugugcacauugccugaugccccaug

SEQ ID NO: 66718 - RNA, 47 nt, Mus musculus
gcaacaaguacuuuaauuuuuuuuuuuuuaaauucuucugaguagau

SEQ ID NO: 66719 - RNA, 42 nt, Mus musculus
aacuucuucacaguuugccaauuucuuguuccuacagcagau

SEQ ID NO: 66720 - RNA, 41 nt, Mus musculus
gacagccaggguuugggcagagaauuaauuguuggggguug

SEQ ID NO: 66721 - RNA, 41 nt, Mus musculus
gagcuccucuaccaucacaggcaaagaacauacuccagugg

SEQ ID NO: 66722 - RNA, 41 nt, Mus musculus
gcagcuggaggaaaagcgcagagcuauugaagcccagaaga

SEQ ID NO: 66723 - RNA, 38 nt, Mus musculus
gcuggugaggaagagucagccaaacuacaggaggauau

SEQ ID NO: 66724 - RNA, 45 nt, Mus musculus
cggguugauggucagccacgaggugcaauaggagcauggccagau

SEQ ID NO: 66725 - RNA, 45 nt, Mus musculus
aggagcuuccacauuuaguccgucccauccuuuguugccacugag

SEQ ID NO: 66726 - RNA, 79 nt, Mus musculus
cucagcuugauacaaguuuuuaauagucucuuucaguuauaugccuuuguuuuauuacuuuuacauugauugacagguu

SEQ ID NO: 66727 - RNA, 44 nt, Mus musculus
auacugcaaccagaaguuguaugauuuguguucgaagcuuuggg

SEQ ID NO: 66728 - RNA, 45 nt, Mus musculus
gccuagaacuugcuauguagaccaggcuggacuugaacucagaga

SEQ ID NO: 66729 - RNA, 46 nt, Mus musculus
uggccuuuuaaauuuuuuuuauuuuuguguuuuugagacaggguau

SEQ ID NO: 66730 - RNA, 70 nt, Mus musculus
auauaaaguggguguccuuauggccagagccuugaguccucuuacucaagcuguaaucaaagaagucaaa

SEQ ID NO: 66731 - RNA, 46 nt, Mus musculus
ugagagaauauuuuaaaacagaaacauaguuuuagaauguggagau

SEQ ID NO: 66732 - RNA, 44 nt, Mus musculus
aaacaaaauggcauaaauggaggucuaguagaaaccaaguaaaa

SEQ ID NO: 66733 - RNA, 45 nt, Mus musculus
aguagaaaaaaaaaaaaaggaaucuuccagaaaauagaacagaaa

SEQ ID NO: 66734 - RNA, 45 nt, Mus musculus
accugcaggugaacaaauggcuuccucacauuuggcuggccuugg

SEQ ID NO: 66735 - RNA, 42 nt, Mus musculus
uuugauugcuuggguccuguagcuucauuauuuggcccagau

SEQ ID NO: 66736 - RNA, 42 nt, Mus musculus
uucucccacugaggguacagguggacugcagagagggcuguc

SEQ ID NO: 66737 - RNA, 41 nt, Mus musculus
ugcaguguggugugaucuuccagcaucauguaauggucaga

SEQ ID NO: 66738 - RNA, 46 nt, Mus musculus
aagcuggccuugaguuccuggcauuuuuccggucuuagccacagug

SEQ ID NO: 66739 - RNA, 46 nt, Mus musculus
cacaucaagcauuuauacuuaaguuucuagaaacaaacugccagaa

SEQ ID NO: 66740 - RNA, 46 nt, Mus musculus
aagguacuuauauauaaugcuuguucaugauuuuuugcugauaguu

SEQ ID NO: 66741 - RNA, 42 nt, Mus musculus
uuggcuuacacuuccacaccacuguucauuauugaaggaagu

SEQ ID NO: 66742 - RNA, 42 nt, Mus musculus
uccuaguuaggguugcuauuguuuugaugaagcaccaugacc

SEQ ID NO: 66743 - RNA, 46 nt, Mus musculus
aaaugggucucuugagguggccaggacauuauauacaccccugaua

SEQ ID NO: 66744 - RNA, 43 nt, Mus musculus
cucugccuccagagugcugggauuaaaggcgugcgacaccaca

SEQ ID NO: 66745 - RNA, 46 nt, Mus musculus
ugcccuggaaacagccuauagacaaagcuggcuuugaacucaggga

SEQ ID NO: 66746 - RNA, 46 nt, Mus musculus
gguuguggauacuuauuuucuacucaucuucaucucucaaguguuu

SEQ ID NO: 66747 - RNA, 45 nt, Mus musculus
auuauacuacaaaccucugguaacaugugauucccuuuacuagaa

SEQ ID NO: 66748 - RNA, 46 nt, Mus musculus
aggauuagggggucacgaguuaaugcauuuuaauucagaaggaagu

SEQ ID NO: 66749 - RNA, 46 nt, Mus musculus
uggggauuccuuuggugugugugcguggggucacuuuugaauagga

SEQ ID NO: 66750 - RNA, 62 nt, Mus musculus
acauacacacacaaaugaauaaauauuguuacuauugagacaggguuucucuguguaguuuu

SEQ ID NO: 66751 - RNA, 142 nt, Mus musculus
gcaugaagaccagaguugaaacccauauuaaaaaggucagauauggagcuggcaagauggcucagcagauaaaagaugcuugcugccaacuuugacaaccugaguuuguaggugccuaggaccuacauaauggaaagagaga

SEQ ID NO: 66752 - RNA, 42 nt, Mus musculus
gauagcuuagauaauuaagugcuuguuaggcauggggcuggg

SEQ ID NO: 66753 - RNA, 42 nt, Mus musculus
uuuguucagacuacugguucaugaguuuagauuguggcucua

SEQ ID NO: 66754 - RNA, 46 nt, Mus musculus
gcaucuggaugcuucacugacaacuuaguuugucuggguggccaua

SEQ ID NO: 66755 - RNA, 104 nt, Mus musculus
gcaccugacugguuuaguuuuauucuaguaccagauuacuugugagaucugguugccucaucaaauaauggagaaaaugggcuuuaagguuuuagaauuauuaa

SEQ ID NO: 66756 - RNA, 46 nt, Mus musculus
cuggcauguggagauaguuuacuuagauucuguuuccuuaacaggg

SEQ ID NO: 66757 - RNA, 45 nt, Mus musculus
cuauggaguuuccuauguagaccagucugacuuugaacucccaga

SEQ ID NO: 66758 - RNA, 46 nt, Mus musculus
uacagauuguauagaaaccaucaucuccuuugguuaauuccuguug

SEQ ID NO: 66759 - RNA, 42 nt, Mus musculus
gggucagaaaagggacugacaugcugggggaugagagcagag

SEQ ID NO: 66760 - RNA, 42 nt, Mus musculus
uguacuuggugcgagccaggugagagguucucagcgguccgc

SEQ ID NO: 66761 - RNA, 45 nt, Mus musculus
cucccagugcugggagaggaaagcaacaguaacuaugccccucag

SEQ ID NO: 66762 - RNA, 41 nt, Mus musculus
uaggcuggacauagugucagaguucuccaaacugggacaca

SEQ ID NO: 66763 - RNA, 42 nt, Mus musculus
ccacagugguggcuucggggguggcuuugucccagugcaguc

SEQ ID NO: 66764 - RNA, 45 nt, Mus musculus
gguguaggguccuggcagaaacguggaaguauccuucggaccagg

SEQ ID NO: 66765 - RNA, 41 nt, Mus musculus
gaccgcggagagacuucggggcugggccuggggcugggccu

SEQ ID NO: 66766 - RNA, 41 nt, Mus musculus
ucccuggggaggcugccaccaugcaaccaggaagaggcaga

SEQ ID NO: 66767 - RNA, 46 nt, Mus musculus
gugugugguaguaugugcuuuuaaucccaguacuuggauggcagaa

SEQ ID NO: 66768 - RNA, 46 nt, Mus musculus
gcuauugcagauugauacugcgggcugcauggaggugguucgagag

SEQ ID NO: 66769 - RNA, 45 nt, Mus musculus
auaagcagagacgcaagagacaggcucuacaucgcaggcuccuua

SEQ ID NO: 66770 - RNA, 46 nt, Mus musculus
uaaagugucccucuguuuccacacauuuccagcuacaucagaagau

SEQ ID NO: 66771 - RNA, 42 nt, Mus musculus
cagugguggcucaugacuaauccuagcauuuaggaagcagag

SEQ ID NO: 66772 - RNA, 45 nt, Mus musculus
ugcuucaagcuguugccaaguauggggcgcaggacugguuuaaaa

SEQ ID NO: 66773 - RNA, 54 nt, Mus musculus
gccugcagaaauuccagcaguacaacaaaacccugaaacgcaaggaguggacag

SEQ ID NO: 66774 - RNA, 45 nt, Mus musculus
ugggguaaagacuaggaccugggagaccuuagaagggugggagga

SEQ ID NO: 66775 - RNA, 51 nt, Mus musculus
ucugagcauccaagcaucaguaagcaggaauggagcacagaagaaguagag

SEQ ID NO: 66776 - RNA, 49 nt, Mus musculus
ucuccagugaguuggaaaggcaggcccuggagaagcagauuaaggaagc

SEQ ID NO: 66777 - RNA, 47 nt, Mus musculus
gaggaggcuggagggaagauucugagucuccguagguacccuggagg

SEQ ID NO: 66778 - RNA, 42 nt, Mus musculus
cugcugccaucuagccugggacccucuaagcaauggugaauc

SEQ ID NO: 66779 - RNA, 42 nt, Mus musculus
ggccaggugugguagcacuugccuauaauuuuagcaccuggg

SEQ ID NO: 66780 - RNA, 41 nt, Mus musculus
cucaagacugaaauagccacuggguuugcagcagggcagau

SEQ ID NO: 66781 - RNA, 28 nt, Mus musculus
cagaggucgaguacuccacaguaacuac

SEQ ID NO: 66782 - RNA, 45 nt, Mus musculus
ggaacauugguuuguucaugcauucuuaacagauuuggccaaaaa

SEQ ID NO: 66783 - RNA, 46 nt, Mus musculus
ggcaucuuguucccagaggccaccagguugcaguagcugaccuacu

SEQ ID NO: 66784 - RNA, 46 nt, Mus musculus
gagcaaacugagccaggcaugguggcucuugcuaguaaucccagau

SEQ ID NO: 66785 - RNA, 44 nt, Mus musculus
uaauuuauggcuuccuuuguguuuugaggggcagaccagcgaga

SEQ ID NO: 66786 - RNA, 47 nt, Mus musculus
aagaggaagggaaagagaguuaaauauuuaaaaaucagcagguagaa

SEQ ID NO: 66787 - RNA, 46 nt, Mus musculus
cgacucacuggcucacccauaucacuucaaggagcugccaccacau

SEQ ID NO: 66788 - RNA, 46 nt, Mus musculus
gucacuggggagagccccagggagcugauauucugaagcugcugau

SEQ ID NO: 66789 - RNA, 46 nt, Mus musculus
ugguuaugagucauuaugugggugcugggaauugaacccaggugau

SEQ ID NO: 66790 - RNA, 46 nt, Mus musculus
cccauuccugcacaggaugcaugguuuucccagguuagccauagau

SEQ ID NO: 66791 - RNA, 45 nt, Mus musculus
gcuuggagcaauggagcaugcugaucuucaugucuguaucuugug

SEQ ID NO: 66792 - RNA, 28 nt, Mus musculus
uuacccuccaaaccagauggcucccaag

SEQ ID NO: 66793 - RNA, 24 nt, Mus musculus
aaggugcaaaggaccaaaggcuug

SEQ ID NO: 66794 - RNA, 42 nt, Mus musculus
ucuaccagaugacaagaacaaaucagugaguauuguccagau

SEQ ID NO: 66795 - RNA, 46 nt, Mus musculus
gaucucuauauuugagaccaguauguucugcuagaaaguucccaga

SEQ ID NO: 66796 - RNA, 42 nt, Mus musculus
uggagggaggcuccacacccgaagcagcuuuccuugggaguu

SEQ ID NO: 66797 - RNA, 46 nt, Mus musculus
uauggacccccaggaucugcacuuggcuucccagaauccuccagau

SEQ ID NO: 66798 - RNA, 42 nt, Mus musculus
ccagccgccgcagcagccucagcucccauucacaccaggugu

SEQ ID NO: 66799 - RNA, 41 nt, Mus musculus
ugggaccggagguacugguaugacucugaacaugacccaua

SEQ ID NO: 66800 - RNA, 46 nt, Mus musculus
uuagcaggggauguccaaccacugccugugcccaugcagccaagua

SEQ ID NO: 66801 - RNA, 47 nt, Mus musculus
gagaaggcaagaggcauguggaucuguuugcuggagugcagaaggga

SEQ ID NO: 66802 - RNA, 49 nt, Mus musculus
gagcaacagagacagagacagagacagacauacuuaauugugagaaaau

SEQ ID NO: 66803 - RNA, 46 nt, Mus musculus
gucagaaggagccuuagaaacaggguuguagcagcuaggccagauc

SEQ ID NO: 66804 - RNA, 46 nt, Mus musculus
guaugaugccuaccagucucaguacccuucaccguacccgucagau

SEQ ID NO: 66805 - RNA, 45 nt, Mus musculus
gcuggugccuccucggccacagaauucuccccaagugccccaagc

SEQ ID NO: 66806 - RNA, 42 nt, Mus musculus
guacuuugguuccuaacaguaauaaggcaaagcacucuagua

SEQ ID NO: 66807 - RNA, 46 nt, Mus musculus
acugaauccuaaugagaagaaucaguccuggggagaugcuguggug

SEQ ID NO: 66808 - RNA, 45 nt, Mus musculus
ccaguaaaaucccacuugguuggagugaaaccaguugaagcagau

SEQ ID NO: 66809 - RNA, 45 nt, Mus musculus
ccgugagacccugaguguggaucccuucccccugagugaucagau

SEQ ID NO: 66810 - RNA, 45 nt, Mus musculus
ugaggcugcgcaggaaggagaugcgcaaccuuauuuuucgcaguc

SEQ ID NO: 66811 - RNA, 38 nt, Mus musculus
ucucucaauguuuuuucaaggggaagagacagagaaug

SEQ ID NO: 66812 - RNA, 45 nt, Mus musculus
ucaaucccuucacucagggaaauaguccugaaaaccaggcgcauc

SEQ ID NO: 66813 - RNA, 42 nt, Mus musculus
gaauugggaauaugugggcaagcccagaguugaagcagaauc

SEQ ID NO: 66814 - RNA, 44 nt, Mus musculus
aaugcaccaguggcucccauaacacgcccauugcagccaguaac

SEQ ID NO: 66815 - RNA, 46 nt, Mus musculus
cuugaaagaauauauggccaaaaucuuaauagugaauucagaagac

SEQ ID NO: 66816 - RNA, 46 nt, Mus musculus
aauguucaaguugcaagauuauuucaccugaaacaggcauauugug

SEQ ID NO: 66817 - RNA, 45 nt, Mus musculus
aacauuuaaaggguuccggcucagauuuugacuuagaagggaggu

SEQ ID NO: 66818 - RNA, 46 nt, Mus musculus
aaacagggaguagcagcguuuauuuguaaucucuuggccggcggag

SEQ ID NO: 66819 - RNA, 45 nt, Mus musculus
aucacugcuguguuugguucuuuuucuauaaaugaacucucagaa

SEQ ID NO: 66820 - RNA, 42 nt, Mus musculus
caagcugguggacacuugcuaccaguccaugagggccaccuu

SEQ ID NO: 66821 - RNA, 46 nt, Mus musculus
gaugcaugugguagucaggguagagucagagguuaaagggcugugg

SEQ ID NO: 66822 - RNA, 46 nt, Mus musculus
uccccgugguguacucgucuuucucuuccuucuacaaugucaagac

SEQ ID NO: 66823 - RNA, 42 nt, Mus musculus
ccuggacaugauggguaggcugccaucaaggcuuggccacag

SEQ ID NO: 66824 - RNA, 46 nt, Mus musculus
agcagcaagaguuuccugggacugggacagucggagucagggguua

SEQ ID NO: 66825 - RNA, 45 nt, Mus musculus
agcauggaaauaaaauuguuuacauuuuuggaugauuugagguuu

SEQ ID NO: 66826 - RNA, 41 nt, Mus musculus
cgugccucccuggccuaggccagccaagcuuggguugcaga

SEQ ID NO: 66827 - RNA, 46 nt, Mus musculus
uggagaucaggcuagguuguccugcaaugggggcugcccgagagaa

SEQ ID NO: 66828 - RNA, 45 nt, Mus musculus
cucaggucaaacagugugccaagcccuuaaggacuugccgaaagu

SEQ ID NO: 66829 - RNA, 57 nt, Mus musculus
aaaggggugcugccaguguggaagcuaguacagaauuguaucgaggauaaggaaaga

SEQ ID NO: 66830 - RNA, 46 nt, Mus musculus
gcacugaaucaggugagagaggauugaucccaaaagucagaggcag

SEQ ID NO: 66831 - RNA, 44 nt, Mus musculus
uguauuucaggaugcacagggaggucauuaucaugagccacuug

SEQ ID NO: 66832 - RNA, 45 nt, Mus musculus
augguuuucuguuggcucugaguggaauacgcaggauguguacau

SEQ ID NO: 66833 - RNA, 45 nt, Mus musculus
auuaugagaugcacguucgagcagccaacaucgugagugugggau

SEQ ID NO: 66834 - RNA, 45 nt, Mus musculus
ggaaagcagagggaaugugacucaccugaccggugcggguaggag

SEQ ID NO: 66835 - RNA, 46 nt, Mus musculus
gccaaguccccaggccaaaagcaguagcagggauuaaaagcaggaa

SEQ ID NO: 66836 - RNA, 45 nt, Mus musculus
caggguccuccucggccccacuccacuccgggcccggcccuccag

SEQ ID NO: 66837 - RNA, 41 nt, Mus musculus
cgccagcaccccagcuugagacuacugcccaacacccgcaa

SEQ ID NO: 66838 - RNA, 48 nt, Mus musculus
agaaaggagggggacccgggaguauugugccuggaaagcgugggaccu

SEQ ID NO: 66839 - RNA, 45 nt, Mus musculus
gucccugccugccuucuacacaagaggaagaagagagaggaccag

SEQ ID NO: 66840 - RNA, 46 nt, Mus musculus
gacuuucugacagaccaacaggaugagaagccggagcauucagaag

SEQ ID NO: 66841 - RNA, 44 nt, Mus musculus
cuaccuugcuccucucugacagaauacucaguccugucccauag

SEQ ID NO: 66842 - RNA, 41 nt, Mus musculus
aucaucacaagcccaagaacuucaguuccuuuaagcagcug

SEQ ID NO: 66843 - RNA, 45 nt, Mus musculus
cacuauauaccacaaaugccauuauuuauuuugauguuuccaaag

SEQ ID NO: 66844 - RNA, 47 nt, Mus musculus
agaaaacaaugauacacauauugguuuggcaaaaguuuucugaagau

SEQ ID NO: 66845 - RNA, 46 nt, Mus musculus
uuggcugcauacagcagagcaaguugacaaaaaucugagcaagcaa

SEQ ID NO: 66846 - RNA, 44 nt, Mus musculus
ggccaagagccaccaccaggagcaggccuccaaucacugacaug

SEQ ID NO: 66847 - RNA, 42 nt, Mus musculus
caugcggaugccauccuccaggaaggugcugaucaggcagag

SEQ ID NO: 66848 - RNA, 26 nt, Mus musculus
acaccccaggccccgccccuccagcc

SEQ ID NO: 66849 - RNA, 46 nt, Mus musculus
aauaauuaaaagcacucuaccacuuggaauauugccagccccagcu

SEQ ID NO: 66850 - RNA, 45 nt, Mus musculus
acagaucuuguuuaauccuuugaggaauaggcuuuuguggguagc

SEQ ID NO: 66851 - RNA, 46 nt, Mus musculus
aggccuccagcaggauccuuguggucaugacauugaguacagggua

SEQ ID NO: 66852 - RNA, 112 nt, Mus musculus
aggggaagagagcaucgcagcccgugugucgaucgugaaccaguaugggaaguguguuuaugacaaguacgucaagccaacugagccagugacugacuacaggacagccguc

SEQ ID NO: 66853 - RNA, 69 nt, Mus musculus
cugguuugaugauguggauccagaugauauugaggaugccauaggcccagaggcagccaugcugguacg

SEQ ID NO: 66854 - RNA, 45 nt, Mus musculus
ggaagauacuaguaccucccacagauaccucuggaacagagcaga

SEQ ID NO: 66855 - RNA, 48 nt, Mus musculus
caaaaugcacccccaaauaauccagcagaacagaaaaaaggccucaga

SEQ ID NO: 66856 - RNA, 45 nt, Mus musculus
accggcgacaggccaccuucaucccgaacuuucugucagguagcc

SEQ ID NO: 66857 - RNA, 45 nt, Mus musculus
ccugggccuaucaggaagcucgcuaggaagaaagccaagaagaag

SEQ ID NO: 66858 - RNA, 46 nt, Mus musculus
uagcucucuacuccauagcugaggaccgcuucucucaccagcggag

SEQ ID NO: 66859 - RNA, 46 nt, Mus musculus
uggccaugaagaucaagccgugguauaaaaacgcaacacccaagaa

SEQ ID NO: 66860 - RNA, 45 nt, Mus musculus
ggcggcggggccgggcgcucuggcgucgcgucggcuagcccuacg

SEQ ID NO: 66861 - RNA, 46 nt, Mus musculus
cuuacauauaauaaauaaauaaauaaauaaauaaauaaaagaauaa

SEQ ID NO: 66862 - RNA, 46 nt, Mus musculus
gaaagauucccaagaaaaagaauaaaaaggggggcuggugagaugg

SEQ ID NO: 66863 - RNA, 93 nt, Mus musculus
ugucucuggcuucuucuccucuguggccauggcucugaagcccacagggcaggacaccgugaagggggagucacaauggaagaggcugucagc

SEQ ID NO: 66864 - RNA, 25 nt, Mus musculus
caugucuuuaaucccaggaagggag

SEQ ID NO: 66865 - RNA, 45 nt, Mus musculus
uuuaucaucagaggcagacacaaggagguuagaaucugaugacca

SEQ ID NO: 66866 - RNA, 46 nt, Mus musculus
uuugaaagaauuguccuuuugcuaaaguuugugucacccccaagaa

SEQ ID NO: 66867 - RNA, 44 nt, Mus musculus
ccaaugagugucuucagacacuggccagaggcggugucccagau

SEQ ID NO: 66868 - RNA, 46 nt, Mus musculus
ccuugcaguacacuauaguagcaaauguguauccccaacuccagga

SEQ ID NO: 66869 - RNA, 32 nt, Mus musculus
ugacugcucugaaaaaucaguaaaccccaaga

SEQ ID NO: 66870 - RNA, 82 nt, Mus musculus
cuggcgcaggaccucacuccagcggagcgcccacggggagcgggucgcggggcagcagcggugaggaggccacgagacuaga

SEQ ID NO: 66871 - RNA, 28 nt, Mus musculus
gagggagagcaugggcugacgaugcuca

SEQ ID NO: 66872 - RNA, 46 nt, Mus musculus
uccuguggugcgacccacuuugaagucacccucagugcauggccag

SEQ ID NO: 66873 - RNA, 42 nt, Mus musculus
ccggcccuuucuuucuucuucucucuuauucuuucccgccau

SEQ ID NO: 66874 - RNA, 46 nt, Mus musculus
ucgugagcagauggauaugauuguaaugacagcagaucccggugag

SEQ ID NO: 66875 - RNA, 42 nt, Mus musculus
gcacugaggguagugagagaaacuugguccaacaaggcccua

SEQ ID NO: 66876 - RNA, 46 nt, Mus musculus
ggaaaguucagcagauauuaagagaacaggacaguggaggguccug

SEQ ID NO: 66877 - RNA, 45 nt, Mus musculus
uacacauuccaagccuccccggggaugcuugaaaccacaguuaua

SEQ ID NO: 66878 - RNA, 44 nt, Mus musculus
ggggguggugauggugcugaugguggugauggugguagugauga

SEQ ID NO: 66879 - RNA, 23 nt, Mus musculus
auugauugaugaucugguucauu

SEQ ID NO: 66880 - RNA, 23 nt, Mus musculus
auuuuccuuccagagggcccugu

SEQ ID NO: 66881 - RNA, 41 nt, Mus musculus
guguugcugagaagaaguggagauugugugacucaggcaag

SEQ ID NO: 66882 - RNA, 45 nt, Mus musculus
acgaaaaccacagguuucugugcuacucgaagaucuuccagcgag

SEQ ID NO: 66883 - RNA, 40 nt, Mus musculus
uuuugguaguugacuaguuuguugauauuuuguuuuugag

SEQ ID NO: 66884 - RNA, 46 nt, Mus musculus
ugguuuucccgaggacuucuccauccugacaaccgugaaagccaag

SEQ ID NO: 66885 - RNA, 44 nt, Mus musculus
gugucuacaagaaaaaugucaccuugauccucgacuguaagaag

SEQ ID NO: 66886 - RNA, 46 nt, Mus musculus
gcuuugggguuugggagcagggacacagcugucacguaaggguguu

SEQ ID NO: 66887 - RNA, 62 nt, Mus musculus
guaguggugauagugaucuacauggugguaugggguugguagugcugaugauagugaaugug

SEQ ID NO: 66888 - RNA, 52 nt, Mus musculus
ucuugguaguguuaaugguggugguggugauccugaugaugguugucuuggu

SEQ ID NO: 66889 - RNA, 52 nt, Mus musculus; identical to SEQ ID NO: 66888

SEQ ID NO: 66890 - RNA, 45 nt, Mus musculus
gauggauggauggauggauggauggauggauggaugggugaaugg

SEQ ID NO: 66891 - RNA, 45 nt, Mus musculus
gggugaacaaaugaauugugugaauggauggauggaugggugagg

SEQ ID NO: 66892 - RNA, 42 nt, Mus musculus
agcagauagguugguggguaaauggauggauggauggaugga

SEQ ID NO: 66893 - RNA, 74 nt, Mus musculus
gugacauccaacaguugcuuuucgucucugacaaccgagcugccuaugacuacugugagcacuacagccccgac

SEQ ID NO: 66894 - RNA, 54 nt, Mus musculus
aguacccagaaggagagggugagaccuauuacuaugaguauccauauuaugaag

SEQ ID NO: 66895 - RNA, 59 nt, Mus musculus
acccugaagacccgggaaaggagccugccccuacucagaagccaguggaagcugccaga

SEQ ID NO: 66896 - RNA, 56 nt, Mus musculus
aggacagucuagggaucggggacuaugacuacgugcccccagaugacuauuacacu

SEQ ID NO: 66897 - RNA, 84 nt, Mus musculus
acuuuggauauggcgaggguguggagaacccugaccagcccaccaaccccgacucaggggcugagguccccaccagcaccacug

SEQ ID NO: 66898 - RNA, 65 nt, Mus musculus
agcuccaggagaagggaaggaugaccugggcggcgaauucaccgaggaaaccaucaagaaucuag

SEQ ID NO: 66899 - RNA, 72 nt, Mus musculus
aggaaaacuacuaugacccguacuuugaccccgacuccgacuccagugucucuccaucagagauagggccag

SEQ ID NO: 66900 - RNA, 41 nt, Mus musculus
gugagaaagggcaaaagggagaaccagccaucauugagccg

SEQ ID NO: 66901 - RNA, 44 nt, Mus musculus
agacuuacuuaagcuuauuguguguagaguuggcaccccaguuc

SEQ ID NO: 66902 - RNA, 27 nt, Mus musculus
cucaauugcucuccacuuuauuuccua

SEQ ID NO: 66903 - RNA, 42 nt, Mus musculus
ccagcugccugucagaggaaaugggaagugggagaugagcag

SEQ ID NO: 66904 - RNA, 42 nt, Mus musculus
agccccuggcugacuuugacauaggcuaccucccacccccag

SEQ ID NO: 66905 - RNA, 47 nt, Mus musculus
cugguccuucuggcccgcccggaaucccaggagaugauggagaaagg

SEQ ID NO: 66906 - RNA, 45 nt, Mus musculus
ugcuugggccaaaaggccccccagggccuccuggaccuccuguaa

SEQ ID NO: 66907 - RNA, 43 nt, Mus musculus
guguaacggguauggauggccagccuggcccaaaaggaaaugu

SEQ ID NO: 66908 - RNA, 45 nt, Mus musculus
ugggccgccaggacagcaggguaauccuggugcccagguaagugu

SEQ ID NO: 66909 - RNA, 44 nt, Mus musculus
uuggucuccuaagaccaauggggucugggggcauggggugaggg

SEQ ID NO: 66910 - RNA, 45 nt, Mus musculus
ccuccuggcccccagggucccauuggcuaccccgguccacgagga

SEQ ID NO: 66911 - RNA, 46 nt, Mus musculus
ucaucucugcuggguucuucuguuuauguuucucuccaccacagag

SEQ ID NO: 66912 - RNA, 43 nt, Mus musculus
ggggcagauggcauccgaggucugaagggcaccaagggggaga

SEQ ID NO: 66913 - RNA, 30 nt, Mus musculus
cggcuucccuggguuuaaaggcgacauggg

SEQ ID NO: 66914 - RNA, 50 nt, Mus musculus
ggaaaucggcccaccugguccccgaggagaagaugguccugaagguccaa

SEQ ID NO: 66915 - RNA, 47 nt, Mus musculus
gcuuggcgugcccggauuaccgggguacccaggaagacaagggccaa

SEQ ID NO: 66916 - RNA, 49 nt, Mus musculus
guuccauuggauucccuggcuucccgggcgccaacggagagaagggugg

SEQ ID NO: 66917 - RNA, 45 nt, Mus musculus
agugguccugggucucacagguguggaauaugcugcagggguaga

SEQ ID NO: 66918 - RNA, 42 nt, Mus musculus
uggggagaguucugaagguaguucugguuucaugugggagag

SEQ ID NO: 66919 - RNA, 41 nt, Mus musculus
ggacaccuggaaagccaggaccacggggacagagaggccca

SEQ ID NO: 66920 - RNA, 42 nt, Mus musculus
agggcccgcggggugaacgaggcccacgaggcaucacgggga

SEQ ID NO: 66921 - RNA, 45 nt, Mus musculus
cagggcaacuccggaggugauggcccagcuggcccuccuggugaa

SEQ ID NO: 66922 - RNA, 45 nt, Mus musculus
agggcccaccaggcaaggacggacucccuggacacccugggcaga

SEQ ID NO: 66923 - RNA, 46 nt, Mus musculus
cuccaggcccuccuggugaacagggccucccaggugcugcugggaa

SEQ ID NO: 66924 - RNA, 44 nt, Mus musculus
gggugacccagguccugcuggccucccugggaaggauggcccuc

SEQ ID NO: 66925 - RNA, 42 nt, Mus musculus
gggagaccugggccucagggaccuccggggccugcuggagag

SEQ ID NO: 66926 - RNA, 45 nt, Mus musculus
ucccuggaccagccggcccaguggguccuccuggagaagauggag

SEQ ID NO: 66927 - RNA, 33 nt, Mus musculus
cucaaggcccgauuggacagccaggcccuucgg

SEQ ID NO: 66928 - RNA, 76 nt, Mus musculus
gugaaccuggcccucguggacagcagggccuguuugggcagaaaggagaugaagguucaagagguuucccaggacc

SEQ ID NO: 66929 - RNA, 44 nt, Mus musculus
acaggguuugccaggaccuccaggagaaaagggcgagacaggag

SEQ ID NO: 66930 - RNA, 46 nt, Mus musculus
accacaggguccuccuggagggauuggcaacccuggugcagucgga

SEQ ID NO: 66931 - RNA, 42 nt, Mus musculus
acauaugcguucgugugugugugugugugugugugugcgcgc

SEQ ID NO: 66932 - RNA, 42 nt, Mus musculus
ugcccauucgaucuccaauccccacagccuccuuccauccag

SEQ ID NO: 66933 - RNA, 46 nt, Mus musculus
cucagggagaaccuggugaagcuggagauccuggccuuccaggaga

SEQ ID NO: 66934 - RNA, 80 nt, Mus musculus
gaggggagaagggagaggcuggccccucuggugcugcuggacccccuggacccaaaggcccuccuggagaugauggcccc

SEQ ID NO: 66935 - RNA, 46 nt, Mus musculus
ggcuuuccuggagauccuggucccccuggagagccaggccccgcag

SEQ ID NO: 66936 - RNA, 42 nt, Mus musculus
ggcccaccuggugacaaaggggacgauggugaaccugggcag

SEQ ID NO: 66937 - RNA, 45 nt, Mus musculus
cccccaggcccugcaggcccugaaggcaggcagggggagaaagga

SEQ ID NO: 66938 - RNA, 45 nt, Mus musculus
uauguguauauugugucugcaugugugguucugugguuguaugug

SEQ ID NO: 66939 - RNA, 45 nt, Mus musculus
caugccaucugcauaauccacguagcucuccccagccccaucguc

SEQ ID NO: 66940 - RNA, 77 nt, Mus musculus
gacgauggggcuggggagagcuacguggauuaugcagauggcauggaagagaucuuugguucccucaacucccugaa

SEQ ID NO: 66941 - RNA, 42 nt, Mus musculus
cagaugaagcgaccacugggcacccagcagaacccagcccgu

SEQ ID NO: 66942 - RNA, 34 nt, Mus musculus
gcucuagaacaguuuucaccccaugucaccccag

SEQ ID NO: 66943 - RNA, 91 nt, Mus musculus
ugaaggcaaccccgugggcgugguacaaaugaccuuccugcggcugcugagcgccucugcccaccagaacgucaccuacaacugcuaccag

SEQ ID NO: 66944 - RNA, 80 nt, Mus musculus
agaggcgagguauagaacagaaguacacuggggggaggggggaggagaaagcagcccccuccugguuuuaguucgggaaa

SEQ ID NO: 66945 - RNA, 79 nt, Mus musculus
cggugcuggagaucgacacgcccaaaguagagcaaguccccauuguggacaucauguucaacgacuuuggcgaagccuc

SEQ ID NO: 66946 - RNA, 42 nt, Mus musculus
ugugcacggcccaucccggacagugaacauuucucaccccug

SEQ ID NO: 66947 - RNA, 42 nt, Mus musculus
agccguguccccacggagccgaaucacaugaccuagccacac

SEQ ID NO: 66948 - RNA, 46 nt, Mus musculus
guguuaauggaccguuggccgggagugggggcgggacaguauuuga

SEQ ID NO: 66949 - RNA, 43 nt, Mus musculus
uuuuuuuuaaaacaacccucaacacauccacucagaggccaaa

SEQ ID NO: 66950 - RNA, 65 nt, Mus musculus
auguuaagugugccuggcuuucagucuugcauggaaacccagccuuaggcccaugggggcagcgg

SEQ ID NO: 66951 - RNA, 46 nt, Mus musculus
gggcucgaaauccggcucucgguagagggcaucgccuuacccccac

SEQ ID NO: 66952 - RNA, 50 nt, Mus musculus
aaggcauuugauauccugccuuuccuacagcacucagauuaaaacacagg

SEQ ID NO: 66953 - RNA, 46 nt, Mus musculus
uccuuguuccuuccugcagaggcugaugggacaguguccagggcug

SEQ ID NO: 66954 - RNA, 43 nt, Mus musculus
guugcugaauguuuguggugcuaaucucugugugugugccaag

SEQ ID NO: 66955 - RNA, 47 nt, Mus musculus
ggcuugagaaaugugggauggacucuggcuccagggucgcugagcug

SEQ ID NO: 66956 - RNA, 46 nt, Mus musculus
cacagagagucacucuggugcuuguguccccaccccaccccugaag

SEQ ID NO: 66957 - RNA, 46 nt, Mus musculus
gugagccagggacugcugugcaugccucugcaugagaaaaagccau

SEQ ID NO: 66958 - RNA, 47 nt, Mus musculus
acgguacauuguauauuucccagcagucuaaacuaagccucagauuu

SEQ ID NO: 66959 - RNA, 46 nt, Mus musculus
cguuguaacagugucucaauaaagcaguuuacuguuuacaccccag

SEQ ID NO: 66960 - RNA, 45 nt, Mus musculus
aagaccucaccuggaagccuugcagagcaucagccuacaccugag

SEQ ID NO: 66961 - RNA, 46 nt, Mus musculus
ccacagagccugagaccccagugagcacgaagcugaccgcccacag

SEQ ID NO: 66962 - RNA, 46 nt, Mus musculus
cagaagcgauccuggacaucuccaagaccauucugccagcccccau

SEQ ID NO: 66963 - RNA, 46 nt, Mus musculus
aaguguguucggucagcugcccaguugugccaaagugggugccgag

SEQ ID NO: 66964 - RNA, 26 nt, Mus musculus
ucuugccugaugugugugcaugcaug

SEQ ID NO: 66965 - RNA, 42 nt, Mus musculus
gagugugccuguguguuaggcagcauaggguggaaguagggg

SEQ ID NO: 66966 - RNA, 46 nt, Mus musculus
cacccggacuuggacacuauauuuuauguucaguuucccaggagau

SEQ ID NO: 66967 - RNA, 41 nt, Mus musculus
aacgcuugacuucacuaauuggccuucgagugcccgggcaa

SEQ ID NO: 66968 - RNA, 48 nt, Mus musculus
ucccuuuccacgaguaagaagacaacuugcugaggccucgggugugaa

SEQ ID NO: 66969 - RNA, 45 nt, Mus musculus
guagucgcuggucuucucuggggcaggcuuagccuugggcucccc

SEQ ID NO: 66970 - RNA, 46 nt, Mus musculus
gagguuuuucuucagacauuuggccucccgcaggaaacuagcccag

SEQ ID NO: 66971 - RNA, 68 nt, Mus musculus
augcccuugcgguaggccacgugcgcggugaaguucaaagccaguuggagauucaaggcugucugauc

SEQ ID NO: 66972 - RNA, 46 nt, Mus musculus
uaggacuguggugcugaugcugaggacagggaguggggacacagac

SEQ ID NO: 66973 - RNA, 46 nt, Mus musculus
uggauuuuauugguggagaaacuaaguuaaaaauaaaggucuagga

SEQ ID NO: 66974 - RNA, 44 nt, Mus musculus
augggaaucaagaacaacgccguauggacccguccccggguagc

SEQ ID NO: 66975 - RNA, 41 nt, Mus musculus
guucccacagcaaggaauuugaggacauccuccuccuucau

SEQ ID NO: 66976 - RNA, 40 nt, Mus musculus
ucgcuggccaguguuccuggaggagaugacgcugacauca

SEQ ID NO: 66977 - RNA, 45 nt, Mus musculus
ugacauaagaggccucugugaguggcugauggucagcccugggau

SEQ ID NO: 66978 - RNA, 66 nt, Mus musculus
ucaggcaugaccucccaggggugcucacgggagauaguaccucgcaugcggaguacuucccuggcc

SEQ ID NO: 66979 - RNA, 45 nt, Mus musculus
gcugugggagcugcugaccaauccucaguggcuggcugugcacuc

SEQ ID NO: 66980 - RNA, 46 nt, Mus musculus
aaaggguugggggaagaugagauaacgcuccaggccaaggagagga

SEQ ID NO: 66981 - RNA, 41 nt, Mus musculus
aauuuccaaguaaguuaaucagcuagcagcaagccccagag

SEQ ID NO: 66982 - RNA, 46 nt, Mus musculus
caaggauaccuuacuguaagcauaaacacaaggguuaagagaaaga

SEQ ID NO: 66983 - RNA, 28 nt, Mus musculus
gaggguacuguaaccuguaaacaagaag

SEQ ID NO: 66984 - RNA, 45 nt, Mus musculus
cagaaacuugaccacuuuauacacacucaaacugaacaccaggag

SEQ ID NO: 66985 - RNA, 40 nt, Mus musculus
cuuccucggaaaccuaggaagucuguagaucuaucgagag

SEQ ID NO: 66986 - RNA, 44 nt, Mus musculus
ccucaggcugucucagcuaccuguaaggggcccuggaggcuccc

SEQ ID NO: 66987 - RNA, 45 nt, Mus musculus
cucagagcuaagagccacacacaggcggugggaaagccccuagcc

SEQ ID NO: 66988 - RNA, 25 nt, Mus musculus
aaccagacucaggauggggauggga

SEQ ID NO: 66989 - RNA, 46 nt, Mus musculus
aucagaccaccucacaauacugagugugggccccuuugcaccagau

SEQ ID NO: 66990 - RNA, 46 nt, Mus musculus
cgcuuacaaagccuaaacuuccauucaaugagggcaaagggcaguc

SEQ ID NO: 66991 - RNA, 45 nt, Mus musculus
gagguggcucuggaacugguucuagcucaggagcuggugccacca

SEQ ID NO: 66992 - RNA, 23 nt, Mus musculus
agcaguggcccugccugcucacc

SEQ ID NO: 66993 - RNA, 46 nt, Mus musculus
ucugggcucuccuaggguucaucuccaguguggcaaacuuggaggu

SEQ ID NO: 66994 - RNA, 45 nt, Mus musculus
uagagauaguccuucauggcaguguccagcaucaccaggucagug

SEQ ID NO: 66995 - RNA, 46 nt, Mus musculus
aggagacucugggacgaagcucauguugaucuccuccacaucagag

SEQ ID NO: 66996 - RNA, 46 nt, Mus musculus
ggcugacccugaugaugcagcagucgcccaccugcugguuguagag

SEQ ID NO: 66997 - RNA, 45 nt, Mus musculus
aaggacacugagcaagagaggcccuaucccaacucggcccccaac

SEQ ID NO: 66998 - RNA, 50 nt, Mus musculus
gaguugggauagggccucucuugcucaguguccuugcugggguggguggu

SEQ ID NO: 66999 - RNA, 46 nt, Mus musculus
uucguucuggccgaaauuugaaagugggggaaacccagcguaaucg

SEQ ID NO: 67000 - RNA, 42 nt, Mus musculus
ucccccucuggguucugccuggcuccuuaaaagcgcacacca

SEQ ID NO: 67001 - RNA, 88 nt, Mus musculus
agacgacgauucaggucacuguaaaaugaaccguuacgauaagaagauugacagucuaaugaacgcggucgguugucucaaaucugag

SEQ ID NO: 67002 - RNA, 47 nt, Mus musculus
gaugcagaaaggugaacgccaaauggccaaaagguuccuggaggaga

SEQ ID NO: 67003 - RNA, 52 nt, Mus musculus
auacgcucgauguugugucugagcaccguguucucaugcuccgucucugcaa

SEQ ID NO: 67004 - RNA, 45 nt, Mus musculus
agagacggagcaugagaacacggugcucagacacaacaucgagcg

SEQ ID NO: 67005 - RNA, 42 nt, Mus musculus
agcaggagaaggaaugccucauguccaaacuaguggaggcug

SEQ ID NO: 67006 - RNA, 46 nt, Mus musculus
ucuaugccaggacaguuaaaggugaggugagauguuuauguagaag

SEQ ID NO: 67007 - RNA, 46 nt, Mus musculus
ccuuauuccagagcaacuccugcugacccccuuccuauccccagga

SEQ ID NO: 67008 - RNA, 45 nt, Mus musculus
ccagggcucggcucucggaggcuuuacauaggcagcugcagguag

SEQ ID NO: 67009 - RNA, 45 nt, Mus musculus
acacucaucaguuugacaagcuaaguaguaaggauucugucagau

SEQ ID NO: 67010 - RNA, 42 nt, Mus musculus
uaucuuggauaaucaaggagggcuccuuagaacaggggggag

SEQ ID NO: 67011 - RNA, 46 nt, Mus musculus
gccacugcauaggcacucaggaaggagagcuagccgggcugcuaag

SEQ ID NO: 67012 - RNA, 35 nt, Mus musculus
aggugaccuaaagggacaugaagaaagcugaagac

SEQ ID NO: 67013 - RNA, 37 nt, Mus musculus
cugcgagccugucauugaaaggaggccucggcugcag

SEQ ID NO: 67014 - RNA, 46 nt, Mus musculus
uuaaaaaaaaaaaagagcacuggcugcucuuccagaggaccccagg

SEQ ID NO: 67015 - RNA, 67 nt, Mus musculus
gcagcgagagagcuacacagagaaaggaggaggagaaagagaaugaggaggaggaagaggaggagga

SEQ ID NO: 67016 - RNA, 46 nt, Mus musculus
cagcacauuagcuggagaugcugggauggagggaauguguggggag

SEQ ID NO: 67017 - RNA, 42 nt, Mus musculus
gggguuccauuccauguccucccuugcagccuauacugugag

SEQ ID NO: 67018 - RNA, 45 nt, Mus musculus
gcuccuuggggguaggggaguacccagcagacaaauagcauggga

SEQ ID NO: 67019 - RNA, 45 nt, Mus musculus
cuccugagugcugggauuaaaggugugcaccaccaugucuggcuc

SEQ ID NO: 67020 - RNA, 45 nt, Mus musculus
ggagccagacaugguggugcacaccuuuaaucccagcacucagga

SEQ ID NO: 67021 - RNA, 46 nt, Mus musculus
aacuguacacucgagguagccaggccagggguuguguagugucuag

SEQ ID NO: 67022 - RNA, 46 nt, Mus musculus
agcccucaggagagaaguagacagaacccccccugccaccccuaaa

SEQ ID NO: 67023 - RNA, 43 nt, Mus musculus
gaggaagaaggcagcagccagguugucuaggguugcuggagag

SEQ ID NO: 67024 - RNA, 45 nt, Mus musculus
cagcaaccccuuugaccgagggccgacucgaaaccuggcccacuu

SEQ ID NO: 67025 - RNA, 45 nt, Mus musculus
ccagguuucgagucggcccucggucaaagggguugcuggugcgcu

SEQ ID NO: 67026 - RNA, 45 nt, Mus musculus
cucccugcugcuuuaucuggcugugucacucauggaccccggcua

SEQ ID NO: 67027 - RNA, 42 nt, Mus musculus
cuaggaaggugccagccagccuguuuaagcccauggcaguga

SEQ ID NO: 67028 - RNA, 46 nt, Mus musculus
cugggcucuaccuguccuucccagaaauugccucccaaccccuccc

SEQ ID NO: 67029 - RNA, 45 nt, Mus musculus
gaaaauuacugggauuaauuaggguccaacuugggaaucaggcgg

SEQ ID NO: 67030 - RNA, 45 nt, Mus musculus
auccucagacacauugaaaucuccauuucuaucucccaccaguuc

SEQ ID NO: 67031 - RNA, 46 nt, Mus musculus
agaugugccugggguggggguaggagguggauuuaagaggccagau

SEQ ID NO: 67032 - RNA, 45 nt, Mus musculus
ggcggugguggugcacaccuuuaaucccagcacucgggagacaaa

SEQ ID NO: 67033 - RNA, 46 nt, Mus musculus
aauaaaaucugaugcccucuucuggcaugcaggcaaacaagcagau

SEQ ID NO: 67034 - RNA, 45 nt, Mus musculus
ccagugcccuguggccagugcaccaaaggagacaggaagggacag

SEQ ID NO: 67035 - RNA, 42 nt, Mus musculus
gaaaucgaaucgguugccaucagcaaagagggagucccagau

SEQ ID NO: 67036 - RNA, 78 nt, Mus musculus
agccgcauguugacagugaagucccccuccaguaacugcucccggaucagucugcagggaaacaaggagccacagugc

SEQ ID NO: 67037 - RNA, 49 nt, Mus musculus
cacguuacuucgagucuuggaguuccuuggcuuucuguaggaucuggca

SEQ ID NO: 67038 - RNA, 45 nt, Mus musculus
gugccagcuacuggagccucacuccugcuggccagucucuggaga

SEQ ID NO: 67039 - RNA, 45 nt, Mus musculus
agcacucaacccaaccuggcuaaagcaauggccugggaaggaggc

SEQ ID NO: 67040 - RNA, 44 nt, Mus musculus
acuggggcugagcuaccagcuaccaaguccuaggucugggggcg

SEQ ID NO: 67041 - RNA, 43 nt, Mus musculus
ccaggaauccucaaccccuuggacagcccucaccacaugcguc

SEQ ID NO: 67042 - RNA, 42 nt, Mus musculus
gcggcagcgugcccaagaggaagaggcuaaacgccaggaaga

SEQ ID NO: 67043 - RNA, 45 nt, Mus musculus
ugaacauggccaaaggguugaauggcgaaaauggaaacagcagag

SEQ ID NO: 67044 - RNA, 65 nt, Mus musculus
cacugucucacacuaggagaucuuugaagucguuggacuggacuggguuaggaacuuuuuguaga

SEQ ID NO: 67045 - RNA, 41 nt, Mus musculus
gagggggcucgcgcgccgccgcacggccuggaggguggaga

SEQ ID NO: 67046 - RNA, 46 nt, Mus musculus
uggcccagcuaugagggaguuagagcaauauagcaguaguuaacca

SEQ ID NO: 67047 - RNA, 42 nt, Mus musculus
guuccuggggaaggggaaggguuggucacuagaggcccagug

SEQ ID NO: 67048 - RNA, 42 nt, Mus musculus
cagucaggugugaggaucagguguucuacagagcucugagac

SEQ ID NO: 67049 - RNA, 42 nt, Mus musculus
ugagaggaccuggguucaauucccagcacccacagggcagcu

SEQ ID NO: 67050 - RNA, 42 nt, Mus musculus
agugcugggauuaaaggugugugccaccaccgccgggccuuu

SEQ ID NO: 67051 - RNA, 46 nt, Mus musculus
cagacuccacugugcugcccauggcguucucggcuagcuuugagau

SEQ ID NO: 67052 - RNA, 42 nt, Mus musculus
aggaaguuacccauaaccucccucgugcaccccuacccccag

SEQ ID NO: 67053 - RNA, 47 nt, Mus musculus
ccugccgacgccugacacaggccccacagguaucaaguaugaccuag

SEQ ID NO: 67054 - RNA, 46 nt, Mus musculus
uggugcguggaaacuugaaccagaaguugcuacaggccaggaagau

SEQ ID NO: 67055 - RNA, 45 nt, Mus musculus
ugucggagacagugguggaggagagugaccccaagccagccuuca

SEQ ID NO: 67056 - RNA, 46 nt, Mus musculus
guuguugagguucagcuggcgcagcuuguuuucacucaccucagac

SEQ ID NO: 67057 - RNA, 46 nt, Mus musculus
guucacggacaucaaggagaucccgcuguggaucuacagccugaag

SEQ ID NO: 67058 - RNA, 46 nt, Mus musculus
guagcgguuguucucugcacucagguugcccgucaggugcagcucc

SEQ ID NO: 67059 - RNA, 46 nt, Mus musculus
accaccugcggcagcuugcucagguugcucuugagucgcagcaccu

SEQ ID NO: 67060 - RNA, 110 nt, Mus musculus
ugguuguaccacagcuuaaggcaggugaggcggugcaggugcuggaagcugaugaucuccucaauggucuugagguuguuguccuucaggucaaucuccugcagguugug

SEQ ID NO: 67061 - RNA, 45 nt, Mus musculus
cugccuuaagcugugguacaaccacauugccuacauccccaucca

SEQ ID NO: 67062 - RNA, 75 nt, Mus musculus
cggcaguagaagagcuggguggggauuuucucgauuuuguugcgguucagguagaggcgcucgagguuggugagg

SEQ ID NO: 67063 - RNA, 78 nt, Mus musculus
uggagguucugcaggaggccaaugucggcggggaggaaggucagguuguuguggcugagguccagguagcgcagcuug

SEQ ID NO: 67064 - RNA, 43 nt, Mus musculus
gucgcugcccucgagagugggcgagcugaccaaccugacgcag

SEQ ID NO: 67065 - RNA, 64 nt, Mus musculus
aagaggacuuguucagcacacugccaccugaggugaaggagcggcucuggagagcugacaagga

SEQ ID NO: 67066 - RNA, 46 nt, Mus musculus
uuccucccgcugggacauggacacccaggacaggcacuugcuggag

SEQ ID NO: 67067 - RNA, 46 nt, Mus musculus
ccucagaggccgagccagcaccagaggcccaggaacaguaacuuag

SEQ ID NO: 67068 - RNA, 46 nt, Mus musculus
uuuccacuucccaucuuuucccuccagauaacuuacacauucccaa

SEQ ID NO: 67069 - RNA, 43 nt, Mus musculus
cuccuggggcaggcuuuuauuuuuguuugcuuuuaaggugguu

SEQ ID NO: 67070 - RNA, 46 nt, Mus musculus
aaaaaaccaccuuaaaagcaaacaaaaauaaaagccugccccagga

SEQ ID NO: 67071 - RNA, 63 nt, Mus musculus
uucccagaugaacggugcuccauuccccucccuacccccacaaugccccuccacacacacagu

SEQ ID NO: 67072 - RNA, 46 nt, Mus musculus
gggcuccuuaacacuguguguguggaggggcauuguggggguaggg

SEQ ID NO: 67073 - RNA, 71 nt, Mus musculus
guuaaggagcccagagcagcugcuuccccucccccaacucuguccccacaucauggguuugcucagugcca

SEQ ID NO: 67074 - RNA, 127 nt, Mus musculus
gguuccaggacaguuuguacugggcaccugguuugcacacaguacaguuuagcgucuaguggcgguaagccacucugcuuuagaucaaucacuaggguccccacuuagaaggguccucgccuuagau

SEQ ID NO: 67075 - RNA, 47 nt, Mus musculus
cguuuuagcgucucuugucuuaaugauuaugucugucucuccgucca

SEQ ID NO: 67076 - RNA, 46 nt, Mus musculus
cugacuuguagacucaguucagauaucaaauaaaucuauaacacag

SEQ ID NO: 67077 - RNA, 42 nt, Mus musculus
auacaccuuucuuacauacuacuguauaacuacagccccuuu

SEQ ID NO: 67078 - RNA, 46 nt, Mus musculus
cuuccugaggccaggcuagcccucaagcucccaauuccugugaugu

SEQ ID NO: 67079 - RNA, 45 nt, Mus musculus
ggaguacacuggguuuagacgcauaauuaaauucaacaccucagg

SEQ ID NO: 67080 - RNA, 46 nt, Mus musculus
gugcauuuguaugggaugugugugugaguauggugugugugugugu

SEQ ID NO: 67081 - RNA, 46 nt, Mus musculus
guguguguguggugugugcaugcauauguauguguuuguaugugag

SEQ ID NO: 67082 - RNA, 45 nt, Mus musculus
aaaaaaaaaaaaaaagaacccagguucaauuccagcaccccaaac

SEQ ID NO: 67083 - RNA, 43 nt, Mus musculus
ucacaaccaucuguaacaagaccugauucccuccucugguguc

SEQ ID NO: 67084 - RNA, 45 nt, Mus musculus
ucuuguuacagaugguugugagccaccaugugguugcuggggacc

SEQ ID NO: 67085 - RNA, 45 nt, Mus musculus
uaaaucaaucaaucaaucaaucaaucaaucaaucuuugggccaga

SEQ ID NO: 67086 - RNA, 41 nt, Mus musculus
ugaguguccuguggagugggaguguguccgcaugagugugc

SEQ ID NO: 67087 - RNA, 45 nt, Mus musculus
agggcaaggauguggugagaggagaggagagcagacagggcugga

SEQ ID NO: 67088 - RNA, 46 nt, Mus musculus
uuucaaacaccggauggccacugaugucccaucuccagcccgaggc

SEQ ID NO: 67089 - RNA, 45 nt, Mus musculus
aggacagcuagggcuacacagagaaacccugucuugaaagaacaa

SEQ ID NO: 67090 - RNA, 45 nt, Mus musculus
cccugugaugaugccaguccaaugcuggauggagaugccccagga

SEQ ID NO: 67091 - RNA, 46 nt, Mus musculus
ucucaaaacaaggguaaagaaggcuagggcuauaugucagugcgag

SEQ ID NO: 67092 - RNA, 42 nt, Mus musculus
ucuguaaugggaucugaugcccucuucuggugugcagaagua

SEQ ID NO: 67093 - RNA, 45 nt, Mus musculus
aauaauaaauaaaucuuugaaaaaaaaaaaagaaaaaaaaaagau

SEQ ID NO: 67094 - RNA, 45 nt, Mus musculus
cucacaaccauccguaacaagaacugacucccucuucuggugugu

SEQ ID NO: 67095 - RNA, 40 nt, Mus musculus
acacauugcagagacccuuuccuuguaaggacugggagau

SEQ ID NO: 67096 - RNA, 46 nt, Mus musculus
uggggacacagaucugugcuaggucuccuaagucaguaagaaagga

SEQ ID NO: 67097 - RNA, 46 nt, Mus musculus
ugguccccacagcagcuagccaccuggacaccaagaaucaagagau

SEQ ID NO: 67098 - RNA, 44 nt, Mus musculus
gcagguagauguguguuaggauaagggguccacugucucguuca

SEQ ID NO: 67099 - RNA, 46 nt, Mus musculus
gcaccaccaggcaggccacagaggccagcaaagaccaauaggcaag

SEQ ID NO: 67100 - RNA, 24 nt, Mus musculus
augggggcggggcugggccgcgcg

SEQ ID NO: 67101 - RNA, 42 nt, Mus musculus
guccaguucauacauaggcaguccccccuugucagcccucga

SEQ ID NO: 67102 - RNA, 79 nt, Mus musculus
cugucauugugucagccuauagugcuuccuuuuggcagauuauguaauaugcuguugugugacagacuuuuccugggga

SEQ ID NO: 67103 - RNA, 46 nt, Mus musculus
gauguucauaaccuuuuuuuuucuuaguuuuauuuuauguacauag

SEQ ID NO: 67104 - RNA, 45 nt, Mus musculus
gggcagucaaugcucuuaaccacugagccaucucuacagccccaa

SEQ ID NO: 67105 - RNA, 35 nt, Mus musculus
cuugacaugggucaugggacccaguguaggcccuc

SEQ ID NO: 67106 - RNA, 46 nt, Mus musculus
cagacaguugugaaucaccauguggguguuugggauaagaccuggg

SEQ ID NO: 67107 - RNA, 42 nt, Mus musculus
cagaaucagauugaggcggaacugaauaaauauuggcagcgg

SEQ ID NO: 67108 - RNA, 46 nt, Mus musculus
auccgugcagggguugaaauaucaaagaaucacaugcaagugagag

SEQ ID NO: 67109 - RNA, 87 nt, Mus musculus
gagaacauccagccugcugggcuucagucuuuuguauagagagagagcagagcagagcagagggaaggauuugagcaacaguuuggu

SEQ ID NO: 67110 - RNA, 46 nt, Mus musculus
aguaccggcagcaguuugaggagcuguauagaacagaagcaccaac

SEQ ID NO: 67111 - RNA, 69 nt, Mus musculus
agcgucaggugucgcggugguugguucagugccuccgggaacaguccaugcuguuagaaauuauuuucc

SEQ ID NO: 67112 - RNA, 79 nt, Mus musculus
uuuauuaugcauacuucgagauggcaccaagugaccuauugguacuaaccaagauguucaaggagcaaggguuugguag

SEQ ID NO: 67113 - RNA, 76 nt, Mus musculus
acaucgagucccugcacaaguacgccuuggaugacaggcgagagcugcaccaguuugcucaggauggccucaucug

SEQ ID NO: 67114 - RNA, 42 nt, Mus musculus
uccuccgucacacacugagcccagaagagaccagcagugugg

SEQ ID NO: 67115 - RNA, 42 nt, Mus musculus
uuuucuucuuuacugggauaagaucuuagucuguagcccuag

SEQ ID NO: 67116 - RNA, 42 nt, Mus musculus
ggguugaacgacccuuucacaggggucacugucaggaaacag

SEQ ID NO: 67117 - RNA, 46 nt, Mus musculus
aaaagaaaggggaagaagaaaaagaaauggacuaugaaucccugag

SEQ ID NO: 67118 - RNA, 42 nt, Mus musculus
ugugucuauggucuucucuccuuugcccucaccucacuggag

SEQ ID NO: 67119 - RNA, 29 nt, Mus musculus
cuugacaacacaugaauauuaggcaacag

SEQ ID NO: 67120 - RNA, 42 nt, Mus musculus
ggucuacauaauguguuccaggccagccagggcuacacagag

SEQ ID NO: 67121 - RNA, 47 nt, Mus musculus
ucugcaauugcuccgagcccucgugucagggaaguccacugccaaaa

SEQ ID NO: 67122 - RNA, 46 nt, Mus musculus
ugugcgcgcaagugugugcgcgcgcgugugugugugugcgugugug

SEQ ID NO: 67123 - RNA, 46 nt, Mus musculus
gagcuacacagagaaacccugucucaaaaaaaaaaaaaaauugaaa

SEQ ID NO: 67124 - RNA, 42 nt, Mus musculus
uagcccuccuggaguuuccaucaguaaagcauaagccuaccu

SEQ ID NO: 67125 - RNA, 57 nt, Mus musculus
uucugggcucuuggcucucagcacuccuuauucaccugcaguucuuuguuuaagccu

SEQ ID NO: 67126 - RNA, 46 nt, Mus musculus
ucggcucuccuacuccauuuucuuuuuagauuuacuuauguuuaug

SEQ ID NO: 67127 - RNA, 46 nt, Mus musculus
ugggcugauucuagagcuggcugcugcgugcucaucacagcugcag

SEQ ID NO: 67128 - RNA, 42 nt, Mus musculus
ugcuggucuccgccuggaggauacuucucaucauugcugcca

SEQ ID NO: 67129 - RNA, 44 nt, Mus musculus
cugacauggcagugcggcgccagcuguuucuugaugugcuugau

SEQ ID NO: 67130 - RNA, 46 nt, Mus musculus
ggccuggaggugaggcucagugauaaagaggugccccagcuccuug

SEQ ID NO: 67131 - RNA, 46 nt, Mus musculus
uccagaggccaaaagagggcaauuagaugcccuggaacuagaguua

SEQ ID NO: 67132 - RNA, 47 nt, Mus musculus
cuguguuuuaucgguaauuuaguguuuugauaugugucaugggacgg

SEQ ID NO: 67133 - RNA, 46 nt, Mus musculus
uauuaccaugccuggugauuaagaaagaaaguuggcuggguagaga

SEQ ID NO: 67134 - RNA, 46 nt, Mus musculus
aaugccgugaagacagugcagagucuagccugccuggaggaagcag

SEQ ID NO: 67135 - RNA, 42 nt, Mus musculus
caccacagggcaaggccaccucucucuccaaagccagcccag

SEQ ID NO: 67136 - RNA, 46 nt, Mus musculus
gugggcggaggcugucugaugggccucuuuucccagaaugcaccaa

SEQ ID NO: 67137 - RNA, 42 nt, Mus musculus
ucuugcccauccccuggcucacuuccugagcuugaaaccuag

SEQ ID NO: 67138 - RNA, 84 nt, Mus musculus
augauggauggaggggugaagcagagaccucuacagaccagagucaccaaguggagccuuuuuuuuucuuauuuuaauuucaau

SEQ ID NO: 67139 - RNA, 46 nt, Mus musculus
aggauuuuuauuuuuuacuuuuugccugagacaagccaagugugag

SEQ ID NO: 67140 - RNA, 45 nt, Mus musculus
gccuuugucaaaggcaugggugacuccacagugccggugagaggg

SEQ ID NO: 67141 - RNA, 46 nt, Mus musculus
cacuuuggaaaggacuuccccaaguccgagaagcuaagcccugaug

SEQ ID NO: 67142 - RNA, 79 nt, Mus musculus
uggugcccuugccaaugcccaagaagcugcgguucaacaucacaccugagaucaagaacgacauagagaaagccaaaca

SEQ ID NO: 67143 - RNA, 44 nt, Mus musculus
gagaugguugugagccgccacgugguuugaacucaggaccucug

SEQ ID NO: 67144 - RNA, 45 nt, Mus musculus
uggcucacugaggcuuugaacuuccuuccccuccccgccccccca

SEQ ID NO: 67145 - RNA, 51 nt, Mus musculus
auguguaccacagugacggaacaccgcucaccucagaucagaucuuugugc

SEQ ID NO: 67146 - RNA, 46 nt, Mus musculus
uugggagaugguuagugugaggcaggaaacccugaauagcccaagg

SEQ ID NO: 67147 - RNA, 46 nt, Mus musculus
cucuaggcaguaccagucgcacaggcucaggggaagaugauguuga

SEQ ID NO: 67148 - RNA, 87 nt, Mus musculus
aaugggcugugugauggaggggaagugagucuccuucugugccauguggauggaguguguguguguuguguuguguguguguguggu

SEQ ID NO: 67149 - RNA, 27 nt, Mus musculus
aggcagggaagccuggugguuagaaca

SEQ ID NO: 67150 - RNA, 41 nt, Mus musculus
aucuuccuuccucccugcccugccuguccuuucccuccaaa

SEQ ID NO: 67151 - RNA, 42 nt, Mus musculus
auugaguauucaucacaggacugauggaucgaucggggccuc

SEQ ID NO: 67152 - RNA, 43 nt, Mus musculus
gguggauuugagcaacaauggcuuuuaauccuccucccccccc

SEQ ID NO: 67153 - RNA, 46 nt, Mus musculus
uaugguggcucacaaccacccguaacaagaucugaugcccucuucu

SEQ ID NO: 67154 - RNA, 28 nt, Mus musculus
guaguuuugucuaggaagggugagagcu

SEQ ID NO: 67155 - RNA, 47 nt, Mus musculus
cuuagggcccaccuguugcaagaggucuggugggugagauuagggcg

SEQ ID NO: 67156 - RNA, 45 nt, Mus musculus
ucagcccuuuccucugcggccuacucuguaaaugcagugccaggc

SEQ ID NO: 67157 - RNA, 45 nt, Mus musculus
caucgcggucugagaugcagaguaggguggggcagaggagcuagc

SEQ ID NO: 67158 - RNA, 46 nt, Mus musculus
gggccugggaggauugcucaccggcgcggggucugaaccgguagau

SEQ ID NO: 67159 - RNA, 45 nt, Mus musculus
cagccagggcuacacagagagacccuguauuaaaaacccaaagga

SEQ ID NO: 67160 - RNA, 46 nt, Mus musculus
aguaccaagacagccaggagagacccuguaucaaaaaaagagagag

SEQ ID NO: 67161 - RNA, 46 nt, Mus musculus
aaaucccagcaagcacaugguggcucacaaccaucccugaugggag

SEQ ID NO: 67162 - RNA, 46 nt, Mus musculus
caaccagaugcugaguggcaucccugagguggaccugggcauagag

SEQ ID NO: 67163 - RNA, 45 nt, Mus musculus
acagggggcaugguggacaugaagaaacugaaggagcggggcaaa

SEQ ID NO: 67164 - RNA, 42 nt, Mus musculus
auuccagcuuaugucagaucaacaaaacccuagccagcacac

SEQ ID NO: 67165 - RNA, 46 nt, Mus musculus
cgccgggcugacucggagucggaggaggaugaacaagaaucagagg

SEQ ID NO: 67166 - RNA, 42 nt, Mus musculus
ccugcccugcugaggcggggcccuacgggcuugggguguggc

SEQ ID NO: 67167 - RNA, 45 nt, Mus musculus
cacuugcuagucuuccagaggacuagaguuuaguuuacagcagca

SEQ ID NO: 67168 - RNA, 46 nt, Mus musculus
gguauaaauuucgcccagcuucagauaaccccuaccugcagcucuc

SEQ ID NO: 67169 - RNA, 42 nt, Mus musculus
uuuggaguugaggugcaguagacggggagggaacuggaggac

SEQ ID NO: 67170 - RNA, 42 nt, Mus musculus
cccaaauaauugucagacugagcccagagguuucaccugcag

SEQ ID NO: 67171 - RNA, 46 nt, Mus musculus
cgggcaugaagaucagaaacccgucaaucaaauauaaacaggcuag

SEQ ID NO: 67172 - RNA, 45 nt, Mus musculus
cuaaauuggugcaaacgccuaauuaacaaaaggauucgacauaag

SEQ ID NO: 67173 - RNA, 46 nt, Mus musculus
gugcugcaugugugcagugcucauagaggccagaagagggcgccaa

SEQ ID NO: 67174 - RNA, 46 nt, Mus musculus
ggucucaauaucacauuuacuuucacagagugguucaucuggccag

SEQ ID NO: 67175 - RNA, 45 nt, Mus musculus
acaucacuaaucgagccguggcacuuacaguccuucacagucuca

SEQ ID NO: 67176 - RNA, 44 nt, Mus musculus
gcagagguuccucucuaugccugcaccugggguacauaggggga

SEQ ID NO: 67177 - RNA, 41 nt, Mus musculus
cuuugaggaagccaggaagaaggcgcugaagcuuggggcca

SEQ ID NO: 67178 - RNA, 78 nt, Mus musculus
ucccuucaagggaauuucaccucuaguugauagcuucuguuugagaucuuaggggacaccagaguucuguccuauugg

SEQ ID NO: 67179 - RNA, 94 nt, Mus musculus
augggcuauugggauugacuaguaaugucugccaugagugcagaagggagaguaacaguacgguuggcuagaaugaauuagugauauauacuac

SEQ ID NO: 67180 - RNA, 41 nt, Mus musculus
agacagguggagauugcccagcgugaaggggccaaguaugu

SEQ ID NO: 67181 - RNA, 46 nt, Mus musculus
caaggcuuaccaccuugcuguauggggcuggugaugaugcagguac

SEQ ID NO: 67182 - RNA, 44 nt, Mus musculus
gacacccagcuccuggaccauuugggagaugggugaggacacag

SEQ ID NO: 67183 - RNA, 41 nt, Mus musculus
cccucuagauuugaaagaaaagacuggaaaugugagccgaa

SEQ ID NO: 67184 - RNA, 42 nt, Mus musculus
gaguuuuacaaccgguucaagggccgaaaugaucugauggag

SEQ ID NO: 67185 - RNA, 24 nt, Mus musculus
ggaacgcagcccugccucagccgc

SEQ ID NO: 67186 - RNA, 45 nt, Mus musculus
caagcagccgggcggcuuugugugaaauucacagccaggcaagau

SEQ ID NO: 67187 - RNA, 30 nt, Mus musculus
gcucuagaauuuuaaguaccagcccaugag

SEQ ID NO: 67188 - RNA, 45 nt, Mus musculus
gucugcaccaagcguacugucacugccagggcucaggugccagag

SEQ ID NO: 67189 - RNA, 48 nt, Mus musculus
aacugagcuuuuaggagggagaguuaaaaagaaggcaggcacccggcg

SEQ ID NO: 67190 - RNA, 23 nt, Mus musculus
cuuggcauguggccggagaaagg

SEQ ID NO: 67191 - RNA, 46 nt, Mus musculus
ugggacuucuggcugauggagaagugccaggggcugguggucguag

SEQ ID NO: 67192 - RNA, 47 nt, Mus musculus
cuacacaaaaacucaggacccugccaaagcacccaacagcccagaug

SEQ ID NO: 67193 - RNA, 49 nt, Mus musculus
uguccuagaggaagaaacuggacacagucaugcccggugaucagacuag

SEQ ID NO: 67194 - RNA, 42 nt, Mus musculus
gagggugggguggugggcacaggcugcucugcugagccccag

SEQ ID NO: 67195 - RNA, 45 nt, Mus musculus
ccccaggggucccugugaaggugaccaacaucaaagauggcacaa

SEQ ID NO: 67196 - RNA, 97 nt, Mus musculus
agcuagccagaccgaccguccugccgggugaagggguacagugagugaaaagagguaacaggugaugauaaaagcugagacuacaguaaugagggaa

SEQ ID NO: 67197 - RNA, 47 nt, Mus musculus
aggcagcagugcacaguucccagcuggcuagauguaugauggagaga

SEQ ID NO: 67198 - RNA, 42 nt, Mus musculus
ugaguccugauccaauuucaucuccacugagaaucaacccuu

SEQ ID NO: 67199 - RNA, 32 nt, Mus musculus
cucgguccucagcucuaccuagauguugugug

SEQ ID NO: 67200 - RNA, 57 nt, Mus musculus
gagccugagggcuggggagccuggguggauuggcuuggcugcauuguggcuguuuac

SEQ ID NO: 67201 - RNA, 99 nt, Mus musculus
auacagucuuuaauaucacaucugcuuccuaacuccagaggggggcuaauuaagugaagugaaugaagucaguggggagaagccugaggaggaggagga

SEQ ID NO: 67202 - RNA, 94 nt, Mus musculus
aggggaggaggagggagaggaaggggaggaggaggaaugaaaggaggaagaggaaggagaggaggaggaagaggaggaggaggaaggaaaggaa

SEQ ID NO: 67203 - RNA, 42 nt, Mus musculus
uccucuccccauucugcuccuuccuccacucacugcccccca

SEQ ID NO: 67204 - RNA, 45 nt, Mus musculus
cccucuuugcucggugguuuguauacugacugucaaaagccccaa

SEQ ID NO: 67205 - RNA, 45 nt, Mus musculus
uacacacgcacgcgcgcgcgcgcgcacacacacacacacacacac

SEQ ID NO: 67206 - RNA, 46 nt, Mus musculus
uugugagccaucauguaguugcugggaauugaacucaggaccuuug

SEQ ID NO: 67207 - RNA, 46 nt, Mus musculus
caggcuggccucgaacucagagauaugccugccucugccuccugag

SEQ ID NO: 67208 - RNA, 42 nt, Mus musculus
cauuuucuccacaagccgcagaguggacugucguggccccag

SEQ ID NO: 67209 - RNA, 45 nt, Mus musculus
ccauccuuuaccacgcucauuuagacauagaggccuucacgaugg

SEQ ID NO: 67210 - RNA, 46 nt, Mus musculus
aggcaggcuucaaaagucacucccacaggaccugggaagcuguuag

SEQ ID NO: 67211 - RNA, 46 nt, Mus musculus
cugagcgauuaggagcuuucaaaggaaauaaaaccuuggagcagag

SEQ ID NO: 67212 - RNA, 46 nt, Mus musculus
cccgccuguccucaacaugaaaauggguguaguguauaacucuagc

SEQ ID NO: 67213 - RNA, 46 nt, Mus musculus
cacugcugcauuauuuugcaggaauggaaacagcuguaggccccag

SEQ ID NO: 67214 - RNA, 49 nt, Mus musculus
cuggcacagcccugaaugugaauuuguucgccacuguauccagaagucc

SEQ ID NO: 67215 - RNA, 29 nt, Mus musculus
cgggagucuccacuuucacucuacaauga

SEQ ID NO: 67216 - RNA, 45 nt, Mus musculus
aauucccuagacacaggcccagaauggucaagaaacuugccagga

SEQ ID NO: 67217 - RNA, 45 nt, Mus musculus
aaagaggagcgggccuccccacucugcagcucucccaggcuucag

SEQ ID NO: 67218 - RNA, 42 nt, Mus musculus
cgacgggcugccuaaaccgaaugggaacucuugcgggccggg

SEQ ID NO: 67219 - RNA, 45 nt, Mus musculus
cggggcuggaucucaccuaccauagaaagguuaccagcccuagga

SEQ ID NO: 67220 - RNA, 43 nt, Mus musculus
aggaaugaaaggagaggagggugacacaacacgagggaggagg

SEQ ID NO: 67221 - RNA, 45 nt, Mus musculus
caaccauccguaaugagaucugacucccucuucugguaugucuga

SEQ ID NO: 67222 - RNA, 42 nt, Mus musculus
cagaucaguuuguucacucucuccacagagccggccacagac

SEQ ID NO: 67223 - RNA, 51 nt, Mus musculus
gcagcugcuuccccuucuccacagcaaacuguucucucccuuucagcccca

SEQ ID NO: 67224 - RNA, 44 nt, Mus musculus
gagaggcugggcaagguggggaauuauccacaaucccagcgccu

SEQ ID NO: 67225 - RNA, 45 nt, Mus musculus
aguccaaaauaacuggguucuguguuguugcuuuuuguucuuaga

SEQ ID NO: 67226 - RNA, 42 nt, Mus musculus
agcuacacagagaaacccugucuggaaaaaaaccaaaaaaac

SEQ ID NO: 67227 - RNA, 45 nt, Mus musculus
ucucugaguuaccagcaagacuacacaguuccgaagccgggagau

SEQ ID NO: 67228 - RNA, 42 nt, Mus musculus
uaccaggacaguuucauggggcauuacauuguguggggugau

SEQ ID NO: 67229 - RNA, 45 nt, Mus musculus
ggguuaggguaaggcuggaaauggaacuugggaacuugcacauuu

SEQ ID NO: 67230 - RNA, 51 nt, Mus musculus
gccuucaaaggugagccagggcugcuggcccaauagccccgagagagagag

SEQ ID NO: 67231 - RNA, 51 nt, Mus musculus
caugccccugugguccgcacaccuucuauccaacccagucuccugccucag

SEQ ID NO: 67232 - RNA, 46 nt, Mus musculus
caucccagggggaggagcgggcuagugcuccaaguggcucagagug

SEQ ID NO: 67233 - RNA, 45 nt, Mus musculus
gagcaaagguucucagaggacccuagggaccaggaggugcuagga

SEQ ID NO: 67234 - RNA, 44 nt, Mus musculus
agucuguuugauuuacuggcaucucaguuuucuaaucugucaga

SEQ ID NO: 67235 - RNA, 46 nt, Mus musculus
uaggcuuccugagucucaguccucagugaaucuaucuugggcagag

SEQ ID NO: 67236 - RNA, 46 nt, Mus musculus
uagggaguggcacuauuugaaaggauuaggagguguggccuugcug

SEQ ID NO: 67237 - RNA, 46 nt, Mus musculus
acgaguuggucacagaaagacauaugccauggaaguccaugccuag

SEQ ID NO: 67238 - RNA, 46 nt, Mus musculus
cguuaguagcccccgucagagcaggggguugucuggcuuucagugg

SEQ ID NO: 67239 - RNA, 41 nt, Mus musculus
uugcugguuuccaguuggauagacagugacuugcagucugg

SEQ ID NO: 67240 - RNA, 41 nt, Mus musculus
aauacagauacaauucaccuaccccacccgcuaacuggaga

SEQ ID NO: 67241 - RNA, 46 nt, Mus musculus
accagguuguuuaaauucucuauuuuaaaaucuuuuuuuggguugg

SEQ ID NO: 67242 - RNA, 46 nt, Mus musculus
ugacccuuguagccugcgcccauccagcccgcacucccgcccccag

SEQ ID NO: 67243 - RNA, 46 nt, Mus musculus
aguugcuuccugccugaggcccacaaccgcauuccuguuugcccag

SEQ ID NO: 67244 - RNA, 42 nt, Mus musculus
ggguguuuccgagcgaccagguggccuugcuggagaugggag

SEQ ID NO: 67245 - RNA, 44 nt, Mus musculus
ugucuuggggaagcucaggccuuacuugcugcauauaguggagg

SEQ ID NO: 67246 - RNA, 46 nt, Mus musculus
gugugugugugguguggugugguguagguguguguauguguugugu

SEQ ID NO: 67247 - RNA, 71 nt, Mus musculus
guguguugugugugugugugugugcauuguaugugugugguguguguuuguguguguugugugugugacug

SEQ ID NO: 67248 - RNA, 46 nt, Mus musculus
auuuuauguacguguguacccuguagcuguccuuagacauacccaa

SEQ ID NO: 67249 - RNA, 102 nt, Mus musculus
cucuggaagugcucuuaacugcugagccaucucuccagcccaagaucacaucuucaucagggagaauagagagcaagugagccaagcuaaaaacccuacuga

SEQ ID NO: 67250 - RNA, 46 nt, Mus musculus
ggggugggugggagugugugaggauggguagaagaugggcagauau

SEQ ID NO: 67251 - RNA, 48 nt, Mus musculus
cuauggaauagcugacugaaagacccauacaguguucuaagcaagauc

SEQ ID NO: 67252 - RNA, 44 nt, Mus musculus
aacauccccagugccugggaagagauggcuggcuugacacagaa

SEQ ID NO: 67253 - RNA, 45 nt, Mus musculus
cucgugccuuuggagugagugguugcauucacugggaacacacag

SEQ ID NO: 67254 - RNA, 42 nt, Mus musculus
ucaccacaggcccccucggcucucacacucucuccagagugc

SEQ ID NO: 67255 - RNA, 45 nt, Mus musculus
auggcuagguaacguuccauguacacuucuguucaucugcccaca

SEQ ID NO: 67256 - RNA, 41 nt, Mus musculus
ggaagggaauuacuacacagccgggguggcugugaccgugu

SEQ ID NO: 67257 - RNA, 46 nt, Mus musculus
uuuguacagguuucaaguugagcgucucuaguuaaggcugauguag

SEQ ID NO: 67258 - RNA, 45 nt, Mus musculus
aaccugccaagccugaagucugaaaacaaaggaaacgaccccaac

SEQ ID NO: 67259 - RNA, 46 nt, Mus musculus
aagcuucaguuugucauuuuugugacuggugagugucugggguuag

SEQ ID NO: 67260 - RNA, 41 nt, Mus musculus
guauuguccccuggauacaaagcuguugucugccauaacug

SEQ ID NO: 67261 - RNA, 42 nt, Mus musculus
aguaauuuuccugggcguguuccauacucaccaguggcccag

SEQ ID NO: 67262 - RNA, 45 nt, Mus musculus
guggaaccuuucacaaaagcuaguguugguguuguuguguccuuu

SEQ ID NO: 67263 - RNA, 45 nt, Mus musculus
gagcagacaguguucuuaaucacugagucaacucuccagccccca

SEQ ID NO: 67264 - RNA, 47 nt, Mus musculus
uacgacuuccucuucugaguauaaguguaugucauggugcuugguac

SEQ ID NO: 67265 - RNA, 43 nt, Mus musculus
augccagggaucuuagcucgauucauuaggcuugcauuguaag

SEQ ID NO: 67266 - RNA, 46 nt, Mus musculus
ccauucuccucuguuaauccaggaagagaugggaucugugugucag

SEQ ID NO: 67267 - RNA, 44 nt, Mus musculus
ggccuccacgaggaaguggacuauuccgagaaacugaaguucag

SEQ ID NO: 67268 - RNA, 34 nt, Mus musculus
cucugcagacagcacugacgccaagcgcacucag

SEQ ID NO: 67269 - RNA, 61 nt, Mus musculus
guguugaaaacccaaaaaguagagggagggaugucuccaguucugaggaaugugauucagu

SEQ ID NO: 67270 - RNA, 60 nt, Mus musculus
ucuuucucacuauguuguacgugugugugugugugugugugugcgcgcacgggagcucag

SEQ ID NO: 67271 - RNA, 45 nt, Mus musculus
gucagagauguccgaggccguggaacgagcccgaaagcgcaggga

SEQ ID NO: 67272 - RNA, 46 nt, Mus musculus
gcccgagaggagaggcuggcugccugugcugccaaacucaagcagc

SEQ ID NO: 67273 - RNA, 63 nt, Mus musculus
ccaccauguucuuggaagagacaccugcaacauccccaacagucgcucagagcaauagcagca

SEQ ID NO: 67274 - RNA, 41 nt, Mus musculus
gguuucccagggucaccaagggcucaugggacugggggggg

SEQ ID NO: 67275 - RNA, 45 nt, Mus musculus
ccaccuucucacccccagcgcaccuucuacccacaccacccccag

SEQ ID NO: 67276 - RNA, 42 nt, Mus musculus
gggguagagacauauugucauuucaucacuugagaggcugag

SEQ ID NO: 67277 - RNA, 42 nt, Mus musculus
uggguuaaguguuaagacugucucccaaaaaagcaaaccaaa

SEQ ID NO: 67278 - RNA, 46 nt, Mus musculus
uuuuauuuuuuuaaaauauguguuuacccauuuggggaguuagaag

SEQ ID NO: 67279 - RNA, 45 nt, Mus musculus
gaaggcuauguucugccuuguggcuuccgccgggcauucuguguu

SEQ ID NO: 67280 - RNA, 46 nt, Mus musculus
cgacccagcuccuguguggagcccagagggcuacauggcacugcag

SEQ ID NO: 67281 - RNA, 45 nt, Mus musculus
gggccuguggggaccugaggaggagucccaucugcuggcaagcca

SEQ ID NO: 67282 - RNA, 45 nt, Mus musculus
ggagagaaccacucacgccagcucugacgguccugaaacccccag

SEQ ID NO: 67283 - RNA, 47 nt, Mus musculus
agcaagcucuguggugggugaaggcuucauugaaguccugaccaaga

SEQ ID NO: 67284 - RNA, 48 nt, Mus musculus
cuggagcaagaugugacugugccuggcagcagccugggcacugagauc

SEQ ID NO: 67285 - RNA, 47 nt, Mus musculus
ggagaggcagggcacuuuccggagacucacaccuuugagccgucagu

SEQ ID NO: 67286 - RNA, 54 nt, Mus musculus
gucagcccucccugugcagggcgccgccagugacucauggaggacagcugucac

SEQ ID NO: 67287 - RNA, 79 nt, Mus musculus
aagagcagccagggagauaguggcguugacuugagugcugagucucgggagucgucugcgaccuccucacagcgcaguu

SEQ ID NO: 67288 - RNA, 64 nt, Mus musculus
ccccauauggcacucucaagccugaggaaauuagcgggccuggccuggcggaaucuaaggccga

SEQ ID NO: 67289 - RNA, 79 nt, Mus musculus
ccacaaggacucagaacaaggcucugcacagagcaaggagcacagaccaggacccaucggcaacgagcggucucugaaa

SEQ ID NO: 67290 - RNA, 46 nt, Mus musculus
cgagcggcugccaggggccguugucccgccuguuaaugggguggag

SEQ ID NO: 67291 - RNA, 46 nt, Mus musculus
agaggaaagggaagcugggagcugagcacucugcucuuuugcggag

SEQ ID NO: 67292 - RNA, 46 nt, Mus musculus
ucccuagggagggagcccagagcaagcaccaccaccccacccccag

SEQ ID NO: 67293 - RNA, 46 nt, Mus musculus
auggagucugcacgcaaggcuugggaaaacucccccaguuugccag

SEQ ID NO: 67294 - RNA, 46 nt, Mus musculus
auaucuccuggcagcucuagcauacugguuccaagacauccugcuc

SEQ ID NO: 67295 - RNA, 46 nt, Mus musculus
ugcucugcucugagguccuggugucucagugauguguuuccaauag

SEQ ID NO: 67296 - RNA, 41 nt, Mus musculus
uggggacugggcgauugugcacacucaguuuccugucccuu

SEQ ID NO: 67297 - RNA, 45 nt, Mus musculus
cagcauggcccccuuuguguuucugagugucacugaggcguccuu

SEQ ID NO: 67298 - RNA, 46 nt, Mus musculus
ggggaaauuguguuuguuucuaaucugcaguguaucaggcucugag

SEQ ID NO: 67299 - RNA, 45 nt, Mus musculus
aaagcuccugagaguuccaucgucagccagccugcaucguggaca

SEQ ID NO: 67300 - RNA, 46 nt, Mus musculus
gugacuguggagugagccuccugugcagugcagaccugcccgcccg

SEQ ID NO: 67301 - RNA, 71 nt, Mus musculus
aguuaauguuucagaauaagaauuaucuguucagggcccuuuugcugucauuggacacagugaguauugag

SEQ ID NO: 67302 - RNA, 45 nt, Mus musculus
gggacuccuaaguggacagugcuucugaggagggaugcgagaaga

SEQ ID NO: 67303 - RNA, 45 nt, Mus musculus
gcaucccuccucagaagcacuguccacuuaggaguccccagcaca

SEQ ID NO: 67304 - RNA, 63 nt, Mus musculus
gccaagcucuaccccauaagucucacucaguaaaagccacacagucaccucuuagaaaugcgg

SEQ ID NO: 67305 - RNA, 46 nt, Mus musculus
gcuguuacaaacucaaaaugugcccuuuaggugagccugcugucag

SEQ ID NO: 67306 - RNA, 45 nt, Mus musculus
aagaaacacuagaauuuauuuauauguauugauguuguaggucua

SEQ ID NO: 67307 - RNA, 46 nt, Mus musculus
aucauccgaggaguagggacauuuggccugaagccugcccucuguc

SEQ ID NO: 67308 - RNA, 42 nt, Mus musculus
ugggaacagguaaaguccagcccugccuuuucuacugcugag

SEQ ID NO: 67309 - RNA, 44 nt, Mus musculus
aauccaugguuuggcaaccaggacucuucagucuguugguccug

SEQ ID NO: 67310 - RNA, 35 nt, Mus musculus
ucuuugugagauggcucuaagacaaguuaggucau

SEQ ID NO: 67311 - RNA, 46 nt, Mus musculus
ugcuaaagguguacugugcagcuuguuuagacgugauauggggaac

SEQ ID NO: 67312 - RNA, 45 nt, Mus musculus
aggacaucuuucgaauccugucuuaagguuuuaaaauaaccaauu

SEQ ID NO: 67313 - RNA, 45 nt, Mus musculus
ggcugcgcacgcgcgucucagagucugucggccgcguagacacaa

SEQ ID NO: 67314 - RNA, 42 nt, Mus musculus
gucguuuccagggcggccucuuguaaaagccagagugggaag

SEQ ID NO: 67315 - RNA, 46 nt, Mus musculus
ucgggaggacucccuggaaaagagggaaagaacuaccauuaaagua

SEQ ID NO: 67316 - RNA, 41 nt, Mus musculus
ugcaauauaagcuuaucaaauaaaauuuuucaagggcgcaa

SEQ ID NO: 67317 - RNA, 45 nt, Mus musculus
gaguacaguagcaaugugccuauaugguccuuacgccugcugcca

SEQ ID NO: 67318 - RNA, 43 nt, Mus musculus
ccugcuugugcucggcauugcagcuguccacgcguggaaucug

SEQ ID NO: 67319 - RNA, 46 nt, Mus musculus
aguucauugucagccucuucagacacaccagaaaagggcaucagau

SEQ ID NO: 67320 - RNA, 46 nt, Mus musculus
uacauaagauaaauaauaaaauuaaaaaguaaaaaagaagaagaag

SEQ ID NO: 67321 - RNA, 41 nt, Mus musculus
gccuccaugcagguucuggaaauggcuaccgcacucugcag

SEQ ID NO: 67322 - RNA, 74 nt, Mus musculus
cuggccuggaaggcacuggacaugauuuggucauggggcccagagcgguagagcagcaucagguggacauagaa

SEQ ID NO: 67323 - RNA, 84 nt, Mus musculus
aaucauguccagugccuuccaggccagcuuggagguaagaaacacacagagcaaagacagucaggcucagcuucucugugagca

SEQ ID NO: 67324 - RNA, 107 nt, Mus musculus
augcgggaucuguagcccucgggagggaaagguggggcagggcagcuagggcuccaucucgagacuuuguuuucaguaaccaaaugaguggauaucagguagauaaa

SEQ ID NO: 67325 - RNA, 88 nt, Mus musculus
cugcguccucaguuugggauuaaagacgugugccaccaucaaccggcccauguugguguuuuuaaaggaauuguaaaauacugauugu

SEQ ID NO: 67326 - RNA, 46 nt, Mus musculus
uuagacaccucaugagacagacucaagcccgugcacaugacacuag

SEQ ID NO: 67327 - RNA, 45 nt, Mus musculus
auagaaaaggucuuagauaagcucaggaggccaagcaucccaccc

SEQ ID NO: 67328 - RNA, 44 nt, Mus musculus
acccaaggccagccccuggagguggccuuugguucccaggucac

SEQ ID NO: 67329 - RNA, 45 nt, Mus musculus
gcaacaggugaccuguuaucccuucaaagacaucaauaacuggug

SEQ ID NO: 67330 - RNA, 42 nt, Mus musculus
cagcaaccauaugagauuggaaacgggccagccuggggaaaa

SEQ ID NO: 67331 - RNA, 51 nt, Mus musculus
agacaccagcuggugguaaacaacccuccccggccuguaagacauggagac

SEQ ID NO: 67332 - RNA, 78 nt, Mus musculus
augucgcagccccacugagcccccauucucaagaagucuccugcuacauugacuauaacaucuccaugccugcccaga

SEQ ID NO: 67333 - RNA, 45 nt, Mus musculus
cauugugaacagagaguccaaccgggauaccuggaagacuaucuu

SEQ ID NO: 67334 - RNA, 42 nt, Mus musculus
uagcugagcggggcucaccucccugacuggggguuccggcag

SEQ ID NO: 67335 - RNA, 46 nt, Mus musculus
ggaggaggcuccugcaucccagaguacacuaauccugucuuggccg

SEQ ID NO: 67336 - RNA, 46 nt, Mus musculus
ccccaaaucuccauuacuccugauuuucaguuuugacaaacaagag

SEQ ID NO: 67337 - RNA, 46 nt, Mus musculus
ccuuccagauccugcugcucccgauuguccugcagcacgccagcga

SEQ ID NO: 67338 - RNA, 42 nt, Mus musculus
aggacagcagcagggccgcccagaccuggugggauguggcag

SEQ ID NO: 67339 - RNA, 89 nt, Mus musculus
cuaaagaguccugggagacugcagccaccuaacugccacggccaaggugucguccauucacuuccuuaccuuuaauguaaauaaaacag

SEQ ID NO: 67340 - RNA, 42 nt, Mus musculus
ccugauggcccacucccaucuacccaagauccaggcccccag

SEQ ID NO: 67341 - RNA, 46 nt, Mus musculus
cggcaccgaggcgggcccaacgggcgcaaccacaagaggaccuucc

SEQ ID NO: 67342 - RNA, 45 nt, Mus musculus
gcagggacaacuggcuccucuguccuucuuccugugguaccacug

SEQ ID NO: 67343 - RNA, 24 nt, Mus musculus
acaggaagaaggacagaggagcca

SEQ ID NO: 67344 - RNA, 41 nt, Mus musculus
uggccuaugugucucaggcuagaccccggugugcccguaug

SEQ ID NO: 67345 - RNA, 24 nt, Mus musculus
auacagaggagcagaggcucaaau

SEQ ID NO: 67346 - RNA, 46 nt, Mus musculus
auguccgccgugguggucguaaacgcccaguuccuaagggugcaac

SEQ ID NO: 67347 - RNA, 46 nt, Mus musculus; identical to SEQ ID NO: 39629

SEQ ID NO: 67348 - RNA, 44 nt, Mus musculus
ccugcugcccacacugacaguguguccgccccaccagaaacaga

SEQ ID NO: 67349 - RNA, 42 nt, Mus musculus
aagacuccuaaagcuuagccuccugauuuugauucguguucu

SEQ ID NO: 67350 - RNA, 46 nt, Mus musculus
uucaacaaguauauccuggcugccuauuaauaugagguccuaaguc

SEQ ID NO: 67351 - RNA, 46 nt, Mus musculus
gagaaccucgggaggaaugcucauuguuugggccuuuguguaugug

SEQ ID NO: 67352 - RNA, 46 nt, Mus musculus
ggcugugucugggugguuacagcagucaagagaggaguccccugag

SEQ ID NO: 67353 - RNA, 45 nt, Mus musculus
cuggggaugggucaaacuauagaacagcuacccagaggugucaug

SEQ ID NO: 67354 - RNA, 45 nt, Mus musculus
gaugguugugagccaccaugugguugcugggauuugaaccuggga

SEQ ID NO: 67355 - RNA, 43 nt, Mus musculus
ugugugugugauuuagaggcucuguggaggugggcuaaggucu

SEQ ID NO: 67356 - RNA, 42 nt, Mus musculus
aagaucaucuuuguggugggugaguuguaggcaggcgggcag

SEQ ID NO: 67357 - RNA, 46 nt, Mus musculus
uuuguugggagggguaugcauguucugugggaucaacauggccguc

SEQ ID NO: 67358 - RNA, 49 nt, Mus musculus
aucgacggcuacccgagggaggugaaacagggagaagaauuugaacaga

SEQ ID NO: 67359 - RNA, 63 nt, Mus musculus
ggguaaugggaccugugcuggccuggcgugggauggagacagauacaagcauagaucaauaug

SEQ ID NO: 67360 - RNA, 101 nt, Mus musculus
ggacagcccacacugcugcuguauguggacgcaggcgccgagaccaugacccaacgacuccugaagcgaggggagaccaguggccgcguggaugacaacga

SEQ ID NO: 67361 - RNA, 40 nt, Mus musculus
uuuuuaagacagcaucucgugugacuuaagcuggccucaa

SEQ ID NO: 67362 - RNA, 49 nt, Mus musculus
uccugucacgcuaugucccaacccuuauccucggcguuaagacaagagc

SEQ ID NO: 67363 - RNA, 45 nt, Mus musculus
cuggggccccgucuccaucccuagugacuuccccuguaagcccag

SEQ ID NO: 67364 - RNA, 42 nt, Mus musculus
gcagggugcuucccagaguccccaccaucguagcaggcuuuc

SEQ ID NO: 67365 - RNA, 46 nt, Mus musculus
uuaaaagcuguuuuuuuauuacauuaauuaauuuggguuggggcac

SEQ ID NO: 67366 - RNA, 46 nt, Mus musculus
aagaugggcagguacugccugcugaagacucagcucugggucccua

SEQ ID NO: 67367 - RNA, 44 nt, Mus musculus
ccagugcaggggcgguugucuccagagguguggccuggggagua

SEQ ID NO: 67368 - RNA, 46 nt, Mus musculus
aauguccuaaaugguguuucuacgauaaagucuauacccuggcgcu

SEQ ID NO: 67369 - RNA, 46 nt, Mus musculus
accagucuacuaggagauacaguggagaaaauagcauggcagaaag

SEQ ID NO: 67370 - RNA, 46 nt, Mus musculus
ucagaggagugcauaugaguauacuccuggggauuugucccuugag

SEQ ID NO: 67371 - RNA, 46 nt, Mus musculus
aagacuggaaucuaaguauucagaauugaccggcgggcaggcagaa

SEQ ID NO: 67372 - RNA, 41 nt, Mus musculus
cuguacagagaaacccugucucgaaaaaccgaaggggaaaa

SEQ ID NO: 67373 - RNA, 46 nt, Mus musculus
aaccaaauggaagucuuucccacugucuccuucuuagccuggaaau

SEQ ID NO: 67374 - RNA, 41 nt, Mus musculus
acuguucugaaacucacucaggaaaccaggcuggcccaaga

SEQ ID NO: 67375 - RNA, 45 nt, Mus musculus
guccuaacuccuuuguggccacaggcaaagcgaaggucugaauau

SEQ ID NO: 67376 - RNA, 76 nt, Mus musculus
cauugcuccagcauggcggaucccaaagagaagaggcagucgaugguuuuuagacauuuauuguagaaaggcagag

SEQ ID NO: 67377 - RNA, 45 nt, Mus musculus
cugccuucagacacacacuagaagagggcaucagaucccauuaca

SEQ ID NO: 67378 - RNA, 45 nt, Mus musculus
gguggugaagucacugaaggccuuuguacaggacccagcccccag

SEQ ID NO: 67379 - RNA, 46 nt, Mus musculus
uucggaaauuuuucuuggcuugggaagaaguuccggguugcgggga

SEQ ID NO: 67380 - RNA, 42 nt, Mus musculus
cuccuggccugauggaaguccugcagcccuuccugggcccuu

SEQ ID NO: 67381 - RNA, 41 nt, Mus musculus
gcuucugaagcuggagcgauggcaauucuucccugcccucc

SEQ ID NO: 67382 - RNA, 42 nt, Mus musculus
uggguggcuccuggaagaaaucuuuccuaagcugguuggcaa

SEQ ID NO: 67383 - RNA, 34 nt, Mus musculus
cacagguuccccaaauggaaggacucaagcuacu

SEQ ID NO: 67384 - RNA, 73 nt, Mus musculus
guccagggaugcggcggaguugggccuugagccggcagguuuccgaggcucgguuccccgggaagcgguggcu

SEQ ID NO: 67385 - RNA, 90 nt, Mus musculus
uuuacauauggggguuguugugaccccucugagcagauaugcaguaacuagaguguuguuucccugugccaagcggagcuguuugggcug

SEQ ID NO: 67386 - RNA, 46 nt, Mus musculus
gcuggggggcagcgcaaggugaggcucuuaugugcguagguuuggg

SEQ ID NO: 67387 - RNA, 46 nt, Mus musculus
ccacauacaggcaggccaacaccaccucuggacaacagcuaggcag

SEQ ID NO: 67388 - RNA, 68 nt, Mus musculus
ugauuuuucucagcaucaaccauaugagcuuccacugccuuguugucuuauacccauuuuauagauaa

SEQ ID NO: 67389 - RNA, 45 nt, Mus musculus
uacagaggacaguaugguucuuugcuguuugguggaauuacggug

SEQ ID NO: 67390 - RNA, 46 nt, Mus musculus
uuuuauucagcuucuucagcguguccagcaguuucuguggggugag

SEQ ID NO: 67391 - RNA, 51 nt, Mus musculus
ggcaaggaaaggagacgguaggaaaggaauacgucuggagaagaguugggg

SEQ ID NO: 67392 - RNA, 44 nt, Mus musculus
aggugaacagggagagagagagagaggagagggaugggaugaag

SEQ ID NO: 67393 - RNA, 45 nt, Mus musculus
acgagauguuuaugaaggcgagguaugaggaggagggaugggaug

SEQ ID NO: 67394 - RNA, 41 nt, Mus musculus
uccgaucucauggggagcgguacucgagagucaaggcccag

SEQ ID NO: 67395 - RNA, 46 nt, Mus musculus
gcuaggagcuggcauuagaggcuucaaggaaaacgucugggggaau

SEQ ID NO: 67396 - RNA, 46 nt, Mus musculus
uuugucaagaaaagcaaauaauacugaaaauugaucuuagccccaa

SEQ ID NO: 67397 - RNA, 24 nt, Mus musculus
ucugagaauggcgggugauagaga

SEQ ID NO: 67398 - RNA, 75 nt, Mus musculus
ccggcuagccauaauucucaguggucgcugauugccuggagcuuccuggcuggcuaaguucucacaggggagggu

SEQ ID NO: 67399 - RNA, 45 nt, Mus musculus
uccaggcgugguggugggcugagcauagauggggaagguggcuag

SEQ ID NO: 67400 - RNA, 42 nt, Mus musculus
ucucuccucucaagaggaagugcggggcagggggcccgugag

SEQ ID NO: 67401 - RNA, 46 nt, Mus musculus
guaaaccuauguagccaccccacaaggagauuuaaccguagccuag

SEQ ID NO: 67402 - RNA, 42 nt, Mus musculus
acagggaaguaaaacaguguaucagaagguaucauccagcag

SEQ ID NO: 67403 - RNA, 45 nt, Mus musculus
gcaugcgugcgugaguccaugagugagugugugugcgugcuugug

SEQ ID NO: 67404 - RNA, 45 nt, Mus musculus
augcauuagcucaugcugugaugauuauaauuagaugcaaaugga

SEQ ID NO: 67405 - RNA, 45 nt, Mus musculus
aaagaggguuaacccagcaggucucuucaggacaccugcggugag

SEQ ID NO: 67406 - RNA, 42 nt, Mus musculus
acacuaucucugaaggguugcuaaguagcauuuacgggguug

SEQ ID NO: 67407 - RNA, 46 nt, Mus musculus
ugaggaccaguauggugucucccucuucaauagcaugcgccaugag

SEQ ID NO: 67408 - RNA, 28 nt, Mus musculus
aauauagaccaccaagugggagucuccg

SEQ ID NO: 67409 - RNA, 45 nt, Mus musculus
guggugguguguguguguguguguguguguauguguguguguugc

SEQ ID NO: 67410 - RNA, 46 nt, Mus musculus
gccccuggaugaacgcaucaucuucuccggaaaccuuuuccaguac

SEQ ID NO: 67411 - RNA, 71 nt, Mus musculus
cccugaauggagggaggaggugaugggguaggcuccaccuguggaggugauggauaggcaagguugggcaa

SEQ ID NO: 67412 - RNA, 45 nt, Mus musculus
gaacagagacaauacugugugugugugugugugugugugugugug

SEQ ID NO: 67413 - RNA, 46 nt, Mus musculus
cacaacagagacagacagagagagacgaagugaggcuggaggggag

SEQ ID NO: 67414 - RNA, 46 nt, Mus musculus
ccugcugauguggucccagaggcagagggaggcccagagcggcuuu

SEQ ID NO: 67415 - RNA, 45 nt, Mus musculus
cugugaccgaguaggggacccuaggucagguaggggaagggugag

SEQ ID NO: 67416 - RNA, 46 nt, Mus musculus
auggcugugcugggucaggguggugguaucuuggaggacgaaggag

SEQ ID NO: 67417 - RNA, 42 nt, Mus musculus
gcuucaccgaggugcgggaugucuucuucaaagaggucacag

SEQ ID NO: 67418 - RNA, 46 nt, Mus musculus
ggaacucaauaauccuaaagagaugucuauugaguuggggccuaaa

SEQ ID NO: 67419 - RNA, 42 nt, Mus musculus
ccacaugccucccagaacacccguugcucacuuagcugccaa

SEQ ID NO: 67420 - RNA, 45 nt, Mus musculus
gaagggacccaccaaggaggagcugugcaaauccauccagcggau

SEQ ID NO: 67421 - RNA, 42 nt, Mus musculus
gcagaucaccauucccuuccugcucaaaaagcuggcccccac

SEQ ID NO: 67422 - RNA, 46 nt, Mus musculus
ccguccccccauccauaccaccacugaggacagugcgggagugcag

SEQ ID NO: 67423 - RNA, 41 nt, Mus musculus
caaugcugggucugguuuugaggguuuccucuuugugcaag

SEQ ID NO: 67424 - RNA, 42 nt, Mus musculus
cggcagaugaaagcagugguggugugacucacguauaggaag

SEQ ID NO: 67425 - RNA, 45 nt, Mus musculus
gcuuaggggucuuacaggggagugaugcuagaggucagaggucau

SEQ ID NO: 67426 - RNA, 44 nt, Mus musculus
ggcagguacugagaacaacggggagaggcguggccaugggcugg

SEQ ID NO: 67427 - RNA, 24 nt, Mus musculus
cagcaaagucuugcuagccaccuc

SEQ ID NO: 67428 - RNA, 46 nt, Mus musculus
gagcagucagugcucuuaaccgcugagccaucucucuagcccucuc

SEQ ID NO: 67429 - RNA, 35 nt, Mus musculus
cucucuaguuuuuugguagauuuauuagagcagua

SEQ ID NO: 67430 - RNA, 23 nt, Mus musculus
agaccugucuggggcaggugcca

SEQ ID NO: 67431 - RNA, 46 nt, Mus musculus
cuugaacucacagagauccaauugccucugucuccuuugugcuggg

SEQ ID NO: 67432 - RNA, 41 nt, Mus musculus
caguagcucagcgugcucccgcugcccaagguccaggcgcc

SEQ ID NO: 67433 - RNA, 42 nt, Mus musculus
agcccuguuccaucgagcgcugaauaugccugcagcagcccu

SEQ ID NO: 67434 - RNA, 43 nt, Mus musculus
aaaucccacaaccacaugguggcucacaaccacccguaaugag

SEQ ID NO: 67435 - RNA, 42 nt, Mus musculus
aaccuggggcagucuucuugccucagccucccagaggccaag

SEQ ID NO: 67436 - RNA, 42 nt, Mus musculus
cuccccucuuacacacguggcagccaaggcccaagggagacc

SEQ ID NO: 67437 - RNA, 62 nt, Mus musculus
gaccgaucuucggggccaaggcggauguggcgccgaccucgccuccggugcaccucagguac

SEQ ID NO: 67438 - RNA, 46 nt, Mus musculus
caugugcccaaaguugaagccaggaccuucaagcucaccgccagcc

SEQ ID NO: 67439 - RNA, 46 nt, Mus musculus
gucaguuucacuguaauucugagacccuuccagucaccgguagccu

SEQ ID NO: 67440 - RNA, 47 nt, Mus musculus
ucuggcucuuuccugggcuccguguccugggucauuagccaccauau

SEQ ID NO: 67441 - RNA, 46 nt, Mus musculus
uuucugagcccauauggcuaagucccuuucugaucucccagucaag

SEQ ID NO: 67442 - RNA, 95 nt, Mus musculus
cugacuccucaccucagggcccucuuugcccagaucucaacccagauucccaccgugaggcccaccagacucugagugcggucucugcagccugc

SEQ ID NO: 67443 - RNA, 42 nt, Mus musculus
ggugggaaucuggguugagaucugggcaaagagggcccugag

SEQ ID NO: 67444 - RNA, 45 nt, Mus musculus
aagggucugucaucgucccucgaaaugggcugugacuuguuccag

SEQ ID NO: 67445 - RNA, 46 nt, Mus musculus
gugccugggaaagcgaggcucaugggaauguugugacugcccugag

SEQ ID NO: 67446 - RNA, 42 nt, Mus musculus
ggugaggacacagaugccgguagccacacccuugacaugcag

SEQ ID NO: 67447 - RNA, 46 nt, Mus musculus
ugcagcaugagcaggagcagcagugucaaaccccacacccacaggg

SEQ ID NO: 67448 - RNA, 46 nt, Mus musculus
cuaucuuuugaacgagaagggcccccacaugcucauguuugagaac

SEQ ID NO: 67449 - RNA, 50 nt, Mus musculus
ugguguuguuggacccaggaccugcaagaagcaugcacuaaggcagcugc

SEQ ID NO: 67450 - RNA, 45 nt, Mus musculus
cugaggccagugaggcagggcugcucggcggccaguccagccuga

SEQ ID NO: 67451 - RNA, 40 nt, Mus musculus
ccaucagcagcacagccuggccguggccuccaggagaggu

SEQ ID NO: 67452 - RNA, 46 nt, Mus musculus
aucccagcccagugugcuugugccucuacaccacccugcccaagua

SEQ ID NO: 67453 - RNA, 46 nt, Mus musculus
gcuguugcugagcugggcucucagcccucuuuuucacagaucagga

SEQ ID NO: 67454 - RNA, 42 nt, Mus musculus
gcccuuuuccuuaaauagggucacaugugucucaggccagcu

SEQ ID NO: 67455 - RNA, 28 nt, Mus musculus
ucuguggagagguggggcuucaguggaa

SEQ ID NO: 67456 - RNA, 45 nt, Mus musculus
gacucugaggaaaguaguggucacaaucuuagguuaguuucggag

SEQ ID NO: 67457 - RNA, 45 nt, Mus musculus
uuguuguugaaauauuaauagauaguggggcccugcagagguaga

SEQ ID NO: 67458 - RNA, 42 nt, Mus musculus
cacagagagaguacauuuaccucaacagguacaagcgggcag

SEQ ID NO: 67459 - RNA, 46 nt, Mus musculus
agcagaagcggcagaucgagacgcugcagcagcugguagagguaga

SEQ ID NO: 67460 - RNA, 50 nt, Mus musculus
augaacucgagagucacgcagcuguacaugcaacuucuacaugagaucau

SEQ ID NO: 67461 - RNA, 42 nt, Mus musculus
ugugugccagcauagccaggugcuggaacuugugcuccaggu

SEQ ID NO: 67462 - RNA, 50 nt, Mus musculus
aguuccagcaccuggcuaugcuggcacacaaccaaucagaggucauugcu

SEQ ID NO: 67463 - RNA, 46 nt, Mus musculus
gaaaucugguugaugaugcgguuguaggugggugguugguagaccc

SEQ ID NO: 67464 - RNA, 89 nt, Mus musculus
gcuccaccucgggucuaccaaccacccaccuacaaccgcaucaucaaccagauuuccaccaaugagauccagagugaccagaaucugaa

SEQ ID NO: 67465 - RNA, 71 nt, Mus musculus
ggugcugccgcccuccuugcccaccaugccugcccuuaccagucucccaucuuccacugauaagccaucag

SEQ ID NO: 67466 - RNA, 46 nt, Mus musculus
ggcaggugugugaaggcucuggcaaaucgucaggguaggggagcag

SEQ ID NO: 67467 - RNA, 42 nt, Mus musculus
caggcgguuccggggccaucuuccuugcaaccccacccccag

SEQ ID NO: 67468 - RNA, 46 nt, Mus musculus
cauuaugauguuugaaaccuaaaacaaaaucucacuggcucucaga

SEQ ID NO: 67469 - RNA, 46 nt, Mus musculus
ucaccugcuguuuauacugaucauuuugccucucacuuacauuaag

SEQ ID NO: 67470 - RNA, 42 nt, Mus musculus
agagagggcgggaagaagggagggggggaagggagggaagag

SEQ ID NO: 67471 - RNA, 42 nt, Mus musculus
gaagggaagaagggaggaagggagggagggaggaaggaggga

SEQ ID NO: 67472 - RNA, 46 nt, Mus musculus
ggaagauggucacagcaccagcuccaucuaccuggugaagccugag

SEQ ID NO: 67473 - RNA, 41 nt, Mus musculus
agacgccuggauggcucugucaacuucuucaggaacuggga

SEQ ID NO: 67474 - RNA, 45 nt, Mus musculus
auugaccugagcugcucaugcccuccuuacuguccccucuugguu

SEQ ID NO: 67475 - RNA, 50 nt, Mus musculus
aacaucgauggugaguacuggcugggccuggagaacaucuacuggcugac

SEQ ID NO: 67476 - RNA, 45 nt, Mus musculus
aacgccccagccgcagcuuauaguacucgcuuucuggcuccaguc

SEQ ID NO: 67477 - RNA, 46 nt, Mus musculus
acaacggcaaacaguuuaccacccuggacagggaccaugaugucua

SEQ ID NO: 67478 - RNA, 29 nt, Mus musculus
aaaagcagccauugcucuguaguguaugu

SEQ ID NO: 67479 - RNA, 46 nt, Mus musculus
ccccguccugguaucugcuccgguaauggcccccacgguaccagac

SEQ ID NO: 67480 - RNA, 45 nt, Mus musculus
cugguaccgugggggccauuaccggagcagauaccaggacggggu

SEQ ID NO: 67481 - RNA, 48 nt, Mus musculus
aggaggcucuuacucacucaagaagguggugaugaugauucggcccaa

SEQ ID NO: 67482 - RNA, 46 nt, Mus musculus
aagguguugggguugggccgaaucaucaucaccaccuucuugagug

SEQ ID NO: 67483 - RNA, 46 nt, Mus musculus
ucccuacugcguucuuuuacaccuaacagcuccuuguauuccagga

SEQ ID NO: 67484 - RNA, 52 nt, Mus musculus
uaagucccuuuaauaaagacacaacugccaauaucgccagaucugacagaca

SEQ ID NO: 67485 - RNA, 45 nt, Mus musculus
aggcugagggguaacuguacggagggaugcugagccguccugaga

SEQ ID NO: 67486 - RNA, 41 nt, Mus musculus
cuuugccagagacaccccacuggagagaagucgcugccaau

SEQ ID NO: 67487 - RNA, 42 nt, Mus musculus
cccugucaccaagcuacaucuccucagaagaugaggccacag

SEQ ID NO: 67488 - RNA, 45 nt, Mus musculus
uaaacaagacucaggaagccacccugcugcagugugucaggagcc

SEQ ID NO: 67489 - RNA, 46 nt, Mus musculus
uguaaugacacaaaucugcaauaaaagccaucaguguuacguggau

SEQ ID NO: 67490 - RNA, 44 nt, Mus musculus
aagaaaaacggagaggaaugggguagaaauggacaggcacaggg

SEQ ID NO: 67491 - RNA, 45 nt, Mus musculus
cuuguacagaagagacgggcgaagccaggagcuugaggcccgcgg

SEQ ID NO: 67492 - RNA, 41 nt, Mus musculus
ugcugggaucugacacugcagccggugguucuaaaccugga

SEQ ID NO: 67493 - RNA, 41 nt, Mus musculus
uggauaagugaagacacugucugcuguggugggggcggagc

SEQ ID NO: 67494 - RNA, 46 nt, Mus musculus
aaauuauauagaauuuacaaaauuaaugaauauuaaauggggaggc

SEQ ID NO: 67495 - RNA, 45 nt, Mus musculus
gcuaaauauauuccauguuaucacuguggaaauaaauaugaagau

SEQ ID NO: 67496 - RNA, 46 nt, Mus musculus
cgaccgucugcucccucucuaagaacucggccacaccgugccaaaa

SEQ ID NO: 67497 - RNA, 46 nt, Mus musculus
aaggcguguaccaccauggacauguguugagccugcgcauuggggc

SEQ ID NO: 67498 - RNA, 46 nt, Mus musculus
cuuccaaguugcugugugagcguucggucgugaggcaccugcacgg

SEQ ID NO: 67499 - RNA, 32 nt, Mus musculus
uuaacaacgaauagaucuucaagcccaaaguu

SEQ ID NO: 67500 - RNA, 46 nt, Mus musculus
gaauuuugggugguuuucaggguucugcaugaacauauccagagau

SEQ ID NO: 67501 - RNA, 46 nt, Mus musculus
acagcuaagcagcccugcagcauuucuaagugaaucuguaagagau

SEQ ID NO: 67502 - RNA, 46 nt, Mus musculus
agacuuucagaaacuuacugcugcugaugauaaaacggcucaggug

SEQ ID NO: 67503 - RNA, 45 nt, Mus musculus
cuuugacaucccauaccuauaaucuaucacuugggaggcugaggg

SEQ ID NO: 67504 - RNA, 45 nt, Mus musculus
agaugcugauaaugcaggccacucacaaagugggaagcuggaaua

SEQ ID NO: 67505 - RNA, 46 nt, Mus musculus
gagaucugaugccccucuucuggggugucugaagacagcuacagug

SEQ ID NO: 67506 - RNA, 46 nt, Mus musculus
auaacuccaguuccaggggauccaacacccucuuuuguccucagca

SEQ ID NO: 67507 - RNA, 45 nt, Mus musculus
auaaauauuuuaaaagcaguuuucuuuuacugugaggccaggaga

SEQ ID NO: 67508 - RNA, 45 nt, Mus musculus
acagucucagguagaacccuagaauucaccaaacgaaggagagag

SEQ ID NO: 67509 - RNA, 46 nt, Mus musculus
gugagccaccaugugguugcugggauuugaacucuggaccuacgga

SEQ ID NO: 67510 - RNA, 45 nt, Mus musculus
cagccggugcucuuaacuacugagccaucucuccagcccccauuu

SEQ ID NO: 67511 - RNA, 46 nt, Mus musculus
ugcagaaucaucagccugugugcugcacagcggggacccagggagu

SEQ ID NO: 67512 - RNA, 42 nt, Mus musculus
uuauguuuuagugagagggaacccuccccccagcccccuacc

SEQ ID NO: 67513 - RNA, 42 nt, Mus musculus
cagcucagcacccagggaccaugccaccugacugcuggagug

SEQ ID NO: 67514 - RNA, 42 nt, Mus musculus
cugugguuucccccuagaggccacagugggucucgguguguu

SEQ ID NO: 67515 - RNA, 45 nt, Mus musculus
cagccagggcuauacagagaaaccaugucuuaaaaaaagaaaaua

SEQ ID NO: 67516 - RNA, 46 nt, Mus musculus
cuacaguguacuuacauauaaauaauaauaaaucuuuaaaaaaaaa

SEQ ID NO: 67517 - RNA, 46 nt, Mus musculus
ugcagcucugauuuugggggcaaagauucuguaacuaguccagaua

SEQ ID NO: 67518 - RNA, 46 nt, Mus musculus
uuagucauguguucaucacugagcuguaucuccacccccaagagau

SEQ ID NO: 67519 - RNA, 46 nt, Mus musculus
ucacaaaagcuguuuucuguucagaggcuccagacuuaaagcagga

SEQ ID NO: 67520 - RNA, 46 nt, Mus musculus
cacugauguccugggaagugacuucgacccgaacguugaugaagau

SEQ ID NO: 67521 - RNA, 50 nt, Mus musculus
uucucauuuagacugggcacaucugucuccuuucagcagugguaaggugg

SEQ ID NO: 67522 - RNA, 42 nt, Mus musculus
guaucugaacuuggggcaggaccuucugggaguaacggaguu

SEQ ID NO: 67523 - RNA, 41 nt, Mus musculus
aaccugauaaaaccuugcgcuuuucccucugcagugauaau

SEQ ID NO: 67524 - RNA, 62 nt, Mus musculus
agagaugucaaaguuggagucaaaauugguuuuaagaauuuguuaagaguaugagguuagag

SEQ ID NO: 67525 - RNA, 52 nt, Mus musculus
gccuggacaaugagacugugccucaaaaauaaaguaaaagccagaaagggaa

SEQ ID NO: 67526 - RNA, 46 nt, Mus musculus
ugccaccaacauauauaucuaauuuuuuuuuaaacuucaaagggga

SEQ ID NO: 67527 - RNA, 41 nt, Mus musculus
guuguaagccaucauguagggguuggaaaucaaauucaggu

SEQ ID NO: 67528 - RNA, 45 nt, Mus musculus
auuccugguuuguagagucacccucuuacggugcucugguggugu

SEQ ID NO: 67529 - RNA, 46 nt, Mus musculus
gcuuaaucguguugcuuuguuuuauuuuguguuuugauacugaguc

SEQ ID NO: 67530 - RNA, 45 nt, Mus musculus
uuucauugugaguuuuucccuuauuuguuagcaacucggagcaga

SEQ ID NO: 67531 - RNA, 80 nt, Mus musculus
gugcucuuaacugcugagccaacucaccagcccucuaauggucagauuugaagaagagucuguauugucaucaggagaau

SEQ ID NO: 67532 - RNA, 46 nt, Mus musculus
gacuggaguuauacaucuauaagcuaguaugugcuuguugagaguu

SEQ ID NO: 67533 - RNA, 45 nt, Mus musculus
gaaaagaaaagaaaagggaaaaauauauguauucaugguaggaga

SEQ ID NO: 67534 - RNA, 46 nt, Mus musculus
agacaagauacacauuuuauugggaacauuauuuuguuugcuagau

SEQ ID NO: 67535 - RNA, 46 nt, Mus musculus
ugcuggcuugcuucauuuguccugcaguugucaauccagagcagua

SEQ ID NO: 67536 - RNA, 46 nt, Mus musculus
uuuuaacuguaacaauuuaguauaauguuguuaaaaguagucagau

SEQ ID NO: 67537 - RNA, 46 nt, Mus musculus
ggauacuuugguccuucuuagaagggggaucaaaauucccauggga

SEQ ID NO: 67538 - RNA, 46 nt, Mus musculus
auacccaagguacaauucacagaccacaugaauugaagcucaagaa

SEQ ID NO: 67539 - RNA, 46 nt, Mus musculus
guguguguauguguguguguguguguguguguguguaucugugugu

SEQ ID NO: 67540 - RNA, 70 nt, Mus musculus
guuuuaaccauaugaguugaaaagcuuaaauuauuccucaguuugauuuuauauaaaaaugugguaagug

SEQ ID NO: 67541 - RNA, 41 nt, Mus musculus
agucuggucuacagagugaguuccaggauagccaggauuau

SEQ ID NO: 67542 - RNA, 46 nt, Mus musculus
gggaaauuaaaucguuuuuucuuuccucagccauguagcucugugu

SEQ ID NO: 67543 - RNA, 45 nt, Mus musculus
auuauaaauagucaugugugugguauggagugaacuugguucauu

SEQ ID NO: 67544 - RNA, 42 nt, Mus musculus
uccaguguacuggggaaucagcucaacacuguaggaagaaga

SEQ ID NO: 67545 - RNA, 46 nt, Mus musculus
ggacucaauagcccuguucaccuaaaacuggguauguacaccaggu

SEQ ID NO: 67546 - RNA, 46 nt, Mus musculus
aauuaaauuaaacuuaauaaaaugaaaauuuugaguuugagcaaaa

SEQ ID NO: 67547 - RNA, 42 nt, Mus musculus
gcgauuaaauagcuagaauggucgauugauaagugcugagaa

SEQ ID NO: 67548 - RNA, 46 nt, Mus musculus
ucagaucagagucuuccaacacuuucuggacaggcuucaugguaga

SEQ ID NO: 67549 - RNA, 46 nt, Mus musculus
guuucaauaccaaguguaaggggacaaacaucaagcaguaccagau

SEQ ID NO: 67550 - RNA, 42 nt, Mus musculus
auuaccuucauagaccuugauuguuacaguuggcugauuauc

SEQ ID NO: 67551 - RNA, 46 nt, Mus musculus
aaccucuucauuugaguuacaaaacauacuucuuucccugggagga

SEQ ID NO: 67552 - RNA, 42 nt, Mus musculus
ugcucuuaauuucaacucuucaaagcauuguaagccccucug

SEQ ID NO: 67553 - RNA, 46 nt, Mus musculus
uucucagcaucauuaaccauccuuucaauuucuucaggugucaggc

SEQ ID NO: 67554 - RNA, 23 nt, Mus musculus
gggcuggggacauagggaucuug

SEQ ID NO: 67555 - RNA, 45 nt, Mus musculus
cuccccuccauccccaagaacauuccacacaucguccgcagcuau

SEQ ID NO: 67556 - RNA, 45 nt, Mus musculus
guagaggccggccaugaccauguggagagaggggagaaggaaaug

SEQ ID NO: 67557 - RNA, 42 nt, Mus musculus
augccuauaaucccaauauucugaaggcagaggcaggcagau

SEQ ID NO: 67558 - RNA, 45 nt, Mus musculus
aagacccucuuccuagcugccugguagcagccuucagauaaagau

SEQ ID NO: 67559 - RNA, 46 nt, Mus musculus
aguccuggugaguagacacagguuacuuucuuuuuaucgcugugau

SEQ ID NO: 67560 - RNA, 45 nt, Mus musculus
gaaugaaugaaugaaugaaugaaugaaugaaugaacaaaggagca

SEQ ID NO: 67561 - RNA, 63 nt, Mus musculus
ucaugaaacugugguaaugagacugaaacugucugggaagaucuucagaggaaagauagaggg

SEQ ID NO: 67562 - RNA, 46 nt, Mus musculus
gccaugccaacuccuugaaacuggcuuuaaauauccacuagcagug

SEQ ID NO: 67563 - RNA, 45 nt, Mus musculus
gcggagauguggccggcagaggggacgcaaaggagguggcuagga

SEQ ID NO: 67564 - RNA, 45 nt, Mus musculus
gcuucugacauaccuugacagcuucaagcauuuucacacggggag

SEQ ID NO: 67565 - RNA, 46 nt, Mus musculus
uccuuaccugauuuuugccucaaaaucuuggguaucuuggguaguc

SEQ ID NO: 67566 - RNA, 45 nt, Mus musculus
ugugcauauguauaggcacacgugccauagugcacauguggagau

SEQ ID NO: 67567 - RNA, 46 nt, Mus musculus
gugguguggugugguguggugugugguguggugugguguggugugg

SEQ ID NO: 67568 - RNA, 42 nt, Mus musculus
ugaaagccucacaaaucuaaauauaaacaugagcagcuagca

SEQ ID NO: 67569 - RNA, 46 nt, Mus musculus
ggucaaguucauagcaacagaaagccgagaucaggcaccagggaga

SEQ ID NO: 67570 - RNA, 42 nt, Mus musculus
cacagaaaaauuaaaacagagcuagcguaugagccagcaacu

SEQ ID NO: 67571 - RNA, 45 nt, Mus musculus
gaccaagguauuuuuggauaugcuacucaaagcacaggcaacaga

SEQ ID NO: 67572 - RNA, 46 nt, Mus musculus
aacucagcacaguguaauuaaggacaggaauguaaaacgugaagcg

SEQ ID NO: 67573 - RNA, 46 nt, Mus musculus
uaaacccaaagaagauuugaaauuguucuauuuauagguauaaaug

SEQ ID NO: 67574 - RNA, 42 nt, Mus musculus
uaccacaaguggacuggugacucaacuccuaaaagagcugac

SEQ ID NO: 67575 - RNA, 97 nt, Mus musculus
acccaggcuggccuggaagcucuguuugaaaguaaccugcuggaugauuugaagaauguaaugaaaacaaacgacguuguucgauacagggucuaug

SEQ ID NO: 67576 - RNA, 62 nt, Mus musculus
uguuacugagauucucaauaaugcugagcuguugaaacagauuguuuauugcauuggcggag

SEQ ID NO: 67577 - RNA, 45 nt, Mus musculus
gacucacccugaugacucuguaaaaacccucacucugucgcaggu

SEQ ID NO: 67578 - RNA, 42 nt, Mus musculus
auuuucccccuucucccccccaacccccaucaccacccauca

SEQ ID NO: 67579 - RNA, 44 nt, Mus musculus
uuuuaaaaauuauuuuaagagagagagagcaagcaugugugugc

SEQ ID NO: 67580 - RNA, 46 nt, Mus musculus
ucuguaaucuugacaccuugcgugagggaaauuuaacaccuaagau

SEQ ID NO: 67581 - RNA, 46 nt, Mus musculus
cuuuuuguauuugaauuuuaauuugaaaagauagugagcuccaguc

SEQ ID NO: 67582 - RNA, 57 nt, Mus musculus
auguguaaauuaauccacuauauaccccuuacaagcgagaguaaacugcauaaccca

SEQ ID NO: 67583 - RNA, 42 nt, Mus musculus
cucugggaaccuaguaggugggcgggcagacgggagccaggg

SEQ ID NO: 67584 - RNA, 42 nt, Mus musculus
ucagucucuuagucucccggcacgcgcaagacuccgggcccc

SEQ ID NO: 67585 - RNA, 46 nt, Mus musculus
uacuucacgauuaucguacccuugaagccuagaagcuaauuggcag

SEQ ID NO: 67586 - RNA, 45 nt, Mus musculus
uuaguaauccaguaggcuaaaacucagucacagggaggggaggag

SEQ ID NO: 67587 - RNA, 42 nt, Mus musculus
ggguauuuccccaaaguucauccacccagucuaagcccagag

SEQ ID NO: 67588 - RNA, 57 nt, Mus musculus
ccccucccucuucuuuccuguauguucacuagaggggcuuuuagaauggauagaaau

SEQ ID NO: 67589 - RNA, 47 nt, Mus musculus
gcccuucagcuucgauaccuucaaacccugaccacuaucgcugcaga

SEQ ID NO: 67590 - RNA, 41 nt, Mus musculus
aggugauugcagcugaaggggaaaugaaugcguccagagcu

SEQ ID NO: 67591 - RNA, 46 nt, Mus musculus
uuugccaucugccucaugaugauaccauggaaugcugucccauuuc

SEQ ID NO: 67592 - RNA, 27 nt, Mus musculus
agccgcccgggaggcuagggccaaggu

SEQ ID NO: 67593 - RNA, 24 nt, Mus musculus
aacugaccugaagugggagcucag

SEQ ID NO: 67594 - RNA, 46 nt, Mus musculus
ucguaauuauaaccuucccaauaucaauauggauuugcauaaaggu

SEQ ID NO: 67595 - RNA, 46 nt, Mus musculus
cacuugcuaaauucuagaagucuggugugggaugcuggugaaaggg

SEQ ID NO: 67596 - RNA, 42 nt, Mus musculus
guuaagcuagagcaguggacaauagugcagguggauggcaga

SEQ ID NO: 67597 - RNA, 42 nt, Mus musculus
gcucacgcacaacuggggcacugaagaugacgagacucagag

SEQ ID NO: 67598 - RNA, 54 nt, Mus musculus
acauugggauugccguuccugaugucuacagugccuguaagagauuugaagaac

SEQ ID NO: 67599 - RNA, 74 nt, Mus musculus
uucugaauccuaacaaaauagcaacgauuauuuaguuucgggagaaugugccuuugagguaugggggacagcgg

SEQ ID NO: 67600 - RNA, 46 nt, Mus musculus
uguuuugccaaccuaauuuucaaguagcaauuuaucuuaugaccuu

SEQ ID NO: 67601 - RNA, 45 nt, Mus musculus
aagguacuccugagagcaauucggaaucaugcugacaaggacaca

SEQ ID NO: 67602 - RNA, 41 nt, Mus musculus
cgaugaauguaguaggacuggggaaacuaagucucguguuu

SEQ ID NO: 67603 - RNA, 45 nt, Mus musculus
ccaauuggcuuggaggagaaggacuggguacgcuggacuuggaga

SEQ ID NO: 67604 - RNA, 41 nt, Mus musculus
ugucagcugaucacagcagcaauggcuaauucaguccgagu

SEQ ID NO: 67605 - RNA, 41 nt, Mus musculus
ggccacccagacucccagaucugucaccuccuccccuaaga

SEQ ID NO: 67606 - RNA, 44 nt, Mus musculus
aaaagaagggucuuagaaguccggcuaggcuggccgccaucagg

SEQ ID NO: 67607 - RNA, 42 nt, Mus musculus
guuacacuauagagugauggaguagauagaaucagggggauu

SEQ ID NO: 67608 - RNA, 45 nt, Mus musculus
gaggaugcuaggggggauaugugugugggagguggacuuuaccag

SEQ ID NO: 67609 - RNA, 46 nt, Mus musculus
ucaaugccauuacucccaaacaagucuuuauuucagauguggagaa

SEQ ID NO: 67610 - RNA, 41 nt, Mus musculus
uacugucuggaacuauuggcaguaacuaucuagggccagua

SEQ ID NO: 67611 - RNA, 45 nt, Mus musculus
caaggcagucaucagagcagcuacuuguguguuucaugugccuga

SEQ ID NO: 67612 - RNA, 46 nt, Mus musculus
aagaccugugugcaaggaaacaaaaaucccagggucauccagagau

SEQ ID NO: 67613 - RNA, 45 nt, Mus musculus
aacuaagcgauuacuucaagagccacggguuaagugcagggagag

SEQ ID NO: 67614 - RNA, 46 nt, Mus musculus
augcuugccuuccagugugugugugugugugugugugugugugugu

SEQ ID NO: 67615 - RNA, 45 nt, Mus musculus
cuugcuggcauugugcaauagugucuggguuugguggcugacuau

SEQ ID NO: 67616 - RNA, 44 nt, Mus musculus
agggaggguugcuguagccccuuugagauucagaacccuugaga

SEQ ID NO: 67617 - RNA, 41 nt, Mus musculus
ccaaccuuauccccagcccuccgaccuacaacucagcgcau

SEQ ID NO: 67618 - RNA, 46 nt, Mus musculus
gcuacuauacucgcauucugcccucuguacccaaagacugccccac

SEQ ID NO: 67619 - RNA, 46 nt, Mus musculus
agggcaguaggcaacagcuccuccaacauggacauaaucaaggaag

SEQ ID NO: 67620 - RNA, 42 nt, Mus musculus
cuguguguguguguguguguguguauguguguguguaggcca

SEQ ID NO: 67621 - RNA, 42 nt, Mus musculus
uccacgaucuggcuucgugaacauaaccgcgugugcgaccug

SEQ ID NO: 67622 - RNA, 45 nt, Mus musculus
ugcuguuccgagcccaguuccaauaucgaaaccgcaucgccaugg

SEQ ID NO: 67623 - RNA, 45 nt, Mus musculus
gugugugugugugugugagagagagagagagagagagaggucaga

SEQ ID NO: 67624 - RNA, 45 nt, Mus musculus
gauucugagacugacagcaugcuaaucucuuacagauugguggag

SEQ ID NO: 67625 - RNA, 46 nt, Mus musculus
ccgggguugcugcuggagaagugccagcccaacuccaucuuuggag

SEQ ID NO: 67626 - RNA, 52 nt, Mus musculus
cugccucaacaccaagaccugccccuauguuuccuuccgugugccagauuac

SEQ ID NO: 67627 - RNA, 47 nt, Mus musculus
gagagcugaugcucacauuugaaacuuugggucuuacccuugccuag

SEQ ID NO: 67628 - RNA, 46 nt, Mus musculus
cuuuguuaacuaagaaaguuagaagugguuuugucugccuccucag

SEQ ID NO: 67629 - RNA, 45 nt, Mus musculus
guuccuacuaucauuuacaccagcuguuuuaucucuuucucuagg

SEQ ID NO: 67630 - RNA, 45 nt, Mus musculus
ucaagguguguauguaggcuuauguuauacuacaauggccugggg

SEQ ID NO: 67631 - RNA, 44 nt, Mus musculus
gcgacugaugagaaagagaugucugugaaggccaagugacugag

SEQ ID NO: 67632 - RNA, 45 nt, Mus musculus
gagcaucuuuggagcugugacugaugagaaagagacguccgugaa

SEQ ID NO: 67633 - RNA, 42 nt, Mus musculus
ucacaaaaguagugcggaacgguauuguuucuaaagugagau

SEQ ID NO: 67634 - RNA, 46 nt, Mus musculus
agaggucacagaaauaguaggggaugguguuguuucuaaagugaga

SEQ ID NO: 67635 - RNA, 45 nt, Mus musculus
uguggcgaaugucaacacccaugauggcgccuucugcucggccag

SEQ ID NO: 67636 - RNA, 46 nt, Mus musculus
gguugagugaugugucagaacaggacaacuuaagcagggcacccag

SEQ ID NO: 67637 - RNA, 46 nt, Mus musculus
agguacauggccaucugucauccucuccauuacaucacuaucauga

SEQ ID NO: 67638 - RNA, 42 nt, Mus musculus
agauccugaguucaauacguuccacucaggaaaccuggagag

SEQ ID NO: 67639 - RNA, 46 nt, Mus musculus
ccaaggagcgccaggcauagacguggugacauaacugugguauaga

SEQ ID NO: 67640 - RNA, 46 nt, Mus musculus
guugaaauacuucuuaauucugucuggcauuucauucaauagagag

SEQ ID NO: 67641 - RNA, 45 nt, Mus musculus
uucaauuugaauuuccaaauuguaauguuucccuuugugcuauag

SEQ ID NO: 67642 - RNA, 42 nt, Mus musculus
uuuuaaggcauauacucagcuucuauuuaaaacuauaaaaua

SEQ ID NO: 67643 - RNA, 46 nt, Mus musculus
uguaucccuuugcuggcaagggaguacaaggagucaaaccacagau

SEQ ID NO: 67644 - RNA, 46 nt, Mus musculus
ugucuuagaacuguucuuuuguuuuagugaauaaagaguaccaaug

SEQ ID NO: 67645 - RNA, 46 nt, Mus musculus
ucaucugaccuuucuucaaaaugauaccugcugaugucacagagga

SEQ ID NO: 67646 - RNA, 46 nt, Mus musculus
caguguuggcaaccucauucugaaaacucacguuaugucugaagau

SEQ ID NO: 67647 - RNA, 47 nt, Mus musculus
caauggaacagcaguggaaaauggucauccagcccagcagcaccaga

SEQ ID NO: 67648 - RNA, 45 nt, Mus musculus
guuacugauuuaucuggucauagaaagcauucuaguaccggagac

SEQ ID NO: 67649 - RNA, 46 nt, Mus musculus
aacugcuucccaaggaagugcaacuaagcccaucagcguaucaggu

SEQ ID NO: 67650 - RNA, 55 nt, Mus musculus
gggauguaaagagaagagugcauuuauuugaagcucagagaaggacaaaagaaga

SEQ ID NO: 67651 - RNA, 73 nt, Mus musculus
guaccauaggcucuuguauaaaugccauugauucggagcccaaagacguaauugcuaauucaaaugcuguauu

SEQ ID NO: 67652 - RNA, 46 nt, Mus musculus
ucauuugaagaccaguugugaggaacaguuaagaagaaagccagau

SEQ ID NO: 67653 - RNA, 46 nt, Mus musculus
uuccaugccauaugcugaucauuacaguacauucuccccucgagau

SEQ ID NO: 67654 - RNA, 46 nt, Mus musculus
acucagauaccuuuugaagucccacaauacccacaaacaggcaagu

SEQ ID NO: 67655 - RNA, 46 nt, Mus musculus
uaaaacauagaaaacguuuaaccuaggaucugcuagcugcucagua

SEQ ID NO: 67656 - RNA, 48 nt, Mus musculus
accugcauuguuucccaaagugugaauaauaaauaguagggagaucuu

SEQ ID NO: 67657 - RNA, 46 nt, Mus musculus
ugaaagguuuuguguuacuggaacucaggaauauguguacucaguu

SEQ ID NO: 67658 - RNA, 45 nt, Mus musculus
aaaaucugcugcugccaaguugacaacugguauuugguccugagg

SEQ ID NO: 67659 - RNA, 46 nt, Mus musculus
aguagaaaccuaaacaggugagaaguuugaaugucuagccccauuu

SEQ ID NO: 67660 - RNA, 45 nt, Mus musculus
agcuaaucccacgaggcacugacagugcaguaaggacuuuggaga

SEQ ID NO: 67661 - RNA, 46 nt, Mus musculus
aaacaugcugauuauuuuuaaacagguaccgauuaaggaacaaaaa

SEQ ID NO: 67662 - RNA, 41 nt, Mus musculus
uaaggccagggcuacacagagaagcccugugguggggguug

SEQ ID NO: 67663 - RNA, 48 nt, Mus musculus
ccugccucugccucccaaguguuggaauuugccaccaccacccugcug

SEQ ID NO: 67664 - RNA, 46 nt, Mus musculus
agagacauuugggagaguccaaagugaacaagacccugagccaggc

SEQ ID NO: 67665 - RNA, 46 nt, Mus musculus
aacaaggggguuguccacgaggaacaaauuguacauuugcccauuc

SEQ ID NO: 67666 - RNA, 46 nt, Mus musculus
ucuuccaguaggaaauggugaauggaacuuguuucugcaugcauga

SEQ ID NO: 67667 - RNA, 46 nt, Mus musculus
uucuuaaguuccuuuaaaaauuauuuuguuacuacaauuugaagau

SEQ ID NO: 67668 - RNA, 46 nt, Mus musculus
guuuugcagcgaacuggugacccugcuaauuuaaauaggcugagac

SEQ ID NO: 67669 - RNA, 42 nt, Mus musculus
ucggaguuacgaggcacuacgcagagaacaugaugcccagau

SEQ ID NO: 67670 - RNA, 72 nt, Mus musculus
gaguucaaaucccagcaaccacaugguggcucgcaaccauccuaacgagaucugauucccucuucuggagug

SEQ ID NO: 67671 - RNA, 56 nt, Mus musculus
auugcuaggccaugacugagguuaccccacaacacacacacacacacacacacaca

SEQ ID NO: 67672 - RNA, 45 nt, Mus musculus
cagguuucucucuguagccuugggugcucuggaacuugcccuaua

SEQ ID NO: 67673 - RNA, 46 nt, Mus musculus
uuggauacuuguucauguuugcuuuuuaucuguaaaagcacuagau

SEQ ID NO: 67674 - RNA, 47 nt, Mus musculus
caauucccagcaaccacaugguggcucacaaucaucuguaacgaacg

SEQ ID NO: 67675 - RNA, 23 nt, Mus musculus
cuugcaguaaugugagugaggaa

SEQ ID NO: 67676 - RNA, 41 nt, Mus musculus
guagaggacuuggcacucuacuuaaaaccacuaaguggagg

SEQ ID NO: 67677 - RNA, 45 nt, Mus musculus
guagccgcgccugguggcacaugcuuggaaacucagcacuugaga

SEQ ID NO: 67678 - RNA, 46 nt, Mus musculus
aucugcuauaaugaauuugaugagaaugugcacaaacccaucaguu

SEQ ID NO: 67679 - RNA, 42 nt, Mus musculus
gguuauccaaagaaaacacuucaaucuucaaacgguccagua

SEQ ID NO: 67680 - RNA, 46 nt, Mus musculus
auuauccuaaauaccuauauuuaauguuuaucugauggccuuuguc

SEQ ID NO: 67681 - RNA, 42 nt, Mus musculus
ggaacccaaaacuuucccaaugguauccuuuuagagucagaa

SEQ ID NO: 67682 - RNA, 45 nt, Mus musculus
auuuccauccuugaaaucaccagaguuuuuaagauacuggcagac

SEQ ID NO: 67683 - RNA, 44 nt, Mus musculus
caaauccuagcaaccacauaguggcucacaaccauccauaauga

SEQ ID NO: 67684 - RNA, 46 nt, Mus musculus
uugcaugacauuucugaaaaauucagcaaaguagaaucuguaaaga

SEQ ID NO: 67685 - RNA, 46 nt, Mus musculus
gagcugggcaaagugcacaugccuauaauucuagcacuugggagau

SEQ ID NO: 67686 - RNA, 45 nt, Mus musculus
uugaaaguuuugcuuguggggaggguguuuuauaaugugguuguu

SEQ ID NO: 67687 - RNA, 42 nt, Mus musculus
aaugacuuuuuuagacacauuuuauaaaaaugcagcacaugu

SEQ ID NO: 67688 - RNA, 46 nt, Mus musculus
ggaaagcaaugcauuacaaucugcugcagagacacugacaucagag

SEQ ID NO: 67689 - RNA, 64 nt, Mus musculus
ugaaauacuugacugcugccaguuaccuucagaugguucacauuguagaaaaaugcacagaagc

SEQ ID NO: 67690 - RNA, 26 nt, Mus musculus
ugcuccacuuucaugagagaucaguu

SEQ ID NO: 67691 - RNA, 42 nt, Mus musculus
gagucugauguucuacacuuccaguuugaacagcaaggagau

SEQ ID NO: 67692 - RNA, 45 nt, Mus musculus
acaauuuaacauuaaggagcuggguguaugaaaaacggaccaaga

SEQ ID NO: 67693 - RNA, 46 nt, Mus musculus
aaagcacaaguugggaaauggagcugaaaucgugaauguaauagau

SEQ ID NO: 67694 - RNA, 46 nt, Mus musculus
cgacuugggaaccgugugccucguuggagggaguuggcaggcaggc

SEQ ID NO: 67695 - RNA, 46 nt, Mus musculus
gccucaaagccaguuuugcuagucgguaagugaaagugacggagac

SEQ ID NO: 67696 - RNA, 46 nt, Mus musculus
cucucuaguuggaggcuauuucuugauuaauuucagucacucagaa

SEQ ID NO: 67697 - RNA, 46 nt, Mus musculus
ccuuguauucauccaucugaagacaguauggauauggaggacagug

SEQ ID NO: 67698 - RNA, 46 nt, Mus musculus
aauggcuacgcuaaugaagcaggaacuccaauuggagccaacagua

SEQ ID NO: 67699 - RNA, 46 nt, Mus musculus
aggaggcaagugcuaaugugucauagauaauuauacgcugaaagag

SEQ ID NO: 67700 - RNA, 46 nt, Mus musculus
ggucaggggucuggagaccuaauggucagcaaacccagccccagcc

SEQ ID NO: 67701 - RNA, 46 nt, Mus musculus
ggccagagaccccuuugaggauuugcugcgaaaaaccaagcaagau

SEQ ID NO: 67702 - RNA, 25 nt, Mus musculus
cuagggccagcauaugcaccuagca

SEQ ID NO: 67703 - RNA, 89 nt, Mus musculus
aguuacacuugccccuuugaggguaaucaaagacaccacaaucucugaacagcaaaaaggcucaagccauuguuagguggcccacagau

SEQ ID NO: 67704 - RNA, 46 nt, Mus musculus
agagauggcucagcgguuaagaauacuugacuacucuuccagaggu

SEQ ID NO: 67705 - RNA, 46 nt, Mus musculus
ccaaggauggcaccacccacaaugggcuaguguuaauaccaaagau

SEQ ID NO: 67706 - RNA, 42 nt, Mus musculus
caucauagcaacacuaacccuaaguaggagagaugggcggga

SEQ ID NO: 67707 - RNA, 46 nt, Mus musculus
uaugcuaacgucugaggguccggggcuggaaguacaggagggaggu

SEQ ID NO: 67708 - RNA, 31 nt, Mus musculus
cucuggaucuggccagcaggcagguuccaag

SEQ ID NO: 67709 - RNA, 46 nt, Mus musculus
aaggaagaaggggaguaaacuguucccuucuccuuucuuacagguc

SEQ ID NO: 67710 - RNA, 48 nt, Mus musculus
gcugaggcauugggcucccauggcagcugcagcagugagguggaaaag

SEQ ID NO: 67711 - RNA, 46 nt, Mus musculus
agaagcgggccgccgagaagguguccgaggcccgcaagcgaaagaa

SEQ ID NO: 67712 - RNA, 44 nt, Mus musculus
ugccucgcggaugguggcagcggcggcagcggcgacucagaccc

SEQ ID NO: 67713 - RNA, 41 nt, Mus musculus
gcaugagcuuucuugucaucaggcuggaaucaccagggaga

SEQ ID NO: 67714 - RNA, 46 nt, Mus musculus
ucccuacucucuuaaauaccaucaauaaaguucgcugcacccaccu

SEQ ID NO: 67715 - RNA, 45 nt, Mus musculus
aggauuucuuacuccuuagaggccauguaggccaugagguccacc

SEQ ID NO: 67716 - RNA, 45 nt, Mus musculus
caguagauuguuuuuuguuuuuguuuuuguuuucuuccccucuca

SEQ ID NO: 67717 - RNA, 46 nt, Mus musculus
acuuuucagucccaaagucuggaaugguguggugugguguggugug

SEQ ID NO: 67718 - RNA, 44 nt, Mus musculus
uggacagguacagggcgaauuacugggggaaggggaaaaaggga

SEQ ID NO: 67719 - RNA, 45 nt, Mus musculus
ugguaucauggcggaaccacaaggauucgccaccagaggaaucag

SEQ ID NO: 67720 - RNA, 41 nt, Mus musculus
aucugguacauaugugaguggaugcuuagauacagcccaua

SEQ ID NO: 67721 - RNA, 41 nt, Mus musculus
cucucucucucucucucucucucucucucuguguguggugc

SEQ ID NO: 67722 - RNA, 46 nt, Mus musculus
aacaaaguaaaauuuuaaaaaaguugaguguggucaauucagucag

SEQ ID NO: 67723 - RNA, 46 nt, Mus musculus
agguaaggugggauagaccucaucugaaggaaggauuggaguccug

SEQ ID NO: 67724 - RNA, 46 nt, Mus musculus
gacauaguauauaagacauuuaaaauauagguucaguucuugggag

SEQ ID NO: 67725 - RNA, 45 nt, Mus musculus
ccuugguuuucuugucuuuuuauuauugcuagugugcaagcucag

SEQ ID NO: 67726 - RNA, 45 nt, Mus musculus
guuagaauaaaaugcagaggacacugggaaguaaagagguuuaaa

SEQ ID NO: 67727 - RNA, 46 nt, Mus musculus
gacugggggugggaugggucuauaagcauuuuuuauaaagggcuag

SEQ ID NO: 67728 - RNA, 46 nt, Mus musculus
uugcagaugagauaaagggaguagcuguguuaggagauaagaugag

SEQ ID NO: 67729 - RNA, 46 nt, Mus musculus
gauauauauggaacauuaggcaguuguuggaagaugaaucaccgaa

SEQ ID NO: 67730 - RNA, 46 nt, Mus musculus
aguugacagccuuauaggaaugucaagucacagauguagguccaag

SEQ ID NO: 67731 - RNA, 45 nt, Mus musculus
uuaacuuuacacauuguugguaacuccaggagauguuucugugga

SEQ ID NO: 67732 - RNA, 31 nt, Mus musculus
aguuagcuguggucugucacuuuucaagaua

SEQ ID NO: 67733 - RNA, 46 nt, Mus musculus
ucaagauuaagcuuacagaaaagguaaaauuaaaucauacccagaa

SEQ ID NO: 67734 - RNA, 45 nt, Mus musculus
auaguauaaacaauaucuugaauacuccuuuugaauaggugagua

SEQ ID NO: 67735 - RNA, 46 nt, Mus musculus
cuuccugaggaaaacggggcaucaacgaagccugaagauuuaggua

SEQ ID NO: 67736 - RNA, 32 nt, Mus musculus
uguaggaugauuaggggaugguauaggagagg

SEQ ID NO: 67737 - RNA, 46 nt, Mus musculus
uuuacuagugugauacauuucugguuaauucuuaguuucugguaug

SEQ ID NO: 67738 - RNA, 45 nt, Mus musculus
ggcugccagggccaggaagcaggaguggguggguuguugagcaug

SEQ ID NO: 67739 - RNA, 79 nt, Mus musculus
guauucuagguucccgaaugauagauaaacacacacacacacacacaaacauauacacccacccaugcacagagcccua

SEQ ID NO: 67740 - RNA, 44 nt, Mus musculus
acagggaaacgccagggccaauaggcgggagugggaggaugggg

SEQ ID NO: 67741 - RNA, 41 nt, Mus musculus
caaucagaauggauaagaucaaaagcucaggugauagcaca

SEQ ID NO: 67742 - RNA, 45 nt, Mus musculus
acauggugucucacaaccaucuauagugagaucugaugcccucuu

SEQ ID NO: 67743 - RNA, 42 nt, Mus musculus
aagggguugugucccaagugaccuauuucacuaggcccccag

SEQ ID NO: 67744 - RNA, 46 nt, Mus musculus
auuuacauuaaguuuucuguuaccuuacaggugcuauacuuggcag

SEQ ID NO: 67745 - RNA, 46 nt, Mus musculus
gccaugccucacaagagacaggguccugucagcaaaauagagcaag

SEQ ID NO: 67746 - RNA, 45 nt, Mus musculus
cucugcuuucauauugaaguuauuaaugaugaaaaguggucucag

SEQ ID NO: 67747 - RNA, 41 nt, Mus musculus
guuaccuguauguaugcauaaauguaaagauacaaccugcu

SEQ ID NO: 67748 - RNA, 46 nt, Mus musculus
cucucucuauauauauauauauauauauauauauauauacagaaug

SEQ ID NO: 67749 - RNA, 29 nt, Mus musculus
cuauaauaagaguacaucaucauuggcaa

SEQ ID NO: 67750 - RNA, 46 nt, Mus musculus
agcgauaaacuuuuauauagagaaaugagaauuuaaaacuguagua

SEQ ID NO: 67751 - RNA, 46 nt, Mus musculus
cucuccuagccucauguuuuuucuguggauaaaaaaagcccgacuc

SEQ ID NO: 67752 - RNA, 36 nt, Mus musculus
agguguaugugcauaugugauugugggugcccacaa

SEQ ID NO: 67753 - RNA, 92 nt, Mus musculus
aaccauuggcccggaccugguaauauaaggcauugaaguaacuauaaugaggugcagucacagcugagaaauuuaaggugugguauacagau

SEQ ID NO: 67754 - RNA, 45 nt, Mus musculus
gcaccuuuguuuuuauaaguaucauaaauauguuuuugagaggac

SEQ ID NO: 67755 - RNA, 82 nt, Mus musculus
gggagauggaucugggaaacuuacugcaucgucugcagcacagauaugaagaggagucuaagggaaaagcugcaaacuguaa

SEQ ID NO: 67756 - RNA, 71 nt, Mus musculus
agaacuucugaaaauguacucgaagaauguggcccucuccaaaucaaggaucuuuuggaccuggcuaauca

SEQ ID NO: 67757 - RNA, 46 nt, Mus musculus
cauagucaucaaagugggguacaguaaagaggcuuccaagcauuac

SEQ ID NO: 67758 - RNA, 44 nt, Mus musculus
aaccaguguuugaauuuauuugaagucuaucuaugcccugcaca

SEQ ID NO: 67759 - RNA, 46 nt, Mus musculus
gcacauuauaccaaaucuuccuaaaaaguaauuuuucaaaaaagua

SEQ ID NO: 67760 - RNA, 37 nt, Mus musculus
uuccauguacauucuuuguauauguucagaagggauc

SEQ ID NO: 67761 - RNA, 40 nt, Mus musculus
ugagcaaaguuggaguuuauuaggaaagagauuuuagcgu

SEQ ID NO: 67762 - RNA, 42 nt, Mus musculus
gcacacaaaaagaacccgugaauacaaaauuggaagccagaa

SEQ ID NO: 67763 - RNA, 46 nt, Mus musculus
auuuaauauuuucucauuauucaagguuuuuuccucccaguaagaa

SEQ ID NO: 67764 - RNA, 46 nt, Mus musculus
uuauaauagcaaugaaacauuuaaaugacauauaugaagaggagcc

SEQ ID NO: 67765 - RNA, 46 nt, Mus musculus
uauucgccuuagaauccaagcuacacauaugcugugccuccaucag

SEQ ID NO: 67766 - RNA, 46 nt, Mus musculus
uuuaaaucgaguaaccguaucacacccauuuaugacuucagcagau

SEQ ID NO: 67767 - RNA, 45 nt, Mus musculus
agaaucaguaaagauaccaugguagaaaauuaugagacaugccau

SEQ ID NO: 67768 - RNA, 56 nt, Mus musculus
aaacagacuaaauggagauccagcuuugccauuuaccugcugugaaagaaggggaa

SEQ ID NO: 67769 - RNA, 46 nt, Mus musculus
ccaagaaacagaacuguuugaaaggauuaggaaauguggccuugua

SEQ ID NO: 67770 - RNA, 26 nt, Mus musculus
cuuucagcagcuggucaguagcaucu

SEQ ID NO: 67771 - RNA, 45 nt, Mus musculus
uuucccaaguaaggucuggcugucugguugcccggaauacauaag

SEQ ID NO: 67772 - RNA, 48 nt, Mus musculus
aaauauuguggaaaaucaaaugaauucauuaaauguaucugccgguga

SEQ ID NO: 67773 - RNA, 45 nt, Mus musculus
acucuuagaaaagagagugaagucacgauuuucucaccggcagau

SEQ ID NO: 67774 - RNA, 46 nt, Mus musculus
aaugcuguuagucccuuccgccugguccuuggugcuggggcagacc

SEQ ID NO: 67775 - RNA, 53 nt, Mus musculus
gguggggguucuuaccaacuucucugagugcaggggguucucuaggauggauc

SEQ ID NO: 67776 - RNA, 81 nt, Mus musculus
aaacuaggggucugccccagaagcaaggaccgggcugaagggguagaagggauggaaagggagggcagggguuuggugggu

SEQ ID NO: 67777 - RNA, 45 nt, Mus musculus
cuucaguccacugcucugagugaagcugguccucuaggauagauc

SEQ ID NO: 67778 - RNA, 46 nt, Mus musculus
agacuucauagagucaccuagaccaacaaacaccagggauauccag

SEQ ID NO: 67779 - RNA, 46 nt, Mus musculus
cuuaaaggacucuauuaucuucauaagauaggauuuuaggacagau

SEQ ID NO: 67780 - RNA, 46 nt, Mus musculus
uuagauuuggucuuuucauuguuuccugaauuuccugaaugcuuug

SEQ ID NO: 67781 - RNA, 42 nt, Mus musculus
gggaccuuuuuccauccuuuuauucugagauugggccugucu

SEQ ID NO: 67782 - RNA, 42 nt, Mus musculus
auggauuuucacauauugauccaaccuugcaucccgggaaug

SEQ ID NO: 67783 - RNA, 39 nt, Mus musculus
cagaguuacccuccuccucagcuucuuucagcuuucccu

SEQ ID NO: 67784 - RNA, 46 nt, Mus musculus
uaucagcuaguuuaugcugccuguuugguaguccaguguuugagag

SEQ ID NO: 67785 - RNA, 45 nt, Mus musculus
ccaaucuacauguaaguccaauaacugcuacuggugucugugcag

SEQ ID NO: 67786 - RNA, 45 nt, Mus musculus
gaguucuguaggcuucuuguauguucaugggcaucucuuucacua

SEQ ID NO: 67787 - RNA, 42 nt, Mus musculus
aggacuccugcagacaaaugaaaaaauugcucugaaagagau

SEQ ID NO: 67788 - RNA, 46 nt, Mus musculus
uuuauuaauaguuuauauaaauuauuaagauauuaaaguuucaguu

SEQ ID NO: 67789 - RNA, 41 nt, Mus musculus
uuuuuuucuauagcuuuuaacugcuuucaguggcaccuggu

SEQ ID NO: 67790 - RNA, 46 nt, Mus musculus
auccugacucuucaauuucucacucuuugccuucaccuccugagug

SEQ ID NO: 67791 - RNA, 55 nt, Mus musculus
auagugucuccuggaccauuuuugaugugaauaaaaguguuuuacauugcccuua

SEQ ID NO: 67792 - RNA, 27 nt, Mus musculus
agggccaagaaguaggagugaguggau

SEQ ID NO: 67793 - RNA, 46 nt, Mus musculus
uuuacaauuuauuuuuaaccuucaaacaaaucuuucaugucaaggu

SEQ ID NO: 67794 - RNA, 49 nt, Mus musculus
auggagaaagcaauucuguacucauuguuggaccacgaggaucaggaaa

SEQ ID NO: 67795 - RNA, 41 nt, Mus musculus
ugugguggcgcacaccuuuaaucccagcacuuggaggcaaa

SEQ ID NO: 67796 - RNA, 46 nt, Mus musculus
ccagggcuacacagagaaaaaaagaaagaaagaaagagagagagag

SEQ ID NO: 67797 - RNA, 46 nt, Mus musculus
uauugaaguuauugaaggcuucuguuccaugaacuuguugauuucu

SEQ ID NO: 67798 - RNA, 56 nt, Mus musculus
gauuugaauuaaucgagaugagcagucguaaaaccaagaguaaugcacaugcagag

SEQ ID NO: 67799 - RNA, 45 nt, Mus musculus
acucucuuuguucuguuuaauguuuuaaccauaauaugccauaag

SEQ ID NO: 67800 - RNA, 46 nt, Mus musculus
cagcauagcaguaagcuaugcuggauguagaauaaugcaaauagau

SEQ ID NO: 67801 - RNA, 45 nt, Mus musculus
gggaguuuaaauaagaacuucaacugguaacggaaccugcuuaaa

SEQ ID NO: 67802 - RNA, 45 nt, Mus musculus
cucguccuacuuugcuauauuuuuuuuaaaauucaaggaucagug

SEQ ID NO: 67803 - RNA, 47 nt, Mus musculus
uccaaaugagucaucaaucucaaagaaaauaaauacaaccguaaguu

SEQ ID NO: 67804 - RNA, 46 nt, Mus musculus
gauuagaguaaguuccuacauuccugcuuauaaacacuguccaauc

SEQ ID NO: 67805 - RNA, 46 nt, Mus musculus
ucucuuacauucauauauagugaaaagauauauaaaaggcuaagau

SEQ ID NO: 67806 - RNA, 46 nt, Mus musculus
gacagccagggcuacacagagaaacccugucuugaaaaaacaauaa

SEQ ID NO: 67807 - RNA, 46 nt, Mus musculus
aaagcagugaaucacaagaaucaagauaauaguaagguggcaccag

SEQ ID NO: 67808 - RNA, 46 nt, Mus musculus
cagaaggcuuuugggugaggaacaugauugggcaguguugagaggu

SEQ ID NO: 67809 - RNA, 45 nt, Mus musculus
cggcggcggccggcuuugcccgauuuaggcaggcuugacugggag

SEQ ID NO: 67810 - RNA, 41 nt, Mus musculus
cgacccggaagccauuguaagcaggggguagccgggcgggg

SEQ ID NO: 67811 - RNA, 46 nt, Mus musculus
aggguaauaaagggggggaguggaggaggaggaggcgaaggaggag

SEQ ID NO: 67812 - RNA, 45 nt, Mus musculus
cagcuccagggaaggcacucaaaaguggggggcaggaaagguaag

SEQ ID NO: 67813 - RNA, 45 nt, Mus musculus
gaggaagccugaggaugguuccauucauuguuccugggccucaag

SEQ ID NO: 67814 - RNA, 45 nt, Mus musculus
caugccuuccaggcugauuggaccggggucaccagaauugagucg

SEQ ID NO: 67815 - RNA, 41 nt, Mus musculus
uuugaagcgcuggagcggugucucccuuaaaccgcggcaga

SEQ ID NO: 67816 - RNA, 45 nt, Mus musculus
ucguugaugaaaacgagaagucaaauaaaagaugugaucgucaga

SEQ ID NO: 67817 - RNA, 55 nt, Mus musculus
uugugauuguccuuaacaagugguaaauuguuccguguaauauuuuuugugcgcu

SEQ ID NO: 67818 - RNA, 46 nt, Mus musculus
agcccuuacaagaugcauagaccagcacuacagagauugcguagau

SEQ ID NO: 67819 - RNA, 82 nt, Mus musculus
uguguaaauaagacaaauaaaaacguuaagcggaacaaaucgcagagggccacaaagcggauuucgcacaugccuagcagac

SEQ ID NO: 67820 - RNA, 45 nt, Mus musculus
uuucuuuauuaggauauauuuauuuuuauuuuaugugcauuggug

SEQ ID NO: 67821 - RNA, 42 nt, Mus musculus
aggaaggagaaagggaaggaaggaaggaaggaaggaaggaga

SEQ ID NO: 67822 - RNA, 23 nt, Mus musculus
uuauucugggcuccucauuuggu

SEQ ID NO: 67823 - RNA, 46 nt, Mus musculus
acaguuguggaggcucaucuacauauuaaucaaggaaagccauuua

SEQ ID NO: 67824 - RNA, 46 nt, Mus musculus
uuccuaugcugucuaacagagggcuugcuuacaguagaugcagaag

SEQ ID NO: 67825 - RNA, 42 nt, Mus musculus
cagcaacuauauaguucagucucugcacuuauagcagaaugu

SEQ ID NO: 67826 - RNA, 42 nt, Mus musculus
uaaggaagggggaugggugugcuccuaggaaugccggcuuau

SEQ ID NO: 67827 - RNA, 46 nt, Mus musculus
cuucccagcuaugcuucuuggcuuuaguguacuggacaggcagauu

SEQ ID NO: 67828 - RNA, 30 nt, Mus musculus
cgcaaucuugaaacuauagagaaaguguug

SEQ ID NO: 67829 - RNA, 105 nt, Mus musculus
ugggcuggaaccucugagggacuuggggaauuagacugugggaggaaggggccagagucccaagaucuccagaggcaacccucagcacaaaggcuagaagaaaga

SEQ ID NO: 67830 - RNA, 135 nt, Mus musculus
aaagccggugcugguggggaacugggcugccagacagauuagggcgaaacuggcgaggaggagcgcacaagcgccaacacgcaggguugcugucaggcgggguggcccgagguggagccgugcucaacugggagu

SEQ ID NO: 67831 - RNA, 27 nt, Mus musculus
ggacugagcaccccccaacccccacac

SEQ ID NO: 67832 - RNA, 52 nt, Mus musculus
gcaguguaauucucaaacaccguagggacguaauucuggacgaacgaaaggg

SEQ ID NO: 67833 - RNA, 47 nt, Mus musculus
gccagccagaaauuauccaguaaaucuaucauggauccuaaucagaa

SEQ ID NO: 67834 - RNA, 97 nt, Mus musculus
auacuucucucuauaaaaagcagauauaaaaauaaaucgcaaggccggcgggaaccccuuuaagcacagcggaguggaggaggagaggcagcggcuc

SEQ ID NO: 67835 - RNA, 46 nt, Mus musculus
aagcggagcggauuggaaggcugggcguauaaagcggcgcggagag

SEQ ID NO: 67836 - RNA, 42 nt, Mus musculus
acacacacaaauacacagagagagagagagagagagagagca

SEQ ID NO: 67837 - RNA, 56 nt, Mus musculus
cacuuuggauggugaccagcauuggaaagcaaaguuuagcuguuuagaucuagagg

SEQ ID NO: 67838 - RNA, 46 nt, Mus musculus
ccauuuuaucagaaagcuagucagaguugcuccuggaaucccagau

SEQ ID NO: 67839 - RNA, 45 nt, Mus musculus
acagacucuucucccauuugaacuggggcuuguucaauuagccua

SEQ ID NO: 67840 - RNA, 46 nt, Mus musculus
ucuguaaucaaggcuauuucuuguuguuucugaagcagcaauggca

SEQ ID NO: 67841 - RNA, 46 nt, Mus musculus
ugugauuucucaggacaccuuaacaugagccagucaggcacccccc

SEQ ID NO: 67842 - RNA, 46 nt, Mus musculus
ccagcuguaacaaagaguugaugaaacucccacuucggugcaaggu

SEQ ID NO: 67843 - RNA, 46 nt, Mus musculus
gauuaaacuaagcuaucuccuagcuagguuuguuuugucuguagau

SEQ ID NO: 67844 - RNA, 82 nt, Mus musculus
cuguccagggcugccucaauccuaucucacaaagguaagccaccauacaaggcuuuacauuucuuuuauugggcccugagca

SEQ ID NO: 67845 - RNA, 46 nt, Mus musculus
ucacaucagucaguggacugacuaucauacuccacauucuccagag

SEQ ID NO: 67846 - RNA, 46 nt, Mus musculus
agccugagcuacauagcauccuuuauaaauaaauaguaguccagac

SEQ ID NO: 67847 - RNA, 51 nt, Mus musculus
ucacuggugacacaguacuuuaaucccagcauucaggagggagagacaagc

SEQ ID NO: 67848 - RNA, 46 nt, Mus musculus
gcuuucaaacagaaaacauaacacacacacacacacacacacacac

SEQ ID NO: 67849 - RNA, 46 nt, Mus musculus
agaacccacagguugaaaaccacuguaauagaggaaggcaccagac

SEQ ID NO: 67850 - RNA, 46 nt, Mus musculus
acacacaugcaauuugaaagaaaaguuuuuuaaaugauggcaagga

SEQ ID NO: 67851 - RNA, 46 nt, Mus musculus
ucaguucucagcaccugcacugccugugacgauagcuccaugagau

SEQ ID NO: 67852 - RNA, 41 nt, Mus musculus
ugugccuaauccugcagagacuugaugcauauggggggggg

SEQ ID NO: 67853 - RNA, 46 nt, Mus musculus
uucuugacuaaacugagcagaaaauaaaguguccugugaagcaucc

SEQ ID NO: 67854 - RNA, 46 nt, Mus musculus
ccgacuugauuucuuaccugcauucgcuaaauuuucugaaucagau

SEQ ID NO: 67855 - RNA, 45 nt, Mus musculus
ggaugaucaucauuuucugacacauguucuguugggcugagcaga

SEQ ID NO: 67856 - RNA, 48 nt, Mus musculus
ggcugucacugcaagaaucuacagcuucugaacgccgccucgaagacc

SEQ ID NO: 67857 - RNA, 46 nt, Mus musculus
acuucucuuguguuggcauucaacuugggugaauuuuucgggagac

SEQ ID NO: 67858 - RNA, 48 nt, Mus musculus
gcgucuguaucguaagucuucucuuucacaguuacuauuucaggugga

SEQ ID NO: 67859 - RNA, 48 nt, Mus musculus
cgugcucagucucaacauccuugcuuacagguaugggaguaucagaaa

SEQ ID NO: 67860 - RNA, 45 nt, Mus musculus
uccuggggacagaaauccuuuggcugaagugguauuaugcuagac

SEQ ID NO: 67861 - RNA, 46 nt, Mus musculus
augguauacucugagggccuuuuuuacauuaaacaccuuuggagaa

SEQ ID NO: 67862 - RNA, 42 nt, Mus musculus
uagguaagccuacagaaaaaaacaaaguaguggaugccuagg

SEQ ID NO: 67863 - RNA, 42 nt, Mus musculus
ccucucccaccucaaucauuaaccaagaaaaugcccccagag

SEQ ID NO: 67864 - RNA, 25 nt, Mus musculus
uuuuaaaaagaaaauaaaucaaauu

SEQ ID NO: 67865 - RNA, 41 nt, Mus musculus
ggucuugcgaagauucuaugccccaguauaggggaacguca

SEQ ID NO: 67866 - RNA, 46 nt, Mus musculus
uggaugcucacagucaucaaauagauggaacacaggguccccaaug

SEQ ID NO: 67867 - RNA, 44 nt, Mus musculus
gagcugaugagggccauuuucauucaaacugccucugugugugu

SEQ ID NO: 67868 - RNA, 42 nt, Mus musculus
auuuaaaagaaugauuacauuauauuucuuuauggggcagug

SEQ ID NO: 67869 - RNA, 45 nt, Mus musculus
aaaucuuugguuuuugguccugacuacuaacauauuuggguaggu

SEQ ID NO: 67870 - RNA, 46 nt, Mus musculus
agaucacauucaagcuaagccauuuuuugauacuaugcugugacug

SEQ ID NO: 67871 - RNA, 46 nt, Mus musculus
auccaguagaucauguuucuacaucuucaguuugacaaaggcagau

SEQ ID NO: 67872 - RNA, 47 nt, Mus musculus
aauagucaagauugcuaaugagucccaguacuugacacggaggucag

SEQ ID NO: 67873 - RNA, 45 nt, Mus musculus
guuauucaaaauaccuaacaacuugcaacagaaucuccuugaguu

SEQ ID NO: 67874 - RNA, 45 nt, Mus musculus
aaaucccugaaauuuuguuucaucguacccaugguagcuacagua

SEQ ID NO: 67875 - RNA, 65 nt, Mus musculus
uuugcaggguaacugggauacuucuggcagugaacugagugaaggggaauuggaaaagcgcagaa

SEQ ID NO: 67876 - RNA, 42 nt, Mus musculus
aaguagacagagaucagaaucaaaacacaaaucaccuaagaa

SEQ ID NO: 67877 - RNA, 46 nt, Mus musculus
uccagaaucagauacugaacgagaaaaggauaaaaaagaaaaagau

SEQ ID NO: 67878 - RNA, 46 nt, Mus musculus
agaaguuacaagaagucaaaaaagcauaagaagaaaagcaaaaaga

SEQ ID NO: 67879 - RNA, 42 nt, Mus musculus
aauucuacugcagcuugaugugccugauaacuaugggaggcc

SEQ ID NO: 67880 - RNA, 46 nt, Mus musculus
aaauccuuacaggaaguuauguuauguuacaaauaagcaaacuaac

SEQ ID NO: 67881 - RNA, 46 nt, Mus musculus
uaagucuauaguagaaauauuuucacuuguuucaagacaggcucuu

SEQ ID NO: 67882 - RNA, 46 nt, Mus musculus
aguaauuaagccugggaauauccuaaaguuuucuuggacagcagau

SEQ ID NO: 67883 - RNA, 82 nt, Mus musculus
uguagaauuuuuucacaugacaaauaggugugcaggggcuauuaaagauagugucagaaauuugcuuuuuguuccuaggugc

SEQ ID NO: 67884 - RNA, 73 nt, Mus musculus
uuuguaaaggaaccagcguuugaggauauaacucuagaaucugaaagaaaaagaauauuuaaagauuucaugc

SEQ ID NO: 67885 - RNA, 46 nt, Mus musculus
guugaaacaggcuaccccuccaauagaacuggaugcugucugggaa

SEQ ID NO: 67886 - RNA, 46 nt, Mus musculus
caaaagaucaacuacuuuggaugcuggaaauaucaaguuggcuuuc

SEQ ID NO: 67887 - RNA, 46 nt, Mus musculus
uuuccaagcauaccuuaggaguugggauggauguggguugggguug

SEQ ID NO: 67888 - RNA, 46 nt, Mus musculus
ccaccaucagcucugacauucgcuucacuaacaugcugggucagcc

SEQ ID NO: 67889 - RNA, 46 nt, Mus musculus
guagcuccuauugaacaguggagcccuaggaauuacagaacuaagg

SEQ ID NO: 67890 - RNA, 45 nt, Mus musculus
aaaucuacaaaauaacaaauaguuaaaguuuuuauaguguggaga

SEQ ID NO: 67891 - RNA, 46 nt, Mus musculus
gauacuuguuucuaguucauuaccuaggcuuuguggaugcccagua

SEQ ID NO: 67892 - RNA, 33 nt, Mus musculus
acuuuguugagagaaaggaggaggcagcguaaa

SEQ ID NO: 67893 - RNA, 46 nt, Mus musculus
uaaggaagaaaaaguggugacaacaaaguuagauagacgaguagag

SEQ ID NO: 67894 - RNA, 44 nt, Mus musculus
gaacaagcaaagcagcuacgaaagagaaauugggaagccuuaaa

SEQ ID NO: 67895 - RNA, 57 nt, Mus musculus
ugauuucauaaucacuagaaaagcugagcaaauguuuggggagauggaaguuuggaa

SEQ ID NO: 67896 - RNA, 48 nt, Mus musculus
agugagaaaaagcaggccuuuaaugccuauaaaguccagacggagaaa

SEQ ID NO: 67897 - RNA, 46 nt, Mus musculus
ugggagcaggcuaugaaaaugaucauaaaugauccucgguacaggu

SEQ ID NO: 67898 - RNA, 69 nt, Mus musculus
uuacuccuaaaaaagaagaggaagagagccaaccagcaaaaaaaacauauacuuggaauacaaaggagg

SEQ ID NO: 67899 - RNA, 42 nt, Mus musculus
augcuacaaaaauucuuuaacuuuauguccuuggccucagac

SEQ ID NO: 67900 - RNA, 46 nt, Mus musculus
cugugcagguuugaugaaagcaaaauagugguagaaguuggaagug

SEQ ID NO: 67901 - RNA, 46 nt, Mus musculus
ugauguaacauuuuuugugggcucuuauuuucuuguugcucuagau

SEQ ID NO: 67902 - RNA, 46 nt, Mus musculus
ucaaacaaaggagucccgcugggccaaaccuaaggaacuugaagau

SEQ ID NO: 67903 - RNA, 46 nt, Mus musculus
uuuuucccuuuagaaaucaauguggacagaacauaaaucaccugau

SEQ ID NO: 67904 - RNA, 45 nt, Mus musculus
uucuuauaggggaccaauuuagaacuuuguccaaguaccuguagg

SEQ ID NO: 67905 - RNA, 46 nt, Mus musculus
ccuaccacccuggacuucacauaccuguuuuuucauacagcuaguc

SEQ ID NO: 67906 - RNA, 45 nt, Mus musculus
aggacauaccauuuaagaaaacauauuuuucccuuuccuagcaga

SEQ ID NO: 67907 - RNA, 46 nt, Mus musculus
gguucagucuuuuauaugacagauugcuacuuuuggugucucaggu

SEQ ID NO: 67908 - RNA, 45 nt, Mus musculus
aaaacgacaaagugaauucuuuuuucuaauucugacaucuuggau

SEQ ID NO: 67909 - RNA, 45 nt, Mus musculus
aagacagguauacauguuagcacacagacuugaauacaggcagaa

SEQ ID NO: 67910 - RNA, 42 nt, Mus musculus
aaugccuaacaaaauucugauguauuucacaggcucagggaa

SEQ ID NO: 67911 - RNA, 54 nt, Mus musculus
acaguguuccaagucuuagcuaucucaauuauacuagaaagaaagaaagaaaga

SEQ ID NO: 67912 - RNA, 46 nt, Mus musculus
ccaagacucugacucaaaacagucaaccaaaaagagagagacagag

SEQ ID NO: 67913 - RNA, 46 nt, Mus musculus
cacuuuauaaaauuaggggacuucacucaguauuuggugcauagau

SEQ ID NO: 67914 - RNA, 46 nt, Mus musculus
auuaaaauaaacagcaaguaauaauucauuaggaaaaauuugagaa

SEQ ID NO: 67915 - RNA, 42 nt, Mus musculus
gaagaauugaacacuuucuguugaucacugcuggcugcaguc

SEQ ID NO: 67916 - RNA, 46 nt, Mus musculus
aaaaaaaaaucugcagaccguuugaagacaugguuauaaagcaauc

SEQ ID NO: 67917 - RNA, 46 nt, Mus musculus
uuuguaguuuuuuuuuucuuauugauucuaauuuugacugccagga

SEQ ID NO: 67918 - RNA, 44 nt, Mus musculus
ugaguuaauaaaaggacaagaauuagggugagagugggaagaaa

SEQ ID NO: 67919 - RNA, 40 nt, Mus musculus
uuauuuaaaaaaaauaauuuugauggauguuaggagagau

SEQ ID NO: 67920 - RNA, 46 nt, Mus musculus
ugaauuuauccuugguuucuagagauuauuugcuaagccaucuuua

SEQ ID NO: 67921 - RNA, 45 nt, Mus musculus
uguacuucaguagcauauauaauaaagaaaggaguuuaggggaga

SEQ ID NO: 67922 - RNA, 42 nt, Mus musculus
aaguauuauuuugagcguauguuccaaguaaucuagcaaaau

SEQ ID NO: 67923 - RNA, 46 nt, Mus musculus
aacaguuguaauuuuuaaaauaauacuuuauauauuggccaaagua

SEQ ID NO: 67924 - RNA, 44 nt, Mus musculus
ucuauauauuaaauugaaagcauuguuuacucugugugugugug

SEQ ID NO: 67925 - RNA, 46 nt, Mus musculus
uaaguccugucagguaauauguuuacuguuaaugaggaaucaaggu

SEQ ID NO: 67926 - RNA, 49 nt, Mus musculus
acugaaaaggaccguacaaauaaaucagauaaaugagcuuuaaauagua

SEQ ID NO: 67927 - RNA, 46 nt, Mus musculus
uucuuuccacagaaagauaaaauaaaacaauuugcuacugccagac

SEQ ID NO: 67928 - RNA, 45 nt, Mus musculus
gcgcacgccuuugaucccagcacuugggaggcaguggcaguuaga

SEQ ID NO: 67929 - RNA, 46 nt, Mus musculus
acgcuuucccuuuggcuugcuuaguuuuguuugagugugucgagau

SEQ ID NO: 67930 - RNA, 45 nt, Mus musculus
uggcaugcauuaugcaccaaugggcaugcacccuaugggucagag

SEQ ID NO: 67931 - RNA, 54 nt, Mus musculus
gcccgacgaugaggccggggacuggagccgagcguggaggccucauggugagug

SEQ ID NO: 67932 - RNA, 46 nt, Mus musculus
ucggcccggguauuccgacuacacucagggggacagcuggggugag

SEQ ID NO: 67933 - RNA, 46 nt, Mus musculus
gguuugcacuguucucugaaccuaggacaaggauccccacccccac

SEQ ID NO: 67934 - RNA, 46 nt, Mus musculus
cuacucuucuaccuaaaccucuuuguauuuacagaauugcaugcag

SEQ ID NO: 67935 - RNA, 50 nt, Mus musculus
guuuuuuaaagaaagguuuguuaugaagcguuggaagaucuuuuggggga

SEQ ID NO: 67936 - RNA, 46 nt, Mus musculus
uaacacguuucacucauuccucuuuuaagauuguucugaggccaga

SEQ ID NO: 67937 - RNA, 46 nt, Mus musculus
gaagaacaaacuuuagccagacuccauaauacauacugggaggcag

SEQ ID NO: 67938 - RNA, 45 nt, Mus musculus
uaacugcuggauuguccuguugcagcuuuucuuggacagugacuu

SEQ ID NO: 67939 - RNA, 46 nt, Mus musculus
agucaaaaugcaaaguuugaaaaguuuuugucagguguguggccag

SEQ ID NO: 67940 - RNA, 45 nt, Mus musculus
ucacaaauacucguguguaucugaaauguaaauucuaugccuaug

SEQ ID NO: 67941 - RNA, 46 nt, Mus musculus
guuuuuuaagacaguggaaauaacaaaucgggaaagcuacugccaa

SEQ ID NO: 67942 - RNA, 46 nt, Mus musculus
auagacuaaaacauggguuuuaauaaaagaauaauuucaagggaag

SEQ ID NO: 67943 - RNA, 52 nt, Mus musculus
auauuuuucaggcuaaguuacagaguaggggauauauaaguuaguggugagg

SEQ ID NO: 67944 - RNA, 46 nt, Mus musculus
aaauguauugcuagaaauuaccuucaauauaaaauccaggugggaa

SEQ ID NO: 67945 - RNA, 45 nt, Mus musculus
ugccuccuagguuuauuuguaaauuuuauagaugacuugguuuaa

SEQ ID NO: 67946 - RNA, 28 nt, Mus musculus
gcucuauugcuuacaucuuuagaagcca

SEQ ID NO: 67947 - RNA, 46 nt, Mus musculus
aucgacuuuguacuaauaaaauuaaaaauacauuuuuauccaggaa

SEQ ID NO: 67948 - RNA, 61 nt, Mus musculus
uuauaaaauuauuuuaucuccucucuaccuguguaaagccccauucccauuaucaccccaa

SEQ ID NO: 67949 - RNA, 61 nt, Mus musculus
uggaagugggaaggaguagggcugaggaaacauacagugacuagacugaugucccagaaua

SEQ ID NO: 67950 - RNA, 47 nt, Mus musculus
acuuccaccucuaaaauaagcccugaucauagaacagcgagcccguu

SEQ ID NO: 67951 - RNA, 49 nt, Mus musculus
acuccuuuaaucccaguaccugggagucagaggaagguggaucucuggg

SEQ ID NO: 67952 - RNA, 46 nt, Mus musculus
uaauuuaguagcauuagcaccccuuuuuaagacaacaacaacaaaa

SEQ ID NO: 67953 - RNA, 45 nt, Mus musculus
cuaacucaagccagacccccuacaacaagaggauccagggccagc

SEQ ID NO: 67954 - RNA, 45 nt, Mus musculus
uguacuaugcuuuaugauaaggagacgucugcaugugcggcacag

SEQ ID NO: 67955 - RNA, 45 nt, Mus musculus
gagucccuaacccuaaagauaauuguaacaacagcagcaacaggc

SEQ ID NO: 67956 - RNA, 46 nt, Mus musculus
aguaaaacuuaauuuagccuguccaaauaccuggcuaugacaagau

SEQ ID NO: 67957 - RNA, 89 nt, Mus musculus
guaaccuugaauccagaucccaacgagauuaaaagcuauugcuauguaucaaaggaagaagucagagaaauuuugaagaaggcagccag

SEQ ID NO: 67958 - RNA, 46 nt, Mus musculus
gucuucuuguuuaauacugaaaauaagcuccuguuacagcagagau

SEQ ID NO: 67959 - RNA, 46 nt, Mus musculus
aauaaauaccagccaucuugaugaaaaacagguucagcuucuagcg

SEQ ID NO: 67960 - RNA, 46 nt, Mus musculus
aaaaaaaaaaaaaaaaaaaaaaagaaaaaaaagaaaaaaagaaaga

SEQ ID NO: 67961 - RNA, 45 nt, Mus musculus
gaacaggagaggaugagaggcuacaaaagagcagagacagagaca

SEQ ID NO: 67962 - RNA, 44 nt, Mus musculus
ugucuuaauuagaguuuacaguucagagauuuaauccauuguca

SEQ ID NO: 67963 - RNA, 45 nt, Mus musculus
acugagcccuccuuggguacccuugguuuugcuuaacccuuuuag

SEQ ID NO: 67964 - RNA, 41 nt, Mus musculus
ggucccucucugacuugugugacucggugggacugcggugu

SEQ ID NO: 67965 - RNA, 46 nt, Mus musculus
uggccugaaacuagcaauauagaccagguuggucuagaacucagag

SEQ ID NO: 67966 - RNA, 46 nt, Mus musculus
gguggcaucaugugugguggccucaggucuuuaaucccaguacuaa

SEQ ID NO: 67967 - RNA, 45 nt, Mus musculus
aguuguucaacugaggaauuaucaugugggcaaccauugcgcuaa

SEQ ID NO: 67968 - RNA, 28 nt, Mus musculus
acuagaguggucaugacccugaacuaug

SEQ ID NO: 67969 - RNA, 46 nt, Mus musculus
cuacuggagacugccccagaaaacgucaaacaguaauaaaacccaa

SEQ ID NO: 67970 - RNA, 80 nt, Mus musculus
aaacaaacaaacaaacaaccucacuaguucaaagaacucagacauccuuguaguuuuaacuugaguuuuagugugaguga

SEQ ID NO: 67971 - RNA, 42 nt, Mus musculus
ggauugcugucagccucuaaauccuggacauacugggcagga

SEQ ID NO: 67972 - RNA, 47 nt, Mus musculus
aauauaugauuuagcugggaggguggccuuggcccugagugggagga

SEQ ID NO: 67973 - RNA, 45 nt, Mus musculus
uuggugugguuuugacuuuuaaagaagauaaaguuuagccuaagg

SEQ ID NO: 67974 - RNA, 45 nt, Mus musculus
gaugcccgggugcuuuuuucacacuugccaaguuuguccucuuag

SEQ ID NO: 67975 - RNA, 42 nt, Mus musculus
ccaggcugcucauaaguggagugagagaaauggguaguugag

SEQ ID NO: 67976 - RNA, 24 nt, Mus musculus
auguuggcugauaaggggguaaug

SEQ ID NO: 67977 - RNA, 41 nt, Mus musculus
cuacuaaaguagaagcugaguuaguucaggcuucccgguga

SEQ ID NO: 67978 - RNA, 46 nt, Mus musculus
gcugacagucuugauuuuccugaguaggccucuugauguccuggag

SEQ ID NO: 67979 - RNA, 45 nt, Mus musculus
cucauuucccagagccagaaacgggcaaagguuguugagcagaag

SEQ ID NO: 67980 - RNA, 46 nt, Mus musculus
ugggggggggggcauaugaaugucugugugcacaccuaguugucaa

SEQ ID NO: 67981 - RNA, 45 nt, Mus musculus
uuucuuucuuucuuucuuucuuuuuaauuacagcaauagaaauua

SEQ ID NO: 67982 - RNA, 42 nt, Mus musculus
acugaaacuggucuuagaugugaacuguguucuuaggggcau

SEQ ID NO: 67983 - RNA, 42 nt, Mus musculus
ucagugagggcugucugggaggucugagaucacagccucgag

SEQ ID NO: 67984 - RNA, 61 nt, Mus musculus
auaccaucugaaagucaacucccucgucugaucuucagcugcagaaaaaaaaagggacuaa

SEQ ID NO: 67985 - RNA, 53 nt, Mus musculus
uuuagaauaccaaaagaucucuguaggauuuacuaaguagaggugguggcgug

SEQ ID NO: 67986 - RNA, 44 nt, Mus musculus
auuacuucauccauaauuuugugggcuccagugauugaaucuca

SEQ ID NO: 67987 - RNA, 42 nt, Mus musculus
uuuuuaaaaauacucucugugggaccuaugucuaagggccag

SEQ ID NO: 67988 - RNA, 46 nt, Mus musculus
cuuuugaaguacuuaauuuuucuuuucuuuuuucgcucacugggga

SEQ ID NO: 67989 - RNA, 46 nt, Mus musculus
agauuccuuuucuguuaaaaauaguuuccuuuaauauggcccccaa

SEQ ID NO: 67990 - RNA, 46 nt, Mus musculus
cuucugcuuucagcauuccuuaguugccuguaguucuuugugugag

SEQ ID NO: 67991 - RNA, 42 nt, Mus musculus
acuuucuuagaagugugacaacuacacuuauuugugggucag

SEQ ID NO: 67992 - RNA, 46 nt, Mus musculus
ucugccuaauuuaucugagacaggcucucucucuucccuggccuag

SEQ ID NO: 67993 - RNA, 44 nt, Mus musculus
guuagaaauaacucguguuucauaaagcugcagugcuuugcauc

SEQ ID NO: 67994 - RNA, 45 nt, Mus musculus
uccugaaaaugugcauaacauuugaagacagagcuuuccaggcag

SEQ ID NO: 67995 - RNA, 46 nt, Mus musculus
uagguuuaaugucccucuguguucugagcccuugcccgugauguag

SEQ ID NO: 67996 - RNA, 86 nt, Mus musculus
aaauggagggcaccuuugggaauguggagggaauagauggggggagauguauauuuguuuaggguguacuguaucuguaggaacca

SEQ ID NO: 67997 - RNA, 46 nt, Mus musculus
cauuuguaaccucacauaauuauugaguguaaauuccaagcuguag

SEQ ID NO: 67998 - RNA, 42 nt, Mus musculus
gccccucuucuuguuccugacucuuauuacuuuguagcccag

SEQ ID NO: 67999 - RNA, 66 nt, Mus musculus
auuucuguuuccacccaugauacuuugguauacagcacagagguaguagcuguuuaaucaauaugc

SEQ ID NO: 68000 - RNA, 46 nt, Mus musculus
aagggguuaaugaagacuuaggacaaaggcuacaggaaugggauaa

SEQ ID NO: 68001 - RNA, 48 nt, Mus musculus
uaauuuccuugcugaagcaccugguugggguagggggaaugagagaga

SEQ ID NO: 68002 - RNA, 42 nt, Mus musculus
cuguguuuggacaguucuccuccaccaccaccccgcccccgc

SEQ ID NO: 68003 - RNA, 45 nt, Mus musculus
ucagcguuaacugcgcuggcaauaauaaauaggaaaagccuccag

SEQ ID NO: 68004 - RNA, 45 nt, Mus musculus
uaugaaaugaucauuauaaguuaugguaacagcuuuuaggugugu

SEQ ID NO: 68005 - RNA, 33 nt, Mus musculus
uggguuugcuuuuaaacagcuguuacccucuca

SEQ ID NO: 68006 - RNA, 46 nt, Mus musculus
auaagaggucuacuauauguucuucaaauauauuugcguaaggaag

SEQ ID NO: 68007 - RNA, 41 nt, Mus musculus
aaguuucuuauugcuaaccuaguccucuccauuuggcccau

SEQ ID NO: 68008 - RNA, 46 nt, Mus musculus
caugcagggaagcaucacaugauaacaauauauaugaaaaugggag

SEQ ID NO: 68009 - RNA, 45 nt, Mus musculus
cccccuucucuuccuuccuugugucacaagugccuuccuggccag

SEQ ID NO: 68010 - RNA, 46 nt, Mus musculus
agccacuguguccaggaugagugugaaaaccugaccccgauaggag

SEQ ID NO: 68011 - RNA, 41 nt, Mus musculus
gugugugugugugugugugugugugugucuguguuugucug

SEQ ID NO: 68012 - RNA, 44 nt, Mus musculus
cagugggaggcugugucuuagaaaugggggcaagguggccuuga

SEQ ID NO: 68013 - RNA, 47 nt, Mus musculus
aggcugcagaggaagcccugccuaggauuguugaacuaaugggaaga

SEQ ID NO: 68014 - RNA, 40 nt, Mus musculus
ccuuggagaccucagaugaagcuugcuuuuuaggagggcc

SEQ ID NO: 68015 - RNA, 46 nt, Mus musculus
aggugugugugugauuuauaccauuuauuuauuacauuuauaccag

SEQ ID NO: 68016 - RNA, 42 nt, Mus musculus
aaaagaagcugugguguguguuaccacauguagaaugggcau

SEQ ID NO: 68017 - RNA, 46 nt, Mus musculus
aauguacaaauggacgaaaacacacugcaugaaauucucugcgaag

SEQ ID NO: 68018 - RNA, 44 nt, Mus musculus
aaaccccaaagucgguguccuuugaacucagcaaauaaugcaca

SEQ ID NO: 68019 - RNA, 46 nt, Mus musculus
ggucucagcccccgucccacuccacccccaccccugaaauaugcag

SEQ ID NO: 68020 - RNA, 46 nt, Mus musculus
uuccuacugagugugaugucacaucucugcucucaaaugcaugcuu

SEQ ID NO: 68021 - RNA, 31 nt, Mus musculus
agcugaaagcaugaaucaauaaaacugauua

SEQ ID NO: 68022 - RNA, 51 nt, Mus musculus
cagccuggaagccaugguucagagcaucaaguucacgcagaucgagaugaa

SEQ ID NO: 68023 - RNA, 45 nt, Mus musculus
aaaguggcccgccaccugagucgaugccagagaugcccacuacac

SEQ ID NO: 68024 - RNA, 45 nt, Mus musculus
cagaaaggaagagaaagcuccuuucuacugggaugaugcgcauag

SEQ ID NO: 68025 - RNA, 45 nt, Mus musculus
uccuuucuguaauacauaguauagguuuaugacaaggccuggaac

SEQ ID NO: 68026 - RNA, 46 nt, Mus musculus
cuuuuaaucaaguaggcuucagggccuaacaugauuuacaguucag

SEQ ID NO: 68027 - RNA, 46 nt, Mus musculus
gccgcuucccaugcuauguaggucuccuuuuaugcuccugguuaag

SEQ ID NO: 68028 - RNA, 46 nt, Mus musculus
ccacgauucuggcauuuauuuauuuguuuauuugaguuggggggug

SEQ ID NO: 68029 - RNA, 41 nt, Mus musculus
ugccucuaccucccaagugcugggauuaagaccugugccau

SEQ ID NO: 68030 - RNA, 45 nt, Mus musculus
aguggaccacauauucauggguuagcugggaaugucccagagaga

SEQ ID NO: 68031 - RNA, 45 nt, Mus musculus
cuaacacacuacagagauugaagguaccccaaaccacagugacuu

SEQ ID NO: 68032 - RNA, 46 nt, Mus musculus
cauuuacguauggguagacacuggguauguauccgcccagcaccug

SEQ ID NO: 68033 - RNA, 41 nt, Mus musculus
cuguuuccuacggaguacauuuccauacauuucagggggca

SEQ ID NO: 68034 - RNA, 42 nt, Mus musculus
caugcacacaaaauuaaauaaauagaaauuuaauaaaggcac

SEQ ID NO: 68035 - RNA, 46 nt, Mus musculus
accuucaugguagcaaauuuaugugcacauccucugguaaccgcag

SEQ ID NO: 68036 - RNA, 71 nt, Mus musculus
agguguugguucugggcuggcaucagggagcagagggaggagaugcagccuggguaggguucugccaggug

SEQ ID NO: 68037 - RNA, 44 nt, Mus musculus
agaucuguguuuuggaccaaagccuuggcagcggugguauggag

SEQ ID NO: 68038 - RNA, 49 nt, Mus musculus
gggcgcucgcucuguugggcuuuugaaguagaccagcugagagaugaca

SEQ ID NO: 68039 - RNA, 46 nt, Mus musculus
ucuggcugcauggaauagaagguggguuuggauuuuuuugguuuuu

SEQ ID NO: 68040 - RNA, 45 nt, Mus musculus
gacuaagaacugaguuuguuucucuguugcugugauaaacaccau

SEQ ID NO: 68041 - RNA, 48 nt, Mus musculus
gauugagaagaugaaaucagugauugauugauaaguacacagaaggaa

SEQ ID NO: 68042 - RNA, 42 nt, Mus musculus
ccguaggcuuuagaagcacauuggaaaaaagaagucagcgcu

SEQ ID NO: 68043 - RNA, 42 nt, Mus musculus
agagggagucacagauuucccagguguuggcuaguugauggc

SEQ ID NO: 68044 - RNA, 45 nt, Mus musculus
aagaguauauuuaggcuuaggguuucagaaggauuuaaggguugg

SEQ ID NO: 68045 - RNA, 46 nt, Mus musculus
uaggaacugaaauauuuuaccaggaguaugauggcuaaucuugggg

SEQ ID NO: 68046 - RNA, 45 nt, Mus musculus
acagagauagagagagagacagacagaggcagagagagacagaca

SEQ ID NO: 68047 - RNA, 46 nt, Mus musculus
agugugagugugccaagggccugugggagcccuuggaagccagaag

SEQ ID NO: 68048 - RNA, 46 nt, Mus musculus
ucaggaaacagcauucuuagaggagaauuucaaauacuuguugcag

SEQ ID NO: 68049 - RNA, 28 nt, Mus musculus
ggggagugguggucauacuuggaaacag

SEQ ID NO: 68050 - RNA, 46 nt, Mus musculus
uuuuccuaaauaaacucuuguuauauugaagggaaacaaaagccag

SEQ ID NO: 68051 - RNA, 45 nt, Mus musculus
aaaaaaagacaaggaaauaaagaaaaacuccaagauaccaaagga

SEQ ID NO: 68052 - RNA, 42 nt, Mus musculus
cggaguggacgcuacaucuaugguuguacccuguggagggcg

SEQ ID NO: 68053 - RNA, 42 nt, Mus musculus
cuguaucagcuguucugcuguuuucaauuuuuauuggggaag

SEQ ID NO: 68054 - RNA, 41 nt, Mus musculus
ggagcccaggcaggcaugguguacuugucuaaguggggaaa

SEQ ID NO: 68055 - RNA, 46 nt, Mus musculus
agcgucugugugagggcacaucacagccacccuucccagcuugcag

SEQ ID NO: 68056 - RNA, 42 nt, Mus musculus
auuuauaacaguacaaaguuacaguuaugaaguagcaacgga

SEQ ID NO: 68057 - RNA, 44 nt, Mus musculus
ccuauuucaaggaaggggauggcauuagggcuugugugcuugua

SEQ ID NO: 68058 - RNA, 46 nt, Mus musculus
aggaaugugccuuaauuuuugaagaagagggagaagaaggaggaag

SEQ ID NO: 68059 - RNA, 46 nt, Mus musculus
uauccuccacccccaccuccccagaacagauuugugguggauucag

SEQ ID NO: 68060 - RNA, 46 nt, Mus musculus
acuuuaugucuggcuugcccagaauccuaccguucagagcacccag

SEQ ID NO: 68061 - RNA, 46 nt, Mus musculus
cacugcccagccucgagagaacacaagcugugagccugggaaagag

SEQ ID NO: 68062 - RNA, 44 nt, Mus musculus
aggaggaaugagaauauuccagguacaguacaaggaucugugaa

SEQ ID NO: 68063 - RNA, 46 nt, Mus musculus
aacucuguaaccuuuggccuaugucuuuccuccuuauccaccccag

SEQ ID NO: 68064 - RNA, 46 nt, Mus musculus
ccagauuuucaggaauauagcuguggggguuugaauaugcuuggcu

SEQ ID NO: 68065 - RNA, 28 nt, Mus musculus
cuugcaagauagccuucuguuugccucu

SEQ ID NO: 68066 - RNA, 61 nt, Mus musculus
ggaugcugauuaugggguggguuuucuggauuuuuaaugagaucaaaagcagaguuauaaa

SEQ ID NO: 68067 - RNA, 41 nt, Mus musculus
cagguuaucuggggagagucccggguuccuuaucagaacgg

SEQ ID NO: 68068 - RNA, 88 nt, Mus musculus
acagaagaugaugacucaggcaaaggucucccaccccaggagaaggaaauuaggaaagagauaaccaaguagaacagggucaggggga

SEQ ID NO: 68069 - RNA, 48 nt, Mus musculus
guugugugguggaccgugugugugugugugugugugugugugugugug

SEQ ID NO: 68070 - RNA, 45 nt, Mus musculus
gcaaaaacaagcaaaaauggaagucaguuggaaauuaggucugga

SEQ ID NO: 68071 - RNA, 46 nt, Mus musculus
ucacacuagcccucuguaaccagugauccgggcaggauggcaccag

SEQ ID NO: 68072 - RNA, 46 nt, Mus musculus
auaccccacuucucagggugggccugagauuaaaagacuuuugcag

SEQ ID NO: 68073 - RNA, 45 nt, Mus musculus
uuuuguucuuuaaagccugacaaaaggugauguaugcuugcccuc

SEQ ID NO: 68074 - RNA, 45 nt, Mus musculus
ucuucagagagcaugagcuguuguuaugguaacacaucucggaau

SEQ ID NO: 68075 - RNA, 42 nt, Mus musculus
gagcgugugcgugugcgugugcgugugugugugugugugggc

SEQ ID NO: 68076 - RNA, 46 nt, Mus musculus
ggcugcacugcucugcgaugaaaugauccgggaauuucagugacag

SEQ ID NO: 68077 - RNA, 42 nt, Mus musculus
ugaauuuuagacuuugagucauaguuaucuuucuucggggau

SEQ ID NO: 68078 - RNA, 45 nt, Mus musculus
ugauugccacaggucagcacgggggcagcuggugcauugguugga

SEQ ID NO: 68079 - RNA, 41 nt, Mus musculus
uucggcgugugcuaccugugcucucucgaaugaagucccua

SEQ ID NO: 68080 - RNA, 46 nt, Mus musculus
auaguuacagauccaaacauuuuaggaucccuuuaaaacagcccgg

SEQ ID NO: 68081 - RNA, 46 nt, Mus musculus
gaugguugugagccaucacgugguugcugggauuugaacucaggau

SEQ ID NO: 68082 - RNA, 46 nt, Mus musculus
uaugguuugggcccuuuucuuuucacuacaaccugguugucuugug

SEQ ID NO: 68083 - RNA, 42 nt, Mus musculus
augucacacgugugacagcuucagcugaagaguuucagagag

SEQ ID NO: 68084 - RNA, 41 nt, Mus musculus
auucacauuuuuuuuucuuccauuaugaauuuaaauucaaa

SEQ ID NO: 68085 - RNA, 42 nt, Mus musculus
agguuuagaaucugcugacgacucaggcuuguaacagggcag

SEQ ID NO: 68086 - RNA, 58 nt, Mus musculus
guuuccuaaauauuugcguuaacuuggaaugacauaugcguuauuuuuugaguccugc

SEQ ID NO: 68087 - RNA, 42 nt, Mus musculus
uuaacaaggaagucucguccccacccccagcucugccaccau

SEQ ID NO: 68088 - RNA, 42 nt, Mus musculus
agagguugaacagccuucaucuggacaucugaaaugccccag

SEQ ID NO: 68089 - RNA, 46 nt, Mus musculus
acguuucuuuccucuuuguuuuugugcugaacacggaagccaggac

SEQ ID NO: 68090 - RNA, 46 nt, Mus musculus
aacuaaagcuggcuauaccucagccaugcgaggacaccaugagaag

SEQ ID NO: 68091 - RNA, 46 nt, Mus musculus
ccuuggauuuggguuugugaauguugaugaaucuguucaccucugg

SEQ ID NO: 68092 - RNA, 50 nt, Mus musculus
guuccaggaccagcuucagggagacagaugaacuuuauucaggguaaauc

SEQ ID NO: 68093 - RNA, 47 nt, Mus musculus
agacgccucauuagcagggggaggcauuugaagaaugggcucuuauc

SEQ ID NO: 68094 - RNA, 46 nt, Mus musculus
caacuauuuucgaaagcaguuaaacguuuuguagucucgccagcag

SEQ ID NO: 68095 - RNA, 42 nt, Mus musculus
gguguguguguguguguggugugugugugugugugugguauu

SEQ ID NO: 68096 - RNA, 46 nt, Mus musculus
uuggcuauaucugugggcagccaccacugcuuuagccuuccccgag

SEQ ID NO: 68097 - RNA, 36 nt, Mus musculus
uagcacguagagagcugaggaaagcagauugguaua

SEQ ID NO: 68098 - RNA, 46 nt, Mus musculus
cuaugggacuuggcaggucugagcuuccccagagaugugcccucug

SEQ ID NO: 68099 - RNA, 46 nt, Mus musculus
gcauccagaucuucuuuuaacaucucagucccuccggauuggcaag

SEQ ID NO: 68100 - RNA, 45 nt, Mus musculus
aaacacauuaccccuccagaauaguuaagagcaggcuuuggcuga

SEQ ID NO: 68101 - RNA, 46 nt, Mus musculus
aaagcuuuuuaaaaguuaaacaucugugauuuuucuauagagggag

SEQ ID NO: 68102 - RNA, 49 nt, Mus musculus
guuuauuaaaguuuacacaagccuguaaacaucuguaaggaaagacgua

SEQ ID NO: 68103 - RNA, 46 nt, Mus musculus
uggauugagaaaauaauacuucucucauuccucccccugccccccg

SEQ ID NO: 68104 - RNA, 46 nt, Mus musculus
gagaaaaugguuuccauagugaaaugggugaauacagucuguagag

SEQ ID NO: 68105 - RNA, 90 nt, Mus musculus
uaacggaccucaaaagucugggaugcaggaacagagcaaacccaaacccaguacacaggaaggaauaacagaaaucaaugcaacagaggc

SEQ ID NO: 68106 - RNA, 42 nt, Mus musculus
ccagcaggcaucuaacagugucugcuuuaaggagugggggag

SEQ ID NO: 68107 - RNA, 45 nt, Mus musculus
agggucaucccagaagaggugucugauagccuugguacgggggaa

SEQ ID NO: 68108 - RNA, 51 nt, Mus musculus
aaauugauauuugcuguaagaugaggacagccuguuuguucugagaugccc

SEQ ID NO: 68109 - RNA, 46 nt, Mus musculus
gcacuguuauucuucacucggggugggggugggguaacucugccag

SEQ ID NO: 68110 - RNA, 42 nt, Mus musculus
uccccauucgggaaucuucacuguugucuuucuuuguuccag

SEQ ID NO: 68111 - RNA, 46 nt, Mus musculus
cagaacuuaagaaaauguccauauuaaccuuacagccauggcccag

SEQ ID NO: 68112 - RNA, 42 nt, Mus musculus
aauaaaauagccaagacagggaagccaagcuaccacccccua

SEQ ID NO: 68113 - RNA, 46 nt, Mus musculus
agagcucuggcucgcucauaaugccacggcccaacucaguugcagg

SEQ ID NO: 68114 - RNA, 46 nt, Mus musculus
uggcugaaucuuccaaaugugggagcuguacauagucucugaccau

SEQ ID NO: 68115 - RNA, 41 nt, Mus musculus
aacaccugcugggccugggacugcugacagccagagaccga

SEQ ID NO: 68116 - RNA, 42 nt, Mus musculus
ugcuuucaagaggggcguccuggagccacuuacaagccuaag

SEQ ID NO: 68117 - RNA, 45 nt, Mus musculus
agcacuucaccccugagagaguccaaccacacagucuuggugaua

SEQ ID NO: 68118 - RNA, 46 nt, Mus musculus
auagauggcuugaaugaagcugaguuucauaagccugauuacggag

SEQ ID NO: 68119 - RNA, 46 nt, Mus musculus
uuaucguucagaccugguuuagcuacagguuggcuacucaaagcag

SEQ ID NO: 68120 - RNA, 46 nt, Mus musculus
cuuauguccagaaaaacaaaaccaaaauaaacaaacaaaaaaggag

SEQ ID NO: 68121 - RNA, 42 nt, Mus musculus
aaaggauauaagauuauuaauaggaagaacaagcuacugcag

SEQ ID NO: 68122 - RNA, 42 nt, Mus musculus
agcaguuggagccuguggagaaccucucucaaggggcagggu

SEQ ID NO: 68123 - RNA, 46 nt, Mus musculus
ucucugcgccucaggauguagaggaggguggcagggaaggggguug

SEQ ID NO: 68124 - RNA, 46 nt, Mus musculus
gaucccuuucaauaauucgaccauuuaagcagugguauaucgccag

SEQ ID NO: 68125 - RNA, 46 nt, Mus musculus
uccaguaaguucuuccuuguguaucugcuuagaauugggccccuug

SEQ ID NO: 68126 - RNA, 45 nt, Mus musculus
uugccucaaguguugucauauggcuggugccagccccugcccaua

SEQ ID NO: 68127 - RNA, 42 nt, Mus musculus
agcugggaaguggagggcuggggacacagaggauggcgggag

SEQ ID NO: 68128 - RNA, 46 nt, Mus musculus
cucucacauucacacagacacacucacacaccucucauacagacac

SEQ ID NO: 68129 - RNA, 78 nt, Mus musculus
caaguguguagcuuaccauuucuugucacuaaguauuggccccagugaugagaaaagccuagcguauguguggucccu

SEQ ID NO: 68130 - RNA, 46 nt, Mus musculus
uguccauugagugcagugagcuaagaauacaagaacauguugagag

SEQ ID NO: 68131 - RNA, 46 nt, Mus musculus
ccgcuaggugugaaaguaccaugggauuuuuccucacaaucuggag

SEQ ID NO: 68132 - RNA, 45 nt, Mus musculus
cuagaaauguccgucuguucagugauuucauuuuaauaugugcag

SEQ ID NO: 68133 - RNA, 45 nt, Mus musculus
acucuccuucuggaauuuggcgccugccuggaugggaugucggag

SEQ ID NO: 68134 - RNA, 42 nt, Mus musculus
aaaggaugcucaccguuaccuuuccccgacuugugcccccag

SEQ ID NO: 68135 - RNA, 46 nt, Mus musculus
acugggaugaacccacauguuuuagaaaacuccuaaguaccugcug

SEQ ID NO: 68136 - RNA, 36 nt, Mus musculus
cuuguucauuuuuauuuuaucuuuggucuuuaggua

SEQ ID NO: 68137 - RNA, 42 nt, Mus musculus
cuuuucugggaacagauaagacuagcuagcacgugcccccca

SEQ ID NO: 68138 - RNA, 41 nt, Mus musculus
cuuuucugggaacagauaagacuagcuagcacgugcacccc

SEQ ID NO: 68139 - RNA, 46 nt, Mus musculus
gagguuaaaggaacugagcuacacaaaguucuaccucuugcccuag

SEQ ID NO: 68140 - RNA, 41 nt, Mus musculus
gaauuccuguauagaaccugaucugguuugaggcugagcag

SEQ ID NO: 68141 - RNA, 45 nt, Mus musculus
ucuauaauucuguaggugcaguucaguccaagacuauuagucaag

SEQ ID NO: 68142 - RNA, 47 nt, Mus musculus
gccacuuccaagccugauauuuugauuauacuuuugcagaaauuggu

SEQ ID NO: 68143 - RNA, 46 nt, Mus musculus
acauuccagcaugaccucuugucuagaugccuguuaaucuccaaac

SEQ ID NO: 68144 - RNA, 41 nt, Mus musculus
ucccagcccucugucaagauaacaggauaacuaaggggguu

SEQ ID NO: 68145 - RNA, 46 nt, Mus musculus
cuacuuccaugauauggugaauugaagaguauuuuuauagcccccu

SEQ ID NO: 68146 - RNA, 42 nt, Mus musculus
ugaaaaugguguuauuggaagauguucaaaugcugguuugag

SEQ ID NO: 68147 - RNA, 46 nt, Mus musculus
aaaccugcuuaagacuuguuagcauucuuuauuguaagcucgagau

SEQ ID NO: 68148 - RNA, 45 nt, Mus musculus
uugugauaauuuaggcgauaaauuuuuacgaauuucagagaaacg

SEQ ID NO: 68149 - RNA, 46 nt, Mus musculus
caugugaaagcaucucuaaauuagguuugauuguaucccaugugua

SEQ ID NO: 68150 - RNA, 46 nt, Mus musculus
guguuucauauuuauacuuuagaguauuuuuguacaagauccagau

SEQ ID NO: 68151 - RNA, 46 nt, Mus musculus
uguuguuugcuacuucuguauuuguaaacaaucaccgucccuaaga

SEQ ID NO: 68152 - RNA, 46 nt, Mus musculus
agcugagacuucagcuuuuacaguuccugucuuucacauaggagau

SEQ ID NO: 68153 - RNA, 46 nt, Mus musculus
cucugaguaaguaggcaaccuguccuuacaggcauccggucaagaa

SEQ ID NO: 68154 - RNA, 42 nt, Mus musculus
uagacaccugugcugacacauuacaaaaacauacaccgacac

SEQ ID NO: 68155 - RNA, 47 nt, Mus musculus
caccauagcagaugaaaaugagaauaaguuugugagcagacugauga

SEQ ID NO: 68156 - RNA, 46 nt, Mus musculus
gaaauacauagauggcauuuuagucaugcugucacaaaccccaguu

SEQ ID NO: 68157 - RNA, 58 nt, Mus musculus
uuacgcuucggaccagguacugcacagcuucucagaggccaaacaagugugucaagag

SEQ ID NO: 68158 - RNA, 46 nt, Mus musculus
agauaaaaagcugaucuuucauguaaaaucaucaaaauguccagug

SEQ ID NO: 68159 - RNA, 46 nt, Mus musculus
gaggagauuggcagggcgggaaaugauauaaaugcagcacccagcu

SEQ ID NO: 68160 - RNA, 46 nt, Mus musculus
uuuucuuucaaauuuuaacacaaaaacacauauaacaggcaaagac

SEQ ID NO: 68161 - RNA, 50 nt, Mus musculus
auugugaaccgugacggauucccucucuggguugggcucucaagucauga

SEQ ID NO: 68162 - RNA, 46 nt, Mus musculus
guugguugguugguugguugguugguuaguugauugauugguuggu

SEQ ID NO: 68163 - RNA, 42 nt, Mus musculus
acaaaaagccacauucuagcuugaagccaucggcagcaagac

SEQ ID NO: 68164 - RNA, 46 nt, Mus musculus
uugaugugguuugauaaaacugcauuguccuacacacacuggagaa

SEQ ID NO: 68165 - RNA, 47 nt, Mus musculus
ugaggugaguguaugacaucugaauccaaccuuucaagcuccuagaa

SEQ ID NO: 68166 - RNA, 48 nt, Mus musculus
aaacaaaccaaaaaaaucuccugacaccaacaagaaaacagaaaccca

SEQ ID NO: 68167 - RNA, 64 nt, Mus musculus
aggcagcuucagucagaagggaauuuagaaaaccacccugcaaacaaagauggaacucaaccac

SEQ ID NO: 68168 - RNA, 42 nt, Mus musculus
gccaggcaagccccugucucagaaacaaacaaaggcucaguu

SEQ ID NO: 68169 - RNA, 46 nt, Mus musculus
uuaguaacugggcuggaagcaaugagcaacuugaugacugcgugau

SEQ ID NO: 68170 - RNA, 34 nt, Mus musculus
ugagagagaagagggugggggagagagagagaga

SEQ ID NO: 68171 - RNA, 41 nt, Mus musculus
uaucuaaauaaccuauacaaaaucaucucgaagccccugac

SEQ ID NO: 68172 - RNA, 45 nt, Mus musculus
gccuugauucuuaaucucaaaaagucaccgcuuacugggaccugg

SEQ ID NO: 68173 - RNA, 42 nt, Mus musculus
aaugcacaguuccauuuauaacacauauucaaacaggcagau

SEQ ID NO: 68174 - RNA, 41 nt, Mus musculus
ugccuacgaaaggauaaacagauggacagacaacagagagc

SEQ ID NO: 68175 - RNA, 41 nt, Mus musculus
gaaagauacaaugucucuucauuagagaaauacagcccaga

SEQ ID NO: 68176 - RNA, 45 nt, Mus musculus
auugcuuacaugacugauauuaaauaucaacuugauagguaugua

SEQ ID NO: 68177 - RNA, 46 nt, Mus musculus
guuggggugaguggguaagggaggagggaagaauacagggagagag

SEQ ID NO: 68178 - RNA, 46 nt, Mus musculus
guauaugaguauuugccuaaaauguguuuaugcagugccuguagag

SEQ ID NO: 68179 - RNA, 46 nt, Mus musculus
ugcauauucaaggcuagugcuuuaccauugaacugcguacccagac

SEQ ID NO: 68180 - RNA, 45 nt, Mus musculus
acggaguaguuuuuaggaaaucauagaaaguaaaagaaggcaagg

SEQ ID NO: 68181 - RNA, 46 nt, Mus musculus
gugucagagguaggguucuucacaagacuccagcauagcaagagau

SEQ ID NO: 68182 - RNA, 46 nt, Mus musculus
augcaguggcucacauucacagaucuccuguggugagaugggaggc

SEQ ID NO: 68183 - RNA, 45 nt, Mus musculus
ccaacugguugcaguggugaaguggggguagaacauggcuagaga

SEQ ID NO: 68184 - RNA, 46 nt, Mus musculus
gggcuagguacacagccuaggaaggaaaagagcacgcuagggagau

SEQ ID NO: 68185 - RNA, 46 nt, Mus musculus
cagucccaaggcuaggauaguucccaggcuagaacagucccaaguc

SEQ ID NO: 68186 - RNA, 53 nt, Mus musculus
ucaaugaaaaaagaggcugugaauuuagaagagagcagggagagguguauagg

SEQ ID NO: 68187 - RNA, 46 nt, Mus musculus
cucaacgcuucacaaagaauuacaagcaacuaaaaaaucuugagag

SEQ ID NO: 68188 - RNA, 42 nt, Mus musculus
agaaaguggcugugaagguaacugggaaaagaaugagcagau

SEQ ID NO: 68189 - RNA, 41 nt, Mus musculus
ucuaauagcaagaagagaguagcguuuguaggaggcaaagg

SEQ ID NO: 68190 - RNA, 49 nt, Mus musculus
aaaaaaggaaagaaauggaggugaauuggaucucugucaagauacccau

SEQ ID NO: 68191 - RNA, 45 nt, Mus musculus
cagggggaucccccaccugcucaguggagaaggagaggggaaagg

SEQ ID NO: 68192 - RNA, 45 nt, Mus musculus
acauacaaacaugcaugcacugcagagaaagaaaugggugacaga

SEQ ID NO: 68193 - RNA, 45 nt, Mus musculus
gcaacagacuucccuuaucuucuguaguuugugauacuuuggaga

SEQ ID NO: 68194 - RNA, 46 nt, Mus musculus
uggagcuacgcuuacuuacuuucugauguagaugguguccagaguu

SEQ ID NO: 68195 - RNA, 73 nt, Mus musculus
ugaugagccuucacccaacaccacaaggacucccagccaucacgacuuuacugugcccacuuaacgcaaggaa

SEQ ID NO: 68196 - RNA, 28 nt, Mus musculus
uuucccagagacuuuucugccccuuggu

SEQ ID NO: 68197 - RNA, 42 nt, Mus musculus
uuggauuccaauccugccaugugucagcuguguaucaccgac

SEQ ID NO: 68198 - RNA, 46 nt, Mus musculus
uuuuacuuaacugaaaaauaccuaagagcauuucuggcugcuccag

SEQ ID NO: 68199 - RNA, 44 nt, Mus musculus
aagaggcaaaugcugaacuuagcgugaugggcauggguggauga

SEQ ID NO: 68200 - RNA, 45 nt, Mus musculus
guucucucuauccuuaaaaaaccagacuucgcuuggcugccagaa

SEQ ID NO: 68201 - RNA, 49 nt, Mus musculus
uaugucagaaacagagagaaaugaaaaagaaagcgcgcgcagaaagaua

SEQ ID NO: 68202 - RNA, 48 nt, Mus musculus
aguugggaaaagcugggaaaagauauagcaagagaggaaguagauggg

SEQ ID NO: 68203 - RNA, 54 nt, Mus musculus; identical to SEQ ID NO: 45135

SEQ ID NO: 68204 - RNA, 52 nt, Mus musculus
agaggcaugcucuccuacgaaguagauccauuaauagucgcugggauugugc

SEQ ID NO: 68205 - RNA, 56 nt, Mus musculus
ucuucagcugaggaacggugguaccgguaaguguaaagaaauuaauguaaaucucu

SEQ ID NO: 68206 - RNA, 46 nt, Mus musculus
ccuuucuggcugagcaagauuucaaaaaacugaauacccaccccag

SEQ ID NO: 68207 - RNA, 46 nt, Mus musculus
aagaagaaauucuuugaauuagcgccuggugucagguggagugcag

SEQ ID NO: 68208 - RNA, 44 nt, Mus musculus
agcuccaucaccaacaaucaccaguuucuuccugauggcagccg

SEQ ID NO: 68209 - RNA, 27 nt, Mus musculus
gcuccgagccaaggaccggcagcucca

SEQ ID NO: 68210 - RNA, 42 nt, Mus musculus
gagugggcggacagggaggcuaccuggccagcaaaaccccag

SEQ ID NO: 68211 - RNA, 46 nt, Mus musculus
auaugguuaaacuuaugcaguaucugaguuauuuuucuugguagua

SEQ ID NO: 68212 - RNA, 46 nt, Mus musculus
gaaaagagguuucguuucuuuuaguuugcuugcuuguuuguuuguu

SEQ ID NO: 68213 - RNA, 24 nt, Mus musculus
uuaaaguaugcacauggaucaaau

SEQ ID NO: 68214 - RNA, 46 nt, Mus musculus
aguauguuaaagguuugguagccagucuuuggcacuaccaggagau

SEQ ID NO: 68215 - RNA, 24 nt, Mus musculus
gaguacugugacugaacugaaucu

SEQ ID NO: 68216 - RNA, 46 nt, Mus musculus
uuuuuaaaaaaacaaaaacacaaacagcaccccacacacacaagau

SEQ ID NO: 68217 - RNA, 46 nt, Mus musculus
uaaacucaucuauaaauuccaccaaccaaaaucuuccuggcuuuuu

SEQ ID NO: 68218 - RNA, 46 nt, Mus musculus
ugugagccaccauaugguugcucggauuugaacucaggaccucugg

SEQ ID NO: 68219 - RNA, 46 nt, Mus musculus
caaaagcagguggaucuggaggcuauccuagucuauguacauagag

SEQ ID NO: 68220 - RNA, 46 nt, Mus musculus
cucuuauaauguaauggcuucugaguugauuucccugucccuuuuu

SEQ ID NO: 68221 - RNA, 24 nt, Mus musculus
caaaauagccgacuucgucgagag

SEQ ID NO: 68222 - RNA, 46 nt, Mus musculus
uccugaucagcagaggcugaucuuugcugguaagcagcuggaagau

SEQ ID NO: 68223 - RNA, 46 nt, Mus musculus
gacugagaaucgcuugagcugucugagucacuggaggaggaggagg

SEQ ID NO: 68224 - RNA, 46 nt, Mus musculus
uauuuauuauuuauuauauguaaguacacuguagcugucuccagaa

SEQ ID NO: 68225 - RNA, 86 nt, Mus musculus
ucucucucucuguuuuuccucuccuugucaucggcuuuaggaggacuuuuucucauuagaaaucuauuuucugguauaggagggau

SEQ ID NO: 68226 - RNA, 44 nt, Mus musculus
ccaauguggaggagucucacuucgucugaaucgaucccucgauc

SEQ ID NO: 68227 - RNA, 85 nt, Mus musculus
uuuggaguucucuuugcuucuacuccuuuccugaucuuucccuuuaggauccagugguuuuucuuuuucuuuaguagucucauga

SEQ ID NO: 68228 - RNA, 47 nt, Mus musculus
cucccuuguucuacuguuguaacuguguuuacuuuuagucagauccc

SEQ ID NO: 68229 - RNA, 46 nt, Mus musculus
cuuuacuucucgaucguccuggcguucuucgaucccggcuucguga

SEQ ID NO: 68230 - RNA, 46 nt, Mus musculus
gcauuaugucugccucagccuccugagugcugggauuacuggucug

SEQ ID NO: 68231 - RNA, 46 nt, Mus musculus
cuuccuuaaguuuuguagauuucuauuuuaaguacaucacucauag

SEQ ID NO: 68232 - RNA, 45 nt, Mus musculus
uccaggccuuuucuacauagaaugguccagacuagccagggguag

SEQ ID NO: 68233 - RNA, 46 nt, Mus musculus
augggcagagucuuuaaauauuugagagaugaggggguaaaagcag

SEQ ID NO: 68234 - RNA, 41 nt, Mus musculus
uccccugaugucaagucaugaagagacccaaguguguucaa

SEQ ID NO: 68235 - RNA, 41 nt, Mus musculus
ucauaauugucucuguaauuuccuccugaguagcagucaua

SEQ ID NO: 68236 - RNA, 46 nt, Mus musculus
cugucauaucuuccacuuccauaucccuggucucuaccaccucuag

SEQ ID NO: 68237 - RNA, 46 nt, Mus musculus; identical to SEQ ID NO: 44619

SEQ ID NO: 68238 - RNA, 45 nt, Mus musculus
ugacgacguugauggggaagugagcguacacagaccgcaucuugu

SEQ ID NO: 68239 - RNA, 46 nt, Mus musculus
cgcccagggugcuccgcggacucgggccuggccgccccggcguccc

SEQ ID NO: 68240 - RNA, 43 nt, Mus musculus
aggaacuuccguucuucuuucuaagaugaaauagucggggaga

SEQ ID NO: 68241 - RNA, 46 nt, Mus musculus
cuugauuauguggauuccuguaagauagcagcagauacgggcauca

SEQ ID NO: 68242 - RNA, 59 nt, Mus musculus
auuacuuuuguacauguaugaaaaagagggaggaggggggagagagagagagagacaga

SEQ ID NO: 68243 - RNA, 74 nt, Mus musculus
uacuauauaugcauauacuuuagggacaggaauuaaaggaucagauuugaagcaaacuuuaacuuuuauacuua

SEQ ID NO: 68244 - RNA, 46 nt, Mus musculus
gaccaccuggguucuuaggaacaaaugacuguauccacucauagca

SEQ ID NO: 68245 - RNA, 42 nt, Mus musculus
agaucugggaagagggggcaagaacuacccaaucccccagcu

SEQ ID NO: 68246 - RNA, 45 nt, Mus musculus
uaucaugcaggagagaggacaggaaaaguaaacauuaggauggag

SEQ ID NO: 68247 - RNA, 35 nt, Mus musculus
cuggcacucauguucuguaguacauaucuggaggu

SEQ ID NO: 68248 - RNA, 43 nt, Mus musculus
ugcagaaacgaaugcuaacccccaacaagcccuggccgcccca

SEQ ID NO: 68249 - RNA, 46 nt, Mus musculus
ccccugaagcucuacguguacaacacagacacagacaacugcagag

SEQ ID NO: 68250 - RNA, 41 nt, Mus musculus
agugaaauguguuuaaccaccagaauucugagucguugcaa

SEQ ID NO: 68251 - RNA, 46 nt, Mus musculus
gacauuauauacauacagcccucuaaucacagcauucaggaaguag

SEQ ID NO: 68252 - RNA, 42 nt, Mus musculus
guuuuguuuuguuuuguuuuuugcugggggauaguguuugau

SEQ ID NO: 68253 - RNA, 42 nt, Mus musculus
agugccaggugccagggaaagaugagauugugguggaagcag

SEQ ID NO: 68254 - RNA, 36 nt, Mus musculus
ggggauuagaagugacacagaauauagggacucuag

SEQ ID NO: 68255 - RNA, 46 nt, Mus musculus
agguccagcugucuucagucaguccuccaucuuugucaccaccagg

SEQ ID NO: 68256 - RNA, 45 nt, Mus musculus
cacugucugcuucauaguguucuaggcauugaggcccuugucagu

SEQ ID NO: 68257 - RNA, 45 nt, Mus musculus
uaucugaggauacuaugcaccuauaguacacagacauauaugcag

SEQ ID NO: 68258 - RNA, 41 nt, Mus musculus
cccaggcucugcuucuucuuccucagccauaaacccaugua

SEQ ID NO: 68259 - RNA, 46 nt, Mus musculus
uuacuggaaugcgggaucgccgacuacauggguuuauggcugagga

SEQ ID NO: 68260 - RNA, 46 nt, Mus musculus
uaucacaauacccaguaagacucuuacagcuuaauuaaccaaucag

SEQ ID NO: 68261 - RNA, 45 nt, Mus musculus
uguugccgccacaaguaaaccagucccuugcuucuaugccaccaa

SEQ ID NO: 68262 - RNA, 46 nt, Mus musculus
agcagcaggcuaaagacuuguuugauaaugguguuugcuccugaaa

SEQ ID NO: 68263 - RNA, 45 nt, Mus musculus
ugcucccguguuaaauuguguggauucucgguauuuccagugcag

SEQ ID NO: 68264 - RNA, 45 nt, Mus musculus
guguugcuuguguagcauuugcugcuuucacagccugaucccuca

SEQ ID NO: 68265 - RNA, 45 nt, Mus musculus
caguugucgcucaucagugaacccuggugucggaauucugaagag

SEQ ID NO: 68266 - RNA, 46 nt, Mus musculus
gugacugcucugugcaguccaggccugguauuuuuguuuuucugag

SEQ ID NO: 68267 - RNA, 41 nt, Mus musculus
guucagaaccgacguggucuguuuaguuaaccacgggguca

SEQ ID NO: 68268 - RNA, 47 nt, Mus musculus
cuguagguguccuguacauaauucuaaggggaaacuacgcaagaggc

SEQ ID NO: 68269 - RNA, 44 nt, Mus musculus
uggcuugcugccaggcaucuacugccguucugggagguucaucu

SEQ ID NO: 68270 - RNA, 92 nt, Mus musculus
uaugccuuguguaaggaaaugaaauauuuuaugccuagugcccacaugcaacauuucuuguacuuuguaagucguuugcaagaacacagacc

SEQ ID NO: 68271 - RNA, 47 nt, Mus musculus
ccauggcacacuauuaauugaacaucuuuuuauucugccuguacaca

SEQ ID NO: 68272 - RNA, 46 nt, Mus musculus
uacuuaacgguaucgcggcaauaaacuccagucgcuuuacggucuc

SEQ ID NO: 68273 - RNA, 24 nt, Mus musculus
agacugcuucagggaugcccagug

SEQ ID NO: 68274 - RNA, 25 nt, Mus musculus
agacaggcguucuuacccuuuugag

SEQ ID NO: 68275 - RNA, 41 nt, Mus musculus
cacccacacccauuagcggagagucacuggggaagucagcg

SEQ ID NO: 68276 - RNA, 41 nt, Mus musculus
uggcagugacucuguguguguguguguguguguguguguau

SEQ ID NO: 68277 - RNA, 46 nt, Mus musculus
cauugcuguucaucacugaaagaagucaggacucuaacucaagcag

SEQ ID NO: 68278 - RNA, 45 nt, Mus musculus
aagaaagaaagccuggaugccaggccccaucccauuagcccccuc

SEQ ID NO: 68279 - RNA, 74 nt, Mus musculus
agagaccaagcuagacacaggugaaggcagagugagccagagaaugagaaggagccagaagauuagaacagacu

SEQ ID NO: 68280 - RNA, 78 nt, Mus musculus
ugaggucaaacagagcaauucagugagaagcugagagaagccagauggaauuauucaucuuggagaagaguuuugagc

SEQ ID NO: 68281 - RNA, 41 nt, Mus musculus
ggccuagaauguuuucagccucugagacucacugcugaaua

SEQ ID NO: 68282 - RNA, 46 nt, Mus musculus
guuaucagucagaggcaguaaaccuccaagaugacaguuacaacac

SEQ ID NO: 68283 - RNA, 42 nt, Mus musculus
cagagaaacuaagcaauacaagucuucaccucuccaugagac

SEQ ID NO: 68284 - RNA, 41 nt, Mus musculus
gcaugguagugcacacuuucaaucucagaauucuggaggca

SEQ ID NO: 68285 - RNA, 69 nt, Mus musculus
aaacucuggcaggauaggguauaacucaguaguagauagaucacuugucaaauauaugcaagaccugcc

SEQ ID NO: 68286 - RNA, 47 nt, Mus musculus
agacuuugagauggcagagacuccaagcuucaagaagccaagaugga

SEQ ID NO: 68287 - RNA, 45 nt, Mus musculus
ccauuccuacuuaaacugauucccaaaccuuacagugaugcagau

SEQ ID NO: 68288 - RNA, 46 nt, Mus musculus
guuuucaaaugcaugucuuuacuaguuaaguaaaguggaagggagg

SEQ ID NO: 68289 - RNA, 41 nt, Mus musculus
gacuggcagacacuggggggagggggagagggagagagaga

SEQ ID NO: 68290 - RNA, 46 nt, Mus musculus
guguguguguguauauauauauguguguguguguguguguauaaaa

SEQ ID NO: 68291 - RNA, 42 nt, Mus musculus
agagagagagagagagagagagagagagaaggagcugggcau

SEQ ID NO: 68292 - RNA, 50 nt, Mus musculus
gaauuccaggacagccagggcuacacacacacagagagagagagagagga

SEQ ID NO: 68293 - RNA, 45 nt, Mus musculus
gauuuauuuuuauaaaaccaaagucuccagugacgagcagggugu

SEQ ID NO: 68294 - RNA, 45 nt, Mus musculus
cuacuaagagguaugaccuuguuagaguagauguggccuuguuga

SEQ ID NO: 68295 - RNA, 88 nt, Mus musculus
uucccuuaguuugucaagucccuggguucaauacucagcacuaaaaggaggaggagggaggaaagaaggagaagaaaauaaaggaaag

SEQ ID NO: 68296 - RNA, 45 nt, Mus musculus
auccaagaggccagccuggaccacgguagaucuugucucaaaaag

SEQ ID NO: 68297 - RNA, 42 nt, Mus musculus
aguuccagcaaauugccacgaucuccacaauacugccccaga

SEQ ID NO: 68298 - RNA, 42 nt, Mus musculus
uacacaggacauuaauaaacggcucccagacauaggcccaac

SEQ ID NO: 68299 - RNA, 41 nt, Mus musculus
cugccaucacaaugaacucagagaugccucuguuggggguu

SEQ ID NO: 68300 - RNA, 45 nt, Mus musculus
gugcggugucaggucaguuauggaacccgcuuuagcagcagcgag

SEQ ID NO: 68301 - RNA, 46 nt, Mus musculus
aggccaucucccaccuugcucaccugaguuugggugaggcccaggg

SEQ ID NO: 68302 - RNA, 45 nt, Mus musculus
aaaaaacccugucugagagagagagagagagagagagagagagag

SEQ ID NO: 68303 - RNA, 46 nt, Mus musculus
acuaguuaauuuuaugucaacuugauagaaacuagagucaucaaag

SEQ ID NO: 68304 - RNA, 45 nt, Mus musculus
caaucuuaucuggaccaacaacuacagagaggccagaagccaggg

SEQ ID NO: 68305 - RNA, 45 nt, Mus musculus
gacagacuguuccuaagggcugaggcuuucacuauggcugcaagg

SEQ ID NO: 68306 - RNA, 46 nt, Mus musculus
aaaucccagcacccacaugguggcucacaaccacccauaaugagau

SEQ ID NO: 68307 - RNA, 45 nt, Mus musculus
cuuugauaagccuagaagguccaaauuagaauucaaagccacgau

SEQ ID NO: 68308 - RNA, 46 nt, Mus musculus
gguggcuggcacaugccuuuaaucccagcacucuggaggcagaggc

SEQ ID NO: 68309 - RNA, 45 nt, Mus musculus
ugguaccugccucaccaacucucagucuccaggggugggggcugg

SEQ ID NO: 68310 - RNA, 42 nt, Mus musculus
ccuucuuucugcaucuucuuuucucuccccacugcccgagca

SEQ ID NO: 68311 - RNA, 45 nt, Mus musculus
agaucaacuggacaaaggagguuggugugcauauauauaccuauu

SEQ ID NO: 68312 - RNA, 46 nt, Mus musculus
aguuucagucaccuauuaucuaccuucucuuaugucagagcccuua

SEQ ID NO: 68313 - RNA, 46 nt, Mus musculus
agaauuacuuauuuaaacaaagccugaaagucugauuaaugcccaa

SEQ ID NO: 68314 - RNA, 41 nt, Mus musculus
cuauguaggugcaugcuauucucuccuuuaacucagcucca

SEQ ID NO: 68315 - RNA, 46 nt, Mus musculus
ccucgguggaaugcaucuggagcucagauacaggacucacccccag

SEQ ID NO: 68316 - RNA, 46 nt, Mus musculus
gcccuccggguauuucgugccggaaacuucauugcuacccugagag

SEQ ID NO: 68317 - RNA, 42 nt, Mus musculus
ucuucuucuucuucuucuucuucuucuucuucagagucagag

SEQ ID NO: 68318 - RNA, 78 nt, Mus musculus
cuuccuccuccucuuccucggugggcagggcacccaaggagcccaggauccgggaccuugaccugguaagaggucgag

SEQ ID NO: 68319 - RNA, 42 nt, Mus musculus
aaggaaggaaggaaggaaggaagaaaggaaggaagaggccau

SEQ ID NO: 68320 - RNA, 44 nt, Mus musculus
gggagggugacuucaggcacccacccauaaacuacacuggcaga

SEQ ID NO: 68321 - RNA, 46 nt, Mus musculus
aauaaaguauaacauaugcaaacauaacaaaaucacuuccacagug

SEQ ID NO: 68322 - RNA, 45 nt, Mus musculus
gaagugaugaauuacagaggcacagaagaacacauacagguuacu

SEQ ID NO: 68323 - RNA, 47 nt, Mus musculus
ucuaugggaagaccucacaucugagagcacaccugcguuggcauucg

SEQ ID NO: 68324 - RNA, 84 nt, Mus musculus
aacaguaaagacaauuuugauuuguauuuguugugugggauacuaggaaaguuaacuuagcuuuagcuaauuuuuaaaaauaug

SEQ ID NO: 68325 - RNA, 46 nt, Mus musculus
gcaugauuccuccuugucuuugcuuaugcuauuccucugccuggaa

SEQ ID NO: 68326 - RNA, 42 nt, Mus musculus
aguaacucugcugaaaauuacucucuuuuaguggcacuuuca

SEQ ID NO: 68327 - RNA, 46 nt, Mus musculus
ccgcuaguuugaggccagccugagcuauaguguaagaccaugucug

SEQ ID NO: 68328 - RNA, 45 nt, Mus musculus
aacaauaaugacuaggacagagauauuucucagugaggcccaaaa

SEQ ID NO: 68329 - RNA, 45 nt, Mus musculus
ucaaauguuagcaaaaagaaacuggauagcaauuuugguaucaag

SEQ ID NO: 68330 - RNA, 53 nt, Mus musculus
augaccuaacacauuuacgaguacaagugguagaugaagaaggggaccaacaa

SEQ ID NO: 68331 - RNA, 45 nt, Mus musculus
cucaaguugauaguuugaguaguuaaguuacuaaugacaagggga

SEQ ID NO: 68332 - RNA, 46 nt, Mus musculus
agagcuauaauuguauucuuauuuaggaacaaaauuuuggcagguu

SEQ ID NO: 68333 - RNA, 65 nt, Mus musculus
acucauauacauaaaauaaauaaaucuuuaaaaaauuucuuugcucuuuagaaccuggaagagug

SEQ ID NO: 68334 - RNA, 46 nt, Mus musculus
agguccuaaaaauuaaauuccuaacaaccauaugaaggcucaugac

SEQ ID NO: 68335 - RNA, 41 nt, Mus musculus
aguguacuuauguauaauaauaaauaaaucuaugggccaga

SEQ ID NO: 68336 - RNA, 46 nt, Mus musculus
ggauaguugugagccaccaugugguugcugggauuugaacccagga

SEQ ID NO: 68337 - RNA, 46 nt, Mus musculus
caguuaaauuugaaaagguuuguuuauaauuguagaggccucaguc

SEQ ID NO: 68338 - RNA, 32 nt, Mus musculus
ggcacuccuuucaaccaauacccugucagaga

SEQ ID NO: 68339 - RNA, 28 nt, Mus musculus
ucacacugacaggcccaaucucuccacu

SEQ ID NO: 68340 - RNA, 46 nt, Mus musculus
uuauuuucaguaagcuugaauuauaauuuuuuuaaaucgaacccug

SEQ ID NO: 68341 - RNA, 23 nt, Mus musculus
cuguaaauggaacagauagaagc

SEQ ID NO: 68342 - RNA, 46 nt, Mus musculus
acuaaagguagaaggcuguuucaguuauauaggauaaagugauaaa

SEQ ID NO: 68343 - RNA, 46 nt, Mus musculus
uagccccagcugucuuggaacuugcucuauagaccagugcugagau

SEQ ID NO: 68344 - RNA, 46 nt, Mus musculus
cuaugaagcacccugccucugcuuucugaaugcuaauaguacaggu

SEQ ID NO: 68345 - RNA, 44 nt, Mus musculus
auuccugaauagaaauuuugggcuauucaaaaguuguuaaaaga

SEQ ID NO: 68346 - RNA, 46 nt, Mus musculus
ucauccaggccugaggaggcauggaugcgaggcagugacaggaggu

SEQ ID NO: 68347 - RNA, 52 nt, Mus musculus
aguuaauuuuuaauagaaaccagauggguagaagggcagauaaugacaaguu

SEQ ID NO: 68348 - RNA, 46 nt, Mus musculus
aauaaaaguaguauaauuucauuugaagacuauuaagccugugugu

SEQ ID NO: 68349 - RNA, 46 nt, Mus musculus
uugcaugaaaacuguccuuuaaaacaaaacacccauggaaggagau

SEQ ID NO: 68350 - RNA, 39 nt, Mus musculus
acagcuacauccaggagagaaugccgacaguccugcagg

SEQ ID NO: 68351 - RNA, 45 nt, Mus musculus
ccuguuguacaacaucuacaacuucaagauucucagcagccaacc

SEQ ID NO: 68352 - RNA, 46 nt, Mus musculus
cacaaauagcuugacuacuacuagugggcaaguccauucuucagau

SEQ ID NO: 68353 - RNA, 49 nt, Mus musculus
ggcauuaaugccgauggacauuugauaaacacaggacaagcuauggaua

SEQ ID NO: 68354 - RNA, 46 nt, Mus musculus
cuucagaauuugcagaaucaacaaauauuuucaguugcaccaggau

SEQ ID NO: 68355 - RNA, 45 nt, Mus musculus
aaacuauacuuaaauauauuuaaguacucuaaaauuacuggagau

SEQ ID NO: 68356 - RNA, 45 nt, Mus musculus
uuaguaaauagauauuuuuagucugaaauuagacuauggacagug

SEQ ID NO: 68357 - RNA, 41 nt, Mus musculus
cgagcgcggggagaggcgccgcagaccccggaggaggagga

SEQ ID NO: 68358 - RNA, 41 nt, Mus musculus
ggaacgaggaggaggaggguuacagccgcggcgggcggggg

SEQ ID NO: 68359 - RNA, 24 nt, Mus musculus
ggcgccacggccgcucauugucuc

SEQ ID NO: 68360 - RNA, 41 nt, Mus musculus
cgguguugacacacgccuuuaaucccagcacuugggaggca

SEQ ID NO: 68361 - RNA, 46 nt, Mus musculus
uagacuaggacaaaguugguaauaacaucagcuacaacuccaagag

SEQ ID NO: 68362 - RNA, 46 nt, Mus musculus
uaaacaguuaaggacaaaagugaggaccagccagauggcuuagcag

SEQ ID NO: 68363 - RNA, 46 nt, Mus musculus
gguacagacacuaaucuuaauaauucuaaaucuuguacucagggug

SEQ ID NO: 68364 - RNA, 45 nt, Mus musculus
aaauagccacagucugaaucucauuuauuuuuaagcuagucagag

SEQ ID NO: 68365 - RNA, 79 nt, Mus musculus
cacaugagcacaaguucagaaaugaauaguuugaaaguagguucuuggaaaauaaauaaauaaauaaauaaauaaagac

SEQ ID NO: 68366 - RNA, 46 nt, Mus musculus
uccaugucaauauccaggucagaaacuuguaucucccagccucaag

SEQ ID NO: 68367 - RNA, 42 nt, Mus musculus
gguuucugacuucgcuagggauaugagacuaugaagggagaa

SEQ ID NO: 68368 - RNA, 46 nt, Mus musculus
auuauuaauuucaauagaaucacuucauucauuuaaagcuuaagag

SEQ ID NO: 68369 - RNA, 46 nt, Mus musculus
ugguuaauguuuuaaggaggacuaaaggacgccaaugagaacccag

SEQ ID NO: 68370 - RNA, 71 nt, Mus musculus
aaucccagcaaccauaugguggcucacaaccaucugcaacgagaucugacgcccucuucuggagugucuga

SEQ ID NO: 68371 - RNA, 64 nt, Mus musculus
uugucugaagcuaugggucucuuuuguuugaugguugcguucuugaucuuguuugccauguaac

SEQ ID NO: 68372 - RNA, 70 nt, Mus musculus
agaguaaggugaagacucagugggaaaguagacguggaaagagggaaaugaugaaauaaugguagcccuu

SEQ ID NO: 68373 - RNA, 133 nt, Mus musculus
gcagagacauugauacugcugccaaauucauuggugcaggugcugcaacaguaggaguugcugguucuggugcugguauuggaacagucuuuggcagucuuaucauugguuaugccagguaaucaugucuguc

SEQ ID NO: 68374 - RNA, 41 nt, Mus musculus
acaguuuuuaauggggcccagaauggugugugucagcugau

SEQ ID NO: 68375 - RNA, 45 nt, Mus musculus
ucauuauucuguuuuauacuuuuaaaaauccuaagagguauaggu

SEQ ID NO: 68376 - RNA, 49 nt, Mus musculus
auagaccaauuucugcaucaguguuaucucggccagagacuaggacugg

SEQ ID NO: 68377 - RNA, 46 nt, Mus musculus
uacagcacuacaguuacugaaacuuccacaacacucagucacuugg

SEQ ID NO: 68378 - RNA, 41 nt, Mus musculus
ccuauggaguuggggucgacgcgaaggucggggugcugaga

SEQ ID NO: 68379 - RNA, 46 nt, Mus musculus
agcauucacgccgagggaccggcucuccuucacccuugccccgaug

SEQ ID NO: 68380 - RNA, 46 nt, Mus musculus
augauggauuugggacuagagagggaacaguaauugagggcuagaa

SEQ ID NO: 68381 - RNA, 46 nt, Mus musculus
uaaguuugauugcugagagccacacaguggaagaugagaaccaacu

SEQ ID NO: 68382 - RNA, 46 nt, Mus musculus
uucaaguuuauuaaauuucuaaguguuuuaguacuauuggccauca

SEQ ID NO: 68383 - RNA, 45 nt, Mus musculus
uuuuaauuauguaaugauugucauuaagauaauauaugcugaguu

SEQ ID NO: 68384 - RNA, 45 nt, Mus musculus
uaaucaauaaauauauagcugcugaauuggaguagcaccgcuugg

SEQ ID NO: 68385 - RNA, 45 nt, Mus musculus
ugcuuacacacaauuuuguuuuuggggggaacaguccuguggaga

SEQ ID NO: 68386 - RNA, 46 nt, Mus musculus
cucucgcucaguucuguggcuaugcuuugccuuuucugccucaaug

SEQ ID NO: 68387 - RNA, 45 nt, Mus musculus
uuuaaugaaacucacuagacugaguauguauaccaaguaucaggu

SEQ ID NO: 68388 - RNA, 45 nt, Mus musculus
ugaauacuucaucauuaaauuuuaacuuuggagauauuugccagu

SEQ ID NO: 68389 - RNA, 45 nt, Mus musculus
uguguguguguguguuguucccaucaagauuguuuuucuacagau

SEQ ID NO: 68390 - RNA, 46 nt, Mus musculus
auauuucaaaacuauuuuaaauugaaauaaguauuuugggguagua

SEQ ID NO: 68391 - RNA, 39 nt, Mus musculus
uuaggagcugggauaaaaaucuaaaacuuagguaaagau

SEQ ID NO: 68392 - RNA, 46 nt, Mus musculus
auuguacauccagauacuuugauaacagauaacagaaacacaagaa

SEQ ID NO: 68393 - RNA, 46 nt, Mus musculus
gaaaucuccggagugaagucuaacuggcucaaagugaaccccagua

SEQ ID NO: 68394 - RNA, 46 nt, Mus musculus
cuauuuuuaacguuaccagguuauuuaaccaaguuauuaccaaguu

SEQ ID NO: 68395 - RNA, 45 nt, Mus musculus
uacuuaugguagauucuuguauuccuuuaaaaacucaacugagau

SEQ ID NO: 68396 - RNA, 42 nt, Mus musculus
gggaccgccagaaagaacuguugcuccagccuugcccaggcg

SEQ ID NO: 68397 - RNA, 46 nt, Mus musculus
ucgucagcgaacugcagcucaaagaaaccuuuccccagcaccagca

SEQ ID NO: 68398 - RNA, 46 nt, Mus musculus
ccaagaagcaggaguggguggguuggugagcagggggaggguagaa

SEQ ID NO: 68399 - RNA, 60 nt, Mus musculus
ugaagugguuugcagccccauaagaggaacaauaauaugaacuagccaguauccccagag

SEQ ID NO: 68400 - RNA, 62 nt, Mus musculus
gucauacauuggacugagcacaggguccccaaugaaggagcuagagaaaguauccaaggagc

SEQ ID NO: 68401 - RNA, 46 nt, Mus musculus
uacuucaguccuucuuagaagggggaacaaaauacccguggaagga

SEQ ID NO: 68402 - RNA, 46 nt, Mus musculus
cugcauguuuaucuugugccacgugcaugccuggugcuaggagagg

SEQ ID NO: 68403 - RNA, 46 nt, Mus musculus
auaucaagaauuauuaacaaugcagaucuuauuguuugcacuuaga

SEQ ID NO: 68404 - RNA, 46 nt, Mus musculus
uuuuuccguugguagcauguguaguaccuuccuguaccaaagggga

SEQ ID NO: 68405 - RNA, 46 nt, Mus musculus
aaauguaaaaugaaauuugccaccauucacauuccuggcaacucuc

SEQ ID NO: 68406 - RNA, 46 nt, Mus musculus
gaacuauuugcugccuagaugcuuguauuaucauggaauagaagau

SEQ ID NO: 68407 - RNA, 46 nt, Mus musculus
auaguguguuaagaaaucuuuugaauaaguaauacugcuggccaau

SEQ ID NO: 68408 - RNA, 45 nt, Mus musculus
gaaaauaauuuuagauaaauugaaaaacauaaaggagaaugggac

SEQ ID NO: 68409 - RNA, 41 nt, Mus musculus
guaauaaauugucuuaguuuucuguugaugugacaggguaa

SEQ ID NO: 68410 - RNA, 45 nt, Mus musculus
caaaacccacacaaaaaucacaaaucauaauauagaagcaaaaga

SEQ ID NO: 68411 - RNA, 45 nt, Mus musculus
ggugaggucaguggauccccuggaucuguaacuagagucacagau

SEQ ID NO: 68412 - RNA, 46 nt, Mus musculus
aaaaaaauugguaguguuauuucccacucuauaugauguaguaguc

SEQ ID NO: 68413 - RNA, 46 nt, Mus musculus
cacuauccuuacauuuauggaacaaaaucagcauggcauggcagau

SEQ ID NO: 68414 - RNA, 46 nt, Mus musculus
ucugucacaucuagucagucaugguugugagaggaucuguugaagg

SEQ ID NO: 68415 - RNA, 45 nt, Mus musculus
gguguguaugaauuaucuauagcuauguagcaaacugccccagaa

SEQ ID NO: 68416 - RNA, 46 nt, Mus musculus
uucuauaauaaaauacaaaauaauuuccuuuaacuuagcccuagag

SEQ ID NO: 68417 - RNA, 45 nt, Mus musculus
acuuggcaaguauaagaaccucuugcuuaguuaugugccccaaag

SEQ ID NO: 68418 - RNA, 46 nt, Mus musculus
ggguuuccuccaugguguuuuuguuuguuuguuuuuaaacuaagau

SEQ ID NO: 68419 - RNA, 49 nt, Mus musculus
cccaguuguucuguguguguuagacaaucauucuaucucugaguuacau

SEQ ID NO: 68420 - RNA, 46 nt, Mus musculus
uuucacauaugcuaggcaaguacucuaccacccucuagccccacua

SEQ ID NO: 68421 - RNA, 45 nt, Mus musculus
agcaagggagcaagaguaaaagcaagaggguaagagguaagagau

SEQ ID NO: 68422 - RNA, 47 nt, Mus musculus
guguguguguguuuuguuuuguuuuguuuuuuucaagaaaggcagag

SEQ ID NO: 68423 - RNA, 46 nt, Mus musculus
caagugacuucuuaaggguggugguuuuuuucuucuaccguguggg

SEQ ID NO: 68424 - RNA, 44 nt, Mus musculus
gggagaggagcagauggauugagugaaauugauggauuggagau

SEQ ID NO: 68425 - RNA, 33 nt, Mus musculus
guguagcuucuaauaaauuagaaggaaguaaga

SEQ ID NO: 68426 - RNA, 45 nt, Mus musculus
cuacagacuucugaagaauugaugucugaauuugagacuugcaga

SEQ ID NO: 68427 - RNA, 46 nt, Mus musculus
acugugugauugauuauauaaccaaaggcugcacuaagaggaagga

SEQ ID NO: 68428 - RNA, 42 nt, Mus musculus
caugauuccuguaggaauugggcauggagcaggggagguauu

SEQ ID NO: 68429 - RNA, 46 nt, Mus musculus
uagacugauagacagauuaaaaauaguauuuaggggcuggagagau

SEQ ID NO: 68430 - RNA, 46 nt, Mus musculus
ugcggacggagaguucggauuggugaauuuauuucugcgugcaguu

SEQ ID NO: 68431 - RNA, 44 nt, Mus musculus
uuauuuguuuuguuuuaucuuauauauuauuuuauuaccccuua

SEQ ID NO: 68432 - RNA, 46 nt, Mus musculus
gagggagguggcuccagaugagaugagaaguagggagauucuggga

SEQ ID NO: 68433 - RNA, 45 nt, Mus musculus
uggcuccaacaggaggagggaucacaagaaugugaggaucaagaa

SEQ ID NO: 68434 - RNA, 41 nt, Mus musculus
gagccaugcugcacccgugugcgcacggcagccacgggaac

SEQ ID NO: 68435 - RNA, 41 nt, Mus musculus
gagaugaccaggguggaccuucggaauuaccuugagcagau

SEQ ID NO: 68436 - RNA, 49 nt, Mus musculus
acugagauggagauagggaggcagauaaaaauacgcugugugucggacu

SEQ ID NO: 68437 - RNA, 42 nt, Mus musculus
ccuguuugcgcaguuuuugggggagggaagcagacacgggug

SEQ ID NO: 68438 - RNA, 55 nt, Mus musculus
ggauggagguacuaagaaagacuggagaaaggagagaaagcaggauggaggcgag

SEQ ID NO: 68439 - RNA, 87 nt, Mus musculus
guuuuaaaagacaaauagcugugguuugaaauacgucauagccacugggaguuaauuaauuaggaaaaucuauuuucauguugauuu

SEQ ID NO: 68440 - RNA, 46 nt, Mus musculus
gcugggaugauuaaacggcuuuuguuuaaaacagauuagggcguug

SEQ ID NO: 68441 - RNA, 45 nt, Mus musculus
gaggaauccuguaaaguuugcuauuauagucacauuuugugcaag

SEQ ID NO: 68442 - RNA, 45 nt, Mus musculus
uauuuuucugaggcuagcagagagagagagagagagagagagaga

SEQ ID NO: 68443 - RNA, 46 nt, Mus musculus
ccuguugaugaugauuuuuuuuuuuuuaaaucacagcagcccccag

SEQ ID NO: 68444 - RNA, 46 nt, Mus musculus
ggucucugugaguuaucugggggacacuguauuugcucgcauaugu

SEQ ID NO: 68445 - RNA, 46 nt, Mus musculus
uggcaucuauuccgucuggcaucuauuccucugcaaaggaucagaa

SEQ ID NO: 68446 - RNA, 45 nt, Mus musculus
ccuuuccuuuccuuuccuuuccuuuccuuuccuuuccuaaccucc

SEQ ID NO: 68447 - RNA, 41 nt, Mus musculus
accgcaagcgaaggagacgcgggcgcuccgggugagcgcug

SEQ ID NO: 68448 - RNA, 46 nt, Mus musculus
accauaagaaaugacccuaaaucuauuucauuggguagagcaagua

SEQ ID NO: 68449 - RNA, 42 nt, Mus musculus
cgaagguagccccuuucuggcacuggcacuacggcaccaauu

SEQ ID NO: 68450 - RNA, 45 nt, Mus musculus
ggacacccucugcuguaaacacugcugugcuaaccccugggagau

SEQ ID NO: 68451 - RNA, 26 nt, Mus musculus
aggccgggggggggggccgcgggggc

SEQ ID NO: 68452 - RNA, 42 nt, Mus musculus
gagcccuggacaucagcuccugggacagguauugcgggagaa

SEQ ID NO: 68453 - RNA, 46 nt, Mus musculus
uagcccuuuuaggucccaaccgacgaggcacaguagugucugucag

SEQ ID NO: 68454 - RNA, 45 nt, Mus musculus
cgcuuccucucuccaguucuccuuggccuguaacaggaaugcccc

SEQ ID NO: 68455 - RNA, 46 nt, Mus musculus
aacaccuugcuucaugggaaaaccuugcuugucauucccaccgcug

SEQ ID NO: 68456 - RNA, 46 nt, Mus musculus
aaagagcagagacagcuuccugaagcgggugaaggagaacaaccag

SEQ ID NO: 68457 - RNA, 61 nt, Mus musculus
ucuuuuaaguggcccaagucuugcuccagcucgacaauguucuccagcuuccuuuuccuac

SEQ ID NO: 68458 - RNA, 45 nt, Mus musculus
aggaguucagagagugacugacugauggcagcggaggaaggcaug

SEQ ID NO: 68459 - RNA, 45 nt, Mus musculus
ccuucuccuguuccuucuggaguugcucuugucuuuccuuuucga

SEQ ID NO: 68460 - RNA, 46 nt, Mus musculus
uauacauaaaguaaauuuaaaaaucuuuaaaaaaaaaaaaaaaagg

SEQ ID NO: 68461 - RNA, 46 nt, Mus musculus
cggcuuguugagcuacuguuuuugugguaguugaaagauggcauag

SEQ ID NO: 68462 - RNA, 42 nt, Mus musculus
aacaugggaggagcaggcuugagaaauguauacagaccccuu

SEQ ID NO: 68463 - RNA, 45 nt, Mus musculus
cucugcagccaggagacuuguaugggaagcaagggguggggccuu

SEQ ID NO: 68464 - RNA, 45 nt, Mus musculus
aaagaacuagaaauguccggcuaacaaagcuuucacacggcagag

SEQ ID NO: 68465 - RNA, 46 nt, Mus musculus
gggacuguaguccuggcgguggcaacuccaaguccaucaugcugag

SEQ ID NO: 68466 - RNA, 46 nt, Mus musculus
aagucaguccaaggccaguugaugaaugauaucuuggagugcaggu

SEQ ID NO: 68467 - RNA, 45 nt, Mus musculus
ucguagccaaagagcaacguagcaaguaagcccaguaucccagca

SEQ ID NO: 68468 - RNA, 42 nt, Mus musculus
gaggagagcacgggagugggcagggaguuggcagggugggcg

SEQ ID NO: 68469 - RNA, 47 nt, Mus musculus
ggguuucuguguaaaucuugaaguuuguaaugaaaacagcccuggag

SEQ ID NO: 68470 - RNA, 46 nt, Mus musculus
uuuguugcugcucuugugggagaagacaguguuaguaauaaaggag

SEQ ID NO: 68471 - RNA, 23 nt, Mus musculus
aggcaggagcauggcaacgucca

SEQ ID NO: 68472 - RNA, 46 nt, Mus musculus
auuacuguguacagagggagucauaaauccuugagcaagauaggag

SEQ ID NO: 68473 - RNA, 45 nt, Mus musculus
cacugacagacacaccaccucugcugcagggagguugggcaguac

SEQ ID NO: 68474 - RNA, 46 nt, Mus musculus
aauuccuuuggguagcuuucauucccuuuucuuaaaauagucagag

SEQ ID NO: 68475 - RNA, 46 nt, Mus musculus
cuaagucugucugucugucugucugucucucucucagugugugugu

SEQ ID NO: 68476 - RNA, 46 nt, Mus musculus
acuguccuggaacucacucuguagaccaggcugaccuugaucucag

SEQ ID NO: 68477 - RNA, 45 nt, Mus musculus
aucuuaaaaaacaaaacaaaacaaccccccuuucucaaacuguag

SEQ ID NO: 68478 - RNA, 45 nt, Mus musculus
uggagugugcaaaccauacaucuccuaggagaacacugccaccuu

SEQ ID NO: 68479 - RNA, 45 nt, Mus musculus
cacacccggcuggauuuuguauucuuuauugcaguuuuccuggug

SEQ ID NO: 68480 - RNA, 49 nt, Mus musculus
gucucagcuccaaacgagauuguuauucuaaaaggcaaaguuuacucug

SEQ ID NO: 68481 - RNA, 45 nt, Mus musculus
acuuacugauacagcugcuccuagauucuuaaauguuuccgucag

SEQ ID NO: 68482 - RNA, 29 nt, Mus musculus
acucauaaaaugaaauuuaaucaaguaua

SEQ ID NO: 68483 - RNA, 42 nt, Mus musculus
accacaugguggcucacaaccacccguaaugagaguaaugag

SEQ ID NO: 68484 - RNA, 46 nt, Mus musculus
gagaacaaucugacagcucacguagaggcugggauaacaggacaag

SEQ ID NO: 68485 - RNA, 45 nt, Mus musculus
cuaaguaagacuagauuuagauuguuugugucaucaaaaggggcc

SEQ ID NO: 68486 - RNA, 44 nt, Mus musculus
aaagcaguugcugcacuggaugacaucagaugccaacacagauu

SEQ ID NO: 68487 - RNA, 42 nt, Mus musculus
aauucagcaccgugggaggauggauaucuacucgagcgucag

SEQ ID NO: 68488 - RNA, 46 nt, Mus musculus
uuuaucaagaguuuagucuuuuuuggugauauucuugcuguaggag

SEQ ID NO: 68489 - RNA, 46 nt, Mus musculus
aucauuuuucccuuuuccuuuuuuuaaaaggacuaaaucaugccag

SEQ ID NO: 68490 - RNA, 46 nt, Mus musculus
uaugugucauauuuuuuuccuuucuaaagagaauaacuuuggccag

SEQ ID NO: 68491 - RNA, 45 nt, Mus musculus
agacauccccacucaugugccugaucucagguggaugcuuuuccc

SEQ ID NO: 68492 - RNA, 41 nt, Mus musculus
auuucccuuuaccaccugacaaauuuucuucccugcccacc

SEQ ID NO: 68493 - RNA, 41 nt, Mus musculus
acugugagacucuguuucaaaaguaagaucaaagcuggaua

SEQ ID NO: 68494 - RNA, 41 nt, Mus musculus
cucccagccuaaggagaacucagccuuguaagcgagggcag

SEQ ID NO: 68495 - RNA, 46 nt, Mus musculus
uaaacuguaaccuuuucccuucuuaggucaugcucuuaaaccucag

SEQ ID NO: 68496 - RNA, 27 nt, Mus musculus
ucuucagacacaccagagaagagggua

SEQ ID NO: 68497 - RNA, 45 nt, Mus musculus
guauuaaaauauuaauuggggugucuaaaauuucagaaguacuaa

SEQ ID NO: 68498 - RNA, 42 nt, Mus musculus
uagacugccauaaacuagcaggcuuacauauuuuaaaccaag

SEQ ID NO: 68499 - RNA, 45 nt, Mus musculus
gacucagaccuucagccuugucagugaggaaauagauuaguacag

SEQ ID NO: 68500 - RNA, 46 nt, Mus musculus
gagccaucccagugcccuuaaaguaauguuuuuaaacaguugcaaa

SEQ ID NO: 68501 - RNA, 45 nt, Mus musculus
uccucaacaucuucuacauuguuagaacugugucucaauccugag

SEQ ID NO: 68502 - RNA, 41 nt, Mus musculus
acuguaaacucuacaugcaguguuuuuguguacaugggcaa

SEQ ID NO: 68503 - RNA, 46 nt, Mus musculus
agauguuucuuugauaauacaaauauucuguauuuuugccguuaag

SEQ ID NO: 68504 - RNA, 46 nt, Mus musculus
acugguuaacugauuuuuaaaaauuauuauuauuaaauaguagccc

SEQ ID NO: 68505 - RNA, 46 nt, Mus musculus
aaaaaaaaaaaguauuuuaagauggaaaauaaguggcaaucagaac

SEQ ID NO: 68506 - RNA, 45 nt, Mus musculus
uuuuagauggcuuuugaagauuugguauaagagaauguauuagaa

SEQ ID NO: 68507 - RNA, 42 nt, Mus musculus
caagucaaggcagcagggccuccagcagggaacaggaugaau

SEQ ID NO: 68508 - RNA, 46 nt, Mus musculus
uagagaggaaauccuugccaauggagggagccugucacaucaccau

SEQ ID NO: 68509 - RNA, 47 nt, Mus musculus
uaaucaacaaauaauugaucccauaugaucaaaauaagagauguuuu

SEQ ID NO: 68510 - RNA, 46 nt, Mus musculus
cuguauguugcuuuauacuaaaaucaaggacuguucuaguacucag

SEQ ID NO: 68511 - RNA, 46 nt, Mus musculus
gcauaugugugugcaugugugcaugugugugcccaugaacuuggag

SEQ ID NO: 68512 - RNA, 75 nt, Mus musculus
gaccuuauaccuucuuuaaaaaucauuaaauaugacaaagggaacagagagugaggauggcacguuguagagaag

SEQ ID NO: 68513 - RNA, 46 nt, Mus musculus
ugauaagacaaaggaauuaaauaacuaaaauaauuuugaaagagag

SEQ ID NO: 68514 - RNA, 36 nt, Mus musculus
cugcccuuaugauucugcagcaguuuugacaaaaua

SEQ ID NO: 68515 - RNA, 46 nt, Mus musculus
guugacauaaaacuauccagcacaaugccaauaacaauugccccau

SEQ ID NO: 68516 - RNA, 45 nt, Mus musculus
aauccuuagcauaagaaaacaacaacaaaaacugacauugccagc

SEQ ID NO: 68517 - RNA, 45 nt, Mus musculus
ucaucguacuaaguaauggaaaaauaggaagcuauggggacuaga

SEQ ID NO: 68518 - RNA, 41 nt, Mus musculus
gaucagcccugugcaugcuggacauguccuguauacccuga

SEQ ID NO: 68519 - RNA, 46 nt, Mus musculus
gaguucuuguguguguguguguguguguggagagggagggauggag

SEQ ID NO: 68520 - RNA, 46 nt, Mus musculus
aaaauuucuccguccuuuuaauuguauuucuuaaaguauuuuaaag

SEQ ID NO: 68521 - RNA, 42 nt, Mus musculus
guguguacugaagccuuuuucauucucuuuuccagugggcaa

SEQ ID NO: 68522 - RNA, 46 nt, Mus musculus
gagagauauuuguguauguuguuaaagcauacuuuccugugaguag

SEQ ID NO: 68523 - RNA, 46 nt, Mus musculus
gacuucaaaauaguaaauaauuuuuaacuauuauaauuggccucaa

SEQ ID NO: 68524 - RNA, 46 nt, Mus musculus
caucagaucuuugauuaaagacuuugaugguuugaaauagccggac

SEQ ID NO: 68525 - RNA, 46 nt, Mus musculus
uucuuucagaagugucugcacauggcuucaugaagcuaagcccagg

SEQ ID NO: 68526 - RNA, 30 nt, Mus musculus
uguuaaucccagagauauuuuuugucauac

SEQ ID NO: 68527 - RNA, 46 nt, Mus musculus
aagugucugcuucucaugccuacuguuccgacccaggggcccugag

SEQ ID NO: 68528 - RNA, 46 nt, Mus musculus
ugaaauacuuugcucugauacaucuugacuugaauaauaccuuauc

SEQ ID NO: 68529 - RNA, 41 nt, Mus musculus
cuagugaucagcaagcacacauccgaauuggugcugaggga

SEQ ID NO: 68530 - RNA, 44 nt, Mus musculus
uuuagggugugugagguagagaugcccagguugggguguuuggg

SEQ ID NO: 68531 - RNA, 42 nt, Mus musculus
uggggaggggaguuagaggguaguaggggcagagaaaggcag

SEQ ID NO: 68532 - RNA, 46 nt, Mus musculus
uuguuaugauaccaaaguccuauacagaagaagaccugcgggagaa

SEQ ID NO: 68533 - RNA, 44 nt, Mus musculus
agaagcugucuccaaacgccugucgguggugucgagaguccccu

SEQ ID NO: 68534 - RNA, 46 nt, Mus musculus
ggauaaauuggaaagggacagccauggcguagggagagucaugaaa

SEQ ID NO: 68535 - RNA, 45 nt, Mus musculus
caauauauuuuguuaauuuaaaauuguuuaaauucagggcuggaa

SEQ ID NO: 68536 - RNA, 45 nt, Mus musculus
gucuagagcaguguuucucaaccuguggugugcagcgaccugaga

SEQ ID NO: 68537 - RNA, 70 nt, Mus musculus
caccacaguaugaggaacuauacuaaagggucacagcauuaggaagguugagaaccacugcccuagggca

SEQ ID NO: 68538 - RNA, 46 nt, Mus musculus
gcaucuguguauuuuuagagaacucugaccauuugcuaaccuccau

SEQ ID NO: 68539 - RNA, 46 nt, Mus musculus
agccuuucuaaugauaauuuacauuuuaaagggaauuauuggcuug

SEQ ID NO: 68540 - RNA, 46 nt, Mus musculus
auaguaguuguuuccuagaacaaaauguuguuguguauagcagaaa

SEQ ID NO: 68541 - RNA, 24 nt, Mus musculus
agcgcucauaaaaaccaccggccu

SEQ ID NO: 68542 - RNA, 38 nt, Mus musculus
gcuucauuucuccuaaggaauacaaugugcaccaacau

SEQ ID NO: 68543 - RNA, 53 nt, Mus musculus
acagaaggacuuugaaaaagaugcaaacccccgugacaagucauaucagaagg

SEQ ID NO: 68544 - RNA, 45 nt, Mus musculus
aagcaaauagacacggauaaugaccggcaacucuccaaagcugag

SEQ ID NO: 68545 - RNA, 47 nt, Mus musculus
acucugauguuugagauugaacuuuaugcugugaccaaaggaccaag

SEQ ID NO: 68546 - RNA, 53 nt, Mus musculus
guguguguguguguuugaguguguguguguguuugagugugugugugugugug

SEQ ID NO: 68547 - RNA, 32 nt, Mus musculus
aguuccuuuucuccaggcugcugccaaaaggu

SEQ ID NO: 68548 - RNA, 46 nt, Mus musculus
cagagaugggagagcaaauaaaacaauggguauagggcacacagug

SEQ ID NO: 68549 - RNA, 45 nt, Mus musculus
ucauaaaggggcuggacauugcuaugauggacaugugcccugggg

SEQ ID NO: 68550 - RNA, 45 nt, Mus musculus
ggaaagagauuccagucuuaaguaacaagugccugagcuguauuu

SEQ ID NO: 68551 - RNA, 29 nt, Mus musculus
aggaaaggagacuugcuaaaugcccauua

SEQ ID NO: 68552 - RNA, 42 nt, Mus musculus
ucucucucucucucucucucgcaaagcagagcccgccgccag

SEQ ID NO: 68553 - RNA, 42 nt, Mus musculus
agagggcaguccccuuuuggcagcgccauugcaggacgggag

SEQ ID NO: 68554 - RNA, 28 nt, Mus musculus
uuuaaaauaacaaaaugucggucgguga

SEQ ID NO: 68555 - RNA, 46 nt, Mus musculus
gaauccucgccgccggccguggggacggcuguggggcggcugccag

SEQ ID NO: 68556 - RNA, 45 nt, Mus musculus
aggaccccgucaccguaaauaagcauaugggcgacuaacggggua

SEQ ID NO: 68557 - RNA, 46 nt, Mus musculus
guaaauauuuagacgguauuagugacuucugaacauucucggcgag

SEQ ID NO: 68558 - RNA, 42 nt, Mus musculus
ccuuagaaguuuucccagagauaaguucaccaagauguccag

SEQ ID NO: 68559 - RNA, 84 nt, Mus musculus
augaugagagcccuagcaccagcaguggcaguucagaugcagaucagcgagacccugccgcuccagagcccgaggaacaggaag

SEQ ID NO: 68560 - RNA, 45 nt, Mus musculus
gagguuuaauggagauuguaugcuuuaaauuuacuuuuuacuuag

SEQ ID NO: 68561 - RNA, 50 nt, Mus musculus
ggaaaaaaaaguugaaugaaaugcagaaaaauuuggggggaaagccaaau

SEQ ID NO: 68562 - RNA, 47 nt, Mus musculus
cuuuuucuugguaguacauggauaaagguguuaucuccggcgauaag

SEQ ID NO: 68563 - RNA, 46 nt, Mus musculus
agggucaccugacuaccuuccuggcacagcuuguagacacaccgag

SEQ ID NO: 68564 - RNA, 46 nt, Mus musculus
uugcacuaacaagucaugcuuuauucuuauucuuccauuuucucag

SEQ ID NO: 68565 - RNA, 45 nt, Mus musculus
aaagacuuggauugcuguaagaauaaagccauuucugcccccaga

SEQ ID NO: 68566 - RNA, 46 nt, Mus musculus
ugucuuaauuuuucuguucauucuagauauagaaaauuacauagag

SEQ ID NO: 68567 - RNA, 47 nt, Mus musculus
ugugcauguaugguagucuaccugugccagauccaaguuguugcaga

SEQ ID NO: 68568 - RNA, 46 nt, Mus musculus
uuccucuacacaguccauucuuuuaacucuccuuaucacuuagcag

SEQ ID NO: 68569 - RNA, 46 nt, Mus musculus
aagauuuuuacauuacaauccauaacaguuauguaguagcagcuaa

SEQ ID NO: 68570 - RNA, 47 nt, Mus musculus
caguguuaagguugagaaccacagcuauaaugucuuuugaccucaag

SEQ ID NO: 68571 - RNA, 46 nt, Mus musculus
guuuuuguucaugguguuuuggcaauggcaauagaaacccgaagac

SEQ ID NO: 68572 - RNA, 41 nt, Mus musculus
guguuaauaggauuuuuaucuguuacuugaaaaugugccuu

SEQ ID NO: 68573 - RNA, 44 nt, Mus musculus
uauuuucauaaaacaacugauaauacuuccagcuuucuccuuca

SEQ ID NO: 68574 - RNA, 46 nt, Mus musculus
gugugcagaugccuuggugauagggauggagccuugcaggcacuug

SEQ ID NO: 68575 - RNA, 46 nt, Mus musculus
cuuuauggcuauggaauuauacaucuuuauuccauuuaaugcaaag

SEQ ID NO: 68576 - RNA, 46 nt, Mus musculus
cuccuagaauuaguuaacuucagguggaagucauaaauagcuguag

SEQ ID NO: 68577 - RNA, 45 nt, Mus musculus
guuugaggauauaguccauuaugauggggaagccaugacagcagg

SEQ ID NO: 68578 - RNA, 47 nt, Mus musculus
aggagaauaaggaaggcuaguuauuaggugauaaggacugaauaggg

SEQ ID NO: 68579 - RNA, 41 nt, Mus musculus
uuaagaaucaaaaugugucugggguugguaugcacaugcaa

SEQ ID NO: 68580 - RNA, 46 nt, Mus musculus
aaaaugccauugcugaauucuuguggcuauuguucacuugagaaag

SEQ ID NO: 68581 - RNA, 40 nt, Mus musculus
cauaauacuuauguaagcacacaaagcaagagggagcuga

SEQ ID NO: 68582 - RNA, 53 nt, Mus musculus
aaagguauuuacaugguaguaaucuaaccaaagaguacauauuggaugcagaa

SEQ ID NO: 68583 - RNA, 84 nt, Mus musculus
cuauauucugucaaauaaaagucagaaaaaauaaguucugauagagcccauauuaaagguggcugugcugagugcacacgcuga

SEQ ID NO: 68584 - RNA, 46 nt, Mus musculus
uuccuaaacggucagcccuaaagacauagacugaagagagagggag

SEQ ID NO: 68585 - RNA, 46 nt, Mus musculus
uuuaaaacauacauguuuuaauguccuuuucacuuuuccagcggau

SEQ ID NO: 68586 - RNA, 46 nt, Mus musculus
aguagcuguagaugacuaggaauuaugucauuuguauuaagcccag

SEQ ID NO: 68587 - RNA, 46 nt, Mus musculus
caugcuguugugaaauguuuuaccuuugucaguuuguaaugagagg

SEQ ID NO: 68588 - RNA, 46 nt, Mus musculus
ugaugaaauaaagacguggcuaugaagauugauuauuaaggacuag

SEQ ID NO: 68589 - RNA, 41 nt, Mus musculus
gcaguuuccguuaucaucacauuaauguacacauuggcaca

SEQ ID NO: 68590 - RNA, 44 nt, Mus musculus
ccacccaaagaugcaagauaugauuuagguuuguuaggcugagu

SEQ ID NO: 68591 - RNA, 53 nt, Mus musculus
ugggacuugagcagaccagaagaauauaguucugagggaaccgagggaacagg

SEQ ID NO: 68592 - RNA, 45 nt, Mus musculus
agggcaggaaaggagcacucaacucugcgucagaaagaagcugaa

SEQ ID NO: 68593 - RNA, 45 nt, Mus musculus
caaacaucaucucugaaacucccuccauggguguuccacucccag

SEQ ID NO: 68594 - RNA, 45 nt, Mus musculus
ccacuuaccaguaaguacauaucaugugaguucuuuagugauugg

SEQ ID NO: 68595 - RNA, 46 nt, Mus musculus
uuacacaaccuugacaaauacuauaccagcuacagaaagccaucag

SEQ ID NO: 68596 - RNA, 46 nt, Mus musculus
ccuucaguccuucccugaacuccuucauuggggucccucugcucaa

SEQ ID NO: 68597 - RNA, 42 nt, Mus musculus
aaggacaaugggcugaucagcucagauaccucccaggcccag

SEQ ID NO: 68598 - RNA, 46 nt, Mus musculus
aagaaaaaagaaggagagagagagagagagagagagagagagagag

SEQ ID NO: 68599 - RNA, 45 nt, Mus musculus
uccuauagggagaguucugaucuguaccuacgguuccuucugaga

SEQ ID NO: 68600 - RNA, 46 nt, Mus musculus
uguggcuugcuaccaaaagagaguaauguuaaaucugucaccagac

SEQ ID NO: 68601 - RNA, 41 nt, Mus musculus
acugugaaauguuguguaguucagcugagaggugcagcaga

SEQ ID NO: 68602 - RNA, 30 nt, Mus musculus
ugauggucuuuguagcaguuuccuugccua

SEQ ID NO: 68603 - RNA, 46 nt, Mus musculus
guccucugcaagagcagcaagugcucuuagccacuaagccccuuuu

SEQ ID NO: 68604 - RNA, 30 nt, Mus musculus
ggacuggacacacuugauauggaacagcuc

SEQ ID NO: 68605 - RNA, 46 nt, Mus musculus
ugcaaagaaacagugcccuuucagcuguagugaguucagggagaag

SEQ ID NO: 68606 - RNA, 46 nt, Mus musculus
aaugcauucaaauauggagcuuucuuauuaaaauuauagggcaguc

SEQ ID NO: 68607 - RNA, 64 nt, Mus musculus
gggaaaauccuuuucccauugagcugucacuggccugcaucauuuuauuuuugaacuaucaagc

SEQ ID NO: 68608 - RNA, 46 nt, Mus musculus
guuaagagcacugcucuuccauagaaccuagguucuacugccagca

SEQ ID NO: 68609 - RNA, 46 nt, Mus musculus
ccgucaccugacuccagaccacuaucuucuagcuuucugccaugau

SEQ ID NO: 68610 - RNA, 46 nt, Mus musculus
ucacccaucacucacuaaugaagaaaauguccuagagccagaucuu

SEQ ID NO: 68611 - RNA, 67 nt, Mus musculus
ucuucagcaaacacaacacuuagacagccauggagaaccaaccaucacgagucuguauacaaacugg

SEQ ID NO: 68612 - RNA, 46 nt, Mus musculus
gacuauguauaaucaagcuacacaggaaauugcaaagccaucagag

SEQ ID NO: 68613 - RNA, 42 nt, Mus musculus
acacaaacagggcuuauuagcguaguuugucuucaggcuuau

SEQ ID NO: 68614 - RNA, 44 nt, Mus musculus
uuauaaacagugccucugcuccauagcagauuaacaccaccagg

SEQ ID NO: 68615 - RNA, 45 nt, Mus musculus
agaauacugaaggccaagagucucucaaauucucugaggcgcauu

SEQ ID NO: 68616 - RNA, 39 nt, Mus musculus
agcagugaauaagaagucaaaaaaacagacgggcaagaa

SEQ ID NO: 68617 - RNA, 44 nt, Mus musculus
cucacaaccaucuguaauaggaucugaugcccucugcuggugug

SEQ ID NO: 68618 - RNA, 46 nt, Mus musculus
uugccuuuccucugcucugcacucacuucaugagcugcacacauga

SEQ ID NO: 68619 - RNA, 45 nt, Mus musculus
acaggcguacacuagcgucuccaaagcuucacuuagccuugcaga

SEQ ID NO: 68620 - RNA, 46 nt, Mus musculus
ccuuuuccaaaggaucacauucccuuaucacuuuagacacuuaggc

SEQ ID NO: 68621 - RNA, 46 nt, Mus musculus
gaagccugaucauagcccugagggaucaugguucucgagagcagau

SEQ ID NO: 68622 - RNA, 46 nt, Mus musculus
aauuucuuaccagcaaaacaaguauuagacauaaaagcccagaauu

SEQ ID NO: 68623 - RNA, 45 nt, Mus musculus
ucucaucagugcacccagcacaaugcuuaauccugcgcagucgga

SEQ ID NO: 68624 - RNA, 42 nt, Mus musculus
ucagugggacagcuacagaaauccgugaucagauugccauag

SEQ ID NO: 68625 - RNA, 46 nt, Mus musculus
gccuuggucagaugauuguggacuaugaaaacccuuuaaaaaagau

SEQ ID NO: 68626 - RNA, 73 nt, Mus musculus
uuuaacaaagaacuacuuagacuugacuguaaccuauacaacauuaaugauacugcugucccggauugaagaa

SEQ ID NO: 68627 - RNA, 45 nt, Mus musculus
gagauucugaaaaaucuggcguuguauuacuuuacauuuguagau

SEQ ID NO: 68628 - RNA, 45 nt, Mus musculus
uaggauggauaagaaaggaauuaggaucugacgagugacagugga

SEQ ID NO: 68629 - RNA, 46 nt, Mus musculus
gcguauuuucuuacuauaggcuucaucaggcaguuauaauagagaa

SEQ ID NO: 68630 - RNA, 42 nt, Mus musculus
ugugaaggcucuaugccccaguauaggggaaugccaguacua

SEQ ID NO: 68631 - RNA, 45 nt, Mus musculus
cacaaguauauuguugguguauggagagugacaaggaugauagag

SEQ ID NO: 68632 - RNA, 42 nt, Mus musculus
ccauuacuuguaauuccuguaccuaggaggggaggcaggggg

SEQ ID NO: 68633 - RNA, 45 nt, Mus musculus
gguggugcacaccuuuuaugucaguacacaagaggcagaggcagg

SEQ ID NO: 68634 - RNA, 45 nt, Mus musculus
gauuacacacucaccugaaaugaguuuucauaaaagcugucucuu

SEQ ID NO: 68635 - RNA, 45 nt, Mus musculus
uuguugaaaauaauuauuuaaaaauuuuuaauuuagauaggaaug

SEQ ID NO: 68636 - RNA, 46 nt, Mus musculus
uuaaaaaauaaauugucgccaggcaugguggcacacgccuuuaagc

SEQ ID NO: 68637 - RNA, 46 nt, Mus musculus
uuuauccuuauaucuuuaaccuaguuuucuuuuggaguuggcaaug

SEQ ID NO: 68638 - RNA, 47 nt, Mus musculus
aucugcugugaaauucauagucagaaaauuuccugcuguagaaacgc

SEQ ID NO: 68639 - RNA, 27 nt, Mus musculus
uauuucuuuugugaucuugggaaaugg

SEQ ID NO: 68640 - RNA, 41 nt, Mus musculus
ggcgucggcaugcucacgcgccucuacaacaucaagaaggu

SEQ ID NO: 68641 - RNA, 42 nt, Mus musculus
augggcgcgccgcgcugaggcggaggucgcgggcgggcaggc

SEQ ID NO: 68642 - RNA, 42 nt, Mus musculus
ggccucguagaugccaguggacgcaccgcugggcaccgcagc

SEQ ID NO: 68643 - RNA, 45 nt, Mus musculus
cgauggacaccacuggguaguucuggacgaaggacuuguacagau

SEQ ID NO: 68644 - RNA, 44 nt, Mus musculus
uccgcuuaggguuggucacugugaggucaucgcccaccaccugg

SEQ ID NO: 68645 - RNA, 50 nt, Mus musculus
agagccccaccaccaggucugcgaugaaaguguccucaguuuccccagau

SEQ ID NO: 68646 - RNA, 61 nt, Mus musculus
ugguuguacuuggccaggcgcucggaucggcaaggggcaccagucuugaucugcccagugc

SEQ ID NO: 68647 - RNA, 46 nt, Mus musculus
ugauucagaccaaucacaugauugcaaaacugggucuccagcaggg

SEQ ID NO: 68648 - RNA, 42 nt, Mus musculus
gugagcugccaugugguugcugggauuugaacucagaaccuu

SEQ ID NO: 68649 - RNA, 46 nt, Mus musculus
ccucucucucucuuucucucuaucucuuccuuucuuuuccugcugc

SEQ ID NO: 68650 - RNA, 46 nt, Mus musculus
ugcgauuaugggcauugcccucacaccugauuuuaggugguacuag

SEQ ID NO: 68651 - RNA, 45 nt, Mus musculus
ggcguggcuugcucugcaguuuaguuuggauuuugaauguguggg

SEQ ID NO: 68652 - RNA, 46 nt, Mus musculus
ugcuacacaagggaagaauagauuguuuauuacagccuguuacuag

SEQ ID NO: 68653 - RNA, 59 nt, Mus musculus
aaacccucuuauugccacguguuuuccuuuuccaaggaagcagauguuacuaacagacu

SEQ ID NO: 68654 - RNA, 46 nt, Mus musculus
ugcuguguuccugcagaaccucggagaugguggcuggugggaugag

SEQ ID NO: 68655 - RNA, 42 nt, Mus musculus
uccuuuccuucuuuuuuuuguuuuuuuuuuuguuuuuuuuuu

SEQ ID NO: 68656 - RNA, 42 nt, Mus musculus
auuuuacaaagaggaauugucuucuaaacauccaggccuaaa

SEQ ID NO: 68657 - RNA, 46 nt, Mus musculus
auuuuuagaucuuggaugauuuuguucauuuccuucuccuguuuga

SEQ ID NO: 68658 - RNA, 42 nt, Mus musculus
augcgugcacacagauuuccgugcaugugcacacacagacag

SEQ ID NO: 68659 - RNA, 46 nt, Mus musculus
ugugagauacuaaaauaguuuuucuuuagcagaacauuucuuagag

SEQ ID NO: 68660 - RNA, 42 nt, Mus musculus
ccgcaucauuaaucccagcauucaugaggcagaggcuggcag

SEQ ID NO: 68661 - RNA, 45 nt, Mus musculus
uacagcaucaaauauaauaaccaauuagcaacacggacugcacaa

SEQ ID NO: 68662 - RNA, 47 nt, Mus musculus
agauuuugucucaggaguuccaagagcagcaaggacuuugggaaugg

SEQ ID NO: 68663 - RNA, 46 nt, Mus musculus
ugaugggaaaaauauguccucuuuacacaauuuuacuggugaacag

SEQ ID NO: 68664 - RNA, 45 nt, Mus musculus
ugcguauuuuggauuuucuguagcugcuacugacauuaaugggga

SEQ ID NO: 68665 - RNA, 41 nt, Mus musculus
auauccaagauacaauucacagaacacaugaaacucuagaa

SEQ ID NO: 68666 - RNA, 42 nt, Mus musculus
auacccauggaaggauuuacagagacaaaauucggagcuaag

SEQ ID NO: 68667 - RNA, 45 nt, Mus musculus
ucucuagcugcauauguagcagaggauggcguagucagcuaucaa

SEQ ID NO: 68668 - RNA, 46 nt, Mus musculus
uaagaagggacuuguuuauaucuucaauggaagguccacaggcuug

SEQ ID NO: 68669 - RNA, 46 nt, Mus musculus
augcccccaagcuuuggcuauucaaugaagggagcuacagauguag

SEQ ID NO: 68670 - RNA, 83 nt, Mus musculus
caacuuuuuaaauggcaucuauugccuuuugcuuuuaaggagcuaguauuuuaugaacuggugcaaucacucugugugugugu

SEQ ID NO: 68671 - RNA, 46 nt, Mus musculus
guguguguaugcaugcauacauugaaugcauauguuuugagacaag

SEQ ID NO: 68672 - RNA, 46 nt, Mus musculus
guuguacauuugagacuguauaauauuuuauuguuuggauuuucag

SEQ ID NO: 68673 - RNA, 42 nt, Mus musculus
guacccuagcauuuuaaaucaagacaauaagaucugcccguu

SEQ ID NO: 68674 - RNA, 46 nt, Mus musculus
agcuuaaaugaaaagccuuuuuccccuuagcuuaaauuaaaagcag

SEQ ID NO: 68675 - RNA, 46 nt, Mus musculus
agucagugucaaagccaauaucgaagguagaguuuauuccugucag

SEQ ID NO: 68676 - RNA, 61 nt, Mus musculus
ucugaauuuagagacaagcucacucccaucaccauuuucauggaguaucgguuggaccaga

SEQ ID NO: 68677 - RNA, 66 nt, Mus musculus
gaacggcugcugaugccacaggcuugcagcccauccugaaccaguucacuccggccaacgucaguc

SEQ ID NO: 68678 - RNA, 47 nt, Mus musculus
auauucuacuugacuguggugaagacaaugucuguaaaccuaaauug

SEQ ID NO: 68679 - RNA, 75 nt, Mus musculus
aaaagaagaucuauauuggggacgacaacccucugacacugacugugaaggcgcagaaucaaggggaaggcgccu

SEQ ID NO: 68680 - RNA, 69 nt, Mus musculus
augaagcugagcucaucguuucuaucccaccgcaggcugacuucaucgggguuguccggaacaacgaag

SEQ ID NO: 68681 - RNA, 49 nt, Mus musculus
acuguccugugcauuuaagacagaaaaccaaacucggcagguggugugc

SEQ ID NO: 68682 - RNA, 47 nt, Mus musculus
ugcaccagcagucagagauggauacuucugugaaguuugacuugaaa

SEQ ID NO: 68683 - RNA, 45 nt, Mus musculus
gcuuuucuccaucuuugaauuaaugguaauuaagauaauugguug

SEQ ID NO: 68684 - RNA, 46 nt, Mus musculus
uccaguugugucuuacaagguugaccucgccguuuuggcugcugug

SEQ ID NO: 68685 - RNA, 47 nt, Mus musculus
uaucuuucuuccaauuccaaauugggaguacaaggaaaacccugaga

SEQ ID NO: 68686 - RNA, 89 nt, Mus musculus
acaacacucuguuguacauucuucauuacgacauugacgggccaaugaacugcacggcagauacagagaucaacccuuugagaaucaag

SEQ ID NO: 68687 - RNA, 42 nt, Mus musculus
uuuuuauuuaauuaugcuauaauuuuucuuuguggcacauac

SEQ ID NO: 68688 - RNA, 46 nt, Mus musculus
accuucgaagucaucuucccugugaagccaucuucucugcccacac

SEQ ID NO: 68689 - RNA, 45 nt, Mus musculus
auuuucuucccaucacuacaucagggcauuauucucuccccguuc

SEQ ID NO: 68690 - RNA, 46 nt, Mus musculus
accaugcaucagcuuuuucugauuugaccuggaggagagccagggu

SEQ ID NO: 68691 - RNA, 46 nt, Mus musculus
cacugaucuacagggagugacuacaaaccccauucucuaaguccuu

SEQ ID NO: 68692 - RNA, 46 nt, Mus musculus
ucgccaagugcuugcagaucaccugccagguuggucgacuggauag

SEQ ID NO: 68693 - RNA, 45 nt, Mus musculus
cugcuuccuuuaauaucauagaauucccuuacaagaaccugccga

SEQ ID NO: 68694 - RNA, 48 nt, Mus musculus
gcagggcugcugcuacuggcuguguugguauuuguaauguacagggua

SEQ ID NO: 68695 - RNA, 45 nt, Mus musculus
cgaucuguuacugagcuagaacuaugcuuuuucuuuaacuggcag

SEQ ID NO: 68696 - RNA, 42 nt, Mus musculus
ugaaauggauauuugucgacuucucuuuaugaauaaguucag

SEQ ID NO: 68697 - RNA, 45 nt, Mus musculus
cucuacucuaacugcucaucaaaaagacauucuuuaauuggacca

SEQ ID NO: 68698 - RNA, 45 nt, Mus musculus
ggugaucuauaaaaccugccuccacugucagaaagaaugcuacaa

SEQ ID NO: 68699 - RNA, 47 nt, Mus musculus
ccgucuuaagugguggugauuuauucacaguuccucaaggccccggg

SEQ ID NO: 68700 - RNA, 46 nt, Mus musculus
augaagcacauuuaugugaguuguacgaauuagaauauagacagga

SEQ ID NO: 68701 - RNA, 46 nt, Mus musculus
uauuccuauuauggcuucuaugccaaggaauaacuuucuguuagag

SEQ ID NO: 68702 - RNA, 47 nt, Mus musculus
ucuuuaucccauaacagcauaggcauguagucaacaaaauagcaaga

SEQ ID NO: 68703 - RNA, 103 nt, Mus musculus
auuuucauaauauagguuaauuaaagaaauugauugauccagaggacauuugacacaugugaggaauauuaacguggauacugauuucuuauagagauauuua

SEQ ID NO: 68704 - RNA, 46 nt, Mus musculus
uuaauuaucaucauaauucugauuguguucugaaugacuacggaag

SEQ ID NO: 68705 - RNA, 82 nt, Mus musculus
auccucaugaauacauuauuuauauaaugaggaaaaucacuaagagcagacaagaguuuguugccgccuuacgagaacagug

SEQ ID NO: 68706 - RNA, 45 nt, Mus musculus
auccauccccauuugagagaauucuggggagagccucaaggagaa

SEQ ID NO: 68707 - RNA, 40 nt, Mus musculus
uuuuuguuagcagaaaagaacaacucugcuguaguuguag

SEQ ID NO: 68708 - RNA, 37 nt, Mus musculus
uuuguuuguuuguuuuuuuuaccucuaaaccauccaa

SEQ ID NO: 68709 - RNA, 48 nt, Mus musculus
ucaucaaaaacaagucaaaaggaguaguuaagauucagagaagaaagg

SEQ ID NO: 68710 - RNA, 48 nt, Mus musculus
acuggaugugggggaaauaauaauaauuuuacuaccagaaggagaugu

SEQ ID NO: 68711 - RNA, 51 nt, Mus musculus
aucguggccgucccuggugucuucaaccagcagacaguggauuauguaaag

SEQ ID NO: 68712 - RNA, 46 nt, Mus musculus
aaaauugaucauaaucagauauacaggaaaaaauccccagugaguu

SEQ ID NO: 68713 - RNA, 45 nt, Mus musculus
agucaaauaaguuguaauuucaaaugugaguaccggugucccagg

SEQ ID NO: 68714 - RNA, 52 nt, Mus musculus
ucagucuagcaggauuucuuauuuagcuuuggagagaugucucauacugguc

SEQ ID NO: 68715 - RNA, 46 nt, Mus musculus
uuuagagguugggaagcuaucuggcucaccacuauugcccccacgg

SEQ ID NO: 68716 - RNA, 46 nt, Mus musculus
uacucuaagucauaauucccugagggucgcuuuucucuuugaagau

SEQ ID NO: 68717 - RNA, 84 nt, Mus musculus
agacuaucuugagucuagucaaagacaaucguugucccagacggcagagcccuccagagaaacacuccucagacaucaacagau

SEQ ID NO: 68718 - RNA, 46 nt, Mus musculus
aagaauguggcacuuccuuugccaaaaucacagacagcacccuacc

SEQ ID NO: 68719 - RNA, 46 nt, Mus musculus
uacacauaaucauuggccuucuggaagaggagugauguuggcagag

SEQ ID NO: 68720 - RNA, 46 nt, Mus musculus
auuaucuuuuuuuaaaauaaugauuuuauuauuugaggggcauguu

SEQ ID NO: 68721 - RNA, 45 nt, Mus musculus
aacaucgugguuccccagucucccaaagugcccaggcgucggggu

SEQ ID NO: 68722 - RNA, 44 nt, Mus musculus
gggcaaccgcaacaacuuugaaacuuuggaugagugcaagaaga

SEQ ID NO: 68723 - RNA, 66 nt, Mus musculus
cuucuuggaagaggacccuggacucugccgagguuacaugaagagguaucuuuauaacaaccagac

SEQ ID NO: 68724 - RNA, 24 nt, Mus musculus
guggaaagggagggagaagccuaa

SEQ ID NO: 68725 - RNA, 46 nt, Mus musculus
aucauuauaaauuaauaauuauaaauuauaaauuuacauagcaguc

SEQ ID NO: 68726 - RNA, 29 nt, Mus musculus
cugcauaucagauaucauucauaccagau

SEQ ID NO: 68727 - RNA, 46 nt, Mus musculus
auguuuucuuaacugaaaacuuagacacuacagacacuguucauug

SEQ ID NO: 68728 - RNA, 98 nt, Mus musculus
aagaucaagucauaauaguacauugucgaugacggccacugauucacauccuuccuuuggcagguuaugagaagacagcugugaaggcagcaucugga

SEQ ID NO: 68729 - RNA, 71 nt, Mus musculus
cuugcauuugauaugcacuaacauaauagguaaaaacaauaauaaaacaaggaaacaaaaaugacuggcua

SEQ ID NO: 68730 - RNA, 46 nt, Mus musculus
auaaugugugauuaaacuucauuggcauucuuacucucagucacau

SEQ ID NO: 68731 - RNA, 58 nt, Mus musculus
uauuaucacauauaaacuucuauuauuugaguaagcuuagaguuucuaaaacugaccu

SEQ ID NO: 68732 - RNA, 90 nt, Mus musculus
gcaaugauaaggaguuauuuuuucaauauguauacucaucaaugugaagaauuuauauacgggggaugugaagggaacgagaaccgauuu

SEQ ID NO: 68733 - RNA, 45 nt, Mus musculus
aguaaugaauugcaaauggaagaagauaguugaaaguagccuaga

SEQ ID NO: 68734 - RNA, 45 nt, Mus musculus
gccagccagccuagcgugccuuuugaguucuaggguagugagaga

SEQ ID NO: 68735 - RNA, 46 nt, Mus musculus
ggaacaagguuggguaaacccaacuccugagccugaugccuuaguu

SEQ ID NO: 68736 - RNA, 46 nt, Mus musculus
aacugucugaaggagauucuugcuaacacgguuuuaucuuugagcu

SEQ ID NO: 68737 - RNA, 46 nt, Mus musculus
gcugggagucaaacccagguccucuguuagcuguugagccaucucu

SEQ ID NO: 68738 - RNA, 41 nt, Mus musculus
acuccuuaaaccagggaaaggugacuugaugagcugcaggg

SEQ ID NO: 68739 - RNA, 44 nt, Mus musculus
ccauuggugagcuauuucuggagagggaagaucauggggugaag

SEQ ID NO: 68740 - RNA, 44 nt, Mus musculus
ggaauauugucaucuuaauaguaaaguuuuuguucuggggacag

SEQ ID NO: 68741 - RNA, 41 nt, Mus musculus
cacuguagcuaucuucagacauaccaguaaagggcaucaga

SEQ ID NO: 68742 - RNA, 44 nt, Mus musculus
uugagcuguucacugugugguguuugguuauggcagcccuagau

SEQ ID NO: 68743 - RNA, 46 nt, Mus musculus
ccagcagguggcucauccauccauccauccauccauccauccaucc

SEQ ID NO: 68744 - RNA, 34 nt, Mus musculus
agucgcagcaugacgaagguugagaaccacuucc

SEQ ID NO: 68745 - RNA, 42 nt, Mus musculus
agugaaauuagaugaaggaacauuuagaaaaagcccccuauc

SEQ ID NO: 68746 - RNA, 45 nt, Mus musculus
guggguuaauuuagacugcaguauuuguguaacaagugccuuuac

SEQ ID NO: 68747 - RNA, 51 nt, Mus musculus
acucgagagaagagacugggguuuucggcuucccgagcaaccuuuacagag

SEQ ID NO: 68748 - RNA, 42 nt, Mus musculus
ugagagagcuuugaaauucguaaaaaguacuugugaguagga

SEQ ID NO: 68749 - RNA, 46 nt, Mus musculus
auaagagagagaggagagagagagacagagagaaaaagagagagac

SEQ ID NO: 68750 - RNA, 45 nt, Mus musculus
aacaauaaacagugaugucugaugccgcagccaaaguugccggga

SEQ ID NO: 68751 - RNA, 46 nt, Mus musculus
accguugccuuagcucugaguuaaagacaagcaccuagcccuagga

SEQ ID NO: 68752 - RNA, 46 nt, Mus musculus
agccuguuccugggguugggggaggggaguaaagaaaugaccaugg

SEQ ID NO: 68753 - RNA, 41 nt, Mus musculus
auuucacuccaucuuugcuuuucuguggucuagccccacca

SEQ ID NO: 68754 - RNA, 39 nt, Mus musculus
augggagaaaauuugugaggcccacagaaggccucuggg

SEQ ID NO: 68755 - RNA, 102 nt, Mus musculus
uggcucugcaccaccaccccucaagaaaaaggugaucuuugcugggaaggaaaugaggacgagggacgagaggaaggccgugacgugagcugaguguggcca

SEQ ID NO: 68756 - RNA, 40 nt, Mus musculus
uuuuucuuuucaaaaauuaagaaguuagcauuagucugga

SEQ ID NO: 68757 - RNA, 47 nt, Mus musculus
uccagaucugggagcuucuuucuccugccuaagcaccuguaguuagg

SEQ ID NO: 68758 - RNA, 42 nt, Mus musculus
acccaagcauauuguuuuuaaucauaguauuucacuccugau

SEQ ID NO: 68759 - RNA, 44 nt, Mus musculus
auguuggcgggaaggagaguuaucccaugcccugucucgugagc

SEQ ID NO: 68760 - RNA, 46 nt, Mus musculus
agaugaguaaguaaauaaauuuaaaaaaacaaaaacuacaggagau

SEQ ID NO: 68761 - RNA, 45 nt, Mus musculus
augguggccgcacaaagaggaaguccuucacaguuaugcagaguc

SEQ ID NO: 68762 - RNA, 26 nt, Mus musculus
cuuuuguuuccacagaaacguaaaga

SEQ ID NO: 68763 - RNA, 46 nt, Mus musculus
aagcagacagggucuuuauccugugagcaucauaccgugaauagag

SEQ ID NO: 68764 - RNA, 46 nt, Mus musculus
ccuccaaacuucacugucccccaguuccagcccuucacacacagau

SEQ ID NO: 68765 - RNA, 82 nt, Mus musculus
ucaaaggucuugccaugcagguguagaaagguaggguagauccggauaucguaucgaccgcgaggagucaaacacugcagcu

SEQ ID NO: 68766 - RNA, 46 nt, Mus musculus
acucauucauguugagagucaaggagauguccucauccuuggagaa

SEQ ID NO: 68767 - RNA, 44 nt, Mus musculus
accauuucauagagggauccugacauguucuuggugagucgccc

SEQ ID NO: 68768 - RNA, 46 nt, Mus musculus
ucaggaggcagaggcaggcagaucucugaguucaagaccagucugg

SEQ ID NO: 68769 - RNA, 45 nt, Mus musculus
cucuucacggucacugucacccucauugcuggaggagcuggcaga

SEQ ID NO: 68770 - RNA, 42 nt, Mus musculus
ggccgggcgugguggcacacgccuuuaaucccagucucaaaa

SEQ ID NO: 68771 - RNA, 42 nt, Mus musculus
acucaacugccuggaugaagacuuggaugacgagccccggga

SEQ ID NO: 68772 - RNA, 42 nt, Mus musculus
uacucagaugaaaaaacguuugcuuuucaucguggcugggau

SEQ ID NO: 68773 - RNA, 45 nt, Mus musculus
acguuuggaaccacagaaugcuuccuguuggcagcaauggcuuau

SEQ ID NO: 68774 - RNA, 46 nt, Mus musculus
uaccacagcacaaucucagugucucauauaaugaugacucucagau

SEQ ID NO: 68775 - RNA, 46 nt, Mus musculus
cugauaucuaagaaagacagauugcuaagaaagugauacaugggag

SEQ ID NO: 68776 - RNA, 42 nt, Mus musculus
aauacauagcaaucaauaguccaaauagaacccacuggagau

SEQ ID NO: 68777 - RNA, 46 nt, Mus musculus
cuccaucagaggucuauaaugaguccaacuauguuauaguagagau

SEQ ID NO: 68778 - RNA, 33 nt, Mus musculus
gaugaugucuauuuucucacagaucagaugaaa

SEQ ID NO: 68779 - RNA, 45 nt, Mus musculus
guaggaacuuugccuaagaagcaaauaguggaggaccacucaaga

SEQ ID NO: 68780 - RNA, 44 nt, Mus musculus
uguuacccagagauagucuugacaaaugaagcaaaugagagaga

SEQ ID NO: 68781 - RNA, 45 nt, Mus musculus
guggacaguuuuuucuguuaggaggguccacaaggcacagugagg

SEQ ID NO: 68782 - RNA, 42 nt, Mus musculus
gcauugaauuuaugggaccucugcucacucuggccccaagau

SEQ ID NO: 68783 - RNA, 42 nt, Mus musculus
aaaaaaaaaaaaaagaaagaaagaaaaacaaaacaaaacaaa

SEQ ID NO: 68784 - RNA, 76 nt, Mus musculus
aaacauguccagcaggaaguguuucauguucauggcuggcguuuaccuggugggaacaucagaugcuuugauacau

SEQ ID NO: 68785 - RNA, 48 nt, Mus musculus
uucuucugugaucuaccuccaauuuaccuucucuccugcucagauacu

SEQ ID NO: 68786 - RNA, 45 nt, Mus musculus
ggaugagucauuguuccaagaaauggacgauuuggagcuagaaga

SEQ ID NO: 68787 - RNA, 47 nt, Mus musculus
ucgugacagcuguucaagaaaaguuaaaugaaauaguugaucagaua

SEQ ID NO: 68788 - RNA, 46 nt, Mus musculus
aauuuuaccacagccucuuucacaucuuuguuccucaggcuguaaa

SEQ ID NO: 68789 - RNA, 46 nt, Mus musculus
aaaaaauuguggugugguaaaguaugacuucagguguacccaaaag

SEQ ID NO: 68790 - RNA, 30 nt, Mus musculus
ugguuauacaugaugucaaugucugcagua

SEQ ID NO: 68791 - RNA, 46 nt, Mus musculus
aucuccuauauuguaaucuuauacucucugagaagccacagugcag

SEQ ID NO: 68792 - RNA, 46 nt, Mus musculus
uagggucuuuuauacauuccacugcucagauuguuuuggcauugag

SEQ ID NO: 68793 - RNA, 42 nt, Mus musculus
uuggugccacugagauauucaucuuggugguaauggccuaug

SEQ ID NO: 68794 - RNA, 46 nt, Mus musculus
cuggucuccuauggugucauccuguucucucugaaagcucacaguu

SEQ ID NO: 68795 - RNA, 46 nt, Mus musculus
ugcccaggacaccaucacaagauugccacagagccuccgguucaug

SEQ ID NO: 68796 - RNA, 45 nt, Mus musculus
ugcauauuuguguaucuucgcccaguaauuaccuucucuauugau

SEQ ID NO: 68797 - RNA, 45 nt, Mus musculus
cagaaauaauggucaaugauauuggggccacagaagggcaaagga

SEQ ID NO: 68798 - RNA, 42 nt, Mus musculus
guuccuugaaugugacuauguugcuucauccacagcugaacg

SEQ ID NO: 68799 - RNA, 45 nt, Mus musculus
cagcaaugggagaggcugcugguuauauugcaucugcugucugga

SEQ ID NO: 68800 - RNA, 47 nt, Mus musculus
cuucuuacugucugccccaagcccucaguggaacugugaacaaaagu

SEQ ID NO: 68801 - RNA, 67 nt, Mus musculus
cccuaaaguaguccuguagaagauuagagucccuuaaaaaaaucaaagcaacauaaucauaaucaca

SEQ ID NO: 68802 - RNA, 46 nt, Mus musculus
uuuacucagguugucauuuuauguaugugugugugucugugugucu

SEQ ID NO: 68803 - RNA, 46 nt, Mus musculus
aaagccaggauuauguuggguugaauauauuuuaaguaucagaggu

SEQ ID NO: 68804 - RNA, 45 nt, Mus musculus
ucuaucagaacacaacggcaaugacaaucuaugaaaaccucgagc

SEQ ID NO: 68805 - RNA, 46 nt, Mus musculus
auguuuuccucaaucaguguguuuuggauauuaucagagcccagaa

SEQ ID NO: 68806 - RNA, 46 nt, Mus musculus
ucucuguuggggggggagugagggagggagggagagaaugagagag

SEQ ID NO: 68807 - RNA, 46 nt, Mus musculus
aaacucaaaauugaacugggugcguugucuccacauagggugagua

SEQ ID NO: 68808 - RNA, 45 nt, Mus musculus
ugccuucucucucucucucucucucucucucucucucguguacau

SEQ ID NO: 68809 - RNA, 42 nt, Mus musculus
uauuauauggaauggcaaccguauguauaaucagagggaaga

SEQ ID NO: 68810 - RNA, 45 nt, Mus musculus
aauucuagccuuaaacuccuugugagguguucuuccuacucaaga

SEQ ID NO: 68811 - RNA, 71 nt, Mus musculus
agauguuuugaaguacacguaugaggauuucaaaaggggagccucggauacuuaugucacauaccucauaa

SEQ ID NO: 68812 - RNA, 71 nt, Mus musculus
ugcccuugaaagcaagcacaaaaagauuacuuggggcauucugagggcaucuucuggguggaagaagaggg

SEQ ID NO: 68813 - RNA, 42 nt, Mus musculus
uauucagcaccuuuguggugguauggaaacauuacagaagau

SEQ ID NO: 68814 - RNA, 50 nt, Mus musculus
gagggcagcuguuuaccuggugcuuucaaggaucagguaggaaguaccuu

SEQ ID NO: 68815 - RNA, 44 nt, Mus musculus
cccaccuacuccggauggauccccuaauauuacaucggucaguc

SEQ ID NO: 68816 - RNA, 78 nt, Mus musculus
cuauuugaauuuuucuaccucguacaacaucagcaucgccaccuugucaugugggaagauggcgcuucccgcccagaa

SEQ ID NO: 68817 - RNA, 64 nt, Mus musculus
ucaggagugauuccugggacaauaugacacgccuagagaacugcacuucggaugaugacacaga

SEQ ID NO: 68818 - RNA, 46 nt, Mus musculus
agauaaaaguaggcaaguagauagguggugauuauggcuaagagga

SEQ ID NO: 68819 - RNA, 41 nt, Mus musculus
gagcaaugacuccaaguccuucgagauuuucaucaagcagg

SEQ ID NO: 68820 - RNA, 46 nt, Mus musculus
agaugaauggauuccaggaggggcaacgcuguauugauaccaaggc

SEQ ID NO: 68821 - RNA, 45 nt, Mus musculus
uuuauauacaugaacagucacguguccggccucuuucccggagug

SEQ ID NO: 68822 - RNA, 46 nt, Mus musculus
uauagccugagggagucugggauaauggggaacucacaccagagag

SEQ ID NO: 68823 - RNA, 41 nt, Mus musculus
uuauuuucccauugaggaagguccuaacacacagggggaga

SEQ ID NO: 68824 - RNA, 44 nt, Mus musculus
ucgaggucaucgggugaagugaaaggguagcuuugggguuuggu

SEQ ID NO: 68825 - RNA, 45 nt, Mus musculus
gaggcuuaagugagaugaugaauguaacacccaaugcagugacag

SEQ ID NO: 68826 - RNA, 58 nt, Mus musculus
aggcaaggauuugccuuucugcggacuguauuucggggagcgguuggauaauacucac

SEQ ID NO: 68827 - RNA, 41 nt, Mus musculus
guggugguacccauuccguccacugaagcuucacccucagu

SEQ ID NO: 68828 - RNA, 45 nt, Mus musculus
aagaguugguuggaacuggguccuggauuuucuucgcucaucugg

SEQ ID NO: 68829 - RNA, 44 nt, Mus musculus
gugcuggagaucgcagguagugggcacgaggacaaggagagagg

SEQ ID NO: 68830 - RNA, 42 nt, Mus musculus
ucagagacacagagacagacagacugacugacugagggguau

SEQ ID NO: 68831 - RNA, 45 nt, Mus musculus
aaauuuuacccauuuuggacuugucuguggaagcaauuagggaga

SEQ ID NO: 68832 - RNA, 44 nt, Mus musculus
aaugcuagguuuuggauuggacuuugggucagcuucaggguagu

SEQ ID NO: 68833 - RNA, 45 nt, Mus musculus
ucccuggugggccguuggcuccugaguaagauagauacaugcagu

SEQ ID NO: 68834 - RNA, 41 nt, Mus musculus
gaggcagagaggcagaggggcagagaggcagaggggcagag

SEQ ID NO: 68835 - RNA, 68 nt, Mus musculus
agaggggcagaggggcagaggcagaggagcagaggggcagaggggcagaggcagaggggcagaggggc

SEQ ID NO: 68836 - RNA, 28 nt, Mus musculus
gcuacacugggaaagucaucuggcuucc

SEQ ID NO: 68837 - RNA, 46 nt, Mus musculus
uaguaacgugguuguuugaggacagaggacacuuguacuuggggau

SEQ ID NO: 68838 - RNA, 45 nt, Mus musculus
auuggacucugggggauuauuaaaaccccuagaggacauaaaguu

SEQ ID NO: 68839 - RNA, 45 nt, Mus musculus
agaaagacagagacagaccagauagacagacagacagagacagac

SEQ ID NO: 68840 - RNA, 46 nt, Mus musculus
uauuugugagcauugcaaugugucggaguguagccacuguucugua

SEQ ID NO: 68841 - RNA, 46 nt, Mus musculus
acagguuucaggggaaggugagguggaagugaggguugcuugagau

SEQ ID NO: 68842 - RNA, 42 nt, Mus musculus
agcaguuguaaauuuaucaguuaccaaacucaaggugcaaga

SEQ ID NO: 68843 - RNA, 41 nt, Mus musculus
ggugagagggggaggauggagggggagugcuuggcccuggg

SEQ ID NO: 68844 - RNA, 23 nt, Mus musculus
guaugaggagcaggggcuuucaa

SEQ ID NO: 68845 - RNA, 46 nt, Mus musculus
gagaaauuaggaggucaguagguuagaugaggaccaagccaaaggc

SEQ ID NO: 68846 - RNA, 46 nt, Mus musculus
caucgaacaucuggauccauggcauauuacuuaguauuuaguguuu

SEQ ID NO: 68847 - RNA, 45 nt, Mus musculus
ccagaacagacuucauuaguggcacacaauagccaugacuguuga

SEQ ID NO: 68848 - RNA, 46 nt, Mus musculus
augggauuauugaaauauauguuuuauuauuuauccucuggcaguu

SEQ ID NO: 68849 - RNA, 42 nt, Mus musculus
gacuccccaccaggguuguuugauuuugcuauggcugaugau

SEQ ID NO: 68850 - RNA, 46 nt, Mus musculus
aguuccugugcuuuccuuugcuuucaguuuucuucccuuggcaggc

SEQ ID NO: 68851 - RNA, 42 nt, Mus musculus
cuuggacuucagaagugaugagauccuguuuagccugcauuc

SEQ ID NO: 68852 - RNA, 46 nt, Mus musculus
uuauuagacuuuaaaaccuuuuacauguguuucugaguugcuguga

SEQ ID NO: 68853 - RNA, 46 nt, Mus musculus
gcgcucacaucguggcuuacaacuaucuguaacuccugccucaggg

SEQ ID NO: 68854 - RNA, 42 nt, Mus musculus
aguguuugcucuacccacccacagacuuggaaagaugcagaa

SEQ ID NO: 68855 - RNA, 46 nt, Mus musculus
gucuguauugccugauuuuaaauggacucuucucucaggugaagac

SEQ ID NO: 68856 - RNA, 46 nt, Mus musculus
ucuggaguuagacuccuuagguaugcauccuuccauccccgcaggc

SEQ ID NO: 68857 - RNA, 66 nt, Mus musculus
gguugcguucuugauuaaguuuauuuguauuguauuguuuauuggucuauguguauaugugugugg

SEQ ID NO: 68858 - RNA, 46 nt, Mus musculus
gccgaguacguuugacacggagacuggcuuaagaaaccuggaagac

SEQ ID NO: 68859 - RNA, 41 nt, Mus musculus
gagcuuucugggcuggcuguugccaguuugaugggguucua

SEQ ID NO: 68860 - RNA, 64 nt, Mus musculus
gugugugugugugugugugcccaauguaaagaagaaaaagggaggaauguaaaaagaggaguaa

SEQ ID NO: 68861 - RNA, 46 nt, Mus musculus
gcaugcagggauggccuaggcuuguacacccccaaagacagugaga

SEQ ID NO: 68862 - RNA, 42 nt, Mus musculus
uccaucauccagauggucagaugccagcgucacuguggagau

SEQ ID NO: 68863 - RNA, 46 nt, Mus musculus
guguguguguguguguguauguuaugagugcggaaguagcugagug

SEQ ID NO: 68864 - RNA, 45 nt, Mus musculus
aaaaggaaaagaaaaagaaaaaaguaaaaaaaaaaaaggaaaaga

SEQ ID NO: 68865 - RNA, 46 nt, Mus musculus
caggaggauugaaaauuugaagcuggcuugggcaauauauugagac

SEQ ID NO: 68866 - RNA, 42 nt, Mus musculus
ggguuuugccaaauagagggaagcauaaaacugaggcaaaua

SEQ ID NO: 68867 - RNA, 42 nt, Mus musculus
uguaagauacacugcaguacaaaacagugcgccuccuggggg

SEQ ID NO: 68868 - RNA, 45 nt, Mus musculus
caguggaaacucaguggagcaucugagagagaggcagcaugggaa

SEQ ID NO: 68869 - RNA, 41 nt, Mus musculus
aagaaaacuguuugggucugucucauuuuuugagggaaaau

SEQ ID NO: 68870 - RNA, 46 nt, Mus musculus
uacuucugagacguacccuuguaaaucagcauguuuggauccacac

SEQ ID NO: 68871 - RNA, 45 nt, Mus musculus
augaggggggaaucuuugaaguguagacuucugggaugucugaga

SEQ ID NO: 68872 - RNA, 38 nt, Mus musculus
cuggguuugauugagagagccuguuucaguaaauaagu

SEQ ID NO: 68873 - RNA, 46 nt, Mus musculus
acauuauucaguuuuccaguagucuuaccaauagccuuguccaggu

SEQ ID NO: 68874 - RNA, 45 nt, Mus musculus
acuaggguggguuugcaaguuagaaaaagaagcugagcugggagu

SEQ ID NO: 68875 - RNA, 41 nt, Mus musculus
ugaaguguuuuauagauguugcuaucaggaccuagagaggg

SEQ ID NO: 68876 - RNA, 45 nt, Mus musculus
uggcgcacgccuuuaauccaguacuugggaggcggaggcaggcgg

SEQ ID NO: 68877 - RNA, 46 nt, Mus musculus
uuuuuaaaacccaaagccagaauucuccacccccacccccacaccu

SEQ ID NO: 68878 - RNA, 72 nt, Mus musculus
ggcugaguaugaaugaaggagugggagagggagggaagcagacagaugggagagagagggauaggggaagac

SEQ ID NO: 68879 - RNA, 46 nt, Mus musculus
guauccuuuagaaucaugauagaggguaacauuuacagccuuugau

SEQ ID NO: 68880 - RNA, 25 nt, Mus musculus
cguuuuuauagagaugcaggcuuuc

SEQ ID NO: 68881 - RNA, 46 nt, Mus musculus
ggucaggaucagacguucugggucuuggcucuguucagauccauau

SEQ ID NO: 68882 - RNA, 45 nt, Mus musculus
uguuuaggguuuuuuuuuuuuuuguuuucuuuagagccuggcagg

SEQ ID NO: 68883 - RNA, 42 nt, Mus musculus
uaagcguccuaugggguaccagggugagccgggcagggcauc

SEQ ID NO: 68884 - RNA, 66 nt, Mus musculus
ggaagucuguugaaaacaaacguggacaugucauaggguagauacuaagugugugagugugugugg

SEQ ID NO: 68885 - RNA, 46 nt, Mus musculus
ccggccgugcccaccuccugucacuggcuacauuuucuguagaguu

SEQ ID NO: 68886 - RNA, 46 nt, Mus musculus
aaucugccucaaaaagauaaauguagacagagauauagcagaagac

SEQ ID NO: 68887 - RNA, 45 nt, Mus musculus
gauaaaguacuuggcgugcuaaaauaaagaccaaggaguuuggau

SEQ ID NO: 68888 - RNA, 136 nt, Mus musculus
aaaagaaaaaaagaaaaagagaaaaagagaaaaagaaaaaaagagaaaaagagaaaaagagaaaaagagaaaaagagaaaaaaagaaaaaagaaaaaaaggaaaaaaggaaaaaaaagaaaaagagaaaaagaaaa

SEQ ID NO: 68889 - RNA, 41 nt, Mus musculus
cauguacagagcaagcacucucuacaucuuuagccccugga

SEQ ID NO: 68890 - RNA, 46 nt, Mus musculus
uagugaaucccgaggaagcagucugaguaaaugaucuuuaggugug

SEQ ID NO: 68891 - RNA, 42 nt, Mus musculus
acuuagcaaaacaguauuuguaaacuauaucaagcccaugau

SEQ ID NO: 68892 - RNA, 46 nt, Mus musculus
uguucgaagugguugcugcuguuaugugggggcauuucaggguagu

SEQ ID NO: 68893 - RNA, 46 nt, Mus musculus
acuaauacuuccugcuuagcugggugguggggggaucaaauaagau

SEQ ID NO: 68894 - RNA, 41 nt, Mus musculus
acacaaacaugaggaucugaguucaaaucccuagggccagu

SEQ ID NO: 68895 - RNA, 45 nt, Mus musculus
acugcuucuuauuugaaguuccccuucuccaagaauucgcuaugc

SEQ ID NO: 68896 - RNA, 45 nt, Mus musculus
uauauuauauauguacaccacuuuucauauaaagccuuuucagau

SEQ ID NO: 68897 - RNA, 93 nt, Mus musculus
aacuaauugucagcaaggguaacuuauaguuucuaaagcaggauuugcacaggacucgugguguuguccccagcaaauaauucuuuacuggac

SEQ ID NO: 68898 - RNA, 45 nt, Mus musculus
gacacaaaugaagcauaggcuggggauggaaacugacuuugagag

SEQ ID NO: 68899 - RNA, 42 nt, Mus musculus
gcggagcggggacuaggcggaccggcuggcggagaaggaggc

SEQ ID NO: 68900 - RNA, 42 nt, Mus musculus
ccuuuggguuggcucugcgucccaggccuucacccucucgag

SEQ ID NO: 68901 - RNA, 46 nt, Mus musculus
uuaaagcugcacuuucagugaguucagagaggggguuuuaacucag

SEQ ID NO: 68902 - RNA, 40 nt, Mus musculus
ccuaaaugucugacuuguguuccuagcucagcacauugca

SEQ ID NO: 68903 - RNA, 48 nt, Mus musculus
ugcacauugugaaagguacuuuauggguuaggaacacuuggagagauu

SEQ ID NO: 68904 - RNA, 46 nt, Mus musculus
acucgauuugaguaucaguucuguguucuucaucuuguaaaacaag

SEQ ID NO: 68905 - RNA, 46 nt, Mus musculus
uucaaggccauucuugacuuccuaagagguuaaaguuaaccuggau

SEQ ID NO: 68906 - RNA, 46 nt, Mus musculus
ucaaaucccagcaaccgcaugguggcucacaaccacccauaaugag

SEQ ID NO: 68907 - RNA, 46 nt, Mus musculus
acacaggccuuuucgcauucuccaccacugagauguacuacuccag

SEQ ID NO: 68908 - RNA, 45 nt, Mus musculus
gucauuggcuguagguuauagcugaccucuauuuuuaaaguggca

SEQ ID NO: 68909 - RNA, 46 nt, Mus musculus
uguugagcggguccagggaauccagacucugguccuagggcuuucg

SEQ ID NO: 68910 - RNA, 42 nt, Mus musculus
acacuguagcugucuucagacacuccagaagagggaguccga

SEQ ID NO: 68911 - RNA, 46 nt, Mus musculus
ugauucuggcaaagaauccaauagggaugagaggcuguugauagag

SEQ ID NO: 68912 - RNA, 30 nt, Mus musculus
ucuuuguugcauuacuucacagaacccaag

SEQ ID NO: 68913 - RNA, 133 nt, Mus musculus
gagccgaggaaacagcuuguuuuuccggaagguuccuugugggaagacuuacuguuaugaccuaagaauguuaaucugaagauguggggcagggacagugacauuucuauagucccaaugcacagaauuaugg

SEQ ID NO: 68914 - RNA, 45 nt, Mus musculus
cuauacaguguggcacgcuuuuuuaauaaucauuuaaucuuggga

SEQ ID NO: 68915 - RNA, 49 nt, Mus musculus
uugauuucccagcaccacagggaaguacgcagccaucuauaacucuaga

SEQ ID NO: 68916 - RNA, 45 nt, Mus musculus
acaaccauccauauugauaucugacuuccucuucuggggcuauug

SEQ ID NO: 68917 - RNA, 42 nt, Mus musculus
aaaccgugagguguacguagcccuaucucgguacagcggagg

SEQ ID NO: 68918 - RNA, 46 nt, Mus musculus
uuaagaacucacuggagcgagagguaaguaagaaacagcagcuuag

SEQ ID NO: 68919 - RNA, 45 nt, Mus musculus
cugcauuccucaguggcccucaguggccuucucucuauuuuggca

SEQ ID NO: 68920 - RNA, 46 nt, Mus musculus
uucacguggcacuugucaguuucugugucaaagcacuggaucaguc

SEQ ID NO: 68921 - RNA, 43 nt, Mus musculus
gagccagccucuucucagacuuaggcacagccucucuuaccag

SEQ ID NO: 68922 - RNA, 46 nt, Mus musculus
uacugauuaucucucaugcugacuuaagagucugaagacuguggau

SEQ ID NO: 68923 - RNA, 45 nt, Mus musculus
acaaugcuacugaacaucuggaaagcuguaccaaggcuacuccag

SEQ ID NO: 68924 - RNA, 45 nt, Mus musculus
auaguugugagccaccacgugguugcugggauuugaacucaggac

SEQ ID NO: 68925 - RNA, 46 nt, Mus musculus
uauuucauuucucuaguuucuuaaauaauguuacacaaaaccaggu

SEQ ID NO: 68926 - RNA, 45 nt, Mus musculus
gacaugugaguugcugccuuuguaagauggcacuagccuagagca

SEQ ID NO: 68927 - RNA, 68 nt, Mus musculus
uuauagaaaaagaacaaaagaacaugacuguccccggaauuucccaaaauauugucacaggucucaag

SEQ ID NO: 68928 - RNA, 46 nt, Mus musculus
acaaggcaugguaguggcacagggccgacaucccaacaccccagaa

SEQ ID NO: 68929 - RNA, 46 nt, Mus musculus
gagcaccccuuauuauauaugcuauguuaauaguuaucauugagaa

SEQ ID NO: 68930 - RNA, 46 nt, Mus musculus
aaaauugugacuuguguguggugguuugaauaugcuuggcucaggg

SEQ ID NO: 68931 - RNA, 42 nt, Mus musculus
acgaggaguacgagacccgauuccugugcaacaccucgaagg

SEQ ID NO: 68932 - RNA, 59 nt, Mus musculus
cccugucgccccacguguucuucgugcccacccccggggguguccuagauucccgcccc

SEQ ID NO: 68933 - RNA, 43 nt, Mus musculus
acggcucuggagggugccuucuucgcuaggucccaggcuuugg

SEQ ID NO: 68934 - RNA, 72 nt, Mus musculus
gguuugaauugcacuuuuucacuuuuuccaguuuguuucuuuuuagauccuuagaaugacggugucuucaga

SEQ ID NO: 68935 - RNA, 26 nt, Mus musculus
cucauuuaaagaugugggucagaaga

SEQ ID NO: 68936 - RNA, 86 nt, Mus musculus
ugaugaccaacugggguuugguuaaaaaagauuuuuggggauggagauauuuacauguacauaaugagauaucuugaaguaccaac

SEQ ID NO: 68937 - RNA, 47 nt, Mus musculus
ucaucuggcuauuuuaauugugcauucuuguguguuuguggagagag

SEQ ID NO: 68938 - RNA, 87 nt, Mus musculus
agaagagagcauuggaucccucuagagcuagaauuacaggcuguugugagcuaucugauaugggugcagggaacugaacuagauccu

SEQ ID NO: 68939 - RNA, 46 nt, Mus musculus
ucuauguauaggugugugcuuguugugguacaauguggaaaagaag

SEQ ID NO: 68940 - RNA, 45 nt, Mus musculus
cugccacccaagugcugggauaauguuuccuuuuuuaaauuguag

SEQ ID NO: 68941 - RNA, 46 nt, Mus musculus
ggugcaccuguguauguagaggcaaaacacacacacacccguaaag

SEQ ID NO: 68942 - RNA, 61 nt, Mus musculus
agaucucguuacagaugguagugagccaccaugugguugcugggauuugaacucgggaccu

SEQ ID NO: 68943 - RNA, 46 nt, Mus musculus
gggcaacuugugguaguugguuuucuucuuccaucuuuacauggag

SEQ ID NO: 68944 - RNA, 43 nt, Mus musculus
cuuuuuuauugauucucucugaguuuaacaucaugcaccccag

SEQ ID NO: 68945 - RNA, 46 nt, Mus musculus
cacucaaaagaaaauaaaaauaaacaaaaaaacccccaaagcguag

SEQ ID NO: 68946 - RNA, 46 nt, Mus musculus
ccagugaggagcagggcuaacucucccagcuaguagcagguggcaa

SEQ ID NO: 68947 - RNA, 46 nt, Mus musculus
gggagcaaauucuagaagaaaauaggggaaugugauacuuggugau

SEQ ID NO: 68948 - RNA, 45 nt, Mus musculus
aaaaaacagcuuacagaccucuuuacuaaauuaauuuggguuaua

SEQ ID NO: 68949 - RNA, 46 nt, Mus musculus
uaaacucuuauaaugccaacacuuacauaacauagacaccguguga

SEQ ID NO: 68950 - RNA, 46 nt, Mus musculus
gcugugugguaguacuucuuaaaagcaguguacuaaagaaaaguag

SEQ ID NO: 68951 - RNA, 45 nt, Mus musculus
aaagugaaaaugcaguugccagucuugcugucuucaauagaauag

SEQ ID NO: 68952 - RNA, 46 nt, Mus musculus
gaccuaguaaaaauuuuuuucagucuuuucaguuccugaggcuaag

SEQ ID NO: 68953 - RNA, 46 nt, Mus musculus
uacaaauuauagaagauugagaauuuugggacuggguggagaaaag

SEQ ID NO: 68954 - RNA, 46 nt, Mus musculus
ucuuuggaguggguacaguaggacuauuaauuugccuuuugcugag

SEQ ID NO: 68955 - RNA, 46 nt, Mus musculus
aaagaaauuauuaauauuauuuuuaaagaacugcacuuaggcccag

SEQ ID NO: 68956 - RNA, 46 nt, Mus musculus
ccacuugggaggcugaggcagcaagaucuugaguuaggaggccagc

SEQ ID NO: 68957 - RNA, 47 nt, Mus musculus
ugaaaaugaaauuacugacuacuuuaauuuuguaaaacagccaagau

SEQ ID NO: 68958 - RNA, 70 nt, Mus musculus
augaaucacaagagguagcggcuuauaaacaaauaccacaauauggguaagggaaagaggggcuuuauuu

SEQ ID NO: 68959 - RNA, 44 nt, Mus musculus
uagaaugauaaagacuacaguugaaucuaaaccuuccacugaga

SEQ ID NO: 68960 - RNA, 46 nt, Mus musculus
caguguacauguagauauauagcugagugacuaaaaauaaccccaa

SEQ ID NO: 68961 - RNA, 46 nt, Mus musculus
uguauguggguacacugucuucagacacaccagaagaggacaucag

SEQ ID NO: 68962 - RNA, 46 nt, Mus musculus
augcuccuuagcaauuugaaaaaugcuuagugucuguccuguucag

SEQ ID NO: 68963 - RNA, 46 nt, Mus musculus
uggaugguugugagccgccaugugguugcugggaauugaacuccag

SEQ ID NO: 68964 - RNA, 32 nt, Mus musculus
cuuguauauaaaacuugccugaguuccuguga

SEQ ID NO: 68965 - RNA, 45 nt, Mus musculus
ugguugugagccaccaugggguugcugggauuugaacuccugacc

SEQ ID NO: 68966 - RNA, 46 nt, Mus musculus
aguguaugacacuagcuccucucuuaacuugcagguaagggcccac

SEQ ID NO: 68967 - RNA, 46 nt, Mus musculus
auccccuggaacaucauuaacaauggaaauuuuaacuuggcuccca

SEQ ID NO: 68968 - RNA, 46 nt, Mus musculus
aaguugggaccuccuauguuaugcuuggauuucuuaagagaaacag

SEQ ID NO: 68969 - RNA, 46 nt, Mus musculus
gccagucuucuuaccaaauacuaggaguauauguuugagccaccag

SEQ ID NO: 68970 - RNA, 43 nt, Mus musculus
uuggucaauaugaaaacaguuaagagaacucuguugccgggac

SEQ ID NO: 68971 - RNA, 46 nt, Mus musculus
cuggagaucuaguucacuugacagagugcuugucuagaaccugugg

SEQ ID NO: 68972 - RNA, 52 nt, Mus musculus
gcacagagaagggucucuguucaucuuuguauuuggugcuaaucaagaagga

SEQ ID NO: 68973 - RNA, 42 nt, Mus musculus
cccaguuccuuuaguugucuaagauguuaaacuaacccacga

SEQ ID NO: 68974 - RNA, 33 nt, Mus musculus
ucuuuucauuugcuuacacuucaagaaacggag

SEQ ID NO: 68975 - RNA, 46 nt, Mus musculus
uggccuaugccccuuuuccaaaucaagccaugucauuagccacauc

SEQ ID NO: 68976 - RNA, 46 nt, Mus musculus
guugaguguaguguuuucacuuguuuaguauuacuuucugaggcag

SEQ ID NO: 68977 - RNA, 46 nt, Mus musculus
uuguuuuuguuuuuguuuuguuuuugaggguggcagcuagagggag

SEQ ID NO: 68978 - RNA, 46 nt, Mus musculus
uaaauggguggguaacuggaaauuuuucuauuuguauaaugagcaa

SEQ ID NO: 68979 - RNA, 46 nt, Mus musculus
acuuugauaauucuuaaagauguagaguugauauauaaaaaagcag

SEQ ID NO: 68980 - RNA, 88 nt, Mus musculus
aagaaacauuuaugaugcgagauugcccuuaaguucuugacaguuugcagagugggaauacauuuauucaaguaggaguguuuggugu

SEQ ID NO: 68981 - RNA, 43 nt, Mus musculus
auagaaccaacuuacaagcaucauaugcuuaccuuucggagcg

SEQ ID NO: 68982 - RNA, 41 nt, Mus musculus
ggccagguuccaaggaccuggucugagaaagacuugaggga

SEQ ID NO: 68983 - RNA, 45 nt, Mus musculus
auucagggugcuguuuuguuacauuuuacacccguaaagcugcau

SEQ ID NO: 68984 - RNA, 72 nt, Mus musculus
uacuaaaaagcauuuuggaggaaaggucuuugcugugggaauuacugugaaaaggagaauauaaagggaaca

SEQ ID NO: 68985 - RNA, 46 nt, Mus musculus
uuuaacuuuaugacucacguucugucuauucuuguguuuuguugag

SEQ ID NO: 68986 - RNA, 42 nt, Mus musculus
uuuccccuuuccuuuccccuuuccccuuuccccuuuccccuu

SEQ ID NO: 68987 - RNA, 45 nt, Mus musculus
uguacugaaaaugacauccgagucauguuuucuucguuuggacag

SEQ ID NO: 68988 - RNA, 67 nt, Mus musculus
agguugugcauuugugacuuuuacuacaagaaccauggcacagacagcuaucaaagcaaugcaccaa

SEQ ID NO: 68989 - RNA, 86 nt, Mus musculus
gcucauccccaauggugguaaaguuugccgacacccagaaggacaaagaacagaagagaauggcccagcagcuccagcagcagaug

SEQ ID NO: 68990 - RNA, 45 nt, Mus musculus
ucuguguggggaaaccuggcuggucugaacacacuuggaccccag

SEQ ID NO: 68991 - RNA, 45 nt, Mus musculus
agacugaaauaugacuuugagucauacagucuaaaagaaggucca

SEQ ID NO: 68992 - RNA, 46 nt, Mus musculus
caugaguucuaggucagccugugauccacagugaguucuuggccag

SEQ ID NO: 68993 - RNA, 45 nt, Mus musculus
uccauuucuaaaauaguucucaguuuauucuaacuagaaugccuu

SEQ ID NO: 68994 - RNA, 46 nt, Mus musculus
cagcuccuacagcagacugccuccucugggaaccucaacacccuga

SEQ ID NO: 68995 - RNA, 46 nt, Mus musculus
agucugagagauggguaccauuugugucaaaauguuacugcucgug

SEQ ID NO: 68996 - RNA, 46 nt, Mus musculus
cacaccaagugguaccaaugcucucacuacauccagcaguccccuc

SEQ ID NO: 68997 - RNA, 42 nt, Mus musculus
gacuacuugcgguaguuaauucuucucaccucguggucccag

SEQ ID NO: 68998 - RNA, 32 nt, Mus musculus
gcuccagcagcaguaauucugucaaccccaua

SEQ ID NO: 68999 - RNA, 48 nt, Mus musculus
auuggugagugguaucaggccuaccaugugcuagaaaacaguaaugaa

SEQ ID NO: 69000 - RNA, 45 nt, Mus musculus
cagaauuuauugacacagcagaguauuggugcugcuggaagccag

SEQ ID NO: 69001 - RNA, 49 nt, Mus musculus
agaaccaacugagaaagacuaugaaguacagugcuuuuugccauuuugu

SEQ ID NO: 69002 - RNA, 47 nt, Mus musculus
ggaauugaucuggucauuugacaaggaucuucuuuuguuagggaguu

SEQ ID NO: 69003 - RNA, 54 nt, Mus musculus
guccuaaaugagauacugagaugugaugggaucaagugagauagcugcuagguu

SEQ ID NO: 69004 - RNA, 54 nt, Mus musculus
uagagacccagaggaugugaggaagcaaaccaaguguguguauaggagaagagu

SEQ ID NO: 69005 - RNA, 42 nt, Mus musculus
ggcagacuugaauugaaguccuccucuuuuagacuccugaag

SEQ ID NO: 69006 - RNA, 42 nt, Mus musculus
guccagaaggagccaaccuguucaucuaucaccugccccagg

SEQ ID NO: 69007 - RNA, 44 nt, Mus musculus
gaggauuuuugacagaucccacugagacuuaagcacugguggga

SEQ ID NO: 69008 - RNA, 45 nt, Mus musculus
cucugggaaaaccuguggauaaaaccaaaugccaaauguuggaca

SEQ ID NO: 69009 - RNA, 46 nt, Mus musculus
aaugcuuuucuugaccuuguuugagcuuuccuuuuuuccuguuuga

SEQ ID NO: 69010 - RNA, 46 nt, Mus musculus
uuaauugcacagacacacagacaaaaagucauuuuguaucugccaa

SEQ ID NO: 69011 - RNA, 46 nt, Mus musculus
ugcaugaagaggccgaaacugggagugcgcacgagccccugaggga

SEQ ID NO: 69012 - RNA, 46 nt, Mus musculus
aaaugaccagauuucuuuuuugagagcaagguguuagcugugagaa

SEQ ID NO: 69013 - RNA, 42 nt, Mus musculus
augaucccagagaacuuugcucagaaauaccuagaaucagga

SEQ ID NO: 69014 - RNA, 45 nt, Mus musculus
guuaugcauuaagaccuauuuaggggcuggggaauguaucuuaua

SEQ ID NO: 69015 - RNA, 46 nt, Mus musculus
ugcucagcugccagugucccaucagcacaacagucaagagggagau

SEQ ID NO: 69016 - RNA, 41 nt, Mus musculus
cuuguucuguagauauaaauaaauuacuuagaccggcugcc

SEQ ID NO: 69017 - RNA, 44 nt, Mus musculus
ccauuuuccuuacccuuccuacuuacccccucuacagccaaaga

SEQ ID NO: 69018 - RNA, 42 nt, Mus musculus
acaggccucacuucucauugacaaagaaaccagcccaaggag

SEQ ID NO: 69019 - RNA, 41 nt, Mus musculus
aagaagucgaaaaggaaggaaugguuaaaauggcucagugg

SEQ ID NO: 69020 - RNA, 44 nt, Mus musculus
gcucacaaccaucuguaaugagauccgaugcccucuucugaugu

SEQ ID NO: 69021 - RNA, 46 nt, Mus musculus
ccuggaucugcucccucuugggcucucucaugguugggcucagugg

SEQ ID NO: 69022 - RNA, 78 nt, Mus musculus
cccuccggagccugggggcugcagcugccugucgccuggauaauaaagaaagcgaguccuggggggcuuugcugagug

SEQ ID NO: 69023 - RNA, 46 nt, Mus musculus
ggcuggagccagcucagaaggaaaauaugugugguucuugggagac

SEQ ID NO: 69024 - RNA, 45 nt, Mus musculus
ccaagguaacaaagcguagacuccgggccuguauggguggcauca

SEQ ID NO: 69025 - RNA, 38 nt, Mus musculus
gcuuucuuccccagguggggaaggugccuguguguaug

SEQ ID NO: 69026 - RNA, 46 nt, Mus musculus
gaauuuguagugaguaaaaaaaaacaaaaaacugaaguccugagaa

SEQ ID NO: 69027 - RNA, 47 nt, Mus musculus
uggcuugggagucaggacagauaggaaaggggguagagauaagccuc

SEQ ID NO: 69028 - RNA, 45 nt, Mus musculus
uggagccacagacagccaaugccacaauuaccucugggcagggga

SEQ ID NO: 69029 - RNA, 45 nt, Mus musculus
cuccuaccuguguccucccacugucauccagguacagcccaagua

SEQ ID NO: 69030 - RNA, 45 nt, Mus musculus
acacauucugugaggaguggcagcuguuuguuaauaggccaaaag

SEQ ID NO: 69031 - RNA, 48 nt, Mus musculus
uucucauuuggagccaagaggaagaugggucacagaaagaucaugaaa

SEQ ID NO: 69032 - RNA, 46 nt, Mus musculus
ucuguuaguuccccaagacagccccaaccucugagacagaccagca

SEQ ID NO: 69033 - RNA, 43 nt, Mus musculus
ucccuaugaacuaaggacaauagauguguuugauggaagcuca

SEQ ID NO: 69034 - RNA, 46 nt, Mus musculus
aaaacaaaaaugcccaaguugguaucaccuuaagaaacugcaggaa

SEQ ID NO: 69035 - RNA, 25 nt, Mus musculus
uagaggaggcugauuuccaggaaga

SEQ ID NO: 69036 - RNA, 45 nt, Mus musculus
gaugugcaguggaaaacaucugguuucccuuggggucagaucugg

SEQ ID NO: 69037 - RNA, 41 nt, Mus musculus
uaacaucgcaccuagcgccugggggcguuuaggcaccuaga

SEQ ID NO: 69038 - RNA, 46 nt, Mus musculus
guccaaagcuuugucauuuugccauccccacuacccaaggaaugac

SEQ ID NO: 69039 - RNA, 41 nt, Mus musculus
cccuucucugaccuucaguucuguucuagaaaacaggugga

SEQ ID NO: 69040 - RNA, 49 nt, Mus musculus
agccccccagcacuggccgguggaaagccccucgcugccagguccgcac

SEQ ID NO: 69041 - RNA, 45 nt, Mus musculus
gcggcccacccgcuccuguaauuuucgaagcugcuccugggacau

SEQ ID NO: 69042 - RNA, 42 nt, Mus musculus
uuuugucuuucuucaggggaagaguugcugaagaugagcgag

SEQ ID NO: 69043 - RNA, 45 nt, Mus musculus
cugaccugggccagagcuuaacccuuccuggacugcuggaccuga

SEQ ID NO: 69044 - RNA, 51 nt, Mus musculus
gaagucucagggcccaugaagggcaggggucugugucuagaguuggagguu

SEQ ID NO: 69045 - RNA, 25 nt, Mus musculus
uuugaggccaguccagaauauacac

SEQ ID NO: 69046 - RNA, 46 nt, Mus musculus
acacacacaaagucaacaacuccccagacccacaagaccggcaucu

SEQ ID NO: 69047 - RNA, 48 nt, Mus musculus
uucaauacaaacagugcugaaagaaagucaugucccucuggggaggga

SEQ ID NO: 69048 - RNA, 45 nt, Mus musculus
caaucauguaccauugugucugguuuacuguguguuuauuaaaag

SEQ ID NO: 69049 - RNA, 46 nt, Mus musculus
uaagugggucagagaugguucugggguuuggaauaugcggagccag

SEQ ID NO: 69050 - RNA, 42 nt, Mus musculus
aguguugugauguuucugggaacugcagaaaguugaccguaa

SEQ ID NO: 69051 - RNA, 45 nt, Mus musculus
ugcaacaucuuaggaauuaaugaagaagcuggguuuaggcaagca

SEQ ID NO: 69052 - RNA, 42 nt, Mus musculus
cuuccaaagaaagcacugggaaacugcuaagguagccggccu

SEQ ID NO: 69053 - RNA, 41 nt, Mus musculus
auucccagcaaccacaugguggcucacaaccaucuggagua

SEQ ID NO: 69054 - RNA, 46 nt, Mus musculus
cagcugacccuucccaguuccagcccaggcugaaggcagggcccag

SEQ ID NO: 69055 - RNA, 46 nt, Mus musculus
ccaaaaaaaaaaaaaaaagugagaaagagagaaaagaaaaagaaag

SEQ ID NO: 69056 - RNA, 45 nt, Mus musculus
gugacaacagugacgagcaaugcggugagugggagcagaaagagg

SEQ ID NO: 69057 - RNA, 45 nt, Mus musculus
aacucgggcuggcgcugugauggugaugcagacugugaugaccag

SEQ ID NO: 69058 - RNA, 45 nt, Mus musculus
guagcaucaaaggcuuggggggccaaggagaaggguuugggugca

SEQ ID NO: 69059 - RNA, 41 nt, Mus musculus
cacagacuuguagacacaccauggcaguuaaaauaguaggc

SEQ ID NO: 69060 - RNA, 46 nt, Mus musculus
uggggaggaugacugugcggacaacagcgaugaagaaaacugugag

SEQ ID NO: 69061 - RNA, 46 nt, Mus musculus
gcagaggaagcugugcaacgggaucaacgacugcggugacagcagu

SEQ ID NO: 69062 - RNA, 93 nt, Mus musculus
aauguuaacaacgguggcugugcccagaagugucagauggugcgaggggcagugcaguguaccugccacacaggcuaccggcucacagaggau

SEQ ID NO: 69063 - RNA, 42 nt, Mus musculus
augggguggcuuaggagugugugggaagaugguuguaggcag

SEQ ID NO: 69064 - RNA, 42 nt, Mus musculus
uguaguguguggcugaacauccuuggcuuacucaaccucucc

SEQ ID NO: 69065 - RNA, 46 nt, Mus musculus
cagaguuuucuccuuuuauccuguggguucuaaagcuggaacucag

SEQ ID NO: 69066 - RNA, 42 nt, Mus musculus
agaccaagaguauacaaagugcugaccggcugacugggcuag

SEQ ID NO: 69067 - RNA, 46 nt, Mus musculus
gugugugugugugugacucuuguucucaucuauauuucugugccug

SEQ ID NO: 69068 - RNA, 46 nt, Mus musculus
cuuucuuccuccaccuuugccuucuguuccugcugucacugccaag

SEQ ID NO: 69069 - RNA, 46 nt, Mus musculus
gacacaggaacgaaucggauugaaguuggcaaccuggaugggucua

SEQ ID NO: 69070 - RNA, 46 nt, Mus musculus
ugcuuguuugcuguuuuggugacuguaaagcuacucaggggccuga

SEQ ID NO: 69071 - RNA, 46 nt, Mus musculus
aggccugggcugcgcugugugagacaucucaaaaacguguguguau

SEQ ID NO: 69072 - RNA, 50 nt, Mus musculus
gugucugucucugugugucugucugugucugugugugugucugucugugu

SEQ ID NO: 69073 - RNA, 45 nt, Mus musculus
ugugugugugucugucugugucugugugugugucugucugugucu

SEQ ID NO: 69074 - RNA, 46 nt, Mus musculus
ugugagccaccaugugguugcugggauuugaacuucugaccuuugg

SEQ ID NO: 69075 - RNA, 37 nt, Mus musculus
gaagcaauaggcucugggauugguaauuucuccucua

SEQ ID NO: 69076 - RNA, 46 nt, Mus musculus
ccuucucuuucucuucucaggaucuacuggguagaugcacaucugg

SEQ ID NO: 69077 - RNA, 46 nt, Mus musculus
gggcauauaggguacuuuugggauagcauuugaaauguaaaugaag

SEQ ID NO: 69078 - RNA, 45 nt, Mus musculus
uguagaacguuuaagaagcucugcaaagaaagcauagcauccuac

SEQ ID NO: 69079 - RNA, 55 nt, Mus musculus
uccauagaaaccgaagcacaggagagauuggcaggugcugagaauggaggagagg

SEQ ID NO: 69080 - RNA, 46 nt, Mus musculus
ccuccugaguggaaaggggcaaggaucuuuuugcacuugggcuguu

SEQ ID NO: 69081 - RNA, 54 nt, Mus musculus
uaugcaagauugaaugcaucccauuuuguuucuugcggagggcaggaugaaaga

SEQ ID NO: 69082 - RNA, 63 nt, Mus musculus
gcuguuggauauuaaacauuauacuagauucaaggaacacauuugugagccuggggaaaaaag

SEQ ID NO: 69083 - RNA, 45 nt, Mus musculus
auagaauccuuuaauuggggcuuaaugggcuuauucuaguaggaa

SEQ ID NO: 69084 - RNA, 98 nt, Mus musculus
ugaagauggcuaaaguguacucauuauauauauaaaauaaauaagaucuggggggcagggagaaaaaaaaacauaugguucaaguauuaaaggggcuc

SEQ ID NO: 69085 - RNA, 50 nt, Mus musculus
caggaagugaaauggagcugaauccuauguucuaggagagaacagauuaa

SEQ ID NO: 69086 - RNA, 85 nt, Mus musculus
aggaaagcuugaguccacagguggggugauacuuguuuuuaaucccagcguucaagaaauggagccauacagaucucugaguuca

SEQ ID NO: 69087 - RNA, 46 nt, Mus musculus
cuugauguaucuaccagagauaagaaauauggauaacaggcauggu

SEQ ID NO: 69088 - RNA, 40 nt, Mus musculus
uuuugaaacaaagucugauguaaucuaggcuggcacugaa

SEQ ID NO: 69089 - RNA, 41 nt, Mus musculus
acauuuugagagugauaguuuuauugugugugugugugugu

SEQ ID NO: 69090 - RNA, 82 nt, Mus musculus
guguguguuguguguuguguguuguguguguguguguguguguguguguuguguguuguguguugugugugugugugugugu

SEQ ID NO: 69091 - RNA, 42 nt, Mus musculus
acuacaguguacuuacauauaauaaauaauuuaaaaaauaau

SEQ ID NO: 69092 - RNA, 45 nt, Mus musculus
aaccuaacuuuugcccuuuuggcuaaacugaccagugaaccccag

SEQ ID NO: 69093 - RNA, 46 nt, Mus musculus
gaaauuuaaaauaaaagcauaccacacuuauuaagcauuuggauag

SEQ ID NO: 69094 - RNA, 46 nt, Mus musculus
ugacugggacuggagcuuaguaaagcacugacguagaggcccugag

SEQ ID NO: 69095 - RNA, 46 nt, Mus musculus
ugucucagagagaaaaagacagacagacagacagaaacaggcagac

SEQ ID NO: 69096 - RNA, 24 nt, Mus musculus
aaaaacgaaaaaacaaaacuacac

SEQ ID NO: 69097 - RNA, 43 nt, Mus musculus
uuuauuuauuauauauguaaguacacuguagcugucuuucaga

SEQ ID NO: 69098 - RNA, 46 nt, Mus musculus
aauuugucacugauuccaaugcagugguucaauugaaaggacuaga

SEQ ID NO: 69099 - RNA, 62 nt, Mus musculus
gccaaggaacugggcauagagauuugccucauguauguugagauugaaaaaggagagucugu

SEQ ID NO: 69100 - RNA, 46 nt, Mus musculus
auaagaccagaaaguuaauacuaaaacuagcauguuggaagcugag

SEQ ID NO: 69101 - RNA, 41 nt, Mus musculus
acaguguacuuauguauaauaaauaaaucuuugggccagaa

SEQ ID NO: 69102 - RNA, 51 nt, Mus musculus
gacaaggcuguucgggaugaagccaaauuauuugcuauagagauuuaucga

SEQ ID NO: 69103 - RNA, 46 nt, Mus musculus
uacguuuuaaaaauauuuuauuaauacuugcaguugaaagaauuag

SEQ ID NO: 69104 - RNA, 46 nt, Mus musculus
ugaugauggugaugagguaccacagguagaugcuuaugagcuucug

SEQ ID NO: 69105 - RNA, 46 nt, Mus musculus
gaaguacuagugaaaaaccccaagcuggaagcaggcgauuacgcag

SEQ ID NO: 69106 - RNA, 46 nt, Mus musculus
uagccugaguuuuuacugguucuguuuaacuuacugucuagcuaag

SEQ ID NO: 69107 - RNA, 45 nt, Mus musculus
guagcugucauguucuaccuuugaaggauaacagguucgccaaga

SEQ ID NO: 69108 - RNA, 78 nt, Mus musculus
auggugaguuggcaagauggcucagagggugaagacuggccacauaguaaccuaaguuaauuccccagaucuccuuua

SEQ ID NO: 69109 - RNA, 46 nt, Mus musculus
guguguguauauauguaaacaauguuuaaagcacuuacagaggaug

SEQ ID NO: 69110 - RNA, 48 nt, Mus musculus
cucuaccuggaagggcugcagcaucaggggcugcaggggacaaagaca

SEQ ID NO: 69111 - RNA, 41 nt, Mus musculus
gcacaccuuugaucccagcacuugggaggcaaaagcaggug

SEQ ID NO: 69112 - RNA, 47 nt, Mus musculus
ucaaaucccagcaaccacaugguggcucacaaccaucuguaaacggg

SEQ ID NO: 69113 - RNA, 46 nt, Mus musculus
uucuaaaacgucugcucagauuguauuagauggccuuguagacaag

SEQ ID NO: 69114 - RNA, 45 nt, Mus musculus
uccugcugcaacuuccuguuaguauauaguauuuagucaggcccu

SEQ ID NO: 69115 - RNA, 46 nt, Mus musculus
cuaggaaagugccaauagcaaagcuggaauucaggcauucuuguuu

SEQ ID NO: 69116 - RNA, 43 nt, Mus musculus
gggaauugcuaagcacagcacaagugcuacagaugaaggagaa

SEQ ID NO: 69117 - RNA, 46 nt, Mus musculus
ucuaagauuggugacaagaauuggaagaucaggaaagaaggccuag

SEQ ID NO: 69118 - RNA, 46 nt, Mus musculus
cguaaaaccaagaaaucuacaaauaauuuccuauuuaaucagugag

SEQ ID NO: 69119 - RNA, 45 nt, Mus musculus
acagaucuuauccuuuguguuccucaucuguauuccugucuaaaa

SEQ ID NO: 69120 - RNA, 46 nt, Mus musculus
caacaacaaaaaaauuccuuauauauugaaaaauuuaagacuacag

SEQ ID NO: 69121 - RNA, 46 nt, Mus musculus
caaacucauguaauucuagguccauggauacacacacacacacaca

SEQ ID NO: 69122 - RNA, 41 nt, Mus musculus
uaguagaaauuuaaauuuauaaugggacuggagagauggcu

SEQ ID NO: 69123 - RNA, 46 nt, Mus musculus
uaaugaaagcacuggaauauuuaaaauugcuuuucacccugcugag

SEQ ID NO: 69124 - RNA, 41 nt, Mus musculus
uggaaggaaccaaguccaaaaacucuaagcagagagcaggu

SEQ ID NO: 69125 - RNA, 46 nt, Mus musculus
ccugaaccuaaguaaguucagcuuucucaaauacaaacagcuugug

SEQ ID NO: 69126 - RNA, 87 nt, Mus musculus
cucaucuacagcacacacauggcagaugagaaguuggacaaggaugaaaucaucaaguuguauagcuguaucauuggcaacaugauu

SEQ ID NO: 69127 - RNA, 41 nt, Mus musculus
uaagacuuucucugcaaaaaacaacugaaggagggguggag

SEQ ID NO: 69128 - RNA, 41 nt, Mus musculus
ggagagagaaagcaaaggccggauuccuacuucaacaggug

SEQ ID NO: 69129 - RNA, 46 nt, Mus musculus
acuguguaucuguguaccauaucugugcaguacccucagcggccag

SEQ ID NO: 69130 - RNA, 46 nt, Mus musculus
ugucuuccauugcucguuguuuuccauuuuauaaauugaggcaggg

SEQ ID NO: 69131 - RNA, 46 nt, Mus musculus
aagcucucacagcuccgggagucccgggaacagcaccagcacucag

SEQ ID NO: 69132 - RNA, 42 nt, Mus musculus
ccuccacaacuaacauugaugacuugaaaaagagacuggaga

SEQ ID NO: 69133 - RNA, 86 nt, Mus musculus
uuuaguuacugaucuagaagcccuguagugugaagcggccgcugcaggccauuguacacaaacugguuguauguaucagacugcag

SEQ ID NO: 69134 - RNA, 45 nt, Mus musculus
uagcccugaagggacacuguauucuguaugaaugcauggcaugag

SEQ ID NO: 69135 - RNA, 46 nt, Mus musculus
uguacauuuuaguucacuaaauugagguuuggguguuccuggaguc

SEQ ID NO: 69136 - RNA, 46 nt, Mus musculus
ccaauaaacauaucuagaaugcauguccuugauaacagcucugagg

SEQ ID NO: 69137 - RNA, 45 nt, Mus musculus
uuucugaagguaaaaagaacauaaaaguuuucaugguguugagau

SEQ ID NO: 69138 - RNA, 27 nt, Mus musculus
cugcagguggugaaccugcccauugua

SEQ ID NO: 69139 - RNA, 45 nt, Mus musculus
uuucuuucuuucuuucuuucuuucaucuuuacuuuuggggcgagg

SEQ ID NO: 69140 - RNA, 42 nt, Mus musculus
aggcccauucgguaugaugccaacucauggagaugcugaggc

SEQ ID NO: 69141 - RNA, 45 nt, Mus musculus
ugugugugugugugugugugugugugugugugucugggaugggga

SEQ ID NO: 69142 - RNA, 45 nt, Mus musculus
aauccagacagcaguaccacgggacccuggugcuacaccacagau

SEQ ID NO: 69143 - RNA, 42 nt, Mus musculus
gcauaaagcacuccuggcacccgcucugcccugcccccaucc

SEQ ID NO: 69144 - RNA, 44 nt, Mus musculus
agcggcggcggcugugccagguccuggacugaguuaucccggag

SEQ ID NO: 69145 - RNA, 42 nt, Mus musculus
ucauuuaaucaaaugucuugauccuaaaaaaaagucuuggag

SEQ ID NO: 69146 - RNA, 45 nt, Mus musculus
gaggcugagaaacccucucagaaaaaaaaaaagaaagaaagaaag

SEQ ID NO: 69147 - RNA, 46 nt, Mus musculus
gaaagacgaaagcuucugaauguguucuggaauguggccuggacca

SEQ ID NO: 69148 - RNA, 46 nt, Mus musculus
ucccugaaacuggaguugcagacaguugugagaauugaacaaccag

SEQ ID NO: 69149 - RNA, 73 nt, Mus musculus
gccaucucuccagcccccaaccuuauguuuuuauacuguauaauuuguaauauauuuucagugugugugaggg

SEQ ID NO: 69150 - RNA, 42 nt, Mus musculus
aaauuuuuauggacuucauucaguaucauuaugaauggauag

SEQ ID NO: 69151 - RNA, 46 nt, Mus musculus
uuugggaggcagaggcuggcagaucugaguuugagaccagucuagu

SEQ ID NO: 69152 - RNA, 45 nt, Mus musculus
ugaaagaguuauuuuggagugggcuauaaauauuuuguccugugg

SEQ ID NO: 69153 - RNA, 42 nt, Mus musculus
cccaggaugugauugagcuagcccuggaugugauugagcuag

SEQ ID NO: 69154 - RNA, 42 nt, Mus musculus
auagauagcacucuaucugcuaaaccaucuuuccagccccca

SEQ ID NO: 69155 - RNA, 46 nt, Mus musculus
aacaucugugugguuuuaacuucccaucauccuuacagucagucag

SEQ ID NO: 69156 - RNA, 46 nt, Mus musculus
cucuccaauuagcuguuugaccauaggcaaguaacuucacacugag

SEQ ID NO: 69157 - RNA, 41 nt, Mus musculus
gcuuuugacaauacuauugcuuuagcuccagggguuucuaa

SEQ ID NO: 69158 - RNA, 46 nt, Mus musculus
cuuuauaguuuaagcuagccuuuaauuuagaauucuaaugccucag

SEQ ID NO: 69159 - RNA, 45 nt, Mus musculus
gccagguuuuuuguuuggagucaugaucucacuuuauagcccuag

SEQ ID NO: 69160 - RNA, 46 nt, Mus musculus
agcagucgggugccuuuacccacugagccaucucaccagccccaac

SEQ ID NO: 69161 - RNA, 46 nt, Mus musculus
uuccuuugacaugucuguaauuguagcaucugagacaugagccaag

SEQ ID NO: 69162 - RNA, 46 nt, Mus musculus
acuuccaaaaaauguuaugcagaauguuaugaucagagccuggcac

SEQ ID NO: 69163 - RNA, 46 nt, Mus musculus
cgaugacagugagcaguaaaggguuucauugaaaaugauguugaga

SEQ ID NO: 69164 - RNA, 45 nt, Mus musculus
uuuauuuauuuauuuauuuauuuaguagaauuuuguuuauuugau

SEQ ID NO: 69165 - RNA, 46 nt, Mus musculus
cuccuccuccuucuuuuaaauacccuccuccuuuccuucuuucuag

SEQ ID NO: 69166 - RNA, 42 nt, Mus musculus
agcagcugguacuuuagacucugaaccaucucuccagccuag

SEQ ID NO: 69167 - RNA, 42 nt, Mus musculus
cccuucccuucccuucccuucccuucccuucccuuccccaca

SEQ ID NO: 69168 - RNA, 45 nt, Mus musculus
gccagggcuagugccuuaugucugaaauagcacuguuagcaggua

SEQ ID NO: 69169 - RNA, 46 nt, Mus musculus
caguagcugagaauuuauauaugaaugacaaacaugaggcagagag

SEQ ID NO: 69170 - RNA, 46 nt, Mus musculus
aaaagaacuaugacaagauaaaauauuuuugaaagaaaaauucuag

SEQ ID NO: 69171 - RNA, 46 nt, Mus musculus
uggcuccugagcaccaugaaaguugucccagagaagaaugcuguac

SEQ ID NO: 69172 - RNA, 84 nt, Mus musculus
uagccccugggcugacagguucugaguggacccggacaguacucacucugaacucucguucugagguagaaucuaugcccccac

SEQ ID NO: 69173 - RNA, 42 nt, Mus musculus
agauggagggaaugguuccagccaaaacaacucaggcagcau

SEQ ID NO: 69174 - RNA, 46 nt, Mus musculus
gccuagcuccagcaggcuggaguugagcagcucugcuaguucacaa

SEQ ID NO: 69175 - RNA, 42 nt, Mus musculus
gaacuguaucacaggaggccuuacaucaagauaugccugaag

SEQ ID NO: 69176 - RNA, 46 nt, Mus musculus
aauguaccuacauuccaaacaaacaaacaaacaaacaagcaaacaa

SEQ ID NO: 69177 - RNA, 46 nt, Mus musculus
cuucccuucuuuuaucuguauugcuauucacuaccucaacccacau

SEQ ID NO: 69178 - RNA, 44 nt, Mus musculus
auggauccccggaaauacaauuugcuaaacgcaugaaacucaag

SEQ ID NO: 69179 - RNA, 46 nt, Mus musculus
uagaauacaguauacuaugagaauugacaacuggcucagaaacgug

SEQ ID NO: 69180 - RNA, 46 nt, Mus musculus
gaugucacuguugggcugcuacugcugaguuugguuggcagggaag

SEQ ID NO: 69181 - RNA, 45 nt, Mus musculus
ugauauggaguggcauggggcaguggugagcuuuugaaggucaga

SEQ ID NO: 69182 - RNA, 46 nt, Mus musculus
uugaauucaugauccuacuuccacugucuuucaagugcugaggcag

SEQ ID NO: 69183 - RNA, 46 nt, Mus musculus
cagagaguaucucauucuaaggggagaaagacaaaaagaguaucaa

SEQ ID NO: 69184 - RNA, 46 nt, Mus musculus
ugugguugguugcaguuuacaauagggugauuagaggaaauaggau

SEQ ID NO: 69185 - RNA, 49 nt, Mus musculus
ugcucccccacaacccccaaaucaaaagauguauuguuauaaauaugca

SEQ ID NO: 69186 - RNA, 46 nt, Mus musculus
aucuuaaaucuccaccuaacugugugcauuuaguacugaguccugg

SEQ ID NO: 69187 - RNA, 42 nt, Mus musculus
cuuccaacugcccagugcuggaauuuuugcacgugccaccag

SEQ ID NO: 69188 - RNA, 42 nt, Mus musculus
cggauaaucugucucauaucccuugaccacauuucaccccag

SEQ ID NO: 69189 - RNA, 46 nt, Mus musculus
auggcuucaaacacaagaagauccucccaccucugccuccugagag

SEQ ID NO: 69190 - RNA, 46 nt, Mus musculus
cucccuucagcccuuccugauuucauauuaccaaauugugugauag

SEQ ID NO: 69191 - RNA, 54 nt, Mus musculus
gagucuucccucauuucauuaucccguuaugauggagcaggauccagagagcac

SEQ ID NO: 69192 - RNA, 44 nt, Mus musculus
uucaggugauuggggauuguugcagguaagugaauggcaucucu

SEQ ID NO: 69193 - RNA, 29 nt, Mus musculus
uguuggcugucacauggacaaccaaaaga

SEQ ID NO: 69194 - RNA, 45 nt, Mus musculus
gaauguguuuguguguguuaugcauauguguguuugugguauggg

SEQ ID NO: 69195 - RNA, 42 nt, Mus musculus
aguuuacaguggugggcuaggcaagucaguaguauaggccag

SEQ ID NO: 69196 - RNA, 44 nt, Mus musculus
uacugucuuuuccauaucccagaaguagcaaauccaaggaucua

SEQ ID NO: 69197 - RNA, 42 nt, Mus musculus
agugggguaaagacaaggccuaagagcagggccagccccaag

SEQ ID NO: 69198 - RNA, 41 nt, Mus musculus
gacuacuuuuuguuuuguuuguuuuuaaauugcgugggguu

SEQ ID NO: 69199 - RNA, 38 nt, Mus musculus
uuuuguuuuuuguuuuuuguuuuuaauuuaggcagcaa

SEQ ID NO: 69200 - RNA, 46 nt, Mus musculus
cccacccaaaaaaauaccccacugagaguuaaucaaagaugcauag

SEQ ID NO: 69201 - RNA, 45 nt, Mus musculus
uaguuuuuagcacuugcuacuauugcuaaugucaaccaacuguag

SEQ ID NO: 69202 - RNA, 46 nt, Mus musculus
uuucucucaaaucucccaugcacaaaauuuguucuucuauccccag

SEQ ID NO: 69203 - RNA, 42 nt, Mus musculus
uaauccugguuccugugcuguccuuuuucucuguugcugcug

SEQ ID NO: 69204 - RNA, 46 nt, Mus musculus
uuuuucaaaugacguuguuuaggagugcauuuuucaucauggccag

SEQ ID NO: 69205 - RNA, 56 nt, Mus musculus
uuuggcagcuggcagaccauaggaucuggucuuccccuugaccuaacauaaaaucc

SEQ ID NO: 69206 - RNA, 48 nt, Mus musculus
aggcccuggucugguaggugaacugauuauuccaaccuccagauaacc

SEQ ID NO: 69207 - RNA, 46 nt, Mus musculus
cugucuuggucacuccauaccacauaucuugcuuuucugccagcaa

SEQ ID NO: 69208 - RNA, 46 nt, Mus musculus
uuuuccuuugcucuaguaauucuguaccuuuacauuccauucccua

SEQ ID NO: 69209 - RNA, 45 nt, Mus musculus
ggacagcuuccuuuuaauuacuuaaagaaaaaaaauucuucugaa

SEQ ID NO: 69210 - RNA, 45 nt, Mus musculus
uuuaccacaaaugcagauggaauguaccccagaugcaucgagcca

SEQ ID NO: 69211 - RNA, 33 nt, Mus musculus
ucuuaaucacuucauggacacaaagcuggcaua

SEQ ID NO: 69212 - RNA, 42 nt, Mus musculus
guacuugguuggugguaguguuugggagagauauuggaggug

SEQ ID NO: 69213 - RNA, 42 nt, Mus musculus
guaagccacaaugugguugcugggauuugaacucaggacuuu

SEQ ID NO: 69214 - RNA, 45 nt, Mus musculus
auucccauaguagaggauuuaacaaguuugggcuacagaggaaca

SEQ ID NO: 69215 - RNA, 45 nt, Mus musculus
ucugugggugguugggccccuuggggccacauguauuucugugua

SEQ ID NO: 69216 - RNA, 42 nt, Mus musculus
cacagaacuccccagcuauuauccaacauuaagccaccccag

SEQ ID NO: 69217 - RNA, 42 nt, Mus musculus
guugagugcuucacuugggcuuuguugcucuuuuguguggga

SEQ ID NO: 69218 - RNA, 46 nt, Mus musculus
ggguccuuaaacaggagcuaagaggcacagaguuuuacugggcauu

SEQ ID NO: 69219 - RNA, 43 nt, Mus musculus
gauuuuuuuuuaugcuuuaauucucuugucaugugcugagugg

SEQ ID NO: 69220 - RNA, 45 nt, Mus musculus
ggagggagggagagagagagagagagagagagagagagagacaaa

SEQ ID NO: 69221 - RNA, 24 nt, Mus musculus
ucuuuuuuggaccauuagccacag

SEQ ID NO: 69222 - RNA, 42 nt, Mus musculus
ccuauauauguguauguucuauguguucaggugcuugcagag

SEQ ID NO: 69223 - RNA, 42 nt, Mus musculus
cgagcagccagaggggcuuuccugaugaaggcauccuggcag

SEQ ID NO: 69224 - RNA, 46 nt, Mus musculus
gaaaugcucuacaccaagcgauuugguaagggauaggaagcccaac

SEQ ID NO: 69225 - RNA, 45 nt, Mus musculus
guguuauuuaucauuacaggaaaacaucaaauuguuacuucaaga

SEQ ID NO: 69226 - RNA, 46 nt, Mus musculus
uaguuccaugcauuuggugggguuguuuuauuuuguuauuugguua

SEQ ID NO: 69227 - RNA, 45 nt, Mus musculus
ugagaauaagaaagccaagcucauuuucuuaacuagauaccugaa

SEQ ID NO: 69228 - RNA, 42 nt, Mus musculus
gccagagcugagggaauuuguuuggaggauucugcugggaag

SEQ ID NO: 69229 - RNA, 42 nt, Mus musculus
acucuauaacucagucaccuuugcuguuggauucccuuucac

SEQ ID NO: 69230 - RNA, 46 nt, Mus musculus
acauuuauuuuaaugugucuaaucuucaccacuauccugccccaga

SEQ ID NO: 69231 - RNA, 46 nt, Mus musculus
uaaguacgcuguagcugucuucagacacuccagaaaagggcaucag

SEQ ID NO: 69232 - RNA, 45 nt, Mus musculus
ugccaccgguguacacaguaaaccauaauugagcaaaggccccag

SEQ ID NO: 69233 - RNA, 46 nt, Mus musculus
caggugguuguaagccaccaugugguugcugugauuugaacucagg

SEQ ID NO: 69234 - RNA, 46 nt, Mus musculus
ucuuuuuauagccuuuugaagcacauagauacacacacacacacac

SEQ ID NO: 69235 - RNA, 41 nt, Mus musculus
ccuuuaagguccugaugauagagggaugaggugagggguac

SEQ ID NO: 69236 - RNA, 41 nt, Mus musculus
ggaaggggggagagagagagagagagagagagagggagaga

SEQ ID NO: 69237 - RNA, 46 nt, Mus musculus
aggacuguugaacccaaauaaacaaacaaauaaaauuaagaaccgu

SEQ ID NO: 69238 - RNA, 46 nt, Mus musculus
aacaagcuucuuggguaucucuuguaaaguccuacuugucacccua

SEQ ID NO: 69239 - RNA, 46 nt, Mus musculus
gcuucauggcuucccuguaaaugagggugaggggagauguuacuag

SEQ ID NO: 69240 - RNA, 45 nt, Mus musculus
aagaaccuagaacagugucucaaucguccuuaccaagucccaaga

SEQ ID NO: 69241 - RNA, 42 nt, Mus musculus
agacaauggaaggagaagcccugaugugcaucaggccaagag

SEQ ID NO: 69242 - RNA, 45 nt, Mus musculus
aucuucugaauguaaagcuggagccuagcuauucagggcagauag

SEQ ID NO: 69243 - RNA, 42 nt, Mus musculus
gaaugagaggguggggcauggagccaguggauaagggggcag

SEQ ID NO: 69244 - RNA, 46 nt, Mus musculus
uuccaugucagugacuuaugcucaccaaaugcggacaccuguggag

SEQ ID NO: 69245 - RNA, 46 nt, Mus musculus
ugggaggagaggggauagucuacugcuaaugagggagacaccaaag

SEQ ID NO: 69246 - RNA, 46 nt, Mus musculus
gucgggcuggaacagggccccagaccccuuugaaaggcaagcgcgg

SEQ ID NO: 69247 - RNA, 45 nt, Mus musculus
uugacugacaggacuagacagggccucuccagggguugcggguug

SEQ ID NO: 69248 - RNA, 42 nt, Mus musculus
gauggugccuuugugcguauguggaaugcuuguguguuggcg

SEQ ID NO: 69249 - RNA, 47 nt, Mus musculus
ugacgacgacaguguaggaaugggagaacaaaucucccuuggccacg

SEQ ID NO: 69250 - RNA, 44 nt, Mus musculus
ugaucaccggccucacccugaagaugacgcagaugagggcaagg

SEQ ID NO: 69251 - RNA, 46 nt, Mus musculus
acggucugaacuggcaccaccuggcccauaucuuuuaccuugccuc

SEQ ID NO: 69252 - RNA, 42 nt, Mus musculus
gcaggaaggcggaaagcaccgauuacagcauaacgggggacc

SEQ ID NO: 69253 - RNA, 47 nt, Mus musculus
agcagucaucuggacagggcaacugggaggccaugcuaagccgagau

SEQ ID NO: 69254 - RNA, 55 nt, Mus musculus
cuuccugucagcucugucaaucacgccuguccucucacgcccacaccaagugccc

SEQ ID NO: 69255 - RNA, 45 nt, Mus musculus
ucaggacugaggcaguaacacugccuugaguucaagguuacagac

SEQ ID NO: 69256 - RNA, 46 nt, Mus musculus
cugcccauuuccccggugaggaacuuggaguacucugauccuagau

SEQ ID NO: 69257 - RNA, 45 nt, Mus musculus
agcauguaccuuugggacagccuuuccauaguuuuaagcgcagag

SEQ ID NO: 69258 - RNA, 41 nt, Mus musculus
gggugggaucagggaggaguuaacucugcgcuuaaaacuau

SEQ ID NO: 69259 - RNA, 46 nt, Mus musculus
cccaccuuccucaguugacaaagacaagccuuucccaggaacccag

SEQ ID NO: 69260 - RNA, 68 nt, Mus musculus
guacaaugcccagugccaggagaccauccgcgugacuaagcccugcaccuccaagaccaagucaaaga

SEQ ID NO: 69261 - RNA, 59 nt, Mus musculus
ggggcgugugaugggagcacuggcaccaaagcccgccaagggacccugaagaaggcgcg

SEQ ID NO: 69262 - RNA, 45 nt, Mus musculus
cccagacccagcgcguccauugcaaggugcccugcaacuggaaga

SEQ ID NO: 69263 - RNA, 46 nt, Mus musculus
augcagcaccgaggcuucuuccuucucgcccuucuugcccucuugg

SEQ ID NO: 69264 - RNA, 41 nt, Mus musculus
cgcacugguaaaaccgaacuccaggaccagagacccagaga

SEQ ID NO: 69265 - RNA, 47 nt, Mus musculus
gucacuaugggaaggaaacggguagcccagugagugguuuaucggag

SEQ ID NO: 69266 - RNA, 46 nt, Mus musculus
aacggaguggucagcccaggggagcaguccaagugucuggggacau

SEQ ID NO: 69267 - RNA, 45 nt, Mus musculus
gucuuggaguggccuaggagaguuugauggugguguuggggccca

SEQ ID NO: 69268 - RNA, 45 nt, Mus musculus
ucucaaguacuugguggucucauggaugcugucugcacggucaug

SEQ ID NO: 69269 - RNA, 95 nt, Mus musculus
gcauagacacugucagcugcgauagggucuucuuucacagucauugagccggaagagaaugcaggaaggcagggcacaagggagcccagcaccag

SEQ ID NO: 69270 - RNA, 44 nt, Mus musculus
ucugcuuugaucacuggcagcugagucauuucuccuggggccug

SEQ ID NO: 69271 - RNA, 42 nt, Mus musculus
uguccuccaucuugacaggcacaagggggcucuggggugcag

SEQ ID NO: 69272 - RNA, 46 nt, Mus musculus
caggucauuggagaaguccuccauguucuccacaaagugguccagg

SEQ ID NO: 69273 - RNA, 41 nt, Mus musculus
gaaugugugugugaaugugugugaaugugugugugugugug

SEQ ID NO: 69274 - RNA, 45 nt, Mus musculus
uugucucugcugcuuucauuuuuguuauucuuuuggaaggggaag

SEQ ID NO: 69275 - RNA, 42 nt, Mus musculus
ggaaagagagacacgcauggcccaggcucacaagggaaacag

SEQ ID NO: 69276 - RNA, 45 nt, Mus musculus
gaugaacaccauuuccuucccuuugaggaaggcagcggaacuaga

SEQ ID NO: 69277 - RNA, 46 nt, Mus musculus
aacagaaggaaggccagcucgcagcuuuaaaugugguucucaagaa

SEQ ID NO: 69278 - RNA, 48 nt, Mus musculus
cuuuccuuuuccaaaauggcagaugaugacuaaagagagagcccacag

SEQ ID NO: 69279 - RNA, 38 nt, Mus musculus
gcucugggacuccauuccuaaggggaggaacggaugac

SEQ ID NO: 69280 - RNA, 46 nt, Mus musculus
uaguccaacuguuuguguccaucauucugacuagaagcauccuaug

SEQ ID NO: 69281 - RNA, 32 nt, Mus musculus
gccacaguguauguguggggagaaagagaaag

SEQ ID NO: 69282 - RNA, 42 nt, Mus musculus
uauggagaaagaaguuaugaaaagaaggaucugggggcaccu

SEQ ID NO: 69283 - RNA, 46 nt, Mus musculus
gaacuggugccugggcaacugagcagccuccugagugcccccuuug

SEQ ID NO: 69284 - RNA, 46 nt, Mus musculus
ugugucaguucaguuucucacuuaugaaaauggaagaguagcagau

SEQ ID NO: 69285 - RNA, 46 nt, Mus musculus
gggauuaaaggcgugcgucaccaccucccaucccauccguguuccc

SEQ ID NO: 69286 - RNA, 46 nt, Mus musculus
ugcauucugggccgugcuccugucugcagagcauccagguguagcu

SEQ ID NO: 69287 - RNA, 49 nt, Mus musculus
gugagcucccagauagcaguccugucagcuggugcccguaacccccaga

SEQ ID NO: 69288 - RNA, 63 nt, Mus musculus
gucauuacaacuuaaaucaguacuccagaaaaacaccucuagguucugugcuugccucaaaca

SEQ ID NO: 69289 - RNA, 45 nt, Mus musculus
auccucuauccauuuuagucaugugacucgggcuugaggccgagg

SEQ ID NO: 69290 - RNA, 47 nt, Mus musculus
gagacaaggcccuaugcucccaaaucuaaucaagaugacagccagga

SEQ ID NO: 69291 - RNA, 45 nt, Mus musculus
aguuugguucccauggcagaguucuauagcaucauucccccaccc

SEQ ID NO: 69292 - RNA, 45 nt, Mus musculus
uaagacucauugcagaaacgaaauucccuuugugagcaguuauca

SEQ ID NO: 69293 - RNA, 42 nt, Mus musculus
gucagacagcagggccuaggcagguggcuggaaaguggagau

SEQ ID NO: 69294 - RNA, 45 nt, Mus musculus
gugcuagcagugucugaugagagacacuuaaggcgcaggggagag

SEQ ID NO: 69295 - RNA, 46 nt, Mus musculus
guuuuuccccuggccuccacaccugcacacauguacacacagagaa

SEQ ID NO: 69296 - RNA, 46 nt, Mus musculus
uagggcugagggaugcacuuuuggguaguagagggcacaagcaggu

SEQ ID NO: 69297 - RNA, 46 nt, Mus musculus
cucuccagcucuaguacucuauuaaaugaaaaaaagaauaguagaa

SEQ ID NO: 69298 - RNA, 46 nt, Mus musculus
uguaggagcuagaaagacugaugguuaggacagacaugcggaagca

SEQ ID NO: 69299 - RNA, 42 nt, Mus musculus
ggauuccccacggaaggacuuggcccagcuguuuggcaagga

SEQ ID NO: 69300 - RNA, 46 nt, Mus musculus
cucacccggacaggcaggccuugcauaagcuccuucucggccagcg

SEQ ID NO: 69301 - RNA, 42 nt, Mus musculus
agcaagagggcuaacugaacuggacaauaaugggccagaguu

SEQ ID NO: 69302 - RNA, 46 nt, Mus musculus
aaggcuucuguaaaccuccaguagucagggaauguagcucagggau

SEQ ID NO: 69303 - RNA, 45 nt, Mus musculus
ggguugucugauaauuaaauaauacaugcaaaacaagugggacag

SEQ ID NO: 69304 - RNA, 45 nt, Mus musculus
cuuauuuguuauguugucaugaagauguuucguuuuuuacuggga

SEQ ID NO: 69305 - RNA, 42 nt, Mus musculus
uggagaacaggaugguggcccuucugggccaagagaagccag

SEQ ID NO: 69306 - RNA, 45 nt, Mus musculus
acacuucagacuaccuuuggaggcaguugggagcugagccgagag

SEQ ID NO: 69307 - RNA, 45 nt, Mus musculus
caaggccugugcacagacagugcuggccgugcucuacuacgaaga

SEQ ID NO: 69308 - RNA, 42 nt, Mus musculus
guccuuauauauucccccucugcuaaguucugccugggagaa

SEQ ID NO: 69309 - RNA, 42 nt, Mus musculus
uuagcagcaggaagcugggaagaggcugaguacuggggggau

SEQ ID NO: 69310 - RNA, 42 nt, Mus musculus
ccuucucccuucccugggucuuguuucgugacaccaccuccc

SEQ ID NO: 69311 - RNA, 48 nt, Mus musculus
ccaguuugaggacaggggacacgugagucgcagggagaaaggaagcga

SEQ ID NO: 69312 - RNA, 42 nt, Mus musculus
uuggaucuccgggacuucauguccugacuaggucuggaagcg

SEQ ID NO: 69313 - RNA, 45 nt, Mus musculus
gcugccaugcuuccugccaugaugauaauggacuaaaccccugaa

SEQ ID NO: 69314 - RNA, 44 nt, Mus musculus
ucggaccccaaaaugaaaccugaaagugcuguaugcucugagau

SEQ ID NO: 69315 - RNA, 44 nt, Mus musculus; identical to SEQ ID NO: 69314

SEQ ID NO: 69316 - RNA, 42 nt, Mus musculus
ucccugaaagugggagcugcuccagggaggacagggccucga

SEQ ID NO: 69317 - RNA, 41 nt, Mus musculus
agagaaggaaucagggauggagggaagacagggagggagaa

SEQ ID NO: 69318 - RNA, 45 nt, Mus musculus
gcaugcgugugacugugggcaguguaagggcuggagggugguggu

SEQ ID NO: 69319 - RNA, 41 nt, Mus musculus
aggagggagggaggaaggaaggaaggaaggaaggaagguag

SEQ ID NO: 69320 - RNA, 45 nt, Mus musculus
uguguguguguugauguguguguauguguguguguguguguguug

SEQ ID NO: 69321 - RNA, 64 nt, Mus musculus
uagcaagugucugccaagaucacuucaaagcagaugggggagauggguaggaggcuggugcugg

SEQ ID NO: 69322 - RNA, 46 nt, Mus musculus
gucagggcauguuuaggugccagacagcaugugcagagcugagaga

SEQ ID NO: 69323 - RNA, 41 nt, Mus musculus
gaaguaaagagggagguuguguaggucaaaaggaggugaag

SEQ ID NO: 69324 - RNA, 44 nt, Mus musculus
ugaggcagggguucaguacauaugauugacagagaagggggaga

SEQ ID NO: 69325 - RNA, 46 nt, Mus musculus
uuccucagccuacggggacauucucacucaggccuauaugcacaag

SEQ ID NO: 69326 - RNA, 51 nt, Mus musculus
uguucauucacaugugagucuauuauuccagcugucucaaaauagcaguca

SEQ ID NO: 69327 - RNA, 42 nt, Mus musculus
auaaugggguguguuuguauucgugcguaaaggcgugugugu

SEQ ID NO: 69328 - RNA, 42 nt, Mus musculus
cccccgcccuucuccuaguauaggccugucccagcccucugu

SEQ ID NO: 69329 - RNA, 41 nt, Mus musculus
gaacggugccagaggcuggacaagcuuacucaaggcucaga

SEQ ID NO: 69330 - RNA, 45 nt, Mus musculus
ugaccuugacucaggagcaauguacuagauuaauucaaacccaga

SEQ ID NO: 69331 - RNA, 46 nt, Mus musculus
ugcuggacaacuauuuauauuuccauuuagcaccgagugcccaagg

SEQ ID NO: 69332 - RNA, 45 nt, Mus musculus
guacugucuuccugaggaaacugaauagcuuagcauuuugguggg

SEQ ID NO: 69333 - RNA, 77 nt, Mus musculus
ccucgggaugggaaaauccuuucuaagcauaaaacccaugaaaggucaaagaaaggucaguggagucaagcccagau

SEQ ID NO: 69334 - RNA, 41 nt, Mus musculus
aaacagacaacucccccaaacaaaacaaaaaugcuguguag

SEQ ID NO: 69335 - RNA, 75 nt, Mus musculus
ggcuaagggaaaagaauacagaggagggcaaacuggaccaccagagcuaaagggagcgugaguuuauaaggaggc

SEQ ID NO: 69336 - RNA, 41 nt, Mus musculus
ggcucagugagccagcaugaggagcauaguaggcaaagaga

SEQ ID NO: 69337 - RNA, 46 nt, Mus musculus
gcagucacugggucagagacagugugggguuugaacuccuuggagg

SEQ ID NO: 69338 - RNA, 87 nt, Mus musculus
cucauaagugagaaaauuuaucugaggucuugaaauaaaguuggcugcggaaaugaggucgggaagaaacauaaacagucagugcuc

SEQ ID NO: 69339 - RNA, 48 nt, Mus musculus
gagcaugaagucuauuuuucagaaaccugggaaaguauaggucaugga

SEQ ID NO: 69340 - RNA, 45 nt, Mus musculus
agagcguaacagccaaaccaagccaaagcccgaugcauggugaac

SEQ ID NO: 69341 - RNA, 58 nt, Mus musculus
cuaguucccaagugauaaacaugagcaguguguuaguguccagaaauaccccuuccug

SEQ ID NO: 69342 - RNA, 45 nt, Mus musculus
ucuucagugaccauuauauauauauaugcagcgccaccacccccu

SEQ ID NO: 69343 - RNA, 42 nt, Mus musculus
guuuauuuaucuugacacaggaccuuaguacauagcccagac

SEQ ID NO: 69344 - RNA, 46 nt, Mus musculus
uguccgacagggcugggcacagauuuuagcaggacaaaugcagacg

SEQ ID NO: 69345 - RNA, 42 nt, Mus musculus
ccccaagcuuaauggccugaauuuaaucccaagaacccaggu

SEQ ID NO: 69346 - RNA, 46 nt, Mus musculus
ggcugcgauuucauuuugacuuuguucucuugaacaagggccagcu

SEQ ID NO: 69347 - RNA, 53 nt, Mus musculus
uuaacugccuucucuaguaguucagaugcugccaaguuccuucuucacauaag

SEQ ID NO: 69348 - RNA, 42 nt, Mus musculus
aaguaacaagcucaagguuuugagauaugccugcccccugga

SEQ ID NO: 69349 - RNA, 42 nt, Mus musculus
gguguaagcaguugauacugaggauggugacacugggaguug

SEQ ID NO: 69350 - RNA, 45 nt, Mus musculus
ugagauuuuuguaggggagucagagguuuccacuuggccauacua

SEQ ID NO: 69351 - RNA, 44 nt, Mus musculus
gaagaacuuguacuucuguauggaagaucuaauacuggcccagg

SEQ ID NO: 69352 - RNA, 45 nt, Mus musculus
uucugcucauaaguagucuguuaugcuauuuagauauugguagau

SEQ ID NO: 69353 - RNA, 42 nt, Mus musculus
gcccacucagcauuuauguggguguggauuuagccccucaug

SEQ ID NO: 69354 - RNA, 42 nt, Mus musculus
ggccagccuggaggagcaaggaacagcagcaaugugaccgac

SEQ ID NO: 69355 - RNA, 46 nt, Mus musculus
uguuaggaccuauuaaguucugggacuccucgaacugacagcacuc

SEQ ID NO: 69356 - RNA, 46 nt, Mus musculus
guaacugugguguugaaaugaaaguguauuuuugauaguggaaaac

SEQ ID NO: 69357 - RNA, 46 nt, Mus musculus
uuuagcauuagagggaacagggcucgauuaauuuguuaugggcaga

SEQ ID NO: 69358 - RNA, 53 nt, Mus musculus
uccccagagucuucacuguugucucaguaauuacuaacauggcauaguuggca

SEQ ID NO: 69359 - RNA, 47 nt, Mus musculus
aaucauggguuucagcaagucuuugcggaaucgcuaccugaagaaaa

SEQ ID NO: 69360 - RNA, 46 nt, Mus musculus
uuaaaucucuguaaauaauaauguagagaauuagaagguggcagau

SEQ ID NO: 69361 - RNA, 35 nt, Mus musculus
ugacugcacagcagagucccucuugaccuggauag

SEQ ID NO: 69362 - RNA, 46 nt, Mus musculus
cagaagagggcaaaaaagauauggucccaucuuaacauuagcaguu

SEQ ID NO: 69363 - RNA, 45 nt, Mus musculus
auagagccacagccuuugccuuaagaauguguccaggcuggagag

SEQ ID NO: 69364 - RNA, 46 nt, Mus musculus
gguguuuaacacagcaauagauucacuaacuagaacaccccacuac

SEQ ID NO: 69365 - RNA, 58 nt, Mus musculus
ggcaacaaaagacucaagaucccugacucaaggcacacagauauuuaaacacacuacc

SEQ ID NO: 69366 - RNA, 41 nt, Mus musculus
uaccucuucucuuguuuauucuuuuucauuuugguugguug

SEQ ID NO: 69367 - RNA, 41 nt, Mus musculus
ugccugauaggaaucuaauauggcuagaaaccaccccacau

SEQ ID NO: 69368 - RNA, 46 nt, Mus musculus
gcuagagcaaacuguggaauguccucuguguucucugcccugugaa

SEQ ID NO: 69369 - RNA, 45 nt, Mus musculus
caucucguuaacacacagaucaagugaccucguuaacacagagau

SEQ ID NO: 69370 - RNA, 45 nt, Mus musculus
agccugcuucuuccaagcccuuuccuuugcuuacuuccuaggagu

SEQ ID NO: 69371 - RNA, 47 nt, Mus musculus
gguacauccuggcaguaccacagccaugcucagcagacaagaaagag

SEQ ID NO: 69372 - RNA, 75 nt, Mus musculus
guaguuuguauccaacugagggggcagguaggugacccacauggguuucuggagugucacagauggaaauagauu

SEQ ID NO: 69373 - RNA, 47 nt, Mus musculus
aucuaaaggggugauucucaacaucuccucagccaguggcaugcucc

SEQ ID NO: 69374 - RNA, 46 nt, Mus musculus
gagcuauuuuuaguucauugaauuacgcuucauucaccggccagac

SEQ ID NO: 69375 - RNA, 44 nt, Mus musculus
auccccaccaucuacauagggauuucugauguuguggccacaga

SEQ ID NO: 69376 - RNA, 45 nt, Mus musculus
guuuaugaaagacuugacugcaugugaacaaaggugggcucuggu

SEQ ID NO: 69377 - RNA, 46 nt, Mus musculus
uuaggaaccaaaauccagaaggagaaugacaacagacugugcagaa

SEQ ID NO: 69378 - RNA, 46 nt, Mus musculus
gugggacagauugguagguggggcguuuuaucuguugccaguuaga

SEQ ID NO: 69379 - RNA, 46 nt, Mus musculus
gauguaugagauuuuuccaaacauucuagaacuauagccaacugac

SEQ ID NO: 69380 - RNA, 46 nt, Mus musculus
gcaacuuacugcaaaggagagcagcaguguuaguuguuugccagaa

SEQ ID NO: 69381 - RNA, 45 nt, Mus musculus
aaaugaccugguagaaagccaucagaagcuguggaaagcuagagu

SEQ ID NO: 69382 - RNA, 42 nt, Mus musculus
cucuagaccuucaucugcaaggaaagagcaaaugcuggagga

SEQ ID NO: 69383 - RNA, 45 nt, Mus musculus
ugcccccugucugcucauagaagcaucucauuauggguccugagu

SEQ ID NO: 69384 - RNA, 46 nt, Mus musculus
caagauuguugccaaagauauuugaaaacuauaugagcacuaagaa

SEQ ID NO: 69385 - RNA, 42 nt, Mus musculus
aguccauuugcagcuaaugugacaaaaguaccucggacuguc

SEQ ID NO: 69386 - RNA, 45 nt, Mus musculus
cuugucguucuuuaaaaucacagugauucuaaguguggcccuaca

SEQ ID NO: 69387 - RNA, 46 nt, Mus musculus
cugguucuagcugaauaguucacuuucaaaagauuuauuuuggggg

SEQ ID NO: 69388 - RNA, 45 nt, Mus musculus
ccugaaugcaaaggguuaucacagauaaagagaugauccaggaga

SEQ ID NO: 69389 - RNA, 45 nt, Mus musculus
ucaguagcagugauugcugggaaccuugggguaauaaagggagau

SEQ ID NO: 69390 - RNA, 42 nt, Mus musculus
cucugaggcaccaugcagaugugaaaaugguuuagagcagug

SEQ ID NO: 69391 - RNA, 42 nt, Mus musculus
auaaacugaaguuuaagugagcugaggagucaccaguggaga

SEQ ID NO: 69392 - RNA, 46 nt, Mus musculus
aauucacuguuauauggcaaggcaagauucuagaagccaacgagag

SEQ ID NO: 69393 - RNA, 46 nt, Mus musculus
guccagcugucugcaguucagagcuggcuccugugaggacgaaccu

SEQ ID NO: 69394 - RNA, 46 nt, Mus musculus
uacgaguauccggaauacuuucuggaaauucccgacuuggacaacg

SEQ ID NO: 69395 - RNA, 46 nt, Mus musculus
uccaugaaggaaaagcauuuaaacuggaguaauaaggacuugagau

SEQ ID NO: 69396 - RNA, 46 nt, Mus musculus
auuacuaaaagaguuuugaaggcccuagggguaggagcagcaaugg

SEQ ID NO: 69397 - RNA, 40 nt, Mus musculus
uucagggaguuuuaucacagcaaagggacaaaaauaaagg

SEQ ID NO: 69398 - RNA, 45 nt, Mus musculus
cuggucauauauaauaaaagcaagauucuugguauugggcucaga

SEQ ID NO: 69399 - RNA, 46 nt, Mus musculus
cuggagccuuccuggcuugagaaguugagagaaauuccaugcagau

SEQ ID NO: 69400 - RNA, 44 nt, Mus musculus
guaguagaguagacaugaccagaggacuauacuggacugagaag

SEQ ID NO: 69401 - RNA, 45 nt, Mus musculus
augacugcuccaaggugugguugaggagguuuuaauuuuagauau

SEQ ID NO: 69402 - RNA, 46 nt, Mus musculus
cuuggcauuuuggaggacaugaaagaugaugaucuuuaaaccaaga

SEQ ID NO: 69403 - RNA, 23 nt, Mus musculus
uuucuagggauaaggacagauga

SEQ ID NO: 69404 - RNA, 46 nt, Mus musculus
auguccacuuugccccuucuuagaauugggaacaaaacacccaugg

SEQ ID NO: 69405 - RNA, 45 nt, Mus musculus
auuuaugagaaagaaaggaaccaguguaccagugugaggugacgg

SEQ ID NO: 69406 - RNA, 42 nt, Mus musculus
gcuuuuguauguagauaauacuaacagacucagccccaugaa

SEQ ID NO: 69407 - RNA, 44 nt, Mus musculus
ugauauuuaugauaaaauuaagacaggccugucuggucuugaga

SEQ ID NO: 69408 - RNA, 41 nt, Mus musculus
aaggacuggagcagaguggggaggggaaacugugggcagga

SEQ ID NO: 69409 - RNA, 23 nt, Mus musculus
auaugaagccugagugagagguu

SEQ ID NO: 69410 - RNA, 52 nt, Mus musculus
ucaacucuuacuacaagugagauggaaauguguagagccuuagaggaaaggg

SEQ ID NO: 69411 - RNA, 42 nt, Mus musculus
uuguccuagaacuggggagcaguaggaagaacagcuggagau

SEQ ID NO: 69412 - RNA, 49 nt, Mus musculus
cucugagaagcuaauauuugcucaaggacccaacaagagacggggaauu

SEQ ID NO: 69413 - RNA, 44 nt, Mus musculus
agagacaagcaaguacuuacuuuauuaaaaacaaaggugucaga

SEQ ID NO: 69414 - RNA, 45 nt, Mus musculus
guggccccgacugacucagggagggagggaguauaaggaaaugag

SEQ ID NO: 69415 - RNA, 45 nt, Mus musculus
cccuuuccgcuuccauagcacagaucucuguugcaugccagguau

SEQ ID NO: 69416 - RNA, 42 nt, Mus musculus
aaauaagcaucuuuuucagaaaaugucuuuaagggggcguaa

SEQ ID NO: 69417 - RNA, 45 nt, Mus musculus
uguccucauaggcucauauuuuugaaugcuuagucauuagggaga

SEQ ID NO: 69418 - RNA, 46 nt, Mus musculus
ggugccacucaguauguuucuugccuugccuuuauucagccagagu

SEQ ID NO: 69419 - RNA, 46 nt, Mus musculus
auuuaaaaauugcacucagcaugagcauguugcuuucucugcaucu

SEQ ID NO: 69420 - RNA, 46 nt, Mus musculus
ccacaugguauccacaggaguucucauaacauguuuccugccacuc

SEQ ID NO: 69421 - RNA, 47 nt, Mus musculus
uugcaaauucugaagcagcucugccuguuauccugacaucuacauga

SEQ ID NO: 69422 - RNA, 50 nt, Mus musculus
ggaugcuaagugcucacaacccugguaaauguuaccuugccacaggacga

SEQ ID NO: 69423 - RNA, 42 nt, Mus musculus
uacuaaugaaucaggugauuaguccuuucucugccaccuguu

SEQ ID NO: 69424 - RNA, 46 nt, Mus musculus
uuuuaauuuuaaaaaaguauuaauuauauacuuagaggcaggagca

SEQ ID NO: 69425 - RNA, 46 nt, Mus musculus
auggugguuggcugugcuuauccacagcuacaguuuguuaguuaga

SEQ ID NO: 69426 - RNA, 46 nt, Mus musculus
aaaauaauaacaguaaaucuauuauauguaugaaaaacacuggggg

SEQ ID NO: 69427 - RNA, 46 nt, Mus musculus
guguuugugcaguacagcuauuaauguuuauuaucuuuagucagau

SEQ ID NO: 69428 - RNA, 45 nt, Mus musculus
uuuauucagggugaaccaaaggguuuuggguugagacuauccaug

SEQ ID NO: 69429 - RNA, 42 nt, Mus musculus
auucuugugaauuaaaaagagaaaaccaacaaguuugcagug

SEQ ID NO: 69430 - RNA, 46 nt, Mus musculus
gaggcaccuggaagaguccagagugaaugugacccuaaacuaagcu

SEQ ID NO: 69431 - RNA, 45 nt, Mus musculus
ugucuauucuuuuucuuaccuacaauaaaaaacuuuccccugaug

SEQ ID NO: 69432 - RNA, 41 nt, Mus musculus
uccucauacuuacuauuacucaauaacuacuugggcccaga

SEQ ID NO: 69433 - RNA, 46 nt, Mus musculus
auaaacaccaaacggauaaguaaguaaccuguacuaagugccugag

SEQ ID NO: 69434 - RNA, 45 nt, Mus musculus
uucauugacuugaccuuuauuaaaauagaaguuauagcaccagac

SEQ ID NO: 69435 - RNA, 45 nt, Mus musculus
cacaucugagaaacagaagucauuaaagcaugaaucacagucaga

SEQ ID NO: 69436 - RNA, 52 nt, Mus musculus
aguuagcaaaacguggaaugaagauuguccugaucagcaggucccaagauaa

SEQ ID NO: 69437 - RNA, 44 nt, Mus musculus
guuguuacagguggcacugauggaauuggaaaagcauaugcaga

SEQ ID NO: 69438 - RNA, 45 nt, Mus musculus
aucgcuggcuuguaagacaaacaucucuaaauauauugacaaaua

SEQ ID NO: 69439 - RNA, 42 nt, Mus musculus
uggguucccuccuguguauuuauaguaaaaccugaacuugaa

SEQ ID NO: 69440 - RNA, 46 nt, Mus musculus
uucaagauggugucccaaguaagucauuuauagagugcagguagaa

SEQ ID NO: 69441 - RNA, 45 nt, Mus musculus
aagaaaaaaacgagaugcagaugcacuagaaguuguuuuaggaga

SEQ ID NO: 69442 - RNA, 23 nt, Mus musculus
augcaggaaguuacugguguuuu

SEQ ID NO: 69443 - RNA, 42 nt, Mus musculus
gcuugugacgucuuaguuacauuuguauuuuagccauuagau

SEQ ID NO: 69444 - RNA, 100 nt, Mus musculus
caaacugcaguauggaaguagagaaagcacauggcuguauuuuggaggauauguuuauauuuaaugcacagcuguuuacuguugagcauuauuaggacuu

SEQ ID NO: 69445 - RNA, 45 nt, Mus musculus
cugugagaaggugagaggauauagacaggucuuaugguggaugga

SEQ ID NO: 69446 - RNA, 45 nt, Mus musculus
gugaaggagcauguaagaggcaugcaaccuuuggguuuauucuga

SEQ ID NO: 69447 - RNA, 46 nt, Mus musculus
ucauuagacacagucuggucacagcauuugagaagguaggacagug

SEQ ID NO: 69448 - RNA, 60 nt, Mus musculus
ugguaugugaugguagaguugagguuuuaaaacugugagcagggaggccuuucugaagag

SEQ ID NO: 69449 - RNA, 55 nt, Mus musculus
gggaaugcuuuucuuguugagaaucuuugccaguugaagagauuauccacagcac

SEQ ID NO: 69450 - RNA, 45 nt, Mus musculus
cugauggcuguuuggauuuguuagucuguuguagaaggccuaaag

SEQ ID NO: 69451 - RNA, 46 nt, Mus musculus
cacacuucugugaauuuuauugggaguugauuauauguccccaaac

SEQ ID NO: 69452 - RNA, 45 nt, Mus musculus
aauguuuuugccucuaggaagcaauacguuuugaugccugaaguu

SEQ ID NO: 69453 - RNA, 46 nt, Mus musculus
guauguuugauuuauagacuccuaagacuuaaagaccuauauagau

SEQ ID NO: 69454 - RNA, 45 nt, Mus musculus
uaauugaggaaaauacguaauaauaaaaaaaaagaaguaagagug

SEQ ID NO: 69455 - RNA, 74 nt, Mus musculus
ccccauuacaggggaacaccagggccaaaauaugggaaugggugggcagggaagugggggggaggguauggggg

SEQ ID NO: 69456 - RNA, 49 nt, Mus musculus
ggggagagagugagagagagagagaaagagaaggcuagagagaaagaga

SEQ ID NO: 69457 - RNA, 45 nt, Mus musculus
gguucccaacacugaugagagugagugcaguggaucuugacugga

SEQ ID NO: 69458 - RNA, 42 nt, Mus musculus
auuuguugggaacaaaaagggggcccuggggaagagagggga

SEQ ID NO: 69459 - RNA, 46 nt, Mus musculus
agacuaagaacugucacaucguuuuggacaagagaaacggaagaga

SEQ ID NO: 69460 - RNA, 46 nt, Mus musculus
caccucccuucccuuccagauccacucucauuagaaaagagcagac

SEQ ID NO: 69461 - RNA, 46 nt, Mus musculus
gugaugcuuuccacugugguuugauuuuuauuugauucauugaguu

SEQ ID NO: 69462 - RNA, 45 nt, Mus musculus
agaguuacaggugagacuccaaauaaauaaagaaguaaaguaaga

SEQ ID NO: 69463 - RNA, 46 nt, Mus musculus
guuggagaaaauguuacugaaaaaccugguuuccauguguagaaaa

SEQ ID NO: 69464 - RNA, 45 nt, Mus musculus
gguugugagccacuaugugguugcugggauuugaacucggaaccu

SEQ ID NO: 69465 - RNA, 42 nt, Mus musculus
gaagcacuaaguacacgguagcugucuucagacacaccagaa

SEQ ID NO: 69466 - RNA, 45 nt, Mus musculus
guaugcuguaguuuacagucagaagagaguuuagaggcucaggau

SEQ ID NO: 69467 - RNA, 42 nt, Mus musculus
uuuuuaaaguuuuuaggagacuaaaggugaaucccaggagau

SEQ ID NO: 69468 - RNA, 42 nt, Mus musculus
uugauuuuacugauucuguugaugacaaugaauugccaaaga

SEQ ID NO: 69469 - RNA, 66 nt, Mus musculus
gcacuaacuagggcucggacagcugauugugaugguggaguagugaagaaagcgcuugggggugca

SEQ ID NO: 69470 - RNA, 45 nt, Mus musculus
uagggaaaggccaggugagcuggauguugaguguccaaaggcaga

SEQ ID NO: 69471 - RNA, 42 nt, Mus musculus
ugaggagcaagccaguaagcagcauuucuccuagggccuaug

SEQ ID NO: 69472 - RNA, 46 nt, Mus musculus
uaccaaauuuaaccagguguugaauauugauuuuguugucugagau

SEQ ID NO: 69473 - RNA, 41 nt, Mus musculus
uaugccugugugugugugugugugugugugagagagagaga

SEQ ID NO: 69474 - RNA, 45 nt, Mus musculus
caguuuauaugauuucagcagccaaggacaggcacagaaagacgg

SEQ ID NO: 69475 - RNA, 45 nt, Mus musculus
aggcuggaccaucccuggacccuggacuguauaaaacacuuaguc

SEQ ID NO: 69476 - RNA, 48 nt, Mus musculus
agaaauuugaccuagaacauugggauaugaaagagaacugugguguca

SEQ ID NO: 69477 - RNA, 46 nt, Mus musculus
cagauuuuaaaaaugagaacgaaggucguaucagagaaguugagaa

SEQ ID NO: 69478 - RNA, 46 nt, Mus musculus
gguggaggcggugucggaggaaaucuugguaaauuauucuggaguu

SEQ ID NO: 69479 - RNA, 46 nt, Mus musculus
gcuugaaaacuggcccugugcuauggaugagagcauaggugaagau

SEQ ID NO: 69480 - RNA, 50 nt, Mus musculus
uggugcgugggcaacgaggccuuggucgguccgcgacucggagaaugggc

SEQ ID NO: 69481 - RNA, 46 nt, Mus musculus
ucuucagaaacaggguuucccagacacuguaaauacugagccagga

SEQ ID NO: 69482 - RNA, 42 nt, Mus musculus
cauuccuccaacgauagcaugcaguagccacaaccaggagga

SEQ ID NO: 69483 - RNA, 46 nt, Mus musculus
accucauauuaaacauaacgugaagucuuuaauuaaaacaguuuaa

SEQ ID NO: 69484 - RNA, 45 nt, Mus musculus
guaacucuguaccaaagccugugguacuguaggugaaggugaaau

SEQ ID NO: 69485 - RNA, 45 nt, Mus musculus
agugggugcugguugggaauugaugaucauaugcugauacagagg

SEQ ID NO: 69486 - RNA, 45 nt, Mus musculus
cucaaugcccauguaauaggaauccuaaaaagaaaaaggggagga

SEQ ID NO: 69487 - RNA, 43 nt, Mus musculus
gcaagccagaaguccccuccacccagcacaagaaaugaaagga

SEQ ID NO: 69488 - RNA, 57 nt, Mus musculus
gagcacaggaagagguacaggagaggaaggacaggauggaauacacaacacagagaa

SEQ ID NO: 69489 - RNA, 76 nt, Mus musculus
auccugaaugcuagcgaacaggagagagucccaggcagguuggaagauuggaagucgcagcagggagaauacagau

SEQ ID NO: 69490 - RNA, 51 nt, Mus musculus
auaacgugaaagaacuuaugaaucaaaaucacaaaacuaaaaaugcaggga

SEQ ID NO: 69491 - RNA, 47 nt, Mus musculus
acagaagugauccagacucaggcccaccauacagaggaacagcaagg

SEQ ID NO: 69492 - RNA, 46 nt, Mus musculus
caguuucugaauauggccacagaagucuacucccugagaggaagau

SEQ ID NO: 69493 - RNA, 42 nt, Mus musculus
cuguggugcucuacccccagcugagcagcgauggcagcaucc

SEQ ID NO: 69494 - RNA, 45 nt, Mus musculus
cagcacuccuuccucuguggcguguucaucagugacugccuaucg

SEQ ID NO: 69495 - RNA, 45 nt, Mus musculus
guguucccauuaagucagacguauccucauaaaaucaaaaccaga

SEQ ID NO: 69496 - RNA, 96 nt, Mus musculus
uuugcaggauauuuuuauauauuuguaucauauauuuuccacgggggcggggguaauaucaaugucauuuaaagaccauaaacaaugcggcaguaa

SEQ ID NO: 69497 - RNA, 45 nt, Mus musculus
aaaggggaucauaaaaaaccuccugggaaaaaaguagaggcaagu

SEQ ID NO: 69498 - RNA, 46 nt, Mus musculus
caugagcguacauugccauacaggcugaucuuauucacagcuagau

SEQ ID NO: 69499 - RNA, 53 nt, Mus musculus
uuucagcaggccuggccucuggaaggcuuugggggaacauuagaaaugaaggg

SEQ ID NO: 69500 - RNA, 61 nt, Mus musculus
gcaaugguucugacgagguggagaagucagaugaaacaaagauguccgaagagauacuggc

SEQ ID NO: 69501 - RNA, 42 nt, Mus musculus
gcaaucucgugucuucuuuggcaccaauacacccacacaguu

SEQ ID NO: 69502 - RNA, 46 nt, Mus musculus
uguuuccuccuugcaacauccacucaacauagggugaacaucagau

SEQ ID NO: 69503 - RNA, 45 nt, Mus musculus
agaagugccagaaucucauucaagguuugucauuuuggucuuaga

SEQ ID NO: 69504 - RNA, 41 nt, Mus musculus
gugcucuuaaccccugagccaccucuccagccccuggagau

SEQ ID NO: 69505 - RNA, 46 nt, Mus musculus
cuuuguuuucuacucuaugacaauagagaucaauucaaccccaaac

SEQ ID NO: 69506 - RNA, 46 nt, Mus musculus
uuacucacuuggucauuuaaggaaaggccauguagcaggaucaaaa

SEQ ID NO: 69507 - RNA, 46 nt, Mus musculus
ugaccuccuccacacacaugcauguaacacacacacacacacacac

SEQ ID NO: 69508 - RNA, 34 nt, Mus musculus
cugggaucacaggcauggaccacaugauccaggu

SEQ ID NO: 69509 - RNA, 42 nt, Mus musculus
uggaucugaaagccaaaauacccgaugaccaugcacgcaaag

SEQ ID NO: 69510 - RNA, 46 nt, Mus musculus
cccaacccccugacuguuccauaacugacuacagaaaaagccacac

SEQ ID NO: 69511 - RNA, 42 nt, Mus musculus
uaaaaaaguauuugaguguuacauacugauccucagggagag

SEQ ID NO: 69512 - RNA, 46 nt, Mus musculus
auagcuugcacugccaaugggaccaaccugugcgcuaccaucgagg

SEQ ID NO: 69513 - RNA, 48 nt, Mus musculus
cugauucaggaggagcagauccugcgcaacaucauccacgagacgcag

SEQ ID NO: 69514 - RNA, 45 nt, Mus musculus
acaacuuucuuguuuguugagauagaacaguugcuagaggggggu

SEQ ID NO: 69515 - RNA, 99 nt, Mus musculus
ccaauguucuacacagagcgcauuucucugcggaugcugccgucgugguccaugcagcucuggaugacagugacuucuucaccagcuauuacacacugg

SEQ ID NO: 69516 - RNA, 51 nt, Mus musculus
auugaaagcuguguaccuaacauucauuaaggagaaaaauacguaagguag

SEQ ID NO: 69517 - RNA, 81 nt, Mus musculus
aguggagugugccaugcgagcgcuucacuucucuuccagguaagauuucucuucuucgggccuccagaucagccgcaccaa

SEQ ID NO: 69518 - RNA, 46 nt, Mus musculus
gagacacgggccuggaacagagacacaauaaagaagaccccgacug

SEQ ID NO: 69519 - RNA, 48 nt, Mus musculus
ugagcacuagcgcaagcauaaauucaugguaguugaaaagcagcuugu

SEQ ID NO: 69520 - RNA, 46 nt, Mus musculus
augaaucuuaaaaguuaaaaagucucaugaaggaaagguagaaacu

SEQ ID NO: 69521 - RNA, 46 nt, Mus musculus
acgguugugagccaccaugugguugcugagaauugaacucacgacc

SEQ ID NO: 69522 - RNA, 46 nt, Mus musculus
ucucuggguuccccucugccaggagauccaggcagcaucaggagcc

SEQ ID NO: 69523 - RNA, 45 nt, Mus musculus
uucagauucucggagauaauuuuccaugcacuuuggaggcucaga

SEQ ID NO: 69524 - RNA, 47 nt, Mus musculus
cuggaccguaacccucgcuugcaauggcugcgucuuuggucgggaag

SEQ ID NO: 69525 - RNA, 46 nt, Mus musculus
uaaugagacaagaaacaacaguuaacuaccucaaagaacuggaggu

SEQ ID NO: 69526 - RNA, 41 nt, Mus musculus
gugugugucugucugucuguguguaugugugugcaugugug

SEQ ID NO: 69527 - RNA, 41 nt, Mus musculus
ucccauuuuuaaaaaugauugcauugauugacuggcugugu

SEQ ID NO: 69528 - RNA, 46 nt, Mus musculus
uauguagagaagugaugagaaaaauaaugaacaagaaaggugaaaa

SEQ ID NO: 69529 - RNA, 42 nt, Mus musculus
agccgggccccuggguggcuccgcgcggccccgcccccagcu

SEQ ID NO: 69530 - RNA, 45 nt, Mus musculus
aacuuuuccucuuugccugagggcauuuguaaacucggcagaagu

SEQ ID NO: 69531 - RNA, 47 nt, Mus musculus
uucuuacacaggugucuucaucaccaucacuucuacacugggggaaa

SEQ ID NO: 69532 - RNA, 44 nt, Mus musculus
auuauuguguaaguuagccaauagucuuuagauuaaggcaacag

SEQ ID NO: 69533 - RNA, 46 nt, Mus musculus
ucauuggauugccggggaugucccuuuaaaaggacugcugccuuca

SEQ ID NO: 69534 - RNA, 42 nt, Mus musculus
aggggaaauagagguggccgagguuggggaacacgaggaaau

SEQ ID NO: 69535 - RNA, 46 nt, Mus musculus
aucaugccaugcaccuuaaauauaaacaaaugcaguagugagagag

SEQ ID NO: 69536 - RNA, 41 nt, Mus musculus
caaccccuccucuugcguaggaaaagcuuacuaccggcaac

SEQ ID NO: 69537 - RNA, 42 nt, Mus musculus
augugauaccuaagcacuugaaaaagaaaauaugccagcuau

SEQ ID NO: 69538 - RNA, 46 nt, Mus musculus
ucaccaccuaagaagucuccaggaggaccaaaaagagaugccagac

SEQ ID NO: 69539 - RNA, 42 nt, Mus musculus
aucaguuggggcgaaaacuuccagacuucuuaacagccaaac

SEQ ID NO: 69540 - RNA, 45 nt, Mus musculus
cacccugaccaccccaguggaaggccucgauauacagcuggaggu

SEQ ID NO: 69541 - RNA, 62 nt, Mus musculus
auucuucaaggagaagacauuguuagagaacgagcaauuaaauuccuguccacaaaacucaa

SEQ ID NO: 69542 - RNA, 57 nt, Mus musculus
ugcagaauuuaaccuggugaacaaugcucugcuaaguauauuuaagauggaugcaaa

SEQ ID NO: 69543 - RNA, 46 nt, Mus musculus
ugggcaccagcacauagugcagacacacacauauacacacagagau

SEQ ID NO: 69544 - RNA, 42 nt, Mus musculus
augccuaccaagugauacuggauggcgugaaaggcggcacca

SEQ ID NO: 69545 - RNA, 45 nt, Mus musculus
gaguauucaacagucacuuagucacaguauuugaccacuuaagcg

SEQ ID NO: 69546 - RNA, 46 nt, Mus musculus
uuuaaaaaaaaaagcuagguugacuugaucaccuucuucaagaggu

SEQ ID NO: 69547 - RNA, 46 nt, Mus musculus
ugauacuuaaacauuuuuaguuucguuuuuauugagugugugugug

SEQ ID NO: 69548 - RNA, 45 nt, Mus musculus
ccugaaugugcaagugucagaccucacugugaccuggaugugaga

SEQ ID NO: 69549 - RNA, 45 nt, Mus musculus
uaggaaaaguguguuuugacagccauuuacauagaguacauuagg

SEQ ID NO: 69550 - RNA, 42 nt, Mus musculus
guagguucgccuucacagauguguaaacgcuguuaggccagu

SEQ ID NO: 69551 - RNA, 25 nt, Mus musculus
aaccucccuaaguuuaaggggaagu

SEQ ID NO: 69552 - RNA, 46 nt, Mus musculus
uuuguauuauuuccaguggaagaguuuugugaagaaagucacaggg

SEQ ID NO: 69553 - RNA, 57 nt, Mus musculus
cgggcguuggaggcgcgguagcggcuucgcgcucucucuggcgauuagcgaugcgcg

SEQ ID NO: 69554 - RNA, 47 nt, Mus musculus
cccgggcuguugaugaaauggaaaguuuuccucaagagaucgaaauu

SEQ ID NO: 69555 - RNA, 74 nt, Mus musculus
agaccuucucugcaagaaucucaaugcccaggucaccacgagccaccaucaucccaucacuggccuccaagauc

SEQ ID NO: 69556 - RNA, 35 nt, Mus musculus
gccagcaccuuucuccuucaccugcagugagauga

SEQ ID NO: 69557 - RNA, 45 nt, Mus musculus
ccacauucauucuagacuuaaucaucuccuucagcaucuccacag

SEQ ID NO: 69558 - RNA, 74 nt, Mus musculus; identical to SEQ ID NO: 69555

SEQ ID NO: 69559 - RNA, 35 nt, Mus musculus; identical to SEQ ID NO: 69556

SEQ ID NO: 69560 - RNA, 45 nt, Mus musculus; identical to SEQ ID NO: 69557

SEQ ID NO: 69561 - RNA, 46 nt, Mus musculus
aggauagaaaacagacuugaucagguugggauggaauucaagagau

SEQ ID NO: 69562 - RNA, 45 nt, Mus musculus
augacuccaguagaacugugaugugaucuugcugcugggcuggga

SEQ ID NO: 69563 - RNA, 45 nt, Mus musculus
guggggguaggggagcauucuauggggucaagaagagugggaaaa

SEQ ID NO: 69564 - RNA, 42 nt, Mus musculus
cagucaugagucaaaaagcaggauuacuuuuucaugcaagaa

SEQ ID NO: 69565 - RNA, 46 nt, Mus musculus
guugccugcuuuaaugucuggauaagaacuugcuuguaauugguag

SEQ ID NO: 69566 - RNA, 44 nt, Mus musculus
guuuuuauuagcuccuuguucaagcuaggaacuugccuggcaga

SEQ ID NO: 69567 - RNA, 56 nt, Mus musculus
ccuucaucuucuucaccuaugccaauugaaaacauggaagaaaagaaagaaagaaa

SEQ ID NO: 69568 - RNA, 45 nt, Mus musculus
gagugaaagguccugcagugugcagcaagggagggggcaggcuag

SEQ ID NO: 69569 - RNA, 46 nt, Mus musculus
gaauuugccuucuguguguauauaugugcauaaauugugcuguaaa

SEQ ID NO: 69570 - RNA, 46 nt, Mus musculus
cuuugggagaugcaguccauuuuugucgcccccuccaccccuuccc

SEQ ID NO: 69571 - RNA, 91 nt, Mus musculus
gggcaacgaccaaccagccaacgcccacccaauggucugaucgccaagcugucuaaaaaaaaaaauuguguguuacccacuugccccuuuc

SEQ ID NO: 69572 - RNA, 42 nt, Mus musculus
ccccgcccccgcuccgacgcccccgcacggacgcccucaguu

SEQ ID NO: 69573 - RNA, 46 nt, Mus musculus
guuguaaaaaauggaaccuagggucucuggugugaagggucuggga

SEQ ID NO: 69574 - RNA, 46 nt, Mus musculus
augaguuuuucuauuguuccuuugauuuuucagagacccccccuuu

SEQ ID NO: 69575 - RNA, 46 nt, Mus musculus
uuuuguaaaguauuaggagcccuuaaaguguucuuuugccaucaac

SEQ ID NO: 69576 - RNA, 46 nt, Mus musculus
aacagaaaugaaaguguaaacauccagcaguagcuugccacgagga

SEQ ID NO: 69577 - RNA, 46 nt, Mus musculus
agcaucugagccugcuggguucacccagcucaaucucauugaagau

SEQ ID NO: 69578 - RNA, 61 nt, Mus musculus
uaacaggguauaaauugauucauaauaaguaccgguccaucuuccaucuugacccguugug

SEQ ID NO: 69579 - RNA, 46 nt, Mus musculus
uaguaagcuauuuaucuuuguuuuugaaauaucaaacccuggaggu

SEQ ID NO: 69580 - RNA, 47 nt, Mus musculus
ccagaaccuagauuggucucugggaggaaauuugaauggguccauau

SEQ ID NO: 69581 - RNA, 71 nt, Mus musculus
aaaugcacauucuuggucccuauugaaccuuaucccuacccaaagucccagggaacauccaccagcuaagg

SEQ ID NO: 69582 - RNA, 46 nt, Mus musculus
auugggguguagugccuacgccauuaacuugaaaagacagcacgau

SEQ ID NO: 69583 - RNA, 40 nt, Mus musculus
agaagaaaaagcuggugaucaacgguggcaaugggacggu

SEQ ID NO: 69584 - RNA, 46 nt, Mus musculus
caggaagaugaaguugagaaagcaccaugcucaguucuggacacau

SEQ ID NO: 69585 - RNA, 45 nt, Mus musculus
gaucgagacucauccaaggacuccagggggaguucccgcacugug

SEQ ID NO: 69586 - RNA, 46 nt, Mus musculus
cuuaaugguuuaugguacucucucugauaaaguggcuaugugggaa

SEQ ID NO: 69587 - RNA, 46 nt, Mus musculus
ucuguuaauuuaucuuuuucucucuugugguaaauuuuacugagau

SEQ ID NO: 69588 - RNA, 47 nt, Mus musculus
auggggaaauagaugugugugugugugugugugugugugugugugug

SEQ ID NO: 69589 - RNA, 46 nt, Mus musculus
ugcuucaaacauuauagaugacgaugucagcagcggcuccaccauc

SEQ ID NO: 69590 - RNA, 45 nt, Mus musculus
uuaggagagccaugaucagaguaaaggaguuagcuaauggcagau

SEQ ID NO: 69591 - RNA, 52 nt, Mus musculus
uccucgucacguccaacaccucccacuaugacacauauugcuucaaugccuc

SEQ ID NO: 69592 - RNA, 46 nt, Mus musculus
uuuccuagccuuaguauuugucacccaagucauaggacuccuagau

SEQ ID NO: 69593 - RNA, 24 nt, Mus musculus
aaggcauucagaaacaggccccag

SEQ ID NO: 69594 - RNA, 45 nt, Mus musculus
agucuggaauugacuacugaaucguauacuaauauugucugucac

SEQ ID NO: 69595 - RNA, 45 nt, Mus musculus
acuuugccucuugcaguugagccuggcacauccacaucagcagau

SEQ ID NO: 69596 - RNA, 61 nt, Mus musculus
caggugcggacauucuacacaaagguguugaacgaggaggagaggaaacgccugugugaga

SEQ ID NO: 69597 - RNA, 45 nt, Mus musculus
gcguccagugcgcuguagaugugaaacgcuucaacagugcuaaug

SEQ ID NO: 69598 - RNA, 46 nt, Mus musculus
gagucaacgauuagauggagccuacauccaaaugagacgaucagau

SEQ ID NO: 69599 - RNA, 41 nt, Mus musculus
gccuguaguucuggugaaacuggggcaccaacucugacugg

SEQ ID NO: 69600 - RNA, 51 nt, Mus musculus
gagaccuccugugcugugacaugcucuauaggcgcugccagccacccagau

SEQ ID NO: 69601 - RNA, 42 nt, Mus musculus
guaggccuggauauauuugaguccuucccuguaaaggcagag

SEQ ID NO: 69602 - RNA, 42 nt, Mus musculus
gucuuugguugcuugaguggggaaggacuguuuggucaggua

SEQ ID NO: 69603 - RNA, 45 nt, Mus musculus
aagcacggcuugggaacugucggguagagcaauucucagugauga

SEQ ID NO: 69604 - RNA, 46 nt, Mus musculus
guccuggacguuuuacauccaggucaugacuuuuaaggaggcagaa

SEQ ID NO: 69605 - RNA, 46 nt, Mus musculus
aauauuuuguuggccaccaauucaaagaacaaauucaggccacuca

SEQ ID NO: 69606 - RNA, 46 nt, Mus musculus
caugaauggcuauggaucacacaccuucaaguugguuaaugcagau

SEQ ID NO: 69607 - RNA, 45 nt, Mus musculus
uuagcauuccuucauagaaauuuugucauuuucuauaggugaagu

SEQ ID NO: 69608 - RNA, 42 nt, Mus musculus
ugggaaagauagaacacggagcaguaugugcccugcggagag

SEQ ID NO: 69609 - RNA, 75 nt, Mus musculus
guugacgugugacaaggauuuuugagagcagauuuaguaguucagcacuuagcacauaggaaauugaaggacaag

SEQ ID NO: 69610 - RNA, 45 nt, Mus musculus
uuguuuguuuuuaauugugaagagauaccacacauugcuugagag

SEQ ID NO: 69611 - RNA, 46 nt, Mus musculus
gcucuuucucccuuaaaacccugauuuuguugguuaacugggagau

SEQ ID NO: 69612 - RNA, 42 nt, Mus musculus
cuacaccaugucggacagucgggacccagccagcgaccagau

SEQ ID NO: 69613 - RNA, 55 nt, Mus musculus
gacuaucgagaaagacucuuacuacaaaaaugaggggagagagaauauuuuuaau

SEQ ID NO: 69614 - RNA, 47 nt, Mus musculus
aagaagagagauaacaacagaaaggauaugaaacugaagcgaaagaa

SEQ ID NO: 69615 - RNA, 52 nt, Mus musculus
augaagcagcaaaggaauuccaggagaaacacaagaaggaagucgggaagcu

SEQ ID NO: 69616 - RNA, 71 nt, Mus musculus
ccuguuguguuguccuuguagcuguucaaugaugugcaggaaaaggcuauugaggagcagaugguggcagu

SEQ ID NO: 69617 - RNA, 42 nt, Mus musculus
uguuuauaauaaguacuaaaacuuagauguauuugcgcagau

SEQ ID NO: 69618 - RNA, 70 nt, Mus musculus
ccugaagcgucuagagauguacucucggaacauggucgauuaccaccucaucauggaucuuaucccagcc

SEQ ID NO: 69619 - RNA, 45 nt, Mus musculus
cuauauagcuuuauaaaucuagaaagcauagaaucauuguuuagu

SEQ ID NO: 69620 - RNA, 24 nt, Mus musculus
cgcuggccgaugaggaugaggcug

SEQ ID NO: 69621 - RNA, 42 nt, Mus musculus
cacacugaggagucagcugucgagcaucccuuucuggcagug

SEQ ID NO: 69622 - RNA, 46 nt, Mus musculus
ggggggugugugucugugucauuuucccuucccuaaacuuggaguu

SEQ ID NO: 69623 - RNA, 46 nt, Mus musculus
accugugccccccacccagaaugcccugccugaagugcuugcaguu

SEQ ID NO: 69624 - RNA, 67 nt, Mus musculus
uccaagucgcacuuggcuuugagaaaggcagaacugcagucaccaucaauucccagucaggccugug

SEQ ID NO: 69625 - RNA, 49 nt, Mus musculus
cuccauguaacucagccagcguugagccugagaagacaaggcaguaggu

SEQ ID NO: 69626 - RNA, 45 nt, Mus musculus
agguaugguagcauguucgugaacacccuugaugggaggcugaag

SEQ ID NO: 69627 - RNA, 42 nt, Mus musculus
agcaccacugcugagaacaagaccacaacgacagccagacug

SEQ ID NO: 69628 - RNA, 39 nt, Mus musculus
auuggguuagucgucuuuauuauuuaugaggcacaaggu

SEQ ID NO: 69629 - RNA, 46 nt, Mus musculus
uucuucuuaaaacuuuaaaauagaguucaucuugguauggaaagau

SEQ ID NO: 69630 - RNA, 46 nt, Mus musculus
aaacugggccaggcugagcugguugugauagaugaagcugccgcua

SEQ ID NO: 69631 - RNA, 63 nt, Mus musculus
auucuugagcugccaaaaguagaaaguggggaguugugggaagagaggaaggggacagugcgg

SEQ ID NO: 69632 - RNA, 46 nt, Mus musculus
agguuggugaugucagggcagagaggacaaaucagagacccagugc

SEQ ID NO: 69633 - RNA, 60 nt, Mus musculus
guguauuuaaggaugagagaggugggggagaggagcggugggaagacaauggauuuagga

SEQ ID NO: 69634 - RNA, 69 nt, Mus musculus
gguuauuuauauugccuccguggccauuuuaaaacagcagaaaacucuaaagcaacugauggauuguuu

SEQ ID NO: 69635 - RNA, 47 nt, Mus musculus
aaguaaggcagaucuccccccccucccccccgccccgucaccuccag

SEQ ID NO: 69636 - RNA, 46 nt, Mus musculus
gcaggguauuggcucugagaaaguguguccuucuagccuggaaauu

SEQ ID NO: 69637 - RNA, 44 nt, Mus musculus
cccuuucagcucacugcugccugauucucucagcuggggacagg

SEQ ID NO: 69638 - RNA, 42 nt, Mus musculus
ugugugagaauggugguguguugcagauuaucagcaccaagu

SEQ ID NO: 69639 - RNA, 46 nt, Mus musculus
gucuguguguaaauggaucuuauaggaauccuaccuaaggguauga

SEQ ID NO: 69640 - RNA, 24 nt, Mus musculus
uuggguuaggguuaggaaccagca

SEQ ID NO: 69641 - RNA, 42 nt, Mus musculus
cagagcaaagaaaaaggaaaggaagucuagaggugugggcac

SEQ ID NO: 69642 - RNA, 45 nt, Mus musculus
guuacggugcuggaugagcuguggaaaaaaugagugguaggugag

SEQ ID NO: 69643 - RNA, 46 nt, Mus musculus
acaaauaacuucuaguucuacuuuaaagcuggaagaauuuaaacau

SEQ ID NO: 69644 - RNA, 46 nt, Mus musculus
gucagaucagcuagguggguuagaauuuuguuugaggcaccuugac

SEQ ID NO: 69645 - RNA, 45 nt, Mus musculus
uuuuuuaagauuuauuuauuauuuuuauguaagaacacuguagcu

SEQ ID NO: 69646 - RNA, 44 nt, Mus musculus
uuauuauuacuauguuuuaauuguguguguuguguggggucaga

SEQ ID NO: 69647 - RNA, 45 nt, Mus musculus
guacacccaauaacccauaugguacuuuuuaaaaucaccuguaua

SEQ ID NO: 69648 - RNA, 42 nt, Mus musculus
uauggguaagggugggggcagugguggaggugggggcagacc

SEQ ID NO: 69649 - RNA, 42 nt, Mus musculus
uguaauguuggucugcccccaccuccaccacugcccccaccc

SEQ ID NO: 69650 - RNA, 46 nt, Mus musculus
gcuuaauuuuuauuguauugcuuauaauuuauuucugucgagagaa

SEQ ID NO: 69651 - RNA, 48 nt, Mus musculus
acagaaacugacugaccuauucagugauuucagagaacuagacaccaa

SEQ ID NO: 69652 - RNA, 46 nt, Mus musculus
ucaccugaaauuugcaggcaggcauugaagagacuucagcuguuac

SEQ ID NO: 69653 - RNA, 46 nt, Mus musculus
caaucuaaggacaaaucaucagggcauauauguacuucaggacaac

SEQ ID NO: 69654 - RNA, 46 nt, Mus musculus
uuaugugacaagugcuuuauucaccgagccauuccuccagcccaag

SEQ ID NO: 69655 - RNA, 46 nt, Mus musculus
uuugggguacauucacguacaauuauuucuccuugaauaucggcag

SEQ ID NO: 69656 - RNA, 45 nt, Mus musculus
caaaauaggcaaacaaaucaguuauguuuuaagccacaugcagca

SEQ ID NO: 69657 - RNA, 57 nt, Mus musculus
gagugaagccguccuagcuuugcucucugugccuacauuaagaugaguaucuugggu

SEQ ID NO: 69658 - RNA, 82 nt, Mus musculus
uuuuaauuucuuuggugcugaaacugaaacuaaggccuaacccauucuaagcucucccucugcacugcaugcuuuagcccuu

SEQ ID NO: 69659 - RNA, 82 nt, Mus musculus
uguauuugcgcacacacuugugucucggguguguauuugcagagggcgcacgugaggaagaccuggaugcugucgaagcuca

SEQ ID NO: 69660 - RNA, 42 nt, Mus musculus
cuuuguaaguuguauucauggaagucuuuuuguuuugggggg

SEQ ID NO: 69661 - RNA, 46 nt, Mus musculus
gacugaaauacugucucccuuuaaccuuuugcauacacaccggcuu

SEQ ID NO: 69662 - RNA, 42 nt, Mus musculus
aacaauguuguaucaggugguuuccccaucaucagagaccag

SEQ ID NO: 69663 - RNA, 41 nt, Mus musculus
guuggacagucgcuacuggaggauaacaaacgcuaaagggg

SEQ ID NO: 69664 - RNA, 42 nt, Mus musculus
ccauauuagguggcucauaaccauguauaacuccagccccag

SEQ ID NO: 69665 - RNA, 44 nt, Mus musculus
gaauacacaagcuguaccacauuuucuacaacaucaggcuacau

SEQ ID NO: 69666 - RNA, 46 nt, Mus musculus
acauuuugaggaaguaucuuaggguuguaguaauauauaaagggag

SEQ ID NO: 69667 - RNA, 77 nt, Mus musculus
acauugaaugcuuagaagacgcccucccagcuccuggaguggguagguuugagguaauucuagaaaaguggacaagc

SEQ ID NO: 69668 - RNA, 49 nt, Mus musculus
cucuggaauagacuuccauuuucuuucuuggguaaaggggaugagagga

SEQ ID NO: 69669 - RNA, 96 nt, Mus musculus
gccucccaagugcuagaugugugcaccaugccuacaccagaccagacuuccauucuuggccaacaccagaccagacuuccauucuugguuagccca

SEQ ID NO: 69670 - RNA, 46 nt, Mus musculus
caaauuuugauauauuuugguuaauauuuaguucaaaauacucaag

SEQ ID NO: 69671 - RNA, 42 nt, Mus musculus
cuaaguuaagagcauugagguaaugcaugggcaggcaggcag

SEQ ID NO: 69672 - RNA, 46 nt, Mus musculus
ggagauaauagaauuguguuuuacauuuuuuuuuguccuccaccag

SEQ ID NO: 69673 - RNA, 45 nt, Mus musculus
ccugaugaauaugaagagauggaggaggaagcugaggaggaggag

SEQ ID NO: 69674 - RNA, 46 nt, Mus musculus
guuuugucaauaauguaaauaauugugcucagcauauagccggaag

SEQ ID NO: 69675 - RNA, 45 nt, Mus musculus
aguuccuuuguuuaaaaauauuuucuacuuaaaaacaaaacagag

SEQ ID NO: 69676 - RNA, 44 nt, Mus musculus
uaugacuccacccacggcaaguucaacagcacagucaaggccga

SEQ ID NO: 69677 - RNA, 46 nt, Mus musculus
cccagugggcauaaacccccgccuguuaccauccccaaccauucau

SEQ ID NO: 69678 - RNA, 43 nt, Mus musculus
ggauccucugcgagauauucuuccaggccguccaggaguagaa

SEQ ID NO: 69679 - RNA, 46 nt, Mus musculus
guuguagucccccgaggccaugucaggagacgcagccgcggagcag

SEQ ID NO: 69680 - RNA, 48 nt, Mus musculus
aucugcgcuggcaguguuuuccucgucugccccccaguccucuguccc

SEQ ID NO: 69681 - RNA, 57 nt, Mus musculus
aacacuuuauuuuugcuuuuacgaccacgcaaacauugcagaauuugguaaacugaa

SEQ ID NO: 69682 - RNA, 87 nt, Mus musculus
uaugaaugauacauaaguauuuuacaaaugggacuuuuagauaggagaucucacccuuuugcuguuuggcuguuuguuuguuuugga

SEQ ID NO: 69683 - RNA, 66 nt, Mus musculus
uagguuuucacaguguagcccugacuaggcaggaccuucugacaggauugcuuccuuggccuccag

SEQ ID NO: 69684 - RNA, 57 nt, Mus musculus
uacuguaaaaaacaaaacugaguuuuugaaagguguguguuuugaucuugauccacg

SEQ ID NO: 69685 - RNA, 57 nt, Mus musculus
aauccccagcuaauaaaauagaaauuauuggagguugacagaugagguaaaauagga

SEQ ID NO: 69686 - RNA, 51 nt, Mus musculus
uauuuuucuaaaacuguuuauuuuacucuacucuuaccgggcuggcauuuu

SEQ ID NO: 69687 - RNA, 46 nt, Mus musculus
agaacugugaugagacuuuauaaaccuccauucuccaaaccccuuu

SEQ ID NO: 69688 - RNA, 46 nt, Mus musculus
gcuuaucucauaaacaaucuguuagacuguaccuucucaccuaugu

SEQ ID NO: 69689 - RNA, 46 nt, Mus musculus
uaguucuguauucccagaacucagguugagacagagaggguaggag

SEQ ID NO: 69690 - RNA, 46 nt, Mus musculus
ccccuggagcuggauacagauacuuguaagccaguguagaugcuag

SEQ ID NO: 69691 - RNA, 49 nt, Mus musculus
cauacccccagccucuuagucccacuacagauuuuacaugggaaggaag

SEQ ID NO: 69692 - RNA, 49 nt, Mus musculus
uuaaaaguaacaguguuaccaaauaauguaaaagucaggguagauauga

SEQ ID NO: 69693 - RNA, 46 nt, Mus musculus
gucugggcaauuggcaguuguaugggaaaaacucuaaaaggggauc

SEQ ID NO: 69694 - RNA, 42 nt, Mus musculus
ugugucaccacugucuggcuauuuauuuuucuuuugaggcag

SEQ ID NO: 69695 - RNA, 42 nt, Mus musculus
aguuuauuuuccaagcauagguuuaacuccuuaaguccccau

SEQ ID NO: 69696 - RNA, 45 nt, Mus musculus
uauauauauauagagagagagagagagagagagagagagaagggu

SEQ ID NO: 69697 - RNA, 44 nt, Mus musculus
guguuguguauauuaguacaagugcuuucagauguuagccauca

SEQ ID NO: 69698 - RNA, 46 nt, Mus musculus
gguugggagccaccaugugguugcugggaauugaacucaggaucuu

SEQ ID NO: 69699 - RNA, 45 nt, Mus musculus
aacgaaccaucucuucagccccucaggugcuuaaaagaucaccca

SEQ ID NO: 69700 - RNA, 67 nt, Mus musculus
uguguauaaaacaaucacagccaucuuuuucuuguaaaaguacauuuuuauaaaauacauagugauu

SEQ ID NO: 69701 - RNA, 42 nt, Mus musculus
gugagccaccaugugguugcugggguuugaacucgggaccuu

SEQ ID NO: 69702 - RNA, 41 nt, Mus musculus
caacuuuuaggcuguuuuuaacccaugauuugaggccauuu

SEQ ID NO: 69703 - RNA, 45 nt, Mus musculus
cugaagccuggggcuuauaauagaucugccuuccaaguccugggg

SEQ ID NO: 69704 - RNA, 48 nt, Mus musculus
guguuuuguggccugguauguucccagggaggccagaagagacuguca

SEQ ID NO: 69705 - RNA, 40 nt, Mus musculus
uuuugaggcaaauucuuucuuuguagcacaggcuguccuu

SEQ ID NO: 69706 - RNA, 47 nt, Mus musculus
ccaguuccccaguucuggcagauucuggaaacuguacauugaagcag

SEQ ID NO: 69707 - RNA, 58 nt, Mus musculus
uuaaugucccagugucaauuggcacuaaguaaucacucacagauuauaaauuaaugga

SEQ ID NO: 69708 - RNA, 45 nt, Mus musculus
acacauuauaguuuguauuuaaaacucacaagaaucaagcaugau

SEQ ID NO: 69709 - RNA, 46 nt, Mus musculus
ucauaagacuuugcaaacggaaggauggucucauugguagcugaag

SEQ ID NO: 69710 - RNA, 46 nt, Mus musculus
guuuguuuuuaauuauugcauauguggaguaccacagcauucagag

SEQ ID NO: 69711 - RNA, 45 nt, Mus musculus
aagaaaagaagaggguucuugaaggguauuuaagauauguggaaa

SEQ ID NO: 69712 - RNA, 45 nt, Mus musculus
ugugagccaccaugugguugcuggaauuugaacccaggaccuuug

SEQ ID NO: 69713 - RNA, 45 nt, Mus musculus
uuacuucuuaagauaagaaaauguuauauaaacccuccaagugac

SEQ ID NO: 69714 - RNA, 46 nt, Mus musculus
gacaggucuuucagggguuuguuuaagucuuucaaagaauuaggag

SEQ ID NO: 69715 - RNA, 42 nt, Mus musculus
aacaaauccucuaauucuguuuuaguaacaggaaucauaauu

SEQ ID NO: 69716 - RNA, 46 nt, Mus musculus
gaaaaaaggaaauugaaaguuugacuucugucuuuagaguuuuaua

SEQ ID NO: 69717 - RNA, 42 nt, Mus musculus
caguaguuuccaagacaguuugcauauaauuugagggggaau

SEQ ID NO: 69718 - RNA, 46 nt, Mus musculus
uggcaugucaucuuuuaagaguucugugccaaaaagcuacacugag

SEQ ID NO: 69719 - RNA, 85 nt, Mus musculus
cugugucauuuacaaacugaaaaggaugaaagaagcuucuuugaucugaagaauggaaugggaaaauccugacaugaacagugag

SEQ ID NO: 69720 - RNA, 46 nt, Mus musculus
ucugggggagugcacuuucauaggaggccucuacauaucugagaua

SEQ ID NO: 69721 - RNA, 53 nt, Mus musculus
gagcuuuaucagacuaaaaaaaccauuucuuaacauccagaaguaagagagag

SEQ ID NO: 69722 - RNA, 89 nt, Mus musculus
uucuagacuucagccaauagauugcugaugcuuauugaaucccaggaaggauugagggugggggaaagcuauacccagacaugagaaca

SEQ ID NO: 69723 - RNA, 58 nt, Mus musculus
aaaguuagcagcaacaaaaagccuucagaagugaaugcagaaugucugugaccuucag

SEQ ID NO: 69724 - RNA, 42 nt, Mus musculus
ugcugaaagaaagcaccugaccacuuaauucaaauuacuaua

SEQ ID NO: 69725 - RNA, 83 nt, Mus musculus
guacugggacuaaaggccugugccaccacgcccagcugcaaguaacuucuuuaagaagauggcucaaauuucauuuauuuuug

SEQ ID NO: 69726 - RNA, 71 nt, Mus musculus
aauuagugugaaccccaggcugaccuugaauuuguguuguaaucccagcuagccuugaacuaucacccccc

SEQ ID NO: 69727 - RNA, 50 nt, Mus musculus
gaagcugaacauaagcuuuacuuuaaauaaauaccauuaggagauggaga

SEQ ID NO: 69728 - RNA, 46 nt, Mus musculus
guauggguuugcuaaucugauuaaacagugacaaacaagaggcccu

SEQ ID NO: 69729 - RNA, 46 nt, Mus musculus
gcuaacucuauaaguugaacaauuuuguacauccaauuucagcauu

SEQ ID NO: 69730 - RNA, 46 nt, Mus musculus
acauaaugaaauugucaaaauauaucugguaaauuaaaggucauuu

SEQ ID NO: 69731 - RNA, 45 nt, Mus musculus
agagaaugaucuugaaucauuuguuuucugaugagugagcagaau

SEQ ID NO: 69732 - RNA, 45 nt, Mus musculus
auuacuauaguuuauuuaaaaagcagacauuaugaaugguaccaa

SEQ ID NO: 69733 - RNA, 49 nt, Mus musculus
aauuuaguuaucccuauaauaaaaucagaaaacuaggugcauagauuga

SEQ ID NO: 69734 - RNA, 47 nt, Mus musculus
cuguuaagauuuuuaauauuuguaagguuuauuucauaguugcaggu

SEQ ID NO: 69735 - RNA, 27 nt, Mus musculus
ccuuacuuguuacaaacucugcuuuuc

SEQ ID NO: 69736 - RNA, 45 nt, Mus musculus
aaaaaaaaaaaagaggaaugaaaaaacaaagaaucaaagaauuca

SEQ ID NO: 69737 - RNA, 45 nt, Mus musculus
gcauacuuuaucacugugacaguucugaaaacuguuuaacagccu

SEQ ID NO: 69738 - RNA, 46 nt, Mus musculus
acuuuauauaaucuacugcuuuuguuucuuugagauggaccccagg

SEQ ID NO: 69739 - RNA, 31 nt, Mus musculus
cuugcugucuauaucuacuccucaccuguca

SEQ ID NO: 69740 - RNA, 46 nt, Mus musculus
ucuuuuuuaagagagagagggggaaaauaugaaguuggguggcggg

SEQ ID NO: 69741 - RNA, 46 nt, Mus musculus
ccaguaucaaacggccaguccugaaaauacaaggaauaucaaacag

SEQ ID NO: 69742 - RNA, 46 nt, Mus musculus
aguuucuauaugaccaaaugguaaauaaauaugguacgaguuggag

SEQ ID NO: 69743 - RNA, 45 nt, Mus musculus
uagaugaucuuuuuauacaaaauucucuauauuacuuuguccuua

SEQ ID NO: 69744 - RNA, 46 nt, Mus musculus
aaggacucaggucauucgcauauaccuacugagauaucgccccaag

SEQ ID NO: 69745 - RNA, 45 nt, Mus musculus
aauauauguauaugaaaacauauaaacguagacacauugauggag

SEQ ID NO: 69746 - RNA, 36 nt, Mus musculus
uugcauaugcagauuaugaagaggugagaagaguca

SEQ ID NO: 69747 - RNA, 45 nt, Mus musculus
gguaacaauaaacaguugugaguccuugaguucauauacguuuau

SEQ ID NO: 69748 - RNA, 25 nt, Mus musculus
acgguuuacagcauucagagaagag

SEQ ID NO: 69749 - RNA, 45 nt, Mus musculus
uuccagacccaguuguagcuccuuccauagugccuguucugaaag

SEQ ID NO: 69750 - RNA, 37 nt, Mus musculus
aagacgaugggacaguguugcuguccacaguuacagc

SEQ ID NO: 69751 - RNA, 58 nt, Mus musculus
gcaaucugguauauguugucaacuaucccaaagauaacaaaaggaaaauagaugagac

SEQ ID NO: 69752 - RNA, 41 nt, Mus musculus
aguggaaguaaugucacaacgacauaugauagaugggcgac

SEQ ID NO: 69753 - RNA, 46 nt, Mus musculus
ucagcgugcauauauccagugcugaaccuaagcauaauagcaauag

SEQ ID NO: 69754 - RNA, 45 nt, Mus musculus
caguugggcccaucugggaauaaccaaagccagggcagcaugcag

SEQ ID NO: 69755 - RNA, 45 nt, Mus musculus
ccccccccuugguugggggucagcaucaaaagcaggaucgggcag

SEQ ID NO: 69756 - RNA, 60 nt, Mus musculus
uguaggugguggggggugguuaguagguugguuguuagguuagguagauuuagaauggug

SEQ ID NO: 69757 - RNA, 52 nt, Mus musculus
uuguucaguguggaguauauucagcaguauuuuugacauuuuucuuuagaaa

SEQ ID NO: 69758 - RNA, 46 nt, Mus musculus
aacugccguuugccuaauugguaaaccaacacuacaauugaucuca

SEQ ID NO: 69759 - RNA, 45 nt, Mus musculus
aucccacccuaugaauuuuuuccuuaggaaaaucuccauuuggga

SEQ ID NO: 69760 - RNA, 46 nt, Mus musculus
uucauauaugaaaguacaauaugaagccuucauuuaaucucugcag

SEQ ID NO: 69761 - RNA, 46 nt, Mus musculus
gaagaaacacuucauugaaaguagugcuguaaauauucugccauag

SEQ ID NO: 69762 - RNA, 42 nt, Mus musculus
gaacuaaaauggucuacugcaaaauugaucagacccaaagaa

SEQ ID NO: 69763 - RNA, 46 nt, Mus musculus; identical to SEQ ID NO: 21905

SEQ ID NO: 69764 - RNA, 46 nt, Mus musculus
uacauaauauucugcuguaacucccugcuuacagccagcuaaagau

SEQ ID NO: 69765 - RNA, 42 nt, Mus musculus
ggcaggcuaacugaaugcugggauccagguucagugagagcc

SEQ ID NO: 69766 - RNA, 46 nt, Mus musculus
uccaaaugccuuucuuuuugaccaucuucuuacucuaaagccaguc

SEQ ID NO: 69767 - RNA, 24 nt, Mus musculus
caccuuuccauuggcuccugaagg

SEQ ID NO: 69768 - RNA, 61 nt, Mus musculus
guguuugcauauuacaauauacuuaaucacagcuaugcacuuuucucuuuuuaaaaaguuu

SEQ ID NO: 69769 - RNA, 46 nt, Mus musculus
auacaaagugaauuuaggaccagucugggguacauaagucccuguc

SEQ ID NO: 69770 - RNA, 44 nt, Mus musculus; identical to SEQ ID NO: 21907

SEQ ID NO: 69771 - RNA, 46 nt, Mus musculus
ugugaugaacaguguggugucccuccuguugauccuggaaccagac

SEQ ID NO: 69772 - RNA, 46 nt, Mus musculus
guuuucuucaguuguugagaccuccugaccuaaaauccagcuagua

SEQ ID NO: 69773 - RNA, 46 nt, Mus musculus
uuagagcgauuaauaucucuaauacuugaaaaugaguuaagcagca

SEQ ID NO: 69774 - RNA, 56 nt, Mus musculus
acacaauuggaggguaguuaguuagcacuugcauguuacuuuggaagcagggcaga

SEQ ID NO: 69775 - RNA, 70 nt, Mus musculus
gcaggaaacugaauaugaucuuugugaacuaugugucugcguggacuuuguagagggagggagggaauca

SEQ ID NO: 69776 - RNA, 46 nt, Mus musculus
cacuugaguuuucaaaauaucuuuuuuauaauaccaugccaucuuc

SEQ ID NO: 69777 - RNA, 45 nt, Mus musculus
augcacacauagaaagaugccgcauuaagaguauuugacagcaga

SEQ ID NO: 69778 - RNA, 42 nt, Mus musculus
guccgcagucgucgaugacgacccagaacuuuucggggacag

SEQ ID NO: 69779 - RNA, 44 nt, Mus musculus
ccaguggcgaaucucauccuuguccagcuucccauccuuguuca

SEQ ID NO: 69780 - RNA, 46 nt, Mus musculus
gcauucucagacaauuuuauuucacuucucuaacaauuaccguaag

SEQ ID NO: 69781 - RNA, 23 nt, Mus musculus
agaugggaaagcuggggcucuga

SEQ ID NO: 69782 - RNA, 47 nt, Mus musculus
cagaaaggcagugaacuccucccgaguagcugucaggucgccgucaa

SEQ ID NO: 69783 - RNA, 47 nt, Mus musculus
cguccgggcuuagcugaucgaaggucuuggaguccuccuugcccagg

SEQ ID NO: 69784 - RNA, 46 nt, Mus musculus
gguuguccucgggcggccgcucgcccagcucugaguccggccgaac

SEQ ID NO: 69785 - RNA, 45 nt, Mus musculus
gugacaguagguacagcacaugccuuuauauuuuuaaggcacuca

SEQ ID NO: 69786 - RNA, 46 nt, Mus musculus
uaguucccagucuuuguaguuuagaugucaaacuccuuuuaggcag

SEQ ID NO: 69787 - RNA, 45 nt, Mus musculus
ucggaagccauggaugacccaugcacgcuuugagaccuccgucag

SEQ ID NO: 69788 - RNA, 42 nt, Mus musculus
agagaaaaugauuugugucuacacaauaccauuucccagcag

SEQ ID NO: 69789 - RNA, 41 nt, Mus musculus
accagccccuucacaggcucaugcaguucauagauggggua

SEQ ID NO: 69790 - RNA, 46 nt, Mus musculus
gcaggcuauuugcaucaggcuguucacuccauccuuguaccuccag

SEQ ID NO: 69791 - RNA, 42 nt, Mus musculus
uuuuuuguuuguuuguuugguugguugguugguugggguuuu

SEQ ID NO: 69792 - RNA, 44 nt, Mus musculus
ccuucacugcagaaaaagccaccuggcguucuaacuggcagcaa

SEQ ID NO: 69793 - RNA, 46 nt, Mus musculus
uuagcauugugacaucuagccaauaaggaugguccaggacugcaaa

SEQ ID NO: 69794 - RNA, 24 nt, Mus musculus
uggcugaguuuggugauacguagc

SEQ ID NO: 69795 - RNA, 45 nt, Mus musculus
aagcagccuguccuguuugcaagcaauuauaggaauuuugagggg

SEQ ID NO: 69796 - RNA, 48 nt, Mus musculus
ggcuggugguagcagagucaacaucaaaguaugcuucgugguguucug

SEQ ID NO: 69797 - RNA, 41 nt, Mus musculus
cuucagaggugacauuguaauugcaaaaagcccaagugauc

SEQ ID NO: 69798 - RNA, 46 nt, Mus musculus
uuaauauuaacugaguacacugaggaaacaaaauggucugucacag

SEQ ID NO: 69799 - RNA, 46 nt, Mus musculus
gaguuuggacucauccuugaguuuucuuuuuucaccuuacugcgaa

SEQ ID NO: 69800 - RNA, 46 nt, Mus musculus
gagacccucucucaaaacaaaaaaauaacaauaauaacaaccccuc

SEQ ID NO: 69801 - RNA, 41 nt, Mus musculus
ccuucucaggggagggggagggggagaguagugauugggaa

SEQ ID NO: 69802 - RNA, 45 nt, Mus musculus
uuaagcaguuacuaagacuccaaauauaagaaaagaaugcagcca

SEQ ID NO: 69803 - RNA, 46 nt, Mus musculus
uguguguaaaaauaauaaagaggccuucaguucaaaagggauuaag

SEQ ID NO: 69804 - RNA, 46 nt, Mus musculus
uguaucacucccauuccauuugcuaaaacagaaacaaaauggccug

SEQ ID NO: 69805 - RNA, 46 nt, Mus musculus
aaaauuacuccuauucaaaauagcuuuaaaaacaaacuacagccaa

SEQ ID NO: 69806 - RNA, 46 nt, Mus musculus
aaaacauucuuuuuaagaaaugauguuaggaaaacugggcagacac

SEQ ID NO: 69807 - RNA, 42 nt, Mus musculus
guucuauacagcaggaaaaugaucaagugaagagacaggcua

SEQ ID NO: 69808 - RNA, 42 nt, Mus musculus
gaaugaauuuguuauuuccugggaaaauagaugcaaguggag

SEQ ID NO: 69809 - RNA, 46 nt, Mus musculus
guccuacagauccaaaacuacaggaucuccaugacacaggcagcag

SEQ ID NO: 69810 - RNA, 45 nt, Mus musculus
ugggaccacauagcaggguggaauguaaauaucaugggcccucag

SEQ ID NO: 69811 - RNA, 45 nt, Mus musculus
ugauauuuagucauuuaguagaaaugaaagcaaaacugacaugua

SEQ ID NO: 69812 - RNA, 45 nt, Mus musculus
uccccacuagaaauauacucccauuguaaguaaaaauaaauggcc

SEQ ID NO: 69813 - RNA, 42 nt, Mus musculus
agagagaaagagagagagagggagggagggagggaggagaag

SEQ ID NO: 69814 - RNA, 42 nt, Mus musculus
cuagcccagggucaccccccuccccccgagucuggaaugcag

SEQ ID NO: 69815 - RNA, 46 nt, Mus musculus
ucauuugaugacaauucuuucaaugucuugaaaccugugugccgag

SEQ ID NO: 69816 - RNA, 46 nt, Mus musculus
uacaaauucaguacuauuucacucaaaacacaaauggaaagccccc

SEQ ID NO: 69817 - RNA, 46 nt, Mus musculus
cgggucuccgcugggcuccggaagcaccgucucugcacaggccaag

SEQ ID NO: 69818 - RNA, 94 nt, Mus musculus; identical to SEQ ID NO: 27989

SEQ ID NO: 69819 - RNA, 41 nt, Mus musculus; identical to SEQ ID NO: 27990

SEQ ID NO: 69820 - RNA, 54 nt, Mus musculus
ugcauaacugaauuuauuugcaauucucaguuugauuugagguaacagaagaga

SEQ ID NO: 69821 - RNA, 46 nt, Mus musculus
uuaaccugcaugcuguaaauguguuuaaauaaaggaaaaucuuuuu

SEQ ID NO: 69822 - RNA, 45 nt, Mus musculus
gguauuugugguucugaggcuaauucacacaaaggaaaggcugag

SEQ ID NO: 69823 - RNA, 45 nt, Mus musculus
caugcugauaauagacuaaaacauggaaagcuaugcucuguggaa

SEQ ID NO: 69824 - RNA, 46 nt, Mus musculus
uuaaaaaaaaauuaauuguguggguggguggaagucagcuuguaag

SEQ ID NO: 69825 - RNA, 43 nt, Mus musculus
auaagaacuucuuucucaagauagugccagcccuugcccucau

SEQ ID NO: 69826 - RNA, 46 nt, Mus musculus
uuagaccuuugucaguagcuggggcuggcgaagugguuccugaguu

SEQ ID NO: 69827 - RNA, 32 nt, Mus musculus
guuugauucuuccaaaggaguagguaaacuuu

SEQ ID NO: 69828 - RNA, 93 nt, Mus musculus
aaccuuuucuauuucacauaacucaauuuguuuaacccugggauuauuuccugugcuucuguuuuaccuaaguuuccuccagugauuucagau

SEQ ID NO: 69829 - RNA, 42 nt, Mus musculus
ugcuuuuguuuuaaucccaggucguggggauacggggcugcu

SEQ ID NO: 69830 - RNA, 46 nt, Mus musculus
uuccgcuaggacugaauaaaauaccauuuucucuauccccucagcu

SEQ ID NO: 69831 - RNA, 42 nt, Mus musculus
uugguaaggucgcauaguuccagaaggauagagcaaugagaa

SEQ ID NO: 69832 - RNA, 49 nt, Mus musculus
aggaaacugcugggcucccagcccacugaauuuucuuucuuggggcaga

SEQ ID NO: 69833 - RNA, 46 nt, Mus musculus
aagagcaacaaagccauuucaguaauuugcuggugccuuaccaggu

SEQ ID NO: 69834 - RNA, 45 nt, Mus musculus
cccgccuaagguucuucauuaugcucucggccaagucugccacag

SEQ ID NO: 69835 - RNA, 42 nt, Mus musculus
gauaauuuuugguauuuuaaggaagaggcugccaugcuggag

SEQ ID NO: 69836 - RNA, 43 nt, Mus musculus
uggacuuugaaucuuuugagaccgcuagugcacgauggggggg

SEQ ID NO: 69837 - RNA, 45 nt, Mus musculus
aguauaugauaaggaugagauuuuaaaaagaaaaacagagggaga

SEQ ID NO: 69838 - RNA, 46 nt, Mus musculus
gguuuuauugcucuaacagaaucucuucuuucgacuccaucuaaag

SEQ ID NO: 69839 - RNA, 47 nt, Mus musculus
uacgaccuggauggggaagagagcuauggcaaguaccugaggcggga

SEQ ID NO: 69840 - RNA, 54 nt, Mus musculus
ucgcaggcgcugcucccagggggaagggggccaagccaguagcuugcugagccu

SEQ ID NO: 69841 - RNA, 52 nt, Mus musculus
cccgaaguugaucuggauggguuucuuuugccaccugugucgaggcuacuuu

SEQ ID NO: 69842 - RNA, 46 nt, Mus musculus
aaccauuuauguuagaaugccaucaaacuauugcuaaacuugauga

SEQ ID NO: 69843 - RNA, 42 nt, Mus musculus
ucguuaaacacuacagagagugggcuggugcuuuagucaaag

SEQ ID NO: 69844 - RNA, 46 nt, Mus musculus
cuuuaaaaauugaguaugaauguaaacuugaugcucuagcaaaaga

SEQ ID NO: 69845 - RNA, 46 nt, Mus musculus
ugcuauugucugugugcagcaagaaaaggaucagaaguuguuagag

SEQ ID NO: 69846 - RNA, 46 nt, Mus musculus
aacaugagauauaaguuagagguugaacuugcacuaaaggaagcag

SEQ ID NO: 69847 - RNA, 45 nt, Mus musculus
agaaaaaauaacccaacaagaagagaaguaugaagcacuuaugca

SEQ ID NO: 69848 - RNA, 46 nt, Mus musculus
uuuugaaaaaaacaaagcgguucaaacugcacuagaugaauuuaaa

SEQ ID NO: 69849 - RNA, 45 nt, Mus musculus
aucuuuagugauaagcuaaaaaguacaaugcagcagcaagagcgg

SEQ ID NO: 69850 - RNA, 44 nt, Mus musculus
uagaggaaaguccaacaucaaugagggacagauuggccaaaaga

SEQ ID NO: 69851 - RNA, 45 nt, Mus musculus
ccuuggauaccccauagaugguccuaggccuuugaauacagagau

SEQ ID NO: 69852 - RNA, 45 nt, Mus musculus
cacaggguucaaaaagggaguaacaacugcaucaaauagggccag

SEQ ID NO: 69853 - RNA, 42 nt, Mus musculus
uguggggagggaguuagggggcgcgcacgugggggcggcugg

SEQ ID NO: 69854 - RNA, 42 nt, Mus musculus
cucaaccacucugcgccgagaggcggggucaugccgggagac

SEQ ID NO: 69855 - RNA, 45 nt, Mus musculus
ugaggcaaagauaagggauaauggggaagggcugggagacagccg

SEQ ID NO: 69856 - RNA, 63 nt, Mus musculus
cugaggauccgagagcuguaacuguugggcaaaggccucuuggcugaucauucgacuccggcc

SEQ ID NO: 69857 - RNA, 49 nt, Mus musculus
ccuccaggcuccugcccccguccagggccgcuagcgcuagggccacauu

SEQ ID NO: 69858 - RNA, 54 nt, Mus musculus
gagggagaggcccuggcugcauccaggcuggcacagcucggcaugcaaagucgu

SEQ ID NO: 69859 - RNA, 52 nt, Mus musculus
ccucuguacggcaagcuuuucagcgccuaccuacgccccccacacaagccuc

SEQ ID NO: 69860 - RNA, 56 nt, Mus musculus
gggaggugcuucgaggcuuguguggggggcguagguaggcgcugaaaagcuugccg

SEQ ID NO: 69861 - RNA, 44 nt, Mus musculus
ggguaggccucugacgccguccugagagcagggcuggguuugag

SEQ ID NO: 69862 - RNA, 41 nt, Mus musculus
agggcaguuauguuucuccaauauuaccucaacgagcaggg

SEQ ID NO: 69863 - RNA, 46 nt, Mus musculus
ugggacaacagacuugcuccgcccauccugcucgguucuccccaga

SEQ ID NO: 69864 - RNA, 41 nt, Mus musculus
gagggcucguuaaucuuuuacgcugcucaugccucggccua

SEQ ID NO: 69865 - RNA, 72 nt, Mus musculus
acgugaaugagucuauacugaugggccucgccuguaaaaggaacaauauuuuucuuucuuuuuuucaugcca

SEQ ID NO: 69866 - RNA, 42 nt, Mus musculus
gggccuccugcgcgccgcggcuccggaacgguuagcggcuag

SEQ ID NO: 69867 - RNA, 42 nt, Mus musculus
ugcaugcuccguccucagcuagaaccgugggacacucggcag

SEQ ID NO: 69868 - RNA, 120 nt, Mus musculus
ggaccaggggagauagcuaggauucugaaagaaccaaguuauacaggauuagcaucguuuuguucuuauuuuguuuucucgaaaauuauuuuucaguuacugguggggcacuuuauaaaa

SEQ ID NO: 69869 - RNA, 48 nt, Mus musculus
uugaggguuuuugguuuuuuuuccccuucuauuuuugcaaucagaagu

SEQ ID NO: 69870 - RNA, 45 nt, Mus musculus
uaggucacugcaguagucuuuuuggcgugggaaaguagcuggcaa

SEQ ID NO: 69871 - RNA, 42 nt, Mus musculus
uuucagauguugaaauuuuuuuuccauagaguaacuggcaag

SEQ ID NO: 69872 - RNA, 46 nt, Mus musculus
aaccuagaaggaguacuuauuggaaagaaagaauucaguggaagug

SEQ ID NO: 69873 - RNA, 42 nt, Mus musculus
augguuccucuuauuucuguacuaagggggcugaggcaggag

SEQ ID NO: 69874 - RNA, 44 nt, Mus musculus
uugugagccaccaugugguugcugagaauugaacucaggaagag

SEQ ID NO: 69875 - RNA, 46 nt, Mus musculus
aaauaaaguguucccugaucuuucucgugugaaguaaaaggacaga

SEQ ID NO: 69876 - RNA, 46 nt, Mus musculus
ucaaaucccagcaaccgcaugguggcucacaaccaucuauaacaag

SEQ ID NO: 69877 - RNA, 64 nt, Mus musculus
uaccagacagaauucccuccugugucacaggccaccauaucagucagagagcacuugguuaacc

SEQ ID NO: 69878 - RNA, 46 nt, Mus musculus
ccuaacacugccacugucugggccaagcauauuaaaaucacugcag

SEQ ID NO: 69879 - RNA, 50 nt, Mus musculus
aucuaaaaagaacaugacuuguagagaucccugagaucuuuguaggggau

SEQ ID NO: 69880 - RNA, 41 nt, Mus musculus
agaaaccuuugaaugcuguaagaguuuaauggggcgauugu

SEQ ID NO: 69881 - RNA, 45 nt, Mus musculus
auucuagcaaagaaucaggcuaugucuugucauguauguucugaa

SEQ ID NO: 69882 - RNA, 46 nt, Mus musculus
uaaaaauaaaaaguagagcaagaagaugugaaaagcuauacuuugg

SEQ ID NO: 69883 - RNA, 45 nt, Mus musculus
gucuaauaaaucuaauguucaccuaauuuucauauuggcugcuaa

SEQ ID NO: 69884 - RNA, 46 nt, Mus musculus
auaaagcaacucuuaguuuauugaucgaguaaugucaggauggcag

SEQ ID NO: 69885 - RNA, 45 nt, Mus musculus
uaugacucauacuugcugucuuuggcaauuguguccuauccccag

SEQ ID NO: 69886 - RNA, 41 nt, Mus musculus
ucaaaucccggcaaccacaugguagcucacaaccacccaua

SEQ ID NO: 69887 - RNA, 46 nt, Mus musculus
agugucucaguccccaguagcaccagaauacagccccaaagcaaaa

SEQ ID NO: 69888 - RNA, 46 nt, Mus musculus
ugcucugcauugugacauaguguaacacaaaucugcauucugacag

SEQ ID NO: 69889 - RNA, 43 nt, Mus musculus
gcuaagcucuagaagcagcuuacauaucuguuagcaaaugagg

SEQ ID NO: 69890 - RNA, 45 nt, Mus musculus
uguuauuugcaggaaaauggauguaagcagacaucaugcuaagca

SEQ ID NO: 69891 - RNA, 40 nt, Mus musculus
uuuuuuuaaagacaugaacguaaaaaguggaauacuaggg

SEQ ID NO: 69892 - RNA, 45 nt, Mus musculus
cauagaaacuacagcauauuauaaauacagguugugugagcacca

SEQ ID NO: 69893 - RNA, 46 nt, Mus musculus
gaaagaaccaaaacacugcuacuuuuguauagcuucuugcugacag

SEQ ID NO: 69894 - RNA, 48 nt, Mus musculus
uguuaucaaaaacugauguucuuuuuaaaguuuuaauauuuacuuauu

SEQ ID NO: 69895 - RNA, 102 nt, Mus musculus
ggcauugguucucuccuaccauauguguugugcacauugaacucaaauugucaggcuuggcagcaacugacuuuaccugcugagccagcuauccaguccaaa

SEQ ID NO: 69896 - RNA, 46 nt, Mus musculus
ggggaggaacuugauaugacuuguuugcuuacagaaaaagcuccag

SEQ ID NO: 69897 - RNA, 48 nt, Mus musculus
augguagcacauuccuguaaucccaacaugugggaaacucaagacaac

SEQ ID NO: 69898 - RNA, 46 nt, Mus musculus
ucugucucaaucuuucuuuucuccccuaaauuaugaaauugccaag

SEQ ID NO: 69899 - RNA, 46 nt, Mus musculus
ugauaccaauacguaauagugguaagaugaggaaagcauugcccag

SEQ ID NO: 69900 - RNA, 46 nt, Mus musculus
ugucaccacgcccagcuuccuuuaucuuuugaacuuuuaccuccaa

SEQ ID NO: 69901 - RNA, 49 nt, Mus musculus
uaugauagauuuccuuaauguguccaucuguuugaaucuucugggugau

SEQ ID NO: 69902 - RNA, 61 nt, Mus musculus
ggauugucugcaugaaauucagcuguguggacuagaggaauuuaguguugucaaguguagu

SEQ ID NO: 69903 - RNA, 46 nt, Mus musculus
acaagacuaaggguggaucagcacaugaagaaccaacacagccagg

SEQ ID NO: 69904 - RNA, 55 nt, Mus musculus
accucaggauucaaaauccacacccacacuaaucuuaacaccccccccccuuuuu

SEQ ID NO: 69905 - RNA, 49 nt, Mus musculus
ggugauugugaguugcugugugugugcugggaauugaacccagguccuc

SEQ ID NO: 69906 - RNA, 45 nt, Mus musculus
cuuuuucucccauuaucagcauuaacaauuuguaaaguagcccau

SEQ ID NO: 69907 - RNA, 46 nt, Mus musculus
aaagcccgaaaugcuuaucucaauaauuccaacuaugaagaaggag

SEQ ID NO: 69908 - RNA, 41 nt, Mus musculus
ggagagagagggugagcacaggcugugaguaggaaggaaga

SEQ ID NO: 69909 - RNA, 45 nt, Mus musculus
aauuauagaauacuuguaggagggggcugcaguugggauguaaag

SEQ ID NO: 69910 - RNA, 25 nt, Mus musculus
aggguauuaaauacucauaaaaaug

SEQ ID NO: 69911 - RNA, 46 nt, Mus musculus
gcuaugucacgucucaaacugucauauuccauucugaugaccccac

SEQ ID NO: 69912 - RNA, 46 nt, Mus musculus
uggcucacaaccauucuuaauaagaucugacgcccucuucuggugu

SEQ ID NO: 69913 - RNA, 100 nt, Mus musculus
agaucgaaacucaaugcuacgcuugaccagcauuggcucugaugaggacgaagagacagaaacguaccaggagaaggugcacaugacuuggaccaaggau

SEQ ID NO: 69914 - RNA, 36 nt, Mus musculus
cuaucaucuccauggacgaugagucuuagggaaguc

SEQ ID NO: 69915 - RNA, 42 nt, Mus musculus
ucuucuguugagggauuauuuguuucugcugggauggcagau

SEQ ID NO: 69916 - RNA, 58 nt, Mus musculus
gcagaaacaaauaaucccucaacagaagaauggucaaguccuaaaagcuauuucuaug

SEQ ID NO: 69917 - RNA, 46 nt, Mus musculus
agguaaugaguuaguaaaacauaugcuagaaauguaacuggcaaca

SEQ ID NO: 69918 - RNA, 42 nt, Mus musculus
cagaagacacgggucagugagcaccagaaaguuaacaggcag

SEQ ID NO: 69919 - RNA, 45 nt, Mus musculus
aggugcuugugucaggccacugcaaaccugucugccaguguaggc

SEQ ID NO: 69920 - RNA, 46 nt, Mus musculus
agaguggcacaauuuacugucagugaaaggaaauguaaaagcagcc

SEQ ID NO: 69921 - RNA, 46 nt, Mus musculus
aaaggaaaacaugcuggauccuuugcuacucaagugggccugggag

SEQ ID NO: 69922 - RNA, 45 nt, Mus musculus
guaaaagccagccugcccaggaacugccuaacacauccaccccug

SEQ ID NO: 69923 - RNA, 45 nt, Mus musculus
ugcucaguagcagcuucuccuuucaauaaauuaaacgguugagaa

SEQ ID NO: 69924 - RNA, 43 nt, Mus musculus
uuauuuauguucccagcacagagcaaaacaaacaaaaccagac

SEQ ID NO: 69925 - RNA, 46 nt, Mus musculus
cauaaguugugcuguaguuucuuuucugcuguaacaugcugcacac

SEQ ID NO: 69926 - RNA, 49 nt, Mus musculus
gguccauaugcauggugcuuucugggggucacagaaguaagccuccucc

SEQ ID NO: 69927 - RNA, 45 nt, Mus musculus
agaauggaguucaguggaggaggcuuacuucugugacccccagaa

SEQ ID NO: 69928 - RNA, 56 nt, Mus musculus
uggcugaaauggccauaagugcuugaaugggucgccaggccaucauacacaccauc

SEQ ID NO: 69929 - RNA, 45 nt, Mus musculus
caaaucccagaaagcacaugguggcucacaaccacccauauugag

SEQ ID NO: 69930 - RNA, 41 nt, Mus musculus
caauguugcugccuucagacacaccagaagagggcgucaga

SEQ ID NO: 69931 - RNA, 45 nt, Mus musculus
ggcacauggaaaggcuugacucuguaauauuagagagaccccaaa

SEQ ID NO: 69932 - RNA, 46 nt, Mus musculus
uacuuggacaagcaagugccugauaccagcgugcaagagaccgacc

SEQ ID NO: 69933 - RNA, 45 nt, Mus musculus
agagggagucucccuguccacugccccggucacuucggccccuaa

SEQ ID NO: 69934 - RNA, 46 nt, Mus musculus
augugcaguguguguguguguguguguguguguguguguguuuaca

SEQ ID NO: 69935 - RNA, 41 nt, Mus musculus
uaaggaaagaaaagaaaagaaaagaaaagaggaaaggggga

SEQ ID NO: 69936 - RNA, 46 nt, Mus musculus
ggccgucaagaaauucauguuuaggaugaugaagaaauaccuugag

SEQ ID NO: 69937 - RNA, 46 nt, Mus musculus
aaaugaaaaugaauauucaucuucuccugaacgauuuuaacagcag

SEQ ID NO: 69938 - RNA, 45 nt, Mus musculus
gaugucgacuccacccgaagauaaauaaaugacaguagguuugau

SEQ ID NO: 69939 - RNA, 45 nt, Mus musculus
uauuuaucuucggguggagucgacaucugcacccuacggggaaag

SEQ ID NO: 69940 - RNA, 45 nt, Mus musculus
aaggaaaugccucagccgggccuaggcugcucuggggaaaaccug

SEQ ID NO: 69941 - RNA, 45 nt, Mus musculus
uugcagucaaugauucuuaugcggcuaugucaaguuucuguccuu

SEQ ID NO: 69942 - RNA, 45 nt, Mus musculus
ggcuucuaaagucccuugaaaacagcuauaucaauuucuuggcag

SEQ ID NO: 69943 - RNA, 46 nt, Mus musculus
uggaagagauaauucuauaauuauugccgauuucguacuuaacgag

SEQ ID NO: 69944 - RNA, 45 nt, Mus musculus
ggcucagccguuaaaggcuaggcucacaaccaaaaauauaugaga

SEQ ID NO: 69945 - RNA, 46 nt, Mus musculus
agcagauuuacccaguccagaucaucauacaucacugccccaagga

SEQ ID NO: 69946 - RNA, 23 nt, Mus musculus
cuuuugaagcuuuuuaaaggcug

SEQ ID NO: 69947 - RNA, 45 nt, Mus musculus
uuuuuugguugcugugacaaauaccugagaagcaauuuaagaaga

SEQ ID NO: 69948 - RNA, 45 nt, Mus musculus
uucauuuaucagccauuugaccauauccaacuuuaagguuaguaa

SEQ ID NO: 69949 - RNA, 46 nt, Mus musculus
agcuccccucccccaaugagccccuuaauugguuauuugguaccaa

SEQ ID NO: 69950 - RNA, 45 nt, Mus musculus
uuaaagcuaugaccagcaaugagguaagaaaguucuaguugcuga

SEQ ID NO: 69951 - RNA, 46 nt, Mus musculus
acuugccuagcaugggcuauuuauuuagcacacauauuacgggugg

SEQ ID NO: 69952 - RNA, 68 nt, Mus musculus
cuggggcaaaaggagugcauauuggauacauuucucaagaggaaguuaaaaaaaaagaaggaagaaag

SEQ ID NO: 69953 - RNA, 46 nt, Mus musculus
uuauguuuucuuuuccacuuuuguuuauuuacuuucauuaguugag

SEQ ID NO: 69954 - RNA, 61 nt, Mus musculus
auucaauccucauaguaagagaggcuuugauaaagcggaaaggaagaaaagaaauauuucc

SEQ ID NO: 69955 - RNA, 42 nt, Mus musculus
ugugugagagagagagagagagacagagacagagagagagag

SEQ ID NO: 69956 - RNA, 45 nt, Mus musculus
agcuguggcccauacuacuacacagugagcaguaagguucccaga

SEQ ID NO: 69957 - RNA, 23 nt, Mus musculus
acagacuuaguuugugccuguug

SEQ ID NO: 69958 - RNA, 75 nt, Mus musculus
auggggcuuuucugacaguagaaaagggaagucagaauggaauuaggaaauauuuugauggaagauucuagaauc

SEQ ID NO: 69959 - RNA, 94 nt, Mus musculus
uuaguggcuuggugaaaggaaaggaagaagaauaaaaauaacuccccaguuucuaguuggagagaauuuugguuguuaguaauucaaguaugau

SEQ ID NO: 69960 - RNA, 85 nt, Mus musculus
gagaucuguuuuagacauguugauuaaaaacuagugguggguguggaaaccaguuugguacagaaaaaguuacaacagagccuag

SEQ ID NO: 69961 - RNA, 48 nt, Mus musculus
aacuucguaucucauauuuaccuacaacuuagagccuauugaucagcc

SEQ ID NO: 69962 - RNA, 46 nt, Mus musculus
uuguaaaauuuuuauuuauuuagugugugugugugugugugugugu

SEQ ID NO: 69963 - RNA, 45 nt, Mus musculus
cuuuccuaacuuuacguggauucugaggcuacaucauggagguag

SEQ ID NO: 69964 - RNA, 46 nt, Mus musculus
uuagguuguguuagcugccacugcugugacauucagaauacccgag

SEQ ID NO: 69965 - RNA, 63 nt, Mus musculus
uuuauauauuuuauuauuauagggcagugauuuuuuuuuaagcuccaauuaaauguauuuaag

SEQ ID NO: 69966 - RNA, 48 nt, Mus musculus; identical to SEQ ID NO: 69961

SEQ ID NO: 69967 - RNA, 46 nt, Mus musculus
ucuugaguacugugauuaaagauacgugccaccacacccugcccag

SEQ ID NO: 69968 - RNA, 46 nt, Mus musculus
ugguguguaacuauauguaccuauuugcuauugucuaaagcaugau

SEQ ID NO: 69969 - RNA, 69 nt, Mus musculus
aggaauuugagauugaauguagcuuugacuuucuggagaaagagaaguauaagugaacuuguagcuuau

SEQ ID NO: 69970 - RNA, 46 nt, Mus musculus
gcuguguagacuuacuuccucugguaaagucuuuacuucaaagcag

SEQ ID NO: 69971 - RNA, 46 nt, Mus musculus
gcagcccuugacugcuuuauuacaccaucugauuuuuagccuggag

SEQ ID NO: 69972 - RNA, 46 nt, Mus musculus
agacagcgcuggauucuaugauuuccaaaaggaggucucuccugag

SEQ ID NO: 69973 - RNA, 46 nt, Mus musculus
aaugaaauccuaacaaucuacuucacauugaaguggaaauaucaag

SEQ ID NO: 69974 - RNA, 45 nt, Mus musculus
auuuuaaaacuuaaagcagugacuacugagacccccagccccccu

SEQ ID NO: 69975 - RNA, 92 nt, Mus musculus
uacuuuauaauuuuuuaguugcacaauaucaaauacuauggaucagauuauugacuaaacaguaucuuuuuaaaaaaaaaucaaaguucaag

SEQ ID NO: 69976 - RNA, 42 nt, Mus musculus
uacucugcccuccguuuccuuuaucccaucccacauugccua

SEQ ID NO: 69977 - RNA, 46 nt, Mus musculus
augguugugagccaccaugugguugcugggauuugaacucucgacc

SEQ ID NO: 69978 - RNA, 45 nt, Mus musculus
gccuccaucuuucuuuaggauugaaauaauccuguccagcauaua

SEQ ID NO: 69979 - RNA, 46 nt, Mus musculus
agaaaugaucuuaaccugaaacaaaugcagccagcccucaaaacag

SEQ ID NO: 69980 - RNA, 44 nt, Mus musculus
ggcaccauaugaguuaggccccgggaagacaaaaauucuagcag

SEQ ID NO: 69981 - RNA, 45 nt, Mus musculus
ucacucauuagcagaucucacucacuaaauaacuuaacucagcca

SEQ ID NO: 69982 - RNA, 41 nt, Mus musculus
ugcagguggaagaagacagcgauucagagaccuauggagaa

SEQ ID NO: 69983 - RNA, 46 nt, Mus musculus
gcucugcaggugagaguuguaguugugugcuuguuguuuagagcug

SEQ ID NO: 69984 - RNA, 45 nt, Mus musculus
cuuuggccaauuauagauuaggaacacuuuuuauucaagguagga

SEQ ID NO: 69985 - RNA, 45 nt, Mus musculus
cuucuuuauauaaauuaauacacuaaauuauggcaauugcuuggg

SEQ ID NO: 69986 - RNA, 45 nt, Mus musculus
uucuuacugagaagguuuguuuaaaguccuggggacgaugaggga

SEQ ID NO: 69987 - RNA, 47 nt, Mus musculus
auagaugaauugcucacaauucacaacugcucauacucacaaaugga

SEQ ID NO: 69988 - RNA, 46 nt, Mus musculus
ugaaguuggucuugauucacagagagccuccugccccugccuccag

SEQ ID NO: 69989 - RNA, 46 nt, Mus musculus
aaauauaguaugacaacacucaaaaucuugagcugugcacccagag

SEQ ID NO: 69990 - RNA, 46 nt, Mus musculus
aguggaaagagaggcccauuggucgugcaaacuuuacaugccccag

SEQ ID NO: 69991 - RNA, 46 nt, Mus musculus
uuuguggaaggauuuucuggucugcauuguccuuggaagcuagaag

SEQ ID NO: 69992 - RNA, 42 nt, Mus musculus
aauuacuccuccccauggacagcagugcgcccuggcaggaag

SEQ ID NO: 69993 - RNA, 46 nt, Mus musculus
guuuuaaaacuaugugaaauucugaucaccuguauauaaaguauag

SEQ ID NO: 69994 - RNA, 46 nt, Mus musculus
cccucuugcaagguucucauaaaucauagauaacacacugccaagg

SEQ ID NO: 69995 - RNA, 48 nt, Mus musculus
uuauacacuuaaguauguuauacacacuuaaagaaggcccagaaagua

SEQ ID NO: 69996 - RNA, 51 nt, Mus musculus
ucuuucuaaguggucuguaguuauccuuaucauuuauaacauagagccagu

SEQ ID NO: 69997 - RNA, 46 nt, Mus musculus
uuauaaacauucauucuucuaauuuagaagacaguuccaaccccag

SEQ ID NO: 69998 - RNA, 80 nt, Mus musculus
ggacucgauaccacuuacauuuaaggugggucuuccuaccccaguuaaccuaauuuagaugauuccuuauguacacacuc

SEQ ID NO: 69999 - RNA, 45 nt, Mus musculus
uaaagucaucguaaguagaaacaaccauaauuaugaggguaugca

SEQ ID NO: 70000 - RNA, 41 nt, Mus musculus
uucucuugggggccucuucauggucugagauuuaugcacaa

SEQ ID NO: 70001 - RNA, 23 nt, Mus musculus
gagccccagggaggggagggaga

SEQ ID NO: 70002 - RNA, 25 nt, Mus musculus
ggaggggagugguucuggggaguua

SEQ ID NO: 70003 - RNA, 67 nt, Mus musculus
gacuuagacugacccugcucagucuucuaaguagcugagcccacaggugcaugccaucagcccuagg

SEQ ID NO: 70004 - RNA, 81 nt, Mus musculus
acaaaggaacucuccagagcacuaauuuccaggugaugcagaggggagaaaugagcagcgagggugcagaaacgcaguggg

SEQ ID NO: 70005 - RNA, 93 nt, Mus musculus
ggaaaagccaggagcucugggaacagcaguguugaaugcaauggagaagucaagucccgagaauauuuuugagggguuggggcuagaacccag

SEQ ID NO: 70006 - RNA, 59 nt, Mus musculus
agcugugggggccacagcugcaauguaaacgguuaaggguacaugaggagaagauucgg

SEQ ID NO: 70007 - RNA, 61 nt, Mus musculus
uguguaggugugguuuauuguaugagaaauuuguuagagaggaugcagagauguuugggga

SEQ ID NO: 70008 - RNA, 55 nt, Mus musculus
ugugagcucacuggcaggcgagcuagaagaaaagggcuuggcauggcagcucgga

SEQ ID NO: 70009 - RNA, 46 nt, Mus musculus
uauggcacauguaaagugccccaaaugcuccaucccgacaggugag

SEQ ID NO: 70010 - RNA, 45 nt, Mus musculus
caugcauggggauuauuugggauucacggaggcaggugccaugag

SEQ ID NO: 70011 - RNA, 42 nt, Mus musculus
aucagcugcuggcccuuuacagcuguugcuagaagcauggag

SEQ ID NO: 70012 - RNA, 45 nt, Mus musculus
gagguucugaaaauauugauaaccaggcucacuccauauguguua

SEQ ID NO: 70013 - RNA, 42 nt, Mus musculus
accaaccaaccaaacaaacaaacaaaaaaccccacagggcag

SEQ ID NO: 70014 - RNA, 47 nt, Mus musculus
acauuacuauaccuugguaacuagaaguugacauaaagguuaggcag

SEQ ID NO: 70015 - RNA, 46 nt, Mus musculus
uagcugagagcuuacauccugaucuguaggccaagagagaagagag

SEQ ID NO: 70016 - RNA, 46 nt, Mus musculus
ggcuagaucuauuuuaggcuuagaacuacuacuguccugcaggaac

SEQ ID NO: 70017 - RNA, 42 nt, Mus musculus
auuaucuaguguuugcauuuacugaauaagaaugaugaagag

SEQ ID NO: 70018 - RNA, 45 nt, Mus musculus
uuugaagggcaucagauuuguccaguuagaaucaccuuauuugua

SEQ ID NO: 70019 - RNA, 46 nt, Mus musculus
gacaacuggcucucugaaguuaauaauauuaaauccuaauuuucag

SEQ ID NO: 70020 - RNA, 45 nt, Mus musculus
uugcuaucuugauauuuccuaaaauguuauuugcaacaucuaaaa

SEQ ID NO: 70021 - RNA, 46 nt, Mus musculus
aacacacacauaucuauuaaaguauucacuuauuagacugaaagag

SEQ ID NO: 70022 - RNA, 46 nt, Mus musculus
guuauaacucccuuuaacaacugguccauugcuugcuaucuuacag

SEQ ID NO: 70023 - RNA, 46 nt, Mus musculus
gacuuucccugccuguaggagcucacucacacucauugaguuggau

SEQ ID NO: 70024 - RNA, 46 nt, Mus musculus
uagauuuugauauucuaauguagagcacuggaaaauggggccagag

SEQ ID NO: 70025 - RNA, 46 nt, Mus musculus
cugcccuagaaagcuucgccacuccucccucccccaagaaacccua

SEQ ID NO: 70026 - RNA, 46 nt, Mus musculus
cuuugauuuauuuauucaguguauucauuuuugugugugguguaug

SEQ ID NO: 70027 - RNA, 43 nt, Mus musculus
augaggacuauuuaaauuuaauucuuguuaauuauguguguga

SEQ ID NO: 70028 - RNA, 42 nt, Mus musculus
ucugcugaguuuaaaauucagguaggagauaaaaagggagag

SEQ ID NO: 70029 - RNA, 45 nt, Mus musculus
aaaccccccuaucuccuccccgcucccacugcucaccaacccacc

SEQ ID NO: 70030 - RNA, 46 nt, Mus musculus
caaaaaaugugguucauuuacacaauggaguacuaugcagguauua

SEQ ID NO: 70031 - RNA, 49 nt, Mus musculus
aaagcaccuaccccaacacagucaguggcagaccaccuggaagaagaac

SEQ ID NO: 70032 - RNA, 45 nt, Mus musculus
gugcgccaccaugccuggcucacuuuucuuuucauuguggaaaac

SEQ ID NO: 70033 - RNA, 46 nt, Mus musculus
cauagggcuugugggcucaaccucuguaucuugacugagaacccca

SEQ ID NO: 70034 - RNA, 45 nt, Mus musculus
agauggguaucaaucagaauuaauaaaguuuaaugaagagaggag

SEQ ID NO: 70035 - RNA, 42 nt, Mus musculus
ucccaaggguacgguggaucaaaguaagucaucucacaguag

SEQ ID NO: 70036 - RNA, 65 nt, Mus musculus
gcuucaaucauuuuaaaacaaagaaggauuauauaggcuaugauggaauuugcuuuggauaaggg

SEQ ID NO: 70037 - RNA, 48 nt, Mus musculus
uuugagagacuuaugauguguguauauaagcaaauagcagauaaugau

SEQ ID NO: 70038 - RNA, 88 nt, Mus musculus
uucucuauuuuacauggcagccucugaguugggcaaagaagaaucaggcccuugcauguugcuagagacuuuugucaggucagaggga

SEQ ID NO: 70039 - RNA, 46 nt, Mus musculus
augguuauuuaauguaauuaggaauucaaaguccuucgguuacugu

SEQ ID NO: 70040 - RNA, 82 nt, Mus musculus
acaaguugcaaucuccaucuuaccuauuaaaauaaugccagaaaccaaauaugaaucuuauggccuucaauuugugcuuggc

SEQ ID NO: 70041 - RNA, 46 nt, Mus musculus
ggauugccucaaaacuaacuucuuugaaacuaucagcagccuaagu

SEQ ID NO: 70042 - RNA, 47 nt, Mus musculus
cuaaaaauaaaaaauaauaaucaaaaaacaguuuggcagccacagua

SEQ ID NO: 70043 - RNA, 54 nt, Mus musculus
cacaaaugcaaaugcagacuuuggaggguagugaagagagaaaaauaagagagg

SEQ ID NO: 70044 - RNA, 44 nt, Mus musculus
uggaaggcagacauucacugcccaucaaagauaccacagucaaa

SEQ ID NO: 70045 - RNA, 46 nt, Mus musculus
gcaauacuccuuaagacugagauucuagcuauaaaugccccaaaua

SEQ ID NO: 70046 - RNA, 42 nt, Mus musculus
cuccccaaaugucuacuuagcauuuaugucagggccagagug

SEQ ID NO: 70047 - RNA, 49 nt, Mus musculus
guguuugccucacuucauuugcucucagagggucaauaggaaaguucca

SEQ ID NO: 70048 - RNA, 97 nt, Mus musculus
aguuagacaugucuggggccuuuucuguuuggcuuuuguuauaggagagaaucagaggagagggagggagagagagagggagagggagagggagagg

SEQ ID NO: 70049 - RNA, 54 nt, Mus musculus
gcuggauuaacauugcuuguccgucauuucugaaaaaugcuuuagacguacaga

SEQ ID NO: 70050 - RNA, 46 nt, Mus musculus
uguuuuaagaaccaagugaaauuaaaaaagaaaauguggccuccua

SEQ ID NO: 70051 - RNA, 61 nt, Mus musculus
gcaaaaggguuuuccugauauuuaaaagaacccagacacacagaggaaaaauauaaucagc

SEQ ID NO: 70052 - RNA, 50 nt, Mus musculus
ggcugaggaccagucugggccagugaaauucaguagugagaugucuagag

SEQ ID NO: 70053 - RNA, 46 nt, Mus musculus
gcucccauagcccaucccuuucuuugcucucccugacaucucaguc

SEQ ID NO: 70054 - RNA, 52 nt, Mus musculus
gcaccaggauuucacuugagaaugaauacuaaugggggagguaacucugagg

SEQ ID NO: 70055 - RNA, 98 nt, Mus musculus
gggcacauucagccugucauagccaugcugagagagccacacccaaaccacccgauuccuacuuggcuuaaaccuagaggccagaagaaccagcaguu

SEQ ID NO: 70056 - RNA, 64 nt, Mus musculus
cccaagaaguucaccaccaugauggucacacucaacuguccugagcuacagccacccaccaaga

SEQ ID NO: 70057 - RNA, 54 nt, Mus musculus
cuaucaucaaccgcuucuguuauggccagugcaacuccuucuacauccccaggc

SEQ ID NO: 70058 - RNA, 58 nt, Mus musculus
ggagaggaggugcuugaguccagccaagaggcccugcacgugacagagcgcaaguauc

SEQ ID NO: 70059 - RNA, 45 nt, Mus musculus
gagcguugcuucuccuccuggggacccuacugccaacagcugagg

SEQ ID NO: 70060 - RNA, 38 nt, Mus musculus
aggacuguuuggggaaaugacacaguaaagcagcaggg

SEQ ID NO: 70061 - RNA, 69 nt, Mus musculus
gcucgagccgcggucucacgcagcgccacucguccacagcgaagaaccugaggacccacggaagugaca

SEQ ID NO: 70062 - RNA, 46 nt, Mus musculus
gcucaagguaaccucacacccaguccagcggaugccagccugaguc

SEQ ID NO: 70063 - RNA, 44 nt, Mus musculus
auucgggacaucaucaauaggcgcugugggaauaauccacugau

SEQ ID NO: 70064 - RNA, 43 nt, Mus musculus
gaguauuuugccaaugcuccucagcccaucuuuaaaggcagau

SEQ ID NO: 70065 - RNA, 78 nt, Mus musculus
agaagaagucaaacgguuacaaaagagucuggggguucccggagaugcuucguauaccugugaaacugccggcuauuu

SEQ ID NO: 70066 - RNA, 46 nt, Mus musculus
aguuuuagaaggagaacaaaauacucacaggagcaaauauggagau

SEQ ID NO: 70067 - RNA, 46 nt, Mus musculus
agcaugcuguggcaacaaaugcugccugcucacuguagagagagcu

SEQ ID NO: 70068 - RNA, 46 nt, Mus musculus
guaauuuccuuacuuaguagauuggguguuccucugacacagagau

SEQ ID NO: 70069 - RNA, 47 nt, Mus musculus
cauguuauuccuaauagaggcccuuauccuuacaaccagcccaaacg

SEQ ID NO: 70070 - RNA, 48 nt, Mus musculus
ucccaguaagaaguggaaaggggaagaaaagaaaagaugcagacgggg

SEQ ID NO: 70071 - RNA, 46 nt, Mus musculus
agaggccacccuguucuuuagauaagacuuuacacugucccucuaa

SEQ ID NO: 70072 - RNA, 41 nt, Mus musculus
agagaugaacuuggagcagacauccauuuuaaggggugaga

SEQ ID NO: 70073 - RNA, 46 nt, Mus musculus
ggagccgaagauguguaugacacuuucaaugucauaaugaggagga

SEQ ID NO: 70074 - RNA, 46 nt, Mus musculus
caugugcaguguaccuacaccuuagguuugacuccccagcacugaa

SEQ ID NO: 70075 - RNA, 41 nt, Mus musculus
gaguucgugcagaugucaccaucaaucugaaugucagagac

SEQ ID NO: 70076 - RNA, 42 nt, Mus musculus
auaggagcuguccaaggguaaagugauuagagcggaggaagu

SEQ ID NO: 70077 - RNA, 46 nt, Mus musculus
ugaagaguuucuuuaagaaaaucccuuuguucuaacugugguagau

SEQ ID NO: 70078 - RNA, 37 nt, Mus musculus
acuguucuguguucuguggacuuagaagcuagaaaag

SEQ ID NO: 70079 - RNA, 45 nt, Mus musculus
uugguuaauaccuuguuguuggguguuuuuuuuuuuuaugauuua

SEQ ID NO: 70080 - RNA, 46 nt, Mus musculus
ugguuagagaccgauacuuccgcuguuuuaguaaaaggagacagau

SEQ ID NO: 70081 - RNA, 45 nt, Mus musculus
guucuucucuuccagguauccuuggugaaauuuacaaggcaggag

SEQ ID NO: 70082 - RNA, 86 nt, Mus musculus
uuuuagacaugcugaaguucuauacuggcuuugagauuaacgaccagacuggaaaugcucugacagagaacgagaugaccacgauu

SEQ ID NO: 70083 - RNA, 46 nt, Mus musculus
uguauacaguugaacaaggagacagguuaugguguauaauugaauc

SEQ ID NO: 70084 - RNA, 46 nt, Mus musculus
ugcuuccuuuuauguagugcugaauccaaauaaguuaccagcagac

SEQ ID NO: 70085 - RNA, 46 nt, Mus musculus
augaugaaaagauggacccagaagcaagagagcaguaugugggcca

SEQ ID NO: 70086 - RNA, 46 nt, Mus musculus
uaauguacuuaauuuuaguacuguaaggugaaaugaggggcuaaua

SEQ ID NO: 70087 - RNA, 46 nt, Mus musculus
gcagcagcuuaucucgcucccgauguggaugggcuugcagccugug

SEQ ID NO: 70088 - RNA, 45 nt, Mus musculus
uugauuccuccucuguuacugaacuuaaaaaaugaaaaugagagg

SEQ ID NO: 70089 - RNA, 46 nt, Mus musculus
uuaccaaauguaggcaacuaaaaauaauaggugacggugccauuua

SEQ ID NO: 70090 - RNA, 52 nt, Mus musculus
uaguuggugcagguaacugaaauuacagaaagcaaaauuauggauaaagugc

SEQ ID NO: 70091 - RNA, 46 nt, Mus musculus
cuuuccuauaagcauuagaauuaaguucuauguaaguugggcagcg

SEQ ID NO: 70092 - RNA, 46 nt, Mus musculus
agguaauaugugagccuugacgggugcuuauacuguacuugcagau

SEQ ID NO: 70093 - RNA, 33 nt, Mus musculus
gaagaacccucuuacucaugggcagggccagau

SEQ ID NO: 70094 - RNA, 45 nt, Mus musculus
gagaguucugugacagugugcgcuuggugaaacuauuuaggagau

SEQ ID NO: 70095 - RNA, 46 nt, Mus musculus
agauauagauagauagauagauagauagauagauagauaggugaua

SEQ ID NO: 70096 - RNA, 46 nt, Mus musculus
uauacuuuuggcaacagguaauugaagaaauauaugaaaaagagau

SEQ ID NO: 70097 - RNA, 46 nt, Mus musculus
ugggguggggugguaugugcuggugagugcaguuaucuguggagga

SEQ ID NO: 70098 - RNA, 46 nt, Mus musculus
gcuucugaauuguauuacucugacaagacucugucuacaaguagau

SEQ ID NO: 70099 - RNA, 46 nt, Mus musculus
cagcccaagaaaaucguggcccccacggugucccagaucaacgcgg

SEQ ID NO: 70100 - RNA, 43 nt, Mus musculus
acaugagaggguguuggguuuugucaaaggcuuuuccagcauc

SEQ ID NO: 70101 - RNA, 45 nt, Mus musculus
gauggugucuuagucaggguuucuauuccugcacaaacaccauga

SEQ ID NO: 70102 - RNA, 46 nt, Mus musculus
aauguugugcuuguaugaccaugagucuuugccugagugauaagau

SEQ ID NO: 70103 - RNA, 46 nt, Mus musculus
uguuggaaguaugggugauggaguaauuguaaguuuugaucauggu

SEQ ID NO: 70104 - RNA, 42 nt, Mus musculus
uuaaaagcuaggaauccaucauguccaauuuggccucaugug

SEQ ID NO: 70105 - RNA, 46 nt, Mus musculus
gugacuucauaggcaauugcuugccaugcauaaucaggaguaagau

SEQ ID NO: 70106 - RNA, 46 nt, Mus musculus
uuugagugcucagucugugguaaaacauuuagacaagcaccucauu

SEQ ID NO: 70107 - RNA, 56 nt, Mus musculus
uguccugugcaguaaaucuuuccgacagucaacccacuuaaaaauccaccaacuca

SEQ ID NO: 70108 - RNA, 46 nt, Mus musculus
acuacacccaugcucuaagucugaugccacauacagcaccacgaag

SEQ ID NO: 70109 - RNA, 59 nt, Mus musculus
uugagaccaagcaagagaagccgguauauggaauguguaauacuuuuacugcagaugag

SEQ ID NO: 70110 - RNA, 42 nt, Mus musculus
ucacaaucugccuuucaguuguaauauuugccaacgccacuu

SEQ ID NO: 70111 - RNA, 82 nt, Mus musculus
uguggaacuuaagaaugccauggaacucaucaggauaugccacugaggaaugugauggcugaaaacaacuuuaaaaugcuga

SEQ ID NO: 70112 - RNA, 41 nt, Mus musculus
cauucauuugcacagcauugcucccaguuuaaagaaucuca

SEQ ID NO: 70113 - RNA, 42 nt, Mus musculus
uguacuuguuuuugucaggaagucuucaacaaagcagaaggg

SEQ ID NO: 70114 - RNA, 46 nt, Mus musculus
guuguuuauaaucauauaguugccuuguguuguuuuagugcgagac

SEQ ID NO: 70115 - RNA, 46 nt, Mus musculus
gugcguauccaauccuaauacuagugauagcuacuugaccgcagac

SEQ ID NO: 70116 - RNA, 25 nt, Mus musculus
aucauguuauaaugucuggauaguc

SEQ ID NO: 70117 - RNA, 47 nt, Mus musculus
aaaaaaagaaagaaagaggcgaagacuguuguaaauguuaccauaga

SEQ ID NO: 70118 - RNA, 42 nt, Mus musculus
auccugcuuucucccuccagauugagcccaggaccccuagac

SEQ ID NO: 70119 - RNA, 46 nt, Mus musculus
agucuagggguccugggcucaaucuggagggagaaagcaggaugag

SEQ ID NO: 70120 - RNA, 46 nt, Mus musculus
guuguuugguguuuguuguuuaccgauguagacaagugugugugug

SEQ ID NO: 70121 - RNA, 42 nt, Mus musculus
ucuuccuuuuccaggggcagccuuaguucucauggcccugaa

SEQ ID NO: 70122 - RNA, 76 nt, Mus musculus; identical to SEQ ID NO: 33033

SEQ ID NO: 70123 - RNA, 41 nt, Mus musculus; identical to SEQ ID NO: 33034

SEQ ID NO: 70124 - RNA, 43 nt, Mus musculus; identical to SEQ ID NO: 33035

SEQ ID NO: 70125 - RNA, 46 nt, Mus musculus; identical to SEQ ID NO: 33037

SEQ ID NO: 70126 - RNA, 46 nt, Mus musculus
cggcaggccgaagucggggcguggaucuucaugagcagucccagca

SEQ ID NO: 70127 - RNA, 58 nt, Mus musculus
gggaacaaagcugaccuugccaacaagcgcaugguggaguaugaagaggcucaggcau

SEQ ID NO: 70128 - RNA, 45 nt, Mus musculus; identical to SEQ ID NO: 33042

SEQ ID NO: 70129 - RNA, 32 nt, Mus musculus; identical to SEQ ID NO: 33045

SEQ ID NO: 70130 - RNA, 46 nt, Mus musculus
caauuggaauugacuuuuaagcaccaauacuuuuaacuguccagau

SEQ ID NO: 70131 - RNA, 47 nt, Mus musculus
ucugagacuugguucuugaauuucccucuguggccaagaaugguggu

SEQ ID NO: 70132 - RNA, 58 nt, Mus musculus
aguugauuuuauagugcuuucuuuccucuaggaguuaagucugucucuuccccagcag

SEQ ID NO: 70133 - RNA, 42 nt, Mus musculus
cacucgaagcuuguuuguccuuguguagauuuuuggguucag

SEQ ID NO: 70134 - RNA, 46 nt, Mus musculus
ggaaugacgggaacuuuuauuaguaucuugcaauaaagcagcuggg

SEQ ID NO: 70135 - RNA, 46 nt, Mus musculus
aaaaauguaaaaggcaucuugacagugauaagucaaaugagggaaa

SEQ ID NO: 70136 - RNA, 46 nt, Mus musculus
gaucauuuagcuuuguuagaaaauaggcucaaaauuacgggaaaau

SEQ ID NO: 70137 - RNA, 46 nt, Mus musculus
cucugucuccaaaaaagcaaaauagauauuuuuaaaugacuuugag

SEQ ID NO: 70138 - RNA, 45 nt, Mus musculus
uuccaaagaauacaaauuucuuuuaaugauaauucaaagccuuag

SEQ ID NO: 70139 - RNA, 66 nt, Mus musculus
ucagucuucugacguccaucagugcuagcacuuaaguauaccuguagauaaaaugcucauauauuu

SEQ ID NO: 70140 - RNA, 45 nt, Mus musculus
uugcuuugugaucucuauuaaaggaauauauuuacuuauguguug

SEQ ID NO: 70141 - RNA, 48 nt, Mus musculus
cccauuacagaugguuaugagccaucaggugcuugcuggaaauugaac

SEQ ID NO: 70142 - RNA, 84 nt, Mus musculus
uugacaugggugcuagugaucaaacaccaaccuccucccagaacaagugcucugcaucacagagccauuucuccagcaccaaau

SEQ ID NO: 70143 - RNA, 47 nt, Mus musculus
uuacuaguuuuuaaaaguaauuauuucaaaagugauaaugcuaacgu

SEQ ID NO: 70144 - RNA, 45 nt, Mus musculus
uacucauuuguggcauuggaaugacagacugguaguagcagccag

SEQ ID NO: 70145 - RNA, 45 nt, Mus musculus
uggcuuuuggaguaagguucaugguaguauuuaguuuacacuaca

SEQ ID NO: 70146 - RNA, 45 nt, Mus musculus
caaaaaguaugcauaaagcuuaaucguuaguaauaacgaaaacag

SEQ ID NO: 70147 - RNA, 44 nt, Mus musculus
uuccggaagcagugguuucccugguggugaagcuccgcggggaa

SEQ ID NO: 70148 - RNA, 46 nt, Mus musculus
agaauaagucauauucuguuccugagaauaaaaguagaaugaacag

SEQ ID NO: 70149 - RNA, 46 nt, Mus musculus
auuuuuuuaucagcauauuuuucuuauguagacuuguuuucuggau

SEQ ID NO: 70150 - RNA, 46 nt, Mus musculus
cuguggugagaggggcaugucaugaaacaaagcugcucacuucuug

SEQ ID NO: 70151 - RNA, 42 nt, Mus musculus
gcuguaggacagugaaaauuaaaucgauuuauauugcauuua

SEQ ID NO: 70152 - RNA, 46 nt, Mus musculus
uaguacaacaaaguucugagaaagaucucugaaaagcacagaccag

SEQ ID NO: 70153 - RNA, 45 nt, Mus musculus
auauaucugauuaaagagcaguacaggaguguguguugcgggcag

SEQ ID NO: 70154 - RNA, 40 nt, Mus musculus
uagacgcugugcugagugugugugugugugugugugugug

SEQ ID NO: 70155 - RNA, 45 nt, Mus musculus
aucuuacuacacuugcagggaagcaaaaccgcaguaauguuccag

SEQ ID NO: 70156 - RNA, 87 nt, Mus musculus
ccagagaugacucaagugguggauggcuaccacucggagggagcggacugagcagcgucacugucuucagagucccucaucaggaag

SEQ ID NO: 70157 - RNA, 42 nt, Mus musculus
agaaagugaaccugggauucagaagaacgaucuuauuguaau

SEQ ID NO: 70158 - RNA, 46 nt, Mus musculus
auuagaauauagacugagguaaaugacauaauuagaauuaaaacag

SEQ ID NO: 70159 - RNA, 46 nt, Mus musculus
guugcauauaacaaacagcauugucuuaagaaacacuuccacguau

SEQ ID NO: 70160 - RNA, 42 nt, Mus musculus
cucaucuauaauaaggucacucccacauuucaccacuggaag

SEQ ID NO: 70161 - RNA, 46 nt, Mus musculus
auauaucagccaccgaacucauacacuauugcacaaugccagaaag

SEQ ID NO: 70162 - RNA, 46 nt, Mus musculus
uguguuuauaugggugugugugugugugugugugugugugugugug

SEQ ID NO: 70163 - RNA, 58 nt, Mus musculus
uaagacacagccucccucguuaaaauuuaagucaaaacgaagaaaagaggauggggaa

SEQ ID NO: 70164 - RNA, 61 nt, Mus musculus
cguucucgcugcguauacugccaggaaagguuuaaucaugaagaaaacgccagggggaaau

SEQ ID NO: 70165 - RNA, 49 nt, Mus musculus
ucugugcugagagcaugcuauaucauuguaugucagacucagagggaga

SEQ ID NO: 70166 - RNA, 45 nt, Mus musculus
gcuguuggcaagcaauauggaaucuugccgguaucauuggggcca

SEQ ID NO: 70167 - RNA, 45 nt, Mus musculus
uuucagaaggcagucauuucugguuauugauuacaaaaggucaac

SEQ ID NO: 70168 - RNA, 45 nt, Mus musculus
auuugaauucuuuaggacauuaacuaaaaagugcacuaagggaca

SEQ ID NO: 70169 - RNA, 44 nt, Mus musculus
uaguuaacucaucuaguuaauaacguuuguguccaugugagaga

SEQ ID NO: 70170 - RNA, 46 nt, Mus musculus
cucuugggcugcaguuuauauugagucauaucuguacauucuggag

SEQ ID NO: 70171 - RNA, 45 nt, Mus musculus
gaggguuccuuuaguuguuuuguuucugugguauucagccagcaa

SEQ ID NO: 70172 - RNA, 46 nt, Mus musculus
uucugugcuuauuacucacauaacaaugguaauuaauaccuuucag

SEQ ID NO: 70173 - RNA, 45 nt, Mus musculus
augugucacacuucggcuuguguuggcuuucuucuuuugccccag

SEQ ID NO: 70174 - RNA, 44 nt, Mus musculus
ugggcuguucaggguggccagugcccaccagagaaaucgggggu

SEQ ID NO: 70175 - RNA, 46 nt, Mus musculus
gaguguaaguaagucuuuccccaaaugcauaugguugcuggaagaa

SEQ ID NO: 70176 - RNA, 74 nt, Mus musculus
aaauagagggagucaaacagaaaauauuaaaaauaugcgcacacagacaaacagaggugauuuauacaaaccag

SEQ ID NO: 70177 - RNA, 46 nt, Mus musculus
ucuucagccuucggguucacaaacuauaccuccaagacaccccaag

SEQ ID NO: 70178 - RNA, 41 nt, Mus musculus
augaguucaaagaugucaaacacaccguuaucucccccaga

SEQ ID NO: 70179 - RNA, 46 nt, Mus musculus
ggugcacgaaggggccccggucgccgacuggugaagggccaagauc

SEQ ID NO: 70180 - RNA, 50 nt, Mus musculus
ucagguuggcauucucaaugcggaaggcggggcuggauagaucuuggccc

SEQ ID NO: 70181 - RNA, 60 nt, Mus musculus
gcagaugaagaagacccggggcacacuccuggcuguggaacggaaagacaacacuggcca

SEQ ID NO: 70182 - RNA, 45 nt, Mus musculus
ccacugacaccacuuguugcuucccuggcaggcucaggcucaggu

SEQ ID NO: 70183 - RNA, 47 nt, Mus musculus
uguuuguucaagaggaccgggcucaacucuacauagacugugauaag

SEQ ID NO: 70184 - RNA, 46 nt, Mus musculus
uugacaucucccuuugcaacucggagccuggcaacgcuggccagau

SEQ ID NO: 70185 - RNA, 48 nt, Mus musculus
ucaccagggaucuggccagcguugccaggcuccgaguugcaaagggag

SEQ ID NO: 70186 - RNA, 45 nt, Mus musculus
agggggugcugcagaaugugagguuugucuuuggaaccaccccag

SEQ ID NO: 70187 - RNA, 45 nt, Mus musculus
cuggaaccguucaccacguuguugucaaggguaagaaggacguug

SEQ ID NO: 70188 - RNA, 52 nt, Mus musculus
acguggugaacgguuccagcccugcuauccgcaccaacuacaucggccacaa

SEQ ID NO: 70189 - RNA, 46 nt, Mus musculus
gggccugcgcaccaucgugaccacucugcaggacagcauccgaaaa

SEQ ID NO: 70190 - RNA, 45 nt, Mus musculus
cuuuucggaugcuguccugcagaguggucacgauggugcgcaggc

SEQ ID NO: 70191 - RNA, 47 nt, Mus musculus
uuguucuuguacuggacuccauugugaaagcagaggggaggccgcuu

SEQ ID NO: 70192 - RNA, 57 nt, Mus musculus
ugagcugaagcggccuccccucugcuuucacaauggaguccaguacaagaacaacga

SEQ ID NO: 70193 - RNA, 52 nt, Mus musculus
cucgguuaccaucugcaaaaagguguccugucccaucaugcccugcuccaac

SEQ ID NO: 70194 - RNA, 56 nt, Mus musculus
gauggcuggucucccuggucugaguggaccuccugcucugccacauguggcaaugg

SEQ ID NO: 70195 - RNA, 49 nt, Mus musculus
gcagagcaggagguccacucagaccagggagaccagccaucgucagcag

SEQ ID NO: 70196 - RNA, 52 nt, Mus musculus
aauucagcaacguggucguuccugugacagccucaacaacagaugcgagggc

SEQ ID NO: 70197 - RNA, 45 nt, Mus musculus
aucuuuugucacacuccugaauguggcagguccuugucuguaccg

SEQ ID NO: 70198 - RNA, 46 nt, Mus musculus
ggucacagaacaggacgaccauggagaccagugacuccagccacca

SEQ ID NO: 70199 - RNA, 71 nt, Mus musculus
gucacuggucuccauggucguccuguucugugaccuguggugacggugugaucacaaggauccggcucugc

SEQ ID NO: 70200 - RNA, 45 nt, Mus musculus
agggcuucccguucaucugggggcugggggaguugcagagccgga

SEQ ID NO: 70201 - RNA, 80 nt, Mus musculus
aacucccccagcccccagaugaacgggaagcccugugaaggugaagcccgggagaccaaagccugcaagaaagacgccug

SEQ ID NO: 70202 - RNA, 65 nt, Mus musculus
cccuggucaccaugggacaucugcucugucaccuguggaggaggagugcagagacgcagccgacu

SEQ ID NO: 70203 - RNA, 54 nt, Mus musculus
cuguaacaaccccacaccccaguuuggaggcaaagacuguguuggcgaugugac

SEQ ID NO: 70204 - RNA, 45 nt, Mus musculus
uacacuuggcaccagcaaagcagggauuggacaggcauccaucug

SEQ ID NO: 70205 - RNA, 49 nt, Mus musculus
gugcguguccuccuggcuacaguggaaauggcauccagugcaaagacgu

SEQ ID NO: 70206 - RNA, 46 nt, Mus musculus
cucaucgacgucuuugcacuggaugccauuuccacuguagccagga

SEQ ID NO: 70207 - RNA, 88 nt, Mus musculus
caaagaagugccugaugcuugcuucaaucacaacggagaacaucggugcaagaacacagauccuggcuacaacugccugcccugccca

SEQ ID NO: 70208 - RNA, 46 nt, Mus musculus
ugagccagugaaucguggugggcagggcaggcaguuguagccagga

SEQ ID NO: 70209 - RNA, 46 nt, Mus musculus
aaaccgcgaaaccccugcacggacgggacgcaugacugcaacaaga

SEQ ID NO: 70210 - RNA, 46 nt, Mus musculus
cacuguagugacccagguaguugcacuuagcguucuuguugcaguc

SEQ ID NO: 70211 - RNA, 51 nt, Mus musculus
gagugcaagcccggcuaugcaggcaauggcaucaucugcggagaggacaca

SEQ ID NO: 70212 - RNA, 45 nt, Mus musculus
gccguccaggucuguguccucuccgcagaugaugccauugccugc

SEQ ID NO: 70213 - RNA, 91 nt, Mus musculus
cugccccaaccuucccaacucggggcaggaagacuaugacaaggacgggauuggcgaugccugcgaugaugacgaugacaacgacaagauc

SEQ ID NO: 70214 - RNA, 52 nt, Mus musculus
cgccaaucccguccuugucauagucuuccugccccgaguugggaagguuggg

SEQ ID NO: 70215 - RNA, 46 nt, Mus musculus
gaauacucagucaguauauggaccaaguacuagauaacugcaguag

SEQ ID NO: 70216 - RNA, 81 nt, Mus musculus
uguccauuccauuacaacccagcccaguaugacuaugacagagaugaugugggagaccgcugugacaacugccccuacaac

SEQ ID NO: 70217 - RNA, 29 nt, Mus musculus
uggucaggguugugguuguaggggcaguu

SEQ ID NO: 70218 - RNA, 70 nt, Mus musculus
cacaacccugaccaagcagacacagacaaaaacggggagggcgaugccugugcuguggacaucgauggag

SEQ ID NO: 70219 - RNA, 55 nt, Mus musculus
gaacgagacaacugccaguacguuuacaacguggaccagagggacacggacaugg

SEQ ID NO: 70220 - RNA, 47 nt, Mus musculus
acucagagcuggagagaauucugguuucuccuauuccccccaacgga

SEQ ID NO: 70221 - RNA, 46 nt, Mus musculus
uuguugucacaaguguccccuaugaggucugagucagaguccagcu

SEQ ID NO: 70222 - RNA, 45 nt, Mus musculus
gacucugacucagaccucauaggggacacuugugacaacaaucag

SEQ ID NO: 70223 - RNA, 46 nt, Mus musculus
cccugaugacagagacaacugcaggcuggugcccaauccugaccag

SEQ ID NO: 70224 - RNA, 84 nt, Mus musculus
gaggugacgccugcaaagacgacuuugaccaugacaaugugccagauauugaugacaucuguccugagaauuuugacaucagug

SEQ ID NO: 70225 - RNA, 125 nt, Mus musculus
aaaccgauuuccgacaauuccagaugauuccucuagaucccaaaggaaccucccaaaaugacccuaacuggguuguccgccaucagggcaaagaacuuguccagacuguaaacugugacccugga

SEQ ID NO: 70226 - RNA, 45 nt, Mus musculus
augcuguggacuucagcgguaccuucuucaucaacaccgagagag

SEQ ID NO: 70227 - RNA, 47 nt, Mus musculus
ggaaacaagucacccaguccuacugggacaccaaccccacaagggcu

SEQ ID NO: 70228 - RNA, 71 nt, Mus musculus
ccugucuguaaagguugugaacuccaccaccggcccuggcgagcaccugcggaaugcacuguggcacacag

SEQ ID NO: 70229 - RNA, 44 nt, Mus musculus
cugcauacagauggcgucucagccacaggccaaagaccgguuau

SEQ ID NO: 70230 - RNA, 46 nt, Mus musculus
ucauggcugacucgggacccaucuaugacaaaaccuacgccggcgg

SEQ ID NO: 70231 - RNA, 48 nt, Mus musculus
caggccuagucuaccgccggcguagguuuugucauagaugggucccga

SEQ ID NO: 70232 - RNA, 44 nt, Mus musculus
uuuuuagaaggugcauugccagcgcugguuaugauuggcagcug

SEQ ID NO: 70233 - RNA, 77 nt, Mus musculus
aucagcugccaaucauaaccagcgcuggcaaugcaccuucuaaaaacaagggcuagagaaaccccccaccccugccg

SEQ ID NO: 70234 - RNA, 46 nt, Mus musculus
ugaggcaggucucaggcuuuacaaguccacacuaugcaagaagaga

SEQ ID NO: 70235 - RNA, 100 nt, Mus musculus
ggaucgccuuuccucgccuuccuugccucucuucuugcauaguguggacuuguaaagccugagaccugccucaagaaaaugcaguuuucaaacccagagu

SEQ ID NO: 70236 - RNA, 48 nt, Mus musculus
uauuuacuucccacuaggaaggugcccgcuccacucugccuuacucac

SEQ ID NO: 70237 - RNA, 46 nt, Mus musculus
gugugugcugcucagagguggccucgaagaaguucuggcucuguga

SEQ ID NO: 70238 - RNA, 73 nt, Mus musculus
aggcaggagccaaagcucuagggagggcauguacccaagagaugacuguaugaaaauguggaggagcuguucg

SEQ ID NO: 70239 - RNA, 94 nt, Mus musculus
guacuaaaucauuuucaggggacagacagacuugcugcauuucugcaugcugcuggugagagcugauugacccaaucuuccacacaggcacuug

SEQ ID NO: 70240 - RNA, 46 nt, Mus musculus
gccagcauggcccacacuucugaccccuacccuggccacugcaggu

SEQ ID NO: 70241 - RNA, 68 nt, Mus musculus
auucugcauguacaacaugcauauguauaaggacagcuagagaaccuuaccgucucagugagcucuag

SEQ ID NO: 70242 - RNA, 54 nt, Mus musculus
cugccuccgcaggaggggcagugcgccuuuacuuuaugguuagaaaggcacaaa

SEQ ID NO: 70243 - RNA, 46 nt, Mus musculus
aaccaaaagagauuuggaaaaauccaugguaacugagagaaaaagg

SEQ ID NO: 70244 - RNA, 47 nt, Mus musculus
uuuaacaauguaauauauuuauuuuguuccccuauucuggaggguuc

SEQ ID NO: 70245 - RNA, 81 nt, Mus musculus
cuaccuggaauuagacugcauauagcaaauguuugcaagcagguagcugaggcggaucagcaaaucucuccaaaaccagug

SEQ ID NO: 70246 - RNA, 50 nt, Mus musculus
cuuccccuuuguuuucucuguaguuucaaguggaauuagguggcggccgc

SEQ ID NO: 70247 - RNA, 55 nt, Mus musculus
uggaacuucuauacaaauauuaccucauuuguugugugacugaguaaagaauuuu

SEQ ID NO: 70248 - RNA, 99 nt, Mus musculus
gaaagaguuuaagugucaauaaacuuaaaacuacuguugugucuaaaaagucgguguuguacauagcauaaaaauccuuugccgaggaugaucccaaga

SEQ ID NO: 70249 - RNA, 45 nt, Mus musculus
uaacauuacaaagcuguuucuuucuugggaucauccucggcaaag

SEQ ID NO: 70250 - RNA, 57 nt, Mus musculus
ccguugcuuuuauuuuuauaaauuauuuucucguugccauuggaauagagaucucag

SEQ ID NO: 70251 - RNA, 46 nt, Mus musculus
auuuccugauaaauuauuuaaauagcauaucuacauagucugagau

SEQ ID NO: 70252 - RNA, 47 nt, Mus musculus
acugccuguagaguuaguauuucugguuuuuauauguugcacacuga

SEQ ID NO: 70253 - RNA, 66 nt, Mus musculus
uuguuuuuguuuuugcuuuuuacuucccaguuuugacucuuugccaauacccuuuuuccuaggaac

SEQ ID NO: 70254 - RNA, 46 nt, Mus musculus
cuuguauauuacuguuucuuauguacaaggaacaacaauaaaucau

SEQ ID NO: 70255 - RNA, 42 nt, Mus musculus
uaccuucuucuuucacuuucugcugcuauaacaugcuacuac

SEQ ID NO: 70256 - RNA, 46 nt, Mus musculus
aucaagucacuguaggacuggguacauccucucccacuaaggccag

SEQ ID NO: 70257 - RNA, 46 nt, Mus musculus
auuucugccuucagucuuccccauucauuccuuauucaacagccag

SEQ ID NO: 70258 - RNA, 46 nt, Mus musculus
uggcugggacagugucaggcaguucuagcuuaaugugcagggacag

SEQ ID NO: 70259 - RNA, 46 nt, Mus musculus
aggguucuccaugccgagcacuguaucagcuggaauuguugggcgu

SEQ ID NO: 70260 - RNA, 42 nt, Mus musculus
uacacaucuggcuguguguuagcaggccuuuauuagucgugg

SEQ ID NO: 70261 - RNA, 45 nt, Mus musculus
auggaauugucccuucagauucuacaaaacggauaagccuccuga

SEQ ID NO: 70262 - RNA, 46 nt, Mus musculus
gacuuggauuuucucccacuuucuuuaaugguaauaugucuccuag

SEQ ID NO: 70263 - RNA, 46 nt, Mus musculus
acauucuccaucccucauauuccauugagauggaucuuacccauau

SEQ ID NO: 70264 - RNA, 43 nt, Mus musculus
gcaacgugaaauccuccacgagauucagagaaggaaagaggag

SEQ ID NO: 70265 - RNA, 42 nt, Mus musculus
auauaauuacaguaauuuaucaaaugaguccaaaggcaggag

SEQ ID NO: 70266 - RNA, 45 nt, Mus musculus
gaauaucaaaacaaagggacuguagugccagucugcccuggguaa

SEQ ID NO: 70267 - RNA, 46 nt, Mus musculus
gccuuugucaguuguggcucucugugcuaauuagcaucuauugcaa

SEQ ID NO: 70268 - RNA, 46 nt, Mus musculus
augagcagcugggaaaggugguauacaaugcuuuggaaacagccac

SEQ ID NO: 70269 - RNA, 45 nt, Mus musculus
auggcagauccuggacuaacaagguccugguagcuauaacuaucu

SEQ ID NO: 70270 - RNA, 45 nt, Mus musculus
aauauccucaauaaccuauuaugacuggguuguuguacacuugua

SEQ ID NO: 70271 - RNA, 42 nt, Mus musculus
cucugggggacaagacuacauugagaccgucauucccagcaa

SEQ ID NO: 70272 - RNA, 45 nt, Mus musculus
ugcagguuagaaagugugaagaacagcugaggugcgugccauggu

SEQ ID NO: 70273 - RNA, 45 nt, Mus musculus
cgccugcaccaugagaacauugugcgcuacuacaacgccuggauc

SEQ ID NO: 70274 - RNA, 37 nt, Mus musculus
uggcaggcagaaguagugcaaaggaaaacggcagagg

SEQ ID NO: 70275 - RNA, 51 nt, Mus musculus
agagcuaauuaaugugagggguaagaaacagugagaugagaguaaggagag

SEQ ID NO: 70276 - RNA, 45 nt, Mus musculus
uucaagaccaaccugggccacauaaugagacccccaucacccaaa

SEQ ID NO: 70277 - RNA, 45 nt, Mus musculus
gacccuagaaggucagugggaguguagcaggccaaaauccagggc

SEQ ID NO: 70278 - RNA, 46 nt, Mus musculus
ucggcuaugugaacaucccauguucugacuggcugaaacugugaag

SEQ ID NO: 70279 - RNA, 47 nt, Mus musculus
auggugacaagauggaccgccagggcuaauuucgcagaugaaguuag

SEQ ID NO: 70280 - RNA, 44 nt, Mus musculus
gucagagcugcagagugagacccugacacccaccacagcaaaga

SEQ ID NO: 70281 - RNA, 46 nt, Mus musculus
aauaaauaauggacaaagauaagugagggcuagggauguggcucag

SEQ ID NO: 70282 - RNA, 46 nt, Mus musculus
cagaaagaauuuucguucucaaccaacuucgagaugugggugucag

SEQ ID NO: 70283 - RNA, 46 nt, Mus musculus
ccagccuaggcuacaugacauuccagaccuuaucuucucacccccu

SEQ ID NO: 70284 - RNA, 51 nt, Mus musculus
ggaggaguccgagcugcaugaagugcugcaccacacgcuggccaacauaga

SEQ ID NO: 70285 - RNA, 59 nt, Mus musculus
ugggaaggccuaccgcaccaugaugagucagaucuucugccagcacaucucccccgcua

SEQ ID NO: 70286 - RNA, 46 nt, Mus musculus
uuuuuuccaaauaauuaugugcaugugugagagaaaugugggggga

SEQ ID NO: 70287 - RNA, 46 nt, Mus musculus
cagccccaagaaaaaaauguuuuuauguuucaaacuuuuccagaag

SEQ ID NO: 70288 - RNA, 45 nt, Mus musculus
caagaaucugguugaagcuguccagaucagugacucuauacccag

SEQ ID NO: 70289 - RNA, 46 nt, Mus musculus
ccaguuccuggcauucagcaaacgcaggcaaaggguugugccugag

SEQ ID NO: 70290 - RNA, 45 nt, Mus musculus
ucauucuuuccaaggucaaguccuuugagaaggagaggcaaacag

SEQ ID NO: 70291 - RNA, 46 nt, Mus musculus
ugcuuuauagaccaggccugccuguccaggauagcaccacccacag

SEQ ID NO: 70292 - RNA, 42 nt, Mus musculus
cauacuagguaagcacuauacuccugagucauagccccagau

SEQ ID NO: 70293 - RNA, 42 nt, Mus musculus
cgcaugcauguguguguacacacaaaaacuuuugaugggcag

SEQ ID NO: 70294 - RNA, 46 nt, Mus musculus
cgaaacuuugaaagacgaacugaagguuuucaaugaaaccgccaag

SEQ ID NO: 70295 - RNA, 46 nt, Mus musculus
gaaacggcaggugcugccgugggugcgucagcccuuaccuguagcu

SEQ ID NO: 70296 - RNA, 44 nt, Mus musculus
uccuuccucuuuucuuuuucucugucccagagauccagccccag

SEQ ID NO: 70297 - RNA, 41 nt, Mus musculus
ucaguacuaagucugggacuuuaguuaccaauggcaugcca

SEQ ID NO: 70298 - RNA, 42 nt, Mus musculus
gccaggcacgguagcacacaccuucuauuacagaggcagcag

SEQ ID NO: 70299 - RNA, 45 nt, Mus musculus
guagggaaauuccccgagccagcacagauaaauuuuaagguggga

SEQ ID NO: 70300 - RNA, 46 nt, Mus musculus
cgaagccagugacuucacaauaauccuagaggaaauggagcagcuc

SEQ ID NO: 70301 - RNA, 49 nt, Mus musculus
gauccagugagcaucuuucguucauccucuagucccaugucgggagccg

SEQ ID NO: 70302 - RNA, 42 nt, Mus musculus
gcccuucgccucccugggccugguccccgcucuccgggaccu

SEQ ID NO: 70303 - RNA, 46 nt, Mus musculus
cguccugcccggacagcggccucguaguaagacaguggcugggauc

SEQ ID NO: 70304 - RNA, 26 nt, Mus musculus
acauacuccuucuccagcugcacagg

SEQ ID NO: 70305 - RNA, 46 nt, Mus musculus
ggucauugagaaucggguggcccaggaauuggagguggacucggau

SEQ ID NO: 70306 - RNA, 51 nt, Mus musculus
aguccaugccuguggaauaaagaauaaacuguuuaccaggaguugagagag

SEQ ID NO: 70307 - RNA, 82 nt, Mus musculus
gcgcgagcgccaacggcccgcucuccuucuccuggagcgccgcguuucgcuucuccuuucccaaagccgcuccauucccggg

SEQ ID NO: 70308 - RNA, 45 nt, Mus musculus
ugguauguguuucugaccgacguucccugcuuccguggucugaag

SEQ ID NO: 70309 - RNA, 47 nt, Mus musculus
acaauaauagaguuucggguuucugcagguccaacauuaguaaagac

SEQ ID NO: 70310 - RNA, 75 nt, Mus musculus
aacugagaguggcacuguuugaaaggauuaggaggagggguggccuuguuggaggagauguguuaaugagggaug

SEQ ID NO: 70311 - RNA, 72 nt, Mus musculus
agcuuugagguuuccaaaacucugccugcuguuuguggacguucuuggcuacuccuucagcauuguguuugc

SEQ ID NO: 70312 - RNA, 42 nt, Mus musculus
uggugucucuucacagcaauaaaacugugacuaagacagaag

SEQ ID NO: 70313 - RNA, 46 nt, Mus musculus
guagacuucauggggauggcauuucauuggucagauuguuggagag

SEQ ID NO: 70314 - RNA, 46 nt, Mus musculus
uuccagaaaguuuugaaucucauugguuaagugguaacuaguucac

SEQ ID NO: 70315 - RNA, 46 nt, Mus musculus
cugaucagcucauuaguucucccuuaauuacaccaccggugcaagc

SEQ ID NO: 70316 - RNA, 66 nt, Mus musculus
uccagcccccuaauuauuuuaugaaaugaaaaaaaaaucuugagauuuuugcaauuugggcaauua

SEQ ID NO: 70317 - RNA, 45 nt, Mus musculus
gcagguccucuuucuugugcuuauucuucuugaggcagcagcaga

SEQ ID NO: 70318 - RNA, 45 nt, Mus musculus
cucugaggcuugaaacugguagcaccucauccuaaaacagcagag

SEQ ID NO: 70319 - RNA, 46 nt, Mus musculus
cucuuuaagaaaaaugggaauggggcuuguaaaaaaggggggauaa

SEQ ID NO: 70320 - RNA, 46 nt, Mus musculus
ucaucacaaaauacauagauucaaaucauauaaguuuacaauagag

SEQ ID NO: 70321 - RNA, 46 nt, Mus musculus
uggagaguuaaaaccauaauuaaguuauuagugaaguuuuguauag

SEQ ID NO: 70322 - RNA, 46 nt, Mus musculus
aucuauagaugaagauauaccaggaaaagcauauuaauagcagcag

SEQ ID NO: 70323 - RNA, 46 nt, Mus musculus
uuacuuugaguauuaauauuccaguauuaaguauaacaugguacuu

SEQ ID NO: 70324 - RNA, 46 nt, Mus musculus
agaaaaaaguuuucaaaaauggaugggguauauucagaagcuaaug

SEQ ID NO: 70325 - RNA, 46 nt, Mus musculus
auucggugcugcugaaauguuauuuucuauuacagaaaggccacuu

SEQ ID NO: 70326 - RNA, 42 nt, Mus musculus
uuucuccaaaauugguaccauaaacuagugauccguuugcag

SEQ ID NO: 70327 - RNA, 44 nt, Mus musculus
aguccucuucaggaccucaaauguggaaaucaaacaaaccaggu

SEQ ID NO: 70328 - RNA, 46 nt, Mus musculus
ucuuaggaaccuaauccuccaagaaaaaggaaaagcucucgucgag

SEQ ID NO: 70329 - RNA, 41 nt, Mus musculus
gcauaaauaaaucuuaaaaaaaaaaaagagagagagagaca

SEQ ID NO: 70330 - RNA, 42 nt, Mus musculus
uguauuucuuauuggugagagugcuguguaugagugugugug

SEQ ID NO: 70331 - RNA, 41 nt, Mus musculus
ucuagaguauuccagacagagucucacaugaaaacagagag

SEQ ID NO: 70332 - RNA, 46 nt, Mus musculus
auaguucucaauuacagacugcaaccaugaaaggaaacaugcaaau

SEQ ID NO: 70333 - RNA, 42 nt, Mus musculus
cuaucagcuauggaagaggaaaaaaaauugcugaaggcugau

SEQ ID NO: 70334 - RNA, 46 nt, Mus musculus
aauccagaugcuggcccacucagagagaaaacuauuuauuuagaag

SEQ ID NO: 70335 - RNA, 41 nt, Mus musculus
aaagccuuagccucaaaaacaagaguauuacauuuccagag

SEQ ID NO: 70336 - RNA, 46 nt, Mus musculus
aguuagugaucaaaguucaaugaaaaucaaguuucacaaagcugau

SEQ ID NO: 70337 - RNA, 46 nt, Mus musculus
gaagucacucaaacugaaagugccauagcgcugcuuaaagaugaag

SEQ ID NO: 70338 - RNA, 46 nt, Mus musculus
auguuacaaaugagaaaaaaaucagaacacaugacagugcacaaga

SEQ ID NO: 70339 - RNA, 46 nt, Mus musculus
auguacuguguaccugaggacacuuuugugcauauguaugauacgg

SEQ ID NO: 70340 - RNA, 46 nt, Mus musculus
ccagaacaucauauuacucuauacugaacuacacacccagcccugu

SEQ ID NO: 70341 - RNA, 45 nt, Mus musculus
gcggauguaaauaggaacuugugggaaaaagugaaagacuacucu

SEQ ID NO: 70342 - RNA, 41 nt, Mus musculus
uaccuaauagaaaggaaggaaggaaggaaggaaggaaggaa

SEQ ID NO: 70343 - RNA, 41 nt, Mus musculus
ucuuaccucaggagccucccucauacauacacucaggcaca

SEQ ID NO: 70344 - RNA, 46 nt, Mus musculus
cucuccaccucacagcuguuuucuucaugcuaucuguaguaccuag

SEQ ID NO: 70345 - RNA, 42 nt, Mus musculus
gugugugucuugagcacugggauuaaaggcauaugccaccac

SEQ ID NO: 70346 - RNA, 46 nt, Mus musculus
agaccugguugaaaaacaaaauacuuaaaugauauaucggggucaa

SEQ ID NO: 70347 - RNA, 46 nt, Mus musculus
auuaaaggcaugcgccaccacugccuagcuaaucauuucuuguuau

SEQ ID NO: 70348 - RNA, 31 nt, Mus musculus
aauguauauucuuuuuauuucucauguauac

SEQ ID NO: 70349 - RNA, 44 nt, Mus musculus
cugcaaguaauuuaaauucccccaauuuaaauuaagguaggaga

SEQ ID NO: 70350 - RNA, 46 nt, Mus musculus
cucuauagcacuaagaaagaaagaacaguuagaacuuaacaaagag

SEQ ID NO: 70351 - RNA, 46 nt, Mus musculus
cagaaaaacucugucucgacaccccccccccaaaaaaaagucccau

SEQ ID NO: 70352 - RNA, 45 nt, Mus musculus
ugggcuacaugcaacagggucaucuaccaacagcacgggcaguuc

SEQ ID NO: 70353 - RNA, 46 nt, Mus musculus
caguguaagacaaaacaaacaaaaaacuuucaguuauuucggcuag

SEQ ID NO: 70354 - RNA, 46 nt, Mus musculus
guguauaugugucaauaaauucauuacaggcauuagaaaagucuaa

SEQ ID NO: 70355 - RNA, 42 nt, Mus musculus
auccagcucagacuuuuaauaagaauaaaguccaguggggag

SEQ ID NO: 70356 - RNA, 42 nt, Mus musculus
accugcgccgccgggccacucucugguucucuucuauaugag

SEQ ID NO: 70357 - RNA, 47 nt, Mus musculus
uagucaaagaaaaccuuuggccaggagugauagccucagagguggug

SEQ ID NO: 70358 - RNA, 36 nt, Mus musculus
cccaccuggagagccuggcuguggaaaaccccaaag

SEQ ID NO: 70359 - RNA, 45 nt, Mus musculus
aacuucuuccagaagugaaagccccagguccacuuugaaggagag

SEQ ID NO: 70360 - RNA, 46 nt, Mus musculus
ucugugugucugugagucugugugugugugugugugugugugugug

SEQ ID NO: 70361 - RNA, 45 nt, Mus musculus
uguucugacccauggcagagugcgccugcuguugaguaaggggca

SEQ ID NO: 70362 - RNA, 50 nt, Mus musculus
cgaaagcuuuuuaaucucuccaaagaagaugauguccgccaguauguugu

SEQ ID NO: 70363 - RNA, 48 nt, Mus musculus
auaacacaaacgccgauguauugcucugaagaagcaacgcacuaagaa

SEQ ID NO: 70364 - RNA, 47 nt, Mus musculus
agaaugaaggaagccaaagaaaagcgccaggaacagauugccaagag

SEQ ID NO: 70365 - RNA, 45 nt, Mus musculus
gcugcucggcauugaggagaaggcggcagacaaagaggugagaac

SEQ ID NO: 70366 - RNA, 46 nt, Mus musculus
aacagagagcaaccggcaugcaugggaugacuuuaaagacagagau

SEQ ID NO: 70367 - RNA, 42 nt, Mus musculus
ggugggcauucucucugcccugcacccauuugcucuggagac

SEQ ID NO: 70368 - RNA, 46 nt, Mus musculus
caguagucuaucaaucuuaguuccacugguacauuuaagggcagau

SEQ ID NO: 70369 - RNA, 41 nt, Mus musculus
caaagaacaaucuuguccccaaggaauuucacaccccuaua

SEQ ID NO: 70370 - RNA, 45 nt, Mus musculus
auacaugcuuauaauccaagcaucugauagaaggaggcaggaaga

SEQ ID NO: 70371 - RNA, 46 nt, Mus musculus
gccuucccaaauagcuuauaccuaagagaacacuaccacaagagag

SEQ ID NO: 70372 - RNA, 44 nt, Mus musculus
gucuguggccugcccuugggacaucauuuccaguuuuccaguaa

SEQ ID NO: 70373 - RNA, 46 nt, Mus musculus
gcuuuccccgacauuucuccuccaacuccuucccaaacgcccccag

SEQ ID NO: 70374 - RNA, 44 nt, Mus musculus
gggagcaguccuguccucccuggccuuggggcucgagggcagcc

SEQ ID NO: 70375 - RNA, 46 nt, Mus musculus
cacuguucuccuugauccucgcacugugcuaggagagggggaugac

SEQ ID NO: 70376 - RNA, 73 nt, Mus musculus
gggcacaaaugaaauucacggguagaggaaaagacagaggacacacuccuaagggaagaggcaauaggagcag

SEQ ID NO: 70377 - RNA, 42 nt, Mus musculus
gaacaggaugcaggaacugaugauaaaaucccagggcuagga

SEQ ID NO: 70378 - RNA, 42 nt, Mus musculus
aguggauuccccagagaauaggccugaggcugagggaggaga

SEQ ID NO: 70379 - RNA, 42 nt, Mus musculus
aggugggggaggagugugugugugugugugugugugugugug

SEQ ID NO: 70380 - RNA, 42 nt, Mus musculus
aagcuguagauuggggcuguuuugaaggacaugaagauggga

SEQ ID NO: 70381 - RNA, 42 nt, Mus musculus
caacaccgccacgaaggaggaggacuagcagcacagggagga

SEQ ID NO: 70382 - RNA, 42 nt, Mus musculus
uucagaguugguagcaaggauggauuuucccgaggagagaga

SEQ ID NO: 70383 - RNA, 42 nt, Mus musculus
ggaaggaggguggcuucaguguuuacccugcggugcccagga

SEQ ID NO: 70384 - RNA, 41 nt, Mus musculus
gcggcagcaucuccuccacuauaagcuucccaacuccagcc

SEQ ID NO: 70385 - RNA, 45 nt, Mus musculus
aaagaaaucuacuuuguguguguguguuuacgugugugugugugu

SEQ ID NO: 70386 - RNA, 45 nt, Mus musculus
ggaguggacuuuaccuuaaggaaaagaugagguggaggagagagg

SEQ ID NO: 70387 - RNA, 48 nt, Mus musculus
guucaaaucccagcaagagaucugacucccucuucuggagugucugaa

SEQ ID NO: 70388 - RNA, 46 nt, Mus musculus
agcccgagccagucugcugagcucccaagccuuguacuguggagag

SEQ ID NO: 70389 - RNA, 33 nt, Mus musculus
aaaaaguaccuagcaaauacuaacuaaaaagaa

SEQ ID NO: 70390 - RNA, 42 nt, Mus musculus
ccaagaagcagaguccaaagagacccucaguucuugucacua

SEQ ID NO: 70391 - RNA, 41 nt, Mus musculus
ucacagcuuugcaugucggagucaauggcuuagggcuuaga

SEQ ID NO: 70392 - RNA, 46 nt, Mus musculus
uuuauuuuuauugcuuucauucauuccucugugugugugugugugu

SEQ ID NO: 70393 - RNA, 42 nt, Mus musculus
aucuaauuugagaaaauuuugagaguuuugucacccacagau

SEQ ID NO: 70394 - RNA, 45 nt, Mus musculus
ggaggccaggagaugacauuagauucccuggaauuggaguuacag

SEQ ID NO: 70395 - RNA, 46 nt, Mus musculus
acagccagggcuacacagagaaacccugucucgaaaaacccuagca

SEQ ID NO: 70396 - RNA, 46 nt, Mus musculus
uuuguuguuaccuaaaacaaauuaaucuggaggaccauuucaguag

SEQ ID NO: 70397 - RNA, 42 nt, Mus musculus
ggguacggcaggggcggggccggugagaagucucugggaaag

SEQ ID NO: 70398 - RNA, 41 nt, Mus musculus
ucuccuuuccugauucuggaagcuucauaaguucuuucugg

SEQ ID NO: 70399 - RNA, 75 nt, Mus musculus
gugaguugaaugagagugagaacuuuguaaacaaaggagcugugauuuguaagugcuaauucgaaggcggagaaa

SEQ ID NO: 70400 - RNA, 45 nt, Mus musculus
auuaauuggacacacacaggugaauguuugaucccggggcuguaa

SEQ ID NO: 70401 - RNA, 48 nt, Mus musculus
agaacagagaguuucugccuuccauagauuaaaaaccaaagagaagac

SEQ ID NO: 70402 - RNA, 52 nt, Mus musculus
uagaugaggucuuuaugccucuaaaauccugaaguuucuaucaaaauauuga

SEQ ID NO: 70403 - RNA, 45 nt, Mus musculus
ugauggcaccacagaggggcccuucaaccagggcuauggggaggg

SEQ ID NO: 70404 - RNA, 46 nt, Mus musculus
cugaagcccaagcugaucgaggcuguggacaacaugcugaccaaca

SEQ ID NO: 70405 - RNA, 46 nt, Mus musculus
acaggcaugcaccuacacacacacacacacacacacacacacacac

SEQ ID NO: 70406 - RNA, 24 nt, Mus musculus
aggcugaacauggagacuuugcuc

SEQ ID NO: 70407 - RNA, 46 nt, Mus musculus
uagugagaccugggccaggaggcacuccaaagccugaagcagagaa

SEQ ID NO: 70408 - RNA, 46 nt, Mus musculus
cugaguucagggaucuuauucuaacuagcuauguuccccaagagau

SEQ ID NO: 70409 - RNA, 42 nt, Mus musculus
uacaacaaggcuagaauugggaggccugccacagggaguggu

SEQ ID NO: 70410 - RNA, 42 nt, Mus musculus
gucugcagagggccugcugggaaggagugguaacugugggag

SEQ ID NO: 70411 - RNA, 42 nt, Mus musculus
ccuaaacauggagauggagguaacaggcauugggguccagug

SEQ ID NO: 70412 - RNA, 46 nt, Mus musculus
gguccagagccaaccacagauuccuucauugcugugauguaugggg

SEQ ID NO: 70413 - RNA, 23 nt, Mus musculus
gaaugcaauuauuagagagcauc

SEQ ID NO: 70414 - RNA, 45 nt, Mus musculus
aagugaugaacauuuccaugaguaaaugcuuaguaagggcuagag

SEQ ID NO: 70415 - RNA, 45 nt, Mus musculus
gugcuaauuaaaaacaaaaaguguauuccaaaaagaaaaccaagu

SEQ ID NO: 70416 - RNA, 46 nt, Mus musculus
uuaaauggaaagaacagauugguagaaucgccuauagaucuuagca

SEQ ID NO: 70417 - RNA, 42 nt, Mus musculus
uccacgaguuucacucgccagcgcuggaggacgccgacuucg

SEQ ID NO: 70418 - RNA, 49 nt, Mus musculus
aguggggcuuuaaggugcaggggauuugcagauuugcauucaaguugag

SEQ ID NO: 70419 - RNA, 46 nt, Mus musculus
guuaucaaaugggaagucuacucuggguuuuguuucugaauuggga

SEQ ID NO: 70420 - RNA, 45 nt, Mus musculus
uaaagcugcugacguguuuccacccaugagaaggacacauacagu

SEQ ID NO: 70421 - RNA, 40 nt, Mus musculus
cagaaauccuugccuugguuuauacaaaaucuagagagaa

SEQ ID NO: 70422 - RNA, 46 nt, Mus musculus
ugugaaucaccaugugguugcugggacuugaacucaggcccuuugg

SEQ ID NO: 70423 - RNA, 41 nt, Mus musculus
gucaaagauggaguaaauaaugggaaacugccauagaagau

SEQ ID NO: 70424 - RNA, 45 nt, Mus musculus
gauaacgaaaggcugcuaaaagaauaaaggucuuaggaguucaga

SEQ ID NO: 70425 - RNA, 46 nt, Mus musculus
agggccugaguacagauacccaggcccagcaucaaaugccccaggu

SEQ ID NO: 70426 - RNA, 46 nt, Mus musculus
guaauacuacauuucuguguuccugcacauggaugugaguggagua

SEQ ID NO: 70427 - RNA, 46 nt, Mus musculus
aaucugagugaaggguuacagaacccuuacuuacagaagcagaaau

SEQ ID NO: 70428 - RNA, 45 nt, Mus musculus
cccacaccuguguucccguucuuucccccccucucauauuuagau

SEQ ID NO: 70429 - RNA, 87 nt, Mus musculus
uaggccuugucuagcuuauggugaugauggggugagaugaaagucuguuacugucucuggaguucaggucaucauuuaaugguauuu

SEQ ID NO: 70430 - RNA, 45 nt, Mus musculus
gugugugagugaguguguguguguaugagugugugugugugugug

SEQ ID NO: 70431 - RNA, 46 nt, Mus musculus
uaguucaaagacacuuaaguagaauaagaguuuaauggcuaaaguu

SEQ ID NO: 70432 - RNA, 46 nt, Mus musculus
ugaagacaguguuccaaggaggaguucuuaauggaaucagaugauc

SEQ ID NO: 70433 - RNA, 45 nt, Mus musculus
ucaccugugggaugugaaagagaagagaaacuggagaugaggcca

SEQ ID NO: 70434 - RNA, 42 nt, Mus musculus
aaacuccuaacugcugaaccaugcauuucuccagccccaaau

SEQ ID NO: 70435 - RNA, 46 nt, Mus musculus
guaaauaucugauauuugaccccaaaggggagugccgcccacaggu

SEQ ID NO: 70436 - RNA, 44 nt, Mus musculus
cauuacaaaauacaauguuuacuauagauuuccgccccccccca

SEQ ID NO: 70437 - RNA, 46 nt, Mus musculus
cuugucuugcuugugaugaccauuucuguuacugaaagcugaggac

SEQ ID NO: 70438 - RNA, 45 nt, Mus musculus
ucccaaaauguugguagaaauuaaaaccaggucagguuggaagag

SEQ ID NO: 70439 - RNA, 47 nt, Mus musculus
ugguggcacccugucacaaaacaacaacaaaacuggaaaccaugaag

SEQ ID NO: 70440 - RNA, 44 nt, Mus musculus
gcaauagguaagagcacaaaaccuguaaaguacaagggcagaag

SEQ ID NO: 70441 - RNA, 25 nt, Mus musculus
uguaagacaucuguguuuagauuac

SEQ ID NO: 70442 - RNA, 45 nt, Mus musculus
cauuugcuuggauucucuuagcaaaugcugcaaaguagcaugcag

SEQ ID NO: 70443 - RNA, 52 nt, Mus musculus
ggaaaaucucaagggaaaaaaaggcuugucugggagauaccaaacaucauca

SEQ ID NO: 70444 - RNA, 44 nt, Mus musculus
aaaagugcugauugcuacaaugaaaucuacaauuucaagguaaa

SEQ ID NO: 70445 - RNA, 46 nt, Mus musculus
uuggaauccucucauguuuacagugauuucuucuuucauaguugau

SEQ ID NO: 70446 - RNA, 46 nt, Mus musculus
ccgaauuccuuauguuuaaagauauugaguaucuaagcuagggugg

SEQ ID NO: 70447 - RNA, 46 nt, Mus musculus
ucucauuaaugggugguuguuagccaccaugugguugcugggauuu

SEQ ID NO: 70448 - RNA, 46 nt, Mus musculus
caugcauuaauucucccuccgugauuuggguguggaugugauguga

SEQ ID NO: 70449 - RNA, 48 nt, Mus musculus
guaacuugggaaaagaaucucaaugagggguugucuagaucugguugg

SEQ ID NO: 70450 - RNA, 41 nt, Mus musculus
gcaggcaucuuaccaacaaagccaucucccuagccccuuaa

SEQ ID NO: 70451 - RNA, 45 nt, Mus musculus
cuagaauguuacaaaauccaguacuagggcuggaugaaagggaga

SEQ ID NO: 70452 - RNA, 46 nt, Mus musculus
gaacuuuaagcauggaacaggagagaaacuuaauacacagggagag

SEQ ID NO: 70453 - RNA, 45 nt, Mus musculus
ucguuucuuggugcagguccggcacccguguuugcugcagauaga

SEQ ID NO: 70454 - RNA, 46 nt, Mus musculus
cuccauaagaugugauuguagggcauuuucuaaauuagugauugag

SEQ ID NO: 70455 - RNA, 41 nt, Mus musculus
gcuaguuccaccauucuccuuauuagcauuucucagccaca

SEQ ID NO: 70456 - RNA, 58 nt, Mus musculus
gggcugagcuggucugggccagucugggccaugucccuggggcuggaguugaagcgga

SEQ ID NO: 70457 - RNA, 42 nt, Mus musculus
uaauaaugcuaaccaugacgucucaagcucaugucaggacau

SEQ ID NO: 70458 - RNA, 45 nt, Mus musculus
gcaugagcauggagacaggcaccggcuucacuagcucugccugcc

SEQ ID NO: 70459 - RNA, 44 nt, Mus musculus
aguagguuucuuagaaacugcuuaaaugucacuuacaggcucua

SEQ ID NO: 70460 - RNA, 42 nt, Mus musculus
ugagccaccacgugguugcugggauuugaacucaggacccuu

SEQ ID NO: 70461 - RNA, 46 nt, Mus musculus
ggguauuuuaucacagcaacauaagcuaagaaacucugggauccag

SEQ ID NO: 70462 - RNA, 44 nt, Mus musculus
acaguauuucuaguuuacucucugccccauuccugagguucaag

SEQ ID NO: 70463 - RNA, 46 nt, Mus musculus
ucuuucuagaagaugcccuggucauggcauuucaucauagcaauag

SEQ ID NO: 70464 - RNA, 41 nt, Mus musculus
gcuuucuucugaggucauuuccaauacuucucauagcccua

SEQ ID NO: 70465 - RNA, 46 nt, Mus musculus
uuucucgucucccgauucagaaguaucaauggcaacuacuucuaac

SEQ ID NO: 70466 - RNA, 44 nt, Mus musculus
ggaaaaagggugcaggcagcagagcugucucaaaagaugucuga

SEQ ID NO: 70467 - RNA, 46 nt, Mus musculus
ucugaacuucaacguacgcugucugcagugcugcccgcgccugcag

SEQ ID NO: 70468 - RNA, 45 nt, Mus musculus
uccuucguuuauuuuuucucucaagacuugguaguucaggggaag

SEQ ID NO: 70469 - RNA, 46 nt, Mus musculus
uauuaccagggagccaggggagcauaaguguuaaaugaggggucag

SEQ ID NO: 70470 - RNA, 64 nt, Mus musculus
ucuccuggcugugcaggucucgggcugaaugcaugacaggcauuaugugaccagacgguaacug

SEQ ID NO: 70471 - RNA, 45 nt, Mus musculus
uuccaacccuuucaccuguuccgacagagggagucagaggggcca

SEQ ID NO: 70472 - RNA, 46 nt, Mus musculus
cuuuaccaguacccuccccaguaaagaagcuauacacaggagcccu

SEQ ID NO: 70473 - RNA, 25 nt, Mus musculus
agccaaggacagguaugagaggcac

SEQ ID NO: 70474 - RNA, 74 nt, Mus musculus
gauguguuccuguuuuggacuucaaacugaugugucggcuuagaucucucuggagcgaggcgggaaaaccaagu

SEQ ID NO: 70475 - RNA, 25 nt, Mus musculus
cgugauuuggauguguaggaagaac

SEQ ID NO: 70476 - RNA, 45 nt, Mus musculus
uuugagcgguucuuuaaauuuugcuuaugaggaccugauuuaggg

SEQ ID NO: 70477 - RNA, 46 nt, Mus musculus
guaucgcuugcguaucccucaggaggacuccuguacuuggcagcuu

SEQ ID NO: 70478 - RNA, 46 nt, Mus musculus
uuccaguuuccguuacuguuguucaugugccagcugggaaagccac

SEQ ID NO: 70479 - RNA, 46 nt, Mus musculus
uggggcugccugucaucugaguuuacuucuuggcuguuacugggag

SEQ ID NO: 70480 - RNA, 64 nt, Mus musculus
uguauuaacugaacaaguuccuuaucaaaauacucuuccucuuccucuuccuuuccaucaucuu

SEQ ID NO: 70481 - RNA, 67 nt, Mus musculus
cucuuuccugggcaucaacauuaucuuugugcaacuggccagaaaugugcuuugcauaugcagagag

SEQ ID NO: 70482 - RNA, 44 nt, Mus musculus
aagaaaaggaaagaaaagagaaaagaaaagaaaagaaaagaaaa

SEQ ID NO: 70483 - RNA, 45 nt, Mus musculus
ggcucacaaccaucuguaaugagauccaaugcccucuucuguugu

SEQ ID NO: 70484 - RNA, 46 nt, Mus musculus
aaaauuagccaggcaugguggcccacgccuuuaaucccagcacuug

SEQ ID NO: 70485 - RNA, 45 nt, Mus musculus
gaguaaacugcuguuagaaggacugguggucacaucguucuugcu

SEQ ID NO: 70486 - RNA, 46 nt, Mus musculus
acagacauucucucugccaaaaaagaaaaaagggggaauuguuggg

SEQ ID NO: 70487 - RNA, 46 nt, Mus musculus
cgauguggcacaauaugcauuuucguucucguaccauagugaccag

SEQ ID NO: 70488 - RNA, 42 nt, Mus musculus
aagaagugguacuagaaacugagacaacaagccauguggcag

SEQ ID NO: 70489 - RNA, 42 nt, Mus musculus
agccagugcucuuaacuacugagacaucucuauagcccccaa

SEQ ID NO: 70490 - RNA, 42 nt, Mus musculus
cuuauuauuaguccauuaucaaggcaaggagcaagguggcag

SEQ ID NO: 70491 - RNA, 47 nt, Mus musculus
ccuacgccaucuggccgccgaggacccggcgagggagcucccagacg

SEQ ID NO: 70492 - RNA, 41 nt, Mus musculus
uccuauuucagaguacagucuaucacuggguugggggggag

SEQ ID NO: 70493 - RNA, 41 nt, Mus musculus
ugugaagauauccugcuguccucgccucaagguccuccggc

SEQ ID NO: 70494 - RNA, 49 nt, Mus musculus
uaaaccuaucgaagguuuuacagauauuuucuuuucacacccauuauuu

SEQ ID NO: 70495 - RNA, 49 nt, Mus musculus
gaguggguugauaguggcuguguaauuguguugaaaguguuuugaggaa

SEQ ID NO: 70496 - RNA, 58 nt, Mus musculus
uaccugacacaguuggggagcugcaggccaucgaacucaaucucaaccagaaccaggu

SEQ ID NO: 70497 - RNA, 46 nt, Mus musculus
auuacccccccagcuuuguugccugagacaucuagauguaguagau

SEQ ID NO: 70498 - RNA, 42 nt, Mus musculus
caccgcacacagcacaggaauccuuccuaccaguggccagga

SEQ ID NO: 70499 - RNA, 41 nt, Mus musculus
ucccgcccggcgcuggcggccucgcgggcccaugacgagaa

SEQ ID NO: 70500 - RNA, 46 nt, Mus musculus
cucuuuguacaggcauuuucugcagggaaaaaaaaaacuuguguag

SEQ ID NO: 70501 - RNA, 47 nt, Mus musculus
gcaccucagagauucccacuuugauaaguuuaucguccaagccgaga

SEQ ID NO: 70502 - RNA, 52 nt, Mus musculus
uggcuccauuaguuccaguaccaugaagaaacugauagccaagaagccacau

SEQ ID NO: 70503 - RNA, 76 nt, Mus musculus
guuuccagauguuccaaguuauacaucagcuuacuacuagugcugaggacauccugauggugagacacagaggcag

SEQ ID NO: 70504 - RNA, 45 nt, Mus musculus
gauucuaugcauuuggcuuagugcugcuggcacaagcauccacag

SEQ ID NO: 70505 - RNA, 75 nt, Mus musculus
cgucauuaaggaauuugcagaugauggugucaaguaccuggagcugaggagcacucccagagaagaaaaugcuac

SEQ ID NO: 70506 - RNA, 46 nt, Mus musculus
gaaacacugccucccccgcaaaaaaaggcaaggugaauggcaccag

SEQ ID NO: 70507 - RNA, 42 nt, Mus musculus
aucuauauuuuauaugccagacuagcuaauauccagccgcau

SEQ ID NO: 70508 - RNA, 46 nt, Mus musculus
ggcauaaaacaaugcaaacaggaaaacuuagauauugauguuaggu

SEQ ID NO: 70509 - RNA, 42 nt, Mus musculus
uggcuucaucugugauuuucuuuaucauaucuuucugccaag

SEQ ID NO: 70510 - RNA, 46 nt, Mus musculus
guccagcagacaccaaaugaagcccuguucugcucuagaucgccag

SEQ ID NO: 70511 - RNA, 46 nt, Mus musculus
uaguaacagucuuugcgugcauguuaauugcauuauguguguugaa

SEQ ID NO: 70512 - RNA, 41 nt, Mus musculus
guuuaucucaaacuaccucacaaacaaauagugccagugcu

SEQ ID NO: 70513 - RNA, 46 nt, Mus musculus
aacuaauuuucacauuuauuaagaucugagauaguagcaaggagaa

SEQ ID NO: 70514 - RNA, 42 nt, Mus musculus
aaguaggaaaaaaccuuaagaaugcaugauagagccguagag

SEQ ID NO: 70515 - RNA, 44 nt, Mus musculus
gcgcgcggcucuguggcaucuccucucccgguggacugcgggga

SEQ ID NO: 70516 - RNA, 42 nt, Mus musculus
gauccuugaaagacaagccauauuuuauauguccccucgaug

SEQ ID NO: 70517 - RNA, 46 nt, Mus musculus
cuugcugcaucugugugcaccauguguauguccuguaccugcccag

SEQ ID NO: 70518 - RNA, 46 nt, Mus musculus
cuggcugacccgcaucucuccauaucacaugucaauuacuccuuag

SEQ ID NO: 70519 - RNA, 46 nt, Mus musculus
uuuccccucugugaugguuguaguggagcaaauuaaaagccaaaag

SEQ ID NO: 70520 - RNA, 45 nt, Mus musculus
ucugagaugagucauccuuucuaccuggccagguagcagcagagg

SEQ ID NO: 70521 - RNA, 46 nt, Mus musculus
aaguugccuuuagaaaccugagacaacagguaacacugacacugag

SEQ ID NO: 70522 - RNA, 46 nt, Mus musculus
ucaugggccacuaugugguugcugggaauugaacucaggaccucug

SEQ ID NO: 70523 - RNA, 59 nt, Mus musculus
ggcagagagugaggagaguccacaauaggaggucugcuacagagcuggaggugagacug

SEQ ID NO: 70524 - RNA, 42 nt, Mus musculus
ggcugggguaugggaaugggggagcaagguuaggaggugaag

SEQ ID NO: 70525 - RNA, 45 nt, Mus musculus
auaaauugugugucuggguguguaguguauguacuuauguuacaa

SEQ ID NO: 70526 - RNA, 42 nt, Mus musculus
ggcucugauuuacugaauuguacacugaaauucuuuccccag

SEQ ID NO: 70527 - RNA, 46 nt, Mus musculus
aagguguugcuagaugacgacaaccuucucccucuguugcaccuga

SEQ ID NO: 70528 - RNA, 23 nt, Mus musculus
gaaaguggaguggaguaggacug

SEQ ID NO: 70529 - RNA, 45 nt, Mus musculus
gugugagcaugccuugccugguaauccuagcauuucuauuaugag

SEQ ID NO: 70530 - RNA, 46 nt, Mus musculus
acccagaaacaaaggguuuuauuugggcuugagcauauagcaucag

SEQ ID NO: 70531 - RNA, 46 nt, Mus musculus
guagauaaucuucaguacuaucuccagguacguucugugcaaugga

SEQ ID NO: 70532 - RNA, 46 nt, Mus musculus
aagccugcuauugcuaacuaagucaguggagaggacgaggcaggag

SEQ ID NO: 70533 - RNA, 46 nt, Mus musculus
aucuuuacauuucugacacuuaaaauacaguguuaaagggaacgag

SEQ ID NO: 70534 - RNA, 83 nt, Mus musculus
gucuucacuccuguucaagauucuuuccaguguucggaaucaccagaucaacucagauuuggcucaguuacugcuccggcuag

SEQ ID NO: 70535 - RNA, 42 nt, Mus musculus
aaucuaguaagugccccaugaauuguuccuaccugcccagag

SEQ ID NO: 70536 - RNA, 38 nt, Mus musculus
aacauagcaguacauagccuaacacagaccuuacccuc

SEQ ID NO: 70537 - RNA, 46 nt, Mus musculus
ugaugucuguaacaaaucucucaaaucauucaucaaaugccugcag

SEQ ID NO: 70538 - RNA, 45 nt, Mus musculus
ccuguuagcgaacggcuucucauucucuaaauaaagccagcgguc

SEQ ID NO: 70539 - RNA, 45 nt, Mus musculus
aaagauacuuggucuuacugguuuuauucccugcuauuguggaga

SEQ ID NO: 70540 - RNA, 42 nt, Mus musculus
cgucuggccuuguagaacuauugaauggaaauaccacuggag

SEQ ID NO: 70541 - RNA, 45 nt, Mus musculus
uuauguuuggaaggugcauaggagauguucuggugaugggcagcu

SEQ ID NO: 70542 - RNA, 46 nt, Mus musculus
uuguuaauuuucauacuacagagacacaggugugcaugcuauagau

SEQ ID NO: 70543 - RNA, 45 nt, Mus musculus
gcuuggcccauaugaagcugucacaccgcucacgaaggcagcaga

SEQ ID NO: 70544 - RNA, 46 nt, Mus musculus
ggagucuggggagcuguauuacagcauugaaaaagaaggccaaagg

SEQ ID NO: 70545 - RNA, 42 nt, Mus musculus
aaaaucaguagugaugugccauuuuuauguuguaugugagau

SEQ ID NO: 70546 - RNA, 46 nt, Mus musculus
caccagaugacaaguccuucacccgcauuaugccucgugugccaga

SEQ ID NO: 70547 - RNA, 29 nt, Mus musculus
aggaguagagggaagaggagaauagagag

SEQ ID NO: 70548 - RNA, 42 nt, Mus musculus
cuuuuucccccaucccccuugcugagguuuuggugaugaguu

SEQ ID NO: 70549 - RNA, 45 nt, Mus musculus
aaggaggcaagaggcaagggagagaagcaggaguaagagagagag

SEQ ID NO: 70550 - RNA, 44 nt, Mus musculus
gggaggggaguuaagaggguagcagaggcagggaaaggcagaga

SEQ ID NO: 70551 - RNA, 46 nt, Mus musculus
acuccauagcuaaagucagaguuagaauuguucgguuauaucauug

SEQ ID NO: 70552 - RNA, 41 nt, Mus musculus
aaugaaucuuaaaacaggugccaggaaaaccagcuggugga

SEQ ID NO: 70553 - RNA, 86 nt, Mus musculus
gcuagggugucuucaauaugcugauggugguaguugggagucuggaauaggaggaccucaaauucaaggccauccugagcugagaa

SEQ ID NO: 70554 - RNA, 43 nt, Mus musculus
uacccccauacacauaauuuaaauaaaagagucuagaguagaa

SEQ ID NO: 70555 - RNA, 41 nt, Mus musculus
gagaggaguugagaugauggagagagaagguggagggaagg

SEQ ID NO: 70556 - RNA, 46 nt, Mus musculus
cccugucucgaaaaaccaaaaagaaagaaagaaagaaggaaggaaa

SEQ ID NO: 70557 - RNA, 45 nt, Mus musculus
gugugugugugugugugugugugagagagagagagagagguucuc

SEQ ID NO: 70558 - RNA, 26 nt, Mus musculus
cauuuggugcuauccagcuagguucc

SEQ ID NO: 70559 - RNA, 50 nt, Mus musculus
acccgaucaggagacacagcagccccaaguucaagagaaagagagcccag

SEQ ID NO: 70560 - RNA, 46 nt, Mus musculus
ccagaggaagaaccaugugcugagaauagauuagauacuccagaag

SEQ ID NO: 70561 - RNA, 46 nt, Mus musculus
agcccucuccucgagcugauguuuccugugaaccuuuggaggaggu

SEQ ID NO: 70562 - RNA, 46 nt, Mus musculus
gauuaguauugacuccccccagaaacugcaaguacuugaccaggaa

SEQ ID NO: 70563 - RNA, 46 nt, Mus musculus
agucccugagacucccuguggaagucacagagaggagcccaaagaa

SEQ ID NO: 70564 - RNA, 46 nt, Mus musculus
uucuccagcuacccguucggaggcacuuuccagugucuuagaucag

SEQ ID NO: 70565 - RNA, 46 nt, Mus musculus
guuauucuuuaguagggauuuuauaagaaaaacacugaacagagug

SEQ ID NO: 70566 - RNA, 46 nt, Mus musculus
uuuuucuuugugaaacccuggcuguccuggaacucacucuguagau

SEQ ID NO: 70567 - RNA, 42 nt, Mus musculus
uacacuguagcugucuucagaaacaacagaagggcgucagau

SEQ ID NO: 70568 - RNA, 46 nt, Mus musculus
aaauuucuguaacauaauugcuguucgugguauuggagcaugagua

SEQ ID NO: 70569 - RNA, 44 nt, Mus musculus
uuuuucuucuccuuguuuauaaucaauauucacuauauaaaauu

SEQ ID NO: 70570 - RNA, 45 nt, Mus musculus
guucccagcacccacaugauggcucacaaccaucuguaaccccag

SEQ ID NO: 70571 - RNA, 46 nt, Mus musculus
gagcacugguaugaaauguguuuucucacauguggagcugguuaua

SEQ ID NO: 70572 - RNA, 42 nt, Mus musculus
ggcagugacaguagaagcugcuucucucccagaggaggagaa

SEQ ID NO: 70573 - RNA, 42 nt, Mus musculus
guguaucccuggcuguccuggaaugcucucuguagcccaggu

SEQ ID NO: 70574 - RNA, 46 nt, Mus musculus
ccuguuagauuuuuaaaaauuguuuuuuguguuugaggggcagaua

SEQ ID NO: 70575 - RNA, 45 nt, Mus musculus
aucagucaggucauugaacgguuaccucagccaaacaggacaagc

SEQ ID NO: 70576 - RNA, 45 nt, Mus musculus
cacuccuugccugauaauagaagauucucagccugaaagccaggu

SEQ ID NO: 70577 - RNA, 45 nt, Mus musculus
cccggggcucaguggcgucagaacgcggggagaguuguguggggg

SEQ ID NO: 70578 - RNA, 41 nt, Mus musculus
gggggcgggguggcaagcauggcggcggugacggggacggg

SEQ ID NO: 70579 - RNA, 42 nt, Mus musculus
agccccagcuccggaguugucuccauggcaacgcugccaggc

SEQ ID NO: 70580 - RNA, 42 nt, Mus musculus
guuuuccuaaagcuauguuaaaaaugcuuagaugcuucagag

SEQ ID NO: 70581 - RNA, 46 nt, Mus musculus
gaccuccagcagcucuaaggaccuucuccccaaauccuguuuagua

SEQ ID NO: 70582 - RNA, 42 nt, Mus musculus
cucuguucuugcucccuuuauccucgggaaagucugggacaa

SEQ ID NO: 70583 - RNA, 45 nt, Mus musculus
guucacucuccucccuggccgcagcaauguucucuggggucagcu

SEQ ID NO: 70584 - RNA, 41 nt, Mus musculus
cucucagccuuugucucuuccucuuccucaucugagggaug

SEQ ID NO: 70585 - RNA, 27 nt, Mus musculus
uugccugucuccuccgucuggggagcu

SEQ ID NO: 70586 - RNA, 47 nt, Mus musculus
uugaagcccuugucuucuuccagggaagaggugggugagauggugcc

SEQ ID NO: 70587 - RNA, 42 nt, Mus musculus
cuccaggugaguguuuccugucaccugacagugcagagugag

SEQ ID NO: 70588 - RNA, 42 nt, Mus musculus
cucugugcucuugugcucuggcucuugguucaggggccuggg

SEQ ID NO: 70589 - RNA, 46 nt, Mus musculus
agcucugucugucuguguugguugggggaugaugugcucuggagcc

SEQ ID NO: 70590 - RNA, 42 nt, Mus musculus
ugguugagaggugugggggccaauccccagaugcccccagug

SEQ ID NO: 70591 - RNA, 39 nt, Mus musculus
aguggguccugccagagaugcauagcuaaacguuggagu

SEQ ID NO: 70592 - RNA, 46 nt, Mus musculus
uccucauugccuuuggucuugaaaccccaggaagagaugaggggaa

SEQ ID NO: 70593 - RNA, 45 nt, Mus musculus
uugugggacgcaguaagacaauagagcagccacauguccccaggu

SEQ ID NO: 70594 - RNA, 45 nt, Mus musculus
uguggggaggagcggagcacagcggcagggaggggagcuaggaag

SEQ ID NO: 70595 - RNA, 46 nt, Mus musculus
aacuugguuuauuguuagagguggagguggcucuguuacagcagcu

SEQ ID NO: 70596 - RNA, 45 nt, Mus musculus
caucaggaaagcuccagacacugggaugacuacaagguucccuuc

SEQ ID NO: 70597 - RNA, 46 nt, Mus musculus
gugccuuggggugugagucgggagcugacaggaagaggcacugccu

SEQ ID NO: 70598 - RNA, 46 nt, Mus musculus
gggacuggaaagcuggcucagcaguuaagagcacuggcuuuugcaa

SEQ ID NO: 70599 - RNA, 41 nt, Mus musculus
ucuucucuguaucuuaacuuggaucuccuuucuuauuccca

SEQ ID NO: 70600 - RNA, 46 nt, Mus musculus
ugaauaagcuuuccucucugaagccuuacuuaaagacgcaaaccag

SEQ ID NO: 70601 - RNA, 42 nt, Mus musculus
auacgauacaucccaaccauagccucccacccuccaguccau

SEQ ID NO: 70602 - RNA, 42 nt, Mus musculus
uugcaagaggcuugccccugaguaugaagcugcagcaaccag

SEQ ID NO: 70603 - RNA, 46 nt, Mus musculus
aaaagaggucggauauuaaccaaaugguuaauuguaaggcugguau

SEQ ID NO: 70604 - RNA, 46 nt, Mus musculus
agagauggugaagaagcgggugcuuaugaugggccuaggacugcug

SEQ ID NO: 70605 - RNA, 45 nt, Mus musculus
gccaccaugcccaaugaaacuggguauuuugaggacaggaaaugg

SEQ ID NO: 70606 - RNA, 32 nt, Mus musculus
gcaggaccagcuucaguuccucucaggacuga

SEQ ID NO: 70607 - RNA, 47 nt, Mus musculus
guaauuuuaaguucuggugcaggucucuuugguugcaucucauagaa

SEQ ID NO: 70608 - RNA, 73 nt, Mus musculus
agccagcaacuugagagauaacuaccgauuugcacacaccaacauugagucucuggugaaggaguacgaugau

SEQ ID NO: 70609 - RNA, 47 nt, Mus musculus
gaagacaaaacuguggcauauacugaaaagaaaaugaccaguggcaa

SEQ ID NO: 70610 - RNA, 28 nt, Mus musculus
caguuuuggucucuguccucauaugacg

SEQ ID NO: 70611 - RNA, 46 nt, Mus musculus
ugauguggacuaugaaaagaaugcuaaagguucuaacuacuggaga

SEQ ID NO: 70612 - RNA, 46 nt, Mus musculus
cuguuauuaacaguuguaacuaucuuaucuuguaacccugggguau

SEQ ID NO: 70613 - RNA, 46 nt, Mus musculus
aacuuugcuguagcuagccguaaaaccuuuagccaugaacugucag

SEQ ID NO: 70614 - RNA, 46 nt, Mus musculus
cuacuggagagguuccuguuguggcuaucagaacugcuaaaggaga

SEQ ID NO: 70615 - RNA, 46 nt, Mus musculus
uuaucauuuuucucaguuuagguacuuugaaagauuaaugacugac

SEQ ID NO: 70616 - RNA, 75 nt, Mus musculus
aggcucuugaacaguuccugcaagaauacuuugauggcaacuugaagagauaccugaagucugaacccaucccag

SEQ ID NO: 70617 - RNA, 46 nt, Mus musculus
acugagcuacauccccagcaaagcaagcccuuacagacagguccag

SEQ ID NO: 70618 - RNA, 42 nt, Mus musculus
cgccaccacgcccagcuuacacacaaguaauuuuuaaagaag

SEQ ID NO: 70619 - RNA, 49 nt, Mus musculus
acguguugaggaauguugugauacaaguugaggugauuucaguccagaa

SEQ ID NO: 70620 - RNA, 80 nt, Mus musculus
guugugguagcagagaauuuugaugacauagugaaugaagaagauaaggacgugcugauugaauuuuacgccccuuggug

SEQ ID NO: 70621 - RNA, 84 nt, Mus musculus
uggccacuguaagaaucuggaacccaaguauaaagagcugggagaaaaaguaagucuaaauccucuucugaauaugaguuugag

SEQ ID NO: 70622 - RNA, 45 nt, Mus musculus
ucagcaaagauccaaauauugucauagccaagauggaugccacag

SEQ ID NO: 70623 - RNA, 42 nt, Mus musculus
ggguugagauggagucuauuuuguugcuuaggcuggccucaa

SEQ ID NO: 70624 - RNA, 57 nt, Mus musculus
gagaagcuacaaaccccccuauaauucaagaagaaaaaccuaagaagaagaagaagg

SEQ ID NO: 70625 - RNA, 53 nt, Mus musculus
agccaaaugcaccacuuuauaaaaggacucuuacaccagagaaggcaaaacca

SEQ ID NO: 70626 - RNA, 86 nt, Mus musculus
gaauccuguuaaauuuucucuaaacuguuucuuagcugcacuguuugaaaauacaaggaccaguuuauguuugugguuuugggaga

SEQ ID NO: 70627 - RNA, 56 nt, Mus musculus
ggggguuauuuucuaauuuuuuuuguacauuuggaacagugacaauaaaugugccc

SEQ ID NO: 70628 - RNA, 44 nt, Mus musculus
agacuucagcgaggaacuccagaacacaagguaaaggcaggauu

SEQ ID NO: 70629 - RNA, 42 nt, Mus musculus
cucccaggcaugccaggauuacacagugagaaccgacuccaa

SEQ ID NO: 70630 - RNA, 45 nt, Mus musculus
ugggagaggccaaggugagagcuuauuaaagaaauguaaggguag

SEQ ID NO: 70631 - RNA, 46 nt, Mus musculus
caacgcuuaggcagguaaggacaagguaagagaaguuugcaggaaa

SEQ ID NO: 70632 - RNA, 44 nt, Mus musculus
gucuucagucuuagaauuguuuggggaggaguggcauggacagg

SEQ ID NO: 70633 - RNA, 42 nt, Mus musculus
cgcucucucacccccaaccucccucgcacauccggccagcac

SEQ ID NO: 70634 - RNA, 42 nt, Mus musculus
guguguguguguguguguguguguguguguaauuccaaguga

SEQ ID NO: 70635 - RNA, 66 nt, Mus musculus
cccaucaucucggcgcuuucccuuaaccgagucgcucugcuucuucauguucuucuggcgggcgag

SEQ ID NO: 70636 - RNA, 42 nt, Mus musculus
ccccugcccuugcccuuaaggucagaacuaaggcccgcagaa

SEQ ID NO: 70637 - RNA, 46 nt, Mus musculus
ggauuaaaaccuaugguagccucugcucccuucuuccccugcccug

SEQ ID NO: 70638 - RNA, 42 nt, Mus musculus
cccaggagccuuaccugauccuagcaguguggcacaagaccc

SEQ ID NO: 70639 - RNA, 46 nt, Mus musculus
uuaagagcauaaucuaaagggucugucucccaguuuguuacuacag

SEQ ID NO: 70640 - RNA, 42 nt, Mus musculus
aaaacuggcucuugaucuguaguaacaaacugggagacagac

SEQ ID NO: 70641 - RNA, 45 nt, Mus musculus
agggccuuagcuuuugaaccucccuacuuccucauaaccagggca

SEQ ID NO: 70642 - RNA, 41 nt, Mus musculus
ucuagggcaaaggagcagggccaggucagcugaccaagaga

SEQ ID NO: 70643 - RNA, 46 nt, Mus musculus
uagcacagugccuagcacauuguggguacucaauaaaaggaaacag

SEQ ID NO: 70644 - RNA, 45 nt, Mus musculus
cuuguaaaccuugauaauccacaaggguccaaauaacucggccag

SEQ ID NO: 70645 - RNA, 45 nt, Mus musculus
uccagcuuccugcucuuaaguaggaaguuguagccuacucuugcu

SEQ ID NO: 70646 - RNA, 46 nt, Mus musculus
aacagcuugaggcuccagaagcuaguuaggguagagagaaaaccag

SEQ ID NO: 70647 - RNA, 45 nt, Mus musculus
caaugugccuuggugguguggguagugaacagauagucgaaggag

SEQ ID NO: 70648 - RNA, 42 nt, Mus musculus
ucagcagcaccacugucauguuuccuuggcuucucgggaggc

SEQ ID NO: 70649 - RNA, 42 nt, Mus musculus
ccaaaucccaccauugcuaucagccuucccggagccccagug

SEQ ID NO: 70650 - RNA, 46 nt, Mus musculus
ugcccauguguucccucaagcuccuuucugcugcugcucgagagau

SEQ ID NO: 70651 - RNA, 46 nt, Mus musculus
accaaaaccaaaagaaacaacugucagacaggaggaccuuccaguu

SEQ ID NO: 70652 - RNA, 46 nt, Mus musculus
ccaaaaaccaaaagaaacaacugucagacaggaggaccuuccaguu

SEQ ID NO: 70653 - RNA, 46 nt, Mus musculus
cguauuaaagauuucauuuauuauguuuugaagaaacugaguauau

SEQ ID NO: 70654 - RNA, 45 nt, Mus musculus
acagcuacaguguauuuguauaaauaacauaaauaaaucuaagaa

SEQ ID NO: 70655 - RNA, 42 nt, Mus musculus
auagguaaaucaagggaaaccuguaguacaugaacuccaguc

SEQ ID NO: 70656 - RNA, 41 nt, Mus musculus
cacucggggugagugcacaccucgguggugguggugguggu

SEQ ID NO: 70657 - RNA, 46 nt, Mus musculus
cccgguuguaaauaauucuagcaaaucagugguccauaagaagaaa

SEQ ID NO: 70658 - RNA, 25 nt, Mus musculus
acugccccagaagaaggccaacagc

SEQ ID NO: 70659 - RNA, 46 nt, Mus musculus
uucugauagcacacacaucaaacaaguaaguaauaaaaucugaggg

SEQ ID NO: 70660 - RNA, 44 nt, Mus musculus
guauacuuacauauaacaauaaauaaaaucucugggcuggagcg

SEQ ID NO: 70661 - RNA, 46 nt, Mus musculus
acaugguggcucacaaccauccauaaugagaucugacccccucuuc

SEQ ID NO: 70662 - RNA, 44 nt, Mus musculus
gugagccaccaugugguugcugggauuugaacucaggaagaaca

SEQ ID NO: 70663 - RNA, 46 nt, Mus musculus
augcacaauaaauauaaagaugugagauuuaaagaaugagccccag

SEQ ID NO: 70664 - RNA, 53 nt, Mus musculus
uggcauuuaguguuuguagaggcagagguaucagguugguagcguggggguug

SEQ ID NO: 70665 - RNA, 61 nt, Mus musculus
aaaauuaaaaaaaaauuuuuaagguagaguuucuguggccguucuggaacuugcucuuaga

SEQ ID NO: 70666 - RNA, 42 nt, Mus musculus
gccuccugaguacugggauuacaggucugugccaccagcccu

SEQ ID NO: 70667 - RNA, 46 nt, Mus musculus
gugugugcuguguguguaugugguguaugcaggugagugugggcac

SEQ ID NO: 70668 - RNA, 44 nt, Mus musculus
ggguuuaggguuaggguuaggguuaggguuaggguugggguuag

SEQ ID NO: 70669 - RNA, 47 nt, Mus musculus
ggguugggguuaggguuaggguuaggguuaggguuaggguugggguu

SEQ ID NO: 70670 - RNA, 51 nt, Mus musculus
uaggguuaggguugggguuaggguuaggguuaggguuaggguuaggguugg

SEQ ID NO: 70671 - RNA, 46 nt, Mus musculus
ccugcauguaugucuguguaccacaugcaugcuuggugcugagcag

SEQ ID NO: 70672 - RNA, 45 nt, Mus musculus
auaaggcuuuagaguuguuaguucuggguaauaguuuguuucucu

SEQ ID NO: 70673 - RNA, 41 nt, Mus musculus
cauaguggcgcacgccuuuaaucccagcacuagggaggcag

SEQ ID NO: 70674 - RNA, 45 nt, Mus musculus
aguggcauggucaucagugaggcuacuguucguaaggugaccaaa

SEQ ID NO: 70675 - RNA, 46 nt, Mus musculus
aaguuguuguacuacuaccuuuuggaaguuaucugaagucugccug

SEQ ID NO: 70676 - RNA, 46 nt, Mus musculus
uuagcuugaauaucuuuagccaucuggguauaauuaucuggcagag

SEQ ID NO: 70677 - RNA, 46 nt, Mus musculus
auacucuaccaacugaacuacagucacagcacuuacuuaugccaag

SEQ ID NO: 70678 - RNA, 44 nt, Mus musculus
uucacuccuuccaccauguugaguucuggguucaagcaugugag

SEQ ID NO: 70679 - RNA, 67 nt, Mus musculus
gauuuacaucggaauuacacucuguccguacuaacucucaauguguucacucucccagacaggcagc

SEQ ID NO: 70680 - RNA, 96 nt, Mus musculus
gcaucuucacucugcugggucuggaacaaagucgggggugaggaaaagacacaacuagggaaaggagugaugguugcugucuugcuaucauugaag

SEQ ID NO: 70681 - RNA, 46 nt, Mus musculus
agacccagcagagugaagaugcgauguacguuuucuaugcucacag

SEQ ID NO: 70682 - RNA, 45 nt, Mus musculus
uaacaaggauaugguggcacaugcccauacuauagucgcagacau

SEQ ID NO: 70683 - RNA, 42 nt, Mus musculus
caggugugaagagacagaugugucagacaugaagggacaggu

SEQ ID NO: 70684 - RNA, 46 nt, Mus musculus
gcugagcaaccacauaaaauaccagcgacugccuguaaccccagcc

SEQ ID NO: 70685 - RNA, 46 nt, Mus musculus
cguuccaguacacuuggcaucuuucaacacuuuuaauuaggcugua

SEQ ID NO: 70686 - RNA, 46 nt, Mus musculus
ggcagaaggacuaaguucaaagcuaaccugggcuacauagcaagau

SEQ ID NO: 70687 - RNA, 87 nt, Mus musculus
aauucugggaacuuuucagagguuauauaaaugcuagagcccccaguagacgggguggggugguuguugguuguucagggggauugg

SEQ ID NO: 70688 - RNA, 47 nt, Mus musculus
uuuuuucuugccacccuuuauccacgccgcccagcccccccccccgc

SEQ ID NO: 70689 - RNA, 46 nt, Mus musculus
gcaagaaaaaauccacaaaguaguaaagaccagcuacagcccuaag

SEQ ID NO: 70690 - RNA, 61 nt, Mus musculus
gccaauaaccgcuaacaauccuucuuggggcccccacauuugcauacccucugaaaaguuc

SEQ ID NO: 70691 - RNA, 43 nt, Mus musculus
ugggaacuuuucagaggguaugcaaaugugggggccccaagaa

SEQ ID NO: 70692 - RNA, 46 nt, Mus musculus
aauaguaaauucaaggccaauguggcucaccuucccuucuccccag

SEQ ID NO: 70693 - RNA, 45 nt, Mus musculus
gggaaggugagccacauuggccuugaauuuacuauuaccugaggu

SEQ ID NO: 70694 - RNA, 46 nt, Mus musculus
uaugcauauauguauauacgauauauguuuauauauauucugcugg

SEQ ID NO: 70695 - RNA, 39 nt, Mus musculus
auaaugucuuugaguaaucuuuauaauuaaaaaucuaga

SEQ ID NO: 70696 - RNA, 32 nt, Mus musculus
gcauaccauguguaugcaauaccugcagagau

SEQ ID NO: 70697 - RNA, 44 nt, Mus musculus
cuagugugugugugcaugugcauacacauguguggagauccgag

SEQ ID NO: 70698 - RNA, 45 nt, Mus musculus
uuccacaagcaugaggcacauacagggcacacaggcaugcaugca

SEQ ID NO: 70699 - RNA, 44 nt, Mus musculus
agcuauuauuccuuuucugcucccuaugacagacugacugccuu

SEQ ID NO: 70700 - RNA, 46 nt, Mus musculus
ucucccuaaacaauucucccccauaaacaaacccaagcauccucag

SEQ ID NO: 70701 - RNA, 46 nt, Mus musculus
uucagaucaucugugcccugcuauccuuccucucuugugcccccuc

SEQ ID NO: 70702 - RNA, 46 nt, Mus musculus
uaagugguuuuucagcaagaaaugaaaagcacuugaggcgauacag

SEQ ID NO: 70703 - RNA, 46 nt, Mus musculus
ggaguaucaugaaaacauuuucagucaucuuauauguugcugucag

SEQ ID NO: 70704 - RNA, 56 nt, Mus musculus
caucuugacaaguauaaaaaacaaauuuaaauaaaguaaaagaucauuuuaaaagc

SEQ ID NO: 70705 - RNA, 42 nt, Mus musculus
accuaggggauuaguaaagcaugucuguaguugcauccagag

SEQ ID NO: 70706 - RNA, 46 nt, Mus musculus
aauagggagaaguagcacugaguaguagggagauguggccuuguag

SEQ ID NO: 70707 - RNA, 46 nt, Mus musculus
gggauuuuacaaauccuccuacacugaaaauuaaaacacugaugaa

SEQ ID NO: 70708 - RNA, 46 nt, Mus musculus
auugggaauagaagccccuuggucuugcaaacuuuauaugccccag

SEQ ID NO: 70709 - RNA, 46 nt, Mus musculus
aucaauuacugagugaguaggugggacuuccugguuggacagagga

SEQ ID NO: 70710 - RNA, 42 nt, Mus musculus
acagaagacugucaucuuuuugguguuugagacaaaggagaa

SEQ ID NO: 70711 - RNA, 45 nt, Mus musculus
ggcggcagacgucuuuaguuccagcacugaaagcagaggcaggca

SEQ ID NO: 70712 - RNA, 46 nt, Mus musculus
uugagaaguugaacagcagcuaaagcugugguagagccaaauggga

SEQ ID NO: 70713 - RNA, 46 nt, Mus musculus
ucgucaggaguuucuucgacaggaagaucagcuucaagacuacagg

SEQ ID NO: 70714 - RNA, 46 nt, Mus musculus
ucuauguauaacuacuuacuauaugaguauuuuuaaccugccagua

SEQ ID NO: 70715 - RNA, 46 nt, Mus musculus
cagaaagucaccauuuuuacauguuuugacuuuuuuuccugacacu

SEQ ID NO: 70716 - RNA, 30 nt, Mus musculus
auuuaguuuucaguguggacagcagaucaa

SEQ ID NO: 70717 - RNA, 42 nt, Mus musculus
ccagucugauuuacagagugaguuccaggauagccagggcug

SEQ ID NO: 70718 - RNA, 103 nt, Mus musculus
ucaaaugauggaaaagaauuggguagaaacgaucauggagcaccuaaaaauauuccaaaugugccugaaaaugaugcaaauaagaaugaagaccccucaagca

SEQ ID NO: 70719 - RNA, 41 nt, Mus musculus
aaaguauuuuaguuaaaaaucagggccaggaaguaggcuca

SEQ ID NO: 70720 - RNA, 46 nt, Mus musculus
uguaguggcacauauccgcaaccccagaacuacagugagguaggag

SEQ ID NO: 70721 - RNA, 55 nt, Mus musculus
aacaacucaaacgaguuggugaugcagggaugccuggaguagaagagaaugaccu

SEQ ID NO: 70722 - RNA, 46 nt, Mus musculus
gaugguugugagccaccaugugguugcugggaauugaacucaauac

SEQ ID NO: 70723 - RNA, 64 nt, Mus musculus
aaagaagcccccuguguuagcuucucaacaugaaagucaucagacaaucucccaucuuccaacu

SEQ ID NO: 70724 - RNA, 115 nt, Mus musculus
aaucccaguacuucaaaacagaacccuucaaauccucuucagcacauaauuccaggcccaaacuuggaucgggaacccagaauucaaacagacacguuaaagcaggccaccaggg

SEQ ID NO: 70725 - RNA, 45 nt, Mus musculus
agcccuggauugaagggauagugcacacuuguaaucccagccuuu

SEQ ID NO: 70726 - RNA, 44 nt, Mus musculus
uacauauauguauauguaccguguacaugcaguaccuuuggaag

SEQ ID NO: 70727 - RNA, 41 nt, Mus musculus
ugguuaucucagugugugugugugugugugugugugugugu

SEQ ID NO: 70728 - RNA, 46 nt, Mus musculus
acuuaaaaauuauaaggcccacacuccuuuaaucuugaaacuccug

SEQ ID NO: 70729 - RNA, 45 nt, Mus musculus
gaccagucagagcuacaaagugauagauagauaaccugucucaag

SEQ ID NO: 70730 - RNA, 46 nt, Mus musculus
aaucauuuccaauuuuaaaaaaaaucauguagauccacaacuccau

SEQ ID NO: 70731 - RNA, 45 nt, Mus musculus
acuucuuuaagcuuccauuaacauuuaaaaaccaugaacuaggag

SEQ ID NO: 70732 - RNA, 42 nt, Mus musculus
uacaguguagcugucuucagacacaccagaaaagggcaucag

SEQ ID NO: 70733 - RNA, 95 nt, Mus musculus
gcggauuauaauggggaugaugguaacguaggugaguaugaggcagacaagcaggcugagcuggcuuacaaugaggaagaagauggugauggugg

SEQ ID NO: 70734 - RNA, 45 nt, Mus musculus
ugugaccgugaaacucaccucuuagguuuugguugaauuugugua

SEQ ID NO: 70735 - RNA, 46 nt, Mus musculus
agaacuauuuuaugauaaguacaaguuaaguuuuuuccauuuuuag

SEQ ID NO: 70736 - RNA, 45 nt, Mus musculus
auuacuuuuuauaguuauuaaaaauuuacuuagguucaggacaag

SEQ ID NO: 70737 - RNA, 46 nt, Mus musculus
guaagcacaggcucugcucugcugauuguggaagcaauuuuuugag

SEQ ID NO: 70738 - RNA, 46 nt, Mus musculus
cugucucugccaccccgugugugugugugugugugugugugugugu

SEQ ID NO: 70739 - RNA, 46 nt, Mus musculus
cugucuccaaauuccaaaaaccaaaauaaauaaauagauagauaga

SEQ ID NO: 70740 - RNA, 46 nt, Mus musculus
cacacaagcacacauguaugugcacaguaaagaacguagacagaag

SEQ ID NO: 70741 - RNA, 41 nt, Mus musculus
aauucccagcaacuacaugguggcucacaaccacccguagu

SEQ ID NO: 70742 - RNA, 41 nt, Mus musculus
ugcagaugaugaagaacgagagcuucagauggauccugcag

SEQ ID NO: 70743 - RNA, 46 nt, Mus musculus
ccuuuaagucuaagggauucccgaaacccaaagugcugugcaacag

SEQ ID NO: 70744 - RNA, 48 nt, Mus musculus
gguucuguugcugcugagggauaagcgggaaagacaccaccuauugcg

SEQ ID NO: 70745 - RNA, 46 nt, Mus musculus
aaggcagggaguguuaucuuucucaugcuacuaagacaauaccaag

SEQ ID NO: 70746 - RNA, 46 nt, Mus musculus
cagcugggcagugauggcacacgccuuuaaucucagcacucgggag

SEQ ID NO: 70747 - RNA, 58 nt, Mus musculus
uacuacugcauuuuaaggaaaguuaaauuuuuauauguugguugugaucaggagauag

SEQ ID NO: 70748 - RNA, 47 nt, Mus musculus
cgugagcuccagguucuguaagacccagucucagccaggcagagaaa

SEQ ID NO: 70749 - RNA, 55 nt, Mus musculus
uuuuuauuggaaagaaguugauaagaaaccugguaagaggaguagacaagugugc

SEQ ID NO: 70750 - RNA, 68 nt, Mus musculus
cgauggaguuuaggguuuuuugguuaguugauuacguugaugaauauaggagaaacaauaaaacagga

SEQ ID NO: 70751 - RNA, 46 nt, Mus musculus
aacucuuggaguauuuuacugaaugcugaauauuaugaacagaaag

SEQ ID NO: 70752 - RNA, 37 nt, Mus musculus
ucugauuuagaucaaggaaaggguucagguuggccag

SEQ ID NO: 70753 - RNA, 47 nt, Mus musculus
aaggcuucucagcaguccaguccaauccagacacagcgcacugccag

SEQ ID NO: 70754 - RNA, 46 nt, Mus musculus
ccggcuuauugucuucaauuaaaaaguucauuaaaggaagcacacc

SEQ ID NO: 70755 - RNA, 46 nt, Mus musculus
acuguguugugugagggaucuugggggaaacagaaguacugaacuu

SEQ ID NO: 70756 - RNA, 42 nt, Mus musculus
gaguaccaccaaccuacucccauaccaguguucaguggacag

SEQ ID NO: 70757 - RNA, 48 nt, Mus musculus
aauugaacgugauauagauaauaauuuaaucacaucaacaccaagaac

SEQ ID NO: 70758 - RNA, 93 nt, Mus musculus
auauuaaaacaccaagggaagaggaguguuguauaaggaaauugagauacuggaaguugauuuuguuauuuucguuuaaaauuauacuugaag

SEQ ID NO: 70759 - RNA, 46 nt, Mus musculus
uugaaaauugugguugccaucauggcuuaauguauuuaaacuggaa

SEQ ID NO: 70760 - RNA, 45 nt, Mus musculus
uucaauugccaacaaccacaugguggcucacaaccauccguaaca

SEQ ID NO: 70761 - RNA, 41 nt, Mus musculus
gugauggcugauuaggccaucuuuugauauauaugcagcua

SEQ ID NO: 70762 - RNA, 46 nt, Mus musculus
ccacuucuguguuugcuaggccccuaauauuuuuuaaaauggcuag

SEQ ID NO: 70763 - RNA, 46 nt, Mus musculus
auacagagaaacccugucuugaaaaacaaacaaacaaacaaaauaa

SEQ ID NO: 70764 - RNA, 139 nt, Mus musculus
gguguuggaauuaaaggggugugcuaccaugucuuucuguguucagauguuuaaaaagaagugugggacugagcacuuggcuuguuagagggccugguuaauuaacaugugaugaugccauguguuccagccccauuac

SEQ ID NO: 70765 - RNA, 100 nt, Mus musculus
uguaaaguauaaccuaguaguacuaguaugaaauaaaaaaaaaacagaaaauagaggaaagauaugcuuuaaauuaauuaacuaaaaguaacauguccca

SEQ ID NO: 70766 - RNA, 47 nt, Mus musculus
aauuauugagauuaacaaaugaaucacuaauauugggaacagaagca

SEQ ID NO: 70767 - RNA, 46 nt, Mus musculus
aaacaagauaguaacuuucugucuauauacugacaggaauagggag

SEQ ID NO: 70768 - RNA, 42 nt, Mus musculus
gugaaaguaaucuuuucuuuucuucuuacuaaauagcaccag

SEQ ID NO: 70769 - RNA, 71 nt, Mus musculus
uagcaguuccuuuugugccaauguaauaaaucuagugggauagacaaugaaaacuagccaccucgagucug

SEQ ID NO: 70770 - RNA, 47 nt, Mus musculus
uuguacauucuaggaaagugcuuuauagcuaaucauaugacaagcua

SEQ ID NO: 70771 - RNA, 46 nt, Mus musculus
aaauuugauuuauagcuauuauuucaucaaacauguuccgccucug

SEQ ID NO: 70772 - RNA, 60 nt, Mus musculus
gaguauuuugaaugguuuuauuuaggcacccuagcauuagaccaguuuguuugggaccgg

SEQ ID NO: 70773 - RNA, 60 nt, Mus musculus
uuguuuuugagguguuggguauuauuccagggucugguuaugcaagacaaguguuauuau

SEQ ID NO: 70774 - RNA, 70 nt, Mus musculus
uacuacauuauauccuaagccuaaagcaguuguauuuauuauauuuugccuggauagaaacagcucccug

SEQ ID NO: 70775 - RNA, 46 nt, Mus musculus
aguaguuuuaucaguauuuuaaugguuuauuaacacaaaguaguag

SEQ ID NO: 70776 - RNA, 46 nt, Mus musculus
uuuuagcauuuuugguuuuuugguuuuuggaggauuuuugggguag

SEQ ID NO: 70777 - RNA, 42 nt, Mus musculus
aacuguguuguccaucuccucauucuguacaguaaggcaggg

SEQ ID NO: 70778 - RNA, 36 nt, Mus musculus
cagacuaugguaagcacucaaggagcuaggaugcug

SEQ ID NO: 70779 - RNA, 42 nt, Mus musculus
uaggauccauuuauaggugaggaaacuaaggugugcccaaag

SEQ ID NO: 70780 - RNA, 46 nt, Mus musculus
ugauucuguuugcauuuuuuaguacuauguacauacaguuagggag

SEQ ID NO: 70781 - RNA, 46 nt, Mus musculus
gggggguacuuuagaauagaucucuuuaugagacuuaaguuuggag

SEQ ID NO: 70782 - RNA, 45 nt, Mus musculus
cacacagucugcaaaugauuggauggaugcuaccugguuggaaga

SEQ ID NO: 70783 - RNA, 45 nt, Mus musculus
gaagcuugcauagagaaacccuaucuugaaaaauaaaaaguagaa

SEQ ID NO: 70784 - RNA, 46 nt, Mus musculus
aacaacagcaacaacaaauaauuaaccaguagaagauuguggcaga

SEQ ID NO: 70785 - RNA, 28 nt, Mus musculus
cuugcuccaguugcucuggucgccccac

SEQ ID NO: 70786 - RNA, 44 nt, Mus musculus
cuuaauacauagucaccccuucauagcccuuuuagaguggacca

SEQ ID NO: 70787 - RNA, 42 nt, Mus musculus
uucucaaaauugugaaccuaguuaauaucuucuugcccccau

SEQ ID NO: 70788 - RNA, 45 nt, Mus musculus
auuguguaacuucuauaaauggcuauuuucuuguaacugucagug

SEQ ID NO: 70789 - RNA, 46 nt, Mus musculus
ucuaaauuaacuuagaauaguuucccaccgaauaacuaugccaaga

SEQ ID NO: 70790 - RNA, 42 nt, Mus musculus
uauauucaaacguugcuuaaauuauugaaaucuaagucacau

SEQ ID NO: 70791 - RNA, 45 nt, Mus musculus
uuagaccuuagaacaugccuguaaggaccauagagugagucaaau

SEQ ID NO: 70792 - RNA, 23 nt, Mus musculus
gggagggggggggaaggcaaaac

SEQ ID NO: 70793 - RNA, 45 nt, Mus musculus
gaguuccaggacagccagggcuacacagagaaacccuaucccgaa

SEQ ID NO: 70794 - RNA, 41 nt, Mus musculus
uuccuggcaaccacaugguggcucacaaccaucugcaaugg

SEQ ID NO: 70795 - RNA, 42 nt, Mus musculus
ggcggcggcacggccggcggggaccgcugggaaggcgaggac

SEQ ID NO: 70796 - RNA, 78 nt, Mus musculus
uauacagcucuaagggauguucaauccuaauaaaguauuuggagaucuuuacccccauuugaguugaaaagcccagaa

SEQ ID NO: 70797 - RNA, 81 nt, Mus musculus
aauuuuuugaaauuguaaauaugcuucugaaggacccucagacgggaugcugccuuaaagauaugcucgcagguuagaaga

SEQ ID NO: 70798 - RNA, 46 nt, Mus musculus
auaaacaacaccagccuaccgacagggucacagaaaaccugaagaa

SEQ ID NO: 70799 - RNA, 45 nt, Mus musculus
gaagacagcccuacuagacuacaucaaacguugccgcccuggaga

SEQ ID NO: 70800 - RNA, 45 nt, Mus musculus
gugcauaccuuggcaaguucauacagacagaggaccugccggcag

SEQ ID NO: 70801 - RNA, 41 nt, Mus musculus
cggaugaaucacaaaagcaucaggggaugagaaaggggcca

SEQ ID NO: 70802 - RNA, 42 nt, Mus musculus
ggacacccagcgcugccgccuggggccggccgccuuccgcag

SEQ ID NO: 70803 - RNA, 45 nt, Mus musculus
ugcggccccaggcgggagccccgaguuccgccgcggugcuggagg

SEQ ID NO: 70804 - RNA, 46 nt, Mus musculus
gcauauuaaacugaaauagccuuuggaaugagaacuuagucacagu

SEQ ID NO: 70805 - RNA, 46 nt, Mus musculus
auugugacuagagcaguuaggaacacugauaagcacgugucucugc

SEQ ID NO: 70806 - RNA, 42 nt, Mus musculus
uuaguugagaggguagagugguagguguggaucagggaggag

SEQ ID NO: 70807 - RNA, 45 nt, Mus musculus
agaugcauacacauguauauacauauauuacuaacuugccauaga

SEQ ID NO: 70808 - RNA, 46 nt, Mus musculus
uguugaagugaagguuuugagaaacuauacuacuaagccaucagac

SEQ ID NO: 70809 - RNA, 45 nt, Mus musculus
gguaagcaacagcagccggggaaggugugaacauggagaccaagg

SEQ ID NO: 70810 - RNA, 46 nt, Mus musculus
ugguggccauauguuuuauaucacuuuuuuaugguauccagcauag

SEQ ID NO: 70811 - RNA, 45 nt, Mus musculus
cauugucugacuuuauagauuccuuucaaguaauaggcacaaaau

SEQ ID NO: 70812 - RNA, 46 nt, Mus musculus
aaaguaauaaauuagaagcuugcuucucaauuaccuaacugaaguu

SEQ ID NO: 70813 - RNA, 45 nt, Mus musculus
gaaacugcucucuuaugguugucaugaaaacuauaguucauagug

SEQ ID NO: 70814 - RNA, 51 nt, Mus musculus
guaaaaaugaacuuuuacaacucccaccagcuauuaacaggauagugugga

SEQ ID NO: 70815 - RNA, 60 nt, Mus musculus
guuugaaucugcagagucagcggaaaaggccugcaggaucaugaauggcaucaagaucag

SEQ ID NO: 70816 - RNA, 64 nt, Mus musculus
gucauguaauguuugcagagauaaagauggagaauggcaagucaaaaggcugugggacagucag

SEQ ID NO: 70817 - RNA, 46 nt, Mus musculus
uagucucagcagugcucuuguuuaaaacuacuaguuucucugagau

SEQ ID NO: 70818 - RNA, 51 nt, Mus musculus
uuauuauuggaggaagucaggaaaggaacuuaaaugggaguaggauucugg

SEQ ID NO: 70819 - RNA, 42 nt, Mus musculus
gcguuuauuauaauaauuuacuaauuuucuuucaccccagau

SEQ ID NO: 70820 - RNA, 57 nt, Mus musculus
ucagaugaguaauaguuuugcuauuugguagauuagaacaaacaacagggcuuacuu

SEQ ID NO: 70821 - RNA, 74 nt, Mus musculus
acuaauuuuuucauuuuagcuuccuuuugacuugacuuggcagaaauuaaaagagaaauucagccaauguggua

SEQ ID NO: 70822 - RNA, 35 nt, Mus musculus
aggcuccaaaggcaaccagauauuuguuagaaaug

SEQ ID NO: 70823 - RNA, 61 nt, Mus musculus
gcaucgauguagaccgaggguuuuuaucaggucccaugggaagcggaaugagagacagauu

SEQ ID NO: 70824 - RNA, 47 nt, Mus musculus
aggcggcagcaugagcggcaugagcacugugacuggaggcaugggca

SEQ ID NO: 70825 - RNA, 46 nt, Mus musculus
aaguuuguuauagaagugaauauucuucuccauuuucagaacugau

SEQ ID NO: 70826 - RNA, 96 nt, Mus musculus
ucugugcuuugguuuucaacaguuacuauauuugcuauuguaaaauauaagaauuaaaagcuauuauaauaugaaaguggaauguuuuauaauaug

SEQ ID NO: 70827 - RNA, 34 nt, Mus musculus
gagcuccacauacugagguaaaaggugaggaagg

SEQ ID NO: 70828 - RNA, 46 nt, Mus musculus
uaucuccuaguuuguuucaucugugcaccuuaugccucuggcagau

SEQ ID NO: 70829 - RNA, 46 nt, Mus musculus
uuuaauuucaugguucucuuauaauuuacauaguucuuuacuagaa

SEQ ID NO: 70830 - RNA, 99 nt, Mus musculus
ucagagcuauaccguggugcaaugacuaguagcauggagcgagauuucggacguggugauauuggauuaagucgaggcuuuggcgauuccuuugguaga

SEQ ID NO: 70831 - RNA, 46 nt, Mus musculus
cacaugggcacuagagaacacuuguaaacaugccaggaagggggaa

SEQ ID NO: 70832 - RNA, 57 nt, Mus musculus
guuugguggucuggaagcaaugaauagcauggcaggcuuugguggaguuggccgaau

SEQ ID NO: 70833 - RNA, 46 nt, Mus musculus
uguuguaugugaacaguaaacuuuuuuucuuguaugaugcucagag

SEQ ID NO: 70834 - RNA, 73 nt, Mus musculus
guuuggguuaauguaaauagcuguacuacugugucugcauuuggguuugcuaugauaacaagcaucggguagu

SEQ ID NO: 70835 - RNA, 41 nt, Mus musculus
aaagaaaccuugugagagucgcugacaugaaaagagggcag

SEQ ID NO: 70836 - RNA, 46 nt, Mus musculus
gcugaacauaacugguguaaugggaaauuuggguccaagugguaag

SEQ ID NO: 70837 - RNA, 39 nt, Mus musculus
uuggguguguaugcauguguaugugugggggguuggagu

SEQ ID NO: 70838 - RNA, 46 nt, Mus musculus
acugcucuaaucucagguuggcaauaucauaaccgguccuggagaa

SEQ ID NO: 70839 - RNA, 45 nt, Mus musculus
uguguauggguguuugccuguaucaguuuugugcagugucugggg

SEQ ID NO: 70840 - RNA, 46 nt, Mus musculus
cuguuaagccagcuguacucucagccuggaugagauuggcgaagga

SEQ ID NO: 70841 - RNA, 46 nt, Mus musculus
ugaagcaggggaagggacccgauuccugccaaaucaucuuggagua

SEQ ID NO: 70842 - RNA, 46 nt, Mus musculus
aguaauuucuuuuuaauaaacccuuucuuuauucacgccuaaaaau

SEQ ID NO: 70843 - RNA, 46 nt, Mus musculus
uaacauaaugagaccugucucaaacugaaguaugaaggcuggagau

SEQ ID NO: 70844 - RNA, 47 nt, Mus musculus
acagacuguagauaguucaguaaccagaaauuacaggcaaauggaag

SEQ ID NO: 70845 - RNA, 47 nt, Mus musculus
uaguuaugaguucagauguauuuggugaguucauauauaagaaggga

SEQ ID NO: 70846 - RNA, 46 nt, Mus musculus
gaugacaaaucugucccucaugaagacuaccguucacaugauagua

SEQ ID NO: 70847 - RNA, 46 nt, Mus musculus
cauguucaaugggcaguuuuuauuugauagaccuaugcaugugaaa

SEQ ID NO: 70848 - RNA, 50 nt, Mus musculus
gcauagcuggaacugugaagcgagcugauauuaaagaagacaaggauggc

SEQ ID NO: 70849 - RNA, 46 nt, Mus musculus
auagauuuaugagguuaaaaaagauaauuuguuuuuacaaugagag

SEQ ID NO: 70850 - RNA, 49 nt, Mus musculus
cauaauuauaauagaugccuaaguuucccaugugcagaauaggauugag

SEQ ID NO: 70851 - RNA, 47 nt, Mus musculus
uuaucaugagauuauuuuguuagguaugugcugauagguuuguagau

SEQ ID NO: 70852 - RNA, 46 nt, Mus musculus
ucaauaauccaaacauuccuccugagguuaucagcaauuugcaggc

SEQ ID NO: 70853 - RNA, 46 nt, Mus musculus
caucuuuccuuauuugcuuuuuuaaaucaauauguacagacugaga

SEQ ID NO: 70854 - RNA, 46 nt, Mus musculus
uuauucccuacaagcaugcccagaagucaucccccugcccccacga

SEQ ID NO: 70855 - RNA, 42 nt, Mus musculus
uauaauuuucuaauaauuugguaaucauaauuugcagcauau

SEQ ID NO: 70856 - RNA, 48 nt, Mus musculus
guauccuacauucuuuacuggaauuaacuucaaauuaaagagauuggc

SEQ ID NO: 70857 - RNA, 41 nt, Mus musculus
uuuauguuguuuugccauauuaguuugaucaugggccaaac

SEQ ID NO: 70858 - RNA, 46 nt, Mus musculus
cgugguugaauucaaagaugaagaauuuguaaagaaagcauuagaa

SEQ ID NO: 70859 - RNA, 46 nt, Mus musculus
uuuaagauuugagguuuuaucugagcaagucugacauaugccaacc

SEQ ID NO: 70860 - RNA, 46 nt, Mus musculus
guauguugaucugguccugacugcuggugaauaauaggugcuuuuc

SEQ ID NO: 70861 - RNA, 44 nt, Mus musculus
ugacaugaaguggcaggcuauuaaagauuugaugagagaaaaag

SEQ ID NO: 70862 - RNA, 45 nt, Mus musculus
ucaaaagauaagaauucgggcacuggagaaaagaaagguccaaau

SEQ ID NO: 70863 - RNA, 57 nt, Mus musculus
aacucaagaugcuuuuguuugucuucuaauucacagggagaaugaugagucagugaa

SEQ ID NO: 70864 - RNA, 46 nt, Mus musculus
uaugugugugagccaugauguucauauugauaucagaggacaauuu

SEQ ID NO: 70865 - RNA, 88 nt, Mus musculus
ucugucuccuagugcuggaauuauaaguaugugccaccauuuuuauaauaugagcuagcuuuuaauauuuaauuuaguuaagacaguu

SEQ ID NO: 70866 - RNA, 45 nt, Mus musculus
uaaauaggcaaauagaugugcuguaauuuugauucugguuuuaag

SEQ ID NO: 70867 - RNA, 46 nt, Mus musculus
uacugcuuuaaaaauguaaauuguaguuuuaaauauaaauccagau

SEQ ID NO: 70868 - RNA, 46 nt, Mus musculus
gaaaauauugagcauguauguccuuguaauuuuaaugcuugggaga

SEQ ID NO: 70869 - RNA, 45 nt, Mus musculus
cagaugguaugcuuaguugccauucuagauacaguguagagagau

SEQ ID NO: 70870 - RNA, 46 nt, Mus musculus
guaagcaaauguuuauuacagucauguaaccuucauucagccaggu

SEQ ID NO: 70871 - RNA, 58 nt, Mus musculus
cuccagaacuugguuacuggaaguuuguauacuuaggcagacaucucauuagacuugu

SEQ ID NO: 70872 - RNA, 46 nt, Mus musculus
guauuuauauugugcuauuuauaaaauauucaacacuaggguagga

SEQ ID NO: 70873 - RNA, 46 nt, Mus musculus
uucuauuagacccaaaaauacagugucuacaguugcauugcaggau

SEQ ID NO: 70874 - RNA, 42 nt, Mus musculus
uagaguaucuggacucuagcuguggggugcaauggggcugag

SEQ ID NO: 70875 - RNA, 43 nt, Mus musculus
acaugauacacgcguuguuuuagguauuauaaguaaggcagag

SEQ ID NO: 70876 - RNA, 42 nt, Mus musculus
cuuauucuguaaaaacugaaguugaaaauaaugccaguaauu

SEQ ID NO: 70877 - RNA, 46 nt, Mus musculus
gucaucugugucuguagagaauuuagucgacguuaauccauaagau

SEQ ID NO: 70878 - RNA, 41 nt, Mus musculus
gaaaccgccgcgcagcagcgccaacggcguuaaaauguauu

SEQ ID NO: 70879 - RNA, 45 nt, Mus musculus
caacacagcucaugcaucuaaggcucaggggacagcauggcagaa

SEQ ID NO: 70880 - RNA, 46 nt, Mus musculus
uucccaagugcuucauaaaccagccacacaguaaaugacuggagag

SEQ ID NO: 70881 - RNA, 46 nt, Mus musculus
cuaaaggaaacuugggcauagccagcccaggcgauucguccaaggu

SEQ ID NO: 70882 - RNA, 42 nt, Mus musculus
cggagguuuguuccaggacaagcaaacugcagaaccccagau

SEQ ID NO: 70883 - RNA, 46 nt, Mus musculus
auucucaugggagugugugugucuugugugugugugugugugugug

SEQ ID NO: 70884 - RNA, 47 nt, Mus musculus
gugcacugagguuggggaggacaaggaagcagccucagccaccagag

SEQ ID NO: 70885 - RNA, 108 nt, Mus musculus
auccagagaccaaauaauuaaaugaaaaagcaaccuuaggcagguagaauuauauuuuccccaagccagaaccuucacaucaugguacaauuguucaccgagucgauc

SEQ ID NO: 70886 - RNA, 79 nt, Mus musculus
gaagccgguggcugggaccuacuccuuacaaaucagcagcaccccacuuuauaaaaagaaagaacuuaaccaguuagaa

SEQ ID NO: 70887 - RNA, 42 nt, Mus musculus
aagauggcuucuuuaaaaucaaccagaaagaaggggucagcu

SEQ ID NO: 70888 - RNA, 45 nt, Mus musculus
agccggcuagcuuugcuuucaauauuucccaugucaauaacaagg

SEQ ID NO: 70889 - RNA, 46 nt, Mus musculus
gacaacucacuguccccagaggccugcuaugaguguaagaucaacg

SEQ ID NO: 70890 - RNA, 45 nt, Mus musculus
guuccuugaagauuuacuuugguuucaggaggaucguggccaggu

SEQ ID NO: 70891 - RNA, 45 nt, Mus musculus
caacggggguucucacucgaucagaguggugccagcugugaaggu

SEQ ID NO: 70892 - RNA, 83 nt, Mus musculus
ucccaaacccugcaauuuuauaugcaaaaacacagaagggaguuaccaguguuccugcccgaagggcuacauucugcaagagg

SEQ ID NO: 70893 - RNA, 46 nt, Mus musculus
uaaaacuggcuacacuccggauauaacagggaccgccuguguaggu

SEQ ID NO: 70894 - RNA, 46 nt, Mus musculus
aacagagaugucugaggcagcugugaagaccugugagccucauggg

SEQ ID NO: 70895 - RNA, 42 nt, Mus musculus
cucuguccccacggccgaggauucaugaccaacggagcaggu

SEQ ID NO: 70896 - RNA, 46 nt, Mus musculus
agugcugcugugauggagggagaggcuggggaccccacugugagau

SEQ ID NO: 70897 - RNA, 45 nt, Mus musculus
uguagauagauuacucguuugcaaagaaaacugagagagugcgug

SEQ ID NO: 70898 - RNA, 42 nt, Mus musculus
aaccucauugguaccuacaugugcaucugcggcccuggguac

SEQ ID NO: 70899 - RNA, 49 nt, Mus musculus
augcccuguuggauacguucuccgagaagacaggaggauguguaaaggu

SEQ ID NO: 70900 - RNA, 42 nt, Mus musculus
ggcuccuaucgaugcgaguguccuuuugguuauauucuggaa

SEQ ID NO: 70901 - RNA, 46 nt, Mus musculus
ccaagcaggagugcugcugugcuuugaagggagaaggcuggggaga

SEQ ID NO: 70902 - RNA, 46 nt, Mus musculus
uccagagggguucucccuguccuccacuggaagaaggugccaaggu

SEQ ID NO: 70903 - RNA, 25 nt, Mus musculus
uuacaugacccaagaggcaguuagu

SEQ ID NO: 70904 - RNA, 46 nt, Mus musculus
gcauuugcccgccuggguauagucuacagaaugacaagugugaagg

SEQ ID NO: 70905 - RNA, 59 nt, Mus musculus
ggaaccuuugcagaaauggccagugugucaauaccgugggcuccuuucagugcaggugc

SEQ ID NO: 70906 - RNA, 46 nt, Mus musculus
uguaaccauggcuucauacugucucacaacaaugacugcauaggug

SEQ ID NO: 70907 - RNA, 46 nt, Mus musculus
ucacacuggcuucaaaacaaauguggaucagaccaugugcuuaggu

SEQ ID NO: 70908 - RNA, 46 nt, Mus musculus
acuguaagcccggcuaccgccuuaccuccacaggucaaugcaacgg

SEQ ID NO: 70909 - RNA, 46 nt, Mus musculus
cgagaucuugccacugugaguaaaucugguauaaauacccauugcu

SEQ ID NO: 70910 - RNA, 46 nt, Mus musculus
ugguauugcacuucccagugaugggacaaauuuauagugacaaaua

SEQ ID NO: 70911 - RNA, 46 nt, Mus musculus
gucccgugggauucuucuauaacgacaaguuacugguuugugaagg

SEQ ID NO: 70912 - RNA, 49 nt, Mus musculus
agaagaagucuaugcuacagaaacuauuacgcugacaaccagaccugcg

SEQ ID NO: 70913 - RNA, 46 nt, Mus musculus
cguuggcaacuauaccugcauuuguccuccagacuacaugcaagug

SEQ ID NO: 70914 - RNA, 45 nt, Mus musculus
ucgcuguccaacugguuacuaccugaaugaagacacucgagugug

SEQ ID NO: 70915 - RNA, 45 nt, Mus musculus
gacaucgaugagugccaggagcuuccagggcugugccaagggggg

SEQ ID NO: 70916 - RNA, 45 nt, Mus musculus
gcccuggaggagaagguuuucguccaaaucccaucaccguuauau

SEQ ID NO: 70917 - RNA, 46 nt, Mus musculus
cacuggaagaaauuauuauguaaauccuuauugcuugauggagaag

SEQ ID NO: 70918 - RNA, 42 nt, Mus musculus
ccugcuguuguucacuggguaaagcuuggggaaccccaugug

SEQ ID NO: 70919 - RNA, 47 nt, Mus musculus
gauauccgaccccggggagacaauggagauacagccugcagcaauga

SEQ ID NO: 70920 - RNA, 58 nt, Mus musculus
cccaccaccugcaucaguggaaacugugucaacacucccgguaguuacacaugcgauu

SEQ ID NO: 70921 - RNA, 45 nt, Mus musculus
uccauccaugcucagguucugaccugaguaucagagugcuugaua

SEQ ID NO: 70922 - RNA, 49 nt, Mus musculus
cucccuuccaaacaucugugucuuuggaacuugccacaaccucccgggc

SEQ ID NO: 70923 - RNA, 68 nt, Mus musculus
cccuggcggguaccgcugugaaugcgacaugggcuucgugcccagugcugacgggaaggccugugaag

SEQ ID NO: 70924 - RNA, 54 nt, Mus musculus
cgacgagugcuccgagaaccugaaccucuguggcaauggccagugccucaacgc

SEQ ID NO: 70925 - RNA, 45 nt, Mus musculus
ugcucuaauggaacccacaugugcagccaacacgcggacugcaag

SEQ ID NO: 70926 - RNA, 49 nt, Mus musculus
gacaugcuguaugcacaaauacagccgggagcuucaagugcagcugcag

SEQ ID NO: 70927 - RNA, 54 nt, Mus musculus
cguucaucugccacugugauaugggauauucagggaagaaaggaaaaacgggcu

SEQ ID NO: 70928 - RNA, 41 nt, Mus musculus
uacaggugccugugcuaugauggguucauggcaucugaaga

SEQ ID NO: 70929 - RNA, 46 nt, Mus musculus
gagcuaugaauguagcugucagccaggcuucgcgcuaaugccagac

SEQ ID NO: 70930 - RNA, 42 nt, Mus musculus
agugugagcugagugcgaaucucuguccccaugggcguugug

SEQ ID NO: 70931 - RNA, 48 nt, Mus musculus
gauccucuccugugucgaggaggcauuugccacaacacagagggaagc

SEQ ID NO: 70932 - RNA, 45 nt, Mus musculus
uuuguuuggauuuugguuuguuugugcuuuguuuugcuguggguu

SEQ ID NO: 70933 - RNA, 49 nt, Mus musculus
ccucuguggccgaggccagugugugaacaccccgggggacuuugaaugc

SEQ ID NO: 70934 - RNA, 46 nt, Mus musculus
ugacaguggcuuugcucuggauucugaagagaggaacuguacaggu

SEQ ID NO: 70935 - RNA, 46 nt, Mus musculus
ugguagugguggugguggugguauuugugugugugugugugugugu

SEQ ID NO: 70936 - RNA, 54 nt, Mus musculus
uugagaaacagccgggaguaugaggaacucuguccccgaggaccuggguuugcc

SEQ ID NO: 70937 - RNA, 45 nt, Mus musculus
ccgaauggaugccugcugcugcucuguuggggcagccuggggaac

SEQ ID NO: 70938 - RNA, 45 nt, Mus musculus
uaucaaugagugugaaguguucccgggaguaugcaagaacggccu

SEQ ID NO: 70939 - RNA, 44 nt, Mus musculus
ucccauuugugguaaaggguucucaagaauuaaaggcacgcaau

SEQ ID NO: 70940 - RNA, 48 nt, Mus musculus
caagggcacuugcuggcagacugucaucgacgggcgcugugagaucaa

SEQ ID NO: 70941 - RNA, 48 nt, Mus musculus
uccuucauuugugaauguucuccugaaaguacucuggacccaacaaaa

SEQ ID NO: 70942 - RNA, 88 nt, Mus musculus
uuaaugagugugugcugaacagucuacuuugugacaauggacaaugucgaaacacaccuggaaguuuugucugcaccugccccaaagg

SEQ ID NO: 70943 - RNA, 82 nt, Mus musculus
ugugaaaaucuccgugggaccuacaaauguauaugcaacucgggauaugaaguagacauaacugggaaaaacugugucggua

SEQ ID NO: 70944 - RNA, 45 nt, Mus musculus
ggaauaucaggcacucugcagcaguggaccgggaaugacaucagc

SEQ ID NO: 70945 - RNA, 46 nt, Mus musculus
augcugccugccacgcugcugccugaggcacuaccuugggauagcu

SEQ ID NO: 70946 - RNA, 40 nt, Mus musculus
ccuuuggggaacccugccagccguguccugcacagaauuc

SEQ ID NO: 70947 - RNA, 58 nt, Mus musculus
gcggagcacaugcuauggaggauacaggagaggccagugcgugaagccguuguuuggu

SEQ ID NO: 70948 - RNA, 23 nt, Mus musculus
cuuccccugcggggggggggggg

SEQ ID NO: 70949 - RNA, 46 nt, Mus musculus
uugcaaaccuggguuccaacuggcaucagauggccgcuacugcaaa

SEQ ID NO: 70950 - RNA, 41 nt, Mus musculus
cuagauauggaugagugcagcauccgaaacaugugccuaaa

SEQ ID NO: 70951 - RNA, 45 nt, Mus musculus
augagugucuucagaauggccggaucugcaacaauggucgcugua

SEQ ID NO: 70952 - RNA, 42 nt, Mus musculus
ccuuauucuaagccucacuucuuugaagguguugcuacaaaa

SEQ ID NO: 70953 - RNA, 49 nt, Mus musculus
cacugcagagcuggcuaccagagcacacucaccagaacugagugcagag

SEQ ID NO: 70954 - RNA, 72 nt, Mus musculus
caagcugugcucugucccucugguaauucccgggagaccagaauauccucccccacccauuggcccccuucc

SEQ ID NO: 70955 - RNA, 42 nt, Mus musculus
aaugucccccugguuuuuacaccucuccugauggcaccagau

SEQ ID NO: 70956 - RNA, 46 nt, Mus musculus
guaucugccuugugggaaauuugauuagaacaaauacagaagauga

SEQ ID NO: 70957 - RNA, 45 nt, Mus musculus
gauauucguuaaggcauuucuuuaggaucagugugugugugagag

SEQ ID NO: 70958 - RNA, 50 nt, Mus musculus
gaugugucaaggaggaaauugcauuaauaccguuggaucuuuugagugca

SEQ ID NO: 70959 - RNA, 46 nt, Mus musculus
cagaaauaaguuagaacugacuucacuguuuuaaaugcccccagau

SEQ ID NO: 70960 - RNA, 46 nt, Mus musculus
uuugcugugccaccgugggccgagccuggggccaccccugugagau

SEQ ID NO: 70961 - RNA, 46 nt, Mus musculus
uagaguacaauauguacucacagugaaguggugugccugcuuagac

SEQ ID NO: 70962 - RNA, 46 nt, Mus musculus
acagagagagagggagagagagagacaaagagacacacagagagag

SEQ ID NO: 70963 - RNA, 45 nt, Mus musculus
cacccacccacagcucaccucuuugcuucucugaucccagcagau

SEQ ID NO: 70964 - RNA, 41 nt, Mus musculus
ucacccucugcuguugcauugagcaaaacugucuuagagau

SEQ ID NO: 70965 - RNA, 42 nt, Mus musculus
aagagagagagagagagagagagagagagagagcggguguga

SEQ ID NO: 70966 - RNA, 45 nt, Mus musculus
gagagagggagagagagaagagagaagagaagagaagagaagaga

SEQ ID NO: 70967 - RNA, 45 nt, Mus musculus
gccuguggaagaaauaccagagagagagagagagagagagagaga

SEQ ID NO: 70968 - RNA, 46 nt, Mus musculus
aggaagacacuauuugacuuauagguggcagaguugggucauuaag

SEQ ID NO: 70969 - RNA, 41 nt, Mus musculus
gacucagccauguuccaugcccuuuacagaaauuccaaaga

SEQ ID NO: 70970 - RNA, 46 nt, Mus musculus
cauaaaacaaaaucaaagucguggauguaggaaagguagaggagga

SEQ ID NO: 70971 - RNA, 45 nt, Mus musculus
gaacauuguagaagagggggcagaaugauggucauagcuggaaga

SEQ ID NO: 70972 - RNA, 50 nt, Mus musculus
acuuacauucauaggggagggaauggaagaggaagaggaggaggaagagg

SEQ ID NO: 70973 - RNA, 53 nt, Mus musculus
aaaaauauuucucccaaauuaguuuucucuuuaaaaugagaaaagcaggaggu

SEQ ID NO: 70974 - RNA, 45 nt, Mus musculus
uuuguugcaaugcagcacauaucaaugcuuuguucuucuugguug

SEQ ID NO: 70975 - RNA, 41 nt, Mus musculus
auggagacugaugugagcuugugcuugugggugcgugugug

SEQ ID NO: 70976 - RNA, 47 nt, Mus musculus
uaagaaaggauacagucuguccuggcagagacagcauggcaggaggg

SEQ ID NO: 70977 - RNA, 42 nt, Mus musculus
agaaauucuccuuugcauguauaaauugggagcgggccaguc

SEQ ID NO: 70978 - RNA, 46 nt, Mus musculus
ccagccuggcuggccagugaguucccagaaucuaccugucccuucc

SEQ ID NO: 70979 - RNA, 62 nt, Mus musculus
ucuccuuaucuugcagcugucugugaaaguggcugucucaacggagggagguguguggcccc

SEQ ID NO: 70980 - RNA, 46 nt, Mus musculus
cacugaggggagaucauucccauuguguuugcugcccuuucugagu

SEQ ID NO: 70981 - RNA, 45 nt, Mus musculus
ugaaagcuuggucaacauuuuucuguccagggaugauccagagua

SEQ ID NO: 70982 - RNA, 45 nt, Mus musculus
gcacuugcccgucuggucagauaucuccuuccuguggcuccagau

SEQ ID NO: 70983 - RNA, 42 nt, Mus musculus
cagguuuuuaaggacaaagcaaggucccauuacauugcagcu

SEQ ID NO: 70984 - RNA, 23 nt, Mus musculus
aguucugggcgaucugagucauc

SEQ ID NO: 70985 - RNA, 42 nt, Mus musculus
ggaaacaggaaaugggcauaaagagaaaagaugagggaagaa

SEQ ID NO: 70986 - RNA, 46 nt, Mus musculus
uuccccuaagaguuuuuaaucguuuaaaaaggacaaucucugagau

SEQ ID NO: 70987 - RNA, 42 nt, Mus musculus
cgggccgcuggaaggcgcggcggcggcggcggcggcggcggc

SEQ ID NO: 70988 - RNA, 46 nt, Mus musculus
gcugccugggaggaaggcugcgcccaggucacagaggcgguuagag

SEQ ID NO: 70989 - RNA, 45 nt, Mus musculus
augcgcaauuauuaccugaguugucuucagcagaucuugcaggau

SEQ ID NO: 70990 - RNA, 48 nt, Mus musculus
uggguuuuccaucccgcaggugacaugcuucgguauauucaggagagc

SEQ ID NO: 70991 - RNA, 88 nt, Mus musculus
uaccaaacugccauugugaaguguuccauucuaaagaacaugagacguacaacguuuaaacuaugcuuucuucaccuugucugccaga

SEQ ID NO: 70992 - RNA, 92 nt, Mus musculus
gcugcguucuucucuucccugagccuuuuagaauaugacaaaagacauuguuuuucuuccccugugcagcugucacugucuuaggucuaaca

SEQ ID NO: 70993 - RNA, 46 nt, Mus musculus
aauuaacuaauuaguuaacuuuacaucccaaccacagugcccccuc

SEQ ID NO: 70994 - RNA, 91 nt, Mus musculus
cguagguguggugcucacugcugacucuugccucaguccucagucucuuuacuguacucguugcaaaaugauaauucuuccaacuccagac

SEQ ID NO: 70995 - RNA, 46 nt, Mus musculus
gcgaccaagggguucaaaauguaggggccaaaagucaacaauagca

SEQ ID NO: 70996 - RNA, 46 nt, Mus musculus
uauuuagaaagaagcauugaugcuuacuguuuguauaaagucagug

SEQ ID NO: 70997 - RNA, 45 nt, Mus musculus
agaaagaaaggaaggaagaaggaaaggaaggaagaaagaaagaaa

SEQ ID NO: 70998 - RNA, 46 nt, Mus musculus
uacuuucauuguaaaguguuuguguuagcucugcauugguaugugu

SEQ ID NO: 70999 - RNA, 45 nt, Mus musculus
gcuggcugcaggagcaagcugcuggagcuacacagcaggcugaga

SEQ ID NO: 71000 - RNA, 42 nt, Mus musculus
gagaaguacaaaucaagacuuguguaaucagaugagacagau

SEQ ID NO: 71001 - RNA, 45 nt, Mus musculus
gugccauugcauacacuagcaagauuuuacugaaaggacccagau

SEQ ID NO: 71002 - RNA, 41 nt, Mus musculus
uugaaaggcaugcagggaguguaauccguuucuccagaagg

SEQ ID NO: 71003 - RNA, 45 nt, Mus musculus
accuguacacguaagaagcccccuugagacaugcgccuuauagau

SEQ ID NO: 71004 - RNA, 46 nt, Mus musculus
uaacauuucauuuaaaaucaucuaaaaucuuucaauuccaggagua

SEQ ID NO: 71005 - RNA, 46 nt, Mus musculus
augggaaagugacucucagugugaguguuuuaauccagccacaugg

SEQ ID NO: 71006 - RNA, 64 nt, Mus musculus
caucccauaauuaccugguugacaaauguaggccacugugccugagaugaaguggaggggaccc

SEQ ID NO: 71007 - RNA, 53 nt, Mus musculus
uaacagcuaugucuggaagagagcaaggaagaagguagcggggcuagauggag

SEQ ID NO: 71008 - RNA, 45 nt, Mus musculus
aguuuauguaacuaaaauacagguuauggggucagggagguggcu

SEQ ID NO: 71009 - RNA, 46 nt, Mus musculus
uggcucagcuacagcuacaguugcagcaagcacagaaggcccacgu

SEQ ID NO: 71010 - RNA, 48 nt, Mus musculus
cgugcaacaacuggagcggaaccaggaagcagucagauuagagaagac

SEQ ID NO: 71011 - RNA, 42 nt, Mus musculus
caaagaauuucccaugaucccaccuccuaccccugggcuuag

SEQ ID NO: 71012 - RNA, 46 nt, Mus musculus
ugucauccuuacagaagaauuuggacgcuaccauaacggcccuuca

SEQ ID NO: 71013 - RNA, 42 nt, Mus musculus
augaaaaggauggcuuggcccucagccuucgggaaucccagc

SEQ ID NO: 71014 - RNA, 46 nt, Mus musculus
aguuguuuaaaaagcuugaaauacauuacccuagcugaucacagau

SEQ ID NO: 71015 - RNA, 45 nt, Mus musculus
gaaauuugagcugaaauguuaaagaaagaaagaaagaaacaaaga

SEQ ID NO: 71016 - RNA, 45 nt, Mus musculus
auaaagcuguauauaagccuuaccguaacuccucugugcagaaga

SEQ ID NO: 71017 - RNA, 75 nt, Mus musculus
gcaucuuggguaccacccuggagaagguggggaugaaggcggaaguggcuauagcccuccagguaaacgggagca

SEQ ID NO: 71018 - RNA, 42 nt, Mus musculus
auccuucugagcaucuggaaaggaaguggauugagcgggaua

SEQ ID NO: 71019 - RNA, 35 nt, Mus musculus
cuccucuccugagcgccacgauucugacugcagua

SEQ ID NO: 71020 - RNA, 46 nt, Mus musculus
caccucuguagaacaaguaaagccugcugcucauuaauccuggcgu

SEQ ID NO: 71021 - RNA, 45 nt, Mus musculus
gcugcugcugcucccaccaccugggcagaugucacucccccaagg

SEQ ID NO: 71022 - RNA, 42 nt, Mus musculus
uuggaguuuggcaguguagcacugcagacacaaaaugaagau

SEQ ID NO: 71023 - RNA, 45 nt, Mus musculus
acuaaaguuugcucacaaaacaaguaaauauuuuucccucuaugu

SEQ ID NO: 71024 - RNA, 41 nt, Mus musculus
ucccuucucgaucuucagccugggcgucccaucggcagacc

SEQ ID NO: 71025 - RNA, 44 nt, Mus musculus
gggagcaaauggggaaagggacuuguaagggugagacugggugg

SEQ ID NO: 71026 - RNA, 46 nt, Mus musculus
gagacccacagccaaacacuaggcagagccagggagcccuuggaag

SEQ ID NO: 71027 - RNA, 45 nt, Mus musculus
ugugucuaagacagcuacaguguacucauauacauaaaauaaaua

SEQ ID NO: 71028 - RNA, 45 nt, Mus musculus
gaggacacaauuacagguaguguguucacuacagaccucaccuag

SEQ ID NO: 71029 - RNA, 23 nt, Mus musculus
gcaaggguucuggagacgaggug

SEQ ID NO: 71030 - RNA, 45 nt, Mus musculus
caaggaagaaagauuaguaauaaucucaucuccccucuguaccau

SEQ ID NO: 71031 - RNA, 46 nt, Mus musculus
gaggugcggggaccgcggcgccucggagccgucagggcagacgcgg

SEQ ID NO: 71032 - RNA, 45 nt, Mus musculus
aaauccccaccgaaaaguccccgucggcgcggagggacacggcgg

SEQ ID NO: 71033 - RNA, 47 nt, Mus musculus
uauagugaaaguuuguagccaguguaagacauagcaaaguaaacaga

SEQ ID NO: 71034 - RNA, 46 nt, Mus musculus
auuuugaguaaauaguuaauugccuuaauugugcuauagcaucuag

SEQ ID NO: 71035 - RNA, 46 nt, Mus musculus
aagauaaaaguagcagcuaagaacauggcuucagcuacuguugcug

SEQ ID NO: 71036 - RNA, 47 nt, Mus musculus
agcugcacagaauuuuguaguaaccucauuaaaaguaaacgugagcc

SEQ ID NO: 71037 - RNA, 46 nt, Mus musculus
agaugguugugagccaccacgugguugcugggauuugaacuuugga

SEQ ID NO: 71038 - RNA, 46 nt, Mus musculus
uugacuguuagauuuauuccucuuccuugucuguguauccucauag

SEQ ID NO: 71039 - RNA, 42 nt, Mus musculus
cuccuacggugcccagcgaguuugauguaguuugccggucuc

SEQ ID NO: 71040 - RNA, 46 nt, Mus musculus
ucacuaaaucgccaaauuagugugccuaauuuguucuuuccugcag

SEQ ID NO: 71041 - RNA, 47 nt, Mus musculus
uacacagagaaacccugucucggaaaaaaaaaaaaagaaagaaagaa

SEQ ID NO: 71042 - RNA, 41 nt, Mus musculus
uaguuaaauuacuaaaugguaauuaguugugucuggcagaa

SEQ ID NO: 71043 - RNA, 42 nt, Mus musculus
uccucuccuucugugucaucuguacucccccacccccagcug

SEQ ID NO: 71044 - RNA, 46 nt, Mus musculus
aaaugaaucaaugaagacaagcuaagauaccuguguaggaaugaag

SEQ ID NO: 71045 - RNA, 45 nt, Mus musculus
gagaaagauuggcuucuuccugagcuaaguugguaacauggggua

SEQ ID NO: 71046 - RNA, 42 nt, Mus musculus
uaucagggucugauguaucucuuaagacuagccuaaccccag

SEQ ID NO: 71047 - RNA, 49 nt, Mus musculus
uuuuguaaauucucuucguuucuaaguuauauacacagcgcgcagaaga

SEQ ID NO: 71048 - RNA, 46 nt, Mus musculus
uaugugcuuuauaugaaauauguggcaguuuauaaucuuaucaaaa

SEQ ID NO: 71049 - RNA, 46 nt, Mus musculus
uauauaaaccgauuguuugcuuuuuguuguaauaaauuauugcuag

SEQ ID NO: 71050 - RNA, 46 nt, Mus musculus
caacauagagagauccucuaucaauaaauaaaacagagggacugga

SEQ ID NO: 71051 - RNA, 44 nt, Mus musculus
uuuuugcuuuacuuuuggaacuuaguuuuuuucucuuuggcaag

SEQ ID NO: 71052 - RNA, 46 nt, Mus musculus
gccuagucggccaucaguggaaagagagacacauuggucuugcaaa

SEQ ID NO: 71053 - RNA, 46 nt, Mus musculus
uugcauagauacaugauaacuguuacacagauuucuuuacggucac

SEQ ID NO: 71054 - RNA, 46 nt, Mus musculus
aaagcuauugaagaagcugaaagacucuccgaaagccuuaaacuaa

SEQ ID NO: 71055 - RNA, 46 nt, Mus musculus
gauacgaagaggcugaaguucggaaacaacuugaagaaaaggacag

SEQ ID NO: 71056 - RNA, 45 nt, Mus musculus
uguggaaaauuuacuggauuccaaaaccaaaacccaaaggguauu

SEQ ID NO: 71057 - RNA, 46 nt, Mus musculus
agggccaggcauggugguaaggugagugccuuuaaucccagcagag

SEQ ID NO: 71058 - RNA, 46 nt, Mus musculus
aaaucuuaaccuguaauuugcauguauccauaccugguauugugag

SEQ ID NO: 71059 - RNA, 45 nt, Mus musculus
agcaugggugcuuaucuuuggugucuaucccaguguggcaggguu

SEQ ID NO: 71060 - RNA, 46 nt, Mus musculus
cgcaguuuacaaccaaugcuaaggucacuccacccccucggagcag

SEQ ID NO: 71061 - RNA, 77 nt, Mus musculus
gugacagagaauuggaucuaaucugagcuuuguucuacagguaugaggagcugaggaaggaauuguaaguuuaagau

SEQ ID NO: 71062 - RNA, 46 nt, Mus musculus
ggcucuucuggaguuugggaagagagaaugauguuaggcaguaggc

SEQ ID NO: 71063 - RNA, 45 nt, Mus musculus
cucuagguugaucguacgaaaaaaccgucagucaaguugccugaa

SEQ ID NO: 71064 - RNA, 41 nt, Mus musculus
gaaaagaauaaacaggagaaggaacuuugggacaagcagca

SEQ ID NO: 71065 - RNA, 45 nt, Mus musculus
caaagcaaaggauggacaagagaaaaaagacagcaaacagaccaa

SEQ ID NO: 71066 - RNA, 46 nt, Mus musculus
guauuuucagcauucucuugcuuauguuuaaaauauauuagaggac

SEQ ID NO: 71067 - RNA, 46 nt, Mus musculus
cugccucucugccucugcaccucugccucugugccucugccucugc

SEQ ID NO: 71068 - RNA, 31 nt, Mus musculus
cugccucugccacucucugccucugccccau

SEQ ID NO: 71069 - RNA, 46 nt, Mus musculus
cuccugguacucagccuuagaugcugacuagcauaugagcacccug

SEQ ID NO: 71070 - RNA, 46 nt, Mus musculus
cuugggagagagugccuuuauuuacugagcugucugaccacccaag

SEQ ID NO: 71071 - RNA, 45 nt, Mus musculus
uugaguguggcuauguacaaacuagagcacacacacaagcgugaa

SEQ ID NO: 71072 - RNA, 46 nt, Mus musculus
caugcauguaucuuuuauuaaagcaguaucuuuacgaaaggaccac

SEQ ID NO: 71073 - RNA, 46 nt, Mus musculus
aggucaucagcagcuuauauccucuuuuauacuucccugggaccac

SEQ ID NO: 71074 - RNA, 45 nt, Mus musculus
uuacaggagucauuuauuucaaaacaacuuuuugagucugcccca

SEQ ID NO: 71075 - RNA, 46 nt, Mus musculus
ccauuuuccuauucacugcuccagccucuucucauuucuagcccca

SEQ ID NO: 71076 - RNA, 46 nt, Mus musculus
aguccauuuacuguuaccuauaugguuuuggagcuaaccacuugag

SEQ ID NO: 71077 - RNA, 52 nt, Mus musculus
gcugcaaggcagccaagggcagugcaauagcucauacuguugugggagccuc

SEQ ID NO: 71078 - RNA, 45 nt, Mus musculus
uuggaacugcuuauacauuguauucauugacuuuaauagaauuag

SEQ ID NO: 71079 - RNA, 45 nt, Mus musculus
ccuccaugugugguugugccucagugucucagggcugcagcagua

SEQ ID NO: 71080 - RNA, 46 nt, Mus musculus
aauaaauuaauaaauaaaauuuucauuuuuagucauauuuuuuaag

SEQ ID NO: 71081 - RNA, 45 nt, Mus musculus
cgcuuucuccagacagcaccuaggcaugucagcaagaaggguggg

SEQ ID NO: 71082 - RNA, 45 nt, Mus musculus
uuccccaaguuaauuggucuauauuaggccugugauuagacagua

SEQ ID NO: 71083 - RNA, 45 nt, Mus musculus
agcaagaacagguaaaucaacagaggcagaaacgacauuagggaa

SEQ ID NO: 71084 - RNA, 46 nt, Mus musculus
aaucauuucuccauagccucuuucuguccuuaaagaauucccagau

SEQ ID NO: 71085 - RNA, 46 nt, Mus musculus
ccaggugaauaaaauagaaauucauuacgccaagacugccaaaaag

SEQ ID NO: 71086 - RNA, 45 nt, Mus musculus
gcuuuuguuucuuguuccugacccccaccccacucccacccagaa

SEQ ID NO: 71087 - RNA, 24 nt, Mus musculus
cugucagguccagagcaaccagua

SEQ ID NO: 71088 - RNA, 46 nt, Mus musculus
guuuaagaagaaugaucaaguauuugacaucaaugcugaggcugaa

SEQ ID NO: 71089 - RNA, 45 nt, Mus musculus
ucugcccaucccuggccggguuccaguuuacuaaaugggacagcg

SEQ ID NO: 71090 - RNA, 45 nt, Mus musculus
gagagccccucgagcugccggaucuggguuucguagacaugacag

SEQ ID NO: 71091 - RNA, 36 nt, Mus musculus
gacugggguauuucucuccacgcugcacugccagga

SEQ ID NO: 71092 - RNA, 46 nt, Mus musculus
ugugcucuuuuccgccucacauucauuugucuugaccuguccccau

SEQ ID NO: 71093 - RNA, 46 nt, Mus musculus
uccugcaaaaccauugaacagaaucucagcaauaucaaugucucgg

SEQ ID NO: 71094 - RNA, 44 nt, Mus musculus
aggaggagcgguccaucccaguuaggcugugcuacaagugguua

SEQ ID NO: 71095 - RNA, 53 nt, Mus musculus
ucgucagcuguuaccuguguguucacuauccccccacccccacccccgugugc

SEQ ID NO: 71096 - RNA, 46 nt, Mus musculus
uucaguuuggauuuguugccugugacuucuggagaggcgcucaggu

SEQ ID NO: 71097 - RNA, 45 nt, Mus musculus
cuguccguuauggacucgagauuuuuaagcaaacauugagaagaa

SEQ ID NO: 71098 - RNA, 42 nt, Mus musculus
uguguucggcgggguucggccgggggcuccggcgggggaggg

SEQ ID NO: 71099 - RNA, 46 nt, Mus musculus
cgguuaccgcgcuuggcgcucgcgauuuaaaacuuacuccggagac

SEQ ID NO: 71100 - RNA, 45 nt, Mus musculus
uucaccuagagagaacaggcagaaaucagguuaguggggaccugg

SEQ ID NO: 71101 - RNA, 44 nt, Mus musculus
aacuaggccagggacuguugaacaccuguaauuugccagguugg

SEQ ID NO: 71102 - RNA, 42 nt, Mus musculus
ucugcuagcuaugaugacacagugaagcuauaccaggaagaa

SEQ ID NO: 71103 - RNA, 45 nt, Mus musculus
ggcuugggccccaucuggcaaccucuuggcuaccugcagcagaga

SEQ ID NO: 71104 - RNA, 46 nt, Mus musculus
uggcaucugccagcuuugaugccaccacuuguauuuggaagaagaa

SEQ ID NO: 71105 - RNA, 52 nt, Mus musculus
gcggcgccaucccagcccugaggccugcugaccggugaggagcagggacuag

SEQ ID NO: 71106 - RNA, 42 nt, Mus musculus
ugauaacccugguccaagucuccuccgguccccuugccagua

SEQ ID NO: 71107 - RNA, 47 nt, Mus musculus
cugccuucagcacacaugggucaggaggaggucagacacugacaggu

SEQ ID NO: 71108 - RNA, 46 nt, Mus musculus
acaugagugcagcagcaccucagugaucaggauguauguguacuag

SEQ ID NO: 71109 - RNA, 46 nt, Mus musculus
cucuucuggagugucugaagacagcuacaguguacuuauauaauau

SEQ ID NO: 71110 - RNA, 45 nt, Mus musculus
uacccaacagaggaagaagaacaagcacuggagcuacuaucugag

SEQ ID NO: 71111 - RNA, 42 nt, Mus musculus
gcuccucuuacacccagaggagccacuucccccagcaggucu

SEQ ID NO: 71112 - RNA, 31 nt, Mus musculus
agagccgggacucugauuucauauaauguac

SEQ ID NO: 71113 - RNA, 46 nt, Mus musculus
uggauccagguaggcaagcuguucuuguuccguuaugagcaucucu

SEQ ID NO: 71114 - RNA, 48 nt, Mus musculus
uccaaucucugcccucccauaagacaacaaacauuuugaacaagaaug

SEQ ID NO: 71115 - RNA, 48 nt, Mus musculus
ucuuuggccagaaagaauggugaauauguggacaaaugccuaugcaga

SEQ ID NO: 71116 - RNA, 46 nt, Mus musculus
acuccuggcaccuuucacagaggaaguucucaaagcccacagcuag

SEQ ID NO: 71117 - RNA, 46 nt, Mus musculus
cccauacacuggaccccaagugugugaaagcauuuagggcugucuu

SEQ ID NO: 71118 - RNA, 46 nt, Mus musculus
aguagucuccuggacacuuugggaaauccugugcuagaaaugggag

SEQ ID NO: 71119 - RNA, 48 nt, Mus musculus
ggcuauugauauuaaguaaaguaccugaaagugugagaauugggggga

SEQ ID NO: 71120 - RNA, 47 nt, Mus musculus
gcugggguagagagcccaggaacauccuugucauaugcacuagaaga

SEQ ID NO: 71121 - RNA, 58 nt, Mus musculus
uccagcugguuucuuacucagagguaccugggccaggacaguauggaauacaagguuc

SEQ ID NO: 71122 - RNA, 32 nt, Mus musculus
cuugaaaugagacaaacucuuuggggauguca

SEQ ID NO: 71123 - RNA, 42 nt, Mus musculus
cccccgcggccagggcgcgggaagcaaagcgguggccguccc

SEQ ID NO: 71124 - RNA, 44 nt, Mus musculus
accgccugugggaaagacaagaaaggguaugauuagccaagagg

SEQ ID NO: 71125 - RNA, 45 nt, Mus musculus
acaaugaagacaacaaauucgaauaucaacucaccuggucauaga

SEQ ID NO: 71126 - RNA, 42 nt, Mus musculus
aguacagguagggcaagauuuccacaggaccacccuggagga

SEQ ID NO: 71127 - RNA, 46 nt, Mus musculus
ccuugguccuguggggguucaaugccccaggguaggggaaugccag

SEQ ID NO: 71128 - RNA, 41 nt, Mus musculus
uucguggcuuguguguguguguguguguguguguguguuuu

SEQ ID NO: 71129 - RNA, 46 nt, Mus musculus
aaucuggaaguguggaaugcaaaggacccaaggaggggagucuuaa

SEQ ID NO: 71130 - RNA, 42 nt, Mus musculus
gaugggcguggagggagcagugaucaugugguacaggcagca

SEQ ID NO: 71131 - RNA, 46 nt, Mus musculus
gcaaggaagguucucgccaaaaccaagauggagggcagggccuguc

SEQ ID NO: 71132 - RNA, 42 nt, Mus musculus
augcuccaugccuugucuuuuaaucuguuauuuuagggccag

SEQ ID NO: 71133 - RNA, 44 nt, Mus musculus
gaugugacuugcaaaagcacccuaggacaugcuguccuucccuc

SEQ ID NO: 71134 - RNA, 39 nt, Mus musculus
cugcaacgugauccuugugaaggaggagaacaccaggua

SEQ ID NO: 71135 - RNA, 44 nt, Mus musculus
caucaggaaggguuugcaccccagucucauaucccaggaccaag

SEQ ID NO: 71136 - RNA, 46 nt, Mus musculus
gucccuggagcagcacauacccaccaguuuugaugccucccagaag

SEQ ID NO: 71137 - RNA, 90 nt, Mus musculus
gcuaaauaccaauagucucccuagucaguccuccagugcacagccagaaaagucugauaugggcccaaacagagauaacauuccagaagu

SEQ ID NO: 71138 - RNA, 44 nt, Mus musculus
ggauuaaagagguggacagugauacagcuggucaaaggaaggga

SEQ ID NO: 71139 - RNA, 46 nt, Mus musculus
ucagggccuugagcaggaaagggccaggcucacugaagauguaaca

SEQ ID NO: 71140 - RNA, 46 nt, Mus musculus
guuaaggugguaacucaggggacucacagauggaccaaaagugcug

SEQ ID NO: 71141 - RNA, 45 nt, Mus musculus
cgccugugcgaaggccuugaguaugggacugagcaagcggcagag

SEQ ID NO: 71142 - RNA, 45 nt, Mus musculus
uggaaagaugaaagcuagguggccuguaaagcuugaagcagccug

SEQ ID NO: 71143 - RNA, 41 nt, Mus musculus
ccaccauguguauauugagaauugaacucgggaccccugga

SEQ ID NO: 71144 - RNA, 45 nt, Mus musculus
ccagaagggagaggacucugacagggaaugaagaccagaccuaga

SEQ ID NO: 71145 - RNA, 46 nt, Mus musculus
cagccuuuggacuguggcauggcgguacuuguguaaaacgacagag

SEQ ID NO: 71146 - RNA, 46 nt, Mus musculus
cacugcgaaaggaagcuggagagaucauaggacagauguuaggaga

SEQ ID NO: 71147 - RNA, 46 nt, Mus musculus
caaaugucagcuccauccaagaaagcccucacuaaacaccaagacc

SEQ ID NO: 71148 - RNA, 45 nt, Mus musculus
guuaggagccaccuuugcucagacagguugucuguuugcaugauc

SEQ ID NO: 71149 - RNA, 42 nt, Mus musculus
cacuggugcggccaguuauggacugagugagagcccccauac

SEQ ID NO: 71150 - RNA, 76 nt, Mus musculus
ggaagagagaaucuccacugaguugccuccgucggccuguuagcauauuugugugggacaucuucugaauugccag

SEQ ID NO: 71151 - RNA, 45 nt, Mus musculus
aaaauucauguucacaaagaaggaugucaucuuuucauaccagau

SEQ ID NO: 71152 - RNA, 42 nt, Mus musculus
aguaaagcugcaaccggagcucacuucucuccucgggaagca

SEQ ID NO: 71153 - RNA, 46 nt, Mus musculus
cccagccugugaaguuucgagcacacacacacacacacacacacac

SEQ ID NO: 71154 - RNA, 41 nt, Mus musculus
gucuagguguucaagaagccgaguggacgcgguggcggagg

SEQ ID NO: 71155 - RNA, 45 nt, Mus musculus
cauacuuacuauuuauguauguuuaaaaaaaauaaagcccauaug

SEQ ID NO: 71156 - RNA, 45 nt, Mus musculus
uaugugggaggaauuuuuucacaucauguugaauauaccggauug

SEQ ID NO: 71157 - RNA, 51 nt, Mus musculus
cuuuggcucuuacaugaaaguaaaaaaugaaggaggagucuggaaaccuga

SEQ ID NO: 71158 - RNA, 46 nt, Mus musculus
cugguuuucaguguccugagaugcucaguaacaagccauggaacua

SEQ ID NO: 71159 - RNA, 46 nt, Mus musculus
auucauggagacauuaagccagauaacuucauacuaggacacaggu

SEQ ID NO: 71160 - RNA, 47 nt, Mus musculus
auccccagcaccuacauggugucuuacaacugucuguagccccaauu

SEQ ID NO: 71161 - RNA, 46 nt, Mus musculus
ugcugcccaacuuucgucuacaccauuccacaaauuuccagcagau

SEQ ID NO: 71162 - RNA, 46 nt, Mus musculus
accacagccuaaaaauaagcccuuaggagcuaggaccuuuggagaa

SEQ ID NO: 71163 - RNA, 46 nt, Mus musculus
augcuauuuuguuuuccugcagaaaaugcaguaucuucgggagauu

SEQ ID NO: 71164 - RNA, 46 nt, Mus musculus
uucaccucgcugcaaaguaccuuaugucauuaucuaggaccuaggu

SEQ ID NO: 71165 - RNA, 60 nt, Mus musculus
auuauaggaggguggacacugcucuguagugacagaucucuacuaggcccugagugcaag

SEQ ID NO: 71166 - RNA, 62 nt, Mus musculus
guuagaauugagaaagcuagaaaugaaaacucagggguuaauuuuuuucuuagaggacauaa

SEQ ID NO: 71167 - RNA, 46 nt, Mus musculus
ccaacacuuccugacauuucugaugauaaagaugaauggccaucuc

SEQ ID NO: 71168 - RNA, 46 nt, Mus musculus
ccuguuaauguuccaagcaccuaagauauuuucagugcuuucagau

SEQ ID NO: 71169 - RNA, 45 nt, Mus musculus
uuacuauuaggguggagaguuaggauucaaagaaagugaccagga

SEQ ID NO: 71170 - RNA, 46 nt, Mus musculus
uguggguuuuugcaugugagugcagugcccucagaagaggugauug

SEQ ID NO: 71171 - RNA, 44 nt, Mus musculus
cccagaaauauaaucaaaggaagaagcaugagcagugggguacu

SEQ ID NO: 71172 - RNA, 42 nt, Mus musculus
cagcaaguuauguacugcaaggaaaagcuuauucguggagau

SEQ ID NO: 71173 - RNA, 31 nt, Mus musculus
cuguuauaaauggugucuuucuccccaguag

SEQ ID NO: 71174 - RNA, 42 nt, Mus musculus
gccucugucauagcuauaaaaaaaauauuauuucugccauuu

SEQ ID NO: 71175 - RNA, 42 nt, Mus musculus
auguguuucauuuacuuaucaguucauccuuuaguaccagau

SEQ ID NO: 71176 - RNA, 42 nt, Mus musculus
auauaauuaugugaauuguguauguacuuaacacccccagag

SEQ ID NO: 71177 - RNA, 73 nt, Mus musculus
auacauguccugggcagggcaucuggaagcccagggagagcugcagcaugccagugcuauuuuucagacagga

SEQ ID NO: 71178 - RNA, 91 nt, Mus musculus
aaguggguagaagagaauuuuccugacaauaaagaauacuugaugacauuauuagaacauuuaaugaaggaauuuuuacauaagaagaacu

SEQ ID NO: 71179 - RNA, 42 nt, Mus musculus
uacuucucuauucuagcauguuugaagcccauaugcaaagcu

SEQ ID NO: 71180 - RNA, 53 nt, Mus musculus
uuuuaugugauauuuggguuguugaagucaagauuuccauucucuaguacaua

SEQ ID NO: 71181 - RNA, 46 nt, Mus musculus
cuaacuuagcugugcucuugagaaauaagacaaugacguuggagau

SEQ ID NO: 71182 - RNA, 45 nt, Mus musculus
uauccaaaaucuguuggcguuaagcaauuuaauuuuugaucagau

SEQ ID NO: 71183 - RNA, 52 nt, Mus musculus
gguauuucgccgcugcgcguuuuuucucgucauggacaaccuagaaaauguc

SEQ ID NO: 71184 - RNA, 46 nt, Mus musculus
ucgucaguugccucugugcaccagaggguggcacuccagaggugga

SEQ ID NO: 71185 - RNA, 41 nt, Mus musculus
caggugcagggcagccaccuuggggauuuuggucuggcaga

SEQ ID NO: 71186 - RNA, 44 nt, Mus musculus
uccccagugccuguauauuuucuuuuagcauguccaggguugca

SEQ ID NO: 71187 - RNA, 48 nt, Mus musculus
uuucaggaaggcugcugaagcucugggaaucaucauugcauugacagg

SEQ ID NO: 71188 - RNA, 46 nt, Mus musculus
agaggcuuccaaaccugccccuuccgugccuacuuuagagccaaca

SEQ ID NO: 71189 - RNA, 45 nt, Mus musculus
acaucaguucuggguugugugcauuucauggguaucucucaagau

SEQ ID NO: 71190 - RNA, 46 nt, Mus musculus
aucaucagcauuucaguauaauuagagagcuagaaagccccaagac

SEQ ID NO: 71191 - RNA, 47 nt, Mus musculus
ugauaggcuacagguguuaaucgccuaagccagcaagcaagcccuca

SEQ ID NO: 71192 - RNA, 42 nt, Mus musculus
gcaggagcuggagggccagguuccauuccagaaagggcccag

SEQ ID NO: 71193 - RNA, 85 nt, Mus musculus
aaaaguguaccaugagauguuguuucugggucauggguccauucauauuuuauagacuucuagggagcccgcuuccaugguggug

SEQ ID NO: 71194 - RNA, 45 nt, Mus musculus
uuuuggcuauugguuucuaggaugaccacgaagcugggaaggcaa

SEQ ID NO: 71195 - RNA, 42 nt, Mus musculus
ggaugucgacggccgguggcggaaccugcccagcgggcccag

SEQ ID NO: 71196 - RNA, 41 nt, Mus musculus
cuuuggguaguucagagaaaaaaagcaacucauaagccuag

SEQ ID NO: 71197 - RNA, 40 nt, Mus musculus
cgagucugguuuggggcgaaccauuucuggguacugugag

SEQ ID NO: 71198 - RNA, 95 nt, Mus musculus
ugcaagaggaaaacuugccaccuguucugaguuggucauguugaggaagauaaaaaguccaggggaaucauuguaacagugguagcagaguaagg

SEQ ID NO: 71199 - RNA, 45 nt, Mus musculus
aauccagguguuuagaaagcucugcauuagauaaggcuaagggaa

SEQ ID NO: 71200 - RNA, 46 nt, Mus musculus
ugugagaacaaaggauggggauauguuggagagcuuugacugccag

SEQ ID NO: 71201 - RNA, 45 nt, Mus musculus
uugcauuggugugguagaugucagugaguguagaccacaaguggu

SEQ ID NO: 71202 - RNA, 46 nt, Mus musculus
ccgugaauggaguccccaaagggaucauuaaacaguuucucggcua

SEQ ID NO: 71203 - RNA, 46 nt, Mus musculus
ggcucaucuuaacaagcgauuugccuuugguugugguaguggucag

SEQ ID NO: 71204 - RNA, 45 nt, Mus musculus
agcuuuucugauuaucagauuuuccaggagcuuaucaagggcaaa

SEQ ID NO: 71205 - RNA, 46 nt, Mus musculus
gaagcucagccuuccugauugguacccuaacguggaagcugccgag

SEQ ID NO: 71206 - RNA, 24 nt, Mus musculus
auuaggggaagaggaaauguuaca

SEQ ID NO: 71207 - RNA, 45 nt, Mus musculus
acuuuuuauguaaaauacuucacccagcuggaaaguaaccacuga

SEQ ID NO: 71208 - RNA, 45 nt, Mus musculus
acguauuaaguaaaugaguaaaucuaaaacaauuaaccaaucaaa

SEQ ID NO: 71209 - RNA, 24 nt, Mus musculus
cuucacugauaaugugcugagaug

SEQ ID NO: 71210 - RNA, 41 nt, Mus musculus
cauuuauccuccucucuggccccucacauuggacaggguag

SEQ ID NO: 71211 - RNA, 46 nt, Mus musculus
ucagacuuacaguaagcuucaagaauacuacgaagaaugcccacag

SEQ ID NO: 71212 - RNA, 46 nt, Mus musculus
cgcuguggcaugaugguggaggucagagggcagcauaaggguggag

SEQ ID NO: 71213 - RNA, 45 nt, Mus musculus
gaucagauaauaaacucuaucgacuccaaaccccucagagcccuc

SEQ ID NO: 71214 - RNA, 48 nt, Mus musculus
gcucauggaagcgucuacaagucugaguucauagaccucucagagaag

SEQ ID NO: 71215 - RNA, 42 nt, Mus musculus
aguauggcgacccuuacuacagcuaccucaaccuuaacacug

SEQ ID NO: 71216 - RNA, 46 nt, Mus musculus
ucaaaucccagcaaccacaugguggcucacaaccaucugcagugug

SEQ ID NO: 71217 - RNA, 47 nt, Mus musculus
acuguguuguggacaacaucaaaguguguaguaacgacaugggcagu

SEQ ID NO: 71218 - RNA, 82 nt, Mus musculus
gcaucacaguccgcaucccccggaacccaaccauuggagauaaguuugccagccgacauggucagaagggcauuuugagcag

SEQ ID NO: 71219 - RNA, 68 nt, Mus musculus
cugcucccugcuuucaguagcagagggugucuguuauccagagcaggccaguacaauaaacagaaaau

SEQ ID NO: 71220 - RNA, 46 nt, Mus musculus
acaugcgccgcuuccugcagugugcagagcaggugcagccaccaag

SEQ ID NO: 71221 - RNA, 45 nt, Mus musculus
cccugcugugugucuggcgcuccuggacaucaggacacuaaauaa

SEQ ID NO: 71222 - RNA, 42 nt, Mus musculus
gggcaguggacauaaaaauacugaucuuauugaaaacagcag

SEQ ID NO: 71223 - RNA, 43 nt, Mus musculus
gucauauucacuggggagggucugaauguauggcugccagaaa

SEQ ID NO: 71224 - RNA, 46 nt, Mus musculus
agaaauaggcguacuggcgugcuguguuuuuauacuggcugaagac

SEQ ID NO: 71225 - RNA, 44 nt, Mus musculus
aaaaccacuguggaucacaaacucugcauuugaccgagugccau

SEQ ID NO: 71226 - RNA, 45 nt, Mus musculus
agucaugcagaauacucggagaaaagcuagaagcugggcagagau

SEQ ID NO: 71227 - RNA, 32 nt, Mus musculus; identical to SEQ ID NO: 22055

SEQ ID NO: 71228 - RNA, 45 nt, Mus musculus
uaagaaaauucuuuuuggccuacagagauggcucagcgguuaaga

SEQ ID NO: 71229 - RNA, 42 nt, Mus musculus
guuuuuuguuugucuuuuguuuuuguuuuuguuuuuugagau

SEQ ID NO: 71230 - RNA, 50 nt, Mus musculus
gagggacucucuacccacucgugaagcagccgcgggcgccucagcaggcg

SEQ ID NO: 71231 - RNA, 49 nt, Mus musculus
agggccgaacagagagaccagaagaacgagacugaggcaggcucgagcc

SEQ ID NO: 71232 - RNA, 82 nt, Mus musculus
uggcucuggagggcuaaaagcacggagcagaauuccauggcggauuagagaaaggacgcaaguucauccuggggggacgaag

SEQ ID NO: 71233 - RNA, 45 nt, Mus musculus
gaagcccaggaugagcauccauagauugucauacuucgguggagc

SEQ ID NO: 71234 - RNA, 46 nt, Mus musculus
agggagaaaccaaugguugcaccgacaauacaaugggucccagaaa

SEQ ID NO: 71235 - RNA, 46 nt, Mus musculus
ucuccugagaaaaauucauuuauucuuacuguaauucagcccagag

SEQ ID NO: 71236 - RNA, 44 nt, Mus musculus
cccucaucuguuacugagggauuagugagcaagugagagacaga

SEQ ID NO: 71237 - RNA, 42 nt, Mus musculus
auggugggccggguguggucguucacgccuuuaaucccagca

SEQ ID NO: 71238 - RNA, 46 nt, Mus musculus
caaaugccuuaaaaggaaaaacaaaaacaggcaagaggauguugau

SEQ ID NO: 71239 - RNA, 42 nt, Mus musculus
ccagacgauaagggcacagaaaacugcacaucccaccgagau

SEQ ID NO: 71240 - RNA, 42 nt, Mus musculus
guccucuccuccaccacagcccggaguggcccaguggcacac

SEQ ID NO: 71241 - RNA, 42 nt, Mus musculus
acuaccacuucaucccgucuagauuacucaguguccccccag

SEQ ID NO: 71242 - RNA, 48 nt, Mus musculus
agaggacugguagccugaggaggccacgagcaccgcagagacuauggc

SEQ ID NO: 71243 - RNA, 46 nt, Mus musculus
ggcagcccagguuuuauuuacaguccuccuuuugcacuuguuauug

SEQ ID NO: 71244 - RNA, 45 nt, Mus musculus
gagaguaggagaugagaauguggucagugcuguaaggggguugag

SEQ ID NO: 71245 - RNA, 46 nt, Mus musculus
gguacauuuuugucuuaaaauuuaaauugugggggacuggagagau

SEQ ID NO: 71246 - RNA, 31 nt, Mus musculus
ugccucugccuccuggugcugggacuaaagg

SEQ ID NO: 71247 - RNA, 45 nt, Mus musculus
gcuuguaaagcaccauuauuucacccuugugcuguauucauaguu

SEQ ID NO: 71248 - RNA, 45 nt, Mus musculus
aguuuuugcaugugaaugcuuugggugauauauauauagagagau

SEQ ID NO: 71249 - RNA, 45 nt, Mus musculus
gcacucgggaggcagaggcaggccggggcucguguggucaggaga

SEQ ID NO: 71250 - RNA, 48 nt, Mus musculus
cacugauuuuagaaaagaacguuuuucuucauuaugauuagaaggaga

SEQ ID NO: 71251 - RNA, 82 nt, Mus musculus
cauuccugaugagugcuccgucauugcucgcaucaugccagguucaagugagcaaggaaggcuuagaguauacauggacagu

SEQ ID NO: 71252 - RNA, 41 nt, Mus musculus
agcagccgcaaguaggaagggagccccaagugcgacccaga

SEQ ID NO: 71253 - RNA, 45 nt, Mus musculus
acagcaagcacauggaggaaaugcuaaauguacacaucccgagac

SEQ ID NO: 71254 - RNA, 43 nt, Mus musculus
agagcagugucauucacugcaggacugucaagaaaccccaggc

SEQ ID NO: 71255 - RNA, 46 nt, Mus musculus
cuacaagacccaucaacauuaaauuccagacuaaaccagccaguau

SEQ ID NO: 71256 - RNA, 46 nt, Mus musculus
uuauuucucucuuucucucuaacuuucuuucauugaacaggccaac

SEQ ID NO: 71257 - RNA, 46 nt, Mus musculus
gccuuaucuaaaagccaagaauaucugccccaaaccaccaccaucu

SEQ ID NO: 71258 - RNA, 46 nt, Mus musculus
ugcuacacuugucccuaggauagcccccaaaaaagucacaaaagga

SEQ ID NO: 71259 - RNA, 42 nt, Mus musculus
guaccuggcagccaagggaaagcuaaaggaccccaacgccaa

SEQ ID NO: 71260 - RNA, 42 nt, Mus musculus
cagaacuuugacagcagucagguggcagguucggccccaguc

SEQ ID NO: 71261 - RNA, 45 nt, Mus musculus
agagagacagagagagagagagacagagagagagagagacuuacu

SEQ ID NO: 71262 - RNA, 39 nt, Mus musculus
agacgaauggccauuuaaucgugaguaagagaugaagag

SEQ ID NO: 71263 - RNA, 42 nt, Mus musculus
acuagaguuucugcuacacacuauuuuaagucuggggaaaaa

SEQ ID NO: 71264 - RNA, 41 nt, Mus musculus
uguaaacagucccgugaaucaaacccaggagagcccggcgg

SEQ ID NO: 71265 - RNA, 42 nt, Mus musculus
cccgggccccccuugccucaucccuccgucuagccccgagau

SEQ ID NO: 71266 - RNA, 46 nt, Mus musculus
gagacuggugagggcccagaauucugcuagugccaacuccacguuc

SEQ ID NO: 71267 - RNA, 45 nt, Mus musculus
aaacaagcacaaaucucaugugcugaaccaaauagggguccagau

SEQ ID NO: 71268 - RNA, 42 nt, Mus musculus
aacguucucucuugguguauagcugugaaauacuggggacac

SEQ ID NO: 71269 - RNA, 45 nt, Mus musculus
gucugagagcaggagccacaagaggugacaacaggaucccccagg

SEQ ID NO: 71270 - RNA, 46 nt, Mus musculus
caagaugaaguuccuccuccuuaggcugacaucagagccccuggca

SEQ ID NO: 71271 - RNA, 42 nt, Mus musculus
cugccagauguggugcuguagcuccuucccagaaggucugac

SEQ ID NO: 71272 - RNA, 48 nt, Mus musculus
ccauggucugagcaccaccccacauuucacacagguaaacaacccaga

SEQ ID NO: 71273 - RNA, 25 nt, Mus musculus
agcacauuuuaccaccucaacagaa

SEQ ID NO: 71274 - RNA, 46 nt, Mus musculus
caauaaagccaggcgugguggugcacgccuuuaaucccagcacuca

SEQ ID NO: 71275 - RNA, 45 nt, Mus musculus
ucacaaccauuuguaaugggaucugaugcccucuucugcugugug

SEQ ID NO: 71276 - RNA, 42 nt, Mus musculus
auuauugggggcuggagagauggcucagugguuaagagcacu

SEQ ID NO: 71277 - RNA, 45 nt, Mus musculus
uauuauucuacugaaggagaaagagaaggguagagugggcagccc

SEQ ID NO: 71278 - RNA, 42 nt, Mus musculus
uagauagugagccuuuaucaggaacccagagcaggacuagag

SEQ ID NO: 71279 - RNA, 41 nt, Mus musculus
gccccagagcuucuacuggcaagucugcaccccagacagag

SEQ ID NO: 71280 - RNA, 46 nt, Mus musculus
accugccuagaguugagcccccccagugcccccagaugggguggga

SEQ ID NO: 71281 - RNA, 41 nt, Mus musculus
ugucaacuuggccuaugaaauacuugaaccagaacccacgg

SEQ ID NO: 71282 - RNA, 45 nt, Mus musculus
gcacucuccauugaaagauauuagaggcuucugacuggccaucau

SEQ ID NO: 71283 - RNA, 46 nt, Mus musculus
caggcgcaccuaccaguaaucuaucucaggaaugaguugcuuaugg

SEQ ID NO: 71284 - RNA, 45 nt, Mus musculus
cuuaccucuccucgauacuuucaggacauagcuauccuccaagag

SEQ ID NO: 71285 - RNA, 46 nt, Mus musculus
uuuuguuuuagacagggucuuauacuauguagcccugaaaucauag

SEQ ID NO: 71286 - RNA, 34 nt, Mus musculus
uuuuuuugagauaauuacaguugccccuuucccu

SEQ ID NO: 71287 - RNA, 46 nt, Mus musculus
cuguuuuaagauuucauuuacuaucuguaaagggaugcaaagccag

SEQ ID NO: 71288 - RNA, 45 nt, Mus musculus
caggaucaaguucaugugcuugucaaaggcuuugaaggucccgau

SEQ ID NO: 71289 - RNA, 42 nt, Mus musculus
uagucgccagccagccagccgcuggauucccgccgccgccgc

SEQ ID NO: 71290 - RNA, 46 nt, Mus musculus
uccaaggccaccugggaugaagagaagggacagaaggccaccagac

SEQ ID NO: 71291 - RNA, 46 nt, Mus musculus
acgcgcaucgagaagguauugauaucuuuauccaguugguccagga

SEQ ID NO: 71292 - RNA, 45 nt, Mus musculus
ccccaauuaaggcugacaggcugggggcuacuuggcucaucuugg

SEQ ID NO: 71293 - RNA, 46 nt, Mus musculus
ccagguuggugaggcugccagcaugagcaaugaggcgugcaccuac

SEQ ID NO: 71294 - RNA, 46 nt, Mus musculus
gaacuuucuaccucaccaagugccaaccuagcucccagaggcagag

SEQ ID NO: 71295 - RNA, 45 nt, Mus musculus
aauucuugaggcaauacugcauuuguuugcuagguaucgggagau

SEQ ID NO: 71296 - RNA, 73 nt, Mus musculus
cagucucauagaaagacagccguuccucaacuuguucucggaguuuuuccccaaauacacuuguggggaccuc

SEQ ID NO: 71297 - RNA, 52 nt, Mus musculus
accugaaccacagcuuccuucaugacauccagguucuuccgugggaucucuc

SEQ ID NO: 71298 - RNA, 47 nt, Mus musculus
uggugauuucagcagccgcuuccucugccuggcaaaaaagcaaggcg

SEQ ID NO: 71299 - RNA, 49 nt, Mus musculus
uccucugggguacugcuguuuucugacgaggccagggccagugcagcca

SEQ ID NO: 71300 - RNA, 77 nt, Mus musculus
ugcccccaccccccaucaugagacacuaucaccuccagacacagaacagggagagcaggaauucacacuacccccgu

SEQ ID NO: 71301 - RNA, 91 nt, Mus musculus
acucucacauuuuauaauuucccuggcccucuuaaacccuagagaaaacccccuguaugcugcucacgauggauaucaugcagagcuccca

SEQ ID NO: 71302 - RNA, 46 nt, Mus musculus
uccuuaggugaggacuucuuucucuuagcacugcuaguggccaucu

SEQ ID NO: 71303 - RNA, 45 nt, Mus musculus
uuuucuuuuucuuugugcugcucuuugugaaguuagcagcaacuu

SEQ ID NO: 71304 - RNA, 46 nt, Mus musculus
agcugucauuacugcccugucauaaauccuauacaugcccaugaaa

SEQ ID NO: 71305 - RNA, 46 nt, Mus musculus
aaaggaccaugcuucguauacaucccuucaguacaauggaccagaa

SEQ ID NO: 71306 - RNA, 46 nt, Mus musculus
gcuguagguacggacucgagacaugggaggcuacagcaccacaacu

SEQ ID NO: 71307 - RNA, 46 nt, Mus musculus
gcggcaucucaaguagguuacaggaagcucaagcugggucgugggu

SEQ ID NO: 71308 - RNA, 46 nt, Mus musculus
ugguuccuggggagagcuacagugcagaguaugcaguuuuugagac

SEQ ID NO: 71309 - RNA, 45 nt, Mus musculus
ucuggaacaugaggugaggcuuagaaacuacggaggacaaggaga

SEQ ID NO: 71310 - RNA, 49 nt, Mus musculus
uuccuggauacaagacucggcacaacaaucuagaccugguuaucauucg

SEQ ID NO: 71311 - RNA, 45 nt, Mus musculus
cugucccuguggaauuuaaggagcaucaucugagcgaggugcaga

SEQ ID NO: 71312 - RNA, 44 nt, Mus musculus
ugcugucaaggaaguguucaaggugaauagcccggggcggggga

SEQ ID NO: 71313 - RNA, 46 nt, Mus musculus
gggagaagucugugucguggcagguuggcaccugugggccugugga

SEQ ID NO: 71314 - RNA, 52 nt, Mus musculus
cucaggaggagcaggcuugggugcaacugaaagagcaagaagugcucaagcu

SEQ ID NO: 71315 - RNA, 42 nt, Mus musculus
guccccucuagaagccaagcuugucuuguaagucucuuggag

SEQ ID NO: 71316 - RNA, 45 nt, Mus musculus
acagaaggugaccacagggcagcugguacacaggcucauuugugg

SEQ ID NO: 71317 - RNA, 46 nt, Mus musculus
aauucuuaauuccagcccugcuuucuuuaaaaauauuugguuuuac

SEQ ID NO: 71318 - RNA, 25 nt, Mus musculus
cagaggcagaggagcagaggcgcag

SEQ ID NO: 71319 - RNA, 42 nt, Mus musculus
gggcagaggcagaggggcagaggcagaggagcagaggggcag

SEQ ID NO: 71320 - RNA, 64 nt, Mus musculus
aggggcagagaggcagaggggcagagaggcagaggggcagagaggcagagaggcagaggcgcag

SEQ ID NO: 71321 - RNA, 46 nt, Mus musculus
aaccacagcaaagaaaagcacaaaaggggcugaagagaaggcucag

SEQ ID NO: 71322 - RNA, 46 nt, Mus musculus
acuuuaaaagacacguucuuggaaauaguuaggaagaaauauucag

SEQ ID NO: 71323 - RNA, 46 nt, Mus musculus
cugaaauagagugcuggaguaggaaccggucgauccgggcuuucag

SEQ ID NO: 71324 - RNA, 45 nt, Mus musculus
auauauaaauauauaaauauauaaauauauauaucuaccauaugu

SEQ ID NO: 71325 - RNA, 41 nt, Mus musculus
agccugggaagaugugagugcgaaaggaggccaaggggaga

SEQ ID NO: 71326 - RNA, 46 nt, Mus musculus
ccagccccuuucccuucuugggcugcuaccgccgccaccaccguca

SEQ ID NO: 71327 - RNA, 44 nt, Mus musculus
ucugucagaaggagcaggccgacuuccugccccggauggaggaa

SEQ ID NO: 71328 - RNA, 42 nt, Mus musculus
acagcugcaggaggaggcggcccagcugauaaggcaacggga

SEQ ID NO: 71329 - RNA, 42 nt, Mus musculus
gcuccgagcacugcagaaaaggaaacagguuagaggcaucag

SEQ ID NO: 71330 - RNA, 45 nt, Mus musculus
cacccaccugugggaaaagccaggaggaaguagcuggcugcuggu

SEQ ID NO: 71331 - RNA, 42 nt, Mus musculus
cuucauggucaccugaacggggucaagguccaaaggggugug

SEQ ID NO: 71332 - RNA, 42 nt, Mus musculus
ggccugacaggaaggacacaacauuagaauugagcaucacag

SEQ ID NO: 71333 - RNA, 46 nt, Mus musculus
acacuggccaggcgugguggcgcaugccuuuaaucccagcacucga

SEQ ID NO: 71334 - RNA, 45 nt, Mus musculus
cucgagugcugggauuaaaggcaugcgccaccacgccuggccagu

SEQ ID NO: 71335 - RNA, 46 nt, Mus musculus
gacagugugcucacauacauaaaauuaaauaaauaaaucuuggaag

SEQ ID NO: 71336 - RNA, 41 nt, Mus musculus
gagcucacagagaacuacucgcuucucccgguacuugagau

SEQ ID NO: 71337 - RNA, 45 nt, Mus musculus
ucucgaaaaaacaaaacaaaacaaaaaauucucagggcuguggau

SEQ ID NO: 71338 - RNA, 46 nt, Mus musculus
agccuagucuuuguaagagagggaaaaaaugcagaugaccacagua

SEQ ID NO: 71339 - RNA, 45 nt, Mus musculus
uagagaucuaucugauucccaagugcuagaauuaaaggcaugcac

SEQ ID NO: 71340 - RNA, 46 nt, Mus musculus
cuuauuuacagacccagguguucugaguaagcugaaaaccuuaggg

SEQ ID NO: 71341 - RNA, 45 nt, Mus musculus
aaucccuagauaaguaccuucucaugggcagagaaaagugaagau

SEQ ID NO: 71342 - RNA, 46 nt, Mus musculus
gccuuuaauccacaacuuucuggucauauuccaucccugccccaag

SEQ ID NO: 71343 - RNA, 33 nt, Mus musculus
uuggggcagggauggaauaugaccagaaaguug

SEQ ID NO: 71344 - RNA, 42 nt, Mus musculus
gcagccaguuccucugggguuauguagauaaacuugccccgg

SEQ ID NO: 71345 - RNA, 42 nt, Mus musculus
cuagaagccuccgccuagcuuuggagugaggcaugggaagaa

SEQ ID NO: 71346 - RNA, 42 nt, Mus musculus
ugaagaugguaaguugugaugcccuuucagacuguccccaac

SEQ ID NO: 71347 - RNA, 88 nt, Mus musculus
ggaagagaggaaggcucaggaggagcaggcccggcgggagcacgaggaguaccugaaacugaaggaggccuucgugguagaagaagaa

SEQ ID NO: 71348 - RNA, 45 nt, Mus musculus
ucucccuguuuuaguuuuucauguauugguauauuucucacaaga

SEQ ID NO: 71349 - RNA, 79 nt, Mus musculus
cggaaacgccuagagucccaacgugaggccgaauggaagaaggaagaggaacggcuucgccugaaggaagaacagaagg

SEQ ID NO: 71350 - RNA, 42 nt, Mus musculus
agccguuccucuuccuucuuccauucggccucacguugggac

SEQ ID NO: 71351 - RNA, 44 nt, Mus musculus
guggcuuucuuuggccucuguggggggugagaaaacuagcuaga

SEQ ID NO: 71352 - RNA, 81 nt, Mus musculus
guucacccaacagggaaaauuggagccaagaaacuacggaagcuagaggaaaaacaggcucgaaaggcucagcgagaggca

SEQ ID NO: 71353 - RNA, 24 nt, Mus musculus
ggggaugagaaugugggucaaacu

SEQ ID NO: 71354 - RNA, 45 nt, Mus musculus
ggggucugcuuccaguucucuguucuucagacuccuggggcaaag

SEQ ID NO: 71355 - RNA, 46 nt, Mus musculus
gucugaagaacagagaacuggaagcagaccccggcgucggagggac

SEQ ID NO: 71356 - RNA, 56 nt, Mus musculus
gaccccggcugcgagucaggaagaggaucaggccgaugagcaaaacugccgccacc

SEQ ID NO: 71357 - RNA, 40 nt, Mus musculus
gcucaaagaacuaaaacaaaacaacccauccucaaaagau

SEQ ID NO: 71358 - RNA, 46 nt, Mus musculus
auauauguauauauauauauauagagagagagagagagagagagaa

SEQ ID NO: 71359 - RNA, 42 nt, Mus musculus
gaugucauggaugcugagcauaggcccugaccugcgccaccc

SEQ ID NO: 71360 - RNA, 46 nt, Mus musculus
cugcccuacaugaagauggucuuuccccucaucaugauugccauga

SEQ ID NO: 71361 - RNA, 44 nt, Mus musculus
acaucauacccacccacacacuacauccggagagugccccaaag

SEQ ID NO: 71362 - RNA, 45 nt, Mus musculus
caagagccgcagggcacagcaugagcucccuccauacucacagac

SEQ ID NO: 71363 - RNA, 45 nt, Mus musculus
agaugguugugagccaucacguggggauugaacucaggaccuuug

SEQ ID NO: 71364 - RNA, 42 nt, Mus musculus
ucaaggcuaagaaaaggaagagaaugaugcaucaggcuagga

SEQ ID NO: 71365 - RNA, 45 nt, Mus musculus
cagccaguacuauuuauaaauaauucaaaggcugaucauuguagc

SEQ ID NO: 71366 - RNA, 44 nt, Mus musculus
gcccuguagcugcuuccauaucuagaaacagaucaagaagagac

SEQ ID NO: 71367 - RNA, 24 nt, Mus musculus
gguucacucucccgccacacacac

SEQ ID NO: 71368 - RNA, 83 nt, Mus musculus
gaggaggaggugacauugaauuugagcaugugagguuaaguaggauuugcaagcgugaaguuggggagaagaauuccaaaugg

SEQ ID NO: 71369 - RNA, 45 nt, Mus musculus
uguaauuuuauucuuguagaacuuaacuuuucguuugggaguaaa

SEQ ID NO: 71370 - RNA, 46 nt, Mus musculus
gggaugcaacaggucacucuguuuucaugaaauuguagacuuagag

SEQ ID NO: 71371 - RNA, 42 nt, Mus musculus
ucugaaaaccugggcuacaggcaugagauguuaugggcaguu

SEQ ID NO: 71372 - RNA, 45 nt, Mus musculus
auugugugggaguauagagauaaaaugguuaggucucucuuucag

SEQ ID NO: 71373 - RNA, 88 nt, Mus musculus
uggcacauguuccuuguugguugagguuauuuaccuguaagagggcuugccagggagagaaagagaucugaguguccacaugaauagu

SEQ ID NO: 71374 - RNA, 47 nt, Mus musculus
cauaauuugauuuuaaccuuucaauuuuuaauucuucaagccuucag

SEQ ID NO: 71375 - RNA, 46 nt, Mus musculus
guaagaguauguacacauaugcaugggugcccaaggaagucagaag

SEQ ID NO: 71376 - RNA, 56 nt, Mus musculus
uucuccuuccaccaugugggucuugggauugauugucaggcuuggagggaaggguu

SEQ ID NO: 71377 - RNA, 45 nt, Mus musculus
ucugugugucugugugucugugugucugugugucgugagugggua

SEQ ID NO: 71378 - RNA, 46 nt, Mus musculus
agggcagagauggaaaggugaaacaaguuggagcugagcuuugaug

SEQ ID NO: 71379 - RNA, 94 nt, Mus musculus
aggcuuuugcuggggacuaggugaggauggggagaauuuaaguuagcagcugguacacagagggcaggggagagauaaagaugaaguaguuugu

SEQ ID NO: 71380 - RNA, 66 nt, Mus musculus
caauggcucuaaacccuagaugaggagccuaagcaaggccccgaggaaggcaucuccagggaaaga

SEQ ID NO: 71381 - RNA, 45 nt, Mus musculus
aggcguucggggacuuaaguuuuggauuuggauuuggauuuugga

SEQ ID NO: 71382 - RNA, 80 nt, Mus musculus
cccugagcacaugcucgagugcacgcaugcacauacaugugauaauacauauguugagguucagucuguugcuguggauu

SEQ ID NO: 71383 - RNA, 45 nt, Mus musculus
aguaaauauacauauucaugcuuacagccuguagcuuggcagaag

SEQ ID NO: 71384 - RNA, 51 nt, Mus musculus
uucaguucccaggcuuggggucugaggcagagaccacaaggaagaaagaga

SEQ ID NO: 71385 - RNA, 46 nt, Mus musculus
uggcuuuauaacucagagcuacugacagggaaguagguaggcaaag

SEQ ID NO: 71386 - RNA, 44 nt, Mus musculus
agggccauuugauauuuugaagcuagcaaccauagaaguggaca

SEQ ID NO: 71387 - RNA, 46 nt, Mus musculus
aucaaugauucugagaauuggugcuuugagaagauauggccaacag

SEQ ID NO: 71388 - RNA, 46 nt, Mus musculus
uaaaucuucaaaaauuugggcuguccugggaaaggcaugguguggu

SEQ ID NO: 71389 - RNA, 41 nt, Mus musculus
gacuuaggagaaggugugcuuaguuuccuuucccuccuugu

SEQ ID NO: 71390 - RNA, 75 nt, Mus musculus
acaugauuuuguuaggcguauuagaacuuaaccuuacgugaguguguauuucugguuauugggacacaagggaca

SEQ ID NO: 71391 - RNA, 48 nt, Mus musculus
aguagauguggacaggguccauagagaucuauauuaugcaacugcagu

SEQ ID NO: 71392 - RNA, 49 nt, Mus musculus
uuuuuaucauggucuguacaagaaaucuuaaguaaaugggcuagaaaug

SEQ ID NO: 71393 - RNA, 50 nt, Mus musculus
gugggaagacaacucacugaaagggaggaaauagccuggaagagauaaag

SEQ ID NO: 71394 - RNA, 45 nt, Mus musculus
cucauuacugacagauaguguaucuuagagccuggcagaugggau

SEQ ID NO: 71395 - RNA, 46 nt, Mus musculus
uggaaaauuucagagauuuuaguaaaauuugaaaauggagcuggga

SEQ ID NO: 71396 - RNA, 50 nt, Mus musculus
cagaauguagcugggaccauuuauauguuuaugauggggacucaaucuac

SEQ ID NO: 71397 - RNA, 46 nt, Mus musculus
gaauuuuugcuauuuuauuuuaagaaagauuuuugugugucuacag

SEQ ID NO: 71398 - RNA, 42 nt, Mus musculus
acuuaaauuuucugaaaguuuauuguuacuuuguaugugggg

SEQ ID NO: 71399 - RNA, 46 nt, Mus musculus
aacagcagcagcgcuguugagugugaauguucugaaaacuggaaag

SEQ ID NO: 71400 - RNA, 46 nt, Mus musculus
ugcucaauuccugugccagcuaaccagucuuuuuggacucgagaag

SEQ ID NO: 71401 - RNA, 46 nt, Mus musculus
cacaccuccuaauccuucccaaaacaguuccaccaaucaggaccaa

SEQ ID NO: 71402 - RNA, 77 nt, Mus musculus
aggcauaguaauuaaaagacacaaaguaguguagaacagugaaguaaccuuauaaaauggaugacagcucuaaaaca

SEQ ID NO: 71403 - RNA, 46 nt, Mus musculus
ugcccucuuguggccucugcuggcacugcaugcgcaugguacacag

SEQ ID NO: 71404 - RNA, 46 nt, Mus musculus
cagaagagagcaucaaaucccauuacagaugguugugagccaccaa

SEQ ID NO: 71405 - RNA, 46 nt, Mus musculus
gaacagucaguucucuuaaccacuaagccaucucuccagccccuau

SEQ ID NO: 71406 - RNA, 46 nt, Mus musculus
ccauuaucaagucuagcauacugcaugcgugugacugaguagccau

SEQ ID NO: 71407 - RNA, 46 nt, Mus musculus
cuggagaacugccuucagcaaagaauagcaagagaaagcugucuag

SEQ ID NO: 71408 - RNA, 46 nt, Mus musculus
auacucagggugcucuugugcaaggggguuauggccacaguagugu

SEQ ID NO: 71409 - RNA, 45 nt, Mus musculus
gugacuguuagacuagaauguucagaucugauucagagugccagg

SEQ ID NO: 71410 - RNA, 89 nt, Mus musculus
ggagaugucuuuaggacagagcugauugcugagaggugguuguaggagaggugaguuauuguggggcauaaaagaugagcaagagucag

SEQ ID NO: 71411 - RNA, 24 nt, Mus musculus
ugugagauauguuaauggccagaa

SEQ ID NO: 71412 - RNA, 45 nt, Mus musculus
gcuaccaaauuucucauuguggauuaguauuaaacuugcguggag

SEQ ID NO: 71413 - RNA, 46 nt, Mus musculus
cuaugugauagacuucuagaaaagugauuuaaaguucaaaagguaa

SEQ ID NO: 71414 - RNA, 45 nt, Mus musculus
ggugagauuccuagaaaaugcuguuuauagcuaggaaugggguua

SEQ ID NO: 71415 - RNA, 41 nt, Mus musculus
ugaauguguguauguguguguuuguguauguguguguaugc

SEQ ID NO: 71416 - RNA, 34 nt, Mus musculus
gcaguacagcauaacagacaaacuauggucccuu

SEQ ID NO: 71417 - RNA, 46 nt, Mus musculus
caaugaucacugugucccugugaaccacagcugcacagaaggccag

SEQ ID NO: 71418 - RNA, 46 nt, Mus musculus
ucuuucugucuaucuauccuccaucuaauucuaucuaucuguccac

SEQ ID NO: 71419 - RNA, 45 nt, Mus musculus
cauuugguuggaaacucgugucugaaaaucacuacugcuaaggag

SEQ ID NO: 71420 - RNA, 52 nt, Mus musculus
aggaagcaguguaggcauggucagggcuagggacagcggagacagcaagaua

SEQ ID NO: 71421 - RNA, 44 nt, Mus musculus
guguacagguguguguacaugcauguguguauaagaguauguga

SEQ ID NO: 71422 - RNA, 46 nt, Mus musculus
auguaucauguagggcacugccuauguuuuauuccagaaguuucag

SEQ ID NO: 71423 - RNA, 46 nt, Mus musculus
cagguccucugcaagaacagccagugcuccuacuccccagccccag

SEQ ID NO: 71424 - RNA, 109 nt, Mus musculus
cauuugggaguaguccuucuguuuauuaaaaaaaaaaauuaagaaugauugguuguugugugguggaauucugcugugaacccaucugguucuggacucuauucggaag

SEQ ID NO: 71425 - RNA, 49 nt, Mus musculus
aguuuuaaaguauuucuuuauagcauucuguauuuuuuggcaucuguug

SEQ ID NO: 71426 - RNA, 47 nt, Mus musculus
ugggacuguuaccuucccuuuuagaccugcuuuuaaugugccccaga

SEQ ID NO: 71427 - RNA, 46 nt, Mus musculus
auggccugcuuuugguuuugguugguugguuuuuagacagaucuag

SEQ ID NO: 71428 - RNA, 77 nt, Mus musculus
uuaaauauuuacugaacaaaggaacaaaaugcugagucugucacagagaugaaaauagccguugcuucaggggacag

SEQ ID NO: 71429 - RNA, 46 nt, Mus musculus
auuuaauguugccucuauauuauuagaaauaaauuacaagcugaaa

SEQ ID NO: 71430 - RNA, 46 nt, Mus musculus
acuacauaguaagacuguaucaaucaaucaguagaugaagagaaag

SEQ ID NO: 71431 - RNA, 45 nt, Mus musculus
aaggaaggaaggaaggaaggaaggggaagaacaaaacaagcuuag

SEQ ID NO: 71432 - RNA, 46 nt, Mus musculus
uauugguaaugaagguuugcuggauaauucaaaggauacugcaaag

SEQ ID NO: 71433 - RNA, 46 nt, Mus musculus
ccaaacaucacuuucuuuguuuaugucaguaauuucacuuggccca

SEQ ID NO: 71434 - RNA, 47 nt, Mus musculus
uucuagauucaguuagagacccugucucaaguaaaauaagguagaga

SEQ ID NO: 71435 - RNA, 45 nt, Mus musculus
acuuuucucaguaguacggccaauuaguugacuugucuaacggag

SEQ ID NO: 71436 - RNA, 23 nt, Mus musculus
uauguaugaugagucaggaccca

SEQ ID NO: 71437 - RNA, 27 nt, Mus musculus
agacuggggacccuugaagcguccaac

SEQ ID NO: 71438 - RNA, 44 nt, Mus musculus
ucugcucuacucauggguggaggagaccagugccgaccccguga

SEQ ID NO: 71439 - RNA, 45 nt, Mus musculus
ucugucuuacacacaugcacacauacacacacacuaagugccuag

SEQ ID NO: 71440 - RNA, 58 nt, Mus musculus
uugcaguuuguucuuuuuuuaaagucuaauuugcagccaagaacgaguaauucucacc

SEQ ID NO: 71441 - RNA, 42 nt, Mus musculus
aagagcagaaaguucuagaaaugaucccagccucauccccua

SEQ ID NO: 71442 - RNA, 42 nt, Mus musculus
gggugacacacggcugugaucuaagcauucagaagacagagg

SEQ ID NO: 71443 - RNA, 46 nt, Mus musculus
cagcaaaaggaaaauaccagaauaucuggaaagcuugaaguguaag

SEQ ID NO: 71444 - RNA, 50 nt, Mus musculus
aaauaaaaguaaauacuauaauacaaaguuccuucugaaauaaaaguaga

SEQ ID NO: 71445 - RNA, 45 nt, Mus musculus
gaaaaaaagagggagucucaggaaaagaacaccccaggggacagg

SEQ ID NO: 71446 - RNA, 81 nt, Mus musculus
guacacuguagcugucuucagacacuccagaagaaggcaccagaucuuguuauggaugguugugagccaccauguggcugc

SEQ ID NO: 71447 - RNA, 45 nt, Mus musculus
guuacaguguacuuauguauaauaaaugaaucucuggggccagau

SEQ ID NO: 71448 - RNA, 46 nt, Mus musculus
cccagcaccacaugguggcucacaaccaucuguaaugggauccacc

SEQ ID NO: 71449 - RNA, 24 nt, Mus musculus
cugucuuguaggggaaggaaagaa

SEQ ID NO: 71450 - RNA, 46 nt, Mus musculus
aaaaccaagcauacaaacaaacaaaaaauuaggugugguggcacau

SEQ ID NO: 71451 - RNA, 77 nt, Mus musculus
ucauaaaaugcuggguguggccagguggugguagcacaagccuuuaaucauagugcuugggagacagaggcaggcag

SEQ ID NO: 71452 - RNA, 23 nt, Mus musculus
gcugaaagcacgaagacagcucu

SEQ ID NO: 71453 - RNA, 46 nt, Mus musculus
uccagccaucaaugcuaaagaugcugcucugaaugggcacacaccu

SEQ ID NO: 71454 - RNA, 51 nt, Mus musculus
auacugauugucagcauaacuggaguaggaagcacccagagcauuagugug

SEQ ID NO: 71455 - RNA, 46 nt, Mus musculus
gccucagguuucauagacguguuuguacacuaagaauucugcagca

SEQ ID NO: 71456 - RNA, 46 nt, Mus musculus
cugcuuccccuaccuucuccaggaugacaaaagcuugccccccagu

SEQ ID NO: 71457 - RNA, 45 nt, Mus musculus
caaacaaccuaggugaggucacuggauaaugcacacccuugauau

SEQ ID NO: 71458 - RNA, 82 nt, Mus musculus
cugucugugcccaucacuucucacugggauuccaggcugccaacaggggagagccuuauuuaucauuuugagaccuauuuau

SEQ ID NO: 71459 - RNA, 87 nt, Mus musculus
aucuguuguuuuugcccugggcucacugcccccuuccccacacuccuaacuguaugaaucccucaccauucccacccacccccccgc

SEQ ID NO: 71460 - RNA, 44 nt, Mus musculus
ggaaaagauccguggacaguuuuacuccuuacugccaccuggag

SEQ ID NO: 71461 - RNA, 42 nt, Mus musculus
gugugugccaggcugggccagccagcacauuuaccugcugac

SEQ ID NO: 71462 - RNA, 46 nt, Mus musculus
aucccccacuugaaaaucaucaagccuggguccucuuugggaucgg

SEQ ID NO: 71463 - RNA, 42 nt, Mus musculus
ggggaggaaaugauggagggaggaaggaaagaaggaaggaag

SEQ ID NO: 71464 - RNA, 44 nt, Mus musculus
agggaggaaagggggaggaaaugauggagggaggaaggaaagaa

SEQ ID NO: 71465 - RNA, 46 nt, Mus musculus
uacggauaucaacaugccauuagcaacucaaaggcggucagagaag

SEQ ID NO: 71466 - RNA, 59 nt, Mus musculus
guggaagguuuuuucccccaucuuuucaauuucuucaaggacaagaaaugacacaaaaa

SEQ ID NO: 71467 - RNA, 58 nt, Mus musculus
gcccagugguuccucugacucaggaauuaacucugcguccagcuuuccuaugaaucuc

SEQ ID NO: 71468 - RNA, 46 nt, Mus musculus
uuccaaccucucccauuccauccauaaauacauccaggcuguccug

SEQ ID NO: 71469 - RNA, 46 nt, Mus musculus
gguugugagccaccaugugguugcugggauuugaauucagggcccc

SEQ ID NO: 71470 - RNA, 46 nt, Mus musculus
ccgccaucuugacaauauucaacuucccuuuuauauuuuguucuca

SEQ ID NO: 71471 - RNA, 50 nt, Mus musculus
agccagggugcaggaagcaagaggagcaagaagcaagagagagaagcaag

SEQ ID NO: 71472 - RNA, 52 nt, Mus musculus
gagccagggugcaggaagcaagaggagcaagaagcaagagagagaagcaaga

SEQ ID NO: 71473 - RNA, 45 nt, Mus musculus
auuucuucaucuuuaaacauggcuuuggcaacaccuugagucuau

SEQ ID NO: 71474 - RNA, 46 nt, Mus musculus
aucccagaugcuuaaaguucuucucccacauguuguuugacaucag

SEQ ID NO: 71475 - RNA, 44 nt, Mus musculus
gacaaccucauggugguaguuggggucagccccauggcggugga

SEQ ID NO: 71476 - RNA, 45 nt, Mus musculus
gggccuugguggcuacaugcuggggagcgccaugagcaggcccau

SEQ ID NO: 71477 - RNA, 51 nt, Mus musculus
uaccgcuacccuaaccaaguguacuacaggccaguggaucaguacagcaac

SEQ ID NO: 71478 - RNA, 50 nt, Mus musculus
agaugugcgucacccaguaccagaaggagucccaggccuauuacgacggg

SEQ ID NO: 71479 - RNA, 45 nt, Mus musculus
ucuuucaauugaggugguucucauucuugcuucucuguguccccc

SEQ ID NO: 71480 - RNA, 67 nt, Mus musculus
auggagucugucaucagccagugcuaacaccgggccaauaagaauauaacaccaaauaacugcuggc

SEQ ID NO: 71481 - RNA, 46 nt, Mus musculus
gcauccacacguggaauucuuucuuuacuaacaaacgauagcugau

SEQ ID NO: 71482 - RNA, 109 nt, Mus musculus
uuguccuacugacguugaaagcaaaccuuuguucauucccagggcacuagaaugaucuuuagccuugcuuggauugaacuaggagaucuugacucugaggagagccagc

SEQ ID NO: 71483 - RNA, 44 nt, Mus musculus
uucugcccuauguuucuguacuucuauuugaacuggauaacaga

SEQ ID NO: 71484 - RNA, 46 nt, Mus musculus
ggcagagaggccccugugcguccuacauacaugacgggguauguuc

SEQ ID NO: 71485 - RNA, 36 nt, Mus musculus
uuuucuuuuuaagauaaacaccaguguugcccccca

SEQ ID NO: 71486 - RNA, 45 nt, Mus musculus
auuuaaacacaguaaagggguacaaguuucauacuagggcagagg

SEQ ID NO: 71487 - RNA, 45 nt, Mus musculus
guuuaaucuucagucauaccagcuccaagagaugaggccucaguc

SEQ ID NO: 71488 - RNA, 46 nt, Mus musculus
cauaguccucccaaacauauggggaauguguguuuauguaccagau

SEQ ID NO: 71489 - RNA, 46 nt, Mus musculus
guacuaaauuuggcuuugguuuccaagccaagggaaaagcugaaga

SEQ ID NO: 71490 - RNA, 46 nt, Mus musculus
guggcuuaucaggucacauguccaccacaucuugauucuugcagga

SEQ ID NO: 71491 - RNA, 45 nt, Mus musculus
ggggagcagaaagguccugacucccucccucccugucacccugga

SEQ ID NO: 71492 - RNA, 64 nt, Mus musculus
uguggagaccuccucuggccagggggccacugguguccucacuguguugggauucuguuauccc

SEQ ID NO: 71493 - RNA, 46 nt, Mus musculus
ccccucugccuuccagugaucucuuuccuacaagcugcuucgaggu

SEQ ID NO: 71494 - RNA, 28 nt, Mus musculus
ggcuacacuuggaaaggcuuugggaaga

SEQ ID NO: 71495 - RNA, 47 nt, Mus musculus
gugugcggagcagguaccccagaggaaagaggaaucaagaaauggaa

SEQ ID NO: 71496 - RNA, 46 nt, Mus musculus
ugguugugagccaccaugugguugcugggaauugaguucaggaccu

SEQ ID NO: 71497 - RNA, 46 nt, Mus musculus
uuguaggaggcuguguggcuuucauuuuggacaacaccaucccagg

SEQ ID NO: 71498 - RNA, 46 nt, Mus musculus
gccucuccuuugucucuguaaaacuuuugauuucucagacucauac

SEQ ID NO: 71499 - RNA, 23 nt, Mus musculus
agaaggaugagaggcaccaugua

SEQ ID NO: 71500 - RNA, 45 nt, Mus musculus
cauauuagcaugugccuccauacuugcuuggaggugccuucggau

SEQ ID NO: 71501 - RNA, 46 nt, Mus musculus
accugucagcuuuauuaugcacaauuaaacuucauguccagccaaa

SEQ ID NO: 71502 - RNA, 90 nt, Mus musculus
aucccuuuucaacgaaaucuguggagucacagugaagcagauccugggccugacuccuaaacucaucugacccuacaagcccucuaccag

SEQ ID NO: 71503 - RNA, 42 nt, Mus musculus
cgcuuggguggguggugcaugaugaaaaagaaaguuggaguu

SEQ ID NO: 71504 - RNA, 45 nt, Mus musculus
gcucauuacccacugagccuucucccuaacccuaaagcuagaaga

SEQ ID NO: 71505 - RNA, 42 nt, Mus musculus
agaacugaauacaugaaaucaauggaaacuuuagcuacaaca

SEQ ID NO: 71506 - RNA, 46 nt, Mus musculus
gggguuucuuacuuuagucaguaucaagaaauucuaggccagcugu

SEQ ID NO: 71507 - RNA, 46 nt, Mus musculus
cugucugaacuaagaaccuuucagaccugccuggcaaagcugagug

SEQ ID NO: 71508 - RNA, 45 nt, Mus musculus
uuuaauucauuucaggccagggcuaguuaagugauuguuuuagau

SEQ ID NO: 71509 - RNA, 45 nt, Mus musculus
uggcagccaggaagagagugaggaacacaagaagggcucagggcg

SEQ ID NO: 71510 - RNA, 42 nt, Mus musculus
auaaaaugcucaccuuaggugccaagauuagguucggauuag

SEQ ID NO: 71511 - RNA, 42 nt, Mus musculus
caggggauccugugcccucuucuggcaugcauacacacagac

SEQ ID NO: 71512 - RNA, 41 nt, Mus musculus
agcuucaggacaggacgagcagaccaguauggaggggaacc

SEQ ID NO: 71513 - RNA, 46 nt, Mus musculus
aagagugugguucaaaauauuauugauugauuaauuaccagaggau

SEQ ID NO: 71514 - RNA, 46 nt, Mus musculus
aggcauggaugauucagggugaauguuucauccaaacugccaaguc

SEQ ID NO: 71515 - RNA, 46 nt, Mus musculus
cccaguugucccuaaaagauguguuauagcuguuccccaagccucu

SEQ ID NO: 71516 - RNA, 79 nt, Mus musculus
uggugaugaccauaccccagaacauuauauagggucauaagagaggcagggauagcaugucuaggacuugaggaggugg

SEQ ID NO: 71517 - RNA, 46 nt, Mus musculus
ucuguggaucucucucucucucucuccauuggagacagugcaagug

SEQ ID NO: 71518 - RNA, 44 nt, Mus musculus
cgcggugcccuuuuugcuggcugaugccaugugcgugggggaug

SEQ ID NO: 71519 - RNA, 42 nt, Mus musculus
auguggucuguauguccuacagacagcaggacaccaguguua

SEQ ID NO: 71520 - RNA, 46 nt, Mus musculus
gauggggguucugggaacugaacuccaguguccugcaagaacagua

SEQ ID NO: 71521 - RNA, 45 nt, Mus musculus
uugcagagacccuggacagcacugggagccuggauccccagaggu

SEQ ID NO: 71522 - RNA, 49 nt, Mus musculus
gcccuguuucugcagggguuugggggugucuguauguuuguuuuguaau

SEQ ID NO: 71523 - RNA, 74 nt, Mus musculus
uggggccacauccagcggagagcaggacaacgaggacacggagcucauggcaaucuacaccacagagaacggca

SEQ ID NO: 71524 - RNA, 24 nt, Mus musculus
ggugcacaugcugagucagcaggu

SEQ ID NO: 71525 - RNA, 45 nt, Mus musculus
gauggaugcuuugccugaauauaugacugugaaucacauacagac

SEQ ID NO: 71526 - RNA, 45 nt, Mus musculus
guuccuuuaaugcuacuugcgacguggcuguuccuggcccuguag

SEQ ID NO: 71527 - RNA, 45 nt, Mus musculus
uuuauguccaccaucaccaccuccauaacuaccucugcugccacc

SEQ ID NO: 71528 - RNA, 45 nt, Mus musculus
auauaccugauguaaugaaaagaaaaagacaaagcuacaacagau

SEQ ID NO: 71529 - RNA, 37 nt, Mus musculus
ugaguuaacccaggaaggaaguacacacugcuauuaa

SEQ ID NO: 71530 - RNA, 61 nt, Mus musculus
ucucccgguaagaguguuuccugccugcaguucuucucuggaguauacguaggacacacuu

SEQ ID NO: 71531 - RNA, 62 nt, Mus musculus
gaggcugggggcuccacggaaggcaaauaugaagaggaggcgaagcacucgaauuucuuuac

SEQ ID NO: 71532 - RNA, 45 nt, Mus musculus
gagucugugcaaguguauguaccacuuguguguaaaagcccucag

SEQ ID NO: 71533 - RNA, 44 nt, Mus musculus
cuggugauaaccauauuguuauuuguuuguuuucgggugcuaga

SEQ ID NO: 71534 - RNA, 46 nt, Mus musculus
uauauuuauaacacgcauauuuguauuuauacacugcugguaaggu

SEQ ID NO: 71535 - RNA, 42 nt, Mus musculus
ugugugagagagagagagagagagagagagagaugcauauac

SEQ ID NO: 71536 - RNA, 46 nt, Mus musculus
ugaauaugucugugccuguuucuuaugugcauuugugaccgugugg

SEQ ID NO: 71537 - RNA, 44 nt, Mus musculus
cucugaagaagccugcugcaagacugguuucaagacgauaaugg

SEQ ID NO: 71538 - RNA, 45 nt, Mus musculus
cuuuaaguuuugcaaucugaugucuuugggcucugauagggggaa

SEQ ID NO: 71539 - RNA, 42 nt, Mus musculus
uccacaccccagggacuuggguugugugguuuguugugagag

SEQ ID NO: 71540 - RNA, 46 nt, Mus musculus
uguguguguguuguggggaggguauguauaugcacuugagucuagg

SEQ ID NO: 71541 - RNA, 43 nt, Mus musculus
ucccuuucccuuucccuuucccuuucccuuucccucucccucu

SEQ ID NO: 71542 - RNA, 46 nt, Mus musculus
ccuuguaaacucauggugacuugcauaagaaggacagaaaaaagau

SEQ ID NO: 71543 - RNA, 42 nt, Mus musculus
uuacauaaaaacuguuuauggugugauucuuagcaacaagac

SEQ ID NO: 71544 - RNA, 44 nt, Mus musculus
augcuuggacacucgacucuacauaccucucccuacccacuaga

SEQ ID NO: 71545 - RNA, 52 nt, Mus musculus
uaauagagccacuucccaugggccaauguucaaaccaccgcaacaucugaua

SEQ ID NO: 71546 - RNA, 49 nt, Mus musculus
uaccccagaacaaagggcagggaaugugagacaaaggcaggagacgagg

SEQ ID NO: 71547 - RNA, 46 nt, Mus musculus
cuugaugauaaugaacugaaccucugaaccccaauggaaugcuguc

SEQ ID NO: 71548 - RNA, 46 nt, Mus musculus
ugccuggaagucagaaugcuagcagccuucagaugaacauauagaa

SEQ ID NO: 71549 - RNA, 42 nt, Mus musculus
cagguacaauggccuuuucagagugauugaagguugacuguu

SEQ ID NO: 71550 - RNA, 46 nt, Mus musculus
aguagaaugacaagauacaauucaaaacuguccucauuaugcuuag

SEQ ID NO: 71551 - RNA, 41 nt, Mus musculus
uauuuuugugugcccuuagucucugaauguucuugugugag

SEQ ID NO: 71552 - RNA, 46 nt, Mus musculus
ccauuuuuucuuaaauaugugugggaagcuuacagagucgaguccu

SEQ ID NO: 71553 - RNA, 46 nt, Mus musculus
uucuuuccugggguugggagugguagguucuguuuucauccaaggu

SEQ ID NO: 71554 - RNA, 46 nt, Mus musculus
uacuauaauaauuagugagaaaagaggcccugaauuuaaaggagau

SEQ ID NO: 71555 - RNA, 44 nt, Mus musculus
guggcaaaugucaacacccaugauggcgccuccugcucggccag

SEQ ID NO: 71556 - RNA, 46 nt, Mus musculus
augcuccuccaccuucauaucccaguaaaaccaaauaucuguagau

SEQ ID NO: 71557 - RNA, 42 nt, Mus musculus
uggcacacaagcauacaucugcauauacauuugcagacaaua

SEQ ID NO: 71558 - RNA, 46 nt, Mus musculus
aaauauuugagugauugauccacaguugguggacuguuuaggaagg

SEQ ID NO: 71559 - RNA, 46 nt, Mus musculus
cauccacugccucugugggaauuaggcacacuuguggugcgcagac

SEQ ID NO: 71560 - RNA, 42 nt, Mus musculus
gaagcuuaaccuugagcugaaucuacuuaugaugcggggcuu

SEQ ID NO: 71561 - RNA, 46 nt, Mus musculus
gaaaguacauaacuuuauaacuuguaauacaaaucaggcaugguuu

SEQ ID NO: 71562 - RNA, 67 nt, Mus musculus
acgcccauggcuagguugcggucgcagcgguaugugucgaagccuucggagcgcagaguaagcugua

SEQ ID NO: 71563 - RNA, 82 nt, Mus musculus
gcucugcagguucacgccgcccgagcugacgucccagcaggccucauugaugaggucuuugagagccuccagcaccuucuuc

SEQ ID NO: 71564 - RNA, 45 nt, Mus musculus
acuagaugagagcuacucuaagaggaacgaggucuggcugccaag

SEQ ID NO: 71565 - RNA, 42 nt, Mus musculus
ggcaaaucgagcugugcgcggcggccugccuugaagcuggag

SEQ ID NO: 71566 - RNA, 45 nt, Mus musculus
cuugucuaauuaagggugacuugaaggugugagaagggggagaag

SEQ ID NO: 71567 - RNA, 118 nt, Mus musculus
acugguuaguucauguuguuguuuaugacuuaauacccuuuaaaaauguuaguuugcuaucuuugacucggggucuuacagguuguugcuuccuguaagagguaccaccaucugccaa

SEQ ID NO: 71568 - RNA, 49 nt, Mus musculus
uuucuuuuuguaaagacagaguuucacuguauccuggaacucagugugu

SEQ ID NO: 71569 - RNA, 53 nt, Mus musculus
agagcaagaugaccuugaacucacagagauccugggcuuucuugaggacuggg

SEQ ID NO: 71570 - RNA, 46 nt, Mus musculus
uuaaguauaagauguaaaauacaagugaggucucaguguguguggu

SEQ ID NO: 71571 - RNA, 46 nt, Mus musculus
caguucaaauaaucauucuuuagauuguuugaaagcguccgcccag

SEQ ID NO: 71572 - RNA, 45 nt, Mus musculus
caguuugggaaagaggcuugggcucuugacuacuaagugugccag

SEQ ID NO: 71573 - RNA, 46 nt, Mus musculus
gggggaguagugaggcaccccaccccaccgccccauuagccaccuu

SEQ ID NO: 71574 - RNA, 72 nt, Mus musculus
guagggauggcauugggcccacauggcugccuguccucggaaaguuaaauuuuaucaaauuauuauaggugg

SEQ ID NO: 71575 - RNA, 45 nt, Mus musculus
gguccccauagagccaucuuggacuuuccucaagacuuggcugag

SEQ ID NO: 71576 - RNA, 46 nt, Mus musculus
uauauaugcaaacaaaguagcuaaacaaaucaaacauuuaacuaag

SEQ ID NO: 71577 - RNA, 45 nt, Mus musculus
uuuucgauuguaaaggcuaauugacaggaaauugaaaggacaaaa

SEQ ID NO: 71578 - RNA, 42 nt, Mus musculus
acccaagcuuuccuuaaaaagaugucuucuaucugcccccac

SEQ ID NO: 71579 - RNA, 46 nt, Mus musculus
uaccaugaccaaaguuguuuauuacugagcccgcuuagauggcugg

SEQ ID NO: 71580 - RNA, 69 nt, Mus musculus
gggaaaggaaggaaggcucuugaggaagaggcggggcccuggaaagaaaugggguuucuaggagggaag

SEQ ID NO: 71581 - RNA, 82 nt, Mus musculus
ugugcccugggaaggaggagaggcccugggagcagccuauucugcaugcacugaccuauguccauuaaggagggaggcgagg

SEQ ID NO: 71582 - RNA, 46 nt, Mus musculus
uaaaggagccaaucacugggcgaguaggcaggacuucuggguugga

SEQ ID NO: 71583 - RNA, 41 nt, Mus musculus
auuugaaguauauggggcugguguggaagcaacaccagugg

SEQ ID NO: 71584 - RNA, 45 nt, Mus musculus
uuauauacagauuuugucggaaucaagucgggaauuucgccugug

SEQ ID NO: 71585 - RNA, 45 nt, Mus musculus
uuuaaccagccacaggaagcuuauauucugcuaacgugggcucaa

SEQ ID NO: 71586 - RNA, 41 nt, Mus musculus
agccaacccaggcuauuuacauugagagaacagauuugaga

SEQ ID NO: 71587 - RNA, 46 nt, Mus musculus; identical to SEQ ID NO: 71582

SEQ ID NO: 71588 - RNA, 41 nt, Mus musculus; identical to SEQ ID NO: 71583

SEQ ID NO: 71589 - RNA, 46 nt, Mus musculus
ccugccaggccuccaaguuaccggcucaagggugggagugugcccu

SEQ ID NO: 71590 - RNA, 62 nt, Mus musculus
cugggguaacagaaagaugugaaugcuguacacugaacucagaucuucuggaaggggaggga

SEQ ID NO: 71591 - RNA, 51 nt, Mus musculus
gcuucccuuugacagcuauccugaguggaaggaggugccuguggguuaagg

SEQ ID NO: 71592 - RNA, 24 nt, Mus musculus
cgauggcaggcucagggccaggcc

SEQ ID NO: 71593 - RNA, 27 nt, Mus musculus
ugaggcccccacacauauagcuugaag

SEQ ID NO: 71594 - RNA, 23 nt, Mus musculus
ggauuguauggcacguuugagga

SEQ ID NO: 71595 - RNA, 52 nt, Mus musculus
ggucaucaguuucuugcuauagaaauaaauaaugugguagaugucagggcau

SEQ ID NO: 71596 - RNA, 58 nt, Mus musculus
ccauuuuuauaaaaugguauuaauaacaaaggaaauugaugaguggaugaagggggug

SEQ ID NO: 71597 - RNA, 46 nt, Mus musculus
ggcugagguuuagcugugggaacacaaaaggggagaaacugccgac

SEQ ID NO: 71598 - RNA, 44 nt, Mus musculus
gcauguuuguacugagucuaguuaagaagcauuaucggcugcag

SEQ ID NO: 71599 - RNA, 46 nt, Mus musculus
ugaauagagugaggagguuguguuaggguuucauugcugugaagag

SEQ ID NO: 71600 - RNA, 46 nt, Mus musculus
uguaugcauauuugcauauauacacacauaugugugaaggcccaag

SEQ ID NO: 71601 - RNA, 46 nt, Mus musculus
agagggcaggugagcuuugcuuauguaguuugcuuucaccauauag

SEQ ID NO: 71602 - RNA, 46 nt, Mus musculus
gaguugggaguaugugugugugugugugugugugugugugugugug

SEQ ID NO: 71603 - RNA, 46 nt, Mus musculus
cauagggaccagaaagcagcuuaggaaaucuauccauuggcccuuu

SEQ ID NO: 71604 - RNA, 45 nt, Mus musculus
uuuuagauacuagauuuuguuauuuuaauagucaauggccugagg

SEQ ID NO: 71605 - RNA, 46 nt, Mus musculus
acaaaacuucgggagaggggaggagucauuaaccugagguugucug

SEQ ID NO: 71606 - RNA, 46 nt, Mus musculus
uggacuuuguagccccgucaaggccguuuguggucuacugucagua

SEQ ID NO: 71607 - RNA, 70 nt, Mus musculus
gcagaaaacaacucaggagaacagagaccaauggagauuguuccuggggacccagagaauaaggagccca

SEQ ID NO: 71608 - RNA, 46 nt, Mus musculus
aguccaagaauuggaaguuagagaaccagaucgaguugcuuuaaga

SEQ ID NO: 71609 - RNA, 46 nt, Mus musculus
auaguucagcagcuaauugaaaauaguacaacauuccgugacaaga

SEQ ID NO: 71610 - RNA, 48 nt, Mus musculus
cuuacucaagaugauauaaaagcucugaaagacaagggcauuaaagga

SEQ ID NO: 71611 - RNA, 42 nt, Mus musculus
ugcauccaugacggugacuucguggugcugaagcgagaagau

SEQ ID NO: 71612 - RNA, 46 nt, Mus musculus
gggagucagggauugcguacgacuuuucucaggcugcuucccuaug

SEQ ID NO: 71613 - RNA, 65 nt, Mus musculus
ugaggauccugaagacuugagcuuuuaucacagggcuaucacaagcaaccuugauuauuauuagu

SEQ ID NO: 71614 - RNA, 60 nt, Mus musculus
uggaguuacuuucuuuuggaacaguuuuaggacagccugccacagaaaguaauacagcga

SEQ ID NO: 71615 - RNA, 86 nt, Mus musculus
uaugguguaccuuaaucaugauggagauuaaaagaauuaacuauacaacacauaagguuuauacugcagcauggaacuuugcaagc

SEQ ID NO: 71616 - RNA, 84 nt, Mus musculus
aguggugcuuauagaggcagagguuuuggacgaggaagauuccaaagcuggaaaagaggaagagguggugggaacuucucagga

SEQ ID NO: 71617 - RNA, 41 nt, Mus musculus
cgauauguuuucucucgggaaagagacaauucaagggccgg

SEQ ID NO: 71618 - RNA, 61 nt, Mus musculus
cacaagccucacaaccguuacuucaacagucaacauuggaucaguuuaucccguauaaggg

SEQ ID NO: 71619 - RNA, 50 nt, Mus musculus
cuuccaagcauuuguuugagcauuauugcuauaugauguaucaggaaaac

SEQ ID NO: 71620 - RNA, 54 nt, Mus musculus
ugauuccugugacugagggagaaccaaccaagaaaugccaagguuaucagaagu

SEQ ID NO: 71621 - RNA, 62 nt, Mus musculus
uuuauugagaagauucaagcauuugagaaauuuuucacaaggcauaucgacuuauacgauaa

SEQ ID NO: 71622 - RNA, 42 nt, Mus musculus
augauaggucuuaaggggguacaaucuggacacagcagcgag

SEQ ID NO: 71623 - RNA, 45 nt, Mus musculus
uaguaugucuacgugaguuaugcugugaguguaagcauccaugaa

SEQ ID NO: 71624 - RNA, 44 nt, Mus musculus
cucugagccccauugucugcguggaacgggucucuagucgcagg

SEQ ID NO: 71625 - RNA, 46 nt, Mus musculus
gaggaaaaucaugaggcugaauuuaccaugccuaggagcagugaag

SEQ ID NO: 71626 - RNA, 46 nt, Mus musculus
agagcagucagugcucuuaaccgcugaacaaucucuccagcccaua

SEQ ID NO: 71627 - RNA, 46 nt, Mus musculus
aauuuaaaaaauaguauuuuccuuuagaaucugaugaaaugaccag

SEQ ID NO: 71628 - RNA, 36 nt, Mus musculus
cugguuccaggaaguaggaaccuagaagaagcacug

SEQ ID NO: 71629 - RNA, 41 nt, Mus musculus
aguuuagccggagaccccuaacugugugaggaaguggaaga

SEQ ID NO: 71630 - RNA, 45 nt, Mus musculus
gauacgccaaaugaacagcaugaccacuuacuuucugaacaugug

SEQ ID NO: 71631 - RNA, 46 nt, Mus musculus
uuggaagucauccauccuuaugugccaaaguugucuucaugccaaa

SEQ ID NO: 71632 - RNA, 45 nt, Mus musculus
aaaucugcacagguaguguugcuuguggaugcagaccuugugagu

SEQ ID NO: 71633 - RNA, 45 nt, Mus musculus
uuaugcuaaggaugcugaagucaguucucuacaauggugggcugu

SEQ ID NO: 71634 - RNA, 46 nt, Mus musculus
accaaaccaguccacaaacacagagagaugcgugggcugacaucug

SEQ ID NO: 71635 - RNA, 46 nt, Mus musculus
uggcaugucauauucgcgggcuacagccuggaugaucaagaggaug

SEQ ID NO: 71636 - RNA, 46 nt, Mus musculus
cuuaugucucgucucaguaagugugugugugugugugugugugugu

SEQ ID NO: 71637 - RNA, 45 nt, Mus musculus
cagcauuugagaggcugagccagcaaauugacguaaguuccagga

SEQ ID NO: 71638 - RNA, 45 nt, Mus musculus
acuguaaaauauagguugcuauuucuuuuacuuuugcagggcaag

SEQ ID NO: 71639 - RNA, 45 nt, Mus musculus
cuacuucuccuagguuuggcucuuugguggacuugcaagucccag

SEQ ID NO: 71640 - RNA, 50 nt, Mus musculus
ccggacaguaacaaagcauuacagcccgaacccaccucccgccaccaucg

SEQ ID NO: 71641 - RNA, 45 nt, Mus musculus
gauugguuuucaccuucccucuuggcuuuacuuaaaauaccaugg

SEQ ID NO: 71642 - RNA, 46 nt, Mus musculus
uuguguguacacauauguaucuaugugugguuaugugugagugcag

SEQ ID NO: 71643 - RNA, 45 nt, Mus musculus
uguggaagagaggaaagcagagcacagaaggagguaggugagaga

SEQ ID NO: 71644 - RNA, 46 nt, Mus musculus
gagcuugagcgcuugcuucuggucagcuucaagauuaccacauuag

SEQ ID NO: 71645 - RNA, 45 nt, Mus musculus
guggggaagaucaguggaagacugauaaauacuuaaugugagcuc

SEQ ID NO: 71646 - RNA, 46 nt, Mus musculus
aagaucaugauguuaugaacaagagacauuuuugagaauaggaaag

SEQ ID NO: 71647 - RNA, 42 nt, Mus musculus
gucccucugugggcccaugcugaaccauccuuucccugugag

SEQ ID NO: 71648 - RNA, 41 nt, Mus musculus
ggagagagggaggagaacggggagagaggggguaaggagca

SEQ ID NO: 71649 - RNA, 46 nt, Mus musculus
cuaacuaagaagaaaaagaaaucccuaaauauuaggauggguuaag

SEQ ID NO: 71650 - RNA, 46 nt, Mus musculus
accccuguuucuucagcucaaagcacaguuguucuuuuccauguag

SEQ ID NO: 71651 - RNA, 46 nt, Mus musculus
aaguguuuguggagaggccucaaugacguuuaacaguuaguuguaa

SEQ ID NO: 71652 - RNA, 45 nt, Mus musculus
uggagagagagacagauagagacagagagagacagaaacagagag

SEQ ID NO: 71653 - RNA, 45 nt, Mus musculus
ccccagagauucuuuuauuguugagaauaguuuuugcuaucguag

SEQ ID NO: 71654 - RNA, 45 nt, Mus musculus
guccaugugucucuguuuaguuucuguuuccaggaucugucuguu

SEQ ID NO: 71655 - RNA, 48 nt, Mus musculus
agaagucauauuuguucagggagcuuuugugugagaguuuucaggaug

SEQ ID NO: 71656 - RNA, 46 nt, Mus musculus
ggugguauuuagaugcaaauagccuggguguugcaaacguggaaag

SEQ ID NO: 71657 - RNA, 46 nt, Mus musculus
cuaaaaauucugccucggugaugaggcucagacauaguaucccagg

SEQ ID NO: 71658 - RNA, 46 nt, Mus musculus
cucagucaugcuuuuccaauacucuucacuucuacaucaacccuag

SEQ ID NO: 71659 - RNA, 61 nt, Mus musculus
ccugcaucccucagagcagaacacacucacugacaagugcacagacagcaugacagagaug

SEQ ID NO: 71660 - RNA, 46 nt, Mus musculus
ugaauucgguaguagaagaaguauugacaggaaggcuuucuguugg

SEQ ID NO: 71661 - RNA, 46 nt, Mus musculus
gucaaguuggguacauucaacuuucaacucuagcauuucuuugaag

SEQ ID NO: 71662 - RNA, 45 nt, Mus musculus
acuuauuuuucuauuuuauauuacuggaaauacacauaguagagg

SEQ ID NO: 71663 - RNA, 46 nt, Mus musculus
uuucccuuuacagguuccuauuacaagcugauauucuugcagagaa

SEQ ID NO: 71664 - RNA, 46 nt, Mus musculus
agggaggagaggagaggaaaucucaggggaaguuaaguagggcagu

SEQ ID NO: 71665 - RNA, 42 nt, Mus musculus
uggggucauuaauuugaacugacacccagaagcugccaggag

SEQ ID NO: 71666 - RNA, 45 nt, Mus musculus
aggacuggaugucugagaaaagaaugaaucuuccuuacccccccc

SEQ ID NO: 71667 - RNA, 46 nt, Mus musculus
aaauugaugcaaaagcaaauugaugcaauugucuuuuccaccccga

SEQ ID NO: 71668 - RNA, 42 nt, Mus musculus
cagucagaacagacugauguuaaaguucucggagcacggcaa

SEQ ID NO: 71669 - RNA, 42 nt, Mus musculus
uuaugcugugacaaaugcauagcaugaggcaacuuaagggag

SEQ ID NO: 71670 - RNA, 45 nt, Mus musculus
gagggaaggagagaggaucugccaguguaaaaacaauaggaggaa

SEQ ID NO: 71671 - RNA, 45 nt, Mus musculus
auugauugaaugaauggcuggcuauaagugaaaggauaguugcgu

SEQ ID NO: 71672 - RNA, 42 nt, Mus musculus
caacccaucucuccuuccuuuagaagguuguguucuuuccug

SEQ ID NO: 71673 - RNA, 45 nt, Mus musculus
ugucugcuuaugggucugguuuuggccuuucuggccagucuugag

SEQ ID NO: 71674 - RNA, 42 nt, Mus musculus
gguuaugguacgugcugcaguacccuguuucugugccccucu

SEQ ID NO: 71675 - RNA, 46 nt, Mus musculus
guuacucagcaggaaacagaguagugaggucuggugaaaggcucag

SEQ ID NO: 71676 - RNA, 89 nt, Mus musculus
cacauguagacagcagacagauagcagauccgugauggcagagagagagagagagagagcagagaaggaccaagcggggacucagagga

SEQ ID NO: 71677 - RNA, 44 nt, Mus musculus
uacgucaugcaacagauaugguguaaaggggguuuguuuacugg

SEQ ID NO: 71678 - RNA, 23 nt, Mus musculus
ccuuucauguugacuauccagua

SEQ ID NO: 71679 - RNA, 46 nt, Mus musculus
uuuuauguacucauuggcuauucauauaucuuuuuuuucuuuugag

SEQ ID NO: 71680 - RNA, 46 nt, Mus musculus
ugaccuagaccaacacaccugaagaguuccccugacuaaucaccag

SEQ ID NO: 71681 - RNA, 41 nt, Mus musculus
gaaagcauccagcucauaaauuggaauagaaaugggaccaa

SEQ ID NO: 71682 - RNA, 46 nt, Mus musculus
ccugguaaguucuaagccacugagagacccugucucaaaacgcaag

SEQ ID NO: 71683 - RNA, 46 nt, Mus musculus
aggcuggccugccuuggguggcuccauaguauuuaguauuauagug

SEQ ID NO: 71684 - RNA, 45 nt, Mus musculus
ggauuauaugagacacuguuucuuagauaugaaguccagagccug

SEQ ID NO: 71685 - RNA, 46 nt, Mus musculus
ccuugacuggugugugugugugugugugugugugugugugugaucu

SEQ ID NO: 71686 - RNA, 46 nt, Mus musculus
ucugugcgauuggauuggggcuggcgcuguguuccacucaccagag

SEQ ID NO: 71687 - RNA, 45 nt, Mus musculus
aaauggacccaccuggauucuuugccauguuacuguuaucugcag

SEQ ID NO: 71688 - RNA, 46 nt, Mus musculus
uuuccucaagagagggauacaccuucacuguauccagaacucccag

SEQ ID NO: 71689 - RNA, 46 nt, Mus musculus
ccuugaaccaccaugaugggugcuaggaaucgaaccucgggccucu

SEQ ID NO: 71690 - RNA, 41 nt, Mus musculus
auaacugaggucaaugaauauuuauuuuagcuagggcccug

SEQ ID NO: 71691 - RNA, 46 nt, Mus musculus
aggaugaacaugguuuuuguugguucauuuuucuagacacugacac

SEQ ID NO: 71692 - RNA, 46 nt, Mus musculus
cugccauucucuuggcagaugaacucuagacagaucaucuuagcag

SEQ ID NO: 71693 - RNA, 46 nt, Mus musculus
ucacacuuugccugcucagccuuccuguggaucuguguagugggac

SEQ ID NO: 71694 - RNA, 81 nt, Mus musculus
guggcucuguggaagacugugaccaccgcaggagaguuucucuuggaaaugaaggauuagucccggaggacgcggauaggg

SEQ ID NO: 71695 - RNA, 46 nt, Mus musculus
uuaccagccuuagaguugucagauccuggguugcuuuugaaacaag

SEQ ID NO: 71696 - RNA, 46 nt, Mus musculus
gcagagcgacucagcugcaauuacugaacaauuagcuacagaucag

SEQ ID NO: 71697 - RNA, 51 nt, Mus musculus
guuuuccuaacaggcuuguuacuuuuucaucauuuuagaacugucuccaga

SEQ ID NO: 71698 - RNA, 46 nt, Mus musculus
aacucucagaacuuacucugucacugaagaaaguaagggugggaau

SEQ ID NO: 71699 - RNA, 45 nt, Mus musculus
agcucugaagaaaagaauagaaacaauggaagauccccagcaaca

SEQ ID NO: 71700 - RNA, 99 nt, Mus musculus
ucugauccuaauuucaagaaaacaaaagcuauggaaaaaauucuggaggagaaagcucggcaucgagaacggaaggaagaacuucuuauucaagcagua

SEQ ID NO: 71701 - RNA, 33 nt, Mus musculus
cucacuucaaugagagaaacugucucagaaaau

SEQ ID NO: 71702 - RNA, 46 nt, Mus musculus
auuuggaagaaaaaaaaacgacgggugaguucuuaauugggucaga

SEQ ID NO: 71703 - RNA, 45 nt, Mus musculus
agaguggaucacaccacuguucucugguugagcacuaaaugagau

SEQ ID NO: 71704 - RNA, 45 nt, Mus musculus
uggaugaggaagaggacagcaagaaacacuucaauuaugacaaga

SEQ ID NO: 71705 - RNA, 46 nt, Mus musculus
uuaggcaaagaagacucccuugagguagugauauuugagcugagau

SEQ ID NO: 71706 - RNA, 46 nt, Mus musculus
aaaaaaaaaaaaaagaaauagauuaguacagagaauauaacuagga

SEQ ID NO: 71707 - RNA, 35 nt, Mus musculus
uaugugcaccacauacaugcagugucugaggaaga

SEQ ID NO: 71708 - RNA, 46 nt, Mus musculus
acguaucugaugugaacacagcaggacaagcugauacccaggaguu

SEQ ID NO: 71709 - RNA, 46 nt, Mus musculus
caucuuaauccaacugcagccaggagaggagugucucccagcagcu

SEQ ID NO: 71710 - RNA, 42 nt, Mus musculus
cucuguuuaaguguuucaacuaugauaauguuguggggaguu

SEQ ID NO: 71711 - RNA, 45 nt, Mus musculus
cuguuacuuuugcuuggaaugcuuuuuuccauccuuucccuuuaa

SEQ ID NO: 71712 - RNA, 46 nt, Mus musculus
cuuaugugaucuguuaauuuauuguccuucauaaguugcaccaacc

SEQ ID NO: 71713 - RNA, 45 nt, Mus musculus
gaguguauccauguucucuuucucuguguguuuauuguuggugua

SEQ ID NO: 71714 - RNA, 45 nt, Mus musculus
ucucaucucagaagaagcuuuucaguuugaugaagucccgcuugu

SEQ ID NO: 71715 - RNA, 46 nt, Mus musculus
ggcucgggcauagccucacaagagacagcuauaucaggauccuguc

SEQ ID NO: 71716 - RNA, 68 nt, Mus musculus
cuuuuacuagagcuuucuucaaaacuuaaguagccagcuaauugccacuaauagaaugauuccaugag

SEQ ID NO: 71717 - RNA, 47 nt, Mus musculus
gggaaaggauaaacugaccccuugggaacaguuuuuagagaagaaga

SEQ ID NO: 71718 - RNA, 45 nt, Mus musculus
uuuauuuauucaucuauuuuuguuagaaauguugaaggacacagu

SEQ ID NO: 71719 - RNA, 45 nt, Mus musculus
cagucucuaccugauucauuuugcauacugagaccacagguaaac

SEQ ID NO: 71720 - RNA, 53 nt, Mus musculus
uucugaguauuucaacaucugcuaaguauuuugaaguucaaaggggggaaaac

SEQ ID NO: 71721 - RNA, 50 nt, Mus musculus
guguuagugaugguggucaguaacacuuuaaagcguuugaaauugagugc

SEQ ID NO: 71722 - RNA, 45 nt, Mus musculus
uggauggaaccguuuuuagagcaagcugugcugcugaggcugagu

SEQ ID NO: 71723 - RNA, 45 nt, Mus musculus
gaagacuguuucuccugcuaucagcauuccuuaguugccuguaau

SEQ ID NO: 71724 - RNA, 36 nt, Mus musculus
uuaucaaguagcuuacccaaaauagaaguaccagga

SEQ ID NO: 71725 - RNA, 46 nt, Mus musculus
aaccuguggucuucucaagcuacugaaacuaccacugucaaaagau

SEQ ID NO: 71726 - RNA, 46 nt, Mus musculus
uaaaaagaaaauaaaacacauauaucauaaaauaaaaugcacaaaa

SEQ ID NO: 71727 - RNA, 75 nt, Mus musculus
cucuugcagguuauucaagaaaaagaaaagaaaggaaaagaaaaugauauggaaauggaaaucaaauggguucca

SEQ ID NO: 71728 - RNA, 46 nt, Mus musculus
aagguuaucuggagagagagagagagaauaugagagagagagagag

SEQ ID NO: 71729 - RNA, 46 nt, Mus musculus
guauacguauuuuugauuuaguuuuucuccauuagggccucuagag

SEQ ID NO: 71730 - RNA, 46 nt, Mus musculus
uuauugcugugaauuaguuuuguuuccuuaauugagugucuaagua

SEQ ID NO: 71731 - RNA, 42 nt, Mus musculus
aggaugaaagugacagugguccugaucuugcaagggguaaag

SEQ ID NO: 71732 - RNA, 47 nt, Mus musculus
uaagugaugguaaaaccucagcugaugaggaugaaagugaagaagaa

SEQ ID NO: 71733 - RNA, 46 nt, Mus musculus
agacaaacaugagaguugggugaacgauuuugguuuguggugagca

SEQ ID NO: 71734 - RNA, 46 nt, Mus musculus
gugaaauuaaauuuaaguugucuuaauguuguguauuuagagagag

SEQ ID NO: 71735 - RNA, 44 nt, Mus musculus
gcggaggauugugggagugcgcuccaugugaacucagacuggga

SEQ ID NO: 71736 - RNA, 67 nt, Mus musculus
gagauugucaacauuaaucuugugagagacaagaagauugggaaauccaaaggauucuguuuccugu

SEQ ID NO: 71737 - RNA, 58 nt, Mus musculus
gcuaugaagaccagaggagcacaguucuggcuguugacaauuucaauggaauuaagau

SEQ ID NO: 71738 - RNA, 45 nt, Mus musculus
uuugugagcuuggcaucuucgucuucagagacuucaggaggacuu

SEQ ID NO: 71739 - RNA, 47 nt, Mus musculus
gaagucucugaagacgaagaugccaagcucacaaaaaagcacaaaaa

SEQ ID NO: 71740 - RNA, 55 nt, Mus musculus
acaguagcaagacuuccgagagagcacagaagucagaacacagagagagcaagaa

SEQ ID NO: 71741 - RNA, 31 nt, Mus musculus
caaguccgccagcaggagggaggcagaggag

SEQ ID NO: 71742 - RNA, 46 nt, Mus musculus
cuggaagagaaaaaaaagggggggaagugaccagauguccuaugag

SEQ ID NO: 71743 - RNA, 46 nt, Mus musculus
cuccuuugcuacacacgcacacacaggugugugcgcacuuaugaca

SEQ ID NO: 71744 - RNA, 43 nt, Mus musculus
ucacguugcgagcugcuggcggccgcaacauuuuggcgccgga

SEQ ID NO: 71745 - RNA, 48 nt, Mus musculus
gcgcuagcuuaaaauuucaguuuuguaaaguguugcuaaggaugcggu

SEQ ID NO: 71746 - RNA, 41 nt, Mus musculus
ccucuuagacccggugaggccaaggcuaaggcgucuggguu

SEQ ID NO: 71747 - RNA, 41 nt, Mus musculus
aaccuggccaccucugacaccgagacgagaggagccccaga

SEQ ID NO: 71748 - RNA, 58 nt, Mus musculus
ggccuccugggaggaagagaaggccuccugggagaaagagaaggccuccagggagaaa

SEQ ID NO: 71749 - RNA, 66 nt, Mus musculus
augagcagcuacagaggaagcagguggcacuggaagcaacacagagggucaauaagaccuuagaac

SEQ ID NO: 71750 - RNA, 46 nt, Mus musculus
uaaguauccuccauccuguccccaagccgaggcagaugugaaugag

SEQ ID NO: 71751 - RNA, 42 nt, Mus musculus
auucuucagcaagcaacugauuuauuuuuaagacaaaccaag

SEQ ID NO: 71752 - RNA, 46 nt, Mus musculus
gaacauaauugauuccuuagcaaauugaauaguugcauagcuguag

SEQ ID NO: 71753 - RNA, 46 nt, Mus musculus
auagaauaaauuugagagagaaucuaacuuucuaguggcaggguag

SEQ ID NO: 71754 - RNA, 28 nt, Mus musculus
gcccccgcccccgccgccgccgccaccc

SEQ ID NO: 71755 - RNA, 44 nt, Mus musculus
ucuagaaaaugcgguuugcucugccuaccaaucucugcucucua

SEQ ID NO: 71756 - RNA, 45 nt, Mus musculus
gccuggugagugacucccagaguccucagcagccacacuggcaga

SEQ ID NO: 71757 - RNA, 56 nt, Mus musculus
uuuauguuuuaguuauuuauuuaguccaugggucuuggguugguaauaacucuggu

SEQ ID NO: 71758 - RNA, 46 nt, Mus musculus
ucaccuucaccauugaaccuuuuccaccuggagcugaggccccacu

SEQ ID NO: 71759 - RNA, 46 nt, Mus musculus
uaacccuuguugauaucuagaauaauaaagucacacaacacaaguc

SEQ ID NO: 71760 - RNA, 46 nt, Mus musculus
augcugaguggaaaaaauguuuugaaaauggggaaacaugccaguc

SEQ ID NO: 71761 - RNA, 41 nt, Mus musculus
cuugggaacaggagcuccuguguccuucaccauccacugau

SEQ ID NO: 71762 - RNA, 45 nt, Mus musculus
gcucacuauaccagcaucuuacagacuuaugauuuuguauacaga

SEQ ID NO: 71763 - RNA, 45 nt, Mus musculus
aauguuuuuaucccaaggaauguauaaaaccaaguucaaggagau

SEQ ID NO: 71764 - RNA, 41 nt, Mus musculus
uuuaaggaagguacugcacuguauaauacagcacagccaga

SEQ ID NO: 71765 - RNA, 39 nt, Mus musculus
cuguaucuggaagcaauaauucaaaaccaccgggaaguc

SEQ ID NO: 71766 - RNA, 45 nt, Mus musculus
aauacaguuagccacuuuauuuugcauuuguuucuucucugagug

SEQ ID NO: 71767 - RNA, 46 nt, Mus musculus
ugggugcuuucaaugaccuuguauuaauaaucagaaaucaaaagau

SEQ ID NO: 71768 - RNA, 46 nt, Mus musculus
guuuuaucacuuaccuguuagauggugaacagagaaagccucagau

SEQ ID NO: 71769 - RNA, 46 nt, Mus musculus
guaggcugugagcauccaccucuguauuugucaggcacuggcagag

SEQ ID NO: 71770 - RNA, 42 nt, Mus musculus
gucaccaucuagacuugaggaaaccacguccuacagagggau

SEQ ID NO: 71771 - RNA, 46 nt, Mus musculus
aauuuguguuccauuuuugaaagugguuuuacuuuuaucuguagau

SEQ ID NO: 71772 - RNA, 46 nt, Mus musculus
guuagauaaccugcuguaggucacacaggucugugaguguggaagc

SEQ ID NO: 71773 - RNA, 46 nt, Mus musculus
gccaggaggucaagccucuuggugcuccgugcauugguccccagga

SEQ ID NO: 71774 - RNA, 45 nt, Mus musculus
ccaugggcacuagcaacccugccuggaauugccagagcccccaca

SEQ ID NO: 71775 - RNA, 46 nt, Mus musculus
cacuuuucagccaagagccucccauauacccaaaccaucacagauc

SEQ ID NO: 71776 - RNA, 49 nt, Mus musculus
guuuguuaauggcuacaauagcagguucaacucagaacagugucccaag

SEQ ID NO: 71777 - RNA, 48 nt, Mus musculus
guguguggugugugugugugugugugugguguguguguguauguguau

SEQ ID NO: 71778 - RNA, 46 nt, Mus musculus
uguggugugugugugugguguguguguguguguguggugugugugu

SEQ ID NO: 71779 - RNA, 26 nt, Mus musculus
cacaaaaacaaaugggaccacauuca

SEQ ID NO: 71780 - RNA, 46 nt, Mus musculus
auacacuugauaaaaucacuuuguuuggagugccccacuggcugcu

SEQ ID NO: 71781 - RNA, 42 nt, Mus musculus
ugcacaaagaaauguugggcaggacugagcccuguuccagau

SEQ ID NO: 71782 - RNA, 58 nt, Mus musculus
gacugaaaacugaguuaccaaaaagggaaaaguuaagacauaucuccgaaaagaagga

SEQ ID NO: 71783 - RNA, 61 nt, Mus musculus
gcugaaggugguggguuuguacuagaguuuguauauagaaggagaaaacuggguguaagag

SEQ ID NO: 71784 - RNA, 39 nt, Mus musculus
guauacccauagacaaaguucugugaaacugugaaagag

SEQ ID NO: 71785 - RNA, 46 nt, Mus musculus
accagauaauaugcucaguuuuuuuauccagauagaaaacuuguaa

SEQ ID NO: 71786 - RNA, 46 nt, Mus musculus
aaagagggauguguagcaaguuguugaaaucuuauucggagcguca

SEQ ID NO: 71787 - RNA, 28 nt, Mus musculus
ugaguugaagacuguuccuuuagaagac

SEQ ID NO: 71788 - RNA, 46 nt, Mus musculus
guggguuuauggguggucuucagcgcaauggcagcacgggacagac

SEQ ID NO: 71789 - RNA, 42 nt, Mus musculus
aucccaauuccuggacuuaugucuggugucuuggccucuaaa

SEQ ID NO: 71790 - RNA, 47 nt, Mus musculus
uguucuuuuguuuguuuguuuucugucaaagaauuaaagggcuagaa

SEQ ID NO: 71791 - RNA, 46 nt, Mus musculus
cccaaguaggccucaaauauguaauucucaugccucagccccuaag

SEQ ID NO: 71792 - RNA, 86 nt, Mus musculus
cauggugggaaacauagcaacaugcaggcagacaugggguuagagagguagcugagaauucuacaucuggauccucaggcagcaga

SEQ ID NO: 71793 - RNA, 46 nt, Mus musculus
acaccuuagagaagagggugggauugaccuggaccugauaguggag

SEQ ID NO: 71794 - RNA, 45 nt, Mus musculus
aagaggguggguauaacuacagauauacaauguuaugugcaggaa

SEQ ID NO: 71795 - RNA, 45 nt, Mus musculus
uacacuucuuaguauguuacauaucagucauuuuauuuccccggg

SEQ ID NO: 71796 - RNA, 46 nt, Mus musculus
ucucuuuugaaagaugcaucgccauuugcucccucggggucuggau

SEQ ID NO: 71797 - RNA, 42 nt, Mus musculus
gcuuacccaccccacccucuguuucuauccuuuacugcuaca

SEQ ID NO: 71798 - RNA, 46 nt, Mus musculus
augccuuaauauuuucuucugagacuaaauuagaaaguaaagagau

SEQ ID NO: 71799 - RNA, 42 nt, Mus musculus
agcugaucugugaaauuguaggaucagaugacauacugguac

SEQ ID NO: 71800 - RNA, 34 nt, Mus musculus
ugagaaccauuggaauuaugcaucccccguacuc

SEQ ID NO: 71801 - RNA, 46 nt, Mus musculus
uucauauggaaagcccuauaggcuauguaaacuaucagaccaggaa

SEQ ID NO: 71802 - RNA, 41 nt, Mus musculus
auauguguaaugaccaagauuuuauuuuugucaccagaggu

SEQ ID NO: 71803 - RNA, 45 nt, Mus musculus
aacacacagacaguguucccauugcuucucaaagucaagugcagu

SEQ ID NO: 71804 - RNA, 46 nt, Mus musculus
augcuucaggauaugacuucaaaauggcuuuacuaugcagccuuua

SEQ ID NO: 71805 - RNA, 46 nt, Mus musculus
aguuauuguuacaaauuugcauauagaaauuucgggaaauguggau

SEQ ID NO: 71806 - RNA, 46 nt, Mus musculus
gaucuuccuguugccucuccagcccagcugcacugugccuggaaua

SEQ ID NO: 71807 - RNA, 41 nt, Mus musculus
aaugaugccauacaggacaccuaagaagauuaauggguaga

SEQ ID NO: 71808 - RNA, 42 nt, Mus musculus
aguagcucuacuuccuauaauccuaacauuugggaggccgag

SEQ ID NO: 71809 - RNA, 24 nt, Mus musculus
gguguuuauucccgccccccuuuc

SEQ ID NO: 71810 - RNA, 41 nt, Mus musculus
uguauaugaguacucuguagcuaucuucagacacaccagaa

SEQ ID NO: 71811 - RNA, 46 nt, Mus musculus
ugguaguuaaaguuuuucccacuuagguugauuagagguccaaaua

SEQ ID NO: 71812 - RNA, 45 nt, Mus musculus
guuucucuagcuuucugcggcaacaggguguggaaggugaggaga

SEQ ID NO: 71813 - RNA, 42 nt, Mus musculus
ggaaagacacuaaguaaggccugaggcagaaagaaagcauga

SEQ ID NO: 71814 - RNA, 46 nt, Mus musculus
aaacucccucacggcguggaguguuacugauaaggagcaggaaguu

SEQ ID NO: 71815 - RNA, 46 nt, Mus musculus
ugcacuuuagaaauggcuacaaggggacccauucuccaagggagua

SEQ ID NO: 71816 - RNA, 50 nt, Mus musculus
ugaggcuacagagagugggaacuccugcacugugaguagggaucgguaug

SEQ ID NO: 71817 - RNA, 44 nt, Mus musculus
cuuggggcagcaugggcaugacaggcagagaacagggcugagau

SEQ ID NO: 71818 - RNA, 46 nt, Mus musculus
ugagucaacccaccagaauuguaauaauagaagcaaugguaguaga

SEQ ID NO: 71819 - RNA, 46 nt, Mus musculus
gccaaugagauucagaagugccaccacaucuggagcaccaggagug

SEQ ID NO: 71820 - RNA, 46 nt, Mus musculus
aucuucagucuuacuaccaaaguaagucacguaaugaaguccagag

SEQ ID NO: 71821 - RNA, 45 nt, Mus musculus
gaguggaaaaauuugacugugacaguggagggaaagggccauaag

SEQ ID NO: 71822 - RNA, 46 nt, Mus musculus
uguaaagaacuaguacaggguaagggaauuuuacguugccguuagc

SEQ ID NO: 71823 - RNA, 46 nt, Mus musculus
uccuguacugucaugugucauuugucauagacagaaauguccagau

SEQ ID NO: 71824 - RNA, 45 nt, Mus musculus
ugucauuauacuaugccuaugugagguuuguuuuguuugcaauag

SEQ ID NO: 71825 - RNA, 46 nt, Mus musculus
aaaaaaaaaaaaccuggaaauauaugacaucuacguuaggccugac

SEQ ID NO: 71826 - RNA, 121 nt, Mus musculus
ccaggcuggaugacucacuucauuugaucugagagccaaagagguaccaguacuuccugcgccagugggaguagggucaagagcauggaucagcugacagcugaugggcugcccaggaaag

SEQ ID NO: 71827 - RNA, 80 nt, Mus musculus
agaggggaagguuuggagcaggugcuauuuaaauguuggcuugccagugugacauucuagugaaagcaguugggauggau

SEQ ID NO: 71828 - RNA, 76 nt, Mus musculus
gguggagguagcaaaaguggacaaggcuuccaagagcucuugaucuggaagggaggaggaaacgggaacuaugugu

SEQ ID NO: 71829 - RNA, 58 nt, Mus musculus
auugugucaagcaacuguauguaaugcuucaggcuggaaggaaggacuauacgggaga

SEQ ID NO: 71830 - RNA, 66 nt, Mus musculus
aagaaaccaagugacaggaguugaaaaagaaaccaagugacaggaguugacaggagucuuagugga

SEQ ID NO: 71831 - RNA, 45 nt, Mus musculus
guuugcuugagagugguaggccuuaagaaagugacaggcauaagc

SEQ ID NO: 71832 - RNA, 45 nt, Mus musculus
cuacauauuucaaaucucugacagugcuaaacaaguagccagaug

SEQ ID NO: 71833 - RNA, 42 nt, Mus musculus
gggaagagggaaacgugauaauuuuuuaaaacccaggaagaa

SEQ ID NO: 71834 - RNA, 41 nt, Mus musculus
gcccgggggaagauugguacauuccagauccaaacuguagc

SEQ ID NO: 71835 - RNA, 46 nt, Mus musculus
gauugaggccuguuuaccucauggaugggugagaaaaagaucaaga

SEQ ID NO: 71836 - RNA, 45 nt, Mus musculus
ccuugucugaccgaagacucagcaacuccagucuuuguagcauug

SEQ ID NO: 71837 - RNA, 46 nt, Mus musculus
uaaacuaauucaacacacacacacacacacacacacacacacacac

SEQ ID NO: 71838 - RNA, 41 nt, Mus musculus
guuuuucucccuagaaagacagaaauuagguagauggauaa

SEQ ID NO: 71839 - RNA, 41 nt, Mus musculus
aaccuuugugcuguauguauugcauccucgcuugucacuga

SEQ ID NO: 71840 - RNA, 46 nt, Mus musculus
ccaagccagacgaucugaguucaaccccuggaacccauggcgagaa

SEQ ID NO: 71841 - RNA, 45 nt, Mus musculus
uuggagugaguguuuacugacuguggagucaugaagucccaagua

SEQ ID NO: 71842 - RNA, 64 nt, Mus musculus
uugaauuguaaagauuuauuuuauuuuuauuugugugcgugugugugcgagagagagagagaga

SEQ ID NO: 71843 - RNA, 46 nt, Mus musculus
auagcguuuuuaaagguauuuuuugcuguauuaauaaagucaagua

SEQ ID NO: 71844 - RNA, 45 nt, Mus musculus
ugcucccauguauuguauucuacagccacaguggcggugugggua

SEQ ID NO: 71845 - RNA, 44 nt, Mus musculus
acguccauccaugugaagccacuucugaaugaauuggaaacagc

SEQ ID NO: 71846 - RNA, 45 nt, Mus musculus
cuauagaccaggcuggccucaaacucaugugugugugugugugug

SEQ ID NO: 71847 - RNA, 45 nt, Mus musculus
agaugucagaccaccaagaauauagaaaauaagaaacuacccuaa

SEQ ID NO: 71848 - RNA, 46 nt, Mus musculus
agggcagcuuuggaaguaggaacaguaguuuuacaguguagcagac

SEQ ID NO: 71849 - RNA, 46 nt, Mus musculus
gauuuguuuccauuucuaguuugauuauuucaaaauaauagcagau

SEQ ID NO: 71850 - RNA, 46 nt, Mus musculus
cacacugcuggauucacuggguaggugugacucauccuguucccac

SEQ ID NO: 71851 - RNA, 45 nt, Mus musculus
cuugaguaauugguuguguaguuuaguuuugaguguagcagaggg

SEQ ID NO: 71852 - RNA, 65 nt, Mus musculus
ccucugcauauauguuguggucggugugugcuaauacucaacacacacacacacacacacacaca

SEQ ID NO: 71853 - RNA, 53 nt, Mus musculus
agggugaguugggagaauugccaggaguucuuaggccagcuaaccuugcauac

SEQ ID NO: 71854 - RNA, 45 nt, Mus musculus
agaacucccuugaaaagccagauacaguaaagcaagcgucuagaa

SEQ ID NO: 71855 - RNA, 50 nt, Mus musculus
aagaaaaguguaugacuguaaggaaaggccaaauguggagaccuggcugg

SEQ ID NO: 71856 - RNA, 46 nt, Mus musculus
acacacaugcacaugcacgcaugcaugcaugcacuuaccccaaaac

SEQ ID NO: 71857 - RNA, 46 nt, Mus musculus
ugcuggagaacuggagaggacugacagagcaaggcgauggguaagg

SEQ ID NO: 71858 - RNA, 84 nt, Mus musculus
gguggguaguaaucaccaggucugggcucuggcucugggugugggugguagagguggagccugacaacuacauuagcgaugagg

SEQ ID NO: 71859 - RNA, 76 nt, Mus musculus
augggccaguaggguggaagaguuguugggguuaggguugaggagugggcaggaaagauaagaaauggcagggaga

SEQ ID NO: 71860 - RNA, 39 nt, Mus musculus
gcuaccacauguaagugcucccccccccccccaguaagu

SEQ ID NO: 71861 - RNA, 46 nt, Mus musculus
cugucugucugucugucugucugucugugugugugugugucuaugu

SEQ ID NO: 71862 - RNA, 46 nt, Mus musculus
cagaauaguaaugacucagcuauauaaaugaugacaaacagcagca

SEQ ID NO: 71863 - RNA, 44 nt, Mus musculus
aauuggguaauaggcaaagacaggcaauuagaaagcacuguaga

SEQ ID NO: 71864 - RNA, 45 nt, Mus musculus
auauacuaacaagaaaaauuauaauguauauaugucacaaccaga

SEQ ID NO: 71865 - RNA, 45 nt, Mus musculus
cacuuaaugcuccuaagugaaauggagacauuuuauagauaagau

SEQ ID NO: 71866 - RNA, 46 nt, Mus musculus
ccaauguagcuccagguucagcgauaguucuuuucucaagggagua

SEQ ID NO: 71867 - RNA, 46 nt, Mus musculus
aauuugaguugauaguaagaggaagaauuaauaagaagggugagau

SEQ ID NO: 71868 - RNA, 45 nt, Mus musculus
augucugggcuuugcaacuaaaagauggccaggcaaugugcuagu

SEQ ID NO: 71869 - RNA, 45 nt, Mus musculus
auaauggggcguggcaaguuugauguacuacagguuaagugugag

SEQ ID NO: 71870 - RNA, 46 nt, Mus musculus
caggcaaacaauggauuguuggaagaggaaggccaggaugagagau

SEQ ID NO: 71871 - RNA, 48 nt, Mus musculus
aacugcccaucuccuaggacuaccagaauaauggaucaggaagggaga

SEQ ID NO: 71872 - RNA, 45 nt, Mus musculus
acgguaccaagcuaugacuggcaacugcugggaguaggucuggag

SEQ ID NO: 71873 - RNA, 45 nt, Mus musculus
ucuucagacacaccagaagaggguacuggaucucauuaccaggga

SEQ ID NO: 71874 - RNA, 46 nt, Mus musculus
agggagaaggauugugguagggaugauugagaggggggcagugaac

SEQ ID NO: 71875 - RNA, 41 nt, Mus musculus
ggagaagugccuagccuuguagagacuugaugugccagggu

SEQ ID NO: 71876 - RNA, 45 nt, Mus musculus
cuggcccuggcauuccccuauacuggggccuagaaucuucgcaag

SEQ ID NO: 71877 - RNA, 46 nt, Mus musculus
aggguagccauugcagaggaagucucugauggaggagagagguuag

SEQ ID NO: 71878 - RNA, 46 nt, Mus musculus
guuuagggaaaugcucaucaaguuagggcagauucgcagcgagaug

SEQ ID NO: 71879 - RNA, 70 nt, Mus musculus
aaaucaggacaggcucugcagugccagguuccucaccgagagguaagggagcguguggaaggaaaacugg

SEQ ID NO: 71880 - RNA, 45 nt, Mus musculus
ugguugugagccaccaugugguugcugggauuuaaacuuuggaag

SEQ ID NO: 71881 - RNA, 42 nt, Mus musculus
agugggacacuuacacuuauauauagggcguguccuauggag

SEQ ID NO: 71882 - RNA, 48 nt, Mus musculus
cagaacuaguguacacauguaaguauacacacgcauauguauagagca

SEQ ID NO: 71883 - RNA, 46 nt, Mus musculus
ccagugggaauggaccugaagucuuuuguuucucuuagugggucag

SEQ ID NO: 71884 - RNA, 45 nt, Mus musculus
uauccccaaacuggaaaaccacuuacucuccaaauucaggucaua

SEQ ID NO: 71885 - RNA, 42 nt, Mus musculus
agaagagaaagagagagagagagggagagagagagagaaaga

SEQ ID NO: 71886 - RNA, 45 nt, Mus musculus
accguuuuggugaaagacuucagcuguguuguuuuaugccaacag

SEQ ID NO: 71887 - RNA, 49 nt, Mus musculus
ccagcagugaaacgggauaaucagaauuggaaaugugggccaaaaauag

SEQ ID NO: 71888 - RNA, 46 nt, Mus musculus
cccauccgcuuuaccuuauaugaaagaggagguuucaggcuucuag

SEQ ID NO: 71889 - RNA, 46 nt, Mus musculus
aaucagaaguggcugaaacaaaugaugauaaagauaaugggauugu

SEQ ID NO: 71890 - RNA, 46 nt, Mus musculus
uuuugaggaaaacaacuguuuguucuugugaggaaggagaguagag

SEQ ID NO: 71891 - RNA, 46 nt, Mus musculus
gggguggggggaaguggaggagugauuuuaguuuuguuauaccaag

SEQ ID NO: 71892 - RNA, 45 nt, Mus musculus
gaucuugaccacggggacucaaagucacagaaggccguccugaaa

SEQ ID NO: 71893 - RNA, 45 nt, Mus musculus
uccugauucaaaaagggaacccuccccagauucaccaagacagua

SEQ ID NO: 71894 - RNA, 42 nt, Mus musculus
auggacauaccacaaauaauuuguguauuuaagagucuggag

SEQ ID NO: 71895 - RNA, 46 nt, Mus musculus
uccaugucaugugggacaguugaagauuguuuuaagaggacggugu

SEQ ID NO: 71896 - RNA, 46 nt, Mus musculus
guucuuguucaggucauauucugacagccauguugaugagacauug

SEQ ID NO: 71897 - RNA, 45 nt, Mus musculus
auguauguggguguguauguguauguauuaugugugugccucuaa

SEQ ID NO: 71898 - RNA, 41 nt, Mus musculus
ucagagagauuuuauaaaaaagacauuacuguggugcuacu

SEQ ID NO: 71899 - RNA, 45 nt, Mus musculus
uuacuagaugagccaacgauuucaucuagacucuucagcuuucaa

SEQ ID NO: 71900 - RNA, 59 nt, Mus musculus
cugaacugacaucucuucauaucauauuuggucacagguccauuaugaaaauauccuug

SEQ ID NO: 71901 - RNA, 72 nt, Mus musculus
auggggaagggacauugaguugucauuugcacugucacugaaguuacucaaaagaggagcuuguagggcaag

SEQ ID NO: 71902 - RNA, 83 nt, Mus musculus
gauguaguugaguggcaggguguguauuagcauacaugagguccuggggaagaaaaaagagauuguggcugcaagaaagagcc

SEQ ID NO: 71903 - RNA, 85 nt, Mus musculus
gacagaacucuacucagggaguuuuauuuuguuuuugguacuggagauugaaccuugagccugcucuuacacuaagucauuuagg

SEQ ID NO: 71904 - RNA, 45 nt, Mus musculus
auguuauaauaaaagaauaccacuuuuauaaucaaagggaaaaag

SEQ ID NO: 71905 - RNA, 46 nt, Mus musculus
uaucuuaauaaaacuguuuaauaaaaauagugucuccuggcacuag

SEQ ID NO: 71906 - RNA, 45 nt, Mus musculus
gucaagcugggcucaggcuuagcucacguccuuggaugucauggg

SEQ ID NO: 71907 - RNA, 41 nt, Mus musculus
cagccuuagguguuaggaagagaacaaggaggaaagggggg

SEQ ID NO: 71908 - RNA, 27 nt, Mus musculus
accuacaucuagauccacaaagcagaa

SEQ ID NO: 71909 - RNA, 41 nt, Mus musculus
uaguccaucauccaggaaagucagggcaggaacucaaggca

SEQ ID NO: 71910 - RNA, 46 nt, Mus musculus
gauguacaugcuuuuuuucaugucuggauccacgucugcauccuag

SEQ ID NO: 71911 - RNA, 45 nt, Mus musculus
cacaaagugaauuuccuuuaauaggaucccacagccuccuguuuc

SEQ ID NO: 71912 - RNA, 42 nt, Mus musculus
accuacagccugaucaguaaggucccaggagcuagccugcag

SEQ ID NO: 71913 - RNA, 45 nt, Mus musculus
gugagccuuaaugagcagagacagucuaugguuuuagagcuuuau

SEQ ID NO: 71914 - RNA, 42 nt, Mus musculus
aggaguguuucuugugucuuagcagcacucaugggaaggcag

SEQ ID NO: 71915 - RNA, 32 nt, Mus musculus
ggaacuguuuaagaaccucuagcaaacaauac

SEQ ID NO: 71916 - RNA, 46 nt, Mus musculus
gccuacucuuuuacuuuggacuaaauacuauuucaaacagccuggc

SEQ ID NO: 71917 - RNA, 46 nt, Mus musculus
uugccucucuuuucaugugugugugugugugugugucggugugugu

SEQ ID NO: 71918 - RNA, 46 nt, Mus musculus
gugucugugugugugucugugugugugucugugugugugugcgucu

SEQ ID NO: 71919 - RNA, 46 nt, Mus musculus
ucugugugugugugagugugucuguguguguguguguaggccagag

SEQ ID NO: 71920 - RNA, 45 nt, Mus musculus
uugaucuguaagauaccuugaaauuagguaugauaaugccucuaa

SEQ ID NO: 71921 - RNA, 46 nt, Mus musculus
gaaugggauugcuucccccauuucucaauaugcuuguuagugauau

SEQ ID NO: 71922 - RNA, 45 nt, Mus musculus
ugagcuauuuagccagagucugucagcccaacacuugggagguag

SEQ ID NO: 71923 - RNA, 45 nt, Mus musculus
ugacacaaaugcuuuuguaucuaaguguuaaacacuagacuggaa

SEQ ID NO: 71924 - RNA, 46 nt, Mus musculus
uagccaaaagaaugcaacgguguaaagauuccaguugaugccagua

SEQ ID NO: 71925 - RNA, 45 nt, Mus musculus
uuuucaauauuguaagaccaagaagacuucucuacauggcaauag

SEQ ID NO: 71926 - RNA, 51 nt, Mus musculus
guucagagcaucaaaggaaggaauggaagcagcaguugagaagcagcgagu

SEQ ID NO: 71927 - RNA, 46 nt, Mus musculus
uucucccuccacccaaugucugugguguggcauuuucguugguuuu

SEQ ID NO: 71928 - RNA, 45 nt, Mus musculus
agugcaccuggugaaggagaacacaaaaucauggauuacauuaga

SEQ ID NO: 71929 - RNA, 46 nt, Mus musculus
uuaugcuuggucuugcuacacaugaaccuaacuucaccauaaucag

SEQ ID NO: 71930 - RNA, 42 nt, Mus musculus
gaagaaacaguuaaguauaguauacuaugugauuuuggacag

SEQ ID NO: 71931 - RNA, 46 nt, Mus musculus
uuuaaugaauaauauuugucuccugguggcagggaaggugcaauug

SEQ ID NO: 71932 - RNA, 82 nt, Mus musculus
augucaaucugcaaagaguacagaugaucauguuagcaguuggugaaguugaggauagcauuuuuaaaaagagaaaagauga

SEQ ID NO: 71933 - RNA, 46 nt, Mus musculus
cuuuguacuugauuauucuauaaagacugugauguuugcugggugg

SEQ ID NO: 71934 - RNA, 41 nt, Mus musculus
aagcuaucauguuuuuauaagaacuauuuauacucaggguu

SEQ ID NO: 71935 - RNA, 41 nt, Mus musculus
caaaaauucugcccucugagagcccucauucuuuaggggaa

SEQ ID NO: 71936 - RNA, 45 nt, Mus musculus
caauauuguaguucuaaaaaacacagcaaggggccuuaccaagag

SEQ ID NO: 71937 - RNA, 45 nt, Mus musculus
ccagugccaauggggcuggccagugggccaaaauguagguuguaa

SEQ ID NO: 71938 - RNA, 44 nt, Mus musculus
agauuuaaaaaaaaauuggagcagcagcuccucuaacauuugga

SEQ ID NO: 71939 - RNA, 91 nt, Mus musculus
uccaugggaagagagaagugaaaagagguguuaguacugagccccagggaacaauaacauugagcaaaggcgggaagugagacuagaggaa

SEQ ID NO: 71940 - RNA, 46 nt, Mus musculus
gacuaagauaucacagucuacagcuggcuuagaaacuuugaagaga

SEQ ID NO: 71941 - RNA, 46 nt, Mus musculus
gcacacuguucucucuggguuggauuuccagaaccacagaaauaaa

SEQ ID NO: 71942 - RNA, 46 nt, Mus musculus
aaagaacccuacccuguauauuaacuuggccuagaaucaacaauag

SEQ ID NO: 71943 - RNA, 46 nt, Mus musculus
uuucuuaacuuguauuuucuccauauugcauacaagauaaaccuaa

SEQ ID NO: 71944 - RNA, 30 nt, Mus musculus
gacgacagaaagaaaaaagaaagaggauga

SEQ ID NO: 71945 - RNA, 46 nt, Mus musculus
auuauguguacuuuagggcagaguuauuaaguauuacagacuguug

SEQ ID NO: 71946 - RNA, 46 nt, Mus musculus
ccuaauacaaguuuugcaucugauggcuccccaucuccacuaggag

SEQ ID NO: 71947 - RNA, 45 nt, Mus musculus
gcaguaauuaauguggagaguuagaauagucacuaauuccaggga

SEQ ID NO: 71948 - RNA, 45 nt, Mus musculus
uuacaauauuuuuuaaauaaaggaaccacugauaugaagcagaca

SEQ ID NO: 71949 - RNA, 46 nt, Mus musculus
ccaguauaauugacuucuauccugaagauuuugcuauugauuugaa

SEQ ID NO: 71950 - RNA, 45 nt, Mus musculus
uuauggaaacuuguaaaauauauaguagaaacuuaacaguugaca

SEQ ID NO: 71951 - RNA, 46 nt, Mus musculus
ugaggcagagggggcguaucaucaauuuacagauugaagggcuaag

SEQ ID NO: 71952 - RNA, 46 nt, Mus musculus
auauuaguugguaaagcguuuaccuggguugauuauaccuuaaaau

SEQ ID NO: 71953 - RNA, 46 nt, Mus musculus
uggagcugucauauuggcuacacuggcuggccagcaaguaccugag

SEQ ID NO: 71954 - RNA, 47 nt, Mus musculus
cuuuggcuguucuguuuuacagauucuaauauaaacccuugcccaua

SEQ ID NO: 71955 - RNA, 46 nt, Mus musculus
ccccugugcccauguugcgggaccugacacagaacacugcagucag

SEQ ID NO: 71956 - RNA, 46 nt, Mus musculus
auucauccaggguacagcuuagauuuuuacaagugaauuuuaacag

SEQ ID NO: 71957 - RNA, 45 nt, Mus musculus
uucaaagaaaagaaugauuuagucuuuaagauuauccuugccccc

SEQ ID NO: 71958 - RNA, 45 nt, Mus musculus
uguaugugacuguagaauaguacuagcuuuguguguuccuuggga

SEQ ID NO: 71959 - RNA, 46 nt, Mus musculus
gugagcugccugguguggguacagguccucugcaaagagcagcaag

SEQ ID NO: 71960 - RNA, 46 nt, Mus musculus
gauuuuuauauccuguaucuuuacuaagucuaucaguuccauuggg

SEQ ID NO: 71961 - RNA, 46 nt, Mus musculus
uugucuuacuuuauuaccauagcaaaauuauguuagauaugagugu

SEQ ID NO: 71962 - RNA, 45 nt, Mus musculus
cuccauaauuagucucauuuauuguaccuuaaguugcagccccuu

SEQ ID NO: 71963 - RNA, 46 nt, Mus musculus
uguccagacugccacccugauguguguauaauuggaaaccuagcag

SEQ ID NO: 71964 - RNA, 46 nt, Mus musculus
cuggcucuuucuauagagaaaguuaccugaagacaaugcaauagag

SEQ ID NO: 71965 - RNA, 46 nt, Mus musculus
caauuuuucguuguucucuuucaguauuaauuuuaaagauccacag

SEQ ID NO: 71966 - RNA, 45 nt, Mus musculus
gccuggaacucacuacauagaucaaacugacuuuaaacacccaga

SEQ ID NO: 71967 - RNA, 42 nt, Mus musculus
acuauuguuuguuuauuuuugagguaagguuuugcuagccag

SEQ ID NO: 71968 - RNA, 46 nt, Mus musculus
aagucuauguaugugauacauagccacgcacuacaggaagugagag

SEQ ID NO: 71969 - RNA, 46 nt, Mus musculus
cccaagauuccuggcgaggcccuccuccucuuuuccagcagcauag

SEQ ID NO: 71970 - RNA, 42 nt, Mus musculus
aauuucucuuuagcaggguugugcaguuuaaugaggcauaac

SEQ ID NO: 71971 - RNA, 46 nt, Mus musculus
aaggauuuguuucaaaaacaagccauuguuccucuuucccaaacag

SEQ ID NO: 71972 - RNA, 46 nt, Mus musculus
aaaaaaccaaaaaaaaaaaaaagaaagauuauuguugucaauacag

SEQ ID NO: 71973 - RNA, 46 nt, Mus musculus
ccaugaaauuuacuaagacuaaaaagaaaaaugagugacaguccag

SEQ ID NO: 71974 - RNA, 44 nt, Mus musculus
gaccuggaggcuauccacccagacgugacgaucaccgaggaggg

SEQ ID NO: 71975 - RNA, 46 nt, Mus musculus
cuggggacacugaaccccaguucaagauauguaaacaaguuggaag

SEQ ID NO: 71976 - RNA, 45 nt, Mus musculus
gagaaggacggaaauacccuuugccaccacccucgggaagauaca

SEQ ID NO: 71977 - RNA, 47 nt, Mus musculus
guauauuuuuacugaucugaucucacuguuucaugcugcuuuccaga

SEQ ID NO: 71978 - RNA, 42 nt, Mus musculus
ucccaaagucuccacucagccucucauuucccuuguccccag

SEQ ID NO: 71979 - RNA, 45 nt, Mus musculus
gaauagaggacacugagaugauuuucgcuugagacugccccagug

SEQ ID NO: 71980 - RNA, 32 nt, Mus musculus
gcuuaccucgggcuccgcguaguagcugcucc

SEQ ID NO: 71981 - RNA, 41 nt, Mus musculus
gugccacacagaguccagaaggguuuuguuuuaaguaagcu

SEQ ID NO: 71982 - RNA, 46 nt, Mus musculus
accccagugugccaguucauaagaaucugcauuuugacaacaucca

SEQ ID NO: 71983 - RNA, 46 nt, Mus musculus
cuuucuuuuaaugagacucuugaacaauaucucguaauucagaggg

SEQ ID NO: 71984 - RNA, 42 nt, Mus musculus
augauuguugcuguuguuuugaaugggaaugacaaaagaggu

SEQ ID NO: 71985 - RNA, 46 nt, Mus musculus
cuagucaauagugcuggaaugucacagaaaauaaacuuaaggaagu

SEQ ID NO: 71986 - RNA, 46 nt, Mus musculus
uuuccaaacucuuaugugaaacagaaaagaaacacuaaaagcagaa

SEQ ID NO: 71987 - RNA, 47 nt, Mus musculus
ccauggggucaagguuugccuucaagccuacagaucagcagcacuag

SEQ ID NO: 71988 - RNA, 50 nt, Mus musculus
uagauacuggacaacugggcggagguggcaaauacagcggagaucccaga

SEQ ID NO: 71989 - RNA, 46 nt, Mus musculus
acugggcuguccugcuucaaguccucccuacccucgcuuguccuga

SEQ ID NO: 71990 - RNA, 45 nt, Mus musculus
gccagggugcuuuuaaguugccagagaacacagcugggaggcugg

SEQ ID NO: 71991 - RNA, 61 nt, Mus musculus
cucucucucucuccagccucccagcuguguucucuggcaacuuaaaagcacccuggcuggu

SEQ ID NO: 71992 - RNA, 46 nt, Mus musculus
ggcggaagaugcgcacuuguacuccagcucugcacgagcagcgccc

SEQ ID NO: 71993 - RNA, 46 nt, Mus musculus
gggacaggcuggcaauggagaugccaaugagcacgccagagugcac

SEQ ID NO: 71994 - RNA, 37 nt, Mus musculus
gucagauuagcaaagacugugaccccaucccuguuag

SEQ ID NO: 71995 - RNA, 46 nt, Mus musculus
ggcgaaugcuucaccagugaaugucgaaacuucccuggcuccuaug

SEQ ID NO: 71996 - RNA, 42 nt, Mus musculus
aagugcgaaauguucugcaaugaaacuucgugcccagcagac

SEQ ID NO: 71997 - RNA, 23 nt, Mus musculus
cuaugauggcuaugaguuggugg

SEQ ID NO: 71998 - RNA, 73 nt, Mus musculus
ugugagacaggcuaccaguuggcugcagacggacaccggugugaggacguggaugacuguaagcaggggccca

SEQ ID NO: 71999 - RNA, 71 nt, Mus musculus
aaucgugcaacgaacucugcgagcauuuuugugucagcaacgcugaagugccaggcucuuacuccuguaug

SEQ ID NO: 72000 - RNA, 54 nt, Mus musculus
cuucagagggacacugggcuugggaagcgacaggagccuggaauugcagcgugg

SEQ ID NO: 72001 - RNA, 50 nt, Mus musculus
ccuggggcucuccgcacuagccaagcugcagcccacaggcagucaaugcg

SEQ ID NO: 72002 - RNA, 45 nt, Mus musculus
aaaugaccuuggaggaggccaggggaaacaauacuagggcagcaa

SEQ ID NO: 72003 - RNA, 44 nt, Mus musculus
gggaaagggggccaugaucucugagcccagacaaaacuugcacg

SEQ ID NO: 72004 - RNA, 42 nt, Mus musculus
ugugugugugugaugacgcgcacgcuuggggaauaggcagau

SEQ ID NO: 72005 - RNA, 46 nt, Mus musculus
guggcaaauggcuucuuuuugcauuuuuacuccgcccccaccccaa

SEQ ID NO: 72006 - RNA, 46 nt, Mus musculus
aaacaaacaaacaaacaaacaaacuacucagaaagaagugccugga

SEQ ID NO: 72007 - RNA, 42 nt, Mus musculus
ccaauagcaacugguuccucugguuccuaauuagggggaaag

SEQ ID NO: 72008 - RNA, 46 nt, Mus musculus
ugucugggggugaaagcuguguguugguuugucauuguggggaguu

SEQ ID NO: 72009 - RNA, 46 nt, Mus musculus
gaacuaccagccaggccuccccaaaaggaagacaacgaugacagaa

SEQ ID NO: 72010 - RNA, 45 nt, Mus musculus
gaagaucaucggugguccgggacucgggguagccaaggugggguc

SEQ ID NO: 72011 - RNA, 46 nt, Mus musculus
cuucugggccacuugugugaugucacuguuagcauagagaaccagg

SEQ ID NO: 72012 - RNA, 53 nt, Mus musculus
agcagugcuggcggccaccagcaaguuuuuuaaggagguguuccuaaacgaga

SEQ ID NO: 72013 - RNA, 48 nt, Mus musculus
gacuuugcuucguuucuggaguuugucuauacugccaaagugcgggua

SEQ ID NO: 72014 - RNA, 62 nt, Mus musculus
uucucugagucucaggagguggaggccagcaguggcccccaggugagugugacccccagcuc

SEQ ID NO: 72015 - RNA, 51 nt, Mus musculus
gcucucaccagaaacaccauccaagaaguguaaggagaaacuggacaagaa

SEQ ID NO: 72016 - RNA, 52 nt, Mus musculus
aagccgcagagaaugacaaguguccucaggaccaaagcccagacaaugagag

SEQ ID NO: 72017 - RNA, 45 nt, Mus musculus
cugcuaguguagaacuggaggaaagccugcagaaaguggaggggg

SEQ ID NO: 72018 - RNA, 64 nt, Mus musculus
ggggcgagagcauggugguugucaucuuucaguuugccugaguucaaaguacuuguguaggaag

SEQ ID NO: 72019 - RNA, 45 nt, Mus musculus
caucaugcugguugugaaacugaaaugcuccugugugggucucag

SEQ ID NO: 72020 - RNA, 41 nt, Mus musculus
auucucugccuuccagugccucacagcauaaauaaggccca

SEQ ID NO: 72021 - RNA, 46 nt, Mus musculus
cagguuacagcugggcuucagcuuuuccaucgagucaggcuuacag

SEQ ID NO: 72022 - RNA, 46 nt, Mus musculus
gugugcuugcggaccuuugcucagcgcaauucccuguaccagcaua

SEQ ID NO: 72023 - RNA, 46 nt, Mus musculus
cagguccauaaagaucccacagcacagccuucaaaauagugagcag

SEQ ID NO: 72024 - RNA, 46 nt, Mus musculus
ugcauguggacggacuuuuacugacaagucuacucuccggaggcau

SEQ ID NO: 72025 - RNA, 94 nt, Mus musculus
uuccuugucauuguagauggcucacccaagaaugaugaagggcauaagacagaacaacccgaugaugaauaugcaucacccaaacuuucagauc

SEQ ID NO: 72026 - RNA, 46 nt, Mus musculus
ucugaucugcaugaucucagcuacauuucaucagcaaacacggcag

SEQ ID NO: 72027 - RNA, 45 nt, Mus musculus
cagccuacgcugcacagcuggagcaguaccagaaagccaucgaga

SEQ ID NO: 72028 - RNA, 46 nt, Mus musculus
cguggagaaaucccuucucuccuuccacuaugagagucccaggaau

SEQ ID NO: 72029 - RNA, 45 nt, Mus musculus
cuuuagggcuacauacuuuauucuguugacugaggaggccaacuu

SEQ ID NO: 72030 - RNA, 42 nt, Mus musculus
augugagccuuagagggacauuuuuuauucaagccaccacag

SEQ ID NO: 72031 - RNA, 53 nt, Mus musculus
uucuucauuuacaauucaaaugcuaucccgacagucccuauacccucccccca

SEQ ID NO: 72032 - RNA, 46 nt, Mus musculus
uuuuuauuuuuuuaaccuuucucauuaucuccuuuagucuuagauc

SEQ ID NO: 72033 - RNA, 50 nt, Mus musculus
ccccgugugcuagaacgugugugugccuucuccuuccuccacugccugcu

SEQ ID NO: 72034 - RNA, 46 nt, Mus musculus
gcuguuauauuuaugacauaaagcuuuuaaaaauaguccagcuccc

SEQ ID NO: 72035 - RNA, 46 nt, Mus musculus
gccucuucuguggcucuguuuugugagcaacucugaaagugauauu

SEQ ID NO: 72036 - RNA, 46 nt, Mus musculus
cacuguuuaccucuggcuggccuagacucaguuauguagaccagac

SEQ ID NO: 72037 - RNA, 41 nt, Mus musculus
guuuacauucugagcuuucaaaaagcaaaaccugcccugag

SEQ ID NO: 72038 - RNA, 46 nt, Mus musculus
gccaugccuugcucaauuaaaaaaaaaaaacuccuuuggcucuguu

SEQ ID NO: 72039 - RNA, 46 nt, Mus musculus
gcugaauuuugucagggagugugugccuuuccagggcacgcuguag

SEQ ID NO: 72040 - RNA, 55 nt, Mus musculus
ccagaucuacagcgugcccuggaaaggcacacacucccugacaaaauucagcugc

SEQ ID NO: 72041 - RNA, 48 nt, Mus musculus
gucccagacaaauuugacugacuguccuuuccaugaccagccccaucu

SEQ ID NO: 72042 - RNA, 46 nt, Mus musculus
ucauggaaaggacagucagucaaauuugucugggacuugguacaug

SEQ ID NO: 72043 - RNA, 42 nt, Mus musculus
uuugucgucuaaaaccugggcuuccuuugggucaacuuuggg

SEQ ID NO: 72044 - RNA, 45 nt, Mus musculus
gagucuaagucuaagguagucuguccaucuacucaguggguggag

SEQ ID NO: 72045 - RNA, 65 nt, Mus musculus
ugggcggcgaccccaaaacaaggcccgcgaauguugggagccccggaggaggcagaugccaauga

SEQ ID NO: 72046 - RNA, 46 nt, Mus musculus
ggggcucccaacauucgcgggccuuguuuuggggucgccgcccagg

SEQ ID NO: 72047 - RNA, 45 nt, Mus musculus
acuccgugcgacuuuuacccaaaugcgagcguuagggacccgccc

SEQ ID NO: 72048 - RNA, 42 nt, Mus musculus
gaagggucgcaguggccggacuagggagacacagugucgccc

SEQ ID NO: 72049 - RNA, 46 nt, Mus musculus
ggaugaggguugaggaagcugugcggucaagaaugugugugaaggg

SEQ ID NO: 72050 - RNA, 46 nt, Mus musculus
uagagaugaguacuggcccaugaugggccucagucacugcugcaag

SEQ ID NO: 72051 - RNA, 46 nt, Mus musculus
caggaagcugagcacucacaucuuuaauuguaaacauuaagcugag

SEQ ID NO: 72052 - RNA, 46 nt, Mus musculus
gguacaccuuugccaauggccucucagagugccgagccucagccau

SEQ ID NO: 72053 - RNA, 45 nt, Mus musculus
caccgcuaauuucuuaguuccagcuaaccagcaucaauaguccca

SEQ ID NO: 72054 - RNA, 46 nt, Mus musculus
guccucauaauuugcaacaucacacaaccacagaaacuauccgcag

SEQ ID NO: 72055 - RNA, 45 nt, Mus musculus
uguuuaucuguguguguguguguguguguguguguguguguguuc

SEQ ID NO: 72056 - RNA, 41 nt, Mus musculus
aagaaagaaagaaagaaagaaagaaagaaagaaagugacau

SEQ ID NO: 72057 - RNA, 46 nt, Mus musculus
augaacaguuuccauauauaaugcugacuucugauuaccggccaag

SEQ ID NO: 72058 - RNA, 46 nt, Mus musculus
cuaugaucacuacccccaugcuuaguggaaaguaaagugaccaaau

SEQ ID NO: 72059 - RNA, 46 nt, Mus musculus
uugcgaccagauuucaaagcuggugccugugcaucugagcaagcaa

SEQ ID NO: 72060 - RNA, 46 nt, Mus musculus
cagaggauguuugacucacucaguuauaucucauaaacagcacaug

SEQ ID NO: 72061 - RNA, 70 nt, Mus musculus
caagauguuauaccuacuauguaccuuccauccuugaccccauaaauggaugggccccauauaacaggcc

SEQ ID NO: 72062 - RNA, 46 nt, Mus musculus
ucuuauauuugaaugcuugguucccaguugauggaacuguuuggga

SEQ ID NO: 72063 - RNA, 46 nt, Mus musculus
gucauucuuugaacaucccguugacaucuuucuuaggaacaugcag

SEQ ID NO: 72064 - RNA, 42 nt, Mus musculus
ugaaauucuucuuaagagaaagaaucugcugugcucugggag

SEQ ID NO: 72065 - RNA, 45 nt, Mus musculus
gaggaaaacaggagccugcagauaagcagagucucaccacugggu

SEQ ID NO: 72066 - RNA, 45 nt, Mus musculus
uguuuauacgugugugugugugugugugugugugugugugguuuu

SEQ ID NO: 72067 - RNA, 46 nt, Mus musculus
aucuuuuagcugggcugccccaucuaguguaguucuguagcagcag

SEQ ID NO: 72068 - RNA, 46 nt, Mus musculus
auuuuugaaggccaucgcaggcuaggagaagcaauaacagcaccau

SEQ ID NO: 72069 - RNA, 46 nt, Mus musculus
caaggcgauacaccuccugauggagucucaaacauucaaaggccag

SEQ ID NO: 72070 - RNA, 46 nt, Mus musculus
uucugacacaugcacauauguuuuuugaauuauugauuacgucaag

SEQ ID NO: 72071 - RNA, 45 nt, Mus musculus
gcagaugauauagcccaaauuagaggugacucuucucaccucuaa

SEQ ID NO: 72072 - RNA, 73 nt, Mus musculus
uaaaguaugaaaugagguggugguuacuguauaccaaagaaugagagaagaguaaaggagagagagaaagaga

SEQ ID NO: 72073 - RNA, 45 nt, Mus musculus
gguggcucgaugcccauggccauuuaaaccuaugaggauccuaca

SEQ ID NO: 72074 - RNA, 46 nt, Mus musculus
aggccaccauuuuuaauacccauaaacccacaucaagauccugaag

SEQ ID NO: 72075 - RNA, 45 nt, Mus musculus
cuggaccauauuagagauuacauuguaaacacugaaccuggccag

SEQ ID NO: 72076 - RNA, 46 nt, Mus musculus
ucaaacucucccuuuguaaaguugaacuuccagugaaggcaggcag

SEQ ID NO: 72077 - RNA, 41 nt, Mus musculus
ugguuugaauggaagccuaccaccagauacacucugcugga

SEQ ID NO: 72078 - RNA, 45 nt, Mus musculus
aaaaaagcaaagauuucuuuggaucuacaaccaggacauuucuca

SEQ ID NO: 72079 - RNA, 34 nt, Mus musculus
gcuccauugaaaaucauugaauugaugccuccag

SEQ ID NO: 72080 - RNA, 44 nt, Mus musculus
gauugguccauuuaaacauuagcagccuguuaacauuuaacuua

SEQ ID NO: 72081 - RNA, 44 nt, Mus musculus
uuucaaaaugaaauucuuucucagaggggcaaaguugaucuaua

SEQ ID NO: 72082 - RNA, 42 nt, Mus musculus
uugaucauagugagaacacauuuuauagacuuugacuggcag

SEQ ID NO: 72083 - RNA, 46 nt, Mus musculus
aagucauuuccucaguagugaccagaucaugcaauauccagacagc

SEQ ID NO: 72084 - RNA, 46 nt, Mus musculus
gaugguuucauuuuacuuuuuaagaagagaucauaaaauugaguag

SEQ ID NO: 72085 - RNA, 97 nt, Mus musculus
auaugaagauaggcuugaagaauaaccaaagcaaagacaacagaucuggggagaggagaaccaacacaguaaagagccuaugggaugggaucaagua

SEQ ID NO: 72086 - RNA, 109 nt, Mus musculus
guguaaugugcauuacaaauacuugaaggagcagcagacgagaugucugaagcacauuagacacauucaauauuagggauagacucaaaacuagugauauggaaaggug

SEQ ID NO: 72087 - RNA, 45 nt, Mus musculus
uauugggauaaacaaaagcuuaaaccaagugaacaucagccccua

SEQ ID NO: 72088 - RNA, 46 nt, Mus musculus
uuuaaauuauagaaaguguaaaacaaagagaaaaucucagaagcag

SEQ ID NO: 72089 - RNA, 46 nt, Mus musculus
cuaagacaaaggacuacagucaguuaaggcaugcugaaaaugagag

SEQ ID NO: 72090 - RNA, 58 nt, Mus musculus
uaagcauauauguaacaucaauugauaaaaaaugaggccauaaauuugcaagagagca

SEQ ID NO: 72091 - RNA, 46 nt, Mus musculus
aaaaauccaucaaugucaaguacaaauucucaaacaagugaauuga

SEQ ID NO: 72092 - RNA, 69 nt, Mus musculus
caagcauuuaaaagaaaagaaaaauuguaaaggaugugguagauucugaaauguuaaugcauuauucag

SEQ ID NO: 72093 - RNA, 77 nt, Mus musculus
agacugaaguuagauaaauuaaguuugcagaacuuuuugaaagugauaauaauuaaacccaaaauaugacgacuaau

SEQ ID NO: 72094 - RNA, 89 nt, Mus musculus
ugaaaagcuggaaaaucacauacaaaaucaagugagaggaagaauuaacauaaguacaaagggaaauuaacaauaaauaauaggaaggc

SEQ ID NO: 72095 - RNA, 45 nt, Mus musculus
acuuuugauugauacaauauauaacuaauacacaauuuuagaaga

SEQ ID NO: 72096 - RNA, 45 nt, Mus musculus
acuucuagguacaaacuuuguuugugugugugugugugugugugu

SEQ ID NO: 72097 - RNA, 42 nt, Mus musculus
cuuugguacuugcuuuccucuccagugucacaccaaccccag

SEQ ID NO: 72098 - RNA, 23 nt, Mus musculus
aauccuagacaaucauaaaaaca

SEQ ID NO: 72099 - RNA, 78 nt, Mus musculus
cauggcuuaagaaccaucacagagcaagguaaagcagcagcagugauagggaggaaaaggauaagaagggcaaaaucc

SEQ ID NO: 72100 - RNA, 77 nt, Mus musculus
auuaucugcugggaauuguggaugaaaaacaggcuauucauaugaaaauugaaggaauuucuccuuggggcugcaau

SEQ ID NO: 72101 - RNA, 49 nt, Mus musculus
gggguacuaccugauaggcaugcagacaugugagaacaguaauacggug

SEQ ID NO: 72102 - RNA, 46 nt, Mus musculus
cucuguugccuuguugcuuuggccauuugggauuauuugaaaccag

SEQ ID NO: 72103 - RNA, 45 nt, Mus musculus
acacagugacucauuucagcugagaggggaggagaacaaauugca

SEQ ID NO: 72104 - RNA, 46 nt, Mus musculus
aggaacucuugcugcaagaaaauaaagacaaacaugaggcccccag

SEQ ID NO: 72105 - RNA, 23 nt, Mus musculus
gauacucauggcugauaaagguc

SEQ ID NO: 72106 - RNA, 49 nt, Mus musculus
ggcaauuacagugaaugauguuauagggcauuggaguguuugggaguau

SEQ ID NO: 72107 - RNA, 46 nt, Mus musculus
guccggaaauuuuaagcuuuucagagcucccucacagcacccagca

SEQ ID NO: 72108 - RNA, 46 nt, Mus musculus
caaaaacuaagggaauucuguaaaucagauuuuugggaccgcuaag

SEQ ID NO: 72109 - RNA, 45 nt, Mus musculus
acauauuuuuacaugaaauuauauccaggaguaaaacuuuaaucg

SEQ ID NO: 72110 - RNA, 49 nt, Mus musculus
gauacuuacagcaaaccacuggauugaggucggggaccaugauggaaga

SEQ ID NO: 72111 - RNA, 45 nt, Mus musculus
gggaugugagaggcuuccaggauaaaaaugccaaacaguggggau

SEQ ID NO: 72112 - RNA, 45 nt, Mus musculus
cgccuuuaauccuagcacucgggcgggagaggcagguggauuuuu

SEQ ID NO: 72113 - RNA, 46 nt, Mus musculus
uuucaguuuucuauagcauuggauuagaacacaaaaugcagcaucc

SEQ ID NO: 72114 - RNA, 46 nt, Mus musculus
aagcacaacaugggaucaguaauagugucaggguuugguacaagcc

SEQ ID NO: 72115 - RNA, 46 nt, Mus musculus
ggagagauuggggaacccagaggggauaaaaacuucacaaguagag

SEQ ID NO: 72116 - RNA, 42 nt, Mus musculus
agccugaagugacuaccuccuauagcaagcaagacccccagu

SEQ ID NO: 72117 - RNA, 46 nt, Mus musculus
uaccagucuucagaggugaauggggggagagaacugugugggagau

SEQ ID NO: 72118 - RNA, 46 nt, Mus musculus
guucgucaauuccacgcccaagguaacucggugcuggugccaagug

SEQ ID NO: 72119 - RNA, 45 nt, Mus musculus
uuuauguagccagucuguuagucuaugucuuuuuuggggggaauu

SEQ ID NO: 72120 - RNA, 45 nt, Mus musculus
gagcauccacuucuguauuugccagauacuggcauagccucacaa

SEQ ID NO: 72121 - RNA, 93 nt, Mus musculus
aagagucccuuggugggcacuccugggugaguaaugggaaggcagagacaggaagagaugaagugguagcccaggauauucucuuuuugaggu

SEQ ID NO: 72122 - RNA, 42 nt, Mus musculus
agaucuucugaaguauacacagucccauaucuucuggcacca

SEQ ID NO: 72123 - RNA, 46 nt, Mus musculus
caccacaugucacaucuuuucuccaguguaaauuacuucauaccac

SEQ ID NO: 72124 - RNA, 46 nt, Mus musculus
guaagcaguuaaggcccaucggacacacaaacuuuauaugccccag

SEQ ID NO: 72125 - RNA, 46 nt, Mus musculus
cagcuuaauguuguaucuucuuuuacacucaucauaaaauccguag

SEQ ID NO: 72126 - RNA, 73 nt, Mus musculus
uaucuugaguggugcuucaaguucuaaaaggaugggcugacugaggaagaucucccgagacuucaggcggagu

SEQ ID NO: 72127 - RNA, 42 nt, Mus musculus
gaucaauucuguaagccuuguggcugugaugucaugccuagg

SEQ ID NO: 72128 - RNA, 56 nt, Mus musculus
guuugcuauaaauuauacuuaccuucugguucaaagaacacaucagauccaagaau

SEQ ID NO: 72129 - RNA, 46 nt, Mus musculus
acuggacaugcaggaccugcgggacgcggaccuccagcaccgcccg

SEQ ID NO: 72130 - RNA, 45 nt, Mus musculus
gcuacuacacauuguuucccuuuuaguuuugauuucucacaagau

SEQ ID NO: 72131 - RNA, 24 nt, Mus musculus
guagucuaggugggagcaggagau

SEQ ID NO: 72132 - RNA, 45 nt, Mus musculus
caggugaauugugcuggauccuacuaaauuccaaacagggcagau

SEQ ID NO: 72133 - RNA, 96 nt, Mus musculus
cuuccacaggcagagcacccacuuuuccuuccauuuugcccccgccccaucucuucacacauuucuuauugugcucuuguugugguagcuggagau

SEQ ID NO: 72134 - RNA, 81 nt, Mus musculus
ucuuugagaagaugucccucuuuuauugacugaaaugucccuugccccaacacauccaccuauaucucugaaaggaaagcc

SEQ ID NO: 72135 - RNA, 95 nt, Mus musculus
ucagagaaugccuuccuccucaugccugacccuugccccagcagcccucaaaaucucaaccuccccccuuuuuuuuuucaaagcuagguagccca

SEQ ID NO: 72136 - RNA, 42 nt, Mus musculus
uggguuguuuccuugccuguuucuuuaagaugggaccccugg

SEQ ID NO: 72137 - RNA, 44 nt, Mus musculus
guuguuuuuguuguuauugaagaccagccuuaguccuuggugau

SEQ ID NO: 72138 - RNA, 46 nt, Mus musculus
guaguauucuucucuuucuauuuuguggaauaguucucaaaguauu

SEQ ID NO: 72139 - RNA, 41 nt, Mus musculus
aguucaaggaguauucauucaaagaaagucacccuggccau

SEQ ID NO: 72140 - RNA, 46 nt, Mus musculus
ggaaaaagauaguaucuaguucuaagauuagaacuacuaacaagaa

SEQ ID NO: 72141 - RNA, 45 nt, Mus musculus
gaaaaagaccuaagaugcuguggcuaaaaaaaaucagguggcaga

SEQ ID NO: 72142 - RNA, 52 nt, Mus musculus
gaaggaucagaucagccuuggccugaggacaguagccucgagguuaaaggua

SEQ ID NO: 72143 - RNA, 46 nt, Mus musculus
cagaggaguccuuacucagacuuugugacuuugaaaaaggccagug

SEQ ID NO: 72144 - RNA, 46 nt, Mus musculus
uguacccccuaaccaaggaagggagguguuuguguggaccccagau

SEQ ID NO: 72145 - RNA, 113 nt, Mus musculus
cagaaagaaacuucagagauuaaaagguguauuacaagaaggagacaguuaugcgaucuaguaaaagaggcagagaaagugugugugugugagagagagaggcaggaggcaaa

SEQ ID NO: 72146 - RNA, 45 nt, Mus musculus
aguuccuuauguucucucaucagccuacuugggauuacugucaac

SEQ ID NO: 72147 - RNA, 46 nt, Mus musculus
acaagagaaauugaaggcuucuccugaauuggagccaccagcuaaa

SEQ ID NO: 72148 - RNA, 109 nt, Mus musculus
guaguuaggaaucuaguguggcuagagaagcccugcuaggcacugauuauaaaugcuguucuuauagggaccagcagcuucucaaaguucuaugguaagggaacagaug

SEQ ID NO: 72149 - RNA, 46 nt, Mus musculus
ccaucugaguuuauugaauuugugucuugguuucaggguugcgaga

SEQ ID NO: 72150 - RNA, 45 nt, Mus musculus; identical to SEQ ID NO: 50872

SEQ ID NO: 72151 - RNA, 42 nt, Mus musculus
ugcuggcuugugcugacccgcccccagcagaaccaggcccag

SEQ ID NO: 72152 - RNA, 42 nt, Mus musculus
uggccacaggugcuucagguuaaaggagagagaaagguccag

SEQ ID NO: 72153 - RNA, 42 nt, Mus musculus
uggccaguccaaguggaauucuuaguguaggaggagggaggu

SEQ ID NO: 72154 - RNA, 44 nt, Mus musculus
gacaggagacagacaggagacagacagagagagagagagagaga

SEQ ID NO: 72155 - RNA, 62 nt, Mus musculus
gacaggagagaggagagaggagacaggagagaggagacaggagagaggagacaggagacagg

SEQ ID NO: 72156 - RNA, 94 nt, Mus musculus
cacaaacacacacacagagugagagagaaagagagagaggaagagagagagaagagacgagagaggagagaggaggagaggggaggagacggga

SEQ ID NO: 72157 - RNA, 46 nt, Mus musculus
aaucgacaccaccagaaacauuuucaucguucuggagcaugcugug

SEQ ID NO: 72158 - RNA, 44 nt, Mus musculus
aaguaaaacgucuaaagaaacagugucauuugcaugacccggac

SEQ ID NO: 72159 - RNA, 44 nt, Mus musculus
cuaaagagagagggagguauggggggagagaaaaugaggugaga

SEQ ID NO: 72160 - RNA, 42 nt, Mus musculus
ucuccauggcacaagguaacagaauuauguggggaaggauau

SEQ ID NO: 72161 - RNA, 45 nt, Mus musculus
acuuucaaauucauaguuccaaggauggagaaauggcucaguggu

SEQ ID NO: 72162 - RNA, 46 nt, Mus musculus
aaugagcuugacaaaauugucauugagagcaaugccagccccagca

SEQ ID NO: 72163 - RNA, 44 nt, Mus musculus
ggguuucuuacuccuuggaggccauguaggccaugaaguccacc

SEQ ID NO: 72164 - RNA, 42 nt, Mus musculus
guugcaguguccgccggagcgguuugggaagugcacggggcg

SEQ ID NO: 72165 - RNA, 47 nt, Mus musculus
ggagucggcuggcugggaccugcagguagcgccgcgaggcgggccgc

SEQ ID NO: 72166 - RNA, 24 nt, Mus musculus
ggugccuggggucgcuugccacgc

SEQ ID NO: 72167 - RNA, 42 nt, Mus musculus
ugcgggcucgcaguguuggcgagacuuugggcgcugccgcag

SEQ ID NO: 72168 - RNA, 42 nt, Mus musculus
cgaugacuaauauuucuugaguaccuacaacaagccaggcac

SEQ ID NO: 72169 - RNA, 46 nt, Mus musculus
ugucaguuuaguacaacuccuacgauggcacaugacuucccagaag

SEQ ID NO: 72170 - RNA, 42 nt, Mus musculus
augcugccugggguugaaccugaccccacuucuuaccuccag

SEQ ID NO: 72171 - RNA, 41 nt, Mus musculus
guuaauacaugauugugggccaccaugugggugcugggacu

SEQ ID NO: 72172 - RNA, 46 nt, Mus musculus
uuggaaagaaggugaguucaaggccagccugaucuauauaggacag

SEQ ID NO: 72173 - RNA, 46 nt, Mus musculus
ccacaacuggcagguggguguggguggguggaugugagagagagag

SEQ ID NO: 72174 - RNA, 46 nt, Mus musculus
ucauggaugcucagaaguccuccaaagucuuuccugaaucugccuu

SEQ ID NO: 72175 - RNA, 45 nt, Mus musculus
guggcugucuugcuuucugccugucaaucucaguucacaucccac

SEQ ID NO: 72176 - RNA, 46 nt, Mus musculus
agcacaccacagcccuauuccucagaacuccaguugcaacucuaaa

SEQ ID NO: 72177 - RNA, 46 nt, Mus musculus
aauagagugacauccuucagagaccucauucaugaccaagaugaag

SEQ ID NO: 72178 - RNA, 46 nt, Mus musculus
uagugcuucacacuaccucagaacuuugcuuuuaaauauacuggag

SEQ ID NO: 72179 - RNA, 42 nt, Mus musculus
uuggagcagcaccagaggaagagucugccuauguggcaggag

SEQ ID NO: 72180 - RNA, 45 nt, Mus musculus
cccaucagccaguccuguguucucauugugaggaucucagugaga

SEQ ID NO: 72181 - RNA, 41 nt, Mus musculus
agauggcgggaggcuggugcagaaauucaaccacagccaca

SEQ ID NO: 72182 - RNA, 92 nt, Mus musculus
augagaaccaaacccugaaggaagccaaccuucucaacgcugucaucgugcagcgguuaacauaaccgcccagcuguugccucaccucccua

SEQ ID NO: 72183 - RNA, 47 nt, Mus musculus
acuguggccaugcccguggggauuuccucccaccccguacacaccua

SEQ ID NO: 72184 - RNA, 45 nt, Mus musculus
aaaaacacaaaaauuugaagaaauacuaccaauucuguuauauag

SEQ ID NO: 72185 - RNA, 42 nt, Mus musculus
caacugaggaggaggggccagucuggaaguuccgggcaguaa

SEQ ID NO: 72186 - RNA, 41 nt, Mus musculus
aguugaaacauucuuccauugggcuuuuuaguagcaaagau

SEQ ID NO: 72187 - RNA, 46 nt, Mus musculus
uucccccaccgggcuacgaugacauguaccugugaaggccucaaga

SEQ ID NO: 72188 - RNA, 47 nt, Mus musculus
gguggcaugauuguggauccccugagauccggcuucccaagaguacu

SEQ ID NO: 72189 - RNA, 46 nt, Mus musculus
gagaguugguaaccuuuaguuaugcucuguacucucauucucaggu

SEQ ID NO: 72190 - RNA, 86 nt, Mus musculus
uuguauacccucaccucugacagcuucagaagauggacagaauagcugcuauaugaaugaaugaaugaaugaaugauguccaaggu

SEQ ID NO: 72191 - RNA, 56 nt, Mus musculus
cagagguaaaaaaguagaaauggugauagauuugaguucuggugcuacugauaguu

SEQ ID NO: 72192 - RNA, 65 nt, Mus musculus
uccugcuguugccccuccccuggucuccaagugucuccagcagacguguugaaaguauuggugua

SEQ ID NO: 72193 - RNA, 101 nt, Mus musculus
ggaccuauaagaacagugaggagcuucggucucagaucagaucuggaauuaucacaccuauccaugagcagugggagaaggcucgugcaaacaguccuccg

SEQ ID NO: 72194 - RNA, 45 nt, Mus musculus
guguguguguggugugugugugugugugugugugugugugggcgg

SEQ ID NO: 72195 - RNA, 45 nt, Mus musculus
ugagaaaaggcagagggacucaguagcaagaaauaaggacuggua

SEQ ID NO: 72196 - RNA, 47 nt, Mus musculus
guggcagacuugacccugaacuuagaugauuauauugaugcagaaga

SEQ ID NO: 72197 - RNA, 46 nt, Mus musculus
gguuaugguuguguauucacgggguacuucaguuccuugcccaccu

SEQ ID NO: 72198 - RNA, 45 nt, Mus musculus
cagccaggucccagugauaagaaaucagaacuacugccagcuaag

SEQ ID NO: 72199 - RNA, 42 nt, Mus musculus
aaaaucaacuucuaaugaacuucuaaaucguagcacauucau

SEQ ID NO: 72200 - RNA, 45 nt, Mus musculus
ucauuugagaaagugccuccaugcacuuaagaaugacaguaagau

SEQ ID NO: 72201 - RNA, 46 nt, Mus musculus
guaaaacccuaacuaagacaccauuuauacgguuagcugcucuuuu

SEQ ID NO: 72202 - RNA, 45 nt, Mus musculus
gccaccacuacccggcucaucucauuauuuuagcugcccccugau

SEQ ID NO: 72203 - RNA, 42 nt, Mus musculus
agcagguauuuguguugguccucuagcugccuccugccaccc

SEQ ID NO: 72204 - RNA, 46 nt, Mus musculus
acuuucugggcucaggcugcccuugccuccauucucugcugauggg

SEQ ID NO: 72205 - RNA, 76 nt, Mus musculus
gcuuccucaagguccucauccaccaguuuacccaaagcaucugccguagaauacuccgugcuacacccucaacucc

SEQ ID NO: 72206 - RNA, 26 nt, Mus musculus
ugcuggugccgacaacgggcacagcg

SEQ ID NO: 72207 - RNA, 47 nt, Mus musculus
gaggcccaaaggccugcccugaccgugccaaagccagggcccgagcg

SEQ ID NO: 72208 - RNA, 46 nt, Mus musculus
gcucaauugguacaauguuugcauaacgugcccuaaacucucagau

SEQ ID NO: 72209 - RNA, 46 nt, Mus musculus
uuaguacccaucccacccacccucccaccccaaaacuuagccagau

SEQ ID NO: 72210 - RNA, 46 nt, Mus musculus
ucuagaaaaagauaguaauaacccucgagagaacaaggccccauuc

SEQ ID NO: 72211 - RNA, 86 nt, Mus musculus
gggucaaugggauuccaugccacccaagcugucaaaacugccacuaagucgacgaugguggcucucauacugacccagccccacau

SEQ ID NO: 72212 - RNA, 46 nt, Mus musculus
uggcuuuguuuuuuauuguuuaugcacccaugugugcaugcuagag

SEQ ID NO: 72213 - RNA, 52 nt, Mus musculus
cugcgggcucagaaugauguggcugcccggcagacgacagagaugcuaaagg

SEQ ID NO: 72214 - RNA, 46 nt, Mus musculus
gcuuuauagccaccgugacugugcacugucagcuuugcccacuucu

SEQ ID NO: 72215 - RNA, 46 nt, Mus musculus
agaguggucuggugguggugcuuuuaauaagcggcagguaauagaa

SEQ ID NO: 72216 - RNA, 46 nt, Mus musculus
agugugcaaagacugcucagcuguaacccuguuaaucagugcggac

SEQ ID NO: 72217 - RNA, 45 nt, Mus musculus
cauugacagcaccuacucaugccccggcaagcugcuggagagaga

SEQ ID NO: 72218 - RNA, 46 nt, Mus musculus
gaauagaagcguggggcccuugguggugggcugagaggaaugggaa

SEQ ID NO: 72219 - RNA, 48 nt, Mus musculus
agugcugggcaguggcacuuggacuggguagagacagaggccaagaag

SEQ ID NO: 72220 - RNA, 48 nt, Mus musculus
ugucugugagaccagggagcagagggaugguggguauugugggacagg

SEQ ID NO: 72221 - RNA, 44 nt, Mus musculus
caggguagggucuguguuaauguauacagcaccccaggcuaagu

SEQ ID NO: 72222 - RNA, 42 nt, Mus musculus
cagggcggggccaccaggagggucagggucucaguuggucag

SEQ ID NO: 72223 - RNA, 44 nt, Mus musculus
cgaggagacaaggacaguagaaaaagacaagguucaggguacaa

SEQ ID NO: 72224 - RNA, 42 nt, Mus musculus
ggagcaggcuacacugaccccaaagggaaugacagagggcag

SEQ ID NO: 72225 - RNA, 45 nt, Mus musculus
aagugugcuauuucuuagucagauccucaccccguggccuguaac

SEQ ID NO: 72226 - RNA, 45 nt, Mus musculus
caaggccugagaccuaccagauaccugcuucauaccagccugacg

SEQ ID NO: 72227 - RNA, 45 nt, Mus musculus
guguggguuuguugaugaaagugcagccagggcacugccagccca

SEQ ID NO: 72228 - RNA, 42 nt, Mus musculus
ugcugcaucuggcugucccggcuccugguugguccugggcuu

SEQ ID NO: 72229 - RNA, 45 nt, Mus musculus
gaggagauggcccugagccuugcccgggcaguggcuggcggagau

SEQ ID NO: 72230 - RNA, 48 nt, Mus musculus
gaagcagcagcccuuucugaggggaugggcgcagccaggccagaugga

SEQ ID NO: 72231 - RNA, 46 nt, Mus musculus
cugacugugggccuggguacuaaaaguccccagaacagggccugag

SEQ ID NO: 72232 - RNA, 45 nt, Mus musculus
aaaagggacugucccaugaaccagcaccagagaagacagccccgg

SEQ ID NO: 72233 - RNA, 45 nt, Mus musculus
cuuuuuccuuugcuguucacagcaccuagagcagggcguggcacu

SEQ ID NO: 72234 - RNA, 46 nt, Mus musculus
caaaacaaaacaaaacaaaacaaaacaaaacaaaacgugaucuuag

SEQ ID NO: 72235 - RNA, 46 nt, Mus musculus
ugucuuaggauuuauuuuuaaucgugugugugugugugugugugug

SEQ ID NO: 72236 - RNA, 51 nt, Mus musculus
cgaacaaacucgcugaauaggcuagcuggcugaccaguagucuggcuccag

SEQ ID NO: 72237 - RNA, 69 nt, Mus musculus
uauguacucuaggcuagccugaaguucagagccaaccuccugccuuagccucucuggugcugggauuau

SEQ ID NO: 72238 - RNA, 42 nt, Mus musculus
ccagacggcgaaguaaaggagcgagagagugagagugagaag

SEQ ID NO: 72239 - RNA, 45 nt, Mus musculus
ggggggaguggggagcuauaaggguccuagagagauuggcacuac

SEQ ID NO: 72240 - RNA, 46 nt, Mus musculus
gcuauggugcugcuauguauucaaaugcuaaauuuuguaccccaag

SEQ ID NO: 72241 - RNA, 44 nt, Mus musculus
uucucucuggguuauaggggagagugguggugcccagccaguca

SEQ ID NO: 72242 - RNA, 64 nt, Mus musculus
gccauggaaacauccaggaguguguuccugaccugcaaagggagacguuuaaugggaaaagagc

SEQ ID NO: 72243 - RNA, 41 nt, Mus musculus
gggaugccagaggugggcaggggcgcuaaggguaggggagc

SEQ ID NO: 72244 - RNA, 41 nt, Mus musculus
aggagaaaggugguucuaacccagaaucacgagugaguggu

SEQ ID NO: 72245 - RNA, 43 nt, Mus musculus
agggacaaaguacacagcgcggugccucagauagcccacagua

SEQ ID NO: 72246 - RNA, 48 nt, Mus musculus
uaucugcuggaaaaccaaaagguuaguuuaaaacaccguccggggagg

SEQ ID NO: 72247 - RNA, 46 nt, Mus musculus
gccucccaaacucaacaaaaaccaccucuugggucuuuuccagcag

SEQ ID NO: 72248 - RNA, 44 nt, Mus musculus
gaccgacagguucgggaucuggaccggggaguacaagugcgaga

SEQ ID NO: 72249 - RNA, 42 nt, Mus musculus
gguaagggccgcuuccucgugcgcaucuguuuccagggagac

SEQ ID NO: 72250 - RNA, 41 nt, Mus musculus
aguggcgggcucggcagccccgggggccuggccaccccgaa

SEQ ID NO: 72251 - RNA, 43 nt, Mus musculus
agaagaugggcugggcccagguggucaagaaccuggcggagaa

SEQ ID NO: 72252 - RNA, 42 nt, Mus musculus
ggccaauuuuccugaggagccguggcugaggcucagucuggg

SEQ ID NO: 72253 - RNA, 46 nt, Mus musculus
caucagcugucccugaaacccagaaggccaaggcuguggagaccag

SEQ ID NO: 72254 - RNA, 25 nt, Mus musculus
cgacagucugaaaagagcccgagga

SEQ ID NO: 72255 - RNA, 42 nt, Mus musculus
uagaaguaggugugcguguucuucuucaagcugcagggaagg

SEQ ID NO: 72256 - RNA, 42 nt, Mus musculus
ccugggcgugcuugaagaugugcaugaugaagauggugagac

SEQ ID NO: 72257 - RNA, 41 nt, Mus musculus
cggguuccugggauagcugcauguucugugugaguggcugg

SEQ ID NO: 72258 - RNA, 46 nt, Mus musculus
gguaagugcucuaggcugagggcacaucuagggcaagggucuugag

SEQ ID NO: 72259 - RNA, 46 nt, Mus musculus
ucucaguguagugcagucccagcuauacuccaaaagaccaacuuag

SEQ ID NO: 72260 - RNA, 45 nt, Mus musculus
ccacuggcgaccuucaugauccugagaacaggcggaggggagcgg

SEQ ID NO: 72261 - RNA, 45 nt, Mus musculus
gcuccgacagaccaaguaccaccucgcccgcuguccugcccgccu

SEQ ID NO: 72262 - RNA, 25 nt, Mus musculus
aggaggcaagaggaaaaaagugcuc

SEQ ID NO: 72263 - RNA, 71 nt, Mus musculus
gaggaaauauuuuguauuguauauuacaaugaucacuggcugaaaauauuguuuuacaauaguucuauggg

SEQ ID NO: 72264 - RNA, 42 nt, Mus musculus
cggcccgccccagcuuagccaauccgcgggucgagucggcac

SEQ ID NO: 72265 - RNA, 45 nt, Mus musculus
ucaguuuccccugaagagaccgggggaacuugcaagcgcagccac

SEQ ID NO: 72266 - RNA, 45 nt, Mus musculus
ccuaaaauaauguuuggaacgcuuaaugaauaagcuuggugcggg

SEQ ID NO: 72267 - RNA, 45 nt, Mus musculus
cauacauacacacacacacacacacacacacacacaaagaggaaa

SEQ ID NO: 72268 - RNA, 41 nt, Mus musculus
guggcacacgccuuuaaucccagcauuugggaggcaggggc

SEQ ID NO: 72269 - RNA, 46 nt, Mus musculus
ggacaaauaaagacaaaggauguggggcuggagagauggcucagug

SEQ ID NO: 72270 - RNA, 46 nt, Mus musculus
acacacaccuuuaauuccagaaccugggaggcagaggcaggcagau

SEQ ID NO: 72271 - RNA, 33 nt, Mus musculus
uucuugcagucuggcagacacuucucaugaaga

SEQ ID NO: 72272 - RNA, 48 nt, Mus musculus
caaagaaauccugucuugaaaaaagaaaaagaaagaaagaaagaaaga

SEQ ID NO: 72273 - RNA, 42 nt, Mus musculus
gagagagagagagagagagacagacagacagacagagggagg

SEQ ID NO: 72274 - RNA, 45 nt, Mus musculus
aguuuguucuuaguucuuguuuuguugugguuuuuugagauagga

SEQ ID NO: 72275 - RNA, 29 nt, Mus musculus
cccgaugugugccuggugccugcagaggu

SEQ ID NO: 72276 - RNA, 46 nt, Mus musculus
aguacacuguagcugucuucagacacuccagaauagggcgccagau

SEQ ID NO: 72277 - RNA, 46 nt, Mus musculus
cucuucagcauccaaagaugaaaaauugauaaagucggugggggca

SEQ ID NO: 72278 - RNA, 46 nt, Mus musculus
ggggagugaacccuccucuacaggccccauggacaggauccgagac

SEQ ID NO: 72279 - RNA, 46 nt, Mus musculus
uaugugccuuuaauccuaguguuuaaggccagccuggucuagagaa

SEQ ID NO: 72280 - RNA, 45 nt, Mus musculus
gacagcuacaguguacuuacauauaacaacaaauaaaucuuaaaa

SEQ ID NO: 72281 - RNA, 46 nt, Mus musculus
aaucccugggcaucagcccacccuauugagcagauauccuguagau

SEQ ID NO: 72282 - RNA, 44 nt, Mus musculus
aucugugaggaagugaaagucaacugucuugguaaccuggcucg

SEQ ID NO: 72283 - RNA, 85 nt, Mus musculus
aagcugcuucaucaaauguucuuuucuucccuuuggacagguugaaaggcuuaaugauagugcauccucugguuccucgggccug

SEQ ID NO: 72284 - RNA, 78 nt, Mus musculus
augaauucguuucucaauuuccaaaucaaaaccaacaggcugaguaggagguuuaacaggugcucucuugggcaagau

SEQ ID NO: 72285 - RNA, 46 nt, Mus musculus
aaaucccagcaaccacacgauggcucacaaccaucuguaaugagau

SEQ ID NO: 72286 - RNA, 44 nt, Mus musculus
caaacacacaaacacacacacacacacacacacagagagacaga

SEQ ID NO: 72287 - RNA, 46 nt, Mus musculus
aaacccuugaaaaauuaaaaccaaaauuaaugcugugcccucacgg

SEQ ID NO: 72288 - RNA, 46 nt, Mus musculus
agguguccccguccccguccccccucccccacucaguuguccuccc

SEQ ID NO: 72289 - RNA, 46 nt, Mus musculus
gaaaauucuagugucuauauggagcacuugguuuggggguucaggc

SEQ ID NO: 72290 - RNA, 45 nt, Mus musculus
ucugaguaccagugagaagcugccagaaaauuccuggcccaagag

SEQ ID NO: 72291 - RNA, 46 nt, Mus musculus
ucaucuggaaaauaguugguaggaaggaaccaagauaggcaucggg

SEQ ID NO: 72292 - RNA, 46 nt, Mus musculus
uccacccuugcauaggaugggggaauuugaacaauggaagccagcc

SEQ ID NO: 72293 - RNA, 46 nt, Mus musculus
agaaguaacacuaagagggaaaaagaaguuauacuuagcacuguga

SEQ ID NO: 72294 - RNA, 57 nt, Mus musculus
gaaaauucuggcccaggagguaaagggcuuguguuuguacugaggguuagcagugag

SEQ ID NO: 72295 - RNA, 45 nt, Mus musculus
uuccuacaacuucagccccaugcuucaguccagcuuggaacagau

SEQ ID NO: 72296 - RNA, 24 nt, Mus musculus
auucuuuaccgugcaugcuugcuc

SEQ ID NO: 72297 - RNA, 46 nt, Mus musculus
gguuacuauggcuguagccagagggccaugggagaaggggugugga

SEQ ID NO: 72298 - RNA, 46 nt, Mus musculus
aaaucuaaugcccucuugaaguaucugaggacaaacacaguguacu

SEQ ID NO: 72299 - RNA, 46 nt, Mus musculus
aaagcaaucuuccuacuugagccucccaagugccagaacuccaggu

SEQ ID NO: 72300 - RNA, 45 nt, Mus musculus
ucaugggacaugucuucuuaucaggacuucgcugggcugccaccu

SEQ ID NO: 72301 - RNA, 46 nt, Mus musculus
cuggguccauuguucuuuguaggaggcgcugaaggaaaugccugug

SEQ ID NO: 72302 - RNA, 46 nt, Mus musculus
caaggggaagucagacaggacgcaaaaagagcccugcugccacucc

SEQ ID NO: 72303 - RNA, 43 nt, Mus musculus
acugugcuggggccccaggcagugcgagcacaggaugcucuuu

SEQ ID NO: 72304 - RNA, 46 nt, Mus musculus
auagcccacacacugaggggaagccaugaagugugacccugcaguu

SEQ ID NO: 72305 - RNA, 50 nt, Mus musculus
cucacccaaagcgucacagcccgcuggauuuccuucaggucagggaggca

SEQ ID NO: 72306 - RNA, 46 nt, Mus musculus
uuguaagccaccaugugguugcugggaauugaacuugggaccucug

SEQ ID NO: 72307 - RNA, 42 nt, Mus musculus
agaccaagagaagguuggagaggaugaagauuggggucagug

SEQ ID NO: 72308 - RNA, 41 nt, Mus musculus
gggccaccucggguuucaggcucaccacccucaccuguagg

SEQ ID NO: 72309 - RNA, 46 nt, Mus musculus
guuacacucggcaauggccacaugggagucuuguucuagcccaggu

SEQ ID NO: 72310 - RNA, 41 nt, Mus musculus
uuccacagcaauccugggucuuaagcuuucucugcugccac

SEQ ID NO: 72311 - RNA, 24 nt, Mus musculus
ggagcaacaugggggaaaggcuuu

SEQ ID NO: 72312 - RNA, 42 nt, Mus musculus
gacugucuacaacaaaagaauuacugagaaugguucauacac

SEQ ID NO: 72313 - RNA, 49 nt, Mus musculus
acacacacgcgggcacacacauacacacacauacccacggcagacacgc

SEQ ID NO: 72314 - RNA, 45 nt, Mus musculus
aaagucauccaccaagccaggcuuggccacauuggcccuguagua

SEQ ID NO: 72315 - RNA, 48 nt, Mus musculus
aagagcugugcugaguuugugucuggaccucagcucaggacccaggag

SEQ ID NO: 72316 - RNA, 43 nt, Mus musculus
ucggagcacgccggccgcucgcagccgccugccuccaguccag

SEQ ID NO: 72317 - RNA, 42 nt, Mus musculus
ccuucucguagucaccuugugcuaguaacucuucaccaagcu

SEQ ID NO: 72318 - RNA, 42 nt, Mus musculus
auauauggguuuaauagaguggcaguaaguuuugucuggguu

SEQ ID NO: 72319 - RNA, 47 nt, Mus musculus
uauuuauuauuauaucuaaauacacuguagcugaccuuagacacacc

SEQ ID NO: 72320 - RNA, 42 nt, Mus musculus
gaccuuuggaacagcagucaguucucguaaccccugagcccc

SEQ ID NO: 72321 - RNA, 46 nt, Mus musculus
auacauggcaaacagaauacccauauauguaauuaagcgcccccuc

SEQ ID NO: 72322 - RNA, 63 nt, Mus musculus
aaauaauaaaggguguuagcaagaauauuagcuuuucugaaggagauaggaaaccauugcagg

SEQ ID NO: 72323 - RNA, 64 nt, Mus musculus
cucugcccauuuuauuuauuguuguguauauuaugauguaaaggcuccugagacacagugugcu

SEQ ID NO: 72324 - RNA, 46 nt, Mus musculus
uguuaggauuauugauuaagguuacuauuuaauucuuacggaauac

SEQ ID NO: 72325 - RNA, 44 nt, Mus musculus
aaaucccagcaaccacaugguggcucacaaccauccuuaccgag

SEQ ID NO: 72326 - RNA, 46 nt, Mus musculus
uugcgagccaccaugugguugcugggauuugaacuccggaccugcu

SEQ ID NO: 72327 - RNA, 46 nt, Mus musculus
ugcaugugugugucugugcaccacaugagugcaaugcccauagggg

SEQ ID NO: 72328 - RNA, 45 nt, Mus musculus
ccaugccugggugaaaguuguuguuguuaugugguugguuuggcu

SEQ ID NO: 72329 - RNA, 47 nt, Mus musculus
uucuaugaacacuuguuuggaaggaaaguaugauuuagcagucaaag

SEQ ID NO: 72330 - RNA, 46 nt, Mus musculus
gauccagagcagccuucacauuagcuucuauaacagcuggcaggag

SEQ ID NO: 72331 - RNA, 45 nt, Mus musculus
gguugaccuugauuuacuuauuugcuugcaccuccugagcccuag

SEQ ID NO: 72332 - RNA, 47 nt, Mus musculus
aucuaaguacacuguagcugucuucagacacaccagaagggccucag

SEQ ID NO: 72333 - RNA, 46 nt, Mus musculus
augacucuggauaugaauacagacaugaugcugucacuagucacau

SEQ ID NO: 72334 - RNA, 30 nt, Mus musculus
cauguaaauguuaauauaagcuauguguuc

SEQ ID NO: 72335 - RNA, 53 nt, Mus musculus
aagccccuccuucauuuuauauuuuuauucuaaaauauucacaggaaauugaa

SEQ ID NO: 72336 - RNA, 42 nt, Mus musculus
cuguagaccaggcuggccucgaauucagaaauuugccugccu

SEQ ID NO: 72337 - RNA, 45 nt, Mus musculus
auaacugguauauuucaguuuucagauaacuguuuucauggccca

SEQ ID NO: 72338 - RNA, 42 nt, Mus musculus
ccuagugacaucagcuggcaaagcgcccgcccugguaaccgg

SEQ ID NO: 72339 - RNA, 45 nt, Mus musculus
gggagagagggagagggagagagagagggagagagagacugagag

SEQ ID NO: 72340 - RNA, 84 nt, Mus musculus
gcagaugugagagagcugacacauguccagcuaaugaaaggaggaggaaggcugucugcgauugggcuuugaagauuaggggga

SEQ ID NO: 72341 - RNA, 77 nt, Mus musculus
gaaaagaggcuuuuuaauaucuauuucaaguagauuugguauuuuacgagucuggauuuuauaauuuggacauucag

SEQ ID NO: 72342 - RNA, 78 nt, Mus musculus
uuuaucagaguuuagucuugguuucauuuugaugauucauuuaauuuucugucucuauuucauuuuucacuugccacc

SEQ ID NO: 72343 - RNA, 46 nt, Mus musculus
gaagucugacuugaauugugaguuggacacauaccucuaccccuac

SEQ ID NO: 72344 - RNA, 46 nt, Mus musculus
cuaucaguggcuaagucccuaguuuucauaaauacuguggcccaga

SEQ ID NO: 72345 - RNA, 46 nt, Mus musculus
cgcaaccacgcccagcuuuuccuuaauauuuugugauaggguuuaa

SEQ ID NO: 72346 - RNA, 46 nt, Mus musculus
gucacagcuauugggauuucagcuguguuccacagccaguguugag

SEQ ID NO: 72347 - RNA, 28 nt, Mus musculus
augcacuuauauauaaucgcaagccaag

SEQ ID NO: 72348 - RNA, 41 nt, Mus musculus
gucaugcccggcuguggaggccauucuuacucaagccagug

SEQ ID NO: 72349 - RNA, 46 nt, Mus musculus
ugggacugguucuuaugcucauagagugggguacauucauuugcag

SEQ ID NO: 72350 - RNA, 46 nt, Mus musculus
aacuugaguuauagaugguuguuagcuauuaugugcaugcugggac

SEQ ID NO: 72351 - RNA, 45 nt, Mus musculus
aaccacagcuaucaaaagauugauacugcaccauuaaacuaaaag

SEQ ID NO: 72352 - RNA, 45 nt, Mus musculus
auagacaggugugagcugccuuaugggcauugggaauugaacuug

SEQ ID NO: 72353 - RNA, 45 nt, Mus musculus
caccagcccagauuaauuuauuuauguauuuuauguaugcacacc

SEQ ID NO: 72354 - RNA, 45 nt, Mus musculus
gaagucaacccuuaacuauugagccauccaucucucuagccccag

SEQ ID NO: 72355 - RNA, 73 nt, Mus musculus
uggccugggauucacagagaucuacugccucugcuuccugagaucuggguuagagccaccacuaccccuggcc

SEQ ID NO: 72356 - RNA, 64 nt, Mus musculus
cucaagaaguucaccuuccucaagaugagaccucuauccccggugauccagauuugauccauac

SEQ ID NO: 72357 - RNA, 45 nt, Mus musculus
aguguugggaucaaagaugugaccagcuaccuaaacuucucgagu

SEQ ID NO: 72358 - RNA, 46 nt, Mus musculus
ugugggaaaauucaauuugagacauuucauugguuguuaagaugug

SEQ ID NO: 72359 - RNA, 25 nt, Mus musculus
auuuugcccacuucuuaugucugua

SEQ ID NO: 72360 - RNA, 45 nt, Mus musculus
uagacagcauuuacucucauguuugucacuuugagcugugaucag

SEQ ID NO: 72361 - RNA, 46 nt, Mus musculus
cacagagaaacccuuucuugaacgccccccuaccucccacccccaa

SEQ ID NO: 72362 - RNA, 46 nt, Mus musculus
ugcauguaauacguuuaauguucuuguaacuggauuugacacuggg

SEQ ID NO: 72363 - RNA, 42 nt, Mus musculus
gccauucaggauuauacagugaggacagaccccagcccccac

SEQ ID NO: 72364 - RNA, 46 nt, Mus musculus
aauugucacaucauuaugagaguugcuguugcucauuaaucuguag

SEQ ID NO: 72365 - RNA, 23 nt, Mus musculus
auugguagcugucuugacucacc

SEQ ID NO: 72366 - RNA, 45 nt, Mus musculus
gaccugcacuggucugugcuagguccugggcguguuuuaggggga

SEQ ID NO: 72367 - RNA, 42 nt, Mus musculus
uaaguauuacacaagcauucuaccacugaaauaagcgccccc

SEQ ID NO: 72368 - RNA, 42 nt, Mus musculus
auucauuucugagaggacucguuuuaggguuuaaaucagcua

SEQ ID NO: 72369 - RNA, 45 nt, Mus musculus
uuuccaucauaggagagccauuaauuagugguaugaaaaguugac

SEQ ID NO: 72370 - RNA, 46 nt, Mus musculus
uaucuacccuccauacucaguggcguaaugauuauuaaugcauucu

SEQ ID NO: 72371 - RNA, 45 nt, Mus musculus
gaacucuuaaucuggccuaaaaauauuauagcuauugugcuugua

SEQ ID NO: 72372 - RNA, 46 nt, Mus musculus
aaaggcacaguaacauuuaaauaugguuaagacucaguugcacaag

SEQ ID NO: 72373 - RNA, 27 nt, Mus musculus
gucaguggcugguuguccuagauuuua

SEQ ID NO: 72374 - RNA, 82 nt, Mus musculus
cccuccagaaagcugggccccagauggaagaccuggaaacacgucaacuguucucugaagggcacugagaaaacacgggcag

SEQ ID NO: 72375 - RNA, 44 nt, Mus musculus
acuaaucagauaggacgaccaucaucucaugaagaaagcaacca

SEQ ID NO: 72376 - RNA, 44 nt, Mus musculus
cauagagggaaugccacuacaucauguagauguggucugaagau

SEQ ID NO: 72377 - RNA, 46 nt, Mus musculus
ucauuuccuauuuuucuucggauauauauuuuuuuaaaaguuguag

SEQ ID NO: 72378 - RNA, 45 nt, Mus musculus
ucccaugguuuauucucugugcccugugcucuugcuuuuucgugu

SEQ ID NO: 72379 - RNA, 45 nt, Mus musculus
ucuaaaucuauagacaguuauucacugagaauguauaaucaagag

SEQ ID NO: 72380 - RNA, 43 nt, Mus musculus
acugcucauggagguucauggaaauggaaagaggcccaguccg

SEQ ID NO: 72381 - RNA, 45 nt, Mus musculus
uuuacucuuguuguucucuaccuuaagauagagcuggcgcugcag

SEQ ID NO: 72382 - RNA, 50 nt, Mus musculus
gaaagggcugggcaugguagcacacuuauuagcagccaggaggguuaccc

SEQ ID NO: 72383 - RNA, 27 nt, Mus musculus
aaucuuucccaaaaaaaggaggaggag

SEQ ID NO: 72384 - RNA, 45 nt, Mus musculus
gaagaacucaacuauuggaaacggcgguuuaaugaaaauacagag

SEQ ID NO: 72385 - RNA, 42 nt, Mus musculus
gaagccccucugaauugugacauacugaaacuuuauccccag

SEQ ID NO: 72386 - RNA, 46 nt, Mus musculus
uaguauuuggaaagauaauauuauagacaugcuuucuccuucccag

SEQ ID NO: 72387 - RNA, 46 nt, Mus musculus
uaauaaauaaaucuuaaaaaaaaaaaaaaaaaaaaaaagaaaguuc

SEQ ID NO: 72388 - RNA, 64 nt, Mus musculus
ucaggccaugucagagguacagaaggcuguagcugaggcagagcaaaaagccuuugaagugauu

SEQ ID NO: 72389 - RNA, 46 nt, Mus musculus
cuggcauuugggagggagagcaggaggaucaagaguuaaagggcau

SEQ ID NO: 72390 - RNA, 45 nt, Mus musculus
auuuugcuuguguaaaaaauaaucuccaucgcauggaucggucug

SEQ ID NO: 72391 - RNA, 46 nt, Mus musculus
uuuauuaucagguggacauuugaggcauccuuuuucugugcuccgu

SEQ ID NO: 72392 - RNA, 56 nt, Mus musculus
ugccaucuaaaguuuauuaguugucagcaccuugcaucggccacucaguauacucc

SEQ ID NO: 72393 - RNA, 46 nt, Mus musculus
ccauaaaaguauggauuuagugucuuugcacacaguuaaggcugau

SEQ ID NO: 72394 - RNA, 46 nt, Mus musculus
ugaacacccuuuaaguguuaaauuuuuuugccacagaacuacucca

SEQ ID NO: 72395 - RNA, 46 nt, Mus musculus
acacuauauaguucaguucucagacuugucucuaucuugccucugg

SEQ ID NO: 72396 - RNA, 48 nt, Mus musculus
caugagggguagggacaagaagggcuggaaugcuugcuguagaacccc

SEQ ID NO: 72397 - RNA, 45 nt, Mus musculus
gcuaaaggccuggucaucugguagagggucucucagcccagggau

SEQ ID NO: 72398 - RNA, 45 nt, Mus musculus
ggcugagccggacgugguggcgcacgccuuuaaucccagcacucg

SEQ ID NO: 72399 - RNA, 45 nt, Mus musculus
uguuuccaugacaucuuuuugguaguuuuccuuuggagguauaag

SEQ ID NO: 72400 - RNA, 84 nt, Mus musculus
agggagagcacugauggcaguggggaucggcagcugggugugcauacacuaauuguagccuuggccuuuggaggggcagcagag

SEQ ID NO: 72401 - RNA, 46 nt, Mus musculus
cauucugccaucucuagccccaggugaaacauucucaguguguaag

SEQ ID NO: 72402 - RNA, 49 nt, Mus musculus
auggagccagcuugagccaagcaugcaugugcugauaacauuugacagg

SEQ ID NO: 72403 - RNA, 46 nt, Mus musculus
cuaaaauaaggaucuuauuacagagauccuggauauuuucuggauc

SEQ ID NO: 72404 - RNA, 46 nt, Mus musculus
ugaugguaagcucucguuugaagaauuccagaauuacuuugcugau

SEQ ID NO: 72405 - RNA, 42 nt, Mus musculus
ggccuccgcuggagucagaacccuaggcuaucuggcugagug

SEQ ID NO: 72406 - RNA, 45 nt, Mus musculus
ccuuugggucccacagugugugugugugugugugugugggugugu

SEQ ID NO: 72407 - RNA, 45 nt, Mus musculus
ccucaagccaggcacccaucucuggaugccagucuauagcgggua

SEQ ID NO: 72408 - RNA, 46 nt, Mus musculus
aaaggggggagggugggaagggugggaggaaccugacaauaaagag

SEQ ID NO: 72409 - RNA, 42 nt, Mus musculus
aggacagcauccaccuagcaaguacaaaaacucaaggucuga

SEQ ID NO: 72410 - RNA, 46 nt, Mus musculus
gaugcacauccuguuaauauauacugggaacugacaauugccuaag

SEQ ID NO: 72411 - RNA, 46 nt, Mus musculus
agaaagaaugagcagugggcuuugauccaacaaaagggguguuggg

SEQ ID NO: 72412 - RNA, 46 nt, Mus musculus
ccauuaugcacgacacagcagaggcugacucuauaugggggcgcca

SEQ ID NO: 72413 - RNA, 45 nt, Mus musculus
ccacuuaagggggggguuaguuacaaguaguuaauggucuugauc

SEQ ID NO: 72414 - RNA, 42 nt, Mus musculus
uucccagaaaccucaugguggcucacaaccaucuguaauggg

SEQ ID NO: 72415 - RNA, 44 nt, Mus musculus
aguuucuccacuuaaauguucugaacagguaaaccuacagagca

SEQ ID NO: 72416 - RNA, 46 nt, Mus musculus
uaguuuuggugccacauuaaagacguuaauauccaguguuagcuag

SEQ ID NO: 72417 - RNA, 79 nt, Mus musculus
ucagcguccacgucuuuuucuucaguugguucuggcuccacuucuuuugucucugagggcuggguuucuucugucuggg

SEQ ID NO: 72418 - RNA, 45 nt, Mus musculus
cuucuucuucuucuuuuucuuuuugcucauaguaggaucaaaaau

SEQ ID NO: 72419 - RNA, 42 nt, Mus musculus
aaguuuuaaccucggugcuccaccggaaccgagaggggccuc

SEQ ID NO: 72420 - RNA, 80 nt, Mus musculus
guccccggacauggcuguaguucgagcggguucggcagggaugaaaagucaaaccggucggcuucacggcccggagucag

SEQ ID NO: 72421 - RNA, 54 nt, Mus musculus
gcaccgcacuaggcucuugcaucagcgaaagggagcgacaccccgcccuccucu

SEQ ID NO: 72422 - RNA, 45 nt, Mus musculus
agccuucaugugguuguugggaauuggacuuuaggaccucugaua

SEQ ID NO: 72423 - RNA, 47 nt, Mus musculus
cuaaagaauuuuggcucuauuaaaauguaaguguguggcuggaauau

SEQ ID NO: 72424 - RNA, 58 nt, Mus musculus
gguuaggauagauuaaccaagaaaggacaagugacagacugaaaggggcuggaaaaac

SEQ ID NO: 72425 - RNA, 134 nt, Mus musculus
uugguuaaucuauccuaacccuugugaaauagggaccaaaaaaaguaccaacucaguaucaugagguuuaagagacugcccaacaguaaaaaggcccagcucucgggggccuucaaacuccagggguuccugcu

SEQ ID NO: 72426 - RNA, 45 nt, Mus musculus
ggguccuggacugagaaaccaauggaucugcaaaccaggcacaca

SEQ ID NO: 72427 - RNA, 45 nt, Mus musculus
ccaucacuagcaacauccagccucaggacuuccaagacuucugag

SEQ ID NO: 72428 - RNA, 46 nt, Mus musculus
auacuguuccagguguggagggggaauggagagguaccugguaggc

SEQ ID NO: 72429 - RNA, 55 nt, Mus musculus
ugagggauacagcagaggucaaagacagagugaccagccccagaggguguaaggg

SEQ ID NO: 72430 - RNA, 46 nt, Mus musculus
uguuccgggcccuaucucucguucccaagagcaaaugucaccaacu

SEQ ID NO: 72431 - RNA, 84 nt, Mus musculus
agggcccggaacaaggauggcagcuggaaggugaaggacagccccagcacucaguagcgguagugaucaggcuugaaggggccg

SEQ ID NO: 72432 - RNA, 46 nt, Mus musculus
gggcaugcccaucaacggccccuucaagccugaucacuaccgcuac

SEQ ID NO: 72433 - RNA, 52 nt, Mus musculus
ucuucugauggggagcacugcagcuggccaugaggagagaacgaggguagca

SEQ ID NO: 72434 - RNA, 47 nt, Mus musculus
cuguucauuccaggaagcauugugguuagugcuuugguuagaggagg

SEQ ID NO: 72435 - RNA, 44 nt, Mus musculus
cuaaagaaugggcgccgcaucaucuugcuggcugaaggccgucu

SEQ ID NO: 72436 - RNA, 44 nt, Mus musculus
gugggcuugucgguugcccaccacagacgcuguugcagccuaga

SEQ ID NO: 72437 - RNA, 62 nt, Mus musculus
auguggagauugaugugaaguggcucaaugagaacgcgguggagaaagugaacaucaagccc

SEQ ID NO: 72438 - RNA, 46 nt, Mus musculus
ccaaggaugauauccacacagccugugguggugacaaagauguugc

SEQ ID NO: 72439 - RNA, 46 nt, Mus musculus
agugcauugauggggucgaucucggugaugaugacucgggccccaa

SEQ ID NO: 72440 - RNA, 47 nt, Mus musculus
auggcugccgggagucccucauagauggcaucaaacgggccacagau

SEQ ID NO: 72441 - RNA, 47 nt, Mus musculus
ucaucacaucuguggcccguuugaugccaucuaugagggacucccgg

SEQ ID NO: 72442 - RNA, 46 nt, Mus musculus
uuucuucagagauucacuccuaagcucacugagcaccaacagccag

SEQ ID NO: 72443 - RNA, 44 nt, Mus musculus
cugaaggugccugccaucaaugucaacgauucugucaccaaggu

SEQ ID NO: 72444 - RNA, 45 nt, Mus musculus
caccuucaguaucccauuggacaucaucuuguagagguuguggac

SEQ ID NO: 72445 - RNA, 41 nt, Mus musculus
augcagcggcugccauugccaaggcuggcauuccaggugag

SEQ ID NO: 72446 - RNA, 92 nt, Mus musculus
ggcucuggauauagcugagaaugagaugccaggauugaugcgcaugcgggagauguacucagccuccaagccacugaagggugcucgcauug

SEQ ID NO: 72447 - RNA, 50 nt, Mus musculus
uauggaucccugaggguuccuagaguuugccagaugaggagcagccagga

SEQ ID NO: 72448 - RNA, 46 nt, Mus musculus
ggagugguugguugaauggugguuucauuuccuaaaaugggaagau

SEQ ID NO: 72449 - RNA, 46 nt, Mus musculus
cgaagcuauaugauaggcccugucucaaaaauaaaagaacccagca

SEQ ID NO: 72450 - RNA, 45 nt, Mus musculus
guuaaauuccugcgaugggggagagauccgugugucugagcagau

SEQ ID NO: 72451 - RNA, 46 nt, Mus musculus
uuaauggugaagaggacuggcuguuccaggguuuaauuccuagcag

SEQ ID NO: 72452 - RNA, 46 nt, Mus musculus
aacuccaguuccagagacccaacacuuucuucuggccccuguccac

SEQ ID NO: 72453 - RNA, 44 nt, Mus musculus
gccccugcacccacaugguaacugacuacugcccauaacgccag

SEQ ID NO: 72454 - RNA, 24 nt, Mus musculus
ugggccuugagcagggccggagag

SEQ ID NO: 72455 - RNA, 46 nt, Mus musculus
gcccagagcggcagcgcgggcugugaucuuuggucgggcagcgugc

SEQ ID NO: 72456 - RNA, 45 nt, Mus musculus
guguagagaagugggguaaaaggacaaggaggguaaaagggacuu

SEQ ID NO: 72457 - RNA, 24 nt, Mus musculus
gucucccagcuguuuugaccacag

SEQ ID NO: 72458 - RNA, 45 nt, Mus musculus
ucuuucucuuggcuagugaugcugaguuugaacaagagucuaggg

SEQ ID NO: 72459 - RNA, 44 nt, Mus musculus
ucccacuccuuuucagucccuuugacaggaucuuauguagccag

SEQ ID NO: 72460 - RNA, 42 nt, Mus musculus
ccucauugagcaucccagcauguccguuuaugucaccggcag

SEQ ID NO: 72461 - RNA, 42 nt, Mus musculus
ggcucagaggauugggagggaccagccugaucugccagacag

SEQ ID NO: 72462 - RNA, 45 nt, Mus musculus
cacacauugagugcuaaaguguugcaacggcagaaucgcgcccgg

SEQ ID NO: 72463 - RNA, 45 nt, Mus musculus
uucagaaggccucgcuccugaccuaauuucucaaagcuccgguag

SEQ ID NO: 72464 - RNA, 45 nt, Mus musculus
uugagugcaucucuguuggguguuuuguguugagacuggcugaag

SEQ ID NO: 72465 - RNA, 45 nt, Mus musculus
gaagaguaaguagucuuaguggggucggaaaaguaguuugagauc

SEQ ID NO: 72466 - RNA, 24 nt, Mus musculus
ugaucagugcacuuccucucugca

SEQ ID NO: 72467 - RNA, 46 nt, Mus musculus
ucgccgguucccagcucggacacuguuagcgaggcuagagccagag

SEQ ID NO: 72468 - RNA, 42 nt, Mus musculus
ugcaauuuccuaugaccuuugcauuugaggaaacaggcccag

SEQ ID NO: 72469 - RNA, 46 nt, Mus musculus
cugaggauacugaguugggaagagaggugguggagagaggcucgag

SEQ ID NO: 72470 - RNA, 45 nt, Mus musculus
cuagugugccccuagugcagauguggacaaugaagagauuccuga

SEQ ID NO: 72471 - RNA, 23 nt, Mus musculus
ugaggaucugggguagaaagaug

SEQ ID NO: 72472 - RNA, 62 nt, Mus musculus
gcugugcaucaacuucaccaacgagaagcugcagcaguucuucaaccagcacauguucgugc

SEQ ID NO: 72473 - RNA, 46 nt, Mus musculus
cuauuaaauaugcauugaagugaaucacuauucccguucaguugag

SEQ ID NO: 72474 - RNA, 42 nt, Mus musculus
cugacugcuucagccuccucccgcugcucuuagauuagguag

SEQ ID NO: 72475 - RNA, 35 nt, Mus musculus
gcagucacgauucucuugcugcugcuccuggcuuu

SEQ ID NO: 72476 - RNA, 42 nt, Mus musculus
cagugccauuucugucucuguguccccugcaacaguccccag

SEQ ID NO: 72477 - RNA, 44 nt, Mus musculus
gcuggccgacgccagcacccagcgggggcgguuacaaacggaga

SEQ ID NO: 72478 - RNA, 42 nt, Mus musculus
ccaacgcggagguggcccaguggcggagcaaguaugaagcag

SEQ ID NO: 72479 - RNA, 91 nt, Mus musculus
gcagcccuggauaagaagcagcggcacuuggagcgggcgcuggaggagcggaggcggcaggaggaggagaugcagcgggaacucgaggcgg

SEQ ID NO: 72480 - RNA, 46 nt, Mus musculus
auagccacgaggaagcgcuugaggcucuggagacacucaagcggga

SEQ ID NO: 72481 - RNA, 46 nt, Mus musculus
agcacugaaggcucgaucacccuggacuuggggugaaggaagggag

SEQ ID NO: 72482 - RNA, 40 nt, Mus musculus
ggaacuggagaaggccaagaaggcgcuggaaggggagaag

SEQ ID NO: 72483 - RNA, 41 nt, Mus musculus
agacaagggcccgcaaugaagcacugcgccucaagaagaag

SEQ ID NO: 72484 - RNA, 25 nt, Mus musculus
gcgagaugaggagcagaggcuggcu

SEQ ID NO: 72485 - RNA, 44 nt, Mus musculus
gcauucgcaggugggggaugcgccaaagauguuacaaggauggg

SEQ ID NO: 72486 - RNA, 45 nt, Mus musculus
ggcccagcugaguggggaaguggaggaggcugcgcaggagaggcg

SEQ ID NO: 72487 - RNA, 72 nt, Mus musculus
auggccgaggagcugaaaaaggaacaggacacgagcgcacaccuggaacggaugaagaagacccuggaacag

SEQ ID NO: 72488 - RNA, 42 nt, Mus musculus
cuggcucgcaugcaggaccugguggacaagcugcagagcaag

SEQ ID NO: 72489 - RNA, 26 nt, Mus musculus
agcuggaugaugccgaggaacgggca

SEQ ID NO: 72490 - RNA, 41 nt, Mus musculus
ggagugacacccaggcucugaggagggauaccccaccccug

SEQ ID NO: 72491 - RNA, 103 nt, Mus musculus
cuggcugagagcuuacccuuggcuccuccuguguugccaguuuauuaacagcaaauaaaccgauuaaauggagacuauuaaagaacuuuauuuuaaagacuga

SEQ ID NO: 72492 - RNA, 45 nt, Mus musculus
ucuauguccauguagggcuccucaauguagcugacgagggcagag

SEQ ID NO: 72493 - RNA, 45 nt, Mus musculus
ugcgacugcuacagcgaauggagcacagcaagaaauaccccggcu

SEQ ID NO: 72494 - RNA, 45 nt, Mus musculus
gucagcugccucaacaccagccugguaauccugaugcuggcccga

SEQ ID NO: 72495 - RNA, 42 nt, Mus musculus
cuguccuuggagccaccaguauccucagaaaagagccuagac

SEQ ID NO: 72496 - RNA, 44 nt, Mus musculus
auuuccauauugauuaauggcauguagcaaaaggaauuugaaga

SEQ ID NO: 72497 - RNA, 46 nt, Mus musculus
uggggaagccugguggguggcagugagggggaaacaaagcggggag

SEQ ID NO: 72498 - RNA, 46 nt, Mus musculus
gggccuacuaacucggcugcugcaggucaugaagaaggagccagcg

SEQ ID NO: 72499 - RNA, 42 nt, Mus musculus
gcugcagcagggcuaggcucaggacuaagauggcagacagga

SEQ ID NO: 72500 - RNA, 44 nt, Mus musculus
uccaguuuuugagacuucuccagaguuucagugaccaccaugag

SEQ ID NO: 72501 - RNA, 45 nt, Mus musculus
auuuauguauaauaauaaauaaaucuuuaaaaaaaauuaauaucc

SEQ ID NO: 72502 - RNA, 46 nt, Mus musculus
aaaaaauuaauacuauuuuuaaaaauccagacugguccuuguaggu

SEQ ID NO: 72503 - RNA, 105 nt, Mus musculus
ugggcugccacacaccucggccagggcgcagcugccccaguccaugaagauuaugcaugagauuauguacaaacuggaagugcuuuauguccucugcgugcugcu

SEQ ID NO: 72504 - RNA, 46 nt, Mus musculus
gccacucucaaugcguuacaccacuaagugacaguugccuauagau

SEQ ID NO: 72505 - RNA, 46 nt, Mus musculus
aggaugaaggagccaauagucauagccugagucagaugggcuggga

SEQ ID NO: 72506 - RNA, 46 nt, Mus musculus
gccauaaauaaauguuuggcuucauugaaagucagaaaaugcagau

SEQ ID NO: 72507 - RNA, 53 nt, Mus musculus
augacaaguaagaagacauucuuacaaacagcgacucucauugaagacauuuu

SEQ ID NO: 72508 - RNA, 45 nt, Mus musculus
aaggaugcagacaggcagaggucaggugcuuugaggcuucagagg

SEQ ID NO: 72509 - RNA, 25 nt, Mus musculus
aaucgcggugccaggaggcagaggc

SEQ ID NO: 72510 - RNA, 42 nt, Mus musculus
ugagggagaugcagauaguagagcuuaaggcagugaggagga

SEQ ID NO: 72511 - RNA, 45 nt, Mus musculus
agucagcuguaaguugcucuuuucauuccaagcuaagcagcauac

SEQ ID NO: 72512 - RNA, 46 nt, Mus musculus
uuguagaaauucuuaugaggccuaccaucucuauccggggacagaa

SEQ ID NO: 72513 - RNA, 45 nt, Mus musculus
uguguguguguguguguguguguguguguguauacuccugugcug

SEQ ID NO: 72514 - RNA, 45 nt, Mus musculus
ugaaguccuugaguagggaggggcccuaaggcccuaggaaggaga

SEQ ID NO: 72515 - RNA, 45 nt, Mus musculus
ugagugaguguuuucuuaguuuggugucugcucugggguaguugu

SEQ ID NO: 72516 - RNA, 42 nt, Mus musculus
agccccugcuuugugcaagaacucugcaguugaaugggagag

SEQ ID NO: 72517 - RNA, 32 nt, Mus musculus
uuuuaguuuauuuuguuucugcugcccuguuu

SEQ ID NO: 72518 - RNA, 45 nt, Mus musculus
aguaguaaauuaccaauuucuacagugaagacaagggggcuuugg

SEQ ID NO: 72519 - RNA, 45 nt, Mus musculus
uguuggguguguacauauaaagcaggcacuggaggaggccagagc

SEQ ID NO: 72520 - RNA, 44 nt, Mus musculus
aauucugggguguguguaugugugugugugugugugugugugug

SEQ ID NO: 72521 - RNA, 45 nt, Mus musculus
augaaaauugugaaugucuggaaaugucacauugacuaaacaggc

SEQ ID NO: 72522 - RNA, 45 nt, Mus musculus
uuguauauaguuuugaggacuacauaaggaaccaaacaguguuga

SEQ ID NO: 72523 - RNA, 24 nt, Mus musculus
ccuauucucuuucucccucgggca

SEQ ID NO: 72524 - RNA, 56 nt, Mus musculus
ggaggcuguccgggaggggccggagcagagcggaggauggaaagagaacgcgugca

SEQ ID NO: 72525 - RNA, 86 nt, Mus musculus
aaacuucgucaacauccuggaguucugggucccaccugggucggggcaggcucggguuccucaggcugcugauuaggaaagagaag

SEQ ID NO: 72526 - RNA, 41 nt, Mus musculus
uuccugccuucccaagacugacacugcucuccuugccuucu

SEQ ID NO: 72527 - RNA, 42 nt, Mus musculus
agauacaguagucacucuaaauauugccccucugagggagaa

SEQ ID NO: 72528 - RNA, 78 nt, Mus musculus
agaucuccuauuuccaagacaaccaucaugugaggcaucagggcaacgccucucugggaaaacuccugacacacacgc

SEQ ID NO: 72529 - RNA, 41 nt, Mus musculus
uguagcuggaggauggugacguuuuggcuggggccuuccag

SEQ ID NO: 72530 - RNA, 89 nt, Mus musculus
uggaaggccccagccaaaacgucaccauccuccagcuacagcccuggcaggauccggagagcugggagcgcacagagaguggccugcag

SEQ ID NO: 72531 - RNA, 41 nt, Mus musculus
ugcucuagacagcaggauuuuugugaaggaaugggugggcg

SEQ ID NO: 72532 - RNA, 34 nt, Mus musculus
gguggucggaggcuggaugaagggaaggguaggg

SEQ ID NO: 72533 - RNA, 45 nt, Mus musculus
aguggugguuuccuggacaagacauccaagauaucggguuguuga

SEQ ID NO: 72534 - RNA, 46 nt, Mus musculus
cugccgugugggugucaggcucccaggagcccuccaaagcagccaa

SEQ ID NO: 72535 - RNA, 42 nt, Mus musculus
uaucuaauuauucuccaggccccuuggagaaagggcuggacu

SEQ ID NO: 72536 - RNA, 42 nt, Mus musculus
agcauuugugcuuuguguagcuggucugagaagugggugcuu

SEQ ID NO: 72537 - RNA, 58 nt, Mus musculus
aacauaguuaauguguccagguguauccaacuugggaagggacacuggaaugacaggg

SEQ ID NO: 72538 - RNA, 45 nt, Mus musculus
gggaccaggggacugggggagggaggcccagaggagaggacuaga

SEQ ID NO: 72539 - RNA, 44 nt, Mus musculus
cuccucacccugugauuuccugucuuacucccucugggcagaga

SEQ ID NO: 72540 - RNA, 41 nt, Mus musculus
acggcuuccgugcagcucugcuuucacuuuacugccugagg

SEQ ID NO: 72541 - RNA, 42 nt, Mus musculus
uguguguguguguguguguguguguguguaaaagagucuuga

SEQ ID NO: 72542 - RNA, 45 nt, Mus musculus
gucugagggaaccugacucaagaacacccugacccugggacagga

SEQ ID NO: 72543 - RNA, 48 nt, Mus musculus
aggaccccauacccaugucauugcggccaccaccuccggguagagcaa

SEQ ID NO: 72544 - RNA, 45 nt, Mus musculus
uagucaaggugggcuguucauauguucaccaugguugcguucuua

SEQ ID NO: 72545 - RNA, 35 nt, Mus musculus
aacaaaagucccuuugucacccacagugaacuggg

SEQ ID NO: 72546 - RNA, 45 nt, Mus musculus
uggccugcaagaacuuugugaugagaauguagcagugguuaaugg

SEQ ID NO: 72547 - RNA, 46 nt, Mus musculus
uaaaggacaguggagucacagacacuagaaaaccagcuggccugcc

SEQ ID NO: 72548 - RNA, 42 nt, Mus musculus
guagguuaauuccuauauccuaaagaagaacauggcccucau

SEQ ID NO: 72549 - RNA, 46 nt, Mus musculus
gcaaaccaauauuacauagagagaacuuaacuaaaaauaauauaaa

SEQ ID NO: 72550 - RNA, 42 nt, Mus musculus
aguggugguuuuguuucacugaaagcuuucuagccuggugug

SEQ ID NO: 72551 - RNA, 41 nt, Mus musculus
cuccagucucucccuguccuggcagacuccuuuccccaagu

SEQ ID NO: 72552 - RNA, 46 nt, Mus musculus
agccauugugacuguagcacauuaagguaugaguucugguggagau

SEQ ID NO: 72553 - RNA, 68 nt, Mus musculus
accugaaagccacccuuagcuguggcagccuucucucgggaucuuuggaaagaccuucaaguagcaga

SEQ ID NO: 72554 - RNA, 42 nt, Mus musculus
cccagcagagacaggcagaucucucugaauucaaggccaguc

SEQ ID NO: 72555 - RNA, 44 nt, Mus musculus
gagugugaaagaaggggaggggccagggcuaaggguggggcaga

SEQ ID NO: 72556 - RNA, 46 nt, Mus musculus
ugagacccugucucaaaaaaagaaagaaagaaagaaaagaaaggag

SEQ ID NO: 72557 - RNA, 46 nt, Mus musculus
cuuauuuuggggccuuuaaggacaauuuaauacgaaauguguggug

SEQ ID NO: 72558 - RNA, 45 nt, Mus musculus
ccucgugguuguauaagggccucgaaauagcauuucaccuaaaca

SEQ ID NO: 72559 - RNA, 68 nt, Mus musculus
cagggacuguggccugcugcucucuuuccuccaaguccagcauuuucuuucuuaguuuccacaauaga

SEQ ID NO: 72560 - RNA, 36 nt, Mus musculus
gugcacuugagugcaguacuaaaagaaaccagaaga

SEQ ID NO: 72561 - RNA, 46 nt, Mus musculus
cuguugcaugcuucacauaucucaguggauucucaguggcccauug

SEQ ID NO: 72562 - RNA, 42 nt, Mus musculus
acgagucagaaauuguaauuacgaaucccuuugaagccagaa

SEQ ID NO: 72563 - RNA, 45 nt, Mus musculus
ugggaaguacaugugccggaucauaguucauuucaugugggaaga

SEQ ID NO: 72564 - RNA, 45 nt, Mus musculus
agauaguugugagccaccaugugguugcugggaauuggacucagg

SEQ ID NO: 72565 - RNA, 45 nt, Mus musculus
uugcuguggaguuuauauugaguggugcuugcgugggucacagau

SEQ ID NO: 72566 - RNA, 52 nt, Mus musculus
gcuugcuguagagcagcgcagcucgcagcccagcucacagccuagcucccag

SEQ ID NO: 72567 - RNA, 80 nt, Mus musculus
cuuugcuaguuggguucuucgccuuccuuauauguaaaagagaucaggauuauuuaugaggcccuggaaucacugagaga

SEQ ID NO: 72568 - RNA, 41 nt, Mus musculus
gucucugggcuggccuucuacagagacuggggagccgucag

SEQ ID NO: 72569 - RNA, 45 nt, Mus musculus
ggagagucagaaguaacuuguaaagauguuuuaagugccaaagca

SEQ ID NO: 72570 - RNA, 42 nt, Mus musculus
agagggaguggauggcaaaauaaaauauauaaucccugugac

SEQ ID NO: 72571 - RNA, 41 nt, Mus musculus
ugcuggguacuagggcuggcucucaaaaccggggcccagua

SEQ ID NO: 72572 - RNA, 45 nt, Mus musculus
gcaggagaggugguguuugcuuagcauuuuagacuucaagccagg

SEQ ID NO: 72573 - RNA, 46 nt, Mus musculus
auguguguaugcacuacaugcauguggugguguuccacagaggcca

SEQ ID NO: 72574 - RNA, 46 nt, Mus musculus
aaucagucucgaguguguuugggaucagaacagacuguuggagcgg

SEQ ID NO: 72575 - RNA, 46 nt, Mus musculus
ucagccaguucucuuaacagcugagccaucucuccagccccaagau

SEQ ID NO: 72576 - RNA, 56 nt, Mus musculus
aacgugagguguuccaagguccuuuuugaaggaggcauaggcaggaaggguggucc

SEQ ID NO: 72577 - RNA, 56 nt, Mus musculus
gacccugccucauaaagaaaacagaacaaaaagccccgaaucaacaagaaaccaac

SEQ ID NO: 72578 - RNA, 46 nt, Mus musculus
auaaauggugggauauuuucuguugucuuuguguauguauguagau

SEQ ID NO: 72579 - RNA, 71 nt, Mus musculus
uuuccuguuuaucuuucuugguacaaacaugcacaaguaaauaaggaaaaucucuuuuacaugcuuauucc

SEQ ID NO: 72580 - RNA, 51 nt, Mus musculus
ccauaaaaacuaucucucaucgacccucuauuaggugggccuauuuuucua

SEQ ID NO: 72581 - RNA, 67 nt, Mus musculus
ugcuagguaaggaguuuacugcugagcccuacauuauuuuuaaagacagauacuuuggugggagaaa

SEQ ID NO: 72582 - RNA, 78 nt, Mus musculus
acaugugcagcggcucguguguguguguguguguguguguguguguguguguguguagugaggguuaauuauuaugca

SEQ ID NO: 72583 - RNA, 45 nt, Mus musculus
accggcgaggagucucgcguccuggaaccucauucagauccacgg

SEQ ID NO: 72584 - RNA, 42 nt, Mus musculus
uuccggccgguccccauggaggcgcuggggaagcugaagcag

SEQ ID NO: 72585 - RNA, 36 nt, Mus musculus
cucuacguggacaagucucggggggauaaacugaag

SEQ ID NO: 72586 - RNA, 47 nt, Mus musculus
gccggggagcagcagcuggauguggaacacaaccuguucaagaaacg

SEQ ID NO: 72587 - RNA, 46 nt, Mus musculus
ggugacaguguuugaccccaacuccuuggaccccaaucgcugugag

SEQ ID NO: 72588 - RNA, 59 nt, Mus musculus
cugggccuucaagaacccggacaccauugagcagugucggcgagagggcuucagccaga

SEQ ID NO: 72589 - RNA, 45 nt, Mus musculus
gcagggcugugggaagucaccaucacaucgcaaaagugaggcuag

SEQ ID NO: 72590 - RNA, 41 nt, Mus musculus
cauuagcugaaggcugaggagagggggauggagguggcgga

SEQ ID NO: 72591 - RNA, 42 nt, Mus musculus
aacaccugagggauucucugggguuuagagacaagggaguca

SEQ ID NO: 72592 - RNA, 46 nt, Mus musculus
gcaccugucauucggggaggacuauccaggaaucgugaacccccua

SEQ ID NO: 72593 - RNA, 46 nt, Mus musculus
cuuugugaagguggugcccacaguguacaugaagguggacggggag

SEQ ID NO: 72594 - RNA, 44 nt, Mus musculus
ggccggccucauugacucgcucaucuaccacuccgcucgggcca

SEQ ID NO: 72595 - RNA, 45 nt, Mus musculus
ccagccugucaacuacccauauccucuccucagccagcccagccc

SEQ ID NO: 72596 - RNA, 42 nt, Mus musculus
agacaucucuuuguaucgacuucagcugaagaacaccaaguu

SEQ ID NO: 72597 - RNA, 46 nt, Mus musculus
cauuacucuagcugcucagcugaacuggcgccauuagggacuggca

SEQ ID NO: 72598 - RNA, 50 nt, Mus musculus
agccaggaaccucacugccugacgugguccaugcucaaagcagaugggaa

SEQ ID NO: 72599 - RNA, 24 nt, Mus musculus
uuguguaugagaguaggugugauu

SEQ ID NO: 72600 - RNA, 45 nt, Mus musculus
gauuuagcacacuccucuaucaggucagugaggucagcugcagag

SEQ ID NO: 72601 - RNA, 46 nt, Mus musculus
uggagagucauuucucuugucccacucuccuauagguuucagagau

SEQ ID NO: 72602 - RNA, 46 nt, Mus musculus
cuugguggugggccugggagcugcaugugaguuggcacaacaagag

SEQ ID NO: 72603 - RNA, 46 nt, Mus musculus
agugccucacacaugcucuguaccccuguuaacuuacaugcuuaga

SEQ ID NO: 72604 - RNA, 45 nt, Mus musculus
ucccuggaagcugagggcuuucgggucacuuaccucccugugcag

SEQ ID NO: 72605 - RNA, 46 nt, Mus musculus
ucucaacggccgggcgugguggcgcacgccuuuaaucccagcacuu

SEQ ID NO: 72606 - RNA, 46 nt, Mus musculus
agaugucaccucgaugaugcuggucucuucuuaaucacugcuaauu

SEQ ID NO: 72607 - RNA, 46 nt, Mus musculus
gucuucagacacuacagaagagggagucagaucucucguuacagau

SEQ ID NO: 72608 - RNA, 46 nt, Mus musculus
gaucccagagugcuugaugccaugcucccauaccuugucaacuacu

SEQ ID NO: 72609 - RNA, 45 nt, Mus musculus
uggguauggcggccggggcgcuguucggcaccuucuccugucuca

SEQ ID NO: 72610 - RNA, 45 nt, Mus musculus
ccuguaauuguauucccaaauugcuuucuugguuuccuccucagg

SEQ ID NO: 72611 - RNA, 89 nt, Mus musculus
gcuucgcaacacccuuggaaaccggaggcgguggccgggcugggaagaaaccgcaguguguagcuuucuaaccccugaauuuagucggg

SEQ ID NO: 72612 - RNA, 46 nt, Mus musculus
auaaagccaccuaggacuccucaaguggguccuucuccucuggcug

SEQ ID NO: 72613 - RNA, 46 nt, Mus musculus
ugauccuccugucuccuuccauugugcugugacuguuggccaccag

SEQ ID NO: 72614 - RNA, 40 nt, Mus musculus
cugguggccaacagucacagcacaauggaaggagacagga

SEQ ID NO: 72615 - RNA, 42 nt, Mus musculus
aacuaaaaaauccgccugccucugccuccugagugcugggau

SEQ ID NO: 72616 - RNA, 42 nt, Mus musculus
gcccuaucaaccagggacggcuucccucgauaacgggaccag

SEQ ID NO: 72617 - RNA, 45 nt, Mus musculus
ugaccaaacccucagcccaguuggcauggcugcugagucugccuc

SEQ ID NO: 72618 - RNA, 35 nt, Mus musculus
gccaacggcucgucucuucaucuuggucuugccac

SEQ ID NO: 72619 - RNA, 42 nt, Mus musculus
cgaugccgaccuucuuggugcguuuagccaugucgccagacu

SEQ ID NO: 72620 - RNA, 43 nt, Mus musculus
aguucacagaucaugugucucuccaucacaguacaugcgcuuc

SEQ ID NO: 72621 - RNA, 46 nt, Mus musculus
ugucucuggucuucucuucauuugccaugugaggauuuggguugag

SEQ ID NO: 72622 - RNA, 45 nt, Mus musculus
ugaaacagagagccuugaaagagaccagacgagggccacggaaag

SEQ ID NO: 72623 - RNA, 46 nt, Mus musculus
ugcucugaaggccaauggccucuguagccaccuuugacccucaauc

SEQ ID NO: 72624 - RNA, 42 nt, Mus musculus
cuggaaagaggaggaguggaaaggaaagagaaggccagaggg

SEQ ID NO: 72625 - RNA, 44 nt, Mus musculus
cgcuguugcggugcuucgagaguuggcuggcagcagcuccgacc

SEQ ID NO: 72626 - RNA, 46 nt, Mus musculus
cuccauagcuggcugugccagauacccugcuuuccaaccggcucau

SEQ ID NO: 72627 - RNA, 42 nt, Mus musculus
aacagagccggguaugguggcgcacgccuuuaaucccagcac

SEQ ID NO: 72628 - RNA, 41 nt, Mus musculus
accaggcuuugggguuccuuuguguagugcugggugggaau

SEQ ID NO: 72629 - RNA, 44 nt, Mus musculus
aggcucccugaggagagcagcuguguuccacagacugugcagaa

SEQ ID NO: 72630 - RNA, 45 nt, Mus musculus
ugcuuugucuacuuuauuucuucauagcaaugugcccaucucaau

SEQ ID NO: 72631 - RNA, 44 nt, Mus musculus
agagggcuacguccaaugucuucgccauguuugaccagucccag

SEQ ID NO: 72632 - RNA, 45 nt, Mus musculus
acucacuccucuauacccccaaugacaccuccaagguuagggucu

SEQ ID NO: 72633 - RNA, 42 nt, Mus musculus
caauguuuggggagaagcugaacggcacagaccccgaggaug

SEQ ID NO: 72634 - RNA, 45 nt, Mus musculus
uaggcuuguggaguugucucagcacccccagaaugcauugaggga

SEQ ID NO: 72635 - RNA, 46 nt, Mus musculus
aguaagcucaagauuucuucucuauuuuuaauaucuuuuccagcag

SEQ ID NO: 72636 - RNA, 42 nt, Mus musculus
ccuuucucucaauuucugcauagaaucucugacuauccccau

SEQ ID NO: 72637 - RNA, 46 nt, Mus musculus
auuaguugauacacacggugugagucccguguuacaggcccaccag

SEQ ID NO: 72638 - RNA, 46 nt, Mus musculus
ugguacuuguccuagauacaggauggguucgguuacauagguguug

SEQ ID NO: 72639 - RNA, 46 nt, Mus musculus
gggaggugccgaccuugaggggguucucaauuauuggagccagggg

SEQ ID NO: 72640 - RNA, 46 nt, Mus musculus
cgggacacacuguuuaucagguggugguuuaugaaggucgguaugg

SEQ ID NO: 72641 - RNA, 46 nt, Mus musculus
ggggaucuauugacuaguucugucaucuuuuugggucccaggugag

SEQ ID NO: 72642 - RNA, 35 nt, Mus musculus
gaagucaauaguccacacugucuguagaucucucc

SEQ ID NO: 72643 - RNA, 45 nt, Mus musculus
ugaagcugcuuccaucggugaaccaggccaccgcuccgcgccaug

SEQ ID NO: 72644 - RNA, 46 nt, Mus musculus
cucucaagggugugcagggccaccacugucacauuuuggcccauag

SEQ ID NO: 72645 - RNA, 42 nt, Mus musculus
ccuggggucacugguggaauccgugggcuugugacugcccac

SEQ ID NO: 72646 - RNA, 45 nt, Mus musculus
ccgacugagccucaguuuccccauccccacaagggcaagcuccca

SEQ ID NO: 72647 - RNA, 42 nt, Mus musculus
aaaguuuguuucugccucggggcggugggggagggugcggca

SEQ ID NO: 72648 - RNA, 41 nt, Mus musculus
gcgaguugucagaaaguuccugugggaguggcugcagaugg

SEQ ID NO: 72649 - RNA, 42 nt, Mus musculus
uuuagcuauguguguuuguaaaacucugggaacuugcgggau

SEQ ID NO: 72650 - RNA, 44 nt, Mus musculus
ucaugucggacagcgaucuaggcgaggaugaggggcuccuguca

SEQ ID NO: 72651 - RNA, 45 nt, Mus musculus
agacggggucuagacucaaguuauaggaccugauugucagcccaa

SEQ ID NO: 72652 - RNA, 42 nt, Mus musculus
aaggugucuuugaacuuacgugcucuagaggcacauaggcag

SEQ ID NO: 72653 - RNA, 43 nt, Mus musculus
aagagagagaaaagaaucccaggggcagcccucuuagagcugg

SEQ ID NO: 72654 - RNA, 46 nt, Mus musculus
aguguuccaggaagaagggagugugcuauguagaagguguauguau

SEQ ID NO: 72655 - RNA, 41 nt, Mus musculus
caaucagccacggccuagccguaccacacugagaacagaag

SEQ ID NO: 72656 - RNA, 46 nt, Mus musculus
uauccaaguacggaucacugccaagcaucaggaccauucuguccag

SEQ ID NO: 72657 - RNA, 51 nt, Mus musculus; identical to SEQ ID NO: 59443

SEQ ID NO: 72658 - RNA, 45 nt, Mus musculus
cagcucuguuuuucucucuguucugaguaacuccccucaccccac

SEQ ID NO: 72659 - RNA, 47 nt, Mus musculus
acauauucuggcauucccccuccugggauaaaacagggcaucagaaa

SEQ ID NO: 72660 - RNA, 42 nt, Mus musculus
cugucuuuauucaccgaauaacaugggcgguggcuuccccac

SEQ ID NO: 72661 - RNA, 46 nt, Mus musculus
cggauagacuguucuugaggggacaaaugaaaggaccucaacugag

SEQ ID NO: 72662 - RNA, 42 nt, Mus musculus
ugguauacaguugaaggaccagcuuccuaggagccuaggcag

SEQ ID NO: 72663 - RNA, 46 nt, Mus musculus
uucugaucuggucacugacgucauccuggaugaaggaggaaaacag

SEQ ID NO: 72664 - RNA, 47 nt, Mus musculus
gucuacagaaccuaucuuagcuccucacuuugugaggcacuagcccc

SEQ ID NO: 72665 - RNA, 46 nt, Mus musculus
cuccucccuaacucugcuuaaauacgcagucacuucucuuuggcag

SEQ ID NO: 72666 - RNA, 45 nt, Mus musculus
uccccauuuccagcaccugucacagaaaacagacagagaggcaag

SEQ ID NO: 72667 - RNA, 46 nt, Mus musculus
guccucucccgcgucaguccgguucgggguuccccgcugccuccgc

SEQ ID NO: 72668 - RNA, 45 nt, Mus musculus
cuuuuguuuuuaaaucaggaauugagacaaggguacaaacuagaa

SEQ ID NO: 72669 - RNA, 46 nt, Mus musculus
gaugcuguaagaagcauuaucugguguauuuuuagcacugacugaa

SEQ ID NO: 72670 - RNA, 46 nt, Mus musculus
cuacaguguacuuacauaaauauauuaaaaaaaaaaaaaguaggag

SEQ ID NO: 72671 - RNA, 84 nt, Mus musculus
gagagagggagagaaggggggaagagagagagaaggaaggcuagagaguaugagagguaaaagcuuagagagaaagagagagag

SEQ ID NO: 72672 - RNA, 24 nt, Mus musculus
gggggagugguucuggggaggggg

SEQ ID NO: 72673 - RNA, 46 nt, Mus musculus
auccaaucgaucguguucacuucuauuguaagagcaacagcaagca

SEQ ID NO: 72674 - RNA, 45 nt, Mus musculus
cuuccccaagaaguugcuaaagccaaaccugaaaaagccccggau

SEQ ID NO: 72675 - RNA, 46 nt, Mus musculus
gguaggacccaaaggcaggucuagacaacuguaaauaugcccucuc

SEQ ID NO: 72676 - RNA, 48 nt, Mus musculus
aaucuauacaaguauuugggugagacccagccaaagcgugagaagauu

SEQ ID NO: 72677 - RNA, 44 nt, Mus musculus
agaaaggaagguggagcugaaaaguuugggggaggaagagagag

SEQ ID NO: 72678 - RNA, 47 nt, Mus musculus
agguuggaaaucuguaugacauguuccacacucgcaacugcuuacac

SEQ ID NO: 72679 - RNA, 42 nt, Mus musculus
acaaccaucuguaaugagaucugaugcccucuuugguguguc

SEQ ID NO: 72680 - RNA, 46 nt, Mus musculus
uccuuacuggaugauacucaucuaacuuaagaagugguauggaggg

SEQ ID NO: 72681 - RNA, 46 nt, Mus musculus
agaaaagggguuuaucuacuuuguaguucuacaggaaguuuaagag

SEQ ID NO: 72682 - RNA, 46 nt, Mus musculus
ggacaagaccuacauccguaaggugaagcacauuuguucgagagaa

SEQ ID NO: 72683 - RNA, 46 nt, Mus musculus
aaguacacuguagcugucuucagaugcaccagaagagggcaccaga

SEQ ID NO: 72684 - RNA, 45 nt, Mus musculus
uaacccagcuaugcuggcacauggcuguugcagucugucccgaga

SEQ ID NO: 72685 - RNA, 46 nt, Mus musculus
gacauuauuuaccccaaacgauaguuaguguacuugggaugcagaa

SEQ ID NO: 72686 - RNA, 46 nt, Mus musculus
uaucaaggaacaaauuaugggaccaccuauaacaccagucaaagau

SEQ ID NO: 72687 - RNA, 46 nt, Mus musculus
uccauugagauguuugagcaucuggucaauucuaaugaacucaaac

SEQ ID NO: 72688 - RNA, 46 nt, Mus musculus
cugccugcagaaucagaacucuuaggcaucagcucucauuuuagau

SEQ ID NO: 72689 - RNA, 45 nt, Mus musculus
gaagguuuaucccacgggcucgcccagagaaaaaguggaagguau

SEQ ID NO: 72690 - RNA, 63 nt, Mus musculus
cuacagaucagugagcgagauauacucuguguucagauugcggggcucugccacgaccuaggu

SEQ ID NO: 72691 - RNA, 48 nt, Mus musculus
uaccuagcaggcugccuggugcgagcacuugccgaaaaacagccagag

SEQ ID NO: 72692 - RNA, 45 nt, Mus musculus
aacaaaguaauuaugucaggaaauuuagagaaaugcucaucagcu

SEQ ID NO: 72693 - RNA, 48 nt, Mus musculus
uccacccucuccuuaucagaaucaucgacacaccucaguuccagcgac

SEQ ID NO: 72694 - RNA, 79 nt, Mus musculus
uaugaacgcauuuacuguacauaauguaaugagggugcgaggaaucuauaugaacagcauuugcgugguauaaacggga

SEQ ID NO: 72695 - RNA, 45 nt, Mus musculus
auugauauaucuauuuacauuguuucaauuuuaguuccuuggagg

SEQ ID NO: 72696 - RNA, 47 nt, Mus musculus
cggcucguuucugcccuuuuuggaugaggaucgucuggaagaucugg

SEQ ID NO: 72697 - RNA, 46 nt, Mus musculus
gccuaacugaaggacugacuuuaagaaagcuuuaaaagggguugcg

SEQ ID NO: 72698 - RNA, 46 nt, Mus musculus
gcagcucccggaacacuuggccccaugagagauuuugagcgcuuuu

SEQ ID NO: 72699 - RNA, 42 nt, Mus musculus
gggggaagcggcuggcgggaacccgccgcuggagaaggaggc

SEQ ID NO: 72700 - RNA, 46 nt, Mus musculus
gugcuggacaucuucagagguagcgggccugagggacgaaggaugg

SEQ ID NO: 72701 - RNA, 46 nt, Mus musculus
gggcuccagaggagaaagggacuuuuugagaagaaaagcggaggca

SEQ ID NO: 72702 - RNA, 46 nt, Mus musculus
acccgucaccccaaacccuugucccugcaucccuuucuggcgagau

SEQ ID NO: 72703 - RNA, 41 nt, Mus musculus
aacugcccacgugaaucucacucugcgggacuucccaggaa

SEQ ID NO: 72704 - RNA, 44 nt, Mus musculus
aucagugcuuaguugcagugugugcuugagagaaaacugccaga

SEQ ID NO: 72705 - RNA, 45 nt, Mus musculus
cuaagcuaucuugccagccccugcaucucacacuuuaagugacag

SEQ ID NO: 72706 - RNA, 45 nt, Mus musculus
gcgccccgaguagcugaguaaggggguauuuaaaggaaagaacca

SEQ ID NO: 72707 - RNA, 42 nt, Mus musculus
gcucaucuguguccuggccaucaucguacccauucccaaguc

SEQ ID NO: 72708 - RNA, 44 nt, Mus musculus
cacacucagccacaaaacauuuuuuuaaaaagaaguugcaccag

SEQ ID NO: 72709 - RNA, 45 nt, Mus musculus
gacugugggcaaacaguugacgacguuagggcaugugucacugaa

SEQ ID NO: 72710 - RNA, 46 nt, Mus musculus
cucuguggguaccaggcaugcacaugguauucauuuaaacaaggag

SEQ ID NO: 72711 - RNA, 49 nt, Mus musculus
guugucaucguuuuaggaaaagaaacuacugcuaguguggaggaugagg

SEQ ID NO: 72712 - RNA, 42 nt, Mus musculus
ccuuguuggugugacugcuguggccuguguggccguggugug

SEQ ID NO: 72713 - RNA, 35 nt, Mus musculus
uuucccgagacaggguuucucuguguagcuagccc

SEQ ID NO: 72714 - RNA, 42 nt, Mus musculus
cgggggcucagcuuauuuaucuccuggugaggacagacccag

SEQ ID NO: 72715 - RNA, 46 nt, Mus musculus
aaagaagcccaagguugccaucgcuuccaccaacaagaggccgaag

SEQ ID NO: 72716 - RNA, 28 nt, Mus musculus
ugccugcaggggaagguacagcugaaug

SEQ ID NO: 72717 - RNA, 42 nt, Mus musculus
ucucguauucccugaccagugaaggaaaaugauguggagaag

SEQ ID NO: 72718 - RNA, 48 nt, Mus musculus
auagcaaacaccagaguuugggugcaaauacagacugucuggcccagg

SEQ ID NO: 72719 - RNA, 46 nt, Mus musculus; identical to SEQ ID NO: 22723

SEQ ID NO: 72720 - RNA, 45 nt, Mus musculus
uggcacuccucaggaaaaauaacaaaaagaaucucaauaaggggg

SEQ ID NO: 72721 - RNA, 46 nt, Mus musculus
caugagguguggcuuggccccuccuccaccaagcuuaaugcuccag

SEQ ID NO: 72722 - RNA, 42 nt, Mus musculus
ggugcacaaagcaccucaaaguucuugaacccugaccugcag

SEQ ID NO: 72723 - RNA, 46 nt, Mus musculus
cagaugaucuugguaaaaccuuuuucuuccaucuauuauccagcag

SEQ ID NO: 72724 - RNA, 42 nt, Mus musculus
guguccagccucccagaagcugagccccucgccaagguccgg

SEQ ID NO: 72725 - RNA, 46 nt, Mus musculus
uucuuucuuaacaguaaauuacugccuuaaaaaggaggggcuggcg

SEQ ID NO: 72726 - RNA, 45 nt, Mus musculus
aguguagaggagguguguggggagccuguggaugcugcaccauag

SEQ ID NO: 72727 - RNA, 42 nt, Mus musculus
cuugugagaggcagaugggaggacuccugucagccagcugaa

SEQ ID NO: 72728 - RNA, 46 nt, Mus musculus
gcuguuaaauagagaaacucugugucaaaaaaaauaagaaagaaag

SEQ ID NO: 72729 - RNA, 45 nt, Mus musculus
gaaaugcacguaguuggcucuauaaaagaugacuuuaucucagcg

SEQ ID NO: 72730 - RNA, 44 nt, Mus musculus
guggcuuuuuaauuuaucaucuuccugaggugggcuugucaggg

SEQ ID NO: 72731 - RNA, 45 nt, Mus musculus
agcuccgacaucauuugacgggaguagaggggguuacacacagcc

SEQ ID NO: 72732 - RNA, 42 nt, Mus musculus
ugggauagacagccucuucagcuucuaccacaacgugcccaa

SEQ ID NO: 72733 - RNA, 45 nt, Mus musculus
aagacagccagggcuacacaaagaaacccugucuuaaaaagccaa

SEQ ID NO: 72734 - RNA, 42 nt, Mus musculus
cacuauguacaugcccacugaaaccaguagagagcagcagau

SEQ ID NO: 72735 - RNA, 45 nt, Mus musculus
uacacaggagacugucugaaaggagagagggcgaggggugcaggg

SEQ ID NO: 72736 - RNA, 45 nt, Mus musculus
ucuccgaauaugguuaagaugaacccuucaauugggaagcugaga

SEQ ID NO: 72737 - RNA, 48 nt, Mus musculus
uauccauagugagaucuuaucugaaaauaacauuggcaacaaggcacc

SEQ ID NO: 72738 - RNA, 46 nt, Mus musculus
uagugcugaaagcggugugcgaugcuagcaggcccagacagcugga

SEQ ID NO: 72739 - RNA, 46 nt, Mus musculus
acaauggggucaucagcagaaaaggcuuucuaagccugugcuagag

SEQ ID NO: 72740 - RNA, 46 nt, Mus musculus
gagaugcagcucugccauucacuaaaugaaaacaacauugcaugcu

SEQ ID NO: 72741 - RNA, 42 nt, Mus musculus
accugagcccuuggggauggggggagguguugaaccagggug

SEQ ID NO: 72742 - RNA, 49 nt, Mus musculus
uguauggggauuugucacuuugagugugagcagagguagaaggcggagc

SEQ ID NO: 72743 - RNA, 46 nt, Mus musculus
caaaaaguuccagaugaaauggguugugggaaaugcaggucaggga

SEQ ID NO: 72744 - RNA, 42 nt, Mus musculus
agggucaccuggagggaggguuguuuggggcgguggcaucag

SEQ ID NO: 72745 - RNA, 42 nt, Mus musculus
augguugugagucuccauguggguacugagaacugaacccag

SEQ ID NO: 72746 - RNA, 47 nt, Mus musculus
ccuucacucuuucuccuuucccccuaaacucccuauccccccccccc

SEQ ID NO: 72747 - RNA, 45 nt, Mus musculus
agacagccaugucaggcuuccaucagcaagcacuucccggcgucc

SEQ ID NO: 72748 - RNA, 47 nt, Mus musculus
auauuuccuccucugaguauuuugcuuaaccuucuaaaaaacacuga

SEQ ID NO: 72749 - RNA, 45 nt, Mus musculus
ccucacacaggaugauauucucaauuuccauccauuugccugcaa

SEQ ID NO: 72750 - RNA, 45 nt, Mus musculus
cuccacuuuguaaauguaucacauuuucuguauccauuccucugu

SEQ ID NO: 72751 - RNA, 31 nt, Mus musculus
cuugaugauugauuccguguggaucuuguca

SEQ ID NO: 72752 - RNA, 42 nt, Mus musculus
ugucaguuucuuaugcauugguggcagauagugccaggccgc

SEQ ID NO: 72753 - RNA, 46 nt, Mus musculus
gaaaagacuguaaugucuggaguuuuaauuuuucauacugccuuag

SEQ ID NO: 72754 - RNA, 29 nt, Mus musculus
ucuuguuuacuguuuuaaguugucccaag

SEQ ID NO: 72755 - RNA, 46 nt, Mus musculus
cugggauaaaaccaugaccaagagcaacuuguggagaaagggguuu

SEQ ID NO: 72756 - RNA, 46 nt, Mus musculus
uuuuccccauuuauuguugaucacaugcaucucuguauaugcacau

SEQ ID NO: 72757 - RNA, 46 nt, Mus musculus
aagaagacugucucuuccacccucagcucuccuuccuugccugcag

SEQ ID NO: 72758 - RNA, 45 nt, Mus musculus
cggcuaugggauccccugguuaggaugugggauagguagaugcag

SEQ ID NO: 72759 - RNA, 45 nt, Mus musculus
aguguuuaaacuuggcucugguugggucucuccaguucuguucca

SEQ ID NO: 72760 - RNA, 54 nt, Mus musculus
aguaucaagacccugucuucaacaaaugaaagcuuguggggagauggccuggug

SEQ ID NO: 72761 - RNA, 46 nt, Mus musculus
gaaaaucauuuugugugaugugauagugcacaccugucaucccagu

SEQ ID NO: 72762 - RNA, 45 nt, Mus musculus
cacgcuugugugucugaguuuugugaucccacuuaccucugccag

SEQ ID NO: 72763 - RNA, 38 nt, Mus musculus
uuuuaguuauguauuuauuuauuuuuagaaauuucgag

SEQ ID NO: 72764 - RNA, 37 nt, Mus musculus
gagagcacucguguguaaguguagacacaugccccag

SEQ ID NO: 72765 - RNA, 55 nt, Mus musculus
cuuagguccaugguucuaugcaguagaucuaaaaguccguaguaaauaauguguu

SEQ ID NO: 72766 - RNA, 41 nt, Mus musculus
gcgguggucauacuaugugcaugagaaagcagugcucagga

SEQ ID NO: 72767 - RNA, 44 nt, Mus musculus
guggcauuguguaugugauugacuguggcuuuaugaagcugcga

SEQ ID NO: 72768 - RNA, 91 nt, Mus musculus
guggaucuggguggaaggucacugagccuuuagucguagcugcuuuagcaagggcgugguugggaaagaccagggacaguaagcaacgguu

SEQ ID NO: 72769 - RNA, 46 nt, Mus musculus
aggcacaugccaagguaccagcagugcagagacugggcggcuggag

SEQ ID NO: 72770 - RNA, 41 nt, Mus musculus
cgcgugugugugcgugugugugcgugugugugugcgcgcgu

SEQ ID NO: 72771 - RNA, 46 nt, Mus musculus
gccagcgaggugaacguuagcagugagggaccaccuucccugagag

SEQ ID NO: 72772 - RNA, 46 nt, Mus musculus
uuuagcuagcauggccagagaccaggagccuucuaggagguggcac

SEQ ID NO: 72773 - RNA, 45 nt, Mus musculus
aacuuuuaugaucuguucauaaaaguagcuggcuguuuacuuuug

SEQ ID NO: 72774 - RNA, 42 nt, Mus musculus
cccgcugguaagccccucccccgcugguaagccccuccccug

SEQ ID NO: 72775 - RNA, 49 nt, Mus musculus
acacacguucuacccagcacuuguuugugucuuauucaucacaaaggcu

SEQ ID NO: 72776 - RNA, 42 nt, Mus musculus
gacaguuucucaguauuacuggucgguucugcagggccccau

SEQ ID NO: 72777 - RNA, 42 nt, Mus musculus
gaguuggcugagcugugcacugggcccgguccucacccucag

SEQ ID NO: 72778 - RNA, 70 nt, Mus musculus
guugcugaucacugaggucagcugcugcuaugugcguuaaguauaaaaggaaaugccgggcauuuccauc

SEQ ID NO: 72779 - RNA, 64 nt, Mus musculus
cuggggagacuccaugauuccaacugugccacaccccagugggagaucagugguuaccagaggc

SEQ ID NO: 72780 - RNA, 46 nt, Mus musculus
uuguucauuccacagacacaccacaaccggauccuuuguagcagca

SEQ ID NO: 72781 - RNA, 60 nt, Mus musculus
ggaaagauggagaaacugggucauacaucauuuaggggacaaaucgagaacacaaauucc

SEQ ID NO: 72782 - RNA, 59 nt, Mus musculus
aaagcucaaccauaaaaaagaggguagagaagacagggaggggagagagggaaauggag

SEQ ID NO: 72783 - RNA, 45 nt, Mus musculus
gagggaaagagagagagaggaaagggaaagacaaaagacccaaga

SEQ ID NO: 72784 - RNA, 45 nt, Mus musculus
ugauuugagcagacugugguggaaaggagagagugagcuaacagg

SEQ ID NO: 72785 - RNA, 46 nt, Mus musculus
cacaaacugucccuuuaucauugaaccucccuaauuaagcuaacau

SEQ ID NO: 72786 - RNA, 42 nt, Mus musculus
gacggcgacagcagccaccggcccgagacucccgggacagug

SEQ ID NO: 72787 - RNA, 42 nt, Mus musculus
gcgugcgaacgcugcgggcucagaggcagcgcgggggaagag

SEQ ID NO: 72788 - RNA, 46 nt, Mus musculus
agcagcuggggacgagucgggggccggcuggucgcaccugggaauc

SEQ ID NO: 72789 - RNA, 42 nt, Mus musculus
acccggccauccaagcgacuccaaccggccgccccucaucgc

SEQ ID NO: 72790 - RNA, 46 nt, Mus musculus
aagaaaaggagggaagaugaaacaaccggcacaugaagccccgggg

SEQ ID NO: 72791 - RNA, 42 nt, Mus musculus
gccaugucuguccucugcccggcuccggcccggcgcggggga

SEQ ID NO: 72792 - RNA, 46 nt, Mus musculus
aaauaaaagauaauuccgucccuaagccuuccuucuuuggugaggu

SEQ ID NO: 72793 - RNA, 46 nt, Mus musculus
ugucucaaaaauaacccaaaaaacaaaaaacucuaccuugccacaa

SEQ ID NO: 72794 - RNA, 46 nt, Mus musculus
cucaauuuuguuucauugcuaaauauauuacauacuaggcccaacu

SEQ ID NO: 72795 - RNA, 46 nt, Mus musculus
acgcuugauagagcaaauaguuacugacacuaacauccagacaaua

SEQ ID NO: 72796 - RNA, 46 nt, Mus musculus
aaaaccgcuccaguuaggagagaaaaucuuuuuuaucuuagaagau

SEQ ID NO: 72797 - RNA, 46 nt, Mus musculus
gagccuccucaaugccuaucauaacucaugcacagcaagcacagaa

SEQ ID NO: 72798 - RNA, 45 nt, Mus musculus
uaaauauaaacuuucuggguuuaacaccaaauauugccagcauuu

SEQ ID NO: 72799 - RNA, 46 nt, Mus musculus
ucccaggcccacacuuaucagcccagcacacugccagcaccuagac

SEQ ID NO: 72800 - RNA, 41 nt, Mus musculus
ccaaaccuuuauucuacauaaugaaauccagggcagccagg

SEQ ID NO: 72801 - RNA, 49 nt, Mus musculus
uguuucccuccaaagcaugaggggauaaagggagugaaugagcagagaa

SEQ ID NO: 72802 - RNA, 51 nt, Mus musculus
cuugaguuguacugacugccauuuuuaauagaagcaacucuggaaggaaga

SEQ ID NO: 72803 - RNA, 77 nt, Mus musculus
aaaauaacaaauucaagacaauucaguauuuagcauuaacaagacuuaugagccacuguggaaguuucuaacugcau

SEQ ID NO: 72804 - RNA, 56 nt, Mus musculus
ccagauaauucaucuuauucaacaauuugauauggaaauacauuaguaccaguacc

SEQ ID NO: 72805 - RNA, 65 nt, Mus musculus
caaaauaaaacuaggcuuuguacaaauaaaugucaggauuauagagcuuaaccagaagauuauga

SEQ ID NO: 72806 - RNA, 42 nt, Mus musculus
aaaguaacuuccaaauugccuaugcucuagagaaccccuucc

SEQ ID NO: 72807 - RNA, 46 nt, Mus musculus
gugagccaccaugggguugcugugauuugaacucgggaccuuugga

SEQ ID NO: 72808 - RNA, 46 nt, Mus musculus
ugacaaaaggugagagaacucaagaaaauugcucacacugggaaaa

SEQ ID NO: 72809 - RNA, 42 nt, Mus musculus
cucagaauuccauuuacagaagguaggguuggggagggaggc

SEQ ID NO: 72810 - RNA, 50 nt, Mus musculus
aguaggcagccauugaggguuagaauagaugacuauauggccagcauagu

SEQ ID NO: 72811 - RNA, 68 nt, Mus musculus
cuggagaaggacaggacgacuggcugguggcaagcagaucagcagggaguugccaagaggacacacau

SEQ ID NO: 72812 - RNA, 45 nt, Mus musculus
uccugucucaaagauguguaaaaacucuuuucuaucaccucagau

SEQ ID NO: 72813 - RNA, 46 nt, Mus musculus
aaaaaguuuaaaccaggcguggugacgcacgccuuuaaucccagca

SEQ ID NO: 72814 - RNA, 44 nt, Mus musculus
ucaagguaucuaccucuagacucuagaguuagaaaaaggaagaa

SEQ ID NO: 72815 - RNA, 45 nt, Mus musculus
uuuaaggcccuacguucaaucucuaauaggagaaggggaauaagg

SEQ ID NO: 72816 - RNA, 46 nt, Mus musculus
gagcuacacagagaaacccggucuuaaaaaaacaaaaagguugggg

SEQ ID NO: 72817 - RNA, 44 nt, Mus musculus
aaagaaagaaaggaaggaaggaaggaaggaaggaaggaggcagu

SEQ ID NO: 72818 - RNA, 45 nt, Mus musculus
ccacuucuacagcuguuucgccuucaauuacaaagcccuggagau

SEQ ID NO: 72819 - RNA, 46 nt, Mus musculus
guuggguacacacgucuguaauuucaacacuuccaacaauuaagga

SEQ ID NO: 72820 - RNA, 46 nt, Mus musculus
cuucugauuuucuuuucuucuccuucuugauaucuucugucuuaau

SEQ ID NO: 72821 - RNA, 45 nt, Mus musculus
aaaugagaggcaaaguuaggagagagguaggacaggaauuggaag

SEQ ID NO: 72822 - RNA, 46 nt, Mus musculus
cgagaucugacucucucuucuggugugucugaaaacagcuacagug

SEQ ID NO: 72823 - RNA, 45 nt, Mus musculus
acaaccaucuguaacaaaaucugacgcccucuucuucuggagugu

SEQ ID NO: 72824 - RNA, 25 nt, Mus musculus
caggaaugaucuaguguguagggug

SEQ ID NO: 72825 - RNA, 46 nt, Mus musculus
augucggacuuccuuccauuuauguccaggagggggagaaggaacc

SEQ ID NO: 72826 - RNA, 45 nt, Mus musculus
augucaccacuccaguccuauuuucuucuuuacgucugucuaggu

SEQ ID NO: 72827 - RNA, 42 nt, Mus musculus
aagggaaggagggaaggaagguagguagguagguagguaggu

SEQ ID NO: 72828 - RNA, 46 nt, Mus musculus
cuccuucuuccuucucauugccugcucucagagcaagcugugcaag

SEQ ID NO: 72829 - RNA, 47 nt, Mus musculus
auggaggcauuguagguacggaacaccuuggcagucaagcccuccau

SEQ ID NO: 72830 - RNA, 41 nt, Mus musculus
guucaucauugacuucucaaaggucuuugguggcgcccucu

SEQ ID NO: 72831 - RNA, 51 nt, Mus musculus
cuuugcauccuucaugacuuuggcaucagccuuagcacuuuucaggucccu

SEQ ID NO: 72832 - RNA, 46 nt, Mus musculus
ggcuacauaaugagaccaugugagcuggaacacucaggccucugag

SEQ ID NO: 72833 - RNA, 46 nt, Mus musculus
uuguuuguucuccucucgaucuguggcuugaacuuccagcuucauc

SEQ ID NO: 72834 - RNA, 46 nt, Mus musculus
aggagauuagucuagcucaaugauaacccauagcagggguccagag

SEQ ID NO: 72835 - RNA, 46 nt, Mus musculus
ugggaccccccacuuuuugcaccuguaaaaaaaaaaaaagaaagaa

SEQ ID NO: 72836 - RNA, 42 nt, Mus musculus
gaccaccagggacugggcggagacggggcgccaggcgcgagg

SEQ ID NO: 72837 - RNA, 45 nt, Mus musculus
caucgacacacauguacaccauccccaggaagaucugugggaccu

SEQ ID NO: 72838 - RNA, 46 nt, Mus musculus
aaggagccccucccugcuucccccaggaugggucugguuccuggga

SEQ ID NO: 72839 - RNA, 28 nt, Mus musculus
uggucccaagaacacaagcacauuacac

SEQ ID NO: 72840 - RNA, 46 nt, Mus musculus
cccagggacagacuccuaacuccuaacuccuaacccagggacagac

SEQ ID NO: 72841 - RNA, 103 nt, Mus musculus
ggacagacuccuaacuccuaacuccuaacccagggacagacuccuaacuccuaacuccuaacccagggacagacuccuaacuccuaacuccuaacccagggac

SEQ ID NO: 72842 - RNA, 46 nt, Mus musculus
aaucuucuauuuuggcuuuguaggaguugaaauguacuugccgccu

SEQ ID NO: 72843 - RNA, 41 nt, Mus musculus
uggagugaaacagagguuuucuauucaguucuacaaugagg

SEQ ID NO: 72844 - RNA, 45 nt, Mus musculus
caauagugagagaguggguuguucaugguguccgggcacacagca

SEQ ID NO: 72845 - RNA, 54 nt, Mus musculus
gaagcagggagcagaggcaagaacucaggaaacuggcuggaguaagagcagagg

SEQ ID NO: 72846 - RNA, 45 nt, Mus musculus
uggccuuccugcuguacucggcagugcuugaucuuucccucagcc

SEQ ID NO: 72847 - RNA, 24 nt, Mus musculus
aaucucugagccaaacagugagag

SEQ ID NO: 72848 - RNA, 42 nt, Mus musculus
uggggucuggaaauugagugcuacaagcuggcuaccgcagau

SEQ ID NO: 72849 - RNA, 42 nt, Mus musculus
cccggacauggaacagcuggcuggaggcaucugaggcccguu

SEQ ID NO: 72850 - RNA, 46 nt, Mus musculus
gacacaguacaguuuuuugccuucacccagagcugggcagggaggc

SEQ ID NO: 72851 - RNA, 49 nt, Mus musculus
ucucuuuccaaggggcuucagcccuacuccuggcccaagauggaaggac

SEQ ID NO: 72852 - RNA, 42 nt, Mus musculus
aaagcuacaggacaauguaaacuuuguuucccuggcccacca

SEQ ID NO: 72853 - RNA, 46 nt, Mus musculus
aaucguacaacugaugugcauuugagcuucauguggaugccuaggg

SEQ ID NO: 72854 - RNA, 46 nt, Mus musculus
acugagacgaaaaauuuauuaggcuaagcaaccgauuugagcaaga

SEQ ID NO: 72855 - RNA, 45 nt, Mus musculus
cuuggagcugagauuucaagguagaggaagaaguaaugcuuagau

SEQ ID NO: 72856 - RNA, 65 nt, Mus musculus
agagccuagaggagcggcuggcaacucugaccggagagcuaagccccgagagugccauaccagac

SEQ ID NO: 72857 - RNA, 43 nt, Mus musculus
accauggagccaccccaccccaccaggagccagagccucagau

SEQ ID NO: 72858 - RNA, 42 nt, Mus musculus
ugugagcaaacuccaggcgcagcggaccagguggagggagag

SEQ ID NO: 72859 - RNA, 42 nt, Mus musculus
aaaccgugacuguaguuggcucccccugucgccggcaggaug

SEQ ID NO: 72860 - RNA, 23 nt, Mus musculus
gguaccaguccuuccagcccugu

SEQ ID NO: 72861 - RNA, 45 nt, Mus musculus
gguggagguguuuugagacugaaagagacaauucguggccccgag

SEQ ID NO: 72862 - RNA, 46 nt, Mus musculus
cacacuaauccuuccuucucucccggaggagggagggagcccggag

SEQ ID NO: 72863 - RNA, 46 nt, Mus musculus
cacaguggcccuauguaccugcaaggccacucggcggcccccuuac

SEQ ID NO: 72864 - RNA, 46 nt, Mus musculus
aaaaaggucccacgcuccuuuggcuuguggucuuucccuuuccuga

SEQ ID NO: 72865 - RNA, 45 nt, Mus musculus
cauguguuuauuuguaaggagugacauuggggguacacuuagaag

SEQ ID NO: 72866 - RNA, 41 nt, Mus musculus
caagugcgcucugugugugugugugugugugugugugugug

SEQ ID NO: 72867 - RNA, 47 nt, Mus musculus
gagaauuaaacauaguuguaauauagacagcuagguagagcuggagg

SEQ ID NO: 72868 - RNA, 46 nt, Mus musculus
ugccugggccucaugcagaacuuaguaccagagauuauuugaagau

SEQ ID NO: 72869 - RNA, 46 nt, Mus musculus
ucacaccagguaucagggcaguucaucugagauuugaacuaaagau

SEQ ID NO: 72870 - RNA, 45 nt, Mus musculus
uaucgguucugcacuaggcccuguuggggugaagacaagacagac

SEQ ID NO: 72871 - RNA, 46 nt, Mus musculus
gaaacaguuuaggcacugucaaaaaagauauuccugaaaagcagug

SEQ ID NO: 72872 - RNA, 45 nt, Mus musculus
gugaaagucaaaggcaugucaguuuauuacauuugcaacauaaaa

SEQ ID NO: 72873 - RNA, 65 nt, Mus musculus
guuccuuuacuuacuuuuuauacuacacugaugcugcuugauagaagucuguggcuuugucagau

SEQ ID NO: 72874 - RNA, 45 nt, Mus musculus
guccuggcucuuggcaaggaauuauguauuuaggucaguccccag

SEQ ID NO: 72875 - RNA, 67 nt, Mus musculus
ugugaagagaauucuuuauaaagaccuguagauuccuacaacuuugguuuaaguuuuaaguuagaag

SEQ ID NO: 72876 - RNA, 54 nt, Mus musculus
cgcuuugcagauuuggcuguauucagguuuauaucaaaaggcaagauugaguaa

SEQ ID NO: 72877 - RNA, 47 nt, Mus musculus
uccuccuuuaccucuggacucuuguggcuccccugguccucacaggu

SEQ ID NO: 72878 - RNA, 46 nt, Mus musculus
auagacuagcuuugaacuuucccauuguucuaguucugcuguagca

SEQ ID NO: 72879 - RNA, 60 nt, Mus musculus
ccuuuuuccacuugaugcucugcugugccuccuuguacaucaugaugaccauaaccagcu

SEQ ID NO: 72880 - RNA, 64 nt, Mus musculus
ggagugacaguguuauccuuggugauaccaccaauggagccaaugaugaagaggauggacagcc

SEQ ID NO: 72881 - RNA, 42 nt, Mus musculus
ugcuggcauccagaggugacuguagcuagcaaggcaggauug

SEQ ID NO: 72882 - RNA, 42 nt, Mus musculus
agaccaagcuggcuuggaacucacagagaucugccugccucu

SEQ ID NO: 72883 - RNA, 41 nt, Mus musculus
gacugauuaucuuuguuuucugccuuauauauucuagguaa

SEQ ID NO: 72884 - RNA, 46 nt, Mus musculus
uacacccuuuaccucacguggucagccaugaccaaugaaccuggua

SEQ ID NO: 72885 - RNA, 46 nt, Mus musculus
uacaccaagccugacgacugcacagaaaacaaggucuucaucagcc

SEQ ID NO: 72886 - RNA, 47 nt, Mus musculus
gucuguccauuuuuaaaggacuuuuauacucugugugugugugugug

SEQ ID NO: 72887 - RNA, 46 nt, Mus musculus
aguuaaaacaaguaaagaucccagagcagcagugcacaacggguau

SEQ ID NO: 72888 - RNA, 48 nt, Mus musculus
aucaagaugguugauacaaaggcagagaaagauugugacgugcugguc

SEQ ID NO: 72889 - RNA, 46 nt, Mus musculus
aguugcugucccaucaguaagaauuccacuguaacucggcucaucu

SEQ ID NO: 72890 - RNA, 42 nt, Mus musculus
agcaggagcugagaguuuuacaucuucauccaaaggcaaaca

SEQ ID NO: 72891 - RNA, 41 nt, Mus musculus
cacaaagagacagcuaaaaccaaauccaaagaagccacagc

SEQ ID NO: 72892 - RNA, 45 nt, Mus musculus
cauggacucccugggaccugaguggcgccugaagcugcccccuau

SEQ ID NO: 72893 - RNA, 45 nt, Mus musculus
agugcgcuccaaagaggucugaguucaagagcuaauccggaaagg

SEQ ID NO: 72894 - RNA, 45 nt, Mus musculus
auuagggaaggaggaccugcauuuuguuggccuugccagaggggg

SEQ ID NO: 72895 - RNA, 42 nt, Mus musculus
uguccggcaggcucaggugagucaaagggcccgggggcaacg

SEQ ID NO: 72896 - RNA, 42 nt, Mus musculus
guggccccgugggcccaacccccauuccuaggucacccccag

SEQ ID NO: 72897 - RNA, 46 nt, Mus musculus
gggcaggacuuacugaugaggucuaauaaugcauuaacgguuucac

SEQ ID NO: 72898 - RNA, 42 nt, Mus musculus
gugcaaguguggaggagggggugagagguggagucuggguag

SEQ ID NO: 72899 - RNA, 46 nt, Mus musculus
uaggagggagugaguggggaaaggaaagaaaaauggaucgggagag

SEQ ID NO: 72900 - RNA, 25 nt, Mus musculus
auuccaggugagaagcagagacuac

SEQ ID NO: 72901 - RNA, 44 nt, Mus musculus
aguugugggcuaccgugugggugcuaggaaauaaacuuggaacu

SEQ ID NO: 72902 - RNA, 45 nt, Mus musculus
auuacuuaauaauuauuguuuuccacacugauuuugugccuugac

SEQ ID NO: 72903 - RNA, 45 nt, Mus musculus
cucgugguggaugcucuccaggagcguguccgcgucgggggcagg

SEQ ID NO: 72904 - RNA, 46 nt, Mus musculus
aaauccccaauaggcuuggauccucagaaccggucaccgacccagg

SEQ ID NO: 72905 - RNA, 46 nt, Mus musculus
ucacuuuguccuugucccuggcagggagaagaaagaccaucagcag

SEQ ID NO: 72906 - RNA, 46 nt, Mus musculus
uuuuuuaauaccugccagggucaagaaaccggaaagaggucuccag

SEQ ID NO: 72907 - RNA, 46 nt, Mus musculus
cugaauacagcgugaggaugagccaugacuggugugugugugugug

SEQ ID NO: 72908 - RNA, 42 nt, Mus musculus
cguucacgcaaggcuuuuggaggacgcgauacugggggccac

SEQ ID NO: 72909 - RNA, 46 nt, Mus musculus
ugaacaaagaccugcagggcugcugagaugcccagagagggcgcua

SEQ ID NO: 72910 - RNA, 92 nt, Mus musculus
gaguagguuugucucugucuaguguggaucuguaaccacaggccagugaguagguuugucucugucuaguguggaucuguaaccacaggcca

SEQ ID NO: 72911 - RNA, 45 nt, Mus musculus
cccggacucucacagaggccuguccauuggcgucucagagccuag

SEQ ID NO: 72912 - RNA, 70 nt, Mus musculus
ucuaugacuuguuugacacagccaugaucaauaacucucgaaaccucaacauccagcucaaauggaagag

SEQ ID NO: 72913 - RNA, 45 nt, Mus musculus
cccuuccugcaugcgcagcgguacgugaguggcuauggacugcag

SEQ ID NO: 72914 - RNA, 42 nt, Mus musculus
cucacuucucaacaguuuccaaaguaaaccugagggccugug

SEQ ID NO: 72915 - RNA, 46 nt, Mus musculus
uuacauccacuaccaaccugcucaggacaggcagcagccccaccuc

SEQ ID NO: 72916 - RNA, 46 nt, Mus musculus
uugaacgagcccugcucaaguggacagaguacacaccagaccccaa

SEQ ID NO: 72917 - RNA, 46 nt, Mus musculus
ccgugugcuauggcuccuucuacaaucuccucacccgaaccuuuca

SEQ ID NO: 72918 - RNA, 46 nt, Mus musculus
uguuucuauagcgugucacaggaaggugcaugcugugugacaggag

SEQ ID NO: 72919 - RNA, 44 nt, Mus musculus
agcucaaucuaaggaaugaaggcaugguggggcuuuuuggugau

SEQ ID NO: 72920 - RNA, 45 nt, Mus musculus
aaagcaucuccuuuuucuaaccaauaaagugaucgcuuucagcaa

SEQ ID NO: 72921 - RNA, 42 nt, Mus musculus
caguccaggugagcccugcaguagcuugugcacugggugcug

SEQ ID NO: 72922 - RNA, 60 nt, Mus musculus
uggagugucuuacuugggggaaagagacccugugggaggaaggauggagagaagcugggg

SEQ ID NO: 72923 - RNA, 41 nt, Mus musculus
augguugugagccaccauaugguuacugggaauugaacuca

SEQ ID NO: 72924 - RNA, 44 nt, Mus musculus
uaccacuucauuccagaguacauccuggaaccuccaccgugcag

SEQ ID NO: 72925 - RNA, 45 nt, Mus musculus
guacauaccuguggaauuuauacucugguuauaaucugcagaggu

SEQ ID NO: 72926 - RNA, 46 nt, Mus musculus
agggcuacacagagaaacccugucucaaaaaccaaaaagaguugca

SEQ ID NO: 72927 - RNA, 47 nt, Mus musculus
agaagccagaggugcugaagcuuccagagcuggauuuacagccaaau

SEQ ID NO: 72928 - RNA, 46 nt, Mus musculus
auuauggcauguugaugaaagacacuauuguaacuauuaugaagaa

SEQ ID NO: 72929 - RNA, 46 nt, Mus musculus
gaugccaaguucugcacccaggcuucucagcaguucagccacauag

SEQ ID NO: 72930 - RNA, 45 nt, Mus musculus
uaucagcccauauauucauuuauaaaaaguagcuaugaaagaaag

SEQ ID NO: 72931 - RNA, 46 nt, Mus musculus
uauaaaaucacauauggauauaugccacgaauguagacaggaaguu

SEQ ID NO: 72932 - RNA, 42 nt, Mus musculus
aggcaaaagcaggcagauaucugaguucaaaaggggggaggg

SEQ ID NO: 72933 - RNA, 88 nt, Mus musculus
cugggaaguaguugagggaugccuaccacacgggucaugcugggaagaccucucaggacugagaagggggcuuggagagaacagagau

SEQ ID NO: 72934 - RNA, 46 nt, Mus musculus
auacucacacacacacacacacagacauagauuuauaguaauagac

SEQ ID NO: 72935 - RNA, 46 nt, Mus musculus
ggcuugacuggaugcagagaggucaaggaaggcaacaggcaaagau

SEQ ID NO: 72936 - RNA, 46 nt, Mus musculus
gagaaugucaagcaaugacaggccuaggcuguggcaacagugagga

SEQ ID NO: 72937 - RNA, 46 nt, Mus musculus
gagcuccuagccacacugacggguuuguauuguaugaccuacagau

SEQ ID NO: 72938 - RNA, 42 nt, Mus musculus
cauggcugggugcggggcaugagaggugucuaaaggacggau

SEQ ID NO: 72939 - RNA, 44 nt, Mus musculus
cuugauguagauucucccucuggugccucccauccccaaggccc

SEQ ID NO: 72940 - RNA, 45 nt, Mus musculus
aaccacacaggggcauggauggcucucuccccuccagcguucagu

SEQ ID NO: 72941 - RNA, 24 nt, Mus musculus
uuccagucuuagcuugagaggcac

SEQ ID NO: 72942 - RNA, 42 nt, Mus musculus
aggcaggagggccuggagugacugagcucagccugggcaaca

SEQ ID NO: 72943 - RNA, 46 nt, Mus musculus
gccuuuucuauggucaucuaauaacgauucaaaacuugcaggagug

SEQ ID NO: 72944 - RNA, 46 nt, Mus musculus
cugaguuggcuuggaguagacaugaauguggaaagugcugcuaggu

SEQ ID NO: 72945 - RNA, 46 nt, Mus musculus
agcugggcgugguggcgcaugcuuuuaaucccagcauucgggaggc

SEQ ID NO: 72946 - RNA, 46 nt, Mus musculus
ucuuccuauuaaacgaugaugauacuugaugugauuuauagcagau

SEQ ID NO: 72947 - RNA, 45 nt, Mus musculus
ggauggacauuaaagggagggugacggucucguccaugugccuag

SEQ ID NO: 72948 - RNA, 60 nt, Mus musculus
aacuauccuuaacgcgaucugacucccucuucuggagugucugaagacagcguacuuaca

SEQ ID NO: 72949 - RNA, 45 nt, Mus musculus
gggucgcgguuuugugaggccaucccagagguacuggcaccgaga

SEQ ID NO: 72950 - RNA, 44 nt, Mus musculus
uggccugaaguaguaaaggaaguuacggauaacgggguggggga

SEQ ID NO: 72951 - RNA, 45 nt, Mus musculus
cucucccuagaguuccccagcggcuacccuuacaacgcacccaca

SEQ ID NO: 72952 - RNA, 42 nt, Mus musculus
gugguagcagggugugaggaacuucacugugggugcguugua

SEQ ID NO: 72953 - RNA, 42 nt, Mus musculus
auauagugcagaccacuuauccuugaggauguccaggcagau

SEQ ID NO: 72954 - RNA, 45 nt, Mus musculus
uaugaugucaggacuaucuugcucucuauccagagccugcuagga

SEQ ID NO: 72955 - RNA, 42 nt, Mus musculus
cccuucccccacgccccaauccaucacucacucgagccccau

SEQ ID NO: 72956 - RNA, 47 nt, Mus musculus
gggcccugcccaaguugucagcucauugagcaguugugcagcccugu

SEQ ID NO: 72957 - RNA, 39 nt, Mus musculus
ccuaggcgacuucuagcagccaugaguaaaaaaaugagu

SEQ ID NO: 72958 - RNA, 46 nt, Mus musculus
acauaugugcacuguagcaugcauaaacacacaccaccaccaucau

SEQ ID NO: 72959 - RNA, 46 nt, Mus musculus; identical to SEQ ID NO: 72958

SEQ ID NO: 72960 - RNA, 46 nt, Mus musculus
ccauaugugcacuguagcaugcauaaacacacaccaccaccaucau

SEQ ID NO: 72961 - RNA, 45 nt, Mus musculus
acauaugugcacuguagcaugcauaaacacacaccaccaccaccc

SEQ ID NO: 72962 - RNA, 46 nt, Mus musculus; identical to SEQ ID NO: 72958

SEQ ID NO: 72963 - RNA, 46 nt, Mus musculus
guucaaucccaguccccacaaagugcaaagggaaaauggcccccag

SEQ ID NO: 72964 - RNA, 77 nt, Mus musculus
gcuucuggggagcaugugacagaagaggagaucgaaucccugaugaaggauggugauaaaaacaacgacggccgcau

SEQ ID NO: 72965 - RNA, 46 nt, Mus musculus
gugccaaagggacacagguuauacccacaguuucuucagagaguag

SEQ ID NO: 72966 - RNA, 41 nt, Mus musculus
ucugggacacauccaagccaggccaucugggucagggcuuu

SEQ ID NO: 72967 - RNA, 42 nt, Mus musculus
guccgcuuccauaaccucaacaacggcaccucuuuccgcgag

SEQ ID NO: 72968 - RNA, 46 nt, Mus musculus
cgccuuaguaauaauuuccuccauuagccuccucuuuacaaagcag

SEQ ID NO: 72969 - RNA, 45 nt, Mus musculus
agaugguugugagccaccaugugguugcugggaauuaaacuaggg

SEQ ID NO: 72970 - RNA, 46 nt, Mus musculus
uuaugugaaacuaauaauacagagauuauauggauagcaauggcag

SEQ ID NO: 72971 - RNA, 46 nt, Mus musculus
uugccugaguguauuucuguguaccaugugcaggcagugcccacag

SEQ ID NO: 72972 - RNA, 45 nt, Mus musculus
uccuaaaaguaaaucuuacaaacauaaaagggaaaggaaaaggag

SEQ ID NO: 72973 - RNA, 46 nt, Mus musculus
uaagggacuagguuaaauacucagcaccacagaaaagaaaaacaag

SEQ ID NO: 72974 - RNA, 42 nt, Mus musculus
ggaacaacaacauggauaaaacuggcucuuuuuggcagggag

SEQ ID NO: 72975 - RNA, 45 nt, Mus musculus
gaaggaagaauucaaagaaugcccaggacuccaagcugacugugu

SEQ ID NO: 72976 - RNA, 44 nt, Mus musculus
gccauuuugccagcccaaaagaacccuuaagcccaggaguugaa

SEQ ID NO: 72977 - RNA, 46 nt, Mus musculus
ggcuccgcugggcuugaacacgaaccucagccuuccgcguccccca

SEQ ID NO: 72978 - RNA, 42 nt, Mus musculus
caccacuggccggcaauuccuuucacuuuaagggggcuagca

SEQ ID NO: 72979 - RNA, 41 nt, Mus musculus
caagcgucuaaagcccaggcuaggauccuuccucugcaaga

SEQ ID NO: 72980 - RNA, 41 nt, Mus musculus
cccuaccaaugaagaugccagaggccuggcccagauguucc

SEQ ID NO: 72981 - RNA, 46 nt, Mus musculus
guggugccaaaaaacuggcugaggaugugggccaugaucuccagac

SEQ ID NO: 72982 - RNA, 46 nt, Mus musculus
aagcucgccuaggcaaagcugggcggcuggccccgugcagauggcg

SEQ ID NO: 72983 - RNA, 43 nt, Mus musculus
ucugcucacugaagaggugggucggcucuuacagcacugcagc

SEQ ID NO: 72984 - RNA, 42 nt, Mus musculus
cucuaaucacguguacacgcccaguacuaggaacugaaccca

SEQ ID NO: 72985 - RNA, 44 nt, Mus musculus
caguuugcucauuguucacuuuuuuaaucugugggccugagggu

SEQ ID NO: 72986 - RNA, 42 nt, Mus musculus
cagcaacaagagcaguggagacagcgcgguuccgggcaucug

SEQ ID NO: 72987 - RNA, 46 nt, Mus musculus
cggcugcagcucgcucgaugggcugcuuacagagcacggccccuuu

SEQ ID NO: 72988 - RNA, 46 nt, Mus musculus
uccaagcauagggguuguacuccagggugacaccaucuggcuggau

SEQ ID NO: 72989 - RNA, 45 nt, Mus musculus
cauuggucacguacaucuugucauccgaguaggagaagcccaccc

SEQ ID NO: 72990 - RNA, 45 nt, Mus musculus
uuuaagggcuucauaauuguucuccgccaccugaggaugccaaga

SEQ ID NO: 72991 - RNA, 42 nt, Mus musculus
uuuccugacaggagagagcuaugcuggcaucuacauccccac

SEQ ID NO: 72992 - RNA, 46 nt, Mus musculus
cugcucauaggaggcaaguccauugcccacagccagccccugcgaa

SEQ ID NO: 72993 - RNA, 46 nt, Mus musculus
uucgcaggggcuggcugugggcaauggacuugccuccuaugagcag

SEQ ID NO: 72994 - RNA, 80 nt, Mus musculus
ccacagacuuuggacuucacugcagacccacugcugcgcucagaacaaguguaacuucuaugacaacaaagacccagagu

SEQ ID NO: 72995 - RNA, 24 nt, Mus musculus
uucccagaggaggccgcaguaucg

SEQ ID NO: 72996 - RNA, 42 nt, Mus musculus
aagucacguggcagggaauagucgaguuagggcuggacccag

SEQ ID NO: 72997 - RNA, 46 nt, Mus musculus
cccaccagcacacggagcauagagauuguagauguugaggccagau

SEQ ID NO: 72998 - RNA, 46 nt, Mus musculus
caucuacaaucucuaugcuccgugugcugguggggugcccggcaga

SEQ ID NO: 72999 - RNA, 47 nt, Mus musculus
uaguccaggauuuuggcaacaucuucacucgccugccacuuaagcgg

SEQ ID NO: 73000 - RNA, 36 nt, Mus musculus
accucaggaaaucuccgcuuaaguggcaggcgagug

SEQ ID NO: 73001 - RNA, 64 nt, Mus musculus
guugagguaguuggaaggggcugugguguuggugcagggaggauccaagcguaccuugucccca

SEQ ID NO: 73002 - RNA, 68 nt, Mus musculus
uggggacaagguacgcuuggauccucccugcaccaacaccacagccccuuccaacuaccucaacaacc

SEQ ID NO: 73003 - RNA, 44 nt, Mus musculus
gugaauuuacaguaccgccgccucuaccaaagcaugaacuccca

SEQ ID NO: 73004 - RNA, 42 nt, Mus musculus
gauggaggugcagcgccggcccuggcuaguggacuacgggga

SEQ ID NO: 73005 - RNA, 42 nt, Mus musculus
cuaaugcucccguggggcaaguccuguacuaaaacugcccag

SEQ ID NO: 73006 - RNA, 46 nt, Mus musculus
cccgacugcauaaaaacugaccaccccaggaccccaacagagcuag

SEQ ID NO: 73007 - RNA, 45 nt, Mus musculus
uccagaauuagucaaccaucaauuagaauccauccaccccccucc

SEQ ID NO: 73008 - RNA, 69 nt, Mus musculus
accuaacugaagucuucucugcacccccugccaaccccuucccaucuacaguguuaguggucccggugc

SEQ ID NO: 73009 - RNA, 45 nt, Mus musculus
gggggugcagagaagacuucaguuagguuccugaaugccagccac

SEQ ID NO: 73010 - RNA, 45 nt, Mus musculus
ugccaaagggcuucgagaagugauugacaagaaccguccugcaga

SEQ ID NO: 73011 - RNA, 46 nt, Mus musculus
gcacgaaguugauacccucaggaagggggaucugcaccccacgcca

SEQ ID NO: 73012 - RNA, 42 nt, Mus musculus
gcugaucccacugcaggccccacugaagacacugcugcaaau

SEQ ID NO: 73013 - RNA, 45 nt, Mus musculus
gaguuauauagugagacuaugcugagagagagagagagagagaga

SEQ ID NO: 73014 - RNA, 48 nt, Mus musculus
caucaccuuggccccgcccauguugcccgaaguggagcuguccaagau

SEQ ID NO: 73015 - RNA, 46 nt, Mus musculus
uuaugcauuuaauaguauuacauggcccauagagcggccgggagau

SEQ ID NO: 73016 - RNA, 46 nt, Mus musculus
guggccagaguuggaaguuaccccacauacacaacagugagguggc

SEQ ID NO: 73017 - RNA, 49 nt, Mus musculus
gggcgguggagccucagcuggaggacgacgagaggaugguguacguggc

SEQ ID NO: 73018 - RNA, 46 nt, Mus musculus
cugcagcucaaauauccuaacuucuaauccugaucccaccccuggc

SEQ ID NO: 73019 - RNA, 26 nt, Mus musculus
ugaugguugguuagugaugugauagg

SEQ ID NO: 73020 - RNA, 46 nt, Mus musculus
gagugcacuguagcugucuucagaugcaccagaagagggcacugga

SEQ ID NO: 73021 - RNA, 46 nt, Mus musculus
cgaguauauagaauauggggggcgggaucucugggaggcuugagaa

SEQ ID NO: 73022 - RNA, 46 nt, Mus musculus
ggcucacaaccauccguaaugagaucugaugcccucuucugugucu

SEQ ID NO: 73023 - RNA, 45 nt, Mus musculus
guguccauccgaacaggucuacagcucucccaggauuccaguggu

SEQ ID NO: 73024 - RNA, 41 nt, Mus musculus
uucaaaacaaaaaacaaaacuaaaagucaaggugcggcaua

SEQ ID NO: 73025 - RNA, 46 nt, Mus musculus
gagugcuaggauuaaaguugugugugugugugugugugugugugug

SEQ ID NO: 73026 - RNA, 46 nt, Mus musculus
aacaaaacagaaaccaaaaagacgaaaacagaucuagcaaucacaa

SEQ ID NO: 73027 - RNA, 41 nt, Mus musculus
gucuauccagaggguggcgccaaaaagagggaagcccagga

SEQ ID NO: 73028 - RNA, 42 nt, Mus musculus
cugggacaccgccccagacugggcgggucugggcguggccaa

SEQ ID NO: 73029 - RNA, 46 nt, Mus musculus
gugguauucaguacugguagccuggcaugguggguacuacccagug

SEQ ID NO: 73030 - RNA, 41 nt, Mus musculus
gcugugguuugugccauuagccaugauuucacagcggcugg

SEQ ID NO: 73031 - RNA, 44 nt, Mus musculus
uguguguucauugaguauguguguucauugaguguguguguuca

SEQ ID NO: 73032 - RNA, 42 nt, Mus musculus
gguguggccagcacagcgguauccccacaagccaggcagcca

SEQ ID NO: 73033 - RNA, 42 nt, Mus musculus
gagacccacguaagacacccaaagugauuagccaagguagcc

SEQ ID NO: 73034 - RNA, 41 nt, Mus musculus
ggccagcaggaggccaagccccaggcugugagagcacagga

SEQ ID NO: 73035 - RNA, 46 nt, Mus musculus
agaagcuggcugcuucucaaguauuaggcacccaggcaagacacca

SEQ ID NO: 73036 - RNA, 46 nt, Mus musculus
uguggggucacccaccagacucucaagaguuccuuuacuagaaggg

SEQ ID NO: 73037 - RNA, 45 nt, Mus musculus
aggcgacaggaacaguagaccaggccugggaucccagcacuugag

SEQ ID NO: 73038 - RNA, 46 nt, Mus musculus
ggaggaagaagaaaugugguuccuuucuaguguagaagccagagcu

SEQ ID NO: 73039 - RNA, 44 nt, Mus musculus
ggucacugccgaacccggaguacuacacccuccgcuaugcagau

SEQ ID NO: 73040 - RNA, 42 nt, Mus musculus
uguuccagggcaugugugucucucuucccgaggccccgagau

SEQ ID NO: 73041 - RNA, 46 nt, Mus musculus
uuuucauuaagagagcgccugcucccaaaccuguaggcaaggagug

SEQ ID NO: 73042 - RNA, 44 nt, Mus musculus
ugcauccgcugggccuggaaaacugauagcacacacgauuaaca

SEQ ID NO: 73043 - RNA, 46 nt, Mus musculus
uucaggguuccugaggcaccagcuauaaaaugauaugggagcagug

SEQ ID NO: 73044 - RNA, 45 nt, Mus musculus
ggcggggugggauggagugggguaggaugguggugguagaggagg

SEQ ID NO: 73045 - RNA, 46 nt, Mus musculus
ggauagaauagucacugaugguucaugacuuuaaucacaguuaggc

SEQ ID NO: 73046 - RNA, 46 nt, Mus musculus
caacuaagcuugaacuucuaugcuggguagcacuucuuagcuugcu

SEQ ID NO: 73047 - RNA, 46 nt, Mus musculus
ggaugcccaggguggucuuggaaagacaagaucauguuucguaaga

SEQ ID NO: 73048 - RNA, 41 nt, Mus musculus
ugcuggggauacugggacuggaguugccagcagggcggguu

SEQ ID NO: 73049 - RNA, 42 nt, Mus musculus
gaggacaugagcacauaggugcaggcuccugagcaggcggag

SEQ ID NO: 73050 - RNA, 42 nt, Mus musculus
guagcucuucgggaagcggugcuucaccacggccgcgcggcc

SEQ ID NO: 73051 - RNA, 45 nt, Mus musculus
aggcggcuccgcucgcgcgcagcggccagcgccucggccuccgcc

SEQ ID NO: 73052 - RNA, 46 nt, Mus musculus
ugagaagaaagacacauucaaggggcccccucuccauggcucagau

SEQ ID NO: 73053 - RNA, 45 nt, Mus musculus
agaauggccuuccucuuucuuccagagccugugcagcauccgguc

SEQ ID NO: 73054 - RNA, 24 nt, Mus musculus
ucuuaaacgggggaaagagggugg

SEQ ID NO: 73055 - RNA, 42 nt, Mus musculus
cgccucggcaaucugcacaaguguugaacccuccaccuggau

SEQ ID NO: 73056 - RNA, 46 nt, Mus musculus
gcuagcagaugccugugaucugacauguacacuaguaguaacccug

SEQ ID NO: 73057 - RNA, 46 nt, Mus musculus
agagcagucagugcucuuacugcugagccaucucuccagcccccuu

SEQ ID NO: 73058 - RNA, 46 nt, Mus musculus
cauuugaaagaucaguuguccuuuacuuagaauuuccacuugucug

SEQ ID NO: 73059 - RNA, 46 nt, Mus musculus
auauuugcaugugugugugaugaguguguguauguuuguguauguu

SEQ ID NO: 73060 - RNA, 45 nt, Mus musculus
uuguaugugugagugugugugaguguguaugugaguguguauguu

SEQ ID NO: 73061 - RNA, 42 nt, Mus musculus
aaguuaagaaccaggacugaggaugaagccagaagggaagag

SEQ ID NO: 73062 - RNA, 45 nt, Mus musculus
aaaaaaagaauuagugagaguaauaauagucgagagaagagagau

SEQ ID NO: 73063 - RNA, 46 nt, Mus musculus
aggacccuucugagcaugauggugagagaugaauuucaaagcaaag

SEQ ID NO: 73064 - RNA, 42 nt, Mus musculus
uaccaaugagcuagaaguacugcaaagccuuucgugugugug

SEQ ID NO: 73065 - RNA, 42 nt, Mus musculus
aucccagcaaccacgugguggcucacaaccaucuuuaggggg

SEQ ID NO: 73066 - RNA, 41 nt, Mus musculus
cuacccuuaaugagaucugaugcccucuucuggugugucug

SEQ ID NO: 73067 - RNA, 46 nt, Mus musculus
aaaggcccuguugcucucuuggaacuuaaaaauauuaagagcccaa

SEQ ID NO: 73068 - RNA, 46 nt, Mus musculus
acaaaaauaauuuuaugguuggggggguccccacaacaugaggaac

SEQ ID NO: 73069 - RNA, 45 nt, Mus musculus
agcuggaggugacacaugggagcuggaaacaguaccugggucccc

SEQ ID NO: 73070 - RNA, 45 nt, Mus musculus
ccacauucauucacucacacacacaugauuucagaagcugaaggc

SEQ ID NO: 73071 - RNA, 46 nt, Mus musculus
ggccugucuagcuaauuggugagcuucuguuuccauaagagaucca

SEQ ID NO: 73072 - RNA, 46 nt, Mus musculus
uggaauucggggcgucuuaggaaaauccaagucaaguggugggaag

SEQ ID NO: 73073 - RNA, 46 nt, Mus musculus
gacucagguuacugcccagacuccuguugucuugaagugugcuuag

SEQ ID NO: 73074 - RNA, 44 nt, Mus musculus
gaaauuacaugucuauaagaaaauaaaauccuuuuguuuuauug

SEQ ID NO: 73075 - RNA, 46 nt, Mus musculus
ugcagguccaaggauguguccuuuccgcuagcccuggaguacugag

SEQ ID NO: 73076 - RNA, 46 nt, Mus musculus
uucucuguguaacacuggcuguccuggaacucacucuguagaccag

SEQ ID NO: 73077 - RNA, 29 nt, Mus musculus
aagauuguuuuauguguguguuuugccuu

SEQ ID NO: 73078 - RNA, 46 nt, Mus musculus
uagauauggaaaaauuaauugcucuaaucuucuuagaauuucccag

SEQ ID NO: 73079 - RNA, 45 nt, Mus musculus
agaagggagggaggagagacagacagaugaaggauguggcagagg

SEQ ID NO: 73080 - RNA, 45 nt, Mus musculus
acauacugaacuagaggccacugaggcucugagugaaugagguag

SEQ ID NO: 73081 - RNA, 31 nt, Mus musculus
uucacagcugagaaguuucucgaauccguag

SEQ ID NO: 73082 - RNA, 46 nt, Mus musculus
agcuauuaaagccaacauagugcaucugaugcugagcaguccagag

SEQ ID NO: 73083 - RNA, 44 nt, Mus musculus
gacacacaaaaccuuugcauuuauaauaaaccuuaacagcacua

SEQ ID NO: 73084 - RNA, 46 nt, Mus musculus
gaccagaacacgcugacaaguaucugugaaaaaguuauugugccua

SEQ ID NO: 73085 - RNA, 45 nt, Mus musculus
uagcugcugaugaagaagcuuuugaagauaauucugaggaguaca

SEQ ID NO: 73086 - RNA, 46 nt, Mus musculus
aguagcuuguuuaagcuccgaugucugauuugucaguaaucuucag

SEQ ID NO: 73087 - RNA, 29 nt, Mus musculus
ugccacagcauaaguacagaggucagaag

SEQ ID NO: 73088 - RNA, 45 nt, Mus musculus
auggucgccgggcgugguggugcacgccuuuaaucccagcacuug

SEQ ID NO: 73089 - RNA, 46 nt, Mus musculus
aucuguggccaaggcugggaaccagaauucaguuuugaaaauccac

SEQ ID NO: 73090 - RNA, 42 nt, Mus musculus
gaaagggaaaggagacauuuuuaaguguacgaagguauauag

SEQ ID NO: 73091 - RNA, 41 nt, Mus musculus
ucaugagaaguuucucccuccugcaagaggccaucaucccc

SEQ ID NO: 73092 - RNA, 45 nt, Mus musculus
uggcuguuaguaagguaacagccaguuaagaaacuagguugccuu

SEQ ID NO: 73093 - RNA, 45 nt, Mus musculus
ccauaaugugcauaccugaugcccaccaaggucagaaggugucag

SEQ ID NO: 73094 - RNA, 27 nt, Mus musculus
augcugggaaacuaagcaggcccugua

SEQ ID NO: 73095 - RNA, 45 nt, Mus musculus
ugcuguugugaauuuugaggaggcucuguuucuaguguucacuga

SEQ ID NO: 73096 - RNA, 51 nt, Mus musculus
agguuucuuaguguuuauuaacuuauauugcauuaaguauggggcacuagc

SEQ ID NO: 73097 - RNA, 45 nt, Mus musculus
gguuuuggaaaaaaucauuauuccagagauucaaaagguaucugg

SEQ ID NO: 73098 - RNA, 45 nt, Mus musculus
gaguguccaccaaugauggacacggaguacacuaagcugugguga

SEQ ID NO: 73099 - RNA, 42 nt, Mus musculus
ggcugcacaauugacuggcuaacucuuggagggccuggggag

SEQ ID NO: 73100 - RNA, 46 nt, Mus musculus
gcagucaguccuccuacaaagaaagacucaagagggcuagugguag

SEQ ID NO: 73101 - RNA, 46 nt, Mus musculus
uuuuaagauuuauuuuaugccaguaugcuauagaagagggcaucag

SEQ ID NO: 73102 - RNA, 49 nt, Mus musculus
uuacaaucucucauuggccuguuugaauuaccugaagaugacagcauuc

SEQ ID NO: 73103 - RNA, 46 nt, Mus musculus
gcauagguagcugugaguuugaggcuaaccugggauaccuaacaag

SEQ ID NO: 73104 - RNA, 42 nt, Mus musculus
uguaugugugugcacgcacgcaugugcaugcacgugugcgag

SEQ ID NO: 73105 - RNA, 42 nt, Mus musculus
gccuuuuccccacaugguggcagcguuucauuuaggccccag

SEQ ID NO: 73106 - RNA, 46 nt, Mus musculus
ccaauugagcaguaacugaagaaagugugauaugagggacugggag

SEQ ID NO: 73107 - RNA, 46 nt, Mus musculus
gcacuagacccucugagcaacuguacuaccuuuccagagcccaggg

SEQ ID NO: 73108 - RNA, 24 nt, Mus musculus
ugauggugacuuuggugaccugug

SEQ ID NO: 73109 - RNA, 46 nt, Mus musculus
acugccauuuuucuuucuuaagacuccaguaaagaaaccaggagac

SEQ ID NO: 73110 - RNA, 46 nt, Mus musculus
ggguucaaaguuccccaggcgcagccugccaagccagcacucaaau

SEQ ID NO: 73111 - RNA, 32 nt, Mus musculus
aggaguggguaccaauaagaagguggccaagc

SEQ ID NO: 73112 - RNA, 46 nt, Mus musculus
aaaucccagcgaccacaugguggcucacaaccacccauaaugagau

SEQ ID NO: 73113 - RNA, 46 nt, Mus musculus
cggauuauggccaagggaugaauccuauuaguagacuugcacagau

SEQ ID NO: 73114 - RNA, 55 nt, Mus musculus
guaggggaaggagaagggaaaagcaagaagaucuccaagaagaaugcggccaggg

SEQ ID NO: 73115 - RNA, 55 nt, Mus musculus
gaguggcccaccacacaugaagaacuuugugaccaggguuucaguuggggaauuu

SEQ ID NO: 73116 - RNA, 46 nt, Mus musculus
agugucaucuuuagggguagaagguacagcgacaauugccugaaug

SEQ ID NO: 73117 - RNA, 46 nt, Mus musculus
gguguagacaacgcuguccuggggaguuuucugauagucugcaggg

SEQ ID NO: 73118 - RNA, 46 nt, Mus musculus
cagaacuugcuggcuccacaauggucacaccggcagccuagguagu

SEQ ID NO: 73119 - RNA, 46 nt, Mus musculus
uuguuuuuugagacaauuucucuguguagccuuggcuguccuggaa

SEQ ID NO: 73120 - RNA, 44 nt, Mus musculus
ucuguagguaaauggaagagaagcagaggaagaaaaccucaaua

SEQ ID NO: 73121 - RNA, 42 nt, Mus musculus
cuaagccuggcugcaugaugcuggggaagccaguggguaagg

SEQ ID NO: 73122 - RNA, 42 nt, Mus musculus
uaagaacuagccaaggaaagcagccaugcagccauaagggac

SEQ ID NO: 73123 - RNA, 45 nt, Mus musculus
gaggacucugcagagugaaccccugccagaaagguuggagguaag

SEQ ID NO: 73124 - RNA, 42 nt, Mus musculus
aaaguacuuuuaaccuccuuaaaacuuccucugcuuuuugau

SEQ ID NO: 73125 - RNA, 42 nt, Mus musculus
ggcccugguuccucuguuuucuagauauauaaggcccccugc

SEQ ID NO: 73126 - RNA, 45 nt, Mus musculus
uuuguguauguguguguaccacaucuuaccugauccccguggagg

SEQ ID NO: 73127 - RNA, 28 nt, Mus musculus
auauauguuguaguauguauguggaggu

SEQ ID NO: 73128 - RNA, 41 nt, Mus musculus
guuaauuugacuuauggagagcauggauuuuaggccaagca

SEQ ID NO: 73129 - RNA, 46 nt, Mus musculus
gggcuacaaagacagacucugucuggaccaccuuucccucccccaa

SEQ ID NO: 73130 - RNA, 42 nt, Mus musculus
agggggagaaggagggggaauaguauuaauccugucccaacc

SEQ ID NO: 73131 - RNA, 45 nt, Mus musculus
auaauuaacagggggcuggauuccuggagggcugguuuaguggcu

SEQ ID NO: 73132 - RNA, 42 nt, Mus musculus
uacuccugagugcgaucccgguaccuacaaggggaaagaaga

SEQ ID NO: 73133 - RNA, 42 nt, Mus musculus
agaaaacuacuuuguuuugggaaagaaauagaagucugagag

SEQ ID NO: 73134 - RNA, 46 nt, Mus musculus
uccuuggagccugccucauccucacccggauucuccugccccuuca

SEQ ID NO: 73135 - RNA, 42 nt, Mus musculus
uauacagagaaacccugucucgaaaaaccaaaaaaggggcug

SEQ ID NO: 73136 - RNA, 41 nt, Mus musculus
ucagccaggcgugguggcgcacgccuuuaaucccaggcaga

SEQ ID NO: 73137 - RNA, 45 nt, Mus musculus
guacacuguagcugucuucagauacacaagaagagggcaucaggu

SEQ ID NO: 73138 - RNA, 45 nt, Mus musculus
caaaugcuaucccaaaaguuccccauacccucccccugcccuacu

SEQ ID NO: 73139 - RNA, 46 nt, Mus musculus
ccagcaccagcacgcgagugacugcagccuggcggggcuuguagau

SEQ ID NO: 73140 - RNA, 45 nt, Mus musculus
cacccacagccaggcagguagugaugcugcagaacugggccagcu

SEQ ID NO: 73141 - RNA, 42 nt, Mus musculus
gggccuccaggcgcugggucugugacaaguugccguggagcu

SEQ ID NO: 73142 - RNA, 45 nt, Mus musculus
ucucacuguuuucacuccuucaaugucaagaccgcgggcugccac

SEQ ID NO: 73143 - RNA, 46 nt, Mus musculus
uccgacugcugcaucucuuuuuccuccgccuccagcugcagcacug

SEQ ID NO: 73144 - RNA, 45 nt, Mus musculus
aguuccaggacagccagggcuacacagacaaacccugucugggaa

SEQ ID NO: 73145 - RNA, 46 nt, Mus musculus
ccuuguggagcaggaucauccauacccuucgagagaacaaccagau

SEQ ID NO: 73146 - RNA, 46 nt, Mus musculus
agcugugccaguaccuccugugccaggaguaccugcccucccagau

SEQ ID NO: 73147 - RNA, 45 nt, Mus musculus
uccugcucaggaaaguugugcuccacaaagaaaagguuggaggag

SEQ ID NO: 73148 - RNA, 42 nt, Mus musculus
cuuaaucugcucauacuugagaacagaaggaugguucuccag

SEQ ID NO: 73149 - RNA, 44 nt, Mus musculus
guuuggagacagacuuuguguauguguaucugacagguuggcag

SEQ ID NO: 73150 - RNA, 75 nt, Mus musculus
ccuuaagcacauuuagaugagagagagaguaaaggaggagagaauauuugucaucgaggagagaggaaacgccaa

SEQ ID NO: 73151 - RNA, 42 nt, Mus musculus
gggaggagggggaggaggagaaagagaggaggaggggcagga

SEQ ID NO: 73152 - RNA, 44 nt, Mus musculus
cauucugacagccuuggcacuguagauagaggagggauggggga

SEQ ID NO: 73153 - RNA, 46 nt, Mus musculus
ugggugggcagaugccaccacaacgugccuuuugugacagcccuag

SEQ ID NO: 73154 - RNA, 42 nt, Mus musculus
gcugccaagccuuaugaccugaguucaauccccgggacccac

SEQ ID NO: 73155 - RNA, 46 nt, Mus musculus
acuucugagccugugaccaugguaacuuauuuuccuaaaagccaag

SEQ ID NO: 73156 - RNA, 46 nt, Mus musculus
cauaccacuuuacauaaacuugaaacuuuucuguggaaacauccag

SEQ ID NO: 73157 - RNA, 46 nt, Mus musculus
guauacugucugauaaagucgccaccaaugucaucagagaccugag

SEQ ID NO: 73158 - RNA, 46 nt, Mus musculus
gaaggaaaggguuaauucauuuggcuuacauuuccauacugcuaau

SEQ ID NO: 73159 - RNA, 45 nt, Mus musculus
gacagacagcaggagagaagauguucuucagaagccaacugagga

SEQ ID NO: 73160 - RNA, 46 nt, Mus musculus
gucagcgagagggacagagaccgagcaggcagugccuagugugaag

SEQ ID NO: 73161 - RNA, 41 nt, Mus musculus
uucaguccuagguuucagcaccaaaugugaccgauagagca

SEQ ID NO: 73162 - RNA, 41 nt, Mus musculus
agggguagggaggguggacccauagcucagagcaggggaca

SEQ ID NO: 73163 - RNA, 44 nt, Mus musculus
caaguauaacaacuugggcuacuuaaggccaacaacaacaaaga

SEQ ID NO: 73164 - RNA, 57 nt, Mus musculus
gcauacaagcuugggaccugaguuugauccccagaacccacguaaagauggaggaga

SEQ ID NO: 73165 - RNA, 46 nt, Mus musculus
cuaagaaaaaaaaaauuuuuuuaaacccauuuguggggcuggagag

SEQ ID NO: 73166 - RNA, 46 nt, Mus musculus
uucugauuuuucucauuaaaggaauauucuaccacagcuagccgaa

SEQ ID NO: 73167 - RNA, 46 nt, Mus musculus
uccuaggugugucucacuauaggagaucgcugugauccggguaguu

SEQ ID NO: 73168 - RNA, 46 nt, Mus musculus
ccagcauugcagggacucucuuaagauggaggacaggccaccugag

SEQ ID NO: 73169 - RNA, 45 nt, Mus musculus
cuagcugauagaccgcauguaauuagguguacauacagcagacuc

SEQ ID NO: 73170 - RNA, 44 nt, Mus musculus
cggaggaugcgcgcgggugcucagaugcucugcggaggcgggcu

SEQ ID NO: 73171 - RNA, 46 nt, Mus musculus
gcucagccugcacaagguggacccuuuauaucgauuucggcugauc

SEQ ID NO: 73172 - RNA, 36 nt, Mus musculus
uauaggucuguguaccaugugcauacccuuggaggu

SEQ ID NO: 73173 - RNA, 44 nt, Mus musculus
acauguaguuggagaacugggacccaaauagcaugugccaguau

SEQ ID NO: 73174 - RNA, 42 nt, Mus musculus
ucgcucugcuucgggauccuuggucucccggucuauggagga

SEQ ID NO: 73175 - RNA, 42 nt, Mus musculus
gggugagaagccgagagcggacgacaugaaaugggcacagaa

SEQ ID NO: 73176 - RNA, 45 nt, Mus musculus
cacagagaaacccugucucgaaaaaccaaaaaaaagggggggggg

SEQ ID NO: 73177 - RNA, 32 nt, Mus musculus
uugugacuccagacauucacucagcccacaga

SEQ ID NO: 73178 - RNA, 46 nt, Mus musculus
cgcugcugccacugcuaaacauggccuacaaguuccggacccagag

SEQ ID NO: 73179 - RNA, 30 nt, Mus musculus
gaagccgcugcuggggagcuuggggcugcg

SEQ ID NO: 73180 - RNA, 46 nt, Mus musculus
gggaacucgggcagccgacccgucccgccauggagauggagaagga

SEQ ID NO: 73181 - RNA, 24 nt, Mus musculus
ucuuccuuugucuccuggggagga

SEQ ID NO: 73182 - RNA, 45 nt, Mus musculus
gaagccugggugcuuuuuaaucuuuacuguuaacaggugacggau

SEQ ID NO: 73183 - RNA, 51 nt, Mus musculus
uaagaauagcuuucucucuuugagcauuugcaaaggaaugguaagacuaaa

SEQ ID NO: 73184 - RNA, 46 nt, Mus musculus
ggcuaccuagggacucuggccucccucaguguggcagaggugcuua

SEQ ID NO: 73185 - RNA, 61 nt, Mus musculus
gcuuuuucuuacuguucaguccuuugauucugccacuuucagugagugauuuguuuuggau

SEQ ID NO: 73186 - RNA, 46 nt, Mus musculus
uagcugauauguguuauagcugccuucauucugaaauagaacccag

SEQ ID NO: 73187 - RNA, 42 nt, Mus musculus
ucuugcuugcccuaguuugcaugaacuaaauuuaggcuucug

SEQ ID NO: 73188 - RNA, 46 nt, Mus musculus
uccccucaagggacauucaagguucuuauaagagggcuuccuggag

SEQ ID NO: 73189 - RNA, 46 nt, Mus musculus
cccucuaggcuagcacucugccaacugagcugcuccacacccccag

SEQ ID NO: 73190 - RNA, 45 nt, Mus musculus
uuggaaguuguugccuuugaaagguagaggugccuggcuuuggua

SEQ ID NO: 73191 - RNA, 46 nt, Mus musculus
cugaccacguugcuucuguguuuucauuugugugguauuuccugag

SEQ ID NO: 73192 - RNA, 45 nt, Mus musculus
augcuggaaggcggcuugacgcugcugucuuucucaugucggcag

SEQ ID NO: 73193 - RNA, 44 nt, Mus musculus
uuuguuuuguuuuguuuuuuguuuuuggcuuuccuuuggggugg

SEQ ID NO: 73194 - RNA, 42 nt, Mus musculus
uaugccuucuaacuggcuuauagucuagaaacacauucagag

SEQ ID NO: 73195 - RNA, 55 nt, Mus musculus
auuaaauugcaccaggaagauaaugacuauaucaaugccagcuugauaaaaaugg

SEQ ID NO: 73196 - RNA, 45 nt, Mus musculus
agguaacaggcugucugucuaaacgauuuuuucaugucaccugaa

SEQ ID NO: 73197 - RNA, 42 nt, Mus musculus
uaagucaguuugcgugacaagaagcagcccagaagcccccag

SEQ ID NO: 73198 - RNA, 41 nt, Mus musculus
guaaguuacagaacacggagagcugcauccauggggggguu

SEQ ID NO: 73199 - RNA, 47 nt, Mus musculus
agcccuugccucacacuugcagaccacacucagggaagaaugagaag

SEQ ID NO: 73200 - RNA, 46 nt, Mus musculus
cagcacccaccaucacuagguagguuuucugcucugcaggcaccgg

SEQ ID NO: 73201 - RNA, 46 nt, Mus musculus
cucuugcacguuccuugguccagcucuaagggcuguccacacuuag

SEQ ID NO: 73202 - RNA, 25 nt, Mus musculus
uucugggagauggugugggagcaga

SEQ ID NO: 73203 - RNA, 42 nt, Mus musculus
aucugaugcccucuucuggugugucugaagauagagcccuca

SEQ ID NO: 73204 - RNA, 46 nt, Mus musculus
uauugccucugcguucugauguagagaccugcucccaugcucacag

SEQ ID NO: 73205 - RNA, 48 nt, Mus musculus
ccgugucuuuguuuguucuacuuugagacuaggguaguucugcgaggu

SEQ ID NO: 73206 - RNA, 42 nt, Mus musculus
ccuggagcauggccccauugugguccacugcagcgccggcau

SEQ ID NO: 73207 - RNA, 46 nt, Mus musculus
agugggugagcgaggagaccuguggggaugaagacagccuggccag

SEQ ID NO: 73208 - RNA, 46 nt, Mus musculus
gcuaggcacuggugagcuucucucgugcccuuuggcaugugaucag

SEQ ID NO: 73209 - RNA, 46 nt, Mus musculus
agcccccacugugcacccggagcuugcaggugcccuggagccccau

SEQ ID NO: 73210 - RNA, 46 nt, Mus musculus
auaagcgaaggcagcuggaacuccgcugccucgugccagcauuuca

SEQ ID NO: 73211 - RNA, 54 nt, Mus musculus
guacaguagccuuagagguggcucucccggagaacaggcgcucucugcccuguc

SEQ ID NO: 73212 - RNA, 88 nt, Mus musculus
ucucucucucucucugucucucucucucucuaaauggccauagaauaaaccauuuuuacaaaaauaaaaaccaacaaaaaacugugcc

SEQ ID NO: 73213 - RNA, 42 nt, Mus musculus
aaauugaugggacauuuccacaguacugagaggacagcaugu

SEQ ID NO: 73214 - RNA, 41 nt, Mus musculus
cccccccccccccaaggagcuuuuugagaaaagaggauagc

SEQ ID NO: 73215 - RNA, 46 nt, Mus musculus
aacaugugacuugguacgacaggauuuuuuguuucccacccgguca

SEQ ID NO: 73216 - RNA, 46 nt, Mus musculus
gugagaucacuaaaggggagcauuccaacugagaccccagaaagag

SEQ ID NO: 73217 - RNA, 42 nt, Mus musculus
ggcuugcucagccugcucucuuauagaaccaagcccagagau

SEQ ID NO: 73218 - RNA, 46 nt, Mus musculus
ggaccacugggacagcaggccaggcugucggcucuagaggugagau

SEQ ID NO: 73219 - RNA, 46 nt, Mus musculus
gaugaguucgagaacacgugugugugugugugugugugugugugug

SEQ ID NO: 73220 - RNA, 45 nt, Mus musculus
uccuggucacccacgagcaaggaagagucauuggcuggaccagug

SEQ ID NO: 73221 - RNA, 46 nt, Mus musculus
gcggugaccacagauagggcacacguaaggucucucuccggugugg

SEQ ID NO: 73222 - RNA, 46 nt, Mus musculus
ggacucugcaggagcacagagcccggagucugagguagcagggcac

SEQ ID NO: 73223 - RNA, 45 nt, Mus musculus
uuugcuggaguugcugcugcugcaggcacaggaucugcuccagga

SEQ ID NO: 73224 - RNA, 49 nt, Mus musculus
gggugccucugcaccccguugguucacggccaccuuggugccgcggagc

SEQ ID NO: 73225 - RNA, 45 nt, Mus musculus
caaguacaggauggaguccgugcccagcuucuucaagucccccga

SEQ ID NO: 73226 - RNA, 45 nt, Mus musculus
uuucuuguguuccaugaauucagagagacuaaagaacucggcaca

SEQ ID NO: 73227 - RNA, 45 nt, Mus musculus
augguugugagccaccaugugguugcugggauuugaaccccagac

SEQ ID NO: 73228 - RNA, 42 nt, Mus musculus
aguacaucccccuugcucuagaaccaacaacaaacaccccau

SEQ ID NO: 73229 - RNA, 42 nt, Mus musculus
uuagcuugaaaccuuaacuaagccaggcacaggcaggucgau

SEQ ID NO: 73230 - RNA, 43 nt, Mus musculus
gccaccucuccaugccgcccacccccagaguccccaccaccag

SEQ ID NO: 73231 - RNA, 42 nt, Mus musculus
agggcgaggaccggcagcaggcgccguagcccccgggaaagg

SEQ ID NO: 73232 - RNA, 44 nt, Mus musculus
gggugcuuauguauccaaaggagggaaaccaauuaugggacugu

SEQ ID NO: 73233 - RNA, 46 nt, Mus musculus
ggguccaagaccucagagaucauuuaaauaagcccucauugaucag

SEQ ID NO: 73234 - RNA, 41 nt, Mus musculus
cguguucaucuaggaagcauagcuaauuagcauccgggcuc

SEQ ID NO: 73235 - RNA, 45 nt, Mus musculus
agcccugauuuucaauaaaccaauuuuccuuuuuccgucucagaa

SEQ ID NO: 73236 - RNA, 45 nt, Mus musculus
uggcggugaaacucugaccacaccaucuucaucucaaagccaaga

SEQ ID NO: 73237 - RNA, 46 nt, Mus musculus
cauuuugucuuuaguacuauuaaagaguaaagaaaaacauagagag

SEQ ID NO: 73238 - RNA, 42 nt, Mus musculus
acaucccagcuuuuggcccacaccucaaaacuguaccccaau

SEQ ID NO: 73239 - RNA, 45 nt, Mus musculus
uggagcuguucuggaugcagguuaugagagaacagcuggauguca

SEQ ID NO: 73240 - RNA, 46 nt, Mus musculus
aaggaaaacaggacucaucuggaguccauuugacugugggaggcag

SEQ ID NO: 73241 - RNA, 45 nt, Mus musculus
ccuccacguggucaugucuggccucuacuucuguggcccguaguc

SEQ ID NO: 73242 - RNA, 45 nt, Mus musculus
cuauguguaauguuuguguaucuauaugugugucucccuguguac

SEQ ID NO: 73243 - RNA, 46 nt, Mus musculus
cuuugugugugugugugugucugugugugugugugucugcgucugu

SEQ ID NO: 73244 - RNA, 41 nt, Mus musculus
ugcccaugggcugcagagcuucaaaguuucuagugccccua

SEQ ID NO: 73245 - RNA, 59 nt, Mus musculus
gauccuuuuuuuggagggaugacucgagaugaugacgacgaugaugaugaugaugauga

SEQ ID NO: 73246 - RNA, 59 nt, Mus musculus
gauuccacggcaacuuuggcuuugaugaucuaguacgagauuuuaauagcaucuucagc

SEQ ID NO: 73247 - RNA, 64 nt, Mus musculus
gucagaaacaccuggugagagacugcgggaggggcagacacuacgagacucaaugcuuaaguac

SEQ ID NO: 73248 - RNA, 45 nt, Mus musculus
agguuucccaggaaggucuggguccacuucuucaaccccagccca

SEQ ID NO: 73249 - RNA, 46 nt, Mus musculus
gcacugugguagacagugagggccggagggagaccacagugaccca

SEQ ID NO: 73250 - RNA, 45 nt, Mus musculus
cccagggacucugcagacccuguucugugguacucuuauuaagga

SEQ ID NO: 73251 - RNA, 52 nt, Mus musculus
agaugacccggguuagacucagggggucacaaaacagaaagacauguaugua

SEQ ID NO: 73252 - RNA, 71 nt, Mus musculus
ugugggggggggggucucacugugggaaacuuaccagagaucaccugugucguagccuucaagugccagag

SEQ ID NO: 73253 - RNA, 42 nt, Mus musculus
gaguugaagauugcagacuucggguggucggugcaugcucca

SEQ ID NO: 73254 - RNA, 46 nt, Mus musculus
caagauuaucuuacuccugugaguauccuguuagcagaguccugau

SEQ ID NO: 73255 - RNA, 42 nt, Mus musculus
aaagccagcaguguacuugggcuuuucucaucaggaggagau

SEQ ID NO: 73256 - RNA, 42 nt, Mus musculus
aggaaaagggaaguuuggaaaugucuacuuggcgcgggagag

SEQ ID NO: 73257 - RNA, 41 nt, Mus musculus
aggaaaugauucugaaaaggagcaggcauccuugcagaaga

SEQ ID NO: 73258 - RNA, 45 nt, Mus musculus
gugucccggcucaauaacccccagaagaaugagcagccugcagcc

SEQ ID NO: 73259 - RNA, 44 nt, Mus musculus
uguguccuucuaacucccagcgugucccuucacaagcccagaaa

SEQ ID NO: 73260 - RNA, 92 nt, Mus musculus
ucgcuuggaggcuucggucgggagcagguuccugccugugaguuggaaagggacauggcuguugagggcgagccuggaugcugcaaacggau

SEQ ID NO: 73261 - RNA, 46 nt, Mus musculus
acaaacaaaaaacccugaucuuagaaggguaacgaaaagaaagaau

SEQ ID NO: 73262 - RNA, 46 nt, Mus musculus
aagccccagagcauaaagcagccaugagugcugucaagagcaggag

SEQ ID NO: 73263 - RNA, 42 nt, Mus musculus
ggucaucgaguuucuguuggacaaaucugcugagaaggcccu

SEQ ID NO: 73264 - RNA, 42 nt, Mus musculus
cgugcugaaguguugagcugagguucacguagacuuucuuag

SEQ ID NO: 73265 - RNA, 46 nt, Mus musculus
gcaguggcucugccaggagcacgugcuggagagguggaggcaggag

SEQ ID NO: 73266 - RNA, 41 nt, Mus musculus
ugcgguuguguguuuucugaacgcgccuugaaggagauaaa

SEQ ID NO: 73267 - RNA, 45 nt, Mus musculus
cccuggguccccaugucugucagcucugcacauuuggguagagac

SEQ ID NO: 73268 - RNA, 42 nt, Mus musculus
cuagaagcggaguaggaacuugagcagguaccacugcggcag

SEQ ID NO: 73269 - RNA, 46 nt, Mus musculus
aaaccccugcuucugguggccuuguaguuucuaagaucuuggucag

SEQ ID NO: 73270 - RNA, 45 nt, Mus musculus
gaggccagccugggcuaccagugaggccuugccucaagacucaag

SEQ ID NO: 73271 - RNA, 51 nt, Mus musculus
ggaggacaucauugugcucaauggcaccaaggaggauguggagaugcugaa

SEQ ID NO: 73272 - RNA, 46 nt, Mus musculus
ggcugcauuggucuucaucaccagauaaguagguggucgguggcuc

SEQ ID NO: 73273 - RNA, 46 nt, Mus musculus
caccuguaauccuauccuccuaaggaagaguuaggagaguuggagg

SEQ ID NO: 73274 - RNA, 65 nt, Mus musculus
caacuaaugggagugcgucugggaaaguuggcaagcccccauguggggcccugaagagguccauu

SEQ ID NO: 73275 - RNA, 48 nt, Mus musculus
cgaccuugaauggauucgacugacuacuaccaaguggaaccgaucaug

SEQ ID NO: 73276 - RNA, 52 nt, Mus musculus
caaccgccacggucugauccgcaaauacgggcugaacaugugccgccagugc

SEQ ID NO: 73277 - RNA, 42 nt, Mus musculus
aagccagaacuaaagccaguacccagagcugaagcuguguag

SEQ ID NO: 73278 - RNA, 45 nt, Mus musculus
gcauauccguguaccacgugcacaccuggugccugcagacucuag

SEQ ID NO: 73279 - RNA, 42 nt, Mus musculus
aggacuacaggcagacuacaggcuacagaacuacaggcagac

SEQ ID NO: 73280 - RNA, 33 nt, Mus musculus
cuacagguggacuacagguuaacuacagguaga

SEQ ID NO: 73281 - RNA, 33 nt, Mus musculus; identical to SEQ ID NO: 73280

SEQ ID NO: 73282 - RNA, 41 nt, Mus musculus
caaccacacgggucaacgucuuuccgugggcgaugguagga

SEQ ID NO: 73283 - RNA, 27 nt, Mus musculus
acuuuacuucaggccuaucugggucua

SEQ ID NO: 73284 - RNA, 24 nt, Mus musculus
ggggcacuagggaacagugggacu

SEQ ID NO: 73285 - RNA, 45 nt, Mus musculus
ccggacgccauguuguggaaaauaacagauaaugucaaguaugaa

SEQ ID NO: 73286 - RNA, 42 nt, Mus musculus
gagcuagaguuucggagaguaggagggagggaggcggcgagc

SEQ ID NO: 73287 - RNA, 46 nt, Mus musculus
cccgggggcucucgggcucuggggcggaucgagacgggugguguga

SEQ ID NO: 73288 - RNA, 42 nt, Mus musculus
cgggguugcagaguaccagccgccuccuuacuucccgccgcc

SEQ ID NO: 73289 - RNA, 48 nt, Mus musculus
ucuagccuggccucgcaccacagccgcucugcaagucuaauaccccau

SEQ ID NO: 73290 - RNA, 46 nt, Mus musculus
gcccggcgggaagucuaccgccgguccgaccugcugcugccucacg

SEQ ID NO: 73291 - RNA, 45 nt, Mus musculus
uuaaacagauuaccaugguggccuggaacagagagagagagagag

SEQ ID NO: 73292 - RNA, 45 nt, Mus musculus
gcucccuugccagaaggaccuggugggaguggucaugaaccccag

SEQ ID NO: 73293 - RNA, 99 nt, Mus musculus
ugcagagcaaaguccaaaaauggaggccgguccuugagggagaaguuggacaaaauuggauugaaccuuccggccgggagacggaaagcugcccacguc

SEQ ID NO: 73294 - RNA, 45 nt, Mus musculus
uaguaaagcgguggcugacuauuuaacgagaccacaucuuggggg

SEQ ID NO: 73295 - RNA, 46 nt, Mus musculus
aaucaagaguagaggugaauaccuguugugaucuuguacuggggag

SEQ ID NO: 73296 - RNA, 43 nt, Mus musculus
ucacaggcaggugugcaaggaguucacugaccuucuccaucaa

SEQ ID NO: 73297 - RNA, 45 nt, Mus musculus
gaaaauggaaaagcacaggaaguaaaauggcugcaaggaggccag

SEQ ID NO: 73298 - RNA, 44 nt, Mus musculus
cuccuggccguggcuggcguucauucgguuuuucccagccguga

SEQ ID NO: 73299 - RNA, 42 nt, Mus musculus
ucuuaggaaugagaaaagguggccucugggagguagggaccu

SEQ ID NO: 73300 - RNA, 42 nt, Mus musculus
auccccugccagcucccccuugucccccaguccccaccccag

SEQ ID NO: 73301 - RNA, 41 nt, Mus musculus
agcucuaguauuuuccuugaccuguguacugcuccuguguu

SEQ ID NO: 73302 - RNA, 26 nt, Mus musculus
gcuuuugugauuggaauguaugcuac

SEQ ID NO: 73303 - RNA, 50 nt, Mus musculus
agcaaaguauucacagcaucgugugacaagacagccaagaugugggaccu

SEQ ID NO: 73304 - RNA, 46 nt, Mus musculus
aguaagagaauccagguucaggaugagaucacacuaagcugugcag

SEQ ID NO: 73305 - RNA, 42 nt, Mus musculus
caguuuucccacaccucccacucuucuguucuuuguccccag

SEQ ID NO: 73306 - RNA, 49 nt, Mus musculus
ggucacgcuugagucaccucucucacuuaccgccccccaggcuucccca

SEQ ID NO: 73307 - RNA, 87 nt, Mus musculus
cauaugacaccagaaaacauaggcaagaaauaaacacuaacccagcaggaccacaccagaccaguccucacaggaaggagcagccag

SEQ ID NO: 73308 - RNA, 46 nt, Mus musculus
cagcuaccaguaugugaaggcaguguuucuuuuuaucccaggaaag

SEQ ID NO: 73309 - RNA, 42 nt, Mus musculus
cuuuucagggccaaagauaacuucaccuucaaaugccaucga

SEQ ID NO: 73310 - RNA, 42 nt, Mus musculus
aggaccaaacuaaagacuucggaacaguuagaucagcccauc

SEQ ID NO: 73311 - RNA, 45 nt, Mus musculus
caauggaaacauauuugccuaugcuuccagcuacgacugguccaa

SEQ ID NO: 73312 - RNA, 45 nt, Mus musculus
uuuuauaauccccaaaagaaaaauuacauuuucuugcguaaugca

SEQ ID NO: 73313 - RNA, 45 nt, Mus musculus
ccugcucacucccaaauucucaucugcaggcacugcuucugggcc

SEQ ID NO: 73314 - RNA, 45 nt, Mus musculus
agaggaucaaugugcggauugagcacaucaagcacucaaauagca

SEQ ID NO: 73315 - RNA, 51 nt, Mus musculus
acccagccucucccaagugugacacaguaucugccuaauaaauucacgaag

SEQ ID NO: 73316 - RNA, 46 nt, Mus musculus
aauuauccauacuggccuuaaaacuuggaauccuuaugccuuagac

SEQ ID NO: 73317 - RNA, 45 nt, Mus musculus
ggacaucagucagauccacaccggucuucauggcagccccccuuu

SEQ ID NO: 73318 - RNA, 46 nt, Mus musculus
aggggaucuccaucugugugcacacagaacagccuauguggaaggu

SEQ ID NO: 73319 - RNA, 46 nt, Mus musculus
ggcuucugagcgcacguagcugggaagcgggugagcgggccaagau

SEQ ID NO: 73320 - RNA, 46 nt, Mus musculus
cuaaaagccauggagaacuuugaggucuugucauaaugcccugagc

SEQ ID NO: 73321 - RNA, 46 nt, Mus musculus
acuuagaggaugaguuccgugugucaaccagcaacauucuccugga

SEQ ID NO: 73322 - RNA, 42 nt, Mus musculus
ccacagcuauuugagguaggcugggacguuccugccgugcuu

SEQ ID NO: 73323 - RNA, 55 nt, Mus musculus
aagguggauccuucuuggagcgugggaaucuacagggcugcuuagaaaugguuug

SEQ ID NO: 73324 - RNA, 55 nt, Mus musculus
gacaaaggccuuagaagaugacuuccaagccuauuucguuaacgaccugcauuca

SEQ ID NO: 73325 - RNA, 42 nt, Mus musculus
uugcccuggcugagggccccguacaagugaacucugggaaga

SEQ ID NO: 73326 - RNA, 46 nt, Mus musculus
uuaccuaugggugccuggguugguuguccauguugaugguugggau

SEQ ID NO: 73327 - RNA, 45 nt, Mus musculus
cacuuggagccacaucucuagccgccaagucagauguauugggaa

SEQ ID NO: 73328 - RNA, 24 nt, Mus musculus
ucaccuucuuggcagccuggagag

SEQ ID NO: 73329 - RNA, 45 nt, Mus musculus
ucuuuguagucugcuggacagauaagacagacauccaccccaagu

SEQ ID NO: 73330 - RNA, 42 nt, Mus musculus
uguccuugaagcuuccucagcccugccugcacuuggccccag

SEQ ID NO: 73331 - RNA, 59 nt, Mus musculus
gacuagauauggucagaauuagggacugaacaaugcccggucugagaagaggagccaug

SEQ ID NO: 73332 - RNA, 61 nt, Mus musculus
caaaugguugcucaguuggcagcaggguggagggagggggcuuggaggaugcauucgcuau

SEQ ID NO: 73333 - RNA, 54 nt, Mus musculus
uauaggggcaggaaugggcuugugugggccauccgugaggugaaggagccaaau

SEQ ID NO: 73334 - RNA, 45 nt, Mus musculus
cacacaagcccauuccugccccuauaaggagaagccaggcagggg

SEQ ID NO: 73335 - RNA, 51 nt, Mus musculus
uagcagggccauggggucuacugggguuggaagccaaggagaagaggacag

SEQ ID NO: 73336 - RNA, 45 nt, Mus musculus
uggauaaguagaagccacccucagccaggcggcgguggcgcacac

SEQ ID NO: 73337 - RNA, 52 nt, Mus musculus
ggagcugcuuccuagauuccuugggccaggaaaggcccugcuuccagccaga

SEQ ID NO: 73338 - RNA, 46 nt, Mus musculus
ggacuuggcugugacauuuaccaucuuuggacacguuuacuuugca

SEQ ID NO: 73339 - RNA, 44 nt, Mus musculus
aggagacggauucuaguucuaauaaguugaauugcaaccaggau

SEQ ID NO: 73340 - RNA, 46 nt, Mus musculus
cuuaugcguggugguagugggggugggggcacacauguacagaggu

SEQ ID NO: 73341 - RNA, 42 nt, Mus musculus
cucuaccuacccagugcuggauuaaagauuuaugccaccaua

SEQ ID NO: 73342 - RNA, 42 nt, Mus musculus
cauaaaucuuuaauccagcacuggguagguagaggagggcag

SEQ ID NO: 73343 - RNA, 46 nt, Mus musculus
uggucauuacagacgacuauugucguauugcucucagugcauuuaa

SEQ ID NO: 73344 - RNA, 56 nt, Mus musculus
ugagcgcauucuuuaaauuguggccauuccuagcuucaaaugucuagauccaggau

SEQ ID NO: 73345 - RNA, 46 nt, Mus musculus
ucagcaaacaguauuucugagcuuugcugugaauggaaagugagga

SEQ ID NO: 73346 - RNA, 45 nt, Mus musculus
ucugcugguuauucaaaagucuauccaucuccuaaagcucccaug

SEQ ID NO: 73347 - RNA, 45 nt, Mus musculus
uacacaaggccagaaggacuuggccaaggcaaaagcugauguagu

SEQ ID NO: 73348 - RNA, 41 nt, Mus musculus
agaguugguggugacuacagaaauauaugagaugggaggug

SEQ ID NO: 73349 - RNA, 46 nt, Mus musculus
accaccaacucugguuuucccauuuaucucuuaaaccugguaccag

SEQ ID NO: 73350 - RNA, 52 nt, Mus musculus
gcugauccugugguggcaggggugguacaggcagucagcaggauugugggac

SEQ ID NO: 73351 - RNA, 46 nt, Mus musculus
gacaaaucagaaccuccauuauggucuaggccaagagcaacgagag

SEQ ID NO: 73352 - RNA, 45 nt, Mus musculus
auggagguucugauuuguccccacguaguagaaugcuggcugcag

SEQ ID NO: 73353 - RNA, 23 nt, Mus musculus
guuuaugaaauggccuugggagu

SEQ ID NO: 73354 - RNA, 48 nt, Mus musculus
uuccuccaugagccauggcacaggcacaccccacauguaauacccaag

SEQ ID NO: 73355 - RNA, 74 nt, Mus musculus
guaggcaggaacauuaccaagcucccuuuuaagaaaccaguauucuucacauaccaaguuggccacaggaacac

SEQ ID NO: 73356 - RNA, 47 nt, Mus musculus
gugcgguaauaauaaucuccugacucagaaacaauuaggcuuagaua

SEQ ID NO: 73357 - RNA, 64 nt, Mus musculus
cuaauugugugcauccugugacagcagaagugacaaaggcggcaaacacauaauuccggaagca

SEQ ID NO: 73358 - RNA, 92 nt, Mus musculus
ccaaagaugaguaagauuggcuuuuaaccaaacuaacccaaagaaaaggauaaagagcaggcuaguaauuagccaggaaggugacauuacau

SEQ ID NO: 73359 - RNA, 46 nt, Mus musculus
auccuuuucuuuggguuaguuugguuaaaagccaaucuuacucauc

SEQ ID NO: 73360 - RNA, 46 nt, Mus musculus
gaauuagucugaugccugccgaccuuuuccuuaaggaagcacucag

SEQ ID NO: 73361 - RNA, 45 nt, Mus musculus
cuaccuuuuagguuuuuauccuauuuuguuuucuagaaggacaga

SEQ ID NO: 73362 - RNA, 45 nt, Mus musculus
agugcucagcuccuccaccacugaaugcccagcacugcugguagg

SEQ ID NO: 73363 - RNA, 45 nt, Mus musculus
uugacauuuucugaugucucucuuaugaaaaagaaagcgggggua

SEQ ID NO: 73364 - RNA, 53 nt, Mus musculus
cuuaaucugcugccuuugacuguaagugcuuuaggaauggaggacuugaaaug

SEQ ID NO: 73365 - RNA, 45 nt, Mus musculus
cccugugguaguuugggugcccaccgaaaggugugacagagcagg

SEQ ID NO: 73366 - RNA, 54 nt, Mus musculus
aagcuuaugacuggagugucaucuuagguccagaaaugaaggcaacagucccag

SEQ ID NO: 73367 - RNA, 47 nt, Mus musculus
gccccaccccugugggcucagcucaggugugcauauggcugugugau

SEQ ID NO: 73368 - RNA, 116 nt, Mus musculus
agaauugaggcaauuaucuucaggcaaaugagucuaggcucuguaaucagccuguccugauaacugggcaacaucggccucaugcacagagcuuugcuuugcuuugagguaaagag

SEQ ID NO: 73369 - RNA, 75 nt, Mus musculus
uagaccaauuuuacaugucuagucacugaggccgcaguagauugggacucuuucuauaugugcaaagugaagugg

SEQ ID NO: 73370 - RNA, 45 nt, Mus musculus
uuccucuggcucgaggcucgcccacucccuggcucccucccccag

SEQ ID NO: 73371 - RNA, 46 nt, Mus musculus
uacucuggacuugcuacccaaaaggcauuacuccuagcuaggcuuu

SEQ ID NO: 73372 - RNA, 43 nt, Mus musculus
gaacccauagacccaccuuuccugcccuccacuguaugcagau

SEQ ID NO: 73373 - RNA, 46 nt, Mus musculus
agugguuugaagguagguacaucccuucuuuuugccccgaggcgag

SEQ ID NO: 73374 - RNA, 42 nt, Mus musculus
uccgauaucgaauccgagaccgaaaucgagaccgagccagag

SEQ ID NO: 73375 - RNA, 42 nt, Mus musculus
acucaggagccugagagcgcaagcgagggggaggagccccag

SEQ ID NO: 73376 - RNA, 43 nt, Mus musculus
cggagagguccgggacugugcgccuaggccauagaggcaggag

SEQ ID NO: 73377 - RNA, 46 nt, Mus musculus
uccuuucuaaaagcuugauucaaauccugaucugagaaggagggag

SEQ ID NO: 73378 - RNA, 45 nt, Mus musculus
cuuccuuacauuggacccuuuguuccagauaggugaaggugugcc

SEQ ID NO: 73379 - RNA, 45 nt, Mus musculus
cagagaagcacgauauaagaaagaauguggaacaaaggauucuca

SEQ ID NO: 73380 - RNA, 42 nt, Mus musculus
uagcccucucuguguagugaguuagccuaccgccaucaugag

SEQ ID NO: 73381 - RNA, 44 nt, Mus musculus
aaucgcaagugauggcccgcccaucgaagucucgggagccccag

SEQ ID NO: 73382 - RNA, 30 nt, Mus musculus
uucggguggccgaacuauaugcccuccagg

SEQ ID NO: 73383 - RNA, 33 nt, Mus musculus
cuugcaaaugugggaacugguagaauucucuag

SEQ ID NO: 73384 - RNA, 46 nt, Mus musculus
ugaagcucugugaugguuaauaggaagaggguaaccuugucacaag

SEQ ID NO: 73385 - RNA, 58 nt, Mus musculus
acaaccauccauaaugagaucugacgcccucuucuagugugucugaagacaacuacag

SEQ ID NO: 73386 - RNA, 46 nt, Mus musculus
uaaauaaucucuauaguuuaauuucugucaaugaaguagguuagag

SEQ ID NO: 73387 - RNA, 42 nt, Mus musculus
uuaaagaagguggcaugucuaagagcaugcccggccccuagc

SEQ ID NO: 73388 - RNA, 46 nt, Mus musculus
gaacacaugcucugcugugccuguagcuggaggcucuuuccuggau

SEQ ID NO: 73389 - RNA, 46 nt, Mus musculus
aggacauuuacauaaaacgauaaaguaauuuaaaauugggugagga

SEQ ID NO: 73390 - RNA, 42 nt, Mus musculus
uguccucuaaaggcaacacacauuuuuaauacccacccccag

SEQ ID NO: 73391 - RNA, 41 nt, Mus musculus
agacucugaauacaaacacacccaggggccugaaggggaga

SEQ ID NO: 73392 - RNA, 45 nt, Mus musculus
ggugccaugucuuagucugacccuuggcucgguccaccugggcac

SEQ ID NO: 73393 - RNA, 43 nt, Mus musculus
gaagauggagaagaagcugcuggagcagaggagaaaggaggag

SEQ ID NO: 73394 - RNA, 45 nt, Mus musculus
gugcuuguguguggacacauuuuccuuuuugguugcucuguccua

SEQ ID NO: 73395 - RNA, 54 nt, Mus musculus
agcgcaacgaggagaaggcgcagcgcgaggccaacaaaaagaucgagaagcagc

SEQ ID NO: 73396 - RNA, 42 nt, Mus musculus
cugugcgcggagcagacguguccugagcuaggccaggccgug

SEQ ID NO: 73397 - RNA, 46 nt, Mus musculus
aaggaugucucuccuuacuuuuuuuaaaguacuggggugggggcag

SEQ ID NO: 73398 - RNA, 46 nt, Mus musculus
ucugauuucaaaguacacaccuggaaacaucuagaaucuucuguau

SEQ ID NO: 73399 - RNA, 45 nt, Mus musculus
uguugugggaggaggggaaaaaccauucccacagggaauacgggc

SEQ ID NO: 73400 - RNA, 46 nt, Mus musculus
augggguggggcuggaggguccuccaaauacuaccuaugaaagaaa

SEQ ID NO: 73401 - RNA, 44 nt, Mus musculus
gugaagcagaugaggauccugcauguuaauggguuuaacggaga

SEQ ID NO: 73402 - RNA, 46 nt, Mus musculus
uaaguuacagccccaaaauucauaguuaguuaauaugcagaaggga

SEQ ID NO: 73403 - RNA, 46 nt, Mus musculus
augcagagacuguguggguuuuguaugaaauugcagugccuugcag

SEQ ID NO: 73404 - RNA, 46 nt, Mus musculus
cuagaugauggcuacaguccuccaucuucgcuauguccuaccccag

SEQ ID NO: 73405 - RNA, 45 nt, Mus musculus
ggcucaguaccaauggcaggaagccauuuuuuaaaaacagaguag

SEQ ID NO: 73406 - RNA, 45 nt, Mus musculus
uucaacgugcgccgccccucucacaccguaacagaaucagccccu

SEQ ID NO: 73407 - RNA, 45 nt, Mus musculus
accccccagaaccccacccuauuggcagguauccacaugccccaa

SEQ ID NO: 73408 - RNA, 42 nt, Mus musculus
uaucccagaggcugguuuaaauaagcaaacaucuagccaacu

SEQ ID NO: 73409 - RNA, 45 nt, Mus musculus
accaguucagaguggacuacauucugagcgugaugaacgugccga

SEQ ID NO: 73410 - RNA, 42 nt, Mus musculus
aguuugcuaucucaaacuuuuucuguuucacagacccaguag

SEQ ID NO: 73411 - RNA, 42 nt, Mus musculus
ugaugugacugccaucaucuucgugguggccagcagcagcua

SEQ ID NO: 73412 - RNA, 26 nt, Mus musculus
cuugcugagaaaguccucgcuggcaa

SEQ ID NO: 73413 - RNA, 63 nt, Mus musculus
agcgacucccgagccgggagaggacccacgcgugacccgggccaaguacuucauucgggauga

SEQ ID NO: 73414 - RNA, 52 nt, Mus musculus
cacugcuaguggagaugggcgccacuacugcuacccucacuuuaccugcgcc

SEQ ID NO: 73415 - RNA, 81 nt, Mus musculus
caguuggucacccaccauagggcaugaucaacaccgcaaccuuuccuuuuucccccagugauucugaaaaaccccucuucc

SEQ ID NO: 73416 - RNA, 69 nt, Mus musculus
ccacaaaaguucccucucacuuucaguaaauaaaauaaaagcagcaacagaaauaaagaaauaaaugaa

SEQ ID NO: 73417 - RNA, 58 nt, Mus musculus
auucaaaaugaaauaaauauuguguugugcagcauuaaaaaaucaauaaaaauuaaaa

SEQ ID NO: 73418 - RNA, 46 nt, Mus musculus
aaaucccagcaaccauaugguggcucacaaccgcccguaaugagau

SEQ ID NO: 73419 - RNA, 58 nt, Mus musculus
aggacagcucaacuuaucaccagaucuggagcccuggaauccaugggaggggggaaca

SEQ ID NO: 73420 - RNA, 59 nt, Mus musculus
gccugccuccucuucuacagugcuugccuucagccacccggagaagagagcuaugguuu

SEQ ID NO: 73421 - RNA, 92 nt, Mus musculus
gccaucgagagugccugcacauuuggggaccccauuguuuagguagaugucucuggaagcagcgcugugaaccaugacagggaggggugauu

SEQ ID NO: 73422 - RNA, 46 nt, Mus musculus
aggcuggaugaggaucgugaccagcaccuacaagggaggcacaggu

SEQ ID NO: 73423 - RNA, 75 nt, Mus musculus
gggggcaucuaugcugagcaccaggaccaggccguuaucaaccacaucaucucuguagcuggcuggggugucagc

SEQ ID NO: 73424 - RNA, 41 nt, Mus musculus
uacggcucccuguccgggagggagaagaugauggccgagau

SEQ ID NO: 73425 - RNA, 41 nt, Mus musculus
uccuuuucuccaaaacauccucuccaacauuugcggucagg

SEQ ID NO: 73426 - RNA, 42 nt, Mus musculus
uggcucuugugaagggggcaaugaccuuccggugugggagua

SEQ ID NO: 73427 - RNA, 46 nt, Mus musculus
cugccucaugucacuugcagacagacaggcagaugucauggcgcug

SEQ ID NO: 73428 - RNA, 45 nt, Mus musculus
agccccaucccccgcccacgugcuccucugugcccucaccagccu

SEQ ID NO: 73429 - RNA, 45 nt, Mus musculus
guuugccaaugguugaugcgguuaagcauccaagcggccucuccu

SEQ ID NO: 73430 - RNA, 41 nt, Mus musculus
cuggaucgaguuaaacgaggaggguguagaacauugcagga

SEQ ID NO: 73431 - RNA, 42 nt, Mus musculus
gagcggauggcaugugguucuauucagagaugugccggguaa

SEQ ID NO: 73432 - RNA, 46 nt, Mus musculus
gagaguauauucagggagcagaaagcccaggcucgaaguccaaggg

SEQ ID NO: 73433 - RNA, 45 nt, Mus musculus
ucugcuccuagaaauaugccacuggccuuggacaacagcccucac

SEQ ID NO: 73434 - RNA, 47 nt, Mus musculus
cauacaaauaaaauaacagcuuaauuucugagagagagagagaauga

SEQ ID NO: 73435 - RNA, 45 nt, Mus musculus
aacugaagaaauucaguuccaaccugggcuaaugcuuucccagau

SEQ ID NO: 73436 - RNA, 46 nt, Mus musculus
cacucaguagaggcacucaaaacacauuccacagaaacgcaaaggu

SEQ ID NO: 73437 - RNA, 46 nt, Mus musculus
uuuagagagacugcuuagucuucaggaauacugacuaugguugaga

SEQ ID NO: 73438 - RNA, 46 nt, Mus musculus
caaggcaaaagacaccgucaauaagacacaaagaacaccaacagau

SEQ ID NO: 73439 - RNA, 46 nt, Mus musculus
uguaaagacugugggacuuucaaaguuguguauaucuuggggauga

SEQ ID NO: 73440 - RNA, 45 nt, Mus musculus
ccaagaacagcagcaacaguaaaguacaggcaucuggagccuaga

SEQ ID NO: 73441 - RNA, 42 nt, Mus musculus
cuuuggugauaaauauaaauguagaaagugugagcuggauua

SEQ ID NO: 73442 - RNA, 46 nt, Mus musculus
gcagcaagcauugaucuccaaguacauaaaugaacacauaccagag

SEQ ID NO: 73443 - RNA, 46 nt, Mus musculus
gaagugaugaccuccaaaaacauaaacgaacacauacaggagagaa

SEQ ID NO: 73444 - RNA, 41 nt, Mus musculus
uuccgggucuuccucagucuggauggcauggcgguggcaga

SEQ ID NO: 73445 - RNA, 45 nt, Mus musculus
acaggcagugagaaugauuuuguaauuucacagauuguauaaaag

SEQ ID NO: 73446 - RNA, 41 nt, Mus musculus
auuauagaucucaguaguuaacaaagcacauggggcaaggu

SEQ ID NO: 73447 - RNA, 47 nt, Mus musculus
gaaucugcucuaggugucaccauucuagagaaugauaagugucaggc

SEQ ID NO: 73448 - RNA, 46 nt, Mus musculus
ucauuugagucauauaaugaacuguucauuucuuccaccuucagua

SEQ ID NO: 73449 - RNA, 46 nt, Mus musculus
uuaagaauuuuuacuaauuaauauuuaguuguauaugcagugauuc

SEQ ID NO: 73450 - RNA, 46 nt, Mus musculus
uuaacauguaggugcaagauccauuuggaguuguuuuuguggaggu

SEQ ID NO: 73451 - RNA, 101 nt, Mus musculus
agcucagaacuccagacaugguaagugcaaagucaucugccacagagaggaggagcaagcagcuuagcaagaaaugcacuuguaguuccacuucccagcac

SEQ ID NO: 73452 - RNA, 47 nt, Mus musculus
aucuacccuuuaaaaaacuaagccuauuugauuugguuuauauuaug

SEQ ID NO: 73453 - RNA, 46 nt, Mus musculus
gcaaauccaguuuuguaauaguuacuauucaucuuagccuugaguu

SEQ ID NO: 73454 - RNA, 66 nt, Mus musculus
gagaauacuguacagaagguauuagaguuacaagggccagcuuugaggaaagcuacaagcaggaaa

SEQ ID NO: 73455 - RNA, 42 nt, Mus musculus
aauuccugcauagggcagugauucagcuauccaugcccaggg

SEQ ID NO: 73456 - RNA, 45 nt, Mus musculus
agcagaugggcauagaguuggcgggaauugacagacagacacaga

SEQ ID NO: 73457 - RNA, 46 nt, Mus musculus
aacacaugcgccaccacgccugguuucauuuucauuaaacccuaaa

SEQ ID NO: 73458 - RNA, 45 nt, Mus musculus
gaaauauaauuauauaucccucgucccccucuacagcccacagau

SEQ ID NO: 73459 - RNA, 45 nt, Mus musculus
ccagcuggaggcagggcuacugagccucucagagcaagcauuucg

SEQ ID NO: 73460 - RNA, 47 nt, Mus musculus
ugacucaagugggggaucagccccugggccuucuucccuggguaauu

SEQ ID NO: 73461 - RNA, 46 nt, Mus musculus
caaaacaaccauacaaauaaaauaauagcuuaauuucuuagagaga

SEQ ID NO: 73462 - RNA, 46 nt, Mus musculus
ccccacaaguggacagaugccagaauauuagcaauuaaagaaagau

SEQ ID NO: 73463 - RNA, 42 nt, Mus musculus
gccccugggaguaacuaagauuccagauccaugcugcuuaau

SEQ ID NO: 73464 - RNA, 78 nt, Mus musculus
gucuucucacaucacucaguagaggcacacaaaacacaucacauagaaaugcaaaggucugcugaauuacauggagaa

SEQ ID NO: 73465 - RNA, 44 nt, Mus musculus
cuuguagaccaggcuggucuggaagucagaaaucugccugccuc

SEQ ID NO: 73466 - RNA, 45 nt, Mus musculus
aucuuaauucugggaaggaaaauagaucuuuauggcacaccaggc

SEQ ID NO: 73467 - RNA, 44 nt, Mus musculus
ucccagcaaccacauggguggcucacaaccaucuguaacgagau

SEQ ID NO: 73468 - RNA, 41 nt, Mus musculus
gaauccaugcugucauuaagaaauuuuuccuggggcuggug

SEQ ID NO: 73469 - RNA, 42 nt, Mus musculus
accuuauuccuccuccucuucugugcugcaaguagaccagcu

SEQ ID NO: 73470 - RNA, 45 nt, Mus musculus
uggucauucaugguccuggcuucuccaaacacuacaugaccccug

SEQ ID NO: 73471 - RNA, 46 nt, Mus musculus
ugagacagacagaaaucuuugagaagggcccaugguaaauccagac

SEQ ID NO: 73472 - RNA, 42 nt, Mus musculus
caguugauucagaacuuauaagaguccagcuuucucugugau

SEQ ID NO: 73473 - RNA, 45 nt, Mus musculus
ugguaagugagaguuuggcugguuauaguaacccgggguggcagu

SEQ ID NO: 73474 - RNA, 41 nt, Mus musculus
aagaacauacaauugaagaccauuuucaaacuucuagaagu

SEQ ID NO: 73475 - RNA, 45 nt, Mus musculus
guucuguauucaguuuugugugauuaauuuuaugaauaguuuaga

SEQ ID NO: 73476 - RNA, 46 nt, Mus musculus
ugcguguggauuuacagggguccagaaggcucgguagcccugggag

SEQ ID NO: 73477 - RNA, 45 nt, Mus musculus
aagaccugauucaggcagugagaaugauuuuguaauuucauagac

SEQ ID NO: 73478 - RNA, 46 nt, Mus musculus
gugugguaggucuuuccagcgcauggaugguaagcgucagccaggc

SEQ ID NO: 73479 - RNA, 45 nt, Mus musculus
cuuaggagucuucagugagugcugcgaggguaacucaggcaagau

SEQ ID NO: 73480 - RNA, 42 nt, Mus musculus
acucaguagccaaucagaaacuccacacggagcugccaguca

SEQ ID NO: 73481 - RNA, 41 nt, Mus musculus
ccagauaccccuucucucagaacacuccuucuagcccagga

SEQ ID NO: 73482 - RNA, 46 nt, Mus musculus
agguccugaguucaaagcccagcaaccacauuguagcucacaacca

SEQ ID NO: 73483 - RNA, 46 nt, Mus musculus
ccagcuucagagcugggaaagacacaauaccagccacauaaaagcu

SEQ ID NO: 73484 - RNA, 46 nt, Mus musculus
cagagaaaggagcuucaguugagacaugccuccaugagauccagau

SEQ ID NO: 73485 - RNA, 118 nt, Mus musculus
aaugcagagcagcuaaggcccagcacuuugagaggccauggaaggcaacuggugaaggugcagacucaggugaaauugauggcccaguacugaagagaucaugcaguguuuuggaguu

SEQ ID NO: 73486 - RNA, 47 nt, Mus musculus
ugggcuagaagauucauucuguguuaagaaugcugugggauguugug

SEQ ID NO: 73487 - RNA, 46 nt, Mus musculus
cauuucuaauucuuuaucaucaugaaaauaaucauacaaaggagau

SEQ ID NO: 73488 - RNA, 45 nt, Mus musculus
uuuuauaagucacaguagucuguaagaaaaggagacacaguugag

SEQ ID NO: 73489 - RNA, 46 nt, Mus musculus
aaagccuuugcaggaaggagugaccuuuaaagagaaaagaccauac

SEQ ID NO: 73490 - RNA, 45 nt, Mus musculus
caaagcagucaucuccgaauacauaagcaaacacauacaggagag

SEQ ID NO: 73491 - RNA, 46 nt, Mus musculus
aggaagcagucaucuccgaauacauaagcgaacacauacaggacag

SEQ ID NO: 73492 - RNA, 45 nt, Mus musculus
gccuuugcaagaaguggugaccaacaagaacauaagcgaacacau

SEQ ID NO: 73493 - RNA, 46 nt, Mus musculus
aagaaguggugaccuccaaaaacauaagcgaacacauacaggagag

SEQ ID NO: 73494 - RNA, 41 nt, Mus musculus; identical to SEQ ID NO: 73474

SEQ ID NO: 73495 - RNA, 33 nt, Mus musculus
uguaggguguaacagcagaguuuggaagguuuc

SEQ ID NO: 73496 - RNA, 45 nt, Mus musculus
auguaauaggucuucccagaggcaggaugguaagcaucagccaga

SEQ ID NO: 73497 - RNA, 41 nt, Mus musculus
cauggggggcuggugagauggcucaacagauaagagcaccc

SEQ ID NO: 73498 - RNA, 45 nt, Mus musculus
aaaccuuuguggcagggguuuguguguggaaauacacuuggcagg

SEQ ID NO: 73499 - RNA, 45 nt, Mus musculus
gaauccaauaccuguuuuugccuggauggucuuugagcauuagcc

SEQ ID NO: 73500 - RNA, 49 nt, Mus musculus
uccccgggguggcacugggcuucggggccaaagggaggagaagucgggg

SEQ ID NO: 73501 - RNA, 48 nt, Mus musculus
gcacggacccaacucggugggugguggaaaagggcagcucuaggcacc

SEQ ID NO: 73502 - RNA, 46 nt, Mus musculus
gagaagguuagucaagcucagaacuccaaacaugguaagugccaga

SEQ ID NO: 73503 - RNA, 46 nt, Mus musculus
aauuggaugagaggcacuuguguuaaugaacuucaaaucugcagau

SEQ ID NO: 73504 - RNA, 46 nt, Mus musculus
uacugcccacaaggggguagaagcaggcaguugaauagcaggggug

SEQ ID NO: 73505 - RNA, 50 nt, Mus musculus
ucuuuuuaucauguuauuaauuuuguuuuucuuuucccgugaguuuguga

SEQ ID NO: 73506 - RNA, 46 nt, Mus musculus
acauaauaugggcaugaaauuguaaacucuuuaagucaggauagcu

SEQ ID NO: 73507 - RNA, 46 nt, Mus musculus
uaauccacuuuggguuccaacgcgacugacaagaacugugaaagau

SEQ ID NO: 73508 - RNA, 46 nt, Mus musculus
gcauaccaucauauuaaguaaaauugauaaucauuaucccauagau

SEQ ID NO: 73509 - RNA, 44 nt, Mus musculus
ucuggcagaguguucagauugagaaaaguuugcauuuggauuga

SEQ ID NO: 73510 - RNA, 45 nt, Mus musculus
cagaagaaggagauaaagaauuagagucugaacaugagagugaga

SEQ ID NO: 73511 - RNA, 56 nt, Mus musculus
agagaaaaggaaaagaaaacaaaauauagagauucaaaagauaauauaaagaauga

SEQ ID NO: 73512 - RNA, 77 nt, Mus musculus
aggaaagcaugucagaaacagagagaaauaaaaaggaaggagcgugcagaaaaauaaguaaaggaagagauauaaaa

SEQ ID NO: 73513 - RNA, 48 nt, Mus musculus
auacuggccagucuauccaggacaagaaaugugaaccagcuguuaagg

SEQ ID NO: 73514 - RNA, 49 nt, Mus musculus
agauucagaacucuucagcuggggaacgguguuaccgguaaguauuaag

SEQ ID NO: 73515 - RNA, 41 nt, Mus musculus
gagaaaggucuuuggaggucuuccagaguauuaggaucaga

SEQ ID NO: 73516 - RNA, 46 nt, Mus musculus
cauaucguuaugaguuucaugguaauaccaaauucuucugggagug

SEQ ID NO: 73517 - RNA, 48 nt, Mus musculus
gcugacaaugcaaaucuuggauggaauacacagacuaugauauaagau

SEQ ID NO: 73518 - RNA, 44 nt, Mus musculus
ggauaaguauaccuuugugggucauaauaagaucauggccagua

SEQ ID NO: 73519 - RNA, 45 nt, Mus musculus
ugcauccagugauauuuccaaagguaauggcuaauacuccuauaa

SEQ ID NO: 73520 - RNA, 46 nt, Mus musculus
acaaauagaaggaaaaccuuucaagguauaauggauacaggagcag

SEQ ID NO: 73521 - RNA, 41 nt, Mus musculus
cacacaacuccuuccucucauucaucauuuuuuccacagau

SEQ ID NO: 73522 - RNA, 45 nt, Mus musculus
auucagggaaauaaugagcuguucucugaauuuguggcucacaug

SEQ ID NO: 73523 - RNA, 50 nt, Mus musculus
auuaggauacccaguacaggucuaugaucaaaccaaucaggcagcaguga

SEQ ID NO: 73524 - RNA, 47 nt, Mus musculus
auauuaugagccaauaucgcauaaacaggugaaagagcagagucagu

SEQ ID NO: 73525 - RNA, 46 nt, Mus musculus
gaguuucggugcucccccaccuacucugccuuaugcagauaagaaa

SEQ ID NO: 73526 - RNA, 48 nt, Mus musculus
uuagaauugucuagcucaguggauucggaauuaucagcaggggaggag

SEQ ID NO: 73527 - RNA, 45 nt, Mus musculus
gccuugauuuuaugccauugccuuaauugucaaugcccaaaaugu

SEQ ID NO: 73528 - RNA, 65 nt, Mus musculus
ggugugcauucagaacucuucagcuggggaauggugguaccaguaaguauaaagaaauuaaugug

SEQ ID NO: 73529 - RNA, 100 nt, Mus musculus
aguggugccgaagacccaguaaaagaaacaucuucaggcaguagaaaagacccccugcuacagggaggauucagaauugcaucguggggaaggagcgggu

SEQ ID NO: 73530 - RNA, 47 nt, Mus musculus
cacuucgccucuacaaucaaucucuccaaauaaaugugugcggaagg

SEQ ID NO: 73531 - RNA, 45 nt, Mus musculus
uguaaagacugugggacuuucaaagguguguauaucuuggggaug

SEQ ID NO: 73532 - RNA, 42 nt, Mus musculus
acugguuuugaagguaugacggaaucaugcagaacagccgag

SEQ ID NO: 73533 - RNA, 44 nt, Mus musculus
ggaauauugaugauaguuagcuggagcuaagaauuuagcaguga

SEQ ID NO: 73534 - RNA, 48 nt, Mus musculus
uuaagaacucugugugaugacugugugggauguuguguaggagcuugg

SEQ ID NO: 73535 - RNA, 46 nt, Mus musculus
uaugaaggcaucuaauguuauaaagccuuugcagcaagcauggauc

SEQ ID NO: 73536 - RNA, 46 nt, Mus musculus
uaagaaguggugaccuccaaauacauaagcgaacacauacaggaga

SEQ ID NO: 73537 - RNA, 46 nt, Mus musculus
auaagaaguggggaccuccaaauacauaagcgaacacauacaggag

SEQ ID NO: 73538 - RNA, 46 nt, Mus musculus; identical to SEQ ID NO: 73536

SEQ ID NO: 73539 - RNA, 46 nt, Mus musculus; identical to SEQ ID NO: 73537

SEQ ID NO: 73540 - RNA, 46 nt, Mus musculus; identical to SEQ ID NO: 73536

SEQ ID NO: 73541 - RNA, 50 nt, Mus musculus
ccuuugcaggaaguggugacuuccaaaaacauaaacgaagacaaagagga

SEQ ID NO: 73542 - RNA, 46 nt, Mus musculus
auuugggaaggacauacaagugaagaccauuuccaaacuucuagaa

SEQ ID NO: 73543 - RNA, 82 nt, Mus musculus
uuacuugaggucuaagacacagacauguggcuagaagggaaggggagauggaaauggucuuucguaucuacagguggcauua

SEQ ID NO: 73544 - RNA, 45 nt, Mus musculus
aagacagacuacuuagucuucaggaggccugacuaugguugagaa

SEQ ID NO: 73545 - RNA, 45 nt, Mus musculus
auucuguauucaguuuugugugauuaauuuuaugaauaguguaga

SEQ ID NO: 73546 - RNA, 46 nt, Mus musculus
ucacuaugcaguguguauauacaggcauugccuuuguugugcagua

SEQ ID NO: 73547 - RNA, 46 nt, Mus musculus
accacaagucauucccugguuauuauaguaaucuccauugacagua

SEQ ID NO: 73548 - RNA, 42 nt, Mus musculus
cagcugucugagucuuuugcucugugauccuacagugaagga

SEQ ID NO: 73549 - RNA, 46 nt, Mus musculus
gugugguaggucuuuccagcgcauggaugguaagcgucagccagga

SEQ ID NO: 73550 - RNA, 46 nt, Mus musculus
ucuuaggugucuucagugagugcugcgaggguaacucaggcaagau

SEQ ID NO: 73551 - RNA, 43 nt, Mus musculus
agacucaguagccaaucagaaccuccacacggagcugccaguc

SEQ ID NO: 73552 - RNA, 46 nt, Mus musculus
ucauaaccuucacguggaacauacaugcaguggaccugaacccagu

SEQ ID NO: 73553 - RNA, 46 nt, Mus musculus
acuccaucuuguguugaagauucauguaaagaauugaggcccaaaa

SEQ ID NO: 73554 - RNA, 46 nt, Mus musculus
gaacaagcuccagucagagacagcuagaacaucuaacaccagagau

SEQ ID NO: 73555 - RNA, 42 nt, Mus musculus
aaaagugacagaauuuguccaaagaaaaacaaagcaggggcu

SEQ ID NO: 73556 - RNA, 46 nt, Mus musculus; identical to SEQ ID NO: 73483

SEQ ID NO: 73557 - RNA, 60 nt, Mus musculus
ugagaggucauggaaggcaacuggugaaggugcagacucaggugaaauugauggcccagu

SEQ ID NO: 73558 - RNA, 42 nt, Mus musculus
uguaggagcuuggaagauaauguugagaaccgugcagaagau

SEQ ID NO: 73559 - RNA, 45 nt, Mus musculus; identical to SEQ ID NO: 73490

SEQ ID NO: 73560 - RNA, 45 nt, Mus musculus
acugaaugcugugagguuagcucaggcaagcuuagaacuucagac

SEQ ID NO: 73561 - RNA, 52 nt, Mus musculus
acaagagcuaggucacagaccaaaggaaaggggaguaugcugcaggggccac

SEQ ID NO: 73562 - RNA, 46 nt, Mus musculus
acuuacauauaauaaauaaaaaaaucuuuaaaaaaaaaaaaaaaaa

SEQ ID NO: 73563 - RNA, 45 nt, Mus musculus
cagcaaccacaugguggcucacaaccaucugaaacaagaucaaga

SEQ ID NO: 73564 - RNA, 46 nt, Mus musculus
uaauuaauauuuuaguuguauauggagagauuuuuucuggggugac

SEQ ID NO: 73565 - RNA, 48 nt, Mus musculus; identical to SEQ ID NO: 73501

SEQ ID NO: 73566 - RNA, 46 nt, Mus musculus
gagaagguuagucaagcucagaacuccaaacaugguaagugccagg

SEQ ID NO: 73567 - RNA, 45 nt, Mus musculus
ggugcugggagucacugcuguucaaauaggcugcccagaguaagg

SEQ ID NO: 73568 - RNA, 45 nt, Mus musculus
ggaauacacacaccaugauauaagauuagacggaggggaggauug

SEQ ID NO: 73569 - RNA, 46 nt, Mus musculus
uacauauaauaaauaaauaaaucuuuaaaaaaagaagugcacagaa

SEQ ID NO: 73570 - RNA, 46 nt, Mus musculus
cccugucucgaaaaaacaaaacaaaacaaaaaagaauuggagagaa

SEQ ID NO: 73571 - RNA, 42 nt, Mus musculus
aaaaaaagccgggcaugguggugcacgccuuuaaucccagca

SEQ ID NO: 73572 - RNA, 45 nt, Mus musculus
gaaagcaaauaaccuaaguauauuuagaaaacgauaacuuaagaa

SEQ ID NO: 73573 - RNA, 42 nt, Mus musculus
aggacuuuuagauugcacaagcaagggaauaagggggacaaa

SEQ ID NO: 73574 - RNA, 50 nt, Mus musculus
agauuucauagugaggagaugguugauuuggauggaucugugggcuguag

SEQ ID NO: 73575 - RNA, 42 nt, Mus musculus
gucagacccaugcaggcauugcuaaauggacuuaguagggau

SEQ ID NO: 73576 - RNA, 46 nt, Mus musculus
uuuugcagagaaccuguauucucuguaucuacacauaggcucagaa

SEQ ID NO: 73577 - RNA, 45 nt, Mus musculus
ggauuggggagcagggugaggacggagguuauaggggauuuucgg

SEQ ID NO: 73578 - RNA, 46 nt, Mus musculus
uggugguacuccugucuuauggccuaguaagccaucaaugugagga

SEQ ID NO: 73579 - RNA, 46 nt, Mus musculus
agaggaggaaccagaguaaauacuuagaacuauagauugcugaguu

SEQ ID NO: 73580 - RNA, 44 nt, Mus musculus
aucuuuaaaucacauaauuauaaacaaaauaagugcuccuaaga

SEQ ID NO: 73581 - RNA, 45 nt, Mus musculus
ugcuacauccaauccaguagugagaagcgcaacaggccccgaaaa

SEQ ID NO: 73582 - RNA, 46 nt, Mus musculus
cucagcagguuugcauauuaggcagaguauaggcauuacucaggaa

SEQ ID NO: 73583 - RNA, 72 nt, Mus musculus
cugcucucaacauuaucuuucaagcuccuacacaacaucccacagaguucuuaacaccgaauggaucuucug

SEQ ID NO: 73584 - RNA, 48 nt, Mus musculus
ccagaaccacagaucuucacaauccaaaauagaaauggcccucaaaag

SEQ ID NO: 73585 - RNA, 59 nt, Mus musculus
aucucuagaacacugccucugugcucucagaaaacacuucccauaugaugccaccucaa

SEQ ID NO: 73586 - RNA, 68 nt, Mus musculus
accaguaccaccuggguaccucuuacacauuaccaaguccagccagagcacaagauacaaccuugacu

SEQ ID NO: 73587 - RNA, 46 nt, Mus musculus
uaaaguauauucucccuucaagagggaaaaauauuagcgcacaguc

SEQ ID NO: 73588 - RNA, 45 nt, Mus musculus
ucacuaguaauccucaaaccuuaguuucuuauucauccccuagau

SEQ ID NO: 73589 - RNA, 45 nt, Mus musculus
gugagccaccaugugguugcuggaauuugaacuccagaccuucgg

SEQ ID NO: 73590 - RNA, 45 nt, Mus musculus
cuguguaucuuuauuugaggaucuaaagcauuugcaugcucagug

SEQ ID NO: 73591 - RNA, 45 nt, Mus musculus
agagacuuuaguaaguaauaauucaggauuaucacagaaaagaau

SEQ ID NO: 73592 - RNA, 46 nt, Mus musculus
guggaugcaggcuugagagcugggaauggcagaauaccagccaugu

SEQ ID NO: 73593 - RNA, 50 nt, Mus musculus
caccucacacaauaauagugggagacuucaacacacagcucucaucaagg

SEQ ID NO: 73594 - RNA, 46 nt, Mus musculus; identical to SEQ ID NO: 73442

SEQ ID NO: 73595 - RNA, 45 nt, Mus musculus
ggcuuugcacgaaguggugaccuccaaaaacauaaacaaacacau

SEQ ID NO: 73596 - RNA, 47 nt, Mus musculus
caaaugagagugguagucaaaggcaucaaauaaaacauacuggagag

SEQ ID NO: 73597 - RNA, 46 nt, Mus musculus
aaaucaaauuuuaaaagaauucauacagauaaaaagacucaucagu

SEQ ID NO: 73598 - RNA, 46 nt, Mus musculus
gaguaaccuuuuaugggaaaauuauguuauaaaugugagccagaua

SEQ ID NO: 73599 - RNA, 47 nt, Mus musculus
aaauauguaauuauuguuugcaaggcauucuauuaguucaaagguag

SEQ ID NO: 73600 - RNA, 61 nt, Mus musculus
acauuugggaagaacauacaagugaagaccauuuucaaacuucuagaagucauggaaggua

SEQ ID NO: 73601 - RNA, 45 nt, Mus musculus
ugucuauguuauuguaauuaguucuuauaauuucaauugagagug

SEQ ID NO: 73602 - RNA, 47 nt, Mus musculus
agaauuuaaucaccuaugaugacgugcaugugaacuucacucaggaa

SEQ ID NO: 73603 - RNA, 48 nt, Mus musculus
caugguuccauacacaacaucuuaauacuaaggcaucagguucccaga

SEQ ID NO: 73604 - RNA, 70 nt, Mus musculus
uggucuuggggaaaacugucuaugguugagaagagggugucugcccauacuugggggcuaauaagagaag

SEQ ID NO: 73605 - RNA, 47 nt, Mus musculus
uguguugcauuucugugggcuacuaugaaaacugugucuaggauaac

SEQ ID NO: 73606 - RNA, 71 nt, Mus musculus
aucaguaguaacuagggucaaauuuauaacaguuuaggggugacuuugaguuaucuuuauuggagucauga

SEQ ID NO: 73607 - RNA, 47 nt, Mus musculus
ugugacuaauuuuauaaaauaguuuagaaguuaguuguaaagaucga

SEQ ID NO: 73608 - RNA, 44 nt, Mus musculus
aguguggauuuacagggguggggguggcucgcuaggccugggag

SEQ ID NO: 73609 - RNA, 45 nt, Mus musculus
ccacaagccauccccugguuauuauaguaauguccauugagagua

SEQ ID NO: 73610 - RNA, 45 nt, Mus musculus
agcuggguuuuccaugcuaaugagggacucugggcaggccuaacc

SEQ ID NO: 73611 - RNA, 86 nt, Mus musculus
agauggcuguaguggguauugcaugcauaauugaauguacaaagaaaggaugcugggccuuuaaaauggaaaauacuuggucuaca

SEQ ID NO: 73612 - RNA, 46 nt, Mus musculus
ucacuuuuaaauuauuguuaauguaugaauuucauugcagguuuuu

SEQ ID NO: 73613 - RNA, 46 nt, Mus musculus
ucauuugaguuauauaaugaacuguucauuucuuccaccuucagua

SEQ ID NO: 73614 - RNA, 63 nt, Mus musculus
uaagaauuuuuacuaauuaauauuuuuguuguguaugcagugauuacuuucugggaugacaug

SEQ ID NO: 73615 - RNA, 45 nt, Mus musculus
uuguucaaaauaaccuggggacugaacuggaaagaaacuuaugga

SEQ ID NO: 73616 - RNA, 78 nt, Mus musculus
auguuauuuucucuaaguucugcccuuagcaguuaacauguaggugcaagauccauuuggaguuguuuuuguggaggu

SEQ ID NO: 73617 - RNA, 103 nt, Mus musculus
caaacucaaaacuccagacaugguaagugcaaagucaucugccacagagaggaggagcaagcagcuuagcaagaaaugcacuuguaguaccacuucccagcac

SEQ ID NO: 73618 - RNA, 41 nt, Mus musculus
ugaacugcaaaucucuagaucuggaaaaugauuggcccagg

SEQ ID NO: 73619 - RNA, 46 nt, Mus musculus
agcugauuuaugggcuauguaagauauccagcuugauucuaggagg

SEQ ID NO: 73620 - RNA, 52 nt, Mus musculus
guaucuacccuuuaaaaaacuaagccuauuugauaugguuuauauuauggaa

SEQ ID NO: 73621 - RNA, 41 nt, Mus musculus
gccaucauaugguugcaaggauuugaacucaggaccuuaag

SEQ ID NO: 73622 - RNA, 45 nt, Mus musculus
aaagaagcuauguguguugcaggugacagagcuggagaagugaga

SEQ ID NO: 73623 - RNA, 55 nt, Mus musculus
guacagaagguauuagaguuacaagggccagcuuugaggaaagcuacaagcagga

SEQ ID NO: 73624 - RNA, 44 nt, Mus musculus
gagccaccaugugguugcugggauuugacucaggaccuucagau

SEQ ID NO: 73625 - RNA, 46 nt, Mus musculus
uucuuacugucuucagugagugcugcgaggguagcucaggcaagcu

SEQ ID NO: 73626 - RNA, 44 nt, Mus musculus
agacucaguagccaaucagaacccccacacggagcugccaguca

SEQ ID NO: 73627 - RNA, 44 nt, Mus musculus
cuuaaugauucuuacacagaacagaggaaugaaaacgcaaagau

SEQ ID NO: 73628 - RNA, 107 nt, Mus musculus
aggcaguguuggaagugggagacaggauggggaggacagugagauagcugggaggagggggggcaagugauuaagaagggaacuagugggaagagggaggcaggagg

SEQ ID NO: 73629 - RNA, 44 nt, Mus musculus
agugggguucauguaugaaugugugugugucugugugugugugu

SEQ ID NO: 73630 - RNA, 45 nt, Mus musculus
uauguguguggaagggagcaugugugcaagucagggucagguaug

SEQ ID NO: 73631 - RNA, 42 nt, Mus musculus
gaaugucugucugugaaguuguugcaggggugcauuuguguu

SEQ ID NO: 73632 - RNA, 45 nt, Mus musculus
gcauguguguggagauguaugugauccuguuuguauuugagcaug

SEQ ID NO: 73633 - RNA, 45 nt, Mus musculus
uguaaauaaagaaaauauucaauaaaaaauaaggagcugucaaug

SEQ ID NO: 73634 - RNA, 47 nt, Mus musculus
uagccagugcugcaaaaucaacaugcacacacauauacugacagagg

SEQ ID NO: 73635 - RNA, 45 nt, Mus musculus
caaaauacagaggcugaauaaacauacaaauaaauuucuuugaga

SEQ ID NO: 73636 - RNA, 95 nt, Mus musculus
cagccggguccaaggagagacuagguccacaaaggagcacacagguggccccauaugccuggcugaugcuuaccauccaugcgcuggaaagaccu

SEQ ID NO: 73637 - RNA, 26 nt, Mus musculus
uugucagcacugcuuuaccugacagu

SEQ ID NO: 73638 - RNA, 45 nt, Mus musculus
uaagaauuccuaaaauuauaucagugauuauuaaacucuuuuaug

SEQ ID NO: 73639 - RNA, 45 nt, Mus musculus
uuauaugccucaauacaggggaaccccaggaccaagaagugggau

SEQ ID NO: 73640 - RNA, 67 nt, Mus musculus
agaaguugaugcucacagucagcuauuggaugggcccaauggaggagcuagagaaaguacccaagga

SEQ ID NO: 73641 - RNA, 46 nt, Mus musculus
auaaucagccuccaaacgcugacaccaauacauauacuagcaagau

SEQ ID NO: 73642 - RNA, 46 nt, Mus musculus
cuguuauuuauuaaaugcaggucuugugccuuuucaugugaccaaa

SEQ ID NO: 73643 - RNA, 42 nt, Mus musculus
acaccuguguggguccuuuagacccugacaggcaagggugaa

SEQ ID NO: 73644 - RNA, 44 nt, Mus musculus
ugaaaagacuguuauagauccugggggcagggcugccucagggg

SEQ ID NO: 73645 - RNA, 47 nt, Mus musculus
uaacucaucccgugccauaacuuugaagucuguuucacucagucgga

SEQ ID NO: 73646 - RNA, 46 nt, Mus musculus
ggcauucuuuuaaagaugagguaaagaagcauucugcacacuaagg

SEQ ID NO: 73647 - RNA, 45 nt, Mus musculus
ugaagacaucuuggcacaugucucuagugccagcuacacaaucag

SEQ ID NO: 73648 - RNA, 42 nt, Mus musculus
ggaacauuugcuacugguugcuugguuugguuugacugguug

SEQ ID NO: 73649 - RNA, 46 nt, Mus musculus
gagcuuccauaucugacucaguguucauuauuaauuaauuacagag

SEQ ID NO: 73650 - RNA, 42 nt, Mus musculus
uuucuuaacuuuaauuucuaauugauugauaugcuuggccca

SEQ ID NO: 73651 - RNA, 46 nt, Mus musculus
agacggggccacacagaaaacccuguugggaaaaacaauuaaaaag

SEQ ID NO: 73652 - RNA, 46 nt, Mus musculus
gcaucagauuacaugugguugcugggacuugaacucaggaccucua

SEQ ID NO: 73653 - RNA, 42 nt, Mus musculus
auggugggaagcauaguggcauucagacagacauggugcugg

SEQ ID NO: 73654 - RNA, 46 nt, Mus musculus
gcugucagacacagaauccauccccaugcauugugggguccaacag

SEQ ID NO: 73655 - RNA, 46 nt, Mus musculus
uuacaaccaucuguaauggggucugacgcccucuucuggugugucu

SEQ ID NO: 73656 - RNA, 42 nt, Mus musculus
guuuggggaccuuuuguuuauuuuugugguaugcggcaucag

SEQ ID NO: 73657 - RNA, 46 nt, Mus musculus
uuauacacauaaaauaaauaacuauuuuaaaaaucagaugcuaggg

SEQ ID NO: 73658 - RNA, 46 nt, Mus musculus
aggaaggaaggaaggaaggaaagaaagaaaggaaagaaagcaagca

SEQ ID NO: 73659 - RNA, 46 nt, Mus musculus
cucucgggggugcaggaggaaaaggcaaucguuucuuccuggccaa

SEQ ID NO: 73660 - RNA, 76 nt, Mus musculus
uugaacccucacguggggaucguucacuaugaaggccaccaacagguagcagguagagccucuaaaacccugccag

SEQ ID NO: 73661 - RNA, 63 nt, Mus musculus
gaugcagaauucaccccuucucacugcacaugagggaagcugcaagucugcaguggggugggg

SEQ ID NO: 73662 - RNA, 78 nt, Mus musculus
gaaggcagagccgcugcgcuagagcgagagggaagaugggaguggacuuggggcgcaggaaagcgugagggggggggg

SEQ ID NO: 73663 - RNA, 42 nt, Mus musculus
gggucuguucagcgacagauccaguggcuguggugguuguug

SEQ ID NO: 73664 - RNA, 45 nt, Mus musculus
gguaccuccuucacaggagaggugagcaucuguaggaaaaaugag

SEQ ID NO: 73665 - RNA, 46 nt, Mus musculus
aacuaaaagacaucaucaacuaaaggcugcaauugcagcccugaag

SEQ ID NO: 73666 - RNA, 46 nt, Mus musculus
ggggucugugaguggcuuccagggcagacccagagucaggcucgag

SEQ ID NO: 73667 - RNA, 45 nt, Mus musculus
caggcaacgagucuguaucuuuagugugugguacuaauauuugua

SEQ ID NO: 73668 - RNA, 41 nt, Mus musculus
ggggugaggaagccguguacacuugugcagugcuucaggca

SEQ ID NO: 73669 - RNA, 46 nt, Mus musculus
cccgagaagcccucucccuggggacacuccugacuucccugcccuu

SEQ ID NO: 73670 - RNA, 42 nt, Mus musculus
ugaucugggaccaucugagcacuauguacgacaugcaggcac

SEQ ID NO: 73671 - RNA, 46 nt, Mus musculus
ucuuccauucccaaauccagagaggaacuuuguccuuccagaugag

SEQ ID NO: 73672 - RNA, 23 nt, Mus musculus
uggguuuccagugaacggcagcu

SEQ ID NO: 73673 - RNA, 45 nt, Mus musculus
uggggccaggggaccaagagucagcaagcaauaagacgccacccu

SEQ ID NO: 73674 - RNA, 45 nt, Mus musculus
aagaagccuauuuuacuaguguuuuguaugaagaaaaauacugca

SEQ ID NO: 73675 - RNA, 75 nt, Mus musculus
auaugccagauacagagaauuuuuagcgguuauuuuuguaauuuuaguaacuuggaaaagaccaaaaaagggagu

SEQ ID NO: 73676 - RNA, 42 nt, Mus musculus
uauggacgacccggaaugcgauuccaccugggaggacgagag

SEQ ID NO: 73677 - RNA, 43 nt, Mus musculus
ugauacgaccgaugaggacacgggcgacgaugacggcgacgcg

SEQ ID NO: 73678 - RNA, 35 nt, Mus musculus
ggucaaaugcaggcucugaugcuugcuucgcccag

SEQ ID NO: 73679 - RNA, 41 nt, Mus musculus
ggccccagacuauaucccggccacugaugggacuagggcag

SEQ ID NO: 73680 - RNA, 46 nt, Mus musculus
auggggaccaaaggcaugaggcuaaguccccgagucccaaagaaag

SEQ ID NO: 73681 - RNA, 42 nt, Mus musculus
cggcgccgggaaagguuaucaagcaaggcuaaggacagagac

SEQ ID NO: 73682 - RNA, 46 nt, Mus musculus
cacuagacauuauguuaggguguuaaaaaggacacagcaaucaaaa

SEQ ID NO: 73683 - RNA, 39 nt, Mus musculus
cucguugaacaugcaaguuauugagcuuuuccauccauu

SEQ ID NO: 73684 - RNA, 46 nt, Mus musculus
ucgcucaucaaguguuucuagguccacacuugguucgaucccagac

SEQ ID NO: 73685 - RNA, 41 nt, Mus musculus
ugucugggcaaacuccaaugcugcuucugucucacgcugac

SEQ ID NO: 73686 - RNA, 46 nt, Mus musculus
ugcuuaagacaucuuuuuuucccccagugcuagggcgagaccccag

SEQ ID NO: 73687 - RNA, 46 nt, Mus musculus
cuccauaccuagaaaagaaacacaucuaauagagaugccccccccc

SEQ ID NO: 73688 - RNA, 50 nt, Mus musculus
acaggggaaagguucucuacuguggugacaaucugccagucacagccgga

SEQ ID NO: 73689 - RNA, 46 nt, Mus musculus
cuguccaggagguaaggaaagcucugcucacuccuuacucacagac

SEQ ID NO: 73690 - RNA, 45 nt, Mus musculus
cucuccugaaacuccucuaccuuauucuuauccuuaccccagaug

SEQ ID NO: 73691 - RNA, 60 nt, Mus musculus
gguuaagaagacaugacaaauaaucaugaagaccagaguccggcacccagaaaagucagg

SEQ ID NO: 73692 - RNA, 94 nt, Mus musculus
aagaacacacacacacauacacacacgucuuuuuuuaaggcagaggaaaaggaaguuuuaauuuucagguagcuaauagauuaaaugaaacaga

SEQ ID NO: 73693 - RNA, 46 nt, Mus musculus
gccaggcaugguggcuccugccugcaauuacagcauuuacaaggcu

SEQ ID NO: 73694 - RNA, 48 nt, Mus musculus
gcuaaucacuuugacguguucuuaaaauuagagggcaugagauguaua

SEQ ID NO: 73695 - RNA, 41 nt, Mus musculus
gacaacccacagggcagcaccgcccaaguccacgugucagu

SEQ ID NO: 73696 - RNA, 77 nt, Mus musculus
guuaucuggaagaguccagacaacauggcuggcagaauagaaugggccuugagaggagucugcaaggagaaggaaag

SEQ ID NO: 73697 - RNA, 46 nt, Mus musculus
uguuucgccuacaagggucacagcaggcccacuaaaagccacacaa

SEQ ID NO: 73698 - RNA, 46 nt, Mus musculus
gguauuguccugagccaaccuugccauuggauuacugggaacacag

SEQ ID NO: 73699 - RNA, 51 nt, Mus musculus
aggaauaaagaggcacggaccuugaugggcaguggucagaauggaggaggg

SEQ ID NO: 73700 - RNA, 46 nt, Mus musculus
gggggacccaaggcuguagcugggcuggguccagaaucccacagag

SEQ ID NO: 73701 - RNA, 45 nt, Mus musculus
gccucuaccuccugagugcuggaauuaaaggcacagguugcaagc

SEQ ID NO: 73702 - RNA, 32 nt, Mus musculus
agugguguggugacaguaaugaagccccaggc

SEQ ID NO: 73703 - RNA, 45 nt, Mus musculus
aggcaaaaugccucuaccccaagacauagcacccugcagccagau

SEQ ID NO: 73704 - RNA, 59 nt, Mus musculus
ugcauagcugcagacaccaggccccacauuacauagcugcagacaccaggccccacaac

SEQ ID NO: 73705 - RNA, 46 nt, Mus musculus
uggggugugugugugugugugugugugugugugugugugucggggg

SEQ ID NO: 73706 - RNA, 37 nt, Mus musculus
agaacuucaaacuggccuacaauuugccacguggacg

SEQ ID NO: 73707 - RNA, 29 nt, Mus musculus
gagcacaacugggagcagauugccgcccu

SEQ ID NO: 73708 - RNA, 46 nt, Mus musculus
gucuguaaggacauugcuucaugggcugcaaguguggccccuggag

SEQ ID NO: 73709 - RNA, 45 nt, Mus musculus
cauaugacucacccugacuuggaccccccaguguucugaguaaga

SEQ ID NO: 73710 - RNA, 46 nt, Mus musculus
ucgucagggaguuagagguccucaugaguggggaccagguccaccc

SEQ ID NO: 73711 - RNA, 45 nt, Mus musculus
cauggucuaaugucuauagacaucuuagguuauuguugcuggaga

SEQ ID NO: 73712 - RNA, 45 nt, Mus musculus
gaccaaacccuaacuucucuccaauauccaaaguuuaccacacag

SEQ ID NO: 73713 - RNA, 46 nt, Mus musculus
gaaugccugggcuucuaacuuaugccugagugagucaugccaguaa

SEQ ID NO: 73714 - RNA, 44 nt, Mus musculus
uuuuguuucagacagcuacaguaaacaacuauuuccuaacauca

SEQ ID NO: 73715 - RNA, 42 nt, Mus musculus
uauccucuucucaucagggcacugcucuuucgugugggggaa

SEQ ID NO: 73716 - RNA, 45 nt, Mus musculus
cuccuugguaaauggcuccuguacugugcaaggccaccacuguua

SEQ ID NO: 73717 - RNA, 48 nt, Mus musculus
guccacaguaugugugaucugggguccacuuguggcaggccccaagau

SEQ ID NO: 73718 - RNA, 70 nt, Mus musculus
uggcugugguugugaugucuguguuuaucuucagugcucaggagaaucgcuauguaggguuugggaacac

SEQ ID NO: 73719 - RNA, 45 nt, Mus musculus
ugauaccagaucuucaaaauacguauaacuaaguagggugugcaa

SEQ ID NO: 73720 - RNA, 24 nt, Mus musculus
uugggucuucagucuugaaauagu

SEQ ID NO: 73721 - RNA, 46 nt, Mus musculus
uugggccacagccugaaugagaauguucucaagccugcacaggaga

SEQ ID NO: 73722 - RNA, 54 nt, Mus musculus
ugggaaauggguacgcuggggaucagcaaaaucuugccucuaauuuucucuggu

SEQ ID NO: 73723 - RNA, 46 nt, Mus musculus
uggagacaacucucagaacagcaacauagaccagagcuucugggag

SEQ ID NO: 73724 - RNA, 42 nt, Mus musculus
uccgcauccaacaacaagaacagcaauagcgauggcugggag

SEQ ID NO: 73725 - RNA, 46 nt, Mus musculus
gcuguguuugcacuuugcccuucuuguuccuccugcauuugaccuc

SEQ ID NO: 73726 - RNA, 44 nt, Mus musculus
caaaggaauuuuccacuauuaagaagaaagacuguuggucugga

SEQ ID NO: 73727 - RNA, 45 nt, Mus musculus
ggacaaaggggagaccagugcagaccuccaggaggccaagcucag

SEQ ID NO: 73728 - RNA, 45 nt, Mus musculus
cgcugggcuugagauucgugucccaguaggcuacuagggugagag

SEQ ID NO: 73729 - RNA, 44 nt, Mus musculus
ucaccaccggauccgccaggcccccaacccauaugcagcagaga

SEQ ID NO: 73730 - RNA, 46 nt, Mus musculus
uuagcaucgccuugggccugccuaucccugagauccgcuggccaau

SEQ ID NO: 73731 - RNA, 41 nt, Mus musculus
caggauuacagccagaugguggaccuuauugcugcagauga

SEQ ID NO: 73732 - RNA, 46 nt, Mus musculus
ucaugaucccuaucaacgguucugugacuaagauuuuuguggcaga

SEQ ID NO: 73733 - RNA, 45 nt, Mus musculus
uguguugaagaggaggaggcacgaauuggccuuugugugucggau

SEQ ID NO: 73734 - RNA, 31 nt, Mus musculus
cugaacugugggauggcauucacgggggaug

SEQ ID NO: 73735 - RNA, 41 nt, Mus musculus
aacuccaagcaauuccgccgcugcagcuuccuacaggagac

SEQ ID NO: 73736 - RNA, 46 nt, Mus musculus
gcacaaauuucucuaugaggaggaagcagcccagcagcagcuagua

SEQ ID NO: 73737 - RNA, 61 nt, Mus musculus
uguauaaaaaaaccccuaguuuauauaccuagggacgacauuuuaagaggcgauuuugugu

SEQ ID NO: 73738 - RNA, 65 nt, Mus musculus
cgugcucuuuggggagagaauuagggacucauucguuuaggcuccaacuuguguuauauggcugg

SEQ ID NO: 73739 - RNA, 125 nt, Mus musculus
uuccuugugucuaggagaugauuucuccgaauucauuaagugcaucuucggaaaaauaaugcaaaagguagcuuuaauuuguuuucagauuggacuuuggggaaauugggucgccguuuguugga

SEQ ID NO: 73740 - RNA, 159 nt, Mus musculus
cucuauaaaaugaggggaaauuuuucuaucauaucugcuuguuauggaagcaaaaaaugauaaauaggagguauuuuacugauaguuuuccuaaauagaaaggacaaagaugcuaaaaauggugauggccuuauuuuguaaaaauccuaccccuaaaac

SEQ ID NO: 73741 - RNA, 46 nt, Mus musculus
ggcaacccugacaaggauuaacagcuaaucugauaacuggcaacua

SEQ ID NO: 73742 - RNA, 46 nt, Mus musculus
cuuuaguguggguuucgcuccuccugacacuuugcauuaacuugag

SEQ ID NO: 73743 - RNA, 46 nt, Mus musculus
cuaaaaaagccauacuuucuuauagugccacucccuaugggccaag

SEQ ID NO: 73744 - RNA, 24 nt, Mus musculus
augguauuacagaucugagcuaac

SEQ ID NO: 73745 - RNA, 46 nt, Mus musculus
ggucuuguucuuuccuaaccugauuuuaagccugcuauguagccgg

SEQ ID NO: 73746 - RNA, 42 nt, Mus musculus
uccugccuuaaugauaauggauugaaacucugaaccuguaag

SEQ ID NO: 73747 - RNA, 46 nt, Mus musculus
ucugucaggcuauugguguaguguaguugcaguggaagaccccagu

SEQ ID NO: 73748 - RNA, 45 nt, Mus musculus
gguuaugagccaccaugugguugcugggguuugaacuccggaccu

SEQ ID NO: 73749 - RNA, 45 nt, Mus musculus
auuuucuugaaggacuuccucaaaugcugguuuuauaugggacaa

SEQ ID NO: 73750 - RNA, 46 nt, Mus musculus
ggaaaugagagaauguguaguuauauaaggucaaguccaguccaag

SEQ ID NO: 73751 - RNA, 107 nt, Mus musculus
cacaaaugcacguacacaaauaaaaggugcuaaaucuauucaaacuagauguagaggugaauacuuuuaaccggguaccuggggaaguggaagaaauugaccaucag

SEQ ID NO: 73752 - RNA, 81 nt, Mus musculus
ucgaacucagaaauccaucuuccucugccucccaagcauugagauuaaaggugugugccaccaugcccagcuguguuuucu

SEQ ID NO: 73753 - RNA, 56 nt, Mus musculus
uauaguagaaguauuugcacacacauuuggcagaaacauauagagaucaaagguug

SEQ ID NO: 73754 - RNA, 46 nt, Mus musculus
ggcugcuggguugugugcugcugagaucauuuuuauaugguugcug

SEQ ID NO: 73755 - RNA, 46 nt, Mus musculus
acaguggaaacauacucuggguauaucuuugaggguguuugcugaa

SEQ ID NO: 73756 - RNA, 24 nt, Mus musculus
uugaaugguugguuuuuacagcac

SEQ ID NO: 73757 - RNA, 45 nt, Mus musculus
augauauucugcuguacucauagauuagugccuuguccagucauu

SEQ ID NO: 73758 - RNA, 44 nt, Mus musculus
aaucauuauaccauguucuuggacuggacaagaaugcaaccuca

SEQ ID NO: 73759 - RNA, 42 nt, Mus musculus
ucuauguagugaauucuagaauagccaggauuauguagacag

SEQ ID NO: 73760 - RNA, 49 nt, Mus musculus
aucacccugacaagaacccugauaacccagaggcugcagacaaguuuaa

SEQ ID NO: 73761 - RNA, 45 nt, Mus musculus
agcaggugcagggagcuguuccugcccaugaacugguagccguag

SEQ ID NO: 73762 - RNA, 44 nt, Mus musculus
gcaucuggccacugcaaccuuagaaucaugaacuguagucacug

SEQ ID NO: 73763 - RNA, 84 nt, Mus musculus
aauaaaugauguugaacuugaaacccuccauauguagaucaguuucaaagugauaauagugauugccacggccaguaaguaccc

SEQ ID NO: 73764 - RNA, 74 nt, Mus musculus
ugaccugucccugugcagacucccuugcaggguuuuacuauguugaucuaaggucuccuugauuucauuugucc

SEQ ID NO: 73765 - RNA, 42 nt, Mus musculus
aauagagaaacacacacacuccccuaacuccuauacuggcag

SEQ ID NO: 73766 - RNA, 48 nt, Mus musculus
ggacccgucuaccaaggcugcuggaguguagguuucuguuugugccca

SEQ ID NO: 73767 - RNA, 47 nt, Mus musculus
uguuuaugaccuuuccuacccuucuaauguucaguuaacacagccag

SEQ ID NO: 73768 - RNA, 46 nt, Mus musculus
cuggauuuguuccugaaucauaaagccagucucuucagaugucaag

SEQ ID NO: 73769 - RNA, 45 nt, Mus musculus
acacagcaggccugucaugccucuguuugguggcaaagcaacaag

SEQ ID NO: 73770 - RNA, 46 nt, Mus musculus
gaccuugaccacauaacaugcuucuguccugaauucaaagcuuaag

SEQ ID NO: 73771 - RNA, 46 nt, Mus musculus
uuccucccuuccuugcugccucacucuguaccccuggcuggccugg

SEQ ID NO: 73772 - RNA, 46 nt, Mus musculus
uaccuagguaacuuguggguaugucuacauccccagacaccaggag

SEQ ID NO: 73773 - RNA, 45 nt, Mus musculus
ggaagguuacauacuccaccaugaucacgccagucaaguuaggag

SEQ ID NO: 73774 - RNA, 41 nt, Mus musculus
ugagccuugaaagagucagauuggggauccuacugggccag

SEQ ID NO: 73775 - RNA, 45 nt, Mus musculus
ccaaguugugugggcugugcugucauccucccacccacccccuag

SEQ ID NO: 73776 - RNA, 88 nt, Mus musculus
uggcucacaaccauguguaaugggaucugaugcccucuucugaugugucugaagacagcuacaguguacucacauacauaacauaaau

SEQ ID NO: 73777 - RNA, 46 nt, Mus musculus
caugagucuuccccuuaaaucuuaguucugugucuuucccgggcac

SEQ ID NO: 73778 - RNA, 45 nt, Mus musculus
aggguagcugccuggaacuagaaugggguuugaauguccccagac

SEQ ID NO: 73779 - RNA, 55 nt, Mus musculus
cugcccuguggcugggugggugguuguugccugcuuauagacccuucuucugaga

SEQ ID NO: 73780 - RNA, 45 nt, Mus musculus
uauacuuggaccccagaccccaacacugugaccagagcccacagc

SEQ ID NO: 73781 - RNA, 42 nt, Mus musculus
gcagcagguacuccaccugcagguucgugaggaggggcggag

SEQ ID NO: 73782 - RNA, 55 nt, Mus musculus
uucgacugaaugcagauaagcugcagagaaugggguugacccaagaggcucagag

SEQ ID NO: 73783 - RNA, 63 nt, Mus musculus
caaggccaguggucuuguggagccaacaagacguuugcaaguggcucaagaagcauuguccuc

SEQ ID NO: 73784 - RNA, 45 nt, Mus musculus
uuauccaaacuagacaaaugacacagggacaucaaccaccaagcu

SEQ ID NO: 73785 - RNA, 45 nt, Mus musculus
ugugagccaccaugugguugcugggauuugaacuucggaucuuca

SEQ ID NO: 73786 - RNA, 41 nt, Mus musculus
agcugagucaggaaaugggaggugggacacuagcaggaaga

SEQ ID NO: 73787 - RNA, 44 nt, Mus musculus
aucccagcaaccacaugguggcacacaaccauccguaacgagau

SEQ ID NO: 73788 - RNA, 46 nt, Mus musculus
uaauggccucaacccugucaaucaaaugaagagauagccuauggag

SEQ ID NO: 73789 - RNA, 42 nt, Mus musculus
auagcaucugcuuccucaucaucuuuuucauagggcccacuu

SEQ ID NO: 73790 - RNA, 45 nt, Mus musculus
gggaucugaugaccucuucugaucugucugaagacagcuacagug

SEQ ID NO: 73791 - RNA, 47 nt, Mus musculus
augaaauaaaaauaagaauauaaaacaugggggcuggugagauggcu

SEQ ID NO: 73792 - RNA, 54 nt, Mus musculus
gaaggagggagaaggagagggagagggagagagagagagagacagagagagaga

SEQ ID NO: 73793 - RNA, 23 nt, Mus musculus
cucugaaugugcagugcugucug

SEQ ID NO: 73794 - RNA, 42 nt, Mus musculus
ucaggccuagcagcucagagucucuucccauugccugcagau

SEQ ID NO: 73795 - RNA, 46 nt, Mus musculus
uggauccacuguucgcgguugaucucuacaccauuggcccguaggg

SEQ ID NO: 73796 - RNA, 46 nt, Mus musculus
uugguaagauucaagaagauccacuaugaaugacaaugcuccagcc

SEQ ID NO: 73797 - RNA, 46 nt, Mus musculus
ucuuuguggagaucucucugucucucucucucugucugucucuguc

SEQ ID NO: 73798 - RNA, 41 nt, Mus musculus
cccuaaggaguuaacucagaaauaccaaggcagcuggcaga

SEQ ID NO: 73799 - RNA, 42 nt, Mus musculus
cagguacauccccugccagccacuuugacuuggcacccauga

SEQ ID NO: 73800 - RNA, 47 nt, Mus musculus
uggcccgagcacgugucagcugcccaaucuuuuccucuagucgggaa

SEQ ID NO: 73801 - RNA, 46 nt, Mus musculus
guugugagccaccauaugguugcugggauuugaacucagggccuuc

SEQ ID NO: 73802 - RNA, 45 nt, Mus musculus
cacaaagaucagcuuccacaugucaguucuggggaccugggacac

SEQ ID NO: 73803 - RNA, 45 nt, Mus musculus
gcugcaguucaaauuuguagaagaaggcccaggcaucccccagau

SEQ ID NO: 73804 - RNA, 45 nt, Mus musculus
cuugcucaguacugcguugugcagauccggauuuuguugcgccag

SEQ ID NO: 73805 - RNA, 44 nt, Mus musculus
caggauugcucuagggguuggagggcuggggucuaaaacaggaa

SEQ ID NO: 73806 - RNA, 63 nt, Mus musculus
aucaucugggcuacagaggcccugcuggagcuucuuuccgguaagagaaagcacaaaugacaa

SEQ ID NO: 73807 - RNA, 46 nt, Mus musculus
ccagaggagccugccuacccuugagguucaaagaacagagcuuagg

SEQ ID NO: 73808 - RNA, 46 nt, Mus musculus
ggcuggacauggaugaagaugguagaagauggaugucaucuguugu

SEQ ID NO: 73809 - RNA, 45 nt, Mus musculus
gggcaagucuuguguuaggcccagaugugaggaaaucuugcccaa

SEQ ID NO: 73810 - RNA, 46 nt, Mus musculus
ccagauguaggaccucagagucagacucauauaaagagcccauuua

SEQ ID NO: 73811 - RNA, 45 nt, Mus musculus
ggggccccacaguccucugaggccuaggucauuugucacacagau

SEQ ID NO: 73812 - RNA, 45 nt, Mus musculus
gcaagagccaucgccacacacauuugaugaugcacagcugcagau

SEQ ID NO: 73813 - RNA, 42 nt, Mus musculus
agcagaggccaaccaacaugugguggacgagaaggcgcgacu

SEQ ID NO: 73814 - RNA, 46 nt, Mus musculus; identical to SEQ ID NO: 50772

SEQ ID NO: 73815 - RNA, 43 nt, Mus musculus
cuuaaggagagagggauaagaguuuuuaaaaaaagggggaauu

SEQ ID NO: 73816 - RNA, 44 nt, Mus musculus
gaccuguuaacaaaugugaugaaagcacaaaccgcccagcgcgu

SEQ ID NO: 73817 - RNA, 46 nt, Mus musculus; identical to SEQ ID NO: 35696

SEQ ID NO: 73818 - RNA, 45 nt, Mus musculus; identical to SEQ ID NO: 35703

SEQ ID NO: 73819 - RNA, 90 nt, Mus musculus
uuugccuuuagugaggugaagggacauuucggaaagugguuuugaacguccuauauuuauucuguaguuuaaaaagauaauagggacagg

SEQ ID NO: 73820 - RNA, 46 nt, Mus musculus
agagaauuguuuuuguuucaaugggcaaaaauuauauauaacugag

SEQ ID NO: 73821 - RNA, 46 nt, Mus musculus
aauuagaccgcacuugugaaagugagaagagacauuaccuccgcag

SEQ ID NO: 73822 - RNA, 45 nt, Mus musculus
aaucaauuacaaauaucuaagucauacucguagaguggguggcag

SEQ ID NO: 73823 - RNA, 42 nt, Mus musculus
cacugauagccaacuaggccaucuucugauucauaugcagcu

SEQ ID NO: 73824 - RNA, 66 nt, Mus musculus
uucaagagagcuauuagaaauacaaagcuccaaguaguaagagagaacagaucagcacaccagaca

SEQ ID NO: 73825 - RNA, 46 nt, Mus musculus
auaguaaaugcauuccaaucugggucaaaguauuauuacaagaaag

SEQ ID NO: 73826 - RNA, 47 nt, Mus musculus
uuaucaacaucagaugucaauuaacacacacacacacacacacacac

SEQ ID NO: 73827 - RNA, 45 nt, Mus musculus
cuuacaccccagcucucuuuccugcucagucaucccagccccuag

SEQ ID NO: 73828 - RNA, 45 nt, Mus musculus
gugaacucaagaucaucuucugacaaauuugucaauucgccauaa

SEQ ID NO: 73829 - RNA, 42 nt, Mus musculus
aggggguaacuacagaauuuaaaauaaaugauguugauccag

SEQ ID NO: 73830 - RNA, 51 nt, Mus musculus
agugagcuacaaacaaacaaaaauuaguuaugaaaugaggguguuguuggg

SEQ ID NO: 73831 - RNA, 88 nt, Mus musculus
caaacucagcaucuguugcuuacucaugaaugacagccccucccugcucagcaaccaaaggauaagcauuuguggacaucuguuaacu

SEQ ID NO: 73832 - RNA, 42 nt, Mus musculus
augcaaauggcuuauguuuuauggaucacuuucugccuguga

SEQ ID NO: 73833 - RNA, 45 nt, Mus musculus
auuuauugacuacagguguagucaauggauguggaaaugugugau

SEQ ID NO: 73834 - RNA, 42 nt, Mus musculus
accuucuaugaauaugcuaagaacauuugcaaucuaccccag

SEQ ID NO: 73835 - RNA, 46 nt, Mus musculus
uuaggucauaucagugcuuuucuaagguacuaaaauaaggcuuuag

SEQ ID NO: 73836 - RNA, 46 nt, Mus musculus
uggaaaaaauaaaguucauuuaguguucauacaucacuaggcuaag

SEQ ID NO: 73837 - RNA, 42 nt, Mus musculus
uaaacuagcuuggagaccuuacuuaaaauuauuaaagcccau

SEQ ID NO: 73838 - RNA, 46 nt, Mus musculus
ggucacaccaaagcacucagugauaacugaagacugaccaaugaag

SEQ ID NO: 73839 - RNA, 46 nt, Mus musculus
auggcguuuccagcuacuguaccuaauuaacagaaaauggccaaag

SEQ ID NO: 73840 - RNA, 42 nt, Mus musculus
ucagaagguucugggguguuugagaaacaucacgaaggccag

SEQ ID NO: 73841 - RNA, 41 nt, Mus musculus
aaacauguguuuugaaggcugugguuucaaacuaguggaua

SEQ ID NO: 73842 - RNA, 42 nt, Mus musculus
agccaggcgugaugcccauucauucaucauccacacagcgag

SEQ ID NO: 73843 - RNA, 44 nt, Mus musculus
auugucaucagcaacuggcaucauaacuuguaaauggcacuuga

SEQ ID NO: 73844 - RNA, 46 nt, Mus musculus
cgggguuggggggagggaagagagagagagagagagagagagagag

SEQ ID NO: 73845 - RNA, 46 nt, Mus musculus
agagaagagggagcacgagcgagaggugcuccagaaggcgcuggag

SEQ ID NO: 73846 - RNA, 46 nt, Mus musculus
aguaucaaaauacuacuacauuucccuugaggagugguggcaggag

SEQ ID NO: 73847 - RNA, 66 nt, Mus musculus
ggcaugcugcagagguucgcaggaacaaggaacugcagguugaacugucuggcugaagcaauggcg

SEQ ID NO: 73848 - RNA, 52 nt, Mus musculus
uaugaaaaacaaaacaaaaaacagaaucaaaaauaaaauaaaaaucaaugcg

SEQ ID NO: 73849 - RNA, 46 nt, Mus musculus
acgcgcuacacauguguuuggguuuuagaaacaggugcaugugaag

SEQ ID NO: 73850 - RNA, 46 nt, Mus musculus
agaccaaaccacuccaucugugaugcugacgcagugaaggggccag

SEQ ID NO: 73851 - RNA, 43 nt, Mus musculus
auaucccuaugacauuaaacgcaaaauguugagguugggaaag

SEQ ID NO: 73852 - RNA, 46 nt, Mus musculus
aauggauuauuaaaguuuauugcuggggguagggagguagaagcag

SEQ ID NO: 73853 - RNA, 46 nt, Mus musculus
ugcaauccucaaagauacuuacuuuucaaacugaaguaacgaggag

SEQ ID NO: 73854 - RNA, 46 nt, Mus musculus
aaaacagugugugguggggcaugcaugugaucccugucucuggcag

SEQ ID NO: 73855 - RNA, 46 nt, Mus musculus
ucaguccacgugagcagcuuccucagcagcccugcagcacacagau

SEQ ID NO: 73856 - RNA, 42 nt, Mus musculus
gggcgagggccggcggccguggauccggagcuggacgcgcug

SEQ ID NO: 73857 - RNA, 42 nt, Mus musculus
uuagaaagccuggaaacaaaguuuuccaaaguuguggaucua

SEQ ID NO: 73858 - RNA, 48 nt, Mus musculus
uuuuucgaguuaggguuugccugugagauugaauccgagagagaggcu

SEQ ID NO: 73859 - RNA, 70 nt, Mus musculus
acccuccauuggaaaguaagacacuuguuuggugcuggagaucucuauaguuuuuuuaaguauccucaga

SEQ ID NO: 73860 - RNA, 47 nt, Mus musculus
ugguucagaccacuuucuacccaauugugaaauucucagagcccaga

SEQ ID NO: 73861 - RNA, 80 nt, Mus musculus
aguuaaccuuuccagaaauuaaacaugaauucaacccagugaugugauugaaauuacuaguuggaauacguugaugucag

SEQ ID NO: 73862 - RNA, 46 nt, Mus musculus
ugaguuugaguuugaggccagcauagucuacaaagugaguuccaga

SEQ ID NO: 73863 - RNA, 46 nt, Mus musculus
gcuugaacuugagacccuccugcuuuagcuucccagucacugccac

SEQ ID NO: 73864 - RNA, 46 nt, Mus musculus
guuucuuuaagacuuuauauuguguuucaaacaaagaaagcccuaa

SEQ ID NO: 73865 - RNA, 46 nt, Mus musculus
aaacgaaggcugugaugucgacgagggccaaguagaaaacuaccag

SEQ ID NO: 73866 - RNA, 46 nt, Mus musculus
ggaaauaugcauacaauaaaaauccuuuggaaaauuaagcagguau

SEQ ID NO: 73867 - RNA, 45 nt, Mus musculus
uucaguggcagaaaaguggguuuucucucaccuaaacaguaugca

SEQ ID NO: 73868 - RNA, 45 nt, Mus musculus
ugcauuuggguuguaaaugaaauuacugaaugggaaagacuaaag

SEQ ID NO: 73869 - RNA, 45 nt, Mus musculus
cucaguguugcaggguauuugaucacacuguggaaaaaccucgag

SEQ ID NO: 73870 - RNA, 44 nt, Mus musculus
cuuuugauuuugaaggaaaacaacacagcugauuuuggggugag

SEQ ID NO: 73871 - RNA, 55 nt, Mus musculus
auccccagccucacaaaaugacauguauaauacuuuaggauaggagauaggaaga

SEQ ID NO: 73872 - RNA, 66 nt, Mus musculus
uuuaaagaacuaguugauacguauagaucaugaaugaggccagccuacuuaagugaccacccaaag

SEQ ID NO: 73873 - RNA, 45 nt, Mus musculus
gcaaaggucaaaguauucuaccucguguuuaauacuaguguuugu

SEQ ID NO: 73874 - RNA, 42 nt, Mus musculus
cagucugugcucuuaacuacugagccaucucuccagccccag

SEQ ID NO: 73875 - RNA, 46 nt, Mus musculus
uuuauuuaauuugagcacuuuuacaaaaaagaaaaaaaguccccac

SEQ ID NO: 73876 - RNA, 45 nt, Mus musculus
ugcucuagacuaaaugucacucuguacccucugucccaccucgag

SEQ ID NO: 73877 - RNA, 24 nt, Mus musculus
cucggguuuuuguucggguuuugg

SEQ ID NO: 73878 - RNA, 46 nt, Mus musculus
cacuaaaaaggcacuugcucauucauucuggaguaagaucauuuaa

SEQ ID NO: 73879 - RNA, 46 nt, Mus musculus
cgcuacggaguaugcauggacuguguagauaagucacagccaggag

SEQ ID NO: 73880 - RNA, 46 nt, Mus musculus
cuauguuccucaagaaugcugcauuggacauacuaugaaucgacaa

SEQ ID NO: 73881 - RNA, 46 nt, Mus musculus
aaagguaauggauugaauacucagaauuuugucugaaagucuggca

SEQ ID NO: 73882 - RNA, 46 nt, Mus musculus
uucauguaauuuauauuuuaaauaaaauauuuuuagaguuuuuaau

SEQ ID NO: 73883 - RNA, 45 nt, Mus musculus
guuguuuaauaacaaaugugaaccaagagaagaaguaaaagcugg

SEQ ID NO: 73884 - RNA, 46 nt, Mus musculus
guaaauuuggaauacacuagcuauugagaacaaaauuuggggguua

SEQ ID NO: 73885 - RNA, 32 nt, Mus musculus
cugccugcuguuuguaaaagcucucuggcaag

SEQ ID NO: 73886 - RNA, 45 nt, Mus musculus
caugaccuggagaaacugcaaguagcagggauuucauagcugggg

SEQ ID NO: 73887 - RNA, 45 nt, Mus musculus
gaugacaaauagccaauugcugggugaaaaugaggaggcaggagg

SEQ ID NO: 73888 - RNA, 45 nt, Mus musculus
uccuuguugcuuuuaucuagagaugcuaagaagcaaccauccuga

SEQ ID NO: 73889 - RNA, 46 nt, Mus musculus
uugcugguuucauagaugauauaaaauugguuccuucuggcagggg

SEQ ID NO: 73890 - RNA, 31 nt, Mus musculus
gaggcagaaaaggaguggaacugggcgguag

SEQ ID NO: 73891 - RNA, 46 nt, Mus musculus
uguggaaggacuuuggaacuuugggcuugaagauccauucgcuguu

SEQ ID NO: 73892 - RNA, 25 nt, Mus musculus
aaugcagacuuuaaagcagcugagc

SEQ ID NO: 73893 - RNA, 46 nt, Mus musculus
ucuccuuauaaacugaauaacuauucagauaccaucuacauuagau

SEQ ID NO: 73894 - RNA, 46 nt, Mus musculus
uuuguucugagccauagcauagugcaggcccacuuugaugccagcu

SEQ ID NO: 73895 - RNA, 46 nt, Mus musculus
acccauugaugugucauagagcaaggaguccuugucccccagagag

SEQ ID NO: 73896 - RNA, 46 nt, Mus musculus
uccuccuuggucaguacucaccucaucacuccagcagccuccccgc

SEQ ID NO: 73897 - RNA, 45 nt, Mus musculus
acccagcuuagguaguuguggcuaauugucgauccaacugugggu

SEQ ID NO: 73898 - RNA, 42 nt, Mus musculus
uuaucacaacuacagauuauucaaaauaaaugagaaugccaa

SEQ ID NO: 73899 - RNA, 46 nt, Mus musculus
cagagcuagagucagcaagacaggaugcuguguuaggguggaagag

SEQ ID NO: 73900 - RNA, 42 nt, Mus musculus
cucaucuccuaacccagaagccaaauguguuuguugccagau

SEQ ID NO: 73901 - RNA, 46 nt, Mus musculus
aguucagaggaaagcucucacaagaaauccugucauaagaccagaa

SEQ ID NO: 73902 - RNA, 46 nt, Mus musculus
caugucacuaagugcaaguuuaaucauccccaaguuccguccagug

SEQ ID NO: 73903 - RNA, 46 nt, Mus musculus
cagggugaaauaaaacugagaauaacuuugucacaugaguggaggg

SEQ ID NO: 73904 - RNA, 41 nt, Mus musculus
gggaaagagggaggcaggaaggaaggaaggaagggaggaag

SEQ ID NO: 73905 - RNA, 46 nt, Mus musculus
aaaacaucuucccaagaguuuauugacucaaaaagcuaggccaguu

SEQ ID NO: 73906 - RNA, 42 nt, Mus musculus
guagaaauggagaccagauagcaaggucauuugcaagagaau

SEQ ID NO: 73907 - RNA, 46 nt, Mus musculus
augaccuugguuuuauacauuguagcuuauuuuuuaaaaugcagua

SEQ ID NO: 73908 - RNA, 46 nt, Mus musculus
ggacucugguggacaaggugcugucuuugcucuuguccguaggauu

SEQ ID NO: 73909 - RNA, 44 nt, Mus musculus
uguucagcuggacaggcagacgacuuccaugagguguggcagag

SEQ ID NO: 73910 - RNA, 123 nt, Mus musculus
gggagacaaggaugcugugggaagagaucuggagaaccccgagaccaggaggauuuuuaucuccucaagucuuuucuugucagaacaaguuuuucuuuauguaacucuccgugucauuucaaa

SEQ ID NO: 73911 - RNA, 46 nt, Mus musculus
caaagguggcauucaccggagaagguucugagaaaagaggugagaa

SEQ ID NO: 73912 - RNA, 42 nt, Mus musculus
uaagaauuugcucagaaacuaacuuacaggaugcccaaaggc

SEQ ID NO: 73913 - RNA, 42 nt, Mus musculus
cacgcccacacagcccuguccuccccgcccagagggacaguc

SEQ ID NO: 73914 - RNA, 42 nt, Mus musculus
cauauugguuuucagaguaugacuguggaaguguuuggaacu

SEQ ID NO: 73915 - RNA, 62 nt, Mus musculus
gcauaucucucuccuucccccuccuccucccccucucccucucccucucucccccucccucu

SEQ ID NO: 73916 - RNA, 45 nt, Mus musculus
ccaggcccaggccacagaauggugccacccauacucagcauagau

SEQ ID NO: 73917 - RNA, 42 nt, Mus musculus
agcugucagcuguugguguuggaaauguaguuuguguuggug

SEQ ID NO: 73918 - RNA, 46 nt, Mus musculus
acacccccggugacgauuccuggauccgcuaaguucacccccaaug

SEQ ID NO: 73919 - RNA, 108 nt, Mus musculus
gccccugcguuucccaucccagacuccagccgaacagaaacuccuugugccaaaacagacacuaagcuggugacgccacugagccgcucagcccccaccacccucuac

SEQ ID NO: 73920 - RNA, 122 nt, Mus musculus
agucugacugcagugauggggaagaagacuucuacuacacggagaucaagcucaacacggaugccacggcugaaggccucaacacuguggccccgguuucacccucccagucucuggcuuca

SEQ ID NO: 73921 - RNA, 42 nt, Mus musculus
aucauuccgagaggagagaauggucugcacaggucgcaagca

SEQ ID NO: 73922 - RNA, 42 nt, Mus musculus
uuacuacaucugguuuuccuuucagaaccacuugggccagug

SEQ ID NO: 73923 - RNA, 41 nt, Mus musculus
gauuucugaguuugaggccagccugguguacagagcaaguu

SEQ ID NO: 73924 - RNA, 45 nt, Mus musculus
ugccggcauccagaagcacauccgggcuguccaccucggguaagg

SEQ ID NO: 73925 - RNA, 45 nt, Mus musculus
cccacugggaaagcccagagcggagauuccgguugucaggaagau

SEQ ID NO: 73926 - RNA, 44 nt, Mus musculus
gugguauguguguaugguguguaugguguguauguguguguggu

SEQ ID NO: 73927 - RNA, 45 nt, Mus musculus
ugagagagagauguauguauguauguguggugugugugugugugu

SEQ ID NO: 73928 - RNA, 46 nt, Mus musculus
ccaggcaggcacggugcaggaggagccaacaguucuacaucuugau

SEQ ID NO: 73929 - RNA, 46 nt, Mus musculus
caucaggucucuacaggauuaagcacaucucuucuacugacaaggc

SEQ ID NO: 73930 - RNA, 46 nt, Mus musculus
uuauuuauuaauuauuuuauuuacaucccaaauguugcccccuccc

SEQ ID NO: 73931 - RNA, 45 nt, Mus musculus
aaggcagcuuacugcagaguuggguccaugauagugaauauaaag

SEQ ID NO: 73932 - RNA, 44 nt, Mus musculus
acaguuaaggaaucuccagaauuucucuuuaacccacgagcaga

SEQ ID NO: 73933 - RNA, 45 nt, Mus musculus
aauaaauaaauaaauaaauaaggaaaaauaauugagaccugaggu

SEQ ID NO: 73934 - RNA, 42 nt, Mus musculus
ggaugcaggguucguacaagguccuaaguucuggcaacagga

SEQ ID NO: 73935 - RNA, 46 nt, Mus musculus
ucuuuucauccguguguguuucucuggaaugacacaucaucaggaa

SEQ ID NO: 73936 - RNA, 44 nt, Mus musculus
cagauguguauacaugcagcuuuucauuucauuggacccacagu

SEQ ID NO: 73937 - RNA, 49 nt, Mus musculus
acuuccagauugacugggaggcugugagucacuguaaugagaggugagc

SEQ ID NO: 73938 - RNA, 67 nt, Mus musculus
ugagggaugagaacugacuaccaagggaaaagauauaaaccuaagaaauaacuaauuugucugggca

SEQ ID NO: 73939 - RNA, 59 nt, Mus musculus
uggcaugucugcgucggaggaugcacuuuagugaccuucgugcauuaggucggcaaucg

SEQ ID NO: 73940 - RNA, 51 nt, Mus musculus
cacccagggagcuucaagaaauguaccucucggacaucaaagaaaucucag

SEQ ID NO: 73941 - RNA, 45 nt, Mus musculus
gagcaccauaggcaaaacacugaacagccuggaagcagggcacaa

SEQ ID NO: 73942 - RNA, 45 nt, Mus musculus
cuuagaagcugaaauacugaacugaggcuuccugugcgugcaugc

SEQ ID NO: 73943 - RNA, 45 nt, Mus musculus
ugucaaccagcccuuugguccgaagcccuccugugcggccuaaug

SEQ ID NO: 73944 - RNA, 51 nt, Mus musculus
cuaucaguagugcugaacugaguccugagggcagguggacaggaagagggg

SEQ ID NO: 73945 - RNA, 45 nt, Mus musculus
cuggggcagaggggcgagcauagacgaaggccgguugcuggggca

SEQ ID NO: 73946 - RNA, 47 nt, Mus musculus
cucauaauccaucaagagacgucaaggcaggaacacaaaccaggaag

SEQ ID NO: 73947 - RNA, 46 nt, Mus musculus
augggaaacuuaggugucuaaauaggguuucuaugcugugauaaaa

SEQ ID NO: 73948 - RNA, 46 nt, Mus musculus
guguucucauugauagagaagcaguguucgggauaagggccuaggg

SEQ ID NO: 73949 - RNA, 70 nt, Mus musculus
uuagcuuucuuacacauuuaaacacaguaaaacuucggggaaaaaacaaaguuauuacaacaaagcuuua

SEQ ID NO: 73950 - RNA, 45 nt, Mus musculus
agaugguagcugagaguucuacaucaugauccacagacugcaaga

SEQ ID NO: 73951 - RNA, 45 nt, Mus musculus
cagguggcaugacauggccuaauacuccucaccacagcagcaaua

SEQ ID NO: 73952 - RNA, 45 nt, Mus musculus
uaaugagaaaaaggugcauuugagcacaggcacuugagagagaga

SEQ ID NO: 73953 - RNA, 46 nt, Mus musculus
cuuugacacuaucauagaaaauguacauacacacaaaaccccacug

SEQ ID NO: 73954 - RNA, 46 nt, Mus musculus
aaguguugggagguguaauauagacauucauccuuucugaugggac

SEQ ID NO: 73955 - RNA, 46 nt, Mus musculus
auguccugagguuauaccguuaguuaugugagaccagaccacagau

SEQ ID NO: 73956 - RNA, 41 nt, Mus musculus
cauggacuaucacguaagcucugcguccaucaaccccaggu

SEQ ID NO: 73957 - RNA, 41 nt, Mus musculus
uacaguguccugucuguaagguaugggcaguuauggaaagg

SEQ ID NO: 73958 - RNA, 41 nt, Mus musculus; identical to SEQ ID NO: 73957

SEQ ID NO: 73959 - RNA, 41 nt, Mus musculus; identical to SEQ ID NO: 73957

SEQ ID NO: 73960 - RNA, 45 nt, Mus musculus
accccuagcuuguuaccaggacuguaucuaacaugcuccagagag

SEQ ID NO: 73961 - RNA, 44 nt, Mus musculus
cgccagccuuuguggcgcacgccuuuaaucccagcacucgggag

SEQ ID NO: 73962 - RNA, 45 nt, Mus musculus
uggcacaggcuugcauccuggugccaccucagcacaggcccagug

SEQ ID NO: 73963 - RNA, 41 nt, Mus musculus
cauauuaaaacccuggaccacuggauuuuaaaccugucagu

SEQ ID NO: 73964 - RNA, 46 nt, Mus musculus
ugaucauuccucuauuaugggagugguuuuguaguaacaaugagau

SEQ ID NO: 73965 - RNA, 45 nt, Mus musculus
cugcuuucagggugguuuggaaagaggagacguugacguuggaga

SEQ ID NO: 73966 - RNA, 42 nt, Mus musculus
uucuuagaagggggaacaaaauacaggaggaaauauggagac

SEQ ID NO: 73967 - RNA, 45 nt, Mus musculus
gugaaucaaggacugccacauaaaaccagauacacugaaucuagu

SEQ ID NO: 73968 - RNA, 45 nt, Mus musculus
aguagcaccuuggggaaauacguuagcucucacagagcccggaga

SEQ ID NO: 73969 - RNA, 42 nt, Mus musculus
gucuuaaggcauguaaaauaaaauggcagggucccgccgggu

SEQ ID NO: 73970 - RNA, 45 nt, Mus musculus
ugcuuacauuggugccgggguugaagacaccagugccuuguugau

SEQ ID NO: 73971 - RNA, 58 nt, Mus musculus
gagacauuugauuuguuuguuucugauaauacagugugguguuggaguguuuggagcc

SEQ ID NO: 73972 - RNA, 41 nt, Mus musculus
uauguucugggacagcauuuugaaagaaaguaaccccauua

SEQ ID NO: 73973 - RNA, 46 nt, Mus musculus
gaauaaaggcacaaauuaugcuuaguggucgggcagguucagaggc

SEQ ID NO: 73974 - RNA, 46 nt, Mus musculus
cacgguauucgguacacaguaccuuucacacaacaagaaccgagaa

SEQ ID NO: 73975 - RNA, 46 nt, Mus musculus
uuguccauugacucacagagaggaacuagcugauaaacgugcagga

SEQ ID NO: 73976 - RNA, 45 nt, Mus musculus
ccagaagaacaaaaccggaacuuuugcacgaauguggucuggagu

SEQ ID NO: 73977 - RNA, 46 nt, Mus musculus
agugacacuaacaaguuuacaaaaagcagacgacaaauugcuaaau

SEQ ID NO: 73978 - RNA, 46 nt, Mus musculus
ugguggccugaugugccuggcuccagaguaucuugagaccauagug

SEQ ID NO: 73979 - RNA, 45 nt, Mus musculus
cagcuaguagauguuagauuuugauagacuuuaggugguagcaug

SEQ ID NO: 73980 - RNA, 42 nt, Mus musculus
cagcaguaguaguagcaguagcaguagcaguagcaguagcag

SEQ ID NO: 73981 - RNA, 41 nt, Mus musculus
aacaguaguaguaguaguagcaguagcaguagcaguagcag

SEQ ID NO: 73982 - RNA, 46 nt, Mus musculus
gggaaaggaaaagaagaaaaaaaagaaagaagagaaaagagagaga

SEQ ID NO: 73983 - RNA, 44 nt, Mus musculus
caacacacuacucaaugauaacuuggucaagaaagaaagaaaga

SEQ ID NO: 73984 - RNA, 46 nt, Mus musculus
caacagaauacaagagauagaagagagaauuucagaugcagaagau

SEQ ID NO: 73985 - RNA, 46 nt, Mus musculus
cugacguagcucuggauuacagacucuggaauauaccaccccaguu

SEQ ID NO: 73986 - RNA, 48 nt, Mus musculus
gcuaaugacugugaggaaaugcugcugcuacuacgugauucaaaggaa

SEQ ID NO: 73987 - RNA, 46 nt, Mus musculus
auccaagaugacuuccucaagaagcuuaagaguuacaacagcagaa

SEQ ID NO: 73988 - RNA, 45 nt, Mus musculus
cagcauguaacacuuugcugaaacagacacuugagggcgugcgau

SEQ ID NO: 73989 - RNA, 46 nt, Mus musculus
gcugugugcacauugacccgcaggaguuugcauucaaaagggauuu

SEQ ID NO: 73990 - RNA, 99 nt, Mus musculus
agacuagaacauauugucaaguugucauaaaaucagccagcacagagccacccagccuacgugugagagugccucaaaaauaaagcagagcagagcaga

SEQ ID NO: 73991 - RNA, 46 nt, Mus musculus
ucaucucuaauuaggaagaugcuggacagacuugcguacagccaga

SEQ ID NO: 73992 - RNA, 69 nt, Mus musculus
uccccauggcuugcucucacccugcucucuuaaaauacccaggacaccagcccaggagugucaccagca

SEQ ID NO: 73993 - RNA, 45 nt, Mus musculus
agugagcuggcucacuucuguaaucucuccccuuaggaggcagaa

SEQ ID NO: 73994 - RNA, 46 nt, Mus musculus
uuaucacuuagaacaguuaggcuuguguacaaaugagacaccagaa

SEQ ID NO: 73995 - RNA, 31 nt, Mus musculus
ugcaguacugaccaaagucaacccuagaucc

SEQ ID NO: 73996 - RNA, 44 nt, Mus musculus
aguggagacgucuacuugcaguugcagagggacgccauugcaaa

SEQ ID NO: 73997 - RNA, 41 nt, Mus musculus
uagaaauccaggagacauaauuaugaaacucaagaggaagg

SEQ ID NO: 73998 - RNA, 46 nt, Mus musculus
aggaguagacuucucucuuggugucagugugugaggccugguaggu

SEQ ID NO: 73999 - RNA, 45 nt, Mus musculus
uggccuuuaccuuggcgcucauacucccucucccucccuccuccu

SEQ ID NO: 74000 - RNA, 46 nt, Mus musculus
cuucucugaguguguguguguauguguguaucucuguguaugaaua

SEQ ID NO: 74001 - RNA, 46 nt, Mus musculus
uggggaaauuccuugugcaaagguaggagcccagugcaguacaagg

SEQ ID NO: 74002 - RNA, 53 nt, Mus musculus
auacacggaagcacacugcucaagcugguauuauugugagcuuuuaaauggua

SEQ ID NO: 74003 - RNA, 46 nt, Mus musculus
ucuacaauuauaggccucuguuuucuuuaaccucuagcugccaauu

SEQ ID NO: 74004 - RNA, 26 nt, Mus musculus
uuuguaggagacagguagagagcagg

SEQ ID NO: 74005 - RNA, 46 nt, Mus musculus
aagaaacguaagauuuuuguguuguacuuugcagguggggaguuuu

SEQ ID NO: 74006 - RNA, 46 nt, Mus musculus
gaaauguguucauucugucuccugcuguaugagaaugucuucagaa

SEQ ID NO: 74007 - RNA, 46 nt, Mus musculus
gggagagaggagaggagagaagacaaaggggagagagagggcgaga

SEQ ID NO: 74008 - RNA, 44 nt, Mus musculus
uauagaaaggcagggggaaagagagaagguaggggggagagaga

SEQ ID NO: 74009 - RNA, 29 nt, Mus musculus
ggagagcaaauguguuccuuuuauuaaga

SEQ ID NO: 74010 - RNA, 47 nt, Mus musculus
acgugccacccgcagaccaaagugaaacaauccaaagagcagaaaga

SEQ ID NO: 74011 - RNA, 45 nt, Mus musculus
caaaucccagcaaccacaugguggcucacaaccaccgauaaugag

SEQ ID NO: 74012 - RNA, 45 nt, Mus musculus
caguccauccucuuguuugaaacacuguggcauguauggcagagg

SEQ ID NO: 74013 - RNA, 46 nt, Mus musculus
gugacaucuagauacucgggccucuuuaaaaauaaaacaagcagac

SEQ ID NO: 74014 - RNA, 45 nt, Mus musculus
uauggauguaucugagucuauuucuaguucugugugggaauggag

SEQ ID NO: 74015 - RNA, 46 nt, Mus musculus
cugguuguuuguccucucuggagaacaccgacaugugggcccaggg

SEQ ID NO: 74016 - RNA, 42 nt, Mus musculus
cacuuuguagaccaggcuggccagaauccacgcccggcaggu

SEQ ID NO: 74017 - RNA, 46 nt, Mus musculus
uugguaacaugguagcuauacauuucaucuucauaccagcugugug

SEQ ID NO: 74018 - RNA, 45 nt, Mus musculus
acguaagauccugaaugagcucagcuguccuuagguguuucucuu

SEQ ID NO: 74019 - RNA, 45 nt, Mus musculus
gcugggugacacaccaggaaacagugcuuuggauagacagcagau

SEQ ID NO: 74020 - RNA, 42 nt, Mus musculus
uagcagauaacacagaggccugacacuggucagcgugcagag

SEQ ID NO: 74021 - RNA, 45 nt, Mus musculus
acaaauguuaucaggcucaggcucacccaaccaugaacccuaaaa

SEQ ID NO: 74022 - RNA, 46 nt, Mus musculus
agccaucgugauugauaagaaggaagaaaagaaaaagcaugaagau

SEQ ID NO: 74023 - RNA, 42 nt, Mus musculus
uacauauauaugcguaccuuguugcuguuuuggcuaaaggag

SEQ ID NO: 74024 - RNA, 27 nt, Mus musculus
gucuuuauuuguucauugugauuucuu

SEQ ID NO: 74025 - RNA, 45 nt, Mus musculus
gcuuauggagcagcuaaccugggguacacacagugcaguggcaga

SEQ ID NO: 74026 - RNA, 46 nt, Mus musculus
cugaguccaugagugugaagaaggggccuucugugcuugcccugug

SEQ ID NO: 74027 - RNA, 42 nt, Mus musculus
cuuuacucccagggcgccugcagugcaacacaccgaccagau

SEQ ID NO: 74028 - RNA, 24 nt, Mus musculus
ggcugcccagcccugcccauuacc

SEQ ID NO: 74029 - RNA, 63 nt, Mus musculus
ggccagcuagcccagaucuccuauaggccagcuagcccagaucuccuauaggccagcuagccc

SEQ ID NO: 74030 - RNA, 71 nt, Mus musculus
uauaggccagcuagcccagaucuccuauaggccagcuagcccagaucuccuauaggccagcuagcccagau

SEQ ID NO: 74031 - RNA, 44 nt, Mus musculus
guugaagaccugcccacaggugugaagugauugauguaugagag

SEQ ID NO: 74032 - RNA, 40 nt, Mus musculus
uucaucaccuuagagauauccugacacuguaucccaagag

SEQ ID NO: 74033 - RNA, 46 nt, Mus musculus
aaguugagacagaaagauuaauauguuaugcucuguaauccaagua

SEQ ID NO: 74034 - RNA, 45 nt, Mus musculus
cuaccgcaacgagcgaucuuuccguuuuuuuguaucuucagaaga

SEQ ID NO: 74035 - RNA, 42 nt, Mus musculus
cauccuaagcacuuacccuccgcccccuuaagauuacaaaag

SEQ ID NO: 74036 - RNA, 59 nt, Mus musculus
uuguuggucgguuccaucacaggcacuugugaaggaguugggagccugugcagcaacaa

SEQ ID NO: 74037 - RNA, 54 nt, Mus musculus
guaggcaaggaaggagcgcuucucugggcaggguggggaacuugggagcuggac

SEQ ID NO: 74038 - RNA, 42 nt, Mus musculus
gcgcagcgcagcccgcggcucccgggaggcgcaggcggaggu

SEQ ID NO: 74039 - RNA, 42 nt, Mus musculus
caccgcgguaggcccugagcgcgcgggcgcagggcccggaga

SEQ ID NO: 74040 - RNA, 44 nt, Mus musculus
gccaggggaggaugauggggcaggacgguggcacaggugaggau

SEQ ID NO: 74041 - RNA, 49 nt, Mus musculus
cgccgcgcagcagcgccaacggcguuaaaauggagaaugaugagucagu

SEQ ID NO: 74042 - RNA, 64 nt, Mus musculus
gacaugaaguggcaggcuauuaaagauuugaugagagaaaaaguuggugagguuacauacgugg

SEQ ID NO: 74043 - RNA, 79 nt, Mus musculus
agcucuuuaaggaugcggaaggaaaaucaagggguuguggcgugguugaauucaaagaugaagaauuuguaaagaaagc

SEQ ID NO: 74044 - RNA, 85 nt, Mus musculus
ucucaauaauccaaacauuccuccugagguuaucagcaauuugcaggcugguagacuugguuccacaauuuuuguugcuaaucuu

SEQ ID NO: 74045 - RNA, 88 nt, Mus musculus
gacuucaaaguugguuggaagaaauuaaaggaaguguucagcauagcuggaacugugaagcgagcugauauuaaagaagacaaggaug

SEQ ID NO: 74046 - RNA, 47 nt, Mus musculus
auggaugacaaaucugucccucaugaagacuaccguucacaugauag

SEQ ID NO: 74047 - RNA, 47 nt, Mus musculus
ggaaauuuggguccaagugguaugggaauggaugguccggguuuugg

SEQ ID NO: 74048 - RNA, 51 nt, Mus musculus
uugguggucuggaagcaaugaauagcauggcaggcuuugguggaguuggcc

SEQ ID NO: 74049 - RNA, 85 nt, Mus musculus
gcaucgauguagaccgaggguuuuuaucaggucccaugggaagcggaaugagagacagauuaggcuccaaaggcaaccagauauu

SEQ ID NO: 74050 - RNA, 60 nt, Mus musculus
uguuagaaaucuuccuuuugacuugacuuggcagaaauuaaaagagaaauucagccaaug

SEQ ID NO: 74051 - RNA, 46 nt, Mus musculus
gcuguugaagugaagguuuugagaaacuauacuacuaagccaucag

SEQ ID NO: 74052 - RNA, 46 nt, Mus musculus
augucuaguggugagggcuauaaaugaaggaaaauggguuucagau

SEQ ID NO: 74053 - RNA, 46 nt, Mus musculus
acuugugugaacuuuacaaaguauauguauauagacagcauuagua

SEQ ID NO: 74054 - RNA, 46 nt, Mus musculus
cccuacaagguaucuuuucuggacuauuaaaguucucuguaaagga

SEQ ID NO: 74055 - RNA, 54 nt, Mus musculus
guuuacauauugacacauaucucuaauuucuuggcaugaaauugaagcucacag

SEQ ID NO: 74056 - RNA, 45 nt, Mus musculus
aggcacuagccaggaguaagacagacccugccucaaaaucacagu

SEQ ID NO: 74057 - RNA, 45 nt, Mus musculus
ugacauaaugggccagugacaaagucuguaauccaaaccucggcg

SEQ ID NO: 74058 - RNA, 46 nt, Mus musculus
acaggacguguuguuguauauguccuuuaccauucacucagcagau

SEQ ID NO: 74059 - RNA, 45 nt, Mus musculus
cuucuugaaauuucacaucaaggucuggaaggugacaggaccagc

SEQ ID NO: 74060 - RNA, 107 nt, Mus musculus
uauuugcaaacuucuuuaguguuccugggcuuaagucuuuuuugguucgagaauugaagagcaucagagcugugauuaguuuuguaagguguacacuggagggauuc

SEQ ID NO: 74061 - RNA, 41 nt, Mus musculus
cucaggcaucguggcugaaugaacacgcacgagacgugacg

SEQ ID NO: 74062 - RNA, 45 nt, Mus musculus
aguuuacuggggucugucaggcucucguaacggauuuuauccaga

SEQ ID NO: 74063 - RNA, 98 nt, Mus musculus
gucguuaugcuucgugaugacagucacuuucucagcaaccaaauaggcagaguaaaaaccaacaccaaacuggccaaucauagagauaucugcaccag

SEQ ID NO: 74064 - RNA, 48 nt, Mus musculus
ccauugguucaccugugucaguccucacugugaaagaucccccagcug

SEQ ID NO: 74065 - RNA, 50 nt, Mus musculus
acuuccuuaucucguuccuucuccacaaagagaguaaugggauagccaau

SEQ ID NO: 74066 - RNA, 45 nt, Mus musculus
ugccaccauccuucuucuccuccucuucuucaucagagccaacau

SEQ ID NO: 74067 - RNA, 49 nt, Mus musculus
guagaacucuccauauuccucauuagugaugucaucaggauuucgcguc

SEQ ID NO: 74068 - RNA, 49 nt, Mus musculus
acauacaacuugauguuguucuuuuucuuucuguuuucaaacagaucaa

SEQ ID NO: 74069 - RNA, 46 nt, Mus musculus
ccaaauucuuucugauaacuuucagaauuuuacuuuguugcagccu

SEQ ID NO: 74070 - RNA, 45 nt, Mus musculus
gccgccuccaggcgcuuggcggcggaggugcccaggcucuugugc

SEQ ID NO: 74071 - RNA, 46 nt, Mus musculus
ggagcagcuucucacuuuccucuagcuuuggggucggucucgaggu

SEQ ID NO: 74072 - RNA, 24 nt, Mus musculus
ucguacauagcugucauagucuga

SEQ ID NO: 74073 - RNA, 49 nt, Mus musculus
uggcccacucuguaaauaaaggcuccacuagguaagucauaaaaccuug

SEQ ID NO: 74074 - RNA, 46 nt, Mus musculus
aucuuaagcuaacacacgugauggccauaucaacucuacgggcacu

SEQ ID NO: 74075 - RNA, 45 nt, Mus musculus
ucagugugcaugggauccagaaccaaguaaaauuaaaagccagca

SEQ ID NO: 74076 - RNA, 42 nt, Mus musculus
cuuaauaaaauucuacucagcaguuugaucaaggggccagag

SEQ ID NO: 74077 - RNA, 45 nt, Mus musculus
cucuuuccccuccccuuucccuuucccuccccuuucccuccccuu

SEQ ID NO: 74078 - RNA, 86 nt, Mus musculus
uaccacaaugcaguccaugcugcagacguuacucaggccaugcacuguuacuuaaaggaaccuaagguaggugguugaaagucgcc

SEQ ID NO: 74079 - RNA, 46 nt, Mus musculus
gugauaggccauguaucagcuggcuuugcaguuaaaaaccaugugu

SEQ ID NO: 74080 - RNA, 46 nt, Mus musculus
ucaggcaugguggcacagaucuuuaaucucaguaucugggagggag

SEQ ID NO: 74081 - RNA, 46 nt, Mus musculus
gccucucccucccagauacugagauuaaagaucugugccaccaugc

SEQ ID NO: 74082 - RNA, 60 nt, Mus musculus
gaagaagaggaggaugaugagaagaaugaagaggaggaugaggaggaagaagaugaugau

SEQ ID NO: 74083 - RNA, 92 nt, Mus musculus
gaagaggaaaagaaggaggaagaugaggaugaggaauaggacagugaggaagaacaggaggaggaagaagaagaagagaagggggaagagga

SEQ ID NO: 74084 - RNA, 44 nt, Mus musculus
aguaggaagggaaaagggagaagggaaaaggaagggaggaggga

SEQ ID NO: 74085 - RNA, 49 nt, Mus musculus
cuguacuaccaagaggguaccagaguaaaacuauaaagaaccacugggu

SEQ ID NO: 74086 - RNA, 45 nt, Mus musculus
uggucuacggaaagcaacuguggcugacauagaauacagacacac

SEQ ID NO: 74087 - RNA, 23 nt, Mus musculus
cacccugcaaucacugccucugu

SEQ ID NO: 74088 - RNA, 42 nt, Mus musculus
auucacacacaaguaaaaggccagcauggcaggggucccggg

SEQ ID NO: 74089 - RNA, 45 nt, Mus musculus
aaguugguuucuaaaacaaucgcaagaguuacucaaagggaacga

SEQ ID NO: 74090 - RNA, 45 nt, Mus musculus
auauuauguccauagguaguuuaacacaauuacugcguaaaguua

SEQ ID NO: 74091 - RNA, 46 nt, Mus musculus
aacuuuuaacccaaaauuuauccugucaacaagaaaugcacauagg

SEQ ID NO: 74092 - RNA, 46 nt, Mus musculus
acugaaauaauaauauauuuuccaacuaagaaaagucuaggcccag

SEQ ID NO: 74093 - RNA, 41 nt, Mus musculus
gagacuuaccuguggaaggaagagaaauggcaagacugcga

SEQ ID NO: 74094 - RNA, 42 nt, Mus musculus
uaaaggucauuugugugugugugugugugugugugugugugu

SEQ ID NO: 74095 - RNA, 45 nt, Mus musculus
ccaugugcucugaaaagcccagagugccgggcgugguggcacaca

SEQ ID NO: 74096 - RNA, 42 nt, Mus musculus
gaaaaguuugcucagccucguuggcucugagaugaugcccag

SEQ ID NO: 74097 - RNA, 45 nt, Mus musculus
aaugcugugaaggaggccaucuuucuauacaaaccauggugacag

SEQ ID NO: 74098 - RNA, 42 nt, Mus musculus
cgucuuuauagcgauaucuuaaagaaaauguggccccaagga

SEQ ID NO: 74099 - RNA, 45 nt, Mus musculus
gaagagaaagggaaaaggcaaaagaaaaaaagaagagaaaggaga

SEQ ID NO: 74100 - RNA, 43 nt, Mus musculus; identical to SEQ ID NO: 50997

SEQ ID NO: 74101 - RNA, 45 nt, Mus musculus
acccagggcuccuacuggaguaggcccuguuaggcauuccaucag

SEQ ID NO: 74102 - RNA, 46 nt, Mus musculus
uccuugaggaguuagggcaguggcuagaagaccucuuucccccuag

SEQ ID NO: 74103 - RNA, 46 nt, Mus musculus
uugggcccuggcggugccgaucgcagaacgucaccgguuucucaga

SEQ ID NO: 74104 - RNA, 42 nt, Mus musculus
auaaccgcugcccgccccgcggacgucuccccgggcccccgc

SEQ ID NO: 74105 - RNA, 46 nt, Mus musculus
ccggggggucaaccaguucggcaacaaguacauccagcagaccaag

SEQ ID NO: 74106 - RNA, 46 nt, Mus musculus
cucuguugcagccagauuucagcgcaugagggaggaauuugauaag

SEQ ID NO: 74107 - RNA, 46 nt, Mus musculus
aacccaggagaagaugaaguugaaggacuaaaacgcuuaaugacag

SEQ ID NO: 74108 - RNA, 46 nt, Mus musculus
uuguuucugguucagcuucaagagaaagccuuguuugcagucccua

SEQ ID NO: 74109 - RNA, 28 nt, Mus musculus
guagaacaaguuuugguuuucucuuguu

SEQ ID NO: 74110 - RNA, 45 nt, Mus musculus
ugagcuccaagccaaagagagacuguuucagagaaucaggugcag

SEQ ID NO: 74111 - RNA, 46 nt, Mus musculus
ucuugcaauuugcagcaaguccguuucucguuggugguuuuggggu

SEQ ID NO: 74112 - RNA, 47 nt, Mus musculus
uucucugguuuuggucgucuagguagaaguggacaacgguguuugua

SEQ ID NO: 74113 - RNA, 79 nt, Mus musculus
cuuguggaggacaagaaagggucgaaugugucuggaucuguugguuucuguuuuauguguuuuuguguauguguuuaga

SEQ ID NO: 74114 - RNA, 46 nt, Mus musculus
ggauucaucagguaacaaggugcuccucucuugaaauuacagcuag

SEQ ID NO: 74115 - RNA, 27 nt, Mus musculus
gugugugugagagagagagagguggga

SEQ ID NO: 74116 - RNA, 74 nt, Mus musculus
acugugcuuauggacuagaacuuaauaaggaugaaagaguuucugcacuggaaguccucccugauagaguugca

SEQ ID NO: 74117 - RNA, 46 nt, Mus musculus
uauagacauaaagaccugauugcuuuccaguuuaaugaaagcuuaa

SEQ ID NO: 74118 - RNA, 47 nt, Mus musculus
gccucauugaacuuaauugagaaguacuucucaguggaggaagagga

SEQ ID NO: 74119 - RNA, 65 nt, Mus musculus
uugacgccauuucaaauaucuuucaggcugcagagaaacuaggugagacagaaaagcucaguaua

SEQ ID NO: 74120 - RNA, 45 nt, Mus musculus
caggagcacuugcagucuuucccagccugcuaacaaaccccaaaa

SEQ ID NO: 74121 - RNA, 46 nt, Mus musculus
agcuacugaacugcccauugugacucccgcacuaagagccauaggg

SEQ ID NO: 74122 - RNA, 46 nt, Mus musculus
guuaguucgacuccugcaccacaaugauccagaaguauuggcagau

SEQ ID NO: 74123 - RNA, 65 nt, Mus musculus
cgaacuaacguaggaagaaucugcucaacggcaucuaagggaggugcaggguucuuguuucgaca

SEQ ID NO: 74124 - RNA, 46 nt, Mus musculus
gcuuucaaaccuuugucgaaacaagaacccugcaccucccuuagau

SEQ ID NO: 74125 - RNA, 45 nt, Mus musculus
uuccaagagcccaaacagcuugcucgcugaugugagcaugaggag

SEQ ID NO: 74126 - RNA, 45 nt, Mus musculus; identical to SEQ ID NO: 66372

SEQ ID NO: 74127 - RNA, 45 nt, Mus musculus
gguacuguaaauuggucuguugaggacauuguuaaaggcauaaac

SEQ ID NO: 74128 - RNA, 59 nt, Mus musculus
agcugcccgacuuaacagguucaagaacaaggggaaggacagcacagaaaugcgucgcc

SEQ ID NO: 74129 - RNA, 46 nt, Mus musculus
aauguguggugaacuuuuuauuguggucauaucauuaaaauaagau

SEQ ID NO: 74130 - RNA, 46 nt, Mus musculus
accauacaauuacgaucguuuggaauuuucuuuugcaaauugagau

SEQ ID NO: 74131 - RNA, 42 nt, Mus musculus
ggaagccagagugggugguuggggagcagggcagcgggaggg

SEQ ID NO: 74132 - RNA, 46 nt, Mus musculus
uaauuaacaucugcugaggccuagucagccaucacugggaggagag

SEQ ID NO: 74133 - RNA, 45 nt, Mus musculus
uaaaauaagaauucagagagaaucaauaggaugacucaggagguc

SEQ ID NO: 74134 - RNA, 41 nt, Mus musculus
cacuugagugcaaguguuuuagugcuuuuacucgccuggau

SEQ ID NO: 74135 - RNA, 46 nt, Mus musculus
cucaacaaugcagcauaggagacgaccuagacaguaugauucagag

SEQ ID NO: 74136 - RNA, 46 nt, Mus musculus
aucuuaaaaaaaaaaaagguccugugaguaaauuguacaaucauac

SEQ ID NO: 74137 - RNA, 46 nt, Mus musculus
acaaccaaccaucuguaaugagaucuaaugcccucuucuggugcga

SEQ ID NO: 74138 - RNA, 45 nt, Mus musculus
uuauaauaacugaagguuaagaacaguccugugggggcuggcgag

SEQ ID NO: 74139 - RNA, 46 nt, Mus musculus
aagcuuuagcaaaauaagcuguuuggcugcuaaugguggagagcaa

SEQ ID NO: 74140 - RNA, 61 nt, Mus musculus
agcuauaugcauguagggcaaauaugugcgugugggggaggcagaggacagaggaacaggg

SEQ ID NO: 74141 - RNA, 41 nt, Mus musculus
gucggggcauucagugcacagggaggccagagggggcauug

SEQ ID NO: 74142 - RNA, 46 nt, Mus musculus
guguaucgcccuguuuuaacguuuauacaugaaccuauaggaagag

SEQ ID NO: 74143 - RNA, 42 nt, Mus musculus
uuucuuugaaaauauauguuuauuagaaucaccugggcgauu

SEQ ID NO: 74144 - RNA, 42 nt, Mus musculus
uuacuuucauaacccaaaaaacaguucugcaaacccucagau

SEQ ID NO: 74145 - RNA, 44 nt, Mus musculus
gugcagcagugggccggcuggaagggacuugagccccguaucag

SEQ ID NO: 74146 - RNA, 44 nt, Mus musculus
ccugcuuccuuaauuacugcagucucagguccugugcgauugga

SEQ ID NO: 74147 - RNA, 41 nt, Mus musculus
guagagccuaugaugaggcauuuacuuaaauuugguggagu

SEQ ID NO: 74148 - RNA, 45 nt, Mus musculus
ccuccuccuccucuucuucuuuuuuuccuuuuuaagagcccagga

SEQ ID NO: 74149 - RNA, 45 nt, Mus musculus
aaaaaaaauugcugauuucauaaugcggaauacuuuuggggagaa

SEQ ID NO: 74150 - RNA, 46 nt, Mus musculus
gaggagaacaagucacucucuuccucuucaaugacugccucgaggu

SEQ ID NO: 74151 - RNA, 49 nt, Mus musculus
aagcacagaagcaaauuuuugauguuguuuaugaaguagauggaugccc

SEQ ID NO: 74152 - RNA, 46 nt, Mus musculus
aaauucaggaaguucuuucauagaacauucucccauugaaccagau

SEQ ID NO: 74153 - RNA, 57 nt, Mus musculus
ggaucacuaaaagaaguaaugacguaagcaguuuauauuuuacuuugugugugugag

SEQ ID NO: 74154 - RNA, 47 nt, Mus musculus
uguggacgacagagccuuguggaacuucucauccggccagugcagag

SEQ ID NO: 74155 - RNA, 45 nt, Mus musculus
uuguaggucuuggagaauuauugagucauggugaugggccugaga

SEQ ID NO: 74156 - RNA, 73 nt, Mus musculus
uacccuccguuuguaaacuucuuugaaaugagcaaggaaaugaucauuaaaugugagaaacaaaagcccagau

SEQ ID NO: 74157 - RNA, 45 nt, Mus musculus
uugugagccaccgugugguugcugggauuugaacucaggaucucu

SEQ ID NO: 74158 - RNA, 45 nt, Mus musculus
gcuagcacuuggagacugaggcaggaaaauugguagccugaacuu

SEQ ID NO: 74159 - RNA, 42 nt, Mus musculus
gaaaccuuuuuauuaguucauguuucauuuaaggcuggaggu

SEQ ID NO: 74160 - RNA, 45 nt, Mus musculus
ggaugaucuugaagaccuuauugcuaacugggaugagagcagaag

SEQ ID NO: 74161 - RNA, 49 nt, Mus musculus
uuugggagcaucccagauaucuuugaugugcauaugaagaucaagguaa

SEQ ID NO: 74162 - RNA, 55 nt, Mus musculus
agaagaaggacagcguggugggccuauucuugcaccugaggagaucaagacuauu

SEQ ID NO: 74163 - RNA, 45 nt, Mus musculus
gcacaaguacaucauucuauagaugggaaggaaaauguaaugaga

SEQ ID NO: 74164 - RNA, 46 nt, Mus musculus
cgacuguguggcuucuuuccuuaugucuuuaucucaccugucagau

SEQ ID NO: 74165 - RNA, 45 nt, Mus musculus
guucuuuuaaagaguauugguguuguuuugggugguaguggugga

SEQ ID NO: 74166 - RNA, 46 nt, Mus musculus
gcucuaccagacugagagcaauuaugucaauauacuggccacaauc

SEQ ID NO: 74167 - RNA, 45 nt, Mus musculus
gccacugaacuucagaacaggaguuaggaauuguccagggcuaua

SEQ ID NO: 74168 - RNA, 45 nt, Mus musculus
gccucaaaacaaaagcaaaaacaaaacaacagaaacccugaagag

SEQ ID NO: 74169 - RNA, 45 nt, Mus musculus
agagacggagauugaaagagacccuggcucagcucuccagggaga

SEQ ID NO: 74170 - RNA, 45 nt, Mus musculus
ugugugggcagauuuggaggauggagggugucuuagucaggguuu

SEQ ID NO: 74171 - RNA, 44 nt, Mus musculus
ugcugugagccugggcacuccaauuaugaagccagaauggauuu

SEQ ID NO: 74172 - RNA, 45 nt, Mus musculus
uuuuagccaauucuuccaaggugugaacagaacaaaaggagaaau

SEQ ID NO: 74173 - RNA, 44 nt, Mus musculus
acacacacacacacacacacacacacacaccuacaccugaaagg

SEQ ID NO: 74174 - RNA, 46 nt, Mus musculus
ugugugaugugaggggugguugguagguaguauugguaguaaaggc

SEQ ID NO: 74175 - RNA, 46 nt, Mus musculus
uuuugaggucaaauuggugacguugguucaucauauggguggaguu

SEQ ID NO: 74176 - RNA, 46 nt, Mus musculus
augaaaaaauccaggaaaugaaagugcccuguguaaagauggacuc

SEQ ID NO: 74177 - RNA, 46 nt, Mus musculus
gagaaugucaaucaguaaccuuuuacuaaguguuaaacggcggggu

SEQ ID NO: 74178 - RNA, 70 nt, Mus musculus
ggaagucccuguuauaaagauaaaagaaaguuguccuggaaaaucggaggaaaaauuaauaaaaaguauu

SEQ ID NO: 74179 - RNA, 28 nt, Mus musculus
agaagaaaugccgcagguugaagcaaga

SEQ ID NO: 74180 - RNA, 44 nt, Mus musculus
cugggcuuauugggagguaaauguuguguagacacuuugcaaga

SEQ ID NO: 74181 - RNA, 42 nt, Mus musculus
ugaucuaugaaagauucugagaauccacauaaaggugaaguc

SEQ ID NO: 74182 - RNA, 45 nt, Mus musculus
aaugguacuaguuuauauacauuugucuugucaagucuuggagau

SEQ ID NO: 74183 - RNA, 41 nt, Mus musculus
uuguccuuucaauaccuauugaguuucuuucccaaccugca

SEQ ID NO: 74184 - RNA, 45 nt, Mus musculus
uuguuuguuugggcagggaugcacuauagcucugcugguccugga

SEQ ID NO: 74185 - RNA, 45 nt, Mus musculus
aaaugaucuguguauuuaagcauuuccaguguuuugggguguagu

SEQ ID NO: 74186 - RNA, 46 nt, Mus musculus
cacgauuccguuguguuuauuuuuaaaaggucuguagaauauguga

SEQ ID NO: 74187 - RNA, 47 nt, Mus musculus
uuccuuagccacaaacuggauaugacagugacauuugucuuuuagga

SEQ ID NO: 74188 - RNA, 45 nt, Mus musculus
aaaaauauaaaacacaggccgccccgccccuuccuggccacagau

SEQ ID NO: 74189 - RNA, 41 nt, Mus musculus
gcguggugaggacugcggggugagugggggacgggaaggga

SEQ ID NO: 74190 - RNA, 46 nt, Mus musculus
cgagccauggcggcgccugugagggggagacuuaguguuugagaag

SEQ ID NO: 74191 - RNA, 52 nt, Mus musculus
uuauacacuuuuuuauauuaauuacucagaugcaagcuugucuucaaaaaua

SEQ ID NO: 74192 - RNA, 46 nt, Mus musculus
aaggagaggaagagagagaagggcagagacuaaaugucuggauuau

SEQ ID NO: 74193 - RNA, 45 nt, Mus musculus
cuugguuuucacuuucuguggacucuuguuaauugacuugcugac

SEQ ID NO: 74194 - RNA, 48 nt, Mus musculus
cauauucagugggaauccacacaguacaaguuuccacacccccaccac

SEQ ID NO: 74195 - RNA, 46 nt, Mus musculus
auagacagauagacagauagauagauagauaauagaagacagguag

SEQ ID NO: 74196 - RNA, 74 nt, Mus musculus
cugacagaaacuggcgaaguccgugaagaucuuaagcugccagaaggugaacugggcaaagaaauagaagggaa

SEQ ID NO: 74197 - RNA, 45 nt, Mus musculus
aagugguuaacaaaccaggguuuuaaaucagcaauguagcaugua

SEQ ID NO: 74198 - RNA, 45 nt, Mus musculus
auucuguggccuggauuauuuuacugcauuguagguaaugccccu

SEQ ID NO: 74199 - RNA, 42 nt, Mus musculus
gccgggaagggaugucuaaagcacaagauauugacguuguag

SEQ ID NO: 74200 - RNA, 46 nt, Mus musculus
auuuaaguauacuauuacauaguucucaagacuuuuuucugucaag

SEQ ID NO: 74201 - RNA, 42 nt, Mus musculus
gagccuaaguggccagguccgcgguugcaaugacguuagcag

SEQ ID NO: 74202 - RNA, 42 nt, Mus musculus
acuggaaaucuuggcaauguuguucacauugaacgccugaag

SEQ ID NO: 74203 - RNA, 45 nt, Mus musculus
caguacaggggaacaccagggccaagaagugagagugggugguua

SEQ ID NO: 74204 - RNA, 44 nt, Mus musculus
ggaagcagguaggagccaguucuauuagcaaagagaucaacaga

SEQ ID NO: 74205 - RNA, 36 nt, Mus musculus
gacaucaggcugaaaauaucaugcaaaauguauuug

SEQ ID NO: 74206 - RNA, 46 nt, Mus musculus
uagcaaaggcuaagaaacuugugagccaagaaagaugaaaagagag

SEQ ID NO: 74207 - RNA, 45 nt, Mus musculus
auuucaugaagaguauuacaugauuucuuauauuuguaccagaga

SEQ ID NO: 74208 - RNA, 45 nt, Mus musculus
auaagaccaagaaagggaaacuuuuuugauggaaagccccaagga

SEQ ID NO: 74209 - RNA, 45 nt, Mus musculus
aagggucaugcaucuauccuagccuuaugucauggucuaccagau

SEQ ID NO: 74210 - RNA, 44 nt, Mus musculus
agaguccauggauaugccugggaaguuagagauuggcagcagau

SEQ ID NO: 74211 - RNA, 46 nt, Mus musculus
auaaguaaauaauacauagcaauuuaagagagaaguaacaagagag

SEQ ID NO: 74212 - RNA, 41 nt, Mus musculus
acuggcugguuuugugugucaacuuaacacaggcuggaguu

SEQ ID NO: 74213 - RNA, 42 nt, Mus musculus
cagguuucagacugaaagcccguuagagcaaagggggauguc

SEQ ID NO: 74214 - RNA, 42 nt, Mus musculus
uacaaucaguacugaagcugaggagcccaggguuggccagga

SEQ ID NO: 74215 - RNA, 46 nt, Mus musculus
uagaaagauggauagaaagaaagaaugaaagauaagaaagacaaag

SEQ ID NO: 74216 - RNA, 45 nt, Mus musculus
ggucuguuccuucucagaaacccuugaaaacagaaagcacaagaa

SEQ ID NO: 74217 - RNA, 45 nt, Mus musculus
uauaccauucacauuuuuauauuaauuauuaacaacaaugaaaac

SEQ ID NO: 74218 - RNA, 46 nt, Mus musculus
gguuguggaucaccacaacacgaggaacugaauuaaagggucgcag

SEQ ID NO: 74219 - RNA, 100 nt, Mus musculus
gggacuggaaagccaccaaaggaagauuguggacagggaggugguggcucugaaggugcagguuguggauggaucuaggaaucagucucuguaaacgucc

SEQ ID NO: 74220 - RNA, 41 nt, Mus musculus
ucaggaggaggggaaaaaaacacaaaacaaaaagccaagaa

SEQ ID NO: 74221 - RNA, 42 nt, Mus musculus
gacugaacgcccgagucaccuggcuggcguguaaacacagau

SEQ ID NO: 74222 - RNA, 46 nt, Mus musculus
uuaagcuuuugagagacagggaaagcuaauaaagaccuuaauggag

SEQ ID NO: 74223 - RNA, 47 nt, Mus musculus
aaaacucaaaacaugauucaucaaggaaaaaagcaucaccaaggggg

SEQ ID NO: 74224 - RNA, 45 nt, Mus musculus
cacauugauggaauugacugccaauaaccucauucagagaugggu

SEQ ID NO: 74225 - RNA, 44 nt, Mus musculus
aguggaagaguuuuccaaaacagaaucaucugaaacgaggcaga

SEQ ID NO: 74226 - RNA, 46 nt, Mus musculus
aaaaauguugaaaaugauauugacauuuuaaaaaguggccugaaau

SEQ ID NO: 74227 - RNA, 45 nt, Mus musculus
aagguuauuugagaaggggaguggaaaggggaguaagcgacagau

SEQ ID NO: 74228 - RNA, 43 nt, Mus musculus
aauggaugggcagagucacuaccugggaguagagaugccagaa

SEQ ID NO: 74229 - RNA, 42 nt, Mus musculus
aaucuuuagaugccucuuguuugaauguaugcuuugugagau

SEQ ID NO: 74230 - RNA, 42 nt, Mus musculus
gguugccauggcuugggcuugaguuuugugagggugguuaua

SEQ ID NO: 74231 - RNA, 46 nt, Mus musculus
caaaagucagcugaggagagccagagaugugcugaaguguucagga

SEQ ID NO: 74232 - RNA, 42 nt, Mus musculus
ucuguacuucauuaccugaccuugagguucgcuuacuaugau

SEQ ID NO: 74233 - RNA, 24 nt, Mus musculus
aguuucccaauacacuuuagagau

SEQ ID NO: 74234 - RNA, 46 nt, Mus musculus
ugugauaacuccagcuuaugucaaguugacacaaaaccagccagua

SEQ ID NO: 74235 - RNA, 46 nt, Mus musculus
uacaacguuagcuguucuaaaaaauuugcacuuagucguuggaauc

SEQ ID NO: 74236 - RNA, 42 nt, Mus musculus
ggcgacacuccugagagucacuagcaaauuccaaggguagac

SEQ ID NO: 74237 - RNA, 46 nt, Mus musculus
uaucacagagaaaggagccucccuugaggaaaugccuccacgagau

SEQ ID NO: 74238 - RNA, 23 nt, Mus musculus
ucaugauaguugcaguuuauaau

SEQ ID NO: 74239 - RNA, 42 nt, Mus musculus
aaugagaucugaugcccucuucuaguguaucugaagacagcu

SEQ ID NO: 74240 - RNA, 46 nt, Mus musculus
uagguuuuucuuuaacaagcauauguagguuguguaaagcauagac

SEQ ID NO: 74241 - RNA, 45 nt, Mus musculus
uuccauaaggugcuaagaagaagguguagccuuuuguguuuagau

SEQ ID NO: 74242 - RNA, 46 nt, Mus musculus
uuuuuguuuuuuaauauagacacuuuuuagccuuuggcggucagau

SEQ ID NO: 74243 - RNA, 46 nt, Mus musculus
aacuuuuguaguuuuucuugagaugauauuuagggcauuugcaggu

SEQ ID NO: 74244 - RNA, 46 nt, Mus musculus
acagcaacaacagcaaauucagccaaucacccuucagaguccaagu

SEQ ID NO: 74245 - RNA, 46 nt, Mus musculus
aucucauuucuucauucucugcgagaaauagacugcucacuuagau

SEQ ID NO: 74246 - RNA, 46 nt, Mus musculus
auacuguauaacauagcuaucaccacauuuguauagagcuggcagu

SEQ ID NO: 74247 - RNA, 67 nt, Mus musculus
acagcacucacucaccagcuguuguccgagcacugaugagagacuuaaaagcacuuacaguacggcc

SEQ ID NO: 74248 - RNA, 45 nt, Mus musculus
uauuuugugugucggcagcaugaacauuucacagugcgugucagg

SEQ ID NO: 74249 - RNA, 58 nt, Mus musculus
ucaaacauuuuaaaaugaggauuuugauaaguuaaagaagaucucacuaaguagcuug

SEQ ID NO: 74250 - RNA, 42 nt, Mus musculus
gucacucggacaucaagcauccaccaguuaauagcaccaggu

SEQ ID NO: 74251 - RNA, 42 nt, Mus musculus
aagcgcuggucaaacccaguccuugacaauuugccauaauaa

SEQ ID NO: 74252 - RNA, 27 nt, Mus musculus
uguuugugguucugagugaccguuagg

SEQ ID NO: 74253 - RNA, 46 nt, Mus musculus
guguuugggcauuuucugugaccucuacgcuugugaaggggcagug

SEQ ID NO: 74254 - RNA, 29 nt, Mus musculus
uuauucuguucaugaauuguggggcacac

SEQ ID NO: 74255 - RNA, 45 nt, Mus musculus
uguacuuacauauaauaaauaaauaaaucuaaaaaaauuaaaaaa

SEQ ID NO: 74256 - RNA, 45 nt, Mus musculus
aaucccagcaaccacaugguggcucacaaccauccguagcaagau

SEQ ID NO: 74257 - RNA, 46 nt, Mus musculus
ccucucagccauaugcuauuuuuuuccuauuuuuuuuagaccagau

SEQ ID NO: 74258 - RNA, 46 nt, Mus musculus
aguacauuguagcugucuucagacaccccagaagaggccaucagau

SEQ ID NO: 74259 - RNA, 46 nt, Mus musculus
uuuccagcccaugugucugguuuuauuuuauguuauuuuuagagau

SEQ ID NO: 74260 - RNA, 42 nt, Mus musculus
ccaccaucaccacauccuccucccgaaugcagcagccacaga

SEQ ID NO: 74261 - RNA, 45 nt, Mus musculus
ugaguguaguauugagcaggugccauaugauacugugguuugcug

SEQ ID NO: 74262 - RNA, 46 nt, Mus musculus
cgacuugaaacuucagguucccggguaggccucuggagugccagag

SEQ ID NO: 74263 - RNA, 41 nt, Mus musculus
aggaggcgcaugcgcacuucguguuagugauggaggagaga

SEQ ID NO: 74264 - RNA, 45 nt, Mus musculus
agaagagggcauuggaucccauuacagaugguugugagccaccca

SEQ ID NO: 74265 - RNA, 42 nt, Mus musculus
cugcugcacacuccuagccuccugggauuuucuugccucaac

SEQ ID NO: 74266 - RNA, 46 nt, Mus musculus
acugaauugucauuuauuaaccauuucuuaguuaacuauccuggag

SEQ ID NO: 74267 - RNA, 46 nt, Mus musculus
uguguauauuuuaaagucuuuuucuguagcauuuuaagaguucuag

SEQ ID NO: 74268 - RNA, 28 nt, Mus musculus
uacaucauuuccuccuucucuuuacuuc

SEQ ID NO: 74269 - RNA, 45 nt, Mus musculus
aacacaccugaagcccagagggacaaaacaauacaaaaaugccag

SEQ ID NO: 74270 - RNA, 45 nt, Mus musculus
gucuaaccugucucaucuugagacuagagcuuguuguuuugguag

SEQ ID NO: 74271 - RNA, 45 nt, Mus musculus
ucugggaccauuuguaaccaauaguauuuuuuauaaaauucggaa

SEQ ID NO: 74272 - RNA, 46 nt, Mus musculus
auguauuauguaaguggcaccacgugugugccuuauaccuacagag

SEQ ID NO: 74273 - RNA, 46 nt, Mus musculus
uuuauuucacguaugugaguacacuugucacugucuucagauacag

SEQ ID NO: 74274 - RNA, 44 nt, Mus musculus
aguguuuacacagacguuccuuaaaugcuuuaguuccugggacu

SEQ ID NO: 74275 - RNA, 30 nt, Mus musculus
gaaggaucaagaauucaaagccagccuggg

SEQ ID NO: 74276 - RNA, 54 nt, Mus musculus
ccagaccugucucauacucuccuuugaugcugguacuuuuuaguuuccugcaac

SEQ ID NO: 74277 - RNA, 52 nt, Mus musculus
aaucuauaacaucaucugagguauuauuaucccauuuuauggaugagacaag

SEQ ID NO: 74278 - RNA, 46 nt, Mus musculus
uauggagcacugacaccuuuguuuguucaacauuuauucacuggag

SEQ ID NO: 74279 - RNA, 46 nt, Mus musculus
ugggaaacuuaaagagcaugacauuaggugggaaggaucuagggga

SEQ ID NO: 74280 - RNA, 46 nt, Mus musculus
cuggugccggaggaagcuucucugaugaugacugagcagagcacag

SEQ ID NO: 74281 - RNA, 44 nt, Mus musculus
uaaaauauuuaaguaaaaauagugucuuguguuuuguuaauaaa

SEQ ID NO: 74282 - RNA, 46 nt, Mus musculus
aauauguuccuguguuuggggagggaaauuuauacuaaaggaagcu

SEQ ID NO: 74283 - RNA, 57 nt, Mus musculus
ccuggggaaagcauugaaacagauuuuccgugaguacagggcuagugcuuguagaga

SEQ ID NO: 74284 - RNA, 67 nt, Mus musculus
guggaugugggguugcaaggccucccgcaggagauggagcaaugaggguggcuuccucagugagagg

SEQ ID NO: 74285 - RNA, 89 nt, Mus musculus
ggguccagcuuauuucaucaacauuuuaauguuucaugcagcacagaaugaccaacuagucugucgcauaggcguugagucacacggag

SEQ ID NO: 74286 - RNA, 46 nt, Mus musculus
gauauguguucuuuugacaaugagcagccguucaccaugaaaugga

SEQ ID NO: 74287 - RNA, 46 nt, Mus musculus
cgcccucuucuggugugucugaggacagcaacaguguacucacaua

SEQ ID NO: 74288 - RNA, 23 nt, Mus musculus
gucacccgaccuuccagcuuuag

SEQ ID NO: 74289 - RNA, 46 nt, Mus musculus
uguagcaugcaggaaugugucauaaaaccacaggaaugagcaccag

SEQ ID NO: 74290 - RNA, 44 nt, Mus musculus
ucagaggaggggcaucucagaggagggcuucaaagaaugugaga

SEQ ID NO: 74291 - RNA, 46 nt, Mus musculus
cucgcccucucccgugugugugugugugugugugugugugcgugug

SEQ ID NO: 74292 - RNA, 42 nt, Mus musculus
uugacuagacacuccacuucuaggcaccuuuguagaucgcac

SEQ ID NO: 74293 - RNA, 46 nt, Mus musculus
uuuuguuggucuuuguucguauuuguuuguugggaaguuggcuaga

SEQ ID NO: 74294 - RNA, 49 nt, Mus musculus
auaauccuucaagucaugagaguuuggaccaaguuggugaagaaaagga

SEQ ID NO: 74295 - RNA, 46 nt, Mus musculus
cgaaaucuaaugcccucuuggaguaucugaggacaaacacagugua

SEQ ID NO: 74296 - RNA, 42 nt, Mus musculus
ccacgcccggcuucucucuuucuuuucuuucuuagaccacau

SEQ ID NO: 74297 - RNA, 46 nt, Mus musculus
uaccccuuggaucaccuuugccuuccuuugcucuccucccagcuau

SEQ ID NO: 74298 - RNA, 60 nt, Mus musculus
cagucuaggucugcaggauuucgauuugcuucgaguuauagggaggggaaguuacgccaa

SEQ ID NO: 74299 - RNA, 54 nt, Mus musculus
aguacuguugguucgguuaaagaaaacagaucgcauuuaugcaaugaaaguugu

SEQ ID NO: 74300 - RNA, 42 nt, Mus musculus
uagcacugaauuaucuucaugagcgagggauaauuuauagag

SEQ ID NO: 74301 - RNA, 47 nt, Mus musculus
auuuggugguuggcuugguuuuauuuugucuuuguuuugguaggugu

SEQ ID NO: 74302 - RNA, 47 nt, Mus musculus
cuccuguuucagccuuccaagugcugggauuacacguggaccaccau

SEQ ID NO: 74303 - RNA, 64 nt, Mus musculus
uuuauuugugcauuguucaccuuccuacagcuauuaaaauaucaaagcagaagacacagucggu

SEQ ID NO: 74304 - RNA, 89 nt, Mus musculus
aggaaagaaaacaucacaaugucaacagucaugaaguagucacuguagucacaugaucucuguuuucauaguaaauuuuaauaaauguu

SEQ ID NO: 74305 - RNA, 47 nt, Mus musculus
uucagguuuaacauauugcauauacaugcugaguuuagacacaugaa

SEQ ID NO: 74306 - RNA, 46 nt, Mus musculus
cacaaccagcacuuucugcggcacucccaauuacauugcuccagag

SEQ ID NO: 74307 - RNA, 46 nt, Mus musculus
ggagggagugucauggugaggagugcugacagucaacagagcagag

SEQ ID NO: 74308 - RNA, 46 nt, Mus musculus
aaugauacugugauucuuaucuuuuuaagucauuuuggaaaagcag

SEQ ID NO: 74309 - RNA, 46 nt, Mus musculus
agcuguguuucuguaucuuuagccauaaaaccgauuucucaccaag

SEQ ID NO: 74310 - RNA, 41 nt, Mus musculus
aaauaaaugaagguauaaaauggguuaccucugugggcaca

SEQ ID NO: 74311 - RNA, 46 nt, Mus musculus
gaggcuuuaacgaugagcuaaacauaagugugcuguaacguccaga

SEQ ID NO: 74312 - RNA, 42 nt, Mus musculus
acaucagagagcacaucaaagugugaggggcagugucccaag

SEQ ID NO: 74313 - RNA, 45 nt, Mus musculus
ucugagcuuccuuuucuuaucauguugccuuaacccuagauccag

SEQ ID NO: 74314 - RNA, 44 nt, Mus musculus
cuuggagaaugcuacguuucauuagaagugugaguugugucaag

SEQ ID NO: 74315 - RNA, 45 nt, Mus musculus
auaaagccaacaaggggccaucgaggccacuugccaaaaccugaa

SEQ ID NO: 74316 - RNA, 46 nt, Mus musculus
cugacacauuucauguugaaguguguguuuccccuaagaccuggaa

SEQ ID NO: 74317 - RNA, 46 nt, Mus musculus
ccugccugggacucuuuggggcuuuguauuccauuuugagaaacuu

SEQ ID NO: 74318 - RNA, 45 nt, Mus musculus
cuuggugucuuagacaccacuuauguugcauaagcuugugaucag

SEQ ID NO: 74319 - RNA, 46 nt, Mus musculus
cagaguuuaagacuuggggcaaacagagucucuuuucuccuccaac

SEQ ID NO: 74320 - RNA, 44 nt, Mus musculus
auuacagagucuuugugcaucggucaacgugaucagcccacagg

SEQ ID NO: 74321 - RNA, 44 nt, Mus musculus
aacgucuggggagcaaacauuccacagcacuccaggcacuggau

SEQ ID NO: 74322 - RNA, 46 nt, Mus musculus
gguauuuuugguucacaugaagguaacagugccacuuggcugacuc

SEQ ID NO: 74323 - RNA, 46 nt, Mus musculus
cacgccuuuaaucccagcacucgggaggccuggccagcacucggga

SEQ ID NO: 74324 - RNA, 44 nt, Mus musculus
cugugugugucugugugugugucugugugugugucuguguuucg

SEQ ID NO: 74325 - RNA, 44 nt, Mus musculus
ugucagaaaaauaaauggugcgaguccuugagugugccucccac

SEQ ID NO: 74326 - RNA, 34 nt, Mus musculus
auguggggcaggccuuccagaggggaugcagacc

SEQ ID NO: 74327 - RNA, 47 nt, Mus musculus
auauagcuuggcauggugguacaugccuguaaucccagcaccaggag

SEQ ID NO: 74328 - RNA, 46 nt, Mus musculus
aaauucuaguugguaaaaaauaaacacaguccuucuaagggcacaa

SEQ ID NO: 74329 - RNA, 44 nt, Mus musculus
uugguagcuacagagaaagggcguucacaaagagucccuauuga

SEQ ID NO: 74330 - RNA, 45 nt, Mus musculus
cuugcagaguucagaaacaaaccgaguucucacagguagccuggc

SEQ ID NO: 74331 - RNA, 41 nt, Mus musculus
uaugaauucaaggaaaccuauguguuaauuacggagggggg

SEQ ID NO: 74332 - RNA, 47 nt, Mus musculus
aaaagagcauccuggugaccaaagaaacgcaccucccuccccgaccc

SEQ ID NO: 74333 - RNA, 46 nt, Mus musculus
uguguggcagaugguugugauuguauauaccuuuuaucccacccag

SEQ ID NO: 74334 - RNA, 45 nt, Mus musculus
augccccaauacaggggaaugccagggccaagaagugggagugca

SEQ ID NO: 74335 - RNA, 46 nt, Mus musculus
acaguugagaaauucucaaagaauaaaagaaauaguaugucuuaaa

SEQ ID NO: 74336 - RNA, 46 nt, Mus musculus
agcuacauucaugucuaagaugggucauccuaacagaugccaccgg

SEQ ID NO: 74337 - RNA, 46 nt, Mus musculus
acaugcuuacucccaccugaugaaaccccagcaugcguggccccag

SEQ ID NO: 74338 - RNA, 90 nt, Mus musculus
cacauugugugugguuauuguguaaaccauaaacuaaaaugccaagaucuaaauauggugagccucaacucagccuaauagacugccuau

SEQ ID NO: 74339 - RNA, 45 nt, Mus musculus
uuguuucauagaaauguaaaucucaugacagagaaaauggcccca

SEQ ID NO: 74340 - RNA, 45 nt, Mus musculus
agccuucacuucagugcgcuucucagcaacuuccuaucugcgggu

SEQ ID NO: 74341 - RNA, 45 nt, Mus musculus
acauguaggcccaguguccaugaaguacagaagagggugucagau

SEQ ID NO: 74342 - RNA, 46 nt, Mus musculus
cuacagacgugacaagauaagagauuuuuagaacccgacauuuuca

SEQ ID NO: 74343 - RNA, 68 nt, Mus musculus
aggagagggagggcugagacugaacacaguggggaggagagggagggcugagacugcacacagugggg

SEQ ID NO: 74344 - RNA, 44 nt, Mus musculus
aggauuuauugcuucauuggaguagguggagccuuccuuguugg

SEQ ID NO: 74345 - RNA, 46 nt, Mus musculus
aggugauaugcugccaucugccuauacugcugcuaucauuguuuga

SEQ ID NO: 74346 - RNA, 46 nt, Mus musculus
uaucaauacccagucucaaaaacaaauaauaaaauacaauuucuaa

SEQ ID NO: 74347 - RNA, 46 nt, Mus musculus
augagaagaugauuucaaagaucauaguuuguuuccuuuuguguag

SEQ ID NO: 74348 - RNA, 42 nt, Mus musculus
ugccacugaugaaaguaccgucucuucuguacaagguucuag

SEQ ID NO: 74349 - RNA, 46 nt, Mus musculus
ugcauaauuuuuaauuaugguuacgguagguuacaaguauguguaa

SEQ ID NO: 74350 - RNA, 45 nt, Mus musculus
augaucgagagacucgacaucagcgagacagcaggagacgcccag

SEQ ID NO: 74351 - RNA, 45 nt, Mus musculus
uaaacaguauaauccgacaaagguuauuccuucuuucagggccau

SEQ ID NO: 74352 - RNA, 42 nt, Mus musculus
uagaguaauucccagugaagguuuccuuaagaggucaggcuu

SEQ ID NO: 74353 - RNA, 45 nt, Mus musculus
aaugcuguuguagagaauucagcuccuagcacccaccacgggcua

SEQ ID NO: 74354 - RNA, 45 nt, Mus musculus
cgugauuaggugaauucuucuguaguuugaauguuggaagcagua

SEQ ID NO: 74355 - RNA, 46 nt, Mus musculus
uccuucacuagccaugggggacugagcucaagaaugcucaagguuu

SEQ ID NO: 74356 - RNA, 55 nt, Mus musculus
gauuaucuauagcuaauacugugaaaaugccauguaaacaguuuacauuuauuug

SEQ ID NO: 74357 - RNA, 57 nt, Mus musculus
caaagauccagacagcaauccauacagcuuacuugauaauacagaauccgaucagac

SEQ ID NO: 74358 - RNA, 60 nt, Mus musculus
ugcagacacugacgccagcgaaucucaccacaguacuaaccgucguaggcggucucguag

SEQ ID NO: 74359 - RNA, 57 nt, Mus musculus
gacugacugaaucugauacagccucaguuaaugagaaugggcuagguauguaagcac

SEQ ID NO: 74360 - RNA, 46 nt, Mus musculus
cuuauauuucugaaugauggugguuguuucaauuacauggcaguuu

SEQ ID NO: 74361 - RNA, 46 nt, Mus musculus
cauugcagggacuauggugugaauuguguugagguugauuggcaaa

SEQ ID NO: 74362 - RNA, 48 nt, Mus musculus
auuuguuuucccuuuauauuccuuuuccuucuuaauguuagagaugua

SEQ ID NO: 74363 - RNA, 46 nt, Mus musculus
auagaaaauucaggcuauuaguaugggcucacuaacuuggaaugac

SEQ ID NO: 74364 - RNA, 48 nt, Mus musculus
cuaaacuuuggacuaauaacuacaaaguguuuuuuucuguauagggau

SEQ ID NO: 74365 - RNA, 45 nt, Mus musculus
gguugcuacaccacauucgucccaccaccuuagauaaaccaggag

SEQ ID NO: 74366 - RNA, 47 nt, Mus musculus
accucccaagggaaacuuuggcuaaaaacaagaaagaaaugguaagg

SEQ ID NO: 74367 - RNA, 67 nt, Mus musculus
guccaacuagcgcuucuggcgaugaaauuccuaagcuaccgcguacucugggagaagaaaagacuaa

SEQ ID NO: 74368 - RNA, 46 nt, Mus musculus
aauagugcuuguacaagcuugccaaagauagaauacggaucgccag

SEQ ID NO: 74369 - RNA, 45 nt, Mus musculus
uugacaccuacuguguuaaaaauauaucaucagaugugccuugag

SEQ ID NO: 74370 - RNA, 45 nt, Mus musculus
cauuuuuaauaauaugcaaccacuucuucacccgaggaaaacuag

SEQ ID NO: 74371 - RNA, 46 nt, Mus musculus
agaaacaucuuuguauuaaauucuaaucaaaggcaauuuguggaag

SEQ ID NO: 74372 - RNA, 46 nt, Mus musculus
cagggcccugugcaugaaaggcuuugacauagcuuuaaacucccag

SEQ ID NO: 74373 - RNA, 46 nt, Mus musculus
uguaauucugaauuuuuuuuaaauuuuauuaguucaaaggggcaaa

SEQ ID NO: 74374 - RNA, 46 nt, Mus musculus
aauuuuacagucacauaagcuuggucauaacugaaaaucaaaacaa

SEQ ID NO: 74375 - RNA, 43 nt, Mus musculus
ggcgaugagcaucccugaucuucccuuuauuggcaguagggcu

SEQ ID NO: 74376 - RNA, 46 nt, Mus musculus
uuacaccuaauauuaaugcugcuucccguuuugucauuuuggguuc

SEQ ID NO: 74377 - RNA, 41 nt, Mus musculus
gaggcuccacaugcuucauggcuuguaaaacauaacggccu

SEQ ID NO: 74378 - RNA, 44 nt, Mus musculus
gcagcaauggucaacccgacugcuaccacugugcuggccuguaa

SEQ ID NO: 74379 - RNA, 44 nt, Mus musculus
ucaccaagaagaaaaggguaagucaucuuuacccacaacaguaa

SEQ ID NO: 74380 - RNA, 46 nt, Mus musculus
cgcgcucaucccagcgcgagcccaccgccacgguacagcuguggag

SEQ ID NO: 74381 - RNA, 42 nt, Mus musculus
aggaagaagaggaggaagaagaaggaaggcaggaaagaggag

SEQ ID NO: 74382 - RNA, 45 nt, Mus musculus
uuauauuuuuguguugccugugacuggauauguuuugggcccuag

SEQ ID NO: 74383 - RNA, 46 nt, Mus musculus
ccuagaaaguacaacuuugaaauuguagucaaaguucauugauaaa

SEQ ID NO: 74384 - RNA, 45 nt, Mus musculus
gcacacguguuuguguguguguauauuaugcauaugugcuuugug

SEQ ID NO: 74385 - RNA, 46 nt, Mus musculus
gugggacauauguauguguauaagcguaguauauaugugguguguu

SEQ ID NO: 74386 - RNA, 24 nt, Mus musculus
ucccgagucucugaccugggcucc

SEQ ID NO: 74387 - RNA, 46 nt, Mus musculus
uguuuuuuauuucucagagagagaagaacaugaaguugggucucug

SEQ ID NO: 74388 - RNA, 45 nt, Mus musculus
gagagaagagagagagagagagagagagagagagagagaguuagu

SEQ ID NO: 74389 - RNA, 77 nt, Mus musculus
uaugaggaucagguaaguagaaaacagcagagaugaagacaaggaaaggggagugacaguuuaacuacaggacagcu

SEQ ID NO: 74390 - RNA, 42 nt, Mus musculus
ugaucuccuuaucuccuucagaacaagccuugauuccagcac

SEQ ID NO: 74391 - RNA, 46 nt, Mus musculus
uaacugauuaugaaggagaaaagguagaaaaauaauacuagugaaa

SEQ ID NO: 74392 - RNA, 46 nt, Mus musculus
ucaaggaaguuaaaaaagaauaauaaaggauguucagugaaaggag

SEQ ID NO: 74393 - RNA, 45 nt, Mus musculus
cuuaaaaaaaaauuagcuaaaaaaaagaauugcaaguauauggag

SEQ ID NO: 74394 - RNA, 42 nt, Mus musculus
auugucagugcaggcaaaacgaauagaaacaauagggcacag

SEQ ID NO: 74395 - RNA, 46 nt, Mus musculus
ucucauugccaacaccaccgggccaguuuacuuagaguuaggguag

SEQ ID NO: 74396 - RNA, 46 nt, Mus musculus
auaacugauuauccaauuuuaaagaauaugcaauaugaucauuuag

SEQ ID NO: 74397 - RNA, 46 nt, Mus musculus
uucaagaauuguuugguuuggaaccaacuauaauuccacccaagaa

SEQ ID NO: 74398 - RNA, 46 nt, Mus musculus
gaguuaaaguaaaaacagaaucucaagaccccacaucuucauggag

SEQ ID NO: 74399 - RNA, 47 nt, Mus musculus
gcugcagucaaaugauguugaucucuacuauuacauggaugagccag

SEQ ID NO: 74400 - RNA, 59 nt, Mus musculus
uuaccuccaugcugggggcuagacaucguuugugguaaagggacagacuuuaacuaugg

SEQ ID NO: 74401 - RNA, 66 nt, Mus musculus
acccugggcugacaggcagagguacuugagugauuauauuucuaauaaucuuucaagugcauugag

SEQ ID NO: 74402 - RNA, 45 nt, Mus musculus
acugugggugugugcacaugagcucacguauccauagaggccaga

SEQ ID NO: 74403 - RNA, 46 nt, Mus musculus
gaacacuuugauccaaauauuaacuuguuuauggagaaaccacaaa

SEQ ID NO: 74404 - RNA, 45 nt, Mus musculus
agccuggggcuuuggggguauauagauucauaaaugaaagacuug

SEQ ID NO: 74405 - RNA, 46 nt, Mus musculus
augaaaaaggccuuauuaaaugauguguggcuguaguuuaugaagg

SEQ ID NO: 74406 - RNA, 42 nt, Mus musculus
gucuggaacuugucuugaguaucauaccugucuaccuggaag

SEQ ID NO: 74407 - RNA, 45 nt, Mus musculus
ugauaaaagagauugcaaacaguuggagugacggcuuggugguua

SEQ ID NO: 74408 - RNA, 93 nt, Mus musculus
auuaucaaguucugaaagucucugagauugcacagccuggaagaccaagacaaauccuugcauuugaacuccgaaugaauauuauuacagaug

SEQ ID NO: 74409 - RNA, 29 nt, Mus musculus
gggcuggcucauauuuagaaauuaauauu

SEQ ID NO: 74410 - RNA, 55 nt, Mus musculus
cuuuaaguuaauaauuguguuauuuaagguuucugcugcugugaugaaacgggau

SEQ ID NO: 74411 - RNA, 41 nt, Mus musculus
cgggagucaggcgacuccgcuggcaagguagcccggggcuc

SEQ ID NO: 74412 - RNA, 46 nt, Mus musculus
ugaugcuacuaccaguaugcaauaucggacccuuuuagaagcagag

SEQ ID NO: 74413 - RNA, 74 nt, Mus musculus
cacagacauggcaaugugaauuggaaguauauaaagccacauaccacuucaucuuugcacagaagaacuucuuu

SEQ ID NO: 74414 - RNA, 46 nt, Mus musculus
ucccugcauuuucuuuagacaggaacaauuuaaaacaauuuugaag

SEQ ID NO: 74415 - RNA, 46 nt, Mus musculus
auauuccaggucucugagacuuucuagagguucccacugcccccua

SEQ ID NO: 74416 - RNA, 46 nt, Mus musculus
ggacuccgugcucaguccaaugguuggcugccucuguacuugucag

SEQ ID NO: 74417 - RNA, 46 nt, Mus musculus
uguuuucuuccccauuaaaauagguagaaauaaacauaauaagaag

SEQ ID NO: 74418 - RNA, 42 nt, Mus musculus
cuuuucuuugccuuuuacggacuuuguuccagcuacgugcaa

SEQ ID NO: 74419 - RNA, 42 nt, Mus musculus
ucagaaauggaagaaacaaugcuaucuguauuaaggccagcc

SEQ ID NO: 74420 - RNA, 42 nt, Mus musculus
cuagguuuccaguacuaggcauaauuucuucuuguugggcag

SEQ ID NO: 74421 - RNA, 45 nt, Mus musculus
ucaaacauccuugcuuuugccucuuuccuguccagccuucuucag

SEQ ID NO: 74422 - RNA, 42 nt, Mus musculus
uugugauuaguggguugcuacaguuauuuuguguucugggau

SEQ ID NO: 74423 - RNA, 41 nt, Mus musculus
gugcaguucgaauugcaaacuguaaucuucacaaucaguca

SEQ ID NO: 74424 - RNA, 46 nt, Mus musculus
cagccaacuuaggucuuauuacaguugauauugcauuagcugccga

SEQ ID NO: 74425 - RNA, 46 nt, Mus musculus
agccuggagaguggaucauuacuaaagaaauccccaagacuguaga

SEQ ID NO: 74426 - RNA, 46 nt, Mus musculus
gugaacaguaugaagaggaaagaaugggaaaacaaaucagugggaa

SEQ ID NO: 74427 - RNA, 45 nt, Mus musculus
aggagaacagcagcuccagugcugcgcagcccuuacuggccggcg

SEQ ID NO: 74428 - RNA, 60 nt, Mus musculus
aucucaggaaccaguccugugucuccuaacacccaagauaagucaguaggacagucuccu

SEQ ID NO: 74429 - RNA, 46 nt, Mus musculus
ccuccaaguccucauugcaucgcccccuugaccuagauacaccaac

SEQ ID NO: 74430 - RNA, 46 nt, Mus musculus
agaccuuauuuuaagaauaaauuaccccaaauaauuuuuugugcag

SEQ ID NO: 74431 - RNA, 46 nt, Mus musculus
aagcuucaacuucuauucuuguuuauauucuauuaaguagcacccc

SEQ ID NO: 74432 - RNA, 41 nt, Mus musculus
uuuuuucucaagggaaauggaggaggaauggauugggggag

SEQ ID NO: 74433 - RNA, 48 nt, Mus musculus
uuuuuucuuuuuuuuaagacacaaaacuggguggguaggacaggaagg

SEQ ID NO: 74434 - RNA, 45 nt, Mus musculus
uuuuauuaugguagaauuuaauugugaugaauacgguaacagcaa

SEQ ID NO: 74435 - RNA, 46 nt, Mus musculus
cuggcaggcgugugucacuccugggagaccagcucucuccugacag

SEQ ID NO: 74436 - RNA, 46 nt, Mus musculus
uuacaaaauuuaugaaucaugacauuaaaugugccauggccccaga

SEQ ID NO: 74437 - RNA, 46 nt, Mus musculus
cuaaugccaccaccuccagauucauguagcaugaaguugacuauua

SEQ ID NO: 74438 - RNA, 42 nt, Mus musculus
gcuguguccucuuuuauacugugcaggaccccuuucccaggg

SEQ ID NO: 74439 - RNA, 41 nt, Mus musculus
cuaauuauauggucaauuuuggagacaguaccaugaggugc

SEQ ID NO: 74440 - RNA, 46 nt, Mus musculus
uuccuaaccucuuuccuagguuuuccauuuccaaguuugccuccau

SEQ ID NO: 74441 - RNA, 41 nt, Mus musculus
uauuuucugauuuuuuguuuuuaaauagagauauggcccau

SEQ ID NO: 74442 - RNA, 42 nt, Mus musculus
uguuugggauuggcauggugaaccgcacacaccuagaggcag

SEQ ID NO: 74443 - RNA, 45 nt, Mus musculus
agcauauugauauugauaaacaagccagagccugguggaaagaag

SEQ ID NO: 74444 - RNA, 46 nt, Mus musculus
ucugacgcccucuucuggagugucugaagacagcuacaguguucuu

SEQ ID NO: 74445 - RNA, 46 nt, Mus musculus
aagugugugugugagugugugugugagugugugugcgugcauaugu

SEQ ID NO: 74446 - RNA, 46 nt, Mus musculus
accaugucagggaaauacauuauggaagaacaugauaguuacucag

SEQ ID NO: 74447 - RNA, 34 nt, Mus musculus
cagguugguuccuuugaacacaaucucacaacag

SEQ ID NO: 74448 - RNA, 45 nt, Mus musculus
uggaaguugaauaagucuggcugcuuccaacaaggauugggagau

SEQ ID NO: 74449 - RNA, 45 nt, Mus musculus
uaagauugguuaagaaaccuuauuguggguuucagauaugaggua

SEQ ID NO: 74450 - RNA, 25 nt, Mus musculus
auauuaaaaaggaaaaaguacacag

SEQ ID NO: 74451 - RNA, 45 nt, Mus musculus
cuugccuaccauucagaacacccugauuuagaucucuagcaccac

SEQ ID NO: 74452 - RNA, 45 nt, Mus musculus
ggcaaaaggcuuaaugcucugggcaacacccuuacaacacugaca

SEQ ID NO: 74453 - RNA, 47 nt, Mus musculus
guagauuaucgaagacaaggaacaucuucuagucagccaggagaacu

SEQ ID NO: 74454 - RNA, 45 nt, Mus musculus
cucaaggauaagugggguuuagguuacaaaccaaguuacagccga

SEQ ID NO: 74455 - RNA, 46 nt, Mus musculus
cgaauaggagaaacugaugagcucccagaaauccguguggaugcag

SEQ ID NO: 74456 - RNA, 45 nt, Mus musculus
auuaaguugaaaaacacaguguggggaaguucaccacaguccaga

SEQ ID NO: 74457 - RNA, 42 nt, Mus musculus
aucguguucaguguucagcucucccaaaaccacaggcggcuu

SEQ ID NO: 74458 - RNA, 46 nt, Mus musculus
uaaugacuggcaagaaagugccauccucucuacagacaaagcccag

SEQ ID NO: 74459 - RNA, 45 nt, Mus musculus
uuauuguguuccauucaguacaucacauuuaucaauauucuagcu

SEQ ID NO: 74460 - RNA, 45 nt, Mus musculus
gcagucagcucacaagaugaagauaugggacauuuugacauccca

SEQ ID NO: 74461 - RNA, 45 nt, Mus musculus
cccuagugucaucuucaacaucugcauacucuuccuucccuguag

SEQ ID NO: 74462 - RNA, 46 nt, Mus musculus
aaaccgaggagaacuggaaacuuuggggacuacauacccugcagag

SEQ ID NO: 74463 - RNA, 46 nt, Mus musculus
auagaaauacaaauuuaagugagagcgcaguguuggcuaguuugag

SEQ ID NO: 74464 - RNA, 31 nt, Mus musculus
agaaauccacuguuucuggucucacaucugg

SEQ ID NO: 74465 - RNA, 42 nt, Mus musculus
ugugauauagggucugcuucauuuaaguacgauaugcgccga

SEQ ID NO: 74466 - RNA, 45 nt, Mus musculus
gugguuugaaaagccaaggccggcuuucuguaggaagcaaccgug

SEQ ID NO: 74467 - RNA, 52 nt, Mus musculus
accuguuccuuaucugccgcccaagacaaugaccaacaaccuggaaaagaau

SEQ ID NO: 74468 - RNA, 45 nt, Mus musculus
uaucuggaugccacauauccuuauuucagguuccauuaccagaag

SEQ ID NO: 74469 - RNA, 50 nt, Mus musculus
gcuuguuuucaugguccaaauuuccguucaaaauccugggcccuuuuuca

SEQ ID NO: 74470 - RNA, 45 nt, Mus musculus
ucauaaauaagucauuuuucuuuguuuuguauguugauuuuugag

SEQ ID NO: 74471 - RNA, 46 nt, Mus musculus
ggacuagagacacauaacacuguguccagcuuuauauugauucugg

SEQ ID NO: 74472 - RNA, 46 nt, Mus musculus
caaaccaugcggugcucuggaaagucccauggcaacaauaaccaag

SEQ ID NO: 74473 - RNA, 46 nt, Mus musculus
ggaguugccaguguaaaagaaugguucaacuaugucacugccacaa

SEQ ID NO: 74474 - RNA, 46 nt, Mus musculus
acggagaacaguacuacuguaaagaauucuaguuuguugagugggu

SEQ ID NO: 74475 - RNA, 46 nt, Mus musculus
aaggugcuguccguucucaucaaaaaacucggaacugcccugcagg

SEQ ID NO: 74476 - RNA, 41 nt, Mus musculus
uuugccuuugccaaaauaagauuuuauuuugaaagacagga

SEQ ID NO: 74477 - RNA, 45 nt, Mus musculus
cugcaauuacuaaagaugaguuuuuuaaaaacccauaugucaagc

SEQ ID NO: 74478 - RNA, 42 nt, Mus musculus
aagaagacaggagacaggagacaagaagacaggagacaggag

SEQ ID NO: 74479 - RNA, 46 nt, Mus musculus
gcccuaaacgacacuagaaaacugcccauccuugcuccugugccau

SEQ ID NO: 74480 - RNA, 42 nt, Mus musculus
aauacgucgguuuacuauggaugcuaacuaauguccccagac

SEQ ID NO: 74481 - RNA, 46 nt, Mus musculus
guccacgaucccacaguaccagaccccaaacaacucucggccaaau

SEQ ID NO: 74482 - RNA, 46 nt, Mus musculus
ugagaaucaaacauggauccaaggcuuacacagucagaaagcagag

SEQ ID NO: 74483 - RNA, 45 nt, Mus musculus
uggcacaugccuuuaaucucagcacucagaggaagaggcaggcag

SEQ ID NO: 74484 - RNA, 46 nt, Mus musculus
aacaaaacaaaacacccaaaucaaaacagaacauucuuagguaaag

SEQ ID NO: 74485 - RNA, 46 nt, Mus musculus
cccucuccaaagaauccuagaaauagauauguauuuaacugaccuu

SEQ ID NO: 74486 - RNA, 46 nt, Mus musculus
acauaaaacaguguauuaaauacaguggaauaaguuccguggggag

SEQ ID NO: 74487 - RNA, 46 nt, Mus musculus
gcacaugaagaagucccagcaaaauauauguucuuuaguucuucag

SEQ ID NO: 74488 - RNA, 45 nt, Mus musculus
aauucuuaauguuuucaaaucaaccuauaagcauauaugcugcug

SEQ ID NO: 74489 - RNA, 42 nt, Mus musculus
gagccuucaucagcagagagacagauggaaaacaggugcagg

SEQ ID NO: 74490 - RNA, 45 nt, Mus musculus
aaacugggagucugugagaagcuggaguagauagauggccucaaa

SEQ ID NO: 74491 - RNA, 88 nt, Mus musculus
ccacugugugcauaaggguagggguauuggcguaucuuugaagcuauaacagugcuggcuuggguaugauaaggcugcaagauggugu

SEQ ID NO: 74492 - RNA, 46 nt, Mus musculus
ggucccagggauggcugccucugaggugaggguagggugagagaag

SEQ ID NO: 74493 - RNA, 46 nt, Mus musculus
uacaguuuauucucaucuaaggacuuaauuguucauaguagcacag

SEQ ID NO: 74494 - RNA, 42 nt, Mus musculus
aauuuacaaugcguacaaacaaaucaguccaucuguccccag

SEQ ID NO: 74495 - RNA, 46 nt, Mus musculus
uacacauaaauaauaaauaaaucauuaacaaauauaucucguccac

SEQ ID NO: 74496 - RNA, 42 nt, Mus musculus
gaaagacucugacuuuugcauuuacacuuaguggccacugau

SEQ ID NO: 74497 - RNA, 45 nt, Mus musculus
uucagagcagccccaaugucaugcacugcuguucaccuagaguua

SEQ ID NO: 74498 - RNA, 42 nt, Mus musculus
aagaaggaagaaggaggaggaagaaggaggaagaaggaggaa

SEQ ID NO: 74499 - RNA, 45 nt, Mus musculus
ucuucaguggucacaguccccagauguaacaaauauggccuucga

SEQ ID NO: 74500 - RNA, 75 nt, Mus musculus
gggauuucuuuccuccaaguuggcuuaagaaucacaauuagagacaggagugaggacaaggugggcuugcuugca

SEQ ID NO: 74501 - RNA, 84 nt, Mus musculus
cucccgaaggaagguucgugcagcuuguguggggcauuccugaaagacgggcgcauuuguuugacuuacauaacgucuuacauc

SEQ ID NO: 74502 - RNA, 42 nt, Mus musculus
acuuugugaagggucgcugguggauaacagcacaggacucag

SEQ ID NO: 74503 - RNA, 45 nt, Mus musculus
cagugggaaaagccagacguggaaaauuuugaguaaaaauccuca

SEQ ID NO: 74504 - RNA, 42 nt, Mus musculus
ccaaugcagauauggaugcuugcagccaaccaucagacugag

SEQ ID NO: 74505 - RNA, 46 nt, Mus musculus
auucauauuuuucucccaggauuaacaacucccccccaccacacac

SEQ ID NO: 74506 - RNA, 46 nt, Mus musculus
ugccuuauguguauggaccucagcuacugcuccagcaccaccccua

SEQ ID NO: 74507 - RNA, 42 nt, Mus musculus
gagaccggaguuacagguuguaagcuacuaacuguuuugaua

SEQ ID NO: 74508 - RNA, 46 nt, Mus musculus
accaguccuccuaaccugugaaucaucuuuccagccccacccccac

SEQ ID NO: 74509 - RNA, 51 nt, Mus musculus
agaagagacuugccauaaaaucauuaacuagagagagagagagagagagag

SEQ ID NO: 74510 - RNA, 45 nt, Mus musculus
gagccaucaauguccugacagcuuucugcaucagaugagaggaug

SEQ ID NO: 74511 - RNA, 42 nt, Mus musculus
uacaguggcugugggugacuuccuguuagugaugaggaguuu

SEQ ID NO: 74512 - RNA, 46 nt, Mus musculus
guauuaguaauuaugauaugaaaacagaaagcagaugugcugguug

SEQ ID NO: 74513 - RNA, 45 nt, Mus musculus
ucguacauuuuccugaucaaaguuuuacaugacauagaaccuuua

SEQ ID NO: 74514 - RNA, 46 nt, Mus musculus
cacaauuucccuucccuuuacugcucccaacucuccacacccccau

SEQ ID NO: 74515 - RNA, 25 nt, Mus musculus
cagaacaggauaucuggcucucucc

SEQ ID NO: 74516 - RNA, 62 nt, Mus musculus
acaaagucuuauguauguuuaugugugcaaauaauucugagagagggagaaagaaaaguuug

SEQ ID NO: 74517 - RNA, 44 nt, Mus musculus
cuucugcacgccagcaucuagcaggaccuggcugaaguuguaag

SEQ ID NO: 74518 - RNA, 47 nt, Mus musculus
ggagaccacgacacuugcccaucuugccggcgccacgggcccaagag

SEQ ID NO: 74519 - RNA, 44 nt, Mus musculus
gcagucaccgacgggaccagaaguggcaugacaaacaguacaag

SEQ ID NO: 74520 - RNA, 84 nt, Mus musculus
gcuggaaaaaguagggguugaggccaaacagccaaauucugccaucaggaagugcgucagggugcagcucauuaagaacgggaa

SEQ ID NO: 74521 - RNA, 48 nt, Mus musculus
agccaauguuucucuguuggcucuauacaaaggcaagaaagaaaggcc

SEQ ID NO: 74522 - RNA, 41 nt, Mus musculus
ugugugugugugugugcgugcgugugugugugugcgugcgu

SEQ ID NO: 74523 - RNA, 46 nt, Mus musculus
cacaaucucuucuuuaagcguaguaaccuggagaaagaugggguga

SEQ ID NO: 74524 - RNA, 45 nt, Mus musculus
uuguggaucagccugaaggagcagaguccaggaucucacucucag

SEQ ID NO: 74525 - RNA, 45 nt, Mus musculus
uggggaccgaagccuuggcacccaucccugcuguuguggccagau

SEQ ID NO: 74526 - RNA, 46 nt, Mus musculus
ucgagccuuuugaaguaaagcaaaaugucccucgcugcccccuccc

SEQ ID NO: 74527 - RNA, 38 nt, Mus musculus
cuggaguggaggucauaaccaagaccuaccugacagag

SEQ ID NO: 74528 - RNA, 45 nt, Mus musculus
gggaaaguuuaaaauacauuagugggcaugucagagaggugguca

SEQ ID NO: 74529 - RNA, 45 nt, Mus musculus
ccagcagagucuucuuucauguuguuuuuacuugaggcagcagag

SEQ ID NO: 74530 - RNA, 27 nt, Mus musculus
aucuccaaaacagacccuucagugaag

SEQ ID NO: 74531 - RNA, 42 nt, Mus musculus
cagaauagacuugaacacaaagauccagaaguacacccaguc

SEQ ID NO: 74532 - RNA, 46 nt, Mus musculus
gaaacccucaccugguuucugauuauaggguccugcugauggagau

SEQ ID NO: 74533 - RNA, 46 nt, Mus musculus
cagagugaggcgguuugaccuucucaagaggaucuugaagacagac

SEQ ID NO: 74534 - RNA, 45 nt, Mus musculus
cugaacauggcccagagcccugugucugccgaggucauucaccag

SEQ ID NO: 74535 - RNA, 46 nt, Mus musculus
aguaugucagaaacagagagauaugaaaaagaaggcacgcacagaa

SEQ ID NO: 74536 - RNA, 46 nt, Mus musculus
cugacgcuucuuaguugggaaaaguugggaaaagauauagcaagag

SEQ ID NO: 74537 - RNA, 45 nt, Mus musculus
cuuaguagggccggugcaagccuugcuuaaagaaagagguuuaaa

SEQ ID NO: 74538 - RNA, 69 nt, Mus musculus
gacagacugcucagaaggauucgaauguguggauucagaacaauucagcuggggaauggugguacuggu

SEQ ID NO: 74539 - RNA, 46 nt, Mus musculus
uucagugcuuuaaguacucagaauguaucaguaaugggggcuggaa

SEQ ID NO: 74540 - RNA, 46 nt, Mus musculus
aucuaccuaaugcuaauaucuuuccaauuaguuuuuccccagaagu

SEQ ID NO: 74541 - RNA, 45 nt, Mus musculus
aaacaagauugacuaaucaggauuuauugauguaauuggcuuaga

SEQ ID NO: 74542 - RNA, 46 nt, Mus musculus
ugcuuuucuucuguuguauuucaugucaggccuguguuuuccagaa

SEQ ID NO: 74543 - RNA, 44 nt, Mus musculus
caucaugugugugucugagaggcaccuucaggccucaguaccag

SEQ ID NO: 74544 - RNA, 46 nt, Mus musculus
aggugaacugugagucaguuggacccucuuugaggaaugcugggag

SEQ ID NO: 74545 - RNA, 44 nt, Mus musculus
acuguaggcagugccacccuagcagguggucccggguuauauaa

SEQ ID NO: 74546 - RNA, 41 nt, Mus musculus
cuccauaaagagaguccauugagugggacugaagagaguca

SEQ ID NO: 74547 - RNA, 46 nt, Mus musculus
aaaggcucacaauucaaggcuacacacacacacacacacagagaga

SEQ ID NO: 74548 - RNA, 46 nt, Mus musculus
aaaggaagagucuauuugggcuuaaaggucaaggggguguggucca

SEQ ID NO: 74549 - RNA, 45 nt, Mus musculus
uaugucaaugagaaagucuacagagucagugcaaagggcauguau

SEQ ID NO: 74550 - RNA, 24 nt, Mus musculus
agaauucaggacugguuuucagca

SEQ ID NO: 74551 - RNA, 47 nt, Mus musculus
ucugagacugcuguugaaagucucauuucuggcuuagaucucacagc

SEQ ID NO: 74552 - RNA, 46 nt, Mus musculus
uggggguaguccagcuuacuagugugucugucugaguguggccuug

SEQ ID NO: 74553 - RNA, 42 nt, Mus musculus
guaaagacggaggcuuggccccacucaugcuugugaccccag

SEQ ID NO: 74554 - RNA, 54 nt, Mus musculus
cacucaaacacauaugguguacagcaaccuugcagcugugagcagguagacggg

SEQ ID NO: 74555 - RNA, 46 nt, Mus musculus
ggacgcauggcugaaauccuaagucuaacuuuccuuagcuguccag

SEQ ID NO: 74556 - RNA, 42 nt, Mus musculus
acaaggggaagggagacucuugccaaaaaaacuuaagcccag

SEQ ID NO: 74557 - RNA, 24 nt, Mus musculus
agauggggucagaugggcugugca

SEQ ID NO: 74558 - RNA, 46 nt, Mus musculus
cucucuuucuguguguguguguguguguguguguguguguaugugu

SEQ ID NO: 74559 - RNA, 46 nt, Mus musculus
aguagauugaaagaaaugaauggagaagcaaggcagauuaggagua

SEQ ID NO: 74560 - RNA, 46 nt, Mus musculus
ugagaugcaggagagaaaaugucauugaugcugcucagaggugcag

SEQ ID NO: 74561 - RNA, 46 nt, Mus musculus
ccucguuaaugaaugccacccacaaugcaaacuguaggucgucaag

SEQ ID NO: 74562 - RNA, 46 nt, Mus musculus
uuaucaucuuuugaauuuagagucccgcagcugccuuggaagacag

SEQ ID NO: 74563 - RNA, 46 nt, Mus musculus
caggaccucugagaagaaaaucagauguggaguuugggggcuuuua

SEQ ID NO: 74564 - RNA, 75 nt, Mus musculus
gcucauagaaaguuuuagacaagcuugggauacauaaaaaccuauuuggaggaagaggaggggaagggggaagga

SEQ ID NO: 74565 - RNA, 78 nt, Mus musculus
ggaggaagaagaagagaugugaggaagaggaggaagaggaggaggagaaggaagaggugggaggaagauggggaggua

SEQ ID NO: 74566 - RNA, 45 nt, Mus musculus
agaggaagaggaagaggaagaggaagaggaggaagaggaggaaga

SEQ ID NO: 74567 - RNA, 46 nt, Mus musculus
gugccaggguggugacuuuacaugccauaauggcacuggcggcaga

SEQ ID NO: 74568 - RNA, 44 nt, Mus musculus
acacaaacgguucccaguuuuuuaucugcacugccaagacuaag

SEQ ID NO: 74569 - RNA, 48 nt, Mus musculus
ggaagccauggaguguuuuggguccaggaauggaaagaccagcaagac

SEQ ID NO: 74570 - RNA, 47 nt, Mus musculus
uucuuuugacuugcaggcauuuuacccauccaaccauuccuucugua

SEQ ID NO: 74571 - RNA, 45 nt, Mus musculus
ugcaggagauggugagaguucuacaucuucaucugaagguugcua

SEQ ID NO: 74572 - RNA, 42 nt, Mus musculus
cagagagagaaccucuguccaccuuuuccccacuacccccuu

SEQ ID NO: 74573 - RNA, 46 nt, Mus musculus
aauuccaagcacccacaugguggcucauaaccaucuguaacuccag

SEQ ID NO: 74574 - RNA, 45 nt, Mus musculus
auugucccgugucuucgagcugguggcaggcgaugcucuugaggu

SEQ ID NO: 74575 - RNA, 46 nt, Mus musculus
guggcucuuggcacacuaauuaacccaacuagaaaugccugcagac

SEQ ID NO: 74576 - RNA, 55 nt, Mus musculus
uacauacauacauacaaacacacauauacauacgugugugugagagagagagaga

SEQ ID NO: 74577 - RNA, 46 nt, Mus musculus
gacauaauaugauauauucacaaaguguaugaaguacaacuuagac

SEQ ID NO: 74578 - RNA, 46 nt, Mus musculus
aucugggcucucacagugucugagcacccugacaugguccccacag

SEQ ID NO: 74579 - RNA, 46 nt, Mus musculus
cacccuggaagucaccuuggcaacaagaguuuaaugagggccuaag

SEQ ID NO: 74580 - RNA, 46 nt, Mus musculus
uaugggcaguauugauugcacuaagaagaggagaugaaauaaaguu

SEQ ID NO: 74581 - RNA, 45 nt, Mus musculus
ugugugaugcauaugccauggugugugugugugggugugugcagu

SEQ ID NO: 74582 - RNA, 39 nt, Mus musculus
gugugugucauggugugugugugggugcaugugccagag

SEQ ID NO: 74583 - RNA, 46 nt, Mus musculus
uuucaguagucugcacaaacuugcugaguucagaaagcuuucacau

SEQ ID NO: 74584 - RNA, 45 nt, Mus musculus
cucauuuguuuucugauauuuuuccuuucccuuugugagugugug

SEQ ID NO: 74585 - RNA, 46 nt, Mus musculus
gagggugguaguuagcaggguuaugcuuugaaaaaaaagagagaga

SEQ ID NO: 74586 - RNA, 46 nt, Mus musculus
aggcuguuuuucuuaagaacgagauuugacaaaaagguaggaggaa

SEQ ID NO: 74587 - RNA, 46 nt, Mus musculus
caagcaaaaaacuccaauaaaacccugaagauacaucaagucagau

SEQ ID NO: 74588 - RNA, 46 nt, Mus musculus
cugcuuuucuuuugaaaaguaaaaguuauuuuguaaagccucaaau

SEQ ID NO: 74589 - RNA, 44 nt, Mus musculus
guagacaggggaaaccaaagggaaaccagacagaggugaggccc

SEQ ID NO: 74590 - RNA, 42 nt, Mus musculus
ugcucgugcaugcuuucccggcaugcuuuguggcaugggcug

SEQ ID NO: 74591 - RNA, 46 nt, Mus musculus
uguguguaucccaucauugagaagcuuacacugaaauagugcugag

SEQ ID NO: 74592 - RNA, 42 nt, Mus musculus
uuugcuacauuuucuuuucuuuacuguuuuguggagccacaa

SEQ ID NO: 74593 - RNA, 42 nt, Mus musculus
agaaaguucuaggcuagccugggauacaggagacucugucca

SEQ ID NO: 74594 - RNA, 42 nt, Mus musculus
gaaggaaaggagggagggggaaggagggagguaaggaggaag

SEQ ID NO: 74595 - RNA, 45 nt, Mus musculus
ccuuuaccaguugaucaaucucuacuacugagauucaggcagaga

SEQ ID NO: 74596 - RNA, 46 nt, Mus musculus
cuuauagacauggaccaacaugacugguuuuauucaguggggagac

SEQ ID NO: 74597 - RNA, 46 nt, Mus musculus
aauaaaaccagucauguugguccaugucuauaagcuuggcauuuag

SEQ ID NO: 74598 - RNA, 42 nt, Mus musculus
ugaaagcaucuuucaaccccaaagcgguugugacccccaggu

SEQ ID NO: 74599 - RNA, 45 nt, Mus musculus
uuuugugaaagauguauauaaaacacugcaguuguacccugaguu

SEQ ID NO: 74600 - RNA, 46 nt, Mus musculus
ggacuuguuuaacuauuuaaggccacugucuccaaguguaagugug

SEQ ID NO: 74601 - RNA, 46 nt, Mus musculus
cgaacuuuuccacacgagggguucucugcuucccuccaucugagcu

SEQ ID NO: 74602 - RNA, 46 nt, Mus musculus
cuucucucugagacguucccucggagcuuguucucacagcccucac

SEQ ID NO: 74603 - RNA, 46 nt, Mus musculus
gagagcgguaaaagcuuaguucucagauaaguacuugucggacuca

SEQ ID NO: 74604 - RNA, 35 nt, Mus musculus
gcauaugugugcaugcaugugcaugugucagggac

SEQ ID NO: 74605 - RNA, 76 nt, Mus musculus
cugauuggcuaauuaagcaguaagagucuugauucuacgggguaauuagguguugaaauggcuaaccaggggugcg

SEQ ID NO: 74606 - RNA, 45 nt, Mus musculus
aggaguuaaggagacagacagagagagagagagaucugaggagaa

SEQ ID NO: 74607 - RNA, 42 nt, Mus musculus
uuugaguagagccccgaguuuccucagagguagcaggcgagc

SEQ ID NO: 74608 - RNA, 46 nt, Mus musculus
ccaagggaaaggaaggcaaaaaaagggcgggaaggaaagcccagac

SEQ ID NO: 74609 - RNA, 45 nt, Mus musculus
uagaccucuagacauccaagauacacagaaaauacacaggacggg

SEQ ID NO: 74610 - RNA, 50 nt, Mus musculus
gagaggcgggaggugaagggggaggggaaagugagggagagagagaggga

SEQ ID NO: 74611 - RNA, 46 nt, Mus musculus
uuaacuaccuuuagaacuuccacaaccuucaugccuugccccacuu

SEQ ID NO: 74612 - RNA, 45 nt, Mus musculus
cuuaacaaauuaagaaccaucuuuaguuccugcaucauaccuagg

SEQ ID NO: 74613 - RNA, 45 nt, Mus musculus
ccuagucucuggaaccuucuguuaugucccacugugccaucagag

SEQ ID NO: 74614 - RNA, 24 nt, Mus musculus
gcuguaaauagcuguucagaaacu

SEQ ID NO: 74615 - RNA, 41 nt, Mus musculus
ggcuguauguugcaagccgcuguccacuaaaaggcagcagg

SEQ ID NO: 74616 - RNA, 42 nt, Mus musculus
cccugucuccuaaggcacacaugcacagccacacaugcagua

SEQ ID NO: 74617 - RNA, 42 nt, Mus musculus
cuucccgcuuccucccucacagcucccuugccugguccagau

SEQ ID NO: 74618 - RNA, 46 nt, Mus musculus
aaucucagcaaccacaugauggcucacaaccacccauaaugagauc

SEQ ID NO: 74619 - RNA, 46 nt, Mus musculus
uuaauaagaaaacaaacagccagauuacccuuucuguccuguagaa

SEQ ID NO: 74620 - RNA, 46 nt, Mus musculus
cagucccaucaacuggcuggcagcaggaaaagcugcuaucagaguc

SEQ ID NO: 74621 - RNA, 46 nt, Mus musculus
acuuugaauucaccaaacugaaaugcauaaauuuagauccacgagc

SEQ ID NO: 74622 - RNA, 45 nt, Mus musculus
caagcccucuucugucucuauggcaugauucauauugucauagca

SEQ ID NO: 74623 - RNA, 42 nt, Mus musculus
acaggcuggcugagaggcucagcaccagaacggcacccagcu

SEQ ID NO: 74624 - RNA, 46 nt, Mus musculus
augggcaagccaaccaccaaggacugacaagaauccaccaugagcu

SEQ ID NO: 74625 - RNA, 64 nt, Mus musculus
gagcccaccuuuaaucccagcacuggugaggcagaggcgagccgaccucuugaguucaaggcca

SEQ ID NO: 74626 - RNA, 73 nt, Mus musculus
agauccccaaagccaaaucucagcugcccagugccugcccugguauuuuuuacuaaugccugaacagcaguag

SEQ ID NO: 74627 - RNA, 45 nt, Mus musculus
gcuaacccaggcacaggaacugccauccucccacacacgccagac

SEQ ID NO: 74628 - RNA, 48 nt, Mus musculus
ccuuccuuggccccuucuucaaauuaaugcucuggggacagagaucag

SEQ ID NO: 74629 - RNA, 43 nt, Mus musculus
aaacagauguuacagaaacaaacuagucuucccagcugcagac

SEQ ID NO: 74630 - RNA, 46 nt, Mus musculus
gacacacuguuucuccacacagcaggaagccgagcgggaaguagag

SEQ ID NO: 74631 - RNA, 45 nt, Mus musculus
cagcgggaaaaggucccaacucaggaagguaaacacaagcagcau

SEQ ID NO: 74632 - RNA, 46 nt, Mus musculus
ugaauaugaacagcugugcuacugaaaacuuucuacaggacaaauu

SEQ ID NO: 74633 - RNA, 46 nt, Mus musculus
aaucugaacauugauauuaauaaacuaaggguaauuuaggggaaac

SEQ ID NO: 74634 - RNA, 42 nt, Mus musculus
gaucugucauuugaucaucugauaaaacuugcauagcaagau

SEQ ID NO: 74635 - RNA, 46 nt, Mus musculus; identical to SEQ ID NO: 28986

SEQ ID NO: 74636 - RNA, 45 nt, Mus musculus
ugcuucucauccucagcuuuguacuucucagcuucuuggaccacu

SEQ ID NO: 74637 - RNA, 44 nt, Mus musculus
uuucaauaccaagggaaagaggagugacauccaagagcagcgaa

SEQ ID NO: 74638 - RNA, 46 nt, Mus musculus
uugcagaaguuucugaaucuuggagauucugguagaaccacccacc

SEQ ID NO: 74639 - RNA, 45 nt, Mus musculus
acggaacaggucagcauucaauuccucagaucaauuuccucauag

SEQ ID NO: 74640 - RNA, 44 nt, Mus musculus
accuugggccugccugcaucauucaccaccaugaagggccagug

SEQ ID NO: 74641 - RNA, 46 nt, Mus musculus
cugauggagaaggcuccaagggcuauggcuucgugcacuaccagga

SEQ ID NO: 74642 - RNA, 46 nt, Mus musculus
uaggcuacgccuaugucaauuuucuccagguuaaugaugcccagaa

SEQ ID NO: 74643 - RNA, 42 nt, Mus musculus
gagagcugcaggcuuguagaguuggggucaaaaaaaggaaau

SEQ ID NO: 74644 - RNA, 24 nt, Mus musculus
uuuuggugggggcguggagagcgc

SEQ ID NO: 74645 - RNA, 45 nt, Mus musculus
agacagagcuaagggggugcuugugcgacacguguaaggcccuag

SEQ ID NO: 74646 - RNA, 44 nt, Mus musculus
augagaucugauacccucuucuggugugucugaagauagccaca

SEQ ID NO: 74647 - RNA, 46 nt, Mus musculus
ucauucuuuucaggagaugcgggcaaagugggugaaaaugccaggg

SEQ ID NO: 74648 - RNA, 41 nt, Mus musculus
uauacagcgaguccgcugacaguguuucccccagccaagau

SEQ ID NO: 74649 - RNA, 45 nt, Mus musculus
gugacacccgagucagagcgggugugugugugugugugugugugu

SEQ ID NO: 74650 - RNA, 46 nt, Mus musculus
acgaacucggaggcuccuuagacaccggugacccagcgaaguuaag

SEQ ID NO: 74651 - RNA, 45 nt, Mus musculus
ccuggaaguccccgcacaggccccugcuggccgcagccgccgccg

SEQ ID NO: 74652 - RNA, 45 nt, Mus musculus
cugucccgcgaguggccccgcggcggcggcagcggagggaggcac

SEQ ID NO: 74653 - RNA, 46 nt, Mus musculus
acuuccgguucuccuguguccuuauccgggauguccuuaccccacc

SEQ ID NO: 74654 - RNA, 46 nt, Mus musculus
aguggaaauauaaauccaagaugcauuuaaugagcccagccugcag

SEQ ID NO: 74655 - RNA, 42 nt, Mus musculus
agagaggaauaggaaaagaucaaacuucagaaucugccacau

SEQ ID NO: 74656 - RNA, 42 nt, Mus musculus
ggccaucuugguguggggacaugugagguaguguggagagaa

SEQ ID NO: 74657 - RNA, 45 nt, Mus musculus
acagucaggaaaagaucuaucugaccccacuugacacuaagagag

SEQ ID NO: 74658 - RNA, 46 nt, Mus musculus
gucauuacuagcacuuaccuaccucagagacauuucaggagaauua

SEQ ID NO: 74659 - RNA, 43 nt, Mus musculus
cacuucccguggauuccgacgagaaaacaacaaaggguuuggu

SEQ ID NO: 74660 - RNA, 70 nt, Mus musculus
ggucagccuugugguccaauagagagauaagugggcgugaugacagcaggagcgaggaccaugaaggaca

SEQ ID NO: 74661 - RNA, 50 nt, Mus musculus
augaugaguggaaacuacuaguugguuuagccuauguguauuagacugug

SEQ ID NO: 74662 - RNA, 46 nt, Mus musculus
cacuauccagcuggcagaucagguucugccacaucuuuuggaaguc

SEQ ID NO: 74663 - RNA, 42 nt, Mus musculus
cagggaccgagguggugugaaauuuaaagaacuucuggagau

SEQ ID NO: 74664 - RNA, 42 nt, Mus musculus
ccuacccuuucuccucucuccccauuucucucugccucagac

SEQ ID NO: 74665 - RNA, 41 nt, Mus musculus
uauguagaugacacaggggagauguacauuguggauggaga

SEQ ID NO: 74666 - RNA, 46 nt, Mus musculus
uuucccuuauuugcucuuauuugcauuauucuuuaacuuguaaggu

SEQ ID NO: 74667 - RNA, 37 nt, Mus musculus
aaacaaacgucacugguucccagaaauaagcgcagca

SEQ ID NO: 74668 - RNA, 42 nt, Mus musculus
acguuuccuggagaauggaggacccucuuuuccggcuggauu

SEQ ID NO: 74669 - RNA, 46 nt, Mus musculus
uucaccuucaucccaccagucacucggcagaugguuuccuugccag

SEQ ID NO: 74670 - RNA, 44 nt, Mus musculus
ucagcuccuguaagaacugguaucaaggugcuaucugcgggaag

SEQ ID NO: 74671 - RNA, 95 nt, Mus musculus
uugugggagccacuaccacucagcacuacuccgaugucucgaagcugagagaagagauugaaggaaaagggucauacacguacuucgcgccgagu

SEQ ID NO: 74672 - RNA, 41 nt, Mus musculus
uauuuaguaguaguaguaguaguaguagugguggugguggu

SEQ ID NO: 74673 - RNA, 46 nt, Mus musculus
ggagaacaaugucaauguugagcuacugaaugccuuacacagccac

SEQ ID NO: 74674 - RNA, 45 nt, Mus musculus
caugguuauuccuucaauguacaacaaucuggggcuuuuuauuaa

SEQ ID NO: 74675 - RNA, 81 nt, Mus musculus
augucauugaccguguccugacacaaauugguaccuccauccaagacuuccuugaagcagaagacgaccuuucaucauuua

SEQ ID NO: 74676 - RNA, 124 nt, Mus musculus
agccgccaucaccucugaccucuuggagucccuuggaagagauggucacuucacgcucuuugcucccaccaaugaagcuuucgagaaacugccacgagguguccuagaaaggaucaugggagac

SEQ ID NO: 74677 - RNA, 56 nt, Mus musculus
cccuccagugcucugaggccaucacuggaggagccguguuugagaccauggaagga

SEQ ID NO: 74678 - RNA, 47 nt, Mus musculus
ugugacuaagaauggugucauccaccugauugaugaaguccucauuc

SEQ ID NO: 74679 - RNA, 57 nt, Mus musculus
uacagccaaacaaguuauugagcuggcuggaaaacagcaaaccacuuucaccgaccu

SEQ ID NO: 74680 - RNA, 68 nt, Mus musculus
gguagcccaauuaggcuuggcauccucucugaagccagauggagaguacaccuuauuagcaccuguga

SEQ ID NO: 74681 - RNA, 46 nt, Mus musculus
uauaugguaagaucugguucuaaaaccuuauuucacaggcauauga

SEQ ID NO: 74682 - RNA, 103 nt, Mus musculus
acacucugagcauggaccaacgccuucuuaagcuaauucugcaaaaucacauauugaaaguaaaaguuggccuuagcgaccucuacaauggacagauacugga

SEQ ID NO: 74683 - RNA, 54 nt, Mus musculus
cucccacugcuaggcuaucugcauagaaaacucaugcauggugagaggaagcaa

SEQ ID NO: 74684 - RNA, 62 nt, Mus musculus
gcagggaaggaauggugccauucacauauuccgagaaaucauccaaccagcagagaaauccc

SEQ ID NO: 74685 - RNA, 49 nt, Mus musculus
uuguuugcaccaaccaaugaugccuucaagggaaugacuagcgaagaaa

SEQ ID NO: 74686 - RNA, 44 nt, Mus musculus
aggggcagugaauggcagauucugauuggugaauggcagauucu

SEQ ID NO: 74687 - RNA, 54 nt, Mus musculus
auaaaaaugcucuccaaaacaucauucuuuaucaccugaccccagggguuuaua

SEQ ID NO: 74688 - RNA, 61 nt, Mus musculus
uuggaaagggauucgaacccggagucacuaauauccugaagaccacacagggaagcaaaau

SEQ ID NO: 74689 - RNA, 46 nt, Mus musculus
acaaauggugucauccacgucguggacaaacuccucuauccagcag

SEQ ID NO: 74690 - RNA, 42 nt, Mus musculus
cagcucuuggaauuacugaacaaacugauaaaauacauccaa

SEQ ID NO: 74691 - RNA, 61 nt, Mus musculus
caaauugaaggugaucccgacuucaggcugauuaaagaaggcgaaacggugacagaaguga

SEQ ID NO: 74692 - RNA, 62 nt, Mus musculus
caaaaucauagauggaguuccuguugaaauaacugaaaaacagacucgggaagaacgaauca

SEQ ID NO: 74693 - RNA, 47 nt, Mus musculus
uagguccugagauaaaauauaccaggauuuccacaggagguggagaa

SEQ ID NO: 74694 - RNA, 49 nt, Mus musculus
cacaaaguucauugaagguggcgauggucacuuauuugaagaugaggag

SEQ ID NO: 74695 - RNA, 46 nt, Mus musculus
gaucaagaaagacaguugaaaucugauguuuaccuaaaauccaguu

SEQ ID NO: 74696 - RNA, 45 nt, Mus musculus
agaccaagcccccaaaugacaguucacaucugucuguaacucgag

SEQ ID NO: 74697 - RNA, 45 nt, Mus musculus
uuagacacaccugcaaagaagauaccagccaacaaaaggguucaa

SEQ ID NO: 74698 - RNA, 87 nt, Mus musculus
caagagaaggccguucucagugaaaacccagaggccagaccacagaguuuauauaauccuaaaucaacgaucugauuuuaagggaaa

SEQ ID NO: 74699 - RNA, 48 nt, Mus musculus
ugauagcuagucuccugugggguaggaacugaggaaauauaggaccau

SEQ ID NO: 74700 - RNA, 64 nt, Mus musculus
agaggcuggaaaaacccaaagcacacaguuaccuuuccaggggaggcuaagguaucaaaagggg

SEQ ID NO: 74701 - RNA, 46 nt, Mus musculus
uguucaguuauacaacaugcaaacaaaccuaccaaauuacgaacag

SEQ ID NO: 74702 - RNA, 47 nt, Mus musculus
gggcaguguccgcccccggcagacagaggucccagaaacgcaccucg

SEQ ID NO: 74703 - RNA, 45 nt, Mus musculus
gaguacauuguagcucugaucuccucggccagggaaagaagcuca

SEQ ID NO: 74704 - RNA, 41 nt, Mus musculus
uuuggugagaggcuuugccucaaaauacaagguggagagua

SEQ ID NO: 74705 - RNA, 100 nt, Mus musculus
uuagggcagaguaaaucuuuugcugguuggagaugccacaagauacuuccuggcuggcucuaugcagaaauucuuuccuagcacagcacagaucacccug

SEQ ID NO: 74706 - RNA, 119 nt, Mus musculus
accaucagcaaugugaagaaggucgccgugcuuuuggcugcuaacucguuugacauaauuuucuugaaggugacuuccacucuaacugcagaggagcaggaggcugccaaguuaauuag

SEQ ID NO: 74707 - RNA, 45 nt, Mus musculus
gaagaaaaacacacauuugcuguuugcuuuuguaauaccugaaag

SEQ ID NO: 74708 - RNA, 46 nt, Mus musculus
uaugcuuaucaacuagacacacugcaaauacacacacacaucccac

SEQ ID NO: 74709 - RNA, 52 nt, Mus musculus
gaaaacacugaguugccuccagaaugccggcuguacuuucagacgucccgca

SEQ ID NO: 74710 - RNA, 46 nt, Mus musculus
gucauguauguuuaccauguacauuuuacuaaaagauacugcagag

SEQ ID NO: 74711 - RNA, 45 nt, Mus musculus
cugaacugcugaagaaugacgcuagacuuggauuaaaggccccgu

SEQ ID NO: 74712 - RNA, 45 nt, Mus musculus
agucuugcugugagcagcugcgcacgcuccugccauacgucaagg

SEQ ID NO: 74713 - RNA, 45 nt, Mus musculus
agcuccuggcugaucggggccugaacguguauuccaugacugcug

SEQ ID NO: 74714 - RNA, 42 nt, Mus musculus
uuggaucuaguuacuucucccucucugugcuucuacccggaa

SEQ ID NO: 74715 - RNA, 42 nt, Mus musculus
gcgcugccucagccagcaucuuucguggauuccgugcggcgu

SEQ ID NO: 74716 - RNA, 45 nt, Mus musculus
aagaaacauuaauauuugaaaauauguagguuugguugccugaag

SEQ ID NO: 74717 - RNA, 42 nt, Mus musculus
agaugguggcugacacgagcgaagugaaacugagaauccgag

SEQ ID NO: 74718 - RNA, 47 nt, Mus musculus
ucuuuauggaggcaucccccagcucccccgaaaagugcacaacaccc

SEQ ID NO: 74719 - RNA, 91 nt, Mus musculus
guaggagcaugcauaacaggacacagaucacuucaugguagauaggaagcagauagagaaagggacugggggccagauguaaccuucagau

SEQ ID NO: 74720 - RNA, 42 nt, Mus musculus
uuucuaucaacagauaaccauggcuaugcuaucccucgaggc

SEQ ID NO: 74721 - RNA, 42 nt, Mus musculus
agaagagagguggggcagggucaggaagcucacaggggaaug

SEQ ID NO: 74722 - RNA, 31 nt, Mus musculus
ucuuaccuggauucggaaaucucauugagag

SEQ ID NO: 74723 - RNA, 48 nt, Mus musculus
uuuuaaauaaaagaucuccgauuuccuuuuuaagaccaagaaggacca

SEQ ID NO: 74724 - RNA, 47 nt, Mus musculus
uucacuguaauuuguauauuuucccuguguugugagacuuugcaccu

SEQ ID NO: 74725 - RNA, 46 nt, Mus musculus
guggcaugugacucuauuuucuauccucuuggcuuuugccgcaguu

SEQ ID NO: 74726 - RNA, 46 nt, Mus musculus
gugguggugguaaguuuugucuuaaaccaacaaguugacucucuua

SEQ ID NO: 74727 - RNA, 46 nt, Mus musculus
caugcguguaugcauaugugaguguagguuccaacagaguucagaa

SEQ ID NO: 74728 - RNA, 46 nt, Mus musculus
agaugcuuucuucuguacuggcugcucugauuggaaucgugggauc

SEQ ID NO: 74729 - RNA, 46 nt, Mus musculus
cuaacaucugaucuguggaaccgcugagcugaagaaagggaacaga

SEQ ID NO: 74730 - RNA, 45 nt, Mus musculus
gccaagaggagguccaaacaccagauaacugugcaccuucccuga

SEQ ID NO: 74731 - RNA, 58 nt, Mus musculus
gacgacccuucccccaaguuaucaaguccaagggugguguugugggcauuaagguaga

SEQ ID NO: 74732 - RNA, 46 nt, Mus musculus
gcugugcccaguauaagaaggauggagccaacuuugccaaguggcg

SEQ ID NO: 74733 - RNA, 47 nt, Mus musculus
ccaucauggaaaaugccaauguucugacccguuaugccagcaucugc

SEQ ID NO: 74734 - RNA, 47 nt, Mus musculus
gagaagguacuggcggcugucuacaaggcucugagcgaccaccaugu

SEQ ID NO: 74735 - RNA, 66 nt, Mus musculus
uggucaccccuggccaugcuugcacccagaaauuuuccaaugaggagauugccauggcaacgguca

SEQ ID NO: 74736 - RNA, 47 nt, Mus musculus
uauaauccaguauguuguacauacaggaacugugccgccaaauccau

SEQ ID NO: 74737 - RNA, 60 nt, Mus musculus
ggaacaaaacaagccauuugaaaaggaaaacgguuauuuuaaaauggugauugacagaga

SEQ ID NO: 74738 - RNA, 50 nt, Mus musculus
ggacaugucacggaguacugcguucuuacgaugucauuagaagcaccuug

SEQ ID NO: 74739 - RNA, 42 nt, Mus musculus
acucuuaaagugaucucucuuuuucugaaggaaccccaauuu

SEQ ID NO: 74740 - RNA, 41 nt, Mus musculus
gugcuccgcugccuuuaugccaaaagacaccgcuguuagag

SEQ ID NO: 74741 - RNA, 87 nt, Mus musculus
caguaagaucccuuuugauccauugaaauagaaacgcacagaguacauuugaucuuggugggaagaggcaaguugaaaggucagagg

SEQ ID NO: 74742 - RNA, 45 nt, Mus musculus
gaaagacaucaagaagcuggaaggaagcuuuuaguugccgugagg

SEQ ID NO: 74743 - RNA, 45 nt, Mus musculus
uguaaccaacauauuauuuguuucguuagcuuuuaaggaccgaga

SEQ ID NO: 74744 - RNA, 46 nt, Mus musculus
uuuuuuuaauugcagcuugguuuuuuuuucaaaaugcagcuuagaa

SEQ ID NO: 74745 - RNA, 46 nt, Mus musculus
aacuuauuuaacuugagcuucaaaaaaaaaaaaucauuguauagau

SEQ ID NO: 74746 - RNA, 32 nt, Mus musculus
aucucucugggucuuauaggcugacaggagua

SEQ ID NO: 74747 - RNA, 46 nt, Mus musculus
acuagcauguaaaugggagagaccagauucgcaugcuaguccagag

SEQ ID NO: 74748 - RNA, 46 nt, Mus musculus
aguagucagugcucuuaaccacugagccaucucacuagcccucaaa

SEQ ID NO: 74749 - RNA, 43 nt, Mus musculus
ucauuauccucugcguccaccgcacagcuucucagcccuagga

SEQ ID NO: 74750 - RNA, 45 nt, Mus musculus
guucuuaucacacauguugggauggaaaguggugaauuugucuag

SEQ ID NO: 74751 - RNA, 46 nt, Mus musculus
uaaguuuaguuucuaaauuuagcauuauguuuuugaagcaacagca

SEQ ID NO: 74752 - RNA, 46 nt, Mus musculus
aagugggacgugacugcuuugaaauggcuuuuaugguagcagauga

SEQ ID NO: 74753 - RNA, 48 nt, Mus musculus
gcucacuggugcugaagucacugagggcguuaacaaaauagaaucgga

SEQ ID NO: 74754 - RNA, 46 nt, Mus musculus
cacugagagaucuguaaccagccuggcuccccugccugcaggagau

SEQ ID NO: 74755 - RNA, 45 nt, Mus musculus
uucauuuugcuauuugugccuugacaccaggguagagauaggaaa

SEQ ID NO: 74756 - RNA, 45 nt, Mus musculus
aguaaaccucuuagcuuacauuguacugaaagacacacuguuuua

SEQ ID NO: 74757 - RNA, 42 nt, Mus musculus
cuucacacaaugcauuuucaucaucuucacccccccacuucc

SEQ ID NO: 74758 - RNA, 42 nt, Mus musculus
gaaagaauaaaguuggaaaagaaagagagagggggggaaaau

SEQ ID NO: 74759 - RNA, 46 nt, Mus musculus
augcuuccuaccuguucauccagauguuuuuccuaagccguagaug

SEQ ID NO: 74760 - RNA, 46 nt, Mus musculus
gauucuugcccuuugugucugaauuaccagacauccccagggauga

SEQ ID NO: 74761 - RNA, 45 nt, Mus musculus
agguacuuacucccaagcuuggugacccgagauuaugccccagaa

SEQ ID NO: 74762 - RNA, 46 nt, Mus musculus
uguguauguguguguaugcaaacacuugcuuauuauacccacuguu

SEQ ID NO: 74763 - RNA, 42 nt, Mus musculus
agagagagagagagagagagagagaaagagauagagagagaa

SEQ ID NO: 74764 - RNA, 46 nt, Mus musculus
gugugagucccaggcccuucagccuuaguuaucauugggucggauc

SEQ ID NO: 74765 - RNA, 46 nt, Mus musculus
cagacugguuccauuuacucccaaucuuuuaagacugcaggaagau

SEQ ID NO: 74766 - RNA, 42 nt, Mus musculus
agugcuuccucucuuuauuguaguuaaucuuuacccacagac

SEQ ID NO: 74767 - RNA, 44 nt, Mus musculus
guggcucuggagagccccgaauuugugugugugugugugugugu

SEQ ID NO: 74768 - RNA, 46 nt, Mus musculus
uuuaucccagguuagcaagcguggagucauagguguuuuggaagau

SEQ ID NO: 74769 - RNA, 48 nt, Mus musculus
uguacauagacaguacagaaaggucaugguuugcuaaggggaagauac

SEQ ID NO: 74770 - RNA, 42 nt, Mus musculus
ggcacccaccuuaggcagcucacagcaucuguaaggccaguc

SEQ ID NO: 74771 - RNA, 44 nt, Mus musculus
gucacaggacugggacaaucccaaggggcugacagggaguauga

SEQ ID NO: 74772 - RNA, 47 nt, Mus musculus
cacgagucuaguugacgguuuucacagaaagaaagaaagaaagaaag

SEQ ID NO: 74773 - RNA, 42 nt, Mus musculus
gaugauggaaaaaccuuucaugcuccuggagugccagaaaua

SEQ ID NO: 74774 - RNA, 51 nt, Mus musculus
caucuaaccaaacaaaaaacucuaugucaagaaugaauuugcugagagaga

SEQ ID NO: 74775 - RNA, 43 nt, Mus musculus
gugccaugcaugcaugaccacaugcaaauacauacaggcaggu

SEQ ID NO: 74776 - RNA, 46 nt, Mus musculus
guaagcauuccuagagauagaacauagaagcuauagcuggguuuug

SEQ ID NO: 74777 - RNA, 42 nt, Mus musculus
caccuauccugccuugcucucugguuugccacagugugugau

SEQ ID NO: 74778 - RNA, 46 nt, Mus musculus
agcuuagucaggacuacugaagguucaaaucuagcccguguuaccu

SEQ ID NO: 74779 - RNA, 46 nt, Mus musculus
uggcaaguuucugugugaugcuuuugaggaaaugcuaucagaagaa

SEQ ID NO: 74780 - RNA, 46 nt, Mus musculus
agauguuuaauacuugcuaauuguuugagucuugauagugguagau

SEQ ID NO: 74781 - RNA, 46 nt, Mus musculus
cagcuauuuaaaaaucuagaaaccauucuuacauugucucccagaa

SEQ ID NO: 74782 - RNA, 46 nt, Mus musculus
ugguggggagcaccuccaguuugaugcuagcacauugccuucagau

SEQ ID NO: 74783 - RNA, 45 nt, Mus musculus
uuuuguaagguuucuuucauauauacacucacaaagcccccugca

SEQ ID NO: 74784 - RNA, 45 nt, Mus musculus
uaucucuuucaguugugucugucugucugucugucucugugucug

SEQ ID NO: 74785 - RNA, 44 nt, Mus musculus
gacuuuauguuauuaguauaaaucuaucauuuaauggcccuaau

SEQ ID NO: 74786 - RNA, 45 nt, Mus musculus
gguaguggauuagucacuguccaagaaucacauaguuaccaugaa

SEQ ID NO: 74787 - RNA, 46 nt, Mus musculus
augggcuuguguuugugacccggaggagccccgcccccccuaagau

SEQ ID NO: 74788 - RNA, 45 nt, Mus musculus
augugugugcgugugcuaugugaguuuauauagauugcaugagug

SEQ ID NO: 74789 - RNA, 46 nt, Mus musculus
cuaaggaucagauguuguccacuuuguguuucuugagcaucuagcu

SEQ ID NO: 74790 - RNA, 30 nt, Mus musculus
aggccuuucuacuucuccccagccccaguc

SEQ ID NO: 74791 - RNA, 46 nt, Mus musculus
uuuguggcagucauuuuuuuuuuuuuuaaauguauacuaagaagga

SEQ ID NO: 74792 - RNA, 44 nt, Mus musculus
acccauaauuccugaacuuugauuauggggguuauuauuggaca

SEQ ID NO: 74793 - RNA, 45 nt, Mus musculus
uauuaggagguguggccuuguuggaguaggugugaccuugcugga

SEQ ID NO: 74794 - RNA, 46 nt, Mus musculus
cuugaguuagugauuuaacaguuucugcauuuugcauaugaagaug

SEQ ID NO: 74795 - RNA, 46 nt, Mus musculus
cuugugccaaguauaauaucauauaauaccauaaaguccagccaug

SEQ ID NO: 74796 - RNA, 45 nt, Mus musculus
cgcucguguguucguggcgugugugugugugugugugugugugug

SEQ ID NO: 74797 - RNA, 42 nt, Mus musculus
ggccagagauacuuccuuaaguaagucugccggcagucaaga

SEQ ID NO: 74798 - RNA, 41 nt, Mus musculus
uagccauagcagauaagucacuaccuaguaaaaggggcaga

SEQ ID NO: 74799 - RNA, 45 nt, Mus musculus
gcacgcucagucugaauguccgccaucuucccggccgccggagaa

SEQ ID NO: 74800 - RNA, 46 nt, Mus musculus
cccugcaguucuaauggucuggauuagauuuccagaacccacauag

SEQ ID NO: 74801 - RNA, 45 nt, Mus musculus
uaucuuuguuaacuugaauugauuauggcaaaaccuuuguucaga

SEQ ID NO: 74802 - RNA, 45 nt, Mus musculus
gugagcuaauuaguccauuuuucagucaguugauauuagugcuua

SEQ ID NO: 74803 - RNA, 59 nt, Mus musculus
aguggaucuuccucuggguguugugggacuggcugcagaguuugcacccaaggucugcu

SEQ ID NO: 74804 - RNA, 46 nt, Mus musculus
gaaugcaaauuagaacccacguucuguccucuuuguguuggcugug

SEQ ID NO: 74805 - RNA, 45 nt, Mus musculus
auuuuaaugugcccuugaauuugauuuguuagauuuuuccaugua

SEQ ID NO: 74806 - RNA, 46 nt, Mus musculus
auacuggaagcacaggauagcaaugacaccauauaugguuauggag

SEQ ID NO: 74807 - RNA, 45 nt, Mus musculus
ugguuucagucuaucacugagggaagucagagaggaaucugagca

SEQ ID NO: 74808 - RNA, 46 nt, Mus musculus
uaauauaugcuacuuaucaaauccuuuaacgauaaauuaccccaaa

SEQ ID NO: 74809 - RNA, 42 nt, Mus musculus
uuguauaaacuguucuuuccuuuuucuuuucauaucacagug

SEQ ID NO: 74810 - RNA, 46 nt, Mus musculus
uuauuauuuuuugcuuauuuuauguguauaggaauuuugccugcau

SEQ ID NO: 74811 - RNA, 45 nt, Mus musculus
aauuagaguugugagcugccaucuaagugcugggaacuaaacaua

SEQ ID NO: 74812 - RNA, 46 nt, Mus musculus
uauaaugaguuaguaagcucuauaaucaaaauaaguugcuggggag

SEQ ID NO: 74813 - RNA, 46 nt, Mus musculus
ugucugucugucugucucugugucugucugucugucugucugucug

SEQ ID NO: 74814 - RNA, 48 nt, Mus musculus
uucugauuaacucaaaaccagagaaugcgugugaacccauagugccuc

SEQ ID NO: 74815 - RNA, 46 nt, Mus musculus
auaugucagugcauuaaauuauucagauuaaaauaagaaugaggcc

SEQ ID NO: 74816 - RNA, 46 nt, Mus musculus
ugaauuucauuuguuucaaaaugaacuuuaaguauuuaguggcuag

SEQ ID NO: 74817 - RNA, 46 nt, Mus musculus
ggcucauggaguuuuguuuuaagcauguauauuuuauguucagcua

SEQ ID NO: 74818 - RNA, 46 nt, Mus musculus
gccuggaggagcugagaguucuacaucuuguuccaaaggcagcuag

SEQ ID NO: 74819 - RNA, 46 nt, Mus musculus
uauuaacuuguuaauucuucagaacaacauucucagaugggcauua

SEQ ID NO: 74820 - RNA, 42 nt, Mus musculus
acccauccauacauguugauguguuaauaacccgagagugag

SEQ ID NO: 74821 - RNA, 45 nt, Mus musculus
gucuuaagacacucauaucucauagacucaauuuuuaaaaaauaa

SEQ ID NO: 74822 - RNA, 45 nt, Mus musculus
gcuuaauagaggacauguggauccauacacuagacuaacgcggga

SEQ ID NO: 74823 - RNA, 46 nt, Mus musculus
aagcugacucgaccagagugcauggcauuucuauguaugaggacau

SEQ ID NO: 74824 - RNA, 45 nt, Mus musculus
ggaauuacagggcuuuuaauaaaagcuuuagauacccaaacucag

SEQ ID NO: 74825 - RNA, 42 nt, Mus musculus
cccauuucaaaaucaggauauuuagacuccuuugcuagugag

SEQ ID NO: 74826 - RNA, 25 nt, Mus musculus
uccacaacauacauauuucuguaac

SEQ ID NO: 74827 - RNA, 45 nt, Mus musculus
uaaugaaugaggucgagguuuuauuacaugcuacuagaggggcua

SEQ ID NO: 74828 - RNA, 45 nt, Mus musculus
aaagucuugaguaaguucucaggacgacuauagauggaucgugug

SEQ ID NO: 74829 - RNA, 45 nt, Mus musculus
gcgcacuguggcacauguguguaugcacauauacauacagaacag

SEQ ID NO: 74830 - RNA, 46 nt, Mus musculus
uuuguucaggacagacauagaaacagaagaaauagacuucguaaag

SEQ ID NO: 74831 - RNA, 84 nt, Mus musculus
aucucuccuugguaacauguaauugucacaguagcaaggagucgcagagucauaucacauagaggaaauggcuauaucaagauu

SEQ ID NO: 74832 - RNA, 111 nt, Mus musculus
acccccacauauguuccacccacagacugaucaccugaaguuacauuuuaucauucaucccauaggccacacuucuccccaacucaucuaucagccccuauucacaugcca

SEQ ID NO: 74833 - RNA, 58 nt, Mus musculus
auuagguugugcagcuuuuccugggaagacaugaauaaacauuuaugcauggaugaca

SEQ ID NO: 74834 - RNA, 80 nt, Mus musculus
gaaccagugaacucauuaggguuacuuacaggaguacggguggcucaaagauagucacguuacuauauagugcaugccag

SEQ ID NO: 74835 - RNA, 60 nt, Mus musculus
cuaacagggucucaucuccuguacuugcuugcuguuucauagauaaucuuugagaagggc

SEQ ID NO: 74836 - RNA, 75 nt, Mus musculus
uucagaggaaacagcuacagagcacuguuucuaaaaacccagaugaauaauucaagaaugaacuggcauagaucu

SEQ ID NO: 74837 - RNA, 45 nt, Mus musculus
gaguacgaugugugugcuaucugucuggaggaguaugaagacgga

SEQ ID NO: 74838 - RNA, 46 nt, Mus musculus
acucaggcaucaaauuagcucucuggggaugacaaaauguagccag

SEQ ID NO: 74839 - RNA, 46 nt, Mus musculus
uacuuaaauauaaucagaaugcuaagacuuuuuauauggccuugua

SEQ ID NO: 74840 - RNA, 46 nt, Mus musculus
guguuuaauaguuauggcauuuuuuuaaaugcauauuaagucagau

SEQ ID NO: 74841 - RNA, 46 nt, Mus musculus
uugugagauggauuuccuuucgaauggcacuaccuuagggacauuc

SEQ ID NO: 74842 - RNA, 41 nt, Mus musculus
cugggaauuugaucgguaugguuacugcaguaaggucgugg

SEQ ID NO: 74843 - RNA, 44 nt, Mus musculus
gggacagacuauuuguagugucuauaggacaugaagcgugcagc

SEQ ID NO: 74844 - RNA, 45 nt, Mus musculus
gagcauuuccuuggcucaucuagucuuccuuuuguagcgcauggu

SEQ ID NO: 74845 - RNA, 46 nt, Mus musculus
aagugcugaaaagacacugaucgaguuagagacuguacaccggcac

SEQ ID NO: 74846 - RNA, 45 nt, Mus musculus
aagagucaagguggggagccaacauacaacguugcuguuggcagg

SEQ ID NO: 74847 - RNA, 54 nt, Mus musculus; identical to SEQ ID NO: 39598

SEQ ID NO: 74848 - RNA, 100 nt, Mus musculus; identical to SEQ ID NO: 39599

SEQ ID NO: 74849 - RNA, 46 nt, Mus musculus; identical to SEQ ID NO: 39600

SEQ ID NO: 74850 - RNA, 46 nt, Mus musculus; identical to SEQ ID NO: 39601

SEQ ID NO: 74851 - RNA, 72 nt, Mus musculus; identical to SEQ ID NO: 39602

SEQ ID NO: 74852 - RNA, 46 nt, Mus musculus; identical to SEQ ID NO: 39603

SEQ ID NO: 74853 - RNA, 179 nt, Mus musculus; identical to SEQ ID NO: 39604

SEQ ID NO: 74854 - RNA, 63 nt, Mus musculus; identical to SEQ ID NO: 39605

SEQ ID NO: 74855 - RNA, 73 nt, Mus musculus; identical to SEQ ID NO: 39606

SEQ ID NO: 74856 - RNA, 72 nt, Mus musculus; identical to SEQ ID NO: 39607

SEQ ID NO: 74857 - RNA, 46 nt, Mus musculus; identical to SEQ ID NO: 39608

SEQ ID NO: 74858 - RNA, 115 nt, Mus musculus; identical to SEQ ID NO: 39609

SEQ ID NO: 74859 - RNA, 53 nt, Mus musculus; identical to SEQ ID NO: 39610

SEQ ID NO: 74860 - RNA, 45 nt, Mus musculus; identical to SEQ ID NO: 39611

SEQ ID NO: 74861 - RNA, 42 nt, Mus musculus
cugcccuccagccucuuccaccauguccaagaugccggccaa

SEQ ID NO: 74862 - RNA, 41 nt, Mus musculus
ggcuccucguugucacagcaguucgccuauccccagccuca

SEQ ID NO: 74863 - RNA, 42 nt, Mus musculus
gugcccaccacuucuguuacuaugccaaauguacccgcgccu

SEQ ID NO: 74864 - RNA, 42 nt, Mus musculus
cacagugcaccaacaagucuaccacagucugaccuaagccag

SEQ ID NO: 74865 - RNA, 45 nt, Mus musculus
caggaacaacacuguccucuugguguaaaauguauugacccccuu

SEQ ID NO: 74866 - RNA, 59 nt, Mus musculus
cucugacagcauucauuuguaauugguaugacacugggauuaaggauuugguuguaaua

SEQ ID NO: 74867 - RNA, 45 nt, Mus musculus
aaaaagaaguuuuaauuuuucauuucccaugacggccugaacuua

SEQ ID NO: 74868 - RNA, 45 nt, Mus musculus
auaaccaagaugaaagaaaauauaauagaguaucauccaguuugg

SEQ ID NO: 74869 - RNA, 46 nt, Mus musculus
aaucuauuuugaguguuuuaggcaguuacuuuuuauuaacaaguaa

SEQ ID NO: 74870 - RNA, 46 nt, Mus musculus
aggauuuuaaaagcaaauuuuaaggcccauuaguuuuuaaagagag

SEQ ID NO: 74871 - RNA, 46 nt, Mus musculus
caauuaaacaauuacuuugaaaugacauaaaaauugaggggacuaa

SEQ ID NO: 74872 - RNA, 46 nt, Mus musculus
aacaacuuucuugaagugaauauaaacuacuacuauugagggguga

SEQ ID NO: 74873 - RNA, 46 nt, Mus musculus
ggccugauuuaguuggugguaggaggagccaaauuagguuuuucag

SEQ ID NO: 74874 - RNA, 49 nt, Mus musculus
uuggaagaucuaaucugugcuucugaugaaaggauucaaagaauagaaa

SEQ ID NO: 74875 - RNA, 41 nt, Mus musculus
aauccaacaacuacuuggcuauucucuguuauccaguguca

SEQ ID NO: 74876 - RNA, 45 nt, Mus musculus
guggaaauugagucagucaguguaaaguagugugaauagcaucug

SEQ ID NO: 74877 - RNA, 46 nt, Mus musculus
gacuauuguuaaggcaucugauacaacuugguguugauaggcucug

SEQ ID NO: 74878 - RNA, 46 nt, Mus musculus
uuucuuuuaacuucuuauaugaaaagaaaauuaaaugugggcugga

SEQ ID NO: 74879 - RNA, 46 nt, Mus musculus
aaggagcauuucaguuagagaaacaguacuguggauuagugugcag

SEQ ID NO: 74880 - RNA, 47 nt, Mus musculus
uaguauaauaagaauaauuagauuugacuuaguauauaaaagcaaca

SEQ ID NO: 74881 - RNA, 46 nt, Mus musculus
gguagaauagugcagucuuacauaaaaaguuaagagcauugaucag

SEQ ID NO: 74882 - RNA, 46 nt, Mus musculus
cacagcuucauagaccucaauccaaguuuugcuuuuggauguagag

SEQ ID NO: 74883 - RNA, 52 nt, Mus musculus
uaauauaaccauaguuccaaaaugguaaggagguauugcuuaaaagaaauca

SEQ ID NO: 74884 - RNA, 46 nt, Mus musculus
uaguugucuuaguuguuaauaaccucuuaggguuauuuguacucag

SEQ ID NO: 74885 - RNA, 45 nt, Mus musculus
gaggcucaugccuuuaaucccagcacucaagaggcaagagucagg

SEQ ID NO: 74886 - RNA, 46 nt, Mus musculus
aauauaguaaaaucaguuacuuuucauugaucauucuuugugccag

SEQ ID NO: 74887 - RNA, 47 nt, Mus musculus
cuggugaaaagccauuugauguaugcaguaagagaagaaguggaagu

SEQ ID NO: 74888 - RNA, 46 nt, Mus musculus
cagagauccagaguccguauguuuacagacuaggaccugcccacag

SEQ ID NO: 74889 - RNA, 45 nt, Mus musculus
gagagaagccugcuuauguuugcuuuguuauuugccucaggagau

SEQ ID NO: 74890 - RNA, 45 nt, Mus musculus
cauuuucuuuuuacuaauaguaagggugagaguaaugaggcaggu

SEQ ID NO: 74891 - RNA, 44 nt, Mus musculus
gcaagaacauaacucagcgcggcaacgucgcuaagaccucggua

SEQ ID NO: 74892 - RNA, 45 nt, Mus musculus
agugaugugcaaggcaaacaagaaacugacaaccuuuugaacaag

SEQ ID NO: 74893 - RNA, 41 nt, Mus musculus
ggaauauucucauccucagcggggauguuaauuuggcagag

SEQ ID NO: 74894 - RNA, 82 nt, Mus musculus
gaaccaaagauggucacuaugguagagauugaccaaauggucacugauggauguaagaaauacaugcggagaacauguggag

SEQ ID NO: 74895 - RNA, 57 nt, Mus musculus
gcuggggcaucuguauuguccuguggaauucucaaaagagauugucuguguccccuc

SEQ ID NO: 74896 - RNA, 46 nt, Mus musculus
gacaacuuguuuauuggcacaugcauaguacaaagcaugaaauaga

SEQ ID NO: 74897 - RNA, 47 nt, Mus musculus
aggucggaaagacugggugucuucuaagaagccaguuaauagaagag

SEQ ID NO: 74898 - RNA, 24 nt, Mus musculus
gaaauacuugaguuuugauaucuc

SEQ ID NO: 74899 - RNA, 42 nt, Mus musculus
agcuauucaaggaaaugaaucucugacccccuuuggcaccga

SEQ ID NO: 74900 - RNA, 42 nt, Mus musculus
ucucuauuuuccugcagaaaccuugucguugccuggucuuag

SEQ ID NO: 74901 - RNA, 46 nt, Mus musculus
cagccaucccguuuggauucaaagguugacccaaguccugaguuag

SEQ ID NO: 74902 - RNA, 46 nt, Mus musculus
gaucaaugaggagcccaauauguuugcauggugggagagggugcag

SEQ ID NO: 74903 - RNA, 46 nt, Mus musculus
guaaagaaaggcauaaaaauagcuacuauuaagaaaauacugauag

SEQ ID NO: 74904 - RNA, 52 nt, Mus musculus
ucuauaggauggaacacagggcccccaauggaggaauuagagaaaacaccca

SEQ ID NO: 74905 - RNA, 46 nt, Mus musculus
guugcacaugaauacaaaauaaaaauaaauugugacaugcuagcag

SEQ ID NO: 74906 - RNA, 83 nt, Mus musculus
ucagggacuuauacaugucaguaaacugauuaaaucucaaaacguaaucgaaagaauucaggcacagggaaauagguaucgug

SEQ ID NO: 74907 - RNA, 45 nt, Mus musculus
ccuagcuugugcuauacaugcuauacauauaugaaagaugguaga

SEQ ID NO: 74908 - RNA, 42 nt, Mus musculus
aaagacaggcuguacaaagauguggacuuuggaaggggcaac

SEQ ID NO: 74909 - RNA, 46 nt, Mus musculus
gccuugugucuguuuuccaccaauguuacaaacaucgcacacagaa

SEQ ID NO: 74910 - RNA, 46 nt, Mus musculus
ugcagacuuuauuuuuuggaagaaguuuaaucaaaggcagccauag

SEQ ID NO: 74911 - RNA, 45 nt, Mus musculus
uguggccuacccuccccgaauuauaaacuaccuucccaggagcau

SEQ ID NO: 74912 - RNA, 48 nt, Mus musculus
ggacuacgccagguggccuuguaaucgacagaccucaagucgguggaa

SEQ ID NO: 74913 - RNA, 46 nt, Mus musculus
auaucugauggcaagcaaugguucucucauuguuuacaaagcaacu

SEQ ID NO: 74914 - RNA, 47 nt, Mus musculus
aacacuuggacugcagagcagauggggucccaccaccccagaucaca

SEQ ID NO: 74915 - RNA, 46 nt, Mus musculus
ugacacuaagacauacaaacuggauauugucucuaggccuccauua

SEQ ID NO: 74916 - RNA, 48 nt, Mus musculus
ucaccuaacaguucuaacagccaucccacggauaaggcaaaacuacag

SEQ ID NO: 74917 - RNA, 43 nt, Mus musculus
uccacaacggaaccuuguauuucaacaaaguugggauggcaga

SEQ ID NO: 74918 - RNA, 46 nt, Mus musculus
aggcuucuggcuccccugugccugagguauccuggaguuugccuga

SEQ ID NO: 74919 - RNA, 49 nt, Mus musculus
augcauguccgccuaagacugacaccugccaaaauugaacacaagcagc

SEQ ID NO: 74920 - RNA, 24 nt, Mus musculus
uugcugcagcuacucugacucuuu

SEQ ID NO: 74921 - RNA, 41 nt, Mus musculus
agcuccucgggcucagagagaaggguagugauucuaagagu

SEQ ID NO: 74922 - RNA, 46 nt, Mus musculus
guuacagacagugaggucccagcaguuuucaagaugaugucaaaua

SEQ ID NO: 74923 - RNA, 46 nt, Mus musculus
ucucuccugggcauaacugaacugccccagaaaugcacucauacuu

SEQ ID NO: 74924 - RNA, 45 nt, Mus musculus
ucaucaacuccuuccuagugcuuccuagcaccacaagaaagagau

SEQ ID NO: 74925 - RNA, 44 nt, Mus musculus
acagccacuaagccuccugaaaaagcuccucuuuuacccacaga

SEQ ID NO: 74926 - RNA, 42 nt, Mus musculus
aagcacaaaacucucaagaagaaaaauucccuggcacccaau

SEQ ID NO: 74927 - RNA, 46 nt, Mus musculus
agaagucuccuccaccgugaauccgcaaacacuacuacccacgcac

SEQ ID NO: 74928 - RNA, 42 nt, Mus musculus
ccucucucugcucggagaauugacccccaacacugggcagca

SEQ ID NO: 74929 - RNA, 46 nt, Mus musculus
uggaaaacaagucucugggauacauaagaaaaacaaacauagagac

SEQ ID NO: 74930 - RNA, 46 nt, Mus musculus
uggacuugaagaacccaagcccaguguucuccuuaagcagccacca

SEQ ID NO: 74931 - RNA, 46 nt, Mus musculus
ucucagucaucaagagacaugcaaauucuuaacaaugggaccuuaa

SEQ ID NO: 74932 - RNA, 26 nt, Mus musculus
cugcacacaguaauuaugggugagau

SEQ ID NO: 74933 - RNA, 46 nt, Mus musculus
ugggaguaaagugagagccccuuauguuagugaggaugggcgaauc

SEQ ID NO: 74934 - RNA, 46 nt, Mus musculus
uucccugcagcucaacagaacugcuaccacacuuagcacauuacag

SEQ ID NO: 74935 - RNA, 46 nt, Mus musculus
acaucaugcuaaauaugucauuuucaacaaaucuugugugcagugu

SEQ ID NO: 74936 - RNA, 45 nt, Mus musculus
aaaccagcaugcugugcucugagaagggccuaaugaaggggcagg

SEQ ID NO: 74937 - RNA, 45 nt, Mus musculus
uaggugaguuugagaacuaacuaaccuauacuauugagggagaag

SEQ ID NO: 74938 - RNA, 52 nt, Mus musculus
ugaugacguguuugugcaaagcaagcaauuugaggagaaacgccugggacgu

SEQ ID NO: 74939 - RNA, 41 nt, Mus musculus
agagagucugguagaugugggagcugggguucagggcgaga

SEQ ID NO: 74940 - RNA, 49 nt, Mus musculus
uaaucaugugauuagucugaaucauuguuucugucaccugucuucccag

SEQ ID NO: 74941 - RNA, 26 nt, Mus musculus
agccuggccaaguacaaucagauccu

SEQ ID NO: 74942 - RNA, 51 nt, Mus musculus
gcguguaagcuugcccaguccaauggcuggggcgucauggugucccaccag

SEQ ID NO: 74943 - RNA, 45 nt, Mus musculus
acauccagguggugggcgaugaccucacagugaccaacccuaaga

SEQ ID NO: 74944 - RNA, 46 nt, Mus musculus
uggcaaguaugaccuggacuucaagucuccggaugaccccagcagg

SEQ ID NO: 74945 - RNA, 44 nt, Mus musculus
ccgaggccacgcgcucuccaaaagaccuccaagguugagcgcgg

SEQ ID NO: 74946 - RNA, 30 nt, Mus musculus
cgugucacccaagaggcaguuugcugucac

SEQ ID NO: 74947 - RNA, 46 nt, Mus musculus
acacuccugagcaguauuauucuaaacuccucuacccagcccaccu

SEQ ID NO: 74948 - RNA, 45 nt, Mus musculus
guguucagugucacaaccguugaccugaaaagaaaaccugcagau

SEQ ID NO: 74949 - RNA, 41 nt, Mus musculus
aauaggcaggccuucuggguucccaggaggcaggugacaga

SEQ ID NO: 74950 - RNA, 42 nt, Mus musculus
ucugccaucacugugacacauuuccuggcaagaguccaaggg

SEQ ID NO: 74951 - RNA, 25 nt, Mus musculus
gagauuuguguguguguuugccuuu

SEQ ID NO: 74952 - RNA, 46 nt, Mus musculus
aauuuaaugucauucuuacuguaguuuuuuuuaauuaccaugagaa

SEQ ID NO: 74953 - RNA, 45 nt, Mus musculus
agacuacuaaaacauugaguuguuuuucugacuauaaccacauug

SEQ ID NO: 74954 - RNA, 47 nt, Mus musculus
aacuguagcuuaguguuaccaagaaagcaaugauaaucaguguguag

SEQ ID NO: 74955 - RNA, 46 nt, Mus musculus
ugcuaacuagcaaguugucuuuagaauagugcaugucaggguagau

SEQ ID NO: 74956 - RNA, 45 nt, Mus musculus
aauccugccacuccucaucagcaaguauacugcagguccccagcc

SEQ ID NO: 74957 - RNA, 46 nt, Mus musculus
uggugcaagccuuuaaucccaacccacauggaguuuguggccagau

SEQ ID NO: 74958 - RNA, 47 nt, Mus musculus
uaugaguuugaggcuagccacauuuacagauaauuacagccagcaau

SEQ ID NO: 74959 - RNA, 46 nt, Mus musculus
uaauaacaacaacauuaguagcccuucugaaaaaagaaaacagaga

SEQ ID NO: 74960 - RNA, 32 nt, Mus musculus
ugugcguuuuauguuuguacuaaccccuagga

SEQ ID NO: 74961 - RNA, 46 nt, Mus musculus
ggcauuuuguuuugauuggggcaaaauguuagucugugguccaguu

SEQ ID NO: 74962 - RNA, 46 nt, Mus musculus
uucagaggagucugaugaaccuuucuucagcuuucacuugccagca

SEQ ID NO: 74963 - RNA, 45 nt, Mus musculus
uuaggggauuuaguacccucuucuggccuccacagacaccaagaa

SEQ ID NO: 74964 - RNA, 46 nt, Mus musculus
uuauccacucaaguggaccguuugcucggaaauauugauggcagaa

SEQ ID NO: 74965 - RNA, 45 nt, Mus musculus
ggaaacgacugcucuuaaguaugguggagaaaguuuauuguaggu

SEQ ID NO: 74966 - RNA, 42 nt, Mus musculus
cauccccuuuuuauuuuuauuauuauuauuauuugcccccca

SEQ ID NO: 74967 - RNA, 46 nt, Mus musculus
uuugaacuuguaugcuuguuuuaagcaaguauuuuaaaccacugag

SEQ ID NO: 74968 - RNA, 32 nt, Mus musculus
gaaggaagaaauuguuuuacuuacacauggag

SEQ ID NO: 74969 - RNA, 45 nt, Mus musculus
gauuucauuaaaacuuuuuucauagugaucaugauucuauaugag

SEQ ID NO: 74970 - RNA, 45 nt, Mus musculus
ugggaacuuuacugugcagaaccgagaacuugaaugcauucgaga

SEQ ID NO: 74971 - RNA, 46 nt, Mus musculus
cuaagugacauuaaacggugauuccugccuuccaucccuugcccag

SEQ ID NO: 74972 - RNA, 46 nt, Mus musculus
gaaaagaauuagcaaaacauuaaauaugacaacaaguccugaggag

SEQ ID NO: 74973 - RNA, 63 nt, Mus musculus
agguuuuucucgcccaaggcacuuuacggccugaucuaaucgaaagugcgucccuuguugcca

SEQ ID NO: 74974 - RNA, 48 nt, Mus musculus
aaaacccaccacaacgacacagaacuuaucaggaaguuaagggaagag

SEQ ID NO: 74975 - RNA, 46 nt, Mus musculus
ugcucauauacugaguuuucauuugauauuuuuuaauuggggcugg

SEQ ID NO: 74976 - RNA, 46 nt, Mus musculus
gcagaauauccucagugacccuggauaccagaguuuacaaacagaa

SEQ ID NO: 74977 - RNA, 49 nt, Mus musculus
agcauauauuaccaacagccguugacuugaggaauuuaaggcaguaguu

SEQ ID NO: 74978 - RNA, 46 nt, Mus musculus
uuguacacuuagaauauauacugugacuugagaagccuuucuuuag

SEQ ID NO: 74979 - RNA, 45 nt, Mus musculus
cagugugugugugugacuguguguguguguguuuguguguuguag

SEQ ID NO: 74980 - RNA, 46 nt, Mus musculus
aacaauggaggaguguuccucuuucuccacauccucacaggcaucu

SEQ ID NO: 74981 - RNA, 46 nt, Mus musculus
uuuuaucacagagaucuuuaauuuccuuaguuagagucaagccaag

SEQ ID NO: 74982 - RNA, 46 nt, Mus musculus
ucccuauacccucccuccacccugcuccccuacccauuggcccugg

SEQ ID NO: 74983 - RNA, 45 nt, Mus musculus
uucucuucccagugauaaugugugaauuugguuuugucguggaau

SEQ ID NO: 74984 - RNA, 42 nt, Mus musculus
uaguaugagaacugaacucagguccuuuguagcaggagccag

SEQ ID NO: 74985 - RNA, 47 nt, Mus musculus
cucucauagcagugauccauggcuuaguguggagcugaggaugauua

SEQ ID NO: 74986 - RNA, 31 nt, Mus musculus
auacugaucacugcuggucaggugaucauau

SEQ ID NO: 74987 - RNA, 45 nt, Mus musculus
uguaucucagugaugggauuauaccauuucuccugcccaccccau

SEQ ID NO: 74988 - RNA, 58 nt, Mus musculus
uguugagauuggggaccauuugugguaauugaaucuagguccaguuguaguauguuug

SEQ ID NO: 74989 - RNA, 45 nt, Mus musculus
cuuucaacaguaggcacgcuguauguagaagagucacagcccaug

SEQ ID NO: 74990 - RNA, 45 nt, Mus musculus
cuauuaagggauauaacuggucuauuguuagagucaacuagguga

SEQ ID NO: 74991 - RNA, 41 nt, Mus musculus
agacuuuuggaucucauugcaucuauguuccacagaaguua

SEQ ID NO: 74992 - RNA, 46 nt, Mus musculus
ucucugcaggaagugcgagaaacaaacaaggaaauaaacgggagaa

SEQ ID NO: 74993 - RNA, 46 nt, Mus musculus
ggaggguuuuaacgauaaagcagugcuuccuccccacaguccacgg

SEQ ID NO: 74994 - RNA, 47 nt, Mus musculus
acggauuauuucaauuauggauucagauguugaauaggugguaagau

SEQ ID NO: 74995 - RNA, 42 nt, Mus musculus
cagguuccaugacuuuccacaagaaugccaucagcgggggac

SEQ ID NO: 74996 - RNA, 42 nt, Mus musculus
aauaauaauccaaggaaugccaggagaguucuuuuuauagau

SEQ ID NO: 74997 - RNA, 55 nt, Mus musculus
ucccagaucccugacuguccacagcgaggagggcagggguagaaaaccuauuuug

SEQ ID NO: 74998 - RNA, 42 nt, Mus musculus
uagauguagucuuaaucguauuuaaguugauacggggcagga

SEQ ID NO: 74999 - RNA, 46 nt, Mus musculus
uacaucuucccuuuaaggaccugagugugaaaggaaacagaugucu

SEQ ID NO: 75000 - RNA, 46 nt, Mus musculus
aaaaaaaaaaaagacugacuuuucaguuguaguucaauaagcagac

SEQ ID NO: 75001 - RNA, 41 nt, Mus musculus
aacagcuucaauuucuguucaaaggggaaaaugcuaacagu

SEQ ID NO: 75002 - RNA, 45 nt, Mus musculus
agacccuuccuuacacuaugggaggugaagacugacaccagaggu

SEQ ID NO: 75003 - RNA, 46 nt, Mus musculus
uaaguaauuuuuuauauuacguguugagaugguaauuuagauagau

SEQ ID NO: 75004 - RNA, 42 nt, Mus musculus
uuucuuacucugguaaaucuuauuguccauucugccucucug

SEQ ID NO: 75005 - RNA, 46 nt, Mus musculus
aauaccuaugacaggccauaacugauaacaaacuucagcccuacau

SEQ ID NO: 75006 - RNA, 46 nt, Mus musculus
cuugcuuucccccaucagauaccagggaaaaguugaaggaugaguu

SEQ ID NO: 75007 - RNA, 44 nt, Mus musculus
gauggaacagcacgcacaugaacagugaaguggauaccaaggac

SEQ ID NO: 75008 - RNA, 41 nt, Mus musculus
uggcuugugaauuuucagauguguucagaauucagggugca

SEQ ID NO: 75009 - RNA, 46 nt, Mus musculus
guuagaacccugagagacaccccaguuaaauuguacagggccaggc

SEQ ID NO: 75010 - RNA, 46 nt, Mus musculus
uuacaguuuuucucaagugggauacagugaggggaauuagcccgua

SEQ ID NO: 75011 - RNA, 46 nt, Mus musculus
auauuguuuuaauuuggaaaggauaauuugaaguuaacugaaauga

SEQ ID NO: 75012 - RNA, 43 nt, Mus musculus
ucugugcuaccacauuucugugugugaagucaugcagccagug

SEQ ID NO: 75013 - RNA, 57 nt, Mus musculus
gggagaaagucaccaccuuuaucuuuaucugacaguauggucagaagcucaagaaau

SEQ ID NO: 75014 - RNA, 66 nt, Mus musculus
cuaaaccaaacuccuucuaagugacugcugugaacuugccacuagguggcggugccuguguagcug

SEQ ID NO: 75015 - RNA, 48 nt, Mus musculus
gaagggauucaaagcaaaguacauuucaguaacacauaugagguaggc

SEQ ID NO: 75016 - RNA, 93 nt, Mus musculus
aacauaugacucuauuuuuaacuuuaaagauauuuacaaggaguagagcuguuucugugcugguagauguuucuguggucugugcuacuuagg

SEQ ID NO: 75017 - RNA, 46 nt, Mus musculus
aucacugauuucauauuccuauuugccguucaccacacccaagaac

SEQ ID NO: 75018 - RNA, 48 nt, Mus musculus
ugggaucauugugucuaugaccaggcuuucgcaccacaggcagaauau

SEQ ID NO: 75019 - RNA, 44 nt, Mus musculus
cacacuguucagcuguauggcuuuggcccuggguggccgggagg

SEQ ID NO: 75020 - RNA, 46 nt, Mus musculus
uuaaaagaaaggcagccaagguaguuaccuaaaaauaguacccagg

SEQ ID NO: 75021 - RNA, 73 nt, Mus musculus
uuuuugacagauugcugaaauuaaaugaauugaaagggaaacucagaguaccagggcauuuuauuaaaaggca

SEQ ID NO: 75022 - RNA, 46 nt, Mus musculus
aagcauauugcuuguagguauuuugucauguuuauagccucccaug

SEQ ID NO: 75023 - RNA, 45 nt, Mus musculus
uauuguugcuuccuucuuuauacugaagaacuucaaccccacagu

SEQ ID NO: 75024 - RNA, 46 nt, Mus musculus
auauuaucuuggccucuuggauaaaaagcagauacauaugggagca

SEQ ID NO: 75025 - RNA, 61 nt, Mus musculus
gccaagcuucuugaauuuggauuaaagcaugugcuaagguagaaaugucaauuacuugugg

SEQ ID NO: 75026 - RNA, 47 nt, Mus musculus
cccaaagaagaauaaauucauuaaguaggugccauuuauaagaucaa

SEQ ID NO: 75027 - RNA, 46 nt, Mus musculus
uagcauucaggugcagcuuacugugccugauuuccuuggagcagcg

SEQ ID NO: 75028 - RNA, 46 nt, Mus musculus
gaccucucugucauuuguuaacuuagcuuuuucaaaguugucaggu

SEQ ID NO: 75029 - RNA, 46 nt, Mus musculus
aacggcugugaauuugaaagggagcccaggggcauucaugggaggg

SEQ ID NO: 75030 - RNA, 64 nt, Mus musculus
ugcuguuuccaaagaagugacucgaaagcuuucugaagcugauaauaggaagaugucccggaag

SEQ ID NO: 75031 - RNA, 45 nt, Mus musculus
ucugacuucccuuuugggauaccaugcuauagacaaauacuccaa

SEQ ID NO: 75032 - RNA, 88 nt, Mus musculus
uugguuaaugucguuccuaugagauugauuuuaagggcacagagaaggaacagagacucagaccacauugugaccugugagggaugcc

SEQ ID NO: 75033 - RNA, 54 nt, Mus musculus
aaucuacaccacaaauauccaucagccuguccuagaaucaccuguagagccugg

SEQ ID NO: 75034 - RNA, 48 nt, Mus musculus
aagagcccuaucugaagcaacucaaugaguuauuuuucuaaggaacuc

SEQ ID NO: 75035 - RNA, 46 nt, Mus musculus
caaccguacucccuuucuuguuuaaucuuaagccaagggacuggcu

SEQ ID NO: 75036 - RNA, 46 nt, Mus musculus
acagcaccugcccuguagccaucgccaccugcagacgagagaggag

SEQ ID NO: 75037 - RNA, 29 nt, Mus musculus
cccaaaggaagggcaggcggagugaacaa

SEQ ID NO: 75038 - RNA, 46 nt, Mus musculus
ccuuugcccaaaacgacgggaaaacgcaagaaauucgccccgagga

SEQ ID NO: 75039 - RNA, 45 nt, Mus musculus
agggauugggaaauacacgggguuaaucucacccuuuccugugga

SEQ ID NO: 75040 - RNA, 43 nt, Mus musculus
uuagguuuauugaggagacucaugguguagguuucgcucgcag

SEQ ID NO: 75041 - RNA, 44 nt, Mus musculus
aaagaaaacaguguucugaccuaccagaccauccucgagcagca

SEQ ID NO: 75042 - RNA, 45 nt, Mus musculus
uaaccuauggcucuuugcuaaaaagauacauuaguauggcuuuga

SEQ ID NO: 75043 - RNA, 45 nt, Mus musculus
cgacccaaguuaaauucugugaaagcaaucacuaaguucaggccu

SEQ ID NO: 75044 - RNA, 46 nt, Mus musculus
cacuggcaauuuagucaaguaucuuuuaaaccuaaaccacucagag

SEQ ID NO: 75045 - RNA, 26 nt, Mus musculus
uccaaggacagggcuaacguuuuguc

SEQ ID NO: 75046 - RNA, 46 nt, Mus musculus
ccugguggggauaugaggugcucacguuuuucuuacuaggccagca

SEQ ID NO: 75047 - RNA, 44 nt, Mus musculus
cuggugauaugguaccucagccucccccacuacaaugugaucga

SEQ ID NO: 75048 - RNA, 46 nt, Mus musculus
uuucaugguuggggaccagcccagcaugagguguugaaggcuaugg

SEQ ID NO: 75049 - RNA, 46 nt, Mus musculus
ucacugagucuagugcucacugaugaccagccaacaaaugccagag

SEQ ID NO: 75050 - RNA, 45 nt, Mus musculus
uacuaccauauaaacuccauuacauugggggccaaacuguucaga

SEQ ID NO: 75051 - RNA, 42 nt, Mus musculus
aauuagagggagcugcaacugggagcgagcagaaagggggag

SEQ ID NO: 75052 - RNA, 45 nt, Mus musculus
cuugguaauguguaagagucacccaggugguacugguucugaagg

SEQ ID NO: 75053 - RNA, 42 nt, Mus musculus
aguuuugaaggaaaaacauuagguagcuggcuaggcggccau

SEQ ID NO: 75054 - RNA, 42 nt, Mus musculus
aauaacuuaggagauggacaucagaucacuguggcuguccag

SEQ ID NO: 75055 - RNA, 46 nt, Mus musculus
aguggggaaauccccacucaauuccccauuuggcgugcacccaaaa

SEQ ID NO: 75056 - RNA, 70 nt, Mus musculus
cuguagauagcagcccuguuaaaaccugucuuugcuuucugaugccuucccugcaucuuccucaucagug

SEQ ID NO: 75057 - RNA, 46 nt, Mus musculus
cauccucucuaccaugauguaaugaaacuguaaacaaacccccaau

SEQ ID NO: 75058 - RNA, 49 nt, Mus musculus
guagcugagagcuaaauucugaucuguaggcaggcagggaggcagagaa

SEQ ID NO: 75059 - RNA, 46 nt, Mus musculus
guuacuacugcugugaugaaacaccaugaccaaaaagcaagcuggg

SEQ ID NO: 75060 - RNA, 25 nt, Mus musculus
cagagguaacagggagguaacaggu

SEQ ID NO: 75061 - RNA, 45 nt, Mus musculus
cagccagagcaacaacuuucuggagaguuuucagucuaaggauuu

SEQ ID NO: 75062 - RNA, 42 nt, Mus musculus
agggguucauuacugggcuguguuaaugagaauggucccuag

SEQ ID NO: 75063 - RNA, 46 nt, Mus musculus
aacaguuccgccaacuagggaccauucucauuaacacagcccagua

SEQ ID NO: 75064 - RNA, 46 nt, Mus musculus
cuggcacccaaguuauacagcaaagugagcccuggguucagggaag

SEQ ID NO: 75065 - RNA, 45 nt, Mus musculus
cugcuucauagaaaaauuaaccagggcugccaaggugaaaagauc

SEQ ID NO: 75066 - RNA, 48 nt, Mus musculus
auaucacacuugggaguagcugcagguuuuguaaacaaaguacaggca

SEQ ID NO: 75067 - RNA, 92 nt, Mus musculus
agccuuauggauggcuuccaggaauguuugggacacuacagaggacuugggcaguggccacuugaccuagaagaaccagaaaccucagcuug

SEQ ID NO: 75068 - RNA, 52 nt, Mus musculus
ccagaaaggaaggagauccagugcaagaugacugugggcguggagagacuug

SEQ ID NO: 75069 - RNA, 52 nt, Mus musculus
ggcacuugcagcaaccgcagaacccuuuccaucugaagcccaggggaggagc

SEQ ID NO: 75070 - RNA, 42 nt, Mus musculus
gugugugugugugugugugugcacgagugcucaagugccagu

SEQ ID NO: 75071 - RNA, 38 nt, Mus musculus
gaagacaagugucaguuuaucaauggguguauagcagg

SEQ ID NO: 75072 - RNA, 46 nt, Mus musculus
ugcuauuggaagaauagaucuucuuaaaugugcaguguugagucac

SEQ ID NO: 75073 - RNA, 45 nt, Mus musculus
uuguaguuacagcauucugaagauagggcuuuauucuagacuugg

SEQ ID NO: 75074 - RNA, 41 nt, Mus musculus
aagagugcacccucacauucagugacaggcugagagcaggg

SEQ ID NO: 75075 - RNA, 47 nt, Mus musculus
cuuaaauucaguucuuugcagcagaucuauuuuaacuaaagcagaga

SEQ ID NO: 75076 - RNA, 53 nt, Mus musculus
auuaaaaacuauuacauuaucgaaauuguucuugguugucgaaugggacgaga

SEQ ID NO: 75077 - RNA, 46 nt, Mus musculus
cuuuuaguccugcagucacaaacacagcuagcucuccgugcugcag

SEQ ID NO: 75078 - RNA, 43 nt, Mus musculus
gcuuccugggggagagguggcgaggaggaagggaaugggagau

SEQ ID NO: 75079 - RNA, 46 nt, Mus musculus
ccuuucccgccuagaaugugcguuccucccuccgggccugcagcag

SEQ ID NO: 75080 - RNA, 46 nt, Mus musculus
acagaugguugugagcugccucuugugugcugaaaauugaccccag

SEQ ID NO: 75081 - RNA, 46 nt, Mus musculus
caagguguuccaaagcaggucuccauuucuuucugcaaacaguguc

SEQ ID NO: 75082 - RNA, 45 nt, Mus musculus
ccaggcauuugugagcugcccaacagugagugcuaggaaccccac

SEQ ID NO: 75083 - RNA, 46 nt, Mus musculus
ugguaugugugcgcacuaggccacacuaugcauauggcggucacag

SEQ ID NO: 75084 - RNA, 53 nt, Mus musculus
cucagugcucucuuaacuucuauuuuuaauaauugaaacgacaaaauacauaa

SEQ ID NO: 75085 - RNA, 88 nt, Mus musculus
uucuuucuacuaauggaaauuccuguuuuuuccugaaaagcggcaaacuuuagaauguuaucuucuuucagauauuuucagccaccag

SEQ ID NO: 75086 - RNA, 69 nt, Mus musculus
uuguugagauuuaaaauuuuuauuuguauggaugcuuugcauguguaugugucuguauauuauguaugu

SEQ ID NO: 75087 - RNA, 45 nt, Mus musculus
caaguuauugauucaucuugcccuuggacuuuuuaauugccugga

SEQ ID NO: 75088 - RNA, 46 nt, Mus musculus
auguuaaguggguacagaagagacugaagaaccauaugggaauugg

SEQ ID NO: 75089 - RNA, 45 nt, Mus musculus
uugacuacuggacuuugcuguagcucacucagucauacuaguugg

SEQ ID NO: 75090 - RNA, 47 nt, Mus musculus
uucagaccaguaucaaacugucuacuuaauguaugucauagaugcca

SEQ ID NO: 75091 - RNA, 45 nt, Mus musculus
uuuucucucuguuucuuuguuuuaaaguuuucauucuagccuuac

SEQ ID NO: 75092 - RNA, 46 nt, Mus musculus
gcaccaauucauuuucuuacgaaaaaguaaauuucugucugaagag

SEQ ID NO: 75093 - RNA, 46 nt, Mus musculus
cucaaggcugggcagaguaacccaguaggaggaaaagggccccaag

SEQ ID NO: 75094 - RNA, 45 nt, Mus musculus
gugguggugagaaucaaacucaaggcuucaagcacuagggacaag

SEQ ID NO: 75095 - RNA, 46 nt, Mus musculus
agaaguguugaaagguccuagauucuguacuuuaguugcuuaccau

SEQ ID NO: 75096 - RNA, 46 nt, Mus musculus
uuuagauggucuggauuuuuauuauucuucaaaacagcaugcucag

SEQ ID NO: 75097 - RNA, 45 nt, Mus musculus
uugaaauuugguuuugugaaaaucaagagaaaucaguuacaagga

SEQ ID NO: 75098 - RNA, 50 nt, Mus musculus
ccuaaacagcucgaagaguuuauugugauagaaugcagcacaguccgaga

SEQ ID NO: 75099 - RNA, 38 nt, Mus musculus
uuuugucucagaaguguuuugagguuuguucagacuag

SEQ ID NO: 75100 - RNA, 45 nt, Mus musculus
ugagagcguuuaagagaugaguauuuuuaauuuuauuuggggaga

SEQ ID NO: 75101 - RNA, 46 nt, Mus musculus
ccuggugcugggguuuguuuuauuuuguuguauuuuaacuuggcag

SEQ ID NO: 75102 - RNA, 48 nt, Mus musculus
ugucaacaaaaugaacucagacagaguuccagaugugguaaggcuuua

SEQ ID NO: 75103 - RNA, 45 nt, Mus musculus
acccccgaguccuuucuccagccuccggauugauauuuauuaaag

SEQ ID NO: 75104 - RNA, 74 nt, Mus musculus
cucauuaccacugagccaucucuucagccuguggccucaauucuugauauuaguaaaaagagcaaauuaaaaca

SEQ ID NO: 75105 - RNA, 57 nt, Mus musculus
aaaaaaauuauuauuauucuauuaaaggaugaguuuuacauuauugggaagcaacag

SEQ ID NO: 75106 - RNA, 45 nt, Mus musculus
guacugguugcuguacacgccauguaaccagaauuccagcccuua

SEQ ID NO: 75107 - RNA, 26 nt, Mus musculus
agaccauccaaugcccucuguaggcc

SEQ ID NO: 75108 - RNA, 45 nt, Mus musculus
aagugacacagaugaugaaggagcaccucgaauuagucuggcuga

SEQ ID NO: 75109 - RNA, 46 nt, Mus musculus
cauauuauauguugcuugcauaucuguggccucaggaaguuggcaa

SEQ ID NO: 75110 - RNA, 45 nt, Mus musculus
aauuguucccuuaaaguguugugaagguuucauaauuugauugau

SEQ ID NO: 75111 - RNA, 46 nt, Mus musculus
uauuguauuuugguacacuuuagaucacuuuuauauccugggguag

SEQ ID NO: 75112 - RNA, 46 nt, Mus musculus
aaucucuuccucuucaggagucagcuuggcccccuucuuguggccc

SEQ ID NO: 75113 - RNA, 46 nt, Mus musculus
caagacaacuugguauaauguuaaagaucuucuaaugggagcuuac

SEQ ID NO: 75114 - RNA, 46 nt, Mus musculus
uaaagcaucgguuaaaaccauacuuuuguauuuguuggaccccagg

SEQ ID NO: 75115 - RNA, 46 nt, Mus musculus
gauagagaagacugggauggacccucauaucauaucuggacaugac

SEQ ID NO: 75116 - RNA, 46 nt, Mus musculus
auccuauuggagaaacaacaauaugaacuaaccaguacccccagag

SEQ ID NO: 75117 - RNA, 24 nt, Mus musculus
auacuccaaaaguuucagugacac

SEQ ID NO: 75118 - RNA, 46 nt, Mus musculus
gcauccuaucaaauguggucugucacuaugcugugcugcuuuagau

SEQ ID NO: 75119 - RNA, 42 nt, Mus musculus
cugacauuacaaaguugucuuugccuucagagagagucacug

SEQ ID NO: 75120 - RNA, 46 nt, Mus musculus
auuuuuauguauagucccccuacuuacuaugcaguagcaggccaua

SEQ ID NO: 75121 - RNA, 46 nt, Mus musculus
uaccuuuccaggaguacucccuccagcaucaaucauccaagaagaa

SEQ ID NO: 75122 - RNA, 46 nt, Mus musculus
aaacuauugaacaaaauauuuugcuauaaaccuaaaauaggcaaug

SEQ ID NO: 75123 - RNA, 46 nt, Mus musculus
guugugugacuaagacagaccugcguaucuggguuugcccgcgggu

SEQ ID NO: 75124 - RNA, 42 nt, Mus musculus
cugaaguucagaugacccaggcuuuaguuuaagggggcuuug

SEQ ID NO: 75125 - RNA, 42 nt, Mus musculus
aacugaagacccagagauaauuccacacaccuauggccaccu

SEQ ID NO: 75126 - RNA, 47 nt, Mus musculus
aguucuagccagagcaguuacacaacaaaaggucaaagggauacaaa

SEQ ID NO: 75127 - RNA, 46 nt, Mus musculus
cuccauuccauaaaagauucuggaggcagaggauuuaaggcuagua

SEQ ID NO: 75128 - RNA, 46 nt, Mus musculus
accaugcauauauuagaguuauaaaugcuacaaaauacugucagau

SEQ ID NO: 75129 - RNA, 46 nt, Mus musculus
guagaaguccaaaaggacaaaugagaggagaaacaaguacaugaua

SEQ ID NO: 75130 - RNA, 46 nt, Mus musculus
uuuucuacuguaguuggcuuuugaaugaggaugacaauggaagaga

SEQ ID NO: 75131 - RNA, 46 nt, Mus musculus
aaagagaaagauuuacugccugcuaaaaguauauuggcccccuuuu

SEQ ID NO: 75132 - RNA, 42 nt, Mus musculus
acacaacauaauuuaacauauaacagauuugaggcccauguu

SEQ ID NO: 75133 - RNA, 45 nt, Mus musculus
ugccaguauagucuucauuuccauugugacccucagccugacuuc

SEQ ID NO: 75134 - RNA, 42 nt, Mus musculus
cacuugaucauaauaguuaauauuaauuacuaugccccauau

SEQ ID NO: 75135 - RNA, 46 nt, Mus musculus
uugguugugguuauacccaggauuuaauacaaccuugagagaagau

SEQ ID NO: 75136 - RNA, 42 nt, Mus musculus
cuuuuuagucuugguagaauaauugaguggcuaaggggaaug

SEQ ID NO: 75137 - RNA, 46 nt, Mus musculus
aguacgucuugguaucagcaauagugucaggguuuggugucugcag

SEQ ID NO: 75138 - RNA, 46 nt, Mus musculus
cacuuaucagugaguacaugccauguguguuccuuugggucugagu

SEQ ID NO: 75139 - RNA, 55 nt, Mus musculus
uugaugaagaaaauacuaccccuuucaugaucaugaggcaggugagcauaggaga

SEQ ID NO: 75140 - RNA, 45 nt, Mus musculus
aauuuauuuaugcucuauaguucagccugauuuccuugggccuag

SEQ ID NO: 75141 - RNA, 45 nt, Mus musculus
uaacaauaaaucaaaucucaucuuuauguauaaaagccccauaug

SEQ ID NO: 75142 - RNA, 28 nt, Mus musculus
ugcucgucagucuccacuugcuccagca

SEQ ID NO: 75143 - RNA, 50 nt, Mus musculus
gaauaauacguagcaauucuuaaaaucacagcuaucuugcuugagaggaa

SEQ ID NO: 75144 - RNA, 47 nt, Mus musculus
cuguacaguugaaaaucaauuggaaagcccgugugucugugucggug

SEQ ID NO: 75145 - RNA, 46 nt, Mus musculus
caugucucagcucaguaccauuuuguuuucuggcuuccggguaguc

SEQ ID NO: 75146 - RNA, 45 nt, Mus musculus
cuuaggugagaacuucuuuuauagucgaguuauacauggacaaga

SEQ ID NO: 75147 - RNA, 57 nt, Mus musculus
caaggaguucacaacagggcgcauccuaaaggaagacaggagcauuaugaggaggag

SEQ ID NO: 75148 - RNA, 57 nt, Mus musculus
guucaggaagaucugacugaagagaaaaaacgggaaauggagcauaauguugaagag

SEQ ID NO: 75149 - RNA, 41 nt, Mus musculus
uggugaauuuaaacccauccagggauaugaggcccugcuag

SEQ ID NO: 75150 - RNA, 45 nt, Mus musculus
cagacuuccuggcucgagaaugggaagcaaaggaagggaagggag

SEQ ID NO: 75151 - RNA, 48 nt, Mus musculus
agaccagcaggaggauaauguugaugagcaguaucaggacgaaggaga

SEQ ID NO: 75152 - RNA, 63 nt, Mus musculus
aaauuugccagaggaaagugaagagcaaaaacaaagcgaagcaaagcaagggaauguagaaau

SEQ ID NO: 75153 - RNA, 62 nt, Mus musculus
gcagaugaccccaacaaucaaggcgaagaugaauuugaggaagccgagcaagugagagaaga

SEQ ID NO: 75154 - RNA, 45 nt, Mus musculus
auugagaaacgucaaaaaaagaaaaaauacagugacucuuaaaga

SEQ ID NO: 75155 - RNA, 46 nt, Mus musculus
augugcacacagagagagagagagagagagagagagagagagagag

SEQ ID NO: 75156 - RNA, 89 nt, Mus musculus
gagauaaccagcgccaagaugaagcugaaggagacccaggcaacagacaggaacuucgugaaccaggacaccaagaaggcgacccugaa

SEQ ID NO: 75157 - RNA, 48 nt, Mus musculus
aagcucauuacaaugcuguggagaaugacaucgcacagggagucgagg

SEQ ID NO: 75158 - RNA, 45 nt, Mus musculus
ugcaccaacagaggcuccaugggcaguugcuaagacaacagcagc

SEQ ID NO: 75159 - RNA, 46 nt, Mus musculus
ccauaugaggaacaguuggaacagcagaggcuggcagcgaggagag

SEQ ID NO: 75160 - RNA, 56 nt, Mus musculus
agaggaacacaggaaggcacuggaggaggaggagauggagcagguggggcaggcgg

SEQ ID NO: 75161 - RNA, 44 nt, Mus musculus
accuuuccccaugggacucacccuccucaagguuacaacggaag

SEQ ID NO: 75162 - RNA, 42 nt, Mus musculus
uuucuggucuuaauauuuauucuauaacuagugcaccccuua

SEQ ID NO: 75163 - RNA, 53 nt, Mus musculus
gagagaagagaauagacaacuaagaaaagcacaccaagacauucacacacagc

SEQ ID NO: 75164 - RNA, 46 nt, Mus musculus
uugugagccaccaugugguugcugagauuugaacucggguccuuug

SEQ ID NO: 75165 - RNA, 98 nt, Mus musculus
agucagcaugaggagcugaggaagcagcacagugaccuggaagaggaacaccggaagcaaggggaagacuucaguagaacguucaaugaccacaagca

SEQ ID NO: 75166 - RNA, 46 nt, Mus musculus
ugaaagggacaaacagacagaacccaaccuuaagaacugagcuuau

SEQ ID NO: 75167 - RNA, 45 nt, Mus musculus
gauuccaauagcagauauagugcauugaauguccaacaucagaug

SEQ ID NO: 75168 - RNA, 45 nt, Mus musculus
uccuuguuuauaaguuagaagcacaagaaacacuuaacaaaggaa

SEQ ID NO: 75169 - RNA, 46 nt, Mus musculus
uuuaaauggaaaugagccccuuuuccauucuuuacugccuggaaaa

SEQ ID NO: 75170 - RNA, 46 nt, Mus musculus
gggcaggggucaugggaugcugauucaugggacaaucaaaagagag

SEQ ID NO: 75171 - RNA, 42 nt, Mus musculus
caggcccaagugugguaggaaugguaauuucagggcagaguc

SEQ ID NO: 75172 - RNA, 46 nt, Mus musculus
uuuaguaugagugugugugugugugugugugugugugugugugugu

SEQ ID NO: 75173 - RNA, 45 nt, Mus musculus
uguguguguguguggugugugugugugguguguguguauguguuu

SEQ ID NO: 75174 - RNA, 45 nt, Mus musculus
ucugagguacugaguucugucaguauuuugacaacuaccuuuaga

SEQ ID NO: 75175 - RNA, 42 nt, Mus musculus
cccugaauuuugugugugugugugugugugugugugugugug

SEQ ID NO: 75176 - RNA, 46 nt, Mus musculus
guaacagaaugacauuagaagauuuuauuacuacauuccuuuagua

SEQ ID NO: 75177 - RNA, 27 nt, Mus musculus
uugcauucuucccaccacuuugucagu

SEQ ID NO: 75178 - RNA, 42 nt, Mus musculus
acugaaaaaaaauuaagaaagcaaguagaguauaaacgagau

SEQ ID NO: 75179 - RNA, 45 nt, Mus musculus
acaugugugugauguagggguaugaugugggucaauguguauguu

SEQ ID NO: 75180 - RNA, 46 nt, Mus musculus
aagaaguaauuaaaauaugaagauucaaauaaaaauuagacuaaga

SEQ ID NO: 75181 - RNA, 42 nt, Mus musculus
uaccacuaaugguauuucauaacauuuauuuagggcccacga

SEQ ID NO: 75182 - RNA, 46 nt, Mus musculus
aagacuauucagugugcucucuggaaacccuguccccuguuaugag

SEQ ID NO: 75183 - RNA, 23 nt, Mus musculus
ucuguagaacccugugugugcau

SEQ ID NO: 75184 - RNA, 42 nt, Mus musculus
caaggggggaaaaaagagacuauauacacuagugacucauga

SEQ ID NO: 75185 - RNA, 42 nt, Mus musculus
gggacugacgguggggacagcgaggccaaaaaguggggagua

SEQ ID NO: 75186 - RNA, 42 nt, Mus musculus
uuuugauuagcacccugcugagugagaccacuggccccagca

SEQ ID NO: 75187 - RNA, 46 nt, Mus musculus
uccuagugcugcaugauuucuuuguugcauuuaaucaaauacagaa

SEQ ID NO: 75188 - RNA, 46 nt, Mus musculus
guguccuuugucuuaaauucauccucuucucagaggcggggaaaac

SEQ ID NO: 75189 - RNA, 46 nt, Mus musculus
gacccccucccucccuuuccucucuuccucccccucucgcccugag

SEQ ID NO: 75190 - RNA, 45 nt, Mus musculus
cuagaacauuccagaaggaaaguguuuccuguucaagcgugagag

SEQ ID NO: 75191 - RNA, 96 nt, Mus musculus
uuaggauaucucuccagcuucugauacuuguuuguuugguugguuuuaaagguauaugugagugugugugugugugugugugugugucugcuacac

SEQ ID NO: 75192 - RNA, 46 nt, Mus musculus
guuuucagcaaaacaucacaugcuuucugacaagacagccuccagg

SEQ ID NO: 75193 - RNA, 45 nt, Mus musculus
gagccacuuugcagaguuaagccugcacuuaccacaugaccagca

SEQ ID NO: 75194 - RNA, 57 nt, Mus musculus
ggcaccucgauagaggggagacagcagcuuacagacccaccaggccuuauccagaag

SEQ ID NO: 75195 - RNA, 46 nt, Mus musculus
gagcagcagagcgaucaggguuuguacuaccugcugucggggagag

SEQ ID NO: 75196 - RNA, 41 nt, Mus musculus
ucaccaugcccaucucacuugucugucccccucuuucccuc

SEQ ID NO: 75197 - RNA, 46 nt, Mus musculus
uccaaacagauguagacagcaggguggccugcugauugcugcagau

SEQ ID NO: 75198 - RNA, 48 nt, Mus musculus
guugauggcccccuugcacauucccuuugugccgcagaaagugggcgg

SEQ ID NO: 75199 - RNA, 46 nt, Mus musculus
aguuccaucuccccggagucugacuuugaaagccggaccaaaagaa

SEQ ID NO: 75200 - RNA, 53 nt, Mus musculus
gcugugaggugcccaggguaagaaggaggauggaccaacaaacccuccacucg

SEQ ID NO: 75201 - RNA, 49 nt, Mus musculus
uaauacuagcgaacugggucacaaaccugaaaagaacagaugcaagagg

SEQ ID NO: 75202 - RNA, 61 nt, Mus musculus
guggaaaucccagugaggaugaccagguuauaaaugggagcaagauaauaaccgcccugga

SEQ ID NO: 75203 - RNA, 42 nt, Mus musculus
ggugagacugacucgcacuguggugauugggaagcagaagga

SEQ ID NO: 75204 - RNA, 46 nt, Mus musculus
uuuucuuuuaaagggcagacauauccaugcaugcuaauaccagagg

SEQ ID NO: 75205 - RNA, 46 nt, Mus musculus
auuuugacacuugguacaaugacaagucccgaacuuaccaccucac

SEQ ID NO: 75206 - RNA, 42 nt, Mus musculus
acugucgggcuccucuccuccccaucucccucgcuggcggcu

SEQ ID NO: 75207 - RNA, 45 nt, Mus musculus
uaccaacugucaugccuguugaccacccucccauuaaagccuucu

SEQ ID NO: 75208 - RNA, 46 nt, Mus musculus
cucaacagauaaugcauaaauaaaugaacauuccugggucccaaua

SEQ ID NO: 75209 - RNA, 45 nt, Mus musculus
ugugugugugugugugugugugagugagagagagagagagugugu

SEQ ID NO: 75210 - RNA, 46 nt, Mus musculus
auuuuuuaaccuuuuuuauugugugugugugugugugugugugugu

SEQ ID NO: 75211 - RNA, 46 nt, Mus musculus
acucggugauugagugcuuguauggcaugcaaagagaccaggauug

SEQ ID NO: 75212 - RNA, 46 nt, Mus musculus
cuagcacgugcuuucucuguccugcguaucugugugugccccaccc

SEQ ID NO: 75213 - RNA, 46 nt, Mus musculus
uuuucucacuaguguuaauauguccauguauauugccguugcucug

SEQ ID NO: 75214 - RNA, 23 nt, Mus musculus
ucagaaugaacugaacacuaauu

SEQ ID NO: 75215 - RNA, 46 nt, Mus musculus
uuguguacuccaaaacagcuugugcagcacacauggaccuggagag

SEQ ID NO: 75216 - RNA, 48 nt, Mus musculus
ccucuuccagcaguuaccagcgccgcuggcuccgaagucagacaacga

SEQ ID NO: 75217 - RNA, 45 nt, Mus musculus
gauguugaaauacgcauuacauaaaauuuaccauuuuccacucuu

SEQ ID NO: 75218 - RNA, 42 nt, Mus musculus
ccccuugacaucugugcgcaugccuuacccuucaccugagau

SEQ ID NO: 75219 - RNA, 46 nt, Mus musculus
cuuuuguacacaaauuugcuuuuaauuuuuauuuuaugguucagau

SEQ ID NO: 75220 - RNA, 46 nt, Mus musculus
aacuuugacggucaucaucucagaaugauugugcacacaagcuagu

SEQ ID NO: 75221 - RNA, 76 nt, Mus musculus
ugcaggacagcuucgaauacauuaaccaagauccucaggcuggaaaacugaacacaaaucaguacaauuugggucc

SEQ ID NO: 75222 - RNA, 24 nt, Mus musculus
uccaucucagaagcuuccccgacc

SEQ ID NO: 75223 - RNA, 45 nt, Mus musculus
aaaauaaaaaggugguuaaaaagggcacgagagacugguuggaaa

SEQ ID NO: 75224 - RNA, 45 nt, Mus musculus
caacauuaggaggguugagaaccauugcucuuaagaugcuuagag

SEQ ID NO: 75225 - RNA, 46 nt, Mus musculus
auauauuguaguuuaaaacacuggaaugauugagaaaagcacgugg

SEQ ID NO: 75226 - RNA, 46 nt, Mus musculus
agauaauccagcuucucucucuuuugaauccacaguuggucguguu

SEQ ID NO: 75227 - RNA, 46 nt, Mus musculus
uuccugugcugcacucugcugcuucgugguguucacgucaacuggu

SEQ ID NO: 75228 - RNA, 46 nt, Mus musculus
uccucccacgguggcauuuacaugauagcacauuauuacccagagu

SEQ ID NO: 75229 - RNA, 75 nt, Mus musculus
ugguugugaccugaguguaaaggaacuccaaacccacacugaaccacagggcaaaccuaagcagacauacagagc

SEQ ID NO: 75230 - RNA, 42 nt, Mus musculus
ugucugggauuuauuuucauaagcauugaugauagcuggaca

SEQ ID NO: 75231 - RNA, 41 nt, Mus musculus
gcuuaauaggaaauguguuaguuggacagguugaauggaga

SEQ ID NO: 75232 - RNA, 41 nt, Mus musculus
uguuauuugggguggccauccacaaaggauaauagccugga

SEQ ID NO: 75233 - RNA, 42 nt, Mus musculus
gugaaaaggauguguaugacaaacuaacuugaauagcgaggu

SEQ ID NO: 75234 - RNA, 46 nt, Mus musculus
cuacucuaggucugucuucacaccaucaguuuagcaguugccacag

SEQ ID NO: 75235 - RNA, 46 nt, Mus musculus
auuucaucagauuuugaauuacagaauuaaagauuaaggaacauag

SEQ ID NO: 75236 - RNA, 46 nt, Mus musculus
accacauuuugaaaaaucacagcuauggcaucaguugucuggagau

SEQ ID NO: 75237 - RNA, 46 nt, Mus musculus
aggcaccaugaggcacuuacucagaugugucugcugagucacaguu

SEQ ID NO: 75238 - RNA, 85 nt, Mus musculus
uagcuaaaccauaauuagaauuuguuuuaaguauucugaaagagggaauggguuuggggucagggaagguggagaaagaagccag

SEQ ID NO: 75239 - RNA, 46 nt, Mus musculus
gcugcccuugucguccucacccuccugccucuuugaaugcugagau

SEQ ID NO: 75240 - RNA, 73 nt, Mus musculus
uuccuccuuauucuaucaaggggugugaugggagcugacugcacaccaagaugaagacacuggaggccuugca

SEQ ID NO: 75241 - RNA, 46 nt, Mus musculus
aaggauugaacuuuuaauauguaaagacugugggacuuuuacaguu

SEQ ID NO: 75242 - RNA, 46 nt, Mus musculus
aauaauguaugaaguuagagagauaauagcuaauauugccagagua

SEQ ID NO: 75243 - RNA, 45 nt, Mus musculus
cuguugcuaucuugucaggacagauggauggauggauggacaggc

SEQ ID NO: 75244 - RNA, 44 nt, Mus musculus
gcuauacacuuguaaguuuagcauccgggaggccgaggcagaag

SEQ ID NO: 75245 - RNA, 46 nt, Mus musculus
caucagcaaauauacaaauaggugaccaaguacuagaaggcaaaaa

SEQ ID NO: 75246 - RNA, 46 nt, Mus musculus
ccuccccaaguaauucagugcacagccaaccaauuugucuacagau

SEQ ID NO: 75247 - RNA, 46 nt, Mus musculus
acuuuccaguugaaaaguuaauuuggaaauggguuaacaggcagua

SEQ ID NO: 75248 - RNA, 46 nt, Mus musculus
aaacucccgcauuccugugugucaguaacacaacaaacaugcagua

SEQ ID NO: 75249 - RNA, 46 nt, Mus musculus
aaguauucaaaaggauggauugauaaacccuaccccaaaaccagaa

SEQ ID NO: 75250 - RNA, 45 nt, Mus musculus
aguaaggcugacuauguagucuucaaccccaucagaaaccugaga

SEQ ID NO: 75251 - RNA, 24 nt, Mus musculus
cauguuuaaaauuuuuuacugguu

SEQ ID NO: 75252 - RNA, 45 nt, Mus musculus
gauagagaauauucuagaagacagggcaagauuucugugugugug

SEQ ID NO: 75253 - RNA, 46 nt, Mus musculus
cauguugugugcccuagaguugaaggugagugugugugugugugug

SEQ ID NO: 75254 - RNA, 46 nt, Mus musculus
aucuuaucugucagccgucaccuauauauagggcauugucacaguc

SEQ ID NO: 75255 - RNA, 56 nt, Mus musculus
agcaaccacaugguggcucacaaccaucuacaacaagaucugacucccucuucugg

SEQ ID NO: 75256 - RNA, 46 nt, Mus musculus
cuucuggugugucugaagacagugacagugugcucacauauauaca

SEQ ID NO: 75257 - RNA, 46 nt, Mus musculus
ggcuuacuaauugguuguaguccugguuucaugaauguccccaaga

SEQ ID NO: 75258 - RNA, 90 nt, Mus musculus
uggccucgacuaucagaauccguaccugaguccauuccgagaguuccagagguggaagcaucaucccagcauccagccaacccuggaagg

SEQ ID NO: 75259 - RNA, 49 nt, Mus musculus
gaaguggaaaccuggaagaguagaucacacuguugguuggcccuuggac

SEQ ID NO: 75260 - RNA, 60 nt, Mus musculus
acaccuagccaagcagcuuuauaagaaauuugaucugagggccagcugugaugcacagac

SEQ ID NO: 75261 - RNA, 66 nt, Mus musculus
gacaacauuugagagaggacuggaacugcaugccaaagucacagucuuugcagaggguugccaugg

SEQ ID NO: 75262 - RNA, 46 nt, Mus musculus
aaguuuacagagguaaauuguuuagaaaauucuugggaauuuagaa

SEQ ID NO: 75263 - RNA, 89 nt, Mus musculus
auuacaucguacgccuaggacaucuggugagcuggaugggagaacaggcagaggcucuuggagucgaaguguauccuggguaugcugcu

SEQ ID NO: 75264 - RNA, 46 nt, Mus musculus
uaacuauauuagauugucgaagugccauagcaauauaaugucagau

SEQ ID NO: 75265 - RNA, 48 nt, Mus musculus
auuuuaacagagaaacacagaauuccugugccaauucuuccagguaga

SEQ ID NO: 75266 - RNA, 46 nt, Mus musculus
caucacuauuaaagccucacccuuacuuucuuacucauccccaaga

SEQ ID NO: 75267 - RNA, 85 nt, Mus musculus
gguugaaggacucaaggcagccuggcuacauagcaagacccaaucuaaaacaagaaguagcagaauuauaacuugacccccuugu

SEQ ID NO: 75268 - RNA, 42 nt, Mus musculus
gaaggacauccgugugugucugguggagaaagcugcucagau

SEQ ID NO: 75269 - RNA, 47 nt, Mus musculus
acaaagcuugccucccuccugugugugugugugugugugugugugug

SEQ ID NO: 75270 - RNA, 62 nt, Mus musculus
aaacucaguucagcauguggaagcggcagagaaaugaccuguccagacaagccggggcagcu

SEQ ID NO: 75271 - RNA, 46 nt, Mus musculus
agguuggugaacgacccuggagggugcugcgugguccuggagucag

SEQ ID NO: 75272 - RNA, 25 nt, Mus musculus
ugcgccuccuggcugauagugaggu

SEQ ID NO: 75273 - RNA, 45 nt, Mus musculus
aagggguugggggguggggcauagaaaugaugucucagugguuaa

SEQ ID NO: 75274 - RNA, 46 nt, Mus musculus
guauuugaaauccauggacuugccaauacuuauccucagcuacuuu

SEQ ID NO: 75275 - RNA, 41 nt, Mus musculus
acacagagagauauggagacagagagacagaaagggacaga

SEQ ID NO: 75276 - RNA, 46 nt, Mus musculus
gucagcccuuaaagggaagggcauuuaauucauguagacaaaggag

SEQ ID NO: 75277 - RNA, 45 nt, Mus musculus
ggacuugucacuuguuuaaugucacuagacaaggaagucagauua

SEQ ID NO: 75278 - RNA, 46 nt, Mus musculus
agaaaaucagacagcuguuauuacaaacagagaccgcucugcucag

SEQ ID NO: 75279 - RNA, 46 nt, Mus musculus
gcaucugcaagcaaugauagccauuccucuguuaagaucaccuggg

SEQ ID NO: 75280 - RNA, 51 nt, Mus musculus
agaccugagugggacugcacugaaauccaucaccacgagugguccaagaug

SEQ ID NO: 75281 - RNA, 42 nt, Mus musculus
uuuaccacaacuugcucaaacuguaauaucaaguggaagcuc

SEQ ID NO: 75282 - RNA, 46 nt, Mus musculus
cuaauuuccauuagauagugcaucauuuuaccauuuuauaugucag

SEQ ID NO: 75283 - RNA, 42 nt, Mus musculus
caugaauuuucaaaacgugaaagucuucaucagcagggccuu

SEQ ID NO: 75284 - RNA, 45 nt, Mus musculus
acucaguuaggguuucuuuuguugugaagagacacugugaccaag

SEQ ID NO: 75285 - RNA, 44 nt, Mus musculus
cuccaacaaggccacacccccuaauagucccauucccugugcca

SEQ ID NO: 75286 - RNA, 46 nt, Mus musculus
agacgcccauuuguguaauucccaguuuaaauuuuaagucauucag

SEQ ID NO: 75287 - RNA, 46 nt, Mus musculus
guuagggaguuuggcauaaauuuaauccugaaaagcaggacuccau

SEQ ID NO: 75288 - RNA, 42 nt, Mus musculus
uucucagagaccaaggcucucacuugcagacaucagcagcca

SEQ ID NO: 75289 - RNA, 42 nt, Mus musculus
agggaugauggccucaaauaaugucuuaggaacaaguagcaa

SEQ ID NO: 75290 - RNA, 45 nt, Mus musculus
gggagcaaggaggcaggaagcaagggagagaagcuggaguaagag

SEQ ID NO: 75291 - RNA, 50 nt, Mus musculus
agauuuauaaucgcuuggauacaaauugcugcggauuccgaccucgaaag

SEQ ID NO: 75292 - RNA, 51 nt, Mus musculus
gaggaccaaacuucugugacguuagcacacauuauccagagaaagaaugac

SEQ ID NO: 75293 - RNA, 42 nt, Mus musculus
ucgcccacaagacugcacagcacauguuuuuaggggacccag

SEQ ID NO: 75294 - RNA, 46 nt, Mus musculus
guacuaaaugccaccauauuucugcuagccauuucuuuccccguaa

SEQ ID NO: 75295 - RNA, 29 nt, Mus musculus
guuuccugaaucugcaguuucuguuuuga

SEQ ID NO: 75296 - RNA, 111 nt, Mus musculus
ugaucagguuuauugggaaagucaaggaggcaggcaaggcaucgagaagcuuaucgacgugauagagcggagagccagaauccuuaucaccuacaucaacgcacacggggc

SEQ ID NO: 75297 - RNA, 46 nt, Mus musculus
uaucaugaacugaguuuaaaaaguuuguagaguuuagagguaugca

SEQ ID NO: 75298 - RNA, 46 nt, Mus musculus
uaauaaaucauucccaugccauuugacugaccugaccagcugcuag

SEQ ID NO: 75299 - RNA, 46 nt, Mus musculus
gcgucugaucugcaaguacaacagucuugaaacaccuucuaaguag

SEQ ID NO: 75300 - RNA, 46 nt, Mus musculus
aucccucuaccaaaccuuucgugggcuuggaggaacuaaggcacac

SEQ ID NO: 75301 - RNA, 46 nt, Mus musculus
cuuucagcucuacuaccgcuuauuugcaaggucauugauuagccag

SEQ ID NO: 75302 - RNA, 48 nt, Mus musculus
ggaagcugaggcuccuacgggcaaacggguagcugaggaugaugagga

SEQ ID NO: 75303 - RNA, 42 nt, Mus musculus
guagcugaagaagaggaagaagguggggaggaagaggaggag

SEQ ID NO: 75304 - RNA, 42 nt, Mus musculus
cuccacaacuucugucuucuccuucaaguccucgguggugau

SEQ ID NO: 75305 - RNA, 30 nt, Mus musculus
cuaaacauagccagauccucugcccacaga

SEQ ID NO: 75306 - RNA, 41 nt, Mus musculus
cugaugacaucaaauuguuaaagaaacuaaucagcccuagu

SEQ ID NO: 75307 - RNA, 45 nt, Mus musculus
uccucugcacccuguuucuuuuacuccucuuccuugcccucaguc

SEQ ID NO: 75308 - RNA, 46 nt, Mus musculus
uauacugggcagccuggcacauggaucgggucucauuuccuuagcu

SEQ ID NO: 75309 - RNA, 42 nt, Mus musculus
aagcugguggucucggcacgucggggugggaggaaggccgau

SEQ ID NO: 75310 - RNA, 46 nt, Mus musculus
aaaggcaaacucacuggcaaugaauuuauuauuuuuuuaggacaag

SEQ ID NO: 75311 - RNA, 23 nt, Mus musculus
guagaguggggauagaacagaaa

SEQ ID NO: 75312 - RNA, 44 nt, Mus musculus
gcaggcuggagauaaacccagaucuccaugacgucaggccagca

SEQ ID NO: 75313 - RNA, 46 nt, Mus musculus
cauaguuucaauauaguuuuggauuaaugaaaugauguuaauguag

SEQ ID NO: 75314 - RNA, 46 nt, Mus musculus
auacagacaccuguccuuuuccuaucaugcuaacuuuacuuuacag

SEQ ID NO: 75315 - RNA, 49 nt, Mus musculus
acacaaaugcaguugcuaccgugagaugccaggcugcagagccacagau

SEQ ID NO: 75316 - RNA, 45 nt, Mus musculus
gauuguuucacauaugguguccugucagagacagagcagaguuag

SEQ ID NO: 75317 - RNA, 58 nt, Mus musculus
aguacaguuccugggaaggaaaugauacauuaaucguggcaaacaggagacugcugag

SEQ ID NO: 75318 - RNA, 45 nt, Mus musculus
uuuuagacagaagaaacucacccagucagcuggaaaccagaaauu

SEQ ID NO: 75319 - RNA, 46 nt, Mus musculus
gaaaguguuuccuucaugagaguauguuuuuucacgagggccccag

SEQ ID NO: 75320 - RNA, 41 nt, Mus musculus
cgcgcgcacacacacacacacacacacacacacaccggguc

SEQ ID NO: 75321 - RNA, 47 nt, Mus musculus
gugaaggagauaacguacaucaacagagacaccaagaucauccugga

SEQ ID NO: 75322 - RNA, 67 nt, Mus musculus
uguguaucccuaacauguccugaguuauaaggcccuaggaggccuuggaaacccauagcuguuuuca

SEQ ID NO: 75323 - RNA, 46 nt, Mus musculus
uucaaacuaauaaaaucaugacuauuuuuaugaaguuuuagaacag

SEQ ID NO: 75324 - RNA, 46 nt, Mus musculus
gguggcggccagaaaccagcaggacuggaagggaccccgcgucucg

SEQ ID NO: 75325 - RNA, 45 nt, Mus musculus
uacgaugaaggucaggguucuaaguuuauucggaaagcuaaggag

SEQ ID NO: 75326 - RNA, 44 nt, Mus musculus; identical to SEQ ID NO: 49896

SEQ ID NO: 75327 - RNA, 45 nt, Mus musculus
caccugccacuucuugaccauggagcacauuuugucccggguaag

SEQ ID NO: 75328 - RNA, 46 nt, Mus musculus; identical to SEQ ID NO: 49898

SEQ ID NO: 75329 - RNA, 46 nt, Mus musculus; identical to SEQ ID NO: 49899

SEQ ID NO: 75330 - RNA, 45 nt, Mus musculus
gugcacaguaacaacuacuaagucaaugccagagugaaggaagaa

SEQ ID NO: 75331 - RNA, 42 nt, Mus musculus
ugugugugugugugugugugugugugugugugcugggggggg

SEQ ID NO: 75332 - RNA, 48 nt, Mus musculus
cuccccgcucguguuauaauggauugcauacaguaacuucugucucag

SEQ ID NO: 75333 - RNA, 41 nt, Mus musculus
ucccgaaaauugccugaaaccaaaacucauccaagcaucga

SEQ ID NO: 75334 - RNA, 46 nt, Mus musculus
cccacccaccuuucucgauuccguaggagaucacacgguacagcag

SEQ ID NO: 75335 - RNA, 42 nt, Mus musculus
ugauucucgagcgcugugacccaucacucccuaccccuagcu

SEQ ID NO: 75336 - RNA, 46 nt, Mus musculus
ucagaaggcaaguucacccaugaggagguaagcagaugaguaagac

SEQ ID NO: 75337 - RNA, 46 nt, Mus musculus
gucaaaggauaccagaggcucuguuuacuuugguggggugggggug

SEQ ID NO: 75338 - RNA, 45 nt, Mus musculus
aaaaaaaaagccucagagaccagaaggggccaucuuguggcagag

SEQ ID NO: 75339 - RNA, 46 nt, Mus musculus
caccacagcagacagacagccgacacagggccaggggcguggauau

SEQ ID NO: 75340 - RNA, 36 nt, Mus musculus
cgagccuucagcauacagcauguucuccugccaguu

SEQ ID NO: 75341 - RNA, 46 nt, Mus musculus
aagagcagcgguuuugcuguuauccaggugagggucaaguuggagg

SEQ ID NO: 75342 - RNA, 48 nt, Mus musculus
uagauuaaaugugaaggaagugacuaaaggacuccauggugcaaggca

SEQ ID NO: 75343 - RNA, 46 nt, Mus musculus
guuuuuauugauuauugaucaucgcugugcacagaaugacacagaa

SEQ ID NO: 75344 - RNA, 60 nt, Mus musculus
uuucaccagaaggaguuuggaggaguacguagucguguuuaauguuguauugggucagug

SEQ ID NO: 75345 - RNA, 67 nt, Mus musculus
ucugcucucauaacucuggcucucucccaaaagcccaccucaugaugccuuccaagugagaauuagg

SEQ ID NO: 75346 - RNA, 45 nt, Mus musculus
gagggaguaguuugcucuuaucuggacugugcuucuguugggggu

SEQ ID NO: 75347 - RNA, 46 nt, Mus musculus
cagggagccucagggucucugggcucucugucaaugacugccuaag

SEQ ID NO: 75348 - RNA, 46 nt, Mus musculus
ucuucaugugaggcugcugggguuuuggcuuuguuuagcugcagaa

SEQ ID NO: 75349 - RNA, 34 nt, Mus musculus
ugacagagcaucucucagugugaggugggccauu

SEQ ID NO: 75350 - RNA, 49 nt, Mus musculus
aguauggagacuagugauaaauucaguguuuccaggaguucggggacag

SEQ ID NO: 75351 - RNA, 46 nt, Mus musculus
gucgcuguguuggggagcacggagguggccguuaaugcuaugaguu

SEQ ID NO: 75352 - RNA, 46 nt, Mus musculus
gcagcuacgaaagccucuuguaucucucuagauuuagucagcagau

SEQ ID NO: 75353 - RNA, 46 nt, Mus musculus
cucuucaucacugagcacaguuaugccuuuaauauuaccccagaau

SEQ ID NO: 75354 - RNA, 42 nt, Mus musculus
uaggggugcaccuauugguucagggacuggcugacugcaguu

SEQ ID NO: 75355 - RNA, 46 nt, Mus musculus
ggagccauuguuuuaaaaggaucauuucuuauagucaggcauagag

SEQ ID NO: 75356 - RNA, 41 nt, Mus musculus
ugcuggaaagugaggcagagcagcccaccaacagacuacag

SEQ ID NO: 75357 - RNA, 41 nt, Mus musculus
gcaugugugugugugugugguguguguguguguggugugug

SEQ ID NO: 75358 - RNA, 45 nt, Mus musculus
uuaccaacagugcuuucuccucauccuuugacaacacggggcaga

SEQ ID NO: 75359 - RNA, 45 nt, Mus musculus
auagcucaggagucaggugugauuaauucagcuuuguccccagag

SEQ ID NO: 75360 - RNA, 46 nt, Mus musculus
gaguugugacuguagagauagacaaucuuacugagauugcggagaa

SEQ ID NO: 75361 - RNA, 45 nt, Mus musculus
cucucguuuccuguguccaccgugacccuucuuuuuaccuccaga

SEQ ID NO: 75362 - RNA, 46 nt, Mus musculus
aaaucccagcggccacaugguggcucacaaccaucuguaacaagau

SEQ ID NO: 75363 - RNA, 41 nt, Mus musculus
uucccaugaaccugauagaagugaaauaucuugcccaagau

SEQ ID NO: 75364 - RNA, 46 nt, Mus musculus
auuuacaaaacagaagagucauguaauaaacuguugcuugggggau

SEQ ID NO: 75365 - RNA, 31 nt, Mus musculus
gguucuccugucuccacccaacccccuuuuc

SEQ ID NO: 75366 - RNA, 25 nt, Mus musculus
uuuuucuugaugccagaauguaagu

SEQ ID NO: 75367 - RNA, 46 nt, Mus musculus
aggacacuuacagcuguuuaauaacauuguccuggggaggcggaga

SEQ ID NO: 75368 - RNA, 80 nt, Mus musculus
cucuuuggaauaacaauuuugccuacaucucuagaucuaaaugucaugaguuugcuacagguuccuaauuggcaauugca

SEQ ID NO: 75369 - RNA, 46 nt, Mus musculus
uuacgaaguagaaaugacauaauuuuaugguugggggucgccagaa

SEQ ID NO: 75370 - RNA, 46 nt, Mus musculus
aggcaguguaugucaaggucaggacccuuacagggagccccaagag

SEQ ID NO: 75371 - RNA, 45 nt, Mus musculus
gacaucccuuaacucuugcuuuaaggcaucaucaguuuguucugu

SEQ ID NO: 75372 - RNA, 42 nt, Mus musculus
agagagagagagagagagagagagagagagagggcuccuugu

SEQ ID NO: 75373 - RNA, 45 nt, Mus musculus
uguggccuuugaaggccaaagaugagaguugguuugaccuggaga

SEQ ID NO: 75374 - RNA, 46 nt, Mus musculus
gagaggggagacagaaugcagagagagggggagaaauagggcaaga

SEQ ID NO: 75375 - RNA, 42 nt, Mus musculus
ccuuuagagggaaaccugcuccauugcuccagcacagcggau

SEQ ID NO: 75376 - RNA, 46 nt, Mus musculus
agacuuggugaagacagucucuuuccagagguugggggucagguag

SEQ ID NO: 75377 - RNA, 42 nt, Mus musculus
agugguaacacacacuuuuauucccagcacuugggagucagc

SEQ ID NO: 75378 - RNA, 47 nt, Mus musculus
auucauacacauaaaauaaaaauaaaucaaaacaaaucuuaggagga

SEQ ID NO: 75379 - RNA, 69 nt, Mus musculus
accgucccuguguucacagguuggaacccuuuaagcagagccuugauaaggaagacuauacaguuggag

SEQ ID NO: 75380 - RNA, 45 nt, Mus musculus
gcuugggaaugaaagacagaagaugaagaaaaaaauauauagaga

SEQ ID NO: 75381 - RNA, 42 nt, Mus musculus
uaguuuuaugucaacuugacacaagcugaagucaucugagag

SEQ ID NO: 75382 - RNA, 46 nt, Mus musculus
guugacccauacagucuggauuguagcacaccaaauaggcacaguc

SEQ ID NO: 75383 - RNA, 41 nt, Mus musculus
aauaucucuucuucuacugcacaccauccacccuugcuuaa

SEQ ID NO: 75384 - RNA, 46 nt, Mus musculus
cuaaugauaugccuagcaaagaacuuaaggcacuguguccaucuuc

SEQ ID NO: 75385 - RNA, 41 nt, Mus musculus
cugcacgcauccugcgaagaagcgucacugcagaggcaccc

SEQ ID NO: 75386 - RNA, 46 nt, Mus musculus
aacacuugguaaucucauuguuauuuguaaaugaaggcagcaagau

SEQ ID NO: 75387 - RNA, 46 nt, Mus musculus
uauuuguguauuuuuguguggaugcauguguguguguguggaaguc

SEQ ID NO: 75388 - RNA, 79 nt, Mus musculus
ccuacagaugacauugcugagaggaaauggggauaaugcugggucgugguaggaagugaguugggagaaauuuggaagc

SEQ ID NO: 75389 - RNA, 46 nt, Mus musculus
aguguggugguuugaaauaaagcuagguaaggaugaugcacagaua

SEQ ID NO: 75390 - RNA, 42 nt, Mus musculus
aaacuuguuaguuagguucauaguuagacucauggcacacaa

SEQ ID NO: 75391 - RNA, 46 nt, Mus musculus
ugaaauaaccucucaaccuucuaggaaucaggaaaugcggccagua

SEQ ID NO: 75392 - RNA, 46 nt, Mus musculus
caaaaaaauuuuuccccguuuugugcugguuuaugguaggcaucuc

SEQ ID NO: 75393 - RNA, 46 nt, Mus musculus
uggacuguauaaaaauuaaaauuuuucuggaugucaaacagcagau

SEQ ID NO: 75394 - RNA, 46 nt, Mus musculus
acauacagagcacaaacauacauauacacagaguacacgcacagaa

SEQ ID NO: 75395 - RNA, 45 nt, Mus musculus
gguagagcacacacaguaccccagccugaggucugacacacaggg

SEQ ID NO: 75396 - RNA, 46 nt, Mus musculus
caauagcaggaaaguuuaaauacucagcagccuggccccuagagau

SEQ ID NO: 75397 - RNA, 46 nt, Mus musculus
acccagcagcaaaggccuguuagaaauuaggaauccuggcacacca

SEQ ID NO: 75398 - RNA, 42 nt, Mus musculus
agagcucacccgcucacugucugacaaugugaaccugcccca

SEQ ID NO: 75399 - RNA, 46 nt, Mus musculus
ucauaaguagagcagccaagacuauggauaaacaagugucucugga

SEQ ID NO: 75400 - RNA, 43 nt, Mus musculus
cgagcugccgcggaggagcccgaguggagacggacggcgccgg

SEQ ID NO: 75401 - RNA, 23 nt, Mus musculus
cucagaauacuguuggaagguga

SEQ ID NO: 75402 - RNA, 45 nt, Mus musculus
aaaaugaaagcaggcuguagcaucguggaaaagccagaaggaggu

SEQ ID NO: 75403 - RNA, 45 nt, Mus musculus
gaaggguguguuugccaaguacucuagagacugugagccguggaa

SEQ ID NO: 75404 - RNA, 45 nt, Mus musculus
ucccggcagauccagcuguggcacuucauccuggaacugcugcag

SEQ ID NO: 75405 - RNA, 46 nt, Mus musculus
caaggauguucuuucccauaacugcaguaacauugccacacccagg

SEQ ID NO: 75406 - RNA, 46 nt, Mus musculus
acaucagccacacaucacccuuguccuaccuuacccuguccugugg

SEQ ID NO: 75407 - RNA, 64 nt, Mus musculus
uuuauacauacagaaagcccauagugggauaguuugcuuugagagggagagagaagaggaagag

SEQ ID NO: 75408 - RNA, 52 nt, Mus musculus
ggcuccccuccccccuuuuuagaaaauguuuucaagacacaugaguguacug

SEQ ID NO: 75409 - RNA, 46 nt, Mus musculus
guuugguuucccaaaccaagcgugacugagcacguuuuaugaggag

SEQ ID NO: 75410 - RNA, 45 nt, Mus musculus
aauguguaaaacuuuguagguguaaaucuauugcaaucucacuaa

SEQ ID NO: 75411 - RNA, 48 nt, Mus musculus
caucagcucugcugugcucgcgggucuuccuagacaucaggcugcacu

SEQ ID NO: 75412 - RNA, 69 nt, Mus musculus
guuauagaaauauauguauaauauacauauuuuuuccagggguaucugauagcucuguauuuuguuaug

SEQ ID NO: 75413 - RNA, 46 nt, Mus musculus
aucaaaaccuccaccacugugcgaaccacggagauuaacuucaaga

SEQ ID NO: 75414 - RNA, 46 nt, Mus musculus
ugagggcugccgagggaaaggguggccgggacugccacgagugaga

SEQ ID NO: 75415 - RNA, 42 nt, Mus musculus
cuuuguacccagccguugacaaccucuccaucuccagcuguc

SEQ ID NO: 75416 - RNA, 45 nt, Mus musculus
agcccuggaggaagaagaaagauucaaagacuuggaggcucugga

SEQ ID NO: 75417 - RNA, 45 nt, Mus musculus
gucacagugacagaaaagcuggaggaacugcagcugccucaggaa

SEQ ID NO: 75418 - RNA, 36 nt, Mus musculus
gacuuuaacuuuugugaacaggaagugacagaagag

SEQ ID NO: 75419 - RNA, 44 nt, Mus musculus
cggugggaaagcccgugccaggcagaggggaauggcugagagca

SEQ ID NO: 75420 - RNA, 46 nt, Mus musculus
guguguacucaggcuacucucaacucaggucuccagauccugugaa

SEQ ID NO: 75421 - RNA, 46 nt, Mus musculus
gggagggucccggggaacaaagagaugugucauuacuaauuagcag

SEQ ID NO: 75422 - RNA, 46 nt, Mus musculus
gggguguaccuuccugaugucacguucucaccccaaccuagcagag

SEQ ID NO: 75423 - RNA, 46 nt, Mus musculus
ucucccccccuuacacacacacacacacacacacacacacacacac

SEQ ID NO: 75424 - RNA, 42 nt, Mus musculus
ccucuggggugacacucauggcagggucuguccucagguucu

SEQ ID NO: 75425 - RNA, 45 nt, Mus musculus
uuuugggaaggcucacugucagucagugguugagaggugcccaga

SEQ ID NO: 75426 - RNA, 45 nt, Mus musculus
cggcuuucugccucuucuucuucuuccugcugucccugaagcucc

SEQ ID NO: 75427 - RNA, 45 nt, Mus musculus
cgcugcuuccuccuuuucuucuuuuuccuggaaggcugaucagau

SEQ ID NO: 75428 - RNA, 45 nt, Mus musculus
ggaugggauguagagaagggaaacccuagcggaauccaaccagac

SEQ ID NO: 75429 - RNA, 46 nt, Mus musculus
cugagugucuugaguggacucacugugcccauugcuagcaucgaca

SEQ ID NO: 75430 - RNA, 46 nt, Mus musculus
ggaagucagaaauuaaaacaaaacaaaaaccagaaagccccagcuu

SEQ ID NO: 75431 - RNA, 46 nt, Mus musculus
cugugugcuccacgacuuuccaggcacuccuauucugcagccaaac

SEQ ID NO: 75432 - RNA, 46 nt, Mus musculus
agugucagaaaauggacauuccuuuccuuggugaaaugcccccaga

SEQ ID NO: 75433 - RNA, 41 nt, Mus musculus
ccaacagcgaaacauacagccacagcuaguuaaacucagcg

SEQ ID NO: 75434 - RNA, 41 nt, Mus musculus
uguggcuguauguuucgcuguuggggaccucacuggggcug

SEQ ID NO: 75435 - RNA, 46 nt, Mus musculus
uguguguucagcuccauuuggccugcagggagaagagacucgccag

SEQ ID NO: 75436 - RNA, 46 nt, Mus musculus
ccuaccuuucuaggaugaccggaaucugggacaacagaggggugga

SEQ ID NO: 75437 - RNA, 46 nt, Mus musculus
ggcagugggcagcaacuccacccugcacuauguguggagcagccug

SEQ ID NO: 75438 - RNA, 45 nt, Mus musculus
aacuguaugcugcucuuggggagcaccaucagggccccagcagga

SEQ ID NO: 75439 - RNA, 37 nt, Mus musculus
cuucaccagggugagggucugaaggagcccagagaga

SEQ ID NO: 75440 - RNA, 46 nt, Mus musculus
ugcguccgagggggcacagccuccaggaaagccauacccuccguac

SEQ ID NO: 75441 - RNA, 45 nt, Mus musculus
ccaguaggaucaucuacagggcggccuugaaaaucggcacucagg

SEQ ID NO: 75442 - RNA, 45 nt, Mus musculus
agguccaagccuuuucuagaucuggucgaccugcucagcccccuc

SEQ ID NO: 75443 - RNA, 50 nt, Mus musculus
agacaucugcugugugcaggaggcgagggggcugagcaggucgaccagau

SEQ ID NO: 75444 - RNA, 45 nt, Mus musculus
uccuccucagagaaagccacuggucgccauugcaugaagccagau

SEQ ID NO: 75445 - RNA, 84 nt, Mus musculus
ucuucacuccaccuuggcaucuucucucccucauucaccaauuguucaagccuucuucgggucccagaacaacuucugugccuu

SEQ ID NO: 75446 - RNA, 42 nt, Mus musculus
guauucugaguaccaguccauaaacugaaacccacucuccag

SEQ ID NO: 75447 - RNA, 46 nt, Mus musculus
ggguucccaaacucccguuuccuguggaugaaacuugaaggccuac

SEQ ID NO: 75448 - RNA, 42 nt, Mus musculus
uacaaacccagaggaugagagcccaaggucgagacuggagaa

SEQ ID NO: 75449 - RNA, 41 nt, Mus musculus
agccagggcuucacagagaaacccugucucggggggaaaaa

SEQ ID NO: 75450 - RNA, 41 nt, Mus musculus
cgcuaccuuggguaaguggccagagcccuuagccuuccaua

SEQ ID NO: 75451 - RNA, 46 nt, Mus musculus
cagggcagauggggcaugguucagagguuauauaagggauugcgau

SEQ ID NO: 75452 - RNA, 45 nt, Mus musculus
cuuuacaucuaaugcuucgcuacaauugccuuuuuuaccauggga

SEQ ID NO: 75453 - RNA, 41 nt, Mus musculus
cguggauguuccuguggcuggaaaugcucccgcuagugaga

SEQ ID NO: 75454 - RNA, 45 nt, Mus musculus
guaugucuugacugguuguuggagggcccugacccaguguugguu

SEQ ID NO: 75455 - RNA, 42 nt, Mus musculus
auuucaggauacacagggaggucauuaucaugagccgcuuga

SEQ ID NO: 75456 - RNA, 57 nt, Mus musculus
uuuucccagcuucugagccuggugggcucugucucaaugauggagggcaaugucaag

SEQ ID NO: 75457 - RNA, 51 nt, Mus musculus
aucugccgugcuugcuuuuucuauauuuuauuuagacaagagaugggaaug

SEQ ID NO: 75458 - RNA, 71 nt, Mus musculus
gaggccaccugcuccccccucaccacaugccaccuccugucugcuccuuaggagagcaggccugaagccaa

SEQ ID NO: 75459 - RNA, 52 nt, Mus musculus
ugcgcaagcuggugcgcucacugaccaugguugaggacaaugaggaugacga

SEQ ID NO: 75460 - RNA, 77 nt, Mus musculus
gacuugguguggaaggcgcagaacaccuggggcugugggagcagccuucgcaccgcucucaucaacuccacuggaga

SEQ ID NO: 75461 - RNA, 41 nt, Mus musculus
ucaggaccaguccaugggcaacuggcagaucaggcgucaga

SEQ ID NO: 75462 - RNA, 42 nt, Mus musculus
gcccagccuaccuaagcuccugagugagauaauccaagaguc

SEQ ID NO: 75463 - RNA, 45 nt, Mus musculus
agcuucucgcagcaugcucgcacuagcgggcguguggcgguagag

SEQ ID NO: 75464 - RNA, 46 nt, Mus musculus
ccuggacauggagauccaugccuaucgaaagcugcuggagggcgag

SEQ ID NO: 75465 - RNA, 36 nt, Mus musculus
gcgcgauaccagccggcgccugcuggcugagaaaga

SEQ ID NO: 75466 - RNA, 50 nt, Mus musculus
cccugcaggagcugcgggcucagcaugaggaccagguggaacaguauaag

SEQ ID NO: 75467 - RNA, 52 nt, Mus musculus
gcgugagaccaagcgccggcaugagacgcggcuuguggagaucgauaacggg

SEQ ID NO: 75468 - RNA, 44 nt, Mus musculus
augagaugcugaggcgaguggaugcugagaacaggcuacagacg

SEQ ID NO: 75469 - RNA, 46 nt, Mus musculus
caaggaagcugcccugagcacugcucucagugagaagcgcacauug

SEQ ID NO: 75470 - RNA, 29 nt, Mus musculus
uuaggagggcaguggggggcgggggagag

SEQ ID NO: 75471 - RNA, 46 nt, Mus musculus
uguaaguacacuguagcuucagacauaccagaagagggcaucagau

SEQ ID NO: 75472 - RNA, 45 nt, Mus musculus
ugugccuucagucucaagaccugggguaggaaucggcuaccuaga

SEQ ID NO: 75473 - RNA, 44 nt, Mus musculus
gggcuuuucuguguaguuggcuguuuuggaacucacucuguaga

SEQ ID NO: 75474 - RNA, 46 nt, Mus musculus
aaacaaaacaaaacaaaacaaaacaaaacaaaacaaaaggauacag

SEQ ID NO: 75475 - RNA, 46 nt, Mus musculus
aaggagcgcgcccgccuccagcuagagcugagcaaagugcgugagg

SEQ ID NO: 75476 - RNA, 44 nt, Mus musculus
caggagcucaaugaccgccuggccguguacaucgaucgcgugcg

SEQ ID NO: 75477 - RNA, 46 nt, Mus musculus
ccggcucgcugucccccugagcagccucuguccuucuguccaaguc

SEQ ID NO: 75478 - RNA, 42 nt, Mus musculus
agccaacccagaucccgaggugcgccagcgcccagcccagau

SEQ ID NO: 75479 - RNA, 42 nt, Mus musculus
gugggaagggagagacuugggaguguuucuggagguugugug

SEQ ID NO: 75480 - RNA, 46 nt, Mus musculus
auaauuuucccagguuacacagcugcuaaguggaaacugcacagag

SEQ ID NO: 75481 - RNA, 46 nt, Mus musculus
auuacauguauucagugcuuguguguaccauauccugagucgagau

SEQ ID NO: 75482 - RNA, 45 nt, Mus musculus
aaacuaacuucauagggaguuaggugucuuugggagaucuggagu

SEQ ID NO: 75483 - RNA, 42 nt, Mus musculus
augcgcgccuggggggcccgcgcgugccuuggcugaagagga

SEQ ID NO: 75484 - RNA, 42 nt, Mus musculus
auguuaggagaugggaggucaggaccagagggcuagcgaauc

SEQ ID NO: 75485 - RNA, 46 nt, Mus musculus
ggcuagaagagguaagaggauggaaagaaacauguggcugggggcu

SEQ ID NO: 75486 - RNA, 45 nt, Mus musculus
agagagaccucccucugcccucaucccacauccuuuccccaucca

SEQ ID NO: 75487 - RNA, 46 nt, Mus musculus
uuuugcgcuuguuucuaggaaaggcucacucagcaagggugggauu

SEQ ID NO: 75488 - RNA, 46 nt, Mus musculus
aauauccuuuucauauaauaaauuaccuaauaaaaagucuuuuuuu

SEQ ID NO: 75489 - RNA, 46 nt, Mus musculus
ucucccaggcucauaaggacaauacuugcacucuacuuccugaguc

SEQ ID NO: 75490 - RNA, 42 nt, Mus musculus
acagcugggagcugugacacaaggguugcacagaggccaccc

SEQ ID NO: 75491 - RNA, 45 nt, Mus musculus
uguucuagagauuuaccaccgcugcuuuuucuuuaauaaaguugg

SEQ ID NO: 75492 - RNA, 48 nt, Mus musculus
gccguccaggccaucauugcugauccaaagacagaccacagacugggg

SEQ ID NO: 75493 - RNA, 48 nt, Mus musculus
uggcuuugacacaggcgaugcaguucuuaaugaagcugcucagauccu

SEQ ID NO: 75494 - RNA, 46 nt, Mus musculus
ccugauuuuaaggcgggugucauggcucuggcuaaccuccuucaga

SEQ ID NO: 75495 - RNA, 42 nt, Mus musculus
aguaucucaaagauguuaacuguccuuucaagauucaggauc

SEQ ID NO: 75496 - RNA, 46 nt, Mus musculus
acuuuaacguuuggcuugaagaccagaaaaucagacacuacaagau

SEQ ID NO: 75497 - RNA, 89 nt, Mus musculus
guauagaauaguuuauucagggcaugggaagaggagcugagaguuaggagagagagagagagagggagaaguagaggcuggccaucagc

SEQ ID NO: 75498 - RNA, 42 nt, Mus musculus
gacucaccgugagcaccccaaacgccucccugggccacagac

SEQ ID NO: 75499 - RNA, 46 nt, Mus musculus
acaagaucugacucccucuucuggugugucugaagacagcuucagu

SEQ ID NO: 75500 - RNA, 98 nt, Mus musculus
ccccaaaaucccuaaugggcuaacaaaaggcuaaagccugugacugaggaggagagagaggaaggugggacuggagauggaguaaggggggcucaggu

SEQ ID NO: 75501 - RNA, 45 nt, Mus musculus
gaacacaggguccccaauggaggagcuagagaaaguaaccaagga

SEQ ID NO: 75502 - RNA, 46 nt, Mus musculus
auggcucucuacgacuagucuccuuuucaagcugugcagccaagcc

SEQ ID NO: 75503 - RNA, 45 nt, Mus musculus
ccugucucucugcagugguaaacagcuggaagaggacucggggac

SEQ ID NO: 75504 - RNA, 46 nt, Mus musculus
cuguucccagcuuggguaccagugcugcacacugcuagggauggag

SEQ ID NO: 75505 - RNA, 46 nt, Mus musculus
cauagagcacucaauacaguuuuaaagguuugguuuugcagggcag

SEQ ID NO: 75506 - RNA, 44 nt, Mus musculus
caggagaaugggcacaaaaggugagggaguuccuaggcaggaga

SEQ ID NO: 75507 - RNA, 23 nt, Mus musculus
gguuugucuuguuguuuggucuu

SEQ ID NO: 75508 - RNA, 45 nt, Mus musculus
agggcuacaugaggcuuuaucuuaaaaauuuaaaagcaaccaaca

SEQ ID NO: 75509 - RNA, 45 nt, Mus musculus
gguauggccguaggucauagauuguuuaaaaaggaaaauccagau

SEQ ID NO: 75510 - RNA, 45 nt, Mus musculus
agcuaagcagggcgaggccugguuaguauuugaaugggagaccac

SEQ ID NO: 75511 - RNA, 42 nt, Mus musculus
ccucguggagggggccacugcccaccaacucagggggcuccu

SEQ ID NO: 75512 - RNA, 42 nt, Mus musculus
cucaucucucaggggcguuggugaagacccuacaagcccaau

SEQ ID NO: 75513 - RNA, 92 nt, Mus musculus
guguuaccaggagggugacagucucucgaacugaaguccaggggaggguagugggagagaauuuauaauaaaagcugccgugcaggaaccca

SEQ ID NO: 75514 - RNA, 45 nt, Mus musculus
gugacucgugugcugucccuucugugugcuccccaggggcucgua

SEQ ID NO: 75515 - RNA, 45 nt, Mus musculus
ucuauguggaggaaugugacuacuugcagguagcuguguggcaag

SEQ ID NO: 75516 - RNA, 46 nt, Mus musculus
ccuggagggccaaacugauucagaauauccaaaauggcaaagguga

SEQ ID NO: 75517 - RNA, 46 nt, Mus musculus
cccuccaggcaccgucacuacuccgcacucccugggaggggugaga

SEQ ID NO: 75518 - RNA, 41 nt, Mus musculus
ccggucaccguggccagccucgucugcgcgggcgugcccgc

SEQ ID NO: 75519 - RNA, 42 nt, Mus musculus
ggggaagagagggaggcgagccgaggaggagaaggaggagga

SEQ ID NO: 75520 - RNA, 74 nt, Mus musculus
cgggcucuugguuugggggagggggacgggaaaguaagcgaguggaggcggagucgcuugugccccugacaggu

SEQ ID NO: 75521 - RNA, 45 nt, Mus musculus
gguaguuuaccuguacaagaucugugguguucucgaaaggcggaa

SEQ ID NO: 75522 - RNA, 41 nt, Mus musculus
guugguuuauagcugcucuguuuauauguguauaauucgag

SEQ ID NO: 75523 - RNA, 45 nt, Mus musculus
uuuagcauuaguaugauuaguaugauaauacagaaugcaugcuaa

SEQ ID NO: 75524 - RNA, 45 nt, Mus musculus
ccaacauccucagagugaucgcuauuaggcugagaauaaggggag

SEQ ID NO: 75525 - RNA, 46 nt, Mus musculus
gaggauauauauauauguauauguauauauccauauccauccugag

SEQ ID NO: 75526 - RNA, 47 nt, Mus musculus
acaggcauggugacucaucagcacauuuagaaaagccuaggcaggaa

SEQ ID NO: 75527 - RNA, 46 nt, Mus musculus
guagaggagguaguuuuuuguuuuuucucuuucauguagcccaggu

SEQ ID NO: 75528 - RNA, 52 nt, Mus musculus
gaagaagaggauccucgcaagcggaaucgagaaaggggcacagaagcaggaa

SEQ ID NO: 75529 - RNA, 46 nt, Mus musculus
accaucaagcacucaaggaaagcacuuaaaagugggaagaugacag

SEQ ID NO: 75530 - RNA, 42 nt, Mus musculus
gcacuucucagggugggccugagguuagauaccuuuugcagg

SEQ ID NO: 75531 - RNA, 45 nt, Mus musculus
auuuauuuuauguaugugaguacauuguugcugucuucagacacu

SEQ ID NO: 75532 - RNA, 42 nt, Mus musculus
aggucugcuuagggcaccagcccauaccagaaggcuuuucag

SEQ ID NO: 75533 - RNA, 41 nt, Mus musculus
uaagcauguaaaccugaguucaaacauuagagaccauguag

SEQ ID NO: 75534 - RNA, 61 nt, Mus musculus
ugccaagccgaagaaagcauccaucuucauucacagggggaaaguaauccuuugucuaaga

SEQ ID NO: 75535 - RNA, 60 nt, Mus musculus
agcuuucuccaguacauucacaaauggcagauuacauuagugcagcaccaucucuuguug

SEQ ID NO: 75536 - RNA, 60 nt, Mus musculus
guccuccuuccaagucuuccaaggcaaaaccgaagaaguuaggaacuggcacuacaguug

SEQ ID NO: 75537 - RNA, 66 nt, Mus musculus
uagcacagcaguuggguugguaacuaaagauccagggaaaaagccuauguucaaugcagcaguagg

SEQ ID NO: 75538 - RNA, 69 nt, Mus musculus
guuccagggcuagugaauaaagagucuggcaagaaauuaggacuuggcaccguaguuggacugguuaau

SEQ ID NO: 75539 - RNA, 81 nt, Mus musculus
aaagaguugggaaagaaacugaguucuacaguuggccuaguggccaaggauguuacgaagaagauuguagcaagcucagca

SEQ ID NO: 75540 - RNA, 46 nt, Mus musculus
agagccaguuuacugcugaaaguacccacuugaauguuggucacag

SEQ ID NO: 75541 - RNA, 42 nt, Mus musculus
uuaaagcuuggugcagucacugcaccagacaaacacugccag

SEQ ID NO: 75542 - RNA, 46 nt, Mus musculus
uggcaagaagcacaugccggucuccaaaaggacuagacuuagaaag

SEQ ID NO: 75543 - RNA, 45 nt, Mus musculus
auuggggcaacaaaucaaugucagcaagaaaggaaccauuuacau

SEQ ID NO: 75544 - RNA, 45 nt, Mus musculus
ccauucccagugacaguggcauugggacagauaauaauagcacau

SEQ ID NO: 75545 - RNA, 46 nt, Mus musculus
uuggagucuuugaaacguuaccgauuugguaaggauacuguuggag

SEQ ID NO: 75546 - RNA, 46 nt, Mus musculus
auaaaauguacaaaagagggaguauaggauucuuugaaaugaggag

SEQ ID NO: 75547 - RNA, 33 nt, Mus musculus
aagaagagauuuuugagagaugugugggacuaa

SEQ ID NO: 75548 - RNA, 42 nt, Mus musculus
aucccagcauccacaugguggcucacaaccacccguggugag

SEQ ID NO: 75549 - RNA, 42 nt, Mus musculus
guuuuuaacuggccuacauguaggagcuggaaaaggagccug

SEQ ID NO: 75550 - RNA, 66 nt, Mus musculus
gccagucugggcuacaugagacccuaaaaacagggagcugaauuguaggaagcagagagagagaga

SEQ ID NO: 75551 - RNA, 39 nt, Mus musculus
uuuuacauauaauccuagcauucaagaggcagaggcaag

SEQ ID NO: 75552 - RNA, 46 nt, Mus musculus
gagcuggcggaggcuuccaagcacaaccuugucucaaaaggcugag

SEQ ID NO: 75553 - RNA, 46 nt, Mus musculus
cuguguugucucuuuuagugaauggaguuccuuccagaagucccag

SEQ ID NO: 75554 - RNA, 45 nt, Mus musculus
uguagacagucuguugcagcggauaguacaucacgaugagcaaga

SEQ ID NO: 75555 - RNA, 45 nt, Mus musculus
acuucuuucugaaaagucagcaaguagguguuccccccaucacau

SEQ ID NO: 75556 - RNA, 47 nt, Mus musculus
gaggaaaaauuggcuguuagaagaacagacuaggaaaaagcagaaga

SEQ ID NO: 75557 - RNA, 46 nt, Mus musculus
ucugguuuuaggguucccaggcuggcugggcuggaggaaaucacgg

SEQ ID NO: 75558 - RNA, 45 nt, Mus musculus
cacuuacauggggauaugaaguagaaacuuaagaguucuuuguaa

SEQ ID NO: 75559 - RNA, 42 nt, Mus musculus
uaauuaucccuggauaauaggcuaauacucauccagugccag

SEQ ID NO: 75560 - RNA, 45 nt, Mus musculus
cugucuacucuguuuaggauucacuacuuguuuuuuaagccccuu

SEQ ID NO: 75561 - RNA, 47 nt, Mus musculus
gaucucucacuggacguggucuuugcugauucggcuagagacuuugg

SEQ ID NO: 75562 - RNA, 45 nt, Mus musculus
aaaagcaaucagugcucuuacccugcuaagccaucucgccagccc

SEQ ID NO: 75563 - RNA, 94 nt, Mus musculus
agcacucucagguaccauuguauucucuagacugaugaugcugcacuagguuagaagguuacaauuaucauucuuaauguuuagccuccccuaa

SEQ ID NO: 75564 - RNA, 53 nt, Mus musculus
uuaaaaguaagaaagaauaccaggugugaugcuguucaccuguaauccaagca

SEQ ID NO: 75565 - RNA, 45 nt, Mus musculus
cauucugugcguaccugccagacuccauagggagacauuucucag

SEQ ID NO: 75566 - RNA, 29 nt, Mus musculus
gcagugagagccaccucaaguacauagag

SEQ ID NO: 75567 - RNA, 46 nt, Mus musculus
gaguauuuuuaaaguuuucuuuaauaccaucacucgagaggcauag

SEQ ID NO: 75568 - RNA, 45 nt, Mus musculus
agcagucggugcucuuaacugcugagccaucucuccagccccgug

SEQ ID NO: 75569 - RNA, 45 nt, Mus musculus
gguagcaaagaguuugcgcuauaagaauucuauuucggggcuggu

SEQ ID NO: 75570 - RNA, 26 nt, Mus musculus
cuggaaaagaaucaagauggagagau

SEQ ID NO: 75571 - RNA, 45 nt, Mus musculus
caggcauaaaauggaaaugccuaauuaaaaagggaaagaggaaag

SEQ ID NO: 75572 - RNA, 72 nt, Mus musculus
ugcauaugaauuuacagaaaauaaagaauccuaauauuccagguguggaagcgcauacacguauaaucuuag

SEQ ID NO: 75573 - RNA, 46 nt, Mus musculus
aaccagacauaccaguauccuuuacaucaugacgauugccagaggu

SEQ ID NO: 75574 - RNA, 46 nt, Mus musculus
uaggcaaugagguuuuuaggaaagaauacuuuacucgugucugugu

SEQ ID NO: 75575 - RNA, 41 nt, Mus musculus
gcaguuuucuuaaccuuagagcauagaaaagagggagccaa

SEQ ID NO: 75576 - RNA, 45 nt, Mus musculus
uggucucacuuuguaaguguaccuauccugggacuucccguguaa

SEQ ID NO: 75577 - RNA, 46 nt, Mus musculus
gcuagggucagggucagggauccugcacucauaccucuagagccag

SEQ ID NO: 75578 - RNA, 46 nt, Mus musculus
acaagauugacuccacaguuacagaugaagccaauguccaacagag

SEQ ID NO: 75579 - RNA, 45 nt, Mus musculus
agggcuacacagagaaacccugucuugaaaaaaaaaaaaaaccag

SEQ ID NO: 75580 - RNA, 46 nt, Mus musculus
ccacucacaugugaagacuaagacuccuuuuauuuguguggaccag

SEQ ID NO: 75581 - RNA, 46 nt, Mus musculus
gaacccccugugcucuuagcuguugaaccaucucucuagccccuac

SEQ ID NO: 75582 - RNA, 46 nt, Mus musculus
acuuacauauaauaaauaaauaaaucuuugaaaggaaggaagaaga

SEQ ID NO: 75583 - RNA, 42 nt, Mus musculus
agggacagucggcgcacgccugauggccacccaguccgucag

SEQ ID NO: 75584 - RNA, 46 nt, Mus musculus
auuaagcccuugagacagggucucucacuauaccugaugcugauag

SEQ ID NO: 75585 - RNA, 46 nt, Mus musculus
caggaaagagccacuggggacauuggggacgcugaaaagaaaccag

SEQ ID NO: 75586 - RNA, 84 nt, Mus musculus
aagggggguggggucacguuucugacaugguacuuucuaaagcucggagcuaguggaaagggaaaggaaguaggcuugucugag

SEQ ID NO: 75587 - RNA, 46 nt, Mus musculus
ccagcacacaugcugcuucucuuccugugugucugcugugcaaaag

SEQ ID NO: 75588 - RNA, 41 nt, Mus musculus
uaagggcacuuugggggucuccuuuuagucaaaagcaagaa

SEQ ID NO: 75589 - RNA, 46 nt, Mus musculus
auaaaugcugcuaauauauuuccuuuuuacagaaaagcauaucuaa

SEQ ID NO: 75590 - RNA, 67 nt, Mus musculus
ccugcccccauccaucuucauggaacuugcaaacaagaucuacaaacggagaaagugaccccggaau

SEQ ID NO: 75591 - RNA, 46 nt, Mus musculus
aauaacucagccgugucaaggcugggaaacccuagaggaaguagaa

SEQ ID NO: 75592 - RNA, 44 nt, Mus musculus
gugguucagugucugcuacgagccucuccucaacagcgccagau

SEQ ID NO: 75593 - RNA, 61 nt, Mus musculus
cuaccuugaucucuuuggagaccccagugugacgggaaaggucggcacugacauccaggac

SEQ ID NO: 75594 - RNA, 62 nt, Mus musculus
ggagaaggaacacgccaaugcccugaagauccugauggagaugggcgaguucuuccaggucc

SEQ ID NO: 75595 - RNA, 41 nt, Mus musculus
gggcaagcccucugucccucugauacuggaaagugggcaga

SEQ ID NO: 75596 - RNA, 49 nt, Mus musculus
ggaagugugaccgucagcccaucacugcggggagucaggguggcaguua

SEQ ID NO: 75597 - RNA, 46 nt, Mus musculus
uguucuaguggguaaagugaguucuaucccagaacccagggaaaga

SEQ ID NO: 75598 - RNA, 46 nt, Mus musculus
uaaaaguucuggagcccugaguuugaucccuagcgcccauguacga

SEQ ID NO: 75599 - RNA, 46 nt, Mus musculus
ggccgugugacaauccagcuguggcagugaacacaaucugcauggu

SEQ ID NO: 75600 - RNA, 44 nt, Mus musculus
cuuccaggagcugguggagccgaagaaacaggaugcugagaguc

SEQ ID NO: 75601 - RNA, 45 nt, Mus musculus
caggacugaagaagcugguagagguguggauucaugagggguuuc

SEQ ID NO: 75602 - RNA, 45 nt, Mus musculus
gaaugggaaccagaaauuggaugcuuauaaccaagaaaagcagaa

SEQ ID NO: 75603 - RNA, 42 nt, Mus musculus
gucucggaucgggugaagcuccgaggcacuaaaggaccaguc

SEQ ID NO: 75604 - RNA, 69 nt, Mus musculus
aaggaacucaaacaugagcggcgacacaaguaccacugaagaggggucgcuagagggcauugcauggcc

SEQ ID NO: 75605 - RNA, 46 nt, Mus musculus
ggugaugagagaagggcuacagugagaugcagugagaggugauggg

SEQ ID NO: 75606 - RNA, 46 nt, Mus musculus; identical to SEQ ID NO: 75605

SEQ ID NO: 75607 - RNA, 42 nt, Mus musculus
ggagcggaugcuucagaaaugacugaaaaguaugaagagaau

SEQ ID NO: 75608 - RNA, 49 nt, Mus musculus
uaccgccugaaauaggaagaauccgaugagccuggcagccaugacacca

SEQ ID NO: 75609 - RNA, 48 nt, Mus musculus
ucaaaucccaguaaccacaugguggcucacaaccaucuguaacgagau

SEQ ID NO: 75610 - RNA, 46 nt, Mus musculus
cgacguccacgucgagugcucucguaacggcugaagguacccagag

SEQ ID NO: 75611 - RNA, 45 nt, Mus musculus
aacguacuuagcugccucuggaucagagagcaccugcauggagag

SEQ ID NO: 75612 - RNA, 42 nt, Mus musculus
gcagcuguagccgcuccauguacuggcgcugcaugcggccgg

SEQ ID NO: 75613 - RNA, 46 nt, Mus musculus
cccuagccuucaugucucugcuggaggagaaacuacugccugugcu

SEQ ID NO: 75614 - RNA, 46 nt, Mus musculus
gcagagacaugaaggcuaggguaucugcuccuuggcgagcugacag

SEQ ID NO: 75615 - RNA, 46 nt, Mus musculus
cugcagccgagugccucguugcuagcucugugguguggugucuaga

SEQ ID NO: 75616 - RNA, 46 nt, Mus musculus
aaggacuauuucucuucucaagugcuaaguuaugcuagauacagga

SEQ ID NO: 75617 - RNA, 45 nt, Mus musculus
uuccaugugucaucagccuguguauuucucuuccucccugcccau

SEQ ID NO: 75618 - RNA, 46 nt, Mus musculus
ugcucuucgaaccagugaugggaaagucauuacagugccacacaag

SEQ ID NO: 75619 - RNA, 45 nt, Mus musculus
uaagaugugugugaugagccccugggaugggaggaccggccccag

SEQ ID NO: 75620 - RNA, 43 nt, Mus musculus
uuuagccugauggaagggguggcugugaccgaguaaggggcua

SEQ ID NO: 75621 - RNA, 26 nt, Mus musculus
gcucagagaccagaaagcacaggaag

SEQ ID NO: 75622 - RNA, 25 nt, Mus musculus
cagcccugcccacagccccugccac

SEQ ID NO: 75623 - RNA, 60 nt, Mus musculus
uaacgauggugucggggaccagugugaugacgaugcugacggggaugguaucaagaaugu

SEQ ID NO: 75624 - RNA, 41 nt, Mus musculus
cugcacucaugugggcacaggcaaaacacccauacagagaa

SEQ ID NO: 75625 - RNA, 81 nt, Mus musculus
gcagcucacaacugccuguaauucuaguuccaggggaccuuacacagacauauaugcaguuaaaccaccaaugcacacaag

SEQ ID NO: 75626 - RNA, 47 nt, Mus musculus
ugccugcgacaacugucccaauguucccaacaaugaccagaaggaca

SEQ ID NO: 75627 - RNA, 46 nt, Mus musculus
gauggcugggggaccuaaggggagaggcugggagcuuggaagucag

SEQ ID NO: 75628 - RNA, 46 nt, Mus musculus
ggguuggacaauugcccuaaaguacccaacccacugcagacagacc

SEQ ID NO: 75629 - RNA, 44 nt, Mus musculus
ugccaaauagcucucagcuggacucagacaaugacgggcuugga

SEQ ID NO: 75630 - RNA, 41 nt, Mus musculus
uuaagcugaucagguuuugcucaggagacaggccuacugga

SEQ ID NO: 75631 - RNA, 46 nt, Mus musculus
agaucagauaggaccugugggaugaaaucacauuuuuacaggagau

SEQ ID NO: 75632 - RNA, 48 nt, Mus musculus
cagcuuaauccgccucgggcuuuucugcaaguacccuccagagcaaga

SEQ ID NO: 75633 - RNA, 45 nt, Mus musculus
gguuucgccuccgagacccauacaucacgguaagcagacucuaga

SEQ ID NO: 75634 - RNA, 46 nt, Mus musculus
aucguucagacuaaaucaacccagcgccucuccuucucccugacca

SEQ ID NO: 75635 - RNA, 45 nt, Mus musculus
uguagcgucuuuaccaucagcauguaccucuccccacuggcugau

SEQ ID NO: 75636 - RNA, 48 nt, Mus musculus
gcgugggggccgugcuucagacucuuuauauccuggcauaucugcacu

SEQ ID NO: 75637 - RNA, 48 nt, Mus musculus
ggagcguggacaacauccaguuccugccuuuucucaccacggauguca

SEQ ID NO: 75638 - RNA, 32 nt, Mus musculus
ugucguucaggaugauugguaaacaccgagaa

SEQ ID NO: 75639 - RNA, 66 nt, Mus musculus
gucaagaaaugaaagcgggcaagagacguggcugcaauaucuugcugcuuuuggaacccagaauaa

SEQ ID NO: 75640 - RNA, 31 nt, Mus musculus
ugugaagacaggaccuaugcaacgcacagac

SEQ ID NO: 75641 - RNA, 46 nt, Mus musculus
uuacagcgccuucucgcugggcuaugaauuccaugccggccaagaa

SEQ ID NO: 75642 - RNA, 44 nt, Mus musculus
uaccgcaccugcaacgccagccaaggcuccaagcgcugggaaug

SEQ ID NO: 75643 - RNA, 43 nt, Mus musculus
gagagagagagagagagagagagagagagagacagcgcgagag

SEQ ID NO: 75644 - RNA, 41 nt, Mus musculus
gggagcugggaagcugagaagccgggagugcggggcucagu

SEQ ID NO: 75645 - RNA, 46 nt, Mus musculus
gacauggacacugucuaucucugcucuguuguaauaaaugugagau

SEQ ID NO: 75646 - RNA, 52 nt, Mus musculus
cucuaagacucaaagaaauggaaccucugccccaaacacuagagaagcagga

SEQ ID NO: 75647 - RNA, 46 nt, Mus musculus
gcuggacagugagagucauguccuggagcuucuacaaaauagguaa

SEQ ID NO: 75648 - RNA, 65 nt, Mus musculus
gaagagcagcaagccagcccagagaggacgcugaguggauccauggagagccggguuguucagga

SEQ ID NO: 75649 - RNA, 46 nt, Mus musculus
gguggaguguccggagaggagagggccauuguuggggggugcuggc

SEQ ID NO: 75650 - RNA, 41 nt, Mus musculus
gcagcccucggcccuccccgccgcugccaaauauaggugag

SEQ ID NO: 75651 - RNA, 46 nt, Mus musculus
cuacaagagguguugaguguggggcucauaaggauucuggggucag

SEQ ID NO: 75652 - RNA, 42 nt, Mus musculus
gccaggugaggaugcugaggacagaaaggaagaacucuggag

SEQ ID NO: 75653 - RNA, 46 nt, Mus musculus
aucauccucuaacuuccacacaugugcugugguacauaugcccccu

SEQ ID NO: 75654 - RNA, 46 nt, Mus musculus
ugguagccacgaguuugagaguugaagucuuuuucugggucgguag

SEQ ID NO: 75655 - RNA, 46 nt, Mus musculus
gaugccagaagggcggcaguuagggcccgagcugggacgguggcag

SEQ ID NO: 75656 - RNA, 45 nt, Mus musculus
uuuacugguccuuccucuccucccaggaaccaggacagaaagcag

SEQ ID NO: 75657 - RNA, 41 nt, Mus musculus
uuuccagcuuucucuccccuccucccaccccacccaaguaa

SEQ ID NO: 75658 - RNA, 41 nt, Mus musculus
aggcgggccuugggggggggggcgaguggaagccaggugaa

SEQ ID NO: 75659 - RNA, 42 nt, Mus musculus
uguuggaagagguggaaguuuauguccuuauugggcggaggg

SEQ ID NO: 75660 - RNA, 86 nt, Mus musculus
gaaaagggugggaaaggcucagggagcgaagcaaaaucucggagaaaagggacgaaaaggagggagggacccauaugcucccugcu

SEQ ID NO: 75661 - RNA, 44 nt, Mus musculus
ugcggagccaccugcuggaaagggaaggaggcccccugcggagg

SEQ ID NO: 75662 - RNA, 42 nt, Mus musculus
agggccaagagggacagccccacauuuucacagcagacagag

SEQ ID NO: 75663 - RNA, 46 nt, Mus musculus
agcaaaaagugcuuuuaacugcugagugaacucuucggcccuugag

SEQ ID NO: 75664 - RNA, 42 nt, Mus musculus
ccccguacucauugaacaucuggcauaugucuggccccaggu

SEQ ID NO: 75665 - RNA, 48 nt, Mus musculus
cucugccugggaggaaagacuaaaaacauggucaugugaggggggcuc

SEQ ID NO: 75666 - RNA, 58 nt, Mus musculus
cggcucucugagagauagggauuuggucgcaccuagagguaggcaggagcaaacaaug

SEQ ID NO: 75667 - RNA, 41 nt, Mus musculus
uugccgagucucuguugugccugaugaaguagccaccauug

SEQ ID NO: 75668 - RNA, 46 nt, Mus musculus
gagccugucaacaucacccaggaaaaagacucuaaggaagugagaa

SEQ ID NO: 75669 - RNA, 46 nt, Mus musculus
cacagugacgcauuaaaaaaaguuacuuauaaggcagggagcagag

SEQ ID NO: 75670 - RNA, 49 nt, Mus musculus
gaguccaacacaaacucuuuaacuacucauccccccuguagagagagaa

SEQ ID NO: 75671 - RNA, 42 nt, Mus musculus
aacuuuccuacaacuugcuacgaaguaugacugggggcagag

SEQ ID NO: 75672 - RNA, 42 nt, Mus musculus
aagaguguggcauucuauugucguggacucuuuacggugaaa

SEQ ID NO: 75673 - RNA, 46 nt, Mus musculus
aucagugaucugaagccuggugagaaaaagagaucucgggauagaa

SEQ ID NO: 75674 - RNA, 45 nt, Mus musculus
ccuugggcaacaugacaugccuguaacagaaacauggggauguga

SEQ ID NO: 75675 - RNA, 41 nt, Mus musculus
cucucuuuugucuguaguccccgcgccggcacuaaccggua

SEQ ID NO: 75676 - RNA, 53 nt, Mus musculus
uuucauaucucaccccuguuucuuaaauaaguaagcaaguguacguggaaguu

SEQ ID NO: 75677 - RNA, 45 nt, Mus musculus
cgagagggcaugggccaguugguggcugcuaacgaugggugacuc

SEQ ID NO: 75678 - RNA, 46 nt, Mus musculus
cugcagaguggcucucuuucuuuccuugucuuccaccacuggcauc

SEQ ID NO: 75679 - RNA, 93 nt, Mus musculus
cuaaagccugguugagcagagccauuccuagagucuaaccagaggcugcaagagaaaaugggcuggaggaaguuuuagagagcaaggaugucc

SEQ ID NO: 75680 - RNA, 45 nt, Mus musculus
ggcaaguuuuuguggucccagguccuucccuuuaaaggucagaca

SEQ ID NO: 75681 - RNA, 46 nt, Mus musculus
aaaucccaccaaccacaugguggcucacaaccaucccuaacgagau

SEQ ID NO: 75682 - RNA, 42 nt, Mus musculus
ccgcuccuccacuucuccccagucacuuucaagaucccagag

SEQ ID NO: 75683 - RNA, 46 nt, Mus musculus
aauuguacagguugaucucugggaucuugaaagugacuggggagaa

SEQ ID NO: 75684 - RNA, 42 nt, Mus musculus
aaggaagaagaggaggaggaggaaaaggaggaggagaguucu

SEQ ID NO: 75685 - RNA, 42 nt, Mus musculus
agaggaggaggaagaagaggaggaggaggagagaggaggagg

SEQ ID NO: 75686 - RNA, 46 nt, Mus musculus
cugcccagacucagauaauagcugggugcucgcugguucugaggua

SEQ ID NO: 75687 - RNA, 44 nt, Mus musculus
cugaacagcaaggugucggucgagggagugagagugccagggau

SEQ ID NO: 75688 - RNA, 42 nt, Mus musculus
ccuaucuggucccuucuucccugcuuagcccaagccccaaca

SEQ ID NO: 75689 - RNA, 42 nt, Mus musculus
gaguaaggucaugaggugaugaaggggagccauguugaggag

SEQ ID NO: 75690 - RNA, 41 nt, Mus musculus
uauguguaugugugucacugugugucugugugugucuauga

SEQ ID NO: 75691 - RNA, 41 nt, Mus musculus
aaagagagagagagagaaagggggagagagagagagagaga

SEQ ID NO: 75692 - RNA, 42 nt, Mus musculus
guggcuggggguaguugagccucugccaguagcugcugggag

SEQ ID NO: 75693 - RNA, 45 nt, Mus musculus
gggcuaugaguucauagaaaccugaccucuggggcaauggggaag

SEQ ID NO: 75694 - RNA, 46 nt, Mus musculus
cgggacuccuccaaggcagauggcaaagaauuagcugggaccuugg

SEQ ID NO: 75695 - RNA, 45 nt, Mus musculus
ggagccgauggucaugggacggaggccccuggagacacagugguc

SEQ ID NO: 75696 - RNA, 46 nt, Mus musculus
gagagugagauccauccacagaacuuacccuccagucccagagcag

SEQ ID NO: 75697 - RNA, 46 nt, Mus musculus
cuggucuacagagugaguuccaggacagccagagcuacacugagaa

SEQ ID NO: 75698 - RNA, 56 nt, Mus musculus
gagcaucgcugcuccagcagugacgacgacacugauguagauguggagggucugcg

SEQ ID NO: 75699 - RNA, 42 nt, Mus musculus
ccgugguacccguagauguggaggaccaggccaagggcgagg

SEQ ID NO: 75700 - RNA, 46 nt, Mus musculus
ccugcaggcuucaagugucccaccagacaguguccccagccugcag

SEQ ID NO: 75701 - RNA, 41 nt, Mus musculus
cuaaggacuguguuagggccggugugccugguuuacaugcu

SEQ ID NO: 75702 - RNA, 46 nt, Mus musculus
agcugcugcaguucugauucuagggccuggugggaggucuugcccu

SEQ ID NO: 75703 - RNA, 45 nt, Mus musculus
ccagacacugcaggaccucgagaaucaggguaucaacacuggcag

SEQ ID NO: 75704 - RNA, 54 nt, Mus musculus
ccagagucccagggaguggggugggaaggagaaguggcgcggugggcagaggga

SEQ ID NO: 75705 - RNA, 46 nt, Mus musculus
ugagggccgggagcacacugggcgcuggagggaggacagacugcgg

SEQ ID NO: 75706 - RNA, 42 nt, Mus musculus
gcuugcuguccuuucugcucccagauucguccgcccgcaguc

SEQ ID NO: 75707 - RNA, 46 nt, Mus musculus
agguacacccuaggaaagaugggaacucccauucuguagaaaggca

SEQ ID NO: 75708 - RNA, 46 nt, Mus musculus
gggcagcugaccaaacagcugccccucucaccugcuuacuuuggag

SEQ ID NO: 75709 - RNA, 46 nt, Mus musculus
uggaugccuuggaggacagccuggaggagguggcacugaaacagac

SEQ ID NO: 75710 - RNA, 42 nt, Mus musculus
aggugggaauuggggaugggcgugggagagaguagccgaggg

SEQ ID NO: 75711 - RNA, 46 nt, Mus musculus
aaauggccuuuaggaaacaaugccacauacugagauaagacccuaa

SEQ ID NO: 75712 - RNA, 46 nt, Mus musculus
gaaagaaggagaagcacuccuggaaccccagaguuguggggcccag

SEQ ID NO: 75713 - RNA, 45 nt, Mus musculus
gcuaaaaaaaaaaaaaaaaaagaagaagaagaaaaaaaaaaaggc

SEQ ID NO: 75714 - RNA, 42 nt, Mus musculus
accacacugcggagaaugaccuggcuugaggccaccccaccu

SEQ ID NO: 75715 - RNA, 45 nt, Mus musculus
ugugugugugccuggugccuacagggccagaagagaacaucagau

SEQ ID NO: 75716 - RNA, 46 nt, Mus musculus
aggccggaggcagguaggcuggcauguuggggugcugggucuggag

SEQ ID NO: 75717 - RNA, 42 nt, Mus musculus
aaaaaaaaaaagccaacugaggcugagaaagcacagggcuag

SEQ ID NO: 75718 - RNA, 45 nt, Mus musculus
aaacugagagaagggauucuuuaagcauacuguuggugaacugag

SEQ ID NO: 75719 - RNA, 42 nt, Mus musculus
aaggacaaauccagggguggcuucuggaaauggacagcagag

SEQ ID NO: 75720 - RNA, 41 nt, Mus musculus
agcaaucuugaggaggguaacacaugugucucugggccaga

SEQ ID NO: 75721 - RNA, 46 nt, Mus musculus
acugugguagacagugagggccggagggagaccacagugacccauc

SEQ ID NO: 75722 - RNA, 98 nt, Mus musculus
acucccagguuucccaggaaggucuggguccacuucuucaaccccagcccaaaucguauuucaaaaguaucucugugaccaagaucacuaagccagau

SEQ ID NO: 75723 - RNA, 56 nt, Mus musculus
ccuggugagagacugcgggaggggcagacacuacgagacucaaugcuuaaguaccc

SEQ ID NO: 75724 - RNA, 46 nt, Mus musculus
gguuucuaguggguuagugaugaauaacagaacuugcagaguaguu

SEQ ID NO: 75725 - RNA, 59 nt, Mus musculus
uuccacggcaacuuuggcuuugaugaucuaguacgagauuuuaauagcaucuucagcga

SEQ ID NO: 75726 - RNA, 49 nt, Mus musculus
gggaugacucgagaugaugacgacgaugaugaugaugaugacgaagcgg

SEQ ID NO: 75727 - RNA, 98 nt, Mus musculus
ccuaauagauccaucaacguuguucugaaaccagaucuccuguguuuucagcugcccagaccccucuuuggcccaguuugcugcccuuguguugauuu

SEQ ID NO: 75728 - RNA, 76 nt, Mus musculus
cccugaagaaaaaccaugggucgucuggcagcuguugggaggugcggagaggcucuguuuagaaacaauacaaaac

SEQ ID NO: 75729 - RNA, 60 nt, Mus musculus
augcaacagggaccugggcggagaaaacaaugggggucuggggaagaggaccaugagcaa

SEQ ID NO: 75730 - RNA, 41 nt, Mus musculus
cccaugggcugcagagcuucaaaguuucuagugccccuacu

SEQ ID NO: 75731 - RNA, 46 nt, Mus musculus
acacacacacaaaauggcgucauaaauaugaacagcauugucagau

SEQ ID NO: 75732 - RNA, 48 nt, Mus musculus
ggaaggugaccccccccccaaauauauaucagcccaacagcccuaagu

SEQ ID NO: 75733 - RNA, 46 nt, Mus musculus
ugagaauguaaucaccuugucaucacucacuuugaaaaggucagaa

SEQ ID NO: 75734 - RNA, 46 nt, Mus musculus
auaacaugaacaguuagcaaaggaaacaugaaagaaugggccagau

SEQ ID NO: 75735 - RNA, 46 nt, Mus musculus
cacacucucagauccuucaccaucaccugcagcaggauggccaggu

SEQ ID NO: 75736 - RNA, 44 nt, Mus musculus
caucaauccagccacagcugcugccuacccaccugcccccuuua

SEQ ID NO: 75737 - RNA, 46 nt, Mus musculus
aaugauugugaacuuaacuccuaaaggcuaccuuuguuguagagau

SEQ ID NO: 75738 - RNA, 46 nt, Mus musculus
gagcuguuaguguuuuaguuuagugguuuuuaauuuggguggaggg

SEQ ID NO: 75739 - RNA, 45 nt, Mus musculus
cuaggagccaaugcuguauuguggauaaaggguggaggguggcuu

SEQ ID NO: 75740 - RNA, 46 nt, Mus musculus
uggccucuauaccugaugucgugcuuuacuuuuggaagauggagau

SEQ ID NO: 75741 - RNA, 51 nt, Mus musculus
uggcccaaccccaacagaaccagacgcagacucaccacaccacgcagcaga

SEQ ID NO: 75742 - RNA, 46 nt, Mus musculus
gagguagaagcaagaagguuccauaauuaagauuuuuggcagauuu

SEQ ID NO: 75743 - RNA, 42 nt, Mus musculus
gccacaaguauaugguuaugaugauuuacagaugcuccagac

SEQ ID NO: 75744 - RNA, 80 nt, Mus musculus
acaaaaaaaaacaaacaaaaaaaaaagaagauauuauagcucagucauggaguucaucacuaacagacauaaggcccugg

SEQ ID NO: 75745 - RNA, 46 nt, Mus musculus
uauaccucccaaaauaaugcucagggcccucuauaugaacagagau

SEQ ID NO: 75746 - RNA, 42 nt, Mus musculus
uucuccuuguuaauuaauugacaguauuuuauuccaauagac

SEQ ID NO: 75747 - RNA, 46 nt, Mus musculus
uuucuggacuguuguggcucaugggaguaggggaaaugugugagau

SEQ ID NO: 75748 - RNA, 42 nt, Mus musculus
gcuguggagaugccuggcucagcagauaucucagggcuaaau

SEQ ID NO: 75749 - RNA, 46 nt, Mus musculus
agaugucuccggggucuucagacaaccaguccuccagcccucagcc

SEQ ID NO: 75750 - RNA, 46 nt, Mus musculus
aacagugcacaguccuuuuacaaagcgccaggcauucaccccaucu

SEQ ID NO: 75751 - RNA, 47 nt, Mus musculus
cuugggauaugggcucaacaacacaaucaccaucacuggugcaguau

SEQ ID NO: 75752 - RNA, 47 nt, Mus musculus
gugagcauguuggggaaaggauuuggugauguuggggaagcuaaagg

SEQ ID NO: 75753 - RNA, 46 nt, Mus musculus
gccauaucacagccugcuucagggaguacauuuucucaccauagca

SEQ ID NO: 75754 - RNA, 45 nt, Mus musculus
ugaauaugaacaaguuuuaccaucugaaauuugguuuauguuagu

SEQ ID NO: 75755 - RNA, 45 nt, Mus musculus
ggaagauagacugguuggguaggguaccaacaaugaaauuaggac

SEQ ID NO: 75756 - RNA, 46 nt, Mus musculus
gauagaaaauggauauauuucugccuuucaaaaucacugcuaagau

SEQ ID NO: 75757 - RNA, 46 nt, Mus musculus
uguaucucauccauuccuguuacagcucuguaauccaauuggcuau

SEQ ID NO: 75758 - RNA, 46 nt, Mus musculus
aagcugagguuuuuaaagauacugcauggcaugguaaauauggugg

SEQ ID NO: 75759 - RNA, 46 nt, Mus musculus
uacacuuaugaacauauauacauaacacacacacagaggguauggg

SEQ ID NO: 75760 - RNA, 46 nt, Mus musculus
agacauuuucuuugagauguguaugugagacaaaaaauugugagga

SEQ ID NO: 75761 - RNA, 46 nt, Mus musculus
uuuuugccuuuuucucuuuaaugaaauacgaucuuauuauguagac

SEQ ID NO: 75762 - RNA, 46 nt, Mus musculus
gcuaacucauuuggacuuccauuuauugcagaugaggcagauuuca

SEQ ID NO: 75763 - RNA, 44 nt, Mus musculus
aauaagggauuggcuuuuagucuagauuaaaaaacuugggugua

SEQ ID NO: 75764 - RNA, 46 nt, Mus musculus
ccuguggaggccagaaaaggauauuagaucccuuacaacuggagau

SEQ ID NO: 75765 - RNA, 46 nt, Mus musculus
uagcaguggcaauacauggaacaacacuggccacuuugaaccagau

SEQ ID NO: 75766 - RNA, 46 nt, Mus musculus
uguaaacugguauacuuuugccacauauuucuuugcucugggaguu

SEQ ID NO: 75767 - RNA, 42 nt, Mus musculus
uuuugucuuaauaacaucaguuauguucucucuuaaugagau

SEQ ID NO: 75768 - RNA, 42 nt, Mus musculus
aaaaagccacccagcuuuuuaucagugagauaaccaccagaa

SEQ ID NO: 75769 - RNA, 51 nt, Mus musculus
ucacagacaucuaccugccacugcuuccugaaugcuaggaucgaagauauu

SEQ ID NO: 75770 - RNA, 41 nt, Mus musculus
uaugggaugguugugagcuaccaugugguugcugggauuug

SEQ ID NO: 75771 - RNA, 54 nt, Mus musculus
cacagacagaggcagaagaggccguggccguggcagaggugacaguguugaggg

SEQ ID NO: 75772 - RNA, 53 nt, Mus musculus
ggccaggaaaauggauuggauggcaccaagaguggagggccuucuggaagagg

SEQ ID NO: 75773 - RNA, 55 nt, Mus musculus
gcgacguggugggccaccaagacgggggagaggugccagccguggacgagagugu

SEQ ID NO: 75774 - RNA, 83 nt, Mus musculus
gucucaggacaaaaggaugguggacaaacugaaucuaaugaagaaggaaaagaaaaucgagaccgggacagagacuauagucg

SEQ ID NO: 75775 - RNA, 44 nt, Mus musculus
auuacauugucuggcucaaaauuucuuaacuguggguccugaga

SEQ ID NO: 75776 - RNA, 46 nt, Mus musculus
gauaagaucacuaaaaaagaauacuaacacagugucaaaggaagau

SEQ ID NO: 75777 - RNA, 46 nt, Mus musculus
gcuuacuugagcaaggauaauuuaucaguggcuacacugcugagua

SEQ ID NO: 75778 - RNA, 33 nt, Mus musculus
uuauuagagaacuuuaguuuuauauggauagau

SEQ ID NO: 75779 - RNA, 45 nt, Mus musculus
agaugucaacagagccaucaauguucuccuggaaggaaauccaga

SEQ ID NO: 75780 - RNA, 46 nt, Mus musculus
acuugcuggcccucucuccagccuuaaaauuuuguuuuuggaagua

SEQ ID NO: 75781 - RNA, 87 nt, Mus musculus
uucuugauucugucucaaucccuaggccacugcagagcaaauucgacuugcacagaugauuucggaccauaaugaugcugacuuuga

SEQ ID NO: 75782 - RNA, 46 nt, Mus musculus
gcuaagcagugagacacugaaaaacaaaaacaaagaccacucaguu

SEQ ID NO: 75783 - RNA, 46 nt, Mus musculus
aauuuguaguagaauuuuaguacuuaaaucucuacucuggguagau

SEQ ID NO: 75784 - RNA, 57 nt, Mus musculus
cccugccuuccaagugcuaggaucaaaggcaugcaccaccacugucuggcucccuua

SEQ ID NO: 75785 - RNA, 45 nt, Mus musculus
guuacuuauucucuuuaaccaauauuuaucaaauauaacccuuuu

SEQ ID NO: 75786 - RNA, 55 nt, Mus musculus
uauucuuccuuguaaauacuguuauuuguauauacuguaaaugaugacgucggug

SEQ ID NO: 75787 - RNA, 36 nt, Mus musculus
uuaaaagucauaugggacagcacaugggaggaagaa

SEQ ID NO: 75788 - RNA, 46 nt, Mus musculus
uauggcuaugaacccuuaggcccuuaacugagcuaugcccacaguu

SEQ ID NO: 75789 - RNA, 45 nt, Mus musculus
uugauugggggcagauuugggauucucuuuuguuuuaaggugagu

SEQ ID NO: 75790 - RNA, 46 nt, Mus musculus
uugacuaucuuauagcuaauuuuaaaacauaauuuuuccucuagcu

SEQ ID NO: 75791 - RNA, 46 nt, Mus musculus
uuucaauaugacuauauuuacaucuaacuuguaaaaugugcaguga

SEQ ID NO: 75792 - RNA, 46 nt, Mus musculus
cuacuaaaauguacuaauucugugcccuuaagugguuugcccagau

SEQ ID NO: 75793 - RNA, 68 nt, Mus musculus
gucuuuaauuauagaucaucccagugauuguuucuguugugaaugggagauacugcugucauguaaaa

SEQ ID NO: 75794 - RNA, 42 nt, Mus musculus
gauuauuuuuugucuccaccucccauauucugcguuggggau

SEQ ID NO: 75795 - RNA, 45 nt, Mus musculus
ccucgguuuggagugcggaggauuaauuuguuccgggugggaggu

SEQ ID NO: 75796 - RNA, 92 nt, Mus musculus
gccggagggggggggcauguggcuagagccugaagggggagagcgagaaagagcgcgggcgagcgaggccugggcccagccugagguagggu

SEQ ID NO: 75797 - RNA, 45 nt, Mus musculus
agaguccgucagaaaacaugguggaugggggcgcuaguuaagcau

SEQ ID NO: 75798 - RNA, 46 nt, Mus musculus
ggaauuaaauuuuuaggaccucugcucgcucugguuggccccacuu

SEQ ID NO: 75799 - RNA, 41 nt, Mus musculus
ugagggccuugccaacacccuugaaaggagugcuaguauuu

SEQ ID NO: 75800 - RNA, 42 nt, Mus musculus
caaggccucuugauaucguaaguacucacucuggccaaagac

SEQ ID NO: 75801 - RNA, 46 nt, Mus musculus
ugauccuauuaggaagcuaucucccagucuugguguaguuuggcag

SEQ ID NO: 75802 - RNA, 45 nt, Mus musculus
ugguuguuuguguguguguguguguguguuuguguguguguguuu

SEQ ID NO: 75803 - RNA, 42 nt, Mus musculus
ccaugaagaaugguaauuaagagaaacugacuuucccuggga

SEQ ID NO: 75804 - RNA, 45 nt, Mus musculus
uagcauuuucaaugacuuccucuucuagaccauuaaugagcacaa

SEQ ID NO: 75805 - RNA, 53 nt, Mus musculus
cuaggcugaacuacauaguaagccugucuuuaaagagaaaacggaaauaauaa

SEQ ID NO: 75806 - RNA, 25 nt, Mus musculus
gcuucggagguugggcgaggugacu

SEQ ID NO: 75807 - RNA, 51 nt, Mus musculus
ucugaucucucuuuugagugugaguggggugugugugugugugugugugug

SEQ ID NO: 75808 - RNA, 25 nt, Mus musculus
cuuagcgcagucuacauuacguaga

SEQ ID NO: 75809 - RNA, 43 nt, Mus musculus
aucuuggccauggguuucuuccugguccuggugauggagcaga

SEQ ID NO: 75810 - RNA, 42 nt, Mus musculus
ucagcacuggcacgauggaccagggaucccccaggccggcgg

SEQ ID NO: 75811 - RNA, 45 nt, Mus musculus
gugguggcuggcugcgggauccucuucucauguaugacaccucug

SEQ ID NO: 75812 - RNA, 46 nt, Mus musculus
uuugcccugcucacuggccuucucuuuguccaaaucuaaggugcuu

SEQ ID NO: 75813 - RNA, 46 nt, Mus musculus
ccugauagccaaccuccccugcccuuucucuugaagcaccuuagau

SEQ ID NO: 75814 - RNA, 98 nt, Mus musculus
uucucuuagauauagggaugggacauuuggacuaugaauaaugagauggaagugggcagagaagaggcuagccccagacccaaagaauaagagauagc

SEQ ID NO: 75815 - RNA, 86 nt, Mus musculus
gaaguuacuacagacguggucagggacauuagaaggaggcagacugcuacagucagaggccaggcaguacaucucagagacaagcu

SEQ ID NO: 75816 - RNA, 46 nt, Mus musculus
uuacgaaaacuggcagagagaccauuuggcacuagucccuuagugg

SEQ ID NO: 75817 - RNA, 42 nt, Mus musculus
guggcauggcaccccuuuagucccagcauuaaggaggcagag

SEQ ID NO: 75818 - RNA, 45 nt, Mus musculus
gugguccauaccuagaaaaaaaccaauaaccugccaaaacuuuau

SEQ ID NO: 75819 - RNA, 42 nt, Mus musculus
gggcguagaggaagcccguaaacaaacuacaagucccagaag

SEQ ID NO: 75820 - RNA, 46 nt, Mus musculus
gagaugcaaaucuggugugugugugugugugugugugugugugugu

SEQ ID NO: 75821 - RNA, 43 nt, Mus musculus
gcauagaccucugaggacuuggagucuauucauuaagcccaga

SEQ ID NO: 75822 - RNA, 45 nt, Mus musculus
cugguucugaucaguucugagcaucagaguuuacccuuccucgag

SEQ ID NO: 75823 - RNA, 46 nt, Mus musculus
cugugcccucucccuccucuaccaguucagucuucuuagcauccag

SEQ ID NO: 75824 - RNA, 40 nt, Mus musculus
gggaaagaagcagaucccagaaacuuaauggucuucagag

SEQ ID NO: 75825 - RNA, 56 nt, Mus musculus
ugucuucucaucuucuaauuaaucuuggacacgucuggaagugaaggcagaaagcg

SEQ ID NO: 75826 - RNA, 55 nt, Mus musculus
ugcuuuuccccaucacugccuuuguacuggcagauaucuuagaaaacagcagugc

SEQ ID NO: 75827 - RNA, 46 nt, Mus musculus
acgagaugcccgcagaaugguguccccacuccgccgauacccccgc

SEQ ID NO: 75828 - RNA, 45 nt, Mus musculus
ccuuggauaccaguaaauugccuacugaccagcgauugcccccau

SEQ ID NO: 75829 - RNA, 42 nt, Mus musculus
ccuggauuuuuagggagugagggaucaaugaguggcccccag

SEQ ID NO: 75830 - RNA, 42 nt, Mus musculus
auccuuuuucuaauaugaaugaaggauccuaaaacugaggaa

SEQ ID NO: 75831 - RNA, 46 nt, Mus musculus
ggagggccuaaaagcacuuguaacuuugaaaaccgucugucuggag

SEQ ID NO: 75832 - RNA, 42 nt, Mus musculus
ccucccuauuucucuuccccuugcaauggaagagagagccag

SEQ ID NO: 75833 - RNA, 44 nt, Mus musculus
ggcgggcaugagguacugagugaaaagggggauggcgagggaaa

SEQ ID NO: 75834 - RNA, 46 nt, Mus musculus
uuuguauauggagucauuauuuuguaauaaacagcuggagcuuauc

SEQ ID NO: 75835 - RNA, 31 nt, Mus musculus
ugcuguuugaaggucucaguaguggccaaag

SEQ ID NO: 75836 - RNA, 45 nt, Mus musculus
cggccuuggcucugcggcccccgcaggcucugaaccuggugcagc

SEQ ID NO: 75837 - RNA, 44 nt, Mus musculus
augggguuggacaugagaugugucaccuaguuugaaagucugag

SEQ ID NO: 75838 - RNA, 42 nt, Mus musculus
ggcccugaaacuaauguagcuggaaucagcaauuugcuaucg

SEQ ID NO: 75839 - RNA, 42 nt, Mus musculus
uccagcuacauuaguuucagggcccgucgcccauagguggag

SEQ ID NO: 75840 - RNA, 42 nt, Mus musculus
ggggcuggaccgggggccgccgaggcucgggcaggggcagca

SEQ ID NO: 75841 - RNA, 45 nt, Mus musculus
aaccucaguagaauucaaguugagucuuuuauuauaaacauugag

SEQ ID NO: 75842 - RNA, 46 nt, Mus musculus
auccucauaaaauaaaauuuaaaaguuacauauuuaagcgccaucc

SEQ ID NO: 75843 - RNA, 45 nt, Mus musculus
uccuauuaacaaguuucgcaacuguugccuucauugcuacccaag

SEQ ID NO: 75844 - RNA, 45 nt, Mus musculus
uguguguguguguguguguaugagcaaacauucuguguuguugca

SEQ ID NO: 75845 - RNA, 71 nt, Mus musculus
gaggaggaggaggaggaggaggaggaggagaaggaggagcaggaggagcaggaggagcaggaggagcagga

SEQ ID NO: 75846 - RNA, 43 nt, Mus musculus
gcaggaggaagaagaggaggaggagaaggaggagcaggaggag

SEQ ID NO: 75847 - RNA, 27 nt, Mus musculus
uugaggggggcagggugcaggcaggga

SEQ ID NO: 75848 - RNA, 49 nt, Mus musculus
augugaaucaggacucagagcugagguucagugaauacuggagacugau

SEQ ID NO: 75849 - RNA, 46 nt, Mus musculus
cuuccuugggaguggccuggggaagccggugagggccccuggaugg

SEQ ID NO: 75850 - RNA, 75 nt, Mus musculus
gaaguuggcugaagauaaaugggguacuuaggcagaucaggacuggcagaguugauguagggugauaugugggua

SEQ ID NO: 75851 - RNA, 58 nt, Mus musculus
aggaaugcguugacugagaaggggauggcugaaugaaugagaugaauguauugcugga

SEQ ID NO: 75852 - RNA, 45 nt, Mus musculus
aacaaaccuugcccucaaauguacaaauucugcuauucggaccag

SEQ ID NO: 75853 - RNA, 46 nt, Mus musculus
ggagaaccugucuuggcaguuggcagucuggcuggggaacaccugg

SEQ ID NO: 75854 - RNA, 46 nt, Mus musculus
gaggagcugaggcagugagauggcugacugcuauacagagcuggag

SEQ ID NO: 75855 - RNA, 42 nt, Mus musculus
gaauuagccgcuucuuuuccucccaaccucuuagccggguag

SEQ ID NO: 75856 - RNA, 45 nt, Mus musculus
aacugugggcugaugagaaagagggagagaaaaagagaccagaga

SEQ ID NO: 75857 - RNA, 42 nt, Mus musculus
gggcuaggaagagaauccaggaagcugcaggaaauugggcaa

SEQ ID NO: 75858 - RNA, 33 nt, Mus musculus
augccaccaggcuaguuuuaaacaugcugugua

SEQ ID NO: 75859 - RNA, 45 nt, Mus musculus
auagugacacucccuaggccaaggauauacaaaccaucacaccua

SEQ ID NO: 75860 - RNA, 46 nt, Mus musculus
uauugauagauagauagauggacacuauuuagauucaugaggauuc

SEQ ID NO: 75861 - RNA, 56 nt, Mus musculus
ggacuuuucaaucuuuauuuuauucuguuuuauuauuuucauuuuucguagugugu

SEQ ID NO: 75862 - RNA, 42 nt, Mus musculus
acaaccacccguaaugagaucugacucccucuucuggagcau

SEQ ID NO: 75863 - RNA, 46 nt, Mus musculus
uauccaucuaucuguucauuauaacauuaauaaaauguuguuauag

SEQ ID NO: 75864 - RNA, 45 nt, Mus musculus
uacucagaggaaaugaccuuugagcugagcagaaagggugauuaa

SEQ ID NO: 75865 - RNA, 45 nt, Mus musculus
gaagagaaguuauuauuugcuaguguaaccagugaugugcuuuca

SEQ ID NO: 75866 - RNA, 24 nt, Mus musculus
cuugaggugcaagagcagaugcug

SEQ ID NO: 75867 - RNA, 46 nt, Mus musculus
gcauggacccccaaagcggugucaggcccuguagaaaugcacacau

SEQ ID NO: 75868 - RNA, 46 nt, Mus musculus
augccaaggcgacauugugggagccaaaggacaauuugugugggag

SEQ ID NO: 75869 - RNA, 50 nt, Mus musculus
agaugaagcugcauuccagaaggugaugagcaacuuggacagcaacaggg

SEQ ID NO: 75870 - RNA, 119 nt, Mus musculus
ucuuccuguccugcauugccaugaugugcaaugaauucuuugagggcugcccagauaaggagccccggaagaagugaagacuccucagaugaaguguugggguguaguuugccaguggg

SEQ ID NO: 75871 - RNA, 53 nt, Mus musculus
ugugagcauagugccuuacucuggcuucuucgcacaugugcacagugcugagc

SEQ ID NO: 75872 - RNA, 47 nt, Mus musculus
acuguccuccagggcuuccaagagaacuagggcauaugacugagcaa

SEQ ID NO: 75873 - RNA, 66 nt, Mus musculus
gaugcugaaauugcaaggcugauggaugaucuggaccguaacaaggaucaggaaguaaacuuccag

SEQ ID NO: 75874 - RNA, 41 nt, Mus musculus
uauuucagagcuucauuguagaucaaagccaaggcccccag

SEQ ID NO: 75875 - RNA, 48 nt, Mus musculus
ugagaugacuuccgggggccucucucggucaaauccagugguggguag

SEQ ID NO: 75876 - RNA, 46 nt, Mus musculus
ccugacguugggcaauccaccuuuucacuguguguuuguguguuau

SEQ ID NO: 75877 - RNA, 45 nt, Mus musculus
acggaguaacugucuauuguguacaguuaaaucauaggugugggg

SEQ ID NO: 75878 - RNA, 42 nt, Mus musculus
uacugguagggaggcugcgguuggugguggugguggggcgug

SEQ ID NO: 75879 - RNA, 42 nt, Mus musculus
uuuucugagccuuguggaaggagcaccagcggcaccguggau

SEQ ID NO: 75880 - RNA, 46 nt, Mus musculus
ggagggcaagggggaauuuuuuuuucuuuuagguacagggccuggu

SEQ ID NO: 75881 - RNA, 46 nt, Mus musculus
uaugauuccaugucauucaaagauauugaaaauaauccuuuaagau

SEQ ID NO: 75882 - RNA, 45 nt, Mus musculus
aaagauggggaaggccuggacagaaggauaucuggggccugagga

SEQ ID NO: 75883 - RNA, 46 nt, Mus musculus
acuucaguggaaauauuaacuacuuuugguggaaaaaaugaagcag

SEQ ID NO: 75884 - RNA, 39 nt, Mus musculus
gaucaaaugcuugaggauaaaggaaguggaauggcguag

SEQ ID NO: 75885 - RNA, 46 nt, Mus musculus
cuguaccacucagauaacuaaacccagaaaauggcucuaucucuga

SEQ ID NO: 75886 - RNA, 42 nt, Mus musculus
agaugccuaccaagugauacuggauggcgugaaaggcggcac

SEQ ID NO: 75887 - RNA, 40 nt, Mus musculus
uuuuuaauaaauguggcaaggagacuagauagggauagag

SEQ ID NO: 75888 - RNA, 72 nt, Mus musculus
ccuuguccucccccaaagugcccagagccuuguccucccccaaagugcacugagccuuguccucccccaaag

SEQ ID NO: 75889 - RNA, 81 nt, Mus musculus
ugcccagagccuuguccucccccaaagugcccagagccuuguccucccccaaagugcccagagccuuguccucccccaaag

SEQ ID NO: 75890 - RNA, 45 nt, Mus musculus
cagggaaaugacuuuccuuucaggaguuaucacaggcacauggag

SEQ ID NO: 75891 - RNA, 42 nt, Mus musculus
gugcggggcuugggcugguugccgaggcagcugcuggggcag

SEQ ID NO: 75892 - RNA, 42 nt, Mus musculus
gggccccaaguccacccaguccucccaggccggcugguccga

SEQ ID NO: 75893 - RNA, 42 nt, Mus musculus
cagugcuccucaucuuggucagucuugggcuccugcauccag

SEQ ID NO: 75894 - RNA, 42 nt, Mus musculus
aagucauccuccacggucccagagguccugucuuuccaacag

SEQ ID NO: 75895 - RNA, 53 nt, Mus musculus
cuccaccaaauauuugguagaagacccccgagagccgggcaccaggcuuggga

SEQ ID NO: 75896 - RNA, 46 nt, Mus musculus
aaaaaaaucaugaaauuggaacggaauguuaagaacauccuaacag

SEQ ID NO: 75897 - RNA, 42 nt, Mus musculus
uccaaagugcccugagccuuguccucccccaaagugcccuga

SEQ ID NO: 75898 - RNA, 45 nt, Mus musculus
guccauccaaaagcaaguaaaagcuuuagcaaucaucaagaccaa

SEQ ID NO: 75899 - RNA, 44 nt, Mus musculus
ugugugugugugugugugugugugucugugucugugucuggucu

SEQ ID NO: 75900 - RNA, 53 nt, Mus musculus
cuguccuucaauuuagaagagagggagagagagagagagagagagagagagag

SEQ ID NO: 75901 - RNA, 45 nt, Mus musculus
agauugucucuuagccuauuugccaaauggugugugugugugugu

SEQ ID NO: 75902 - RNA, 45 nt, Mus musculus
ggauccugaaauacagaaagcuuuugaccuugguaggcuucagga

SEQ ID NO: 75903 - RNA, 45 nt, Mus musculus
cacaauuccuuucuugucaucaccagcagcaaccucggccaagua

SEQ ID NO: 75904 - RNA, 46 nt, Mus musculus
gacaaauggucuacuguguaaauuuuagaaugaggcagacaaaggu

SEQ ID NO: 75905 - RNA, 42 nt, Mus musculus
cccagaauaggccauggugggggggauaauagcgagggagga

SEQ ID NO: 75906 - RNA, 44 nt, Mus musculus
gggaugugaauuacuggaaacauuuuuuaaagaaacgaggggaa

SEQ ID NO: 75907 - RNA, 45 nt, Mus musculus
gacucaaugcaucucucagucucuguaggcauuuuugcuucuggg

SEQ ID NO: 75908 - RNA, 46 nt, Mus musculus
cucuccaaaacugaauuccuuuccuucaugaacacagagcuggcug

SEQ ID NO: 75909 - RNA, 46 nt, Mus musculus
ugugaaggcagccagcucuguguucaugaaggaaaggaauucaguu

SEQ ID NO: 75910 - RNA, 51 nt, Mus musculus
gagacagacaguacaagaagagaguacagugcaggaauacaguagaguuca

SEQ ID NO: 75911 - RNA, 42 nt, Mus musculus
agguaaagacagaaugagcaagagaaugagaaggagccagaa

SEQ ID NO: 75912 - RNA, 49 nt, Mus musculus
ugugugucucuguaugugugugugugugugucucugugucugugugugu

SEQ ID NO: 75913 - RNA, 45 nt, Mus musculus
ugugugugugugucugugucucugugugugugugugucucugugu

SEQ ID NO: 75914 - RNA, 46 nt, Mus musculus
acacacacacagagagacacagagacacacacacacacagagacac

SEQ ID NO: 75915 - RNA, 54 nt, Mus musculus
gugugugugugugucuguguguguaugugugugugucucugugucucugugugu

SEQ ID NO: 75916 - RNA, 58 nt, Mus musculus
ugugucuguguguguaugugugugugucucugugucucugugugucugugugugugug

SEQ ID NO: 75917 - RNA, 42 nt, Mus musculus
uugcagaaccagaaggauccugguguccuugaccgcaugaug

SEQ ID NO: 75918 - RNA, 118 nt, Mus musculus
ggaacuaagaggauuagauucgcuucugggaaguuuggaugaaagaaucauggcacgcuauagcuaagccaccaaugagguugagaaacucuuggaaaucuagcugcccgucacaguu

SEQ ID NO: 75919 - RNA, 47 nt, Mus musculus
aagucaucaccucccccgaccccauccacaccugcacugagcccagc

SEQ ID NO: 75920 - RNA, 46 nt, Mus musculus
acauguugugguaggugugcugggcucagugcagguguggaugggg

SEQ ID NO: 75921 - RNA, 46 nt, Mus musculus
agacccuagguaggguucagugcguguguguugggguggguuacag

SEQ ID NO: 75922 - RNA, 46 nt, Mus musculus
guugguguucagccauuucaaagaauuacauguucugugccaagag

SEQ ID NO: 75923 - RNA, 42 nt, Mus musculus
gaugcuuacguuucacagguuugcaggcgacaaagaccacuu

SEQ ID NO: 75924 - RNA, 42 nt, Mus musculus
cuguggacaaaauaaugaaggaccuggaccagugccgagaug

SEQ ID NO: 75925 - RNA, 48 nt, Mus musculus
cagggcucaccauugcaugcaaugacuauuuuguaguaaacaugaagc

SEQ ID NO: 75926 - RNA, 64 nt, Mus musculus
cggggucacuugaggaaucugccccacugcuucuugugagcagaucaggacccuuaggaaaugu

SEQ ID NO: 75927 - RNA, 61 nt, Mus musculus
gcaaaugagauccaacuccaauucaacaaucugagagagaaaacuuaauccaauggcagag

SEQ ID NO: 75928 - RNA, 45 nt, Mus musculus
acaucagaaaaguauuaccagcccaguguucucauuagaggccag

SEQ ID NO: 75929 - RNA, 45 nt, Mus musculus
aucagaaaaguauuacaagcccaguguucucauuagaggccagua

SEQ ID NO: 75930 - RNA, 46 nt, Mus musculus
caugcacguggugcacauacauacauacauacacacaggcaaaaca

SEQ ID NO: 75931 - RNA, 41 nt, Mus musculus
uccagagguuuaaaaauuauacccuaucucugggucagaga

SEQ ID NO: 75932 - RNA, 41 nt, Mus musculus
ucagaggaggacuggaggggggugggaacaggguuugcugg

SEQ ID NO: 75933 - RNA, 42 nt, Mus musculus
ucgggaggguagagaagcgauaggagcuaagaggggaggcug

SEQ ID NO: 75934 - RNA, 46 nt, Mus musculus
cuaaucccaccaccucccugcaaugggauauguaaaaggcuagaua

SEQ ID NO: 75935 - RNA, 45 nt, Mus musculus
ccugggcuuugguguuuagagggugggucuggaaggacauggaga

SEQ ID NO: 75936 - RNA, 45 nt, Mus musculus
gugagcugcuaccagggccgccugcugcugcaucagcugugggau

SEQ ID NO: 75937 - RNA, 42 nt, Mus musculus
gugauggggguggcgaugaggccauuggcacugauggcagcc

SEQ ID NO: 75938 - RNA, 45 nt, Mus musculus
cagagaggcaggcacacagaugcagagaaaaucuggggggugagg

SEQ ID NO: 75939 - RNA, 70 nt, Mus musculus
gaacaggccaaggagauggacgaggaagauaaggcuuucaggcagaaacaaaaggaggagcagaagaaac

SEQ ID NO: 75940 - RNA, 47 nt, Mus musculus
uuacaugccuguuaccacauucaaaaaucuacagacggucaaugugg

SEQ ID NO: 75941 - RNA, 46 nt, Mus musculus
ggaauaaggaacguuccauaucgcauccgaguacgcuuguccagaa

SEQ ID NO: 75942 - RNA, 46 nt, Mus musculus
ccauggagugggcuucaagaagcgugcuccucgggcgcucaaagaa

SEQ ID NO: 75943 - RNA, 47 nt, Mus musculus; identical to SEQ ID NO: 23623

SEQ ID NO: 75944 - RNA, 44 nt, Mus musculus
uacuugggcccggcagaauggcucccgcaaagaaggguggcgag

SEQ ID NO: 75945 - RNA, 45 nt, Mus musculus
ugugagauggaggacagaggaagacccagagaagaaaagcccaga

SEQ ID NO: 75946 - RNA, 43 nt, Mus musculus
cacaggagagcuaaggugucuuugacagagcugggguguuaag

SEQ ID NO: 75947 - RNA, 46 nt, Mus musculus
guaaucuuccaucugagccuggagcugcugcagggcuagcuuggag

SEQ ID NO: 75948 - RNA, 23 nt, Mus musculus
accuuccacccaaaauauguccu

SEQ ID NO: 75949 - RNA, 141 nt, Mus musculus
ggagagccucccgcugcuuccccucuuccucuagggcccgguucagugcuugcuguuccugcccaaggcgugccagcccccgcugggccucaucuagccggaccuccagagcccgcuuggcugcugccagguuccccuccu

SEQ ID NO: 75950 - RNA, 46 nt, Mus musculus
ggagaggaggaaggcugggcugagagaaaggaaaacucaggcugaa

SEQ ID NO: 75951 - RNA, 44 nt, Mus musculus
accucgggccuccuucaacugcugcuccagacccaggaugcgcc

SEQ ID NO: 75952 - RNA, 46 nt, Mus musculus
acaguccugccgcaguugcugcagggucuuuuguagcuggagguuc

SEQ ID NO: 75953 - RNA, 45 nt, Mus musculus
guuuugugaguuagcaaaggagucugugggcugaugaaaagccag

SEQ ID NO: 75954 - RNA, 44 nt, Mus musculus
ugguaaagcauuugugagaucugggauucaauccuuagcaccaa

SEQ ID NO: 75955 - RNA, 44 nt, Mus musculus
ucaaaucccagcaaccacaugguggcucacaaccuucuguacag

SEQ ID NO: 75956 - RNA, 24 nt, Mus musculus
ccgguggacgggaggggcgguggg

SEQ ID NO: 75957 - RNA, 44 nt, Mus musculus
agacuacgcugauuuccaguauuugaaacaaguucucggccaga

SEQ ID NO: 75958 - RNA, 46 nt, Mus musculus
aaacagaagccugggaguguugguggcugugaagugguccaaacua

SEQ ID NO: 75959 - RNA, 46 nt, Mus musculus
ccaccagaaguuucuugguguguuucucugccggaccguggguggg

SEQ ID NO: 75960 - RNA, 45 nt, Mus musculus
ggaggagcugagaacagaauagggccccugguguggcaugggaga

SEQ ID NO: 75961 - RNA, 46 nt, Mus musculus
cucuucuggggugucugaagagagcuacagcauacuuacauauaau

SEQ ID NO: 75962 - RNA, 44 nt, Mus musculus
gggaaagaagcuguaacacugacaagcccuaguagaaaauggaa

SEQ ID NO: 75963 - RNA, 45 nt, Mus musculus
ugaugagagcaucagccaagcuagguccaggaggcacugucacua

SEQ ID NO: 75964 - RNA, 41 nt, Mus musculus
gaaagaaagaaagaaagaaagaaagaaagaaagaccaaaaa

SEQ ID NO: 75965 - RNA, 50 nt, Mus musculus
aaaaccgcugggaaccggcuuucugggcuccuggaagcagaggaggaaga

SEQ ID NO: 75966 - RNA, 79 nt, Mus musculus
ggggguuucaccgaggcaagagccgggcccaggaagagggaaagagagaggcgaggagaagggaaaacccuggacaaag

SEQ ID NO: 75967 - RNA, 46 nt, Mus musculus
cuuagcuggagguuccagcucccagcacuacggaauggaggugggu

SEQ ID NO: 75968 - RNA, 46 nt, Mus musculus
gagcugagagaguucauguguucugagucucuuucacaaacaguag

SEQ ID NO: 75969 - RNA, 55 nt, Mus musculus
gaaucuggagaugaugaguaucaaggagaccagucugauacggaggaugagguag

SEQ ID NO: 75970 - RNA, 51 nt, Mus musculus
acucugacuuugacauugaugaaggggaugaaccauccagugauggagaag

SEQ ID NO: 75971 - RNA, 37 nt, Mus musculus
agcuugaggccucgcaaggucagcaccccagcaagca

SEQ ID NO: 75972 - RNA, 41 nt, Mus musculus
cagccagggaaacacagagaaacccugucucaaaaaaagag

SEQ ID NO: 75973 - RNA, 46 nt, Mus musculus
uaagaacacuguagcugucuucagacacaccagaagagggagucag

SEQ ID NO: 75974 - RNA, 42 nt, Mus musculus
ccacucagugacggugccgcuuguuggggagcccggccccaa

SEQ ID NO: 75975 - RNA, 45 nt, Mus musculus
cgaggucgauggauaaaggaugaaaauguugaguuugacucugau

SEQ ID NO: 75976 - RNA, 43 nt, Mus musculus
agagcugcgagcaggagagaaagagaacuggucagggaggaga

SEQ ID NO: 75977 - RNA, 45 nt, Mus musculus
caggacucaucguuugguggggcucaugggugcagaggccaagag

SEQ ID NO: 75978 - RNA, 46 nt, Mus musculus
agaucuuaaauauucuacauaugaaagaccuuggagggcuggugag

SEQ ID NO: 75979 - RNA, 44 nt, Mus musculus
caaccacaugguggcucacaaccaucugacucccucuucuagag

SEQ ID NO: 75980 - RNA, 47 nt, Mus musculus
cccagcaaccacaugaugguucacaaccauccauaaugagaucuggc

SEQ ID NO: 75981 - RNA, 34 nt, Mus musculus
uccccacuauaacaguugcugccggaggaagcac

SEQ ID NO: 75982 - RNA, 42 nt, Mus musculus
caaacaggcaagggaacagagcaaaauccaagacagcagaac

SEQ ID NO: 75983 - RNA, 77 nt, Mus musculus
caaaugcuucuugccugcacggugggcugucaacauggccagcgugucuaguacuggucgaugggggcagauggcac

SEQ ID NO: 75984 - RNA, 51 nt, Mus musculus
aagugaaugauguguguggugugugguguguauguuguguguucgagagcc

SEQ ID NO: 75985 - RNA, 45 nt, Mus musculus
ugucacuaaggaguucaggaguauaauaggacucuuuggcuggaa

SEQ ID NO: 75986 - RNA, 41 nt, Mus musculus
aguuacaucccugaggacgaggcacugaugcugcgggaugg

SEQ ID NO: 75987 - RNA, 46 nt, Mus musculus
gcagcaucagugccucguccucagggauguaacuagccagcagguc

SEQ ID NO: 75988 - RNA, 46 nt, Mus musculus
ugucuaggguucaaaggucagagaucaggcuugcgaggaguugggg

SEQ ID NO: 75989 - RNA, 46 nt, Mus musculus
cuucuuaagagacggacaguaacuccaggcacggcaagaagcagca

SEQ ID NO: 75990 - RNA, 41 nt, Mus musculus
aggugcugagugaagucaggcccauagagggcagccagcag

SEQ ID NO: 75991 - RNA, 41 nt, Mus musculus
ucuccgcgugcacccuuccucugaugcccagugaagccgga

SEQ ID NO: 75992 - RNA, 46 nt, Mus musculus
ggguugaaugcuacaaucccaucguccggcuucacugggcaucaga

SEQ ID NO: 75993 - RNA, 42 nt, Mus musculus
ucagugcgcaccggccgggcgcuagaagugggaaacggagua

SEQ ID NO: 75994 - RNA, 42 nt, Mus musculus
cggggcagugacgggcgcgggggcucagggugcagcucggag

SEQ ID NO: 75995 - RNA, 41 nt, Mus musculus
gaauuagucccuauuuccuauccaguuaacccaaaagguag

SEQ ID NO: 75996 - RNA, 46 nt, Mus musculus
gcacacccggcacacacaucccaauuauacauuccaggccccauga

SEQ ID NO: 75997 - RNA, 44 nt, Mus musculus
guucccaccagaaguagucauacaaggucuggagcauccugagu

SEQ ID NO: 75998 - RNA, 46 nt, Mus musculus
uucuggugggaacgacuauggcugccugugaacuuaaccugggcug

SEQ ID NO: 75999 - RNA, 41 nt, Mus musculus
caggcccagucuucucaaaaaguuccgagaagccagguggg

SEQ ID NO: 76000 - RNA, 46 nt, Mus musculus
cacagcugauagaagaugaacgcagugacagagaagaaacagagag

SEQ ID NO: 76001 - RNA, 25 nt, Mus musculus
cucuggggagaaaggauaugaggag

SEQ ID NO: 76002 - RNA, 42 nt, Mus musculus
uaggcuguuuagagucugguuuaaaggcaacugggugaaaaa

SEQ ID NO: 76003 - RNA, 42 nt, Mus musculus
cagcugucauagcugaagggaggggacaggaaggccagagag

SEQ ID NO: 76004 - RNA, 41 nt, Mus musculus
guaaagccacaacuacagguaggaccugauauuucggcgag

SEQ ID NO: 76005 - RNA, 45 nt, Mus musculus
gggcuacacagagaaacccugucccgaaaaaaaaacaaagacaaa

SEQ ID NO: 76006 - RNA, 42 nt, Mus musculus
gaaagcccacugcuggucacacuucagccacagcuguugaua

SEQ ID NO: 76007 - RNA, 45 nt, Mus musculus
caaaauccugacagaugacuuugcagacaaagaaggccuggagau

SEQ ID NO: 76008 - RNA, 46 nt, Mus musculus
ggaauaagaggaggugggaaucucuucuauaaaggacaugauaagu

SEQ ID NO: 76009 - RNA, 42 nt, Mus musculus
uauaagcuuacauuuuauccaauccccaccccacccccaucc

SEQ ID NO: 76010 - RNA, 42 nt, Mus musculus
uacucuguuuucacucucucguucucuuuuacagcaccacaa

SEQ ID NO: 76011 - RNA, 41 nt, Mus musculus
cacugacuguucuuccagaggucccaaguucaauucccaga

SEQ ID NO: 76012 - RNA, 46 nt, Mus musculus
aaauaauggcaaauucaaggccagcccaagcuacaacaaacaacaa

SEQ ID NO: 76013 - RNA, 42 nt, Mus musculus
aaaccaaaauagauucccacuaagacauaauuagagccaggu

SEQ ID NO: 76014 - RNA, 46 nt, Mus musculus
ugcauuagaaaguacagcuauauagagaaauuuuguugguugauug

SEQ ID NO: 76015 - RNA, 48 nt, Mus musculus
aaguaaugggagguaggccuugcacuagaauggaaaugacaguagaaa

SEQ ID NO: 76016 - RNA, 49 nt, Mus musculus
gaucuuauugaaagagagagagagagagggagaaugaaugaacaugaga

SEQ ID NO: 76017 - RNA, 41 nt, Mus musculus
ccguccuaauauggguauguauguccuaaaagauagcuagg

SEQ ID NO: 76018 - RNA, 45 nt, Mus musculus
aguagaucgugcugugguuuuagaguauugcauuauucaugagau

SEQ ID NO: 76019 - RNA, 46 nt, Mus musculus
cacaucuuuuguuuuucuuuuuaacaaguuaaaguaccaaacugau

SEQ ID NO: 76020 - RNA, 49 nt, Mus musculus
uaugcuggcauuguagcugagaccccuaacgucaagaacaagcucaggu

SEQ ID NO: 76021 - RNA, 45 nt, Mus musculus
ccuugggucaggugucuggagaacugagcaaagauggggaccuga

SEQ ID NO: 76022 - RNA, 50 nt, Mus musculus
auucccggcaaccacaugauggcucacaaccauccauaaugagaucuggc

SEQ ID NO: 76023 - RNA, 46 nt, Mus musculus
uuaaaccgggcuaaccuuaacauauggugcuccucuugcccuacuu

SEQ ID NO: 76024 - RNA, 45 nt, Mus musculus
aaagcacugacuacucuuccaaaggucuugaguucaaaucccagc

SEQ ID NO: 76025 - RNA, 45 nt, Mus musculus
ucauggaguuucguuuuggacuaaugaaaauguucugaaaguagg

SEQ ID NO: 76026 - RNA, 68 nt, Mus musculus
uguuauaggccaggcuggccucaaacucaacacaugacggagaauuauauucagccccugguccuucu

SEQ ID NO: 76027 - RNA, 50 nt, Mus musculus
cuugaugagugauuuuugagacaaagucucgugaaguccagauuuaccuc

SEQ ID NO: 76028 - RNA, 46 nt, Mus musculus
ucccgacuguuauauuuccuauauagggauauggauucugacagau

SEQ ID NO: 76029 - RNA, 45 nt, Mus musculus
gcaagggaugucaccaggcugacuuucaucucuagccuccauaga

SEQ ID NO: 76030 - RNA, 46 nt, Mus musculus
aucaugacaguagcucugaggaugaagcuucccggcccacagagau

SEQ ID NO: 76031 - RNA, 27 nt, Mus musculus
acagcagcgcaagaagcagcucgcaga

SEQ ID NO: 76032 - RNA, 43 nt, Mus musculus
cagcugacucugcagagauugcugagcugcagcaggcgguggu

SEQ ID NO: 76033 - RNA, 41 nt, Mus musculus
gcggcggcugcgggugggcgcgaggcggugcgugggugagg

SEQ ID NO: 76034 - RNA, 46 nt, Mus musculus
gucagaugauccggcaccuccugaacuucugucuguuuuaugugag

SEQ ID NO: 76035 - RNA, 46 nt, Mus musculus
caucgacuaucgaaagaaaggauacguuacuccagucaagaaccag

SEQ ID NO: 76036 - RNA, 91 nt, Mus musculus
cuguggaggcggcuauaugaccacugccuuccaauacgugcagcagaacggaggcauugacucugaagaugcuuacccauaugugggccag

SEQ ID NO: 76037 - RNA, 50 nt, Mus musculus
aggaugaaaguuguauguauaacgccacggcaaaggcagcuaaaugcaga

SEQ ID NO: 76038 - RNA, 48 nt, Mus musculus
cagccagcccaucucuucucagauuccuuccuucauggugcaagauau

SEQ ID NO: 76039 - RNA, 46 nt, Mus musculus
auaaaguaucucauuuacaauuuaauaaagaacacugcguccauac

SEQ ID NO: 76040 - RNA, 46 nt, Mus musculus
ccauugggaucucuggaagaaaacccaugagaaagaauacaaggau

SEQ ID NO: 76041 - RNA, 45 nt, Mus musculus
aucccaaauacucaggagguggggacagaagaaucaggaguucua

SEQ ID NO: 76042 - RNA, 41 nt, Mus musculus
agacuaugucuuugaaagaaagaaggaaagagagaagggaa

SEQ ID NO: 76043 - RNA, 45 nt, Mus musculus
uuuauaaugauucacaaucucgaauauucuaugggaaugcauacc

SEQ ID NO: 76044 - RNA, 46 nt, Mus musculus
aggaaguggguggguuggugagcagggggagggggaggggauaggg

SEQ ID NO: 76045 - RNA, 42 nt, Mus musculus
agagagagagagagagagagagagagagagagagaaaucgau

SEQ ID NO: 76046 - RNA, 47 nt, Mus musculus
ucaggucauacucuaaucggacauugccugacacuguggacuggaga

SEQ ID NO: 76047 - RNA, 86 nt, Mus musculus
ugugggggcccuugaagggcagcugaagcugaaaacggggaagcugauaucccucagugcucagaaccugguggacugcucaaaug

SEQ ID NO: 76048 - RNA, 31 nt, Mus musculus
aaugggggcauagaggcagacgcuuccuauc

SEQ ID NO: 76049 - RNA, 42 nt, Mus musculus
aacucucagagauucaccugccucugccuucccagugcuguc

SEQ ID NO: 76050 - RNA, 26 nt, Mus musculus
agguugggacagagggacagagaaag

SEQ ID NO: 76051 - RNA, 45 nt, Mus musculus
aguuggggccuuaacuuuggugaucaaggauacauucggauggca

SEQ ID NO: 76052 - RNA, 46 nt, Mus musculus
cacaaagauggaauauacucuaacuuaauuugccugcaauauccag

SEQ ID NO: 76053 - RNA, 46 nt, Mus musculus
gauucuucuuaggcaucaacaucgcggcggcugcaggguccgaggc

SEQ ID NO: 76054 - RNA, 46 nt, Mus musculus
cgggaagucagccggaaaagggaagggggaggggaaacggggacaa

SEQ ID NO: 76055 - RNA, 46 nt, Mus musculus
aaaacaugcaguagaaugucuacggacuucauccaaggugccacag

SEQ ID NO: 76056 - RNA, 42 nt, Mus musculus
ggguguacaaguuucaauuuacccaaagaaaugaacucagag

SEQ ID NO: 76057 - RNA, 46 nt, Mus musculus
ucuguuuacagacgaggaacaggaucaauucagagaggcuacagac

SEQ ID NO: 76058 - RNA, 46 nt, Mus musculus
cuucaucccuucuuccuccaugccuaacauacaucugaagcaagau

SEQ ID NO: 76059 - RNA, 45 nt, Mus musculus
aggcagcucagacaggggagaaaaagguacagaauucgagaagau

SEQ ID NO: 76060 - RNA, 41 nt, Mus musculus
uaacugauaauaccauaacccaaagaaaauaaaacugggag

SEQ ID NO: 76061 - RNA, 90 nt, Mus musculus
uaaaaaaaaaagacauacugguaaaacuauacaguggaaaugggaagaggggacuggagcccauaucaaaucaagaaaagaacucaacaa

SEQ ID NO: 76062 - RNA, 42 nt, Mus musculus
uuggaaacuuucauaucuagaaauagagaaauccugccacag

SEQ ID NO: 76063 - RNA, 48 nt, Mus musculus
auggcucaguccuuaaaggcuaggcucacaaucaaaaggagagagaga

SEQ ID NO: 76064 - RNA, 45 nt, Mus musculus
aaaaacccucaaaguagaagacagaagggaaaaucauuuagguga

SEQ ID NO: 76065 - RNA, 83 nt, Mus musculus
gagggugaaaaagagaaacgucagcauaagacauccuagccccagucgccacuucacacugaaaaugaugcccaccccagaag

SEQ ID NO: 76066 - RNA, 43 nt, Mus musculus
cuuccccaguaagguaggguagcaguggcugaucccugccccu

SEQ ID NO: 76067 - RNA, 45 nt, Mus musculus
caacaggguaauuuagaagauguggagacgaggauuggggcacag

SEQ ID NO: 76068 - RNA, 46 nt, Mus musculus
cccccuuucuccccagcccagaaaagcaugagggauacaggcaccg

SEQ ID NO: 76069 - RNA, 46 nt, Mus musculus
ggaagugggcggugccuguaucccucaugcuuuucugggcugggga

SEQ ID NO: 76070 - RNA, 46 nt, Mus musculus
uuucaagccgguuccagcugggacugcuccaggacaugggcacaag

SEQ ID NO: 76071 - RNA, 46 nt, Mus musculus
cccggcucugcgucuaccccuacuacacaacuaccugcugccgcuc

SEQ ID NO: 76072 - RNA, 46 nt, Mus musculus
uguugcagggccgcuuccuggaaggucucaggugaggagggcaucg

SEQ ID NO: 76073 - RNA, 46 nt, Mus musculus
ggugggaacaguugcugggagaagucacauugaacucggcccccag

SEQ ID NO: 76074 - RNA, 42 nt, Mus musculus
gaggagccggcaaguucgguguguuggcaguaauggugauga

SEQ ID NO: 76075 - RNA, 46 nt, Mus musculus
agcucuguucauccaacuccucuccugacucacgggaaaugcagag

SEQ ID NO: 76076 - RNA, 46 nt, Mus musculus
cacccuccucuccugggucuggggauccuaguuuuaccaggcugag

SEQ ID NO: 76077 - RNA, 42 nt, Mus musculus
ccuccugcaguccuagagaguccuuccacaaagccuccagcc

SEQ ID NO: 76078 - RNA, 70 nt, Mus musculus
acaaggaaaacaaaacaacaaaaaucuuugauggccagcugccaaacuuucccuuuuuuaggaggacgaa

SEQ ID NO: 76079 - RNA, 52 nt, Mus musculus
cccagaacccgcuccugcaagaugaccucuuucucccaccugagcaccccaa

SEQ ID NO: 76080 - RNA, 46 nt, Mus musculus
agacaaaccuucaugagcuaugaacucaugaucacacgugucagaa

SEQ ID NO: 76081 - RNA, 45 nt, Mus musculus
cugacaagagacuccagcccacucuggagcaucuuugcucccagu

SEQ ID NO: 76082 - RNA, 46 nt, Mus musculus
cccguucucacucagcugaaacuccaaggucuggaacugcucagac

SEQ ID NO: 76083 - RNA, 42 nt, Mus musculus
ggccgugcuuuucagaggccagcucugugcuuggaggcugag

SEQ ID NO: 76084 - RNA, 45 nt, Mus musculus
acccagucagccuggugcuacccuccauccuguaugugcauauga

SEQ ID NO: 76085 - RNA, 41 nt, Mus musculus
uuauuacaauucuggucucucuggggcauggugguacauua

SEQ ID NO: 76086 - RNA, 42 nt, Mus musculus
ucggauaaagugggaugagcagacaucuaacacgaagggaga

SEQ ID NO: 76087 - RNA, 45 nt, Mus musculus
agagcgcaugaagaggccaacgcggcccgaaaacuuacagcagaa

SEQ ID NO: 76088 - RNA, 46 nt, Mus musculus
gagaguccucuguugcucucucuuucccuuagcccugccucugauc

SEQ ID NO: 76089 - RNA, 42 nt, Mus musculus
acagaagcaguucaagacccuacaaagguagaagcccauguc

SEQ ID NO: 76090 - RNA, 46 nt, Mus musculus
augugucuggggugugugugugugugugugugugugugugugugug

SEQ ID NO: 76091 - RNA, 45 nt, Mus musculus
ugguauaaagaugugcaacauuggugguuuguauguaugucugaa

SEQ ID NO: 76092 - RNA, 46 nt, Mus musculus
cacaugguggcuuacaaccaucuguaacaagaucugacccccucuu

SEQ ID NO: 76093 - RNA, 34 nt, Mus musculus
gagauuucacaagcugcuagaaaaacaggcauuc

SEQ ID NO: 76094 - RNA, 45 nt, Mus musculus
gaaugaaauuugcuugagugggguaagagaaugaugaaguugggu

SEQ ID NO: 76095 - RNA, 42 nt, Mus musculus
uccuggaggaggugaguuuuagacaggauuugugggaaggag

SEQ ID NO: 76096 - RNA, 46 nt, Mus musculus
cccacaguggucacugcagccuugaacuguguggggaagggcaugg

SEQ ID NO: 76097 - RNA, 46 nt, Mus musculus
augcauggcagugcuaagaggaggucuuaugggaaguugaggucgg

SEQ ID NO: 76098 - RNA, 45 nt, Mus musculus
ggaagguuuccgguuccgguguaacguucgggcuccgucucaggg

SEQ ID NO: 76099 - RNA, 41 nt, Mus musculus
gauccucagcccuaacccaggcucugcuucuuuccccugau

SEQ ID NO: 76100 - RNA, 41 nt, Mus musculus
uaagccagguaugguggugcaugccuuugaucccagcacuc

SEQ ID NO: 76101 - RNA, 42 nt, Mus musculus
gaacuguacaggccucccucaauaagauacugaggagggaau

SEQ ID NO: 76102 - RNA, 44 nt, Mus musculus
gaccggauccagcgcauaguggguguuuuacagaagccucagau

SEQ ID NO: 76103 - RNA, 80 nt, Mus musculus
ucuaguaaccaacauacagcaccucaucuggaacagcaaggaucugaagucaagagaucaagagacggugaacaggagac

SEQ ID NO: 76104 - RNA, 42 nt, Mus musculus
gucuggccugagcucaugggugcccuugcccucccucucguu

SEQ ID NO: 76105 - RNA, 45 nt, Mus musculus
acugcaggcugaggggaagguguaaagucgguuauucacccaagg

SEQ ID NO: 76106 - RNA, 42 nt, Mus musculus
caccuuccccucagccugcaguucugggcuguucccggccag

SEQ ID NO: 76107 - RNA, 42 nt, Mus musculus
aggaucuuggaauggauaccuagucuguccguucaugcccac

SEQ ID NO: 76108 - RNA, 46 nt, Mus musculus
guucaucuugguccaugugacagaccgaucagaugcacggcuccag

SEQ ID NO: 76109 - RNA, 45 nt, Mus musculus
ucuguuucccaggaaggcagaugagggcuuagcaucacugaguga

SEQ ID NO: 76110 - RNA, 35 nt, Mus musculus
augcuaaaguguuuuucuucauacuugacuuccaa

SEQ ID NO: 76111 - RNA, 45 nt, Mus musculus
gagacaggggcccgagucagggagaaagcauuuaauagugagcug

SEQ ID NO: 76112 - RNA, 103 nt, Mus musculus
uuggagggaaucugaacucaaaaguugccuuagcuauaagauguuagugcuugaagggaaacagguuucugaaugagaugucugagcaagguugggucagagg

SEQ ID NO: 76113 - RNA, 42 nt, Mus musculus
ucaccguuuccauggggcucugggcguucaucacagccggag

SEQ ID NO: 76114 - RNA, 45 nt, Mus musculus
acugaggcugaggguagauggguucaguucagugucuccugccca

SEQ ID NO: 76115 - RNA, 41 nt, Mus musculus
guaugauaaagaccccaaaaugccuuuuuuuuaaagugggg

SEQ ID NO: 76116 - RNA, 42 nt, Mus musculus
caggaacaggauacaaggaguuaauuaaucauaccccugccc

SEQ ID NO: 76117 - RNA, 45 nt, Mus musculus
uuuuuagggcucaccuuuguaucuuauuucauguagacgacucag

SEQ ID NO: 76118 - RNA, 24 nt, Mus musculus
uuggagugagugcugggguacacu

SEQ ID NO: 76119 - RNA, 45 nt, Mus musculus
gguugggggcagggaaagcugcacuguggggaaagagcaggcuag

SEQ ID NO: 76120 - RNA, 42 nt, Mus musculus
agucccaagcuggucauauccauggggcuguacagcaggcag

SEQ ID NO: 76121 - RNA, 42 nt, Mus musculus
ggcuuucacucaccuguaguuucagaacaaugaagcugaaug

SEQ ID NO: 76122 - RNA, 46 nt, Mus musculus
uauuuaaaauaacuagccaggcugcaguugugauuaaagaguaaag

SEQ ID NO: 76123 - RNA, 41 nt, Mus musculus
ugagcagagggcuuggaagcauagaauagaaggaggaggaa

SEQ ID NO: 76124 - RNA, 43 nt, Mus musculus
ugcgugcccgagugugcgcgcgcggguguguggacucggaggu

SEQ ID NO: 76125 - RNA, 42 nt, Mus musculus
uaguggggagggcaggcgaggggaaaggaggaggacauggag

SEQ ID NO: 76126 - RNA, 41 nt, Mus musculus
uaaguuuuaaaucaccaggcucuugugcuuaaaauggcgaa

SEQ ID NO: 76127 - RNA, 23 nt, Mus musculus
ggguccgcgccgccguggucccu

SEQ ID NO: 76128 - RNA, 42 nt, Mus musculus
acgagcuguuaaucccaacagccaggaggcagaggcaggcag

SEQ ID NO: 76129 - RNA, 46 nt, Mus musculus
aggccugaaugacaccuuuaaggaacuggaguuucuuagcauggcc

SEQ ID NO: 76130 - RNA, 46 nt, Mus musculus
uuucucuccauguugaauauguaguuggaacuuagugacaauauaa

SEQ ID NO: 76131 - RNA, 81 nt, Mus musculus
uugaaaagucucgacuuguuuaacugugagaucacaaaccuggaagauuauagagaaaguauuuuugaacugcugcagcag

SEQ ID NO: 76132 - RNA, 45 nt, Mus musculus
ggacggauucgaccaggaggacaacgaagcucccgacucggagga

SEQ ID NO: 76133 - RNA, 72 nt, Mus musculus
gaugaggacgaagaugaagcuggcccaccggaaggcuaugaagaggaggaagaugacgaugaggaugaagcu

SEQ ID NO: 76134 - RNA, 65 nt, Mus musculus
ggcucagaagugggagagggagaagaggaggugggccucucauacuuaaugaaagacgaaauuca

SEQ ID NO: 76135 - RNA, 45 nt, Mus musculus
ugaucuguaagucucaguagcuccuaagaggagaacagaggggag

SEQ ID NO: 76136 - RNA, 42 nt, Mus musculus
cagccuggucuaccuagugaguuccaggacagccagggccau

SEQ ID NO: 76137 - RNA, 46 nt, Mus musculus
agaggcuguuauguuagucuuugcaucuaagagccagugcauugag

SEQ ID NO: 76138 - RNA, 46 nt, Mus musculus
gcuugucuggacucggucauuuguagcacggcugggaucagagcag

SEQ ID NO: 76139 - RNA, 45 nt, Mus musculus
ugcacauguacaguaacaguuguuuggaagggagaaaauccucag

SEQ ID NO: 76140 - RNA, 42 nt, Mus musculus
auuaaaggcgugcgccaccacugccuggcuagauguggccau

SEQ ID NO: 76141 - RNA, 47 nt, Mus musculus
gaagaggacgaugaugacuacguugaugaaggggaggaggaggaaga

SEQ ID NO: 76142 - RNA, 47 nt, Mus musculus
gagggucuucggggagagaagagaaagcgagaugcugaggaugacgg

SEQ ID NO: 76143 - RNA, 60 nt, Mus musculus
agagcgaucacauugucuuuguuucuuuauguaugauagcugucccaguaggagaugaug

SEQ ID NO: 76144 - RNA, 46 nt, Mus musculus
uucucauucaucuucccauagugaaauucucuagcacuguauuuag

SEQ ID NO: 76145 - RNA, 41 nt, Mus musculus
uugggaaguagaagcagagcgagaggguucucuucagaggc

SEQ ID NO: 76146 - RNA, 70 nt, Mus musculus
uggggcugcugcucuuucaacuucacaugucugaccugguuuuuaacauagcaaguaugaacuuauuugu

SEQ ID NO: 76147 - RNA, 45 nt, Mus musculus
uccugcugucagucucuaaagaauucucuuugcaaacuaugccag

SEQ ID NO: 76148 - RNA, 46 nt, Mus musculus
aaugaaaucuauauauugacuuuuuaucaaucaucuauugugcaau

SEQ ID NO: 76149 - RNA, 41 nt, Mus musculus
uugacuaacgccaucacaguguuaaacacgaggacgggcag

SEQ ID NO: 76150 - RNA, 40 nt, Mus musculus
uuuucccuuacugcuguaacuuaaguuuuugaaacugcau

SEQ ID NO: 76151 - RNA, 42 nt, Mus musculus
augaccaaaaaucuugcuggcagccgcccaccacuagcguag

SEQ ID NO: 76152 - RNA, 46 nt, Mus musculus
uuucuuggucucucuagagcccugagcuuuaauucuguaguucacc

SEQ ID NO: 76153 - RNA, 82 nt, Mus musculus
cgcucuccgucgacugccagccagcugggccacagacuuguccagaucgacccggaagcucucagcacaagaggcuggcucc

SEQ ID NO: 76154 - RNA, 45 nt, Mus musculus
ugaugacgauuugaguuccucugcuucucuguaacuuauccuuuc

SEQ ID NO: 76155 - RNA, 46 nt, Mus musculus
cacauagcgguuuuuccaaaucucccugaaaaucccuuucccgcag

SEQ ID NO: 76156 - RNA, 42 nt, Mus musculus
cgcugcucgcucggcggcucgugcuagccgcaggccgggccc

SEQ ID NO: 76157 - RNA, 44 nt, Mus musculus
ugcaauucuucugacuucauccgcucgugguaccugggcacgug

SEQ ID NO: 76158 - RNA, 42 nt, Mus musculus
cagcaucugacagccucagagcagaugacccuacagcaggag

SEQ ID NO: 76159 - RNA, 45 nt, Mus musculus
aguugagucuuaguccugggaagggucaggcggguggacgcugag

SEQ ID NO: 76160 - RNA, 32 nt, Mus musculus
cucgcggggguuauaucacagagacgcgggcc

SEQ ID NO: 76161 - RNA, 46 nt, Mus musculus
gcgcgccggcacccacacgcuccgcguaguugcccuugcgcagcag

SEQ ID NO: 76162 - RNA, 43 nt, Mus musculus
cacgaccggacaucacgaaagcgcaaacagacgaacggccaca

SEQ ID NO: 76163 - RNA, 46 nt, Mus musculus
uacauuguuacauauuguggagauggaauucuagucuuguggagga

SEQ ID NO: 76164 - RNA, 46 nt, Mus musculus
aauguaggaaagcauuaggcaguccauuuauuaaaguaucagcauc

SEQ ID NO: 76165 - RNA, 43 nt, Mus musculus
cgaccggacaucacgaaagcgcaaacagacgaacggccacaac

SEQ ID NO: 76166 - RNA, 46 nt, Mus musculus
gcgccggcacccacacgcuccgcguaguugcccuugcgcagcagcc

SEQ ID NO: 76167 - RNA, 32 nt, Mus musculus
cgcggggguuauaucacagagacgcgggccga

SEQ ID NO: 76168 - RNA, 45 nt, Mus musculus
uugagucuuaguccugggaagggucaggcggguggacgcugagug

SEQ ID NO: 76169 - RNA, 42 nt, Mus musculus
ggacuugcgggcagucugcuucguacgggccauggcgaagac

SEQ ID NO: 76170 - RNA, 33 nt, Mus musculus
uaagggagcaaaacuuaauucucuggggcuggc

SEQ ID NO: 76171 - RNA, 42 nt, Mus musculus
guaccgacgagggacuggucaccccaggugugugcuggagcc

SEQ ID NO: 76172 - RNA, 42 nt, Mus musculus
guaaggaagggccagggaaggguuggacauauccagagguua

SEQ ID NO: 76173 - RNA, 46 nt, Mus musculus
auuuaacuugaagaaggacacagauggcguccuuagaccccaggga

SEQ ID NO: 76174 - RNA, 45 nt, Mus musculus
gagauucgagcugccuacauuggaacaacuaucaucauucgacag

SEQ ID NO: 76175 - RNA, 46 nt, Mus musculus
cucagagcgcaaccgccguggggcuauagccauagauacugccaga

SEQ ID NO: 76176 - RNA, 46 nt, Mus musculus
uuuuuauuuugggugucucuggagugacuacuggagaggggaagga

SEQ ID NO: 76177 - RNA, 42 nt, Mus musculus
cacucuccuccucuggucucgggguuuccagaguuucuccag

SEQ ID NO: 76178 - RNA, 67 nt, Mus musculus
gucuuuugagguggucuucaacgaccccgagaagguguacggcagcggggagaagguggccggacgg

SEQ ID NO: 76179 - RNA, 42 nt, Mus musculus
cccagcaggacugauggugacuugggaggucugugggucggg

SEQ ID NO: 76180 - RNA, 45 nt, Mus musculus
aaacaaauaugaguacaaguucggcuucgagcuuccucaagggua

SEQ ID NO: 76181 - RNA, 77 nt, Mus musculus
cuacgcaaccauauuuuccuuuaaaggauguucccaggggccugugucaaaacaaugaaccaaaauuaaggcuaaga

SEQ ID NO: 76182 - RNA, 72 nt, Mus musculus
uugcguagacuacugggugaaggcuuuucucgaucgccccagccagccaacucaagaggcaaagaaaaacuu

SEQ ID NO: 76183 - RNA, 45 nt, Mus musculus
ccucuugaguuggcuggcuggggcgaucgagaaaagccuucaccc

SEQ ID NO: 76184 - RNA, 49 nt, Mus musculus
guucauuccugauggacgugugucagucucugcucgaauugacagaaaa

SEQ ID NO: 76185 - RNA, 68 nt, Mus musculus
acguguucccgaaucgugguccccaaagcggcuauuguggcccgacacacuuaccuugccaauggcca

SEQ ID NO: 76186 - RNA, 76 nt, Mus musculus
ucagggacuugcgcaucguggcguggcaagagccucagagugcagaagaucagaccauccauccugggcugcaaca

SEQ ID NO: 76187 - RNA, 46 nt, Mus musculus
ccagcaaggaguauucgacuuugaggauguugcagcccaggaugga

SEQ ID NO: 76188 - RNA, 75 nt, Mus musculus
uuucuguacucaacccaucuaacaaacugccauccuccucucuagaucuacgucagugucccuggcuccaagaaa

SEQ ID NO: 76189 - RNA, 48 nt, Mus musculus
agaucaaggaugacuuucuuggagccagggacacugacguagaucuag

SEQ ID NO: 76190 - RNA, 70 nt, Mus musculus
gucauccuugaucugccccuagugauuggcagcaggucuggucugagcagccggacauccagcauggcca

SEQ ID NO: 76191 - RNA, 48 nt, Mus musculus
agcuccuccuugcuauauggacaucauuccugaagaucacagacuaga

SEQ ID NO: 76192 - RNA, 46 nt, Mus musculus
cucuagucugugaucuucaggaaugauguccauauagcaaggagga

SEQ ID NO: 76193 - RNA, 60 nt, Mus musculus
ucugcuggacgauguggacgacucucaagacagcccuaucuuuauguacgccccugaguu

SEQ ID NO: 76194 - RNA, 46 nt, Mus musculus
cagagccaauuucaagucauggccaaaauuuuguaagaggaguguu

SEQ ID NO: 76195 - RNA, 45 nt, Mus musculus
agcauaaucagaugggagaaucuguuauuucccuguaaccccuug

SEQ ID NO: 76196 - RNA, 42 nt, Mus musculus
cgaucagugcuggggcaucucaauguagaaugucacccaggc

SEQ ID NO: 76197 - RNA, 45 nt, Mus musculus
ccaguguugggagaaagugcugcuuucacuguggccucagcccug

SEQ ID NO: 76198 - RNA, 45 nt, Mus musculus
ucucuguaguccugcucuguagaucaggcuaaccccaaacucaga

SEQ ID NO: 76199 - RNA, 41 nt, Mus musculus
auuguagaaaggcagagagagagagagagagagagaggaga

SEQ ID NO: 76200 - RNA, 41 nt, Mus musculus
gagagagagagguaagagacaaggagagagcaagggcuuaa

SEQ ID NO: 76201 - RNA, 46 nt, Mus musculus
auucugcgucgggauuucaaauuucuauguuugugauuuccuuggg

SEQ ID NO: 76202 - RNA, 45 nt, Mus musculus
cccaaguggucauuccaaccuuuguccuccuuucuccugcgccag

SEQ ID NO: 76203 - RNA, 45 nt, Mus musculus
cuauuuuugugcagggaguccagaaagccaggggccgggagagag

SEQ ID NO: 76204 - RNA, 46 nt, Mus musculus
cgcugcuuucagacagcauugcagaugaguuccugaauguccucca

SEQ ID NO: 76205 - RNA, 46 nt, Mus musculus
gaugacaauauggaugaggccauauacugaaaaaccugggcauaga

SEQ ID NO: 76206 - RNA, 44 nt, Mus musculus
agacgcuagagaagaaggaggaggaagugacuucggaggaggau

SEQ ID NO: 76207 - RNA, 42 nt, Mus musculus
cccuggccggcuggaggcuucugggagugauggcuggcgcua

SEQ ID NO: 76208 - RNA, 45 nt, Mus musculus
agggucugccccucuuaucuaucaaucuccuuacucuaagcccag

SEQ ID NO: 76209 - RNA, 45 nt, Mus musculus
uuggggacggcuggccggaugaaguaggggagcugccucauggcc

SEQ ID NO: 76210 - RNA, 44 nt, Mus musculus
cacacauuaugugugugauguugugcaugcgugagagagagaga

SEQ ID NO: 76211 - RNA, 46 nt, Mus musculus
gaacucaccuuuaauuccaaacagugacgguaagguuaguuuguag

SEQ ID NO: 76212 - RNA, 45 nt, Mus musculus
agcgcaggaauacagcagaguccggggagagcagugcaguagcau

SEQ ID NO: 76213 - RNA, 46 nt, Mus musculus
aaccaggagaguuuuacagagacagauugaagagagaacaagcugg

SEQ ID NO: 76214 - RNA, 46 nt, Mus musculus
ccauccucauccauggcgaaaucuucgccccccgccucgugaagau

SEQ ID NO: 76215 - RNA, 44 nt, Mus musculus
gcuccacacugucguaauccucccgcauccgcgcucgggacccc

SEQ ID NO: 76216 - RNA, 82 nt, Mus musculus
ccuuaagagaugaggcaggagcauccuggaggcuuagaguaaggaacuguccuaaugagguccugugguuggagagguagag

SEQ ID NO: 76217 - RNA, 57 nt, Mus musculus
aaaaaguuauugagccaguggagaaauaaaaacaaguaggaggagccaaggauggaa

SEQ ID NO: 76218 - RNA, 42 nt, Mus musculus
uggccaaggcccugcaccuccucaagucuagcugcgccccca

SEQ ID NO: 76219 - RNA, 45 nt, Mus musculus
aggucuccaguacagcgcaguccaggagggaauucagccagagag

SEQ ID NO: 76220 - RNA, 44 nt, Mus musculus
ucagacugagagucagguaaguggccauguuuaggaagauccaa

SEQ ID NO: 76221 - RNA, 46 nt, Mus musculus
uucccuaguggauguuccacacauuucagacacccacaaggccaag

SEQ ID NO: 76222 - RNA, 45 nt, Mus musculus
ggacugagcuuuuuggauuaugaaaucaaucuccauuggccccag

SEQ ID NO: 76223 - RNA, 42 nt, Mus musculus
caagacucuccguucccuacccaaacccaaauaucuggucuu

SEQ ID NO: 76224 - RNA, 58 nt, Mus musculus
aggcccugugaugugauuuuacuuuuauucccaaaguuguagcagaguucucgccuac

SEQ ID NO: 76225 - RNA, 45 nt, Mus musculus
auaagaguugaaagaccucccuaccgggggucaccuugccgcugu

SEQ ID NO: 76226 - RNA, 46 nt, Mus musculus
ugugucugguggccacagagcccagaguacagcggaaccccuagaa

SEQ ID NO: 76227 - RNA, 45 nt, Mus musculus
gcaaugcucagauacccuguaccaauuaaaucugaaucucuagga

SEQ ID NO: 76228 - RNA, 47 nt, Mus musculus
cauacauacauacauacauacacacacacagagagagagagagagag

SEQ ID NO: 76229 - RNA, 46 nt, Mus musculus
gaaguauaccaccccuaaagugaaaauuuucucccucggggcauca

SEQ ID NO: 76230 - RNA, 45 nt, Mus musculus
cuccuguggaaggggucauucgacccccaaagggucacaaccccc

SEQ ID NO: 76231 - RNA, 42 nt, Mus musculus
cagugucguaaugagaaugagguuucgggcccccagcuagau

SEQ ID NO: 76232 - RNA, 44 nt, Mus musculus
cuagaagccauaagugcaggaggggucaggagaacaggcaugga

SEQ ID NO: 76233 - RNA, 46 nt, Mus musculus
cagggaugugauggugacuaacacaggccucccaugggauccagga

SEQ ID NO: 76234 - RNA, 46 nt, Mus musculus
ccucccuuuacucucgagccaaaauaaaccuuucuucccuugagau

SEQ ID NO: 76235 - RNA, 45 nt, Mus musculus
cccucugcucaaucagcugggcgaaucucuccagggccgggcagu

SEQ ID NO: 76236 - RNA, 45 nt, Mus musculus
acugcccggccccaaggcaugcaagcacaaaagcaugcaccucug

SEQ ID NO: 76237 - RNA, 51 nt, Mus musculus
uuuacugacucucaagcuaggagaccagcacaagggggagagcggcaagga

SEQ ID NO: 76238 - RNA, 46 nt, Mus musculus
cuggguccugccaucccaugacugauguucuuccuacucuuggcua

SEQ ID NO: 76239 - RNA, 42 nt, Mus musculus
guagaguuccauggucaggucaacagcaaaugggggccauuu

SEQ ID NO: 76240 - RNA, 36 nt, Mus musculus
gcuugucggggcagccccuugguaccugcuccugga

SEQ ID NO: 76241 - RNA, 46 nt, Mus musculus
cagauggaacugucugcccugcaguccaugauggccaugcaagagg

SEQ ID NO: 76242 - RNA, 42 nt, Mus musculus
agccggagguguaacuggccgccgccggagaagaagggacag

SEQ ID NO: 76243 - RNA, 45 nt, Mus musculus
cccguguggcggacggccuuccgcuggccgccucgaugcaggagg

SEQ ID NO: 76244 - RNA, 46 nt, Mus musculus
accuagcuaaacauucuuggaaaaugcuagugaucuuuggcaauau

SEQ ID NO: 76245 - RNA, 45 nt, Mus musculus
uuuuguucucucaggcuguaguaauacuuacauuauaccuuguga

SEQ ID NO: 76246 - RNA, 45 nt, Mus musculus
gaagaaacaauaaauuccuauuuggguguuugaagaaagggacua

SEQ ID NO: 76247 - RNA, 46 nt, Mus musculus
uaguaguaaauucaucgagucuuguccuuuucccuguagcgcaugu

SEQ ID NO: 76248 - RNA, 45 nt, Mus musculus
ucauucagaaaaccaagaaacucuacauugauagccgugcucgga

SEQ ID NO: 76249 - RNA, 46 nt, Mus musculus
uuacuauccagccuugagucacuguguaucucugacuucccuggaa

SEQ ID NO: 76250 - RNA, 82 nt, Mus musculus
aauuaaguaaaaugaaguagagauuucucagugaugaugauuggauuaucuagagagaguuuaaguuauagauagcugggua

SEQ ID NO: 76251 - RNA, 45 nt, Mus musculus
ugcuggccagugagcuccugggagcugccugucucugcuccccag

SEQ ID NO: 76252 - RNA, 45 nt, Mus musculus
ugccucuaaagaccuugcaagaaaagaccuguccugaaaaugaaa

SEQ ID NO: 76253 - RNA, 41 nt, Mus musculus
guugguagcagugugauugacuuucaagugagacacaguau

SEQ ID NO: 76254 - RNA, 46 nt, Mus musculus
aaguuaacuuucguuguuucccuuuuauauuuugcuuauugcacag

SEQ ID NO: 76255 - RNA, 45 nt, Mus musculus
cagggcaauggacaaugggaagacaggacgcggccucuggugugu

SEQ ID NO: 76256 - RNA, 45 nt, Mus musculus
cagaagguugcccugaagaucauuguuuacuggguaccacaggag

SEQ ID NO: 76257 - RNA, 42 nt, Mus musculus
gugacagagaggggacagcacaguaaaacauggaagucacug

SEQ ID NO: 76258 - RNA, 46 nt, Mus musculus
guagauucagaguaaaaccccaucucuaaacacaagccaaaccccc

SEQ ID NO: 76259 - RNA, 46 nt, Mus musculus
uuguaaaaacugcaggagaggaaggaaggaaagucagaggacgagg

SEQ ID NO: 76260 - RNA, 45 nt, Mus musculus
ugugaagaaguuccugucagaaagucaugggaucucaccaccacc

SEQ ID NO: 76261 - RNA, 46 nt, Mus musculus
aagggccauaggaaccauaugucaugaaggcccugauguccuugag

SEQ ID NO: 76262 - RNA, 46 nt, Mus musculus
cauuagccuuguucauaagucaagccaaggagcucccuucccccca

SEQ ID NO: 76263 - RNA, 46 nt, Mus musculus
gacuugccuuggucauggugucuguucacagcaguaaaacucaaag

SEQ ID NO: 76264 - RNA, 24 nt, Mus musculus
acuagcugucucagaguugggccu

SEQ ID NO: 76265 - RNA, 45 nt, Mus musculus
uuccggcagcagggguccaggcugucacugaugaguacuuugcgc

SEQ ID NO: 76266 - RNA, 50 nt, Mus musculus
ggaaaacagagcaaccgcggcucagaagcccccaagaaugugucugaggu

SEQ ID NO: 76267 - RNA, 45 nt, Mus musculus
gccaggaguagcaacaauaacaguucaguccuccagcagccagag

SEQ ID NO: 76268 - RNA, 43 nt, Mus musculus
cggcacacaaagucacaaccaucagcuacuagguugccaagau

SEQ ID NO: 76269 - RNA, 45 nt, Mus musculus
ugagaaaagugcaacucagauuuacaaguaccaguagagggagau

SEQ ID NO: 76270 - RNA, 46 nt, Mus musculus
gagacaggugcagcaguguccccacccaaagcagagaccugcagag

SEQ ID NO: 76271 - RNA, 45 nt, Mus musculus
uuaauuguguauuugauuccgaagugucucauauuuauggcagau

SEQ ID NO: 76272 - RNA, 37 nt, Mus musculus
cuucaauauggcuggucucgauuaucucaagagagag

SEQ ID NO: 76273 - RNA, 88 nt, Mus musculus
aaacguaaaggggccuggagaauagaggugcagacacacgggccaagacuggaggguucaguucguaagggugauaacuguuaaacua

SEQ ID NO: 76274 - RNA, 61 nt, Mus musculus
uacaggcaaaaaguacgaacaaguuuugguugcuguucuuuguguugugugguagucugac

SEQ ID NO: 76275 - RNA, 69 nt, Mus musculus
uauauauguauaaucugcucuugaguauuuuauaguauauccauuuaauguauucauuugguuaaaagu

SEQ ID NO: 76276 - RNA, 46 nt, Mus musculus
uagccuucagcguauguguuagagacuuuuaaagggaucaggucaa

SEQ ID NO: 76277 - RNA, 46 nt, Mus musculus
cauuauaacuuaugugugucucuuggcagcaaagggaagcagagua

SEQ ID NO: 76278 - RNA, 47 nt, Mus musculus
uuguaucagcaucucaugacaagucgcugagacucugggagagaacg

SEQ ID NO: 76279 - RNA, 50 nt, Mus musculus
uacgcuuugugccuaagucucaccucuucuucaccgcugggaaggaccac

SEQ ID NO: 76280 - RNA, 46 nt, Mus musculus
uauaaaaagcaaauuacuggaaaugaauuuucugucagucauagag

SEQ ID NO: 76281 - RNA, 24 nt, Mus musculus
caguaagguuuaugggggauggcu

SEQ ID NO: 76282 - RNA, 42 nt, Mus musculus
auaugcucucugcuccuucuucguucccggcgauaggcaggu

SEQ ID NO: 76283 - RNA, 46 nt, Mus musculus
aagguacuugccacuaaagaccucaguugaucccuggagcccagac

SEQ ID NO: 76284 - RNA, 46 nt, Mus musculus
gugucucgaugacacugcaggacgagauccuucgaguagccaagau

SEQ ID NO: 76285 - RNA, 92 nt, Mus musculus
cagaugggcaucucuagagaucagugugugugugugugugugugugugugugugugugugugugugugugugugugugugugggugucaccu

SEQ ID NO: 76286 - RNA, 45 nt, Mus musculus
aucagaggacagcacccuugaggcggaugaugaaaaaucugaaga

SEQ ID NO: 76287 - RNA, 46 nt, Mus musculus
gugcugugguuuugugaugaguagcuuuuaucugaacagggcagua

SEQ ID NO: 76288 - RNA, 45 nt, Mus musculus
ggaccuggauaaccagcacugcuucaaaacaaugguuggccaccg

SEQ ID NO: 76289 - RNA, 45 nt, Mus musculus
cucaaagaaggcaaagaaaagaucauuguuuucccagcacagagg

SEQ ID NO: 76290 - RNA, 42 nt, Mus musculus
uuaggugcgggggauaguuugagagugaccaggucgcaggaa

SEQ ID NO: 76291 - RNA, 46 nt, Mus musculus
agaauccugcauaucgaugaagugcacacuagaaaaccaugagaag

SEQ ID NO: 76292 - RNA, 45 nt, Mus musculus
gcuagcaucuauguuguggugugccaagccugaugggcaguaagc

SEQ ID NO: 76293 - RNA, 101 nt, Mus musculus
ucuccauauaauaugcugaaccugguauuuaucauaacugcugcuuaugagccggagugugggagugugcauguagcucacgcuagcauugggagcaugau

SEQ ID NO: 76294 - RNA, 49 nt, Mus musculus
gaaaucuguuuagauugaguuuuucucugaggggcaugaucucaugaag

SEQ ID NO: 76295 - RNA, 49 nt, Mus musculus
auuguguagccccuuuccuccauuuuaacaauggaacaaaccgaaugag

SEQ ID NO: 76296 - RNA, 45 nt, Mus musculus
ccuguguuuuguuuacauggaccacuacagagacugucugcagag

SEQ ID NO: 76297 - RNA, 45 nt, Mus musculus
cugagguuuauauauacaaguuuuaauauuuaauauaugccagau

SEQ ID NO: 76298 - RNA, 46 nt, Mus musculus
uguauugagugguucagugcagggagauucaguaagaagguaaaag

SEQ ID NO: 76299 - RNA, 46 nt, Mus musculus
auugaaaccuauugguaucuauggcgauuuacccacgacccaagau

SEQ ID NO: 76300 - RNA, 46 nt, Mus musculus
auguuaagaauuaucccaguggcacugguuucgaaggcaugaaggg

SEQ ID NO: 76301 - RNA, 46 nt, Mus musculus
gaaaacagaaagcuacugaagauggaauagaacaagagacccacaa

SEQ ID NO: 76302 - RNA, 83 nt, Mus musculus
uucuuuauauaugguaguuaucauagcaccuuuaaucccaguauucaggagacaaaagcauguagaucucuaagaucaagguc

SEQ ID NO: 76303 - RNA, 39 nt, Mus musculus
uucuuuggagaugugucuguucauuuuaugagcccauuu

SEQ ID NO: 76304 - RNA, 44 nt, Mus musculus
gccaugcuaguuuauguuuucuuaauauucaggcaagggugaga

SEQ ID NO: 76305 - RNA, 46 nt, Mus musculus
ccccacuuuauucaguugccuuuaguucuugguauaggguugaggc

SEQ ID NO: 76306 - RNA, 46 nt, Mus musculus
acaucuuauuaagaagucccgaggaggucugguuuuuauuggagaa

SEQ ID NO: 76307 - RNA, 46 nt, Mus musculus
uuuucagcauuguaguuuugugauuuaaaaaaaucaaaccuaagau

SEQ ID NO: 76308 - RNA, 94 nt, Mus musculus
augaaugaugucacugggucaccguuaugacuguacacauggagaccugaagaugcagugucaauggucagguagcuuggugaaggugagaguc

SEQ ID NO: 76309 - RNA, 45 nt, Mus musculus
auuggauggaaagccugcggggauaagaggagaugggugcuggug

SEQ ID NO: 76310 - RNA, 46 nt, Mus musculus
gauugaagauacaguagguguaacuauggagagcaagaaggaagau

SEQ ID NO: 76311 - RNA, 42 nt, Mus musculus
cucuuaccaguaagagaggauuuggauaguguugggacagua

SEQ ID NO: 76312 - RNA, 46 nt, Mus musculus
ucuuggcagacaggaagccaagaaaggggaauacaggcaugguaca

SEQ ID NO: 76313 - RNA, 42 nt, Mus musculus
uaaaaaaacccaugaaucuguaaccuauucuccuggccaguc

SEQ ID NO: 76314 - RNA, 46 nt, Mus musculus
aaguagaugcugacaccauaaucuugaaucuucaaaauugugagcu

SEQ ID NO: 76315 - RNA, 46 nt, Mus musculus
uaaaacaaaaauguaauuuucuuauguuauagacgacugacuggau

SEQ ID NO: 76316 - RNA, 42 nt, Mus musculus
agaagacagaacugcaaaaugcuguucuaagagcacacugag

SEQ ID NO: 76317 - RNA, 41 nt, Mus musculus
uagacuccauaauaaguuuaagagucuucuccgaccugaaa

SEQ ID NO: 76318 - RNA, 46 nt, Mus musculus
gguaacuuuuuccaugauaaauuguaaacuguuggacuugccuagg

SEQ ID NO: 76319 - RNA, 45 nt, Mus musculus
gguaugaggaagaaacgaucuaguaguuucuugggcaguaucaga

SEQ ID NO: 76320 - RNA, 48 nt, Mus musculus
uuuguaaacauggugaagucucuagagggaaguguaacaaugagaaga

SEQ ID NO: 76321 - RNA, 46 nt, Mus musculus
aguauuuagcauguuuaucuuugacuuaaauguaauagccacauau

SEQ ID NO: 76322 - RNA, 42 nt, Mus musculus
ggguuuagaccacuauugcgcuagcauaucuugucgacaggu

SEQ ID NO: 76323 - RNA, 46 nt, Mus musculus
caugaguauuauggaauaauuuuauggucagagaacagcuugugag

SEQ ID NO: 76324 - RNA, 46 nt, Mus musculus
uaaagcaaaaaacccaaaaaaccaagaaaacaaaaacagcccagaa

SEQ ID NO: 76325 - RNA, 46 nt, Mus musculus
auauugaaaaacaacagcuauauuuuuucuauauuugguggaagac

SEQ ID NO: 76326 - RNA, 46 nt, Mus musculus
cccagauuagucaauaaauguuuuauagaaucuuucacagcuagac

SEQ ID NO: 76327 - RNA, 61 nt, Mus musculus
auuuaaagucucagaguacaauuuacagucaccagguuucaguucagaauugcuaauguau

SEQ ID NO: 76328 - RNA, 61 nt, Mus musculus
uggagguuuuagagcaucuuagcguggagggcauggcaguguagaaaaggaagccaggaaa

SEQ ID NO: 76329 - RNA, 42 nt, Mus musculus
uacgugaccauccuuucauuuauacuuuguguacagccagga

SEQ ID NO: 76330 - RNA, 58 nt, Mus musculus
cagucucuuucaagaugaaggacagggcaggaaaaaagaaucaggaaaugcuaagggc

SEQ ID NO: 76331 - RNA, 46 nt, Mus musculus
uuugaagcucuguggcaaggucaugguauaaaaugaagcuguaacu

SEQ ID NO: 76332 - RNA, 81 nt, Mus musculus
ccacccuucucuaguucugaguaaaaaccucuuugcaagauuaaaagacuagauccagagcccagcuuugcuccagggcac

SEQ ID NO: 76333 - RNA, 46 nt, Mus musculus
ucgcuuuauuggagggcuccucgcugcauauuaccugucaggagag

SEQ ID NO: 76334 - RNA, 46 nt, Mus musculus
uucucacugucuucauauuucuugcaauuauuuaaagccaguuaag

SEQ ID NO: 76335 - RNA, 46 nt, Mus musculus
cuggugcuguugauccuggacuuuccagauuccaggaaggugagaa

SEQ ID NO: 76336 - RNA, 46 nt, Mus musculus
uauaauguaguucucagagaacuacuuugcuucauacgugcgaggu

SEQ ID NO: 76337 - RNA, 46 nt, Mus musculus
auguguuggaacuggaaagguucuuuggguagugaugaguucauca

SEQ ID NO: 76338 - RNA, 46 nt, Mus musculus
ccaccuccuggcugcauggaugcuuuuuauuugauauucuggagau

SEQ ID NO: 76339 - RNA, 46 nt, Mus musculus
augaaacaugccugggauaauuacagaacauacggauggggacaua

SEQ ID NO: 76340 - RNA, 25 nt, Mus musculus
gcuugcuuugacuuacuguuucuag

SEQ ID NO: 76341 - RNA, 38 nt, Mus musculus
gaagacauggagaucaagaagaaaagagacaaaauuaa

SEQ ID NO: 76342 - RNA, 102 nt, Mus musculus
agagcugaccaugagaaagcccuggaagaagcaaaagaaaaauuaagaaagucaagagaggaaauccgugcagaaauucagacagagaaaaacaaaguagcc

SEQ ID NO: 76343 - RNA, 45 nt, Mus musculus
ugaugauaauggacugaaccuugaaccuguaagccagccccaauu

SEQ ID NO: 76344 - RNA, 34 nt, Mus musculus
ugaauguuaucuaaaaguaauuuuaugcaauagg

SEQ ID NO: 76345 - RNA, 46 nt, Mus musculus
acaaaaaacuccaucacuugacagaagccuagcugaacaaggagua

SEQ ID NO: 76346 - RNA, 45 nt, Mus musculus
ucaaacagacaugcucaauggagugccuuauuaaugcccucagug

SEQ ID NO: 76347 - RNA, 46 nt, Mus musculus
uuaagguuuguguguguguguguuguauacaugcuguggugcaagu

SEQ ID NO: 76348 - RNA, 42 nt, Mus musculus
cugaaucuugacagcuugcuagacuuugcucagccaccaagu

SEQ ID NO: 76349 - RNA, 41 nt, Mus musculus
ucuuccugauccauggacccgacgaacacagacacagguuc

SEQ ID NO: 76350 - RNA, 47 nt, Mus musculus
uuuauaaaguauuccguccaagagccuaaacgaugacuaccccagcg

SEQ ID NO: 76351 - RNA, 44 nt, Mus musculus
uuaagccuggcauguuagugcaugccuguaauccagcaagaaga

SEQ ID NO: 76352 - RNA, 41 nt, Mus musculus
uauagagagagagagagacagagagacagagagagagagac

SEQ ID NO: 76353 - RNA, 41 nt, Mus musculus
ggcccuagcauaguagggauuucagaaguacuagcugaaug

SEQ ID NO: 76354 - RNA, 46 nt, Mus musculus
ugucuucucugcuggcagaacuggaggcgauccaaaaaggcccagg

SEQ ID NO: 76355 - RNA, 46 nt, Mus musculus
guagcccacacgaaguuggggaggcuuucaaaaguaacacccauca

SEQ ID NO: 76356 - RNA, 46 nt, Mus musculus
uugaugacagauauuaccuuucucccuguguugaacauuaugcacg

SEQ ID NO: 76357 - RNA, 42 nt, Mus musculus
ugccaagccugaugccccggguucaauccccaggccccagag

SEQ ID NO: 76358 - RNA, 46 nt, Mus musculus
uccagaggacccagguucaauucucagcacccacauggcagcucac

SEQ ID NO: 76359 - RNA, 46 nt, Mus musculus
aauucccaagaacuacaagauggcucacagccaucuguaaugagau

SEQ ID NO: 76360 - RNA, 42 nt, Mus musculus
gcuugaugcccagcuggcuacacccucuuuuaccuucaugau

SEQ ID NO: 76361 - RNA, 45 nt, Mus musculus
uugauguugucccagugcuaagaggaagauauaugcauuuuucag

SEQ ID NO: 76362 - RNA, 23 nt, Mus musculus
cagaagcaggcauuagccugguu

SEQ ID NO: 76363 - RNA, 47 nt, Mus musculus
uugcagcuugugacuaucaguccagacugggcuguugaguaggaagg

SEQ ID NO: 76364 - RNA, 44 nt, Mus musculus
uguucucucccagagcacagcauaaacuagggcacaaaagaacu

SEQ ID NO: 76365 - RNA, 46 nt, Mus musculus
auaauguguggaaaaucacgagugaagccauagaugagcugcaucg

SEQ ID NO: 76366 - RNA, 46 nt, Mus musculus
auuauagguuguuuuguucuaaauaacaguuguuugugugguuaag

SEQ ID NO: 76367 - RNA, 46 nt, Mus musculus
gcugcugccccucuccacuugguaccuccccagccccuucccaggc

SEQ ID NO: 76368 - RNA, 42 nt, Mus musculus
uuuccuccaaaaggacauuuuagauacaaggcagcccuauuu

SEQ ID NO: 76369 - RNA, 46 nt, Mus musculus
uggauuccuugugaauuuggcauuuuuccuuuuuaaaugcagaagc

SEQ ID NO: 76370 - RNA, 46 nt, Mus musculus
ccaaggcggaggggaagcagugguguggaaacgucccauggcggca

SEQ ID NO: 76371 - RNA, 46 nt, Mus musculus
ggggggggagagaaauugauugauugauugauugauugggagagug

SEQ ID NO: 76372 - RNA, 42 nt, Mus musculus
aggucuaacaugcuaaguaagacucaguaaagugcaguuuuc

SEQ ID NO: 76373 - RNA, 45 nt, Mus musculus
uuacaguuaugaaguaucaacaaaaauaauuuuaugauugagguu

SEQ ID NO: 76374 - RNA, 46 nt, Mus musculus
gauuguucagaauagcccugauuucaaauaguucagaaauguaguu

SEQ ID NO: 76375 - RNA, 46 nt, Mus musculus
uagaucuucccaccgcggacucgcuggguguagauggcguacggga

SEQ ID NO: 76376 - RNA, 42 nt, Mus musculus
caagcccgggaugccggcgaguaugaaugucacacccccaac

SEQ ID NO: 76377 - RNA, 42 nt, Mus musculus
aauuugaagaugugacuuggaagggaaagugggugagaccag

SEQ ID NO: 76378 - RNA, 102 nt, Mus musculus
aagguuuauacgugccuuuuuguuuuuguaaaaaaggaaaaccuggaaagacugaaagauuacguuuuauaucuggauuuuuacaaauaaagauggcuauua

SEQ ID NO: 76379 - RNA, 102 nt, Mus musculus
cguggaacauugugccacacacugcacccaccccuacccccucuuuguguacuucaagucuuggagcucggaacucuacccugguaggaaagcaccaaagca

SEQ ID NO: 76380 - RNA, 45 nt, Mus musculus
gugcuaagguagaaacacaccgugguuuuuaagaccuuaaaaagu

SEQ ID NO: 76381 - RNA, 46 nt, Mus musculus
ugugccuuccccuacucccuucucaucuuuguguaugacgaggugc

SEQ ID NO: 76382 - RNA, 42 nt, Mus musculus
cacugugagagguuccauaguacccugcauagauuaaaagau

SEQ ID NO: 76383 - RNA, 54 nt, Mus musculus
cuuauccuacugccccgggaugggggcagcccuuaggauguauccccucaagua

SEQ ID NO: 76384 - RNA, 53 nt, Mus musculus
aggaacaagaucuugauauuuggccucuuugaagagacagcccuugcugcuuu

SEQ ID NO: 76385 - RNA, 50 nt, Mus musculus
gacuuggucaucugcaagaccagaaggaauucugucuuccagcagggaau

SEQ ID NO: 76386 - RNA, 43 nt, Mus musculus
accgcugggucaacgauguggaggacagcuacgggcagcagug

SEQ ID NO: 76387 - RNA, 45 nt, Mus musculus
ggcccugggaggcuucuucacuuacuuugugauucuggcugagaa

SEQ ID NO: 76388 - RNA, 45 nt, Mus musculus
gaaugauggcucuguccuggaaaacuugggguguccuggcuggau

SEQ ID NO: 76389 - RNA, 75 nt, Mus musculus
acgagcaagcugagagcgacaucaugaagaggcagcccagaaaccccaaaacggacaaacuugugaacgagcguc

SEQ ID NO: 76390 - RNA, 54 nt, Mus musculus
aaucacccccuucuugauauuuauuauugcaaacauuccacugccccuggggac

SEQ ID NO: 76391 - RNA, 60 nt, Mus musculus
ucugauuuuugauaacuugaagaaauccaucgcuuacacccuaaccaguaacauuccgga

SEQ ID NO: 76392 - RNA, 46 nt, Mus musculus
ugauccuucuggaugacaacuuugccuccauugugacuggaguaga

SEQ ID NO: 76393 - RNA, 47 nt, Mus musculus
augaccuccgaggagcuggaugacaucuugcgguaccacacagagau

SEQ ID NO: 76394 - RNA, 73 nt, Mus musculus
ucagaaggcaaugagacuguggaagacauugcugcccgccucaacauuccagugaaccaggugaaccccaggu

SEQ ID NO: 76395 - RNA, 46 nt, Mus musculus
auacacacauaaucaaaauaaaaucuauaguuguuguccuucagaa

SEQ ID NO: 76396 - RNA, 50 nt, Mus musculus
ggcuuccaguuugacacugacgaugucaauuuccccguggauaaccucug

SEQ ID NO: 76397 - RNA, 85 nt, Mus musculus
ucugcugcggcuccgugauggagaugagggagaaauacagcaagauaguggagauucccuucaacuccaccaacaaguaccaggu

SEQ ID NO: 76398 - RNA, 46 nt, Mus musculus
gaaaaaccaaaaaaaauaaagaaggaugaugcuuaucuugggaguc

SEQ ID NO: 76399 - RNA, 46 nt, Mus musculus
auucuguuuguuuuguuuuuguuuuuuuacauuguuuauuggagau

SEQ ID NO: 76400 - RNA, 86 nt, Mus musculus
ccgcaccgugaugggcaggauugccacgcuugccucugggcuagaagguggccagacccccauugcugaagagauugagcauuuca

SEQ ID NO: 76401 - RNA, 101 nt, Mus musculus
uccucacucacuggugaaucagaaccccagacucgguccccggauuucacaaacgagaaccccuuggagacaaggaacauugccuucuucucaaccaacug

SEQ ID NO: 76402 - RNA, 45 nt, Mus musculus
cccugcugaucuuagaaucauaucugcaaacggcugcaagguagc

SEQ ID NO: 76403 - RNA, 83 nt, Mus musculus
aagcccuugugauucgaaauggagagaaaaugagcaucaaugcggaggaugucgucgucggggaucugguggaggugaaaggg

SEQ ID NO: 76404 - RNA, 42 nt, Mus musculus
gucuugugagaacagcccuaggguaacuguugagcugcagug

SEQ ID NO: 76405 - RNA, 45 nt, Mus musculus
uggcacagcucagcucugcacuuaggugugcuggacuugccuaga

SEQ ID NO: 76406 - RNA, 81 nt, Mus musculus
cccucacacccccucccacuacucccgaaugggugaaauucugccggcagcucuuuggaggcuuuuccauguuacugugga

SEQ ID NO: 76407 - RNA, 43 nt, Mus musculus
auaaacucagccuggaugaacuccaucguaaauacggaacaga

SEQ ID NO: 76408 - RNA, 95 nt, Mus musculus
uggacgagacaaguaugagccugccgcuguaucggagcauggugacaaaaagggcaaaaaggccaagaaggaaagggauauggaugagcucaaga

SEQ ID NO: 76409 - RNA, 45 nt, Mus musculus
gugugagagacuguguguguggaugugacaguguguuugugagug

SEQ ID NO: 76410 - RNA, 42 nt, Mus musculus
ugguggcuguguaggcaucaaguugcagucuacuggggagga

SEQ ID NO: 76411 - RNA, 51 nt, Mus musculus
ccaguugaggacuaaaacuuagaaucacauuuaagaauaaagagcaggccc

SEQ ID NO: 76412 - RNA, 46 nt, Mus musculus
cauccaagccguuccuauaaaccauuuauuccuuaaagccccaucu

SEQ ID NO: 76413 - RNA, 42 nt, Mus musculus
ccgggagcugcucucuucucuuucuagucuccagcaacagga

SEQ ID NO: 76414 - RNA, 45 nt, Mus musculus
cuuccuuguucuggcauccucauuauagaccaguaguagggcaga

SEQ ID NO: 76415 - RNA, 45 nt, Mus musculus
ggucuugaugguaaggcacaagugagauugcccagagggcgugag

SEQ ID NO: 76416 - RNA, 44 nt, Mus musculus
cagaauuauagcaaagucuagacugggcuuuggcgaccaucagg

SEQ ID NO: 76417 - RNA, 46 nt, Mus musculus
auccccucagauccacacgcccuacauuccucuccugcucccagcg

SEQ ID NO: 76418 - RNA, 30 nt, Mus musculus
acuguuuaugugucuguguaugagugugug

SEQ ID NO: 76419 - RNA, 46 nt, Mus musculus
uggcgcacgccgguaggauuugcugaaggaggcagaggcaagagga

SEQ ID NO: 76420 - RNA, 24 nt, Mus musculus
accucagcaucagccgcaggacaa

SEQ ID NO: 76421 - RNA, 42 nt, Mus musculus
cuuugucaucuuccagcuuucauagagagaaaggccacagaa

SEQ ID NO: 76422 - RNA, 45 nt, Mus musculus
aggaaaggacugggagugaggguaggauauaggucaaagguuaga

SEQ ID NO: 76423 - RNA, 42 nt, Mus musculus
ggaagaguacaggucaaaggguagagggaaggacugggagug

SEQ ID NO: 76424 - RNA, 42 nt, Mus musculus
uucuuggcaggcagugcucucugugagaagagggaggggcag

SEQ ID NO: 76425 - RNA, 45 nt, Mus musculus
gaaauugacuacccacucucaccacugccaaucauugacccagug

SEQ ID NO: 76426 - RNA, 45 nt, Mus musculus
ucugugcuggcuaguuuuaugucaaugugacacaaccuagaguca

SEQ ID NO: 76427 - RNA, 47 nt, Mus musculus
cggauuacuaauuaagaaaaugccuuacaggcuuauccacagaccaa

SEQ ID NO: 76428 - RNA, 49 nt, Mus musculus
agaggguuuuuuugauuuaugcuuccacaucauaguucaucaucaagaa

SEQ ID NO: 76429 - RNA, 46 nt, Mus musculus
aacccuucaaggacauuagaguccucaccacuauccagacagggaa

SEQ ID NO: 76430 - RNA, 41 nt, Mus musculus
ugugcacucccagucagacuggaucuccucccaccccgagg

SEQ ID NO: 76431 - RNA, 42 nt, Mus musculus
cgagguucgggcugggcccguggucgcguggccggcuggagu

SEQ ID NO: 76432 - RNA, 46 nt, Mus musculus
ggaggagcaccaggaugcguuggaacugaucaugagcaaguaccgg

SEQ ID NO: 76433 - RNA, 44 nt, Mus musculus
gaugaccuagaacuggaguuagggaugauugugagugaccaugu

SEQ ID NO: 76434 - RNA, 46 nt, Mus musculus
gggguggcaguuuagaauugccacuugguauucauuguccacuaac

SEQ ID NO: 76435 - RNA, 46 nt, Mus musculus
ucuauuaguccccaggaaauacgcuugaaaacaaguaagccggguu

SEQ ID NO: 76436 - RNA, 46 nt, Mus musculus
aauguacauguacagucauguacaucuaauagcucccugugcauga

SEQ ID NO: 76437 - RNA, 45 nt, Mus musculus
cauuggacuuaaaugccaaaaauagcuuuuauuuauuugaccaag

SEQ ID NO: 76438 - RNA, 46 nt, Mus musculus
guugccuuguaugagacauacacauacacacacacacacacacaca

SEQ ID NO: 76439 - RNA, 49 nt, Mus musculus
ggagcuaggaaccugugagugagguaugugugugugugugugugugugu

SEQ ID NO: 76440 - RNA, 46 nt, Mus musculus
acuuucugugaguaauaaaaugcuuccaugagaaaacccagcagau

SEQ ID NO: 76441 - RNA, 46 nt, Mus musculus
ugcauucaggcaaucaagaacaaccugagauucuaauagcucccug

SEQ ID NO: 76442 - RNA, 45 nt, Mus musculus
cauaugucagguuuauaaauaauuccuuuugcacuguuugcccag

SEQ ID NO: 76443 - RNA, 46 nt, Mus musculus
uuugcucauuuuacugagaaaugagucuaagaaguugagcuggaaa

SEQ ID NO: 76444 - RNA, 42 nt, Mus musculus
gggcaugguggcacaugccuguaaucccagaauuuggagcag

SEQ ID NO: 76445 - RNA, 45 nt, Mus musculus
uggugccugagguuugagccagggcuuuguguaugcuaggcaggu

SEQ ID NO: 76446 - RNA, 42 nt, Mus musculus
uaguuuugagguaauuuuagacuuacagaggacuuaucagaa

SEQ ID NO: 76447 - RNA, 45 nt, Mus musculus
gguuccucuguguauuugccaucaauaauagcaaaucauuugcag

SEQ ID NO: 76448 - RNA, 42 nt, Mus musculus
guuagcaggcgccuuugcccauggaccaucuuuaaaccccaa

SEQ ID NO: 76449 - RNA, 46 nt, Mus musculus
cacagagaaacccugucucaaaaaacaaaagaaagaaaaagagaag

SEQ ID NO: 76450 - RNA, 45 nt, Mus musculus
agacuucucagagaacuggugaguuucagagcuauuugggcccua

SEQ ID NO: 76451 - RNA, 44 nt, Mus musculus
aacaaggacaguugacacaaagcaagcccacgaacuggccaaga

SEQ ID NO: 76452 - RNA, 46 nt, Mus musculus
gauuucguuguuguuguuguuguuguuguuguuguuguuguuguug

SEQ ID NO: 76453 - RNA, 46 nt, Mus musculus
cauggaauauauaucuaucuguauguggagagaacguggcccucag

SEQ ID NO: 76454 - RNA, 51 nt, Mus musculus
aagcugauguguuuguucaaauaaagagguauccuucgcuacucgagagaa

SEQ ID NO: 76455 - RNA, 45 nt, Mus musculus
acuuggucuuguuuuguuuuaauaugucuauaugacugguggugg

SEQ ID NO: 76456 - RNA, 45 nt, Mus musculus
cuuuaaacugcugugaacuuugucaugacuugaauaugaagauag

SEQ ID NO: 76457 - RNA, 46 nt, Mus musculus
acuguuuuccuuguuaaauaauuuuaaaaaaauaaaaaacuggaag

SEQ ID NO: 76458 - RNA, 96 nt, Mus musculus
ccuuuauguagaaaggggucaggcugucaggccgcaguaacacugaaugcagcccucaaccccugcacuauacugaguuucaaauuuaguaagacc

SEQ ID NO: 76459 - RNA, 48 nt, Mus musculus
acuuuuaugaacuauaaaugagacagacacaaauacaugagagagaga

SEQ ID NO: 76460 - RNA, 46 nt, Mus musculus
aaucaaucaaucaaccaaucaagucauuaugauaacaauggucuag

SEQ ID NO: 76461 - RNA, 46 nt, Mus musculus
uagaagggcaccauauuugaguuugguuuugaaggaugauuagggg

SEQ ID NO: 76462 - RNA, 45 nt, Mus musculus
acauauuuuuaacaaauacucaguguaaagcuaugauucggggua

SEQ ID NO: 76463 - RNA, 46 nt, Mus musculus
aaguguucuauagagcaugggggugcagaugucgggcaagguccag

SEQ ID NO: 76464 - RNA, 54 nt, Mus musculus
agacuccucggagaaccugacacgugcaucauccacauguuuuccagacuggaa

SEQ ID NO: 76465 - RNA, 51 nt, Mus musculus
guuguugcccuuccacaacuuuccguugauuccguccaccccacaucaugg

SEQ ID NO: 76466 - RNA, 46 nt, Mus musculus
ggacucagucucuccccacacacaucccuuuucuuagccccuuagu

SEQ ID NO: 76467 - RNA, 42 nt, Mus musculus
cugcagccgcuguucuuccagccugcaccuuaucguccccuu

SEQ ID NO: 76468 - RNA, 45 nt, Mus musculus
guccugaugaccaacagacacucgagucuuguucuuucccaucuu

SEQ ID NO: 76469 - RNA, 46 nt, Mus musculus
ugugauggcuuauaaaguuaauuagaaaauaauauuaauuguauag

SEQ ID NO: 76470 - RNA, 40 nt, Mus musculus
gccaccacgcuuggcuuaaaacuuuuuaaauuacaucuuu

SEQ ID NO: 76471 - RNA, 45 nt, Mus musculus
uagcaggaaugcgacaaaacuaguacaaagaaggcuuauuggcag

SEQ ID NO: 76472 - RNA, 46 nt, Mus musculus
cauguggaauucugauaacuuuuuagaggauauauaaaugcuaggg

SEQ ID NO: 76473 - RNA, 67 nt, Mus musculus
gcagaccgcuagguaugacuagagcauguguaggcgcggagcacaaauggcgggacuugaaaggcuu

SEQ ID NO: 76474 - RNA, 46 nt, Mus musculus
uuuaaaccagaaacuauuuuguauuuacuuauuuuaugugucugag

SEQ ID NO: 76475 - RNA, 41 nt, Mus musculus
uuuuuaaauuuuauuuuuaggugugugugugugugugugug

SEQ ID NO: 76476 - RNA, 49 nt, Mus musculus
acugaauuaagagaaaauauugucaauucagaauuguauauccagcaaa

SEQ ID NO: 76477 - RNA, 46 nt, Mus musculus
guuaaacaugaaacgaaaacacuuggaucguuuccguucuggcaag

SEQ ID NO: 76478 - RNA, 23 nt, Mus musculus
agugacucgucaugcaccccacc

SEQ ID NO: 76479 - RNA, 46 nt, Mus musculus
ggacuuuggagugagguauaacugccaccaagagagucccccucau

SEQ ID NO: 76480 - RNA, 43 nt, Mus musculus
aggaauggggcuuuacccagaaacacggaugucaaaagccgag

SEQ ID NO: 76481 - RNA, 45 nt, Mus musculus
gcauagacgggcucuccccagauaaacccuuaaauuuggccuuag

SEQ ID NO: 76482 - RNA, 46 nt, Mus musculus
gggcaggaauguggccccucuauaaauccuuuacccaaaccccgua

SEQ ID NO: 76483 - RNA, 46 nt, Mus musculus
gagcauagagauguugauagcauagaaucaaaguaggaggagaaag

SEQ ID NO: 76484 - RNA, 28 nt, Mus musculus
ucuugacuggaacuguuacaaggcagaa

SEQ ID NO: 76485 - RNA, 102 nt, Mus musculus
gcugaggcuggugugagucugauacccacaacaacagcugauaggaucaccucuuucaacucuucuuaagaaagaaagaaagagagagagagagagagagag

SEQ ID NO: 76486 - RNA, 46 nt, Mus musculus
uaauuugaaucccccacuuuuaugacagcucuaaaauuaguugcag

SEQ ID NO: 76487 - RNA, 44 nt, Mus musculus
ucaauuccuucuuacugaccucaaaguaagaacauuaugcgagu

SEQ ID NO: 76488 - RNA, 46 nt, Mus musculus
aucuguagcccaggcuggagcuugaaguccuucuuucugccucggg

SEQ ID NO: 76489 - RNA, 45 nt, Mus musculus
ucccuuuagugggauuauaaacacaugccaugguagcuggcuuuu

SEQ ID NO: 76490 - RNA, 35 nt, Mus musculus
uuuugauuuuuuuuuuuugguugguugguugguuu

SEQ ID NO: 76491 - RNA, 45 nt, Mus musculus
gugucauggaagccccuuucccagcuccuggccgcaccaucacag

SEQ ID NO: 76492 - RNA, 45 nt, Mus musculus
cacccuacccuaccuggcccaaaguaacagacguuuucagacuag

SEQ ID NO: 76493 - RNA, 58 nt, Mus musculus
uggaacauguggacuuugaaugccuuuucaaaugcuugagugugcgucaucucauccg

SEQ ID NO: 76494 - RNA, 45 nt, Mus musculus
cuacuccguucuuuaucgggaucuugucuuguuccuuaccccacc

SEQ ID NO: 76495 - RNA, 47 nt, Mus musculus
aucacauacacauaaacacacacacacacacagaaggggggggagag

SEQ ID NO: 76496 - RNA, 44 nt, Mus musculus
ggugucucuguaggcaaucacaauuagacagaaaauacgugaaa

SEQ ID NO: 76497 - RNA, 46 nt, Mus musculus
uuuaagccucuaaguuaguaaaauauacuggacugagaagcagcuc

SEQ ID NO: 76498 - RNA, 48 nt, Mus musculus
cccaucuggauacauaagcucccauguccaacucagcaccgagagaga

SEQ ID NO: 76499 - RNA, 42 nt, Mus musculus
gugaaacuuauagaugagagauuuuguagaaaagccccagag

SEQ ID NO: 76500 - RNA, 25 nt, Mus musculus
gcagccuuggugcagauuuuagaag

SEQ ID NO: 76501 - RNA, 45 nt, Mus musculus
aauacucaaaaaauguuuacugcaguaaaucacagugcagcauga

SEQ ID NO: 76502 - RNA, 30 nt, Mus musculus
ucguggggcauuauucucugaacaugacug

SEQ ID NO: 76503 - RNA, 46 nt, Mus musculus
aaagaucucacagagguccuccugccucugccucccaagugcugag

SEQ ID NO: 76504 - RNA, 46 nt, Mus musculus
uugugcuuucuaauuccaguacugucaccauugauuaaaccccccu

SEQ ID NO: 76505 - RNA, 46 nt, Mus musculus
uacacuccaaucccgauggaacaauucaugacugguuguuuauaag

SEQ ID NO: 76506 - RNA, 46 nt, Mus musculus
cuaucaaauguuuacagauaaaggcauuuuaaaaaaauucccacag

SEQ ID NO: 76507 - RNA, 45 nt, Mus musculus
gcgcaucuaccaccaccucuccggcuaccaagcccgugcccgcca

SEQ ID NO: 76508 - RNA, 65 nt, Mus musculus
uaauccggggccgucagguagcucagguaguucuugguaggucgguaucugcgcgucuccuccuc

SEQ ID NO: 76509 - RNA, 42 nt, Mus musculus
accgaccuaccaagaacuaccugagcuaccugacggccccgg

SEQ ID NO: 76510 - RNA, 46 nt, Mus musculus
ccccacugaggagucacaacccaguuuaaaaaccuggcaucuagau

SEQ ID NO: 76511 - RNA, 46 nt, Mus musculus
gaaacgguaagaugagguugagcuaugguaacagcugcuuugccag

SEQ ID NO: 76512 - RNA, 46 nt, Mus musculus
ccagccccuuccucaggucaaaaaaaugacauuacugcauggcaag

SEQ ID NO: 76513 - RNA, 42 nt, Mus musculus
uuuuuuauucuguuugaauaaaauuuagauuagccucugaua

SEQ ID NO: 76514 - RNA, 45 nt, Mus musculus
agguagauaucagggaauagcaaaaaaugaaagcuuguauccugu

SEQ ID NO: 76515 - RNA, 46 nt, Mus musculus
ggaaggaaaagaccuuuauuuugacuuacaguuucggaaauucaag

SEQ ID NO: 76516 - RNA, 45 nt, Mus musculus
gaacaugcagcuuacagcuggaucuaagcugagagaaauggaguc

SEQ ID NO: 76517 - RNA, 58 nt, Mus musculus
gaucaagcagcagcacggggaggccaacaaggaaaacauccgccaagacuucuaauga

SEQ ID NO: 76518 - RNA, 50 nt, Mus musculus
cucaggcgacgugggcuccgcagacucagcggggacuuucucggagcgac

SEQ ID NO: 76519 - RNA, 46 nt, Mus musculus
uaaaguugucaacauguugcuguuuuuaugcuauaaaaaccugguu

SEQ ID NO: 76520 - RNA, 46 nt, Mus musculus
guguagugagaauuguggaauuuuggauucuuuuuuaaaaaugcag

SEQ ID NO: 76521 - RNA, 46 nt, Mus musculus
aagacuguugcuauucaauccaucagauggcacaaauggguguagg

SEQ ID NO: 76522 - RNA, 41 nt, Mus musculus
uuuccccgauugggggaacaggcccuucaucugaugcugga

SEQ ID NO: 76523 - RNA, 45 nt, Mus musculus
aagagaaugaucuaugguuggcuguggucaccuguucuguucuca

SEQ ID NO: 76524 - RNA, 46 nt, Mus musculus
ucucgaguauccgaauauggucugauccuguacacaguauguagca

SEQ ID NO: 76525 - RNA, 45 nt, Mus musculus
cugugugugucuguuugugucugugugugucugugugucuaugug

SEQ ID NO: 76526 - RNA, 41 nt, Mus musculus
gacucuauaugaaauaggacagaaaaagccugggaggcaca

SEQ ID NO: 76527 - RNA, 45 nt, Mus musculus
ugugccuucucugugacugcagcaaaucuacuagagaggagagag

SEQ ID NO: 76528 - RNA, 42 nt, Mus musculus
gacugcgggccaaagugggcauugguagagaagcaggcaggg

SEQ ID NO: 76529 - RNA, 42 nt, Mus musculus
acccuaauuucuaaaggacaaccaaauucucaagccccucug

SEQ ID NO: 76530 - RNA, 46 nt, Mus musculus
aaguuuaagcagcuagccuugugcucuugauucuuaugcccagaca

SEQ ID NO: 76531 - RNA, 46 nt, Mus musculus
gugucuagccaaguuagacccacagacacuugacacagagcagcag

SEQ ID NO: 76532 - RNA, 46 nt, Mus musculus
cucgaaggccuccuggaggaccuggaggggguggugaauuggagaa

SEQ ID NO: 76533 - RNA, 45 nt, Mus musculus
caguuggccuauggaccaaggauccgcuggggccagcagagaaga

SEQ ID NO: 76534 - RNA, 46 nt, Mus musculus
ucgggacuucaaaaacaagauguugccucuccuggagguggcagag

SEQ ID NO: 76535 - RNA, 45 nt, Mus musculus
ccguuaguuuaaguccugcgguuuucuguaguccuugccucugag

SEQ ID NO: 76536 - RNA, 42 nt, Mus musculus
uagcuagccccaucccuagauccuaugauucugaggucaguc

SEQ ID NO: 76537 - RNA, 46 nt, Mus musculus
augaguguuuucagcacaagaaucauaccugccuuguguuugagau

SEQ ID NO: 76538 - RNA, 46 nt, Mus musculus
ccguggugggugcugcugccacgaccaccacugugaccaccaagag

SEQ ID NO: 76539 - RNA, 45 nt, Mus musculus
uugcuuuggcacaguauggacacuauaugugugacuugccuuuga

SEQ ID NO: 76540 - RNA, 45 nt, Mus musculus
aacagaaggauguguaaaaaaacaaaacaaaacaaaaaacaaagc

SEQ ID NO: 76541 - RNA, 46 nt, Mus musculus
uugguuuuagguuauuuaggucaucgguuguuaaauugugccagag

SEQ ID NO: 76542 - RNA, 46 nt, Mus musculus
uugcaugugaauauguaccauguguauaccuggugccuaaggagau

SEQ ID NO: 76543 - RNA, 45 nt, Mus musculus
uuuuaucgcuaucgauuuguuaugcagaaccagcagguauugaga

SEQ ID NO: 76544 - RNA, 46 nt, Mus musculus
aacaggcccauuuaguggcuccaccguucggaguagcugggcacug

SEQ ID NO: 76545 - RNA, 46 nt, Mus musculus
guggauuggaagccagauggccuucacacuuaugauggggguagag

SEQ ID NO: 76546 - RNA, 46 nt, Mus musculus
ccguuaugugugucucgcggcgcccggaguaugcgugacgcggcgg

SEQ ID NO: 76547 - RNA, 47 nt, Mus musculus
cgcgcgcccaggaugccgcgucgcucgccccgacccuugccccaggg

SEQ ID NO: 76548 - RNA, 45 nt, Mus musculus
guuuaacuguucugaucuagcuucuuguacaaaguggccccagag

SEQ ID NO: 76549 - RNA, 46 nt, Mus musculus
uuuuuaaagguccaagaucuuuuuuaaaaauugguugccuuaagag

SEQ ID NO: 76550 - RNA, 46 nt, Mus musculus
acccccagccuccaucuggggggguguaucccacuggcccuccaau

SEQ ID NO: 76551 - RNA, 46 nt, Mus musculus
aguuugcacuucauuucugcuccaaaaagccacaaugggauaaggg

SEQ ID NO: 76552 - RNA, 45 nt, Mus musculus
agagcugagccaaccaaaggcaaauccaaagacuccggcguagac

SEQ ID NO: 76553 - RNA, 46 nt, Mus musculus
ugugcaggccaaugcugaucuugaacucauaaucaucuugccugag

SEQ ID NO: 76554 - RNA, 42 nt, Mus musculus
gggggugaaaacugauaugaacuggcaguucaccagggagag

SEQ ID NO: 76555 - RNA, 44 nt, Mus musculus
uagggugugagcaagaaagcaaggguuggaucuuagggcagaga

SEQ ID NO: 76556 - RNA, 45 nt, Mus musculus
ggcaagaagucgauaguugaugcccaugccaaugaagagauagau

SEQ ID NO: 76557 - RNA, 35 nt, Mus musculus
cucggguggcacuucuucccagcgcuccaaguccc

SEQ ID NO: 76558 - RNA, 44 nt, Mus musculus
ggaccuuguucacccugccccucgucgacucaggacagucccca

SEQ ID NO: 76559 - RNA, 45 nt, Mus musculus
caggcacaaugaggaucaggcuugcugcgagguuguguaugugga

SEQ ID NO: 76560 - RNA, 46 nt, Mus musculus
uucuguuuccuuugacccuuccucaccuggcaggaugagcagaugg

SEQ ID NO: 76561 - RNA, 72 nt, Mus musculus
caccccagccucuccacuaucacccuucuccugcccaaacacggaaguugugucccugacucgagaguggcc

SEQ ID NO: 76562 - RNA, 45 nt, Mus musculus
agacuaggaaagaucccgcuccuguguuguguauaugugucugag

SEQ ID NO: 76563 - RNA, 26 nt, Mus musculus
aaguuaaggaaaagguguugcccgaa

SEQ ID NO: 76564 - RNA, 46 nt, Mus musculus
uuaggguuaguggggcaguuccgcuggagccgccuuucacagggag

SEQ ID NO: 76565 - RNA, 35 nt, Mus musculus
cccagucuuucggggguaccagggaaagccccuug

SEQ ID NO: 76566 - RNA, 42 nt, Mus musculus
ugcccaucauccuaguggggaauaaaaaggaccugaggcaag

SEQ ID NO: 76567 - RNA, 49 nt, Mus musculus
ggaucagugccuuuggcuaccucgagugcucggccaagacuaaggaagg

SEQ ID NO: 76568 - RNA, 46 nt, Mus musculus
caguuacccucccccacgccauccuuguaggacuccaugcugccag

SEQ ID NO: 76569 - RNA, 46 nt, Mus musculus
cuuccccauauuacacaccagcacuuuauauauuuuuggcucacag

SEQ ID NO: 76570 - RNA, 45 nt, Mus musculus
agcagaggaaggggcggaauggucugggcuguaaacuucccggcc

SEQ ID NO: 76571 - RNA, 66 nt, Mus musculus
cccugcaagagaugggaaggccgggaaguuuacagcccagaccauuccgccccuuccucugcuagg

SEQ ID NO: 76572 - RNA, 54 nt, Mus musculus
ucugggucagggauaggcagcaauaaggcuuggcuggugugagaaggcgggcgg

SEQ ID NO: 76573 - RNA, 42 nt, Mus musculus
gacaggacuugcuccaaggucugagcaaacucagccccucua

SEQ ID NO: 76574 - RNA, 45 nt, Mus musculus
ucaucuccaccguccgaagcagccagagcuuuguacagcuggauc

SEQ ID NO: 76575 - RNA, 45 nt, Mus musculus
ucuagauccagcuguacaaagcucuggcugcuucggacgguggag

SEQ ID NO: 76576 - RNA, 42 nt, Mus musculus
gacaagacacuggguacuuggagaugaguaagagaaucgcag

SEQ ID NO: 76577 - RNA, 46 nt, Mus musculus
cccuccuguuacgugauaacaccugucacaugauauugccccaagc

SEQ ID NO: 76578 - RNA, 45 nt, Mus musculus
cucaggcgggcuuuacccuucuuggaggaaggggccaggaguugu

SEQ ID NO: 76579 - RNA, 42 nt, Mus musculus
cugcacgugccuauaaucccagcauuuggagguugagugaga

SEQ ID NO: 76580 - RNA, 42 nt, Mus musculus
gucuugccgguaccuggaggcccaaagaugauguagggggca

SEQ ID NO: 76581 - RNA, 42 nt, Mus musculus
ccccccucggcucaccagaaacucuguguugaccaaccggau

SEQ ID NO: 76582 - RNA, 42 nt, Mus musculus
guaccuucaugggaagcaugggguagacguggagguccaggg

SEQ ID NO: 76583 - RNA, 46 nt, Mus musculus
cggcuuaaagagcacuguggagaaaaguccaauauugggcuguugg

SEQ ID NO: 76584 - RNA, 46 nt, Mus musculus
ugggaacuauuuuugggauauuaaaaauaaaaaauaaaaaguacag

SEQ ID NO: 76585 - RNA, 23 nt, Mus musculus
aggacugucuggggcaggggcag

SEQ ID NO: 76586 - RNA, 49 nt, Mus musculus
aaaguacgggcgggguggcccagcugaugcacagccccguuguaccuac

SEQ ID NO: 76587 - RNA, 65 nt, Mus musculus
gguuuuggugcuaaggguugaaccucaacccucacaaaugcuagacaguacccuuagcucugagc

SEQ ID NO: 76588 - RNA, 46 nt, Mus musculus
ucugauuguauucagaauguaaugagcagaauuuggugacagauag

SEQ ID NO: 76589 - RNA, 45 nt, Mus musculus
gcauuuagaauacccaaaucaaggacuuugcuuuuguaacuguug

SEQ ID NO: 76590 - RNA, 45 nt, Mus musculus
auacagaguuuaggagugcuuaucaaguaagaauuggauguguga

SEQ ID NO: 76591 - RNA, 46 nt, Mus musculus
uauuggcucuugacuuugggggaggcggauacgugcuugugaaaga

SEQ ID NO: 76592 - RNA, 45 nt, Mus musculus
auaaauaauuuaaaaaaaauaauggcaaacugaaccaaaagagaa

SEQ ID NO: 76593 - RNA, 46 nt, Mus musculus
caaucuucuauuuugaaaagaaggcuuccaucuguaaucgcaguag

SEQ ID NO: 76594 - RNA, 46 nt, Mus musculus
agcacauacaaagcucucauagguagaaccccacccaguacuggag

SEQ ID NO: 76595 - RNA, 45 nt, Mus musculus
cuaacuccaaauacaacggauugcuagggacuuaaagcagauguc

SEQ ID NO: 76596 - RNA, 46 nt, Mus musculus
aacaggcugaaaugacgccugggaugguaaggaaaaugcugaagga

SEQ ID NO: 76597 - RNA, 85 nt, Mus musculus
uaugggugagauauggcugcuguuacgugauuuggggcgaguuuuagacggaauuaauaaugauaguguagcuugaggcuagggg

SEQ ID NO: 76598 - RNA, 42 nt, Mus musculus
ugccgaaagcuccgggagaccggccagagguucgagaguuuu

SEQ ID NO: 76599 - RNA, 56 nt, Mus musculus
ggcucagguaggagaaggacggaggaggggaggcagucggggagaagguggcuggc

SEQ ID NO: 76600 - RNA, 46 nt, Mus musculus
ucgggguaaggggagggcccugagggaggggucagacuccuuagga

SEQ ID NO: 76601 - RNA, 46 nt, Mus musculus
aaugccuagagauaugauacaugaauguagcauuaggcccggaacc

SEQ ID NO: 76602 - RNA, 46 nt, Mus musculus
gguuggggaauggccaucauuguuagcauuaugaauguugggagac

SEQ ID NO: 76603 - RNA, 50 nt, Mus musculus
cugcucaccuccugcauagcagcacagccccaugaggccgcacaccagau

SEQ ID NO: 76604 - RNA, 60 nt, Mus musculus
augacuucugagcccacauguggaggcaguuggggguggagagcaggagagcagugagag

SEQ ID NO: 76605 - RNA, 42 nt, Mus musculus
uaggccuugggacuucccccacauccacuauuccggagauuc

SEQ ID NO: 76606 - RNA, 46 nt, Mus musculus
uuauauauuccgguuguuaaaaaagaaaauagagggggcuggagag

SEQ ID NO: 76607 - RNA, 46 nt, Mus musculus
acucuagggagugcuagaagucaaaaagguuggggaggcccucuga

SEQ ID NO: 76608 - RNA, 46 nt, Mus musculus
acaugaaaaccuugucuugagauagguaugucucaggcuggcaggu

SEQ ID NO: 76609 - RNA, 45 nt, Mus musculus
ugugagagagagagagagagagugcaugggagagugggugagaga

SEQ ID NO: 76610 - RNA, 42 nt, Mus musculus
gcauagcugccuuccaaagugaguacaggauagccagggcuu

SEQ ID NO: 76611 - RNA, 46 nt, Mus musculus
caccauggccaagugccuugagaagcaucaccuuuaaucuccaguu

SEQ ID NO: 76612 - RNA, 45 nt, Mus musculus
ccuccacaagugguucauauuaaagauguugcaaaugcugcuaga

SEQ ID NO: 76613 - RNA, 45 nt, Mus musculus
agagagagaaagagaagacagcuacaguguacucaugaaucagag

SEQ ID NO: 76614 - RNA, 44 nt, Mus musculus
agagagagagagagaagacagcuacaguguacucacgaaucaga

SEQ ID NO: 76615 - RNA, 45 nt, Mus musculus
ggaagaccgguccuaaauccaaucagaaagcaguaguuaccacua

SEQ ID NO: 76616 - RNA, 46 nt, Mus musculus
agauaauaagcacaauccugaaauggauccaauaauucagcuagau

SEQ ID NO: 76617 - RNA, 46 nt, Mus musculus
uccugcauggaauuuacuccuauugcggagccaaaauagaccagug

SEQ ID NO: 76618 - RNA, 46 nt, Mus musculus
aguuauauuuuuauuaacccuuugagucagugggcaagaggcaggu

SEQ ID NO: 76619 - RNA, 46 nt, Mus musculus
ugagucacaaggaauuagaaauugauuuucuucuugaaccacagag

SEQ ID NO: 76620 - RNA, 46 nt, Mus musculus
acacaccagcucaggacacugguuacacaguuuuuuauccagagua

SEQ ID NO: 76621 - RNA, 42 nt, Mus musculus
agucccuagggcugagucuccacauuugacauuccaucagac

SEQ ID NO: 76622 - RNA, 41 nt, Mus musculus
gcccucugagcccccucucuccaggaaucaaguccccaacc

SEQ ID NO: 76623 - RNA, 46 nt, Mus musculus
uucccuggagugggugaauggcuggugucaccucuugggcuggcag

SEQ ID NO: 76624 - RNA, 45 nt, Mus musculus
uugggacagacuaccgaaaucuggccagcacugccagcccaagag

SEQ ID NO: 76625 - RNA, 45 nt, Mus musculus
gagacgcuugguuagaacuggggaggagcaaggagaugaugucag

SEQ ID NO: 76626 - RNA, 78 nt, Mus musculus
aucgaaagggagcagcugagagccaaacugaaccgagaggagaaccggacccgugcccugaaggaggagguggagagc

SEQ ID NO: 76627 - RNA, 46 nt, Mus musculus
cucucagcugcucccuuucgauaucgaacucagacagcugcuucuc

SEQ ID NO: 76628 - RNA, 46 nt, Mus musculus
agcuagaggaagaguuggcagccgagaggaagcggggccugcagac

SEQ ID NO: 76629 - RNA, 42 nt, Mus musculus
cucggcugccuugcuaguggccuuccugcacucgagcaccag

SEQ ID NO: 76630 - RNA, 64 nt, Mus musculus
gaagaaagacagaggcaugcacaggacacugcugaaggagaugaugucaccuacaugcuggaga

SEQ ID NO: 76631 - RNA, 41 nt, Mus musculus
gguggugugugugugugugugugugugugugugugacaaau

SEQ ID NO: 76632 - RNA, 44 nt, Mus musculus
gggucagacacacugccauguguguucuagacgacauagccugg

SEQ ID NO: 76633 - RNA, 44 nt, Mus musculus
ucagagagauuuugaaacacugaaggagaaaaaugauagugaga

SEQ ID NO: 76634 - RNA, 46 nt, Mus musculus
ggaacaacuggugacucggauguuaguuuugccaagaagcugccug

SEQ ID NO: 76635 - RNA, 46 nt, Mus musculus
ugcggcuggagcagccucagugggaguggucuugccuagcauuaua

SEQ ID NO: 76636 - RNA, 45 nt, Mus musculus
aacuuucagugaacauuuugucuuagcauccuuucuugcugaggu

SEQ ID NO: 76637 - RNA, 46 nt, Mus musculus
uccagagccucugucguacucaccgcuauaugugucacaugaagaa

SEQ ID NO: 76638 - RNA, 45 nt, Mus musculus
cugagcaucuccccagccuucuuucccuugcuuccuuguguacuc

SEQ ID NO: 76639 - RNA, 42 nt, Mus musculus
gguuugaucuuuugcuauauauuguaaugcuaagugggaggu

SEQ ID NO: 76640 - RNA, 42 nt, Mus musculus
gauggggauguaggcagaguggauuaaaacggcacaaagaag

SEQ ID NO: 76641 - RNA, 41 nt, Mus musculus
guuggcugguugguugguuggcugguuggcugguugguugg

SEQ ID NO: 76642 - RNA, 41 nt, Mus musculus; identical to SEQ ID NO: 76641

SEQ ID NO: 76643 - RNA, 48 nt, Mus musculus
gguugguugguuggcugguugguugguuggcugguuggcugguugguu

SEQ ID NO: 76644 - RNA, 41 nt, Mus musculus; identical to SEQ ID NO: 76641

SEQ ID NO: 76645 - RNA, 41 nt, Mus musculus; identical to SEQ ID NO: 76641

SEQ ID NO: 76646 - RNA, 42 nt, Mus musculus
cugccucucugccucucugccucucugccucugccccucugc

SEQ ID NO: 76647 - RNA, 24 nt, Mus musculus
aaguguguggagugaguaaggacu

SEQ ID NO: 76648 - RNA, 46 nt, Mus musculus
ucaaaccccagcaaccacaugauggcucacaaccauccgaaaugag

SEQ ID NO: 76649 - RNA, 46 nt, Mus musculus
agacaggguuucucuguguagccuuggcugucuuggaacuguguag

SEQ ID NO: 76650 - RNA, 45 nt, Mus musculus
cucuauagacgaagauggucucaaacucagagaucugccugccuc

SEQ ID NO: 76651 - RNA, 42 nt, Mus musculus
ucuaagacuucguaccugaggaccaaagugcagccaccaauu

SEQ ID NO: 76652 - RNA, 45 nt, Mus musculus
acacauacaacccacaacaugaaagaugugaaacugacgagagaa

SEQ ID NO: 76653 - RNA, 44 nt, Mus musculus
uauguggccuuaguuuuucagggcauugcaguacaugugacauu

SEQ ID NO: 76654 - RNA, 47 nt, Mus musculus
agggcacagcaacacauuucccaggcaaaaucaucaaaguaguuaag

SEQ ID NO: 76655 - RNA, 45 nt, Mus musculus
aguuaugagguagcaacgaaauaauucuguggcugggggccacca

SEQ ID NO: 76656 - RNA, 83 nt, Mus musculus
uuaauguacacaccccuuucugcucucuggaggggaggcaagaggcucuccuuugagacuaccuacuaguccaagugaaagag

SEQ ID NO: 76657 - RNA, 45 nt, Mus musculus
ccauaccgacaaucccaauuuuugugcuuuuauuuacucccaguu

SEQ ID NO: 76658 - RNA, 45 nt, Mus musculus
cucucacuacauaucuggaaacaaucauggaacagaucugcagcc

SEQ ID NO: 76659 - RNA, 48 nt, Mus musculus
ucuagggggcugcagaucuguuccaugauuguuuccagauauguagug

SEQ ID NO: 76660 - RNA, 46 nt, Mus musculus
ccaaaauuuaaagcauuaaaauaaaagguacuuuucaguuucagag

SEQ ID NO: 76661 - RNA, 45 nt, Mus musculus
gaauacaggaucuggggaggcuguaggagcaaucacaggcugggg

SEQ ID NO: 76662 - RNA, 46 nt, Mus musculus
ucuucccaucccccagccugugauugcuccuacagccuccccagau

SEQ ID NO: 76663 - RNA, 42 nt, Mus musculus
ugagggaugggcgagggggagaaaaaaagacgaaacccagac

SEQ ID NO: 76664 - RNA, 45 nt, Mus musculus
aaaucuuauacagaacccuaguucuggacccacgcuugccagcag

SEQ ID NO: 76665 - RNA, 42 nt, Mus musculus
ucccugcgaauucagacauccuuucccacaucugucccugcu

SEQ ID NO: 76666 - RNA, 47 nt, Mus musculus
auccaauauaggggugggggcugcagccuagaaaacgguacccacca

SEQ ID NO: 76667 - RNA, 41 nt, Mus musculus
ccuccuuggggaaucccgggaucuggaggcggcggccccgc

SEQ ID NO: 76668 - RNA, 46 nt, Mus musculus
cauuuuggaggaacuugagaggacuugaggcuuucuacugggacac

SEQ ID NO: 76669 - RNA, 45 nt, Mus musculus
aacaacugcaaguuuuucugauacuuaccaggauuaugaggagua

SEQ ID NO: 76670 - RNA, 46 nt, Mus musculus
aaggacuucuucccagagcaaagguaauaagucuuacuuggaaggc

SEQ ID NO: 76671 - RNA, 49 nt, Mus musculus
uguaaaucucgaugugccguuagacugggagacuuacaugcaucggauu

SEQ ID NO: 76672 - RNA, 46 nt, Mus musculus
cugcgaguaagcagauguuggcaguaucugcuacuuacccugaagu

SEQ ID NO: 76673 - RNA, 45 nt, Mus musculus
cucaucucuuaaaauguaguguauugcaacaaauggauguaccac

SEQ ID NO: 76674 - RNA, 46 nt, Mus musculus
cauaauaauuuauaguugggaaaaucagaaagagagagagagagag

SEQ ID NO: 76675 - RNA, 46 nt, Mus musculus
gacaaacuaguaacucuuccagauggugaguuugaagaggccggac

SEQ ID NO: 76676 - RNA, 46 nt, Mus musculus
gaaauuuguacuugcugagcaacauguaaagguguccuguuaagag

SEQ ID NO: 76677 - RNA, 46 nt, Mus musculus
uuugcaagugaagauaucaguggcccccucucauaagaggccucag

SEQ ID NO: 76678 - RNA, 43 nt, Mus musculus
agggcugcuaauucuuugcaggaguggcagacacaggcaccag

SEQ ID NO: 76679 - RNA, 73 nt, Mus musculus
uccuccagaauuauuugugaaaaagaaacuccgcucacggccuuuuugccuuuagguuaaguacugacaagaa

SEQ ID NO: 76680 - RNA, 46 nt, Mus musculus
agagcugacaucagaugucaagaggccauuuugugcacagccacug

SEQ ID NO: 76681 - RNA, 41 nt, Mus musculus
uuuccuaaacaacacaggaccaccuguccuggggugccagu

SEQ ID NO: 76682 - RNA, 45 nt, Mus musculus
agucugcugccccccccauaacuuaaacucgaauuauacucugua

SEQ ID NO: 76683 - RNA, 46 nt, Mus musculus
caguaucuucaaggcaggagcauagaaguguccaggcagguauggu

SEQ ID NO: 76684 - RNA, 45 nt, Mus musculus
uucuacaucuucaucugaaggcugcuaggaaaagacuggcaucca

SEQ ID NO: 76685 - RNA, 46 nt, Mus musculus
cagggaauggggguguggccuuguuggaguagguguggguuguuua

SEQ ID NO: 76686 - RNA, 46 nt, Mus musculus
ggguggggaggacuaauuuauagacacauuuauaagcagcagccaa

SEQ ID NO: 76687 - RNA, 42 nt, Mus musculus
cuguuauugagcacccauuucacagcucucagagacagacau

SEQ ID NO: 76688 - RNA, 46 nt, Mus musculus
uuaaggucagguguugguggugcucgccuuuaaucccagcacacgg

SEQ ID NO: 76689 - RNA, 46 nt, Mus musculus
uuuguguugaaaguuuagaaauguagacugacucaccuguccaguc

SEQ ID NO: 76690 - RNA, 46 nt, Mus musculus
cccccuugaagacaugcuagucuugccuuucuugccuuugauguga

SEQ ID NO: 76691 - RNA, 45 nt, Mus musculus
cacaaauuuacauuuuaaauagguauuuuaaauauauugugacug

SEQ ID NO: 76692 - RNA, 84 nt, Mus musculus
acaauauacauggugcaaaaauguaauacuuuagauauuggaaaaccaggaaauugaaaagagguuauuuuuugcuaaaggaca

SEQ ID NO: 76693 - RNA, 87 nt, Mus musculus
cuggaagaacagcaaaaugccuuuaacugcuuagccaucucuccuucccugccucccaaauuuaacugaaaccacuuaggucuauug

SEQ ID NO: 76694 - RNA, 36 nt, Mus musculus
accaaguucaauauaauugcuccaaauaaaauaaga

SEQ ID NO: 76695 - RNA, 45 nt, Mus musculus
augcuaauuggcucaggagaaaagaccagguaaaaauguagaaga

SEQ ID NO: 76696 - RNA, 26 nt, Mus musculus
aaaagggaagaaagcaagagagugac

SEQ ID NO: 76697 - RNA, 46 nt, Mus musculus
ugacuaacucaacaggaaaauugcuuagcauuaaguaccaguagaa

SEQ ID NO: 76698 - RNA, 46 nt, Mus musculus
uaggccauaaggagugggaaugugguggcuaaaggagcaagcaggu

SEQ ID NO: 76699 - RNA, 46 nt, Mus musculus
ucaaaucccagcaaccacauggaggcucacaaccaucuguaacaag

SEQ ID NO: 76700 - RNA, 56 nt, Mus musculus
ucuuguuacagaugguugugagccuccaugugguugcugggauuugaacuccggac

SEQ ID NO: 76701 - RNA, 45 nt, Mus musculus
aguuccuaguuauggacaguggaaacacuauagcagucaguaagg

SEQ ID NO: 76702 - RNA, 42 nt, Mus musculus
ucugcauuccaaagaacugaguuaaucugaaagccaacauuu

SEQ ID NO: 76703 - RNA, 46 nt, Mus musculus
agccauauuauuaaauaaaauuggauuucauacuaguuauagagaa

SEQ ID NO: 76704 - RNA, 45 nt, Mus musculus
guuuaugcugguagauaacauccagaauuccaccuuagcaccaag

SEQ ID NO: 76705 - RNA, 46 nt, Mus musculus
guuauaguuccagugaggagacuagaaggaauggaagacaagcgag

SEQ ID NO: 76706 - RNA, 46 nt, Mus musculus
gaaugcugagucagagugaagcuggcuggguggugugguuggaggg

SEQ ID NO: 76707 - RNA, 46 nt, Mus musculus
cuagucuuggcuuuugcaaaccuuuuaaaccacaauagagccauuu

SEQ ID NO: 76708 - RNA, 46 nt, Mus musculus
aauugagaugcuaauaucuuuaaaauucuaauugagauccagagcc

SEQ ID NO: 76709 - RNA, 29 nt, Mus musculus
uaagaaacaggugacuaaucugagcuagg

SEQ ID NO: 76710 - RNA, 46 nt, Mus musculus
gauucuugauuugauuagugaccucucaguuaaguuucuuggggac

SEQ ID NO: 76711 - RNA, 46 nt, Mus musculus
aacaaccauggugucugaagccaaaggugcagaauugcuggcuucc

SEQ ID NO: 76712 - RNA, 46 nt, Mus musculus
ugaaaccgucacggugcaugcacauccaaggcauguggaaccacag

SEQ ID NO: 76713 - RNA, 43 nt, Mus musculus
aacuaaacccaucacugcauaacucugguaagaagccccugga

SEQ ID NO: 76714 - RNA, 26 nt, Mus musculus
auucagggaggccagcggaggauuuu

SEQ ID NO: 76715 - RNA, 46 nt, Mus musculus
uucugcuuugaugaagaagugcuggcacugggugcauugccaucag

SEQ ID NO: 76716 - RNA, 46 nt, Mus musculus
gcagccuucgcuuccuuggcuggucccugcugcugggcaagucccg

SEQ ID NO: 76717 - RNA, 42 nt, Mus musculus
ccccgccuccaccccgggagcugcugcgcgacucgcccccgc

SEQ ID NO: 76718 - RNA, 46 nt, Mus musculus
gggaucgcugcguucgccgugcuagaaguaccguuacagggcagag

SEQ ID NO: 76719 - RNA, 42 nt, Mus musculus
gauaaaagcgcuguccaucacucacuuaaaggaguaggccca

SEQ ID NO: 76720 - RNA, 42 nt, Mus musculus
ccggacaguccagccgacaccaucuuaguuagcugccugaaa

SEQ ID NO: 76721 - RNA, 85 nt, Mus musculus
ccaguggacaauugccugcagagcguauugggccagcggguagaucuuccugaggacuuccagaugaacuaugaccuauggcuag

SEQ ID NO: 76722 - RNA, 102 nt, Mus musculus
cggccaugggacuuccaggcagaggagugugcucuccgugccaacauugaacgcuucaaugcccggcgcuaugaccggacccacagcaacccugacuucuug

SEQ ID NO: 76723 - RNA, 49 nt, Mus musculus
auccugaaguucuucaaucaaaacaucauguccuacaucacugccaaga

SEQ ID NO: 76724 - RNA, 46 nt, Mus musculus
gaggguucugaagcccaucuccucuguggacaccugggaaggaggu

SEQ ID NO: 76725 - RNA, 46 nt, Mus musculus
ggccaaagcuuagggagaguuuggaaaagaaaagaaguucaguuuu

SEQ ID NO: 76726 - RNA, 88 nt, Mus musculus
ugaagauccuacuggcagcagcucccacaucgaaagccaaaacagacuccaucaacauccuggcagauguucugcccgaggagaugcc

SEQ ID NO: 76727 - RNA, 49 nt, Mus musculus
caaguuccugcagaaacccucuaucaaggcuugcuccccagccugccuc

SEQ ID NO: 76728 - RNA, 46 nt, Mus musculus
gauuccgggugacauucuugggaugucauauguuucagagccuccu

SEQ ID NO: 76729 - RNA, 46 nt, Mus musculus
guuuccuaccuguaaaagaagaccagcgcuagacuaaggccgucuc

SEQ ID NO: 76730 - RNA, 42 nt, Mus musculus
ccucucucaggggugaguuaagagaccacaaaguccccaacu

SEQ ID NO: 76731 - RNA, 23 nt, Mus musculus
ggggugaggggaaauucccagag

SEQ ID NO: 76732 - RNA, 46 nt, Mus musculus
gaaaauaauauaauaaagacaaagaugagaaaauaaaguuguagag

SEQ ID NO: 76733 - RNA, 46 nt, Mus musculus
agaccacuuaugugagaggacucaugcuaugagaaugaccccagga

SEQ ID NO: 76734 - RNA, 46 nt, Mus musculus
aggugacuuuccuagauaugaccuaccauuuuugcauggccuauga

SEQ ID NO: 76735 - RNA, 42 nt, Mus musculus
caaacagacaacuacaucaagcguuuuacauaggugcugggg

SEQ ID NO: 76736 - RNA, 46 nt, Mus musculus
cuguccuguccucuccuguccuuugaguccccucaugagccuguug

SEQ ID NO: 76737 - RNA, 27 nt, Mus musculus
uuugugggugccugguuacaucggagc

SEQ ID NO: 76738 - RNA, 50 nt, Mus musculus
aacaaggcauucucuaccccuccaccuuaaacauauauuauuaaagacag

SEQ ID NO: 76739 - RNA, 94 nt, Mus musculus
ggagagaggaaggggaggcagagacaaaggccacaggcagagcuaugaaugagaaugggucuugaaaauaugugugcaccccuaagcuugaaau

SEQ ID NO: 76740 - RNA, 64 nt, Mus musculus
ucagagcuggucuuugggcuguguuccuugcccagguuucugcaucuugcacuuugacauuccc

SEQ ID NO: 76741 - RNA, 46 nt, Mus musculus
ugugaauacugaaccugccugcugaacagccugucccauccauccc

SEQ ID NO: 76742 - RNA, 25 nt, Mus musculus
cuccugcccacagccccugccagag

SEQ ID NO: 76743 - RNA, 42 nt, Mus musculus
agcuguuuucaggucugaaucaccaacuaaccccggccagau

SEQ ID NO: 76744 - RNA, 90 nt, Mus musculus
auauauugucauauguugagcuuguagucuauuaaaaaccccaguucuauuuccugugaaccuuuguccaguagaccgucgccaucccau

SEQ ID NO: 76745 - RNA, 46 nt, Mus musculus
ccaagguuauugcugccucccugauuuaggaucauugugccauaga

SEQ ID NO: 76746 - RNA, 46 nt, Mus musculus
gagccaucgagacccucagacauuggauucuucuguggggcgacca

SEQ ID NO: 76747 - RNA, 42 nt, Mus musculus
ggaacucaggaggcagagaggcagagagagaggcagagagag

SEQ ID NO: 76748 - RNA, 68 nt, Mus musculus
aaaagccaguggauauaacagacaggccguugacagaggugaacccuaugagacccauuggccagaca

SEQ ID NO: 76749 - RNA, 51 nt, Mus musculus
uuuucccccuccacgccuguagggggcagcauccaggcagagacugacaga

SEQ ID NO: 76750 - RNA, 48 nt, Mus musculus
uugaaucuucacugggcacuaacuggguccuagaagaagcuucuggag

SEQ ID NO: 76751 - RNA, 54 nt, Mus musculus
gcgaccacccaggaguaccugccagacccucgagucaacagagcaaccaaacca

SEQ ID NO: 76752 - RNA, 58 nt, Mus musculus
guacccuaaagccaccccuagcagugacccggccucugccuccccucaccagcccccc

SEQ ID NO: 76753 - RNA, 42 nt, Mus musculus
ccccagggcccuugcauccucuaucaucucuggccccacuuc

SEQ ID NO: 76754 - RNA, 51 nt, Mus musculus
agaugagaccaugcgcuuuaaagacaacacccccaaugcuaacgccaccga

SEQ ID NO: 76755 - RNA, 45 nt, Mus musculus
ggggcguuguuucuuugcccuuagugggacauggggguagcuagg

SEQ ID NO: 76756 - RNA, 45 nt, Mus musculus
auccacagcaaguggguuugcuucagaagagaaugagagggaaaa

SEQ ID NO: 76757 - RNA, 44 nt, Mus musculus
aggaccugugcugagcaaccuguuggcagagagagagagagaga

SEQ ID NO: 76758 - RNA, 41 nt, Mus musculus
gggaagggagucggcggcucagugggccucugggguguagu

SEQ ID NO: 76759 - RNA, 25 nt, Mus musculus
cgggggagggcgguggagcccgggu

SEQ ID NO: 76760 - RNA, 45 nt, Mus musculus
acagcuauguugccucccuagaauuaaaguaauuuaaucuggagu

SEQ ID NO: 76761 - RNA, 42 nt, Mus musculus
ggacuagaaacuuuggauuagggugugagucgugccccauag

SEQ ID NO: 76762 - RNA, 46 nt, Mus musculus
uagcuucucuuccauggagaagaauucauuccaugagcuuugagcc

SEQ ID NO: 76763 - RNA, 46 nt, Mus musculus
ggggauacagcgauggacugugggcggcuaacuuuauacuggacgc

SEQ ID NO: 76764 - RNA, 45 nt, Mus musculus
uuccucuacccacaguccuggggaccccauagguaggcuggagau

SEQ ID NO: 76765 - RNA, 44 nt, Mus musculus
ggaguuuacugauaccagcuaugaggagaaacgguacaucugug

SEQ ID NO: 76766 - RNA, 44 nt, Mus musculus
acacugaagaagaaaagauacgaguagacaucauggagaaccag

SEQ ID NO: 76767 - RNA, 44 nt, Mus musculus
gguauggcggccggggugcuguuccgcaccuucuccugucucag

SEQ ID NO: 76768 - RNA, 58 nt, Mus musculus
caguuagcuggggucuggaggacgacgagggcaugacacuuacaagauggacaggcau

SEQ ID NO: 76769 - RNA, 53 nt, Mus musculus
gauaauugggccuccacgaacaaucuaugaaaaccgaauauacagccuuaaga

SEQ ID NO: 76770 - RNA, 52 nt, Mus musculus
aauaugagcggcgugagcaguucgaauggagugguggauccgagagccacgg

SEQ ID NO: 76771 - RNA, 65 nt, Mus musculus
auuagucaccaaggccccggccuccccuccccauccaacccaagucuucauuuuccacaguagug

SEQ ID NO: 76772 - RNA, 42 nt, Mus musculus
uggccucauggucucgcuguccacagaugaucccuugcaguu

SEQ ID NO: 76773 - RNA, 45 nt, Mus musculus
ugcccaggcccccguccugcaguaccuguauuaccuggcucagau

SEQ ID NO: 76774 - RNA, 47 nt, Mus musculus
gccccuuaugaguucccagaggaaagccccaucgagcagcuagaaga

SEQ ID NO: 76775 - RNA, 42 nt, Mus musculus
cugggggccucuccgcuacagucugcccgaucccugccaggc

SEQ ID NO: 76776 - RNA, 42 nt, Mus musculus
uguacacguguaucccuuuuuggaaaauagucauaggcagau

SEQ ID NO: 76777 - RNA, 59 nt, Mus musculus
ccuuaguguaaccacuaguccugacugagugucuggugugugugugugagugugugugu

SEQ ID NO: 76778 - RNA, 46 nt, Mus musculus
acucaggcuagacuugccuuuacuuauucuuuccaagacccuagau

SEQ ID NO: 76779 - RNA, 25 nt, Mus musculus
aauggaguggggagggugugggacu

SEQ ID NO: 76780 - RNA, 58 nt, Mus musculus
gcuuccugcaucagucacucccgcugggggcggggcggaggaagggguuggauguggg

SEQ ID NO: 76781 - RNA, 46 nt, Mus musculus
ccggcccuagccaccaucagacagggcacucuaaagacuggagugg

SEQ ID NO: 76782 - RNA, 23 nt, Mus musculus
gggcagagugguccugggcaucu

SEQ ID NO: 76783 - RNA, 45 nt, Mus musculus
cagggaaagggggaacagaagauauuucuccucuagugccuaaaa

SEQ ID NO: 76784 - RNA, 46 nt, Mus musculus
cuuuuuauaacuuuauauuauuuuuuuuaagaaaaaaaaaaaacuc

SEQ ID NO: 76785 - RNA, 44 nt, Mus musculus
gaccucuuaggacauugucagucuggaggucauaugggcuaaag

SEQ ID NO: 76786 - RNA, 45 nt, Mus musculus
guggggaucugggagggcauuugucugggaugccacagaguagaa

SEQ ID NO: 76787 - RNA, 46 nt, Mus musculus
cucuguucugucauuccccacacuugaauuuaagggacuuaaaaga

SEQ ID NO: 76788 - RNA, 46 nt, Mus musculus
uucggggugacaacaagcaucacaccccugaagaaguuugcaagug

SEQ ID NO: 76789 - RNA, 41 nt, Mus musculus
guggguggagcgggccgaccugccugcggcagacggugagu

SEQ ID NO: 76790 - RNA, 48 nt, Mus musculus
aaaguccagaaugaugggggaagggaguuggaggaggagggagaggag

SEQ ID NO: 76791 - RNA, 46 nt, Mus musculus
uggcucacaaccaucuguaauaggauuugaagacagcuacagugua

SEQ ID NO: 76792 - RNA, 45 nt, Mus musculus
cuuguuuaguaacuaaacucuaauaagcuuccuucaaggcacaga

SEQ ID NO: 76793 - RNA, 45 nt, Mus musculus
cggcccggagggaaagcguggggcuuucuauucacauugcggggg

SEQ ID NO: 76794 - RNA, 67 nt, Mus musculus
cagauagcacaagauguucacacuaaagagagagaagguggcuuuuuauauguuauguuuuauaccc

SEQ ID NO: 76795 - RNA, 46 nt, Mus musculus
caccuucucucucuuuagugugaacaucuugugcuaucuguggcca

SEQ ID NO: 76796 - RNA, 42 nt, Mus musculus
uauacacacugcccacacagggcccgcucacacuggcugcag

SEQ ID NO: 76797 - RNA, 41 nt, Mus musculus
aagggguucgggccuauagagaucacauaucgagcgaagau

SEQ ID NO: 76798 - RNA, 41 nt, Mus musculus
gcuuccugguagguaccagcguugguggacccggcguucua

SEQ ID NO: 76799 - RNA, 46 nt, Mus musculus
aggcaugguggugguaaagcaggaucagcacgugucccugaaacua

SEQ ID NO: 76800 - RNA, 45 nt, Mus musculus
aaauggauaaauaggcugguaccugucagauggagacagcccucc

SEQ ID NO: 76801 - RNA, 46 nt, Mus musculus
ucuagucuauccuaggagugugggggugguuugcagggcaugccuc

SEQ ID NO: 76802 - RNA, 44 nt, Mus musculus
ggugcaaggcccaggcuccucagauggacgguucgucgcugcug

SEQ ID NO: 76803 - RNA, 46 nt, Mus musculus
caggguuaaugcaggaaguuaaagaagagaaaucuggagaggcagg

SEQ ID NO: 76804 - RNA, 42 nt, Mus musculus
cggguaauauggggagggcacccaggggaaggagggaggcag

SEQ ID NO: 76805 - RNA, 42 nt, Mus musculus
ccuguguggcggauagcccaaagccccgcugggcacucucau

SEQ ID NO: 76806 - RNA, 42 nt, Mus musculus
caauggaacagaggucuguaaccuccgccaccacgcccccaa

SEQ ID NO: 76807 - RNA, 42 nt, Mus musculus
uuaaugugguauaacuccaguacuagguagaguuagcugaag

SEQ ID NO: 76808 - RNA, 41 nt, Mus musculus
aaaugcugcugucgcacacgaucuucuugguggggcagccu

SEQ ID NO: 76809 - RNA, 45 nt, Mus musculus
acggugguggucgauuccccuagagaaaggacaggguuagcuggg

SEQ ID NO: 76810 - RNA, 41 nt, Mus musculus
ccuggggcaucaguaucccuuugcacauugaagaccaccac

SEQ ID NO: 76811 - RNA, 41 nt, Mus musculus
caggaggagggaacaccaucagaaaaaaguacugagaagag

SEQ ID NO: 76812 - RNA, 57 nt, Mus musculus
ugagcaccaggaggagagagcaccaggagaagggagcacgggaggagggagcauagg

SEQ ID NO: 76813 - RNA, 46 nt, Mus musculus
agacaaagacccaggaaaagagccagcaguggaggaaacgugggag

SEQ ID NO: 76814 - RNA, 46 nt, Mus musculus
caaggcugauuauuuuuguaauuggaggaauuacguacucugagau

SEQ ID NO: 76815 - RNA, 42 nt, Mus musculus
guuagauugcuucguuauugcuuccaaaggugaguuugagau

SEQ ID NO: 76816 - RNA, 88 nt, Mus musculus
aaggaaccacugaagaaaaucuggacagacugauccacaauguaaagauagaagaugauagugauaugauucguaacuggagccaccu

SEQ ID NO: 76817 - RNA, 46 nt, Mus musculus
caucuuaacuuagcugaagacugcaugaauaaguuuaagcugaaua

SEQ ID NO: 76818 - RNA, 46 nt, Mus musculus
cauaacuuaguuacucccauuaaaauguaguuguuaaaggccauug

SEQ ID NO: 76819 - RNA, 41 nt, Mus musculus
uguguguguguguguguguccuucugucugucugugucugu

SEQ ID NO: 76820 - RNA, 46 nt, Mus musculus
aacauagccauuuuaucuuuagcuaucuuagcuaagaccacauagg

SEQ ID NO: 76821 - RNA, 46 nt, Mus musculus
cuguguguagguacacaugugccccuccuugcaugaggagugaguu

SEQ ID NO: 76822 - RNA, 44 nt, Mus musculus
aggguaaaugcagguacgcaugugccuccuccaugcauguggag

SEQ ID NO: 76823 - RNA, 46 nt, Mus musculus
gcauguguuugugugugugugagagacagagagaagcggggaaggg

SEQ ID NO: 76824 - RNA, 41 nt, Mus musculus
gcguguagacagacuaugaaaugacugacaaugggggcaga

SEQ ID NO: 76825 - RNA, 46 nt, Mus musculus
ccaagguugggaccuggggaaugccagcacauaaguguggccagag

SEQ ID NO: 76826 - RNA, 23 nt, Mus musculus
auacaauuugacaugguagcaau

SEQ ID NO: 76827 - RNA, 46 nt, Mus musculus
uaaaauucauccuucagcacaauaaauauauaaguuuaguguagau

SEQ ID NO: 76828 - RNA, 31 nt, Mus musculus
ucagggugugagugcucgcucggauggagau

SEQ ID NO: 76829 - RNA, 92 nt, Mus musculus
aucuaagucccacaugauugauaaagcauccagccacacucuuaaggucaggcugccagagagaggcagucuggugaaaggaagaaaacauc

SEQ ID NO: 76830 - RNA, 46 nt, Mus musculus
gaggcccugcucuuugggagcacugugaagaaccauauugugagau

SEQ ID NO: 76831 - RNA, 42 nt, Mus musculus
gugugugugugugugugugucccugugugucccuggguuugu

SEQ ID NO: 76832 - RNA, 46 nt, Mus musculus
uuuguuguuuuucuaaaguacacaaauaaacagccaggugacagau

SEQ ID NO: 76833 - RNA, 91 nt, Mus musculus
gguaugguuauaaaccauggguuauguuucaggaaggugacuaaugggugugaagaauugagauuguagguagaaaacagcaaagccagau

SEQ ID NO: 76834 - RNA, 42 nt, Mus musculus
gguagcgguccuaguggguugcuguugggcuagcauguaggc

SEQ ID NO: 76835 - RNA, 23 nt, Mus musculus
cuaaguggugauguugcuguuua

SEQ ID NO: 76836 - RNA, 46 nt, Mus musculus
agaacagugcagaauauggaggccuggcuugugaaauuucagaggg

SEQ ID NO: 76837 - RNA, 41 nt, Mus musculus
uaaucccagcacuugggagaagguuagaauguaaagggaga

SEQ ID NO: 76838 - RNA, 46 nt, Mus musculus
uuaaugucccauuagaaagaugagcagaggaaauuaagaggcagcc

SEQ ID NO: 76839 - RNA, 35 nt, Mus musculus
ugggggaagauggcgccgccgguaucggagcgggg

SEQ ID NO: 76840 - RNA, 46 nt, Mus musculus
auuccuuagugucuaagaaaugaccaaugaaucucguccgccacag

SEQ ID NO: 76841 - RNA, 45 nt, Mus musculus
gcgcucucuugaucucucucugucccuuucucggucacugccucu

SEQ ID NO: 76842 - RNA, 94 nt, Mus musculus
cgggaucuucgccuuucuuucucucucucuuuggcuucccgcucuagucguuggcguucuuucucucucucuaauucucugucaaaacuagaag

SEQ ID NO: 76843 - RNA, 46 nt, Mus musculus
cuugaucuucuuggagaccuccgugggcucagugaucuucuuggag

SEQ ID NO: 76844 - RNA, 46 nt, Mus musculus
cccaacagcucccuagggauaggcaggagguugggguagguuaaag

SEQ ID NO: 76845 - RNA, 46 nt, Mus musculus
uuguuuuuaaagcuuuaucuuuuuauauguaagugucuguguaagu

SEQ ID NO: 76846 - RNA, 42 nt, Mus musculus
ggaagacaccugcgcgcgugcgcacacacacacacaccccug

SEQ ID NO: 76847 - RNA, 46 nt, Mus musculus
uacuaccuugccugaggcuaaacuuuucauggccauaugccucaag

SEQ ID NO: 76848 - RNA, 42 nt, Mus musculus
guaguucacuccagauauagucuaguugaugauagccaggaa

SEQ ID NO: 76849 - RNA, 70 nt, Mus musculus
cauuuuuacacauucuugauguaggcacaccacuuacagcuacaagucuauguuucccucacaggaccuc

SEQ ID NO: 76850 - RNA, 46 nt, Mus musculus
gcuuggcuguaaguguuuguccuccugagucaucucccugccccag

SEQ ID NO: 76851 - RNA, 46 nt, Mus musculus
augaguuuuacuucuggcacacaggucacuccauugacucaaagug

SEQ ID NO: 76852 - RNA, 65 nt, Mus musculus
uauaugugugcacauguguuucagauuugaauaugcugaguuuuuuuauaccuuuauaucaugau

SEQ ID NO: 76853 - RNA, 101 nt, Mus musculus
ggccccuguucgucuugauuuucuacgucaucucccccauccccuacuucauugccaaaagggucacauaugacucugacgcgaccagcagugccuguccg

SEQ ID NO: 76854 - RNA, 46 nt, Mus musculus
uggggcaauugggcugacuuuucuuaugcugggaugugccuuggag

SEQ ID NO: 76855 - RNA, 44 nt, Mus musculus
aaggcacaucccagcauaagaaaagucagcccaauugccccacu

SEQ ID NO: 76856 - RNA, 45 nt, Mus musculus
cugauguugaguucuaguuacccgugaucccaaggugaucccgag

SEQ ID NO: 76857 - RNA, 36 nt, Mus musculus
cuucugccagaauugugguaugggacauggauauga

SEQ ID NO: 76858 - RNA, 46 nt, Mus musculus
augaucaaugauuuuggugaucagaaccagaaguuuggauuugaag

SEQ ID NO: 76859 - RNA, 42 nt, Mus musculus
cuuaugaaaccaacaggaaaaaaaauaccuuggugccaccaa

SEQ ID NO: 76860 - RNA, 45 nt, Mus musculus
uauagaaaacgugcuuaggaaucgcuguugccuacuggaggcaca

SEQ ID NO: 76861 - RNA, 42 nt, Mus musculus
uuucacgguggucaaaucuagacuuucaggaucacacaccaa

SEQ ID NO: 76862 - RNA, 41 nt, Mus musculus
uucagaauguugugugauccauuucaaccaacugggggaga

SEQ ID NO: 76863 - RNA, 44 nt, Mus musculus
aagaauaacgaagucuacuuuauuugaauuauacugggcagaau

SEQ ID NO: 76864 - RNA, 42 nt, Mus musculus
guguguguguguguguguguguguguugggguaugcaugucu

SEQ ID NO: 76865 - RNA, 44 nt, Mus musculus
gaaacgacugggggagggcaugcuagagaagcugugauucauua

SEQ ID NO: 76866 - RNA, 46 nt, Mus musculus
auuuaugaggucuuuaaaggggaacugugcacuuuguugucccaag

SEQ ID NO: 76867 - RNA, 62 nt, Mus musculus
ucuugcaaaauaaacgaucaucccgauggcagguauuaccaaggaagaugcgcaguagagug

SEQ ID NO: 76868 - RNA, 45 nt, Mus musculus
cuuuuacaucaaguguuaaacuucuuaauugugagccaacuucag

SEQ ID NO: 76869 - RNA, 67 nt, Mus musculus
uucaggauuauccauguuucgggcacauuuccacaagugcaggagauaaugacggugucucccucuu

SEQ ID NO: 76870 - RNA, 46 nt, Mus musculus
uuggcagucauugcuaagcuguuugcaaugcuuucugcaugagcug

SEQ ID NO: 76871 - RNA, 45 nt, Mus musculus
cacacgucagaacaaccgaauccccaacuugugcagccaccugag

SEQ ID NO: 76872 - RNA, 64 nt, Mus musculus
caggggucucuuccuuaucagaagagaagggaaggaagaugcagggaggagcuaugugagggug

SEQ ID NO: 76873 - RNA, 45 nt, Mus musculus
ucagucaaaacaaguauguggcaguggaauuccugaguaugugca

SEQ ID NO: 76874 - RNA, 46 nt, Mus musculus
acacacacacacacucacacacacacacacacacacagagagagag

SEQ ID NO: 76875 - RNA, 45 nt, Mus musculus
ucacucacuguguugcagcaugcaugggcuaagucagugcaacaa

SEQ ID NO: 76876 - RNA, 46 nt, Mus musculus
cagaagaggaagaagaugccacuaaggacacuuacgucaucgagug

SEQ ID NO: 76877 - RNA, 47 nt, Mus musculus
uuuaauucucuaaauacauaauucaggaagcaugcucagaaagggua

SEQ ID NO: 76878 - RNA, 47 nt, Mus musculus
gagcagaggcugugaacguucagugcagagggagaagcaggcagagg

SEQ ID NO: 76879 - RNA, 45 nt, Mus musculus
aauacacugucauagucuucagacauaccagaagagggcaucaga

SEQ ID NO: 76880 - RNA, 46 nt, Mus musculus
aggcuuggucccuggccuccugcacgggcuggaugcugacguacag

SEQ ID NO: 76881 - RNA, 46 nt, Mus musculus
ucacacaugucugugugagggagucagaucuccuggaccuugaguu

SEQ ID NO: 76882 - RNA, 46 nt, Mus musculus
uuaccccaaaggggguggugaagugauuguccgaguguccccaguu

SEQ ID NO: 76883 - RNA, 46 nt, Mus musculus
acguguaacuugagaccacagagucggcaucugagguugcagagau

SEQ ID NO: 76884 - RNA, 42 nt, Mus musculus
uccuugacagaaauacuuucauggcaauuucuacauggagau

SEQ ID NO: 76885 - RNA, 45 nt, Mus musculus
cucaaauaguuuugaauuuuauaguuaucuuuaagaauuguguua

SEQ ID NO: 76886 - RNA, 46 nt, Mus musculus
guccugugcauggugacagcaacagcccaggaauaaggggguaggu

SEQ ID NO: 76887 - RNA, 45 nt, Mus musculus
uuuuauuuucaagaacagcaauucauuuuaaaaaucugacuagau

SEQ ID NO: 76888 - RNA, 46 nt, Mus musculus
cggaccuaugguauaagcagacuucuuggcaaaggcaccugugauu

SEQ ID NO: 76889 - RNA, 46 nt, Mus musculus
uugacagaguaagacauuauauuauaaaccuuuugacagcccagaa

SEQ ID NO: 76890 - RNA, 45 nt, Mus musculus
cgaucuccgggcucccaggcccccuacccaaacuccccgcccgcc

SEQ ID NO: 76891 - RNA, 43 nt, Mus musculus
ugcacgcgcaaggguaggcccaggaggcagcucagggcggugg

SEQ ID NO: 76892 - RNA, 41 nt, Mus musculus
ugucauuucuccaccccggugcucucuacagggcggccaga

SEQ ID NO: 76893 - RNA, 41 nt, Mus musculus
gcccgccauggagggccagcggguggagguggacgguggga

SEQ ID NO: 76894 - RNA, 46 nt, Mus musculus
ccauucccgagauauucuguuguacguaucucugucuguuuuauag

SEQ ID NO: 76895 - RNA, 103 nt, Mus musculus
acaaaugcugccauuacuguuacuauuuggaugauaaauucuuguuguaaaugcaaccuuaggugguuugaagggguagucuguaggaaaaugaauugucaaa

SEQ ID NO: 76896 - RNA, 42 nt, Mus musculus
auuaaucaguuucagcgccauagucugcuuuucuccgggcuc

SEQ ID NO: 76897 - RNA, 43 nt, Mus musculus
uugucucuucuucucacaccggcucugccagacacaggugcca

SEQ ID NO: 76898 - RNA, 46 nt, Mus musculus
acugcugauugaccaaggcagacuccaguauuuacagcagaaaggc

SEQ ID NO: 76899 - RNA, 46 nt, Mus musculus
uuaaaauaauuuuauugggcaaauaaaucacuagaaaaauuaagau

SEQ ID NO: 76900 - RNA, 43 nt, Mus musculus
uccacucucucaugacagagaagggaaaaaaaaagacagagac

SEQ ID NO: 76901 - RNA, 46 nt, Mus musculus
cagaaaauauauuuuguuagaaaauaguaguuaauagacgugggug

SEQ ID NO: 76902 - RNA, 45 nt, Mus musculus
accuugaggccuuugcgaaugggcugggaauuaugguuaaaagau

SEQ ID NO: 76903 - RNA, 48 nt, Mus musculus
cacaggcacgugcagauaaugguuacaacgguuguguuuaaagagagu

SEQ ID NO: 76904 - RNA, 46 nt, Mus musculus
caugaggcccuggguucaagugcuagaaucauaaaaggaaacagaa

SEQ ID NO: 76905 - RNA, 46 nt, Mus musculus
ucuggggugguuucugacuuaacaggacaugggguauuccucagca

SEQ ID NO: 76906 - RNA, 42 nt, Mus musculus
gcucacaaccauccguaaugagaucugacacccucuccuggu

SEQ ID NO: 76907 - RNA, 46 nt, Mus musculus
auggaagucuauggccugagguagaacgugucagugugacccagga

SEQ ID NO: 76908 - RNA, 46 nt, Mus musculus
agcugugcucuuaccguccuuagaaaagagagcuagauacggaugu

SEQ ID NO: 76909 - RNA, 46 nt, Mus musculus
aaucugugaacagaacuaagcuucgacuagaaauuaagccccagcc

SEQ ID NO: 76910 - RNA, 77 nt, Mus musculus
cuucuauucuaggcaacauugaaaaguuaaaguuacuuggcccaagaagaugcuuuguugaguuuggagcaggaaag

SEQ ID NO: 76911 - RNA, 44 nt, Mus musculus
ugugagcugagcccagacccugagggagcagugagagcugcagu

SEQ ID NO: 76912 - RNA, 46 nt, Mus musculus
gcagagggugauggugugggacggugagagacgggagcauucuuca

SEQ ID NO: 76913 - RNA, 46 nt, Mus musculus
gcacuacugcccagcccucuucuuagucauuuugcgacagauaccc

SEQ ID NO: 76914 - RNA, 100 nt, Mus musculus
aaauucauauuuauguuuggaaacaaaauacaauaauuugguagaaauugauaaguauguucauuugcuucaugauauggaccauuuuacagaauguauc

SEQ ID NO: 76915 - RNA, 100 nt, Mus musculus
aaaacauuuuacuaaccugcuauacacuguuucuaaacucaaacaauagauuuuaaaaauguguguguguguguguguguguguguguguguguucugug

SEQ ID NO: 76916 - RNA, 55 nt, Mus musculus
gcauggggaagaaacuuagaaacaauuuuuguuuguuuguuuagacuuguagauu

SEQ ID NO: 76917 - RNA, 83 nt, Mus musculus
ugcuugaaaaagaucacuagguuuuauuaacuggguucuaauuaauuauaguuauuguuuuugaacgauaaccacuugugaau

SEQ ID NO: 76918 - RNA, 46 nt, Mus musculus
acuaaaagcucccucugcugucucagagacccuuacacucauccuu

SEQ ID NO: 76919 - RNA, 45 nt, Mus musculus
uacacuauuggcugccugugugugugugugugugugugugugugu

SEQ ID NO: 76920 - RNA, 46 nt, Mus musculus
gcuacaguguacuuacauauaauaaauaaauaaaucucaaaaacaa

SEQ ID NO: 76921 - RNA, 42 nt, Mus musculus
ggauuaauucuuuugagagacagaaagagagagagagaaggg

SEQ ID NO: 76922 - RNA, 45 nt, Mus musculus
uacauccagagcuacaggugaaaacuaagaccugggugcugcgag

SEQ ID NO: 76923 - RNA, 46 nt, Mus musculus
gccucuccuggcgcuuguguacugugaggauggcugugacugccac

SEQ ID NO: 76924 - RNA, 46 nt, Mus musculus
augaugugcuggaacaagagauugugcuuacuaucuaaacugacac

SEQ ID NO: 76925 - RNA, 24 nt, Mus musculus
ccgaagaggagcagaugcauuagg

SEQ ID NO: 76926 - RNA, 46 nt, Mus musculus
cuguugauaggucagagaaaccccccaaaaagaagugcugagagag

SEQ ID NO: 76927 - RNA, 45 nt, Mus musculus
agaaagacaggagagagagagagagagagagagagagagaaagag

SEQ ID NO: 76928 - RNA, 42 nt, Mus musculus
uuagugggcuagcagccugacgguguggaggggcagguagau

SEQ ID NO: 76929 - RNA, 45 nt, Mus musculus
gaugaaaguaggagguuucuucaccaggucauucauauauccaga

SEQ ID NO: 76930 - RNA, 46 nt, Mus musculus
ucaaauuuuuauuuugguuugucuauuuaagacacuguagauaggg

SEQ ID NO: 76931 - RNA, 45 nt, Mus musculus
gcucuaaagagacuccgaacauguuccaggcgucagugcugcgcc

SEQ ID NO: 76932 - RNA, 42 nt, Mus musculus
ucaguuagucucagacuaccuggcaggcuugggugggcaucu

SEQ ID NO: 76933 - RNA, 45 nt, Mus musculus
uaggaucuuacguauccuaguuccugucucaaaaggaggaggagg

SEQ ID NO: 76934 - RNA, 41 nt, Mus musculus
aagucauucuuaaaccauucuuaaacuuugaacaugugagc

SEQ ID NO: 76935 - RNA, 46 nt, Mus musculus
cuguuaugcagcugacauauaguauauuacauuugaggcuaguaaa

SEQ ID NO: 76936 - RNA, 42 nt, Mus musculus
gaagcuccauucguuugguucuuuacuguugugaggggagaa

SEQ ID NO: 76937 - RNA, 45 nt, Mus musculus
ucagcugcuuccauucaaaugcugccuuaaaaucgagugccuaaa

SEQ ID NO: 76938 - RNA, 46 nt, Mus musculus
ugugaaccugaaguauuuacgauaagaaaaagaaaacaucucugcu

SEQ ID NO: 76939 - RNA, 35 nt, Mus musculus
uuugggggaggguauuagaguugucaggcugaaag

SEQ ID NO: 76940 - RNA, 41 nt, Mus musculus
accguugagggcuucguuuuagcugaucgucgacugucaga

SEQ ID NO: 76941 - RNA, 46 nt, Mus musculus
cauccugaugcguuguucacuaugugagcugagugcaggcuggauc

SEQ ID NO: 76942 - RNA, 47 nt, Mus musculus
aacauacauagauguuacucuagagaaaagcaguaaaggugcaguaa

SEQ ID NO: 76943 - RNA, 50 nt, Mus musculus
augaaagaaggugaaguucuguacauuauugaggaggacaaaggugaugg

SEQ ID NO: 76944 - RNA, 55 nt, Mus musculus
guaguaguucauguuugguaguauguuguaucuauaacuuuuauuaacauugcag

SEQ ID NO: 76945 - RNA, 46 nt, Mus musculus
ugcuacugacuaucgugccuucuccuguaaugugguggcugcagac

SEQ ID NO: 76946 - RNA, 45 nt, Mus musculus
gccaccccaacaacauggccaccacagugaguuugaugaugaguu

SEQ ID NO: 76947 - RNA, 46 nt, Mus musculus
auugcucuagacauugucaucuuugaaguguuuacuucaggaaagu

SEQ ID NO: 76948 - RNA, 48 nt, Mus musculus
ggcucucugaaguugaaggcaaaacagguauaagaggugacagaagac

SEQ ID NO: 76949 - RNA, 46 nt, Mus musculus
uaaauauuuuauaaacuuuauugcaauagauucgauuuugccagac

SEQ ID NO: 76950 - RNA, 46 nt, Mus musculus
aacaaaaugaaggauguguaugagaaaaauccacagaugggggauc

SEQ ID NO: 76951 - RNA, 53 nt, Mus musculus
uaggacuuaaaaaccuggagacagacacugcagaaucaucugaagaucaaaac

SEQ ID NO: 76952 - RNA, 45 nt, Mus musculus
aggaacuugguuagaaauuguguaagugaaguaauaggauaaggg

SEQ ID NO: 76953 - RNA, 51 nt, Mus musculus
ucaccugcaugccuggugccuguggaggccagcagaccccuggaacuggag

SEQ ID NO: 76954 - RNA, 45 nt, Mus musculus
gcuuucagaaacaccugaggucugucauuugguuucacauaagac

SEQ ID NO: 76955 - RNA, 45 nt, Mus musculus
aagacucugcaccuuuauacuaacuaacauuuaauucaccgagau

SEQ ID NO: 76956 - RNA, 46 nt, Mus musculus
gauauuucaaaguuuacuggauaauauuugaaaacuaaugcuagag

SEQ ID NO: 76957 - RNA, 46 nt, Mus musculus
augucuuaguugccauaguaacugacuagcggcuuagaggacagaa

SEQ ID NO: 76958 - RNA, 58 nt, Mus musculus
uuauugauuccuuucuuuauuuccauauuagccacaguccccacccuuaaccccuacu

SEQ ID NO: 76959 - RNA, 46 nt, Mus musculus
acaaagaugagaauaccggugcuuauuuaagaggaaaugaccugag

SEQ ID NO: 76960 - RNA, 44 nt, Mus musculus
gaaccauuucugacgggaccaucagugcagccaaacaggagagu

SEQ ID NO: 76961 - RNA, 45 nt, Mus musculus
aauuaguuaguguuuuacucuugugaacagauacuaugaccaaga

SEQ ID NO: 76962 - RNA, 42 nt, Mus musculus
uugaaagagaauguagagaagcggagaaagcacagcagaguu

SEQ ID NO: 76963 - RNA, 98 nt, Mus musculus
auacaaacaaggauuccuagacagugaaagaaaauaucaguccagagaccacaauaauauauagaagaaaaaacaacuuagaagaaacagcaacuaug

SEQ ID NO: 76964 - RNA, 91 nt, Mus musculus
uuuuucugaguaauucucagaacacagaucauaaagcauuuuccaggcacagacuuaauagaggcuuucucuggggauucuuacaaacucg

SEQ ID NO: 76965 - RNA, 46 nt, Mus musculus
uaauauaaaacaccuguuuguuacuauucucaauuugugucaaccc

SEQ ID NO: 76966 - RNA, 54 nt, Mus musculus
ucuguauugaaagcagguucugcuguggaagaagagggaauagaugucauuuuc

SEQ ID NO: 76967 - RNA, 46 nt, Mus musculus
uuccuccuaggugccuuugaugagcccauggcaggagacagggaca

SEQ ID NO: 76968 - RNA, 44 nt, Mus musculus
acgaaaagcucaacaauaccuugacauguguuggaaacagaugg

SEQ ID NO: 76969 - RNA, 46 nt, Mus musculus
aauggcgcacagaguauauggugaauuaaugagauaugcccaugau

SEQ ID NO: 76970 - RNA, 46 nt, Mus musculus
aaauuuagaccaggauuuggcuugccuuguuuauucuccagcagaa

SEQ ID NO: 76971 - RNA, 51 nt, Mus musculus
ucuucuagaaaucugguuaagaaguacugucccaaacgcuccuccaaagau

SEQ ID NO: 76972 - RNA, 46 nt, Mus musculus
uccugcugcugcagcucugucuccuccacacagggucgguccagau

SEQ ID NO: 76973 - RNA, 45 nt, Mus musculus
gagauggaggugagccaggcggcgucugguaccgacgguguccgg

SEQ ID NO: 76974 - RNA, 28 nt, Mus musculus
ccuuuucgaccuggccuuguucgucuuc

SEQ ID NO: 76975 - RNA, 45 nt, Mus musculus
cagcugacuucggcaccucuaucuaaccuuuucuucagcccuuga

SEQ ID NO: 76976 - RNA, 43 nt, Mus musculus
cagcuacccguccaguuguucaacuaacaguuuucagccagau

SEQ ID NO: 76977 - RNA, 72 nt, Mus musculus
gccuuccaaaacacagcuugaguccagccucaggaccaaguuuagaagggaguccaugcaugacccaggaaa

SEQ ID NO: 76978 - RNA, 45 nt, Mus musculus
gagcauguuuaccagacaaaugaacacaaaguagaaagaccagau

SEQ ID NO: 76979 - RNA, 45 nt, Mus musculus
gugcuuccaggccucucggccugccaagcaggcuucacuggagug

SEQ ID NO: 76980 - RNA, 45 nt, Mus musculus
gccugacuuacacagaucuggcuuugcaucugcuaccuaaguaau

SEQ ID NO: 76981 - RNA, 42 nt, Mus musculus
uagucacauuccuuugcuuauucccaacaagcuccgcguggc

SEQ ID NO: 76982 - RNA, 46 nt, Mus musculus
guauccuaguuuguaauuccauuuuggagaagguaucauggauguc

SEQ ID NO: 76983 - RNA, 45 nt, Mus musculus
uuuucagugaacauauuaagaugaacagccauaauauggacagua

SEQ ID NO: 76984 - RNA, 41 nt, Mus musculus
aaaggcuuaaugaccauauacgaagaugaaaugaagcaaga

SEQ ID NO: 76985 - RNA, 42 nt, Mus musculus
gaaacccuaaacgucgauagcguuuuuagugagagcgagaag

SEQ ID NO: 76986 - RNA, 71 nt, Mus musculus
aacagaaaaaugcacuuucuucucaacggaaagauuuagaaaagggacagaggaaagauacaggccgacac

SEQ ID NO: 76987 - RNA, 46 nt, Mus musculus
aaguuaagccaugaucaaagagaaaagauaaaagacauuuccagag

SEQ ID NO: 76988 - RNA, 57 nt, Mus musculus
acaaauuucaaacugauauuuccucacuuaaucggagccaaaugcagacaaguggga

SEQ ID NO: 76989 - RNA, 45 nt, Mus musculus
uuauaaaccagauaauucaaaggaaaauggauuugguggucagac

SEQ ID NO: 76990 - RNA, 44 nt, Mus musculus
gaugcacucaggcagguuguccacuggucacauuacagaucggg

SEQ ID NO: 76991 - RNA, 44 nt, Mus musculus
ucugcauuuucugcaaagaugcuuugaugaugcuuccuuggggg

SEQ ID NO: 76992 - RNA, 46 nt, Mus musculus
aucauuauguggauauuuuuucauugcucuuagauaauacccagag

SEQ ID NO: 76993 - RNA, 45 nt, Mus musculus
uguguguguguauguguguguguauguguguguguguguguuugu

SEQ ID NO: 76994 - RNA, 46 nt, Mus musculus
gugcacaugugugugugugugugugugugugugugugugugcgugu

SEQ ID NO: 76995 - RNA, 45 nt, Mus musculus
cauaucauuuagaugccugauucauagguucuaguucuaaagaga

SEQ ID NO: 76996 - RNA, 45 nt, Mus musculus
guugacaguuccauaucaacggcaccuucagucauaaugcuggau

SEQ ID NO: 76997 - RNA, 46 nt, Mus musculus
aauuguauguugcuagagaaacuuacugcacuaaugcauggugaau

SEQ ID NO: 76998 - RNA, 46 nt, Mus musculus
uuucaaucacagacuaacccgucucuugcccuuucacccuggagug

SEQ ID NO: 76999 - RNA, 53 nt, Mus musculus
caucugaaccuaaaucuuuuaagggaaauauugauauccagaugugcuuagau

SEQ ID NO: 77000 - RNA, 41 nt, Mus musculus
aaaaaauaaaaauccgccguguuuuaaugaauugcccagag

SEQ ID NO: 77001 - RNA, 91 nt, Mus musculus
agguaggucugucacagaggagugacaguguuuguaugaacauguggacuuaaacuuggauucuguaaccccagcucuggggguuagaggu

SEQ ID NO: 77002 - RNA, 75 nt, Mus musculus
auaccaaaaacgucugggcaccagaaacauugugagcaagaaaguguugagagcuaggccucagagguaagggga

SEQ ID NO: 77003 - RNA, 53 nt, Mus musculus
gcauguagcauauguuaggugguaaaaguuauaugacuggccaaggaggaaau

SEQ ID NO: 77004 - RNA, 46 nt, Mus musculus
guggaagaggguaaauuucaaguucagggcuguccugaggugagau

SEQ ID NO: 77005 - RNA, 45 nt, Mus musculus
uuuacaaaacacucauuuuguuuuuauuauuuuuagcugagagaa

SEQ ID NO: 77006 - RNA, 45 nt, Mus musculus
cuuauacagaauuguagugcuccuuuuuuuucucccccgccaccu

SEQ ID NO: 77007 - RNA, 46 nt, Mus musculus
cuuccugcaacguuaaauagaaccaccuucaauguaacguauuuuc

SEQ ID NO: 77008 - RNA, 46 nt, Mus musculus
uuauagaccauaaauuuauuuaauacaacagaauaccaccucagau

SEQ ID NO: 77009 - RNA, 71 nt, Mus musculus
uaauguugauagugagugaguccuugcuuuuaauucagcagaugaacauuuaaaguccauugaaacaggag

SEQ ID NO: 77010 - RNA, 46 nt, Mus musculus
guuuuauucauccuuucacccgacaguuucuguucuacucccuuug

SEQ ID NO: 77011 - RNA, 44 nt, Mus musculus
ucacauugucuguagcuuagugcauucucgcuccaguaagcaag

SEQ ID NO: 77012 - RNA, 45 nt, Mus musculus
uucugcaguguucagcucucaauguuggguuugaagggggugugu

SEQ ID NO: 77013 - RNA, 45 nt, Mus musculus
guuuaucaguuucagacucagagaaagggcugggccagcaggaag

SEQ ID NO: 77014 - RNA, 45 nt, Mus musculus
aaaagguuauggcuauaaagaggcuugagagagcuuucaggagau

SEQ ID NO: 77015 - RNA, 45 nt, Mus musculus
aaaaggcuggaguaaucuugcucaucucucucccaugugugaaua

SEQ ID NO: 77016 - RNA, 46 nt, Mus musculus
uaaguugauacauaaaccccagugcaguaguguuaacaggugaggu

SEQ ID NO: 77017 - RNA, 46 nt, Mus musculus
ucaguaugcuggaaugggaaaaggcaaagaucagguggcuagaggu

SEQ ID NO: 77018 - RNA, 45 nt, Mus musculus
aacuuuacuuuuaggcuacauuuagaaggugaggcuuuggagaga

SEQ ID NO: 77019 - RNA, 45 nt, Mus musculus
auugcacaugccaacauuuugaacauagugcgcuaugguaugagg

SEQ ID NO: 77020 - RNA, 45 nt, Mus musculus
cugcuauugucagaagaauuccuaauagauuuucugcgggcaaga

SEQ ID NO: 77021 - RNA, 45 nt, Mus musculus
agcucuacagaggcugacagagaaggcuggguuguauggaccaga

SEQ ID NO: 77022 - RNA, 45 nt, Mus musculus
gaguauggcuucuuuugcuggauauuauucauuaucauucugagu

SEQ ID NO: 77023 - RNA, 46 nt, Mus musculus
aagucuuaaguggaucaaggaauuccacauaaaaccagagacacug

SEQ ID NO: 77024 - RNA, 54 nt, Mus musculus
cagaucagaaucugaggugguugcagucgucaggguagguaacgggagaggcag

SEQ ID NO: 77025 - RNA, 25 nt, Mus musculus
uuacacuugcaucuuuaucacagug

SEQ ID NO: 77026 - RNA, 46 nt, Mus musculus
uuucagugcccccaacucauacuugaccggauguacagaggaaauc

SEQ ID NO: 77027 - RNA, 46 nt, Mus musculus
ugaagauauuuguuggauuaaaaccaauaaaaacaauccuggaaag

SEQ ID NO: 77028 - RNA, 45 nt, Mus musculus
cuggacuagaggacaguaagugugaaccgugggaaggcaggagac

SEQ ID NO: 77029 - RNA, 42 nt, Mus musculus
uucauuaccaccagagauauuucaaaauccuuucccccuuuu

SEQ ID NO: 77030 - RNA, 47 nt, Mus musculus
aaggaugaacuggaaaugcagcaggaggaagagaauuugccauauga

SEQ ID NO: 77031 - RNA, 46 nt, Mus musculus
ggcuuccuaugauacaucugcuccaaacucaaaacggaagugucug

SEQ ID NO: 77032 - RNA, 46 nt, Mus musculus
augaaauauuuucugaaaacacugggcuccuauuuauaaagugggu

SEQ ID NO: 77033 - RNA, 49 nt, Mus musculus
gagugcggauagcauuggugcuguguuaaauagcaaagaugaacagagg

SEQ ID NO: 77034 - RNA, 52 nt, Mus musculus
cgaagcuggggcauggauagccgccugcaggagauccgggagcggcagaagu

SEQ ID NO: 77035 - RNA, 42 nt, Mus musculus
auacauggaguuucacagcccaaaaaucuaguguaaccccag

SEQ ID NO: 77036 - RNA, 45 nt, Mus musculus
aagauaucauccccaccauacaacuacauacucguaggcggaucg

SEQ ID NO: 77037 - RNA, 46 nt, Mus musculus
cugaaccgguucuacaagcgacuguguuuuguauuacugcgaagau

SEQ ID NO: 77038 - RNA, 103 nt, Mus musculus
uacaucuccauuccuuauuccacuuggauuuccucuagcaagaaagcccauucguguguaugggaucaacuguuuauauagucuuuucacacugcagcuuugg

SEQ ID NO: 77039 - RNA, 49 nt, Mus musculus
augcaguugcuuagagacaacuuaacauuauggacaucagacagugcag

SEQ ID NO: 77040 - RNA, 46 nt, Mus musculus
gauccuuaauaauccagagcuugccuacacacuggcuaaaacggcu

SEQ ID NO: 77041 - RNA, 28 nt, Mus musculus
accaagaggcauuugauauaagcaagaa

SEQ ID NO: 77042 - RNA, 42 nt, Mus musculus
aauccagagaguaaggucuucuaucugaaaaugaauggagau

SEQ ID NO: 77043 - RNA, 46 nt, Mus musculus
uuuccggagcuuuacuuccagaaagucaggaagcaagauaucccgg

SEQ ID NO: 77044 - RNA, 46 nt, Mus musculus
uccgaauagaauagacucuccaccaaagaagaaagagaaggcuccu

SEQ ID NO: 77045 - RNA, 41 nt, Mus musculus
guuuaauuuuguaauuagugacugcuagugcuaugccccca

SEQ ID NO: 77046 - RNA, 43 nt, Mus musculus
ugacaccagccgcucuaucaucugaaaugucaaaggccccguu

SEQ ID NO: 77047 - RNA, 44 nt, Mus musculus
cuugcagcuggugggguucuggauauccacuacuuagcccaugg

SEQ ID NO: 77048 - RNA, 46 nt, Mus musculus
uucuuuuuuuuuuuaaauauaaaugcuuuauuuaacaguugcagau

SEQ ID NO: 77049 - RNA, 45 nt, Mus musculus
ccuccuucaacuccagagucucagauuugacgaacauccugagaa

SEQ ID NO: 77050 - RNA, 46 nt, Mus musculus
ggaugacgccgggcuguuggugcagcuccaggaggaagguggagaa

SEQ ID NO: 77051 - RNA, 48 nt, Mus musculus
uggagaccagcucugguuuauugaagaugugaggauuuauggucaaag

SEQ ID NO: 77052 - RNA, 41 nt, Mus musculus
ccgcuccuccuccugccccgagcgcgagcccaggcggagca

SEQ ID NO: 77053 - RNA, 46 nt, Mus musculus
ugugucuaauaaaccugcccugcucaggugcaaauacaggaggggc

SEQ ID NO: 77054 - RNA, 44 nt, Mus musculus
gcucuggcaagggcagagaaacacagcucuguuuuuauggggcu

SEQ ID NO: 77055 - RNA, 44 nt, Mus musculus
acugaaaacaauucucauuuguuucuuugaaaggucuugggugu

SEQ ID NO: 77056 - RNA, 42 nt, Mus musculus
cacgucacuccgacccgaagaagggucugggaggaggcggag

SEQ ID NO: 77057 - RNA, 45 nt, Mus musculus
acgagggggccgaggccuugccaagaaucagagccugcagaucau

SEQ ID NO: 77058 - RNA, 44 nt, Mus musculus
aagaagaaagggccgaaggccuccagggagcgagugugcccgag

SEQ ID NO: 77059 - RNA, 45 nt, Mus musculus
aguugcucgcuggucuuuaccggggcggguuuuucagccauucag

SEQ ID NO: 77060 - RNA, 42 nt, Mus musculus
accccuugcuuaauuauagucauagauuuauaaagacagcuu

SEQ ID NO: 77061 - RNA, 45 nt, Mus musculus
caggcaacgacgaaaauuaaaacugaagagaauucccaacgcaaa

SEQ ID NO: 77062 - RNA, 42 nt, Mus musculus
aaauaaagacacaauuugucuuucacugaaaucccuggggag

SEQ ID NO: 77063 - RNA, 46 nt, Mus musculus
ccaaaggccuacuuccaaacgcuuacuuuuuagccaagugcgugag

SEQ ID NO: 77064 - RNA, 46 nt, Mus musculus
aggaaaucaagaaugaaugggaaaagaggggaaaaaagcggauuag

SEQ ID NO: 77065 - RNA, 50 nt, Mus musculus
gacccgugcuaagcugaguccagaagcuggcuagguuuggguaagaggaa

SEQ ID NO: 77066 - RNA, 45 nt, Mus musculus
uuauuugguuauuuuucuagggcauccggguccuagcgcuuucgg

SEQ ID NO: 77067 - RNA, 54 nt, Mus musculus
gugggcaacucugccccagaaagacugagaauugugcuagaaggucgugcgcac

SEQ ID NO: 77068 - RNA, 42 nt, Mus musculus
cgcuacaggccauuuucuaaauugcuaggauugagaacagga

SEQ ID NO: 77069 - RNA, 41 nt, Mus musculus
gcuuccauauucuucuacuguaucagaaaaguacgguuaga

SEQ ID NO: 77070 - RNA, 42 nt, Mus musculus
gcagaggccaggagagggugagaagggaugugaaggggagga

SEQ ID NO: 77071 - RNA, 46 nt, Mus musculus
agacauuaauuaaccuuaauauuuuugugcaccgacucaggaaugg

SEQ ID NO: 77072 - RNA, 80 nt, Mus musculus
gggggggggggggcaaauuguucuaggcguuguucuggcaucugcuugcuucuagacucccaacccccaccuggcgggca

SEQ ID NO: 77073 - RNA, 44 nt, Mus musculus
ugguuuagguucugauuuuuuugucuuacaaaguuagccggaag

SEQ ID NO: 77074 - RNA, 46 nt, Mus musculus
guccuuggcugucucauggccaugccaagaaacaaaauggaaggag

SEQ ID NO: 77075 - RNA, 46 nt, Mus musculus
uaaucuaauaaggguauuucaucuaauuaagacaaggggcagagug

SEQ ID NO: 77076 - RNA, 41 nt, Mus musculus
aacgcucuugagcgcaaagagcaagccguagguuaggaagg

SEQ ID NO: 77077 - RNA, 45 nt, Mus musculus
gccuaucugagaguuuguuuucuuugacuuuugguguuuugagau

SEQ ID NO: 77078 - RNA, 90 nt, Mus musculus
ugguccucggagcugccaaaggccugcugaauugucggacaguguguauuagagagcggagaaaccuuucccaacccaucacauuggcua

SEQ ID NO: 77079 - RNA, 45 nt, Mus musculus
uuuaucugggugcuagggauuugaacucagguuaucguggcauaa

SEQ ID NO: 77080 - RNA, 61 nt, Mus musculus
gagggucuaagugcuauauugagaauugagcauuaguggaaguaggguagccagaauggag

SEQ ID NO: 77081 - RNA, 46 nt, Mus musculus
ugaaugaagauuuugucaguaauugucacuaaggcagagucgguag

SEQ ID NO: 77082 - RNA, 46 nt, Mus musculus
uacugggcagauagcucuagauguaaagcuuauuaaacaguggcag

SEQ ID NO: 77083 - RNA, 46 nt, Mus musculus
ggucauuguuuguaggucaguaaaugaaggcccaggaaacuccaaa

SEQ ID NO: 77084 - RNA, 46 nt, Mus musculus
cuggggauguguaaagaagugauguucauacuagauugagcaccag

SEQ ID NO: 77085 - RNA, 23 nt, Mus musculus
gugcuguucuccagagaugacgg

SEQ ID NO: 77086 - RNA, 98 nt, Mus musculus
gccagcgggcugcaugcuggugucguuaugaagaaaaaacagaucuauaaagacccugacugcuggagagcaggcgagaauggaggaccauccuugcc

SEQ ID NO: 77087 - RNA, 46 nt, Mus musculus
cauuuugagaccuuucuauacugugucuuuuuuuagaaccucaaag

SEQ ID NO: 77088 - RNA, 42 nt, Mus musculus
uccugagacucgcugucgugguggcucccccaaacugggaag

SEQ ID NO: 77089 - RNA, 45 nt, Mus musculus
uuguaaggacuuuucagcauuauuuuauuuugaaauacaggccaa

SEQ ID NO: 77090 - RNA, 46 nt, Mus musculus
gugcaucucuuguacaguuggaaucacgguugauacuucucuggag

SEQ ID NO: 77091 - RNA, 41 nt, Mus musculus
agacuuguuuccugaacaacaugauguaugaaaggagcaga

SEQ ID NO: 77092 - RNA, 45 nt, Mus musculus
ucagaaauuaacgcaaauugagaaguauauugugagagcugagau

SEQ ID NO: 77093 - RNA, 45 nt, Mus musculus
uaaugaaguuuuaaaggcugacccacucccuccugcaauguggaa

SEQ ID NO: 77094 - RNA, 45 nt, Mus musculus
gaccaggaagccugguuauguguuaucacgaaccaggggugaugc

SEQ ID NO: 77095 - RNA, 45 nt, Mus musculus
gucgcacagacaaacccacagaaggaagagagcccaagagaagca

SEQ ID NO: 77096 - RNA, 45 nt, Mus musculus
aaacaggaaaacuuagacaggaaagaacuacugucaccuaagaua

SEQ ID NO: 77097 - RNA, 46 nt, Mus musculus
acucaacagguuucuucuucuguucaucggcuucgucuguguucuc

SEQ ID NO: 77098 - RNA, 42 nt, Mus musculus
gaguaaacggacaguauaucauggaagggcuugcguccagcu

SEQ ID NO: 77099 - RNA, 45 nt, Mus musculus
accuccaaguguuggcucaaugaccgaugaacaugggcaucagag

SEQ ID NO: 77100 - RNA, 62 nt, Mus musculus
cacagagucagaaagcaaaauagauaugcacauuuuuuaaguaauaaaaaucaagacuugau

SEQ ID NO: 77101 - RNA, 59 nt, Mus musculus
caagcgggcuuuccuuauugaggagcagaaaaucguugugaaagucuugaaggcacaag

SEQ ID NO: 77102 - RNA, 46 nt, Mus musculus
auccccuacagaaucuagauuugggccuaacaagauggggggaggc

SEQ ID NO: 77103 - RNA, 45 nt, Mus musculus
agaauucagaagccgggcuggacucugguuuguuugguaguuuua

SEQ ID NO: 77104 - RNA, 42 nt, Mus musculus
ugcagagcaccagauaacauuucagaacuucuggguggacuu

SEQ ID NO: 77105 - RNA, 47 nt, Mus musculus
uuuggguggcugauugaggaggugacagacaaagguagaaaagauug

SEQ ID NO: 77106 - RNA, 73 nt, Mus musculus
agagcagacaggaaagagaugcugaguuaguguuugaucgcucguaggcagcuggggaggagacggucuugga

SEQ ID NO: 77107 - RNA, 65 nt, Mus musculus
guucgugcugugcggcccaaaguccuuaugagacugucuaagacacagaagcacgucagcagggc

SEQ ID NO: 77108 - RNA, 44 nt, Mus musculus
ucucgaaccccuggcaacaggauuguuuaccucuacaccaagaa

SEQ ID NO: 77109 - RNA, 42 nt, Mus musculus
guaggcacucaggaugguccagcguuugacauaccgccguag

SEQ ID NO: 77110 - RNA, 42 nt, Mus musculus
gcgcuuggcguuugggcuccuuuuacguaaaguggguguugg

SEQ ID NO: 77111 - RNA, 46 nt, Mus musculus
gcacccuggccgucggcuacggcgagcgagagaccgagucgugguc

SEQ ID NO: 77112 - RNA, 46 nt, Mus musculus
uugucuccuuaauacuuaagacauuuguuucugaaacacuaggcau

SEQ ID NO: 77113 - RNA, 45 nt, Mus musculus
agaaagacccgagagagagagagagagagagagagagagagagag

SEQ ID NO: 77114 - RNA, 45 nt, Mus musculus
cgaggccagccuggucuacagagugaguuccaggacaucagaaau

SEQ ID NO: 77115 - RNA, 44 nt, Mus musculus
gcaaacuccucgaugauccugggcuccaggcugagcuugcccag

SEQ ID NO: 77116 - RNA, 42 nt, Mus musculus
ugugaccuaugagaagucuacacauuuauaguccgccucaag

SEQ ID NO: 77117 - RNA, 42 nt, Mus musculus
uuagaaguacagugaagauuuaaagugguagugugccccauu

SEQ ID NO: 77118 - RNA, 42 nt, Mus musculus
uuuccugauuaaccaucagugacugaaaacacauagcucuag

SEQ ID NO: 77119 - RNA, 45 nt, Mus musculus
ugcaguggauggaauaaacccuagaguucuggaagcaauugggag

SEQ ID NO: 77120 - RNA, 45 nt, Mus musculus
gugagcgcaguuuggaagaccuucuacgagaaaggaagccuguga

SEQ ID NO: 77121 - RNA, 42 nt, Mus musculus
agugaaaagcucagcucuaaacagcagcaacagcaggaggag

SEQ ID NO: 77122 - RNA, 46 nt, Mus musculus
uuuagaggugagucacugguuaaaaacaguacugccuuugccaggg

SEQ ID NO: 77123 - RNA, 46 nt, Mus musculus
ccuugucuguggcuuuaaccugguucaccuuccugucuucaccaga

SEQ ID NO: 77124 - RNA, 45 nt, Mus musculus
gaaccuuuucaucucccuccuuaguagucuucccugagcccuaga

SEQ ID NO: 77125 - RNA, 46 nt, Mus musculus
auccucccuguuaauguaaaugacuccaugauagagacagcacaag

SEQ ID NO: 77126 - RNA, 45 nt, Mus musculus
guucuucucaguauauauuaaagaaacucagggacaaacagggug

SEQ ID NO: 77127 - RNA, 45 nt, Mus musculus
auggcauaguacaccgggccuugucuccccauaauauccuguugg

SEQ ID NO: 77128 - RNA, 42 nt, Mus musculus
gucugcaaccuuauagguggaacaacaaugugaacuggccag

SEQ ID NO: 77129 - RNA, 42 nt, Mus musculus
agacuuuauaugccccaguacaggggaacgccagggccgggg

SEQ ID NO: 77130 - RNA, 42 nt, Mus musculus
uaaggcacauaaguguuaccaucugcuucaaaacucggacag

SEQ ID NO: 77131 - RNA, 44 nt, Mus musculus
guuucuguugaguguuaaaugagacacuuaagagaaagccccug

SEQ ID NO: 77132 - RNA, 46 nt, Mus musculus
gugggggcaucgccauuccuuccugcugaaggagaaagcccaguga

SEQ ID NO: 77133 - RNA, 46 nt, Mus musculus
aaaaccauugccuucuggccccaaaucagauguauggucucuuggg

SEQ ID NO: 77134 - RNA, 45 nt, Mus musculus
uguacgcaaggauaaagagauugcaaauauuaaaguuaaaaggaa

SEQ ID NO: 77135 - RNA, 46 nt, Mus musculus
aauuuuaaauuauuuaauuuacaaaaucaacauucaagaaugacag

SEQ ID NO: 77136 - RNA, 45 nt, Mus musculus
aaaaauacuaggccaaauuauagaccaaaguagcucaauguugca

SEQ ID NO: 77137 - RNA, 46 nt, Mus musculus
auauggaaauaacuaaaauguaauguguaucuuaaagcagccugua

SEQ ID NO: 77138 - RNA, 46 nt, Mus musculus
aucugugcucaguauuuucaauugucuuucucaaggccaaccccag

SEQ ID NO: 77139 - RNA, 45 nt, Mus musculus
ggcacaggcuccacgcuaugcuccauucuaaauccauugucugaa

SEQ ID NO: 77140 - RNA, 46 nt, Mus musculus
cauuuaaagauaacacacaacacuuugcaucugugauacaugagag

SEQ ID NO: 77141 - RNA, 46 nt, Mus musculus
guucuaugacccaguauaggggaaugccagggccaggaagcuggag

SEQ ID NO: 77142 - RNA, 46 nt, Mus musculus
guaguguucuuuuaaguuuuauuucauuuuuaguuauauuucucug

SEQ ID NO: 77143 - RNA, 47 nt, Mus musculus
agccacugugaguggagcauggugaggccacauagcaggaacugaag

SEQ ID NO: 77144 - RNA, 47 nt, Mus musculus
cauaacaagaucacucugacaucucauuggcugaaauucaagaacag

SEQ ID NO: 77145 - RNA, 49 nt, Mus musculus
agcaguagaggcaggagaaguuuucgauguucacagauuaguuggaagg

SEQ ID NO: 77146 - RNA, 78 nt, Mus musculus
caggaacaacugcaaaccugugcuccagcaaguggaaggauaagggguucuuaacccgauguagagauguauguuugg

SEQ ID NO: 77147 - RNA, 45 nt, Mus musculus
uuucagggaaccgagcuguaaugguucuguguuuaaaagucaaaa

SEQ ID NO: 77148 - RNA, 45 nt, Mus musculus
uugauaucaauuugaagcacuuuaggaagcugcgaauuaaugaag

SEQ ID NO: 77149 - RNA, 46 nt, Mus musculus
uggggcaucuucuggauaucuuacauuuguuuuucuaaaccuggaa

SEQ ID NO: 77150 - RNA, 46 nt, Mus musculus
uaagauuuagaagugugugugugugugugugugugugugugugugu

SEQ ID NO: 77151 - RNA, 46 nt, Mus musculus
agguguugguccauuaucucagggguuguacaauagaacaaaguag

SEQ ID NO: 77152 - RNA, 46 nt, Mus musculus
gcugauagccauggcugcgaggcacucacuguguacuuacucacac

SEQ ID NO: 77153 - RNA, 42 nt, Mus musculus
agaaacagcuguccuuggcuuugguccugccacuaacaugag

SEQ ID NO: 77154 - RNA, 49 nt, Mus musculus
gugagcaaucacaguaaggcuggugagaaauguuggguuguuagaggga

SEQ ID NO: 77155 - RNA, 46 nt, Mus musculus
agagaggcugcuagguggagguagaagauaauggacucucagugag

SEQ ID NO: 77156 - RNA, 52 nt, Mus musculus
auuuaaagagaaauagauucuggcacaauucuacagaugggguggcaacgag

SEQ ID NO: 77157 - RNA, 47 nt, Mus musculus
auacccauauaggauaaauaaacaaacaauuucugugacaugaguuc

SEQ ID NO: 77158 - RNA, 46 nt, Mus musculus
ugcacucacaccauugggcuggcucaccuucaacccacacguccag

SEQ ID NO: 77159 - RNA, 46 nt, Mus musculus
aaguaaggggcagggacagcucuccugcucucaaccccagggccag

SEQ ID NO: 77160 - RNA, 45 nt, Mus musculus
ucaacucccacagaggccugcucccccaagcacugcagcuggcua

SEQ ID NO: 77161 - RNA, 46 nt, Mus musculus
auaccucuaggagcuuauuaucacauuuuaagcuacauuacaccag

SEQ ID NO: 77162 - RNA, 42 nt, Mus musculus
agagaaagagaaaggagagaggguaugagagagagggguaag

SEQ ID NO: 77163 - RNA, 45 nt, Mus musculus
gguugggagccaccaugugguugcugggauuugaacucagcaccu

SEQ ID NO: 77164 - RNA, 46 nt, Mus musculus
uuugugauucagagauuaaaugaauuguaaaauuacaucugagauu

SEQ ID NO: 77165 - RNA, 46 nt, Mus musculus
ggaugagcccucacgcgucuaucauuagucaagaaaaugcccacag

SEQ ID NO: 77166 - RNA, 45 nt, Mus musculus
ggaauagaaagugugugugugugugugugugugugugugugcgcg

SEQ ID NO: 77167 - RNA, 46 nt, Mus musculus
ucuuacaugccaaaaucugcauuucaugugcauauuuuagugucag

SEQ ID NO: 77168 - RNA, 46 nt, Mus musculus
auugagucuucagcaacuuugguuggugaaaaaaauggagcuucaa

SEQ ID NO: 77169 - RNA, 45 nt, Mus musculus
auggugcuagggcagaaugaauaaggagaccaaggaaaagucaag

SEQ ID NO: 77170 - RNA, 41 nt, Mus musculus
ccuguucagacuaauuuccuaaguucggcgggucccggagc

SEQ ID NO: 77171 - RNA, 46 nt, Mus musculus
ugaaaaagaggcuuguuaacauuauauggggauuagacuguaagag

SEQ ID NO: 77172 - RNA, 46 nt, Mus musculus
agcguaugaugugacuaccaggccauagccucccgguccuggcuuu

SEQ ID NO: 77173 - RNA, 45 nt, Mus musculus
aaaaaaaagaauacaaaaauaacagggagagaauauuuaccucag

SEQ ID NO: 77174 - RNA, 45 nt, Mus musculus
gcuguuuuuguuuguuuuguucugguguguuuucuaaaugaugaa

SEQ ID NO: 77175 - RNA, 60 nt, Mus musculus
uuauauccgaaaucuagaaggaaagaaaugaaagagggaaggcaagacagagaaggcaga

SEQ ID NO: 77176 - RNA, 45 nt, Mus musculus
gaauguguacggagagccagcagcagccucugccccaggguugga

SEQ ID NO: 77177 - RNA, 46 nt, Mus musculus
uaaaagcaaucuuuguaaauaaaaaucacuguuccuacugccaccu

SEQ ID NO: 77178 - RNA, 46 nt, Mus musculus
uucauuuccuucuuggucauguaacugcacagcugauucagaagaa

SEQ ID NO: 77179 - RNA, 45 nt, Mus musculus
ugccgaugauggagcaacacuagcacugucgaggaggacaagauu

SEQ ID NO: 77180 - RNA, 42 nt, Mus musculus
cguggucacacgggggagauuggauuggaugaugugagcuug

SEQ ID NO: 77181 - RNA, 46 nt, Mus musculus
ccuuuaggcacaaggugacugggcugcacucgggcacacugcaggu

SEQ ID NO: 77182 - RNA, 46 nt, Mus musculus
uguuuuagauuggagaaaaggauggaaagagcauaagauggcagag

SEQ ID NO: 77183 - RNA, 46 nt, Mus musculus
ugagauauuugaaaucgaaagaggggucagcgcggaugaggaagua

SEQ ID NO: 77184 - RNA, 41 nt, Mus musculus
cuccuauauugaagcuuacaggagcuggggaaccugcagag

SEQ ID NO: 77185 - RNA, 46 nt, Mus musculus
ccuuauuuuauuuauacagauuauaguucgaaauaacaggcaagau

SEQ ID NO: 77186 - RNA, 42 nt, Mus musculus
uagcagacauagaagcaccccuuccccuuuugauugaugguu

SEQ ID NO: 77187 - RNA, 45 nt, Mus musculus
uuuuuaagauuuuuugauuuguauuuuaauaggauuccgugguga

SEQ ID NO: 77188 - RNA, 57 nt, Mus musculus
accccucccgacagagcccagaacaacuccacuaccaccaaccccagaaaggccauc

SEQ ID NO: 77189 - RNA, 45 nt, Mus musculus
caucuacacaugugccauggcacacacaccccaccaccaccucau

SEQ ID NO: 77190 - RNA, 45 nt, Mus musculus
acaggcaguuagugagggaaagcgauccuugagaaaguccucuga

SEQ ID NO: 77191 - RNA, 46 nt, Mus musculus
gguuggggagcauggaguggggaggauauaggggacuuuuggagag

SEQ ID NO: 77192 - RNA, 44 nt, Mus musculus
aaagucacccucuauaagcagauucucucgucccgcccccaccu

SEQ ID NO: 77193 - RNA, 46 nt, Mus musculus
acucgcuaauugucacaaauaccuaacagagggucaucuugaaguu

SEQ ID NO: 77194 - RNA, 55 nt, Mus musculus
ccaacgaaguggcuauuguggaagacggugaagaggaaugaaucaagaaggagaa

SEQ ID NO: 77195 - RNA, 68 nt, Mus musculus
uucuaaguaaggauuaaaugagaagcuauuuacagagcacuuagcugagggacuggcacauacucaau

SEQ ID NO: 77196 - RNA, 71 nt, Mus musculus
cggccaucaguggaaagagaggcacauuggucuugcaaacuuuauaugccucaguacaggggaacgccugg

SEQ ID NO: 77197 - RNA, 41 nt, Mus musculus
ccaaggagcugaagggauaugcaacccuauagguggaacaa

SEQ ID NO: 77198 - RNA, 46 nt, Mus musculus
gugagccaccaugugguugcugggaauuugaacucaggaccucugg

SEQ ID NO: 77199 - RNA, 44 nt, Mus musculus
cuguuccuuggugugugugugugugugugugugugugugugugu

SEQ ID NO: 77200 - RNA, 46 nt, Mus musculus
acugagaggaggcgcucggggugcgugugugugugugugugugugu

SEQ ID NO: 77201 - RNA, 44 nt, Mus musculus
aaguuaaaaguuaccuguacuuggguuaaauauuaaagggccuu

SEQ ID NO: 77202 - RNA, 45 nt, Mus musculus
uuuuucuucaaucucauauauuauauauauauauauaauauauau

SEQ ID NO: 77203 - RNA, 32 nt, Mus musculus
guggcuggaacugcuccccgaagcugcugccg

SEQ ID NO: 77204 - RNA, 50 nt, Mus musculus
cuugggggugggguaaggagaaaacguugcuaggugguguacauuugguu

SEQ ID NO: 77205 - RNA, 94 nt, Mus musculus
uaacuuaaguacuuagagggacuguccccaaacgucuguuggugaaggguguggaugggugguaaguucugauuggugagaugguccugguuug

SEQ ID NO: 77206 - RNA, 42 nt, Mus musculus
aaauaucugaggugugugcugagcugggauaaggacugugag

SEQ ID NO: 77207 - RNA, 46 nt, Mus musculus
ucccuagcacccacaucaguuagcucauaauugccuauagguccag

SEQ ID NO: 77208 - RNA, 47 nt, Mus musculus
uuaacccaacaaacaguaaacgauauguacuaacuacccagcaauaa

SEQ ID NO: 77209 - RNA, 45 nt, Mus musculus
cccaaacagccccacccacccaaacagaacaagggucaaucggag

SEQ ID NO: 77210 - RNA, 47 nt, Mus musculus
aaagaaagaaaggaaaaagaagaaagaagagagagagagagagagag

SEQ ID NO: 77211 - RNA, 46 nt, Mus musculus
aagugcuguauaguguucacaaaagaaaacuggguagcucuggcag

SEQ ID NO: 77212 - RNA, 45 nt, Mus musculus
aaaugcccaacagugggagaggaaacuugaagaaucuaccuucag

SEQ ID NO: 77213 - RNA, 85 nt, Mus musculus
ccuggggaugcacuccugguauaaagcuuucuggaacugaagauguuggucccccauaccuggagacgguccuugguucacuugc

SEQ ID NO: 77214 - RNA, 51 nt, Mus musculus
caugcaaauucggggcuuucaguucuauccagccaggugcugccuguacag

SEQ ID NO: 77215 - RNA, 46 nt, Mus musculus
uggguugauggucuauuuucccuucccuuaaaagaguucgguugcu

SEQ ID NO: 77216 - RNA, 43 nt, Mus musculus
gacggggagcaagaagugauugugacgguggggucacaguagu

SEQ ID NO: 77217 - RNA, 46 nt, Mus musculus
cugcuagggguguuuacaugagaugcgguacucugcacggcaaugg

SEQ ID NO: 77218 - RNA, 50 nt, Mus musculus
uuuuaaguaauguaacgcuccugccuuuuuccccuuccugcucguugaga

SEQ ID NO: 77219 - RNA, 45 nt, Mus musculus
cugacggcugcuuuuaccgugguuucuuucuuggcuuuccucgaa

SEQ ID NO: 77220 - RNA, 44 nt, Mus musculus
ucucugcuaacgggcuuccauucuggaguuugacagccagaggu

SEQ ID NO: 77221 - RNA, 46 nt, Mus musculus
cacacacacacacacacacacacacacacacacacagagggaagua

SEQ ID NO: 77222 - RNA, 48 nt, Mus musculus
aucccagcaaccacaugguggcucgcaaccauccguaacgagaucuga

SEQ ID NO: 77223 - RNA, 46 nt, Mus musculus
acacacacacacacacacacacagagagagagagagagagagucag

SEQ ID NO: 77224 - RNA, 45 nt, Mus musculus
agaacugccagggcuacacagaaaaccacugucucaaacaaacac

SEQ ID NO: 77225 - RNA, 46 nt, Mus musculus
guacagacacagucaagauuaauggaauagaauugaagacccccac

SEQ ID NO: 77226 - RNA, 41 nt, Mus musculus
aguccaccugggagggagaagaaagaaaucacaauggggga

SEQ ID NO: 77227 - RNA, 46 nt, Mus musculus
uguccccacuugagguucagagcuacaaacauggcugcauuuggac

SEQ ID NO: 77228 - RNA, 25 nt, Mus musculus
gggaggagaaagagagggacaggga

SEQ ID NO: 77229 - RNA, 42 nt, Mus musculus
guggacacugggcaugcuccagguacacauauguacaugcag

SEQ ID NO: 77230 - RNA, 45 nt, Mus musculus
guaugggaggugugugugcacgugcgugugugugugugugugugu

SEQ ID NO: 77231 - RNA, 46 nt, Mus musculus
guauguuuaaaaauaaagauagcauacccgaaucccaugcacccac

SEQ ID NO: 77232 - RNA, 42 nt, Mus musculus
uugaaaaacagaagggggcuguggagguaccggaaagggcag

SEQ ID NO: 77233 - RNA, 46 nt, Mus musculus
ucaaaucccagcaaccauauggugacucacaaccaucucuaaugag

SEQ ID NO: 77234 - RNA, 45 nt, Mus musculus
caacucuucagcauguaaaaaauucuccuuaaauguucaaaauca

SEQ ID NO: 77235 - RNA, 46 nt, Mus musculus
caacaaauaacuuucuauuacaggaacucacuuucaaaugaugccg

SEQ ID NO: 77236 - RNA, 46 nt, Mus musculus
uaccauaacauucuaagaccaugggaaaaaaagauacaguugccau

SEQ ID NO: 77237 - RNA, 46 nt, Mus musculus
uuugugagauucaaccccacugccauuguuaaccgcuagucuucag

SEQ ID NO: 77238 - RNA, 45 nt, Mus musculus
gggcgggccagacauccaacaggaggauuucagaugccagugugg

SEQ ID NO: 77239 - RNA, 46 nt, Mus musculus
caacaaaccaggcaugguaaggcacgccuuuagucccaccacucag

SEQ ID NO: 77240 - RNA, 42 nt, Mus musculus
agcuggacucagcagcaaaugccugcuaaccuggcaccugag

SEQ ID NO: 77241 - RNA, 46 nt, Mus musculus
ugguugugagccaccaugugguugcugggauuugaacucagguuaa

SEQ ID NO: 77242 - RNA, 24 nt, Mus musculus
ccaccagcucugcuuggcaacugg

SEQ ID NO: 77243 - RNA, 46 nt, Mus musculus
uuuuaaaauaauugaaaaauuaggagugauggcagcauaaaaucag

SEQ ID NO: 77244 - RNA, 27 nt, Mus musculus
agcugauucgggggcagcacaaagcca

SEQ ID NO: 77245 - RNA, 52 nt, Mus musculus
caggaaggcagccccaagaaaacacucacuuuccugagacuaaaaggccaga

SEQ ID NO: 77246 - RNA, 46 nt, Mus musculus
gugggugacaugacaguccccgcaaggccgagagaaagagagggag

SEQ ID NO: 77247 - RNA, 46 nt, Mus musculus
auaaugagaucugacgcccucuucugguguguuugaagacagcaac

SEQ ID NO: 77248 - RNA, 45 nt, Mus musculus
uuaugucugaacugugcccaugguaauuacuuauuuguaaacaga

SEQ ID NO: 77249 - RNA, 46 nt, Mus musculus
ucucucucucucucuuucucuuuucucuuuaaauguagcuauguag

SEQ ID NO: 77250 - RNA, 45 nt, Mus musculus
aagaaguagaucucagagguccucaaagaugccaagugccaggug

SEQ ID NO: 77251 - RNA, 45 nt, Mus musculus
guuaugagcuuggagugcagaccuuguaaaacucccucagcacag

SEQ ID NO: 77252 - RNA, 42 nt, Mus musculus
gcgguuugcuucccucgcucgggccgaguggacgugccgccc

SEQ ID NO: 77253 - RNA, 45 nt, Mus musculus
cgagcugcggccucggccuccuccccgcgcggcagcuggugccuc

SEQ ID NO: 77254 - RNA, 42 nt, Mus musculus
cgcccgccaccucgccaccacgcgcccggcggccgcggagcu

SEQ ID NO: 77255 - RNA, 42 nt, Mus musculus
gcggggcaggguccagagccgggcagaggaggagccggggcc

SEQ ID NO: 77256 - RNA, 58 nt, Mus musculus
ggcggggaaggguugucucuucuucucacaccggcucugccagacacaggcgccuuuu

SEQ ID NO: 77257 - RNA, 73 nt, Mus musculus
gugcuuuucgccgggcuccucacuaucccgagguguacucaaagguccggccaaaauucuugauuaucccggc

SEQ ID NO: 77258 - RNA, 45 nt, Mus musculus
caucuaaccuaagcaauagggcugaaaaccgcaucaagauggaga

SEQ ID NO: 77259 - RNA, 41 nt, Mus musculus
cauuaaauacuguaagaagaauugcucaagaauggccaacu

SEQ ID NO: 77260 - RNA, 42 nt, Mus musculus
ugaaccaccaugugguugcugggaauugaacucaggcccucu

SEQ ID NO: 77261 - RNA, 42 nt, Mus musculus
cuggaccugcagaacauugugcuggagggucacgggccaaau

SEQ ID NO: 77262 - RNA, 46 nt, Mus musculus
auugccccaccccaaaacuuaguaagauacaugugacuuaagagau

SEQ ID NO: 77263 - RNA, 46 nt, Mus musculus
ggugguuugaagggguagucuguaggaaaaugaauugucaaaaaga

SEQ ID NO: 77264 - RNA, 66 nt, Mus musculus
auaucaagacaaaugcugccauuacuguuaauauuuggaugauaaauucuuguuguaaaugcaacc

SEQ ID NO: 77265 - RNA, 46 nt, Mus musculus
ucuuaguaguauaauagagucaaggcuuggcaaaaaaaccccacca

SEQ ID NO: 77266 - RNA, 50 nt, Mus musculus
ccgugcaaucucuggcacuagggggucgucuggguuuggaucacauagca

SEQ ID NO: 77267 - RNA, 46 nt, Mus musculus
cugagacaaucuuagcuuguuuuuauuuuuuauuggggguggguuu

SEQ ID NO: 77268 - RNA, 45 nt, Mus musculus
ugcuucuccaaggaucuuaguguuaaaguccuuuuagucgaaggu

SEQ ID NO: 77269 - RNA, 46 nt, Mus musculus
uucccucuggggagugugaugccgcuguacaccaggccagugagag

SEQ ID NO: 77270 - RNA, 44 nt, Mus musculus
aggacuacagagaaaccuugucuuaaaaagccaaaaagaaagga

SEQ ID NO: 77271 - RNA, 46 nt, Mus musculus
gauagagagauagauagauagguagauaacaccugauaagauagug

SEQ ID NO: 77272 - RNA, 46 nt, Mus musculus
agcuacaagcauccagaugauugcaacaguaacccuguccggaggg

SEQ ID NO: 77273 - RNA, 46 nt, Mus musculus
aggaccagccugggcaacuuuaugagauacugccucaagucaagaa

SEQ ID NO: 77274 - RNA, 45 nt, Mus musculus
cggcggggucgggaaugugugugugugugugugugugugugugug

SEQ ID NO: 77275 - RNA, 44 nt, Mus musculus
agcaguauagcuauuguggaagaaagagaugccgguggggauau

SEQ ID NO: 77276 - RNA, 46 nt, Mus musculus
ugccaggcaaacuuagacauaaugggagaaggcaguggagaaagau

SEQ ID NO: 77277 - RNA, 42 nt, Mus musculus
uguuauccacagugugugugugugugugugugugugugugug

SEQ ID NO: 77278 - RNA, 42 nt, Mus musculus
ugauucucugacaaucaacuucucaaggaaacgggaggaaaa

SEQ ID NO: 77279 - RNA, 45 nt, Mus musculus
acacacauccaucaaaugaaugaauaaaauguauuuuuuagagag

SEQ ID NO: 77280 - RNA, 83 nt, Mus musculus
uuuuacugcuuucaccaaacagcuuguucuaaagagaaaagggagagagaucuacacugggugugggggugucagggaggcaa

SEQ ID NO: 77281 - RNA, 45 nt, Mus musculus
ggucugaccuugcuuucuuuacaguuuaguguuauucuggcauuu

SEQ ID NO: 77282 - RNA, 55 nt, Mus musculus
aauuguuuuccauaaagaacaguauaagcauauuauucacauguaaucaccaaua

SEQ ID NO: 77283 - RNA, 48 nt, Mus musculus
ugaugaggacuaauggucacagaggaugcuuugccuaagagccacagu

SEQ ID NO: 77284 - RNA, 24 nt, Mus musculus
cguucagcuucuugggcuuugaga

SEQ ID NO: 77285 - RNA, 53 nt, Mus musculus
gcaguccuguccagcgagagccuguuuguagaaaucccagauggauuauuagc

SEQ ID NO: 77286 - RNA, 46 nt, Mus musculus
cugggagcugguggggucuucagggaauugugagcagcccucagaa

SEQ ID NO: 77287 - RNA, 44 nt, Mus musculus
acuucagaagaaagagaaaugugguggguaggguugggagggga

SEQ ID NO: 77288 - RNA, 45 nt, Mus musculus
agaaaggugacuugugcugugauuccagcauuugggaggcagaaa

SEQ ID NO: 77289 - RNA, 47 nt, Mus musculus
cugaagacagcaacaguauaaucaaagaaagaaagaaagaaagaaag

SEQ ID NO: 77290 - RNA, 45 nt, Mus musculus
gcacugagugagagagagagagagagagagagagagagagagaga

SEQ ID NO: 77291 - RNA, 46 nt, Mus musculus
cgccucacauuccucucucuugcugaucagacagacagagugacuc

SEQ ID NO: 77292 - RNA, 46 nt, Mus musculus
aaauuguuggcaccaaaaaguaagaaguauugaacuauucaaagua

SEQ ID NO: 77293 - RNA, 42 nt, Mus musculus
gucaugccaucaugaaguucugaaauugaaucccaagcaucu

SEQ ID NO: 77294 - RNA, 41 nt, Mus musculus
gguguuguacaccuggaaccccagaccucaggaggcagaga

SEQ ID NO: 77295 - RNA, 46 nt, Mus musculus
cucccuccucccccaucucuguuugugagugugugugugugugugu

SEQ ID NO: 77296 - RNA, 44 nt, Mus musculus
aaugauaugagucacuuggccuuugagcuugguggcauugcaga

SEQ ID NO: 77297 - RNA, 45 nt, Mus musculus
ggugaaguuuaagaaaggaggggagagcuggugagauggcugagu

SEQ ID NO: 77298 - RNA, 48 nt, Mus musculus
aaacaaaaacaaaaaucacagagagagagagagagagagagagagaga

SEQ ID NO: 77299 - RNA, 46 nt, Mus musculus
gucacucagggaaugaauuaccagacugcaauuuuucagaggaguu

SEQ ID NO: 77300 - RNA, 46 nt, Mus musculus
cuauagaugauuagacugcauagaacguaucaauucaggaucagga

SEQ ID NO: 77301 - RNA, 46 nt, Mus musculus
aggaagaagaagaaacaacaugagaaauaaaaggcagacaugaggg

SEQ ID NO: 77302 - RNA, 47 nt, Mus musculus
ugcuaaaauuaaaucuuuagauauaucgagaugagaaggaggaggag

SEQ ID NO: 77303 - RNA, 42 nt, Mus musculus
cacugaugcucacaacagcuuucuucuugauagcuaagagau

SEQ ID NO: 77304 - RNA, 45 nt, Mus musculus
aagcggcuguuguaagcccaguccuccugagaugagaccuugugg

SEQ ID NO: 77305 - RNA, 45 nt, Mus musculus
aggugacuucagucuucaccaagcccugagcuuagagcccccucu

SEQ ID NO: 77306 - RNA, 42 nt, Mus musculus
gaaagccaggucuugccauggaagaaggaacggugcaaagau

SEQ ID NO: 77307 - RNA, 46 nt, Mus musculus
acacacagagagagagagagacagagagagagagacagacagacag

SEQ ID NO: 77308 - RNA, 49 nt, Mus musculus
gcugaauccauagaagcagagaauagaaugguuaccagaggcugggaga

SEQ ID NO: 77309 - RNA, 83 nt, Mus musculus
aaagggcccagugugcagugccacccugggcagaugguccuggccuuugcugaagagaaagagaggaguggacagcgcaggga

SEQ ID NO: 77310 - RNA, 42 nt, Mus musculus
gcagauuacuucuuucuauaaacaaccaugcucagaccaggg

SEQ ID NO: 77311 - RNA, 42 nt, Mus musculus
auucacagacagguauuauuguucgauguaggcugucgagau

SEQ ID NO: 77312 - RNA, 42 nt, Mus musculus
aaaacagccgagagagagagagagagagagagagagagagag

SEQ ID NO: 77313 - RNA, 46 nt, Mus musculus
uaaacaaacgagaccuuucugguuguacccuaagaagaccugagau

SEQ ID NO: 77314 - RNA, 41 nt, Mus musculus
acccucauaagagcauggugccacaugccuuuaagcucaga

SEQ ID NO: 77315 - RNA, 46 nt, Mus musculus
ccuuuccugugcacaggagacagacaggucgccucugugggaagau

SEQ ID NO: 77316 - RNA, 45 nt, Mus musculus
agaguacaugccggucucucucucucauuccuucuccuuccagac

SEQ ID NO: 77317 - RNA, 42 nt, Mus musculus
aggcagcccuaauuaaacuuacucauacacacaagcacagaa

SEQ ID NO: 77318 - RNA, 41 nt, Mus musculus
uagcaguugggugaaugauguaaccugaggugcaacggaga

SEQ ID NO: 77319 - RNA, 41 nt, Mus musculus
aucugacaugacuuucaccaugaauacucuccucagccagc

SEQ ID NO: 77320 - RNA, 46 nt, Mus musculus
ccucucucaaacaaaacaaagcaaaacaacuccacaaagccaaaca

SEQ ID NO: 77321 - RNA, 42 nt, Mus musculus
ugggauacuauugguauuuggaaagucauugggccccgaaag

SEQ ID NO: 77322 - RNA, 41 nt, Mus musculus
cucugugucucucucugucucucucuugucugucugucugu

SEQ ID NO: 77323 - RNA, 46 nt, Mus musculus
gaaaaguggcgcagucaguggugcugacgcaguacugaggggcucu

SEQ ID NO: 77324 - RNA, 46 nt, Mus musculus
caacuucucaaucaggaagcagaggucauaugucauuugccuacau

SEQ ID NO: 77325 - RNA, 46 nt, Mus musculus; identical to SEQ ID NO: 66278

SEQ ID NO: 77326 - RNA, 23 nt, Mus musculus
cgagcgaugauuggcgcgugggg

SEQ ID NO: 77327 - RNA, 41 nt, Mus musculus
ccuccccaaaccccaguauucacugucuccgcagggccaag

SEQ ID NO: 77328 - RNA, 27 nt, Mus musculus
ccguggcugguuguccuagauuucagg

SEQ ID NO: 77329 - RNA, 46 nt, Mus musculus
gaugcacuguuuaauuaguaagcagagaauguacuuguugcugagu

SEQ ID NO: 77330 - RNA, 42 nt, Mus musculus
guagggaaggcgaaggcauggaagacagacagucaggggcaa

SEQ ID NO: 77331 - RNA, 46 nt, Mus musculus
ccagcaguggaggaguguaccucuuucuccacauccucgcaccccu

SEQ ID NO: 77332 - RNA, 46 nt, Mus musculus
auaaauucgaaguuuacauuauuccauccuuaauaauuucugucag

SEQ ID NO: 77333 - RNA, 44 nt, Mus musculus
uucuggugcuggggaaggcgggaaagucuauaccaaagaccaag

SEQ ID NO: 77334 - RNA, 42 nt, Mus musculus
auaggagaauuucauaugcgggaaggcuaagaauaagggcag

SEQ ID NO: 77335 - RNA, 41 nt, Mus musculus
guguguacauauucauaguagacuucuuaaauguggcccag

SEQ ID NO: 77336 - RNA, 46 nt, Mus musculus
uuugaaguuucauccagacaaaaaccacgccccuggagccacggau

SEQ ID NO: 77337 - RNA, 46 nt, Mus musculus
accaauccuggcaaccugagugugaggcucaggacucauguggugg

SEQ ID NO: 77338 - RNA, 46 nt, Mus musculus
aaaggaacauuugcauguauacagaaaccugcgggaagggcaucga

SEQ ID NO: 77339 - RNA, 45 nt, Mus musculus
ccuguaaccaccagaacaacggcagguucaauuuccaccggggcu

SEQ ID NO: 77340 - RNA, 42 nt, Mus musculus
aagaccuguucaauaucuucuuuggcgguggauuuccuucag

SEQ ID NO: 77341 - RNA, 46 nt, Mus musculus
gcuuacagccaucaacaucagcaccgacacagugggcaugaaagag

SEQ ID NO: 77342 - RNA, 46 nt, Mus musculus
uaagccagcugauggucucgaacccuccguacuccuuauaccccag

SEQ ID NO: 77343 - RNA, 41 nt, Mus musculus
gccccugggagugacagugcugacaagaagucucagggucc

SEQ ID NO: 77344 - RNA, 41 nt, Mus musculus
augcagugaaguggccacacaauauagugaagauaaaguca

SEQ ID NO: 77345 - RNA, 76 nt, Mus musculus
ugggauggauaagccuguguuuacagacccaccaguuaagacaaaauuuggauaucauauuauuaugguugaaggg

SEQ ID NO: 77346 - RNA, 46 nt, Mus musculus
uuuaaaagcgaauauaaaggaacacuauuacaaaaaguagaaaaga

SEQ ID NO: 77347 - RNA, 45 nt, Mus musculus
gcaguaugcagccaaaguguaccgugaugagcagcugcggaggaa

SEQ ID NO: 77348 - RNA, 47 nt, Mus musculus
uacauaaugcaucaaauucuuacucuauuacuuaguagacagucgga

SEQ ID NO: 77349 - RNA, 46 nt, Mus musculus
agccauagcuaaagcauuuacagauauauagugacauuuauuagag

SEQ ID NO: 77350 - RNA, 124 nt, Mus musculus
cuaauguggaggaaaagcuggguacgagugacggugaagaggagagacaggagccuagaguggaugcaggggcugagccaauaucuaaacggcaacugaagaagcugaugaaacaaaaacagug

SEQ ID NO: 77351 - RNA, 46 nt, Mus musculus
auaaugaaaaaaaaugucauuugauauuuuagggagaaacgaaaag

SEQ ID NO: 77352 - RNA, 43 nt, Mus musculus
gacgccagcuggaguccaacucagauggcaacgacaggaagcg

SEQ ID NO: 77353 - RNA, 47 nt, Mus musculus
cucaauucaucucaguuuucuaaagaaaauguauuuuuccuaaguga

SEQ ID NO: 77354 - RNA, 46 nt, Mus musculus
acucacauuuaaacaagcaaccaguuacggaaucgaacaugcacag

SEQ ID NO: 77355 - RNA, 42 nt, Mus musculus
uaucacauuuagccuucaugccuuaauccacaaugacaggac

SEQ ID NO: 77356 - RNA, 42 nt, Mus musculus
uuuuaaaugugacuguuacauauugguccugucagcagcgug

SEQ ID NO: 77357 - RNA, 42 nt, Mus musculus
uacaccaugggugacuugaugcuggguguggggccccuggaa

SEQ ID NO: 77358 - RNA, 44 nt, Mus musculus
gagcuccccgcgcuccggcuuccuccgcucagggacucccgcag

SEQ ID NO: 77359 - RNA, 42 nt, Mus musculus
cgguggggggaggggcgccgcgcggggccgcgaugcggcggg

SEQ ID NO: 77360 - RNA, 46 nt, Mus musculus
cuaccaguguuagaggaaaauauuacagauaauaauagaggcaaag

SEQ ID NO: 77361 - RNA, 46 nt, Mus musculus
uguaacaacuguuuacuuuuauaguagcuauuuuuaauguaggcag

SEQ ID NO: 77362 - RNA, 45 nt, Mus musculus
agacaucccaguggguacuauauucauuuaauguaguucuauaag

SEQ ID NO: 77363 - RNA, 68 nt, Mus musculus
uacaauguuuugaucauguuuuuccccucuucugacuccuugaagauucucccuacuuuccugcccac

SEQ ID NO: 77364 - RNA, 83 nt, Mus musculus
uccucuuucaaaaacuccuacuaaaaugaaaaucaaaacaagcagaagacugaccuauaaaacaaacagacaaaaaugcccaa

SEQ ID NO: 77365 - RNA, 55 nt, Mus musculus
uggccacuuauuccuggguguggggccugcccuggagugagagagagagagagag

SEQ ID NO: 77366 - RNA, 42 nt, Mus musculus
gugcuggggcacccugucuagcuugaaccugugcaggccuag

SEQ ID NO: 77367 - RNA, 46 nt, Mus musculus
cauuucuuuuuuuaaaaagaaagaaagagaaagaaagaaggaaaga

SEQ ID NO: 77368 - RNA, 46 nt, Mus musculus
uccaccaugcuggugcuucaguuauuuauguugcccauaacccuuu

SEQ ID NO: 77369 - RNA, 93 nt, Mus musculus
uuuuucuuuuggcaauucuuuugagggguuuggugauccaggcaaaaccaaaacccccuuuaucuuggucaguuucacuguagugcucauaac

SEQ ID NO: 77370 - RNA, 48 nt, Mus musculus
uugaacuggguggcaugguggagguggcauggcgucugagcugagaga

SEQ ID NO: 77371 - RNA, 45 nt, Mus musculus
uuuuucuuuuuucucuuuauucuucuuugggauuuacuaggcuaa

SEQ ID NO: 77372 - RNA, 46 nt, Mus musculus
ugcuccguagaccaggcuggccuugaacacagagaucugccugccu

SEQ ID NO: 77373 - RNA, 45 nt, Mus musculus
uguuuccucuaagauuuuuuuuauuuuugaacucaggauagcagu

SEQ ID NO: 77374 - RNA, 41 nt, Mus musculus
ccaccuagugugugucuguacagcacugugauucuaagcua

SEQ ID NO: 77375 - RNA, 43 nt, Mus musculus
cccauuaggaaaccaccccuaccacuaaucccccaccugcaga

SEQ ID NO: 77376 - RNA, 45 nt, Mus musculus
uagaugugaucaguugucagccuguagaggauucuuguuaaagga

SEQ ID NO: 77377 - RNA, 43 nt, Mus musculus
cucggaguaccagugcugucuaaugcugccuucuccuccugca

SEQ ID NO: 77378 - RNA, 52 nt, Mus musculus
cuaaagaagcccuugugcucacguggcaucacauuuacuaaaaccagaacga

SEQ ID NO: 77379 - RNA, 47 nt, Mus musculus
uuagguuuuaaauacaugaguguguuacauaaucuguauuugcagga

SEQ ID NO: 77380 - RNA, 41 nt, Mus musculus
cuagcagagaugcugugaggaaacccacaccuuuauacuaa

SEQ ID NO: 77381 - RNA, 46 nt, Mus musculus
uuuacaguuagcacugacuaagugaauaaguacuuacauggaucag

SEQ ID NO: 77382 - RNA, 57 nt, Mus musculus
ugcugugccuuauuggagaaucuuucgaugacuacagugaugauguguguggagcug

SEQ ID NO: 77383 - RNA, 60 nt, Mus musculus
uuguuaauguuagagcuaaaggugauaagauagcaauauggacuacugagugugaaaaca

SEQ ID NO: 77384 - RNA, 28 nt, Mus musculus
aucagucccacgcagacacagcuacaaa

SEQ ID NO: 77385 - RNA, 65 nt, Mus musculus
auagguuuguuguuuaagaagacaccuucugaguauucucacaggagacugcgucacgcaaucga

SEQ ID NO: 77386 - RNA, 46 nt, Mus musculus
cgccuuugucuuguacuucuguguucauucuccucccccaccccca

SEQ ID NO: 77387 - RNA, 46 nt, Mus musculus
uuuuuacuuaauggccagaaaauuagcguaaggaaaguauauagag

SEQ ID NO: 77388 - RNA, 46 nt, Mus musculus
uuugucugcaguacguaauuguauaguucagauccugugagaugag

SEQ ID NO: 77389 - RNA, 46 nt, Mus musculus
ucuuuguccauguuuuauuuauuuuuaaaaauaaagacccccaaac

SEQ ID NO: 77390 - RNA, 43 nt, Mus musculus
aggagggggaagaggaggaggaggagaaggagaaggaggagga

SEQ ID NO: 77391 - RNA, 45 nt, Mus musculus
auucugcccccaggaggaagagauaguacaaaacauauguaagau

SEQ ID NO: 77392 - RNA, 44 nt, Mus musculus
auauaaacaaguacaagguccugcuaauggaaagcaagacaggu

SEQ ID NO: 77393 - RNA, 49 nt, Mus musculus
gugucagcuuaugggaaaggcugcaugaggauagacagcgggaaaccag

SEQ ID NO: 77394 - RNA, 48 nt, Mus musculus
gcauguacuaggguggguuuuauggagggaacuuggaacuagacggag

SEQ ID NO: 77395 - RNA, 46 nt, Mus musculus
ucaugguagucugugucauguugucagucuuucucauguugggcag

SEQ ID NO: 77396 - RNA, 42 nt, Mus musculus
uucuuuuuaaccuccaaauaauuaauugaggaugggggagug

SEQ ID NO: 77397 - RNA, 46 nt, Mus musculus
ucuuaggccuaggcaugauuggacgggcauuugauuaacgccagau

SEQ ID NO: 77398 - RNA, 41 nt, Mus musculus
uggacgaaguagcuccaagaguucucacugugacagcccac

SEQ ID NO: 77399 - RNA, 74 nt, Mus musculus
uggcgagaaaaacagcacuuugucugaggaagauuauauugagagaagaagagaaguugaaaguaucuugaaga

SEQ ID NO: 77400 - RNA, 42 nt, Mus musculus
ucacccccaaggaguuccuuuuuaaacacccgaagugcacau

SEQ ID NO: 77401 - RNA, 43 nt, Mus musculus
ucaguuacugucucaucugcuggccauuggcuuggggaccuac

SEQ ID NO: 77402 - RNA, 46 nt, Mus musculus
aaaagacuggagaugaaaaacaaaaucuuugccaaauccacuggag

SEQ ID NO: 77403 - RNA, 46 nt, Mus musculus
uugaaaaucccgaguuacuaacaacauucuuuugcuauauguagau

SEQ ID NO: 77404 - RNA, 42 nt, Mus musculus
aaagaagcuggcucaaaagaaacauuuaaauucaaaccagaa

SEQ ID NO: 77405 - RNA, 46 nt, Mus musculus
gauggcgaccacgcucguguguucccaccaaguaaagucacagacc

SEQ ID NO: 77406 - RNA, 45 nt, Mus musculus
uguauaucugaaggugucagauccccgagaagugaagggacagac

SEQ ID NO: 77407 - RNA, 46 nt, Mus musculus
agcauuuggaagcugauuaugggguggaucccuagguaaggcaguc

SEQ ID NO: 77408 - RNA, 42 nt, Mus musculus
cucacaugagucagagcacagcccaguacccuagccggauga

SEQ ID NO: 77409 - RNA, 45 nt, Mus musculus
aacgacacguucuuuguuaucaccuggaugguaaaaaagccagaa

SEQ ID NO: 77410 - RNA, 45 nt, Mus musculus
ugacagguacaacuucggaacaguuugaacagauguucaccaagu

SEQ ID NO: 77411 - RNA, 42 nt, Mus musculus
aucauccacaccaucgcucuggggccuucggcugcccgagaa

SEQ ID NO: 77412 - RNA, 47 nt, Mus musculus
aacgaacaugaacuaaaaaugcuguucucaacuguugcauguaguuu

SEQ ID NO: 77413 - RNA, 81 nt, Mus musculus
aaugguaacucaagccucuaccuaccuguuugaagccagccaaggaagaguuuauuucagaaacauaagcauauuaguccc

SEQ ID NO: 77414 - RNA, 45 nt, Mus musculus
caaauguaucccaguuuuucaguuacucugugcacacacacuuga

SEQ ID NO: 77415 - RNA, 28 nt, Mus musculus
uugaagaugaggucgugaguuuguuagg

SEQ ID NO: 77416 - RNA, 41 nt, Mus musculus
ccuucuguuccucacccugcaucuccugcagaacacagaga

SEQ ID NO: 77417 - RNA, 42 nt, Mus musculus
cagcuucggccuaggcucgugagcucauggaaucugcagcug

SEQ ID NO: 77418 - RNA, 46 nt, Mus musculus
ggagggagccagggacuuagacgggagcccagaagcuggcgaugga

SEQ ID NO: 77419 - RNA, 91 nt, Mus musculus
gccagugggugaagcaggagguggagggcgggcccgaggugaaggaugagaaaggcguguuggaagugaagcaggaggcggauaguagccu

SEQ ID NO: 77420 - RNA, 49 nt, Mus musculus
aagugaaggaagagaaggugaaggugaaggaggaggugacggacuggga

SEQ ID NO: 77421 - RNA, 34 nt, Mus musculus
augcagcgccuauaaaagaagaggguucccucaa

SEQ ID NO: 77422 - RNA, 42 nt, Mus musculus
gggucccugaagucugaguggugaaguucagguugggcguga

SEQ ID NO: 77423 - RNA, 41 nt, Mus musculus
uagcgcaugccuuuaaucccagugcucaggaggcagaggca

SEQ ID NO: 77424 - RNA, 45 nt, Mus musculus
ccuguaaacugugaaaugcccuugaguccaaauucuaagaccgga

SEQ ID NO: 77425 - RNA, 45 nt, Mus musculus
aggggagguaguugagugggggaguugggagguauagagcagcag

SEQ ID NO: 77426 - RNA, 45 nt, Mus musculus
guuggagacauuuagagggaaacucugaguggaaacauaggcaga

SEQ ID NO: 77427 - RNA, 49 nt, Mus musculus
agacgcaggcugggaacaggacgccugugcuccggggauuagcagggca

SEQ ID NO: 77428 - RNA, 45 nt, Mus musculus
ccuguaagaguuuccaagcauucugaguaaacaugagacuaaggg

SEQ ID NO: 77429 - RNA, 45 nt, Mus musculus
gucauagaacaaacgcuuuggucagguuguagccugucugcgcca

SEQ ID NO: 77430 - RNA, 46 nt, Mus musculus
gaucgauguguuugggguaaaaauuaaauccauagugagcagccac

SEQ ID NO: 77431 - RNA, 46 nt, Mus musculus
aggggcaggugagggaucuauggcacagcucaucucaucagguaga

SEQ ID NO: 77432 - RNA, 42 nt, Mus musculus
uauucugaccucaucaagguccaagacucauuuaaaaggaag

SEQ ID NO: 77433 - RNA, 41 nt, Mus musculus
ucuuggaggccaaaggaaagcccuuuggaacuggaguuuua

SEQ ID NO: 77434 - RNA, 45 nt, Mus musculus
cguaagagaagcaagaaggcuucacuggugaucacauggggagac

SEQ ID NO: 77435 - RNA, 42 nt, Mus musculus
acuggcucuauugcaugcauggugugugugucugugugugag

SEQ ID NO: 77436 - RNA, 49 nt, Mus musculus
aaagcuugacuaauugauaaucugguuauuaucguugcucagauaguug

SEQ ID NO: 77437 - RNA, 46 nt, Mus musculus
cacauccuaaaguauauggacuggaugguuucuuagaggaagauaa

SEQ ID NO: 77438 - RNA, 46 nt, Mus musculus
uuggaggaaucuaaaaggaagguucuagaauuuauaaaacucccaa

SEQ ID NO: 77439 - RNA, 42 nt, Mus musculus
uaaauuuaaaauauacacauauguaaaaauguuuccagcgac

SEQ ID NO: 77440 - RNA, 54 nt, Mus musculus
aagauugaauguuuuuuuauuuaucaaaguguagcuuuuggggagggaggggaa

SEQ ID NO: 77441 - RNA, 74 nt, Mus musculus
uggacggacagcagcgcagccgcaguuggagaaugccaaggggcugauguggacggacagcagcgcagccgcag

SEQ ID NO: 77442 - RNA, 85 nt, Mus musculus
gcagaccagaacugugaagaugcgguuccgaugcgaagauggagagauguuuuccaagaaugucaugaugauccaguccugcaaa

SEQ ID NO: 77443 - RNA, 131 nt, Mus musculus
ggcaagaaaugcagcaagaccaagaaauccccagaaccagucagauuuacuuaugcaggaugcuccagugucaagaaauaccggcccaaauacugcggcuccugcguagauggccggugcugcacaccucu

SEQ ID NO: 77444 - RNA, 38 nt, Mus musculus
aggcugcuguacacugguuguccacaaggacgcacuuc

SEQ ID NO: 77445 - RNA, 46 nt, Mus musculus
guuaccaaugacaacccagagugccgccuggugaaagagacccgga

SEQ ID NO: 77446 - RNA, 46 nt, Mus musculus
gcggcacucuggguugucauugguaacucguguggagaugccaguu

SEQ ID NO: 77447 - RNA, 49 nt, Mus musculus
gaaccgcgaguucuuuucaacccucugcacgcccauggccagaaaugca

SEQ ID NO: 77448 - RNA, 84 nt, Mus musculus
ugggaccaagacguggucugaacgaugcauuucuggccaugggcgugcagaggguugaaaagaacucgcgguucggugccaaag

SEQ ID NO: 77449 - RNA, 78 nt, Mus musculus
accuccucggacucgaugccucggagguggaguuaacgagaaacaaugaguuaaucgcaauuggaaaaggcagcucac

SEQ ID NO: 77450 - RNA, 47 nt, Mus musculus
gcacugcccgcugacuuucaccagccggggguugggacagcccagau

SEQ ID NO: 77451 - RNA, 45 nt, Mus musculus
gggcugucccaacccccggcuggugaaagucagcgggcagugcug

SEQ ID NO: 77452 - RNA, 45 nt, Mus musculus
uaacuccagaaucuaccaaaacggggaaagcuuccagcccaacug

SEQ ID NO: 77453 - RNA, 46 nt, Mus musculus
uacggaaaagugauuccugacuaacuuauuguucagcucuggaguc

SEQ ID NO: 77454 - RNA, 46 nt, Mus musculus
ccuccagagggcaguggcaggcggcggggcagguggagagcgccug

SEQ ID NO: 77455 - RNA, 42 nt, Mus musculus
gccucggcuccgacgacgggcggccgcgggaagcaggcggag

SEQ ID NO: 77456 - RNA, 46 nt, Mus musculus
aagccuaaaggauuuuaaaaaagaaagaaagaggaaagucagccag

SEQ ID NO: 77457 - RNA, 42 nt, Mus musculus
guucaauuaucagaaauucaaauaaauggcaaaagcacccau

SEQ ID NO: 77458 - RNA, 41 nt, Mus musculus
ccugaaggccagccugucuaacaauugguaaaugccagaca

SEQ ID NO: 77459 - RNA, 45 nt, Mus musculus
accaccacccagcuuuggcugggauucuuuacagcacacauucau

SEQ ID NO: 77460 - RNA, 45 nt, Mus musculus
ugugaaguauggacuguaucuaaauggauguacuguuugugcugg

SEQ ID NO: 77461 - RNA, 45 nt, Mus musculus
ggagaagcagccaagaagaagaaguagagaauugugacuccugag

SEQ ID NO: 77462 - RNA, 44 nt, Mus musculus
uggugagagcuugaggaacugggcagagggguacacagcaguga

SEQ ID NO: 77463 - RNA, 45 nt, Mus musculus
ugugcacuuguauuagggaggucuccuacucugauucugcagcug

SEQ ID NO: 77464 - RNA, 46 nt, Mus musculus
cugcucggagaagaagcaacagggugcccugugauaaagccagcag

SEQ ID NO: 77465 - RNA, 46 nt, Mus musculus
cagcugagcgguggaagcaggaagggaggagggugcuggugcagug

SEQ ID NO: 77466 - RNA, 45 nt, Mus musculus
cucaaguagaaaugucagagacugcucaacuuccuugugguaacc

SEQ ID NO: 77467 - RNA, 46 nt, Mus musculus
uugaucaucaucauucauauauaauaacugucauaaaguaggccag

SEQ ID NO: 77468 - RNA, 60 nt, Mus musculus
cugcugacuggagugucuucaaguacgaaucccuucagaccccagaaagucugcuccuuu

SEQ ID NO: 77469 - RNA, 44 nt, Mus musculus
ccaggaagcugcuuccuaaaauaccuuguuacauaggcuuugua

SEQ ID NO: 77470 - RNA, 46 nt, Mus musculus
cuagguuucucaaaccacuuuucaugaaccagugaauauucaagag

SEQ ID NO: 77471 - RNA, 57 nt, Mus musculus; identical to SEQ ID NO: 55150

SEQ ID NO: 77472 - RNA, 46 nt, Mus musculus
gaaauggauacaagucgaaggaaauuccacuuauaaaggacuaggg

SEQ ID NO: 77473 - RNA, 46 nt, Mus musculus
accacguuuuaccuuaaaauuacgaucucuucagaagggcacuuuu

SEQ ID NO: 77474 - RNA, 46 nt, Mus musculus
aaauaagcugcugcuauugaaacugauaguuuuuuacuugucguua

SEQ ID NO: 77475 - RNA, 45 nt, Mus musculus
caaguuaauucuaacugcaugaaaugggauuggaagcaguccuug

SEQ ID NO: 77476 - RNA, 42 nt, Mus musculus
uagauucuuauaguugcuauuauuuuuugaacagggccuauu

SEQ ID NO: 77477 - RNA, 50 nt, Mus musculus
ccaagaccauugacaaccagcgcguuuacgacgagaccacaguagacccc

SEQ ID NO: 77478 - RNA, 42 nt, Mus musculus
cacugaaaacuagacagacuuguaaguaagccuugcccagga

SEQ ID NO: 77479 - RNA, 23 nt, Mus musculus
gggcuggggggggggcgacgugc

SEQ ID NO: 77480 - RNA, 45 nt, Mus musculus
gcagcggcgacacuugauguucacgcgguggaaacagcagcagcg

SEQ ID NO: 77481 - RNA, 45 nt, Mus musculus
agagcccuggacugagggagacuuguuggaguggcguugugcaga

SEQ ID NO: 77482 - RNA, 46 nt, Mus musculus
ucuccaaggauauaagauuguuuuaagucagacaaacccuguugua

SEQ ID NO: 77483 - RNA, 47 nt, Mus musculus
ugacugagaaaugacacuuugggagguuucuccguccucaucggugg

SEQ ID NO: 77484 - RNA, 46 nt, Mus musculus
guagcuugaauucaguuuugccaaaacucuuaguaauuuugaagau

SEQ ID NO: 77485 - RNA, 47 nt, Mus musculus
gaaaggaauuuugugaauuuuagggaggagaaagauagccuggagcu

SEQ ID NO: 77486 - RNA, 52 nt, Mus musculus
agaggcucuggcgauaccagcaacuucgaugacuaugaagaagaagaaaucc

SEQ ID NO: 77487 - RNA, 25 nt, Mus musculus
uucuugguguuuggaagugucugag

SEQ ID NO: 77488 - RNA, 46 nt, Mus musculus
uuauuguuuuuaucaucuuuauuauuauguuuauuguuagucagug

SEQ ID NO: 77489 - RNA, 46 nt, Mus musculus
uguaaauuuuaggggaaaaaaaguacuuacuuuucuccagccaguu

SEQ ID NO: 77490 - RNA, 45 nt, Mus musculus
guggagaauucaacagggaucacggaaaguugaggaagacuagau

SEQ ID NO: 77491 - RNA, 44 nt, Mus musculus
ggaaagaggaaggcaauuucuacaggaaggagaaaggagagaga

SEQ ID NO: 77492 - RNA, 41 nt, Mus musculus
cuguccacugccaccacuguuaccuuacauaagccacuaga

SEQ ID NO: 77493 - RNA, 46 nt, Mus musculus
gacauuagcauucacaugauagauaacugauuaguagcccaaaggu

SEQ ID NO: 77494 - RNA, 49 nt, Mus musculus
gggaaaaguaaauucuauucagaagagaauaagagcccaaggucaugaa

SEQ ID NO: 77495 - RNA, 43 nt, Mus musculus
ggucacagauuucggguucgccaaaagagucaagggcaggaca

SEQ ID NO: 77496 - RNA, 42 nt, Mus musculus
augauaacuugcaauaagauguguuauuugaaggcaauagau

SEQ ID NO: 77497 - RNA, 46 nt, Mus musculus
uaaacggaagugugaguuuccguggacugaugacugacucauagau

SEQ ID NO: 77498 - RNA, 44 nt, Mus musculus
aacacaucugagucaauuaacucauuuuauccauaggaaguacu

SEQ ID NO: 77499 - RNA, 42 nt, Mus musculus
uucucugacacguucuuuaccacguuuucagaagcaccgucu

SEQ ID NO: 77500 - RNA, 31 nt, Mus musculus
uagaguaaugcugggcuugaggauuuugaga

SEQ ID NO: 77501 - RNA, 45 nt, Mus musculus
aaauacuuaaaaauauaaaaauaaaaacaugcaaauaacugaaua

SEQ ID NO: 77502 - RNA, 45 nt, Mus musculus
ggugugggaggggugaauaacaaacaugagugaaagguuguagaa

SEQ ID NO: 77503 - RNA, 31 nt, Mus musculus
uccuuuguuacagcugauaaggggagcaaga

SEQ ID NO: 77504 - RNA, 28 nt, Mus musculus
augcacagcgauaggugcuguugccuuc

SEQ ID NO: 77505 - RNA, 46 nt, Mus musculus
gaagaaaagcaagaaucuaggguuguuuguaacuugucacccuggu

SEQ ID NO: 77506 - RNA, 42 nt, Mus musculus
auguugccgugguaacagcucaugcugauaggauugagaaua

SEQ ID NO: 77507 - RNA, 102 nt, Mus musculus
cucgcuggauccaacaugggcuugugugaguaugugaagcaaacagcauuuaaagauaggcuugagcggugugggaagaggguagcucagugcuuacaugga

SEQ ID NO: 77508 - RNA, 45 nt, Mus musculus
cacuagcaacagcacacagcacuugagucuccgugagguccgcag

SEQ ID NO: 77509 - RNA, 45 nt, Mus musculus
ucuauaguauguagccuauuguuucuggcaucuucuaucuauguu

SEQ ID NO: 77510 - RNA, 46 nt, Mus musculus
aaaaccauuuucaucaacauauucucucucucucauucugugugug

SEQ ID NO: 77511 - RNA, 45 nt, Mus musculus
auugguaugcuguuucuauaauuuucauauguauuagccuugagu

SEQ ID NO: 77512 - RNA, 42 nt, Mus musculus
gugaaaugcagcuaaaucccgaauuugaggagaugaagagau

SEQ ID NO: 77513 - RNA, 45 nt, Mus musculus
ccgugugauauuggugaagaauguggcugcuuuuugcccuugucu

SEQ ID NO: 77514 - RNA, 46 nt, Mus musculus
aacugcccaacuagagagagcaggaguugggaagauguggagagag

SEQ ID NO: 77515 - RNA, 46 nt, Mus musculus
auaaauauacauuggaauuuacuuugacuccaaaaaaaugaaauau

SEQ ID NO: 77516 - RNA, 41 nt, Mus musculus
gaguaaccagugcuuccuggauuucuaagggugcggggaga

SEQ ID NO: 77517 - RNA, 48 nt, Mus musculus
ggaguauauaccuacaaguaggaggccuagauagauagaugaagggag

SEQ ID NO: 77518 - RNA, 45 nt, Mus musculus
uaagagcauaaugaggucgguuaggagcugcaucuuacugccacu

SEQ ID NO: 77519 - RNA, 46 nt, Mus musculus
acaaaggagagauuaaaccuguagagaccauauccaguggauaggc

SEQ ID NO: 77520 - RNA, 45 nt, Mus musculus
gauaaaggaggagaugggggagaaguacagagggucaggaauuug

SEQ ID NO: 77521 - RNA, 46 nt, Mus musculus
gccauuuaucacagcagcaaaaaacaaauuagaacaaugggcaguc

SEQ ID NO: 77522 - RNA, 46 nt, Mus musculus
auguauuagagucuauacauauaaaauagaaaauggguguccuugu

SEQ ID NO: 77523 - RNA, 46 nt, Mus musculus
gagccguuucuuuagccccaaauuuacaauaucuaaaaugggagaa

SEQ ID NO: 77524 - RNA, 46 nt, Mus musculus
cuuguaaaacugccgacaucuauggcuaccauggaaguaaauggga

SEQ ID NO: 77525 - RNA, 46 nt, Mus musculus
guagagaagcccugccaaaaaguauuaaagcacauuagcagcaucu

SEQ ID NO: 77526 - RNA, 45 nt, Mus musculus
cuguagugagggaugggcgucaugcccuauggcuacacuggagau

SEQ ID NO: 77527 - RNA, 46 nt, Mus musculus
gauggguuauauccaauucuaaaacagcaacaacaaaaguauuuca

SEQ ID NO: 77528 - RNA, 64 nt, Mus musculus
ugcuggagcugagaguaaauuagaccacaagacguuaccagcagcacaguguuugguuugaaga

SEQ ID NO: 77529 - RNA, 48 nt, Mus musculus
uuuccucguagaccuguggacaagauccuaaagugucacuuacugugu

SEQ ID NO: 77530 - RNA, 46 nt, Mus musculus
cagaccugaagaaacaagaauugagaucauguuaucaacgagagag

SEQ ID NO: 77531 - RNA, 42 nt, Mus musculus
aggcucgggggugagggccaagccccggggcucacuggagag

SEQ ID NO: 77532 - RNA, 32 nt, Mus musculus
gcgaucgccaagaaaggcagcgaaguggagag

SEQ ID NO: 77533 - RNA, 53 nt, Mus musculus
gcgaugcugaacccuggccuacccagcaccacauagaaguccaggccguagau

SEQ ID NO: 77534 - RNA, 43 nt, Mus musculus
caugggguucuccuuuuccccuugaucuugcgccaugguggag

SEQ ID NO: 77535 - RNA, 45 nt, Mus musculus
gcgcugugggagcugcugaccaauccucaguggcuggcugugcac

SEQ ID NO: 77536 - RNA, 66 nt, Mus musculus
gaucaggcaugaccucccaggggugcucacgggagauaguaccucgcaugcggaguacuucccugg

SEQ ID NO: 77537 - RNA, 47 nt, Mus musculus
gcagguugacauaagaggccucugugaguggcugauggucagcccug

SEQ ID NO: 77538 - RNA, 40 nt, Mus musculus
gcucgcuggccaguguuccuggaggagaugacgcugacau

SEQ ID NO: 77539 - RNA, 48 nt, Mus musculus
ccucuucagguuuaugauguagauaccgucacuuuuccuuuuguagau

SEQ ID NO: 77540 - RNA, 44 nt, Mus musculus
cgaugggaaucaagaacaacgccguauggacccguccccgggua

SEQ ID NO: 77541 - RNA, 42 nt, Mus musculus
ccccucaaauuauaauauuuacaggaaaacgaaaggauggag

SEQ ID NO: 77542 - RNA, 41 nt, Mus musculus
ucuggccucauuaucaguaacuucauccuuuguguggcaga

SEQ ID NO: 77543 - RNA, 46 nt, Mus musculus
acaugaucugccacacaaaggaugaaguuacugauaaugaggccag

SEQ ID NO: 77544 - RNA, 44 nt, Mus musculus
uggauaugggcugccauuuccaaaaaacccugaccagcguggcg

SEQ ID NO: 77545 - RNA, 46 nt, Mus musculus
uucuuccguccauuguuggcacauuaagugagcagccacacaaugc

SEQ ID NO: 77546 - RNA, 46 nt, Mus musculus
uguuuuuguuauuaaagacaaagaacaucccaaguuuaaaagagac

SEQ ID NO: 77547 - RNA, 45 nt, Mus musculus
gagaucaaaaaaggguggaaagaaggcaccaaaaucacuuuuccg

SEQ ID NO: 77548 - RNA, 45 nt, Mus musculus
aagacccucccauuauucaugaacuuaaaguaucgcuugaagaaa

SEQ ID NO: 77549 - RNA, 46 nt, Mus musculus
aauguggcaugaggaucuccguggaaaguguaccugaagguaccuc

SEQ ID NO: 77550 - RNA, 41 nt, Mus musculus
uaaaaaagacaaagaaaaagcaaaauaacacacacagguga

SEQ ID NO: 77551 - RNA, 46 nt, Mus musculus
uucaaacagggccaugcauuaagcaaacuaaaccgacaacucagag

SEQ ID NO: 77552 - RNA, 26 nt, Mus musculus
gaggaaaaauuuaaagaggucgcaga

SEQ ID NO: 77553 - RNA, 45 nt, Mus musculus
agacuauuaucacauuuugggaauugacaaaggagcuacagauga

SEQ ID NO: 77554 - RNA, 47 nt, Mus musculus
auggcaaagaaagaaagaaacagacagacagagggagagagaaagag

SEQ ID NO: 77555 - RNA, 46 nt, Mus musculus
uuuuuggugacuuccuauaaaagagaauaauaaagaaggccuaauu

SEQ ID NO: 77556 - RNA, 33 nt, Mus musculus
uuuagccucucugaaaauccgaagccuuuccua

SEQ ID NO: 77557 - RNA, 41 nt, Mus musculus
uuugagccagucuagcuagccagccaucagucacccagauu

SEQ ID NO: 77558 - RNA, 46 nt, Mus musculus
gcggguguucgugugugugugugugugugugugugugugugguggu

SEQ ID NO: 77559 - RNA, 46 nt, Mus musculus
gcaguacaaggaaagaagcauuuaucaaauaaggagaggcagguag

SEQ ID NO: 77560 - RNA, 46 nt, Mus musculus
uuuuauuaagugcgugugcgugucgugcaugauguuggaggucagg

SEQ ID NO: 77561 - RNA, 46 nt, Mus musculus
aaacagagucuaagaaucaagaugacuacaaugagcauucaugaag

SEQ ID NO: 77562 - RNA, 46 nt, Mus musculus
ggacuugguccaccuaaaauauguuaauuugucugguauucucaug

SEQ ID NO: 77563 - RNA, 46 nt, Mus musculus
uucacacuuuaagggaacuaagaaaauaaacacaggacacagauaa

SEQ ID NO: 77564 - RNA, 46 nt, Mus musculus
cggucaaggcaugcaugccaagggcuacaagagcaucuagguagag

SEQ ID NO: 77565 - RNA, 82 nt, Mus musculus
aauccuuugcccuagaaaaggauucauguaaucaggccucuuccccuuccuccagcgauugguccacuuugcuacccaaggc

SEQ ID NO: 77566 - RNA, 60 nt, Mus musculus
acaguauagucaaguugacaacccggaauagccauuagagauauuaugcaaggaccauac

SEQ ID NO: 77567 - RNA, 94 nt, Mus musculus
gccgccaugccaagauccaagucagaaacuugugucuucuagccuuaagaucuagauuacaggugagcccuccaauucuggauuguaguucauu

SEQ ID NO: 77568 - RNA, 46 nt, Mus musculus
aaguagauuccagugugcuggcaaguaagugcaagugcaagcagau

SEQ ID NO: 77569 - RNA, 45 nt, Mus musculus
uccuucuuguuuauguuucacuaacaacaacaaaaaaaauaaaga

SEQ ID NO: 77570 - RNA, 45 nt, Mus musculus
cugcugcuccagcccuggcccaauuacuaucacuguagucccaga

SEQ ID NO: 77571 - RNA, 44 nt, Mus musculus
acacuggcaagaguuaauacggucaagaaaaggcaggggcaggg

SEQ ID NO: 77572 - RNA, 45 nt, Mus musculus
gcaccaccaauugugauaacugaaaauaucuucaggcacugaguu

SEQ ID NO: 77573 - RNA, 42 nt, Mus musculus
uccucgcggagggaggcgccgcucucgguuaacugcuaagaa

SEQ ID NO: 77574 - RNA, 44 nt, Mus musculus
gcgggaagcggcggggaccgcuagccaggcagccggcccucccu

SEQ ID NO: 77575 - RNA, 42 nt, Mus musculus
ggggcgggaucugcgugcgauccaccaauccuuuccccagcu

SEQ ID NO: 77576 - RNA, 45 nt, Mus musculus
cccggggccauuuggagcuggggaaaggauugguggaucgcacgc

SEQ ID NO: 77577 - RNA, 43 nt, Mus musculus
ccaauaaccugaacgucaaugucuucaaguagcccccgccccc

SEQ ID NO: 77578 - RNA, 45 nt, Mus musculus
uucuggaaggacagcucuaagagguagucagcuaauauaggauaa

SEQ ID NO: 77579 - RNA, 46 nt, Mus musculus
ccuaccucugccuuuaggacuaaaggugugugccacccaugcccag

SEQ ID NO: 77580 - RNA, 48 nt, Mus musculus
uuucuaaaaauuauuuucuuuauuuacauuccugcccacucaccccca

SEQ ID NO: 77581 - RNA, 45 nt, Mus musculus
uuauaaguuuggugcaacugugucuuugaggaugaaugugcgcau

SEQ ID NO: 77582 - RNA, 47 nt, Mus musculus
caaaugacuaugguuaugggggacaaaaaagacccuuagaagaugga

SEQ ID NO: 77583 - RNA, 46 nt, Mus musculus
uauuuauuaccuguguuuaguauguaaaugugaaauaagccagugg

SEQ ID NO: 77584 - RNA, 46 nt, Mus musculus
ucucuugguuuaugugucugaauuuuugcuauacaaaagccuugaa

SEQ ID NO: 77585 - RNA, 46 nt, Mus musculus
ccaauauaucauguauuuuaauaaauaucauuauucuugcuuggug

SEQ ID NO: 77586 - RNA, 42 nt, Mus musculus
caagugcugggauuaaaaggcgugacccaccacugcccggcu

SEQ ID NO: 77587 - RNA, 42 nt, Mus musculus
uuauauaugagugcacuguagcugccuucaggcacacuagaa

SEQ ID NO: 77588 - RNA, 46 nt, Mus musculus
ugugugccuugccauacucaacaggguugguauuacaaaugucuag

SEQ ID NO: 77589 - RNA, 46 nt, Mus musculus
cacauugggaaaaugguauagaaacauuguuaauuugggaaaacag

SEQ ID NO: 77590 - RNA, 62 nt, Mus musculus
guaauuggcagaggaggugaacagaucucacgaauacagcaggaaucuggaugcaagauaca

SEQ ID NO: 77591 - RNA, 46 nt, Mus musculus
gacagauuuggaaauuacauaucauaaaaauaucuuugaaccucau

SEQ ID NO: 77592 - RNA, 46 nt, Mus musculus
ugauuccagccagcaaagcaggacuaguuauuggaaaggggggcga

SEQ ID NO: 77593 - RNA, 58 nt, Mus musculus
uuucagagaagugcggaaugaguauggcucaagaauaggaggcaaugaagggauagau

SEQ ID NO: 77594 - RNA, 45 nt, Mus musculus
caauuccaagauuugcuguuggcauuguaauaggaagaaauggag

SEQ ID NO: 77595 - RNA, 45 nt, Mus musculus
aagguguguauaaaauagacuuuaguguguuuugcauuaguucua

SEQ ID NO: 77596 - RNA, 46 nt, Mus musculus
ucuggugcaagaauagaacugcagagaagcccuccaccuaaugcag

SEQ ID NO: 77597 - RNA, 45 nt, Mus musculus
ccaaaauucaaagaggguaaauuuaaauuuguuauuuaagcguag

SEQ ID NO: 77598 - RNA, 45 nt, Mus musculus
aaucuacuauuaauauguuagcuucauuguauacugcuggucaca

SEQ ID NO: 77599 - RNA, 45 nt, Mus musculus
cuuuuuucuuuguuuuucuuuuguuuuuucacuuugcagccccug

SEQ ID NO: 77600 - RNA, 45 nt, Mus musculus
gagccgggcggcaguggugaacgccauuagucccagcacacagga

SEQ ID NO: 77601 - RNA, 26 nt, Mus musculus
augaaagaugagugucgauuagcaaa

SEQ ID NO: 77602 - RNA, 45 nt, Mus musculus
uacacuugaagcucucuucagaaacaccagcagagggcaucagau

SEQ ID NO: 77603 - RNA, 46 nt, Mus musculus
cugcauguaucuaaccuuuguuucuuucuuguacaaauuaguccau

SEQ ID NO: 77604 - RNA, 58 nt, Mus musculus
caacccccaccugcagcuccugccggugcaccagcuacaacccaaacgaacggacaag

SEQ ID NO: 77605 - RNA, 46 nt, Mus musculus
aaaaugcucacacauaaaauuaaacaguaucuuuaaaaacaugcag

SEQ ID NO: 77606 - RNA, 46 nt, Mus musculus
agugcuucaaagcuauuuguggcuuuucuaaaaaugugugcaggag

SEQ ID NO: 77607 - RNA, 42 nt, Mus musculus
cagcuccagcuggacagguugauuauacaaaggcuugggaag

SEQ ID NO: 77608 - RNA, 46 nt, Mus musculus
uccuggaacuugcuuuguagacaaggcuggccucaaacucggagau

SEQ ID NO: 77609 - RNA, 44 nt, Mus musculus
ugcuuacauaauuucuucucugaacugugauauuuuugagagua

SEQ ID NO: 77610 - RNA, 46 nt, Mus musculus
gucagcaacgguguacuuauuuaugacaguaaauaaaucuuugggu

SEQ ID NO: 77611 - RNA, 45 nt, Mus musculus
guugcaggagcuugcuagccaacuguggauucaguaaaaggagca

SEQ ID NO: 77612 - RNA, 46 nt, Mus musculus
cauuuuuguauuaaaguugaggggguguuuuaggucacaagggcag

SEQ ID NO: 77613 - RNA, 46 nt, Mus musculus
uucauugugugggggaaaaaaccuuuguuaaauauauggaugcaga

SEQ ID NO: 77614 - RNA, 46 nt, Mus musculus
uuuuaaacacuggcauguuuuuuccccuguuggaguauagugguag

SEQ ID NO: 77615 - RNA, 46 nt, Mus musculus
gccuuuucauuaaauguuaguucuaucaucuguggggagcaccauu

SEQ ID NO: 77616 - RNA, 45 nt, Mus musculus
agugacuucccuuccccuuauuuagaucuggaugcauagcucuag

SEQ ID NO: 77617 - RNA, 46 nt, Mus musculus
cuuaacuauuacuauuaaacuucauacuagagcuaugcauccagau

SEQ ID NO: 77618 - RNA, 46 nt, Mus musculus
caugacuuguauuugcugacaaggaagaauaaagaauacuggcagu

SEQ ID NO: 77619 - RNA, 42 nt, Mus musculus
gcugcaagcaccaaaucauagcucauaaaaucagguccugag

SEQ ID NO: 77620 - RNA, 46 nt, Mus musculus
uaagcauuucaaauagcaccagucuuaaccuuuaaaugggaaguag

SEQ ID NO: 77621 - RNA, 46 nt, Mus musculus
uuucuuaaagaaggaucuugguacuuaauugauaaaguggguuuag

SEQ ID NO: 77622 - RNA, 81 nt, Mus musculus
guuacaugucuaguaaauugauguagaauuaacucgcuggagauaaucucauuuuaguucugcaaauucugccuggcuuua

SEQ ID NO: 77623 - RNA, 46 nt, Mus musculus
guguuaaaagaagauuggcuuaaaauggcuacugugaugggaacag

SEQ ID NO: 77624 - RNA, 45 nt, Mus musculus
gugcaagagucugugcugcaagaaaaugacguaaaaugcucaaug

SEQ ID NO: 77625 - RNA, 45 nt, Mus musculus
aacugagcugagaagugguaaaaagacacagcuuggcaguagaag

SEQ ID NO: 77626 - RNA, 23 nt, Mus musculus
uugaucucuuaaauuuccugccu

SEQ ID NO: 77627 - RNA, 49 nt, Mus musculus
ggauaucuauaguugcuguccuuacucagcucauguuugggcaguugug

SEQ ID NO: 77628 - RNA, 46 nt, Mus musculus
aacgugaugguuguagguucagacuucaguagguugagguagaugg

SEQ ID NO: 77629 - RNA, 46 nt, Mus musculus
uuugccugauuugaaaagccuugagaaagagaaggaaaacuguaag

SEQ ID NO: 77630 - RNA, 45 nt, Mus musculus
aguuaguucuugggcuuaaaugcagaaaugucacuuuugggggga

SEQ ID NO: 77631 - RNA, 45 nt, Mus musculus
uaaaaguuaucucaaacuaaugaccgaguuguggcacaagagcag

SEQ ID NO: 77632 - RNA, 46 nt, Mus musculus
ggaggaagagaagagccagucagauguggauuuucagucgugcgag

SEQ ID NO: 77633 - RNA, 46 nt, Mus musculus
ccuggagauggccaaagacuggcagaaagagaaggugugcaauaag

SEQ ID NO: 77634 - RNA, 46 nt, Mus musculus
agaaucuaucacugauguccaucugaaugaccuagcuacgucacag

SEQ ID NO: 77635 - RNA, 46 nt, Mus musculus
acauacuuagacacuguaauagauaaguacaguuaaaaaggaaaua

SEQ ID NO: 77636 - RNA, 46 nt, Mus musculus
aauggagagacuuguuuuuaaaucaguccaucaaacugaaaaggag

SEQ ID NO: 77637 - RNA, 46 nt, Mus musculus
aagauuucgacaugaacugauguuuuccaccaaaauuagcacccau

SEQ ID NO: 77638 - RNA, 46 nt, Mus musculus
aaauuaaaguuagaaggacaaaugguaaaaaccauaacauggcgag

SEQ ID NO: 77639 - RNA, 45 nt, Mus musculus
auuguaauaaaaugugcauuaaaguuaaugaagcguuguccucaa

SEQ ID NO: 77640 - RNA, 46 nt, Mus musculus
cgacagugguugaauaaauuuaagaccuuugcugaaccuggcccua

SEQ ID NO: 77641 - RNA, 46 nt, Mus musculus
aggaaagaaucaagagucuccucuccugauuauuguccauccccau

SEQ ID NO: 77642 - RNA, 45 nt, Mus musculus
uuuggcagguguggcagauguagagaugguugacagcaggcccuc

SEQ ID NO: 77643 - RNA, 46 nt, Mus musculus
gucagcuacagacacuacucacuauuuccaaaaccuuuagccagag

SEQ ID NO: 77644 - RNA, 49 nt, Mus musculus
auacacaaaggaggaagaaaaugcugugggaagaaagauggagguggag

SEQ ID NO: 77645 - RNA, 42 nt, Mus musculus
acaaaaaaacagagcagagacugaaggaaaggccauccagag

SEQ ID NO: 77646 - RNA, 45 nt, Mus musculus
agacagaugcagguucucacagccaaccauuggacuaagccugga

SEQ ID NO: 77647 - RNA, 51 nt, Mus musculus
guaauaauaauagacuuguaggauguaugggaggacagucacaaaaauaau

SEQ ID NO: 77648 - RNA, 44 nt, Mus musculus
aaaucccagcaaccacaugguggcucacagccauccguaagggg

SEQ ID NO: 77649 - RNA, 45 nt, Mus musculus
aguacuacaugaaacuuggcauguguguauuccuagcacuuggga

SEQ ID NO: 77650 - RNA, 46 nt, Mus musculus
cuccgaccuccaguuguucauguugacccugauguacuccaagcag

SEQ ID NO: 77651 - RNA, 43 nt, Mus musculus
gauuuucauccuuuuuucucauuuauuccuuuguacugggcau

SEQ ID NO: 77652 - RNA, 46 nt, Mus musculus
agggacaguugguaacuagguucucugaccuuuguucuacaggcag

SEQ ID NO: 77653 - RNA, 89 nt, Mus musculus
cucaaucgccuuuuccacauuaauagcaucaagcuugcccuaugacgagaaaggaagcagccuauuacagcuaccuaguacucaagugu

SEQ ID NO: 77654 - RNA, 42 nt, Mus musculus
ggcaaauagaaagcaauagccuaguagcuugcaagggcccag

SEQ ID NO: 77655 - RNA, 26 nt, Mus musculus
gaaaagacggaacaacuugaaaucuu

SEQ ID NO: 77656 - RNA, 49 nt, Mus musculus
gauucaacacagaguacccuguggagaagcugaugagggacgccaagau

SEQ ID NO: 77657 - RNA, 60 nt, Mus musculus
uugcuggagacauugccaaucagcuagccacugacgccgugcagauuuucggaggcuaug

SEQ ID NO: 77658 - RNA, 46 nt, Mus musculus
aaauuaaucccaagucugaagucauaacacucagcaggcugaaaca

SEQ ID NO: 77659 - RNA, 28 nt, Mus musculus
ucuagacgaagccacgaaguaugcccug

SEQ ID NO: 77660 - RNA, 46 nt, Mus musculus
gcucacaaccauccguaacaagaucugaccccuucuucuggagugu

SEQ ID NO: 77661 - RNA, 48 nt, Mus musculus
agccuuuacuggauucauuguggaagccgacaccccgggaauacauau

SEQ ID NO: 77662 - RNA, 47 nt, Mus musculus
gaauaaaguuggaacuuauuuuugaaauaauguuucguggaaagaag

SEQ ID NO: 77663 - RNA, 62 nt, Mus musculus
uggcggccauuaagaccaaagcagagaagaagggugacgaguauguuaucaacggccagaag

SEQ ID NO: 77664 - RNA, 46 nt, Mus musculus
auuucagcaguuuauuugguuuucuaagaacauuguaauucuagau

SEQ ID NO: 77665 - RNA, 41 nt, Mus musculus
gcuggaaaugaucaacaaaaaaagaaguauuuggggaggau

SEQ ID NO: 77666 - RNA, 41 nt, Mus musculus
agaguuucaagcaacugcccgcaaguuugccagagaggaga

SEQ ID NO: 77667 - RNA, 46 nt, Mus musculus
cauuuuauuugugggaacuuauauccuuaaccuuauugggggcuua

SEQ ID NO: 77668 - RNA, 46 nt, Mus musculus
cugcagcugcacguuacguauaagcauauacagcuugcugccaggu

SEQ ID NO: 77669 - RNA, 51 nt, Mus musculus
uuaggaacccuuccugaccggcuuauuccagacagcacgagaagaagcccc

SEQ ID NO: 77670 - RNA, 51 nt, Mus musculus; identical to SEQ ID NO: 77669

SEQ ID NO: 77671 - RNA, 51 nt, Mus musculus; identical to SEQ ID NO: 77669

SEQ ID NO: 77672 - RNA, 51 nt, Mus musculus; identical to SEQ ID NO: 77669

SEQ ID NO: 77673 - RNA, 42 nt, Mus musculus
ucuauguacucuguugugucacugcugucucuguccucuguu

SEQ ID NO: 77674 - RNA, 42 nt, Mus musculus; identical to SEQ ID NO: 77673

SEQ ID NO: 77675 - RNA, 42 nt, Mus musculus; identical to SEQ ID NO: 77673

SEQ ID NO: 77676 - RNA, 47 nt, Mus musculus
uguaugugauaccugcagaugagugcagauauguguguggugugugu

SEQ ID NO: 77677 - RNA, 45 nt, Mus musculus
uuauaaauauagcacaagaucaacuaacucuacaccuggcaaagu

SEQ ID NO: 77678 - RNA, 45 nt, Mus musculus
auguuagugggucucugcauugaugucagagucaugucuuuauac

SEQ ID NO: 77679 - RNA, 45 nt, Mus musculus
ggaugccccacccucuaacccugcaucagcuuacuggccaucagc

SEQ ID NO: 77680 - RNA, 46 nt, Mus musculus
uaaggacucugaggauuauucaggaguaaaugccuaggccauaagu

SEQ ID NO: 77681 - RNA, 41 nt, Mus musculus
cagagucugagcaaggcggaccuuagccgcaagggcagugu

SEQ ID NO: 77682 - RNA, 45 nt, Mus musculus
acucgcgccccaacuccggguucacaacuucccaggugcagguag

SEQ ID NO: 77683 - RNA, 60 nt, Mus musculus
acauaguggcacccaccuacaguagucuucaaaagaaagaagagagaccuagagagaguc

SEQ ID NO: 77684 - RNA, 48 nt, Mus musculus
aaaaccuaauacauuguuaacuacaucuugcgcauuuacaguucccag

SEQ ID NO: 77685 - RNA, 46 nt, Mus musculus
aagcagcauucugucacacugaagcggggccugcccuguccaugag

SEQ ID NO: 77686 - RNA, 24 nt, Mus musculus
cagugugagaugcuccaaaguggc

SEQ ID NO: 77687 - RNA, 46 nt, Mus musculus
acgccugcggugucaacccaguagagacauacauucgcucuggggc

SEQ ID NO: 77688 - RNA, 46 nt, Mus musculus
ugcuucugucuuagcauucugguuucuguccccacagcaucucuag

SEQ ID NO: 77689 - RNA, 45 nt, Mus musculus
aucuaacauucacuuugguuucugccacaccgucugucuugccgu

SEQ ID NO: 77690 - RNA, 46 nt, Mus musculus
ugccugucugugucugugccugugccugugccugucugugucugug

SEQ ID NO: 77691 - RNA, 46 nt, Mus musculus
gugccugugccugugccugugccugugucugugccugucugugucu

SEQ ID NO: 77692 - RNA, 42 nt, Mus musculus
ggagaagaagaaagggagagagagagagagagagagagagag

SEQ ID NO: 77693 - RNA, 45 nt, Mus musculus
uuuuugaaggaucagccagccagacgugguuguguuuagaagcga

SEQ ID NO: 77694 - RNA, 44 nt, Mus musculus
auuggagaaagcagcccaggcccacgaagauaucauucacggca

SEQ ID NO: 77695 - RNA, 46 nt, Mus musculus
aacaggacuuuagggaguagacacagugagugacauaauugcagag

SEQ ID NO: 77696 - RNA, 45 nt, Mus musculus
guuaagaccugucugcuuugguuuucauaguaucuuaaccuggag

SEQ ID NO: 77697 - RNA, 46 nt, Mus musculus
ggaagggguuugugccccagaucaagcccggguagccugcuuuccu

SEQ ID NO: 77698 - RNA, 41 nt, Mus musculus
ggacuugugccccagaucaagcccggguagccugcuuuccu

SEQ ID NO: 77699 - RNA, 45 nt, Mus musculus
gauuguccuacuguaggagcuugucaagaaaaucuaggggcucag

SEQ ID NO: 77700 - RNA, 46 nt, Mus musculus
agagagaaagagaaagagagagagagagagagagagaacgagaaca

SEQ ID NO: 77701 - RNA, 46 nt, Mus musculus
uaauguacucggugguuuaaaaaggaagagggauggggaggaggga

SEQ ID NO: 77702 - RNA, 45 nt, Mus musculus
aauacccagucguaagaugaaguacagaauaauauagggagacaa

SEQ ID NO: 77703 - RNA, 46 nt, Mus musculus
gaucuggaauguucucuggaaccggagugagaccuggacugcgaac

SEQ ID NO: 77704 - RNA, 46 nt, Mus musculus
uucccagggcuacaacagaacggacaaacagaagcagggcaaugag

SEQ ID NO: 77705 - RNA, 43 nt, Mus musculus
aaaugcacuuguaaaacuuaaacacauuuaaaggaggacagau

SEQ ID NO: 77706 - RNA, 45 nt, Mus musculus
gacauguaauucugacccuacccucuaaacccagccgucaccaga

SEQ ID NO: 77707 - RNA, 45 nt, Mus musculus
ucucaaguacagaguaauuuucauaugaagaaacaaugcacagaa

SEQ ID NO: 77708 - RNA, 46 nt, Mus musculus
acauuauuucuuuuuugaacuugaacgggaaccagaauguguugau

SEQ ID NO: 77709 - RNA, 45 nt, Mus musculus
aagguuuuaaaauaaaacagaaacggcuacaguucuuaucaggag

SEQ ID NO: 77710 - RNA, 46 nt, Mus musculus
aggagguuauggaggugguggaccaggauauggaaaucaguguggu

SEQ ID NO: 77711 - RNA, 65 nt, Mus musculus
acaagagaugcagucugcuggaucacagagagguuguggagguggaucuggcaacuuuauggguu

SEQ ID NO: 77712 - RNA, 46 nt, Mus musculus
cuuucaccauaggauuuaggggaaagcauuacguauuagacuacag

SEQ ID NO: 77713 - RNA, 24 nt, Mus musculus
agcuggagcucccaacgcagccag

SEQ ID NO: 77714 - RNA, 83 nt, Mus musculus
ucugaauacacaggggaaauguguguaaggggaguaaaggggagagggagggagagggagguagagagaaagagaaggggacg

SEQ ID NO: 77715 - RNA, 45 nt, Mus musculus
gggaagaggaagggagggggaaaagagagagaaagagagagagag

SEQ ID NO: 77716 - RNA, 42 nt, Mus musculus
aaaucugccauuaaaaacaaacacccaguguccaucuggcac

SEQ ID NO: 77717 - RNA, 42 nt, Mus musculus
acacaucaaacacaagacagagugagagcgcgcggcaccggc

SEQ ID NO: 77718 - RNA, 46 nt, Mus musculus
acuaguucagugacauaguucuuaagcacagaagggaggggcugac

SEQ ID NO: 77719 - RNA, 46 nt, Mus musculus
cugcauaaguuagucuguaagcgagcaggauucgaaguccgagccc

SEQ ID NO: 77720 - RNA, 46 nt, Mus musculus
agaauacgggauaaacaucguaguuugggaguaaauucgcugugag

SEQ ID NO: 77721 - RNA, 71 nt, Mus musculus
cugacuacaugguuccuaggauauuugaacuauuuuauauggcuagaauguggaaggcucuggaauguagg

SEQ ID NO: 77722 - RNA, 42 nt, Mus musculus
agaggcucaugugcuugaauauuuggucuccacuugggaaag

SEQ ID NO: 77723 - RNA, 46 nt, Mus musculus
auaauccaaauuaaacacuuucuuuuauaaauuaucuuggucaugg

SEQ ID NO: 77724 - RNA, 46 nt, Mus musculus
aguugcuaaacaggaagccuuccuugcugagcuuguagaaugcaag

SEQ ID NO: 77725 - RNA, 46 nt, Mus musculus
aauuauuuguuuucucucuuuaguggaaucuugcuguuuggcccag

SEQ ID NO: 77726 - RNA, 57 nt, Mus musculus
uaaaugcuuuuguuuugaacaugaaacuaaaaaccuagccuccauaucagacacagc

SEQ ID NO: 77727 - RNA, 42 nt, Mus musculus
uugcaugauuuggggcuguugggaauuuucacuaggcuggag

SEQ ID NO: 77728 - RNA, 41 nt, Mus musculus
uuuuucuuaaagauucaauaugcuuuaauucagggccugga

SEQ ID NO: 77729 - RNA, 45 nt, Mus musculus
ugauguggguagcauggaaucacuggaauugcuuuauuugcggag

SEQ ID NO: 77730 - RNA, 44 nt, Mus musculus
uugacagugugugauguggcugcaguggccaugggaagaagggg

SEQ ID NO: 77731 - RNA, 95 nt, Mus musculus
caucucacagaauuuaaaagugggcacaaaagagaacuugagucaaagagguaaagugccugaauauccggggaaagguauuguggaaaggaggu

SEQ ID NO: 77732 - RNA, 46 nt, Mus musculus
gauaaacaagcaaccuugauuccugaugaccuauuugaugccacaa

SEQ ID NO: 77733 - RNA, 46 nt, Mus musculus
guguuagaauuauuagcucuaaaauuauucgucuuauauaaugcag

SEQ ID NO: 77734 - RNA, 46 nt, Mus musculus
aaaagcagagcuguccaucuuuuuguuccuguuguugaagggcuag

SEQ ID NO: 77735 - RNA, 46 nt, Mus musculus
augguuuguuugggcagacguggaucaugccaacuaauggagucaa

SEQ ID NO: 77736 - RNA, 49 nt, Mus musculus
gauagaagaauuaaaucugcuuccaugucucacagcagaaagacugaag

SEQ ID NO: 77737 - RNA, 47 nt, Mus musculus
guguguacagucaaucauugugcauagaaacaaaaggcugcaggaga

SEQ ID NO: 77738 - RNA, 46 nt, Mus musculus
uuuaaguucuuugccugaagagaugucaucacugacaaaacugcaa

SEQ ID NO: 77739 - RNA, 46 nt, Mus musculus
cagcuuuugcucauuuugauucuuauaaucaauaguaucuucuaug

SEQ ID NO: 77740 - RNA, 41 nt, Mus musculus
ggagaagaggcccuuggucuagcaaagaucauauaccccag

SEQ ID NO: 77741 - RNA, 92 nt, Mus musculus
uuuucgaaaaaaaagggaaauuuugauuauagaacuuaaagcacacuuaaacagagucauccauuuuuaagggugauguaacucuugcccau

SEQ ID NO: 77742 - RNA, 42 nt, Mus musculus
cuuuugcagauucccccagagcuugggaacugugugcagcua

SEQ ID NO: 77743 - RNA, 46 nt, Mus musculus
uugcacuggggagagggauuucugaggucacacuacagggcaccaa

SEQ ID NO: 77744 - RNA, 46 nt, Mus musculus
ucagcccuuacccugaucucaguaguaaccaucuuaguacccccug

SEQ ID NO: 77745 - RNA, 46 nt, Mus musculus
aaauaaccagcccauaauuuguaaauuguaauugucuuauuuccaa

SEQ ID NO: 77746 - RNA, 74 nt, Mus musculus
uggaaauccauuccgaguuccucgagcggccauauuaaugaaaggcacagcugcugugcuggaguauuugagag

SEQ ID NO: 77747 - RNA, 46 nt, Mus musculus
gaguagccagcucaguagaagcaugugucagcucagugucagccug

SEQ ID NO: 77748 - RNA, 45 nt, Mus musculus
gacaucaaaacaaaaguuuccuaagaguuauacagcacucagcag

SEQ ID NO: 77749 - RNA, 43 nt, Mus musculus
ugagagauucgucuugguuucuccagagacuuuucacaaacaa

SEQ ID NO: 77750 - RNA, 46 nt, Mus musculus
cuugaucacaaacugucugaacugaagugccgcuucccccauacaa

SEQ ID NO: 77751 - RNA, 46 nt, Mus musculus
ucagcugcuuaugagguacccacaagguguuuacaggaaacccuag

SEQ ID NO: 77752 - RNA, 46 nt, Mus musculus
ugugaaucgguaaagcugaaaggaauccuuugcugccgugugggag

SEQ ID NO: 77753 - RNA, 41 nt, Mus musculus
aauugaggagaaguguaaacugucauuugaauggggcuuuc

SEQ ID NO: 77754 - RNA, 46 nt, Mus musculus
cagccaaaccccagaacuuguccagagaauuccacuguugccagag

SEQ ID NO: 77755 - RNA, 46 nt, Mus musculus
agcucauaacaggaaaagaugagcuucagaaagccuacagccagag

SEQ ID NO: 77756 - RNA, 42 nt, Mus musculus
agaacugcacauugguucucauuuccacauaaagcagaagau

SEQ ID NO: 77757 - RNA, 46 nt, Mus musculus
accucguggcaguguuuaccaacuggaucaacgacaggcacuaguu

SEQ ID NO: 77758 - RNA, 46 nt, Mus musculus
uugggggguuaggggguuucuuaagguaacauucuucaaggcaagu

SEQ ID NO: 77759 - RNA, 46 nt, Mus musculus
aaacucugacccaaaauaaaccacccuuaaguuguacugcccaggu

SEQ ID NO: 77760 - RNA, 45 nt, Mus musculus
gccuggaugcaauggaccaacugcuuccagguccugcugccauga

SEQ ID NO: 77761 - RNA, 45 nt, Mus musculus
uuguauauccaucucaugcuaagaaaauaaguauuuagccucagu

SEQ ID NO: 77762 - RNA, 46 nt, Mus musculus
ucuaguuaggggagcuaacuagacacaaagggaacaaguugaagau

SEQ ID NO: 77763 - RNA, 46 nt, Mus musculus
agacaaacgagcauuuguauaggagcuguaacaaugaggaacaguc

SEQ ID NO: 77764 - RNA, 44 nt, Mus musculus
uauauccuaucagauuauaaacaaggcuuccucaggcuggcagg

SEQ ID NO: 77765 - RNA, 42 nt, Mus musculus
ugcacuucuguuguaggggcguaaucacagugggcaggugga

SEQ ID NO: 77766 - RNA, 46 nt, Mus musculus
aauaaauuuuaaagcuucagucuaagaauaauuuugcucuguggau

SEQ ID NO: 77767 - RNA, 46 nt, Mus musculus
gcuuggaaagagauuaaagucucaaugaagaagaugaccccucccc

SEQ ID NO: 77768 - RNA, 45 nt, Mus musculus
uguaaugguauagcauuauugaacacuuaugaauucugugcagug

SEQ ID NO: 77769 - RNA, 77 nt, Mus musculus
ucuuuccauuacucaagugcaccccccguuuaggagugauggagggagaggagggauaaacaagcccagcagaagau

SEQ ID NO: 77770 - RNA, 45 nt, Mus musculus
acggagcagggacagcuuguugucaguaucauaaacaaccaaaau

SEQ ID NO: 77771 - RNA, 42 nt, Mus musculus
cugcugacagggcagggggcgacgcgacuggggacccgaagg

SEQ ID NO: 77772 - RNA, 45 nt, Mus musculus
aaaugcuuauuuguauauaaauauaauaaacccgugaccccaacu

SEQ ID NO: 77773 - RNA, 44 nt, Mus musculus
cuccgaugaagaaggcgaaaauuacucgaaagaaguuccugaga

SEQ ID NO: 77774 - RNA, 55 nt, Mus musculus
caagagguaugggggcuucaugagaagccucaaaagaagcccccaacuggaagau

SEQ ID NO: 77775 - RNA, 67 nt, Mus musculus
gaacgggagacaaccgugcgaaagacagccaccaacaagagagcaccaacaaugacgaagacaugag

SEQ ID NO: 77776 - RNA, 68 nt, Mus musculus
aagaagaagcgaacggaggagagauccuugccaagagguauggcggcuucaugaagaaggaugcagau

SEQ ID NO: 77777 - RNA, 46 nt, Mus musculus
cagugggacaguccaccgacacuucacucgagugucgaguacagac

SEQ ID NO: 77778 - RNA, 42 nt, Mus musculus
ucuuaaggagagagggauaagaguuuuaaaaaaaagggggaa

SEQ ID NO: 77779 - RNA, 60 nt, Mus musculus
uauugaaugcuucugcuuuagccuuguugcauaagacacaaagagauaacgcgucagaau

SEQ ID NO: 77780 - RNA, 45 nt, Mus musculus
aacauauauaauucauuuugucaaugguguuuuuguuggucgcag

SEQ ID NO: 77781 - RNA, 45 nt, Mus musculus
acaguuaaggacagacauuauguggcuuggcucaaacuccuaugg

SEQ ID NO: 77782 - RNA, 45 nt, Mus musculus
uccccuuugcuguucucugucugacuuccuaugcaugggggcugg

SEQ ID NO: 77783 - RNA, 97 nt, Mus musculus
cagggguuaggcccuggguuugaucuucagcauuggagggagacagagaagagaggguaacagggagacagagaaagaaagacaaaggaaaaggaga

SEQ ID NO: 77784 - RNA, 45 nt, Mus musculus
cuguuacuauucucugccaguagaaaaaaauaauaaaacaguaga

SEQ ID NO: 77785 - RNA, 46 nt, Mus musculus
ucuugguaaacauuuuucaagguuauuauuuuacaauucuaaaggu

SEQ ID NO: 77786 - RNA, 46 nt, Mus musculus
uucuucaguauuuauuaaacagaggaacuuacugacaaaggcaaua

SEQ ID NO: 77787 - RNA, 46 nt, Mus musculus
uaucaaauccuuaccaaauuccagaaaagaaaacaaacucucagac

SEQ ID NO: 77788 - RNA, 34 nt, Mus musculus
agugcccaaaaaaagcagcuuucuguaccucauu

SEQ ID NO: 77789 - RNA, 73 nt, Mus musculus
uuauuuucuauuuuaaaauuaaagauaacucaagcccuagaauguaaugacauucaugcacugaucucuaagc

SEQ ID NO: 77790 - RNA, 46 nt, Mus musculus
gagagucucuucacuauuuuauccauguaggaauagcagcauagaa

SEQ ID NO: 77791 - RNA, 45 nt, Mus musculus
gagucugcaguuccugccugcuguagauccacuuacgugucaaaa

SEQ ID NO: 77792 - RNA, 46 nt, Mus musculus
auagaaacauuuuaugugauaggaaaauaccacagauaauggagcu

SEQ ID NO: 77793 - RNA, 46 nt, Mus musculus
auuuuucuaaguagcuaaacuguucugucaccaucuacccccaugu

SEQ ID NO: 77794 - RNA, 63 nt, Mus musculus
gaacuagugccugcauuuaaggggcagaaaacuugguuguguugucuacauggcuggccaaag

SEQ ID NO: 77795 - RNA, 41 nt, Mus musculus
aaguaccaugacucuucauccccgugccaugcagcuggaga

SEQ ID NO: 77796 - RNA, 79 nt, Mus musculus
gcacgagguuuggcaggaugccucgucuuuccggcugauauucaucguggauguguggcaccccgagcugaccccucag

SEQ ID NO: 77797 - RNA, 41 nt, Mus musculus
ggaaaugauggguaaaugucuggaagguguguuggcccaca

SEQ ID NO: 77798 - RNA, 46 nt, Mus musculus
uaguagccugagcuggcauuuguguucucuuagggucugcguaaua

SEQ ID NO: 77799 - RNA, 46 nt, Mus musculus
uuguaucuauggagaccuguuuugugaacaauuauauggucaauuu

SEQ ID NO: 77800 - RNA, 42 nt, Mus musculus
auacuccaucaugcacccuggaacucauguguggccgcauac

SEQ ID NO: 77801 - RNA, 48 nt, Mus musculus
aagaccugugcuuuacuagaaaaguuuuccgaaacaacaggaugcaga

SEQ ID NO: 77802 - RNA, 44 nt, Mus musculus
ucgggagaagggcgacuggagccaguucacacuguggcagcaag

SEQ ID NO: 77803 - RNA, 78 nt, Mus musculus
ggaacguggucauugcaccuuuagcaaaacggguguucuuguuagauuggagggggaaagaggaucaagaggggagac

SEQ ID NO: 77804 - RNA, 42 nt, Mus musculus
agcaucaucagucacuaaaucugcccacaugaagccccagcu

SEQ ID NO: 77805 - RNA, 46 nt, Mus musculus
gggauuaguuuaagaaagaaaggaagaaagaaagaaagaaagagag

SEQ ID NO: 77806 - RNA, 46 nt, Mus musculus
ccaaaagaauaugcauaagcuuagaacaugauugauuagaagacca

SEQ ID NO: 77807 - RNA, 46 nt, Mus musculus
ugaguauugcaagauaaaggugagauucuaaucauguuggauaaga

SEQ ID NO: 77808 - RNA, 41 nt, Mus musculus
aaggagagggaggagaaggaagagaagaugauaggaggagg

SEQ ID NO: 77809 - RNA, 46 nt, Mus musculus
gagccuauaauucaggugcugugacacuggguuuauaaaucuagau

SEQ ID NO: 77810 - RNA, 28 nt, Mus musculus
cagaggaacauuuccuugcugguugaga

SEQ ID NO: 77811 - RNA, 46 nt, Mus musculus
guugauugccauagcugaaggcuuggcauuaggacagaugucaggg

SEQ ID NO: 77812 - RNA, 42 nt, Mus musculus
acaucugguuaacauuuaacccaugucagaagggugggagau

SEQ ID NO: 77813 - RNA, 45 nt, Mus musculus
uguguguaugugugugugugugugugugugucugugucugugugu

SEQ ID NO: 77814 - RNA, 45 nt, Mus musculus
uagcuccucccucuuucucucccuuccugagggcaaguuccaagg

SEQ ID NO: 77815 - RNA, 46 nt, Mus musculus
cagaggcuucauaucgaguccacauugucuucagcucuggucucac

SEQ ID NO: 77816 - RNA, 42 nt, Mus musculus
gccgguuuuacuuccacuugggggaugccaugcagagggucg

SEQ ID NO: 77817 - RNA, 42 nt, Mus musculus
gagagagagagagaaagaaagagaggaaggaaggaaggaagg

SEQ ID NO: 77818 - RNA, 46 nt, Mus musculus
cuacaccuauggugauuauaacuuuuauuggguguacuggcuggca

SEQ ID NO: 77819 - RNA, 56 nt, Mus musculus
agauaucaaugaccaaugucuguuaauaccuguuauuuugucguaguuauuaggag

SEQ ID NO: 77820 - RNA, 42 nt, Mus musculus
gugaugaggagaagauacacgcuuuuguguuugggugaaaug

SEQ ID NO: 77821 - RNA, 42 nt, Mus musculus
gucuuuuuuuuuucuuuucuuuucuuuuuuuuuuuuuuuuuu

SEQ ID NO: 77822 - RNA, 56 nt, Mus musculus
gaggcagccgaccugccugaugccccuacagaccuggugaagcugagcuugaagcg

SEQ ID NO: 77823 - RNA, 42 nt, Mus musculus
gugugaagaugacuuggcagagaagcagagaagcaaugaggu

SEQ ID NO: 77824 - RNA, 49 nt, Mus musculus
uccuauguguguguccuuagcaaccaacuuucccccaacuccaccccca

SEQ ID NO: 77825 - RNA, 77 nt, Mus musculus
augugcuguuuucugagaaguuucucacaaaugacuuuaucaacagguguuggcuuuuacaaaguauuugucacuua

SEQ ID NO: 77826 - RNA, 46 nt, Mus musculus
auaggaaguggguucccuggacacugccacaggaaagauggcagga

SEQ ID NO: 77827 - RNA, 51 nt, Mus musculus
acgcauuugaagaacugguucgaaaguacccucagagcccacgagcaagau

SEQ ID NO: 77828 - RNA, 45 nt, Mus musculus
gcaaagccaucuauggcuuuuguuguuguuuguuuugggucugug

SEQ ID NO: 77829 - RNA, 42 nt, Mus musculus
agaaguuauaugggggagagaucaucaaagacaugugcaugg

SEQ ID NO: 77830 - RNA, 46 nt, Mus musculus
ugcccuuaggagaagggcuuucuuugguuuacacagcagcccaagc

SEQ ID NO: 77831 - RNA, 45 nt, Mus musculus
aaucugucuuuaaugacaucgaaacaagaagaaaggaauacaggu

SEQ ID NO: 77832 - RNA, 43 nt, Mus musculus
aaacuuuauaugccccaguauaggggaacgccagggccagaag

SEQ ID NO: 77833 - RNA, 42 nt, Mus musculus
gguguaauaaaguuuugggagcaagaggagugcaguguggau

SEQ ID NO: 77834 - RNA, 23 nt, Mus musculus
cccacauucccugcugcucuccu

SEQ ID NO: 77835 - RNA, 65 nt, Mus musculus
ccaagacuaauuuguguaaugauugugacaaugugggcaggaaaggaaaacaggcuucucaaggg

SEQ ID NO: 77836 - RNA, 46 nt, Mus musculus
uguugaaauacgcauuugcuuuguuuuuaguuuucaucgcaggauu

SEQ ID NO: 77837 - RNA, 55 nt, Mus musculus
aaguaaucucaauacuagccugcagcugcgacaagagggucugagaugacugccg

SEQ ID NO: 77838 - RNA, 43 nt, Mus musculus
caguucagaccacaucccuuggucugagugaucugcccauauu

SEQ ID NO: 77839 - RNA, 42 nt, Mus musculus
uguguguggugugugugugcauguguguguguggugugugug

SEQ ID NO: 77840 - RNA, 58 nt, Mus musculus
uguguauaguuuuucucuagggguggagagaccccuucauaaccaguacccaccugau

SEQ ID NO: 77841 - RNA, 45 nt, Mus musculus
uucuuuugaaaucacauguuacuuugcauuccuguuuguccuuau

SEQ ID NO: 77842 - RNA, 45 nt, Mus musculus
ugcccccacuaccacaggaggaccagacuaauacgcuccaaaaga

SEQ ID NO: 77843 - RNA, 46 nt, Mus musculus
uguuucccuucccugagauuccuccauuugguguuaugagauaguc

SEQ ID NO: 77844 - RNA, 46 nt, Mus musculus
auuuuauuuuuaauuguuuguaugucugugugcauaaguaggagag

SEQ ID NO: 77845 - RNA, 41 nt, Mus musculus
uucuggggugaaggacucgauggaugcauaggacgggggga

SEQ ID NO: 77846 - RNA, 46 nt, Mus musculus
uaugggaucaaguucagaguugaaaagggucgugccgaagaaagug

SEQ ID NO: 77847 - RNA, 45 nt, Mus musculus
ugccugacaaaggcuaagacaguguguccccaggauaucagaaga

SEQ ID NO: 77848 - RNA, 31 nt, Mus musculus
augaucacaguaugaugggaggagcugacau

SEQ ID NO: 77849 - RNA, 45 nt, Mus musculus
aauaaaugucgccucuguugaagaacagcaagacacaccaccagg

SEQ ID NO: 77850 - RNA, 47 nt, Mus musculus
auuuaguguuacaacuaugagacaagaagaguuuuuaagcagaacca

SEQ ID NO: 77851 - RNA, 109 nt, Mus musculus
uacggcugagaugcacuguguucauugucuaaugcuuauugacuccgagauauucaagauacugaagggaagagaagaauucucaauguaacccucacugguaccagac

SEQ ID NO: 77852 - RNA, 44 nt, Mus musculus
uuccucuuagaguuuuuaauucacauuaucugucaggcuggaaa

SEQ ID NO: 77853 - RNA, 45 nt, Mus musculus
auaguauaugaacccucagagcaugaaggggucgcgauuucaggu

SEQ ID NO: 77854 - RNA, 42 nt, Mus musculus
auaauugaugcaugcuggcguguggauuaaaugccuggagau

SEQ ID NO: 77855 - RNA, 46 nt, Mus musculus
ccauguguuuggcguccuuauggacucuauaauauagcaggaagag

SEQ ID NO: 77856 - RNA, 45 nt, Mus musculus
gugaagcagugacagaugcaggugugcugcugccccaugcaggua

SEQ ID NO: 77857 - RNA, 46 nt, Mus musculus
ugaggcugcuuacaucaugguagccaggaagcaacaagcucaggag

SEQ ID NO: 77858 - RNA, 50 nt, Mus musculus
cagaaccauccaaaugacauggaagagaugacgaaugagcaggaaaauuc

SEQ ID NO: 77859 - RNA, 41 nt, Mus musculus
augcaggcguguggcacaugcuuuuaguuccagcacucagg

SEQ ID NO: 77860 - RNA, 86 nt, Mus musculus
cagccggagguugaggacuuccucacagugaccgacagugaugacagauuugaggaccuggaacccgggacaguucaugaagguag

SEQ ID NO: 77861 - RNA, 46 nt, Mus musculus
agcauggcucaugaaagucaguucuacaaggaugggggugcagaag

SEQ ID NO: 77862 - RNA, 42 nt, Mus musculus
ggcccggugaggaggcuggcacaaacacugggagacugaagg

SEQ ID NO: 77863 - RNA, 45 nt, Mus musculus
aaguguggaggaccucauuuguaguucucaauccaugguggcauc

SEQ ID NO: 77864 - RNA, 47 nt, Mus musculus
ugagaggacauuuccaccggaggaggaggcagagacucacgcugagc

SEQ ID NO: 77865 - RNA, 43 nt, Mus musculus
gaauauuuaucaaucccuuuuaaaaaguuuuaaguacacggaa

SEQ ID NO: 77866 - RNA, 44 nt, Mus musculus
gugucauuugacugauaguuuggguggaaaugaagcugugcagu

SEQ ID NO: 77867 - RNA, 42 nt, Mus musculus
aaagacagagagacagagacagacagagagagagacagacag

SEQ ID NO: 77868 - RNA, 46 nt, Mus musculus
cuugucuuggcauccauucugcaaaagugacaauagcuggaggaau

SEQ ID NO: 77869 - RNA, 45 nt, Mus musculus
gguguacuaauaagauauguacuuaccgacuguacagggcaggaa

SEQ ID NO: 77870 - RNA, 46 nt, Mus musculus
uuucugaauuuuugucuuuccuggauccaguaaaggucccuugaau

SEQ ID NO: 77871 - RNA, 45 nt, Mus musculus
ugggcugucagguagacagucccuccagugaaaugcuguguggua

SEQ ID NO: 77872 - RNA, 80 nt, Mus musculus
cuuuuggcauugucucacgauccaguaucuuagcauccagauuucaguuaaagagcacaggugagccgaaagagggagau

SEQ ID NO: 77873 - RNA, 46 nt, Mus musculus
uuguaaugguuuuaauccuuuauuaaauccuguauugagguaagua

SEQ ID NO: 77874 - RNA, 34 nt, Mus musculus
aaaaccugaaagcuaaagaacccaucaaagaaga

SEQ ID NO: 77875 - RNA, 45 nt, Mus musculus
agaaaggccauggcaguugcaaagccguggaggucuaaugcaaau

SEQ ID NO: 77876 - RNA, 46 nt, Mus musculus
uucucccaugguaagaacucagucuccuaccugauauagccaagaa

SEQ ID NO: 77877 - RNA, 46 nt, Mus musculus
cuuagaaacuaaguaggauaguugucaguuaaugggcugcccugau

SEQ ID NO: 77878 - RNA, 47 nt, Mus musculus
guaggaaagaggaaggugaggaucuuggacucagugcgcagucucuu

SEQ ID NO: 77879 - RNA, 44 nt, Mus musculus
gugugcuucguaccggucucuguauucuccgcauuaccuuucug

SEQ ID NO: 77880 - RNA, 44 nt, Mus musculus
cagagaggacucuuaucagcucauucuaacuuacaaggccuuga

SEQ ID NO: 77881 - RNA, 44 nt, Mus musculus
cccuggcguuugaagccuagcucuaauacuaauuuguggaaagu

SEQ ID NO: 77882 - RNA, 41 nt, Mus musculus
aguuuuagguaaaggcaggaagcaaggugacggagaggaga

SEQ ID NO: 77883 - RNA, 46 nt, Mus musculus
gaggguccuuuuucacaugguucauggucauugcauugcucggcgu

SEQ ID NO: 77884 - RNA, 46 nt, Mus musculus
cgaggacuuagucauuucuucccucauuuugaaacauuccagagau

SEQ ID NO: 77885 - RNA, 45 nt, Mus musculus
gaaugggagagaauccugaugagaggucaaagaagauggugcaga

SEQ ID NO: 77886 - RNA, 37 nt, Mus musculus
gcuugcugggcagagagcauaaauagggguacagaca

SEQ ID NO: 77887 - RNA, 45 nt, Mus musculus
uggguggugccaucccugggcugguaauccuggguucuauaagaa

SEQ ID NO: 77888 - RNA, 46 nt, Mus musculus
gccaagcuuugcugagguucacagcauuuugggaaugcccugaggu

SEQ ID NO: 77889 - RNA, 45 nt, Mus musculus
uuagcaugugugaauuuuguagaaagccuaaagaauugcagcaga

SEQ ID NO: 77890 - RNA, 45 nt, Mus musculus
uuuaugguuugggcguuuguguuuuaugacauuguuuguggcaga

SEQ ID NO: 77891 - RNA, 45 nt, Mus musculus
cuuuuacuugaacaaaaguuaguguuaaaguuuagucuuugaguc

SEQ ID NO: 77892 - RNA, 56 nt, Mus musculus
uguuugauaaaauaaauuuaauccauaaccagccuuguuaucauugcuuuuacccc

SEQ ID NO: 77893 - RNA, 48 nt, Mus musculus
gaaauguugacucuuuuccuauguguauguucacagaucuaacccagu

SEQ ID NO: 77894 - RNA, 50 nt, Mus musculus
caagugccaccaccugauguagguaguuucuaugcuucaaagcagagauu

SEQ ID NO: 77895 - RNA, 46 nt, Mus musculus
aauagggcaucuagaguugauaguaauauauaguguguuucaagau

SEQ ID NO: 77896 - RNA, 46 nt, Mus musculus
cacugcacuguuugaauuguugguucuuaaauagaauacgucagau

SEQ ID NO: 77897 - RNA, 42 nt, Mus musculus
cugugugcgcggggcgaggccgcgcucaccgggcggggaggc

SEQ ID NO: 77898 - RNA, 41 nt, Mus musculus
gcggcagcggcucgggcagcgguagcccgagcacggguagc

SEQ ID NO: 77899 - RNA, 41 nt, Mus musculus
ggcagugugucucagagacagugggacugucacauuaacca

SEQ ID NO: 77900 - RNA, 46 nt, Mus musculus
agccgugacagcucagcgcgugaacccccagccuuucucccaucag

SEQ ID NO: 77901 - RNA, 45 nt, Mus musculus
caugccaacagcaccaaccccaacaacuguaaucuuguucugggg

SEQ ID NO: 77902 - RNA, 44 nt, Mus musculus
cuuggacuuugaaucuuuugagaccgcuagugcacgaugggggg

SEQ ID NO: 77903 - RNA, 52 nt, Mus musculus
aacuuaccagcugcccgacuuaacagauucaagaacaaggggaaggacagca

SEQ ID NO: 77904 - RNA, 44 nt, Mus musculus
gaaaugucagcuccuuuccugaugaugcuacuucuccgcuacag

SEQ ID NO: 77905 - RNA, 45 nt, Mus musculus
ucugcuugggcacucaccaacauugcuucuggaacaucugaacag

SEQ ID NO: 77906 - RNA, 46 nt, Mus musculus
acacuuucaaaccuuugucaaaacaagaacccugcaccucccuuag

SEQ ID NO: 77907 - RNA, 46 nt, Mus musculus
acguuaguucgacuccugcaccacaaugauccagaaguauuagcag

SEQ ID NO: 77908 - RNA, 46 nt, Mus musculus
ggagcuacugaacugcccauuaugacucccgcacuaagagccauag

SEQ ID NO: 77909 - RNA, 47 nt, Mus musculus
ucuuucaggcugcagagaaacuaggugagacagaaaagcucaguaua

SEQ ID NO: 77910 - RNA, 61 nt, Mus musculus
ccucauugaacuuaauggagaaguacuucucaguggaggaagaggaagaucaaaauguggu

SEQ ID NO: 77911 - RNA, 42 nt, Mus musculus
uuuucuccggcggcugggaagauggcggacauucagacggag

SEQ ID NO: 77912 - RNA, 46 nt, Mus musculus
cacgcuccgucugaauguccgccaucuucccagccgccggagaaaa

SEQ ID NO: 77913 - RNA, 45 nt, Mus musculus
accuagacaagaaaugccccuucacugguaaugucuccauccgag

SEQ ID NO: 77914 - RNA, 42 nt, Mus musculus
cccagaaguuucucuguaggcuuagagaagugagccccacag

SEQ ID NO: 77915 - RNA, 46 nt, Mus musculus
gaccucaguugacuguuuuuacaauaaaaauauuuugcagcuuauu

SEQ ID NO: 77916 - RNA, 46 nt, Mus musculus
gcuuaaguaacuagguuuucaaaugugggaaaccaagcugaaaggu

SEQ ID NO: 77917 - RNA, 45 nt, Mus musculus
uagaguagcaguugauauuucuaaauugugaccauuguccgagau

SEQ ID NO: 77918 - RNA, 51 nt, Mus musculus
ugacaaaaaugaaaagucuuaagaaaauccucccaggagaacauggagucu

SEQ ID NO: 77919 - RNA, 45 nt, Mus musculus
caaauuauaauggucacauauguuuagcccguugccacuguucgg

SEQ ID NO: 77920 - RNA, 45 nt, Mus musculus
ggccucugccaaaacgcggagccgaaccguagccugacacuccga

SEQ ID NO: 77921 - RNA, 42 nt, Mus musculus
gcccgccggguggggcugggaaggagggaaaggagccuggag

SEQ ID NO: 77922 - RNA, 44 nt, Mus musculus
cuggggagugcaugaauggcccagaugaucaucuaagggugcua

SEQ ID NO: 77923 - RNA, 48 nt, Mus musculus
cagccagacucuccgcaagaaacccagauaauucaggccaagaagaga

SEQ ID NO: 77924 - RNA, 45 nt, Mus musculus
ggaugucaaaaaaagaaaagaggagaucaccaagaagcaucagua

SEQ ID NO: 77925 - RNA, 48 nt, Mus musculus
acugucuggaggaaucagcccuugcauuaucauugaaacaccccauaa

SEQ ID NO: 77926 - RNA, 45 nt, Mus musculus
aauauguauauggguauuugguauaugccuuccaugagacuucag

SEQ ID NO: 77927 - RNA, 46 nt, Mus musculus
uuucaaaauugaacaugagguccauuucuagugauaauggcaucag

SEQ ID NO: 77928 - RNA, 46 nt, Mus musculus
acagaauaguucuuuaaaaugcuucuucucauuuucaaaaagguag

SEQ ID NO: 77929 - RNA, 94 nt, Mus musculus
guuuauuagcaacaauagugaaaugugagggcaauuccuacuaaaccaaagacaugggaagaucuuaaucaccaauguuacuaaaguagcuugc

SEQ ID NO: 77930 - RNA, 46 nt, Mus musculus
gcguccaccguccgccagccaggaaacuaccgcggccugcggccug

SEQ ID NO: 77931 - RNA, 46 nt, Mus musculus
acagugagucaacuucuuucaguauuaauggcaagaacagccucug

SEQ ID NO: 77932 - RNA, 46 nt, Mus musculus
uguggaauuaaauuucuuuaguaaugaccaaauaucaucaacaggu

SEQ ID NO: 77933 - RNA, 78 nt, Mus musculus
gcuccucauccgggucauguucaucagcaucacuccagaguucacgcccguccucccauaguacgggugccaggcaaa

SEQ ID NO: 77934 - RNA, 45 nt, Mus musculus
accccgcaggcugaccgaaaucgcgagcgccccgcagcagguacc

SEQ ID NO: 77935 - RNA, 45 nt, Mus musculus
ggcugccugcgggcagagcagagacaggccuuuaaugauucuuag

SEQ ID NO: 77936 - RNA, 45 nt, Mus musculus
agguaguaacaggcuucacggauuaagggcauuggaagcagccgu

SEQ ID NO: 77937 - RNA, 59 nt, Mus musculus
uuuaauccuuaaacuagagggagccuacagugauugcagacagcguaagggauuuucaa

SEQ ID NO: 77938 - RNA, 45 nt, Mus musculus
cauguuuuaucaagauacccaucucacuguugcauggcacugcug

SEQ ID NO: 77939 - RNA, 46 nt, Mus musculus
guacauuguguguguguguguguauacgccacugugugccauggca

SEQ ID NO: 77940 - RNA, 45 nt, Mus musculus
gcagugguagaccuaaccagaucaucugaacauauccaguuuuca

SEQ ID NO: 77941 - RNA, 42 nt, Mus musculus
cuuucucaaagagggaucccucugcgaccacaugaugcggac

SEQ ID NO: 77942 - RNA, 37 nt, Mus musculus
ccuugacacuuagggucuuaccaaacuggcugaagag

SEQ ID NO: 77943 - RNA, 48 nt, Mus musculus
uuucuaccuuuuucugugcacggccuacaaauauggcuuucccgcuca

SEQ ID NO: 77944 - RNA, 46 nt, Mus musculus
aauuucucaucaucaauggugucauccaaguucuuaauguagagau

SEQ ID NO: 77945 - RNA, 42 nt, Mus musculus
caucucggugacagcuuuggucgccucuucaggagaggggaa

SEQ ID NO: 77946 - RNA, 48 nt, Mus musculus
caguaguaggaaggccacgagaggccggagcauuaccaguuggagcca

SEQ ID NO: 77947 - RNA, 46 nt, Mus musculus
ccugcagcggcuggauggcagggugugggcuguggccacuggaggc

SEQ ID NO: 77948 - RNA, 45 nt, Mus musculus
aguugucaauuuccagcaccaucccggugauuuucccagccaggu

SEQ ID NO: 77949 - RNA, 46 nt, Mus musculus
aacaugagcgguuauuuggcuuuugacucuuauucuugucuaagag

SEQ ID NO: 77950 - RNA, 39 nt, Mus musculus
gggaauuaagcgggaaggagacuauuaagagugggucag

SEQ ID NO: 77951 - RNA, 46 nt, Mus musculus
gggaaacuagacuuucuaagagacaagggaagacuauucaccagag

SEQ ID NO: 77952 - RNA, 41 nt, Mus musculus
aguaggagacuugcgaaugcaagagagagcuaggaggccag

SEQ ID NO: 77953 - RNA, 42 nt, Mus musculus
acacgcugccccgggccuugcagcacgccggucggacgggag

SEQ ID NO: 77954 - RNA, 42 nt, Mus musculus
aggcauggggcucaugguggugggcguccucauuggcaccuu

SEQ ID NO: 77955 - RNA, 45 nt, Mus musculus
gguggcugccaggauccagaacagcgacaagcugagcgccguuau

SEQ ID NO: 77956 - RNA, 45 nt, Mus musculus
uuuuagaggccuugugaccacccuaggaggcgcucuguaugacag

SEQ ID NO: 77957 - RNA, 41 nt, Mus musculus
ugaaaaaaauuacacuacaaauucauauaacacagccccuu

SEQ ID NO: 77958 - RNA, 46 nt, Mus musculus
uuucugguuauauuggagcauggaucgcuuuuguuuuuaacagugg

SEQ ID NO: 77959 - RNA, 46 nt, Mus musculus
uuuuguuuucuagcccaggcuauccuagaacucacugaguagcuca

SEQ ID NO: 77960 - RNA, 46 nt, Mus musculus
cagaaagaacaagacaccuuagccaaggucagcagacgccuaagac

SEQ ID NO: 77961 - RNA, 45 nt, Mus musculus
gagccagacuuugaccuauggcuuagacagagccucagccugugg

SEQ ID NO: 77962 - RNA, 45 nt, Mus musculus
uuuggcauuacuggaucaggagaaaaaaauaaaaaauucuauuac

SEQ ID NO: 77963 - RNA, 46 nt, Mus musculus
ccccccuccuguugagacuaacuucucauuuucucaaugaccauga

SEQ ID NO: 77964 - RNA, 46 nt, Mus musculus
uacaggguuuccugcagauacaggguuucgccaauggcccugcaga

SEQ ID NO: 77965 - RNA, 46 nt, Mus musculus
aguuaggaaccguccucagcaagacgcaaacucuaagucccgagau

SEQ ID NO: 77966 - RNA, 42 nt, Mus musculus
caaugcaccuuuugaugucuucauuuauuuaauccuuggcac

SEQ ID NO: 77967 - RNA, 46 nt, Mus musculus
ucuagaagaaagacuuugaucaguccauucagaccaucgcacccug

SEQ ID NO: 77968 - RNA, 42 nt, Mus musculus
uuuuaugacuucuugcucaguguagucaugugcugcaccaug

SEQ ID NO: 77969 - RNA, 46 nt, Mus musculus
ucagguuugcauuuugcagagguuucuguaggguucaguccguguu

SEQ ID NO: 77970 - RNA, 44 nt, Mus musculus
gauggggugguggugcauuuagaagaugcauuuaacaaguugua

SEQ ID NO: 77971 - RNA, 41 nt, Mus musculus
ugaucuuggcagccaagacugggaacaggacaggcguggaa

SEQ ID NO: 77972 - RNA, 42 nt, Mus musculus
augaucuccugugucagacauuugucuugaauucauuaugua

SEQ ID NO: 77973 - RNA, 28 nt, Mus musculus
aggugaaggcaggaggcucugaggagau

SEQ ID NO: 77974 - RNA, 41 nt, Mus musculus
uagaguacccuaggacccuggcaccacaguuauccuccaga

SEQ ID NO: 77975 - RNA, 46 nt, Mus musculus
ggcuaaauggccaaauuucaguaaaauauguuaauuuuuugaguaa

SEQ ID NO: 77976 - RNA, 41 nt, Mus musculus
gaauauccauuuuguaaugcuaacaaaauuuacucuuggga

SEQ ID NO: 77977 - RNA, 43 nt, Mus musculus
ccagauuacugacguccccuugcccagcuaccugauggcgucu

SEQ ID NO: 77978 - RNA, 68 nt, Mus musculus
gcucccgacucagcuucugaauucuuacuugggaaccacacuacggacuauggaagaugucaucgcag

SEQ ID NO: 77979 - RNA, 45 nt, Mus musculus
guuaguuacagcucagugguuucagaagggauuuagugcagcuag

SEQ ID NO: 77980 - RNA, 47 nt, Mus musculus
aauauugauuccaccuccagaaaacgugaggguccucuuguuguaga

SEQ ID NO: 77981 - RNA, 46 nt, Mus musculus
agguggaaucaauauuguaugauucuuacaaacugugauuguugag

SEQ ID NO: 77982 - RNA, 46 nt, Mus musculus
agcucguuucuuuuuaacaaggcguuuugacuaaacaaggccaccu

SEQ ID NO: 77983 - RNA, 46 nt, Mus musculus
aucauguuuauaguuucaguuaaaaaaaauauauauauguccccau

SEQ ID NO: 77984 - RNA, 46 nt, Mus musculus
agcucucuccgcugccuuuugcuggcaguaaaaccuuugcccuggg

SEQ ID NO: 77985 - RNA, 46 nt, Mus musculus
gcaccuggucuacagugcaugccuggccuccagaccuuuguuaucg

SEQ ID NO: 77986 - RNA, 46 nt, Mus musculus
cagauuacagugaauauaaauauaacccagccaccagccaccagau

SEQ ID NO: 77987 - RNA, 114 nt, Mus musculus
aaccucuuuuucucuucaauucuccuuuucugugaauggcacucaucugccacacaggaaggaucuauuugcaccaauguggcacacacccagcagcuuucaagaacuggaaag

SEQ ID NO: 77988 - RNA, 46 nt, Mus musculus
uuccuguguggcagaugagugccauucacagaaaaggagaauugaa

SEQ ID NO: 77989 - RNA, 46 nt, Mus musculus
ccagacaauaaauauuacauggaucauuccgagccugggaggagcc

SEQ ID NO: 77990 - RNA, 45 nt, Mus musculus
uuaaaguucauugcuuuaagcugaaaagccauuuaaauggaggag

SEQ ID NO: 77991 - RNA, 54 nt, Mus musculus
ccuacaagagcaauuccucuccuccauuuaaauggcuuuucagcuuaaagcaau

SEQ ID NO: 77992 - RNA, 46 nt, Mus musculus
acugcuuuaaaaugacucagaaguccucgagacaauaaugugcuag

SEQ ID NO: 77993 - RNA, 41 nt, Mus musculus
ucugggggaucuuggagagggucuauucauugugugggcgu

SEQ ID NO: 77994 - RNA, 87 nt, Mus musculus
acugucauuagugauugaaugaagucugaagaauaagugcagacuguuaaggaaagaggaaaaugaugagaaaucaaaacacacgaa

SEQ ID NO: 77995 - RNA, 46 nt, Mus musculus
acugucuaaauuuugaauugcaaacaauaguuuggggaaauugcag

SEQ ID NO: 77996 - RNA, 46 nt, Mus musculus
ugugcaaaauaaauuuggcaaauguaccuacauugcagaugggcag

SEQ ID NO: 77997 - RNA, 46 nt, Mus musculus
caugucuucccacuuuauguuggaaacaaaaacguugguaacccag

SEQ ID NO: 77998 - RNA, 45 nt, Mus musculus
uggauccuccgguagauaggauacuaauauccaacauauauaaag

SEQ ID NO: 77999 - RNA, 45 nt, Mus musculus
uccagcaauccagcaauagcaaaagcagcaaaugcaacagaagau

SEQ ID NO: 78000 - RNA, 45 nt, Mus musculus
uucucagcuucagagaggaauaucacagaagaggugaacagauag

SEQ ID NO: 78001 - RNA, 25 nt, Mus musculus
ggaaaauuacuuucuacuagauaca

SEQ ID NO: 78002 - RNA, 45 nt, Mus musculus
ugaugaaaagccgugauccaugggaauuccgucacauaccaucag

SEQ ID NO: 78003 - RNA, 38 nt, Mus musculus
cagcagaauagacaggaccaugaaaggagcugggguag

SEQ ID NO: 78004 - RNA, 42 nt, Mus musculus
gcaucaguacuccacugcuaagccauuucuucagccccaaau

SEQ ID NO: 78005 - RNA, 45 nt, Mus musculus
guuccagaacagccgggacuuuaaaaaacuagugugugugugugu

SEQ ID NO: 78006 - RNA, 44 nt, Mus musculus
cagcaaacagcaagguuugcagggcaagcgcagcagcacagggc

SEQ ID NO: 78007 - RNA, 50 nt, Mus musculus
aauggauggagacucauauccgaagucagcaucugggugaagaagggugu

SEQ ID NO: 78008 - RNA, 46 nt, Mus musculus
agaucuagaauuuaaagucuccuuacaaacucaggagguugggcag

SEQ ID NO: 78009 - RNA, 45 nt, Mus musculus
aaaugaccggccagggagcagcggcagcaccacacaggcauggag

SEQ ID NO: 78010 - RNA, 42 nt, Mus musculus
caagaggaggcuuggagucagggcaguuaaaagggaaaacag

SEQ ID NO: 78011 - RNA, 46 nt, Mus musculus
auauaaagguguuguucauaucacuagaaaauacaaacggagagau

SEQ ID NO: 78012 - RNA, 98 nt, Mus musculus
aggagggacucuuaagaccuugcuuaggcagaguucuuagauuugaauccauaggaucuaaaaaaaaugguuuuuuucaauaaauaaucuuggagauu

SEQ ID NO: 78013 - RNA, 47 nt, Mus musculus
caguucuagacacagaaaaguuauccaacguuaaggcacauuucaga

SEQ ID NO: 78014 - RNA, 47 nt, Mus musculus
cuaauuuaaguuuaggucaaaaucccucuugacugcuagauggggaa

SEQ ID NO: 78015 - RNA, 106 nt, Mus musculus
ucucggacuaaauaguccagcaaagaaaacauccaaaguaaagagucugagacgauaggaagaaaauguuuuguguuuucaaggaaaaaagaggaagccccuguau

SEQ ID NO: 78016 - RNA, 56 nt, Mus musculus
uaagacacaacuugucaagucaguccugaauuaaaacaaauggccucacccaugag

SEQ ID NO: 78017 - RNA, 74 nt, Mus musculus
agcuaagaauaaauguggcaucuucucaauguaaccuucuucuggagaaagcauggagggaaugaauaaauaac

SEQ ID NO: 78018 - RNA, 41 nt, Mus musculus
ucacucucucaaucacgaaguuacaaaucugcacccgaagg

SEQ ID NO: 78019 - RNA, 45 nt, Mus musculus
uugaguucaguuauuauuguugguuuguuuuggacccgggggaau

SEQ ID NO: 78020 - RNA, 24 nt, Mus musculus
uuuucuuauuuccugugugugugu

SEQ ID NO: 78021 - RNA, 42 nt, Mus musculus
guugauucaaggguuggacuguauauaaaauggcuggcaggg

SEQ ID NO: 78022 - RNA, 46 nt, Mus musculus
gccuuaauggacugaugacucugauugguuguucaaguacccuaga

SEQ ID NO: 78023 - RNA, 45 nt, Mus musculus
agguuccuggagauuuacugugaggagagaaguuuagccagggag

SEQ ID NO: 78024 - RNA, 46 nt, Mus musculus
ugguaaacuaagcaaucauuuuggucacuuuuuaugcugcaagaua

SEQ ID NO: 78025 - RNA, 41 nt, Mus musculus
ugagguucacggauucaccgcuuaagaaaaagcugccauug

SEQ ID NO: 78026 - RNA, 49 nt, Mus musculus
aaacaugauccuuucauuccaaagaaagauacaggcuuguacuacagac

SEQ ID NO: 78027 - RNA, 45 nt, Mus musculus
uuauauggaguaccauccggguggggaggaugaacucaugagagc

SEQ ID NO: 78028 - RNA, 73 nt, Mus musculus
gauuggauccgacugaccaagaguggaaaggacuuaacaggauugaagggcggguuaauugaaguaacugaag

SEQ ID NO: 78029 - RNA, 46 nt, Mus musculus
aaggaggaaaauuaucugcuauuauucacaaaaauaaaauccagau

SEQ ID NO: 78030 - RNA, 46 nt, Mus musculus
gguuuggagaaugcugguugcuuagauagugagguuauuagaaaga

SEQ ID NO: 78031 - RNA, 42 nt, Mus musculus
uuaggaguaguaaugcaagaauguuuugggaaaauggcgaag

SEQ ID NO: 78032 - RNA, 48 nt, Mus musculus
gauauuaauugcuugaaguuggaaucaugugauccuguagaaauggug

SEQ ID NO: 78033 - RNA, 81 nt, Mus musculus
auaaauaaauauuuguacagaguuauguaaagacuugcacauaacauaggcauugucccaaaaguucuaaacuguugaagu

SEQ ID NO: 78034 - RNA, 42 nt, Mus musculus
gagagguggaggagagguggaggagagagguggaggagauag

SEQ ID NO: 78035 - RNA, 62 nt, Mus musculus
gaacuuacuaacgaguacagacacuaagucaaagaaauugcccuugaacuucacugaaggua

SEQ ID NO: 78036 - RNA, 46 nt, Mus musculus
aagugccuuguuuauuuuuucagauguucugaaagauggguugaua

SEQ ID NO: 78037 - RNA, 45 nt, Mus musculus
caaaggcugauggaggaggcggagcuggaaucaggaagggaccca

SEQ ID NO: 78038 - RNA, 46 nt, Mus musculus
gcugugaagacuucauucuacuuagcagaauuuuuaguuucugaag

SEQ ID NO: 78039 - RNA, 42 nt, Mus musculus
uccgggcaguggggagagcccggcgggccaccaccaccauca

SEQ ID NO: 78040 - RNA, 43 nt, Mus musculus
agagagaagcacauauggacacacuuuuguuacauuuugagaa

SEQ ID NO: 78041 - RNA, 45 nt, Mus musculus
uauguggaauaacacacacacacacacacacacacacacacacag

SEQ ID NO: 78042 - RNA, 42 nt, Mus musculus
gcuccccucuggaguggauaggguuaauccgggcagccagga

SEQ ID NO: 78043 - RNA, 45 nt, Mus musculus
cacucaaaccccuuuugcuuguagguuuguguaggagauggagag

SEQ ID NO: 78044 - RNA, 42 nt, Mus musculus
guaaugagauuugacucccucuucuggagugucugaagacag

SEQ ID NO: 78045 - RNA, 46 nt, Mus musculus
caacuguuuuuacucaaaagcaagguguacauuguuguaacagaug

SEQ ID NO: 78046 - RNA, 46 nt, Mus musculus
acgucaguuaugcugucagugugaaucaugugaagaaagcaguagc

SEQ ID NO: 78047 - RNA, 46 nt, Mus musculus
ucacuauauacaguuuucucuuauauauaaucugagaugcuuuaag

SEQ ID NO: 78048 - RNA, 55 nt, Mus musculus
gguguuaugaaugcaaugaaaaguugucgacacauugcaacaagaaaguuuuggc

SEQ ID NO: 78049 - RNA, 46 nt, Mus musculus
gaaaggugccugccucaugauggcuagggagcagagagaauuagga

SEQ ID NO: 78050 - RNA, 41 nt, Mus musculus
uuuucuugggcucccaauggaggagcuagagaaaguaccca

SEQ ID NO: 78051 - RNA, 41 nt, Mus musculus
gcagacuuugugugccccgguacaggggaacgccugggcca

SEQ ID NO: 78052 - RNA, 51 nt, Mus musculus
gcauuuucuagaaucauaaaacuuugugaagaaaaacgugaagcaggugaa

SEQ ID NO: 78053 - RNA, 42 nt, Mus musculus
gcuaugugagauucgaaucucucagaguacucauuucaucag

SEQ ID NO: 78054 - RNA, 42 nt, Mus musculus
ucuuuuugaacugaugaacgagauaaaagaagauggcaccaa

SEQ ID NO: 78055 - RNA, 59 nt, Mus musculus
auggcucuuagagcacagugaugucagauauugugauacccccaggacuguucuuuccc

SEQ ID NO: 78056 - RNA, 45 nt, Mus musculus
ggcagaucucugugaguuggaggccagccugguccauauagugag

SEQ ID NO: 78057 - RNA, 46 nt, Mus musculus
ugggcaagccuaggcuacauagugagacccugucugaaaagccaag

SEQ ID NO: 78058 - RNA, 52 nt, Mus musculus
gaucuuuuguuuccuuucuuuugucuugacaaggagugacaguuucgaugga

SEQ ID NO: 78059 - RNA, 24 nt, Mus musculus
gaaguuuacaagaaacagaccaag

SEQ ID NO: 78060 - RNA, 46 nt, Mus musculus
uaacacacuuuugagauggcuauucccccuaaaaaugcugcugaag

SEQ ID NO: 78061 - RNA, 46 nt, Mus musculus
cuguugaagucuuccacuauuauugugugaggugagaugugugcuu

SEQ ID NO: 78062 - RNA, 46 nt, Mus musculus
aggaauagugauuauucccuccuguuauuuuuguuguuauagguag

SEQ ID NO: 78063 - RNA, 42 nt, Mus musculus
aucugugguguuaguuggucuugcugccucugacuguggcuu

SEQ ID NO: 78064 - RNA, 46 nt, Mus musculus
aucugucucugaaaccauaaacaaaaugggggcacggugcugggug

SEQ ID NO: 78065 - RNA, 42 nt, Mus musculus
uguaccuucucccgacacugucuuuuccugcaggaccuccag

SEQ ID NO: 78066 - RNA, 42 nt, Mus musculus
aggcagcuaaguaggacuuuaguggcauuuguuuccaauaag

SEQ ID NO: 78067 - RNA, 46 nt, Mus musculus
ccuggaauuaaaagaauuaugugagauuucuuguccugggugaggg

SEQ ID NO: 78068 - RNA, 42 nt, Mus musculus
uguguaacuaugcagaucugagaaggaaaguguuggcuccaa

SEQ ID NO: 78069 - RNA, 42 nt, Mus musculus
aacuguguaauuuaacaaagauacagaauuauuuggggcuaa

SEQ ID NO: 78070 - RNA, 59 nt, Mus musculus
ugucuguguguguauauauguguaagugugugugugucucugugucuguguauuugugu

SEQ ID NO: 78071 - RNA, 46 nt, Mus musculus
agugcacguguguuugugucucugugugucugugugugugucuaug

SEQ ID NO: 78072 - RNA, 46 nt, Mus musculus
gugugugugucuuugugugugugugagugugugugugucugugugu

SEQ ID NO: 78073 - RNA, 60 nt, Mus musculus
uucucuucuugaaugaguaauuguggcguguuaauacaucagaugugacuuuuguucuuu

SEQ ID NO: 78074 - RNA, 46 nt, Mus musculus
ccuaaauugcugaugccuuacuaacaagguucauaauugcuugcag

SEQ ID NO: 78075 - RNA, 46 nt, Mus musculus
ccuacagugucaggucuguggucagucuuguccgucccccaccccc

SEQ ID NO: 78076 - RNA, 46 nt, Mus musculus
auaucuguucauuguuauuuaguucauuuuuauuuuaaugcugaag

SEQ ID NO: 78077 - RNA, 46 nt, Mus musculus
gccccuacacacacacacacagaguugauaguaaagcaacccccuc

SEQ ID NO: 78078 - RNA, 46 nt, Mus musculus
agaauacuuuaaaguuuaaggauaucuuugaacuguaaaccaccaa

SEQ ID NO: 78079 - RNA, 46 nt, Mus musculus
uuuuuuaauugaaggugaagaaauauauuuuaucuguagagcccag

SEQ ID NO: 78080 - RNA, 46 nt, Mus musculus
aauaauuuauuuguucaagcuagccugucauagcaguugcacccac

SEQ ID NO: 78081 - RNA, 45 nt, Mus musculus
agugauguacaaauaaaauguucauuuauuaccuaguucugagga

SEQ ID NO: 78082 - RNA, 46 nt, Mus musculus
acagauuaccucaggaaaccgugcaaacaaacaagaauguuuacag

SEQ ID NO: 78083 - RNA, 45 nt, Mus musculus
augaaugcuggaauuaaauguauucacuaccacaucaagcccuag

SEQ ID NO: 78084 - RNA, 23 nt, Mus musculus
ccugcuuuagcuucuuacaauug

SEQ ID NO: 78085 - RNA, 46 nt, Mus musculus
ucagaggacuacuuucacgaauugguccucgucuuugaccaugcau

SEQ ID NO: 78086 - RNA, 46 nt, Mus musculus
uaguucagcaguagugccuuugcuuaucucaagaaacaaaaaaaag

SEQ ID NO: 78087 - RNA, 46 nt, Mus musculus
aguuuugaauaugguaaguucuuuuguauaaagaucuuauggugaa

SEQ ID NO: 78088 - RNA, 42 nt, Mus musculus
aacggugaccacaaauucacauuaacuaaugcaaaugcaaaa

SEQ ID NO: 78089 - RNA, 50 nt, Mus musculus
uccgcuggggauuuguugugaggagggaccggaaaaggaguaggauucua

SEQ ID NO: 78090 - RNA, 41 nt, Mus musculus
agcgcggucgcccagccuccucgccuaacuucacggucggg

SEQ ID NO: 78091 - RNA, 42 nt, Mus musculus
agcuugucuucggagcccgaacguaacugcccggaaccgcgg

SEQ ID NO: 78092 - RNA, 42 nt, Mus musculus
aaacauuacaaagugaauuauaacaaaggugaauugcuccag

SEQ ID NO: 78093 - RNA, 41 nt, Mus musculus
aaaucaggcaacagauauuuaacuuggaguccuugguacaa

SEQ ID NO: 78094 - RNA, 46 nt, Mus musculus
augcuuaguguuuaucugugucuaucauaaugacuaauaaauagag

SEQ ID NO: 78095 - RNA, 45 nt, Mus musculus
aucagccuaggaagaauccuggcaaaccuuucugauguguggaaa

SEQ ID NO: 78096 - RNA, 48 nt, Mus musculus
agcaauguauauaauucuuggugacgugaaugauuaaaaaauugggca

SEQ ID NO: 78097 - RNA, 46 nt, Mus musculus
agacuugaagaacuaguuuauuugagguguauaagauauauauuag

SEQ ID NO: 78098 - RNA, 46 nt, Mus musculus
uuuagcuacuauuuccaguugagcauccaaaauauuugcauuagag

SEQ ID NO: 78099 - RNA, 46 nt, Mus musculus
uuaugcuguuaaaaagcacuuuaguuucuacauucauagcugccau

SEQ ID NO: 78100 - RNA, 46 nt, Mus musculus
aagaauucucuagucaaagacgaauuuuuccugaaauuuugaguag

SEQ ID NO: 78101 - RNA, 45 nt, Mus musculus
caucucuauuuagauacccacuggcugguguuggaaauacugcau

SEQ ID NO: 78102 - RNA, 45 nt, Mus musculus
ucuauuugugaaagugccugugguucagguuuucuaaggcugcau

SEQ ID NO: 78103 - RNA, 46 nt, Mus musculus
cagaugcugugauauauuuuguucauuuggucuuuuuuuccuugag

SEQ ID NO: 78104 - RNA, 46 nt, Mus musculus
cagagaaugggcaucauaucaguggaauaaauaaggacguuauaag

SEQ ID NO: 78105 - RNA, 52 nt, Mus musculus
guguguguguguguguguguguguacagauaguagaaugaggaagaauccug

SEQ ID NO: 78106 - RNA, 46 nt, Mus musculus
cucuuacucuugacaaucuuuaucaccaucauccccuucugaaaag

SEQ ID NO: 78107 - RNA, 46 nt, Mus musculus
gggaaacuguaguuugucuuugauuuuugacuacacuagcccagag

SEQ ID NO: 78108 - RNA, 46 nt, Mus musculus
gaguuuuuuguuuuguuuuguuugguuagauauuguauuagucaag

SEQ ID NO: 78109 - RNA, 46 nt, Mus musculus
ucauaauuaugucuaauaugauauaacuagugauauacaaccacaa

SEQ ID NO: 78110 - RNA, 61 nt, Mus musculus
cagagacggacuuuucuaaaaauuuucuuuuucuugaaagaucugagauguggauuuguuu

SEQ ID NO: 78111 - RNA, 64 nt, Mus musculus
uguuuuuuguuaucucugugucugcuaugaacagagaaggguagguagaagaaaggauaugugg

SEQ ID NO: 78112 - RNA, 74 nt, Mus musculus
agcuguggucuaggccugaauuuggguuuaaaucugagcauuuugaggagcaggaggaggguagggucauguga

SEQ ID NO: 78113 - RNA, 74 nt, Mus musculus
acugaccgggcuagacauggagaaggguguguuggaucugucugaguggggagauugaaaugugccguggaagg

SEQ ID NO: 78114 - RNA, 46 nt, Mus musculus
aggcauuaggaagagacacuucuacaagucuacaagucacccaaga

SEQ ID NO: 78115 - RNA, 45 nt, Mus musculus
aaauguauuguggguaauaugauucaaguuugucacauaauugga

SEQ ID NO: 78116 - RNA, 46 nt, Mus musculus
uaaaaagcuugaauagagcuuacugguagggcaucugccuggcaaa

SEQ ID NO: 78117 - RNA, 46 nt, Mus musculus
aaagaaaacauucguaaauacaauaaguuugcaaagagaacugcag

SEQ ID NO: 78118 - RNA, 45 nt, Mus musculus
ggcuuuaguugguggauuaguguucauguagcaucauuguaccag

SEQ ID NO: 78119 - RNA, 42 nt, Mus musculus
aaucaugguuugcauugcuccaaaguuugcuucuagccauaa

SEQ ID NO: 78120 - RNA, 50 nt, Mus musculus
gaauuagaauugccagauagaugaccauuugccagaugaaagcauuauca

SEQ ID NO: 78121 - RNA, 46 nt, Mus musculus
uggaauccaauuggagcuuuauagaagaacuuuugaaacgguccgu

SEQ ID NO: 78122 - RNA, 46 nt, Mus musculus
uuaaauauguuguagcucuguaaaguucuauaauguaaguaacccu

SEQ ID NO: 78123 - RNA, 45 nt, Mus musculus
ugugagucauuaaaaaugaauuuaauuuugagugggaaaauucag

SEQ ID NO: 78124 - RNA, 29 nt, Mus musculus
acauauuuuuacauauuuuuucuuuuuca

SEQ ID NO: 78125 - RNA, 45 nt, Mus musculus
gcgaaugcaucuucauuguuguuugacacuuugugauuucuggga

SEQ ID NO: 78126 - RNA, 53 nt, Mus musculus
aacguuaguaagccaauauuauauauuuaccaguguagugaugauaacaggag

SEQ ID NO: 78127 - RNA, 46 nt, Mus musculus
gcaugagugugaguggguauacacaucuuaauggcaaauauaggag

SEQ ID NO: 78128 - RNA, 46 nt, Mus musculus
ggguaauagaaagaugauuuuacaaauuaguacauagaagcuguag

SEQ ID NO: 78129 - RNA, 46 nt, Mus musculus
uuuauuuaacaaauucguguucaguaaaguagacaugugugaucug

SEQ ID NO: 78130 - RNA, 46 nt, Mus musculus
auagguaaugguuuguauuucucauuguuuucucuuuauacagcag

SEQ ID NO: 78131 - RNA, 46 nt, Mus musculus
aaaggaaaaagagaaaagaacggguauugaaagaacagugauguga

SEQ ID NO: 78132 - RNA, 46 nt, Mus musculus
guuaacucuucuacaauugugacuuuauuaaaugaacuaaacccag

SEQ ID NO: 78133 - RNA, 48 nt, Mus musculus
agaacagugucaucuugcuuauauaaugacagaagaaugaagcgagca

SEQ ID NO: 78134 - RNA, 46 nt, Mus musculus
cuccuacuggcaguuuuccuggaaaccaggacaguauaaugaagag

SEQ ID NO: 78135 - RNA, 46 nt, Mus musculus
guaaaagcaucaaccuggggaaauugguuguucuagaguagucuag

SEQ ID NO: 78136 - RNA, 46 nt, Mus musculus
gaggcuaucauacuuuucuaguucauuugcauuuuaacccaacuag

SEQ ID NO: 78137 - RNA, 46 nt, Mus musculus
aaauauaggaccuuauguguaccuuuaaaauauuacugggagccac

SEQ ID NO: 78138 - RNA, 46 nt, Mus musculus
cacauaaaggaucuuggaaaauucuauuuauuuuuaaaggucacaa

SEQ ID NO: 78139 - RNA, 46 nt, Mus musculus
gcacauaagcuccaagggagauaccaaagucucuagaaacuuacag

SEQ ID NO: 78140 - RNA, 43 nt, Mus musculus
aggcaucuagugcuccagacugagaaaggcugauggcaagaga

SEQ ID NO: 78141 - RNA, 46 nt, Mus musculus
gaagacacaauuauaaauuguaacuaguuagguugacuggugaaag

SEQ ID NO: 78142 - RNA, 45 nt, Mus musculus
gaccuuuuguuaaguguguucuguaaauugugcuucuagaaagag

SEQ ID NO: 78143 - RNA, 46 nt, Mus musculus
gcacucauuugcacauaaauagccauuaacugauaaauucccagag

SEQ ID NO: 78144 - RNA, 46 nt, Mus musculus
uuaauagacugcaaaaacuuuuccuaaaacuuuuucugaacaugag

SEQ ID NO: 78145 - RNA, 46 nt, Mus musculus
uuaauaguaaauuucuguaauauauaagaaguuggugguuuggggg

SEQ ID NO: 78146 - RNA, 46 nt, Mus musculus
cagaaguugccacaugagcacuuuucccugaaucuguagcaguaag

SEQ ID NO: 78147 - RNA, 42 nt, Mus musculus
aguuuauagcauagcuggugcuagaguuaaauugaugccgag

SEQ ID NO: 78148 - RNA, 46 nt, Mus musculus
agaggucucugcaguuguccucuuauagcauguuugcccacagcac

SEQ ID NO: 78149 - RNA, 45 nt, Mus musculus
cugugcuuuucuguacuuagaguucucaauauaaaauaaggucag

SEQ ID NO: 78150 - RNA, 46 nt, Mus musculus
gaguaacaacaugugcaaaucccuuuagugugagaaacgagucaag

SEQ ID NO: 78151 - RNA, 46 nt, Mus musculus
acccuucccagugcuaauauuauagacacaugauccuucacccagg

SEQ ID NO: 78152 - RNA, 46 nt, Mus musculus
ucagacuuuauacaaaguacauaagacuaucuacacauauggacag

SEQ ID NO: 78153 - RNA, 45 nt, Mus musculus
accaaauuggacuaaaguuguaguguagauagucagaaaugguca

SEQ ID NO: 78154 - RNA, 45 nt, Mus musculus
guucauucaugaaaggugucuagaguaacuagcaauuugcuuaua

SEQ ID NO: 78155 - RNA, 46 nt, Mus musculus
gaauauuagaaaugaaaacaaagguguuuaacaucuuguuggguac

SEQ ID NO: 78156 - RNA, 44 nt, Mus musculus
ugcacuuugguuuuaauguuccucaauuuguuuuagcagcacag

SEQ ID NO: 78157 - RNA, 45 nt, Mus musculus
aaagagugucuucucaaaggcucaaauagagcaauuacccagccc

SEQ ID NO: 78158 - RNA, 45 nt, Mus musculus
gauuuacucuaaagacagaaaauccauauguaaugaauaauaaaa

SEQ ID NO: 78159 - RNA, 45 nt, Mus musculus
uuuuauguaacuguugaguaaguccugaccaacuguuugggguca

SEQ ID NO: 78160 - RNA, 46 nt, Mus musculus
auauauauauauauauuguuuuaguaggguuucuauugcugugaag

SEQ ID NO: 78161 - RNA, 46 nt, Mus musculus
cucauggugagagggauggcaguauucagcuagacauggugcugga

SEQ ID NO: 78162 - RNA, 46 nt, Mus musculus
uuaucuauuugaaaauguagagauaaauguuuuuuuagucuggaag

SEQ ID NO: 78163 - RNA, 41 nt, Mus musculus
auuuugugaaagugaaagcaugaaccagcacuauggccuca

SEQ ID NO: 78164 - RNA, 42 nt, Mus musculus
uuuuguuuuuuuguuuuuuuaaauuuuaccucuauggccaaa

SEQ ID NO: 78165 - RNA, 46 nt, Mus musculus
uguagaaggccccgaaagcaguauugcaauucagauuacuuaauuu

SEQ ID NO: 78166 - RNA, 46 nt, Mus musculus
ucaagaagacacacaaaaccagccaguaacauaaccaagacaaagg

SEQ ID NO: 78167 - RNA, 49 nt, Mus musculus
aaaaaucuagcauaauggggaaaggcaaaugguuguguuguggcuggaa

SEQ ID NO: 78168 - RNA, 58 nt, Mus musculus
agugccaagaaugugggcuucaucucacacauaggaagugcugguagguuaggagcag

SEQ ID NO: 78169 - RNA, 46 nt, Mus musculus
gagcucugauuaaaaauacaugcuaaauaugguggaaaaacagaaa

SEQ ID NO: 78170 - RNA, 61 nt, Mus musculus
cugagaaacccugccucuguucccucgaugacgccucuaagaaagcacacuguccaugcca

SEQ ID NO: 78171 - RNA, 45 nt, Mus musculus
agaaacaggauuucccaggaaacauuaagaaugugucgcacugag

SEQ ID NO: 78172 - RNA, 46 nt, Mus musculus
aauaacuuuuguugucuuggggauaaaguuauccucuacugagaag

SEQ ID NO: 78173 - RNA, 46 nt, Mus musculus
uauguauuuuugguuuuggaucuuggaacugacaagaaagguacac

SEQ ID NO: 78174 - RNA, 42 nt, Mus musculus
uuuguuugcgcuaaccuuuuuauccuuuaaccauaacauuag

SEQ ID NO: 78175 - RNA, 46 nt, Mus musculus
uaucuucaugaaguauuuaacauuauauuauuucuaaacuucugag

SEQ ID NO: 78176 - RNA, 46 nt, Mus musculus
auugucuccuuugcuguguaaugagaucuacuccagccauccagag

SEQ ID NO: 78177 - RNA, 46 nt, Mus musculus
ucaaaggguccucacccccuccucgauuagcauccguauuggccuu

SEQ ID NO: 78178 - RNA, 45 nt, Mus musculus
uuccuggcauccugaaauguuugguguugguaaaugaaccccaag

SEQ ID NO: 78179 - RNA, 46 nt, Mus musculus
gagaaugcagaacaggaauccuagcucuguccugauaagcaguuag

SEQ ID NO: 78180 - RNA, 46 nt, Mus musculus
acacauggaggcacaaugcucaccugccacaguggaaacagugaag

SEQ ID NO: 78181 - RNA, 57 nt, Mus musculus
uguacuguuguaucacaaauaauucccuucauugccugcauguaggaagugugugug

SEQ ID NO: 78182 - RNA, 47 nt, Mus musculus
uuaguaacuguauaauaggacauaaggaacacuguaaaacucugcuc

SEQ ID NO: 78183 - RNA, 45 nt, Mus musculus
cgagugaaagugcaaagugugugugugugugugugugugugugug

SEQ ID NO: 78184 - RNA, 47 nt, Mus musculus
agagugagugccugagacucaagugggaacaagaagguggagugagu

SEQ ID NO: 78185 - RNA, 46 nt, Mus musculus
cucaaauauuuuguuacuuuugaagucaaaaucuuaccuccagaag

SEQ ID NO: 78186 - RNA, 25 nt, Mus musculus
guaugaaagaacagcuaaaaauaag

SEQ ID NO: 78187 - RNA, 24 nt, Mus musculus
aucccugaagggaccuagaaaguu

SEQ ID NO: 78188 - RNA, 42 nt, Mus musculus
uguggaagaugagaagaauccagcgaugauggagggaggcag

SEQ ID NO: 78189 - RNA, 45 nt, Mus musculus
guauuuccuaaguauuucagacaauccaaauauuucaucaaagau

SEQ ID NO: 78190 - RNA, 42 nt, Mus musculus
agauauauguguguuuaagaucuuugguaauggcaugcuagu

SEQ ID NO: 78191 - RNA, 46 nt, Mus musculus
aagauucucccugaccuacaguagcagaggaagaggaaagagagga

SEQ ID NO: 78192 - RNA, 46 nt, Mus musculus
uguuguuguugcuguuguuguuguuguuguuguugcuguuguuguu

SEQ ID NO: 78193 - RNA, 45 nt, Mus musculus
auuaaaguugaugauagagauuuauagaaaacauuaaggggcugu

SEQ ID NO: 78194 - RNA, 42 nt, Mus musculus
ucuaaugaacacagaaucuguggguguuuaaacugugcagaa

SEQ ID NO: 78195 - RNA, 46 nt, Mus musculus
aaugccccuaacugacuuuuguuacauaguauuuuccccaaaguag

SEQ ID NO: 78196 - RNA, 38 nt, Mus musculus
ccccucaggucauucuuccuaaaauauauuagacagau

SEQ ID NO: 78197 - RNA, 46 nt, Mus musculus
gucgguaacucuguuacguaauaaaguccauccucaacccccagac

SEQ ID NO: 78198 - RNA, 46 nt, Mus musculus
uaaguuuaugugcuugaaacuguuaucuuaaacuagagcccaagac

SEQ ID NO: 78199 - RNA, 45 nt, Mus musculus
cuagauauaaaauacaauaugcaaaacacaugaaacucaagaaga

SEQ ID NO: 78200 - RNA, 77 nt, Mus musculus
ugcuucuggaacuggcagaaaacgcacaaucaaggacuuacaagaagagguuucaaaccuauacaauaauaucagau

SEQ ID NO: 78201 - RNA, 41 nt, Mus musculus
caggaaagaagaagccggacaucacauucauguuccaggau

SEQ ID NO: 78202 - RNA, 69 nt, Mus musculus
cucuggaaguguaagaggaggaggagggggcaaugccagagaauauaaaauuaagaaaaccaagaagaa

SEQ ID NO: 78203 - RNA, 45 nt, Mus musculus
aguaaaaaggauaaaaaagaugaacgcaggaagaaagcaacaggu

SEQ ID NO: 78204 - RNA, 45 nt, Mus musculus
gugugugugagucuguguguguguguguguguauguguguguggg

SEQ ID NO: 78205 - RNA, 46 nt, Mus musculus
accuggguugacauuucgguauguuuagccuuugucucguacugau

SEQ ID NO: 78206 - RNA, 46 nt, Mus musculus
cucuuguuuuugaaggcaacuuguguuggccaaggacucguagacc

SEQ ID NO: 78207 - RNA, 39 nt, Mus musculus
uucugacuuuccugauaucaauauuuuaaaggucacaga

SEQ ID NO: 78208 - RNA, 25 nt, Mus musculus
aaggcaagaggagaacagaaagguu

SEQ ID NO: 78209 - RNA, 46 nt, Mus musculus
acguccauguaauuucaauuccucucuuuuguucaaaggucgagua

SEQ ID NO: 78210 - RNA, 45 nt, Mus musculus
uuuguuuguuuucagcuggaaaauuugauacuugaaggcaggacu

SEQ ID NO: 78211 - RNA, 27 nt, Mus musculus
gaagcaggcugcauggugaauggggca

SEQ ID NO: 78212 - RNA, 45 nt, Mus musculus
uuuacuauauucaauguaaauaccucacugauaaaacacuggagc

SEQ ID NO: 78213 - RNA, 46 nt, Mus musculus
auuccuacaucaauggcauaagaauuauuuacaucauuugaaagau

SEQ ID NO: 78214 - RNA, 46 nt, Mus musculus
ucaugcuuuaugaugucagcuccccucaacucaaagcucaagagaa

SEQ ID NO: 78215 - RNA, 46 nt, Mus musculus
aaacaagaauuuucagauaaacaauuuauaugguuuuagggagauu

SEQ ID NO: 78216 - RNA, 46 nt, Mus musculus
guugacaaaaacaauaaguuguaccuuaguuacuuuaacuggagaa

SEQ ID NO: 78217 - RNA, 41 nt, Mus musculus
gagcucagcaagaguauugaaauccacaccuauggccaagc

SEQ ID NO: 78218 - RNA, 47 nt, Mus musculus
cuucuugacggugagcacaaaucccuuuguguuugaagugccaagca

SEQ ID NO: 78219 - RNA, 59 nt, Mus musculus
ucacaacagaccgcucauuguacaacaaaucccaugcgguccugauucaccauagagac

SEQ ID NO: 78220 - RNA, 71 nt, Mus musculus
gguauggccauuugggcagaccuuugaccuuacauccugccaagcaauguucaauauccaagggugccauc

SEQ ID NO: 78221 - RNA, 48 nt, Mus musculus
aaauuaugacaucaacauccaaaggcauucuucgcccauuucuaaucg

SEQ ID NO: 78222 - RNA, 46 nt, Mus musculus
acaggacaggacaggacaggacaggacaggacaggacaggagaaag

SEQ ID NO: 78223 - RNA, 46 nt, Mus musculus
ugaauaaagacagugauuaagaacuagugauauaggagagagagau

SEQ ID NO: 78224 - RNA, 53 nt, Mus musculus
augaucuuacaucuacuuccuagaaggagacaagcacagggauagaagggaga

SEQ ID NO: 78225 - RNA, 42 nt, Mus musculus
gcccuccaccccccaccccugucccccaugcccggccuauga

SEQ ID NO: 78226 - RNA, 46 nt, Mus musculus
cauaccuccuccccaguccccugucuccauguggaugcccccaacc

SEQ ID NO: 78227 - RNA, 73 nt, Mus musculus
cagcacaaaguaaggguuggaaaaugcagauccuagcuagacuugcaucuggagaggggugaagugggaagaa

SEQ ID NO: 78228 - RNA, 45 nt, Mus musculus
cucagacguguuugagucuggagggcagcauguauacagagaugg

SEQ ID NO: 78229 - RNA, 45 nt, Mus musculus
uuuauccucuuuacauucuuccagauguuuacagacacccucuuu

SEQ ID NO: 78230 - RNA, 46 nt, Mus musculus
aggaugaaauucaauuccaauaccacacuuugagaagcaaguaacu

SEQ ID NO: 78231 - RNA, 46 nt, Mus musculus
aauccaucaaacugauauucuauuuuaaaaguacauagcauaagug

SEQ ID NO: 78232 - RNA, 46 nt, Mus musculus
uauauaaacaagcaagcaagaaaaccaacaaaaaccccuaaagauc

SEQ ID NO: 78233 - RNA, 46 nt, Mus musculus
cuauaucaaagaaagcaggaaaagacuuucugacuagugcauaagu

SEQ ID NO: 78234 - RNA, 46 nt, Mus musculus
gucaacacaauuggaggugguuguuauuuuuagcaggugggggugu

SEQ ID NO: 78235 - RNA, 44 nt, Mus musculus
agcaggguaucugggagcugaagggaaagaacugcaggcuggag

SEQ ID NO: 78236 - RNA, 46 nt, Mus musculus
agaaaucacagagauugagaguggaaaguagagaaaguauagagga

SEQ ID NO: 78237 - RNA, 66 nt, Mus musculus
ugagucauaguagaagcucgggaaaugauuugggguuaaaagcaugaacacccuuuaaggugaguc

SEQ ID NO: 78238 - RNA, 42 nt, Mus musculus
gaucccaauuccacuugccacuggaccuccuuucccucaguc

SEQ ID NO: 78239 - RNA, 41 nt, Mus musculus
aaaacccauucuguacacagcaaccaaacaggaggcaaaga

SEQ ID NO: 78240 - RNA, 41 nt, Mus musculus
aaccucuagguaugaaagagacacuauuaauucuugucaga

SEQ ID NO: 78241 - RNA, 41 nt, Mus musculus
aaauaaaucaauagagugcaucucgaauaaucccggguaaa

SEQ ID NO: 78242 - RNA, 46 nt, Mus musculus
gguggaaucugccugccuaacucacccucaaaaauuccuugaagau

SEQ ID NO: 78243 - RNA, 46 nt, Mus musculus
aagggagaauagugcuuucucagacacuagaaacugggccugaaag

SEQ ID NO: 78244 - RNA, 46 nt, Mus musculus
caucucuccagccuagaaauauuacuuauaaugugggacuccagac

SEQ ID NO: 78245 - RNA, 45 nt, Mus musculus
ggugagcagggcaagugggggaaagggauaggggauuuucagagg

SEQ ID NO: 78246 - RNA, 46 nt, Mus musculus
uaauuuuucaguuuaguaagaaaauguuaccaaaaagucgguagaa

SEQ ID NO: 78247 - RNA, 45 nt, Mus musculus
agaagcaugagguugagacugaauugaggagagaguacaccagag

SEQ ID NO: 78248 - RNA, 46 nt, Mus musculus
agcagcaagguucagaagagucuccagaaaauugagguugccagug

SEQ ID NO: 78249 - RNA, 46 nt, Mus musculus
auuuguacagucugagugauauaguucuaaauagauauaaagagau

SEQ ID NO: 78250 - RNA, 45 nt, Mus musculus
cucucuccccugugugugugugugugugugugugugugugugugu

SEQ ID NO: 78251 - RNA, 76 nt, Mus musculus
gcacaaacuaaggcagugcaugaucaucaaaguagcuguauacuucauggaggagaaagacauucccaaucccaag

SEQ ID NO: 78252 - RNA, 60 nt, Mus musculus
uuuuaaaggaaaagccauuuuuccaacaguggcaaaugcauuauagugucagcuccauca

SEQ ID NO: 78253 - RNA, 60 nt, Mus musculus
gaaaaugucagaaaaacaaacacacaaaacaacauuuagaaaucuaaacagacacaagua

SEQ ID NO: 78254 - RNA, 46 nt, Mus musculus
cauggcuaacauuaagaagcaaaguaauauauuacuccaagagauc

SEQ ID NO: 78255 - RNA, 46 nt, Mus musculus
auguguguuuaucuguauaauaccaauuuaggaaaaggccaugaau

SEQ ID NO: 78256 - RNA, 46 nt, Mus musculus
ugucuuagucaggguuucuauuccugcacaaaugucaugaccaaga

SEQ ID NO: 78257 - RNA, 46 nt, Mus musculus
aaaguauuaugugcuaaucaaaauaauauuuuuaaauguuugagau

SEQ ID NO: 78258 - RNA, 46 nt, Mus musculus
aaggcaguguuugguagaaaugccaagucuagugucaacagcagug

SEQ ID NO: 78259 - RNA, 46 nt, Mus musculus
gcacugaaaaaggaguaaaggcucaugaauacacaucaucugagau

SEQ ID NO: 78260 - RNA, 46 nt, Mus musculus
accaaucacuaauuaaaaaaaaaauucuucacagacuugcuaguaa

SEQ ID NO: 78261 - RNA, 46 nt, Mus musculus
cucagccugcuuuguuauaaaaccuaagaacaguagcccagaguua

SEQ ID NO: 78262 - RNA, 94 nt, Mus musculus
ugggguuucuauuccugugugacuaugaccaaaagcaacuuggggaagauaggguuuauucagucuuacaguuuuauuucacagggcaucacug

SEQ ID NO: 78263 - RNA, 46 nt, Mus musculus
auuuuaaaaagagcaaggaguaauauacagaaguauuuggguauag

SEQ ID NO: 78264 - RNA, 45 nt, Mus musculus
aaguuaaucaaaguauaauaaauuuagaugaucugaucugaggau

SEQ ID NO: 78265 - RNA, 44 nt, Mus musculus
gcaccguggaguaguucagcacucaucucugcuuuccaugcuau

SEQ ID NO: 78266 - RNA, 46 nt, Mus musculus
ccgaucucugagcacucaacagcuuuuaaauccuuaaaugccaguu

SEQ ID NO: 78267 - RNA, 45 nt, Mus musculus
aaguuuaauuaaauauuuccucugcuuaaaaaguuccugugacuu

SEQ ID NO: 78268 - RNA, 46 nt, Mus musculus
uuauaaacuggugaugccaagaaaagcaaaggaccaggccccaguu

SEQ ID NO: 78269 - RNA, 50 nt, Mus musculus
auguaccaauugaaauaucauaucaccaguggaacauucugccuccaguc

SEQ ID NO: 78270 - RNA, 45 nt, Mus musculus
aauaaagacuugcauuucaggaagacauuucuaauggggccauau

SEQ ID NO: 78271 - RNA, 45 nt, Mus musculus
ucuagggcgugauuuccguccuuguauugcuucuuuucugcuauu

SEQ ID NO: 78272 - RNA, 50 nt, Mus musculus
aggaacugggagaaagagagagaauugccaugacucaggagagaaagaug

SEQ ID NO: 78273 - RNA, 46 nt, Mus musculus
ggauaggagagaaggagggaggggagaaggagagagagagagagag

SEQ ID NO: 78274 - RNA, 41 nt, Mus musculus
uuuacauaugugccuccugaauaauugucagagaaacaagc

SEQ ID NO: 78275 - RNA, 46 nt, Mus musculus
aauacaaacucaacauuaucaguuuuuccauauuaaaagcccaguu

SEQ ID NO: 78276 - RNA, 45 nt, Mus musculus
gauggauuggcuugaguagguuucuuagagcaacacagaggugug

SEQ ID NO: 78277 - RNA, 46 nt, Mus musculus
uuaacuaauguaaugguuauacuugaaaagaauuaauugaacagau

SEQ ID NO: 78278 - RNA, 51 nt, Mus musculus
aucauauuuuugauaccauauuucucuguuuagcccuggaacuuucucugu

SEQ ID NO: 78279 - RNA, 45 nt, Mus musculus
ugaguuccuuugugauuggguaccucacuaaagaugaugcucucc

SEQ ID NO: 78280 - RNA, 46 nt, Mus musculus
cauaaaaacuaugcaauaacauuuaguguuaaaaggaggccaugaa

SEQ ID NO: 78281 - RNA, 47 nt, Mus musculus
agggaaauauaagaaaaaaaauaaaaauaaaacagucgucuagaaag

SEQ ID NO: 78282 - RNA, 46 nt, Mus musculus
uacauuaauauaguucugggaagauauuuuggcuaauauaacaaau

SEQ ID NO: 78283 - RNA, 50 nt, Mus musculus
uuuuaugcauucaccaaugaaugaaaaaagagggcaugaauuuuaaagag

SEQ ID NO: 78284 - RNA, 46 nt, Mus musculus
aagcauuuaucaagcaccuguuugaaguuuuauuucuccagccuag

SEQ ID NO: 78285 - RNA, 45 nt, Mus musculus
uauagguaaguuuauuuauauuauauuuguuuauaggcgugagua

SEQ ID NO: 78286 - RNA, 45 nt, Mus musculus
agccccugagcuacaauauugcugacucccuaauuuacacuagau

SEQ ID NO: 78287 - RNA, 42 nt, Mus musculus
agagagaaagagagagagagagagagagagagaguuauuuuu

SEQ ID NO: 78288 - RNA, 45 nt, Mus musculus
ugcauguauguuugugggcauguacaucugugcauaugagugagg

SEQ ID NO: 78289 - RNA, 42 nt, Mus musculus
cucacucaucaagcaucucuagaccuuuacuaugggcaaguu

SEQ ID NO: 78290 - RNA, 42 nt, Mus musculus
aaguaaaccugaacaccgcaguccaaaugaaagcagcgaggc

SEQ ID NO: 78291 - RNA, 46 nt, Mus musculus
aguucaguuccaaagacugagaaaagauaaaaaugaggaugcgaau

SEQ ID NO: 78292 - RNA, 43 nt, Mus musculus
uuuuucauugcuaggcuuguuauuucacuguaaagccagaaac

SEQ ID NO: 78293 - RNA, 48 nt, Mus musculus
uaccugaaguuugaagaaaaagggggauaaucauggggcagugaaaca

SEQ ID NO: 78294 - RNA, 41 nt, Mus musculus
uauauuauuaaagcaauuauagaaaaacuucaggccaaauu

SEQ ID NO: 78295 - RNA, 41 nt, Mus musculus
uuauugaaggaaagagacccagaggaaaggcagcaggaaga

SEQ ID NO: 78296 - RNA, 96 nt, Mus musculus
uuuacuaauguaacaugacaacaaguguguugaaaucccaaaaugaauguccguauccagaguuugcaaaaagggaaacagaccuaagugcccaua

SEQ ID NO: 78297 - RNA, 46 nt, Mus musculus
aggacagauuuuuuaaaauauguauuauaauaaacuaaaugcagau

SEQ ID NO: 78298 - RNA, 74 nt, Mus musculus
ucuaagaccaccugcaguugaauuuccagaggggggcaggggaagacagaauaaggaagaaacccugaaaagga

SEQ ID NO: 78299 - RNA, 45 nt, Mus musculus
cucucagcuccuccugccccaugccugccuggaaggugccaugcu

SEQ ID NO: 78300 - RNA, 46 nt, Mus musculus
uggugaggaaggggggaaggaaggagcaaaagaaugaggggagaag

SEQ ID NO: 78301 - RNA, 41 nt, Mus musculus
ugauggucgccuaggccaucuuuugauacauaugcagcuag

SEQ ID NO: 78302 - RNA, 46 nt, Mus musculus
acacacacacacacacacgcacacacacacacacacagagagagag

SEQ ID NO: 78303 - RNA, 46 nt, Mus musculus
ucaacagcugggacuaugggaccaacagcuggauucagugggagau

SEQ ID NO: 78304 - RNA, 46 nt, Mus musculus
aguuaaccugggcuguacugggaaucacucauucaaaaugacaaaa

SEQ ID NO: 78305 - RNA, 46 nt, Mus musculus
agagcuuggaguaaugcugaaugcucuguuuuugugguaagcagaa

SEQ ID NO: 78306 - RNA, 46 nt, Mus musculus
uuuuugucauuguuucaaagugcccaacuauuuacaucgcuuagau

SEQ ID NO: 78307 - RNA, 90 nt, Mus musculus
ccuagguuucuccacaaaguccuccucugacccaccuucccucaaagccugaccacagagucauugguccugccaucccguuccuccuca

SEQ ID NO: 78308 - RNA, 45 nt, Mus musculus
gugucacuucaaagagagucauugcugcccuuguuguccccaggu

SEQ ID NO: 78309 - RNA, 46 nt, Mus musculus
uuguacaucuuagucccuugucacccuccugcccucccgcugcuac

SEQ ID NO: 78310 - RNA, 41 nt, Mus musculus
ggcuacgcuacuaggacagcgccgccaccaccgccagcccu

SEQ ID NO: 78311 - RNA, 68 nt, Mus musculus
acugcucuguggggaaaguucuugcugugcaagccugaagaccugagucugaacaccuagaacucaaa

SEQ ID NO: 78312 - RNA, 46 nt, Mus musculus
uagaaaccaguaaguucugggauguauuuuaaaauacacagcagag

SEQ ID NO: 78313 - RNA, 46 nt, Mus musculus
uacuguaagacagaaaaaaauugcuuaucacuucaaaacuagagau

SEQ ID NO: 78314 - RNA, 45 nt, Mus musculus
ccuguggcucuaagugcuuuucuauguuuaaugcccugccuggug

SEQ ID NO: 78315 - RNA, 46 nt, Mus musculus
acugcuaacacgauauaccuggauuaccggccucauaagccaaguc

SEQ ID NO: 78316 - RNA, 46 nt, Mus musculus
uugugaaaagaacaacuugauguuuaucccaaguguaggcccagga

SEQ ID NO: 78317 - RNA, 41 nt, Mus musculus
gacauaaugggugcuaccaggugaaggcaguggguggcaga

SEQ ID NO: 78318 - RNA, 46 nt, Mus musculus
aaguugaguaugaacaagaauucauguaaaauaguaaguagcaggg

SEQ ID NO: 78319 - RNA, 43 nt, Mus musculus
uaugcuuuucuuuuucuuucuugugugugugugugugugugug

SEQ ID NO: 78320 - RNA, 46 nt, Mus musculus
ugaccuccuuccagaacuucauccacuaaaugcgcauucgggaaac

SEQ ID NO: 78321 - RNA, 46 nt, Mus musculus
auaaacacaaugagcuagcugccuucuccuuaagugugagcuacag

SEQ ID NO: 78322 - RNA, 45 nt, Mus musculus
ccccgauggcgcgcgcuaaccgcugcucccgaacccccucgccag

SEQ ID NO: 78323 - RNA, 41 nt, Mus musculus
cuauggagcaccucucuguggagcugguauccgggccgcug

SEQ ID NO: 78324 - RNA, 42 nt, Mus musculus
aacuagaaaggacgcuugccuuagccaacucguaacuggaag

SEQ ID NO: 78325 - RNA, 41 nt, Mus musculus
gugacuuucuucaggugugacaugguuugauaaccauaaga

SEQ ID NO: 78326 - RNA, 43 nt, Mus musculus
aaucccggcaaccacaugguggcucacaaccgucuguaaugag

SEQ ID NO: 78327 - RNA, 46 nt, Mus musculus
gugggaacuguacuuucucuucaguccugcacagcuccugacagau

SEQ ID NO: 78328 - RNA, 45 nt, Mus musculus
ugguuguccccucaggaguuuuaucugggggcagcaucuaaagau

SEQ ID NO: 78329 - RNA, 44 nt, Mus musculus
cccgagugcugggauuaaaggcgugcagcaccaccgcccggcuc

SEQ ID NO: 78330 - RNA, 45 nt, Mus musculus
acaguaacaacacuuaagaagcuaaaaggucaaucaagccauaga

SEQ ID NO: 78331 - RNA, 26 nt, Mus musculus
aggaaaaaggaaaaagggagggaaga

SEQ ID NO: 78332 - RNA, 46 nt, Mus musculus
agagugaggaccacaugggcuauacaaagaacugcuaucuggggaa

SEQ ID NO: 78333 - RNA, 45 nt, Mus musculus
ggcucacaaccaucuguaaugggaucugaggcccucuuauauguc

SEQ ID NO: 78334 - RNA, 45 nt, Mus musculus
cucacaaccauccguaacgaaaucugauucccucuucugaaguau

SEQ ID NO: 78335 - RNA, 42 nt, Mus musculus
aggacagccagggcuaaacagaaaaacccugacuccaaggaa

SEQ ID NO: 78336 - RNA, 46 nt, Mus musculus
cuuggcuuuuguuuuuaguuuagaucuaacccaggcuucaugcagg

SEQ ID NO: 78337 - RNA, 46 nt, Mus musculus
ugagaucugaugcccucuucugguguaucugaggacagcuacagug

SEQ ID NO: 78338 - RNA, 45 nt, Mus musculus
cuuuaaucagcuguguuccuuaacauuaaaacacugucaucauga

SEQ ID NO: 78339 - RNA, 45 nt, Mus musculus
caaagguguguugagguaaagaguuucauaaagauugggcgaguc

SEQ ID NO: 78340 - RNA, 45 nt, Mus musculus
caaagguguguugagguaaagaguuucauaaagacugggcgaguc

SEQ ID NO: 78341 - RNA, 46 nt, Mus musculus
aucugggaacccucuuggcuuguguguuuuagaccccucggcaggu

SEQ ID NO: 78342 - RNA, 45 nt, Mus musculus
cugucucaaauaauaaagaauuuggggaaaaggaagcaagaagau

SEQ ID NO: 78343 - RNA, 46 nt, Mus musculus
auguauauacaaacagggagggggaagauagagauggaacccagcu

SEQ ID NO: 78344 - RNA, 42 nt, Mus musculus
uuucuaacagaagugagccaaaaggaaaauuacgccggagca

SEQ ID NO: 78345 - RNA, 87 nt, Mus musculus
cacagccagcuugugcaugguauacacuugugugaacaaccaaagauaaacagacagaaaagcaaauacaacuugccacuaaccaag

SEQ ID NO: 78346 - RNA, 46 nt, Mus musculus
caauucaauagcaacauaagaggcgugcacauuugaacauccagua

SEQ ID NO: 78347 - RNA, 46 nt, Mus musculus
gagcuuagaaggucguccaugaaguugcugaaucugaaaggcagac

SEQ ID NO: 78348 - RNA, 61 nt, Mus musculus
uguacuugggucucaguuuuuguguccuuacuauaucaugcaagcaucagaggggcaguga

SEQ ID NO: 78349 - RNA, 55 nt, Mus musculus
cuuagaacucacuguacauuggagaagauucuauuuuucagaggcaguuuugaac

SEQ ID NO: 78350 - RNA, 94 nt, Mus musculus
ccaccuuuuucauacagcuugaagaauucuuuguugguagugacacgaaaagcagccauuguacugaaauuguacuugaucaagaugugcccau

SEQ ID NO: 78351 - RNA, 107 nt, Mus musculus
gcuucuaagcagcgcccugaaugaguuuuuagaaguuauaaaauggacuccucgguuaacggaucuggauaacugggauacaguuuugucgaggcuaaaggauuuga

SEQ ID NO: 78352 - RNA, 42 nt, Mus musculus
gcagcugcccagccgcuuccaccaguuccagcagcaccggcc

SEQ ID NO: 78353 - RNA, 42 nt, Mus musculus
aaagggaugggguggcaaaagucacuaggaagcuagucagau

SEQ ID NO: 78354 - RNA, 46 nt, Mus musculus
aaacaaacagccuagaaaaacugucccaguucaugugacacuagga

SEQ ID NO: 78355 - RNA, 46 nt, Mus musculus
acaagaggggauguccuguacgguuacucugaagacccgagaagau

SEQ ID NO: 78356 - RNA, 46 nt, Mus musculus
gauggggugugucccuuggguuugugagggcuaggacacuggagag

SEQ ID NO: 78357 - RNA, 26 nt, Mus musculus
auggucuuaagguaaccccugugaaa

SEQ ID NO: 78358 - RNA, 46 nt, Mus musculus
cacagagaaacccugucucgaaaaaccgaaagaaagaaaggaagga

SEQ ID NO: 78359 - RNA, 24 nt, Mus musculus
gcucugcaaccaaagagauuguua

SEQ ID NO: 78360 - RNA, 45 nt, Mus musculus
gaccaacgcccgaaugacacacuaccagagucuauugcugacaga

SEQ ID NO: 78361 - RNA, 41 nt, Mus musculus; identical to SEQ ID NO: 40308

SEQ ID NO: 78362 - RNA, 45 nt, Mus musculus
aauugagggcuugcaggauuacaccauaagggauguaguaagaga

SEQ ID NO: 78363 - RNA, 55 nt, Mus musculus; identical to SEQ ID NO: 40307

SEQ ID NO: 78364 - RNA, 42 nt, Mus musculus
gauugcaaaugguuuaauguaaucaagaaauucaagcugaag

SEQ ID NO: 78365 - RNA, 46 nt, Mus musculus
uuguauguaguguugguuacugggcaaguguuuggccuccuugggc

SEQ ID NO: 78366 - RNA, 42 nt, Mus musculus
uugugggggucccucauugugaggcagaucauuuggggcuag

SEQ ID NO: 78367 - RNA, 46 nt, Mus musculus
ccccugcuuuagucauuacuguaaaacaagggaacaaaguggagaa

SEQ ID NO: 78368 - RNA, 45 nt, Mus musculus
gcgggcgccaccuccgccgggcuggagaaugaauucuuggggcag

SEQ ID NO: 78369 - RNA, 60 nt, Mus musculus
gggagagagggagagagagagagagggagagagagggagagagagggagagagagagaga

SEQ ID NO: 78370 - RNA, 54 nt, Mus musculus
gagagagagacagggagagagagagacagggagagagagagagacagggagaga

SEQ ID NO: 78371 - RNA, 128 nt, Mus musculus
agagagagagagacagggagagagacagggagagacagagagagagagagagacagggagagagacagggagagacagagagagagagagagacagagagagagagagacagggagagagacagggag

SEQ ID NO: 78372 - RNA, 63 nt, Mus musculus
agacagagagagagagacagagagagagagagagagaaagagaggagagagaguugccaguug

SEQ ID NO: 78373 - RNA, 25 nt, Mus musculus
cuugaaaaaugagggaagauuguua

SEQ ID NO: 78374 - RNA, 46 nt, Mus musculus
uggcaaauaaauguuuuuaguaguggucuuugugcuauggauugua

SEQ ID NO: 78375 - RNA, 46 nt, Mus musculus
uuuuguuacuuggguauguuuuuccuauuguuaagauaggucagga

SEQ ID NO: 78376 - RNA, 46 nt, Mus musculus
gagaaaguggagucugggcuccuugcagaguuguuuggugaacuag

SEQ ID NO: 78377 - RNA, 67 nt, Mus musculus
aaauuuugauuugaugucuuugauaagacuaucaacuuuaaaaagaugaagagaagggaaauacucc

SEQ ID NO: 78378 - RNA, 46 nt, Mus musculus
aauugcaguucuguaucuuuuuuuagacuguucugugacccuguag

SEQ ID NO: 78379 - RNA, 46 nt, Mus musculus
gcauauauuaaagggucacaacauuaggaagguugagaaccacuca

SEQ ID NO: 78380 - RNA, 45 nt, Mus musculus
agaacaaauucuguacaacauaaaacaggaauauaaacgcaugca

SEQ ID NO: 78381 - RNA, 42 nt, Mus musculus
uaaggagaucugacauccuccucuggugucugaaaacagcua

SEQ ID NO: 78382 - RNA, 42 nt, Mus musculus
guuggguuaauuugggugagucaguguggauaaaggcaagau

SEQ ID NO: 78383 - RNA, 46 nt, Mus musculus
uuugaacuuaggugaauuaaauuacauuagcaaaagugggggcuau

SEQ ID NO: 78384 - RNA, 46 nt, Mus musculus
ccuucuuccagaaucgcagucugacagaguuaauacuuggcccugu

SEQ ID NO: 78385 - RNA, 46 nt, Mus musculus
aguugggaccuccugcaacaacucaacaaagaacaaggcagcccac

SEQ ID NO: 78386 - RNA, 42 nt, Mus musculus
gggcugccuuguucuuuguugaguuguugcaggaggucccaa

SEQ ID NO: 78387 - RNA, 45 nt, Mus musculus
ucccaggacauuuaagcaguuagucuacaguacuucugugagaua

SEQ ID NO: 78388 - RNA, 45 nt, Mus musculus
caaguuccugcaguuuugauuuccccacagugauagacugcaacc

SEQ ID NO: 78389 - RNA, 46 nt, Mus musculus
cuggucuuuuagaagaacagcaaguuccucacuugugaacuuuauu

SEQ ID NO: 78390 - RNA, 40 nt, Mus musculus
cgccuucaaaaugcaauugaaauaaacuuccugacuagau

SEQ ID NO: 78391 - RNA, 46 nt, Mus musculus
uagccauagcagcccacugauagcaaugcuucuaguuuauaagcag

SEQ ID NO: 78392 - RNA, 23 nt, Mus musculus
aaucaacagugacaccaaccccg

SEQ ID NO: 78393 - RNA, 53 nt, Mus musculus
agauacgauauuauuucacuggaccuuuacauuucugaguuuuguaaguuagg

SEQ ID NO: 78394 - RNA, 48 nt, Mus musculus
cuauuuggcuuuauacuuaauaaacauucauaugaacagccacggaga

SEQ ID NO: 78395 - RNA, 46 nt, Mus musculus
aacuucuuacgcauagcucucagcagcaccccaaacgccagcacac

SEQ ID NO: 78396 - RNA, 49 nt, Mus musculus
auguugcaaggcuuacauggggaggcuguuaaacagcaagagagugaag

SEQ ID NO: 78397 - RNA, 46 nt, Mus musculus
uugaauuaucaacuuuuaaaacauacuucuagaaguuuggcaaggg

SEQ ID NO: 78398 - RNA, 45 nt, Mus musculus
uuuuuauuuuuuaacgugugugugugugugugugugugugugugu

SEQ ID NO: 78399 - RNA, 45 nt, Mus musculus
cugagaaaauggaugcaaauucuacagucucagaagaaaugagug

SEQ ID NO: 78400 - RNA, 42 nt, Mus musculus
uccuauucugauccuguguuuuuuaaaaacagaagccaaaga

SEQ ID NO: 78401 - RNA, 44 nt, Mus musculus
agaaugaagaacuggaaggauguauuccaaauacugccccugac

SEQ ID NO: 78402 - RNA, 49 nt, Mus musculus
aguauuuggaauacauccuuccaguucuucauucuaaaaacagcagauu

SEQ ID NO: 78403 - RNA, 46 nt, Mus musculus
acuucaucuagccaguuaggccgggugaggaaacacaggacacuuc

SEQ ID NO: 78404 - RNA, 46 nt, Mus musculus
aucacuuucauaucuuacuucacaaccaggaacaauauagacagac

SEQ ID NO: 78405 - RNA, 42 nt, Mus musculus
uucaaucacuagcuacugaacucaagcguuucuagccagcag

SEQ ID NO: 78406 - RNA, 45 nt, Mus musculus
uaaugaaucaaaagcaggacaguggaagguugagcgcagguggau

SEQ ID NO: 78407 - RNA, 45 nt, Mus musculus
uccuccugcagcauagccauacguuuauaucaguuagggggaccu

SEQ ID NO: 78408 - RNA, 46 nt, Mus musculus
ucuuuacacuguuggcauauuuauuuuaauuuagaauuaaauugga

SEQ ID NO: 78409 - RNA, 46 nt, Mus musculus
auuagcauuaagugauuaucauuuuucaaaugguaaggcugaagau

SEQ ID NO: 78410 - RNA, 48 nt, Mus musculus
acucucaccaaugagaagcaacucuuaaggacauaaagagacuguaga

SEQ ID NO: 78411 - RNA, 46 nt, Mus musculus
aaguaaacugcuuuauacuucacagcuauugauacagcacacagac

SEQ ID NO: 78412 - RNA, 45 nt, Mus musculus
auauuccuuugucuuuaaacuccuuuacuuauagcaagcugucug

SEQ ID NO: 78413 - RNA, 51 nt, Mus musculus
agcaggagcugagggcuacaugcuagucccuaggcagaggagaggcagaga

SEQ ID NO: 78414 - RNA, 45 nt, Mus musculus
gggagcuguauugcacauguuuagaaaagaagauaugggauucgg

SEQ ID NO: 78415 - RNA, 46 nt, Mus musculus
aauaaggcaaguuucaagucaguauacuuaaagagguaauacagau

SEQ ID NO: 78416 - RNA, 42 nt, Mus musculus
gauaauagacugaacuucugaaccuguaauccagccccaauu

SEQ ID NO: 78417 - RNA, 42 nt, Mus musculus
gaccgauuugauaucagucauggagaugcagaguuuggaguu

SEQ ID NO: 78418 - RNA, 41 nt, Mus musculus
uuugagguguggcaacaugaagagaaccuaugaaaggcuau

SEQ ID NO: 78419 - RNA, 46 nt, Mus musculus
gggacaauuuaugcuggguagcuggagcuaagaaauuagcagugau

SEQ ID NO: 78420 - RNA, 46 nt, Mus musculus
auauguaaguuacauauguauauguuauaacguuuauguguaagug

SEQ ID NO: 78421 - RNA, 42 nt, Mus musculus
gccagggcuauuaacuucugacccaucucucuagccccaaaa

SEQ ID NO: 78422 - RNA, 42 nt, Mus musculus
aaagugcuuaccaaugacagaguaaaaccaaagcuaccagac

SEQ ID NO: 78423 - RNA, 46 nt, Mus musculus
aaagggaaguaugugugaaaaggaaagcaggaauuugaugggaaac

SEQ ID NO: 78424 - RNA, 45 nt, Mus musculus
auuuuguaguacuauggcccucgaaaguaaaaacuuaggacaguu

SEQ ID NO: 78425 - RNA, 46 nt, Mus musculus
aaaucugaauucagauuuuuguaacugaaucuucaaagaucuccua

SEQ ID NO: 78426 - RNA, 46 nt, Mus musculus
acuuuacuuacagcucucugcuaagaagcauguuuaugaggcaauc

SEQ ID NO: 78427 - RNA, 47 nt, Mus musculus
uguagacaggcauuccaaggaggugacaagugguaaggcccugaaga

SEQ ID NO: 78428 - RNA, 46 nt, Mus musculus
gcuacuucaugccuggcacuugacuuuuuauuuguagccucuagug

SEQ ID NO: 78429 - RNA, 45 nt, Mus musculus
cuuagugcugagauuaaaguaugcuaucacacuuggcccccaacu

SEQ ID NO: 78430 - RNA, 46 nt, Mus musculus
ucugcaaggaggcggcuacagggcuggaggcgagucugaguaaggu

SEQ ID NO: 78431 - RNA, 46 nt, Mus musculus
cuuaucccucccugccuuaauccccaaacuucaaccugucccauua

SEQ ID NO: 78432 - RNA, 45 nt, Mus musculus
agaacaguuuuaaaacuauauaaaguaauacauauuagggcagag

SEQ ID NO: 78433 - RNA, 45 nt, Mus musculus
gggugguugugagcuaccaugugguugcugugauuugaacucaga

SEQ ID NO: 78434 - RNA, 41 nt, Mus musculus
uuucuaacugggcauuccugaggggagauggagcagggaag

SEQ ID NO: 78435 - RNA, 45 nt, Mus musculus
uaaggucugaaaaauaagaaucuuggcaaaauauaaagcauuagu

SEQ ID NO: 78436 - RNA, 45 nt, Mus musculus
cagcugaucuugaauuggcucauuagcaaggagaaaaguucuaag

SEQ ID NO: 78437 - RNA, 46 nt, Mus musculus
uggcguguggcuuucguaggucgaucgccugucagguacaguccag

SEQ ID NO: 78438 - RNA, 46 nt, Mus musculus
ccaaucuccauaguuccaguauggaugcaguuucguggagcagcag

SEQ ID NO: 78439 - RNA, 47 nt, Mus musculus
gaggcugguuacagcaagaugaggguaacucuucuguagaccccggc

SEQ ID NO: 78440 - RNA, 46 nt, Mus musculus
auguuaacucuugcuuguaguagcaugauauuagguccaaaggugg

SEQ ID NO: 78441 - RNA, 46 nt, Mus musculus
agagagagagagagggagggggagagagagagagagagagagagag

SEQ ID NO: 78442 - RNA, 42 nt, Mus musculus
cgucugacuucuuuacaagacccagcaguaucuuccuggcag

SEQ ID NO: 78443 - RNA, 46 nt, Mus musculus
uccucccuuacuucccuccuugcucuccuucugucucaugccccuu

SEQ ID NO: 78444 - RNA, 69 nt, Mus musculus
cuuucgguggauuccuuacuagaagacaacaaucacaagucacagguagacacucaagaccaagccagg

SEQ ID NO: 78445 - RNA, 46 nt, Mus musculus
ucuugacuauuuuaacuaauucuugauaauaaaauucuugccccag

SEQ ID NO: 78446 - RNA, 45 nt, Mus musculus
caggcuggcuuugaacuagaggugaugccagugaugaccuuggau

SEQ ID NO: 78447 - RNA, 46 nt, Mus musculus
acugaagauggcuguaaauauggguuaaaaagugaacuuuucucag

SEQ ID NO: 78448 - RNA, 46 nt, Mus musculus
gccuccugagugcuggaauuaaagguguguaccaccaugcccccaa

SEQ ID NO: 78449 - RNA, 42 nt, Mus musculus
uaaauguauaugagcguaauccuaagcaaauguugcacugaa

SEQ ID NO: 78450 - RNA, 45 nt, Mus musculus
gcugggacuauguaaauuuagaagcuguagaccuagagaugcuua

SEQ ID NO: 78451 - RNA, 46 nt, Mus musculus
cucguuuguagcccagguuggccuagagccacucuguaguccagac

SEQ ID NO: 78452 - RNA, 52 nt, Mus musculus
gugcuggcaugagugacucugagaagugucccauagaccaagguuggugacc

SEQ ID NO: 78453 - RNA, 46 nt, Mus musculus
guagaacagacgcuggacaucagggcuguaucaacaggaaaugcag

SEQ ID NO: 78454 - RNA, 44 nt, Mus musculus
ggauuagcuaagaauagugauuaauuuguuucuaagugcccaua

SEQ ID NO: 78455 - RNA, 45 nt, Mus musculus
ucuuaugcaagaaaacgcauuaugaaugcuuuaauaggaaagacu

SEQ ID NO: 78456 - RNA, 46 nt, Mus musculus
aaagaagcuuuaggacaucaaguaacaagaauaaauuacauuggag

SEQ ID NO: 78457 - RNA, 65 nt, Mus musculus
cauguagagagggauggagguugguagugggggagagacagaugagggaggggcagggaaagugc

SEQ ID NO: 78458 - RNA, 43 nt, Mus musculus
gcuacuuugauuagccuuucucacgaacuuucaaaaaggguaa

SEQ ID NO: 78459 - RNA, 62 nt, Mus musculus
ggugacacgcaggcacugucacuguggcagagauuccgggacuugagcauugaagaguacac

SEQ ID NO: 78460 - RNA, 46 nt, Mus musculus
cuugggguagagagcuaaaauaaaaaacaacccagagcagugccag

SEQ ID NO: 78461 - RNA, 42 nt, Mus musculus
ucuuagcgucuuggaauauacuuugaugaauauucaggagaa

SEQ ID NO: 78462 - RNA, 48 nt, Mus musculus
ucugucugcacugugaugcgaagugaugggaccucucucuaugccacc

SEQ ID NO: 78463 - RNA, 46 nt, Mus musculus
gccaaauacacacauuagacagacagacagacagacaggcaggcag

SEQ ID NO: 78464 - RNA, 70 nt, Mus musculus
uccccagggaccuugcagcugcuauacaucgcauggacaaguacaauuuugacacaaugauuuaugucgu

SEQ ID NO: 78465 - RNA, 47 nt, Mus musculus
cauuuucagcaaguguuccaaaugcugaagaucaugggcuacgacug

SEQ ID NO: 78466 - RNA, 42 nt, Mus musculus
uccccuuugggauaguaaaggggaugaagacucgaagaggag

SEQ ID NO: 78467 - RNA, 36 nt, Mus musculus
ggagacggcagagagaguggggcuugccgccgucau

SEQ ID NO: 78468 - RNA, 46 nt, Mus musculus
uuauuuauucagugauauaaaguaguaucauaguaaugggcagugg

SEQ ID NO: 78469 - RNA, 46 nt, Mus musculus
cagauacacuuugggggaaucucaucuucucgggaggcagcagcag

SEQ ID NO: 78470 - RNA, 44 nt, Mus musculus
aaggagaauaggcucuaccuagaagguggcuggcaugguuggga

SEQ ID NO: 78471 - RNA, 42 nt, Mus musculus
agaugcugugguaccaaacucauccauacuagccugagggag

SEQ ID NO: 78472 - RNA, 45 nt, Mus musculus
ccaugguagauauuuucauucaaacauacuacacauggcaacuaa

SEQ ID NO: 78473 - RNA, 46 nt, Mus musculus
cuggccuucgaacucagaaauccgccuuccucugccucccaagugu

SEQ ID NO: 78474 - RNA, 46 nt, Mus musculus
aacagugacuuaguucuuuuucaggccaccagacugacugccagau

SEQ ID NO: 78475 - RNA, 36 nt, Mus musculus
uucgagauuccagucauaaaaauugaaaguuucguc

SEQ ID NO: 78476 - RNA, 45 nt, Mus musculus
uccuuggagacgcuuuuaaggagcgcuuuguguguaagccacacc

SEQ ID NO: 78477 - RNA, 46 nt, Mus musculus
aaaacuccucagagacagucagcacaaaccacaaccuguuccugac

SEQ ID NO: 78478 - RNA, 47 nt, Mus musculus
augaucaaggaaaaaauaaugaaugaauccaucuuaagacugcagac

SEQ ID NO: 78479 - RNA, 41 nt, Mus musculus
gugggcaacgucaucaagaugauccaaaccagaggugagag

SEQ ID NO: 78480 - RNA, 42 nt, Mus musculus
cucuacuuggucuuacaagaagaguaccacuuaaagccagag

SEQ ID NO: 78481 - RNA, 45 nt, Mus musculus
uagugagccaccaugugguugcugggauuugaacucuggaccuuc

SEQ ID NO: 78482 - RNA, 45 nt, Mus musculus
aggaaagcuuuuucaaauucaaaacagagaauucggcacccagaa

SEQ ID NO: 78483 - RNA, 49 nt, Mus musculus
gaugccuccgugauugccacagucagagacaacguugcagaacuggaac

SEQ ID NO: 78484 - RNA, 41 nt, Mus musculus
uugcugaaagucaacgauauagaaacaggagggggcuagag

SEQ ID NO: 78485 - RNA, 73 nt, Mus musculus
aaccacccauacaaucagaucauguucagauaccuagaccacaaacuuggagagucacgggacccacugccuc

SEQ ID NO: 78486 - RNA, 45 nt, Mus musculus
gaggaugauggagcggaggcguccagcauccagauuuucauucag

SEQ ID NO: 78487 - RNA, 46 nt, Mus musculus
cagauuacuuuuaagacguuuagaaccagaauuuaaggccacaguu

SEQ ID NO: 78488 - RNA, 45 nt, Mus musculus
ugaagacaacuacaguguacuuacauauaauagauaaauaaaucu

SEQ ID NO: 78489 - RNA, 46 nt, Mus musculus
caguguacuuacauauaauaaauaaauaaaucuuugggugggagug

SEQ ID NO: 78490 - RNA, 46 nt, Mus musculus
ccauccguaacgagaucugacucccucuucuggagugucggaagac

SEQ ID NO: 78491 - RNA, 46 nt, Mus musculus
uuuaucagcccaaucaccagcucuccuuuauuuuacuaauugaggu

SEQ ID NO: 78492 - RNA, 83 nt, Mus musculus
gcauacaugaaggaguggaggacgggagugugcauagaugaaggagaggaggacgggagugugcauagaugaaggagaggagg

SEQ ID NO: 78493 - RNA, 63 nt, Mus musculus
acaugaaggaguggaggacgggagugugcauagaugaaggagaggaggacgggagugugcaua

SEQ ID NO: 78494 - RNA, 55 nt, Mus musculus
gugcauagaugaaggagaggaggacgggagugugcauacaugaaggaaaggagga

SEQ ID NO: 78495 - RNA, 78 nt, Mus musculus
agaggaggacgggagugugcauagaugaaggagaggaggacgggagugugcauagaugaaggagaggaggacgggagu

SEQ ID NO: 78496 - RNA, 72 nt, Mus musculus
ugaaggagaggaggacgggagugugcauagaugaaggagaggaggacgggagugugcauagaugaaggagag

SEQ ID NO: 78497 - RNA, 61 nt, Mus musculus
gaaggagaggaggacgggagugugcauagaugaaggagaggaggacgggagugugcauaga

SEQ ID NO: 78498 - RNA, 46 nt, Mus musculus
aguuaaucuuguauccagccacuuggcugaaaguguuuugucagcu

SEQ ID NO: 78499 - RNA, 45 nt, Mus musculus
cucuugcuaguaucagaguaccuuccugaaccaaagaugcuagau

SEQ ID NO: 78500 - RNA, 73 nt, Mus musculus
cagcuacagucgaugcauagaugacgaauccccaagagagcaagacgauugcaaggagcaacuaaaaggaggg

SEQ ID NO: 78501 - RNA, 46 nt, Mus musculus
uuuuguaauucuuagcaaacacuucuuuucuucagauggcaccuau

SEQ ID NO: 78502 - RNA, 46 nt, Mus musculus
acugugacuaaaauguguuuugcauccuguuuaucaaaauggacag

SEQ ID NO: 78503 - RNA, 45 nt, Mus musculus
aguggacauuaccagacugagcuguguuguguggagaggggggag

SEQ ID NO: 78504 - RNA, 42 nt, Mus musculus
gggcuaagcuaccauguccuacaccuuugaaacagugagcga

SEQ ID NO: 78505 - RNA, 45 nt, Mus musculus
uuuuaccuucuggcugcuguuaggagagauuguggacuggcaaga

SEQ ID NO: 78506 - RNA, 59 nt, Mus musculus
aaacccuaaaugaaaccccacagccucaaaauggccauuuuaacuauaaaaguucacug

SEQ ID NO: 78507 - RNA, 45 nt, Mus musculus
gaugauugcggaucacuauguggguauugggaaucaagccuggau

SEQ ID NO: 78508 - RNA, 46 nt, Mus musculus
cuugcuuaguauuauacuuuuugaguucauccauuuuccuguagau

SEQ ID NO: 78509 - RNA, 77 nt, Mus musculus
gaguuugaggaaguggcagagagcccuaaccuaacacagaggaagagaaagaggucagacugugauagugaggagau

SEQ ID NO: 78510 - RNA, 45 nt, Mus musculus
aacgguguauccacagaugggggucaaccccaccagcauugacuc

SEQ ID NO: 78511 - RNA, 86 nt, Mus musculus
accagcgaaucaaacuuccccauuuggaagcuguugugauuggucgaagcccagagaccaagaucacagauaagaaauguucccga

SEQ ID NO: 78512 - RNA, 23 nt, Mus musculus
gcguuugccacugggcuuggaca

SEQ ID NO: 78513 - RNA, 45 nt, Mus musculus
uaggcagccguuugugacgucaucucucagcaccggaagcggcga

SEQ ID NO: 78514 - RNA, 46 nt, Mus musculus
ucaaaggacagagugaauguuuuucuuauucacuaacacaauagau

SEQ ID NO: 78515 - RNA, 44 nt, Mus musculus
aauuuucuagaggcuuuuuuucuuauugcgaggaaccagagugc

SEQ ID NO: 78516 - RNA, 42 nt, Mus musculus
cuuucucccucccacccugaucgaaaaggcggaggggggggg

SEQ ID NO: 78517 - RNA, 42 nt, Mus musculus
ucagagcaugcacucaggauuuuuggcucagacaggggagag

SEQ ID NO: 78518 - RNA, 38 nt, Mus musculus
aguacacagacuaauauauaccaaaguuagcauucccc

SEQ ID NO: 78519 - RNA, 46 nt, Mus musculus
ccguggaauguuaucuucugaccaucuuucaugccuaaacacagau

SEQ ID NO: 78520 - RNA, 45 nt, Mus musculus
uuccuuaaacaggaauuuucauaaaauuauuguggcucagucaga

SEQ ID NO: 78521 - RNA, 29 nt, Mus musculus
uuuuaaguuaggguccuuuauuggggcag

SEQ ID NO: 78522 - RNA, 50 nt, Mus musculus
ucagacccugaagacaucuguuucucauuucccaucugccccaauaaagg

SEQ ID NO: 78523 - RNA, 46 nt, Mus musculus
ucaccauuccccugggcacucccuaacaacuucauaagcugcugau

SEQ ID NO: 78524 - RNA, 64 nt, Mus musculus
ggagagguaguccccaagagcgccccagcggggccgguagaucuggaagauggugauccaggug

SEQ ID NO: 78525 - RNA, 71 nt, Mus musculus
ucagcugugggcuuccucuucugggugaucauucucgccaccuggaucaccaucuuccagaucuaccggcc

SEQ ID NO: 78526 - RNA, 45 nt, Mus musculus; identical to SEQ ID NO: 53051

SEQ ID NO: 78527 - RNA, 42 nt, Mus musculus
cugaagcuugaucuuagggggugagcuugggugugggggcag

SEQ ID NO: 78528 - RNA, 62 nt, Mus musculus
gagggggugaagguauuuuggacaagaauguucugguggaggaaccagccaauacaagggcc

SEQ ID NO: 78529 - RNA, 45 nt, Mus musculus
cuguaauaaaacuauauuccuucuucuggugugcauagagacaga

SEQ ID NO: 78530 - RNA, 45 nt, Mus musculus
cacaggucagucaagcacuccagcaggcagaccugagccugcaua

SEQ ID NO: 78531 - RNA, 42 nt, Mus musculus
uauauuaauugcauugacaaaggaagucucaaaaaagccuau

SEQ ID NO: 78532 - RNA, 24 nt, Mus musculus
uguggguuuuuguucgguuuuucg

SEQ ID NO: 78533 - RNA, 42 nt, Mus musculus
agcagcaugguaaugugaagagggaaacuucaugggguccug

SEQ ID NO: 78534 - RNA, 46 nt, Mus musculus
auagauagauagauaaagucaaggaaauuaucagaugguguaagau

SEQ ID NO: 78535 - RNA, 46 nt, Mus musculus
aaaaaacagucaggauuaggggagaaaagcagggaguggcugccag

SEQ ID NO: 78536 - RNA, 41 nt, Mus musculus
gugagcagaggcaacagcuuggugucucucucaaggcggag

SEQ ID NO: 78537 - RNA, 46 nt, Mus musculus
cccccugaacggcagacacaguaagugggagacccuccagccccca

SEQ ID NO: 78538 - RNA, 45 nt, Mus musculus
gucagccucugggccaagaucaauaacacuggucagucccucggg

SEQ ID NO: 78539 - RNA, 42 nt, Mus musculus
ccagcguccuugugcuucgggggaucuugguugauacuccac

SEQ ID NO: 78540 - RNA, 45 nt, Mus musculus
acuggacaacguggucaaaagccuggaucauggguuugggaguca

SEQ ID NO: 78541 - RNA, 46 nt, Mus musculus
caucggcacagagguugaggcggccugauggguccacaaacacaac

SEQ ID NO: 78542 - RNA, 42 nt, Mus musculus
gggaucugagcugagagagaaacugauuccauugauugucag

SEQ ID NO: 78543 - RNA, 43 nt, Mus musculus
caggcagagcgcacauuguucuuaguuggcagcaagcggcagg

SEQ ID NO: 78544 - RNA, 42 nt, Mus musculus
aagguagcuacccacaacagugaucugggauggaggccggaa

SEQ ID NO: 78545 - RNA, 46 nt, Mus musculus
aaaaugaaacaaaaaacaaaaccaaacaaaaguggcucaggcccuc

SEQ ID NO: 78546 - RNA, 46 nt, Mus musculus
ggaccuucacuccauccuucuccgccucagcuuuaguggcugagac

SEQ ID NO: 78547 - RNA, 46 nt, Mus musculus
aagaaucaauacagugauggaagggaaagaaugcaagacuucagac

SEQ ID NO: 78548 - RNA, 42 nt, Mus musculus
uuuucucucacccaaacuccaccuaauaaaauccugagagca

SEQ ID NO: 78549 - RNA, 55 nt, Mus musculus
ugcacuaggucucagagaugugcagccagucagcucccuuauaaagaaaucaaag

SEQ ID NO: 78550 - RNA, 46 nt, Mus musculus
cguaucccugcagcugaagugucacaguuguaagccgccacauagg

SEQ ID NO: 78551 - RNA, 42 nt, Mus musculus
ucgggaagaaguuuuuagaaagucaggaaguccagaccagga

SEQ ID NO: 78552 - RNA, 43 nt, Mus musculus
ugaccucugcacaugcgacacguuccacaagcacgccacacac

SEQ ID NO: 78553 - RNA, 41 nt, Mus musculus
cccugaccccggcugcugcugaacuguccagcagcccucuc

SEQ ID NO: 78554 - RNA, 45 nt, Mus musculus
cuuccgcacucccaucugugagcacccugcccggccccgccuccu

SEQ ID NO: 78555 - RNA, 46 nt, Mus musculus
ucccuuaaaccuggagcuguaaaccaccacgugggugcugggaauc

SEQ ID NO: 78556 - RNA, 42 nt, Mus musculus
gacagacagguauaaauccugucaguugcugggaguagggaa

SEQ ID NO: 78557 - RNA, 48 nt, Mus musculus
acuggcuaugucuauucaaacagucucaagaaccauuuuguuggaguu

SEQ ID NO: 78558 - RNA, 46 nt, Mus musculus
ccuccacucugaccagcucggccuugagcuccacuagcccaguaac

SEQ ID NO: 78559 - RNA, 41 nt, Mus musculus
gcugccaagccuuucccugagcagacgggacacauuguagu

SEQ ID NO: 78560 - RNA, 46 nt, Mus musculus
cugauaggaaccuuggaauggauuugcaucucuacagcaagcagga

SEQ ID NO: 78561 - RNA, 46 nt, Mus musculus
aucugcauauauuuaacaggaauagguagaugcccggcuaaaagau

SEQ ID NO: 78562 - RNA, 45 nt, Mus musculus
cgcugcuucaagcgcacagcagaaugacacugcgagccccccagc

SEQ ID NO: 78563 - RNA, 45 nt, Mus musculus
cuuccuucugaagacacguguguuuacaagccuggggucaaaauu

SEQ ID NO: 78564 - RNA, 46 nt, Mus musculus
uaggggaggaagacaguucuauucaguggacuuugacggccuagug

SEQ ID NO: 78565 - RNA, 51 nt, Mus musculus
gucauuuacauguuuguuuuuuuuaaguuuauuuuggaguuggagagaagg

SEQ ID NO: 78566 - RNA, 45 nt, Mus musculus
gugauguuuuucugacuucuggagccucugucugguugcugagau

SEQ ID NO: 78567 - RNA, 45 nt, Mus musculus
uugggauugcuagugaagaugacagucagguagggcuuagaagcu

SEQ ID NO: 78568 - RNA, 46 nt, Mus musculus
gcuugugugucugaugugugcacuccaugucccacuuagauuagag

SEQ ID NO: 78569 - RNA, 50 nt, Mus musculus
cuuuggccaagcccuugucuucacaaauucucagcacaacaaucagaugg

SEQ ID NO: 78570 - RNA, 47 nt, Mus musculus
gaucugguggccuugcuccacaagccugcuccucccacccaagccac

SEQ ID NO: 78571 - RNA, 33 nt, Mus musculus
aguggcacaccuuuuuaauccuagcacugagac

SEQ ID NO: 78572 - RNA, 45 nt, Mus musculus
ucuacugccaaucaagagucuccugucuagcugauuggggcaaag

SEQ ID NO: 78573 - RNA, 46 nt, Mus musculus
auauauauuuauuuauuuuauguauaugaguacacuguagccauac

SEQ ID NO: 78574 - RNA, 45 nt, Mus musculus
aguuggcaguuugggaagcugcucagaaugguacagaugagggac

SEQ ID NO: 78575 - RNA, 45 nt, Mus musculus
caagcaaguuucaggacagucgaagcuucaauucugacacaagaa

SEQ ID NO: 78576 - RNA, 46 nt, Mus musculus
aggagacaagccugcggagcggggcaagcgggcccgaggcagaggu

SEQ ID NO: 78577 - RNA, 83 nt, Mus musculus
guuuuuucuuccccuacagauauucaugcuauagacauagauuaaauuaauuagagaugucuaggugugucuucagccccagg

SEQ ID NO: 78578 - RNA, 58 nt, Mus musculus
agucguggacggggaaccaacaaccgcaagggaagaggcggcaaccgaguccgagagu

SEQ ID NO: 78579 - RNA, 61 nt, Mus musculus
uuuuggaagagaaaguucagaaaacaaagaaaacagagagaagaggacggagagagaagcg

SEQ ID NO: 78580 - RNA, 47 nt, Mus musculus
agaggguguuggguccucugaaauuaguguuauaaguuacagauggu

SEQ ID NO: 78581 - RNA, 42 nt, Mus musculus
ucaauguuuggguuuagucacauucuugcuuugaggggaggc

SEQ ID NO: 78582 - RNA, 46 nt, Mus musculus
ggugcuuucuuuucauguauguauguauguguaauacuugcuagcc

SEQ ID NO: 78583 - RNA, 46 nt, Mus musculus
gcuguguugcagggguugggcaggcuguauuuuugagggaguguuc

SEQ ID NO: 78584 - RNA, 48 nt, Mus musculus
gugaacaaagcuaucaauauacuguuggaagggaauucugacaccgug

SEQ ID NO: 78585 - RNA, 46 nt, Mus musculus
gcagaugcggcuugcucaagugaucuuugauaagaaugauucagau

SEQ ID NO: 78586 - RNA, 45 nt, Mus musculus
agagacuuugucucacaacaacaaaaauguaaaacagauugggga

SEQ ID NO: 78587 - RNA, 46 nt, Mus musculus
ggucucacuguguagcccugacuaguguggaacucacuuuguagau

SEQ ID NO: 78588 - RNA, 45 nt, Mus musculus
uaucuaucuaucuaucuaucuaucuaucuaucuaucuggcccagc

SEQ ID NO: 78589 - RNA, 84 nt, Mus musculus
gaucucucuagcucugccuguccaggaacucacgccuuagauaagacuaggcucaaacucagauccaccugcaccuguggaguu

SEQ ID NO: 78590 - RNA, 45 nt, Mus musculus
uacacacuuaaauuguuuccuuuucucuauuucuucacugugaga

SEQ ID NO: 78591 - RNA, 45 nt, Mus musculus
uugcucuuguuuucucagacaucuuuaguuuuucguaccccuauu

SEQ ID NO: 78592 - RNA, 46 nt, Mus musculus
uggcaggugugguggugcaugccuuuaauuccagcacauaggagac

SEQ ID NO: 78593 - RNA, 65 nt, Mus musculus
cagugcuuggaaucacacacagaaucuuacauauguugggcaaauguucugcuauugaacuagac

SEQ ID NO: 78594 - RNA, 24 nt, Mus musculus
caagguagccuaguggguaaaguc

SEQ ID NO: 78595 - RNA, 44 nt, Mus musculus
cuuguccaaaggaaaaagcugccgacugaacuguggggaggagu

SEQ ID NO: 78596 - RNA, 44 nt, Mus musculus
gggaaaaaccacagaugccaacagcacacgcagcccagucacag

SEQ ID NO: 78597 - RNA, 46 nt, Mus musculus
aauuagauauaauaauaaauaaauguuaaaaaaaaaaaaaaagaaa

SEQ ID NO: 78598 - RNA, 46 nt, Mus musculus
uaaggcuugguggcaagugccuuuagucguugagccauuuugagau

SEQ ID NO: 78599 - RNA, 47 nt, Mus musculus
gugaccagauuggacauuacauaaguaugaacauaguaaguugaggu

SEQ ID NO: 78600 - RNA, 45 nt, Mus musculus
uuuuuagguaacugacauuaaaaaaaaaaagaaauaagaugauga

SEQ ID NO: 78601 - RNA, 65 nt, Mus musculus
acacuguagcugucuucagacaccccaaaagagggcaucagaucucauuaaggaugguugugagc

SEQ ID NO: 78602 - RNA, 63 nt, Mus musculus
ugagccaucucuccagcccuguuuguuuguuuuuaaagauguauguauuuauuauaaguaagu

SEQ ID NO: 78603 - RNA, 101 nt, Mus musculus
ugauugaaggaaaaacugcagagcuuuuuuuuugaggagacugcagcuuaacagggauuaauuaauuaauuuuuaaugauuuauuuguuuuauguauguga

SEQ ID NO: 78604 - RNA, 123 nt, Mus musculus
ugguggaaaccaggucaaaggugaagcaggugguuagagaagaauggagaccaugaguguauuccuuagggaaagagcuuaaguagucauugcuuaggacauugaagauuuagcuuccaguag

SEQ ID NO: 78605 - RNA, 72 nt, Mus musculus
agacaagggaaggaugucugaaguuauacugagcaguagagacagaugaaagagagcaagagggaagacugc

SEQ ID NO: 78606 - RNA, 50 nt, Mus musculus
uaguuuuaugguuaguagucacugcaaugugaggaacuggauuaaggggu

SEQ ID NO: 78607 - RNA, 46 nt, Mus musculus
uguguguacgcauguggguauuggaacacgugugcaccugugagaa

SEQ ID NO: 78608 - RNA, 44 nt, Mus musculus
uuuauuacauguaaguacacuguagcugucuucagaccccccag

SEQ ID NO: 78609 - RNA, 46 nt, Mus musculus
ucucagauugguucagugacuguuuggagugucuuuguauaggagg

SEQ ID NO: 78610 - RNA, 45 nt, Mus musculus
agguaccaagcacacacauagugcacauauguacacacaggaaaa

SEQ ID NO: 78611 - RNA, 46 nt, Mus musculus
ccuucagggccuuuuggcuagggcccuuuuccaguugcuaugagau

SEQ ID NO: 78612 - RNA, 45 nt, Mus musculus
aguaacaauuggagcuuuuaggugauucuaugagguacccagaga

SEQ ID NO: 78613 - RNA, 26 nt, Mus musculus
cugccuggcagaagaggcagacuuug

SEQ ID NO: 78614 - RNA, 46 nt, Mus musculus
uguccccuuuuauuuggggcucagaguaguagucacuuugccaacc

SEQ ID NO: 78615 - RNA, 45 nt, Mus musculus
uucuuccaaggccuugaggacauauuguccacuuacaccggagca

SEQ ID NO: 78616 - RNA, 45 nt, Mus musculus
uggaggccuucacaagugagguuccugagcaagcugagggcagcu

SEQ ID NO: 78617 - RNA, 45 nt, Mus musculus
cucugccuccucaggaccuucuccuaaggacaaccgggcccagaa

SEQ ID NO: 78618 - RNA, 47 nt, Mus musculus
cagcugacagcuggguguauuccagggaccccaucaucagccacaga

SEQ ID NO: 78619 - RNA, 46 nt, Mus musculus
gugagagagcagcagaugccagggacucagacagacagacaaagau

SEQ ID NO: 78620 - RNA, 46 nt, Mus musculus
aaauuugacuguguuuaauaugaugcaaauuaaaguugugggagau

SEQ ID NO: 78621 - RNA, 46 nt, Mus musculus
cccaaaguauucacaaggcugguuuugauugagcuugccauguagc

SEQ ID NO: 78622 - RNA, 49 nt, Mus musculus
acuauuuucucacaguuaugcauuacagaaauauaugaaaagauagagc

SEQ ID NO: 78623 - RNA, 52 nt, Mus musculus
ggagaaggugugaagacauagaugccuaauagagaugaaagcagagagaugg

SEQ ID NO: 78624 - RNA, 46 nt, Mus musculus
uauagccaucguaauagcuguguccaaucaccaucuacccaaagcc

SEQ ID NO: 78625 - RNA, 46 nt, Mus musculus
acaacugcguguuguggcagauagcuguaacccagcagcuggagac

SEQ ID NO: 78626 - RNA, 44 nt, Mus musculus
uuuucacauuuaacuuagaaggguuuaaucaaauaaugcucaga

SEQ ID NO: 78627 - RNA, 47 nt, Mus musculus
gaaauggagaaaaucagaguuuguguucgaaaacggccuuuaggugu

SEQ ID NO: 78628 - RNA, 44 nt, Mus musculus
ucuuaaaaauuaaagucuauuuguaaacauauaucaggcagauc

SEQ ID NO: 78629 - RNA, 46 nt, Mus musculus
gugucaggguauaacuauggaauuccucauucuugugucagguaau

SEQ ID NO: 78630 - RNA, 58 nt, Mus musculus
guccacuuaccugaaagugcuggagcacaugcuaccagaugauucccagugccagaca

SEQ ID NO: 78631 - RNA, 25 nt, Mus musculus
gccagcaaagauaaaauggccaaca

SEQ ID NO: 78632 - RNA, 41 nt, Mus musculus
acacagugucuuucuaguaaagacagauauucuagguaagg

SEQ ID NO: 78633 - RNA, 42 nt, Mus musculus
agagagagagagagagagagagagagagagagggcggggagg

SEQ ID NO: 78634 - RNA, 42 nt, Mus musculus
gggagaauaaguucuauucuauucuauucuuaaaugcuaggu

SEQ ID NO: 78635 - RNA, 41 nt, Mus musculus
ccuccacagccuuuacauuggacuuuuugacagagauagau

SEQ ID NO: 78636 - RNA, 45 nt, Mus musculus
ugugagugauauguacaaaucacaauaggaaagacagcagcuaac

SEQ ID NO: 78637 - RNA, 46 nt, Mus musculus
auaauaaauaaauaaaucuuuaaaaaacaaauuauuaggccauccc

SEQ ID NO: 78638 - RNA, 46 nt, Mus musculus
gcuuauggggcaagagagcuuuagucacugaaccaucaccccagau

SEQ ID NO: 78639 - RNA, 46 nt, Mus musculus
aauucuguccucuauccuggccccaggcaaucacugaccugcuuuc

SEQ ID NO: 78640 - RNA, 42 nt, Mus musculus
gaugcuugguggucuugugccucacucauucaugcccuaauu

SEQ ID NO: 78641 - RNA, 42 nt, Mus musculus
auacuacugaggacaaacaagaucaggccaauugccagggaa

SEQ ID NO: 78642 - RNA, 47 nt, Mus musculus
gauagcacagccauuauaugaggcuacuaggggcaaagaagauaaga

SEQ ID NO: 78643 - RNA, 44 nt, Mus musculus
acuacagcccacaaucaggagcuguccuaccaucuggcccgagg

SEQ ID NO: 78644 - RNA, 45 nt, Mus musculus
accacaugugugcuugauguccauggaggucagaagagggcauug

SEQ ID NO: 78645 - RNA, 42 nt, Mus musculus
cuuauagguucagagauucaguccagcaucaucaaggcagga

SEQ ID NO: 78646 - RNA, 42 nt, Mus musculus
cuccagcucccauuuuuuuaaaaacuuuuuuuggggcuagca

SEQ ID NO: 78647 - RNA, 45 nt, Mus musculus
caaaccucauucuccuuuuuucucauauaauuuugaccucugaga

SEQ ID NO: 78648 - RNA, 31 nt, Mus musculus
caugucaaagucaucgucgcuggccaugaga

SEQ ID NO: 78649 - RNA, 46 nt, Mus musculus
acuaugucaggcagccggccugugcuugaugucaaggaauggcuag

SEQ ID NO: 78650 - RNA, 41 nt, Mus musculus
aguauguacaaaagcaacccaagaggacauagcugcgggcg

SEQ ID NO: 78651 - RNA, 42 nt, Mus musculus
uauugucuucagcagccuuggaucugugagauuuugguccau

SEQ ID NO: 78652 - RNA, 89 nt, Mus musculus
uaucugcaugguauacgcugcugucugaauaugaguuccagcgaguagagagauggaugugguccugccgcgcuccuguccauccacag

SEQ ID NO: 78653 - RNA, 44 nt, Mus musculus
guaagcucaagccggaggccccgggcauaggcccgaaggguaua

SEQ ID NO: 78654 - RNA, 46 nt, Mus musculus
acuuuucguggugcccucuuuccauugguggaaggugccagagaug

SEQ ID NO: 78655 - RNA, 46 nt, Mus musculus
uccgcagcuccacgaucagccgagagaaggcaagcucaugguccag

SEQ ID NO: 78656 - RNA, 41 nt, Mus musculus
gaaccuuaggaaagaagcggugauaucugaaguguccauga

SEQ ID NO: 78657 - RNA, 46 nt, Mus musculus
aaaaaaaaaaaaaaaagaaaaaaaaaaagaaaaagaaaaggaagga

SEQ ID NO: 78658 - RNA, 42 nt, Mus musculus
ggcaaacccaaacucacauuggaagagaaaggaacaggguag

SEQ ID NO: 78659 - RNA, 45 nt, Mus musculus
aaaccaccacagggguaagcuggggguaccuccaauggggcagga

SEQ ID NO: 78660 - RNA, 44 nt, Mus musculus
gccucagucacagaggagcugggugcccaguacccuugggugca

SEQ ID NO: 78661 - RNA, 44 nt, Mus musculus
aaaggagccaugaugggcuguucuaacccccauccccacugcca

SEQ ID NO: 78662 - RNA, 42 nt, Mus musculus
cucagugcuaaggaacagaaagaagagaaugcggccugugca

SEQ ID NO: 78663 - RNA, 46 nt, Mus musculus
ccgaggugaacccacugggugccagcacgugccuacuggaugugag

SEQ ID NO: 78664 - RNA, 42 nt, Mus musculus
caggucaucaugcuuguuugccaccccuacccuuggccccag

SEQ ID NO: 78665 - RNA, 73 nt, Mus musculus
aguccaccugaggaauguguacagaagucuguguuccugugaucguguguguaugugagacagggagcaaaag

SEQ ID NO: 78666 - RNA, 88 nt, Mus musculus
uucucugcauguguguacagaugauuggagagugugugcggucuugggcuuggcccuucugggaagugugaagaguugaaauaaaaga

SEQ ID NO: 78667 - RNA, 46 nt, Mus musculus
uggguaauagggagauguuuaccauuaaggagggaaacugaggcag

SEQ ID NO: 78668 - RNA, 46 nt, Mus musculus
acacacacuuaaaaaauuaaauacaaaaacaaaaaauugggaucag

SEQ ID NO: 78669 - RNA, 45 nt, Mus musculus
cguuaggaggaggguuaucuagggacccgaacuuggagucaccaa

SEQ ID NO: 78670 - RNA, 41 nt, Mus musculus
ggcagagccgagccuggcccggacaaaaggcgcggcaggga

SEQ ID NO: 78671 - RNA, 42 nt, Mus musculus
cacugucacacagccgaacaggcgcucacaucauucagccag

SEQ ID NO: 78672 - RNA, 45 nt, Mus musculus
ggggacucaugcacauaccggggggagaugaggaugacagggagg

SEQ ID NO: 78673 - RNA, 30 nt, Mus musculus
ccguuuccgaaaauggcugcccuccuccag

SEQ ID NO: 78674 - RNA, 46 nt, Mus musculus
ccuaucuggggcccccuuaacugucacagcccucacuccugccagg

SEQ ID NO: 78675 - RNA, 44 nt, Mus musculus
uauuacaagauucuugggaucccgucuggggccaaugaggauga

SEQ ID NO: 78676 - RNA, 45 nt, Mus musculus
cgauaggccuucuugaucucauccucauuggccccagacgggauc

SEQ ID NO: 78677 - RNA, 42 nt, Mus musculus
gacaagaacaaagagcccaacgccgaggagaaguuuaaggag

SEQ ID NO: 78678 - RNA, 46 nt, Mus musculus
ugccagaggccucccccuccccccaccuucuucccuucccagccuu

SEQ ID NO: 78679 - RNA, 46 nt, Mus musculus
cccagggaaaaccucugagacugaaggaaggagaaguagccuugag

SEQ ID NO: 78680 - RNA, 45 nt, Mus musculus
ccagugcugcacacaaacucugguacaaugauucuggcuggcugu

SEQ ID NO: 78681 - RNA, 44 nt, Mus musculus
gauuucuggauggcgcuuugaugguggacgcuugguggagcugu

SEQ ID NO: 78682 - RNA, 46 nt, Mus musculus
ccuucuuugguggcuccaaccccuucgauaucuucuuugccagcag

SEQ ID NO: 78683 - RNA, 46 nt, Mus musculus
guucaaaguucgauucccagacagauuaaccccacagacacggcag

SEQ ID NO: 78684 - RNA, 45 nt, Mus musculus
ucuuggggugggguucuuagguuuucucacuuugacaagccccug

SEQ ID NO: 78685 - RNA, 100 nt, Mus musculus
aguggaauaaaagaacaaugugaauguuuuauguagcuaagaucugugaggugcucgccaagucaggcucagcaagcaugaggagaugcgucaugucagg

SEQ ID NO: 78686 - RNA, 46 nt, Mus musculus
gugcgccaccacgccggcucagaguuuucucauuccacuccuagau

SEQ ID NO: 78687 - RNA, 46 nt, Mus musculus
cucccggaggcaguaggcugcccacugcuccugcucuggcccuucc

SEQ ID NO: 78688 - RNA, 42 nt, Mus musculus
uccucucccuggcugaguccucuggcaucuauggugggaggu

SEQ ID NO: 78689 - RNA, 81 nt, Mus musculus
agggggucuaagaggccacuggcuccccuacuuccugucccuagaccuguccuaauauuacugcucauucgcuuggccacc

SEQ ID NO: 78690 - RNA, 45 nt, Mus musculus
uuuaagaccgccauaccauaagggcaagcuguccuuucccgugug

SEQ ID NO: 78691 - RNA, 42 nt, Mus musculus
aagagcucuaaccugagccaccauacucgugacgucgcuggg

SEQ ID NO: 78692 - RNA, 46 nt, Mus musculus
aguaugguagcuccaggaaugaagccuaugggucacuaggguauua

SEQ ID NO: 78693 - RNA, 46 nt, Mus musculus
cuuuucccuuuccugcccuucaacccaucuucgaaagccuguaugu

SEQ ID NO: 78694 - RNA, 45 nt, Mus musculus
uccauacccugucugcucuggguacuucaugugccuguccccucc

SEQ ID NO: 78695 - RNA, 46 nt, Mus musculus
cucuucuuggugccugugggugaggagggaaaugcuagccccaccc

SEQ ID NO: 78696 - RNA, 43 nt, Mus musculus
gggcauggaccagacugcaagcuagagggacaagacaucagac

SEQ ID NO: 78697 - RNA, 44 nt, Mus musculus
agcguguguagacuugugugaggacaaaauguacagcagugagc

SEQ ID NO: 78698 - RNA, 45 nt, Mus musculus
cucccucucuauuaaaggugaagggcucuaggccagagugagagc

SEQ ID NO: 78699 - RNA, 44 nt, Mus musculus
gaagggcccggagcagcggccaccgcggcggagccaauuuggga

SEQ ID NO: 78700 - RNA, 41 nt, Mus musculus
uacaggugauacuugagcgauuugaaggaacuucgggagaa

SEQ ID NO: 78701 - RNA, 45 nt, Mus musculus
gaaaugcuagcugagagcauucggcaauuauacucuaauagguag

SEQ ID NO: 78702 - RNA, 55 nt, Mus musculus
uggaggaacuuugguuugcucugggggcggaggaugagauaaggucuuauugugu

SEQ ID NO: 78703 - RNA, 47 nt, Mus musculus
gaaaccacggcgugugugugugugugugugugugugugugugcgaga

SEQ ID NO: 78704 - RNA, 42 nt, Mus musculus
cacuuccccagcuccauacucucuccguuuccuuguggggac

SEQ ID NO: 78705 - RNA, 46 nt, Mus musculus
gugacauccuagccuugguguuuggccuucucuuugcugucaccag

SEQ ID NO: 78706 - RNA, 27 nt, Mus musculus
aucgcagcacaggaagagaugcuucgg

SEQ ID NO: 78707 - RNA, 46 nt, Mus musculus
cccccaccccgacuccccaucccuauguaaccuucucauuccagga

SEQ ID NO: 78708 - RNA, 47 nt, Mus musculus
gcugcagccaagaagcuggagcagcugaagcccagggccaaacccaa

SEQ ID NO: 78709 - RNA, 41 nt, Mus musculus
uguacaugucauuuagaggucauaugacaacuuggaagagu

SEQ ID NO: 78710 - RNA, 42 nt, Mus musculus
cccugaguucuccagcgucccugcccagaucagcccugaggu

SEQ ID NO: 78711 - RNA, 46 nt, Mus musculus
uguuuccuuggcgcacuuuaaaaagagaccaaguuuaugcgcagua

SEQ ID NO: 78712 - RNA, 42 nt, Mus musculus
gccaagaacagcuagucgaggcugggcgacugguggccaaag

SEQ ID NO: 78713 - RNA, 42 nt, Mus musculus
aguggcaagugcugcagccgcccugguccucaaggccaagag

SEQ ID NO: 78714 - RNA, 45 nt, Mus musculus
ugagaauuuccagguggggagcaugccaccugcccagcagcagau

SEQ ID NO: 78715 - RNA, 41 nt, Mus musculus
uuacagaaaaaaagcaaggaccauuuugggcuggagggaga

SEQ ID NO: 78716 - RNA, 52 nt, Mus musculus
ggauggcuacuacucaguacagacgacagaaggcgagcagaucgcacagcuc

SEQ ID NO: 78717 - RNA, 37 nt, Mus musculus
aauaaauaaauaaaucuuuaaaaaaaaaagaggcaga

SEQ ID NO: 78718 - RNA, 46 nt, Mus musculus
ggugcauugaauaugacugcaggacagaguuagguauuguggaaag

SEQ ID NO: 78719 - RNA, 62 nt, Mus musculus
ggaagaauaaacuggugcccaggcuguugggcaucacuaaggagugugugaugcguguggau

SEQ ID NO: 78720 - RNA, 42 nt, Mus musculus
ugaacuggcuggaccaugggcggacacugagggaacagggag

SEQ ID NO: 78721 - RNA, 48 nt, Mus musculus
ggacagggacccugagaaaagacaagacccuacugcgagaugaaaaga

SEQ ID NO: 78722 - RNA, 46 nt, Mus musculus
agcagagaccccugaagauccggauguuagacggaacggugaagac

SEQ ID NO: 78723 - RNA, 30 nt, Mus musculus
gcaauuugagccaucuaccaugguguacga

SEQ ID NO: 78724 - RNA, 37 nt, Mus musculus
cuccacagccaggucuguccacugcugggaagguucc

SEQ ID NO: 78725 - RNA, 42 nt, Mus musculus
acauucuggagccccagcuuccuaaccuguaaaaauggagau

SEQ ID NO: 78726 - RNA, 65 nt, Mus musculus
ccccaaaagcgaccgggagaaggagcggguagcgggcccagggcggggcgcagagccgggcagcg

SEQ ID NO: 78727 - RNA, 62 nt, Mus musculus
gugggggacguuuccaggacggaaguggccgagagugugucgaagggagggcgaggccggag

SEQ ID NO: 78728 - RNA, 42 nt, Mus musculus
ggcggggauucugaggauccuuguccgccuucgccucgagcu

SEQ ID NO: 78729 - RNA, 42 nt, Mus musculus
gcuguaaugguucagauggcuguucuguguggggcccaagau

SEQ ID NO: 78730 - RNA, 46 nt, Mus musculus
gauuccgucugucagucucuauaccugcuauccuguccacugacac

SEQ ID NO: 78731 - RNA, 42 nt, Mus musculus
ucacacacacagcacuggaucccaccccaagccugcccauuc

SEQ ID NO: 78732 - RNA, 45 nt, Mus musculus
uaccaaauccugaagaggaauaggauguaacagaaaggucccugu

SEQ ID NO: 78733 - RNA, 45 nt, Mus musculus
agaaaugaccccugcccucagagugagcagugggaaaauuggaga

SEQ ID NO: 78734 - RNA, 44 nt, Mus musculus
cccgagcuuccagcuuaccuccaaaggugagauaacuggcagau

SEQ ID NO: 78735 - RNA, 42 nt, Mus musculus
uucagaaugcuaagauuuuaggaauguucauggaauccagca

SEQ ID NO: 78736 - RNA, 41 nt, Mus musculus
uuguuuagacugaauguugagcaugaaaugauugguuaagg

SEQ ID NO: 78737 - RNA, 46 nt, Mus musculus
acaacaacaucaaguacauugaacucaaaaaggagugauaccggga

SEQ ID NO: 78738 - RNA, 44 nt, Mus musculus
uccccaguauaaacuguagacuuuugguaucucauucuccucag

SEQ ID NO: 78739 - RNA, 46 nt, Mus musculus
gccgagggaaagucgggacguucgguaucuucaaaucuguguacag

SEQ ID NO: 78740 - RNA, 42 nt, Mus musculus
gacucaugcccggcaccaggaguccugccuacauacaaccag

SEQ ID NO: 78741 - RNA, 45 nt, Mus musculus
aaacagaagggccucccgagacugcagaugugaaggcaccaagag

SEQ ID NO: 78742 - RNA, 48 nt, Mus musculus
uucaucccugcccucaucuuucccuuaagcaucaguccaucuuaccuu

SEQ ID NO: 78743 - RNA, 46 nt, Mus musculus
gacgggagcccaaggagagagaaacucaggagucaaggagcaaggc

SEQ ID NO: 78744 - RNA, 46 nt, Mus musculus
ggccuguggcuguggcgacuucuggaaggaggcaaaggcugagcag

SEQ ID NO: 78745 - RNA, 42 nt, Mus musculus
gccaggcuguguuccagcagcgcaggcaggugcgcaggggag

SEQ ID NO: 78746 - RNA, 45 nt, Mus musculus
uggcugaacagacacagcgaggcagguuggagcugggaaacucga

SEQ ID NO: 78747 - RNA, 46 nt, Mus musculus
uacugccacgauccaaauacuuuaacccuugaugcucccuggagcc

SEQ ID NO: 78748 - RNA, 46 nt, Mus musculus
ggggcuccagggagcaucaaggguuaaaguauuuggaucguggcag

SEQ ID NO: 78749 - RNA, 45 nt, Mus musculus
cucacacaaaaauugugagcacaagugcuugugagccuagggaga

SEQ ID NO: 78750 - RNA, 68 nt, Mus musculus
uggccgcuaccagagaucuuaggaugcuuuccuaagugccagcagugagcuggaaggcaggaagggaa

SEQ ID NO: 78751 - RNA, 63 nt, Mus musculus
agaccugagccuuguccugggaagggcugucauccuuauuggagaggcaaggugaaacuauaa

SEQ ID NO: 78752 - RNA, 45 nt, Mus musculus
cagggucucagacuggccuugaacaaguacugggauuauagauau

SEQ ID NO: 78753 - RNA, 46 nt, Mus musculus
uaguucagcaaagggugaggugauauggcuugaacuaaagugauag

SEQ ID NO: 78754 - RNA, 46 nt, Mus musculus
gauaggaaaaaagauguuguuguuacaacuuaagagaaacaggcag

SEQ ID NO: 78755 - RNA, 50 nt, Mus musculus
uacaggaaggggguaccagggaagauggacuucgaauuguggagaagaug

SEQ ID NO: 78756 - RNA, 42 nt, Mus musculus
aggccauagauuuaaucucuagccuggaagaggggaaugaag

SEQ ID NO: 78757 - RNA, 46 nt, Mus musculus
cugguggaggaacgcacacaggccuaucuagaggagaaacgcaaag

SEQ ID NO: 78758 - RNA, 90 nt, Mus musculus
uggaugggcaauggucacuguguuuccacacagcaaaaacagacguagccauaucagauggaaaacaugcauagacacaaacccccugcc

SEQ ID NO: 78759 - RNA, 46 nt, Mus musculus
acuccuuguggccaagaagauagcacaggcccagggucugaaagau

SEQ ID NO: 78760 - RNA, 42 nt, Mus musculus
gucaggacaaauacauuaaaucaaguaacaaggcuuaaagau

SEQ ID NO: 78761 - RNA, 42 nt, Mus musculus
gguggcugagggcacccucaggaugguggccaggaucagcau

SEQ ID NO: 78762 - RNA, 45 nt, Mus musculus
aggggauccucaggauugucacaaggaugaagacauaggagaaag

SEQ ID NO: 78763 - RNA, 46 nt, Mus musculus
ucuucauguugacacccaacccuucguggauguuuggaggggugcu

SEQ ID NO: 78764 - RNA, 47 nt, Mus musculus
aaauguguaugugaacguguguauguguguauguguguacgugugug

SEQ ID NO: 78765 - RNA, 46 nt, Mus musculus
auaucccccuacuguguauuuccuagaagugaacaauuccauagag

SEQ ID NO: 78766 - RNA, 46 nt, Mus musculus
ugcgggaggaucuguguguugcagaguuggaaggauuacgugcugg

SEQ ID NO: 78767 - RNA, 46 nt, Mus musculus
agucgcagaauuagcaaaguugaggaccacuaacccacagaggcac

SEQ ID NO: 78768 - RNA, 46 nt, Mus musculus
aggcuccuagggacugggccuauuaagagguguaacgccuuguugg

SEQ ID NO: 78769 - RNA, 45 nt, Mus musculus
gaccccacuggagcucccggggacugaaccaccaaccaaugaaua

SEQ ID NO: 78770 - RNA, 46 nt, Mus musculus
aagacagaggcagaaacucaaagccaaccauuggacugagcucggg

SEQ ID NO: 78771 - RNA, 42 nt, Mus musculus
cccggacuuuauuguggaugcugggaagugcuugcggaugga

SEQ ID NO: 78772 - RNA, 45 nt, Mus musculus
uaaauaaaugaauaaaugacuucaugaaauucucaggcaaauaga

SEQ ID NO: 78773 - RNA, 45 nt, Mus musculus
aaucccagcaaccacaugguggcucaaaaccauccauaaagagau

SEQ ID NO: 78774 - RNA, 45 nt, Mus musculus
auaugaacaacuauggagguuaauaugcagugaggaacuagaggg

SEQ ID NO: 78775 - RNA, 42 nt, Mus musculus
ggaacagaaggauuaaguggagagaggaggaagauuggguaa

SEQ ID NO: 78776 - RNA, 46 nt, Mus musculus
uagaggcuucagcaccaugaagagaaccuaugaggagcuauuagug

SEQ ID NO: 78777 - RNA, 46 nt, Mus musculus
acauuuaacccacuauuugggaucaguaggugccaauggugaagau

SEQ ID NO: 78778 - RNA, 46 nt, Mus musculus
ggacauaaggagauaugauggugugucaaguugacaagggauagau

SEQ ID NO: 78779 - RNA, 42 nt, Mus musculus
gauuaauugcauugacaaaggaagucucaaaaaagccugcua

SEQ ID NO: 78780 - RNA, 46 nt, Mus musculus
cuucccagacuuaucuucggaaacuguaagcgaaucccagugagau

SEQ ID NO: 78781 - RNA, 42 nt, Mus musculus
auuaauaaaauuuaagagcacaagaaaaacagagagcgagag

SEQ ID NO: 78782 - RNA, 45 nt, Mus musculus
agcaauauggaagcauaagccagauaaacccuuuccaccccaacu

SEQ ID NO: 78783 - RNA, 45 nt, Mus musculus
cgaggacacugagguucagaaacacccagugguuguguguugagu

SEQ ID NO: 78784 - RNA, 27 nt, Mus musculus
aaaggggaggagcccuggggacaacuc

SEQ ID NO: 78785 - RNA, 42 nt, Mus musculus
ccgguagcagccgccagcacagugucggcugcugggcggggu

SEQ ID NO: 78786 - RNA, 42 nt, Mus musculus
cgaagaagacccggccgcggccuucuuggcgcagcaagagag

SEQ ID NO: 78787 - RNA, 46 nt, Mus musculus
accaggcuucaggcacagcaagggcuuggugaaaaguuggacagaa

SEQ ID NO: 78788 - RNA, 47 nt, Mus musculus
acguaguuuagcaguuaaagauacgcaaaacuuuggauuguggggag

SEQ ID NO: 78789 - RNA, 44 nt, Mus musculus
ugcauacauuguugaggcuaggacuccuggcgcuauucuuugga

SEQ ID NO: 78790 - RNA, 47 nt, Mus musculus
cguggaaaaggccuauucaguagugaaggaaguaggauauagcuaga

SEQ ID NO: 78791 - RNA, 45 nt, Mus musculus
ccccaaaaaaaacaaaaaaaagcaggacauuaugcuaacuccuag

SEQ ID NO: 78792 - RNA, 24 nt, Mus musculus
ucaguucuagguuauggcccaggu

SEQ ID NO: 78793 - RNA, 46 nt, Mus musculus
aucugcaacagaacgagguauacacagucugagggaggggagaguc

SEQ ID NO: 78794 - RNA, 64 nt, Mus musculus
aguagcauccauagaagagucuaucauucuacgggcaguguuguauguguucagugucacauuu

SEQ ID NO: 78795 - RNA, 45 nt, Mus musculus
ugacaaauagguaggcagaaagagcccugcuaggcaguugggagg

SEQ ID NO: 78796 - RNA, 89 nt, Mus musculus
uuauguaacgacugucacggcuuagccugcuuucuucucuguuaagguacauaauauauaccacaagguguuuuagaaucacaucaauu

SEQ ID NO: 78797 - RNA, 47 nt, Mus musculus
uguguaguaagcagucagugaauuuuagcuacuguuuuucuggaagu

SEQ ID NO: 78798 - RNA, 45 nt, Mus musculus
ccagaagagagcaccagaucucauuacagaugguugugagccacc

SEQ ID NO: 78799 - RNA, 55 nt, Mus musculus
uaagucuuuaaaaaaaaaaaaggcuugaaggcuuugggguauaccgaguaaauug

SEQ ID NO: 78800 - RNA, 69 nt, Mus musculus
aaagacguaaacuugcucccucugcagggaaaaugcccaugggagaugcccacagguuaaacagaaggc

SEQ ID NO: 78801 - RNA, 52 nt, Mus musculus
ggagguggggcaagucagauauugaaaaauaucccucaguggugggggcugg

SEQ ID NO: 78802 - RNA, 57 nt, Mus musculus
caagccaagagagaugaauuaaagguuguuuuucuggagggagauuaauuuuauugg

SEQ ID NO: 78803 - RNA, 46 nt, Mus musculus
gaaauacuugcaguauuauagauuuauuaauaaagagaauuucgag

SEQ ID NO: 78804 - RNA, 61 nt, Mus musculus
acaguuacgcagccauuucagaaguggaucgauugcagucagagccugaaaguauccguaa

SEQ ID NO: 78805 - RNA, 41 nt, Mus musculus
ggcagcucacaacugucuguaacuccugucccaggggaucu

SEQ ID NO: 78806 - RNA, 46 nt, Mus musculus
gcuuggaggcagaguuugucucacaggaaguacauuuuggugguag

SEQ ID NO: 78807 - RNA, 46 nt, Mus musculus
cggaagcaagaagcggaguggaaagaaaaggcgauaaaggagcugg

SEQ ID NO: 78808 - RNA, 46 nt, Mus musculus
cugcagagucucguuacuuuggagagaauuacagacuaaguauaca

SEQ ID NO: 78809 - RNA, 47 nt, Mus musculus
guauuaacuuucaguaaguguaaugugugugugugugugugugugug

SEQ ID NO: 78810 - RNA, 35 nt, Mus musculus
augcaggacuuuguguuaaauccucaaaaugacau

SEQ ID NO: 78811 - RNA, 46 nt, Mus musculus
ccagucagguaucuggugccacucagggaagauccuggcaggagag

SEQ ID NO: 78812 - RNA, 40 nt, Mus musculus
gcagaagaagccuuuguaaacgacauugacgagucauccc

SEQ ID NO: 78813 - RNA, 45 nt, Mus musculus
aaagaugucucucgcaugcgcucaguccucaucucccugaagcag

SEQ ID NO: 78814 - RNA, 47 nt, Mus musculus
ugauugcauguuuccuucaacuguguucucccuggcauucagagacg

SEQ ID NO: 78815 - RNA, 46 nt, Mus musculus
ugaguguucuagucucaccuuagguagauuucugugguuaauggag

SEQ ID NO: 78816 - RNA, 45 nt, Mus musculus
ucuagccuuacaguggugauacucaaagacauggugugauuucag

SEQ ID NO: 78817 - RNA, 45 nt, Mus musculus
guggucugugcauggguaauccuuaugucugugggugucugagga

SEQ ID NO: 78818 - RNA, 45 nt, Mus musculus
uuauuuuuagaaaugguuggaagugggguaugacauaggacauca

SEQ ID NO: 78819 - RNA, 45 nt, Mus musculus
uuuuugguaauggcugccacagauucaacucauauagacagcauc

SEQ ID NO: 78820 - RNA, 46 nt, Mus musculus
aauugaucugaccuaucugaggggagaggaucuucauggagcucca

SEQ ID NO: 78821 - RNA, 69 nt, Mus musculus
aaagaacuguggcagaauuccucacuuugggggauaauuuuucaucuauccucucuuugaguucaaagg

SEQ ID NO: 78822 - RNA, 64 nt, Mus musculus
uuaugcagcuccugaacuaauacaagggaagucguaccuuggaucagagguaauuguuacugau

SEQ ID NO: 78823 - RNA, 46 nt, Mus musculus
caugaccucuuggccugagauucuuugccacagucuguacccgcua

SEQ ID NO: 78824 - RNA, 44 nt, Mus musculus
ggcaauggcagggaaaaugcuuauuuguuuauuuauuuuggaag

SEQ ID NO: 78825 - RNA, 45 nt, Mus musculus
cuuuaucuauguguauuuuacuggauauuaaacuuagggccuuga

SEQ ID NO: 78826 - RNA, 45 nt, Mus musculus
uaguucuguuguugauauuuuuuucuuuguuauuuugagauagga

SEQ ID NO: 78827 - RNA, 55 nt, Mus musculus
uuugcuguguguaugucgguguucauauauuuauguguguaggucugaaguugac

SEQ ID NO: 78828 - RNA, 46 nt, Mus musculus
gaaucaccagccuuggugccaggcugcacggugaggggugaggcag

SEQ ID NO: 78829 - RNA, 45 nt, Mus musculus
acaacugaaggcugcuagaauucccaggauuauccuuagcccaga

SEQ ID NO: 78830 - RNA, 46 nt, Mus musculus
uuuuggguguuaguuuaagggcauaacauuucuuuuacuuugguag

SEQ ID NO: 78831 - RNA, 25 nt, Mus musculus
cucucacaguugcaggugggcacag

SEQ ID NO: 78832 - RNA, 45 nt, Mus musculus
auugugagcacagccaggaugcugaugcguugaguguggguugag

SEQ ID NO: 78833 - RNA, 45 nt, Mus musculus
guguguguguguguguauguguguguaugugugugugugugacug

SEQ ID NO: 78834 - RNA, 46 nt, Mus musculus
gacuaauuugaagcugaucuugugucuugggaaaaagacaggaaaa

SEQ ID NO: 78835 - RNA, 46 nt, Mus musculus
aauaccaccggccuccucaggccccaagacacacagacacacacac

SEQ ID NO: 78836 - RNA, 52 nt, Mus musculus
cagacacacacacacacccaccaccggccuccucaggccccaagacacacag

SEQ ID NO: 78837 - RNA, 46 nt, Mus musculus
gaaguaacacaguugaguggccaguaugcauagaguagagaaccag

SEQ ID NO: 78838 - RNA, 25 nt, Mus musculus
gagcuguuguggggagaauggaaua

SEQ ID NO: 78839 - RNA, 46 nt, Mus musculus
uaucacauggccuacugggauugugcagaccuaaaccugcccaaag

SEQ ID NO: 78840 - RNA, 46 nt, Mus musculus
agagcuuucuguacaucaccgcagcagcaggcagacaauggaggau

SEQ ID NO: 78841 - RNA, 42 nt, Mus musculus
gagggagggaggcagucaaugcagaaaccucuaacuggucag

SEQ ID NO: 78842 - RNA, 42 nt, Mus musculus
gugacacgauggauguggaggaucuuuaguauaauuggggaa

SEQ ID NO: 78843 - RNA, 46 nt, Mus musculus
uaaugggggcaccgacucgcgcucuagaauuccgggaaagggucag

SEQ ID NO: 78844 - RNA, 46 nt, Mus musculus
aaauuugauuuagcugcaaaugauaaaauuaccagaggaggaggag

SEQ ID NO: 78845 - RNA, 46 nt, Mus musculus
caggaaggaaugauuuaccucuccaucgaauagugacuucagccag

SEQ ID NO: 78846 - RNA, 46 nt, Mus musculus
ucucagugaguggcuucuuugauacauaaagaauccaugugggaag

SEQ ID NO: 78847 - RNA, 46 nt, Mus musculus
uguuacugaaccaauuuuuauagcaaauagacauuuuagugaccag

SEQ ID NO: 78848 - RNA, 61 nt, Mus musculus
uccuucuccaaggccacuuagguccauuucucugccaguggaguagaggugcaauagugaa

SEQ ID NO: 78849 - RNA, 47 nt, Mus musculus
ugcugcagguauuaucaguuuuuauguuguugauacugugguuggau

SEQ ID NO: 78850 - RNA, 63 nt, Mus musculus
uuaaucuguguauugucuauauacacagagaaagccacugaccaaauauuagcaguuguuggc

SEQ ID NO: 78851 - RNA, 42 nt, Mus musculus
uggaucucaaccaggcacacauggaggauaccccgaaaaaga

SEQ ID NO: 78852 - RNA, 45 nt, Mus musculus
guauacacacacacacacaaugaaaauguaaguuggaaaauguaa

SEQ ID NO: 78853 - RNA, 42 nt, Mus musculus
augugugccuggugccuacagaggccaggagaggggcaucag

SEQ ID NO: 78854 - RNA, 46 nt, Mus musculus
cugggauuacaaguaugcuaucauagcagcuucuaaaugccuuuau

SEQ ID NO: 78855 - RNA, 45 nt, Mus musculus
cccggcucugggucgcuguggccguuagaguaagacuuuaggcag

SEQ ID NO: 78856 - RNA, 46 nt, Mus musculus
ggcugguuguuuauuucuaaggcuuuaugucccuucucccacccag

SEQ ID NO: 78857 - RNA, 45 nt, Mus musculus
guaauguuuugugaaacuugauaauaagugauaaaaucaguugca

SEQ ID NO: 78858 - RNA, 45 nt, Mus musculus
uagucugggcuagauaagauacuauuucuuguuguuuggugguuu

SEQ ID NO: 78859 - RNA, 46 nt, Mus musculus
uugauccaaauaaaaccucgaauggcuuccugacuguuaaguagag

SEQ ID NO: 78860 - RNA, 46 nt, Mus musculus
uaauuauugucauuuagucagaggauggggaaugaucugagggaag

SEQ ID NO: 78861 - RNA, 45 nt, Mus musculus
cauaaugccaacaaggaggaaggauaugaggaaaagaacugugag

SEQ ID NO: 78862 - RNA, 46 nt, Mus musculus
gaagauaguauuuauagauguaaaagaaaaaauauugaaguccaag

SEQ ID NO: 78863 - RNA, 46 nt, Mus musculus
gaagccuaaaccugaagagaggccaggugugauccgagaggucaug

SEQ ID NO: 78864 - RNA, 46 nt, Mus musculus
uguuauuagucuuaaaaguuaacugccaaaucuaauauuuguagag

SEQ ID NO: 78865 - RNA, 46 nt, Mus musculus
auaguucuauuuuuuguaucugguaauggagaaaauguguguuuau

SEQ ID NO: 78866 - RNA, 46 nt, Mus musculus
cuccccaggaguucugagcuuggaauucauuaagcuaacacaucaa

SEQ ID NO: 78867 - RNA, 102 nt, Mus musculus
auugacuuuaugaaagaacuugaaaugggaaaggguggcccugagaaagagacguugcugaugcuauggaccuaaagaggaaguggcuggauggacuugaug

SEQ ID NO: 78868 - RNA, 46 nt, Mus musculus
gugguuuauaaaugaguacaauuauugaaauugaacuaucacauaa

SEQ ID NO: 78869 - RNA, 46 nt, Mus musculus
augaugauuugccugagaacugagagggcuguugagggacuaggag

SEQ ID NO: 78870 - RNA, 45 nt, Mus musculus
ugucuguugcaaaaagaugcuuccuuuuauuguggguaugaggau

SEQ ID NO: 78871 - RNA, 45 nt, Mus musculus
uuuagcuccuugguuacuuucucuagcuccuccauugaggcccug

SEQ ID NO: 78872 - RNA, 48 nt, Mus musculus
uaauuauaaaaucaauaaaauaagguaaagcccauucagauaagccua

SEQ ID NO: 78873 - RNA, 46 nt, Mus musculus
gacagugcuuuguccuuauguuaaaauaaaaacaagcaagacccag

SEQ ID NO: 78874 - RNA, 47 nt, Mus musculus
aggaauacuuaaaauagucaaugaaugauaaauuguuacaccauuaa

SEQ ID NO: 78875 - RNA, 42 nt, Mus musculus
cucucucucucucucucucucucucacacacacacaccuuca

SEQ ID NO: 78876 - RNA, 46 nt, Mus musculus
auaaugacuugagcuguguuauucacuguuucauggugaaguuguc

SEQ ID NO: 78877 - RNA, 46 nt, Mus musculus
ggugagaugcuagccaucugcccccaggugagagaguagcauuuag

SEQ ID NO: 78878 - RNA, 46 nt, Mus musculus
gaagaaaggugguuuuugaagaguuguagaacuacauuaacccugg

SEQ ID NO: 78879 - RNA, 46 nt, Mus musculus
acuagcacaguauugcagagcuaggcuggaaauggaccaaggacag

SEQ ID NO: 78880 - RNA, 46 nt, Mus musculus
uguauuuauuaaagcuuauuaauaugaaaaucuaaaauuauaagag

SEQ ID NO: 78881 - RNA, 45 nt, Mus musculus
cuugugaaaauucacaaagcauauuuucauuuaguuggcugcuaa

SEQ ID NO: 78882 - RNA, 86 nt, Mus musculus
uguguguguguguguauauauauauacacacacacacacacacacacauauauaucuaucuuacauauauuaaauaaauguauuua

SEQ ID NO: 78883 - RNA, 45 nt, Mus musculus
uacugagauuacuguagcguugaauauguaagauuuuaugauuca

SEQ ID NO: 78884 - RNA, 46 nt, Mus musculus
agcauggguagaugccaggaagguggaaaggugcucaagaaaggag

SEQ ID NO: 78885 - RNA, 46 nt, Mus musculus
auuuacucagaugaaggcuaccaaauguugcuaaacuacuuuuaag

SEQ ID NO: 78886 - RNA, 46 nt, Mus musculus
uuauauaaauuaaguaagacaaaaggaacaauacaaaucuaagaag

SEQ ID NO: 78887 - RNA, 46 nt, Mus musculus
cuuauaguguaguagaagucaggaucugcaggagaaaaaccuagag

SEQ ID NO: 78888 - RNA, 46 nt, Mus musculus
cucuuugaacaacauucagauugaggcacaaaaguagguaggccag

SEQ ID NO: 78889 - RNA, 45 nt, Mus musculus
auuucuucuuaaacacuuguauuuaaugaauaacauuugccaucu

SEQ ID NO: 78890 - RNA, 46 nt, Mus musculus
cugccgccaagaaacaaauguauaccuuauuucuguuugccaugag

SEQ ID NO: 78891 - RNA, 46 nt, Mus musculus
gauggucaauauauuagaagaaauuagagaauguucaucccaagga

SEQ ID NO: 78892 - RNA, 46 nt, Mus musculus
guuuuuaaaaauauuguacuuauuaaauugcaugcauguguauaag

SEQ ID NO: 78893 - RNA, 46 nt, Mus musculus
uuaaccuuuuuuaaauuuuaagcuauuuuugcaaauuuuccucaag

SEQ ID NO: 78894 - RNA, 44 nt, Mus musculus
uauuaaauuacuuagcuuuaguuuauuauauggaaaaaucuuua

SEQ ID NO: 78895 - RNA, 45 nt, Mus musculus
aguggggcugggaaggagagggaaggggguaguaaggauaagggg

SEQ ID NO: 78896 - RNA, 53 nt, Mus musculus
auauauuuuuagaauuaguagagaaccaccaaaggcccccagauagucaaagc

SEQ ID NO: 78897 - RNA, 42 nt, Mus musculus
cauuuaaaaucagucuucccucaguuaauucucgcugggaag

SEQ ID NO: 78898 - RNA, 46 nt, Mus musculus
auuauuaaaaaugccuugaaguuuagaagaauaaaaaauauggcag

SEQ ID NO: 78899 - RNA, 46 nt, Mus musculus
uacuaacuaggaugaaagcaacaggggaacuaggauggggcaccug

SEQ ID NO: 78900 - RNA, 46 nt, Mus musculus
acuuaauaaauauuuauugaauuugaauuaaaaauuaggccucaag

SEQ ID NO: 78901 - RNA, 45 nt, Mus musculus
uuuuuaaguaguauguaaaaacauaaaauugagcauauuagugag

SEQ ID NO: 78902 - RNA, 45 nt, Mus musculus
auauccacuaaaaauuuggcagauauuguguuaacaagccagcau

SEQ ID NO: 78903 - RNA, 58 nt, Mus musculus
uguacauccuuaauuuuugcuacuauuucauuaauuugagccauagaaacauguccaa

SEQ ID NO: 78904 - RNA, 46 nt, Mus musculus
aauuuuaugagguccaaaauaauaauaauuugugucagcuuaccag

SEQ ID NO: 78905 - RNA, 44 nt, Mus musculus
ggauacucaggauuuaaacccaaaaggucuugcuucagacccca

SEQ ID NO: 78906 - RNA, 46 nt, Mus musculus
cucuaguuccccaagucuauugcaguuuugcaaucugaaaccccau

SEQ ID NO: 78907 - RNA, 46 nt, Mus musculus
auuugagacaagagagauggaaaaaguuaauccacuucuaagacag

SEQ ID NO: 78908 - RNA, 42 nt, Mus musculus
gaggcaggaggagcaccaugaguucaaggucugucugggcag

SEQ ID NO: 78909 - RNA, 46 nt, Mus musculus
agaaaaagacaucuucugguaucuccagagcacuccuucaacaaag

SEQ ID NO: 78910 - RNA, 42 nt, Mus musculus
gcaagcucuaugugucugccaccucaccaccauaccaagcuu

SEQ ID NO: 78911 - RNA, 42 nt, Mus musculus
aguagauuuuguuuguuacuuauucuuuccuaucucugucag

SEQ ID NO: 78912 - RNA, 46 nt, Mus musculus
aauccugaaaaaucaucacaucagaaguauuuuacuauguggagag

SEQ ID NO: 78913 - RNA, 46 nt, Mus musculus
uaaaagucucuuaggacuugauaauauaauuaaaaacacugaccaa

SEQ ID NO: 78914 - RNA, 46 nt, Mus musculus
uuaaaaugacuuuuaaauguuauccacuacugacaguuaaagggag

SEQ ID NO: 78915 - RNA, 46 nt, Mus musculus
acuuucuuucuuguuuauuuuauauuaccucaacaggacuugagau

SEQ ID NO: 78916 - RNA, 46 nt, Mus musculus
ucugcuuccugauuauggaugugaugugacaguugcuuucugcgag

SEQ ID NO: 78917 - RNA, 45 nt, Mus musculus
auauaauaaguaagcuuuuauuaauauaaugcuauaguguggggg

SEQ ID NO: 78918 - RNA, 46 nt, Mus musculus
uuuccuuguugcuucugggucuuguccuugccuacuguuaaaugag

SEQ ID NO: 78919 - RNA, 45 nt, Mus musculus
caguuuuacagauaccaguugcaggugaagacauaaugagccaga

SEQ ID NO: 78920 - RNA, 46 nt, Mus musculus
aauaacagcauauauauuuuuccucuuguaaauugauauuuagcag

SEQ ID NO: 78921 - RNA, 46 nt, Mus musculus
uccugagugcugggauuaaaggcuugugccaccaugcucggcugag

SEQ ID NO: 78922 - RNA, 46 nt, Mus musculus
ugugguuagcaaaagccguaacccuugagcuguaucccaccccuug

SEQ ID NO: 78923 - RNA, 46 nt, Mus musculus
caaacaguuaugaauaugaacaucucauuugacuacugaugaacag

SEQ ID NO: 78924 - RNA, 46 nt, Mus musculus
uuauuuauguauuaagacagaugugucuuaacacaaccaccaccca

SEQ ID NO: 78925 - RNA, 42 nt, Mus musculus
gaaaaaaacaaaucuguuaaucacaucuguaugaagcaccug

SEQ ID NO: 78926 - RNA, 45 nt, Mus musculus
auuuaaaaccgaaguaugcuugaauauucuuuauagccuguggau

SEQ ID NO: 78927 - RNA, 46 nt, Mus musculus
caaauuuuaucaucauugcaucacucuggaccggugucuugccugg

SEQ ID NO: 78928 - RNA, 47 nt, Mus musculus
uuaaucugggagggucacuuugugugugugugugugugugugugugu

SEQ ID NO: 78929 - RNA, 46 nt, Mus musculus
acuuauaauagcuaauuucucugaaggaagcucaccaaaacaucag

SEQ ID NO: 78930 - RNA, 46 nt, Mus musculus
uaagacaaaaaaguuuaacguuuuagacaaaucauauuuagguaaa

SEQ ID NO: 78931 - RNA, 45 nt, Mus musculus
uuaaaugggugacuggcacauaggguauuaaaaacaauggggaga

SEQ ID NO: 78932 - RNA, 46 nt, Mus musculus
ugauucuuagacagcaguggcauauaugagcauaggacuaagcaag

SEQ ID NO: 78933 - RNA, 46 nt, Mus musculus
uauggcacguggaagcuuguguuaagaaagaacuaagugaugguga

SEQ ID NO: 78934 - RNA, 46 nt, Mus musculus
uacuagccagauuuccucacuuuaaaauucuuguauauuguuucag

SEQ ID NO: 78935 - RNA, 46 nt, Mus musculus
cuacauguaugugccugcgcaugcaugcacgcacacacacguacag

SEQ ID NO: 78936 - RNA, 42 nt, Mus musculus
ggacuuggucaucuuuacaguagccuuucuuuuagcccccuc

SEQ ID NO: 78937 - RNA, 45 nt, Mus musculus
aaaaccauuagugagugugugugugugugugugugugugugugug

SEQ ID NO: 78938 - RNA, 46 nt, Mus musculus
cacuguaauguugggucaagcugagauucuaagaggcagaccuuug

SEQ ID NO: 78939 - RNA, 44 nt, Mus musculus
uagaaagacuaucaaauuauuuaacaaaucauuuaagggaacaa

SEQ ID NO: 78940 - RNA, 46 nt, Mus musculus
uagucuuuuuuuuaacagaaauuucuauguauuuaauacugugugu

SEQ ID NO: 78941 - RNA, 46 nt, Mus musculus
uuagaagguggccuaaaauaguaaaccauaauuaauuugcccagag

SEQ ID NO: 78942 - RNA, 46 nt, Mus musculus
cugugguccccauacuuguacccaccaaaaagaggagagagagaga

SEQ ID NO: 78943 - RNA, 45 nt, Mus musculus
gcucacaaccauccguaacgagaucugauucccucuucuggaaug

SEQ ID NO: 78944 - RNA, 45 nt, Mus musculus
guucuuaugaguccagucuuauaccacuaucaaaaccacacaaag

SEQ ID NO: 78945 - RNA, 46 nt, Mus musculus
auuuaacauccgucuguaggaggccugaguaucagugacauaagag

SEQ ID NO: 78946 - RNA, 45 nt, Mus musculus
aaauucuuuucagagaagcgagucaagcuugauuuguguuuuuga

SEQ ID NO: 78947 - RNA, 46 nt, Mus musculus
guaauuuaacuuuucagaaauguaacucaacuuugauuuuugucag

SEQ ID NO: 78948 - RNA, 46 nt, Mus musculus
ucccaagcuaagaauuaaucauucauuaaaacuguucacaagccac

SEQ ID NO: 78949 - RNA, 45 nt, Mus musculus
caaaaucaauguaaaagguuguuuuaaaagaaauggaggcaaugg

SEQ ID NO: 78950 - RNA, 44 nt, Mus musculus
cugaaagcccugucacucaucacagcuacauuuucucccgggga

SEQ ID NO: 78951 - RNA, 45 nt, Mus musculus
cuuuagaacacuguguuaccacaguccauaagcauacagcccaca

SEQ ID NO: 78952 - RNA, 50 nt, Mus musculus
gcauuacaaccuuacuacuucuuaguuuaacuaaaaauuucagaauaugg

SEQ ID NO: 78953 - RNA, 63 nt, Mus musculus
aauaucagcagacuaaagcuaacuucagaacuacuguuugacaguccagaagaagagaacagg

SEQ ID NO: 78954 - RNA, 61 nt, Mus musculus
agauaggugcuaaagcuacagccauucaaauaucuuuuaccuugggauugagguguaaggc

SEQ ID NO: 78955 - RNA, 45 nt, Mus musculus
uuuccugugucuguuugcacgugggagggagggaaacagcccagg

SEQ ID NO: 78956 - RNA, 46 nt, Mus musculus
aauucauuugauagugcaauccacaaugccaacucccagaaccaag

SEQ ID NO: 78957 - RNA, 46 nt, Mus musculus
acaccuuguuugcaguccgugaggauguauuuuuuucuuacaggac

SEQ ID NO: 78958 - RNA, 42 nt, Mus musculus
uugccaccucccggacgucugcgcucaccucagcagcagcuc

SEQ ID NO: 78959 - RNA, 45 nt, Mus musculus
uuuuaauuucauuuauaaaauaugucuccauuuuuguaugucuua

SEQ ID NO: 78960 - RNA, 46 nt, Mus musculus
ccuucuccuguccauauuacuauaaucugaaacauaaauguggcaa

SEQ ID NO: 78961 - RNA, 45 nt, Mus musculus
auuguucuccaguucugagcuuuucuuuuuguuuuuguuguuggg

SEQ ID NO: 78962 - RNA, 45 nt, Mus musculus
uuacugaguuacuggugcaugaaaagcuuucagcagugccagcag

SEQ ID NO: 78963 - RNA, 45 nt, Mus musculus
caucuuguauugaaaauaggcugcaaagaaagaaacauccagacc

SEQ ID NO: 78964 - RNA, 46 nt, Mus musculus
gauguaacuuggaacacuuacuuguuuauccgcuacuaucugguag

SEQ ID NO: 78965 - RNA, 25 nt, Mus musculus
ugguuauuucacaugcuuccuaaaa

SEQ ID NO: 78966 - RNA, 46 nt, Mus musculus
uuacagaucucaagaaaaauggagacuuuccaaggcaguucaaaag

SEQ ID NO: 78967 - RNA, 45 nt, Mus musculus
guggccucgagaaaauaaagaaacacagaaagaaaagaccaggag

SEQ ID NO: 78968 - RNA, 46 nt, Mus musculus
agaacagcauguaaaaugaagcugucaccauugaauucuggaggag

SEQ ID NO: 78969 - RNA, 46 nt, Mus musculus
cuugugaaagccuaauguuagaauaagaaaaauaaaaugccugaaa

SEQ ID NO: 78970 - RNA, 41 nt, Mus musculus
ggcuagccucaaauucagagaucugccugccucugccuccc

SEQ ID NO: 78971 - RNA, 42 nt, Mus musculus
uaaaugcagaaccuguuaacuauuucuccagugcaaacccgu

SEQ ID NO: 78972 - RNA, 46 nt, Mus musculus
agaguagaggguacugacugagccguucccagaaaccugccaccaa

SEQ ID NO: 78973 - RNA, 46 nt, Mus musculus
guuuuaauuuauuuauuauaugugaguacacuguagcugucuucag

SEQ ID NO: 78974 - RNA, 45 nt, Mus musculus
gaaaguuacuggccccuccucguggggaacccaucauggcccugg

SEQ ID NO: 78975 - RNA, 46 nt, Mus musculus
cucaacagauaaggggccucgcccucgagccuacagucacuggugg

SEQ ID NO: 78976 - RNA, 42 nt, Mus musculus
caagauguggauguccccgacccugucggugcuggacugggg

SEQ ID NO: 78977 - RNA, 46 nt, Mus musculus
uccucugagcuguguaugcacaaacacacaaaucaucaagcaauau

SEQ ID NO: 78978 - RNA, 41 nt, Mus musculus
cauaauauuaggagcaccagccauaucugagacugggagag

SEQ ID NO: 78979 - RNA, 45 nt, Mus musculus
accaugccuggaucuuaauuuagcuagauagaaucuugccccaag

SEQ ID NO: 78980 - RNA, 73 nt, Mus musculus
caaaguguuauuugugaagucuguuuggaagucagcauacacccacaaugacauuuaagcacagucuauauuu

SEQ ID NO: 78981 - RNA, 45 nt, Mus musculus
ccuggugacggcuucuccuccugucugcagcugaauuggcccaga

SEQ ID NO: 78982 - RNA, 44 nt, Mus musculus
gggagaacaggggcuaggaggugugugugugugugugugugugu

SEQ ID NO: 78983 - RNA, 30 nt, Mus musculus
ugcugagauagagaugacucagcaguucag

SEQ ID NO: 78984 - RNA, 46 nt, Mus musculus
uuuagaaccgggcaugguagcacacacuuuuaaucccagcacucag

SEQ ID NO: 78985 - RNA, 45 nt, Mus musculus
ugcggggucccaccgagacgccuaggcaccccacagcccugggga

SEQ ID NO: 78986 - RNA, 37 nt, Mus musculus
cggcgguguuaacuccaaguauuuauugagagucuga

SEQ ID NO: 78987 - RNA, 47 nt, Mus musculus
uaggugguguuggauagugaaaauaugccugaucugaggacguguga

SEQ ID NO: 78988 - RNA, 98 nt, Mus musculus
auguagacauugggauauuuaguauguuugggaaauagguaggucacaguuuaugcagacaucgggauauuuaguauguuuggggaauagguauacca

SEQ ID NO: 78989 - RNA, 41 nt, Mus musculus
aaggaaucagcuguguaagugacgucagcgcauggacugua

SEQ ID NO: 78990 - RNA, 41 nt, Mus musculus
cgagcgcccagaagagaccagcccugcaaacagugccgugu

SEQ ID NO: 78991 - RNA, 46 nt, Mus musculus
aaaacaugcaaagaaaacagagacacugggaaaggauagucuccuc

SEQ ID NO: 78992 - RNA, 46 nt, Mus musculus
uguauuaaauaauccuucaggauuuuuagaagugaagauggugcag

SEQ ID NO: 78993 - RNA, 46 nt, Mus musculus
acauuaaugaaagcaaagaauaaacccgucuguaaucccagaagcc

SEQ ID NO: 78994 - RNA, 44 nt, Mus musculus
uccuggggaaauuuuuuuuuccaggugaauuucuuccuggcaga

SEQ ID NO: 78995 - RNA, 38 nt, Mus musculus
uuucuuucaucuuuccuaacaggcuauuagcuccagau

SEQ ID NO: 78996 - RNA, 42 nt, Mus musculus
ggggccggcugcugaaccgccuagcugaucuuguggaacgag

SEQ ID NO: 78997 - RNA, 39 nt, Mus musculus
ugcuucacccgacaugagccagugggugucuguggccag

SEQ ID NO: 78998 - RNA, 42 nt, Mus musculus
gcugggacagaaggaaggggcaaagcuucucuguggcgggga

SEQ ID NO: 78999 - RNA, 48 nt, Mus musculus
aaggaggagaucuuugggcccgugcagccucuguucaaguucaagaag

SEQ ID NO: 79000 - RNA, 46 nt, Mus musculus
gaggugaagacugucaccaucaagguucccgagaagaauuccugag

SEQ ID NO: 79001 - RNA, 41 nt, Mus musculus
ugaaggacgccggccccacaucgaucaguguuuggcuggga

SEQ ID NO: 79002 - RNA, 46 nt, Mus musculus
ggacuugcagacgccggccuuccacugcggagcccauccggugccc

SEQ ID NO: 79003 - RNA, 45 nt, Mus musculus
agcagcaugucgcggaggcggcacagcuacgagaacgaugguaag

SEQ ID NO: 79004 - RNA, 98 nt, Mus musculus
ccuggggucccgcgacacugaggacuuaaucccucacuacugaucauggaaaccgcacgugugucugucugcugcugccucuuaggaucacuuagugg

SEQ ID NO: 79005 - RNA, 60 nt, Mus musculus
gaaaggacccugggaagacaggaaaagaacaaagcuaugacagaggucggauguauugca

SEQ ID NO: 79006 - RNA, 92 nt, Mus musculus
uuggauuggcuuuaagcauauuucccuuauaagaaagugcaggaaaacccgagcagauuauuaauucucaugucaguuuugauggucgccgg

SEQ ID NO: 79007 - RNA, 44 nt, Mus musculus
uguuaguguuagguccaaaggguuaaggcaagaaaaaacuuuag

SEQ ID NO: 79008 - RNA, 46 nt, Mus musculus
cucgauuauuuacuaugugaucuugucagggucauaugacuucuua

SEQ ID NO: 79009 - RNA, 46 nt, Mus musculus
aacugcuaaugucucagaggugauacacacagauaaaugcugacau

SEQ ID NO: 79010 - RNA, 41 nt, Mus musculus
agaagagagaaagugaggguagaaguugugagaccggggag

SEQ ID NO: 79011 - RNA, 56 nt, Mus musculus
uacaagguugcuaaucaauaaaguucccguaguuuauuuagagucacagaaagggc

SEQ ID NO: 79012 - RNA, 46 nt, Mus musculus
augcaauucaggcuggaacgccuguuccuauguccuggcuagauag

SEQ ID NO: 79013 - RNA, 46 nt, Mus musculus
aaaaaaaaaagaaggaauuuagauugaaucuuagucaaaaguccag

SEQ ID NO: 79014 - RNA, 46 nt, Mus musculus
accuagcuaagaagaguuaagccccagguucagggagagaccuugc

SEQ ID NO: 79015 - RNA, 30 nt, Mus musculus
gacgucugaugcaaaugaaacugaagauca

SEQ ID NO: 79016 - RNA, 42 nt, Mus musculus
uguguguguguggguguggguguggguguggguguguaugga

SEQ ID NO: 79017 - RNA, 46 nt, Mus musculus
uggauguguguguguguguguguguguguguguguguggguggccu

SEQ ID NO: 79018 - RNA, 46 nt, Mus musculus
aagcuaacaauuuacacaacauuaguuggacugcugaaugccagga

SEQ ID NO: 79019 - RNA, 42 nt, Mus musculus
uuggccaaccaaagaauacacguggagggacccauggcucca

SEQ ID NO: 79020 - RNA, 42 nt, Mus musculus
ccucugccucugccgauuacaaacauuccccaccacacccag

SEQ ID NO: 79021 - RNA, 46 nt, Mus musculus
ugaaggaaacaagaauuugaccucaguauguauuucuccugugcua

SEQ ID NO: 79022 - RNA, 45 nt, Mus musculus
aaaaauauuucaaacaaaauaccuggggugcgcaggcuggccuga

SEQ ID NO: 79023 - RNA, 45 nt, Mus musculus
gucucgaauuaaagguaguuccuuuucccuuguaggugacgugga

SEQ ID NO: 79024 - RNA, 42 nt, Mus musculus
acugaaggucaacagcaucacggaugcacgugggagcggagg

SEQ ID NO: 79025 - RNA, 45 nt, Mus musculus
ggcagagaaaggcagagagaaagagagagaguagauaagugaggu

SEQ ID NO: 79026 - RNA, 41 nt, Mus musculus
ucuguuuaucuguugcuuuuaaaaguaaggcaaccaacgau

SEQ ID NO: 79027 - RNA, 46 nt, Mus musculus
augaauaggaaaauugacagaaugaaauaaaggcuuaccggaaucg

SEQ ID NO: 79028 - RNA, 45 nt, Mus musculus
acucucccaugagagagaguuaagggucugcuuuuucacgaggga

SEQ ID NO: 79029 - RNA, 23 nt, Mus musculus
aauuucccacacaaacaaccuua

SEQ ID NO: 79030 - RNA, 45 nt, Mus musculus
caugaucuugaccgagcacuugguacgaugugaaacggaugggac

SEQ ID NO: 79031 - RNA, 25 nt, Mus musculus
uacauggugacccuggagaaccugc

SEQ ID NO: 79032 - RNA, 46 nt, Mus musculus
aggagcaaaagaaagggagaaaaguacaaacuccuagcaugcagau

SEQ ID NO: 79033 - RNA, 81 nt, Mus musculus
agccugcuaaggagcauuagcaugacuucauagaccuugugaggcacacagcgugccaccccgucuaagggagccccacca

SEQ ID NO: 79034 - RNA, 73 nt, Mus musculus
aauugcggcgagcaauaagaagcaguguauggaaaagagagacaaccacucaccaacauaaauauggaccaga

SEQ ID NO: 79035 - RNA, 42 nt, Mus musculus
auccuaauucccugaguuugguccccagaagaacccacuggu

SEQ ID NO: 79036 - RNA, 46 nt, Mus musculus
cuguaguaggucucccucagaagcagcagcagcagcagcagcagca

SEQ ID NO: 79037 - RNA, 46 nt, Mus musculus
gacguguaaguccagccuguuaguuuauggagcaugagcugagauc

SEQ ID NO: 79038 - RNA, 45 nt, Mus musculus
uacacaggaguuuuggucugcaggcuuuuuugccucaaauaaggu

SEQ ID NO: 79039 - RNA, 51 nt, Mus musculus
uugaagugugggguagccaggaagcucuggaagaugcaaaggaagugaggc

SEQ ID NO: 79040 - RNA, 45 nt, Mus musculus
ccaagacagaagcgaagcaagaguaccuucugaaggacugugauc

SEQ ID NO: 79041 - RNA, 45 nt, Mus musculus
gugacuguccugucaggaauccuugucccuucagugugccauaug

SEQ ID NO: 79042 - RNA, 46 nt, Mus musculus
ucccuuuuggaaugauaauguguguguauauauguguguguaugug

SEQ ID NO: 79043 - RNA, 45 nt, Mus musculus
cugccgaggaaagcugcugacagggaguggaaccagcccaagaga

SEQ ID NO: 79044 - RNA, 53 nt, Mus musculus
guuuuggaguaccacagaaugaccaccacgaacagcagcuauagaagcugugu

SEQ ID NO: 79045 - RNA, 41 nt, Mus musculus
agauuaauauuaggaagcacuacaaaacauuuucaggcaga

SEQ ID NO: 79046 - RNA, 64 nt, Mus musculus
cuccaauaaaagggggaaaacacaacuauguguguguguguguguguguguguguguaugugua

SEQ ID NO: 79047 - RNA, 42 nt, Mus musculus
uuugauccaugagaagaugcagggaugaggggaggggcugga

SEQ ID NO: 79048 - RNA, 45 nt, Mus musculus
caaagguggcuucauuuuagaagaggaagaagagaaacacgagau

SEQ ID NO: 79049 - RNA, 44 nt, Mus musculus
uaggucuguuauagccauaggagugaucuuugaaggccccauuu

SEQ ID NO: 79050 - RNA, 54 nt, Mus musculus
cacauuggaaguagagggcaccuggccagaaucacuggagaaaugcuaggggug

SEQ ID NO: 79051 - RNA, 45 nt, Mus musculus
gcaggcuggcagagacugcucagcagagcacggacuuucugagau

SEQ ID NO: 79052 - RNA, 46 nt, Mus musculus
uuuuguugcaaucuguuuuuuuccaacuuagaacuacaacuaagua

SEQ ID NO: 79053 - RNA, 46 nt, Mus musculus
uuugauuauuauauuuuauguauagcaagaguugaaggucgcagaa

SEQ ID NO: 79054 - RNA, 42 nt, Mus musculus
cuuguuucucuucaacugagaauuuguauccuugccccaaca

SEQ ID NO: 79055 - RNA, 46 nt, Mus musculus
uuugucucacaucuuacaaacaccaaucaagauacuacaggcagau

SEQ ID NO: 79056 - RNA, 77 nt, Mus musculus
aucaaccaccucggauuucaaaagcacaaaagagaugggaaaagaaggcugcauuggaaaaggagcgggaagaaagg

SEQ ID NO: 79057 - RNA, 63 nt, Mus musculus
uggagcaaaaacacagggaagaacuggagcaauugaagcaauugacuuucaaggacaguaaga

SEQ ID NO: 79058 - RNA, 71 nt, Mus musculus
cgcuguucccaaaaacgacaaaaagaggaggaagcagcucacagaagauguugcuaaauuggaaagagaaa

SEQ ID NO: 79059 - RNA, 42 nt, Mus musculus
ucacagagguccaccugccucugccucccaagugcugcacag

SEQ ID NO: 79060 - RNA, 46 nt, Mus musculus
gugaugaacucugggugcacuggcacuggugcuuucccuugaggac

SEQ ID NO: 79061 - RNA, 42 nt, Mus musculus
ccuguagccccuuuacaaguccgguuuacuccucacgcagag

SEQ ID NO: 79062 - RNA, 45 nt, Mus musculus
cgugugcgguguccucugugagacccagaagaaaaagagccagga

SEQ ID NO: 79063 - RNA, 46 nt, Mus musculus
uaucuggguauucaugcaaucauguuuuucuuaaguagagucagag

SEQ ID NO: 79064 - RNA, 46 nt, Mus musculus
caagagcaggucacaacagucaguuuauguggcgcuguggguugaa

SEQ ID NO: 79065 - RNA, 45 nt, Mus musculus
ucuuggagaaaacgucaaaguugucagaagcgcacacaauauaga

SEQ ID NO: 79066 - RNA, 44 nt, Mus musculus
uuuuacaucuagaauaaauuauuuaaauuauuucauagcaaggg

SEQ ID NO: 79067 - RNA, 47 nt, Mus musculus
gagagagagagagagagguccagcaccgagccgaaauucacugagaa

SEQ ID NO: 79068 - RNA, 43 nt, Mus musculus
acaccgauaggcucuguggagagagagagagagagagagagag

SEQ ID NO: 79069 - RNA, 32 nt, Mus musculus
acccgagucccacccaaagccugcggcgagag

SEQ ID NO: 79070 - RNA, 42 nt, Mus musculus
agaacccaaggccaccuagaaguacaacuauccagcccagaa

SEQ ID NO: 79071 - RNA, 46 nt, Mus musculus
ucagacguguuucuuaauguuguuggugucuccagcccucguagug

SEQ ID NO: 79072 - RNA, 45 nt, Mus musculus
caaacgcucccuacuuccauguccuuguauaggcugccagcagaa

SEQ ID NO: 79073 - RNA, 42 nt, Mus musculus
uguauuagaguucucuaaaauagcaaacagcacuuaacagaa

SEQ ID NO: 79074 - RNA, 46 nt, Mus musculus
gaaacgccuuugaaaccaaaagaaagggggaaacaaaggagcuaga

SEQ ID NO: 79075 - RNA, 46 nt, Mus musculus
gaagccauggagaaguucauccacaaaccauccuuaaaagccacga

SEQ ID NO: 79076 - RNA, 46 nt, Mus musculus
cguggagcacuauaaggaguugaagaaaaugguccaagagucagac

SEQ ID NO: 79077 - RNA, 41 nt, Mus musculus
guuaggugucugccuguaucccgguguucaaacuggccaga

SEQ ID NO: 79078 - RNA, 42 nt, Mus musculus
ggucuuucuggcgcucuacgugcuguuucucuccggcgagga

SEQ ID NO: 79079 - RNA, 44 nt, Mus musculus
uagguacccaggguugcauugcauugcuggaaggaggaguucca

SEQ ID NO: 79080 - RNA, 46 nt, Mus musculus
ugcacgcaccacuuuaguuaaagguaaauuagacuaggaucaggaa

SEQ ID NO: 79081 - RNA, 46 nt, Mus musculus
caucucuuucuugccugguguccuuggaggucaccugaaacugcag

SEQ ID NO: 79082 - RNA, 46 nt, Mus musculus
ucuuguagcuguguguaguucuuuggggauugguuuuuguucaaga

SEQ ID NO: 79083 - RNA, 44 nt, Mus musculus
ggucauggaauuuuaagugaugaaggcaauaaguuggggaagcu

SEQ ID NO: 79084 - RNA, 46 nt, Mus musculus
gacacgcuggcccagggaggacaggcauccuaggcuaaaggaacag

SEQ ID NO: 79085 - RNA, 46 nt, Mus musculus
guuagggugaacagcauuugguuaaaggugcaggaagaaggugcag

SEQ ID NO: 79086 - RNA, 45 nt, Mus musculus
uuggcuccgcccccuuuucccuguccagucacaggccuccugcug

SEQ ID NO: 79087 - RNA, 45 nt, Mus musculus
gcaccugacagguagacucaguccauagaaccuaagaucagccag

SEQ ID NO: 79088 - RNA, 46 nt, Mus musculus
acaagucaguuuaguuuagcgcacagugccuggaauguggugccaa

SEQ ID NO: 79089 - RNA, 52 nt, Mus musculus
acacgcgaucauagauugggcuacauccaucugucaucugaagaagaagaag

SEQ ID NO: 79090 - RNA, 54 nt, Mus musculus
guucacguguauuauuuuacagagaauaagaauugacuuugagaaaucaguuuu

SEQ ID NO: 79091 - RNA, 45 nt, Mus musculus
aaggucauuuauccuugggauaagucagucccaguuuggggagau

SEQ ID NO: 79092 - RNA, 46 nt, Mus musculus
acuaugaagaggaggagagccauaagccagagcauuuggcaaagaa

SEQ ID NO: 79093 - RNA, 46 nt, Mus musculus
cagaagcuggcgcccagcgaguauagguauacuuuauugagggauc

SEQ ID NO: 79094 - RNA, 48 nt, Mus musculus
acacagagaauuccaucacggaccugacccgacugacacagccccagg

SEQ ID NO: 79095 - RNA, 44 nt, Mus musculus
guagauuuccuaccaacuugaaaggaauagauuuuauaugaaga

SEQ ID NO: 79096 - RNA, 45 nt, Mus musculus
gauacagaaaguuuagaaauauuccagaaugaaguagcccggcag

SEQ ID NO: 79097 - RNA, 45 nt, Mus musculus
uaaauaauauuuuaaaaagaaaaauaaaaauguaaucccaagaga

SEQ ID NO: 79098 - RNA, 46 nt, Mus musculus
cgauugucuuagaauuuuccuaauacuuuauauguacucgguaagg

SEQ ID NO: 79099 - RNA, 46 nt, Mus musculus
uaaaugugucccucuuguccgagaaauaacauuugaaaauggagag

SEQ ID NO: 79100 - RNA, 42 nt, Mus musculus
cuggggcauaaauuagcuucuugacaguaaaagcaccuagau

SEQ ID NO: 79101 - RNA, 42 nt, Mus musculus
uuggcuguuguguaguguaaguucuuuuauuuggggcucuuu

SEQ ID NO: 79102 - RNA, 40 nt, Mus musculus
gagcagaaggauucagaaaauuacagaguuuuugaaagag

SEQ ID NO: 79103 - RNA, 72 nt, Mus musculus
auaagcaaauacccaacccugaaauuauuucguaauggaaugaugaugaagagagaauacaggggccagcga

SEQ ID NO: 79104 - RNA, 45 nt, Mus musculus
gccucuguaacucuuaaaaacuguucuguuugcuuggugagagcu

SEQ ID NO: 79105 - RNA, 23 nt, Mus musculus
accaaaacugugaaugcaguuug

SEQ ID NO: 79106 - RNA, 25 nt, Mus musculus
uagaacugcaggcccucagggucuc

SEQ ID NO: 79107 - RNA, 46 nt, Mus musculus
guagguagguagguagguagguagguagguagguaggcaggcaggc

SEQ ID NO: 79108 - RNA, 46 nt, Mus musculus
agcggucagugcucuuaacuguugagccaucucaccagccccagau

SEQ ID NO: 79109 - RNA, 49 nt, Mus musculus
gaggaagcaucugaugucauuaaggaagaauauccagauaaaaaucaag

SEQ ID NO: 79110 - RNA, 45 nt, Mus musculus
aaacucacaguuccaguaacauggaaauguguucaauguccagag

SEQ ID NO: 79111 - RNA, 46 nt, Mus musculus
ucuucaguucacauuagacuccuuggauuuaguucuuuugucaguc

SEQ ID NO: 79112 - RNA, 42 nt, Mus musculus
ucugcacugugcuguuucugagcugugcugucuggaggauag

SEQ ID NO: 79113 - RNA, 45 nt, Mus musculus
uuugaguuuuuaauuuuacuauuguauaaagauucuacccauuca

SEQ ID NO: 79114 - RNA, 46 nt, Mus musculus
uaacuucuucuuaagucagauuaggaaaccuuguauauguccaguu

SEQ ID NO: 79115 - RNA, 46 nt, Mus musculus
accuuaaaucuccuuaauuuuuagguuaaaauguaagccccuuguc

SEQ ID NO: 79116 - RNA, 46 nt, Mus musculus
ggccugcaguugucacuuuacacucugaauauuaagagccauagag

SEQ ID NO: 79117 - RNA, 46 nt, Mus musculus
accuauaacagcugaaauagcaagucuugauucagagaauauagau

SEQ ID NO: 79118 - RNA, 45 nt, Mus musculus
ccaauaaauuuuaguuuuacaaggagaagaaaggcaagucucacu

SEQ ID NO: 79119 - RNA, 47 nt, Mus musculus
auuguuuggacaccagaacucaaaugaaaagaggacagggcuggaga

SEQ ID NO: 79120 - RNA, 52 nt, Mus musculus
agcuacacugacuuuuuucauuucuaggcauuuuacaauucuaggagauuuu

SEQ ID NO: 79121 - RNA, 51 nt, Mus musculus
uaucccauuuuaguauuugcuucuuuugucccaaucauggcacaugguaug

SEQ ID NO: 79122 - RNA, 46 nt, Mus musculus
uguaggggaaugccaggaugugagguaggaguggguagguggagag

SEQ ID NO: 79123 - RNA, 46 nt, Mus musculus
uuuuucuaacuggauucauuaggaaugcacuuaaauagaaccuguc

SEQ ID NO: 79124 - RNA, 42 nt, Mus musculus
cccuucucuaaggaggaagggagugggaaaugggggccagga

SEQ ID NO: 79125 - RNA, 46 nt, Mus musculus
gagccauugugaaacccagaaaucagcuugcgguucuugugcagau

SEQ ID NO: 79126 - RNA, 42 nt, Mus musculus
cugauucuuuucuuuguugguucuuugcauuuuggggguguu

SEQ ID NO: 79127 - RNA, 46 nt, Mus musculus
uguuuuguuagguaaggguugguuagggagggaaagccugucagau

SEQ ID NO: 79128 - RNA, 86 nt, Mus musculus
aguuauuuacugguuuugagccuccaggcucagcuguuagaugggaacaggaacucaccugcaaaguccuagagaacaagggagau

SEQ ID NO: 79129 - RNA, 42 nt, Mus musculus
auuuuaaaacauccugagucauaagaagcuucccaccaagau

SEQ ID NO: 79130 - RNA, 45 nt, Mus musculus
gucacccucaaguagugcuuacagcuuauauaaacuggggaggga

SEQ ID NO: 79131 - RNA, 46 nt, Mus musculus
cguuuaagccugguuugaagagauagguacucauagaaauauagaa

SEQ ID NO: 79132 - RNA, 41 nt, Mus musculus
acugaggcagcaguaucgucaaugauucuaagguaucgggu

SEQ ID NO: 79133 - RNA, 45 nt, Mus musculus
cuccucuccuaugauuguguguguguguguguguguguccuauug

SEQ ID NO: 79134 - RNA, 45 nt, Mus musculus
caucuugccaacaauguaaaaaaaguuuucuauagucuucucaga

SEQ ID NO: 79135 - RNA, 23 nt, Mus musculus
agaagccauuucagagaacuccu

SEQ ID NO: 79136 - RNA, 46 nt, Mus musculus; identical to SEQ ID NO: 42982

SEQ ID NO: 79137 - RNA, 45 nt, Mus musculus
acuguauucuucauagcccccauagccugcacuauaggcaccaga

SEQ ID NO: 79138 - RNA, 48 nt, Mus musculus
gcuucccuaaagcuuucucagcuaacucuugugaggcaaacugaacga

SEQ ID NO: 79139 - RNA, 44 nt, Mus musculus; identical to SEQ ID NO: 42985

SEQ ID NO: 79140 - RNA, 44 nt, Mus musculus
uugaacuuacaacacuccugccucagucuccuuauaguugggau

SEQ ID NO: 79141 - RNA, 46 nt, Mus musculus
uuaucguucguuacagagaugaauccuuguccuuugauccuguccg

SEQ ID NO: 79142 - RNA, 41 nt, Mus musculus
uauccacucgcugcugccaauucuuguggaaguggggcuuc

SEQ ID NO: 79143 - RNA, 99 nt, Mus musculus
ggagacaguucugcugaagaacuuaagcuggccaccaagcugacaggaccugugaugcccauccggaauguguacaaaaaggaaaaggccagaguuauc

SEQ ID NO: 79144 - RNA, 45 nt, Mus musculus
uugacugugugguuauguuuggagagaguucugugaggugcugag

SEQ ID NO: 79145 - RNA, 45 nt, Mus musculus
accagcagggaauauggaaacugaagugucuacuuccucuagcca

SEQ ID NO: 79146 - RNA, 41 nt, Mus musculus
cuacacuugagacucaggaaugacuguagacaaugggcaga

SEQ ID NO: 79147 - RNA, 46 nt, Mus musculus
cacauacacacacacacaugagagagagagagagagagagagagag

SEQ ID NO: 79148 - RNA, 42 nt, Mus musculus
ggggagcuggauccccaguagguuucuuuaagguagccccag

SEQ ID NO: 79149 - RNA, 42 nt, Mus musculus
cugcuacagagcaggaguugccacagccucaggcugagacag

SEQ ID NO: 79150 - RNA, 51 nt, Mus musculus
ggccacgcagcaagcccagcuggcagccgcagcugagaucgaugaagaacc

SEQ ID NO: 79151 - RNA, 46 nt, Mus musculus
acaagagcccagcuucagacaccuacauaguguuuggggaagccaa

SEQ ID NO: 79152 - RNA, 50 nt, Mus musculus
aacauucaggaaaacacucagacuccaaccguccaagaggagagugaaga

SEQ ID NO: 79153 - RNA, 46 nt, Mus musculus
guaaaugcuacuauggaauuaacaauguaacuauuugacagcgaag

SEQ ID NO: 79154 - RNA, 42 nt, Mus musculus
acacauaaaaccuacacagcuucaagccagauagggucucag

SEQ ID NO: 79155 - RNA, 46 nt, Mus musculus
aacucugccacgugaaauauuuuuucagacuuuucuaacccaagcu

SEQ ID NO: 79156 - RNA, 44 nt, Mus musculus
auauuuuaagauccuguagagcacuauucauuucagguugcaga

SEQ ID NO: 79157 - RNA, 46 nt, Mus musculus
agauucuuguggaauugugcccuaagcauugucaaggaggggagau

SEQ ID NO: 79158 - RNA, 46 nt, Mus musculus
auucgcaaacugggccugguaaaguauggagaaaaauaugccagua

SEQ ID NO: 79159 - RNA, 42 nt, Mus musculus
ugcccuccugaggggagucccagaaaaggaaguuggcaaggu

SEQ ID NO: 79160 - RNA, 46 nt, Mus musculus
caugggcuacugcccucaguuugacgccaucacagagcugcugacg

SEQ ID NO: 79161 - RNA, 45 nt, Mus musculus
cacacacacacacacacacacagagagagagagagaggcaggcau

SEQ ID NO: 79162 - RNA, 45 nt, Mus musculus
aaggcgaagcuuccuccuuugaaugacgaggaugaggaugugagg

SEQ ID NO: 79163 - RNA, 45 nt, Mus musculus
guguuugauggugucuugcugugcuaggcagaggucauucagaga

SEQ ID NO: 79164 - RNA, 45 nt, Mus musculus
cuagugguaccaaggaccagccuuggcuuggagagggguucugag

SEQ ID NO: 79165 - RNA, 45 nt, Mus musculus
gcagaagggagagaacccgagccaguauggaaucacugcuuucaa

SEQ ID NO: 79166 - RNA, 45 nt, Mus musculus
gcagaucgcuuccucagcagccugggaagguucauggcagggcug

SEQ ID NO: 79167 - RNA, 45 nt, Mus musculus
ugugugugugugugugugugugugugcgcguuugugagagagaga

SEQ ID NO: 79168 - RNA, 46 nt, Mus musculus
acauacaaacaggugauggaaaugaacaaaaccauacuggaccuaa

SEQ ID NO: 79169 - RNA, 46 nt, Mus musculus
uuucccugggugucaguaauucucaagcacuuccuccgagccauga

SEQ ID NO: 79170 - RNA, 45 nt, Mus musculus
gcaacauguaccuaucuuagccaaacguugguucuaguuugaaaa

SEQ ID NO: 79171 - RNA, 24 nt, Mus musculus
cuuaaagaauaagaucugggugaa

SEQ ID NO: 79172 - RNA, 42 nt, Mus musculus
aacagaaaaccgcagacauccuucagaaucugacaggaagaa

SEQ ID NO: 79173 - RNA, 45 nt, Mus musculus
gaucugagucugugugugugugugugugugugugugugugugugu

SEQ ID NO: 79174 - RNA, 48 nt, Mus musculus
cuuccagaauggaaacuggaccaugaagaaccccucaccugcgugcca

SEQ ID NO: 79175 - RNA, 44 nt, Mus musculus
agcuaauuggcuguguuguuuggggccccuuuggggucccuagu

SEQ ID NO: 79176 - RNA, 46 nt, Mus musculus
aagcacaaaaaggaacauuugaaucccaaacggcaaaggugaagau

SEQ ID NO: 79177 - RNA, 46 nt, Mus musculus
ugaaugcucugaccaaagauccaggcuuugggacccgcuguaugga

SEQ ID NO: 79178 - RNA, 46 nt, Mus musculus
gguuuucuucaguucugaugcacggguaggucuguagaugggagaa

SEQ ID NO: 79179 - RNA, 51 nt, Mus musculus
ccacccuuuggcaaguaccccagccuggaacuucagcccuggauguauaau

SEQ ID NO: 79180 - RNA, 41 nt, Mus musculus
accaccaauaacuacgaaauaggauauuaagggggcugauu

SEQ ID NO: 79181 - RNA, 54 nt, Mus musculus
guggaagaggcugcugauugccagacggagccggaaggguuucuuugcucaggu

SEQ ID NO: 79182 - RNA, 62 nt, Mus musculus
ggcaaaggcuccuaccagcugaagggcuggaaacucacccagcaacaguuuguggcccuuuu

SEQ ID NO: 79183 - RNA, 67 nt, Mus musculus
gcagagcugucugcacccauuuacggaagaugaugcuguugaucccaaugacucugacauagaccca

SEQ ID NO: 79184 - RNA, 46 nt, Mus musculus
auuccucaaaguggcugaagagagcgggguggaugcugagaccuca

SEQ ID NO: 79185 - RNA, 80 nt, Mus musculus
gcaacaagauggcaauagaguugguuacuggaaguuuaaggcauucgcaucuggguaauguuagcccaaguuaaacaaug

SEQ ID NO: 79186 - RNA, 46 nt, Mus musculus
aucucggagaccacccuggaagaaguaagcucaacaaucccaaggc

SEQ ID NO: 79187 - RNA, 46 nt, Mus musculus
ucucagagaagcacgugaaagcagagauggagcagauggcccugga

SEQ ID NO: 79188 - RNA, 52 nt, Mus musculus
ucuggcacggccuacauccuggggaaggacauucgcucggagaugagcucca

SEQ ID NO: 79189 - RNA, 46 nt, Mus musculus
agguugcuguggauggcuuggcgcucaacuuuuacgaaggccagau

SEQ ID NO: 79190 - RNA, 41 nt, Mus musculus
caaagcaggagaaucuaacauuuguccuaauagcagcuacu

SEQ ID NO: 79191 - RNA, 45 nt, Mus musculus
ugcaacaaccagaaagucagaugcuauuaaagguuuggcucucug

SEQ ID NO: 79192 - RNA, 50 nt, Mus musculus
gccccucuucaugacucuagccuggaucuacucugucgcugugaucauca

SEQ ID NO: 79193 - RNA, 42 nt, Mus musculus
ggaacaggccaucaucagagugcugacgggaucugagaagaa

SEQ ID NO: 79194 - RNA, 27 nt, Mus musculus
uguuuuguaugaguguuucaucaccug

SEQ ID NO: 79195 - RNA, 46 nt, Mus musculus
ccaagaauuuauguacuugucagcugugauaagaaugggagauaga

SEQ ID NO: 79196 - RNA, 45 nt, Mus musculus
cauguaaaguacaagauccggauggacauugacaacguggagaga

SEQ ID NO: 79197 - RNA, 70 nt, Mus musculus
guuagacagcagaggcaaugaccaguuuugggaacagaaguuggauggauuagauuggacugcccaagac

SEQ ID NO: 79198 - RNA, 45 nt, Mus musculus
aaucaucauguuaucauuaaaauaacagaaagccacgggguuggg

SEQ ID NO: 79199 - RNA, 42 nt, Mus musculus
accucaacagagauugaauaggugaguggcaagggcugagug

SEQ ID NO: 79200 - RNA, 46 nt, Mus musculus
ccuggaaggaaaggccugggaggcuguaaggauccuuauauuuaga

SEQ ID NO: 79201 - RNA, 46 nt, Mus musculus
cgcgguguaguucagacuugucugcaacucacuauaugccccagau

SEQ ID NO: 79202 - RNA, 46 nt, Mus musculus
aaaagcuacacaaagcagggaagaaaagagguugcugggggcagua

SEQ ID NO: 79203 - RNA, 48 nt, Mus musculus
ucccgcaucguguguggucacccagagggugggggccugaagaucaag

SEQ ID NO: 79204 - RNA, 46 nt, Mus musculus
ggaauaggguggguuggauguacugauagaggggacauugacggga

SEQ ID NO: 79205 - RNA, 48 nt, Mus musculus
gaccuugcuugcagcauuuauuuauuuauuguaggcuuuuguagagga

SEQ ID NO: 79206 - RNA, 45 nt, Mus musculus
agaccacauaaaaauaauuagcucaaacaaugacaaaaauguauu

SEQ ID NO: 79207 - RNA, 45 nt, Mus musculus
uuaauggggaaauggcuacuuauuaguguuuuuaaaaccaguaga

SEQ ID NO: 79208 - RNA, 46 nt, Mus musculus
uuaaaaugaagcaaucaauauucuauucuccaccuuccccauagcg

SEQ ID NO: 79209 - RNA, 46 nt, Mus musculus
ggccagugcucuuuucuauuucaugccacuggagugaagccuuuuu

SEQ ID NO: 79210 - RNA, 41 nt, Mus musculus
ccaguaugaggugugugugugugugugugugugugugugua

SEQ ID NO: 79211 - RNA, 46 nt, Mus musculus
gagugagugguguguguguguguguguguguguguguaugugucug

SEQ ID NO: 79212 - RNA, 46 nt, Mus musculus
cacuguaagccaugcuugguguuauuagugcuuucggaacccagaa

SEQ ID NO: 79213 - RNA, 46 nt, Mus musculus
guggcuguggugaaaugcuggagaguaguuggucagugccugagga

SEQ ID NO: 79214 - RNA, 46 nt, Mus musculus
gcuuuguuugguuuuccuugaacuguuaacagggagauaaagagau

SEQ ID NO: 79215 - RNA, 46 nt, Mus musculus
auguuacaggauaccacccacaauucaaugcacuucaaguuuggag

SEQ ID NO: 79216 - RNA, 44 nt, Mus musculus
ggagccagugacugaagcagaucaucucgggcuugggggagaug

SEQ ID NO: 79217 - RNA, 46 nt, Mus musculus
cauaccuggaucucagaggaagggcuccagccuuacugguagagaa

SEQ ID NO: 79218 - RNA, 23 nt, Mus musculus
guauguaaagugaguauuacagu

SEQ ID NO: 79219 - RNA, 45 nt, Mus musculus
ugagcggaggaggaggugcucggguauggauucuugugcgcagac

SEQ ID NO: 79220 - RNA, 46 nt, Mus musculus
gaggaacuugaauucaaggucacuagugagagagcaaugacuagaa

SEQ ID NO: 79221 - RNA, 45 nt, Mus musculus
ucucgggcucuuggauggcacgucugaucuuuguuuuggccaggg

SEQ ID NO: 79222 - RNA, 98 nt, Mus musculus
gucuguagcgaaauguuagagaauaucacuagucacuccagggaucagggagaauuuauaagugcugcugaugggucuugggagaaaacauauauuca

SEQ ID NO: 79223 - RNA, 44 nt, Mus musculus
gggaggacuccauccaggguggcaggaagcuguugaaggguaga

SEQ ID NO: 79224 - RNA, 46 nt, Mus musculus
aaaaggaacaggacaguguaguccaaggccuaagagagagugagug

SEQ ID NO: 79225 - RNA, 94 nt, Mus musculus
ucccaacaagccgguauugauuuauuuguuugccggagauaacagagauggagggccaggaauccuguugucccaccucagaaggggacagacc

SEQ ID NO: 79226 - RNA, 48 nt, Mus musculus
ccaagaaugccaucacccuugaauucugagacccuguuuuucauagcu

SEQ ID NO: 79227 - RNA, 41 nt, Mus musculus
augguaccagucuaggugucugucgacagguaaauggauga

SEQ ID NO: 79228 - RNA, 45 nt, Mus musculus
aaggugugaugcacagaauugauuauuaucuaugugguaacaagu

SEQ ID NO: 79229 - RNA, 42 nt, Mus musculus
gcagcgccuccuggccggguagccuagguauggccuggugcg

SEQ ID NO: 79230 - RNA, 51 nt, Mus musculus
auguccuuguuuccaaagaacucuaguaggaaguguccuaaacggggucuu

SEQ ID NO: 79231 - RNA, 47 nt, Mus musculus
cgcagugugagccaagguucccggacguccucgggguacagccagug

SEQ ID NO: 79232 - RNA, 51 nt, Mus musculus
gacucgaacucccauguaccuuacuucuggggaugcaaauaguacagggga

SEQ ID NO: 79233 - RNA, 42 nt, Mus musculus
cacuucucuccgcggcgcagcgcaaagcugggcagggggcgc

SEQ ID NO: 79234 - RNA, 41 nt, Mus musculus
ggugauuaggugauagguguuaggugauucuuaugggguac

SEQ ID NO: 79235 - RNA, 41 nt, Mus musculus
ucauuccgggaaggaaaauggagacaagugcucauccaaag

SEQ ID NO: 79236 - RNA, 46 nt, Mus musculus
uuuaacaguagucugugauuuguuuguuuggugguggugaugggga

SEQ ID NO: 79237 - RNA, 45 nt, Mus musculus
ccuuuaagacagcaagguauugauaguuuauggauggcuuguuca

SEQ ID NO: 79238 - RNA, 46 nt, Mus musculus
aagauuacuuagcaaauugcuguaugucuuuguccuuaauggcuag

SEQ ID NO: 79239 - RNA, 46 nt, Mus musculus
uacuuuuugauguguuagcauuguuauuuaaaaaugcuacugauaa

SEQ ID NO: 79240 - RNA, 46 nt, Mus musculus
uuacauaguuaauuacggcuccucagagagucucagaggcccugac

SEQ ID NO: 79241 - RNA, 45 nt, Mus musculus
aaacuuuagagcugugguuuugagcagaaaguaauauuagagcca

SEQ ID NO: 79242 - RNA, 32 nt, Mus musculus
cuugacaaccugcacuaaacgccguuucagaa

SEQ ID NO: 79243 - RNA, 42 nt, Mus musculus
gcuuccugaacaugacuuuucaccuggccuggauugaggcag

SEQ ID NO: 79244 - RNA, 46 nt, Mus musculus
aacaaugcaauagcuugguuauacagugauggguccagaagcagag

SEQ ID NO: 79245 - RNA, 33 nt, Mus musculus
gcaggcuccacagccuuucagaauagcaccacc

SEQ ID NO: 79246 - RNA, 46 nt, Mus musculus
guggguaccugaguuagcugcaauuuauagauggaacaggcucaag

SEQ ID NO: 79247 - RNA, 41 nt, Mus musculus
ucuguguguguguguguguguguguguguguuauaccuuau

SEQ ID NO: 79248 - RNA, 42 nt, Mus musculus
uuuugagacaccuuuuagguccucuucccccccuacccccga

SEQ ID NO: 79249 - RNA, 46 nt, Mus musculus
gugugucugugucugugugugugugugugucugugucugugugugu

SEQ ID NO: 79250 - RNA, 87 nt, Mus musculus
ugucucugugugugugugugugugugugucugugucugugugugugucugugugugugugugucugugucugugugugugucugugu

SEQ ID NO: 79251 - RNA, 45 nt, Mus musculus
cacauauccuucccucucaggagaccuuuaucuguaguccacacu

SEQ ID NO: 79252 - RNA, 46 nt, Mus musculus
uuuaaagaaugaaauuuuaauguguuugaauuuguaaugacuacgg

SEQ ID NO: 79253 - RNA, 46 nt, Mus musculus
ccacugaguuggucaccacauaagcuccgggaagucauuucuguag

SEQ ID NO: 79254 - RNA, 46 nt, Mus musculus
ccuaagaaauagauagcagguagagacaauuucaaauagucaaggg

SEQ ID NO: 79255 - RNA, 45 nt, Mus musculus
guacccuuuaguaccuucacccugacuugggagcaucugugagga

SEQ ID NO: 79256 - RNA, 31 nt, Mus musculus
guuuguuuuguuuuguuuucccaugacaggg

SEQ ID NO: 79257 - RNA, 46 nt, Mus musculus
caguaagugagguuauguuguuuucaucccaauuucccggaggcuu

SEQ ID NO: 79258 - RNA, 46 nt, Mus musculus
caugaaaagauuuuuccaaaguuauaggauagcaagaaaacccagg

SEQ ID NO: 79259 - RNA, 45 nt, Mus musculus
guaguauuugugugcgugcgugugugugugugugugugugugugc

SEQ ID NO: 79260 - RNA, 42 nt, Mus musculus
ugugcgugugugugugcgugugugugugugugugcgcgugug

SEQ ID NO: 79261 - RNA, 45 nt, Mus musculus
agucugacuuuagcugcuagauccugaugucccucccaguugcag

SEQ ID NO: 79262 - RNA, 44 nt, Mus musculus
uucuuauugucaguugucuuccucucauuuguaacuagcaccca

SEQ ID NO: 79263 - RNA, 46 nt, Mus musculus
aaagcccuucaaaagcuugaauguuuucaucacgguucccuuccag

SEQ ID NO: 79264 - RNA, 46 nt, Mus musculus
ucuauggaacagaucugugcuaucaucucucauuaccugcacaaug

SEQ ID NO: 79265 - RNA, 45 nt, Mus musculus
auaaaauuaucuguuauagaaccauggaguucuacaaugugagau

SEQ ID NO: 79266 - RNA, 45 nt, Mus musculus
auuucuuucaaaaauucuaguuauuuuauuuagcccuugcccuac

SEQ ID NO: 79267 - RNA, 100 nt, Mus musculus
auuuuguggaaauuguaaacugguaaaaaaaaaaaguaggacuucauaaaaucaugcaaucauagaggcuauagcuagcuaggggaaguguugcaaaggg

SEQ ID NO: 79268 - RNA, 46 nt, Mus musculus
uagccccaaguagcgguggggcugccccuguacguugaaugcccag

SEQ ID NO: 79269 - RNA, 92 nt, Mus musculus
cuucccucagggcagcuucuugguuaaagagccucaggcagagauggaggaagucuuaggucagggucauuuuagucagauauagagcccca

SEQ ID NO: 79270 - RNA, 41 nt, Mus musculus
ugggagggaacuuguaacugucccuuggcauugaagcguga

SEQ ID NO: 79271 - RNA, 46 nt, Mus musculus
uggagaccucaaaugaaccugcauuuguagauuuccuauaccacag

SEQ ID NO: 79272 - RNA, 46 nt, Mus musculus
uaacaaaacauuaaaaguuggaaaaucuaaauuuucaaaagacaag

SEQ ID NO: 79273 - RNA, 45 nt, Mus musculus
ugaugaguugaauuguucaugcaguugaggguaucuuuacaggua

SEQ ID NO: 79274 - RNA, 45 nt, Mus musculus
agagagaagaguaaagaggcagaggguggccauggccacauggag

SEQ ID NO: 79275 - RNA, 45 nt, Mus musculus
aacaggacacagguucagguugguauaacuaaggcacaguacaag

SEQ ID NO: 79276 - RNA, 46 nt, Mus musculus
guuuugcuuaaaucucacaaucuguguucacuccauccgcccauag

SEQ ID NO: 79277 - RNA, 41 nt, Mus musculus
uucccguucagauuccaucacuggcuccauaagaagagaua

SEQ ID NO: 79278 - RNA, 23 nt, Mus musculus
cuauuuauauuaagaaugcagua

SEQ ID NO: 79279 - RNA, 42 nt, Mus musculus
ugaauauacucugacuucaaaauccucuggcuuuugccccaa

SEQ ID NO: 79280 - RNA, 42 nt, Mus musculus
aaggaugccaacucugaccguccuggccgcgcugguucucag

SEQ ID NO: 79281 - RNA, 46 nt, Mus musculus
aagucgucuuguggaugauguugcuuauuaccaauaguguucauuu

SEQ ID NO: 79282 - RNA, 46 nt, Mus musculus
ucucgugguuuucaaaugauauuuguguucuguguuuucucugcag

SEQ ID NO: 79283 - RNA, 42 nt, Mus musculus
uuacaucuauaauuacuggguaaauaaaacccugggaaggaa

SEQ ID NO: 79284 - RNA, 46 nt, Mus musculus
ugcaguacauguggugguaccacgugguuggccugauuuggaucag

SEQ ID NO: 79285 - RNA, 42 nt, Mus musculus
gagcaguuuucuaacagcaguguauuucaaacuuccggggag

SEQ ID NO: 79286 - RNA, 41 nt, Mus musculus
auuguguguguguguguguguguguguuaguuuguguguga

SEQ ID NO: 79287 - RNA, 32 nt, Mus musculus
gccuaacuuuauccacccucuccaguagacag

SEQ ID NO: 79288 - RNA, 31 nt, Mus musculus
guuuuguuuauacuguuuacaacuucauaac

SEQ ID NO: 79289 - RNA, 46 nt, Mus musculus
guucacucgagcacacgugugugugugugugugugugugugagaga

SEQ ID NO: 79290 - RNA, 45 nt, Mus musculus
uauauauguauauguauauacacacacacacauaaucagccaaaa

SEQ ID NO: 79291 - RNA, 45 nt, Mus musculus
uuuuaugcuuauuuuugucaaacauguacgccuuucauacgggug

SEQ ID NO: 79292 - RNA, 45 nt, Mus musculus
agcaugaagcugagaguuucagcgcucugcuucuguuuccaaggc

SEQ ID NO: 79293 - RNA, 46 nt, Mus musculus
auagaaggaaaaucuuuugaaagaaagcauugccuaucagaaguag

SEQ ID NO: 79294 - RNA, 46 nt, Mus musculus
gaauauuucugagccuucagaguuuuugcaauaagagucuggauua

SEQ ID NO: 79295 - RNA, 48 nt, Mus musculus
aaauggaauuuaauuauguaacuaacaacuguccuacuaggugagaga

SEQ ID NO: 79296 - RNA, 48 nt, Mus musculus
uuguagccacacagauuuucgacauugagaaacauugggaacuaaauu

SEQ ID NO: 79297 - RNA, 83 nt, Mus musculus
ucacuuggacaucccugcaucauggacucuugcugccccuguuccaugugcucgcaauuccagcuacuggaagccaccaggaa

SEQ ID NO: 79298 - RNA, 42 nt, Mus musculus
gggaaguauugucucuguaugacuuccccccucugccacccc

SEQ ID NO: 79299 - RNA, 41 nt, Mus musculus
ugugcacaugugcauggugugugugugugugugugugugug

SEQ ID NO: 79300 - RNA, 42 nt, Mus musculus
ucaguguaaggaguaaaguuagagaaaccaguaaggagcuuu

SEQ ID NO: 79301 - RNA, 46 nt, Mus musculus
aagugagaacauaaauaacugcacgcacaacaagcaacaguuuagg

SEQ ID NO: 79302 - RNA, 45 nt, Mus musculus
uguuuacuuuagccauauccaaaagaaaaaaacggaaggaaggag

SEQ ID NO: 79303 - RNA, 49 nt, Mus musculus
gacgccuaaugguuggccagcaucccugcauugauguguuucagguuca

SEQ ID NO: 79304 - RNA, 48 nt, Mus musculus
auguaugugcacacuccugcacuaucaagaacauauacugugcacaca

SEQ ID NO: 79305 - RNA, 46 nt, Mus musculus
ugaggcaaagcaguucugccagccuugccgcauacuauguccccgg

SEQ ID NO: 79306 - RNA, 45 nt, Mus musculus
aggauuuuaagguauguucaaaguuuaauaagcuuuaugggguca

SEQ ID NO: 79307 - RNA, 36 nt, Mus musculus
gaaggcuucuuguuugcuuggaagucuaaguguacu

SEQ ID NO: 79308 - RNA, 46 nt, Mus musculus
agaacaaauacauggucuguagagcgcuccccauccauagccccag

SEQ ID NO: 79309 - RNA, 47 nt, Mus musculus
aaaucaauacaugcucuuaaccacuggaccagcucuccagccucuuu

SEQ ID NO: 79310 - RNA, 54 nt, Mus musculus
aacacaaaaguccuccacaguucauguacacuuuguauaugugcccccccaaca

SEQ ID NO: 79311 - RNA, 45 nt, Mus musculus
auggcugucuccugagaggcccugccagagccuuaaaauacagag

SEQ ID NO: 79312 - RNA, 46 nt, Mus musculus
aaaauugcauuuauuuauuugugugugugugugugugugugugugu

SEQ ID NO: 79313 - RNA, 45 nt, Mus musculus
auguguuuacuuuccagcucaggaaaaggugaccugucucugcag

SEQ ID NO: 79314 - RNA, 46 nt, Mus musculus
aggaaaggcaucaugugauauuuaagugggcauuagcaaaggucaa

SEQ ID NO: 79315 - RNA, 45 nt, Mus musculus
cuuacuugcuuucaauuuaaaaaagaaaaaguuucucaagggaag

SEQ ID NO: 79316 - RNA, 42 nt, Mus musculus
cacucucacagcagaauucucucaugguucacacagucacuc

SEQ ID NO: 79317 - RNA, 46 nt, Mus musculus
cuccccacacacauacacauaauuaaaaagaaaauagaucuuuuag

SEQ ID NO: 79318 - RNA, 46 nt, Mus musculus
uguugaggguguuuuacuuuauacaggaagcacugagaaguggcug

SEQ ID NO: 79319 - RNA, 46 nt, Mus musculus
gagaacucuugucugauauacguguuaaagucaaguuuccagaugc

SEQ ID NO: 79320 - RNA, 45 nt, Mus musculus
gaucaugugaugauacagaacucacuccauagcugaggagaugag

SEQ ID NO: 79321 - RNA, 46 nt, Mus musculus
uacauaucugaaaaugacaugcugacgcccauuauuuuguacaauu

SEQ ID NO: 79322 - RNA, 63 nt, Mus musculus
ugaagaauuugauagcuuguacucuauauuggaugauguaaaggaaagcaugauuagcaccau

SEQ ID NO: 79323 - RNA, 44 nt, Mus musculus
aaugcccuggagaacucugaggaacuacuagaauuugcaacaag

SEQ ID NO: 79324 - RNA, 48 nt, Mus musculus
cuucaaauucuucuauuuaaauugucacguuccuguucuagcaugaga

SEQ ID NO: 79325 - RNA, 46 nt, Mus musculus
auucuagaauauacuucaccugauuuuuuggauauuagaagugugg

SEQ ID NO: 79326 - RNA, 46 nt, Mus musculus
uugugaguguuggugucucacagaaauguagucucuuacuguccag

SEQ ID NO: 79327 - RNA, 39 nt, Mus musculus
uuucuucauuuuuuucauccuguaaggggaggggauauu

SEQ ID NO: 79328 - RNA, 41 nt, Mus musculus
acauuaaauuuucuuacuuuugcagugauugauaugggggu

SEQ ID NO: 79329 - RNA, 46 nt, Mus musculus
uagaucuuuauuuuguauuuuacuucacauuuaucugagugcuuau

SEQ ID NO: 79330 - RNA, 41 nt, Mus musculus
ggcaggauucuuacauucuuggugguguguguuuugggauu

SEQ ID NO: 79331 - RNA, 41 nt, Mus musculus
agaaugacucccccaagagguacggugcccuuaggaccaca

SEQ ID NO: 79332 - RNA, 45 nt, Mus musculus
uaagagagcuugccagcagagagugcugugagcacugaaacucag

SEQ ID NO: 79333 - RNA, 33 nt, Mus musculus
gaaaccuguucaaaacauuuuuuuaaaauggaa

SEQ ID NO: 79334 - RNA, 44 nt, Mus musculus
caauaguagauccuuccuaaucaauaauuaaauguaggggccag

SEQ ID NO: 79335 - RNA, 46 nt, Mus musculus
uuuuguguugauugauuguuugcuuuugagaauccucuagccucag

SEQ ID NO: 79336 - RNA, 25 nt, Mus musculus
gggaauagaacuaggaccucugcaa

SEQ ID NO: 79337 - RNA, 46 nt, Mus musculus
caaaacaaaaccaaacaaaaagaaaauaaauuacagaauacccaag

SEQ ID NO: 79338 - RNA, 46 nt, Mus musculus
uugguagcugacaacucuguaacuguagcuuggagaaugccugaag

SEQ ID NO: 79339 - RNA, 45 nt, Mus musculus
uuuaaaccacaaaauauuagcagagcuuuucaguguguccugugc

SEQ ID NO: 79340 - RNA, 41 nt, Mus musculus
agcuccagcugugaggcaguuucucagugauaaguggggga

SEQ ID NO: 79341 - RNA, 41 nt, Mus musculus
gauuauuuuaucuuacaauagugaacauuugaaaagcgggu

SEQ ID NO: 79342 - RNA, 45 nt, Mus musculus
uuauuauauguaaauauaaauacauaagacuuaauuaacuugcaa

SEQ ID NO: 79343 - RNA, 45 nt, Mus musculus
ccacucaguucuuuuuugcucuuucugacccaaccugugccccug

SEQ ID NO: 79344 - RNA, 49 nt, Mus musculus
aaauccuauaguguggguguagcauauaaaacuuuaggaaaauuugauc

SEQ ID NO: 79345 - RNA, 42 nt, Mus musculus
ccugagaaaauagguguguuuugugacuuugauggggguaag

SEQ ID NO: 79346 - RNA, 46 nt, Mus musculus
aauaguugaaaaacagacaaaugauaucaacacagauaggauacag

SEQ ID NO: 79347 - RNA, 46 nt, Mus musculus
uuaacuuuguaauaaaauguuauuguugcuucuaccaccaugccua

SEQ ID NO: 79348 - RNA, 45 nt, Mus musculus
cuuuaaauagccacaggugguuaggguucuuacaggggcggauga

SEQ ID NO: 79349 - RNA, 59 nt, Mus musculus
ucauuaucaguuggcucugaaauuauuguuugggcacccugagaauaagaauuuauuga

SEQ ID NO: 79350 - RNA, 42 nt, Mus musculus
aggggaauugugaccaccgaccacaggggguggauggcugag

SEQ ID NO: 79351 - RNA, 45 nt, Mus musculus
auccuugcuccacaucccagccagcaugugcugucacuugcauuu

SEQ ID NO: 79352 - RNA, 44 nt, Mus musculus
auuacaggacugguugaaucaauacccucaggcgugggcagaga

SEQ ID NO: 79353 - RNA, 45 nt, Mus musculus
guccgagaugaggcugggcgcccuguccaaacuccagcugagaua

SEQ ID NO: 79354 - RNA, 46 nt, Mus musculus
ccggacgcggccgcaggggaccuugcuccgcccucucgucccagga

SEQ ID NO: 79355 - RNA, 46 nt, Mus musculus
uaaauaucuuccucgacgugaagguaccuugugggcuggcgugguu

SEQ ID NO: 79356 - RNA, 42 nt, Mus musculus
uuccaggugccagagggaccugagcaagucuaccggcccggc

SEQ ID NO: 79357 - RNA, 42 nt, Mus musculus
caucccgcguuguuugcacauuguuugcacuuuccggcugau

SEQ ID NO: 79358 - RNA, 46 nt, Mus musculus
ccccagcacccccagccuuggugcaccggucaaaacauuucccaag

SEQ ID NO: 79359 - RNA, 41 nt, Mus musculus
ggcggcggcggcggaggaggaggugguggugaaggaggagg

SEQ ID NO: 79360 - RNA, 42 nt, Mus musculus
ugcugaagcugcgucuguugcccgccccccucccgcgcugaa

SEQ ID NO: 79361 - RNA, 46 nt, Mus musculus
uucugucuugcuuucucucucccucugguugcucauuauucagaga

SEQ ID NO: 79362 - RNA, 44 nt, Mus musculus
gagagacggauaucucaggucaucugcagcugcagcgagucuga

SEQ ID NO: 79363 - RNA, 45 nt, Mus musculus
agaagcacaugagacucccaaacaacuuccacaacaauaacccga

SEQ ID NO: 79364 - RNA, 46 nt, Mus musculus
gagcgaggggaaagagagagagagagagagagagagagagagagag

SEQ ID NO: 79365 - RNA, 45 nt, Mus musculus
agaauucaguucuuuccuugggucaacugcauacagucucuagaa

SEQ ID NO: 79366 - RNA, 44 nt, Mus musculus
aaggaaggaaggaaagaaagaaagaaagaaagaaagaaaaaaca

SEQ ID NO: 79367 - RNA, 42 nt, Mus musculus
cccuuugagugaaguuggguuuaaguguggauaggcccagca

SEQ ID NO: 79368 - RNA, 42 nt, Mus musculus
ucacucaacauuaggacagacaacauucaacggacagcagga

SEQ ID NO: 79369 - RNA, 45 nt, Mus musculus
gugugugugugugugugugugugugugugugugaaacagagagag

SEQ ID NO: 79370 - RNA, 46 nt, Mus musculus
ccugaggauucaaagcuagaaaguaaaggacagauaagggccaacu

SEQ ID NO: 79371 - RNA, 42 nt, Mus musculus
gaguagcaaucaaaggcucaugaagaugcacugcccccagau

SEQ ID NO: 79372 - RNA, 46 nt, Mus musculus
aagauucaaagaagaauguuuucugaauccacuugacugcccgcaa

SEQ ID NO: 79373 - RNA, 46 nt, Mus musculus
auucuucccauccccuaugaaacucuuagcauugaaacaaacagua

SEQ ID NO: 79374 - RNA, 46 nt, Mus musculus
ucagcgcugcaccauaugccuaaggagugaccucaugcagauuucu

SEQ ID NO: 79375 - RNA, 42 nt, Mus musculus
uaccuuuuucugggggaacccaaagccuccgucuaucuagau

SEQ ID NO: 79376 - RNA, 46 nt, Mus musculus
cccucugaccuagucacauuuggcuacccuaaggcauucaccagag

SEQ ID NO: 79377 - RNA, 42 nt, Mus musculus
acaguuaccucagagaaaacaaaaacagagauggucagagau

SEQ ID NO: 79378 - RNA, 46 nt, Mus musculus
cuuaaucuucugucugagcugcucuuuaguuaaauggggccgggau

SEQ ID NO: 79379 - RNA, 45 nt, Mus musculus
gacugggugugguggcuccagaccaguaauccuaguacaggagag

SEQ ID NO: 79380 - RNA, 46 nt, Mus musculus
aacaaaauugaguuaagagauacauuuuacauuuuagaucccagaa

SEQ ID NO: 79381 - RNA, 47 nt, Mus musculus
caugcacauaggcaaaugacacagaguuugagugugaugacaugauc

SEQ ID NO: 79382 - RNA, 82 nt, Mus musculus
aggucaaguucauuuuccacucuauagcaagucugaggucagccugggauaaugagguccuagaauuaaaaaauaaaaagga

SEQ ID NO: 79383 - RNA, 67 nt, Mus musculus
acucaaucaucaguccuaacaguuccuauaaucucagugcccaguaaguggaauaaggaaaaucaga

SEQ ID NO: 79384 - RNA, 79 nt, Mus musculus
ugaugcucccgggaagaggaagagagaauccucacauugagacaugcuaugaccaggauuucaaagggugagcuaauaa

SEQ ID NO: 79385 - RNA, 79 nt, Mus musculus
guaugcgagaagccgacagcaaagcaaaacaaaauacacucagaucugggauagaaaauaguuaggaugacagaguggc

SEQ ID NO: 79386 - RNA, 80 nt, Mus musculus
gacacagaagaaaaugauauacagcaauuaacggagagucgauggagggcgagaucaaagaugggugauaagacaugcgu

SEQ ID NO: 79387 - RNA, 45 nt, Mus musculus
cuggacagauucagggaugugccugccucugccuccagaguccug

SEQ ID NO: 79388 - RNA, 43 nt, Mus musculus
gggagagagagggagagagagggggagagagagaggggaagag

SEQ ID NO: 79389 - RNA, 46 nt, Mus musculus
cuaagugcauucgggagaacugaggaugcugacaaagguacgaaga

SEQ ID NO: 79390 - RNA, 46 nt, Mus musculus
cuuuccuggaacuugcucuguagauugaccuuugaacucaagagau

SEQ ID NO: 79391 - RNA, 45 nt, Mus musculus
acagucuccuuguucugcuacaaaggagauuaaaggguuaugaga

SEQ ID NO: 79392 - RNA, 46 nt, Mus musculus
acguuagcguugggcaucucccggcucgcagcauucauggacaggu

SEQ ID NO: 79393 - RNA, 45 nt, Mus musculus
caucugaggguaagacauagaagaagaaaacuuggaaguugaaga

SEQ ID NO: 79394 - RNA, 42 nt, Mus musculus
ggauauuuucuauguggcgggaaaugcuacggcggugcaugg

SEQ ID NO: 79395 - RNA, 46 nt, Mus musculus
uggcccagggguggaacgcuugguaaugguuugugaugucccagau

SEQ ID NO: 79396 - RNA, 47 nt, Mus musculus
aaguuguuguacucggacuggcacacuguacacugguauggggugga

SEQ ID NO: 79397 - RNA, 42 nt, Mus musculus
cuucagugguuaucucagguucaagggacacuggcagcuucg

SEQ ID NO: 79398 - RNA, 23 nt, Mus musculus
aauauccagauggaaagggcaga

SEQ ID NO: 79399 - RNA, 46 nt, Mus musculus
ucugagagaagaaaggaggagagcugaagggagagggaacggaggg

SEQ ID NO: 79400 - RNA, 44 nt, Mus musculus
ggucacauggcaaauucuaggacagcuacaugaaacuauuucag

SEQ ID NO: 79401 - RNA, 45 nt, Mus musculus
cggcuguuguaggaggacuugaaagagcagaguuugcagcggaac

SEQ ID NO: 79402 - RNA, 45 nt, Mus musculus
aggauuucucucagcagcucagagucacaucacauugccugagau

SEQ ID NO: 79403 - RNA, 45 nt, Mus musculus
cacacacacacacacacacacacacacacacacagggaauggaac

SEQ ID NO: 79404 - RNA, 42 nt, Mus musculus
ugcagugugggaaacccuaagugagagccaauagccccagag

SEQ ID NO: 79405 - RNA, 45 nt, Mus musculus
ggccugaacugauuccuuccugggccucugcagcaagggacagac

SEQ ID NO: 79406 - RNA, 44 nt, Mus musculus
auagagcuucuauacugagaggugguguacaggugaccccaaca

SEQ ID NO: 79407 - RNA, 23 nt, Mus musculus
uuuucccccucccgccacaguca

SEQ ID NO: 79408 - RNA, 45 nt, Mus musculus
agcaagagaagauuccagugagcuaauggauugcagcccugagac

SEQ ID NO: 79409 - RNA, 46 nt, Mus musculus
cgaucauguugcguuuguauuuggugugauagaggcagagaggaca

SEQ ID NO: 79410 - RNA, 45 nt, Mus musculus
uucugugagauuugggcagacauaggcacaucacaggcaugcugg

SEQ ID NO: 79411 - RNA, 46 nt, Mus musculus
agucuguauuucaguucuauuuuaagccagugugguggugucagua

SEQ ID NO: 79412 - RNA, 47 nt, Mus musculus
guaauaucgcaucauccuguuuccauaaaaggugacaaccaagggag

SEQ ID NO: 79413 - RNA, 24 nt, Mus musculus
ggagagcaggguaagacuaaccuc

SEQ ID NO: 79414 - RNA, 45 nt, Mus musculus
agaaggaggaaucugcuuucucagucuucacugccugcccuccau

SEQ ID NO: 79415 - RNA, 24 nt, Mus musculus
cagaugaaaaucuccguggugaag

SEQ ID NO: 79416 - RNA, 46 nt, Mus musculus
cagaaauaaaccaggcuuauuuaccuggcuuaggucaucaauguag

SEQ ID NO: 79417 - RNA, 46 nt, Mus musculus
caaaaccauaggcgccuguuugcugcccuccucugugauccaggag

SEQ ID NO: 79418 - RNA, 42 nt, Mus musculus
ugguauagguuuugccacagccugcauagucacaaguguggg

SEQ ID NO: 79419 - RNA, 45 nt, Mus musculus
ugacugcaucuggucuggcaggaaaggaggguaguugggccccgg

SEQ ID NO: 79420 - RNA, 47 nt, Mus musculus
ccuuugcuaacacugaugaccgaagggcugcuguacucgcugccagg

SEQ ID NO: 79421 - RNA, 44 nt, Mus musculus
gccacgaagccgcccgaggggcucacgucauugauguccgccag

SEQ ID NO: 79422 - RNA, 46 nt, Mus musculus
uagaggagcccuccaccuguguugcuggcagccacgcccgggucac

SEQ ID NO: 79423 - RNA, 41 nt, Mus musculus
gaggaugaagcugacgccgagguggucacgguggcggccac

SEQ ID NO: 79424 - RNA, 45 nt, Mus musculus
aagauuaaaaacuuuagaaacaaaaccucaaaccaaaacccccag

SEQ ID NO: 79425 - RNA, 67 nt, Mus musculus
ccauccugcuguucuuguacucaguacuguuugaaagcaugguuaggcagaucaugaacuggagucu

SEQ ID NO: 79426 - RNA, 44 nt, Mus musculus
uguuuagcuggcuauaguaggacaugccuauaaucccagcagcc

SEQ ID NO: 79427 - RNA, 89 nt, Mus musculus
gaacugggauguggaagagucugccuuugaacagccucagcuagcacuaggcaguccccacuuucuuuuggguauacaucuuagguacu

SEQ ID NO: 79428 - RNA, 46 nt, Mus musculus
agaagccaguggaagcugagccugcuggaaugacugcccuguuagg

SEQ ID NO: 79429 - RNA, 45 nt, Mus musculus
aagaagcauagccucaaagaagggaguccucuggagggccuggcu

SEQ ID NO: 79430 - RNA, 46 nt, Mus musculus
auaucaugcucaagguauuuuucauuaugcauccucagcccaaaaa

SEQ ID NO: 79431 - RNA, 46 nt, Mus musculus
acaucuuuuauuauuaaauuuuagcuuugcuucgucacaccccacu

SEQ ID NO: 79432 - RNA, 45 nt, Mus musculus
ugguuguaggagcuugauauggccuggcccaacagauaauacaga

SEQ ID NO: 79433 - RNA, 46 nt, Mus musculus
uuguggggcaagccccuuccccacugaugcaucuccagcgccucca

SEQ ID NO: 79434 - RNA, 46 nt, Mus musculus
cugccucauggucuuccccugucugcccacucaggaccgucuagcu

SEQ ID NO: 79435 - RNA, 46 nt, Mus musculus
gagagaaacaggaccaauagaaugaauauauauuaaaaggaaagga

SEQ ID NO: 79436 - RNA, 46 nt, Mus musculus
gaacgaguggggauccaggugcacuggcuagaagcccaguguugcg

SEQ ID NO: 79437 - RNA, 41 nt, Mus musculus
uccccaagauaaugcauuguauacguguaaauacuguaaaa

SEQ ID NO: 79438 - RNA, 46 nt, Mus musculus
gcuuccuagugcuaugauaaaacaccgggcaaaagcagccugagga

SEQ ID NO: 79439 - RNA, 46 nt, Mus musculus
gccuccuguucuuucuuaaacuccaacaggaaaucuucccuuugau

SEQ ID NO: 79440 - RNA, 46 nt, Mus musculus
cucaugugaagaaaaccaccccggagcuggaaauugugcugcagaa

SEQ ID NO: 79441 - RNA, 41 nt, Mus musculus
aaguuggagacagcaguccuuuagcucuagaagcccucuug

SEQ ID NO: 79442 - RNA, 46 nt, Mus musculus
ugcuuguaguccauuagcacugacauauauaucuccacccgcucag

SEQ ID NO: 79443 - RNA, 45 nt, Mus musculus
gaacucuggaaaggguauaaagggggaagcgcccaguggggcugu

SEQ ID NO: 79444 - RNA, 41 nt, Mus musculus
uggugugugugcuggacaugaagaggaaagcugcuccuaga

SEQ ID NO: 79445 - RNA, 46 nt, Mus musculus
caaaaccugcccccacuggcacaccuuuucaaacaaggccacaccu

SEQ ID NO: 79446 - RNA, 46 nt, Mus musculus
gcccccuggcuucuuuauugagaaaacagaaaaucagucuucagag

SEQ ID NO: 79447 - RNA, 45 nt, Mus musculus
guucgauuuguucauccaugcacacagauggaaguagccacgauu

SEQ ID NO: 79448 - RNA, 46 nt, Mus musculus
caguacagcuggcugauggccaggugcucaaguaccuuugggguga

SEQ ID NO: 79449 - RNA, 42 nt, Mus musculus
uucaguuuguugaauggaaaugcaguuacacauugugcagga

SEQ ID NO: 79450 - RNA, 45 nt, Mus musculus
ggaacaaugaagaagaagaagaagaagaaguaaacgcacugcagu

SEQ ID NO: 79451 - RNA, 46 nt, Mus musculus
cucuugaggcugaccucugcuggcaucuggucugaguguugguuau

SEQ ID NO: 79452 - RNA, 45 nt, Mus musculus
gagcucugggaauagugccaaugacuuggcaaauguggcuguuau

SEQ ID NO: 79453 - RNA, 46 nt, Mus musculus
gacccggugacgccgugucgacuccauguucucuguacgggcuggc

SEQ ID NO: 79454 - RNA, 50 nt, Mus musculus
ugcuguggaaugcagauuccucggugcuugcuauauggcuagaagaccuc

SEQ ID NO: 79455 - RNA, 42 nt, Mus musculus
acaugaagcagcuuaugugccauugaaguccuggguggagac

SEQ ID NO: 79456 - RNA, 46 nt, Mus musculus
acaaacaccacacacacacacacacacacacacacacaccccuacc

SEQ ID NO: 79457 - RNA, 41 nt, Mus musculus
ccgccaguguuagcaggccuggguguugccuagguguuuga

SEQ ID NO: 79458 - RNA, 44 nt, Mus musculus
aucucuaauucuuuaaagguuaugguuguacauauggcuguugu

SEQ ID NO: 79459 - RNA, 46 nt, Mus musculus
ggaauuaaaagaaugcuuugaggcugucuguucacuaaauacagau

SEQ ID NO: 79460 - RNA, 46 nt, Mus musculus
gaaauaaauuacacuuaaaaauuuaccuacauuaaaaucuggagaa

SEQ ID NO: 79461 - RNA, 46 nt, Mus musculus
agcauuauauagaagaugaguauuugguggccagggguuugacgug

SEQ ID NO: 79462 - RNA, 46 nt, Mus musculus
uaauggcugaugcucagcuuccugaguugucagugacugucuucau

SEQ ID NO: 79463 - RNA, 46 nt, Mus musculus
uguguucugguuuuaggcacuguuacucugggguuucagagaaguc

SEQ ID NO: 79464 - RNA, 47 nt, Mus musculus
aaagucugugcuggcucuggaucauugccacuguguuuuguauaaga

SEQ ID NO: 79465 - RNA, 47 nt, Mus musculus
agucugcagaucccugcugugagcccaucacucacuaucggucugau

SEQ ID NO: 79466 - RNA, 85 nt, Mus musculus
guguauuagugggccacaagaaaggaguaggggcaguuagaaggcaguguucuuuuccuuccagcuagacuagaucagcuuuaga

SEQ ID NO: 79467 - RNA, 48 nt, Mus musculus
uauucuggugaauggaaaucuauccaugaggucuccuggauaucacuu

SEQ ID NO: 79468 - RNA, 52 nt, Mus musculus
gacuuugaagugaucgcagaggagcagauccaccaggaugauuuuggagaag

SEQ ID NO: 79469 - RNA, 58 nt, Mus musculus
augacugauuuguuacaugaacuccuaagcucaacagacccugauuaugaugacaaaa

SEQ ID NO: 79470 - RNA, 46 nt, Mus musculus
auagcuauagaaaugucuuagaaaacuagcaaucuuuaaagcagua

SEQ ID NO: 79471 - RNA, 41 nt, Mus musculus
ugugugugugugugugugugugugugagagagagagguuga

SEQ ID NO: 79472 - RNA, 42 nt, Mus musculus
guguggccagugguaucucugucaugagcuggaguccugauc

SEQ ID NO: 79473 - RNA, 46 nt, Mus musculus
uucuuugaaugucuuaacaaacuuuacucuucauucacgcugagaa

SEQ ID NO: 79474 - RNA, 42 nt, Mus musculus
ugucugauuaccccaguagccuggucucuuuagccccacucg

SEQ ID NO: 79475 - RNA, 46 nt, Mus musculus
cacggugcugauuggcucagaacguggacugacggaaguagauccu

SEQ ID NO: 79476 - RNA, 45 nt, Mus musculus
cagguuuaacauguuguaaauuaaccugcagauuagccccacgua

SEQ ID NO: 79477 - RNA, 46 nt, Mus musculus
uuaacucugaaaauauaucgccucugcauucucaggugaaggagau

SEQ ID NO: 79478 - RNA, 46 nt, Mus musculus
gcucuauccuuuuaggauguaaacuucggagagaggagggcaggag

SEQ ID NO: 79479 - RNA, 49 nt, Mus musculus
acugguugcugauucugucucuucccccuccugcccuccucucuccgaa

SEQ ID NO: 79480 - RNA, 46 nt, Mus musculus
auuaacuaauggaaauguauuggugauguugauacugcagcuuagc

SEQ ID NO: 79481 - RNA, 46 nt, Mus musculus
ggcucagucacuuuugucacacauaaauaaaaaaagagaaaagugg

SEQ ID NO: 79482 - RNA, 46 nt, Mus musculus
cagugucacaaaagcuuggugccuggaggggcuguuguagucaggu

SEQ ID NO: 79483 - RNA, 46 nt, Mus musculus
auuagauaauaaauccgugagaguccugacccuucuucccugagaa

SEQ ID NO: 79484 - RNA, 46 nt, Mus musculus
aacaaacaaaauacaugaucacauguuacaaaguucacaaguucac

SEQ ID NO: 79485 - RNA, 46 nt, Mus musculus
auuuuaaacccgggcgugguggcgcacgccuauaauuccagaacuc

SEQ ID NO: 79486 - RNA, 47 nt, Mus musculus
gcugguugugguggcgcacgccaguaggauuugcugaaggaggcaga

SEQ ID NO: 79487 - RNA, 46 nt, Mus musculus
uucuaagugucccuuacucuuccugagacuuuugauuagcaggcag

SEQ ID NO: 79488 - RNA, 44 nt, Mus musculus
acugcugggcucuaacuuucugccugcuaaucaaaagucucagg

SEQ ID NO: 79489 - RNA, 53 nt, Mus musculus
gaacaacaagaagaaagagaaaauucccucugggaacaaagcaggugguagac

SEQ ID NO: 79490 - RNA, 71 nt, Mus musculus
caguuccucuguaucuacuugcagcuuuuccaauugcucaggcauucuuccaacuuugagacagaauauag

SEQ ID NO: 79491 - RNA, 46 nt, Mus musculus
ccgcacagccaauucuguaaaccuuucaaaaacaaguagaaggacc

SEQ ID NO: 79492 - RNA, 131 nt, Mus musculus
aaccagcaccauuagcaggcaugugcuuuacaaucacugggaaaaccugauggagauuuuguaauccaagaccucuccucuacccacauggcuagcaugagauuaacccuuucuuucccaacgggcuauuu

SEQ ID NO: 79493 - RNA, 46 nt, Mus musculus
ggaaugcauuacauaggaaaucacagacucuuuaaaaugccucaga

SEQ ID NO: 79494 - RNA, 45 nt, Mus musculus
gauagauuaaguaaccaagcuauccaaaauagaauuauuccccaa

SEQ ID NO: 79495 - RNA, 46 nt, Mus musculus
ugcuguacuggagguuggucagcaguuacuaugguuaacaugguag

SEQ ID NO: 79496 - RNA, 45 nt, Mus musculus
ucagcuuacaucacugaaagaagucaggacuggaacucaaacagg

SEQ ID NO: 79497 - RNA, 46 nt, Mus musculus
gggaaggggaacuacagugguuuaugggaagggagaggcugcaggu

SEQ ID NO: 79498 - RNA, 26 nt, Mus musculus
agagugaucagauggcugggacugua

SEQ ID NO: 79499 - RNA, 46 nt, Mus musculus
ccgucucauuugcaaagcugccucagaauuuggauaaaaaccgaua

SEQ ID NO: 79500 - RNA, 46 nt, Mus musculus
ccaggaccaagaugugggaguggguggguaggggaggagggcagag

SEQ ID NO: 79501 - RNA, 45 nt, Mus musculus
acuucuguguuugccaggcacuggcauagccucauacuagacagc

SEQ ID NO: 79502 - RNA, 46 nt, Mus musculus
auggguggguggguggacagauggauagcuguguggguggagagag

SEQ ID NO: 79503 - RNA, 46 nt, Mus musculus
ccucuucccugggcgaacggacaagugaaugaguggguggauggau

SEQ ID NO: 79504 - RNA, 46 nt, Mus musculus
aaagcaggcucagagaugugaaggagcccauccagugcccauaccu

SEQ ID NO: 79505 - RNA, 55 nt, Mus musculus
acaaaaagaaaaaaaaagaaaaaaaaaggaagcuguauguaagacuaaaagcaag

SEQ ID NO: 79506 - RNA, 25 nt, Mus musculus
uugaacaauacaaugagacaauaca

SEQ ID NO: 79507 - RNA, 41 nt, Mus musculus
auccauccccaugccaaaaaaccagggagcaaagccacagg

SEQ ID NO: 79508 - RNA, 45 nt, Mus musculus
uacauaggccuagagccccagaauucaaccagccccagcccagau

SEQ ID NO: 79509 - RNA, 45 nt, Mus musculus
auuagggaggcuugcuuuccuacaacauugcuguaccuggcuaag

SEQ ID NO: 79510 - RNA, 46 nt, Mus musculus
uccaggaugagcaagagacccugcuuugguaauggaguggaagaca

SEQ ID NO: 79511 - RNA, 42 nt, Mus musculus
aguuuggaucccaaggacccacguuaaagucgggggccaggg

SEQ ID NO: 79512 - RNA, 41 nt, Mus musculus
cuaccaucuguacugggaucugaugcccucuucuggcacac

SEQ ID NO: 79513 - RNA, 42 nt, Mus musculus
gauggagauggcuaccuaguccugauccggaucacaccagau

SEQ ID NO: 79514 - RNA, 44 nt, Mus musculus
ggccuugcuggcuaugaacagaucuagacaugcaaagcaggagu

SEQ ID NO: 79515 - RNA, 73 nt, Mus musculus
cuguucuaggaugcucuuagcaaggucuugguaugaucccagagagcagucgauuuccuuccuuccccccagu

SEQ ID NO: 79516 - RNA, 46 nt, Mus musculus
ccuauucaauuauaauaguuuuguagaagaaauuaugguggcauga

SEQ ID NO: 79517 - RNA, 46 nt, Mus musculus
guaguugugagccaccauguggaugcugggauuugaacucagaacc

SEQ ID NO: 79518 - RNA, 46 nt, Mus musculus
auuauuauauauaaguacacuuuagcugauuucagacgcaccauac

SEQ ID NO: 79519 - RNA, 42 nt, Mus musculus
uaggaccucugcucacucuggucaaccccacuugcuccaguc

SEQ ID NO: 79520 - RNA, 46 nt, Mus musculus
aauacaucauccaggcuaucuugccgacagccaguucauaccagau

SEQ ID NO: 79521 - RNA, 46 nt, Mus musculus
cuguugaauggaagcugggugaguauggcuaguuaacaggacagac

SEQ ID NO: 79522 - RNA, 42 nt, Mus musculus
aaaaguugccuaugauaagcaauaagcuguaauuagagaaaa

SEQ ID NO: 79523 - RNA, 45 nt, Mus musculus
agagagagacacagagagagacagacagagagagagagagaggag

SEQ ID NO: 79524 - RNA, 45 nt, Mus musculus
aauuacccaucuuacuguggccucagaagcaaaauggagagagag

SEQ ID NO: 79525 - RNA, 45 nt, Mus musculus
ugucgccgggcgugguggugcacgccuuuaaucccagcacuuggg

SEQ ID NO: 79526 - RNA, 23 nt, Mus musculus
ggagggaugguggccgugcgcac

SEQ ID NO: 79527 - RNA, 45 nt, Mus musculus
aucugccaucaugguagagggcgugugugugugugugugugugug

SEQ ID NO: 79528 - RNA, 46 nt, Mus musculus
gcuugucugcugggugaaucagcggguguaggaaguuugugaggca

SEQ ID NO: 79529 - RNA, 41 nt, Mus musculus
acaauaauggaagggagagacugaggagguaagacaaagac

SEQ ID NO: 79530 - RNA, 45 nt, Mus musculus
cugcacacgcgugcguguacacacacagacacacacacacacaga

SEQ ID NO: 79531 - RNA, 46 nt, Mus musculus
ccugcacacauaaagggagaccgacacacacccucauacagcagca

SEQ ID NO: 79532 - RNA, 46 nt, Mus musculus
augagccccggguucaguaagagauccugucucagaaaacgaagau

SEQ ID NO: 79533 - RNA, 55 nt, Mus musculus
gagcagguggaugaaggauagauagucuuucuuagcccaguauaagaagcagaga

SEQ ID NO: 79534 - RNA, 46 nt, Mus musculus
agguguuucagggcaaccuugagggugaggggagaggaggcagcuc

SEQ ID NO: 79535 - RNA, 46 nt, Mus musculus
ucuaugucugugugucugugugugugugugugugugugugugugug

SEQ ID NO: 79536 - RNA, 46 nt, Mus musculus
ugugugugugugucucugugugugugugugugugugucuaugucug

SEQ ID NO: 79537 - RNA, 46 nt, Mus musculus
ucccugggaggucgaccucugaaaacagaaucugaaguccccuaag

SEQ ID NO: 79538 - RNA, 42 nt, Mus musculus
agcgagguggcgcacgccuuuaaucccagcacucggggggug

SEQ ID NO: 79539 - RNA, 46 nt, Mus musculus
aaagggauaacauuauagaaaugaagucuuuauaaaugugugagau

SEQ ID NO: 79540 - RNA, 46 nt, Mus musculus
caggacaaagaagcugagccgcagagaaauuguuacauagccagcc

SEQ ID NO: 79541 - RNA, 41 nt, Mus musculus
ugugguuguuaagggccugguugauuucccucacccccacc

SEQ ID NO: 79542 - RNA, 46 nt, Mus musculus
uagagagauugcuuggaauuggguaggugcguauugcuuaaugggu

SEQ ID NO: 79543 - RNA, 41 nt, Mus musculus
acauaaaacuagccaguucaucuugggaaggguagauagau

SEQ ID NO: 79544 - RNA, 42 nt, Mus musculus
aggaagcugguaagaauaugcugagcaucccagggcugggac

SEQ ID NO: 79545 - RNA, 46 nt, Mus musculus
agguccugaguucaaaucccagcaaccacauuguagcucacaacca

SEQ ID NO: 79546 - RNA, 46 nt, Mus musculus
ccgaugccuacuccaagggaacucccaugggauucagagggcagau

SEQ ID NO: 79547 - RNA, 47 nt, Mus musculus
aguuccugucaugcauggccucuuuacagcccuuacccuacuuugcu

SEQ ID NO: 79548 - RNA, 23 nt, Mus musculus
uuccacgcaggccagcuuagugu

SEQ ID NO: 79549 - RNA, 45 nt, Mus musculus
agacuggagggccuugcuggcuggguguuguguuuaugaguggag

SEQ ID NO: 79550 - RNA, 48 nt, Mus musculus
ucuuacacagaugucuuucccgaugauuaaaucaagaucuagauugua

SEQ ID NO: 79551 - RNA, 102 nt, Mus musculus
aaaagacguccuaccucgagggaaaggcaguguaaaggucuccaggcgggucaaguucagaggguaugauggggaggaaggugcagucggagcgcaggaaga

SEQ ID NO: 79552 - RNA, 45 nt, Mus musculus
gaauggauaagugauacaugcuuggagugcgguaauggacuugga

SEQ ID NO: 79553 - RNA, 46 nt, Mus musculus
agaaaggcccuaucccaacucggcccccaacacugagcaucucccu

SEQ ID NO: 79554 - RNA, 45 nt, Mus musculus
cucaccauaccuagcuuguuccuauuuuauauuucuauaggugua

SEQ ID NO: 79555 - RNA, 46 nt, Mus musculus
gcuccacaagguaucccuugggguucccuuggugaccggcuuccag

SEQ ID NO: 79556 - RNA, 46 nt, Mus musculus
ggcuuggucccaggguuaggaugagcauccuuaagagaauguggaa

SEQ ID NO: 79557 - RNA, 41 nt, Mus musculus
cuuguuagugcccucauugcuaacaaaguagaguugggggg

SEQ ID NO: 79558 - RNA, 45 nt, Mus musculus
cagggggaggggaggagaaaagaaguguagacgguagcgugaaag

SEQ ID NO: 79559 - RNA, 36 nt, Mus musculus
acggggggagagagaaggagaaacggaagggacaag

SEQ ID NO: 79560 - RNA, 113 nt, Mus musculus
uaaagaggaggauucggagaggggcugaaaagggggcagcggaaagacaaggagagaauggagugaggagcgguuaagagcagagaguggggugggcaggaggagaagguggg

SEQ ID NO: 79561 - RNA, 46 nt, Mus musculus
auuugaguuccauaaaauuuugacagauguccuuuuacuggaagau

SEQ ID NO: 79562 - RNA, 63 nt, Mus musculus
uggugguauuuaaaaaaaaaaaaaccaagugggggaaaguaaagguuacucuguagcaugcau

SEQ ID NO: 79563 - RNA, 93 nt, Mus musculus
gaaagccucaguauugaagaaaacacuugaaagucuggaaugaaugagaaggggaagaaacaaacaagugccauguucuuuugggauuggaaa

SEQ ID NO: 79564 - RNA, 66 nt, Mus musculus
augcagaggacuucugauugagucuuuagcuacuauggagacagacaacagaccagagcugcagga

SEQ ID NO: 79565 - RNA, 45 nt, Mus musculus
gugagaacagaagcuuuaucugugguagaauuacugcuuaaaaaa

SEQ ID NO: 79566 - RNA, 57 nt, Mus musculus
acacgcagauccugaagcucuggcugagauucuucucgaaacaugcaaaucaauuac

SEQ ID NO: 79567 - RNA, 45 nt, Mus musculus
agcaaacuguuagaauaggugugugugugugugugugugugugug

SEQ ID NO: 79568 - RNA, 84 nt, Mus musculus
acucacuugaaaguaugggaguccguaccaccaaagcugaagaugaaaaugagaaggaaagagagcugcagcuggagucucuac

SEQ ID NO: 79569 - RNA, 41 nt, Mus musculus
ucaguguuuuguuuuguuuuaauaaagugggcaucauaagg

SEQ ID NO: 79570 - RNA, 45 nt, Mus musculus
guugcaaucagcugugcagcugauguuuugaaagccaccaaagaa

SEQ ID NO: 79571 - RNA, 46 nt, Mus musculus
ugauggccaacuaggccaucuuuugauacauaugcagcuaguccca

SEQ ID NO: 79572 - RNA, 83 nt, Mus musculus
gccuggagcuucuuguagacuaggaaucggauuuuacgugacuuggauuauuuuugcagcuagguuuucuagcuaguggagga

SEQ ID NO: 79573 - RNA, 47 nt, Mus musculus
uccugagugcauugaugcaaggccuggcuggaagaacaugggcagga

SEQ ID NO: 79574 - RNA, 49 nt, Mus musculus
gcccuuagcauuucuaggcaugcaugaaauugcugaugaggagaaaucu

SEQ ID NO: 79575 - RNA, 46 nt, Mus musculus
gucuugugcuuugacaauucaugcaauuggaagauacagcccagau

SEQ ID NO: 79576 - RNA, 41 nt, Mus musculus
guagguaaacuuaugagugcuuugcuuaguggucugacaga

SEQ ID NO: 79577 - RNA, 46 nt, Mus musculus
guuugagaaucuuaaaaaggucagauacucccuucaucugcuuauu

SEQ ID NO: 79578 - RNA, 51 nt, Mus musculus
cuugauguuucggugcuaggugaacuaguuccuaggcuaugugagcugauc

SEQ ID NO: 79579 - RNA, 41 nt, Mus musculus
gaaggaaggaaggaaggaaggaaggaaggaacagggggagg

SEQ ID NO: 79580 - RNA, 46 nt, Mus musculus
ugacuguuacaguuaauagcuauauuuuuacaugguuaaaauagau

SEQ ID NO: 79581 - RNA, 46 nt, Mus musculus
auugucuuagggugagagguuaggacuagaaauauagguaggaguc

SEQ ID NO: 79582 - RNA, 46 nt, Mus musculus
auucuucaagauuugauuaaaaaccuuaccagcaacauguggagag

SEQ ID NO: 79583 - RNA, 42 nt, Mus musculus
cugggugggugggugagcacccucauagaaucaggggcagag

SEQ ID NO: 79584 - RNA, 46 nt, Mus musculus
agaaaaugaucuaaaugugaagauguaaaaucagaagggauaagau

SEQ ID NO: 79585 - RNA, 45 nt, Mus musculus
gguucuugagcauaugguaacagauccaaagauuucaaacuaaga

SEQ ID NO: 79586 - RNA, 47 nt, Mus musculus
aauaggaacuaacucuguggcugcccgagaugccuggcuggugacug

SEQ ID NO: 79587 - RNA, 46 nt, Mus musculus
agagagaagaaagagaucaagacagauuucugaucaaggcccagug

SEQ ID NO: 79588 - RNA, 46 nt, Mus musculus
uguuuugcuuauuaucagauuuuagacguuuguuauugggagguua

SEQ ID NO: 79589 - RNA, 42 nt, Mus musculus
ugcucuuaugugaguuaaagagacaggaacugugcugcagau

SEQ ID NO: 79590 - RNA, 42 nt, Mus musculus
ccuagcaauuauaguauuuacacuaagaggaaaccacuaggc

SEQ ID NO: 79591 - RNA, 46 nt, Mus musculus
uuucggauuguuaaucuugauuuuguugaccuuuccccaccccacc

SEQ ID NO: 79592 - RNA, 46 nt, Mus musculus
aaauuugccagcacgguguuucccucagaucauauaccuuccagau

SEQ ID NO: 79593 - RNA, 46 nt, Mus musculus
aggugguauaugauggacuuuuugguacaaauacaaacucaaaguu

SEQ ID NO: 79594 - RNA, 42 nt, Mus musculus
uggaccucaguaugaccuucgauggcagcaugggccguagau

SEQ ID NO: 79595 - RNA, 46 nt, Mus musculus
guagcauucacagcagaauuccuuugaugauguacuuaagccagau

SEQ ID NO: 79596 - RNA, 45 nt, Mus musculus
cagaggaaaagugguuugaacaaauagcuuuaauuaccgggaaaa

SEQ ID NO: 79597 - RNA, 46 nt, Mus musculus
ugccucccuuggcuugcucacauugcuuucuuauagaacccaagau

SEQ ID NO: 79598 - RNA, 46 nt, Mus musculus
agaucaaagcaaaaccauaccauauacuuaacggaggaagaagaga

SEQ ID NO: 79599 - RNA, 45 nt, Mus musculus
uuaaaagaaaggaaagaaaagaaacccccugcccugcccccaaaa

SEQ ID NO: 79600 - RNA, 46 nt, Mus musculus
cggcugaaucaucaaagucagcuucuccuuuuaaucuugcugagaa

SEQ ID NO: 79601 - RNA, 46 nt, Mus musculus
ucaaauguugaguuuuuccuuuuucuuuuuuuaugucauaccacgu

SEQ ID NO: 79602 - RNA, 46 nt, Mus musculus
guaaaaucugaaaaauucugaguuauaucacucuaaagggcuaaga

SEQ ID NO: 79603 - RNA, 46 nt, Mus musculus
ucuuuaaauacuuuugaguugauauuggauaguauuuucuguagau

SEQ ID NO: 79604 - RNA, 46 nt, Mus musculus
ccagaaauuuaucuucuuucauguuuggugugaugaaguaggaguu

SEQ ID NO: 79605 - RNA, 46 nt, Mus musculus
auacucuucucauagcuauuauauaagcuaugaaauacugccaguu

SEQ ID NO: 79606 - RNA, 45 nt, Mus musculus
agccaaguuucacuggagguggcccuccgagcugagugcugagca

SEQ ID NO: 79607 - RNA, 45 nt, Mus musculus
gcuuaugaguuggaccucaaguggcuuggauuuagauaaguguag

SEQ ID NO: 79608 - RNA, 44 nt, Mus musculus
ggcaugaguauguaguaggguagagucuuaucaaauuggucuag

SEQ ID NO: 79609 - RNA, 46 nt, Mus musculus
agaaguugaugaggacucuuguuaaaucaucugguccagcuaucaa

SEQ ID NO: 79610 - RNA, 45 nt, Mus musculus
cuuaucuuuuucccugugguguguagaggaauaaaaauugggagg

SEQ ID NO: 79611 - RNA, 57 nt, Mus musculus
aaauuugauucuaaagcuuugaagagguggggacgaugggaucauaggaauggaugg

SEQ ID NO: 79612 - RNA, 45 nt, Mus musculus
uuauaagaggggauuacaauaaaacagcuuauaggauucuaagaa

SEQ ID NO: 79613 - RNA, 80 nt, Mus musculus
guuagggacgauucuaagacucuaacuggagacuguaggauagagaaauagggcagaaaguaguuuuuaggcagacuuag

SEQ ID NO: 79614 - RNA, 119 nt, Mus musculus
agaaauguagagucugacuugagacagugaaaauggauuuggcacgaagauaauuuuaauugaaguccuaaaguauguagaaaugauuggguuguuauuauauaugugaggguuauuaa

SEQ ID NO: 79615 - RNA, 72 nt, Mus musculus
auggugaaauaauuaauugcaagcacccacagaucuagagcacaagauuuacaaggaggggaucaaaugggu

SEQ ID NO: 79616 - RNA, 50 nt, Mus musculus
agaguuugaacuuaguucuguagacaguagagaacuaacagaguuucgaa

SEQ ID NO: 79617 - RNA, 46 nt, Mus musculus
uaaaucauaugagaguaaugaagauguguuuacuguggcuguguga

SEQ ID NO: 79618 - RNA, 42 nt, Mus musculus
cuaggcucuaagggauaguagcuuaaauugaaacguggagaa

SEQ ID NO: 79619 - RNA, 41 nt, Mus musculus
gcucauauuugcaauuggagugaaauucaauagagggcaga

SEQ ID NO: 79620 - RNA, 87 nt, Mus musculus
ggaagcugaaguacgcguuugguuuggcucugggaagaaaggagacucugaggagagcaagaagagggaggucuccgguacggagag

SEQ ID NO: 79621 - RNA, 81 nt, Mus musculus
gcuguuaauggcagaaaaacaaaacaaaacaaaaaacaaaacgagggugacggagcugucagaaaggagagagucccacuc

SEQ ID NO: 79622 - RNA, 59 nt, Mus musculus
gguugccuuucccgcaccuccaaggaaucggcagaaaggucacagaugggagaugacuu

SEQ ID NO: 79623 - RNA, 44 nt, Mus musculus
cguguuccuccagcuccgaccaggcggacgugacagccgcagac

SEQ ID NO: 79624 - RNA, 45 nt, Mus musculus
aggcucagagcacuauacaaaucuagucaguuucaaguccccagg

SEQ ID NO: 79625 - RNA, 42 nt, Mus musculus
uggguacuaacagaggugguggcgacagcagcagcagcagca

SEQ ID NO: 79626 - RNA, 23 nt, Mus musculus
aggagcaaacaccugaagggcaa

SEQ ID NO: 79627 - RNA, 46 nt, Mus musculus
acaaaucucacuagaaggguaaacuaaauaguuauaggagguagau

SEQ ID NO: 79628 - RNA, 46 nt, Mus musculus
uauguuuaaguguguacuguguaagugucuggugccuguagcgguc

SEQ ID NO: 79629 - RNA, 46 nt, Mus musculus
aaaacaguguguguguguguguguguguguguguguguguagaaaa

SEQ ID NO: 79630 - RNA, 45 nt, Mus musculus
accuuaacauuuauuuuaugcgucugaguguuuugccugccugug

SEQ ID NO: 79631 - RNA, 46 nt, Mus musculus
agccuguuucucuaagaaagauaaagaugcuaucaaacauagagga

SEQ ID NO: 79632 - RNA, 42 nt, Mus musculus
cagaaaacagacaagagaaaaagugauauagaaaagcaagau

SEQ ID NO: 79633 - RNA, 46 nt, Mus musculus
cuccuuagguagguggagaguuuucaaacgcuguuauacuccagau

SEQ ID NO: 79634 - RNA, 45 nt, Mus musculus
agugugucuagugaaagcugacucuaaagaucccauggagguaga

SEQ ID NO: 79635 - RNA, 45 nt, Mus musculus
uguccuggguggguuuuguuugucagaauguagaugugaggcaaa

SEQ ID NO: 79636 - RNA, 42 nt, Mus musculus
agccaaaaaacugaaggagggcgacaggaugaugggcgagca

SEQ ID NO: 79637 - RNA, 45 nt, Mus musculus
ccacugggcuacauucacagcccacagauuucuugaccggaaggc

SEQ ID NO: 79638 - RNA, 42 nt, Mus musculus
gaucauagacuaacccucugaaacuguaagcaagcccccaau

SEQ ID NO: 79639 - RNA, 42 nt, Mus musculus
uuauuacucuuuuaagcuuguuuccagaaaaagcagccccag

SEQ ID NO: 79640 - RNA, 42 nt, Mus musculus
ucccugcaaccacaugguggcucacaaccaucuguaaggcga

SEQ ID NO: 79641 - RNA, 28 nt, Mus musculus
guaugagagagagagagugggggugagg

SEQ ID NO: 79642 - RNA, 46 nt, Mus musculus
ugcagauauaaucacuguuuguuuguaucauaucuuuaguguggaa

SEQ ID NO: 79643 - RNA, 46 nt, Mus musculus
ugagguccaggggcucuggacucuaggauaaaaaaauggcacccag

SEQ ID NO: 79644 - RNA, 45 nt, Mus musculus
guuuuuuguuuuuguauuaaaaauaaguacaauuaaugagacaag

SEQ ID NO: 79645 - RNA, 41 nt, Mus musculus
gugcaugaggagauugagggaaacccagagaaggggugggu

SEQ ID NO: 79646 - RNA, 46 nt, Mus musculus
ccccugugucuaacccagggcuaaucccuuguguuaugauuugcag

SEQ ID NO: 79647 - RNA, 39 nt, Mus musculus
uggcaucuguguuccauugaaugugagcgucacuuagag

SEQ ID NO: 79648 - RNA, 46 nt, Mus musculus
auuaugacuacaugcuggaucacccagaagaauacuauagccauua

SEQ ID NO: 79649 - RNA, 55 nt, Mus musculus
uagucuaccaguuguuuuucuauugcugugauaaaauaccagaacaaaaauaacu

SEQ ID NO: 79650 - RNA, 45 nt, Mus musculus
uauaguugugugagcuggaaaacaaacggagguguucugcaagga

SEQ ID NO: 79651 - RNA, 46 nt, Mus musculus
gagucuuuguuuuagaauaugguaagcauuccugucagacguguag

SEQ ID NO: 79652 - RNA, 46 nt, Mus musculus
gaauagcuacaauaaagcaaucagcuaccuagccacagugcccaag

SEQ ID NO: 79653 - RNA, 45 nt, Mus musculus
uguagguggaucuauaacuuuaacaucaaaggcaaagaguacggg

SEQ ID NO: 79654 - RNA, 45 nt, Mus musculus
cggaagucuaugaagaugucccagucucaguuugacagccuggag

SEQ ID NO: 79655 - RNA, 46 nt, Mus musculus
aagcaggaacaagaggaagaauuaaagaaaaaauuggcaaaugacc

SEQ ID NO: 79656 - RNA, 42 nt, Mus musculus
ucguuuccucucggcgacgcgucccgccgaggccggggagca

SEQ ID NO: 79657 - RNA, 42 nt, Mus musculus
guaacucugcucugcuucaaaaguucccugggguccccaggc

SEQ ID NO: 79658 - RNA, 41 nt, Mus musculus
ucugcacugugagaaauguugguuguuaaucaaaagggguc

SEQ ID NO: 79659 - RNA, 45 nt, Mus musculus
ucucuuuaaaauccuacugguucucagcacuuggagcugcagagg

SEQ ID NO: 79660 - RNA, 46 nt, Mus musculus
uuuuauuacugaaauaacucauggcaauuagaaauagaaaacccag

SEQ ID NO: 79661 - RNA, 46 nt, Mus musculus
ucaccagugaccacaaguccuguugugacuuuuaaagccaaccagu

SEQ ID NO: 79662 - RNA, 45 nt, Mus musculus
cuccuuccacgggaucagugagagauuucauuuaauuuugcuuua

SEQ ID NO: 79663 - RNA, 49 nt, Mus musculus
cccaaaagguguuuguguauguguuuugcuuuuaacaugagacauggaa

SEQ ID NO: 79664 - RNA, 46 nt, Mus musculus
uaugugggugcuagagguuaaauuuagguccacauugcuuguagug

SEQ ID NO: 79665 - RNA, 46 nt, Mus musculus
cuugaugguuuaaugcauuguaucagcauuaaauaaacaaacaaac

SEQ ID NO: 79666 - RNA, 45 nt, Mus musculus
uaggcucuaagcuaauaacuacuucuaagaaaacuccccagucag

SEQ ID NO: 79667 - RNA, 42 nt, Mus musculus
ggguggacaugggaggaucuuucuugugguuccaggccagcu

SEQ ID NO: 79668 - RNA, 46 nt, Mus musculus
gaagcuuagaaucaagucaaaugcuaaguauuugauaaaaggagau

SEQ ID NO: 79669 - RNA, 46 nt, Mus musculus
cacacaucccuuguuagcagaucaugagauagguuugcagagagau

SEQ ID NO: 79670 - RNA, 76 nt, Mus musculus
aucaucagcuguagacaccuaaggacauaagagugcucgggauuauaaagcuugagaauggccuguagggggagaa

SEQ ID NO: 79671 - RNA, 34 nt, Mus musculus
ugaaaauacucucauucuauaguccacucuagau

SEQ ID NO: 79672 - RNA, 58 nt, Mus musculus
gagucugcuguuacuagcauuuggugguauaacaagagcagagacggaaacugggaga

SEQ ID NO: 79673 - RNA, 47 nt, Mus musculus
uuugcucuugucugaccaaacaaugacugacaccagaggagaacagu

SEQ ID NO: 79674 - RNA, 62 nt, Mus musculus
uuuuaauggucugauguagcccuugcuggccucaaaaccuuacuaugcagcugaagauggcc

SEQ ID NO: 79675 - RNA, 46 nt, Mus musculus
uuagcuuauggugucuuagaauucauuucuuacuaguaguccaggu

SEQ ID NO: 79676 - RNA, 46 nt, Mus musculus
guaacaacuauuauacucuuuaaauuuucauuacaguugagcaacg

SEQ ID NO: 79677 - RNA, 81 nt, Mus musculus
aaaagauaacuuugguuuucacaugugguagcuuuuaauuguauucucagcacuugggagguggaggcaggaagaucaaaa

SEQ ID NO: 79678 - RNA, 62 nt, Mus musculus
uauugggagagccuagaagguaguuaagcacacuggguagauuugugagaauaguuaagaac

SEQ ID NO: 79679 - RNA, 102 nt, Mus musculus
aggcuugucccaggcaugcaugcucucugauuggcaguaguuucuaagggccaagguuaguugauuuuuguagguuuucuugugguuccccaagcucucucu

SEQ ID NO: 79680 - RNA, 46 nt, Mus musculus
aacagucagagacagcuccuccuccggcuguuaggagucccacaug

SEQ ID NO: 79681 - RNA, 46 nt, Mus musculus
auuguaaaguccugaucaguggccacugaauauaauugacccagaa

SEQ ID NO: 79682 - RNA, 45 nt, Mus musculus
cuuucaucuucaggauuguuugucauucaguuguuaccuguauaa

SEQ ID NO: 79683 - RNA, 46 nt, Mus musculus
agagugaguuggcagguagagaaggcuggaaggaggggcacgagag

SEQ ID NO: 79684 - RNA, 46 nt, Mus musculus
gcuacacagagaaacccugucucaaaaaaaaaaaaaaucugaggag

SEQ ID NO: 79685 - RNA, 46 nt, Mus musculus
aguucaaaauaccuuacucaucaguuuacucuguguuacaguauag

SEQ ID NO: 79686 - RNA, 46 nt, Mus musculus
aagugggccggguaaacaaacguucuuagaaaccaguggccccaag

SEQ ID NO: 79687 - RNA, 41 nt, Mus musculus
gagcucuaggagagagaaaggagacaugaucguagaaccag

SEQ ID NO: 79688 - RNA, 47 nt, Mus musculus
aaaacagagaguaagagggagucaggaggauggagagagaugcacag

SEQ ID NO: 79689 - RNA, 45 nt, Mus musculus
uauuaugaggggauguggccuuacuggaauggguguggccuugcu

SEQ ID NO: 79690 - RNA, 46 nt, Mus musculus
cacuggaugauaccugguugucuuaauuacuguucuauugcuguua

SEQ ID NO: 79691 - RNA, 45 nt, Mus musculus
uguaaauaggauuaaauaaaaaccacuauuguuaauaacagguca

SEQ ID NO: 79692 - RNA, 46 nt, Mus musculus
gaguugggaggaaugagggaucauuccuucuaagacauagccugag

SEQ ID NO: 79693 - RNA, 46 nt, Mus musculus
ccagguuugagaggcaauggcaggggugucacaacaggaucagcag

SEQ ID NO: 79694 - RNA, 46 nt, Mus musculus
aauauauaaaaauaaauguuuuuuaaaagaugaaauuaguccuuag

SEQ ID NO: 79695 - RNA, 46 nt, Mus musculus
uccuaguguccacacguggcucacaagcacccuaacucugcuccag

SEQ ID NO: 79696 - RNA, 42 nt, Mus musculus
cuauuucuuugagacagggucucauugguacaacucuggcag

SEQ ID NO: 79697 - RNA, 45 nt, Mus musculus
caaaucccagcaaccacaugguggcccacaaccauccauaaugaa

SEQ ID NO: 79698 - RNA, 49 nt, Mus musculus
guguuguuguaaccaaauaacugacagaagcaacuuaaggaagggaggg

SEQ ID NO: 79699 - RNA, 45 nt, Mus musculus
agagcagaccugguccuuuguaucaggguuuagagagcugaugag

SEQ ID NO: 79700 - RNA, 46 nt, Mus musculus
acuugggaaaggacccuguuucuaaaguccagauaagagaggucca

SEQ ID NO: 79701 - RNA, 45 nt, Mus musculus
gauacacuggaaucugggugguaggacuggagccuguagcaguag

SEQ ID NO: 79702 - RNA, 45 nt, Mus musculus
agggcagaccugguccuuuguaucaggguuuagagagcugaugag

SEQ ID NO: 79703 - RNA, 42 nt, Mus musculus
cccuaaaacugguguguguggugauugggugaauuucauuag

SEQ ID NO: 79704 - RNA, 50 nt, Mus musculus
caccuuguucuagggauuaaacauuuccuuuaucgccucuaaacuagcug

SEQ ID NO: 79705 - RNA, 110 nt, Mus musculus
ucugccccucugccucucugccucucugccccucugccucugccccucugccucucugccucucugccucucugccucugccucccaggcauugcagcuaagaucggaac

SEQ ID NO: 79706 - RNA, 44 nt, Mus musculus
aauuacgugacuaaaaccacacccagacugcaguggagcaguaa

SEQ ID NO: 79707 - RNA, 42 nt, Mus musculus
uauaccugaucuccuuuguguggaaaggugagagugggccaa

SEQ ID NO: 79708 - RNA, 42 nt, Mus musculus
gucggguacucuuacccauugagccaucacaccagccccauu

SEQ ID NO: 79709 - RNA, 47 nt, Mus musculus
aaaaagaaaaaaaaauuauaagaaaaaaagcaucuuuuguagucaga

SEQ ID NO: 79710 - RNA, 45 nt, Mus musculus
acugaauggaguuagagauuacugugaccugucauuuggaugcua

SEQ ID NO: 79711 - RNA, 46 nt, Mus musculus
gguaauucugauccaaguagucuuuggacuuugagaagcacccgag

SEQ ID NO: 79712 - RNA, 29 nt, Mus musculus
cuuaaguccuuuaacugauacuuuuuaac

SEQ ID NO: 79713 - RNA, 42 nt, Mus musculus
cuauucaugcuuguucagucugaacagcuuaauaagguggag

SEQ ID NO: 79714 - RNA, 36 nt, Mus musculus
gaauuacuguccugcugaauauauauuccuagccaa

SEQ ID NO: 79715 - RNA, 46 nt, Mus musculus
aagauggggagauugauuuucauaaagccaucaagacauuuugaag

SEQ ID NO: 79716 - RNA, 46 nt, Mus musculus
cacuuaaucugugucuuagaggaguaacugcagauuaaggaacgag

SEQ ID NO: 79717 - RNA, 46 nt, Mus musculus
aaugugaaucuauuguuuuccgguuugguaaucaauacaccuggag

SEQ ID NO: 79718 - RNA, 46 nt, Mus musculus
cuaaguuacugauccuaggccuaagacuauauaauuaaaaugccag

SEQ ID NO: 79719 - RNA, 45 nt, Mus musculus
aagugcugggauuaaaggugugugacaccauugcuaagcuccaga

SEQ ID NO: 79720 - RNA, 79 nt, Mus musculus
aauccuuuucuuguuuguuaaauuauugauccuaggccuaagacuauaagcauacucaaauaucacaguauaacccaag

SEQ ID NO: 79721 - RNA, 45 nt, Mus musculus
auuagguaccaaacuuauuuuggaaauaaccuaguuugcuuuugg

SEQ ID NO: 79722 - RNA, 46 nt, Mus musculus
ugccauugauaucagacuccacauauggccuuauuaauugcuguag

SEQ ID NO: 79723 - RNA, 46 nt, Mus musculus
cuccugucuauacauacacaccuacugaauagaagccuagcugaca

SEQ ID NO: 79724 - RNA, 46 nt, Mus musculus
acuucuccagguuuugauuuguuuuguuuuguuuuauuugcggggg

SEQ ID NO: 79725 - RNA, 45 nt, Mus musculus
uguaacaggauugauggcacuuagggacaucucauccaaccggga

SEQ ID NO: 79726 - RNA, 41 nt, Mus musculus
cucaaaaccacccguaaugagaucugaugcccucuucuggu

SEQ ID NO: 79727 - RNA, 46 nt, Mus musculus
uuuugguuuuuuuuuuuuuauagaauagaguuuauuaagggcauag

SEQ ID NO: 79728 - RNA, 46 nt, Mus musculus
agguaaggaccacaaggagagaagaagagaggaaaggagaagguaa

SEQ ID NO: 79729 - RNA, 45 nt, Mus musculus
gagugaaaugcccgaggacaggcugauggagcagaaauaagccag

SEQ ID NO: 79730 - RNA, 42 nt, Mus musculus
acauaacuguaaagggaucauuuccuguugucucaggccacu

SEQ ID NO: 79731 - RNA, 59 nt, Mus musculus
agcucuaagcgggucgguuuccgucgcagcauagugaagucacccaggacuucagggga

SEQ ID NO: 79732 - RNA, 46 nt, Mus musculus
caucacacuuagcacagguuccuuuacccacuaaaccgucccacau

SEQ ID NO: 79733 - RNA, 46 nt, Mus musculus
uacaguguacuuacauauaauaaauaaauaaaucuuugggcuggag

SEQ ID NO: 79734 - RNA, 44 nt, Mus musculus
gcuaguguacuuacauauaauaaauaauuuaaaaaaaaaaaaaa

SEQ ID NO: 79735 - RNA, 43 nt, Mus musculus
uuauucuaucagauacuacuuucuaccagauccuuacguagag

SEQ ID NO: 79736 - RNA, 45 nt, Mus musculus
uccaagauagaccuagcagaccccugggcuguaaaaugagcaaga

SEQ ID NO: 79737 - RNA, 44 nt, Mus musculus
uguuccuuguccuggaacacagagugcucaccccaugccccaaa

SEQ ID NO: 79738 - RNA, 46 nt, Mus musculus
cugggucacagacucaagucugaugcuacacagcugcccaccgccc

SEQ ID NO: 79739 - RNA, 45 nt, Mus musculus
ugccaagaagggcauggucacccaagccucggaggaaagaacaag

SEQ ID NO: 79740 - RNA, 46 nt, Mus musculus
uaucagaggauaucuuucucauggauuaauucuuugcagccccaag

SEQ ID NO: 79741 - RNA, 46 nt, Mus musculus
ccucagaagcucagagcaaagccauauaauuacuauguuuggucag

SEQ ID NO: 79742 - RNA, 46 nt, Mus musculus
guucuguauuucuuuccucucagaucuuuauuuauucugccccuug

SEQ ID NO: 79743 - RNA, 45 nt, Mus musculus
aggccuuucucaugcaagggauuuuccuuaguauaaaacuugcag

SEQ ID NO: 79744 - RNA, 44 nt, Mus musculus
gugcuggccugaaaggcaugugccaccaugcucaccccccaagu

SEQ ID NO: 79745 - RNA, 46 nt, Mus musculus
guagcagguguauguguugggaauuaugugaggcuguuuggaggag

SEQ ID NO: 79746 - RNA, 53 nt, Mus musculus
gggguuagcuuacagccagcucacauuuuaauauuuucagggguugggaagag

SEQ ID NO: 79747 - RNA, 46 nt, Mus musculus
caaguuccaggacagccagaaaaauccugucucuggaaaccaggag

SEQ ID NO: 79748 - RNA, 45 nt, Mus musculus
uuuguaaggucugagaaacaugauuaaaaaaaaauuggggcuggg

SEQ ID NO: 79749 - RNA, 46 nt, Mus musculus
ggagugaacuuaaguaagugcuguguuuaaguguaggcuugcgaag

SEQ ID NO: 79750 - RNA, 46 nt, Mus musculus
ugaaaagagucaguacagcuuagagccacuagugcaguuuugagag

SEQ ID NO: 79751 - RNA, 93 nt, Mus musculus
cuaucacccuaguagcccacugugauucauaaagugauggacagagacagaucuuggugggggagaaaggacacagaggaacauguagaagca

SEQ ID NO: 79752 - RNA, 42 nt, Mus musculus
cauggcagcugcagcagugagguggaaaaggagacccgggag

SEQ ID NO: 79753 - RNA, 45 nt, Mus musculus
aucugcccccauagaauaggaaaaccuccacagagcuggaguucu

SEQ ID NO: 79754 - RNA, 42 nt, Mus musculus
uaaggaguguaugucgccuguuuuccugugucuucaugcaag

SEQ ID NO: 79755 - RNA, 46 nt, Mus musculus
ugaaggaagaaggggaguaaacuguucccuucuccuuucuuacagg

SEQ ID NO: 79756 - RNA, 41 nt, Mus musculus
uucuuauuccuuggaggccauguaggccaugagguccacca

SEQ ID NO: 79757 - RNA, 102 nt, Mus musculus
aacugaggacuuuaaaagagauuuucccuucccaaacgugucuggacaguaccugauuguauuuuuuuuguuuuguuuuguuuuuuaauaaaagcacaguac

SEQ ID NO: 79758 - RNA, 66 nt, Mus musculus
gaaguuaccccuugccccacccccacccucgauguuuuguacauuuccuacaacugaagccagaaa

SEQ ID NO: 79759 - RNA, 76 nt, Mus musculus
ccgagccagcuguguuuuacacaaagcuguacaauuguuauugguugaggucacaaagaugaaacuugugucauug

SEQ ID NO: 79760 - RNA, 104 nt, Mus musculus
caaguuucuacuuucuuguuugauugagcaaagucuccuagugacagcaacaccaugaauuuuacuucucuugggugguucugggaaugggagaggggcaagcu

SEQ ID NO: 79761 - RNA, 57 nt, Mus musculus
ccacacggaucacugaggcacugauguaggccccucugcaacgacuuccuuugcacc

SEQ ID NO: 79762 - RNA, 64 nt, Mus musculus
cuuccgaaaucuggaaggcaggcguaagcgggcauaaauuccagggauaauuuggugagagagg

SEQ ID NO: 79763 - RNA, 64 nt, Mus musculus
gguuccauuggaagggccaugaguacucaauccaguuugcugagaugaaacugagacccagcaa

SEQ ID NO: 79764 - RNA, 45 nt, Mus musculus
ucaggguauggggaggggaguuaaaaggguauuagaggcagagag

SEQ ID NO: 79765 - RNA, 66 nt, Mus musculus
gagcuuucugguauaagaacugucaucgugucaaccugaugggcagauauggggacaauaaccaca

SEQ ID NO: 79766 - RNA, 67 nt, Mus musculus
agauccuucuccaccuaugacaaggacacagacucagccaucaccaacugugcccuguccuacaaag

SEQ ID NO: 79767 - RNA, 57 nt, Mus musculus
auucaguguuggagaugccaagagucgcuacaagcugaagguagaaggauacagugg

SEQ ID NO: 79768 - RNA, 74 nt, Mus musculus
acagcccaagggcaguaugagcuccggguggaccuacaagaccauggggagucugccuaugcuguguacgacag

SEQ ID NO: 79769 - RNA, 66 nt, Mus musculus
gacgugaggacuucuaucgcaacuggaaggccuaugcugcuggguuuggagaccgcagagaagaau

SEQ ID NO: 79770 - RNA, 104 nt, Mus musculus
cucucaagcaauguugaauggugauacuaccucuggccucuacaccaucuauauaaauggugacaagacucaagcacuggaagucuacugugauaugaccucug

SEQ ID NO: 79771 - RNA, 67 nt, Mus musculus
auccacccacuacucagcaaggauccaggcauugagugggucccugaggagcaagcugauccaaacc

SEQ ID NO: 79772 - RNA, 55 nt, Mus musculus
aggaagucauuguggggccugacaccaccuccuacagccuggcagaccugagccc

SEQ ID NO: 79773 - RNA, 62 nt, Mus musculus
ccccgagcaucggucacuggauaccuccuggucuaugaaucuguggaugguacagucaaggu

SEQ ID NO: 79774 - RNA, 57 nt, Mus musculus
agagaauuuacagcuacagagguucagucagaaacugcccuccuuaccuggagaccu

SEQ ID NO: 79775 - RNA, 47 nt, Mus musculus
ggagccugccacagaguacauccugaguaucuuugcagagaaaggac

SEQ ID NO: 79776 - RNA, 47 nt, Mus musculus
gccauugccacuguggacaguuaugucaucuccuacacaggggagag

SEQ ID NO: 79777 - RNA, 67 nt, Mus musculus
gauggaacagauacugagaccaggcuggugaagcuuaccccggguguagaguaccgcgucaguguga

SEQ ID NO: 79778 - RNA, 111 nt, Mus musculus
gaaggaaaucauguucucagacaucacugaaaaugcagccacagucagcuggagggcaccuacugcucagguggagaguuuccggaucacuuauguaccuaugacaggagg

SEQ ID NO: 79779 - RNA, 46 nt, Mus musculus
cuguaggagcagauguguuagaugagagaaaaagacagaaaugggu

SEQ ID NO: 79780 - RNA, 45 nt, Mus musculus
acucuugcaugugugugugugugugugugugugugugugugugug

SEQ ID NO: 79781 - RNA, 70 nt, Mus musculus
cucagagaggccacugaguacgaaauugaacucuauggaauaagccgcggaaggcgaucccagccaguca

SEQ ID NO: 79782 - RNA, 86 nt, Mus musculus
uuuguuaucaggaucagagauaccaaaaagcaaucugagccacaagaaauaucccucccuucccccgaacguaccagggacauaac

SEQ ID NO: 79783 - RNA, 45 nt, Mus musculus
uucacugcuuuaauagcauggaguuaacagaggccagcuaucaaa

SEQ ID NO: 79784 - RNA, 46 nt, Mus musculus
aaaaggcaugccagcgcuaugacuguaagcuguuucugagccagau

SEQ ID NO: 79785 - RNA, 46 nt, Mus musculus
uauguaaucuuauugcugucauagacagcucuccucuuagccacau

SEQ ID NO: 79786 - RNA, 79 nt, Mus musculus
guacugauuucauugucuaccucucuggaauugcucccagcauccguaccaaaaccaucaguaccacggcuaccacagg

SEQ ID NO: 79787 - RNA, 32 nt, Mus musculus
gcuucaaucucuccuggacagcuaccgacggg

SEQ ID NO: 79788 - RNA, 46 nt, Mus musculus
uagagucuccaucuacggggucauccagggcuauagaacaccgaug

SEQ ID NO: 79789 - RNA, 45 nt, Mus musculus
gacugaggucagcugggacggccucacacucaacuggaccacaga

SEQ ID NO: 79790 - RNA, 46 nt, Mus musculus
aaguaaacuuguccauugcugugauguacacacauaccagauauaa

SEQ ID NO: 79791 - RNA, 45 nt, Mus musculus
augguaaaauuuguggugauaaaguuuugaugcuguaccccucuc

SEQ ID NO: 79792 - RNA, 46 nt, Mus musculus
caugggaagacaaagcacaggaaguggguauuuuuuuggugcagga

SEQ ID NO: 79793 - RNA, 57 nt, Mus musculus
uacaucacccuucgaggggucacccaggacuucggcacggccccucucucuguugag

SEQ ID NO: 79794 - RNA, 45 nt, Mus musculus
gcuccagaaggagccuauaagaacuuuuucauucaggugcuagag

SEQ ID NO: 79795 - RNA, 46 nt, Mus musculus
uugucauucagguacaggaagccaacaauguggagacugcucacaa

SEQ ID NO: 79796 - RNA, 34 nt, Mus musculus
ggggagagugcaguguccuucccagcagggggaa

SEQ ID NO: 79797 - RNA, 31 nt, Mus musculus
gggggacauucgggacaaagagaaugagaaa

SEQ ID NO: 79798 - RNA, 46 nt, Mus musculus
guauucuagaaauuucccauuucuccccuuuaaucuaaugacagcu

SEQ ID NO: 79799 - RNA, 44 nt, Mus musculus
ugcugagaagggcagacacaagagcaagccugcacgugugaagg

SEQ ID NO: 79800 - RNA, 121 nt, Mus musculus
gacaccccuggccaaguuugaucguuaccgccucaacuacagccuccccacaggccagucgauggaaguccagcugccaaaggaugccaccucccauguccugacagaccuggagccaggg

SEQ ID NO: 79801 - RNA, 62 nt, Mus musculus
gaugcacccaaggacuuacgggugucugaaaccacacaagacagucugacguuuuucuggac

SEQ ID NO: 79802 - RNA, 81 nt, Mus musculus
ccggaacugaauaugggauugguguuucugcugucaagggagacaaggagagugauccagcaaccaucaaugcggccacag

SEQ ID NO: 79803 - RNA, 56 nt, Mus musculus
aggugaccaugcugagauagauguuccaaagagccagcaagccacaaccaaaacca

SEQ ID NO: 79804 - RNA, 54 nt, Mus musculus
gacagacaacagcaucaccuuggaguggaggaacgucaaggcagacaucgacag

SEQ ID NO: 79805 - RNA, 62 nt, Mus musculus
cugacacggaguaugaggugucccucaucucccgcagaguggacauggcaagcaacccugcc

SEQ ID NO: 79806 - RNA, 61 nt, Mus musculus
uccuauggcaucaaggauguaccuggagaccguaccaccaucgaccucacacacgaagaca

SEQ ID NO: 79807 - RNA, 58 nt, Mus musculus
ccccagccauauugaggugaaagaugucacagacaccacagcacugaucaccugguuc

SEQ ID NO: 79808 - RNA, 46 nt, Mus musculus
auacccuuagcaguguaaguggguuuguggcugacagcucugagaa

SEQ ID NO: 79809 - RNA, 46 nt, Mus musculus
aaauaucucugcacauugugaaaaacaacacccgaggccccggcuu

SEQ ID NO: 79810 - RNA, 46 nt, Mus musculus
agaucacaaaaagucugaggagaccagagaccuccuaccgccaaac

SEQ ID NO: 79811 - RNA, 45 nt, Mus musculus
aaguagagugggauccucuagacauugcuuucgaaacaugggaga

SEQ ID NO: 79812 - RNA, 46 nt, Mus musculus
augcugauggccuagagaugcaguuccgugugccuggggaccagac

SEQ ID NO: 79813 - RNA, 44 nt, Mus musculus
uccccucccaaagaccuuauugugacagaaguaacagaggagac

SEQ ID NO: 79814 - RNA, 43 nt, Mus musculus
cuggacugugggcagcgcuccugucccaaugacugcagcaacc

SEQ ID NO: 79815 - RNA, 46 nt, Mus musculus
caaugcaucugccacgagggcuucacuggcaaagacugcaaagagc

SEQ ID NO: 79816 - RNA, 80 nt, Mus musculus
guguaucugugaugacgacuacacuggggaagacugcagagaccggcgcuguccccgggacuguagccagcgggggcgcu

SEQ ID NO: 79817 - RNA, 95 nt, Mus musculus
aagugcauaugugaacaaggcuucaagggcuuugacuguagugagaugagcugucccaaugacugccaccaacauggccgcugugugaauggcau

SEQ ID NO: 79818 - RNA, 53 nt, Mus musculus
cccaauggcugcagugggcauggccguugugucaacgggcagugcguguguga

SEQ ID NO: 79819 - RNA, 48 nt, Mus musculus
cggugagcucaccugccccaacgacugucagggccguggccaguguga

SEQ ID NO: 79820 - RNA, 47 nt, Mus musculus
agccccuuugccucaacaacugcuacaaucgugggcgguguguggag

SEQ ID NO: 79821 - RNA, 51 nt, Mus musculus
cuguggccuggaagucugcccagugcccugcagcgaggaacacgggaugug

SEQ ID NO: 79822 - RNA, 64 nt, Mus musculus
uaaucucagaggccagugccuugacggccaguguaucugugacgaggguuucacuggggaagac

SEQ ID NO: 79823 - RNA, 66 nt, Mus musculus
cuucugcagcggacggggcaacuucagugcagaaggcugcggcugugucugugaaccaggcuggaa

SEQ ID NO: 79824 - RNA, 53 nt, Mus musculus
cugagcaggcuggaggagcuggaguugcugguaucgucucuaagggagcagug

SEQ ID NO: 79825 - RNA, 71 nt, Mus musculus
cgccagaguccagugggagcuuccaggaacauacaguggauggggaaaaccaaauuguauucacacaccgc

SEQ ID NO: 79826 - RNA, 51 nt, Mus musculus
acucccgaaggugggguccucaagaaaaucaucaggcacaagcgagagagu

SEQ ID NO: 79827 - RNA, 58 nt, Mus musculus
uacaucuaaauaccaaacucuacugggaguucaggcacccuacagaucuagagacacc

SEQ ID NO: 79828 - RNA, 46 nt, Mus musculus
gcaccuacaugguagcucacauccaucuauaacuugaguucuagau

SEQ ID NO: 79829 - RNA, 42 nt, Mus musculus
ccaguagcagcucucggccucagaaaagucuuggccaaaguu

SEQ ID NO: 79830 - RNA, 41 nt, Mus musculus
acuuucucaugucuguuguuggcauccuuaguuagcucaga

SEQ ID NO: 79831 - RNA, 46 nt, Mus musculus
uucuccaaacaugauuaacuaggaaauaacucuuugcucagcauua

SEQ ID NO: 79832 - RNA, 46 nt, Mus musculus
agaggaucaaggguuuguccggugccaguacuuacugccccuugug

SEQ ID NO: 79833 - RNA, 41 nt, Mus musculus
ucucagguacuuauggugaggcuucuuauugggggugggga

SEQ ID NO: 79834 - RNA, 46 nt, Mus musculus
gauucaaaaagaaauccagagguaauucaggagaugccauggagag

SEQ ID NO: 79835 - RNA, 46 nt, Mus musculus
agacaguuaagguaaccguugcugaguuaaaaaguggaagagaauc

SEQ ID NO: 79836 - RNA, 45 nt, Mus musculus
cagagugagcagaaagagagaaaaaucacacacacacacacgaga

SEQ ID NO: 79837 - RNA, 45 nt, Mus musculus
uucucacaagagucagaacuggcugcaaacccaaacuuucuaagu

SEQ ID NO: 79838 - RNA, 46 nt, Mus musculus
cuaugguagucagacacugacauaaaauagcuaauagucagggaug

SEQ ID NO: 79839 - RNA, 46 nt, Mus musculus
agcacgagagagagagagagagagagagagagagagacagagacag

SEQ ID NO: 79840 - RNA, 45 nt, Mus musculus
aguucuccuguccuaugaaccaaggcuuucgaagggcauggggga

SEQ ID NO: 79841 - RNA, 42 nt, Mus musculus
ggcuuaacccagguacuucuucacggagcuggugcacccaga

SEQ ID NO: 79842 - RNA, 42 nt, Mus musculus
uuuccuuaggauagaaaacuacaaacaagccuugcccagugg

SEQ ID NO: 79843 - RNA, 46 nt, Mus musculus
uucaaacauuguuccaaucuaagguauggauucaucaagcugagcu

SEQ ID NO: 79844 - RNA, 45 nt, Mus musculus
uaaauuuaucugguaaauuaauuaaagcuaaagacugacagagga

SEQ ID NO: 79845 - RNA, 45 nt, Mus musculus
ccauggaugucugaccuuuucugaaaagaaauagagaaggcagau

SEQ ID NO: 79846 - RNA, 45 nt, Mus musculus
uuuagaggucagguggggugggaaguggggacauccacgugaaga

SEQ ID NO: 79847 - RNA, 45 nt, Mus musculus
gacccagggaaaggggaaguggaaaaggggguacccucucagaag

SEQ ID NO: 79848 - RNA, 42 nt, Mus musculus
cugaagagaaauggaggaggaguggauggggguagggaagag

SEQ ID NO: 79849 - RNA, 44 nt, Mus musculus
uaaugugggggccaugcggagagacggggugcagcaugugggag

SEQ ID NO: 79850 - RNA, 45 nt, Mus musculus
ggugaguucccgagggaaucaguacccaguuagaaaaucgcagca

SEQ ID NO: 79851 - RNA, 46 nt, Mus musculus
ggcagacuuguuuaacaagcuggucugcagugccagcuccaggaag

SEQ ID NO: 79852 - RNA, 24 nt, Mus musculus
uagcaggaaccuucacuggaagag

SEQ ID NO: 79853 - RNA, 83 nt, Mus musculus
ggucaaggaggcagcugaggagcggcggagggacuucggggagaaguugacucgucuaagggaacuuacuggagagcugcaga

SEQ ID NO: 79854 - RNA, 45 nt, Mus musculus
gaaguucuucacaggcuccuuggcugagguugagaaguccaacag

SEQ ID NO: 79855 - RNA, 29 nt, Mus musculus
cugccucagccucgguaaccuuuagagag

SEQ ID NO: 79856 - RNA, 46 nt, Mus musculus
cuucuccaucgguucuguuggccccgaugggcagcugggccggcaa

SEQ ID NO: 79857 - RNA, 41 nt, Mus musculus
gagguauggggaucccccucuugcgugcgugugugccggcc

SEQ ID NO: 79858 - RNA, 46 nt, Mus musculus; identical to SEQ ID NO: 34514

SEQ ID NO: 79859 - RNA, 89 nt, Mus musculus
augcuuugguuuuacaccuggcagagugagaaacaagugagauucucugguuuugguugucuagguagaaguggacgacgguguuugua

SEQ ID NO: 79860 - RNA, 41 nt, Mus musculus
aagcaguccucagcguagguuccuuugugugugcacggcaa

SEQ ID NO: 79861 - RNA, 45 nt, Mus musculus
cccucaaagccacucaggccaagcaggcacuuuuggcaaagagag

SEQ ID NO: 79862 - RNA, 42 nt, Mus musculus
uggcggcagcaacgugacaaggugcguguccagcggcuggag

SEQ ID NO: 79863 - RNA, 46 nt, Mus musculus
gagugaguuuauugguaaagagcaccaucaugaaacuuggucugaa

SEQ ID NO: 79864 - RNA, 71 nt, Mus musculus
agacagucccucugacggacaacacggugaucgaggagcaccuggggagauuuggugucauuggccuggaa

SEQ ID NO: 79865 - RNA, 70 nt, Mus musculus
uuccugugcccuuuccuccucucuguggcccgccaugcuaccaggaacagagugggcuuccgcaaagaga

SEQ ID NO: 79866 - RNA, 46 nt, Mus musculus
ucggcagcucaacuagagcaggagcagguuuuccaaaaguaccccu

SEQ ID NO: 79867 - RNA, 42 nt, Mus musculus
gagaaggagaaggagaaggagaaggagaaggagaaggcuggu

SEQ ID NO: 79868 - RNA, 46 nt, Mus musculus
aucucacggucuggaucuaccuauacgguccuacaucggcuucuag

SEQ ID NO: 79869 - RNA, 42 nt, Mus musculus
ucuggauuuccuccagggaaagguccuucuucuuuggggggg

SEQ ID NO: 79870 - RNA, 46 nt, Mus musculus
agacuggcuguauacucuacacaauccacuggcaaggaaagcccug

SEQ ID NO: 79871 - RNA, 46 nt, Mus musculus
uacuauugauccuucaguuucaaaagaauuggcaaaagaaguugag

SEQ ID NO: 79872 - RNA, 47 nt, Mus musculus; identical to SEQ ID NO: 59108

SEQ ID NO: 79873 - RNA, 56 nt, Mus musculus
ugcaaaaugugcuggaacuucucagggaucacuagagacauggcggcggcacagac

SEQ ID NO: 79874 - RNA, 42 nt, Mus musculus
gaaaaugaaauauucuuacgcagaguugagcaugggcugagu

SEQ ID NO: 79875 - RNA, 45 nt, Mus musculus
caagauguggugaggcaagcaagacccaugaaggacauguaauac

SEQ ID NO: 79876 - RNA, 46 nt, Mus musculus
cacagaugaaaggauguuuugcuaaaucaagcaugugggacaugug

SEQ ID NO: 79877 - RNA, 46 nt, Mus musculus
cuccuugacuugcagcaagacaaccagcuacauagugauggaauau

SEQ ID NO: 79878 - RNA, 46 nt, Mus musculus
uuguaaauauauuugguuuauuacaguaaaaccuuuaguaccagua

SEQ ID NO: 79879 - RNA, 42 nt, Mus musculus
gucucuucaaugggacacauuaaauauucucugccugcuguu

SEQ ID NO: 79880 - RNA, 47 nt, Mus musculus
ugguuugugaguacuggaaaagacaaccuccuaaaugccuggcggac

SEQ ID NO: 79881 - RNA, 42 nt, Mus musculus
uggggggaaaaaauguguugcuccaugcagcugggugcaaua

SEQ ID NO: 79882 - RNA, 41 nt, Mus musculus
aguggcuugcugugggcauggaaagcagcaacguggaaguu

SEQ ID NO: 79883 - RNA, 88 nt, Mus musculus
gagccagcuguauugacauuucuaaugauggcaccaagcucuggacaggcgguuuagacaacacugugagguccugggaccugagaga

SEQ ID NO: 79884 - RNA, 46 nt, Mus musculus
gagauggcagaugcggcugugucgagggacaacauaauguggacuu

SEQ ID NO: 79885 - RNA, 49 nt, Mus musculus
auccucagccccugccuguuaugcucuggccaucagccccgacuccaag

SEQ ID NO: 79886 - RNA, 45 nt, Mus musculus
ugaugcccucauuggaccugggauuccccgacaugcucggcagau

SEQ ID NO: 79887 - RNA, 44 nt, Mus musculus
guugugugguuuaugaugcccauugugugcuagcucuagggagu

SEQ ID NO: 79888 - RNA, 46 nt, Mus musculus
uguuucucuuuuccuggaucccaggauacuugcacuugcccaccgg

SEQ ID NO: 79889 - RNA, 53 nt, Mus musculus
guuauaguugucccuccacgaacccccuuuucagaaaugacugcguuuaugag

SEQ ID NO: 79890 - RNA, 45 nt, Mus musculus
uguuuagaacuuaaaucaggcuuuuaaaguucuuuugguuguaua

SEQ ID NO: 79891 - RNA, 41 nt, Mus musculus
cuggguaggaagaacaaagaauaacaauuaugcaaauaagu

SEQ ID NO: 79892 - RNA, 47 nt, Mus musculus
ccuuuauuugugucuugagggaauaugaaggacaaguagcugucuag

SEQ ID NO: 79893 - RNA, 46 nt, Mus musculus
uguggaauccccaagggaagauagguuuggauguuuccaaggagac

SEQ ID NO: 79894 - RNA, 46 nt, Mus musculus
uucuaaucaaaauuaauuuuuuucuaggacagugauggggacaaga

SEQ ID NO: 79895 - RNA, 46 nt, Mus musculus
uuuacacuugguauggaaaguuuguaaaccaaauaaaucaagaggu

SEQ ID NO: 79896 - RNA, 47 nt, Mus musculus
uaaauccacuuaaguuguguuuaaguauuuguucuguuccagaguug

SEQ ID NO: 79897 - RNA, 46 nt, Mus musculus
cugccuguuaguugguuguuguuucuuaauuauuuugugugcagau

SEQ ID NO: 79898 - RNA, 45 nt, Mus musculus
uuguuguagguguuuaggaagaagauugcauuuugacaaguucag

SEQ ID NO: 79899 - RNA, 45 nt, Mus musculus
cauacccuuuuaugugcugaaugcuuacacugcaucuggcaaugu

SEQ ID NO: 79900 - RNA, 46 nt, Mus musculus
uggcuacaaacucacaggaauuucccugcuuauuaugccucuggag

SEQ ID NO: 79901 - RNA, 46 nt, Mus musculus
acuugauuacaaagaacauaguaggacuuauuuuucaugcauagau

SEQ ID NO: 79902 - RNA, 45 nt, Mus musculus
uuucaacuaaauuacucaaauauuuuuguuccuuuuuuuagagau

SEQ ID NO: 79903 - RNA, 47 nt, Mus musculus
uucuacuggccuucagccuuuaucuagcauacucauauuuaagggag

SEQ ID NO: 79904 - RNA, 47 nt, Mus musculus
uaguuaauauucauuuuaaauagaaucagaaaauaaaaauagguuau

SEQ ID NO: 79905 - RNA, 45 nt, Mus musculus
cucaagggcccuguucaacuuugugggacauguuuguuuucugau

SEQ ID NO: 79906 - RNA, 46 nt, Mus musculus
cguguuugauuagaagagacuaaucgcgauuauacuuggagcugga

SEQ ID NO: 79907 - RNA, 48 nt, Mus musculus
ugggcucucuaaucacauucaacaaagaacacaauuaugccugcauuu

SEQ ID NO: 79908 - RNA, 46 nt, Mus musculus
uuuuccuccgugaaccagggagcuucaguggauuuucagcuuagau

SEQ ID NO: 79909 - RNA, 97 nt, Mus musculus
auggaaccaguuaaucuaucaagguuuaaaauuacauccccacuggagaugggaaaaacacaagagccaaggaggauuaaagaaugagccccagcuu

SEQ ID NO: 79910 - RNA, 50 nt, Mus musculus
gucuuuauaguucccucagacacuuuguaaugauaauuagacaugcugcu

SEQ ID NO: 79911 - RNA, 45 nt, Mus musculus
agcugaaauggaggugggguccuuuauuuuauucauaggcaaguu

SEQ ID NO: 79912 - RNA, 46 nt, Mus musculus
gaaagagaaagugugugugugugugugugugugugugugugugugu

SEQ ID NO: 79913 - RNA, 46 nt, Mus musculus
uuaguuuguguguguguguguguguguguguguguguguaucaauc

SEQ ID NO: 79914 - RNA, 45 nt, Mus musculus
ugaaccccuccuuguuuuuagagaggcugaguauaaagaugagca

SEQ ID NO: 79915 - RNA, 46 nt, Mus musculus
uggcaacaguugggucaaaacauuuaaaucauuaauuagaaggagc

SEQ ID NO: 79916 - RNA, 46 nt, Mus musculus
uaagauguuuuauacuuaaggauuuaaaugccuuaaagauaaagua

SEQ ID NO: 79917 - RNA, 45 nt, Mus musculus
cuugacacgauguuguuugacauugauauacugugggggccuaaa

SEQ ID NO: 79918 - RNA, 46 nt, Mus musculus
uacaugaaggauaauuugacuauugcuuucucuaagggcaccuaga

SEQ ID NO: 79919 - RNA, 46 nt, Mus musculus
cucugugcaggaacaucuacgugaugucuggggaggaaauugauuu

SEQ ID NO: 79920 - RNA, 45 nt, Mus musculus
guuugaugugaagaaggggucuucauuuauauauuaggaguucua

SEQ ID NO: 79921 - RNA, 46 nt, Mus musculus
aguauaacuuaucggaggaugcuauguuugauuauccuuuagagga

SEQ ID NO: 79922 - RNA, 46 nt, Mus musculus
ugugugugcacaccaugugcauuugcaucuuaauuggcuccaagau

SEQ ID NO: 79923 - RNA, 46 nt, Mus musculus
auggcuuuuauuccucaugagccucugcugcccagugcccccaggu

SEQ ID NO: 79924 - RNA, 42 nt, Mus musculus
caacucucaguccugugauaugguuggucuuaauggggaagc

SEQ ID NO: 79925 - RNA, 46 nt, Mus musculus
aaggugcuucagccuuagugguuuuaaaagcaugaaaagauuagug

SEQ ID NO: 79926 - RNA, 45 nt, Mus musculus
agcaaacauguuuuugaaaaauuucucaguugaugcagauuugga

SEQ ID NO: 79927 - RNA, 31 nt, Mus musculus
acuuggacacacuguuuacugaacagggaca

SEQ ID NO: 79928 - RNA, 45 nt, Mus musculus
aaggcgauuuuuacuuuugucaagccugaggaaaaagaccaaaga

SEQ ID NO: 79929 - RNA, 42 nt, Mus musculus
caagcgcggggccggccgagccgcccgcaauguggcccugag

SEQ ID NO: 79930 - RNA, 47 nt, Mus musculus
caggagcuggucagcccuuugcuaagagccgaggaggggaaggcagg

SEQ ID NO: 79931 - RNA, 46 nt, Mus musculus
caagauagcacuuaaggauacuuccugaagucuucggugaucuuag

SEQ ID NO: 79932 - RNA, 46 nt, Mus musculus
guaaaaugaugguccugugugcucacuuuuguauaugccuggucag

SEQ ID NO: 79933 - RNA, 43 nt, Mus musculus
uuugcaccgcggagcgcccaggcccgugcugcccugcgaagac

SEQ ID NO: 79934 - RNA, 46 nt, Mus musculus
caucauggcuccccccaggaaccgcacaaagaaauggccucaagac

SEQ ID NO: 79935 - RNA, 42 nt, Mus musculus
uauacacacagacacaggcccaggcaaagggaguggggggga

SEQ ID NO: 79936 - RNA, 42 nt, Mus musculus
caacaaaugcucuuaaccucuguuccuugcuucuagccccuu

SEQ ID NO: 79937 - RNA, 42 nt, Mus musculus
cauggaggugguggagguggagaguccccuaaaucccagcug

SEQ ID NO: 79938 - RNA, 46 nt, Mus musculus
guaugacauguggagauguauauauugccacaacucaucuguugag

SEQ ID NO: 79939 - RNA, 56 nt, Mus musculus
uuucuuucuucaagugugaagugucugcuguguagcagugaugauggagggcaugc

SEQ ID NO: 79940 - RNA, 41 nt, Mus musculus
aaccaaccaaccaaccaaccaaacagauaauuagggugaaa

SEQ ID NO: 79941 - RNA, 45 nt, Mus musculus
gugaagacuuacagucuccagaaaucauguaaaaacugcggccaa

SEQ ID NO: 79942 - RNA, 32 nt, Mus musculus
acaugaggcagcuagauggucauauuacaucu

SEQ ID NO: 79943 - RNA, 88 nt, Mus musculus
cgaaauuauguguuuuaaaaaauaaugguaaauggugugcuuaaggucguaggagaguucaugaggucccaaagacuguaauuucauc

SEQ ID NO: 79944 - RNA, 46 nt, Mus musculus
uuaguaugcugucuaguggugagaugacuuguuaaguaacgagaag

SEQ ID NO: 79945 - RNA, 45 nt, Mus musculus
cugaaaguuguccucugaucuccacuugcaugccacuuccaucac

SEQ ID NO: 79946 - RNA, 45 nt, Mus musculus
aacaugccugccugccuuccuuccuuccucuuugacauggggucu

SEQ ID NO: 79947 - RNA, 45 nt, Mus musculus
cuggcccugaccuugcuauguagcuaagaacauuucuacugucua

SEQ ID NO: 79948 - RNA, 46 nt, Mus musculus
ugagcuuccugauguggguauuggguaccaauuucaagaccuuugg

SEQ ID NO: 79949 - RNA, 45 nt, Mus musculus
ugucuuaaagauuccuuuuuaacgguuuucugugugagcacguug

SEQ ID NO: 79950 - RNA, 83 nt, Mus musculus
gauguagacuggagguguugaguaccugcuguacagucaggagguccugaguucagauuucuaauacgcauguuaaaaaaaaa

SEQ ID NO: 79951 - RNA, 48 nt, Mus musculus
augcauuuauuaccaauaaauaugguaguuguugccacuugagcagga

SEQ ID NO: 79952 - RNA, 76 nt, Mus musculus
uuuguagugcaacacuaauuugcaccucuacuacauuacccccagcauauguugucauuugcuuucaugauuguag

SEQ ID NO: 79953 - RNA, 45 nt, Mus musculus
uuugcuguucuggaucuugaccagaauggccuugaauucauagag

SEQ ID NO: 79954 - RNA, 45 nt, Mus musculus
uaaucucuugauauuagaaaaacuuucucuucuuccuuuguggua

SEQ ID NO: 79955 - RNA, 46 nt, Mus musculus
auuauuuuaguuuuauucagauuuauguuuguuucuuuagcuucag

SEQ ID NO: 79956 - RNA, 80 nt, Mus musculus
auuucacagcgaaauuuagguucugugucugugguuuauguaggaaauuuuuauuggagaacauauauauaggacuggug

SEQ ID NO: 79957 - RNA, 47 nt, Mus musculus
uguuuaggcuguguggcuggggcaaggugugagggaccaggauggca

SEQ ID NO: 79958 - RNA, 94 nt, Mus musculus
guggaacucacuggacuagacuagugcacaugguacacagggggugggaccagugccaagccugaagcuuggaaaggcacuagcagcaacugau

SEQ ID NO: 79959 - RNA, 48 nt, Mus musculus
gccaaacuuggggguuggaaaccccacaggcaggacuggccagacuaa

SEQ ID NO: 79960 - RNA, 45 nt, Mus musculus
cgguggaccugaguacaggguuggggaccagaacaggggcuguag

SEQ ID NO: 79961 - RNA, 45 nt, Mus musculus
uauagagcaauaauaagcuucugagaaauucagcacucaccccag

SEQ ID NO: 79962 - RNA, 63 nt, Mus musculus
cuggaaaaacuuaacuuuuguggcaccuauuuauggagcagauauaaaugggagcauuuauga

SEQ ID NO: 79963 - RNA, 46 nt, Mus musculus
uuucuauugcaacaacaaaacaucaugaccuaaaagcaaguugggg

SEQ ID NO: 79964 - RNA, 46 nt, Mus musculus
auucaauuuccagcaaccacaugauggcucacaaccaucuguacag

SEQ ID NO: 79965 - RNA, 45 nt, Mus musculus
cuacuguuaugaaucauaauguagauauuuguuauguggcccucu

SEQ ID NO: 79966 - RNA, 41 nt, Mus musculus
acagcaaucacuuugauccacugcaccauugcuccacccua

SEQ ID NO: 79967 - RNA, 42 nt, Mus musculus
uucugcuguuuuuauuacuuuuguugugcaauauaaccugag

SEQ ID NO: 79968 - RNA, 45 nt, Mus musculus
ccuuccucaauaugaucuuuucuaguucuauccauuugccugcag

SEQ ID NO: 79969 - RNA, 46 nt, Mus musculus
caggccauaauggucuguucccagccguucugugcaacaacaguag

SEQ ID NO: 79970 - RNA, 45 nt, Mus musculus
cugguaggauagugauucgcuuugucaugauagagaccaaacagg

SEQ ID NO: 79971 - RNA, 46 nt, Mus musculus
ugaacgaacaaggagggagggauguagaaaucaaaaaagaaaagag

SEQ ID NO: 79972 - RNA, 41 nt, Mus musculus
ccccccgccccccaccccagaacugaggacugaacccaggg

SEQ ID NO: 79973 - RNA, 43 nt, Mus musculus
cacuaagaugcuuggugcaucauugcaccauuaggagcuggag

SEQ ID NO: 79974 - RNA, 33 nt, Mus musculus
acacaguggaucacaugcuacaguaaaauggac

SEQ ID NO: 79975 - RNA, 49 nt, Mus musculus
ggguguggaugaauggaauauagcucgccuaaauacagucuuggaugug

SEQ ID NO: 79976 - RNA, 46 nt, Mus musculus
uaccccuuaucucuauuuuggaauguggaaaacaacauuugcgugg

SEQ ID NO: 79977 - RNA, 46 nt, Mus musculus
gagaaucauugauuguuguucauuauugaugagaauuuacuucuuu

SEQ ID NO: 79978 - RNA, 46 nt, Mus musculus
ugaguaaaauaucacuuagcagaacuauaaauaaaggagcuaggga

SEQ ID NO: 79979 - RNA, 47 nt, Mus musculus
auguggguagaagcugucccugauagaaauaccagcagugcuuauga

SEQ ID NO: 79980 - RNA, 46 nt, Mus musculus
uaaguaaauuauugagaguucuaggacaauuaacaacacuaaggag

SEQ ID NO: 79981 - RNA, 46 nt, Mus musculus
uuaacugaagaaauucaaucuaguuaaauaaaauuauaaguuaaag

SEQ ID NO: 79982 - RNA, 46 nt, Mus musculus
gcuggggcaucugcgcuuuucugaguggaaauggaggaacaguggg

SEQ ID NO: 79983 - RNA, 46 nt, Mus musculus
gaauuugccuuucaguugcuuuuucauuuuuuaaaauuugugugug

SEQ ID NO: 79984 - RNA, 45 nt, Mus musculus
auaguaugauauuuucaaaugcuuauaccaugcuuggaaggggaa

SEQ ID NO: 79985 - RNA, 44 nt, Mus musculus
uguagaaccauguaucagaggaugaauacauucuugggggccca

SEQ ID NO: 79986 - RNA, 46 nt, Mus musculus
uuugaguuacuuccuuacugauuuucauauucgcuucuaccagcuu

SEQ ID NO: 79987 - RNA, 41 nt, Mus musculus
gguuuuuguuguuguuguuuugugugugugugugugugugu

SEQ ID NO: 79988 - RNA, 45 nt, Mus musculus
uaaauuuagcaauccaugaacaugagaguucuuuuaauccuauga

SEQ ID NO: 79989 - RNA, 47 nt, Mus musculus
cuacaacccagcauaacaaaggucccaguguuaucuucuuuuagggg

SEQ ID NO: 79990 - RNA, 45 nt, Mus musculus
ggacauaaguuguucuuuaaauccuuuaauccccuaugccauaag

SEQ ID NO: 79991 - RNA, 46 nt, Mus musculus
aucaugcuaaaauucuccucugaaaccucuugauccaggcccccac

SEQ ID NO: 79992 - RNA, 86 nt, Mus musculus
ggggguauugguuaguucuccacugcuuucuuaaaguccccaaauccacauuccuccaaauauaagcauggucaggacuaucacag

SEQ ID NO: 79993 - RNA, 75 nt, Mus musculus
caauaccacaaucccagucuuaguuauucaaccaacagagcuuguaaaauaaaacauagugcucccgagcaacag

SEQ ID NO: 79994 - RNA, 68 nt, Mus musculus
gguaagugcucagagucugcucuggcaaaaguacugggcugcauuuauguguaggaauauaugggaaa

SEQ ID NO: 79995 - RNA, 57 nt, Mus musculus
ggauuuucugagaaaugcuguucagaucuugcucuuacaaaucuaacauucagucaa

SEQ ID NO: 79996 - RNA, 46 nt, Mus musculus
ucccugacucagaauaauguauguguaugugaauugugaugaccag

SEQ ID NO: 79997 - RNA, 46 nt, Mus musculus
cacugcucugcgucagcagggacagcaaaacuauuuucugccuuag

SEQ ID NO: 79998 - RNA, 46 nt, Mus musculus
ugaucuuuaucuugugauccccaggcuucaguuuuuaccccgugag

SEQ ID NO: 79999 - RNA, 57 nt, Mus musculus
uauaggggaaugacaggucagggaagcaggugcauuggugagcagggagagagggga

SEQ ID NO: 80000 - RNA, 45 nt, Mus musculus
ccagauuuggaaacaaggaaaggauauauauacuauugaccauac

SEQ ID NO: 80001 - RNA, 45 nt, Mus musculus
gcaguguuuuaacagacaauaugaauuuaaaagucuuacaaugga

SEQ ID NO: 80002 - RNA, 45 nt, Mus musculus
auguguaucugugauacucagauugccaguguuuuuaucagagua

SEQ ID NO: 80003 - RNA, 45 nt, Mus musculus
cauuggauggagcgcagggcccccaauggagcagcuagagaaagu

SEQ ID NO: 80004 - RNA, 46 nt, Mus musculus
gccauaaguaagucauuccugacauagccugaaaauuuuccggaag

SEQ ID NO: 80005 - RNA, 45 nt, Mus musculus
uuuuuuucuuaguuuguuuguuuuuuuuuaagguguuuauuauca

SEQ ID NO: 80006 - RNA, 44 nt, Mus musculus
uuccuuucauggucccauaacucccccuuuuacuuuuuucaaag

SEQ ID NO: 80007 - RNA, 37 nt, Mus musculus
aaacauuuuggguggggaagcaguaucaaaagaaaac

SEQ ID NO: 80008 - RNA, 46 nt, Mus musculus
aucugugcagcaggcacuggccuuuucuuuugugggaauaaaccug

SEQ ID NO: 80009 - RNA, 75 nt, Mus musculus
cauuugucuguaaaaggaaauugguuguuaauuaaggauugaauaaugguaaucaguauaguugauuugaccuuu

SEQ ID NO: 80010 - RNA, 46 nt, Mus musculus
aauuuuagguugaaaagccugaaaacuguuucagguguccccguua

SEQ ID NO: 80011 - RNA, 52 nt, Mus musculus
aggguauguuuuagcugguucugccccaaguuggucaucagauguggauuaa

SEQ ID NO: 80012 - RNA, 61 nt, Mus musculus
gaagcagcaggaccuaucuccugggguugggaaggcguagucuggggucccugcagaacug

SEQ ID NO: 80013 - RNA, 32 nt, Mus musculus
ucuugggcaccacagucauggcugaaugcugc

SEQ ID NO: 80014 - RNA, 46 nt, Mus musculus
uggagaccauggcugagaacauagagaggccucccaugugaaauua

SEQ ID NO: 80015 - RNA, 97 nt, Mus musculus
ugagaaguggcaguucaugguuuuaaaguguuuauuguuauggcaggaaggggagcuaagaggguaggcaaagaaaggcagagagugggagaagagu

SEQ ID NO: 80016 - RNA, 76 nt, Mus musculus
cgagaaguagagguuggccauggccauguggagagagggaagggaagguggagagaggggggaagggaaaguggag

SEQ ID NO: 80017 - RNA, 46 nt, Mus musculus
cgauggcuccuugcaagccuuccaguuuaaagauagucgccccuag

SEQ ID NO: 80018 - RNA, 46 nt, Mus musculus
cagaaaagagaaaggugaggguaaauguuagaauaaauagccauag

SEQ ID NO: 80019 - RNA, 45 nt, Mus musculus
ucaaauugugauucuucugacauaauaaggaauacuuuauucaag

SEQ ID NO: 80020 - RNA, 46 nt, Mus musculus
agagccaccucuccagcccuugaaaugaauuuuuuucaagugucag

SEQ ID NO: 80021 - RNA, 43 nt, Mus musculus
gauaaauuucgguacauauuucuuauguacuuguagccccucu

SEQ ID NO: 80022 - RNA, 45 nt, Mus musculus
cugucaaucaauccaugagcaugggagaucuuuccaucuucugag

SEQ ID NO: 80023 - RNA, 45 nt, Mus musculus
agacgacauauacuaggauuuccugaacacuucuaguaacugcag

SEQ ID NO: 80024 - RNA, 45 nt, Mus musculus
ugaacucaggaccucuuaacugcugagccaucucuccagcccuua

SEQ ID NO: 80025 - RNA, 45 nt, Mus musculus
aaaucauuguccguuuucuuuccuuguaauuccugcccuaugcaa

SEQ ID NO: 80026 - RNA, 46 nt, Mus musculus
cccagguaacuucccuucucauccucccauggucccucacucucag

SEQ ID NO: 80027 - RNA, 46 nt, Mus musculus
cuuucgaagguccugaguucaaaucccagcaaccacaugguggguc

SEQ ID NO: 80028 - RNA, 46 nt, Mus musculus
cccguccucccuaaauaccauaaucagcugaugcaugguagacgag

SEQ ID NO: 80029 - RNA, 46 nt, Mus musculus
uacagguguugcaaacuuguuugccuaacauaaaggauaguagcag

SEQ ID NO: 80030 - RNA, 102 nt, Mus musculus
cgaacucagaaauccgccugccucugccucccaagcucugggauuaaaggcgugcgccaccaccgucuggcuuuaaauacuucuugauacuggauagauaug

SEQ ID NO: 80031 - RNA, 49 nt, Mus musculus
cucuuccuacuccucuuucucuucguucucuccgccuccuguuccucuu

SEQ ID NO: 80032 - RNA, 45 nt, Mus musculus
ugugguaucacagaugaucuuugcucugcuagggcaaguugcugc

SEQ ID NO: 80033 - RNA, 46 nt, Mus musculus
caggguccugccucagguccucaacugauugugacuuugguauuug

SEQ ID NO: 80034 - RNA, 49 nt, Mus musculus
gacaauauugauuucaaaaucauuuagaaacagaacuuuuaggucaggg

SEQ ID NO: 80035 - RNA, 46 nt, Mus musculus
uagaauaugugugugugugugugugugugugugugugugugucccu

SEQ ID NO: 80036 - RNA, 45 nt, Mus musculus
gaucagaauacuuucuuggcuccauuucucucucuacccuccuag

SEQ ID NO: 80037 - RNA, 74 nt, Mus musculus
cacagguuagacagacaguggaugggcaacuaggacuagauuuggggacuggguaugugaaagaaagggaagag

SEQ ID NO: 80038 - RNA, 45 nt, Mus musculus
aggcugggcccuggagcaagauacacaguauuguccugcucugag

SEQ ID NO: 80039 - RNA, 46 nt, Mus musculus
gaguagcuuauacuuccuucauuccuuugaauuaaaaguaccucag

SEQ ID NO: 80040 - RNA, 46 nt, Mus musculus
caugcuccagugucuuuuuguugaggcauguaaugugucuguugag

SEQ ID NO: 80041 - RNA, 46 nt, Mus musculus
caugguaucaguguccgcauuuucuacuuuuguuguuuucuggcag

SEQ ID NO: 80042 - RNA, 46 nt, Mus musculus
uggucugcaaaaauaauugccuugucuuucuauacuuucccgcucu

SEQ ID NO: 80043 - RNA, 41 nt, Mus musculus
gcagaaguucucuguaagucuuugucaggaaagagcagcaa

SEQ ID NO: 80044 - RNA, 45 nt, Mus musculus
gauuucuaacaguuccuuuucuuuuugugcuguuucaaaacagag

SEQ ID NO: 80045 - RNA, 44 nt, Mus musculus
augguaugcgcucucucccuauguucuugcugauaaggccccag

SEQ ID NO: 80046 - RNA, 46 nt, Mus musculus
uaaacaucacaugcuucagacauagagucaacucaaacgcgguaag

SEQ ID NO: 80047 - RNA, 46 nt, Mus musculus
uuacuuaagacugaaauuccucuaagaaaauagaauuuguacgcag

SEQ ID NO: 80048 - RNA, 46 nt, Mus musculus
aauuauuauauguaaguucauuguaguugucuucaaacacaccaga

SEQ ID NO: 80049 - RNA, 45 nt, Mus musculus
ggugaguugagagcccauuaauauugagagauauuaaagagagau

SEQ ID NO: 80050 - RNA, 46 nt, Mus musculus
cuuucuuugcucuguucauuuaguguuuugguaauuaucugacgag

SEQ ID NO: 80051 - RNA, 45 nt, Mus musculus
cauuugcauuuucuuuauuguuuuuauuuccacuuuuaggucuug

SEQ ID NO: 80052 - RNA, 46 nt, Mus musculus
cugcagguccucuaggauguaucaggauauggagucuucaugggag

SEQ ID NO: 80053 - RNA, 46 nt, Mus musculus
cuuauuggaguauaucugaagcugugugucuguacugcucucagag

SEQ ID NO: 80054 - RNA, 45 nt, Mus musculus
ugguugugagccaccaugugguuacugggauuugaacuccggacc

SEQ ID NO: 80055 - RNA, 45 nt, Mus musculus
aaagaugcagagaguuuccccaguacugcagagggcaacccccag

SEQ ID NO: 80056 - RNA, 45 nt, Mus musculus
cagccagugcucuuuaaccacugagccaucucuccaggcccccca

SEQ ID NO: 80057 - RNA, 51 nt, Mus musculus
acuuccuaaagaaacauuuacuuaugcauucaaagcucccagaugucaagg

SEQ ID NO: 80058 - RNA, 113 nt, Mus musculus
uggcugaaggagaagugcaaaccaacaaaccacuuggccuugaggaauucuccaaauaaguacuaaugcuguuguuacauagaagaugauuuguguuugugugucagggccug

SEQ ID NO: 80059 - RNA, 47 nt, Mus musculus
gggcuuugaaguaacauaacaaugacaaccacaguauugugggggua

SEQ ID NO: 80060 - RNA, 72 nt, Mus musculus
uuuaagaguugaauccuuuaacccugaaccuacauuggcaaugauccuguauguaacacaaaacauguauag

SEQ ID NO: 80061 - RNA, 45 nt, Mus musculus
uuuguaucauuuuuuuuuauuucuaugcaaugaauuuuagcccug

SEQ ID NO: 80062 - RNA, 46 nt, Mus musculus
cagcauuuauagcuucauuugucaaaaauauauuucuuucagccag

SEQ ID NO: 80063 - RNA, 55 nt, Mus musculus
ggugagcaugaguguggcuccgaacagcaaagcggcagguuccagcaguaggcgu

SEQ ID NO: 80064 - RNA, 46 nt, Mus musculus
uggguguuaaaaagagagagaacucuaauuuuggguaaaucagaag

SEQ ID NO: 80065 - RNA, 79 nt, Mus musculus
gaaucagauagauagauagaaagaaaggaaucagauagauagaaagaaagaaaggaaucagauagauagaaagaaagga

SEQ ID NO: 80066 - RNA, 42 nt, Mus musculus
aaauuaacauucuaguguaaaugguauaguaaaaauggggaa

SEQ ID NO: 80067 - RNA, 46 nt, Mus musculus
auguuucuaugggacuugccuguaguguagguaagccauggcacag

SEQ ID NO: 80068 - RNA, 33 nt, Mus musculus
ccagcaugacaguacaaaggaagcagaggccaa

SEQ ID NO: 80069 - RNA, 46 nt, Mus musculus
uuuacaaccacaaccucccagcaaaauacugaugauaauggcacaa

SEQ ID NO: 80070 - RNA, 84 nt, Mus musculus
acauaucacauuggcuuuuguaucuuuagguugaauuugaagauggaucgcagauugcaaugaagagagaagacauauacacuu

SEQ ID NO: 80071 - RNA, 46 nt, Mus musculus
gaaugcaaguguccacuuagaaaugggaaaaccagugcaugcagag

SEQ ID NO: 80072 - RNA, 45 nt, Mus musculus
uuacauuaaaagaaaguguucaaaauagauaaagagguagcauua

SEQ ID NO: 80073 - RNA, 42 nt, Mus musculus
uaaaaaaaaaaagaacagauuauaauaccugugagcaaagag

SEQ ID NO: 80074 - RNA, 47 nt, Mus musculus
gauaagcaucgcuuaucacugaaccuuuauguuuuagugacuuugcc

SEQ ID NO: 80075 - RNA, 75 nt, Mus musculus
gacugugcugggcucuuuuuuacucuuuucagaaacagccccauuaccuuuuauugucucauagaguaaccaugg

SEQ ID NO: 80076 - RNA, 46 nt, Mus musculus
uuucaaaugguaucccaaaaguccccuauacuucuccgccccgccc

SEQ ID NO: 80077 - RNA, 47 nt, Mus musculus
gcuuucuaagaguuacugaaacaaaauguuucuuucugaugacgaag

SEQ ID NO: 80078 - RNA, 66 nt, Mus musculus
uccacagccuccgacaugcgauuugaagacacauuuuauggagcagauguaauccaaggggagagg

SEQ ID NO: 80079 - RNA, 47 nt, Mus musculus
acaguaguugauaaugugcagcagccacagugcagcucagaccagaa

SEQ ID NO: 80080 - RNA, 54 nt, Mus musculus
uuuguuugaccccaaagaauauuccuaaauuaaaggaaacagcagugaauggcc

SEQ ID NO: 80081 - RNA, 46 nt, Mus musculus
uuuauaagaggaaauuuuuugcucuugaagaggaauucauaugaag

SEQ ID NO: 80082 - RNA, 46 nt, Mus musculus
uuuuaaacuaauguaacaugauuuuucuuugcaaaacagccuggag

SEQ ID NO: 80083 - RNA, 44 nt, Mus musculus
cauccgagaugaggcugggcgcccuguccaaacuccagcugaga

SEQ ID NO: 80084 - RNA, 45 nt, Mus musculus
cacacggccaaggauguacuuaacuguaaggacauaccgagaaga

SEQ ID NO: 80085 - RNA, 48 nt, Mus musculus
ggaaucccaccuggcccaggcaccguucugcagauggucaucggcauc

SEQ ID NO: 80086 - RNA, 46 nt, Mus musculus
ucaggggccgccuggccaccaaauagacguaggugcccgccccgaa

SEQ ID NO: 80087 - RNA, 48 nt, Mus musculus
uuuaagaaaaaaaaaagaaguauggcuuauuaugcauucuucaucgag

SEQ ID NO: 80088 - RNA, 47 nt, Mus musculus
acucuuuagaaauaucuguguguugcaauucaaauguauguugagau

SEQ ID NO: 80089 - RNA, 47 nt, Mus musculus
acagaucuguuggucacauuguuaauaguaaaggggacaaguuggag

SEQ ID NO: 80090 - RNA, 45 nt, Mus musculus
gacauggcaaaaccuuaaguauagcaauauaguuaucggguaauu

SEQ ID NO: 80091 - RNA, 46 nt, Mus musculus
aucccccaccugguccuauugaguguauccauugcuccaaggagau

SEQ ID NO: 80092 - RNA, 59 nt, Mus musculus
uuaacugacuuucuagaugccuuaauauuugcaugauaagcuaguuuucuugguuagua

SEQ ID NO: 80093 - RNA, 55 nt, Mus musculus
gacgguagaccagcauugcagcacuuacagucacuaauucccuuaagguugagac

SEQ ID NO: 80094 - RNA, 46 nt, Mus musculus
aaccacaaccauaguauaagaaaauuaggggaaaaacacccaacaa

SEQ ID NO: 80095 - RNA, 42 nt, Mus musculus
augaaaaucauauugcauacagugcauugaaaugggccagau

SEQ ID NO: 80096 - RNA, 46 nt, Mus musculus
cauacagaaauucauacaauuuucacuccacagugaagaccaagau

SEQ ID NO: 80097 - RNA, 43 nt, Mus musculus
guaacccuuguaacaauagcauugaaaagaagcccaggggugg

SEQ ID NO: 80098 - RNA, 41 nt, Mus musculus
ggagccuuucugugaaaagcacuauuuuggagaaccggagu

SEQ ID NO: 80099 - RNA, 42 nt, Mus musculus
acuuucuguccucaucagcaucauuugcaccuguugggagag

SEQ ID NO: 80100 - RNA, 46 nt, Mus musculus
aacugcaguccggggcagcuggguuguuucugaaguuccuugggau

SEQ ID NO: 80101 - RNA, 49 nt, Mus musculus
aagagagacugggacaaccgaagguguagagucaucuuaguaguaggac

SEQ ID NO: 80102 - RNA, 42 nt, Mus musculus
cugucaaacguuugggacaauuuauaacauuuuuugguggga

SEQ ID NO: 80103 - RNA, 46 nt, Mus musculus
accuuuuauauacauggcccuuuaaaaauaaauauugucaccaggu

SEQ ID NO: 80104 - RNA, 46 nt, Mus musculus
aauuaagaacugcagcaaugaagcuguauacucacuguacaggaau

SEQ ID NO: 80105 - RNA, 47 nt, Mus musculus
aauguauuucacaugauguaagcacaccacccaauuuaagcaccagu

SEQ ID NO: 80106 - RNA, 49 nt, Mus musculus
auuauauaaacaugguuuuguuuucacuccaaaguuagagaccaaggaa

SEQ ID NO: 80107 - RNA, 61 nt, Mus musculus
ucagcuuguuugauaaugaauugcuuguauacucaugcagagguugguccaaaagagauuu

SEQ ID NO: 80108 - RNA, 145 nt, Mus musculus
uauauguauguuuuaaaagcaagcaucaggcuucuuugaccuaagugcgacaguuuaaacaaaagcacauaaaaaugauuuuuaaaaaaacuaucucaggauaagugauuaauaccaaaguuccagaaacuuauggcgcugccua

SEQ ID NO: 80109 - RNA, 46 nt, Mus musculus
cuggcaaagagucccaccccaguaagcacuucucugaaugcaaaga

SEQ ID NO: 80110 - RNA, 46 nt, Mus musculus
uggcgacucucuacccugugcagaauccccgaguguauacugagag

SEQ ID NO: 80111 - RNA, 55 nt, Mus musculus
gcagaaacacuuuugcaguugauugcaucacucgugcaagagagagagggacaga

SEQ ID NO: 80112 - RNA, 45 nt, Mus musculus
ccuuuaaaaaaaguccacaugacguacugaugaugagacugcaga

SEQ ID NO: 80113 - RNA, 50 nt, Mus musculus
cuacaucuccacaggauucuuccccaagauugagcacuuucccccagcac

SEQ ID NO: 80114 - RNA, 44 nt, Mus musculus
uaugaaaggacacucaucugagcuugucugguugcugugguagu

SEQ ID NO: 80115 - RNA, 46 nt, Mus musculus
gaaaugauaucauucuuggguugaacgccuaauagaccacagaauu

SEQ ID NO: 80116 - RNA, 46 nt, Mus musculus
auuaaagguucuccuuuugaguaaaaauuucaacuuggcugcuaaa

SEQ ID NO: 80117 - RNA, 46 nt, Mus musculus
uaacuaguaaagaugaagggacaggggacaguuacauggaacagau

SEQ ID NO: 80118 - RNA, 47 nt, Mus musculus
cucuccaaauucaccagcugcuggaagucgaacauggcaugaacgag

SEQ ID NO: 80119 - RNA, 45 nt, Mus musculus
aaacuucuagaaccgguugucauguuauuaauuacaaggucagca

SEQ ID NO: 80120 - RNA, 46 nt, Mus musculus
aaagugucccaaacuaucacuauaacuuuuagucuuugcaguagau

SEQ ID NO: 80121 - RNA, 48 nt, Mus musculus
gugaauccaggagguauuuuauugcauaugaacacagguaccaggaag

SEQ ID NO: 80122 - RNA, 85 nt, Mus musculus
agggaacuggagucaacuucccaaucggagaaauucccagccaaccauacuaucaugacaugaacucuggugugaaccugcagag

SEQ ID NO: 80123 - RNA, 46 nt, Mus musculus
uaucaaaucuuaagguaaagagaguucuugcccugagccaugaaaa

SEQ ID NO: 80124 - RNA, 45 nt, Mus musculus
ccagaguuuaugaaugagggccacaaccaacuguaaagaccaaac

SEQ ID NO: 80125 - RNA, 46 nt, Mus musculus
acucacaugcaguguguaaagggaugcagaaauuaacuuugcagau

SEQ ID NO: 80126 - RNA, 56 nt, Mus musculus
uuucaggguaccucgaggacagcuuuguaaaauccggagucuucaauguaucagag

SEQ ID NO: 80127 - RNA, 46 nt, Mus musculus
uguuaucauucagcaggacauguagaguugaaagcagcacguaaca

SEQ ID NO: 80128 - RNA, 46 nt, Mus musculus
uaguauuuguuaaaaaugggaaauaagcugggcuaugguggcgcac

SEQ ID NO: 80129 - RNA, 46 nt, Mus musculus
gaaggcauauggucugagucuuuuugcaguuaacugaucuccagau

SEQ ID NO: 80130 - RNA, 53 nt, Mus musculus
gcaugauaaaugaaccaaaaaauauacaguuugaauaaacauggaaccaugua

SEQ ID NO: 80131 - RNA, 79 nt, Mus musculus
guaccaucuagaaaagugugucugugaauaugagaaacgaggggaaaaggaagagcaguuuauucagauggaaggacuu

SEQ ID NO: 80132 - RNA, 69 nt, Mus musculus
cauucaacaggccuuacacucagcccagauuaaagacuuugcuuauguagccaacagagagccacguac

SEQ ID NO: 80133 - RNA, 120 nt, Mus musculus
aacaauuacaacaaccaauggccagccugcuuuuuaaggaugagguagaaccugaagugcccaaagccugguauguaauuaacacucaauaaauguuaacuauuauuugcaucgucauca

SEQ ID NO: 80134 - RNA, 50 nt, Mus musculus
ggggagguaagaauuguaaguauucgaagucauaaacaucauagccauca

SEQ ID NO: 80135 - RNA, 50 nt, Mus musculus
gaauacgacuaauaagucacuacuucucuaguaauuauucacccaccugg

SEQ ID NO: 80136 - RNA, 45 nt, Mus musculus
uaauagugcuuagcacauugcuaucaacaaucuauucccgucagu

SEQ ID NO: 80137 - RNA, 45 nt, Mus musculus
agcuaggaauguuuaagacccagauguagaggaaaagacagagga

SEQ ID NO: 80138 - RNA, 42 nt, Mus musculus
agggcuguuacugccuacugugcaagcgugaagacaggagau

SEQ ID NO: 80139 - RNA, 46 nt, Mus musculus
guuauuuuuuguuguuguuguuuguuuuaauuuuaaccguguuaag

SEQ ID NO: 80140 - RNA, 42 nt, Mus musculus
gagucucuugaacucaugacuuuuuaggagcuggccccaagu

SEQ ID NO: 80141 - RNA, 42 nt, Mus musculus
guugcuucccugugauauuccuaccuccugaagccaccaguu

SEQ ID NO: 80142 - RNA, 47 nt, Mus musculus
gcaaaagaagugaaugcuuucagguucacgaucggcuagaauuggag

SEQ ID NO: 80143 - RNA, 50 nt, Mus musculus
uguacuuccuggauaucaaaagcagaguaaagauacagggacaaggaagu

SEQ ID NO: 80144 - RNA, 44 nt, Mus musculus
gaaaggaaaggaaaggaaaggaaaggaaaggaaagggaggaaaa

SEQ ID NO: 80145 - RNA, 45 nt, Mus musculus
aacggcuucucaccgcagccaucuuuguucaccugagccgcgaga

SEQ ID NO: 80146 - RNA, 42 nt, Mus musculus
acgugugcacccugacauuguuggagaacaaaggggcccugu

SEQ ID NO: 80147 - RNA, 45 nt, Mus musculus
ccuuuccuuuccuuuccuuuccuuuccuuuccuuucccccucccc

SEQ ID NO: 80148 - RNA, 23 nt, Mus musculus
cauguucuucagaguucaccuau

SEQ ID NO: 80149 - RNA, 42 nt, Mus musculus
ccucuuuguguccuggccuugccuuccagacagcugccaggu

SEQ ID NO: 80150 - RNA, 46 nt, Mus musculus
gcaaaaagagggccaggaagaauauaccagaugaagggaaucaagc

SEQ ID NO: 80151 - RNA, 46 nt, Mus musculus
uaagaaauuuuaggggaaugcuggagaacaaagaguacgcauaaug

SEQ ID NO: 80152 - RNA, 46 nt, Mus musculus
cucugaaguauuggguuauugauuuaaguuauaaagcaagcagaug

SEQ ID NO: 80153 - RNA, 47 nt, Mus musculus
gacaaaaucucaaugcuaaacuuuuuuuuugaaacgaacucugaauu

SEQ ID NO: 80154 - RNA, 46 nt, Mus musculus
uuggguaggcagagaagcuugggaagcaguagaggacagugcauuu

SEQ ID NO: 80155 - RNA, 45 nt, Mus musculus
gcuagaguugcugggauuaauauuagaauguuugaagaugugaug

SEQ ID NO: 80156 - RNA, 41 nt, Mus musculus
cuaaagagguaaaauuacauaggacagacuuaagcccagag

SEQ ID NO: 80157 - RNA, 46 nt, Mus musculus
auucuuaaugaacuccaguaaaauuaaacuaucaauauagagaggc

SEQ ID NO: 80158 - RNA, 44 nt, Mus musculus
cugcagauacaugcacugaugggggugguuggacuuggauccuc

SEQ ID NO: 80159 - RNA, 42 nt, Mus musculus
aucccuacccccauacaacaacaacacagcuaagcagcgauc

SEQ ID NO: 80160 - RNA, 46 nt, Mus musculus
ugauuuauuggccaaaaggaagagguccuguguggaacuaugaaac

SEQ ID NO: 80161 - RNA, 42 nt, Mus musculus
cauuuccuaccuuuguuugagagcaaauggauuggcccaggc

SEQ ID NO: 80162 - RNA, 48 nt, Mus musculus
agguuguuugggaaacaaggggaauggggacugaggauuaagaaccaa

SEQ ID NO: 80163 - RNA, 45 nt, Mus musculus
ccugauaacaauugcuuauaggucuauugaccugcaccuguagau

SEQ ID NO: 80164 - RNA, 46 nt, Mus musculus
cauuccuguuuuguaaucgccguuuuccccuauccccuuucaagau

SEQ ID NO: 80165 - RNA, 42 nt, Mus musculus
ugaacugaggcuugggagagguugccaaaugagguggcgaug

SEQ ID NO: 80166 - RNA, 46 nt, Mus musculus
ugugcaguaauuuucacagaaccagacaguuuaauuuugccaagag

SEQ ID NO: 80167 - RNA, 45 nt, Mus musculus
cauccuaggcugaacugugggcagcaacuuuuaucaugggggugg

SEQ ID NO: 80168 - RNA, 46 nt, Mus musculus
uuguugaauauaacacauugaauuaaggccacucugagcaugagga

SEQ ID NO: 80169 - RNA, 45 nt, Mus musculus
uaugauggcgugguggccuguggaucugcuguggggauguggaga

SEQ ID NO: 80170 - RNA, 46 nt, Mus musculus
gggaggagcccaaugaauuugauauguuuuagagacgcccugaaac

SEQ ID NO: 80171 - RNA, 45 nt, Mus musculus
agugugugugagguguaacuuuggggaacaaaaaugacggaaaga

SEQ ID NO: 80172 - RNA, 80 nt, Mus musculus
aggauuacaguuuaucaagaugcuacuuuuuacuuuagcaggagugaaauugguaaugagaugacauucaggcucacaga

SEQ ID NO: 80173 - RNA, 47 nt, Mus musculus
uaguggacuuuauccaaacaacaccuuaacaggcaaaccaacuaacc

SEQ ID NO: 80174 - RNA, 46 nt, Mus musculus
gucucuggaacagacacauagggauuagcugagcuccccuggaguc

SEQ ID NO: 80175 - RNA, 46 nt, Mus musculus
augugaauauuguaaggguaugaccuauggggaaaggagucgagag

SEQ ID NO: 80176 - RNA, 45 nt, Mus musculus
uauguggcagugaguggggagggaaccaaaugcucucugagagug

SEQ ID NO: 80177 - RNA, 45 nt, Mus musculus
uagaaagcaaaccccucugcaggcuguauuagaaacccacuuuua

SEQ ID NO: 80178 - RNA, 46 nt, Mus musculus
acagauaauuuucuauuauauaaagcacuacaaaguuuagagagau

SEQ ID NO: 80179 - RNA, 46 nt, Mus musculus
cuuaccauucuauuauagcaauuguuugcaacaaaaagggcagagc

SEQ ID NO: 80180 - RNA, 46 nt, Mus musculus
uuucuucacaguacagagauagccacccuucagucaugcaucaaaa

SEQ ID NO: 80181 - RNA, 45 nt, Mus musculus
uuaugacuaugguugcggagcugaauguuauggaagcguuggagg

SEQ ID NO: 80182 - RNA, 45 nt, Mus musculus
cacuggauggacacugaugcugucaucaaugaggggaugccaggg

SEQ ID NO: 80183 - RNA, 45 nt, Mus musculus
aucaaccauuucauaaacgagcaguuuuaauuuggugcuugcaga

SEQ ID NO: 80184 - RNA, 46 nt, Mus musculus
ggaagcaguucaguuggccaaaagaaucgaacaaagguucuuagcu

SEQ ID NO: 80185 - RNA, 45 nt, Mus musculus
aaacacuugcaugccuacccugucuuucaaauuagugugugcaga

SEQ ID NO: 80186 - RNA, 48 nt, Mus musculus
uuguuuugguucucugccgugugugugugugugugugugugugugugu

SEQ ID NO: 80187 - RNA, 46 nt, Mus musculus
uuugugucauauguguuacuuccaugcuugugaccuuuaggcagac

SEQ ID NO: 80188 - RNA, 41 nt, Mus musculus
augcgguccccuuuuccuuggcaucccuuugagcggcauaa

SEQ ID NO: 80189 - RNA, 46 nt, Mus musculus
aagccuuuugcugagaggaaaaacuaauuguuuuguuuccugagau

SEQ ID NO: 80190 - RNA, 45 nt, Mus musculus
auuuucaagaccacauaccgaucgcugugcaggaagugguggaga

SEQ ID NO: 80191 - RNA, 46 nt, Mus musculus
guuuucaagguuauuuauuauccuucuagaugcugucggaccggua

SEQ ID NO: 80192 - RNA, 45 nt, Mus musculus
ugcgugaaugcuggcugacgaggaaguugacaucagauauaugga

SEQ ID NO: 80193 - RNA, 46 nt, Mus musculus
auaaucaguugcugaguguagcuguaauagaauauucuugcuggau

SEQ ID NO: 80194 - RNA, 46 nt, Mus musculus
aacaacaacaacaacaacaguaacaacagcaaagccaaguccagaa

SEQ ID NO: 80195 - RNA, 46 nt, Mus musculus
gaguuuuagcugcucccaaagaaaacuacuuguguugaaagcauac

SEQ ID NO: 80196 - RNA, 42 nt, Mus musculus
aaacgaugaugcccaagaccccacacuagcaugugggcagag

SEQ ID NO: 80197 - RNA, 42 nt, Mus musculus
uagggaggcagugaaucuagaugcaggaaaccuaagagagag

SEQ ID NO: 80198 - RNA, 46 nt, Mus musculus
ccugcuucucacauguggcaguaggaaucucuucucaccuggagug

SEQ ID NO: 80199 - RNA, 55 nt, Mus musculus
cauguauaugcucagugccuuaaaaagccacaagagggcgcuggauccggaagag

SEQ ID NO: 80200 - RNA, 46 nt, Mus musculus
guguuuucucaggggcuuugugacaaaacaaaacaaaagggaagau

SEQ ID NO: 80201 - RNA, 46 nt, Mus musculus
ucccuuuuuauccuauuaguuuuaauccuaguuccccaaaucagcu

SEQ ID NO: 80202 - RNA, 39 nt, Mus musculus
cuggagugguauugcuggucuacucagcaguucugagau

SEQ ID NO: 80203 - RNA, 46 nt, Mus musculus
uuucucaggcacaguuguagauagauaaaugcaugaauaaaguugg

SEQ ID NO: 80204 - RNA, 46 nt, Mus musculus
uggcucuugaguucacguuucacauguuaucuuguccccuggagua

SEQ ID NO: 80205 - RNA, 58 nt, Mus musculus
uuuagaaaacgaaacacuagguucaaugucaaaggacccuucaauggauauuuuaagg

SEQ ID NO: 80206 - RNA, 46 nt, Mus musculus
aaauguauguaucaaguccccagauuucauuguaacgcacugaaaa

SEQ ID NO: 80207 - RNA, 45 nt, Mus musculus
gaucaugcaaaugagacuacugaauaguaauaguuaugggcaaua

SEQ ID NO: 80208 - RNA, 46 nt, Mus musculus
agggaaguaucuuaaauuauauguuaggcugaugguaugugcagaa

SEQ ID NO: 80209 - RNA, 24 nt, Mus musculus
uaaauuugcuaugcuauguuaaaa

SEQ ID NO: 80210 - RNA, 47 nt, Mus musculus
aaaacagaauuuguucaaacaaguacaaagugaaaaaggagcugccu

SEQ ID NO: 80211 - RNA, 47 nt, Mus musculus
cauccaacuguaggggaacuugugagaacugaguguauacagcaggg

SEQ ID NO: 80212 - RNA, 40 nt, Mus musculus
ugcauugcuguuaacauggucucacuuuucaaaggcagaa

SEQ ID NO: 80213 - RNA, 46 nt, Mus musculus
gcugcucugcguagugauuuggugggcuugcauugugacaucagag

SEQ ID NO: 80214 - RNA, 54 nt, Mus musculus
guguccugucuggagccagaagaugcagggaugcuggugugugugugugugugu

SEQ ID NO: 80215 - RNA, 46 nt, Mus musculus
ccuuuaacucuugaugguuagccacgaaguggacauacgugccgau

SEQ ID NO: 80216 - RNA, 45 nt, Mus musculus
gacugauggcagccaaagcgcuguuuaauaaucuuuguaccaguc

SEQ ID NO: 80217 - RNA, 30 nt, Mus musculus
acuacgugcaggagcaagguaggagcagau

SEQ ID NO: 80218 - RNA, 47 nt, Mus musculus
agucauggugauccuguucaaaggcaucccuuuggagaguacggaug

SEQ ID NO: 80219 - RNA, 47 nt, Mus musculus
cccgugcugugucuuauccaauccagaccagaaggguaagauuagga

SEQ ID NO: 80220 - RNA, 33 nt, Mus musculus
gcauccaggcuccuggccaaacugcgcaaagau

SEQ ID NO: 80221 - RNA, 45 nt, Mus musculus
caaccugcaggcucgaaaacgcaaguacuuuaaaaagcaugagaa

SEQ ID NO: 80222 - RNA, 46 nt, Mus musculus
aauuagaaaauaauguuauuauuuuuuaaguaaguuuugcugaguu

SEQ ID NO: 80223 - RNA, 42 nt, Mus musculus
aggacuggguuuguugcgaaguugcggugaaccggcgcagug

SEQ ID NO: 80224 - RNA, 46 nt, Mus musculus
caccccaauccaacccacaccgaacccucgcgcaccccaaccccca

SEQ ID NO: 80225 - RNA, 42 nt, Mus musculus
ggaauagagcccaggacagaaaagaggaguuugcagccaagc

SEQ ID NO: 80226 - RNA, 42 nt, Mus musculus
guggagaggcuggugcaaaaggaacgcgcguuugcaggagga

SEQ ID NO: 80227 - RNA, 41 nt, Mus musculus
ugaaaaaagaaaaaagaaaagaaaagaaaagaaaaguccca

SEQ ID NO: 80228 - RNA, 45 nt, Mus musculus
gguaacuuccacuuggggaaggaaaaagucacugguucuuucagg

SEQ ID NO: 80229 - RNA, 41 nt, Mus musculus
uacacucagcguccugaaguguguguagagccacaguccga

SEQ ID NO: 80230 - RNA, 46 nt, Mus musculus
uucaucagcuuccucugaaacucgaaagugagggcacacuucagau

SEQ ID NO: 80231 - RNA, 45 nt, Mus musculus
guuaaaaugggagcgacacuaggauguaaagucaucuuuugaaga

SEQ ID NO: 80232 - RNA, 45 nt, Mus musculus
ccagucagagguauaggaugaauggguuguaagcccaaggacaga

SEQ ID NO: 80233 - RNA, 45 nt, Mus musculus
aaauucaagcauuuuuagcaugcacauguuaaaaauaacauagaa

SEQ ID NO: 80234 - RNA, 46 nt, Mus musculus
gcuguuugaucuccacuuaauguucuuucuccuuagcuggccagau

SEQ ID NO: 80235 - RNA, 45 nt, Mus musculus
cuaaaaacuagauuaagaacauuggggacguuaguaagauggagu

SEQ ID NO: 80236 - RNA, 46 nt, Mus musculus
acauuaucuacccuuucucuuuacucucccugguccugaccccucu

SEQ ID NO: 80237 - RNA, 46 nt, Mus musculus
gaaaugugugaccagucagguuuauauuccuguuuuacccuaagau

SEQ ID NO: 80238 - RNA, 46 nt, Mus musculus
uggccuccaugagcaccuucauucauucaccaccacacacacauac

SEQ ID NO: 80239 - RNA, 45 nt, Mus musculus
auuacacuauuucagguugugccugguuaguccuguccugcagau

SEQ ID NO: 80240 - RNA, 46 nt, Mus musculus
uaugugaaugcacggauguuuaaguugccugugagaauaugaaaag

SEQ ID NO: 80241 - RNA, 42 nt, Mus musculus
ggccuggaugcacacagcagcuaugucuuaggggccccagac

SEQ ID NO: 80242 - RNA, 46 nt, Mus musculus
auucccagcagccacaugguggcucacaaccaucuguaauugcccu

SEQ ID NO: 80243 - RNA, 45 nt, Mus musculus
ccuaccacauaaaaccaugugcuaaaaccccagaggcuugugggg

SEQ ID NO: 80244 - RNA, 46 nt, Mus musculus
agguagagacucagugauggaggguuagaccuggagguucaguuug

SEQ ID NO: 80245 - RNA, 45 nt, Mus musculus
uauguauguauguauguauguauguauguuucugugguggucuag

SEQ ID NO: 80246 - RNA, 46 nt, Mus musculus
aaauccacucaucagcgagugagcuuuuguuaaguauagccaagaa

SEQ ID NO: 80247 - RNA, 46 nt, Mus musculus
aacuauacuuaaugaucugagagcagaggugacagaaggagaagag

SEQ ID NO: 80248 - RNA, 46 nt, Mus musculus
uuaauauauucagccaggcauggagguuuugucuggaguccuagau

SEQ ID NO: 80249 - RNA, 41 nt, Mus musculus
gggguugaggucauaguuuuucaaagugugagagagaagau

SEQ ID NO: 80250 - RNA, 45 nt, Mus musculus
augccuuugcauauaaagcgcccuggugauaggugugugguuaag

SEQ ID NO: 80251 - RNA, 82 nt, Mus musculus
gaaaagauucauuuagugcacauugaaaguaccucaugguccagaugacaggauaugggaaggcuuccuuaccuccaucagu

SEQ ID NO: 80252 - RNA, 50 nt, Mus musculus
ucagcuguugugaaauugucacacaaguugcuagauguuaaaaauuuaga

SEQ ID NO: 80253 - RNA, 45 nt, Mus musculus
ccguaauuuccuaacccaauaagcccauauuaaaaacacacagcc

SEQ ID NO: 80254 - RNA, 42 nt, Mus musculus
ccuguuucugagucuugugaggaauucaggggacguggaaug

SEQ ID NO: 80255 - RNA, 45 nt, Mus musculus
ugcuuagugcugugaucuucuucuuuuuucuuucuguugcuucaa

SEQ ID NO: 80256 - RNA, 45 nt, Mus musculus
gauuuauauauguuucuaauguuaauguuaggaauaagccacaga

SEQ ID NO: 80257 - RNA, 45 nt, Mus musculus
ccccauuguucuuucucuccuaucuagugaucagggguggaauaa

SEQ ID NO: 80258 - RNA, 44 nt, Mus musculus
augcuagaugcucuauaggugaggugaggugggugguuguuagu

SEQ ID NO: 80259 - RNA, 45 nt, Mus musculus
guaguuuuaaccauguggugaauaguaguaaccucuauugaagau

SEQ ID NO: 80260 - RNA, 27 nt, Mus musculus
gauggaauaugaaauauaaagaaauaa

SEQ ID NO: 80261 - RNA, 41 nt, Mus musculus
guguggcgguguguguguguguguguguguguguggugggg

SEQ ID NO: 80262 - RNA, 41 nt, Mus musculus
ugugugugugugugugugugugugugagagagaaagaguga

SEQ ID NO: 80263 - RNA, 46 nt, Mus musculus
auguacaggaauuccuucucuccucccaccauaugggccccaggaa

SEQ ID NO: 80264 - RNA, 46 nt, Mus musculus
acacacacacagacacagauacagagagugagugaguuagagagau

SEQ ID NO: 80265 - RNA, 46 nt, Mus musculus
aggaggagggauggugaaaaauuaaagaaagaaagaagccugggua

SEQ ID NO: 80266 - RNA, 44 nt, Mus musculus
ugcggcccggccugggcggcggaggcgcggagccgaguggaaag

SEQ ID NO: 80267 - RNA, 25 nt, Mus musculus
cacaagagaggaagccagucugucu

SEQ ID NO: 80268 - RNA, 46 nt, Mus musculus
aggacuaggaggagggaauuaacuagguaucaagaggugaccgagg

SEQ ID NO: 80269 - RNA, 44 nt, Mus musculus
acccugucuaaacacaaacaugugugugugugugugugugugug

SEQ ID NO: 80270 - RNA, 41 nt, Mus musculus
ggcacaguccugcaggucucccaguguacuucguggcuuuu

SEQ ID NO: 80271 - RNA, 52 nt, Mus musculus
cuguaaccaguuugccuacaaugugcaauugaauuguuauuuaauaaaugac

SEQ ID NO: 80272 - RNA, 45 nt, Mus musculus
uggguuaauugaauuggaggucagcucauucuacaaugcuuugau

SEQ ID NO: 80273 - RNA, 78 nt, Mus musculus
uuacacugcagacaguugaguggccuucuaguuguccugaggacaggaagagacaagugggcaggagcuaagggagau

SEQ ID NO: 80274 - RNA, 84 nt, Mus musculus
auugcaguuucuguagcuaccugcagaggcaguguucugaucgguguuuuguaaauguaaggauuguauuucagagccuuggga

SEQ ID NO: 80275 - RNA, 51 nt, Mus musculus
ccacagaacuuuaucuauuuucugucauguucaagauacuguaccggcacc

SEQ ID NO: 80276 - RNA, 45 nt, Mus musculus
gcaugcauucacauagaaacauacauacauacacauuaaguagac

SEQ ID NO: 80277 - RNA, 45 nt, Mus musculus
aaucauuauaucucacuaauaugaaucacacaauuagcuacagau

SEQ ID NO: 80278 - RNA, 46 nt, Mus musculus
ucuagaggguagauggcuccaccuucccucgucagcgccccagguu

SEQ ID NO: 80279 - RNA, 86 nt, Mus musculus
aaauucuuauacucugccuucacuguagauuucaauugagggggugaagucuuuuaaaagacuggcagguacaauaaagccuaguu

SEQ ID NO: 80280 - RNA, 70 nt, Mus musculus
ggaucuucccccccgguuaacauugacucuugcuauggagaucacucucugugucaagguggacccauga

SEQ ID NO: 80281 - RNA, 45 nt, Mus musculus
caaaaucaacacggacccucuaaauucauacaaguggucgucagc

SEQ ID NO: 80282 - RNA, 46 nt, Mus musculus
acuucuacagaugucaauguuuaauuaaaguuguuucagaacagug

SEQ ID NO: 80283 - RNA, 46 nt, Mus musculus
guccccagcacugagugucauagucaaagccauuguuccugagguc

SEQ ID NO: 80284 - RNA, 58 nt, Mus musculus
caguggugguuuauacuagcuacgggaacccucagagcagcaggguuuugggaggaaa

SEQ ID NO: 80285 - RNA, 42 nt, Mus musculus
uggggugccuggauguuaacugaguugagagucuuuggagga

SEQ ID NO: 80286 - RNA, 46 nt, Mus musculus
gugugugugugugugugugugugugugugagagagagauggugauu

SEQ ID NO: 80287 - RNA, 46 nt, Mus musculus
augaugaaugcuuggugaaauuacugaaaggaugcugccucaagaa

SEQ ID NO: 80288 - RNA, 55 nt, Mus musculus
uggaagcgcuauccucuccugcacgggugccagcagaguuagaagccaaaaccac

SEQ ID NO: 80289 - RNA, 81 nt, Mus musculus
cacguuucggaaccauuucacggcauaacuuccccccaaaagaacauaaccugggagaacugcuagguuguaaacauaaug

SEQ ID NO: 80290 - RNA, 72 nt, Mus musculus
gguccggguggggaaggaaggcccugacauucuaggagcauggggguucgugggggcuuggggugccucgcc

SEQ ID NO: 80291 - RNA, 81 nt, Mus musculus
uguaaauuagcagucugucuuggaauagcuucuucacaugucacccgcaaaagaaaaaaagcaggaaagcccucacgcaug

SEQ ID NO: 80292 - RNA, 56 nt, Mus musculus
uucagagucugcucaguucccuucaccaccccuccacacugucacagccugagacg

SEQ ID NO: 80293 - RNA, 41 nt, Mus musculus
ccuaaacuccugacuuaguaauuaagcuccuguucuccaga

SEQ ID NO: 80294 - RNA, 84 nt, Mus musculus
aaugauguacgucuggaauggcuuuucaauagugggaaaaaggaaggaccuuucugaaaaucucuuggugacuguggagaaggc

SEQ ID NO: 80295 - RNA, 86 nt, Mus musculus
guugccauuuugauguagaauuguaaauaagagaaaacauccuggagccgugcccuccuguggacaugggucucccaccgcaagca

SEQ ID NO: 80296 - RNA, 49 nt, Mus musculus
auaaagugagacugucuuacaaaaccagcugccuucuccaccccuaaaa

SEQ ID NO: 80297 - RNA, 47 nt, Mus musculus
ggcuuauaccuguacuccuagaacuuggguagcugaggccagagaau

SEQ ID NO: 80298 - RNA, 42 nt, Mus musculus
guggauucauauauaccaacaaaauuggaugcaggcguauua

SEQ ID NO: 80299 - RNA, 42 nt, Mus musculus
aaaaucuguucuuagauaagauuuauguauuagguggcugua

SEQ ID NO: 80300 - RNA, 46 nt, Mus musculus
uugaagaucucuagggagaugcagagucaguaagacugucagagua

SEQ ID NO: 80301 - RNA, 43 nt, Mus musculus
aggccuuuaguaacgaggagccuagaauccaguucuguuugug

SEQ ID NO: 80302 - RNA, 45 nt, Mus musculus
uccuugugugugacacauaacacaaacacaacacacagcacacag

SEQ ID NO: 80303 - RNA, 42 nt, Mus musculus
ugaucaacuucaucaaagguggacucaaaauuagaacaaguu

SEQ ID NO: 80304 - RNA, 45 nt, Mus musculus
aaagguucagagcuuggcucaaaguuuaauucugcagcaccaaac

SEQ ID NO: 80305 - RNA, 45 nt, Mus musculus
agagagugcgaugcuuaagugaggugcagagcuuggaauguggga

SEQ ID NO: 80306 - RNA, 46 nt, Mus musculus
gguguauguuggugaagaaauuacucaguguaaaucagucacagug

SEQ ID NO: 80307 - RNA, 47 nt, Mus musculus
aaaucuggacuuuccacuaaauauugaaaaauuaacuggcccauguc

SEQ ID NO: 80308 - RNA, 46 nt, Mus musculus
aaccuuaguuuuaagaggaaugacaugguauuuuuggugugagaau

SEQ ID NO: 80309 - RNA, 42 nt, Mus musculus
cguuuguccuguaggaguguugucagcuuguuugggccauug

SEQ ID NO: 80310 - RNA, 46 nt, Mus musculus
uacuuauauuggugaauuuuaauguggcuaagaugaaucgucaugu

SEQ ID NO: 80311 - RNA, 45 nt, Mus musculus
uuguacugagauguacucaccggcuguguuuuuuccagggccaag

SEQ ID NO: 80312 - RNA, 46 nt, Mus musculus
ucuuuuccuuuuucucuucaguucaucagccaagguggaucucaag

SEQ ID NO: 80313 - RNA, 46 nt, Mus musculus
acuuagugagcuuuaggccaggacuccaguuaaaaagaaugaaaag

SEQ ID NO: 80314 - RNA, 42 nt, Mus musculus
auccacccccucugacacuauagucucugacuuuggccuagu

SEQ ID NO: 80315 - RNA, 46 nt, Mus musculus
auccaguuucuugauagacuaguugcugaaguaguuguguuaagca

SEQ ID NO: 80316 - RNA, 45 nt, Mus musculus
auacaucggucuuugggggcauuucagaugcaaacuagcaaagau

SEQ ID NO: 80317 - RNA, 46 nt, Mus musculus
auuuggagugcauggcggggcaauacugcacuacaucauggucagg

SEQ ID NO: 80318 - RNA, 41 nt, Mus musculus
gggcagagggaccuugggaaggggggaaggcuagcugagag

SEQ ID NO: 80319 - RNA, 45 nt, Mus musculus
cagauauuuacauuaugauucauaucaguagcaaaauuacagaua

SEQ ID NO: 80320 - RNA, 79 nt, Mus musculus
gaaggccugcuccauugcuccagcccgguggauccugaugagaagaggcaguccaugguuucaagguguuuauugcaga

SEQ ID NO: 80321 - RNA, 45 nt, Mus musculus
cccuggggcagcuaggucagccccagggcugaagggagaaggggc

SEQ ID NO: 80322 - RNA, 44 nt, Mus musculus
agccagcuucagggucccugggccaaauggaggccacagacaac

SEQ ID NO: 80323 - RNA, 46 nt, Mus musculus
ccuccugguccuuuuacuuuuuucuccgugggaccccuggcuggga

SEQ ID NO: 80324 - RNA, 45 nt, Mus musculus
cuugaucuauugcaauuguaucucccaaagaauugacccaaagac

SEQ ID NO: 80325 - RNA, 51 nt, Mus musculus
aacuauuuuaguuuaauucuuaaaauaguaauggagcauguuauaauggag

SEQ ID NO: 80326 - RNA, 44 nt, Mus musculus
cgcagcccaguccccagcacaagcaaacaggguuagagcauaga

SEQ ID NO: 80327 - RNA, 45 nt, Mus musculus
aaacgugccacagugugugugugugugugugugugugugugugug

SEQ ID NO: 80328 - RNA, 27 nt, Mus musculus
gagggaacgugcaguagccaaaugaag

SEQ ID NO: 80329 - RNA, 58 nt, Mus musculus
ucuuuucuuuucuuuucuuuucuuucccuuucccuuucccuuucccuuucccuuuccc

SEQ ID NO: 80330 - RNA, 45 nt, Mus musculus
cuucaagaacugggcuugauaagguguaucuauauuagccuagaa

SEQ ID NO: 80331 - RNA, 46 nt, Mus musculus
cuagcugucuuagucaggcuuuuuauuccugcacaaacaucaggac

SEQ ID NO: 80332 - RNA, 26 nt, Mus musculus
ggaaaaaaaaaagucuuugguucuag

SEQ ID NO: 80333 - RNA, 46 nt, Mus musculus
ggacuauauuguuugaguaaauuuaaauuauucaugaguuuuguga

SEQ ID NO: 80334 - RNA, 45 nt, Mus musculus
cuguccauuguucuuauuuauucagauuucacuuagggucccuuc

SEQ ID NO: 80335 - RNA, 46 nt, Mus musculus
auucaagcuguuaccagucuuaauuuuuaaaaaaaguuuuguagcu

SEQ ID NO: 80336 - RNA, 46 nt, Mus musculus
cgggaccauaggauugguugguagguuugagauaaaggcgggagaa

SEQ ID NO: 80337 - RNA, 46 nt, Mus musculus
ugagccgucaugugguugcugggaauugaacucaugaccucuggaa

SEQ ID NO: 80338 - RNA, 41 nt, Mus musculus
ugaguguggaguguguugugcaugugagauagggaggggga

SEQ ID NO: 80339 - RNA, 24 nt, Mus musculus
aaaagaaagcucuguggcugaaga

SEQ ID NO: 80340 - RNA, 42 nt, Mus musculus
caaaaggaaauauaggcauggguuaccaggaggaguggucuu

SEQ ID NO: 80341 - RNA, 46 nt, Mus musculus
aagagagcacuuuccggaggguaacuagagaacaaagcaguaaggu

SEQ ID NO: 80342 - RNA, 46 nt, Mus musculus
aaaaaaaaaaaagaaaaacaaaacaaaacaaagauuuagccaagua

SEQ ID NO: 80343 - RNA, 46 nt, Mus musculus
guguggauagcuagacagcaagcaagggaaggagguguugggagag

SEQ ID NO: 80344 - RNA, 49 nt, Mus musculus
uugugagucuuuagugcugcaugcuguaaagaggagagaagaauaggaa

SEQ ID NO: 80345 - RNA, 45 nt, Mus musculus
uugcugugauaaaaauacccgacagacagacagacaccuuaaggg

SEQ ID NO: 80346 - RNA, 46 nt, Mus musculus
auuaauccauucaugaggguuuuguucuugucuuaguguuccauug

SEQ ID NO: 80347 - RNA, 46 nt, Mus musculus; identical to SEQ ID NO: 58606

SEQ ID NO: 80348 - RNA, 74 nt, Mus musculus
guggcuuaacauggccuauggcaucauguagggaaagaacauagagggggagagaaagcgugaacucacuugaa

SEQ ID NO: 80349 - RNA, 42 nt, Mus musculus
ugcuuccuguuuucaaaacaaaacccgaagggcagugcagga

SEQ ID NO: 80350 - RNA, 54 nt, Mus musculus
aguuuuucauuuacaggaugaauaaagguuaacaggguuuggugugaagggagu

SEQ ID NO: 80351 - RNA, 42 nt, Mus musculus
gggacuggguguggcaggaugccagguggcacuggggacaga

SEQ ID NO: 80352 - RNA, 45 nt, Mus musculus
uguauauagccaaugcuuucucgauguguucaccuuggccuugau

SEQ ID NO: 80353 - RNA, 51 nt, Mus musculus
ucucagggccuauccaggagagcaagggggagggccuggcuuggggcagag

SEQ ID NO: 80354 - RNA, 42 nt, Mus musculus
aggcagugguggcacaugccucuucaaucccagcacccagaa

SEQ ID NO: 80355 - RNA, 41 nt, Mus musculus
uacugggugcgcaguggauaccgcggcgccgggggcgggga

SEQ ID NO: 80356 - RNA, 46 nt, Mus musculus
aaauaaacuggguguggugggacauaccuuuaaucccaggacucag

SEQ ID NO: 80357 - RNA, 46 nt, Mus musculus
cgcgcguguuccaugugggcuccuuuggggagcuauggcguggccg

SEQ ID NO: 80358 - RNA, 45 nt, Mus musculus
cugcaguagccagcgaucugggcugcagucuggaggcagcagcag

SEQ ID NO: 80359 - RNA, 47 nt, Mus musculus
uucucggagacccuuaaccuucgucccccuaaacccuuuccggaagg

SEQ ID NO: 80360 - RNA, 46 nt, Mus musculus
gcgguauauaucugucauugauauuuggacaauggaaguaccugag

SEQ ID NO: 80361 - RNA, 47 nt, Mus musculus
ugaagacccggaagucaucccagagaacacugaccuagugacuuuau

SEQ ID NO: 80362 - RNA, 46 nt, Mus musculus
ucuguggcucuguggcuaugggauacaguuguguguguuuccccag

SEQ ID NO: 80363 - RNA, 23 nt, Mus musculus
cguggagaugucuacacaggcaa

SEQ ID NO: 80364 - RNA, 23 nt, Mus musculus
uccugucucaaaaaagaccucua

SEQ ID NO: 80365 - RNA, 62 nt, Mus musculus
gugaggaaggggcuuuuggacuaucgggaagaaaacaucacaauagaucgcgccuguagaca

SEQ ID NO: 80366 - RNA, 46 nt, Mus musculus
ucccagggcaugucauaggcuguuaguaaccgagcauuacccacag

SEQ ID NO: 80367 - RNA, 56 nt, Mus musculus
ggcucacaaccaucuguaaugagaucugacacccucuucugguucaucugaagaca

SEQ ID NO: 80368 - RNA, 47 nt, Mus musculus
aguguacuuagauauaauaauaaauaaaucuuuaaaagaaaaaaaag

SEQ ID NO: 80369 - RNA, 46 nt, Mus musculus
auugaccugcaggcaaccaggaaugagucuggaucucacuggucag

SEQ ID NO: 80370 - RNA, 46 nt, Mus musculus
acucauauacauaaaauaaauaaauaacucuuaaaaagaaagaaag

SEQ ID NO: 80371 - RNA, 46 nt, Mus musculus
aagaauacacagaguaacuuugucucaaaaaacuaaaaaagaaagg

SEQ ID NO: 80372 - RNA, 44 nt, Mus musculus
cuagggaagaaaccugaaaacccagcagacaugauugaagaagg

SEQ ID NO: 80373 - RNA, 52 nt, Mus musculus
gaagcucacagaacugagagauucaauuugcugugucagugaccuccagauc

SEQ ID NO: 80374 - RNA, 46 nt, Mus musculus
aagaaaagauuaccaugaagaaucccuuuuuauaguaaccuaucag

SEQ ID NO: 80375 - RNA, 46 nt, Mus musculus
ucuuaacauugggauuauucuuaugcauugcuaugccuagcucuag

SEQ ID NO: 80376 - RNA, 46 nt, Mus musculus
cacuugugagcgcggguccaucaucccuucuaccuugagcacccag

SEQ ID NO: 80377 - RNA, 45 nt, Mus musculus
caggacauuuaguacuuaauuauuauuucuuaacuauacagccag

SEQ ID NO: 80378 - RNA, 51 nt, Mus musculus
auuuugaaggaacauuuuacaaugacagaagauacccagaaugcagagacu

SEQ ID NO: 80379 - RNA, 46 nt, Mus musculus
uuucuucuagaccuguaaccagacucaaagcaaaacaggccccuag

SEQ ID NO: 80380 - RNA, 46 nt, Mus musculus
ggucagagucccaugaucgaggauauggaaaauuucagacugcuag

SEQ ID NO: 80381 - RNA, 41 nt, Mus musculus
cuuggcuaaauuaagaaugauacacaguaucauggccccug

SEQ ID NO: 80382 - RNA, 45 nt, Mus musculus
cuugcuuauccuuauguugacccaggaaccuuuaauuaguaccag

SEQ ID NO: 80383 - RNA, 46 nt, Mus musculus
ccuaauaacacacauaaugccaauuaccccguuuuacuagacaaag

SEQ ID NO: 80384 - RNA, 46 nt, Mus musculus
guuucccuugcucuuaaacuaaacgacggagcuguuaauacugcac

SEQ ID NO: 80385 - RNA, 45 nt, Mus musculus
agacugcugugagcugcuauauaguugcuggaaaucagccccaaa

SEQ ID NO: 80386 - RNA, 42 nt, Mus musculus
agggggggagggggaaauucaguccaaugagucugucucaag

SEQ ID NO: 80387 - RNA, 50 nt, Mus musculus
uggauuaaugcuuugagcccaaaaugagauauauuuuuauuacuguagau

SEQ ID NO: 80388 - RNA, 46 nt, Mus musculus
uuacagagcaaaacuguccaaguacaaaguuuuguaauaacaggag

SEQ ID NO: 80389 - RNA, 42 nt, Mus musculus
agaggcuacuuaaagguuuaacucuuuaaaaaagaaugcaag

SEQ ID NO: 80390 - RNA, 45 nt, Mus musculus
ucucauguuggccuuuuagcauguuccuccugugagcagccugga

SEQ ID NO: 80391 - RNA, 46 nt, Mus musculus
aggagacagagccuagguagaucccugugaauucaaggccagccag

SEQ ID NO: 80392 - RNA, 46 nt, Mus musculus
cugguuuagcuaaauuuuuccguuuagauucaacuucuuucuuccc

SEQ ID NO: 80393 - RNA, 76 nt, Mus musculus
uuucuuucuugaaagaacuauuuguauuuacucaagugucugugugaggagcuaaguuucuggaugugggugcugg

SEQ ID NO: 80394 - RNA, 46 nt, Mus musculus
gugcucagccaucucuucacccuuuauuuauacucuccuuuaccaa

SEQ ID NO: 80395 - RNA, 42 nt, Mus musculus
gauguuucuugcuccuauuuagcauauaaacccaaggcccua

SEQ ID NO: 80396 - RNA, 45 nt, Mus musculus
ccuccaaucucucaucaguuuuagagauagaaaaaaaacuuacac

SEQ ID NO: 80397 - RNA, 47 nt, Mus musculus
uuuagagcuuuauuguagaaaggcgagggaaagagaaaagggggaga

SEQ ID NO: 80398 - RNA, 46 nt, Mus musculus
ugaggggguuucuugacagucuccuccuggugaggguacuauaaau

SEQ ID NO: 80399 - RNA, 56 nt, Mus musculus
caggcacucacagucgaguaugauggugcauacuucagcuuugagaggcuugaagg

SEQ ID NO: 80400 - RNA, 45 nt, Mus musculus
cuagcacaggcugucgcccaaugugcuaguucaguguugugugag

SEQ ID NO: 80401 - RNA, 62 nt, Mus musculus
ugacuaaagcaguugacauaaccacuccaaaagcugccaggcgaggaagaaagagaaaggua

SEQ ID NO: 80402 - RNA, 45 nt, Mus musculus
ugauguuugugucuaaaugguuauuaauuaaaugucuaaagagau

SEQ ID NO: 80403 - RNA, 80 nt, Mus musculus
uauuuccuuauucagaaaauaaggaaaaguauggcaaaccaaauaaacggaaagguuuuaaugaaggauugugggagaua

SEQ ID NO: 80404 - RNA, 42 nt, Mus musculus
cagggcuacacagagaaacccugucucgaaaagccaagaaaa

SEQ ID NO: 80405 - RNA, 46 nt, Mus musculus
uaagaccaggcacaugccaucacaccaaggcuggaugagccaaguc

SEQ ID NO: 80406 - RNA, 45 nt, Mus musculus
caugcagauagaacauuccacuggccccaaggacaaggcugggga

SEQ ID NO: 80407 - RNA, 50 nt, Mus musculus
aaaagaaaugcugaauuucuguuuuuaggguaaugguuuacaauuuggag

SEQ ID NO: 80408 - RNA, 53 nt, Mus musculus
agaucugaguuugagcccagccugguuuacagagugaguuccaggacagcuaa

SEQ ID NO: 80409 - RNA, 45 nt, Mus musculus
caaccaucuguaaugagaucugaugcucucuuccagcacauagau

SEQ ID NO: 80410 - RNA, 46 nt, Mus musculus
cauauauuuuguauaugaaaauaggacaagcucccugggggcugga

SEQ ID NO: 80411 - RNA, 91 nt, Mus musculus
gccaaguguguccgugacaggaucaagcgggcuuuccuuauugaggagcagaaaaucguugugaaaguguugaaggcacaagcacagaguc

SEQ ID NO: 80412 - RNA, 79 nt, Mus musculus
cgaaccccuggcaacaggauuguuuaccucuacaccaagaagguugggaaagcaccuaaauccgcauguggcgugugcc

SEQ ID NO: 80413 - RNA, 42 nt, Mus musculus
agaggcacucaggaugguccagcguuugacauaccgccguag

SEQ ID NO: 80414 - RNA, 44 nt, Mus musculus
gcagggaugauguucugggcagccccacggccaucacaccucag

SEQ ID NO: 80415 - RNA, 45 nt, Mus musculus
ugagcuugacaaaguugucauugagagcaaugccagcccuggcau

SEQ ID NO: 80416 - RNA, 48 nt, Mus musculus
uaggaaagauuuauuuguuuuuuuggaggggaguggguaacaggaggg

SEQ ID NO: 80417 - RNA, 45 nt, Mus musculus
gguuuauacaucucaagugaaccuauuuacucagcacauuggcca

SEQ ID NO: 80418 - RNA, 45 nt, Mus musculus
uugacuaaaaccuuaccuggaaugugacugcuuauagccauagga

SEQ ID NO: 80419 - RNA, 42 nt, Mus musculus
aaauggcuauuaaccccgggucuuugaaucucacgaggacgg

SEQ ID NO: 80420 - RNA, 46 nt, Mus musculus
gaaaaugaacaacuagcaauaaaaccaccuguucuuccccuguauu

SEQ ID NO: 80421 - RNA, 46 nt, Mus musculus
ggauucaaccaaccacagacaaagaauguuaaaugcacccaacagc

SEQ ID NO: 80422 - RNA, 46 nt, Mus musculus
uggaaauauuuuccuaaccaauacugcauucacaucaggcacauau

SEQ ID NO: 80423 - RNA, 47 nt, Mus musculus
acacuuugcaaugaauucaauagucaguauuguagcagcucagcuga

SEQ ID NO: 80424 - RNA, 44 nt, Mus musculus
aacaacuacaguuuuguuuugaauuguuuuuagggaggggguag

SEQ ID NO: 80425 - RNA, 46 nt, Mus musculus
auuaaaagcauauacacuaguagaauagugauauuaggagcaagaa

SEQ ID NO: 80426 - RNA, 46 nt, Mus musculus
aucacagugggacacaggaagcuuuucuaaguaaaacugcagagau

SEQ ID NO: 80427 - RNA, 46 nt, Mus musculus
uuaauucuuuuucuugcuugcucuaauuuuuacuuuacccugggag

SEQ ID NO: 80428 - RNA, 46 nt, Mus musculus
ucuagugccaagacuugagaagccaggcaugccaaguugccaaguc

SEQ ID NO: 80429 - RNA, 49 nt, Mus musculus
aaagcaccagagaggacacuccuugugggcacuaucccuaggacagcag

SEQ ID NO: 80430 - RNA, 84 nt, Mus musculus
uucaguuuaccuuucugagucuucucuuuaaccguuaugcaaauuucagagagccugucuucccauccucuucuucagucaacu

SEQ ID NO: 80431 - RNA, 45 nt, Mus musculus
aggugagcgagaagguccugaugaacagcgagaggcccgacgaga

SEQ ID NO: 80432 - RNA, 41 nt, Mus musculus
accaaauccaucguggagcugauggcaauucaggagaaaga

SEQ ID NO: 80433 - RNA, 46 nt, Mus musculus
gcacugaagucaauucuuggucucagaauuuaaaauuuggggagua

SEQ ID NO: 80434 - RNA, 42 nt, Mus musculus
ugccuggaaauuaagggacagaauuuuguggaaagcguagaa

SEQ ID NO: 80435 - RNA, 46 nt, Mus musculus
gcugaaauccaaguugaaagauucaguuccguaacauagucaaaag

SEQ ID NO: 80436 - RNA, 44 nt, Mus musculus
uuggacaaaagugaauagcaaguugaguaaggugugugugugug

SEQ ID NO: 80437 - RNA, 46 nt, Mus musculus
guugcaggcaaaaguauucccaaccugcaaacugaauugcauagag

SEQ ID NO: 80438 - RNA, 26 nt, Mus musculus
ugcuauuguccagucauuuguuugua

SEQ ID NO: 80439 - RNA, 87 nt, Mus musculus
uuggcugcucacagccaaaaccacauagcuuuauaguacuggagucuuguaucugcggaaaccaugcagauacauauaauuagagag

SEQ ID NO: 80440 - RNA, 46 nt, Mus musculus
uuuuccagugugucaaaaacagggagcuuuuugucagggguggaau

SEQ ID NO: 80441 - RNA, 47 nt, Mus musculus
guuuauagggaugagcugugccaaagaguugaucauuuggaucagau

SEQ ID NO: 80442 - RNA, 46 nt, Mus musculus
gucacuucaggaucccuccccuggacuuaacaggacguaggagaug

SEQ ID NO: 80443 - RNA, 82 nt, Mus musculus
ugagcuuccggugaucuucaguaaaucugguucagccccaggcacagcuucuugcccuuaggcaggggaacagagcacugcu

SEQ ID NO: 80444 - RNA, 47 nt, Mus musculus
agaguaaauggguuauuuuuaaugcaauuguauucagauguagaccg

SEQ ID NO: 80445 - RNA, 46 nt, Mus musculus
cccaccgugcaggacuguaauaaaagagaaacaaaugaggcagcuc

SEQ ID NO: 80446 - RNA, 59 nt, Mus musculus
uaauauucaacuauuaauaucguucugcuaaaacaguuuagaauaaagauuuaauguuc

SEQ ID NO: 80447 - RNA, 45 nt, Mus musculus
cauggcaggaaguggauucuucaugcuucagagcugauuuguauu

SEQ ID NO: 80448 - RNA, 44 nt, Mus musculus
ucuaguuuaucuucauucuuugauuggcuagugauugagugugg

SEQ ID NO: 80449 - RNA, 46 nt, Mus musculus
cuauguaguccuaaaugacaugaaaaccucuguagaacaaguagaa

SEQ ID NO: 80450 - RNA, 45 nt, Mus musculus
uaucuauugcccagaacauuaaaacagagaagcuggggggggggg

SEQ ID NO: 80451 - RNA, 46 nt, Mus musculus
cugccuggagcuucaguggcugaguaggauuucaaaucaaggugaa

SEQ ID NO: 80452 - RNA, 44 nt, Mus musculus
aaagaagcuaguuauagcuuggacuuugcuugauaaaugaagau

SEQ ID NO: 80453 - RNA, 46 nt, Mus musculus
gaguagguaaaauuucaacuugccagauggcaugggugcagaaaac

SEQ ID NO: 80454 - RNA, 45 nt, Mus musculus
ggcuuaaaauuauucaugaugcuuuacugaucaugcggaccacuu

SEQ ID NO: 80455 - RNA, 45 nt, Mus musculus
uuaguuuuuacuccaggcagaucuacucaguaauugguggguaag

SEQ ID NO: 80456 - RNA, 46 nt, Mus musculus
agugguuauauggauuuuaucuuaaagaaggacauaggaaacagau

SEQ ID NO: 80457 - RNA, 50 nt, Mus musculus
agaaucaagaacagaggcuaacucaguggggaccauuaguagugaaaaga

SEQ ID NO: 80458 - RNA, 45 nt, Mus musculus
cacagacugcccacuuccaggaucugaugugauucccucucggau

SEQ ID NO: 80459 - RNA, 46 nt, Mus musculus
gccccuuagcaugccuuucaacguagcuuuuucuagccgaggggau

SEQ ID NO: 80460 - RNA, 46 nt, Mus musculus
uaacaggauccaucccaacugagugacacuaaacagacagccagag

SEQ ID NO: 80461 - RNA, 46 nt, Mus musculus
uuuuuaaagcacggaacgggaaaggcauaugguuaugauuugagaa

SEQ ID NO: 80462 - RNA, 45 nt, Mus musculus
aaauaccacuuuaaagaaauuugaaguuacaaagaaugucuagaa

SEQ ID NO: 80463 - RNA, 37 nt, Mus musculus
uguaugcugcugugacuguaguuacuagccacuagaa

SEQ ID NO: 80464 - RNA, 46 nt, Mus musculus
caaauggcuugggaaaugguggauaauaagauacugugaggcaaaa

SEQ ID NO: 80465 - RNA, 45 nt, Mus musculus
aaaaagcugucucuagccccuuccuguagagaauuucccaccggu

SEQ ID NO: 80466 - RNA, 46 nt, Mus musculus
uggcagaaaaucugggggugaaacucauacagacuaccaagaagac

SEQ ID NO: 80467 - RNA, 50 nt, Mus musculus
cuggaaaagagacucccaaacauugucucaucgacugacuagauggaaga

SEQ ID NO: 80468 - RNA, 45 nt, Mus musculus
aaaauuuuguuucauacuauggugucuugagcaugaaagcauaaa

SEQ ID NO: 80469 - RNA, 45 nt, Mus musculus
acugauuagugaaaugugaagggcugagagagguaggaaugagag

SEQ ID NO: 80470 - RNA, 45 nt, Mus musculus
aacuuuaugacagugcuguuuuauacuguucugauuugaccagag

SEQ ID NO: 80471 - RNA, 42 nt, Mus musculus
agcuuucagaaggcuuuaucuuggcuuauaauaucagaggau

SEQ ID NO: 80472 - RNA, 46 nt, Mus musculus
guaccuuagauauaacugauauuuaugaucugaaccaugcccugua

SEQ ID NO: 80473 - RNA, 51 nt, Mus musculus
cuuaucugucuuccuguaacuuugagagguaacuguugagaacaauauguu

SEQ ID NO: 80474 - RNA, 46 nt, Mus musculus
cucuaucucuguauaucaugggaaagcucaugcugucgcuucagag

SEQ ID NO: 80475 - RNA, 46 nt, Mus musculus
auucaacucauaugauucccauuuauuagcacuuuugccagccaca

SEQ ID NO: 80476 - RNA, 46 nt, Mus musculus
guauagauacaugcuacuuuaaggaaacuaagucuauaaagcagau

SEQ ID NO: 80477 - RNA, 45 nt, Mus musculus
uccagcaauccagaagaaaacaaacguuagugucagaagugucug

SEQ ID NO: 80478 - RNA, 46 nt, Mus musculus
aguaagaaguauucugucuaguuacauaccagcaucucuguuagau

SEQ ID NO: 80479 - RNA, 61 nt, Mus musculus
cucauaaaugucaauuaaguuucuauuaagacucaguauguaaaaugaaauuuuaaccuag

SEQ ID NO: 80480 - RNA, 61 nt, Mus musculus
guguguaguuaccugcugauccaccucuccagcccuacuucuaaaucuuguauaaucagca

SEQ ID NO: 80481 - RNA, 44 nt, Mus musculus
auaacuagauauuuuaugucccuuacccguuacaugaggucauu

SEQ ID NO: 80482 - RNA, 45 nt, Mus musculus
uugaggacuguaacaucuaaaacaggguagguaccuacagagaga

SEQ ID NO: 80483 - RNA, 46 nt, Mus musculus
gucuucccucagcaucccaaguagcugggagugugugugugugugu

SEQ ID NO: 80484 - RNA, 45 nt, Mus musculus
ggcuucucucuuugcuuccucccccacacuuaauuaguuucuaga

SEQ ID NO: 80485 - RNA, 42 nt, Mus musculus
caaggaggaggcugcagaauacgcuaaacuuuugaccaagag

SEQ ID NO: 80486 - RNA, 46 nt, Mus musculus
uccauaaaggcuggggugcgugugcuguuuccuucaugcgguagau

SEQ ID NO: 80487 - RNA, 42 nt, Mus musculus
acaacuguccuauccaccuuucuuuucaucugugggccauag

SEQ ID NO: 80488 - RNA, 46 nt, Mus musculus
gcuaggcuugaugaagaauagacaguggaaaaugaacagacaagac

SEQ ID NO: 80489 - RNA, 46 nt, Mus musculus
uuuuaaaacuaaaaugauuaacuuucgguuuauaccaugcugagaa

SEQ ID NO: 80490 - RNA, 46 nt, Mus musculus
augcuguuauaaaaauaacugagaucuacauagaaucacuggagaa

SEQ ID NO: 80491 - RNA, 44 nt, Mus musculus
acaguagaguggauucugcagaugguguauugucugugcauagg

SEQ ID NO: 80492 - RNA, 42 nt, Mus musculus
gcugggcgugguggcgcacgccuuuaauccuaacacuuggga

SEQ ID NO: 80493 - RNA, 46 nt, Mus musculus
aaaagucuucucuaaugauaaaggucauaacaaugagcugcuggag

SEQ ID NO: 80494 - RNA, 41 nt, Mus musculus
aucacaauuugugugugugugugugugugugugugcgcaca

SEQ ID NO: 80495 - RNA, 46 nt, Mus musculus
ucauauauauauuucuuaucagaaugcaaagugagaggagccuuau

SEQ ID NO: 80496 - RNA, 57 nt, Mus musculus
uuuuuaacuacagggagaaaacuccaaaggcucagcuucauacuaaauaucugacca

SEQ ID NO: 80497 - RNA, 46 nt, Mus musculus
ggcucuaaucuguuuguauuuaauauaauuaguuuagcccauugag

SEQ ID NO: 80498 - RNA, 41 nt, Mus musculus
uaagaaaaacuaacauuuugcuuuuuauuugaugccggaga

SEQ ID NO: 80499 - RNA, 45 nt, Mus musculus
gugcauggguaugugugggugcaugggugugugugggugugugug

SEQ ID NO: 80500 - RNA, 46 nt, Mus musculus
uaacagacuaguggccuuauguggacuuuccgugaauaaaacagau

SEQ ID NO: 80501 - RNA, 46 nt, Mus musculus
caacauuaauccuucuuugaagugaauauuuuaaaaguggccaauu

SEQ ID NO: 80502 - RNA, 45 nt, Mus musculus
uggagugaagaaaacagagaauugaagaugagaccaaaaccaggu

SEQ ID NO: 80503 - RNA, 46 nt, Mus musculus
caaaauaaaaaaaaaucagucaaguaaauaaaaucaucuugcagau

SEQ ID NO: 80504 - RNA, 42 nt, Mus musculus
gaggucuagagacccaccauucacuuuuaauuaaccacugca

SEQ ID NO: 80505 - RNA, 46 nt, Mus musculus
acaaauaaaaaaaaaucagucaaguaaauaaauucaucuugcagau

SEQ ID NO: 80506 - RNA, 46 nt, Mus musculus
cugcuguuucacauguagcccugcucauaguagacccuggcaaaga

SEQ ID NO: 80507 - RNA, 47 nt, Mus musculus
uuagagucaugguccccaaauuaaaggguaaccauuaggacagauca

SEQ ID NO: 80508 - RNA, 41 nt, Mus musculus
uucacaaaccaacaucuaacacaaguagcugagccacacaa

SEQ ID NO: 80509 - RNA, 46 nt, Mus musculus
guacaaugacugcuuuuauugaaccaugauacaugauaaguugagg

SEQ ID NO: 80510 - RNA, 60 nt, Mus musculus
auuuuucuuaaaagaugaguuauuuaacaaaauuaugccauaggaugauuugacccauug

SEQ ID NO: 80511 - RNA, 46 nt, Mus musculus
auaaccaguguccuucagagcagaucgugacauuaacaucuaagaa

SEQ ID NO: 80512 - RNA, 46 nt, Mus musculus
ucacaaccucugcuuacuuucuuguuucuggguucuguccccaccu

SEQ ID NO: 80513 - RNA, 42 nt, Mus musculus
aauugaugcugauuaugaaaugaauuuacaggagugggagau

SEQ ID NO: 80514 - RNA, 46 nt, Mus musculus
uuuuauaaaauauuacacacuauaccauacuuuauaguuacgaguu

SEQ ID NO: 80515 - RNA, 44 nt, Mus musculus
augacacgguauugagucacuucacagacucacaguuuguagga

SEQ ID NO: 80516 - RNA, 45 nt, Mus musculus
aacaagucaagugacugcguguuuuuuaccauggaguacaguaua

SEQ ID NO: 80517 - RNA, 46 nt, Mus musculus
gauguaaguacaucuuuagugaaaccugguugcggugacagugcgg

SEQ ID NO: 80518 - RNA, 46 nt, Mus musculus
aucagugcuaucaagaagugauaacccuugagauagguauaaagag

SEQ ID NO: 80519 - RNA, 46 nt, Mus musculus
aauuccuaaugccucugcuucacgaaugcucagccuuuccccuuac

SEQ ID NO: 80520 - RNA, 46 nt, Mus musculus
acaagagaggguaauccuccugccccagccucccaagugcugagau

SEQ ID NO: 80521 - RNA, 46 nt, Mus musculus
acuguguuagugcaugcuauaggagucuaucacuugagagguagau

SEQ ID NO: 80522 - RNA, 45 nt, Mus musculus
ggaggaagaugacaaguuugaaagugaaaauguuacccaggaaag

SEQ ID NO: 80523 - RNA, 46 nt, Mus musculus
ccuccugucucccccagaugccccguuuguauuucagcccccuccu

SEQ ID NO: 80524 - RNA, 47 nt, Mus musculus
cguguguuuuugauaaauuuaagaagucaaaucgcugacacagauag

SEQ ID NO: 80525 - RNA, 42 nt, Mus musculus
caacacuagagcuaagggggggggggagugguuuacccagaa

SEQ ID NO: 80526 - RNA, 66 nt, Mus musculus
aguuauucuucucuucugugucacuuuugacggauggcaccuaaugcaaucaaccacugacuggga

SEQ ID NO: 80527 - RNA, 45 nt, Mus musculus
auguuggggcuggagagauggcuuguggugcugcucuuccagagg

SEQ ID NO: 80528 - RNA, 45 nt, Mus musculus
aaacuuuucaacugggaauuaaagaucuuuacuacaaggggagag

SEQ ID NO: 80529 - RNA, 46 nt, Mus musculus
uuaggguccauuuuccacuuagguguacaugauaccuccagcaggg

SEQ ID NO: 80530 - RNA, 46 nt, Mus musculus
uaagaggcaucuucagaaaugaugucgaaagaaguguaaaaggggu

SEQ ID NO: 80531 - RNA, 45 nt, Mus musculus
aaauaugcuuauaaaaaugaaacuguagucuuaaaaauaaugaga

SEQ ID NO: 80532 - RNA, 42 nt, Mus musculus
agcagccuggaaaccagaacccuggcuucauacaggugagau

SEQ ID NO: 80533 - RNA, 45 nt, Mus musculus
acccuccggugaaacauuuaugacuggacuggacuugggcgaggg

SEQ ID NO: 80534 - RNA, 44 nt, Mus musculus
agaauccuggaagacaagcuggucaagaugcagaggagguagga

SEQ ID NO: 80535 - RNA, 46 nt, Mus musculus
uccacauuuugcgagguuccccucauccucugaagcaccugggauu

SEQ ID NO: 80536 - RNA, 25 nt, Mus musculus
ucugugcaguaaggaaaacugaauc

SEQ ID NO: 80537 - RNA, 46 nt, Mus musculus
aauuuagaagaauaauaguuucuauacccacauuaagccagcuuuu

SEQ ID NO: 80538 - RNA, 29 nt, Mus musculus
aguggaugugagagaaagagacacacaga

SEQ ID NO: 80539 - RNA, 46 nt, Mus musculus
aguguccuuaagccucccacaaauaacagccauuagugggaagguc

SEQ ID NO: 80540 - RNA, 44 nt, Mus musculus
agaagaggcaagagagaacacgcaggcaggcaggcaggcaggca

SEQ ID NO: 80541 - RNA, 46 nt, Mus musculus
gcuugcugcugcaugccaguugauuuuuguguuuugugugugugug

SEQ ID NO: 80542 - RNA, 45 nt, Mus musculus
gaaagcaauaauugugaaaaugguauuuaucccaauggccuaguu

SEQ ID NO: 80543 - RNA, 45 nt, Mus musculus
ugucugucugucugucugucuguuacugcugaguguguguuauga

SEQ ID NO: 80544 - RNA, 45 nt, Mus musculus
uuuauguuuuaagggaaacgaauauuuuacuguccucucaucaaa

SEQ ID NO: 80545 - RNA, 41 nt, Mus musculus
uaucuuuacguuaaagaagauaauucauagaggcaggcaga

SEQ ID NO: 80546 - RNA, 35 nt, Mus musculus
ugaaacucacuaugcagaucacaguggccccagau

SEQ ID NO: 80547 - RNA, 46 nt, Mus musculus
cacacacacacacacauauauauacauacaugaauauuacaaauau

SEQ ID NO: 80548 - RNA, 46 nt, Mus musculus
agugucuuguugcaaccaagauuucuguaaaauacugccugcagac

SEQ ID NO: 80549 - RNA, 47 nt, Mus musculus
uagacuuuucuuuuuaaaccuuagguuuaaaauaaacccugcuaacu

SEQ ID NO: 80550 - RNA, 88 nt, Mus musculus
uuucucuccugggacucuucauaugauuuucccucuggcuuagaucuucaauauccuucucucaucugacuuuguccccuuugcucac

SEQ ID NO: 80551 - RNA, 45 nt, Mus musculus
agacuuuguacacacacucaagucauugcgcaguuucuuugagau

SEQ ID NO: 80552 - RNA, 46 nt, Mus musculus
uauguacuuucacaucuauaacuuuuuaaauaaagcucagugagau

SEQ ID NO: 80553 - RNA, 46 nt, Mus musculus
acacagagagagagagagagagagagagagagagagagucauauuu

SEQ ID NO: 80554 - RNA, 45 nt, Mus musculus
accuuaggaccgagucuugacuggcucaugauggaugcucugaga

SEQ ID NO: 80555 - RNA, 46 nt, Mus musculus
caaguguucaugguacccuaggcagcucaccuacagucggguaaau

SEQ ID NO: 80556 - RNA, 41 nt, Mus musculus
cagcccugaccaagcacucuguccugagauauagccccagc

SEQ ID NO: 80557 - RNA, 46 nt, Mus musculus
gaugaaguuaauauucuagaaaaaccuuuauaucuccuuaagagcu

SEQ ID NO: 80558 - RNA, 46 nt, Mus musculus
gauuucagaacaccuucauagauauuuuuugagauuuguaugagau

SEQ ID NO: 80559 - RNA, 45 nt, Mus musculus
auauuuugaagauuuguguuuuagccccagcauguggacggagau

SEQ ID NO: 80560 - RNA, 46 nt, Mus musculus
aaugaucacgcaaccacccucccaccugccccccacccccagccug

SEQ ID NO: 80561 - RNA, 46 nt, Mus musculus
acuuauuaauucuaaauagucaggucucagaauauguuguguggau

SEQ ID NO: 80562 - RNA, 36 nt, Mus musculus
uucuccaaagccagugccacucccagucggagagau

SEQ ID NO: 80563 - RNA, 36 nt, Mus musculus
cccuauauuucaauuuuuguuuauuuuugaacguca

SEQ ID NO: 80564 - RNA, 41 nt, Mus musculus
ugaaguagguaaaagauuuuacuugugcuuuuugagggaug

SEQ ID NO: 80565 - RNA, 45 nt, Mus musculus
cccaggaacacgauagguuggccaccaagauuuuucuguguagac

SEQ ID NO: 80566 - RNA, 42 nt, Mus musculus
ccccuuuaccuucuccucuccucuuacuuccuuaccccucuc

SEQ ID NO: 80567 - RNA, 46 nt, Mus musculus
agguuugucuguuuauuauguguuuacaauauuaggagcagagauc

SEQ ID NO: 80568 - RNA, 46 nt, Mus musculus
ggcuacaccccuaccccaaggacugagucuccuucagcccccaguu

SEQ ID NO: 80569 - RNA, 45 nt, Mus musculus
gccuauaggucaaguuugcggguggaauauaggauugagcccaga

SEQ ID NO: 80570 - RNA, 44 nt, Mus musculus
gugucugguguggauguguguggguguguguggguguguguagg

SEQ ID NO: 80571 - RNA, 44 nt, Mus musculus
aagcuugagaguuuguuaguguugaaagugugugugcgguacug

SEQ ID NO: 80572 - RNA, 42 nt, Mus musculus
uggggggagguguucagaagaaaaugaggaaggacugaaguu

SEQ ID NO: 80573 - RNA, 46 nt, Mus musculus
uuugggacuuuauuguguuagaaugcuugauuucacaauugcuggu

SEQ ID NO: 80574 - RNA, 45 nt, Mus musculus
ggagguuuuaggguuauguuuguguuuagauuaaauuugaauggu

SEQ ID NO: 80575 - RNA, 33 nt, Mus musculus
caagcaggaacagagaugggaaccuuggcagaa

SEQ ID NO: 80576 - RNA, 55 nt, Mus musculus
aaaaagagaaaaaagaaaggagagaaagaaggauaugaaaauaggagaagugaga

SEQ ID NO: 80577 - RNA, 46 nt, Mus musculus
ugaaacaugucucagcugaggcccuuaggagcugaaguggguucga

SEQ ID NO: 80578 - RNA, 71 nt, Mus musculus
ggccugccauguuugcuugagugucugaguuuggugacaguucuguuauuauauuaaagauguuuccugcc

SEQ ID NO: 80579 - RNA, 46 nt, Mus musculus
ugccaugacccgggcaacuuauaacauaaguuuuugagguccauag

SEQ ID NO: 80580 - RNA, 46 nt, Mus musculus
ggauauuuguaacaugucuacuaaacagauuucuuacauugaagug

SEQ ID NO: 80581 - RNA, 46 nt, Mus musculus
cuuggguccuagagaccaaagaaagaaucagcaggaaggcccaggg

SEQ ID NO: 80582 - RNA, 44 nt, Mus musculus
ucaguguacuuguguaaaagaaacagucuuauaugguaggcagc

SEQ ID NO: 80583 - RNA, 46 nt, Mus musculus
ugaacacagaaaacguacaguaagaaugcaguagaaaugcugaaaa

SEQ ID NO: 80584 - RNA, 45 nt, Mus musculus
ugaauuguuaugugaacauagcugauuauucuucacaguccuaga

SEQ ID NO: 80585 - RNA, 41 nt, Mus musculus
auguggcaaagcuaaguccuuccuaauauauggcugguggg

SEQ ID NO: 80586 - RNA, 46 nt, Mus musculus
auaacuuuuauuauucuauuuaguuaaaacauuaaugguccaaaaa

SEQ ID NO: 80587 - RNA, 46 nt, Mus musculus
aauaaauuuuguuuuaaucugugcagcuguaguuuacuuugcaggc

SEQ ID NO: 80588 - RNA, 45 nt, Mus musculus
cucaagcgagugauuaggcugcacuccagcguuaacccagggcaa

SEQ ID NO: 80589 - RNA, 44 nt, Mus musculus
cagaaauagcuggagcuaaccagggggacaaaagucaacgggau

SEQ ID NO: 80590 - RNA, 45 nt, Mus musculus
cacuauggcucaugcaugauggggcauguucacaucucagaagac

SEQ ID NO: 80591 - RNA, 46 nt, Mus musculus
cacacggagggcauggugcucuugaggugaggaugcaggcugucac

SEQ ID NO: 80592 - RNA, 69 nt, Mus musculus
uaggaauuccucaaaacccccagauaggaagcaggggccaccaaauguaguuuugugguuagggcagac

SEQ ID NO: 80593 - RNA, 46 nt, Mus musculus
ugaauucucugagcaagacaucauuguuuuucuaagaaggagugga

SEQ ID NO: 80594 - RNA, 45 nt, Mus musculus
cuccagcacuuugugaugacuuuuauaagucuggugguuggauug

SEQ ID NO: 80595 - RNA, 45 nt, Mus musculus
aagcacuccagguagacacugugguauggaccaaaaggcacagau

SEQ ID NO: 80596 - RNA, 45 nt, Mus musculus
cuguuguggacaaucugaaguggucccauauuccacaccugggau

SEQ ID NO: 80597 - RNA, 46 nt, Mus musculus
auaauugcagaaauuaucugccacuggcaaaaccacgccccugcua

SEQ ID NO: 80598 - RNA, 29 nt, Mus musculus
uggugugcaugaagacagagcauucacuc

SEQ ID NO: 80599 - RNA, 46 nt, Mus musculus
uugguguuucaucucugaauuggaaacugacagcucagugugagag

SEQ ID NO: 80600 - RNA, 46 nt, Mus musculus
cuaccaccucucuuaauaguagaaaauacuaauuuuguguggaauc

SEQ ID NO: 80601 - RNA, 45 nt, Mus musculus
uauucaggagguagagggaggaggaucaggaguucaaggucauca

SEQ ID NO: 80602 - RNA, 42 nt, Mus musculus
guguuagugugggguaggugaccauggagaugggccagaggc

SEQ ID NO: 80603 - RNA, 45 nt, Mus musculus
aaccuuuccuuuaguagcucaucuuucuuuuuucccacugacuga

SEQ ID NO: 80604 - RNA, 46 nt, Mus musculus
acccuuugugagguuuuuauguuuaaguucuacuuccuguccaggu

SEQ ID NO: 80605 - RNA, 46 nt, Mus musculus
auguacaguagcaaaaauuuuuauaaauuaggaaugauaauaauuu

SEQ ID NO: 80606 - RNA, 41 nt, Mus musculus
uggaggaaacgaucuaggugugaggggagguuggggggaaa

SEQ ID NO: 80607 - RNA, 41 nt, Mus musculus
guggagggaggauggaggguccuaggagagagagcuggaaa

SEQ ID NO: 80608 - RNA, 42 nt, Mus musculus
cccuuggggcaaugagucuccugauguuuuaaugcuggagcu

SEQ ID NO: 80609 - RNA, 46 nt, Mus musculus
guucuguaugauaacagacacacuucaugcccuggaggguggaauu

SEQ ID NO: 80610 - RNA, 41 nt, Mus musculus
gaaaaaaccacuaacaacucuuggugguacuccaggggaca

SEQ ID NO: 80611 - RNA, 46 nt, Mus musculus
aacccuagggauggugaugcuccucuuuagccuccagccuccagua

SEQ ID NO: 80612 - RNA, 46 nt, Mus musculus
aauuuauggauuuuuaaaaaauuauuauggguaaugcugcugagaa

SEQ ID NO: 80613 - RNA, 71 nt, Mus musculus
agaaagcagggaacaacaaugaaugucauugguucuggugucgaaucuuuacccgcucaguguuuggagau

SEQ ID NO: 80614 - RNA, 46 nt, Mus musculus
cugggaagggagcuuaguugguagagcgccucccaugguagcauga

SEQ ID NO: 80615 - RNA, 41 nt, Mus musculus
aagacuaacaguuagugaaggaauuuugcuuaaccggccaa

SEQ ID NO: 80616 - RNA, 46 nt, Mus musculus
agcuucacugucugcaaaggcaaggagaacccgaaaggccccacug

SEQ ID NO: 80617 - RNA, 45 nt, Mus musculus
ugaaauuccuuuuuaguaucuuuuuccccccuuaguccaaagcca

SEQ ID NO: 80618 - RNA, 41 nt, Mus musculus
auauuauuaaucaguaaauaagcuacauuuaaacggcagag

SEQ ID NO: 80619 - RNA, 46 nt, Mus musculus
gcacgccuuuucuuccccuggcuaguauuacuauuugucuacagau

SEQ ID NO: 80620 - RNA, 46 nt, Mus musculus
guggagcucaggacaaaacuagacggaaucucccgugggaugaggc

SEQ ID NO: 80621 - RNA, 42 nt, Mus musculus
cgauggcguccucacaucuagcaaggggcagcugcagaaaau

SEQ ID NO: 80622 - RNA, 46 nt, Mus musculus
cagcuccagacuacaugccagacuguccuggucaacgcccaagggu

SEQ ID NO: 80623 - RNA, 42 nt, Mus musculus
cccagcaaccgcaugguggcucucaaccuucuguaauggggu

SEQ ID NO: 80624 - RNA, 45 nt, Mus musculus
aacacaaucgaauuuccaaaggacccuuaaguuuccacuucaagg

SEQ ID NO: 80625 - RNA, 41 nt, Mus musculus
aucagaaguucucagcugugccugucucagggaaacgaaga

SEQ ID NO: 80626 - RNA, 62 nt, Mus musculus
agagaugacuuaccugugguacuuugaaaaugcuugccccagggaguggcacuauuuggagg

SEQ ID NO: 80627 - RNA, 25 nt, Mus musculus
cgcgggcgcugcgggaggaccgacg

SEQ ID NO: 80628 - RNA, 46 nt, Mus musculus
aagcucuuuuaucuucuugguucuuauguagggucucuggcuagau

SEQ ID NO: 80629 - RNA, 42 nt, Mus musculus
acugaugagagagagggagagggagagggagagggagaggga

SEQ ID NO: 80630 - RNA, 46 nt, Mus musculus
uggaugucaguuuuggaguggcuaccaacauaacaaaaaugagaag

SEQ ID NO: 80631 - RNA, 45 nt, Mus musculus
cuagugagcuguaugugcucaaugccacagcagcuuugucccuag

SEQ ID NO: 80632 - RNA, 46 nt, Mus musculus
cuuggugaaagugcaggagcccaaaaagaagaaagcaaaaguagaa

SEQ ID NO: 80633 - RNA, 53 nt, Mus musculus
aggugguauucuguggaccagucggcacuacaagacaaagcccacucauggca

SEQ ID NO: 80634 - RNA, 42 nt, Mus musculus
cacucccgcgccacgccggccccgcagucuccucccgguccc

SEQ ID NO: 80635 - RNA, 46 nt, Mus musculus
aggaaacaaacagauaagauaaauauuuguauaugauggucccgag

SEQ ID NO: 80636 - RNA, 31 nt, Mus musculus
gcuaagggcugaggucccuagugcaggcccg

SEQ ID NO: 80637 - RNA, 44 nt, Mus musculus
uuggaauaauugguggaacaggcuuggaugaucccgaaauuuua

SEQ ID NO: 80638 - RNA, 46 nt, Mus musculus
uaagugcugaguggcucugagagaugaugugugggaaacacgggga

SEQ ID NO: 80639 - RNA, 46 nt, Mus musculus
caccuaucacuucacauacacaccucgcaaauuagcuuggaugcaa

SEQ ID NO: 80640 - RNA, 45 nt, Mus musculus
uauuauuugugucaaguugacaaggggugaauuguaguggcuguu

SEQ ID NO: 80641 - RNA, 45 nt, Mus musculus
cugugacccuaaucuggaggcugggagauacuaguuucucaccug

SEQ ID NO: 80642 - RNA, 46 nt, Mus musculus
uucucucccugcaagcauucuggacaguucucccccuuuccaccug

SEQ ID NO: 80643 - RNA, 41 nt, Mus musculus
gcaagcauugccauggcaaccgacuaugauuguuggaagga

SEQ ID NO: 80644 - RNA, 45 nt, Mus musculus
uuggguguagcuuaugguguuaaccaccaguccguuuacuaugag

SEQ ID NO: 80645 - RNA, 45 nt, Mus musculus
cauuaaaacuucaaugacuuuacagagauacaagauaagggguag

SEQ ID NO: 80646 - RNA, 45 nt, Mus musculus
gugguuuuccuuagcuucauuuuuaauuucucgucugugugugug

SEQ ID NO: 80647 - RNA, 45 nt, Mus musculus
uugguuuuccuuagcuucauuuuuaauuucucgugugugugugug

SEQ ID NO: 80648 - RNA, 49 nt, Mus musculus
uaaacaaaaaugggaaagauccgcagccuucaugccuuugccuagaaag

SEQ ID NO: 80649 - RNA, 46 nt, Mus musculus
gacaacaaggauuacuagugaaaacauccacuacccuacagcgcua

SEQ ID NO: 80650 - RNA, 45 nt, Mus musculus
uauuccuucaaagaaucauguguaaagaagaauauuaccugccau

SEQ ID NO: 80651 - RNA, 45 nt, Mus musculus
aaauuagcugugccguguuuccguuauacuuagguuauggagcaa

SEQ ID NO: 80652 - RNA, 77 nt, Mus musculus
aauuaaaauggacuuagagaacuuugaaacuccuuugguggugaagugaagacaacaacaauaauauaacugcgcug

SEQ ID NO: 80653 - RNA, 46 nt, Mus musculus
guaguguuucaauaaacaucaguuugcagacuucucagaugaucag

SEQ ID NO: 80654 - RNA, 46 nt, Mus musculus
gaugagauuaccgguuacauggccuagauuggggaaucccacagaa

SEQ ID NO: 80655 - RNA, 45 nt, Mus musculus
uuauucugccaucuuacagucauagaaagaagccaacacucagag

SEQ ID NO: 80656 - RNA, 24 nt, Mus musculus
agggggcggggccggcggcggugc

SEQ ID NO: 80657 - RNA, 47 nt, Mus musculus
ccaaaaaggauaaagacccaguaaauaaaucugguggcaaggccaag

SEQ ID NO: 80658 - RNA, 45 nt, Mus musculus; identical to SEQ ID NO: 55210

SEQ ID NO: 80659 - RNA, 31 nt, Mus musculus
auaauuuacaccagaaacacaaaggguggag

SEQ ID NO: 80660 - RNA, 46 nt, Mus musculus
caaaugugaaucuuuuuauuacugaguaguauucuacaguacagau

SEQ ID NO: 80661 - RNA, 45 nt, Mus musculus
ugugugucugugugucucucugugugugugugugugugugugugu

SEQ ID NO: 80662 - RNA, 24 nt, Mus musculus
uggaggaaacaccugaauguuuuu

SEQ ID NO: 80663 - RNA, 46 nt, Mus musculus
gcaacuguuauaaggcagcaacuguuaaguggugauggauggaaac

SEQ ID NO: 80664 - RNA, 92 nt, Mus musculus
caguguuuuaaagguggacaaauauaagaagcuggaauaaagaacugcugguagagagugggaggaggccacuuuuaaaggaagggcauuaa

SEQ ID NO: 80665 - RNA, 46 nt, Mus musculus
caaguaaagaugcuucucauuaaacuugauuccuguguccccaaca

SEQ ID NO: 80666 - RNA, 50 nt, Mus musculus
uuuuguguuuggauucuuugugcuuuuucauguucgguacaucaauaaac

SEQ ID NO: 80667 - RNA, 42 nt, Mus musculus
caguguuuacccgagcacuuaauaaaauguaaggcugguauu

SEQ ID NO: 80668 - RNA, 46 nt, Mus musculus
uucaucaggaugcacugagaacuauauaguuacguccugcguuuug

SEQ ID NO: 80669 - RNA, 46 nt, Mus musculus
aauuuccuuacauuuuucauacaaaaaucauaaauaucuguaugcu

SEQ ID NO: 80670 - RNA, 46 nt, Mus musculus
auucaguucuguuguccugaggacuugaauuuacagugcaucagau

SEQ ID NO: 80671 - RNA, 46 nt, Mus musculus
gaauguuuuguaucaguucuuuucuuuguaaauggcauuaacauug

SEQ ID NO: 80672 - RNA, 45 nt, Mus musculus
ugucuuaaggaagaugagauguugcacacguuuggauggcagcaa

SEQ ID NO: 80673 - RNA, 47 nt, Mus musculus
aacaaauaaaaaaaauuuacaaaagaauauauaagagcaggcaagaa

SEQ ID NO: 80674 - RNA, 68 nt, Mus musculus
auuugcaacgguuggaaaauuuagaaagauuuaugauguagaaaaauacuuuugagaucuuuguauga

SEQ ID NO: 80675 - RNA, 117 nt, Mus musculus
uauaaaaaagaaaauuuggagaaacuuuuuacugguccuggaacaaauauuuugacuugaauacuuugagaaaucucuucauaugacaccuagugagcuuuuaaaauuuaccaggaa

SEQ ID NO: 80676 - RNA, 46 nt, Mus musculus
agaauacuggagaacuuuucguaaagcaguaccuugccaaagagau

SEQ ID NO: 80677 - RNA, 46 nt, Mus musculus
cuauugccuucuuugaagaagguggaccuuuuaaaguguuucagcu

SEQ ID NO: 80678 - RNA, 46 nt, Mus musculus
cauaaucccuucccacaaccaauugauuucuuugauuuggggagca

SEQ ID NO: 80679 - RNA, 45 nt, Mus musculus
ccacagugggugcccauucucucaggaaugguaaaagacccagug

SEQ ID NO: 80680 - RNA, 42 nt, Mus musculus
ucaggaacccauggaauuguaaggaguaaaagugggcguuug

SEQ ID NO: 80681 - RNA, 45 nt, Mus musculus
gugccuuugagguuguggacugcaacacggcagacccaaauagau

SEQ ID NO: 80682 - RNA, 46 nt, Mus musculus
acauuggucaccuucucaggaaggcucagaguuccucaggacagca

SEQ ID NO: 80683 - RNA, 46 nt, Mus musculus
aacuucagauucugaguucuagucaaauauacaaacaggaugaaga

SEQ ID NO: 80684 - RNA, 48 nt, Mus musculus
gggaguaaggaacauuaguugaaaggaaaccccagcauuaguaaguga

SEQ ID NO: 80685 - RNA, 41 nt, Mus musculus
uguugcuguuucugaauaugguacaguucaagccgggugac

SEQ ID NO: 80686 - RNA, 50 nt, Mus musculus
uuggucacauacauuuuucccauugguauaauagaguauagaaaagagaa

SEQ ID NO: 80687 - RNA, 45 nt, Mus musculus
aacccaaauucucaaguuaucuaguugcugaauaaacaagcagac

SEQ ID NO: 80688 - RNA, 45 nt, Mus musculus
gguuacugggcccaaagcacacuuugagaaaaaccaggccugcag

SEQ ID NO: 80689 - RNA, 45 nt, Mus musculus
uuagcaaauacauauuuuuguucuuauuccaaggaaggggcugcc

SEQ ID NO: 80690 - RNA, 42 nt, Mus musculus
uuccuuugcucuguguguucauguuuuguuuugccccccacc

SEQ ID NO: 80691 - RNA, 46 nt, Mus musculus
uguucauaaauaugcauggacagaaauagauuguggaguggaguga

SEQ ID NO: 80692 - RNA, 57 nt, Mus musculus
ucacaguaugggcgcaucauuacuucucggauucuugucgaccaggucacugguaag

SEQ ID NO: 80693 - RNA, 62 nt, Mus musculus
caaacuuauacgucagcgggcuuccaaaaaccaugacccagaaggagcuggaacagcuguuu

SEQ ID NO: 80694 - RNA, 45 nt, Mus musculus
uuugugagcuuuuuuguuuguuugcuggauuuuguuuuguuuuaa

SEQ ID NO: 80695 - RNA, 46 nt, Mus musculus
uugaaacuugcugugagcaggaaaaucuuuuuuauacaauggagug

SEQ ID NO: 80696 - RNA, 46 nt, Mus musculus
uuuuuccaugcaccacggggcugauaacacguacaacucacagauc

SEQ ID NO: 80697 - RNA, 48 nt, Mus musculus
acacugaggauccagugaugagcaagacuugaauagcgaggauuauaa

SEQ ID NO: 80698 - RNA, 97 nt, Mus musculus
guaagccaaagagaacauguuuggaaaccacauggaccuacagcuuucuaaacaauguuuauaugauauggguaaagcagguaugaauuucaggucu

SEQ ID NO: 80699 - RNA, 46 nt, Mus musculus
uugucuuuuaaauggugcaugauuuucaaaugaagcacuuaaugua

SEQ ID NO: 80700 - RNA, 46 nt, Mus musculus
ccagcagcaaaggggauacuauuuggaggguuaauuauagcuagug

SEQ ID NO: 80701 - RNA, 44 nt, Mus musculus
uaaaacccugauguucaugccuguuuuauucauauggccccuuc

SEQ ID NO: 80702 - RNA, 28 nt, Mus musculus
ugcauccugaaaacagaccguucagaag

SEQ ID NO: 80703 - RNA, 68 nt, Mus musculus
ugaauagauuuucuuuggauauccuucucuaguugcuggaguggaagugagcuuauauagacagugga

SEQ ID NO: 80704 - RNA, 45 nt, Mus musculus
caugguggugugugugugugugugugugagagagagagagagaga

SEQ ID NO: 80705 - RNA, 46 nt, Mus musculus
ugaggagugauuuagaugcacguguuccagaaccagagcuguagua

SEQ ID NO: 80706 - RNA, 72 nt, Mus musculus
ggagcucauacagguuagccacgguugcacaguugcagacagcaguaacucuaguacaucuaauaccccacu

SEQ ID NO: 80707 - RNA, 45 nt, Mus musculus
gcagagcuuggguuacggauuugugaacuacauugaccccaagga

SEQ ID NO: 80708 - RNA, 46 nt, Mus musculus
gaugucugcuuucucaguaccgaggguugucggcauuguuucagug

SEQ ID NO: 80709 - RNA, 45 nt, Mus musculus
uuaggccagagaaugcagcacucucuuguucaaugcaccuuuacc

SEQ ID NO: 80710 - RNA, 46 nt, Mus musculus
aauaugaauuuaucauauucaccucuauuuccagacuccuccuaga

SEQ ID NO: 80711 - RNA, 42 nt, Mus musculus
aagaaaaucuuuuuuaaaagagcaaacuucuaaccaggaaua

SEQ ID NO: 80712 - RNA, 45 nt, Mus musculus
gucaauauaguuucaucugauuuugugaacacauagcacauagaa

SEQ ID NO: 80713 - RNA, 45 nt, Mus musculus
ggugguucagucucuggaagccuccaaagauccagguuaguagau

SEQ ID NO: 80714 - RNA, 42 nt, Mus musculus
aagagagagagagaggagagagagagagagagagagugugug

SEQ ID NO: 80715 - RNA, 42 nt, Mus musculus
agccuaggaagguuguugaugcuuuuauaccagccucgguga

SEQ ID NO: 80716 - RNA, 41 nt, Mus musculus
uagguagaauagaacuuuuacagagcuaucaaugggccauu

SEQ ID NO: 80717 - RNA, 46 nt, Mus musculus
caaccuaauagucaacuaccuuccucagaacaugacacaggaagaa

SEQ ID NO: 80718 - RNA, 46 nt, Mus musculus
auuaauuauucuuuaaguauucacugagaauacuuacccaagaaaa

SEQ ID NO: 80719 - RNA, 45 nt, Mus musculus
ugguuuaggaaaagcucccuggaaaaguuaaugugacuugagaug

SEQ ID NO: 80720 - RNA, 46 nt, Mus musculus
ccuagcaaauaaaacauauuuuggugaucuuguucaaauacaagua

SEQ ID NO: 80721 - RNA, 46 nt, Mus musculus
guagucaauaaacaguagccuuuuuucuucuaccuuucccuguuuu

SEQ ID NO: 80722 - RNA, 46 nt, Mus musculus
guuguaggauguuggcuauuugggggaagcuccauguaguuuggaa

SEQ ID NO: 80723 - RNA, 23 nt, Mus musculus
gucaaaggaggaguggugucucc

SEQ ID NO: 80724 - RNA, 42 nt, Mus musculus
cuucccacccccaccccuccuccuccagcguuuccugcagug

SEQ ID NO: 80725 - RNA, 45 nt, Mus musculus
cccagguuuguuuaccaagucuuggcggauagauugucuugcaga

SEQ ID NO: 80726 - RNA, 46 nt, Mus musculus
uacugcccuuuccucguggcuuugaauacuugcuaauuuuacagau

SEQ ID NO: 80727 - RNA, 46 nt, Mus musculus
cuucaaacaaugaguccauagguguuugugaggugagauagcagau

SEQ ID NO: 80728 - RNA, 46 nt, Mus musculus
uccaagaacuaaauggguucuuuguuuuuguaggauacuccaaaau

SEQ ID NO: 80729 - RNA, 46 nt, Mus musculus
ucaucugaggagauuuacaaaucuccauauuuacaaauaugggucc

SEQ ID NO: 80730 - RNA, 26 nt, Mus musculus
gaggggaagaagagaggacuuccgga

SEQ ID NO: 80731 - RNA, 42 nt, Mus musculus
ucaucucucuaaggaagaaauugaaggguauggugugggguc

SEQ ID NO: 80732 - RNA, 46 nt, Mus musculus
gccgggcucucaugcuguacaucgugguacacacaugagugcacac

SEQ ID NO: 80733 - RNA, 46 nt, Mus musculus
aucuccuagcuaguagugaguuuuaacaauuuaccugagccacaca

SEQ ID NO: 80734 - RNA, 46 nt, Mus musculus
ucuuucucuugaacaugcaugugugcgguggauauggaauccaggg

SEQ ID NO: 80735 - RNA, 45 nt, Mus musculus
ccauucuugcaauggagagacucaggcaguauuguuugcaggaau

SEQ ID NO: 80736 - RNA, 46 nt, Mus musculus
ugucucucucucucucugucucucugucucucucucucugucucuc

SEQ ID NO: 80737 - RNA, 45 nt, Mus musculus
accuggcagcagaauacaugguuaguacguaauucaguggcacag

SEQ ID NO: 80738 - RNA, 46 nt, Mus musculus
aagccagcauuaaugcagcuccugaggaugaacaaugcccacaaag

SEQ ID NO: 80739 - RNA, 46 nt, Mus musculus
ggacuuuuguuuucuguuguugguucuuuccugguagcacagaguu

SEQ ID NO: 80740 - RNA, 46 nt, Mus musculus
gaccucuggggcaaagauugcuugaaaucugauuauuaaaaaauuu

SEQ ID NO: 80741 - RNA, 42 nt, Mus musculus
uuucucuguaguucuggcugucuuggagcuugcucuguagau

SEQ ID NO: 80742 - RNA, 23 nt, Mus musculus
gguauuuauauggagggagggga

SEQ ID NO: 80743 - RNA, 46 nt, Mus musculus
aaaaagaaacgaaguucaaucucuuguuuugugauuuuaauuaaga

SEQ ID NO: 80744 - RNA, 28 nt, Mus musculus
aaaacagccggcuuucuacugcgaaaga

SEQ ID NO: 80745 - RNA, 69 nt, Mus musculus
gcaggcuacaaugggaggcuacauguucagugagcuucgggguugagguuggaaguucauuucguggga

SEQ ID NO: 80746 - RNA, 46 nt, Mus musculus
uuuuuuauuuuuauuuuuauuuuuuuuauucuugagagccagacua

SEQ ID NO: 80747 - RNA, 41 nt, Mus musculus
gcagcgaugcgcuggcaaacccagaaaaccuguaagugagc

SEQ ID NO: 80748 - RNA, 46 nt, Mus musculus
caccguuacuuuaaaaauacacauacacaaaaaccuuaagggagaa

SEQ ID NO: 80749 - RNA, 45 nt, Mus musculus
gagugugugugagagagaaggagaggaaagaaaaaaaggagggag

SEQ ID NO: 80750 - RNA, 46 nt, Mus musculus
ucugugggugguguaaagagauccacacacaaaagguugggggcug

SEQ ID NO: 80751 - RNA, 54 nt, Mus musculus
aggugaagaggaagcauaugaagaaacacaaggagagacauaagaugggcgagg

SEQ ID NO: 80752 - RNA, 44 nt, Mus musculus
agaaaccccggaagcuccaaagcaaccugcaaagaaaaagaaga

SEQ ID NO: 80753 - RNA, 42 nt, Mus musculus
gaagagaagaaaaagaagaaaaagaaaaaaggcagaauaaag

SEQ ID NO: 80754 - RNA, 46 nt, Mus musculus
ucccaagacagugaaaaacaagcccaucccuuccuuacgaguagcu

SEQ ID NO: 80755 - RNA, 46 nt, Mus musculus
auuuauuacaggaguugcuccccaaaaauguuacucauagcuggau

SEQ ID NO: 80756 - RNA, 41 nt, Mus musculus
cgggcggacuuggggccuggcugggcgcucggucgcgggcg

SEQ ID NO: 80757 - RNA, 46 nt, Mus musculus
guagaggagucuuuuauaaacgccuuuaaauguguagauuggaguu

SEQ ID NO: 80758 - RNA, 46 nt, Mus musculus
uguuuucugauaucucuucuaccuuacucccuuauugccccgacca

SEQ ID NO: 80759 - RNA, 45 nt, Mus musculus
ucuggugucacgugacacucauagagaaaagcaccugcacagaag

SEQ ID NO: 80760 - RNA, 46 nt, Mus musculus
ucauugaaaguaauuaaacagacccauucagaaaaugccugcaguc

SEQ ID NO: 80761 - RNA, 45 nt, Mus musculus
gagagagagacagagacagagacagagagagacagacagagaccg

SEQ ID NO: 80762 - RNA, 46 nt, Mus musculus
uuuaucugcuggcuuguuaggcugcacuuuuggaacuuuauaagau

SEQ ID NO: 80763 - RNA, 41 nt, Mus musculus
ugugauuuaaagaaaaggcguuugcuuucucuaggccaagu

SEQ ID NO: 80764 - RNA, 46 nt, Mus musculus
gcaaaagggagcauccuuaguaauguucagacaggaguccaaaggg

SEQ ID NO: 80765 - RNA, 45 nt, Mus musculus
guuccuuuccaauuacaaaagcaaggaagagaauggacuggcaga

SEQ ID NO: 80766 - RNA, 46 nt, Mus musculus
uaguguuugaaaagacaagauggauaaucgaaaaauacaggcuuuc

SEQ ID NO: 80767 - RNA, 30 nt, Mus musculus
ugguuauaagugaagaaguuagcccugaug

SEQ ID NO: 80768 - RNA, 48 nt, Mus musculus
cagaggaggagcaaaauucauuggaaugauuguuaguccauauaaucg

SEQ ID NO: 80769 - RNA, 31 nt, Mus musculus
cagagggaaaggauucugcagccuuggcuac

SEQ ID NO: 80770 - RNA, 44 nt, Mus musculus
cgcccacgugucuauggcagaggugauugggcuucuaggaggaa

SEQ ID NO: 80771 - RNA, 48 nt, Mus musculus
auccuuuccaacugauaccuuguaauuuuuucagugaagaaaagcagg

SEQ ID NO: 80772 - RNA, 46 nt, Mus musculus
auauauauucaaguguuauuucuacuaauagaaguugggucccuga

SEQ ID NO: 80773 - RNA, 46 nt, Mus musculus
gguccgagauccauggggaaacuggugugaugcaaaagacuuagaa

SEQ ID NO: 80774 - RNA, 45 nt, Mus musculus
uacacaccucucuuucgaagcugguccauuuuacacaccucagau

SEQ ID NO: 80775 - RNA, 46 nt, Mus musculus
uuuucucuuguguuucaccuuagccauuuaauuaugaaacagagac

SEQ ID NO: 80776 - RNA, 46 nt, Mus musculus
cugagccugggacuugaguuugaucacugggaucuacuugguagga

SEQ ID NO: 80777 - RNA, 42 nt, Mus musculus
ugguuuuguacaaaacaagcuucuaauuucaagguuagggga

SEQ ID NO: 80778 - RNA, 46 nt, Mus musculus
cugcuuauaagaagugcuuagaagacaaggcauuuuguuguuggag

SEQ ID NO: 80779 - RNA, 37 nt, Mus musculus
uuaaaaggggaagauaaaguuuuaaaaacaaagagac

SEQ ID NO: 80780 - RNA, 83 nt, Mus musculus
uagugucaguuauauggcaguaguuuccuaaguccguuucuuuaauacacaaagccuauuugguauuguuuaaauaugaagau

SEQ ID NO: 80781 - RNA, 23 nt, Mus musculus
uaauauugugugugugugauuuu

SEQ ID NO: 80782 - RNA, 45 nt, Mus musculus
cauugguuagccccuuuuaccaaauauuacaguuauugcuuagau

SEQ ID NO: 80783 - RNA, 46 nt, Mus musculus
uauaaucccagcgcaugggaggcagaggcaggcggauuucugaauu

SEQ ID NO: 80784 - RNA, 45 nt, Mus musculus
acagcaucaguuuuucaagaucacuaucuugauucaacguggaga

SEQ ID NO: 80785 - RNA, 35 nt, Mus musculus
acccugccuccuacccuauuuucuuuagcccugaa

SEQ ID NO: 80786 - RNA, 43 nt, Mus musculus
aauucugagagauguuuuagcauauggagaaugcucggcagau

SEQ ID NO: 80787 - RNA, 41 nt, Mus musculus
gcagucauggaggcggaggaggcggauguggauguggaagg

SEQ ID NO: 80788 - RNA, 42 nt, Mus musculus
ggaggaaagcaguuuuaccaggacaguuuuacagagacagac

SEQ ID NO: 80789 - RNA, 42 nt, Mus musculus
ccaguucccaugagaagagaaaggaaagggaaacgacuaaag

SEQ ID NO: 80790 - RNA, 41 nt, Mus musculus
ucuauauccucuuucucuuccuuucucucucuuucccuguc

SEQ ID NO: 80791 - RNA, 46 nt, Mus musculus
ggaguuugggguaauacaugggagugguauagcugggucauuuagu

SEQ ID NO: 80792 - RNA, 45 nt, Mus musculus
cccaaaucugcgccuuccccaggaaggaaccagcucuccucaggu

SEQ ID NO: 80793 - RNA, 46 nt, Mus musculus
cugcagguccagagguucauuaucuuaucuugggcuaguucuagcu

SEQ ID NO: 80794 - RNA, 45 nt, Mus musculus
acuaaagcccauugagaggugggcuugccugcaguuccgucuaau

SEQ ID NO: 80795 - RNA, 103 nt, Mus musculus
cugccgacagcuuuucuuuccgcuccuuuugaagccuggcugcuuuggacugcacgcccgacaugguggauacacugacacaaagcgcaccuuuuccuggcga

SEQ ID NO: 80796 - RNA, 47 nt, Mus musculus
ugcauuuccauuaaagcauuaaacugcuucaucauggaugcagguac

SEQ ID NO: 80797 - RNA, 46 nt, Mus musculus
acggagcacugcagcucaggcuccaacuccuuuucuuucagaaggc

SEQ ID NO: 80798 - RNA, 46 nt, Mus musculus
cucucagaaaaggcuuucugcugguaaacugacggaggcugugaag

SEQ ID NO: 80799 - RNA, 46 nt, Mus musculus
agagagaccagagcaguugugcuguacaaaccugcaauuccauuag

SEQ ID NO: 80800 - RNA, 42 nt, Mus musculus
cgccugauuuauaugcuguugggaacugagcccaggccagcc

SEQ ID NO: 80801 - RNA, 52 nt, Mus musculus
gcucacccuggccucaaucgugcaagcuaaggaauucagaucauccagugaa

SEQ ID NO: 80802 - RNA, 44 nt, Mus musculus
uuggucagcaaagcagcaguacauuuugaauuuauggguuaguu

SEQ ID NO: 80803 - RNA, 45 nt, Mus musculus
gagacccagaacaaagaaagaacacacuuuuuauaaggggcagau

SEQ ID NO: 80804 - RNA, 42 nt, Mus musculus
cacaaagaccacagagacagccaccgcugcagaccacaagag

SEQ ID NO: 80805 - RNA, 46 nt, Mus musculus
cucguggucuacugaguccacucacucccauguuccaccggggaug

SEQ ID NO: 80806 - RNA, 42 nt, Mus musculus
accucaguauccccacuaggaaaugaagaucaugaccaaggu

SEQ ID NO: 80807 - RNA, 23 nt, Mus musculus
agaaaagcuacaaagcugcagcu

SEQ ID NO: 80808 - RNA, 43 nt, Mus musculus
uuuuauuauuguguuugguacugucucuguagccagaggccgc

SEQ ID NO: 80809 - RNA, 42 nt, Mus musculus
gaaaccuaauugcauuuuuauugauuaaguaagacugcauuu

SEQ ID NO: 80810 - RNA, 42 nt, Mus musculus
gacauaugccuguaaucugaguaguaagagaagugaggugag

SEQ ID NO: 80811 - RNA, 45 nt, Mus musculus
ccaaucaaaaaguaccuauacgaauaaaacaauuagccggcagag

SEQ ID NO: 80812 - RNA, 42 nt, Mus musculus
cucagucucaggacccccgcgagugaacccccgcccgcgcca

SEQ ID NO: 80813 - RNA, 46 nt, Mus musculus
cccaggacacugcgaucacaaacaucucuucucccggccagccucu

SEQ ID NO: 80814 - RNA, 45 nt, Mus musculus
acacuuucccgggugcccaaucuuauguucuccacgucccuucuc

SEQ ID NO: 80815 - RNA, 46 nt, Mus musculus
uggacugccucuugaaagcccauuacuuucacuagguaugacgcca

SEQ ID NO: 80816 - RNA, 45 nt, Mus musculus
aauaaaucuuuaaaaaaaaaaaaagaaaaaagaaaaaaaaagaaa

SEQ ID NO: 80817 - RNA, 46 nt, Mus musculus
uuucacugauucagaguacagaaauacauuuaagggggcuggagag

SEQ ID NO: 80818 - RNA, 46 nt, Mus musculus
ccugccucugccucccaagugcugggauuaaaggggcgcgccaccu

SEQ ID NO: 80819 - RNA, 47 nt, Mus musculus
uuccugugcaucaugcuguagaaauccuucauacauaggguugaguu

SEQ ID NO: 80820 - RNA, 51 nt, Mus musculus
cugguaauuccaccuguuuccucuuucugaagagauuguucuucaaccuug

SEQ ID NO: 80821 - RNA, 46 nt, Mus musculus
ggaauagauuguagauuucucagccuuuuaaucccagcacucagua

SEQ ID NO: 80822 - RNA, 46 nt, Mus musculus
cauguuaacgccuguuuggucacuggauuccuuguuccugucagau

SEQ ID NO: 80823 - RNA, 62 nt, Mus musculus
gggauguagaaggggagagagaauucagaaagucuuucucuucugucacuuuuaccucagaa

SEQ ID NO: 80824 - RNA, 60 nt, Mus musculus
uacaggggaaauauacucacuauaauuuuuuauagaauagcaaguagggaguagacguag

SEQ ID NO: 80825 - RNA, 32 nt, Mus musculus
gccuugcaauagauaugcaucuuauauaacuc

SEQ ID NO: 80826 - RNA, 42 nt, Mus musculus
uaaaucgaucgguggugauuaagaaaucgauauggccugggu

SEQ ID NO: 80827 - RNA, 47 nt, Mus musculus
gagaaugagaggaggaagucagggaggaaacaauuucuguauuguuu

SEQ ID NO: 80828 - RNA, 45 nt, Mus musculus
ggucgcccugaccaaccccaccccccucgcuuuuaggccgcuucu

SEQ ID NO: 80829 - RNA, 41 nt, Mus musculus
gguucagggagggcgugagaguggguggguggggguggaga

SEQ ID NO: 80830 - RNA, 46 nt, Mus musculus
ccuuuccgugagaauuuagaggggagaacgcggagacuuaggccag

SEQ ID NO: 80831 - RNA, 45 nt, Mus musculus
cacuuuuccuguguugaaauccuaacccacaaggugacacuggca

SEQ ID NO: 80832 - RNA, 47 nt, Mus musculus
cucacaaucaccuauaaggggaucugaugaccucuucuggccuguag

SEQ ID NO: 80833 - RNA, 45 nt, Mus musculus
ccuccauagguucaaaccaaagucuaagcacuaagaaggggaggu

SEQ ID NO: 80834 - RNA, 46 nt, Mus musculus
aagugugugaguggcuuucuuagguucucuguguggccuaugugug

SEQ ID NO: 80835 - RNA, 45 nt, Mus musculus
agacaacacaccuggagucagaggagauguguuaacagcggucag

SEQ ID NO: 80836 - RNA, 45 nt, Mus musculus
agaguuucuauuacugugaugaaacaccaugaccaaaagcaacuu

SEQ ID NO: 80837 - RNA, 42 nt, Mus musculus
uaucaucccaacauuucuccuccaaaugcuuuaagcugccau

SEQ ID NO: 80838 - RNA, 45 nt, Mus musculus
uguauguauguauguauguauuauguauacaguauucugucccga

SEQ ID NO: 80839 - RNA, 45 nt, Mus musculus
ccuuguuagggccuuauucuucagugccuuguggcaugaagugag

SEQ ID NO: 80840 - RNA, 46 nt, Mus musculus
ucugucuauagaauucccugcaucaaacuguguguuacaggcacac

SEQ ID NO: 80841 - RNA, 45 nt, Mus musculus
ggggaagaauauauuucucucacucucagcauuccuugccuguag

SEQ ID NO: 80842 - RNA, 46 nt, Mus musculus
cuuguuuagguagccauguuggucagacuauggguauagccucuga

SEQ ID NO: 80843 - RNA, 46 nt, Mus musculus
ucugauccucuggcucuuuagaauuuuugcauccucuuugcaauga

SEQ ID NO: 80844 - RNA, 42 nt, Mus musculus
uuuagaagucaacgcaggauaaagcaauguuggaagccauua

SEQ ID NO: 80845 - RNA, 45 nt, Mus musculus
auuucaucaucuguaaaauggacaaaaagugccuggucaguguag

SEQ ID NO: 80846 - RNA, 45 nt, Mus musculus
cuaccaccagucucuggagcuaaagcaaaaccaacccugccccuc

SEQ ID NO: 80847 - RNA, 42 nt, Mus musculus
uuuaaauugguuuaguugcuguauaucaccauagccccuguu

SEQ ID NO: 80848 - RNA, 44 nt, Mus musculus
ccgacaguggcguaaacaggagacaucacccuauacugcgaaac

SEQ ID NO: 80849 - RNA, 46 nt, Mus musculus
acucauggccagaugacagugacacggcuugugaauacucugaaag

SEQ ID NO: 80850 - RNA, 41 nt, Mus musculus
cuccggaauguuuaauccaguguaaauuuuauaucgccucu

SEQ ID NO: 80851 - RNA, 46 nt, Mus musculus
uuagcagcaagaaauguccuuguugagagugagcaucaagugaaga

SEQ ID NO: 80852 - RNA, 76 nt, Mus musculus
guuucugccuucgggaagccuaaaggaguaucugccaaagaauaagaacaaaaucaaccucaaacagcagcuaaaa

SEQ ID NO: 80853 - RNA, 46 nt, Mus musculus
acaacacaggggagcagguagcugucaagucccugaagccugagag

SEQ ID NO: 80854 - RNA, 70 nt, Mus musculus
uugaggacauuugccuuuuggcagagacacuggggauugaaguagggauuggcaguuguuucugaaggug

SEQ ID NO: 80855 - RNA, 48 nt, Mus musculus
uuguuucugagcagugugguaauuggaauuagugggugagugaggagg

SEQ ID NO: 80856 - RNA, 43 nt, Mus musculus
ccguagcucacuuacugugguauuuacaguuugcucugucuuu

SEQ ID NO: 80857 - RNA, 42 nt, Mus musculus
uuguggagggggggccguuggaucucuucaugcaccggaaaa

SEQ ID NO: 80858 - RNA, 48 nt, Mus musculus
aaggccuucuaugccuuguuuaacaaaucacccuuguccuaagguccc

SEQ ID NO: 80859 - RNA, 46 nt, Mus musculus
gugaugcgugugaaccugacugagcuggggauaaccugcugaagag

SEQ ID NO: 80860 - RNA, 46 nt, Mus musculus
ugcuggacuacaaggaugaggaaggaauugcugaagagaagaagau

SEQ ID NO: 80861 - RNA, 58 nt, Mus musculus
guugaaaaggaaaaaaauaaacugaagcggaaaaaacuggaauauaauaaacacaaga

SEQ ID NO: 80862 - RNA, 62 nt, Mus musculus
auuucuugaaggaauuuaacaacaagaccaucugugacagcagugugucuacacaugaccug

SEQ ID NO: 80863 - RNA, 65 nt, Mus musculus
gcuacaagcgauauauuccagaaacauugaauaaauccaucagacagaggaaccuucuuaccagg

SEQ ID NO: 80864 - RNA, 45 nt, Mus musculus
ugccugggcauggcgguccuggccaucucccacuaugccaugaug

SEQ ID NO: 80865 - RNA, 47 nt, Mus musculus
gauuugaucaaaugccuggcucccauucgggaccccaagacggagca

SEQ ID NO: 80866 - RNA, 32 nt, Mus musculus
gagucaguagaagccacucugccagaugcgcu

SEQ ID NO: 80867 - RNA, 45 nt, Mus musculus
uuuagagucucaccuucaggagacucagugucaguuacuugaggu

SEQ ID NO: 80868 - RNA, 50 nt, Mus musculus
aagaaaaggguuccagaagcaaccccacuccuugaugccaguucacugga

SEQ ID NO: 80869 - RNA, 71 nt, Mus musculus
ucuacuuuaccaacuggcacggaaccaaugacaacgaacagucuguauggcgacauucuccaaagaagcag

SEQ ID NO: 80870 - RNA, 42 nt, Mus musculus
uagcuguagguggcaggugguguuuucaccuaggaagguaug

SEQ ID NO: 80871 - RNA, 46 nt, Mus musculus
gaggaaacgaugaagucugccugcagguuuugcuguuaggaguagg

SEQ ID NO: 80872 - RNA, 46 nt, Mus musculus
cgaaucaucacuguggaugacaaaacgucucuccggcuccacuacc

SEQ ID NO: 80873 - RNA, 48 nt, Mus musculus
aucucuccucucugucacaaccucuucgcccuguacgaugagagcacc

SEQ ID NO: 80874 - RNA, 46 nt, Mus musculus
auaugguaggcucuuacuacccuaguacugcuacauggcauuaaau

SEQ ID NO: 80875 - RNA, 46 nt, Mus musculus
auuucuaugguuucaucucuuauaagucuggucucaguauucagaa

SEQ ID NO: 80876 - RNA, 45 nt, Mus musculus
aaguguauuucacuaguggaaucauuauaugcagagauggcacag

SEQ ID NO: 80877 - RNA, 45 nt, Mus musculus
acaggagagauagcaucagcuuaaggguacaacuggggcccagug

SEQ ID NO: 80878 - RNA, 46 nt, Mus musculus
gcugucugucugucugucugucuguccgucugucugucugucucug

SEQ ID NO: 80879 - RNA, 46 nt, Mus musculus
ggggucucgggagagacagagaaagucuuucuguaaugcugugggu

SEQ ID NO: 80880 - RNA, 46 nt, Mus musculus
gguagggagcccuagagcccauccaguacuuuuucaccuugcagaa

SEQ ID NO: 80881 - RNA, 46 nt, Mus musculus
cuccagaggaaguguggcuugcuguuuuauacucagcugggcagau

SEQ ID NO: 80882 - RNA, 42 nt, Mus musculus
cacuuacuucagccuccuaggaugggguuacaggcaugaguc

SEQ ID NO: 80883 - RNA, 46 nt, Mus musculus
agacuggagacugagugaggauacuuaguuucuguagcggugagaa

SEQ ID NO: 80884 - RNA, 46 nt, Mus musculus
ucaauucucuaaaaucaaaaagcucucaaaaugacagggcugggag

SEQ ID NO: 80885 - RNA, 70 nt, Mus musculus
ugcuagcuucuuuuguaguccuuaucccccggcaugguucuuuauuaaaagcaucuuuuaauagaugauc

SEQ ID NO: 80886 - RNA, 46 nt, Mus musculus
gaauagugaagaaaacuucauaauucuacauaaauaagcaaaugcg

SEQ ID NO: 80887 - RNA, 46 nt, Mus musculus
gagucuuagcuacaauaccauaauuuuuuguaaacuugggugaguu

SEQ ID NO: 80888 - RNA, 42 nt, Mus musculus
uuuagcuuuaaacauagacuagcucagaagaugccgggguga

SEQ ID NO: 80889 - RNA, 46 nt, Mus musculus
agggucaauuuaauuucuuagaaauuuguaaaaaguguguguguau

SEQ ID NO: 80890 - RNA, 44 nt, Mus musculus
gcuuguggcuguggcuucugaacuuugaacuucauuggugagac

SEQ ID NO: 80891 - RNA, 42 nt, Mus musculus
gcugucuuccucucuuauaucagcccuuuccugcuggcuacu

SEQ ID NO: 80892 - RNA, 24 nt, Mus musculus
gguacaaaggagauaagaaaggga

SEQ ID NO: 80893 - RNA, 45 nt, Mus musculus
uuuuguuuguuucauuaugaaauuaucauucaaaggccccuguug

SEQ ID NO: 80894 - RNA, 86 nt, Mus musculus
uccugagccaggucauagguggacaaauaucagugugcugagaagcuggagcacagggaccaagccauuggcaauaucaaggaggc

SEQ ID NO: 80895 - RNA, 86 nt, Mus musculus
uacuaggcauccaguacaggaauuggguaacuaaggaccucaugaugucuuagaagggccacauguacagaaggcuguggugugaa

SEQ ID NO: 80896 - RNA, 73 nt, Mus musculus
cugggauagaaugcgcuucucucaaauggauaguucagggguauuuggagcuuuacagaugagguuguagucu

SEQ ID NO: 80897 - RNA, 42 nt, Mus musculus
ugaggggggaaggaaagggagaggggagagggagaagaagaa

SEQ ID NO: 80898 - RNA, 41 nt, Mus musculus
gggugugugggugugugugugggugugugugugugugggug

SEQ ID NO: 80899 - RNA, 104 nt, Mus musculus
gguuuugaacuuuauaggugguucugggaaugggaaauaaaggaaauaaauagcucugaugucagaggaacaggaagaguaagaucaaguaggaacagccccag

SEQ ID NO: 80900 - RNA, 91 nt, Mus musculus
cuguguggacaugcaauccugagaagagagauuucagggaacauuugcuucccagguuguaugacaaauuuaaauuuauuuuuuggcagug

SEQ ID NO: 80901 - RNA, 46 nt, Mus musculus
auuuuuauugagucuuuaguauuuacuccagaaaguaucagcaguc

SEQ ID NO: 80902 - RNA, 44 nt, Mus musculus
uaaggaugggaacuuaaauugcaguuaggaguuuauacugguuu

SEQ ID NO: 80903 - RNA, 45 nt, Mus musculus
uguuuaauaaguacauuuaaaguuacuagcacacaugagguaaga

SEQ ID NO: 80904 - RNA, 41 nt, Mus musculus
uggacauagaagggaggggucauagguucaacaggccugaa

SEQ ID NO: 80905 - RNA, 45 nt, Mus musculus
uuugugcugguaguaucacacacacacacacacacacacuccaca

SEQ ID NO: 80906 - RNA, 46 nt, Mus musculus
uucuggaagugcucuuaacuggugagccaucucuccaacccaacaa

SEQ ID NO: 80907 - RNA, 46 nt, Mus musculus
gcucagagccuuuuucaaaugcuuuuuaaaaagagaugggguagac

SEQ ID NO: 80908 - RNA, 45 nt, Mus musculus
gauucuggaguuuggcaucagccucugggagagauagugagagau

SEQ ID NO: 80909 - RNA, 46 nt, Mus musculus
uguguguguguguguguguguuuaugugaggggggacaacagcggg

SEQ ID NO: 80910 - RNA, 42 nt, Mus musculus
gugcugggauuaaaggcgugugccaccauugccugucgagau

SEQ ID NO: 80911 - RNA, 46 nt, Mus musculus
augcuuuauaaaauggaauaaaugccucuucuguauggauugagau

SEQ ID NO: 80912 - RNA, 23 nt, Mus musculus
gccagggcggccggggcggggau

SEQ ID NO: 80913 - RNA, 41 nt, Mus musculus
ugcacggcaggcugaguugccugccagacuccugacccaga

SEQ ID NO: 80914 - RNA, 46 nt, Mus musculus
gucaccaacugugguacucacuggcuuguguauucaaaguccuuag

SEQ ID NO: 80915 - RNA, 46 nt, Mus musculus
ggcugguaucucuaacuucagaucucugaagcugaucugugcuguc

SEQ ID NO: 80916 - RNA, 45 nt, Mus musculus
acaugauagcacuuuacagauugaagaaacaaaacgaaacucagg

SEQ ID NO: 80917 - RNA, 45 nt, Mus musculus
uuccaguauguucuuuuucuacaauacauugcaaagcagcuguuu

SEQ ID NO: 80918 - RNA, 54 nt, Mus musculus
gacaggugaucucugaguuccaggcuagccuggucuauggagagagggggaggg

SEQ ID NO: 80919 - RNA, 46 nt, Mus musculus
agagagagaaagagagagagagagagagagagagagagagcacacc

SEQ ID NO: 80920 - RNA, 45 nt, Mus musculus
gggaauaaaagcuuaggccuggcucugggcuaaguuuagugggag

SEQ ID NO: 80921 - RNA, 45 nt, Mus musculus
uggugggcagggcacugucuggcuucuuagcucaccucgccucca

SEQ ID NO: 80922 - RNA, 27 nt, Mus musculus
cggcccgccaccgccgccgcggggacu

SEQ ID NO: 80923 - RNA, 41 nt, Mus musculus
gucugacugaccucugaccccagagggccgagcuugcaggc

SEQ ID NO: 80924 - RNA, 41 nt, Mus musculus
aaccucaagaccggcacgggugaggagcuaaggcgggggga

SEQ ID NO: 80925 - RNA, 46 nt, Mus musculus
ucaagguccuuuugagcaccuagugcucuuaaccacugagccaccc

SEQ ID NO: 80926 - RNA, 41 nt, Mus musculus
gauuaaaggcgugcgccaccacgcccggcuguagguccaca

SEQ ID NO: 80927 - RNA, 46 nt, Mus musculus
gcacuuacuaugcugauggcaucagcuguuuguugaauauagccaa

SEQ ID NO: 80928 - RNA, 46 nt, Mus musculus
ugcucuguguauacagacauuuggguauagccuugguuuuggggaa

SEQ ID NO: 80929 - RNA, 41 nt, Mus musculus
cagggggaaugaugguuuuuguaguguuuaagagggggugg

SEQ ID NO: 80930 - RNA, 46 nt, Mus musculus
gaucugcuguucaaacauuggcagguagaguaaacuuaaaauggag

SEQ ID NO: 80931 - RNA, 45 nt, Mus musculus
ggaagcuccuggggcuguuguaagcacgugcacaagaagcaagag

SEQ ID NO: 80932 - RNA, 53 nt, Mus musculus
agacucugacauccacacacuucccagugacccacaccacagaacgaaaauac

SEQ ID NO: 80933 - RNA, 46 nt, Mus musculus
agaagggugggagugaguuccaggccagccugguuuacaaugggag

SEQ ID NO: 80934 - RNA, 68 nt, Mus musculus
uuaccgaacaaucuacagaagucagcugaacaugggauccuacaucuguaaucucagcauuugggagg

SEQ ID NO: 80935 - RNA, 42 nt, Mus musculus
acaagucaacaucaaaaacccaaaagaaaauugccuccagag

SEQ ID NO: 80936 - RNA, 29 nt, Mus musculus
uuuugguauguguaugugcuuguguguuu

SEQ ID NO: 80937 - RNA, 48 nt, Mus musculus
auauauuccaggacaguuuaggcuccagaguuauaccuugccuuagga

SEQ ID NO: 80938 - RNA, 45 nt, Mus musculus
uuuugagagaggucuuguuggcaagccaggcuggggcacauggaa

SEQ ID NO: 80939 - RNA, 23 nt, Mus musculus
cccaacagacuugagaauugagu

SEQ ID NO: 80940 - RNA, 24 nt, Mus musculus
aaguuguaaaaacagcuccuuaac

SEQ ID NO: 80941 - RNA, 46 nt, Mus musculus
gugugcacaguugcacaugcaugugcaugccagggcauauguagag

SEQ ID NO: 80942 - RNA, 46 nt, Mus musculus
agcaggauggcaguuaauugcuucuuuaauuuuauuucauggacau

SEQ ID NO: 80943 - RNA, 46 nt, Mus musculus
gggcagcaacagccuuuaacuguggagcuauuucuccagccccaga

SEQ ID NO: 80944 - RNA, 45 nt, Mus musculus
ggugacugacugcagguuggccugucagugugccacagggcccuc

SEQ ID NO: 80945 - RNA, 42 nt, Mus musculus
gagcagccgagacagcuugugccaccugugcagaggcgggga

SEQ ID NO: 80946 - RNA, 46 nt, Mus musculus
ucagguuucagggaugcugucccaucuuugcagagaaagagcccca

SEQ ID NO: 80947 - RNA, 41 nt, Mus musculus
acuuuucuauugcugugauaaacgucaugaccaaggcagcu

SEQ ID NO: 80948 - RNA, 46 nt, Mus musculus
uauuaccacguuagucuaguguauggauccacgugcucucuuucag

SEQ ID NO: 80949 - RNA, 46 nt, Mus musculus
gaccaaaggagaaaccagaauagaacuauagcgaaguuacacccau

SEQ ID NO: 80950 - RNA, 55 nt, Mus musculus
auucccucuguagauuggaccucaaauccaaucagaaagcaguugguuacuaccc

SEQ ID NO: 80951 - RNA, 102 nt, Mus musculus
uuuuuguguauuagaaaugaccucugauuuugcuaauaccugucaguaauuccuuuaaacgugcuuaaguuaaggccucgugccguguaaaauaaaauuugu

SEQ ID NO: 80952 - RNA, 54 nt, Mus musculus
uuagguagaucacucaccuuaccuguuugugcauuugacucauggcggaggaug

SEQ ID NO: 80953 - RNA, 31 nt, Mus musculus
cuuccuuagcgccccgcccccaaaugcuggg

SEQ ID NO: 80954 - RNA, 46 nt, Mus musculus
uuucuauauauauauauauauuuucuuuuuuguacuuagcauguag

SEQ ID NO: 80955 - RNA, 45 nt, Mus musculus
gggauuagugguauuuguuuucuguugccgugauaaaaugccaug

SEQ ID NO: 80956 - RNA, 53 nt, Mus musculus
ccagcaagacauauacagaauaucucacgcaaauaaguagaagaccaaggagu

SEQ ID NO: 80957 - RNA, 44 nt, Mus musculus
ucaugaccaggagccgcaucuuaucuuuuaacuggacacccaca

SEQ ID NO: 80958 - RNA, 34 nt, Mus musculus
gaagcccuggacggaaucugugauguggaccuag

SEQ ID NO: 80959 - RNA, 46 nt, Mus musculus
ucuaucugauuaguccucagacucagaaugcugggaagaccccuuu

SEQ ID NO: 80960 - RNA, 46 nt, Mus musculus
accuccaccccacucccugcuguaggugcccaacucagacucacag

SEQ ID NO: 80961 - RNA, 48 nt, Mus musculus
ggauuaugggugugcgccccgugccugcucagacuacuucugaccagc

SEQ ID NO: 80962 - RNA, 46 nt, Mus musculus
gguguuuauuauuaugaaauaucagugugaaucccaaagcccccag

SEQ ID NO: 80963 - RNA, 46 nt, Mus musculus
aaauauuaacgcugucaguguuuuucuucugugagugacuaaccag

SEQ ID NO: 80964 - RNA, 46 nt, Mus musculus
uugguagggguugggugauaaaagcccaggcuuccuggaggggcag

SEQ ID NO: 80965 - RNA, 45 nt, Mus musculus
aggaaaacuucaaacuuuucuuccccucuuguggagucuggggag

SEQ ID NO: 80966 - RNA, 42 nt, Mus musculus
uggguuuagaccaggucaaucugccucaauucuaggcgucag

SEQ ID NO: 80967 - RNA, 52 nt, Mus musculus
ugggauuugggaaaagggaagaaaaauugaaaaccccaggcucuguguggac

SEQ ID NO: 80968 - RNA, 87 nt, Mus musculus
cccccaaguucaagccagucuuuaacucaguguuggcuuaaguuucccuggagcuggcacgucagcuuuucuucagugacaguuggu

SEQ ID NO: 80969 - RNA, 32 nt, Mus musculus
cuugccccguccuuuaccuguuaaacccggag

SEQ ID NO: 80970 - RNA, 74 nt, Mus musculus
cuuccaggagcucagcgaggggaaagugagaguuguagggcaaggauugaggccugggaggaagagucgacauu

SEQ ID NO: 80971 - RNA, 46 nt, Mus musculus
gguagggguguggggugugugugugugugugugugugugugugugu

SEQ ID NO: 80972 - RNA, 42 nt, Mus musculus
uacaggcacauaacugacggagauucuccaaauuagccucca

SEQ ID NO: 80973 - RNA, 45 nt, Mus musculus
ucaacuauauuuaagugugugugugugugugugugugugugugug

SEQ ID NO: 80974 - RNA, 34 nt, Mus musculus
gggcuugguggcaaguggaguugccagacccauu

SEQ ID NO: 80975 - RNA, 46 nt, Mus musculus
guuccuuccuuugacauaugaauggaagcccuccucccacccucua

SEQ ID NO: 80976 - RNA, 46 nt, Mus musculus
agagaauguugugaggguuuagaaaugaagaaaauuggggcuggag

SEQ ID NO: 80977 - RNA, 45 nt, Mus musculus
aaccaucuauaaugggaucugaugcccucuucuggugugccugaa

SEQ ID NO: 80978 - RNA, 58 nt, Mus musculus
ccaugugguuuuggugcuuaaauuuuaauuaagcaguuccagggaggaagaaacagcu

SEQ ID NO: 80979 - RNA, 60 nt, Mus musculus
agaguaguggaauuguauucaaacccagacuguucaccccagaaaccacuucucagguag

SEQ ID NO: 80980 - RNA, 46 nt, Mus musculus
ucugugagcagaugagggauguggcuaauguuuggaugugugagag

SEQ ID NO: 80981 - RNA, 46 nt, Mus musculus
ucacauauuaaaucuggcuucuauucuucagugaaaaaaaaaauag

SEQ ID NO: 80982 - RNA, 30 nt, Mus musculus
uuuugucauggcugcuuuugccugguuggg

SEQ ID NO: 80983 - RNA, 41 nt, Mus musculus
uuaugagcgaaugccaucaugucuagcagagacacggggac

SEQ ID NO: 80984 - RNA, 47 nt, Mus musculus
uaguuugcagaaauugaacccggcuaugacuccugcugcugcaagau

SEQ ID NO: 80985 - RNA, 42 nt, Mus musculus
uugagaauauaguuacaguaucuuuuuugcuuggaagcccag

SEQ ID NO: 80986 - RNA, 46 nt, Mus musculus
augcagcaggcccugggagaagguuguaggcuagaccuggagucag

SEQ ID NO: 80987 - RNA, 46 nt, Mus musculus
ggggcuggaaccuuccuggcucuaccccaccccccacugcccccag

SEQ ID NO: 80988 - RNA, 46 nt, Mus musculus
gaaaaaucucacuaaaagaaauuaaaaguccauuaaaacaaugcag

SEQ ID NO: 80989 - RNA, 46 nt, Mus musculus
ugacacggauguccacacagacaucaugcauauauauauauuacag

SEQ ID NO: 80990 - RNA, 67 nt, Mus musculus
gaaagaugugauggggccaaagcaagauccaggugcaucaagaucgacauaaaucauggagcuccuu

SEQ ID NO: 80991 - RNA, 69 nt, Mus musculus
aucauguggugauacaagcucccacugcuuaggcagacccaucucuauggccuuccuggccacgcccac

SEQ ID NO: 80992 - RNA, 44 nt, Mus musculus
ucucagaggcggccuauaggcugccauguauaacuuguccccag

SEQ ID NO: 80993 - RNA, 65 nt, Mus musculus
cuaagguacucuguguuccgcggaaagaauuucacacccuagaguuuguugugaguggguucugg

SEQ ID NO: 80994 - RNA, 46 nt, Mus musculus
ucacuguaaacuuggccagaagaagccgacauuaaccacgccacag

SEQ ID NO: 80995 - RNA, 46 nt, Mus musculus
auuuauuuuguguuacaguucuaaaggaggaguccguaauggugag

SEQ ID NO: 80996 - RNA, 45 nt, Mus musculus
uuuccaugauagcuauauuaauguauacuucuacccucugugugu

SEQ ID NO: 80997 - RNA, 33 nt, Mus musculus
ugucuauuuuuaauugaucauuuguuuucuuac

SEQ ID NO: 80998 - RNA, 45 nt, Mus musculus
gauauaacuucgccaaguggcuuuugagucauuugacuuguucag

SEQ ID NO: 80999 - RNA, 46 nt, Mus musculus
ccuacaugaguaaaaugagacauaauuacucaggccuugcugggua

SEQ ID NO: 81000 - RNA, 67 nt, Mus musculus
gagauauacuggacgcccauuaaaagccaguugcucuguuggauaacaucuuuaaaagugauucugg

SEQ ID NO: 81001 - RNA, 45 nt, Mus musculus
auucggcuuugugaacacagaggguaccuugcaggcuagggagua

SEQ ID NO: 81002 - RNA, 46 nt, Mus musculus
auguagcaggaagaaaaucuuccuggcuccacauugaaguagcaau

SEQ ID NO: 81003 - RNA, 46 nt, Mus musculus
auuauuauuuuuuuuuaguuucuauuguugugauaaacacugacuu

SEQ ID NO: 81004 - RNA, 66 nt, Mus musculus
gcaggugcgcagacaugguggugcagcaauagcugagagcuuacauccugauucacagacagcagg

SEQ ID NO: 81005 - RNA, 45 nt, Mus musculus
gagagagaauagagggagaacgaacagagaaagauaguuaagaua

SEQ ID NO: 81006 - RNA, 45 nt, Mus musculus
agagagucuugugugggcucuugaaacuucaaaucccagacccag

SEQ ID NO: 81007 - RNA, 46 nt, Mus musculus
uuaaucccacgcuagcuuccagaucuccugggcagcaaggcccaag

SEQ ID NO: 81008 - RNA, 46 nt, Mus musculus
uaaaggauugcauuuucaaguauuuaaugauaaauaccaugaagcc

SEQ ID NO: 81009 - RNA, 88 nt, Mus musculus
uacacaaauaaaugagugaaguuggggcuguacauaugaaaggagauugauuauggcuugguauuguuaauauugaguuguagguaca

SEQ ID NO: 81010 - RNA, 46 nt, Mus musculus
uaaucugcuuuuguguuuugcuugauaacuuccauaaaucagagug

SEQ ID NO: 81011 - RNA, 46 nt, Mus musculus
uggccauauaaaugucuuacaaauauuguauuaugaauagcaacag

SEQ ID NO: 81012 - RNA, 48 nt, Mus musculus
acuacauugaaauuacguaggugggucaaagaaagaauucuguacaaa

SEQ ID NO: 81013 - RNA, 55 nt, Mus musculus
ucagucugaaggaggcuuuggguaucgcagauagucacugggcuuggaaucaggu

SEQ ID NO: 81014 - RNA, 46 nt, Mus musculus
caaacucuuuguguccuuggugucacacaauuuuaauagcugccuu

SEQ ID NO: 81015 - RNA, 47 nt, Mus musculus
gacagccaggacuauacagaagaacccugucucgaaaaaacagagag

SEQ ID NO: 81016 - RNA, 42 nt, Mus musculus
auuaguuaauguaaacacacacacacacacacacacacacac

SEQ ID NO: 81017 - RNA, 46 nt, Mus musculus
aguaguauuuauuaagccuuuccugugagaugauaauugauuucag

SEQ ID NO: 81018 - RNA, 45 nt, Mus musculus
ccacuuccccagugcugggauuauaaacuuaaaccauuaugccug

SEQ ID NO: 81019 - RNA, 46 nt, Mus musculus
uucauaaaauuuauguaggggagaaaugacaauaaaugcaggcaag

SEQ ID NO: 81020 - RNA, 42 nt, Mus musculus
acauauaacauaaaggaucuuuaaacugcaggaauggcggag

SEQ ID NO: 81021 - RNA, 45 nt, Mus musculus
aauuaccuuacccacuguguguguagcugcucuccuuagcugcau

SEQ ID NO: 81022 - RNA, 46 nt, Mus musculus
gugugugugugugugugugugugagugugugugcgugugugcuugu

SEQ ID NO: 81023 - RNA, 45 nt, Mus musculus
uguagggucuggugugugugugugugugugugugugugugugugu

SEQ ID NO: 81024 - RNA, 46 nt, Mus musculus
ggucuauaaacauagagaggguuuggaaugggggacugagugguag

SEQ ID NO: 81025 - RNA, 35 nt, Mus musculus
agacagaaaggggguggaucuggauggaaaggggu

SEQ ID NO: 81026 - RNA, 42 nt, Mus musculus
ggccucuuggcucagucaggcucuauagccccucacccccac

SEQ ID NO: 81027 - RNA, 42 nt, Mus musculus
uguccccaaaccaggcacaagcucacuggcagacuucaggaa

SEQ ID NO: 81028 - RNA, 45 nt, Mus musculus
uuuugguaaugauagcugaugaugaaaaaaaagugaauauggcag

SEQ ID NO: 81029 - RNA, 46 nt, Mus musculus
accuuaaacuuuuuuuaguuacaguuaucuaugugugugggugcau

SEQ ID NO: 81030 - RNA, 42 nt, Mus musculus
uguaaauaccuguauuuucugacagucuuaggugacccccgu

SEQ ID NO: 81031 - RNA, 46 nt, Mus musculus
uaacaguuacuagaaccagggauagaacuuucuggaaagaagacag

SEQ ID NO: 81032 - RNA, 25 nt, Mus musculus
cuugcuccccccacaauccccuuca

SEQ ID NO: 81033 - RNA, 44 nt, Mus musculus
agcugggaugaucccugguaaucgggagcagccuaauucuuuaa

SEQ ID NO: 81034 - RNA, 42 nt, Mus musculus
cucucucucucaggcucuguacauuauuaucugggcaggaau

SEQ ID NO: 81035 - RNA, 45 nt, Mus musculus
guugacucuccccuccguaagugccagcuggcuggaacagaggag

SEQ ID NO: 81036 - RNA, 46 nt, Mus musculus
uguuguuuaguuauguuuuaaaaaggaaucaucagcuuuggugaaa

SEQ ID NO: 81037 - RNA, 32 nt, Mus musculus
aucuagggauuuguuuccuguguagacaggag

SEQ ID NO: 81038 - RNA, 46 nt, Mus musculus
agccugcagccaguccauaccggcaucauuccuacauuugcacaag

SEQ ID NO: 81039 - RNA, 42 nt, Mus musculus
uuugucuguguuggcaugcccccuggugcugucacugagcag

SEQ ID NO: 81040 - RNA, 50 nt, Mus musculus
acuuaagccuugagucaacuuuaguuacuucuguuugaagauggagaugg

SEQ ID NO: 81041 - RNA, 46 nt, Mus musculus
uucuuugaauucuaguuuucuagauauacccuggcuauacagugaa

SEQ ID NO: 81042 - RNA, 41 nt, Mus musculus
ggaccacccaaggucaccucuauaacacaguauagccccaa

SEQ ID NO: 81043 - RNA, 45 nt, Mus musculus
gauguauacacacacacacacacacacacacacacacacuguagu

SEQ ID NO: 81044 - RNA, 42 nt, Mus musculus
ccuggugccuuagguccuuuguuuguguggaauguggguguu

SEQ ID NO: 81045 - RNA, 44 nt, Mus musculus
guguuguguguaagugggaugugugugguuuguauguguggugu

SEQ ID NO: 81046 - RNA, 46 nt, Mus musculus
augaguacacuguagcugucuucagacacaccagagagggcaucag

SEQ ID NO: 81047 - RNA, 53 nt, Mus musculus
acuggauccuugaacucaauucaaagcaaagugagaguuuaagcacuaguguu

SEQ ID NO: 81048 - RNA, 46 nt, Mus musculus
aaaagugaaggcuuaccauugggaagagagaaaggcuuugcacaaa

SEQ ID NO: 81049 - RNA, 46 nt, Mus musculus
cacauacauaaaauaaauaaauaaaucuuaaaaaaaaugggagcag

SEQ ID NO: 81050 - RNA, 46 nt, Mus musculus
agcaaucuacagauuucaugcaaccccaaucaaaauucgcugccag

SEQ ID NO: 81051 - RNA, 47 nt, Mus musculus
uucuuauacuccaggucuaggugucuucuuuuuguaaggugucugua

SEQ ID NO: 81052 - RNA, 44 nt, Mus musculus
caugcaugugaguauguguguguguaccguuaaucugacuccca

SEQ ID NO: 81053 - RNA, 53 nt, Mus musculus
uaguuucagaguagcuaaaccuguaucaccacaaacaaggaaccugaacgugc

SEQ ID NO: 81054 - RNA, 49 nt, Mus musculus
uggguggaggauuuccaccucucagcucaccacagaaagcaucccccca

SEQ ID NO: 81055 - RNA, 46 nt, Mus musculus
uaauuuuggugugcacauaugugaucuggcuucuuaagaagagaga

SEQ ID NO: 81056 - RNA, 46 nt, Mus musculus
agcagagguacagaugccugcaacaucccugugaucauagcuggau

SEQ ID NO: 81057 - RNA, 70 nt, Mus musculus
uugaagaucugcuuucuagucaaggcuucaaugcacacaaagacaaaaaggggccucgaacaauagcuga

SEQ ID NO: 81058 - RNA, 46 nt, Mus musculus
cacucauauacauaaaacaaacaaauaaaucuugaaauaaaagaag

SEQ ID NO: 81059 - RNA, 46 nt, Mus musculus
uaaaagaccuuaaaacucaccccaccuucucuaacaaagccacaau

SEQ ID NO: 81060 - RNA, 46 nt, Mus musculus
uauaagauggagguuguuaguuugaaucaaugauauaagggaucaa

SEQ ID NO: 81061 - RNA, 46 nt, Mus musculus
caaauggaaacccgugggcauggcggaucuggugacgccggagcaa

SEQ ID NO: 81062 - RNA, 45 nt, Mus musculus
uguguuccuuuuaaauaccagguugugacaguuuguuguuggcca

SEQ ID NO: 81063 - RNA, 46 nt, Mus musculus
uaaaauaaaauagaucuuaaacaagcaaagaagcaucccaaaccaa

SEQ ID NO: 81064 - RNA, 44 nt, Mus musculus
cagaugugugaccuuguugugcccuuacauguguggcgcuguaa

SEQ ID NO: 81065 - RNA, 45 nt, Mus musculus
aacacaucuuauucuucucauuuucccaggcucuuggaggcagag

SEQ ID NO: 81066 - RNA, 46 nt, Mus musculus
aguggggcaauugggcugacuuuucuuaugcugggaugugcguugg

SEQ ID NO: 81067 - RNA, 46 nt, Mus musculus
gcugcaugugugagaaugaguccugcucccaggagcuugaaguugu

SEQ ID NO: 81068 - RNA, 24 nt, Mus musculus
cccuggaggcuggccuggaggccg

SEQ ID NO: 81069 - RNA, 87 nt, Mus musculus
cuggccccuguucgucuugauuuucuacgucaucucccccauccccuacuucauugccaaaagggucacauaugacuccgacgcgac

SEQ ID NO: 81070 - RNA, 84 nt, Mus musculus
cagcagugccugucgggaacuggcguauuucuucaccacugggauuguuguuucugccuuuggacuuccuguuguucuugcucg

SEQ ID NO: 81071 - RNA, 65 nt, Mus musculus
gcauugagucuuagaauuuguacuguacguauaugugugcacauguguuucagauuugaauaugc

SEQ ID NO: 81072 - RNA, 46 nt, Mus musculus
agaugaguuuuacuccuggcacacaggucacuccauugacucaaag

SEQ ID NO: 81073 - RNA, 42 nt, Mus musculus
aaaccuuuugccuuggguuaggcuugggagacacuggggcag

SEQ ID NO: 81074 - RNA, 45 nt, Mus musculus
acuuugaugcgauugcacacuuggcgcacgcacauugacggguga

SEQ ID NO: 81075 - RNA, 61 nt, Mus musculus
uguguuguuccucaaauuugggggaccuguucuuaggcaggaacagauaagucauccaaaa

SEQ ID NO: 81076 - RNA, 128 nt, Mus musculus
ggcaguggcugauugcucagaauaagauacaaaauaaccaaaaaaccccucuggggugcaaggagggaaacuuggcuggaauggucccuacuuuaaguggagggcaggauagacaauucuuggaaaug

SEQ ID NO: 81077 - RNA, 94 nt, Mus musculus
auuugguuugcucuugguggugggucuccugaaggguaugaggcaagagugagcagaggggagggagucacugaaguuacacgcuggugcacuu

SEQ ID NO: 81078 - RNA, 93 nt, Mus musculus
aacaguuuuucuagcucaucuuuuuuaucuggagccuacugggagaaggaagugagaacuacaagcacccagucaggaugccaucagcggugu

SEQ ID NO: 81079 - RNA, 46 nt, Mus musculus
ggccuugugcaugacauuauguuuugaauauuuuguguacaaauag

SEQ ID NO: 81080 - RNA, 46 nt, Mus musculus
aguucuggucacauucuucauucaaaaccuuaaggauguccccccc

SEQ ID NO: 81081 - RNA, 46 nt, Mus musculus
ugacagacagggagaaguccccaggagcgcucucgcucucucggau

SEQ ID NO: 81082 - RNA, 45 nt, Mus musculus
ugguuccuggacacggauguugaucugugguaaucuaccagcuca

SEQ ID NO: 81083 - RNA, 42 nt, Mus musculus
ggagguggaaguaaaguggagcugaagcacuuggccuggaga

SEQ ID NO: 81084 - RNA, 42 nt, Mus musculus
uuaauuuguaaaauaaaggcuagagcuggugacugggcagaa

SEQ ID NO: 81085 - RNA, 41 nt, Mus musculus
cgacacaugcucuccugccccagcucgcagcauuagcgcag

SEQ ID NO: 81086 - RNA, 45 nt, Mus musculus
cgcggugugacggggagcaacugugcuggggcaaaccuccgccag

SEQ ID NO: 81087 - RNA, 44 nt, Mus musculus
ccuaauccuacaagucugccagcuauguuuguuggccugccaca

SEQ ID NO: 81088 - RNA, 46 nt, Mus musculus
cauccuaaggcuaagucuguauaguugggaacgugguuuguagaag

SEQ ID NO: 81089 - RNA, 46 nt, Mus musculus
uguaguaacuucacaaaauuguuuuguagaaugaauucuugucaag

SEQ ID NO: 81090 - RNA, 52 nt, Mus musculus
aaugguggcaagcacuucccccuaacaagaaggagcuauuuaaagacagcgu

SEQ ID NO: 81091 - RNA, 45 nt, Mus musculus
uuaauauuaggaaacuaacauuugaaacgacuaaugguggccaug

SEQ ID NO: 81092 - RNA, 45 nt, Mus musculus
uauagagagagagagagagagagagagagagagacagacagauag

SEQ ID NO: 81093 - RNA, 44 nt, Mus musculus
gugugauaguugguucugugaaagauuauauugaugggguccua

SEQ ID NO: 81094 - RNA, 46 nt, Mus musculus
auuugggccauuuguccccgagacagcuuggcaguuuugggccagu

SEQ ID NO: 81095 - RNA, 42 nt, Mus musculus
cuuuucugcugagcugagccccucagugacuguugucaggag

SEQ ID NO: 81096 - RNA, 100 nt, Mus musculus
gacacagcucaguuauaauaagaagagguuuguccacagguacggagauucagaggcacggugauugccuccauugguucaguuguaagaauagaagagg

SEQ ID NO: 81097 - RNA, 46 nt, Mus musculus
gcaaaucaguuacauccagacaaaggaagagaaaaagagaguacag

SEQ ID NO: 81098 - RNA, 46 nt, Mus musculus
gucauaauggacccuuuggggcuacuuagaucucaccaagccauag

SEQ ID NO: 81099 - RNA, 42 nt, Mus musculus
uaucaggcugcaugcaguaaggaguuaccaaguaagggacag

SEQ ID NO: 81100 - RNA, 45 nt, Mus musculus
uuucgggugauggccaacuaggccaucuuuugauacauaugcagc

SEQ ID NO: 81101 - RNA, 46 nt, Mus musculus
aauuuuuuuuaucauuuuuuauuucuaauuuacuuucuugcaaguc

SEQ ID NO: 81102 - RNA, 45 nt, Mus musculus
acuuuguuaguggucuuaaagacuaagccuugacugagcucacag

SEQ ID NO: 81103 - RNA, 45 nt, Mus musculus
uggguaauagcagaauccccuuuaucacagaaauaagaacccaaa

SEQ ID NO: 81104 - RNA, 46 nt, Mus musculus
uaugccuaaguacaggggaacgccagggccaaaaagugggaguggg

SEQ ID NO: 81105 - RNA, 45 nt, Mus musculus
aaauccugagaaugacucagcuacaaguaaguuuuuauaucacgu

SEQ ID NO: 81106 - RNA, 46 nt, Mus musculus
uccccaguguuggacaacaugcauggaccacuaugcuaggacuuau

SEQ ID NO: 81107 - RNA, 46 nt, Mus musculus
cauaggaggauaaaguuaauuguauggaggacagagccugcugugg

SEQ ID NO: 81108 - RNA, 46 nt, Mus musculus
uccacaucuucaucagacuuauucuccagugaaggagguggacagg

SEQ ID NO: 81109 - RNA, 45 nt, Mus musculus
ggcucaaauaauucauucuuggguauauagcuacagugugagcaa

SEQ ID NO: 81110 - RNA, 45 nt, Mus musculus
uuguuguuuuuguuaagacagggucccuauccauuuagucccggc

SEQ ID NO: 81111 - RNA, 46 nt, Mus musculus
aauacaaaaugggacaucaacuaucugauucauuuuaugagcacgg

SEQ ID NO: 81112 - RNA, 46 nt, Mus musculus
gggucugaaguguacgugugugugugugugugugugugugugugug

SEQ ID NO: 81113 - RNA, 45 nt, Mus musculus
aaugauguuuucaaggaaaaaaaaaaaagaauguucaaaggccaa

SEQ ID NO: 81114 - RNA, 45 nt, Mus musculus
uaaagugggaacugacaaucugaaaguggcggucugugcuggggu

SEQ ID NO: 81115 - RNA, 45 nt, Mus musculus
caacuucacauaggguagaugcaucccacacccauucccacugua

SEQ ID NO: 81116 - RNA, 77 nt, Mus musculus
gucacauuguaucuguagucaggaagcacagggagagggagagagaaagggagaaggagagacagagacagagaaac

SEQ ID NO: 81117 - RNA, 45 nt, Mus musculus
cccuggugucgggggcgcccuacgauggaagggaacacggcccug

SEQ ID NO: 81118 - RNA, 55 nt, Mus musculus
ggagccacacgcagcucauuguagaagguguggugccagaucuucuccaugucgu

SEQ ID NO: 81119 - RNA, 46 nt, Mus musculus
gaccccgucaccagaguccaugacaaugccaguggugcgcccagau

SEQ ID NO: 81120 - RNA, 48 nt, Mus musculus
aggaucuucaugagguagucugucaggucccggccagccagguccaga

SEQ ID NO: 81121 - RNA, 45 nt, Mus musculus
aguugaaaguggucucauggauaccacaggacuccaugcccagga

SEQ ID NO: 81122 - RNA, 46 nt, Mus musculus
guugguuaauacccugcacagaucacucaguggugcucacagagau

SEQ ID NO: 81123 - RNA, 42 nt, Mus musculus
gaaacuggguccuaaggcucggacuuucccacccuguuauac

SEQ ID NO: 81124 - RNA, 46 nt, Mus musculus
ucugcagaguuccucagaaguugguuaugaagccaugcuuggagau

SEQ ID NO: 81125 - RNA, 41 nt, Mus musculus
guuggugcaucccagccuuggauucauuaaagccugcuaac

SEQ ID NO: 81126 - RNA, 49 nt, Mus musculus
gagcgacuugcuaaacuuucagauggaguagcugucuugaagguuggag

SEQ ID NO: 81127 - RNA, 46 nt, Mus musculus
gagccagcuuaaagauauggcuauugcuacugguggugcgguguuu

SEQ ID NO: 81128 - RNA, 46 nt, Mus musculus
ggaaaaucccugaaugaugagcuagaaauuauugaaggcaugaagc

SEQ ID NO: 81129 - RNA, 45 nt, Mus musculus
cccugaagaaauugcucagguugcuacaauuucugcaaauggagg

SEQ ID NO: 81130 - RNA, 46 nt, Mus musculus
guaguuuuuauuauguagugacuuuucagaauaaaagcagcugaug

SEQ ID NO: 81131 - RNA, 42 nt, Mus musculus
uuaggguguauuugucuuucaggaagaucauaauggacagag

SEQ ID NO: 81132 - RNA, 46 nt, Mus musculus
cagagauaugccugcauggcucucuuguagccaaagguggggagau

SEQ ID NO: 81133 - RNA, 44 nt, Mus musculus
ccuugucacaucacugcccugacuaugucagaaacagucccagg

SEQ ID NO: 81134 - RNA, 42 nt, Mus musculus
auaccagcauccagggugcccaucgggagauugagggcaggg

SEQ ID NO: 81135 - RNA, 44 nt, Mus musculus
uaccucaguuuaccuccugguucugucauuuacuagcuacaggu

SEQ ID NO: 81136 - RNA, 44 nt, Mus musculus
ccauggaaccuggagcgaauuaucccagcauggcaccagacaga

SEQ ID NO: 81137 - RNA, 45 nt, Mus musculus
ucuugggccucuaggaguggggugaagagaggaaacugaagcaug

SEQ ID NO: 81138 - RNA, 46 nt, Mus musculus
agacccagaggcuacagauugaacaaacugcccaccgccugcagac

SEQ ID NO: 81139 - RNA, 55 nt, Mus musculus
ggcuaguagggugcagaggaagggcuaguagggugcagaggaagggcuaguaggg

SEQ ID NO: 81140 - RNA, 77 nt, Mus musculus
ggcuaguagggugcagaggaagggcuaguagggugcagaggaagggcuaguagggugcagaggaagggcuaguaggg

SEQ ID NO: 81141 - RNA, 55 nt, Mus musculus; identical to SEQ ID NO: 81139

SEQ ID NO: 81142 - RNA, 41 nt, Mus musculus
gaagggcuaguagggugcagaggaagggcuaguaggggugc

SEQ ID NO: 81143 - RNA, 45 nt, Mus musculus
guguguauuccucacugaggaaaagcaucgucaacucuucgugau

SEQ ID NO: 81144 - RNA, 44 nt, Mus musculus
cagucauccugggugccuguugggguucuguaggccucgauuua

SEQ ID NO: 81145 - RNA, 45 nt, Mus musculus
cugguggaugagaacgaacuccaaccccuucacucgcacccagag

SEQ ID NO: 81146 - RNA, 45 nt, Mus musculus
accgcaaaacaaacuuucaccucuuuccugcauaaggcuccucuc

SEQ ID NO: 81147 - RNA, 46 nt, Mus musculus
uuccacaggaaaacagcaccccacuagaacggagccaacucaaggg

SEQ ID NO: 81148 - RNA, 44 nt, Mus musculus
cacauacgcuaacucauguaccaauuugacagaggggacaggga

SEQ ID NO: 81149 - RNA, 46 nt, Mus musculus
uaggcuacuugugugccaguguaacaaauguaccaugguggcaggc

SEQ ID NO: 81150 - RNA, 42 nt, Mus musculus
aacugccugaaaaccccagugggaggacuaagggggcagaga

SEQ ID NO: 81151 - RNA, 44 nt, Mus musculus
gucucgggaccuuugcucucuccucaggaaguucaggggucuaa

SEQ ID NO: 81152 - RNA, 45 nt, Mus musculus
cuacuguguaauuaagucgaaacuuggggugucuggguccaagau

SEQ ID NO: 81153 - RNA, 42 nt, Mus musculus
uuucccguguccaucaugugccaccuccacccacccccagcu

SEQ ID NO: 81154 - RNA, 42 nt, Mus musculus
uggcuuuaaauaucauuugcuagaaagaagaaaaggccaggu

SEQ ID NO: 81155 - RNA, 73 nt, Mus musculus
ucagaacugggucccuuccucaggaagccacccauggcagaagggaguuaguugcuucaucaggcaaggagga

SEQ ID NO: 81156 - RNA, 46 nt, Mus musculus
gggagaucuugggaggcaccauccagccgaagagguagcggaagau

SEQ ID NO: 81157 - RNA, 47 nt, Mus musculus
ccugcucagugccuugccgccuugcagaucuugucguacaccucagg

SEQ ID NO: 81158 - RNA, 46 nt, Mus musculus
ugcaagggugaccuguggggagccugucuggacucagcuguuagau

SEQ ID NO: 81159 - RNA, 42 nt, Mus musculus
accgccccuaagugacacagucaugagcaugugcccccauug

SEQ ID NO: 81160 - RNA, 33 nt, Mus musculus
ugcugggccauacagucucccagcaggggcuuu

SEQ ID NO: 81161 - RNA, 25 nt, Mus musculus
ggaagacacggccaucagugcccac

SEQ ID NO: 81162 - RNA, 45 nt, Mus musculus
uuaaagacugacugacugacugacugacugccugcugagucccac

SEQ ID NO: 81163 - RNA, 44 nt, Mus musculus
uuaaucuacuccccacucaugcaaccaacgaaacgcagccccgc

SEQ ID NO: 81164 - RNA, 42 nt, Mus musculus
aaaucucuggugagcugggagcuucuagaguaggugccugga

SEQ ID NO: 81165 - RNA, 48 nt, Mus musculus
cgugaagugcaaaugauuaagaguuaggaagcaggcuagagagauggc

SEQ ID NO: 81166 - RNA, 41 nt, Mus musculus
aaccagggugagcugaacaugccacagagagcaagaggcag

SEQ ID NO: 81167 - RNA, 45 nt, Mus musculus
cuggagggugcaggaguaggaaagggaagcaaagcuacagauuug

SEQ ID NO: 81168 - RNA, 42 nt, Mus musculus
cagguaaaaacagaaacgagaaaguugggccugguggugcag

SEQ ID NO: 81169 - RNA, 85 nt, Mus musculus
ggaggccuucuauuaacuuggucuuaguaagccagagagccugcuucaucccugugggacaaccaaaagaagagagagagagaga

SEQ ID NO: 81170 - RNA, 45 nt, Mus musculus
uggaagauguagcaggguucuuccuuguacagagucuguucgugg

SEQ ID NO: 81171 - RNA, 84 nt, Mus musculus
cuuuugguuuggauuuaccuauggcauuagcauagcaagcagauauuucuacuuuuguggugcgggagggaaggcuauggacgu

SEQ ID NO: 81172 - RNA, 46 nt, Mus musculus
agggaggaggcuccggacugccaugagccacuguugagccaagaau

SEQ ID NO: 81173 - RNA, 46 nt, Mus musculus
aacucccagcaaccacaugguggcucccaaccaucuguaauguguc

SEQ ID NO: 81174 - RNA, 45 nt, Mus musculus
uucuaccacaguauugauguucaaaaacauacuuucccucauuag

SEQ ID NO: 81175 - RNA, 46 nt, Mus musculus
ccaggucagguugcauauguugcuuuaaaaggauuaggccagagga

SEQ ID NO: 81176 - RNA, 45 nt, Mus musculus
agaaaaagucuuuaaaaaccacuacauuuucaaaugagccaaagg

SEQ ID NO: 81177 - RNA, 58 nt, Mus musculus
gcuugcucuuggacaaaguaugggcccggauaggacaugaguuucugcaguuuggggg

SEQ ID NO: 81178 - RNA, 95 nt, Mus musculus
uggggaagguuagaauuuggggggugggggacugaaauuuuuucuguuugaaaagcuaaagaguggguaaaacuaucaagaugugggagagauua

SEQ ID NO: 81179 - RNA, 76 nt, Mus musculus
aggcgggguugagucuuuugaggggcacgggagagucugggaugugaggaagauggguagaagaucugggagugaa

SEQ ID NO: 81180 - RNA, 47 nt, Mus musculus
agaaacuaguugaggccguggauugggaaguuggagauagugaggcg

SEQ ID NO: 81181 - RNA, 41 nt, Mus musculus
ggagugccgggaaagggggaaagaaaagggguugaggagug

SEQ ID NO: 81182 - RNA, 45 nt, Mus musculus
gugggcuuaagggugggguccgcggcgucccggguuagacugagg

SEQ ID NO: 81183 - RNA, 42 nt, Mus musculus
ggccucggagcuucuaggccucugcaacuaucaggucucugg

SEQ ID NO: 81184 - RNA, 45 nt, Mus musculus
gaugaacuucugaaugguacucagaauguccuggugagaaaugag

SEQ ID NO: 81185 - RNA, 30 nt, Mus musculus
uaaggcaggagggaagaucuucguugccac

SEQ ID NO: 81186 - RNA, 59 nt, Mus musculus
uccagagauggaccaccucccagcagcuauaaccacucccaaccagacaguaacagcgg

SEQ ID NO: 81187 - RNA, 46 nt, Mus musculus
aagggcugcucuguguugaaagaauguggccuuagcagacucuggg

SEQ ID NO: 81188 - RNA, 53 nt, Mus musculus
ucugcaucacagccuuuauagucuuaagcagcaucaauuuauuccacccuaua

SEQ ID NO: 81189 - RNA, 48 nt, Mus musculus
auauguauguucaucaccacgugugugccuggugcuuauggauccccc

SEQ ID NO: 81190 - RNA, 46 nt, Mus musculus
gucuuuucuuguuuuuccuuucccugccauccauuuaaaauugcag

SEQ ID NO: 81191 - RNA, 58 nt, Mus musculus
uauacaguuauuuaaagaauacuuuauucuuauguuguagccaacaaagagaagagag

SEQ ID NO: 81192 - RNA, 46 nt, Mus musculus
gcuuauuggaaucuuuggaugugaaaauaaaaugaugauguuagga

SEQ ID NO: 81193 - RNA, 45 nt, Mus musculus
auagucguuuaugagucugcuguggggaagcuggguauauaaaga

SEQ ID NO: 81194 - RNA, 46 nt, Mus musculus
ugugaguuaguaaaugaauuauuagauaauucuuguaagguagggg

SEQ ID NO: 81195 - RNA, 45 nt, Mus musculus
uucugcuuguguuuuuauguacuucauuucugcccugacugggag

SEQ ID NO: 81196 - RNA, 46 nt, Mus musculus
agugugagaacaacgcuuccgccuagggccgcugcucacugugaag

SEQ ID NO: 81197 - RNA, 54 nt, Mus musculus
uggucucaaggccaagcguaacagauacagagaaggggaaagagaaagugcugg

SEQ ID NO: 81198 - RNA, 45 nt, Mus musculus
guagcuuacuugucccagaauucauuuuacacacacacacacaca

SEQ ID NO: 81199 - RNA, 46 nt, Mus musculus
aggauuaaaggcaugugccaccacgccuggcgccccccaccccuuu

SEQ ID NO: 81200 - RNA, 46 nt, Mus musculus
uguuuugcuuuaagcgugcuuaauacaauuaaaaugcucaugucag

SEQ ID NO: 81201 - RNA, 62 nt, Mus musculus
aagguugauuuuuuaaaauuccauguuugugagcagguguguacauuugcauccaggagccc

SEQ ID NO: 81202 - RNA, 46 nt, Mus musculus
ggcaugagcuuccuaccaacaugccuugugugcaggcacugaccag

SEQ ID NO: 81203 - RNA, 46 nt, Mus musculus
ucuaaacuuccuuaaagagggucaguuccauuagcauuucaggaag

SEQ ID NO: 81204 - RNA, 62 nt, Mus musculus
uuuuuaauaugguaauuuuuguuguuauuagaauugucaaguaauaagggauugcuuuuauu

SEQ ID NO: 81205 - RNA, 59 nt, Mus musculus
uagcagcuauguugauuuugcagaugauuggagcgaugugagugcuucuguugcagcau

SEQ ID NO: 81206 - RNA, 42 nt, Mus musculus
uuguuguuuuucacagcaguacaaauuuuugcguuuccggag

SEQ ID NO: 81207 - RNA, 46 nt, Mus musculus
gcaauuacauucaccucagaaaaacaggcaguacaacucaggacag

SEQ ID NO: 81208 - RNA, 46 nt, Mus musculus
aaauuacagcuaugaaguaguaaugaaaauaauuuuauggcuggag

SEQ ID NO: 81209 - RNA, 42 nt, Mus musculus
uauaggaggaggggguauuggaguuaacccuacagaccugaa

SEQ ID NO: 81210 - RNA, 48 nt, Mus musculus
gccuacuuuuuacauaugauuuuguuaaagcuuuaacagucugucuuu

SEQ ID NO: 81211 - RNA, 46 nt, Mus musculus
ccuuacaggaccugaugcugcuuucucaauauucuccuucucggag

SEQ ID NO: 81212 - RNA, 46 nt, Mus musculus
acuggacugaauauuacauggcccaaguggugacacugcugaguag

SEQ ID NO: 81213 - RNA, 46 nt, Mus musculus
uguacuaugaugaaguugccaccaucucuggugcaguggggccauu

SEQ ID NO: 81214 - RNA, 46 nt, Mus musculus
uuucagacuccaaaaccuagucagacgccuuccgugccgccguuag

SEQ ID NO: 81215 - RNA, 45 nt, Mus musculus
auuucuaacccaucuccuugcgccucuguuacugcugaggguaag

SEQ ID NO: 81216 - RNA, 44 nt, Mus musculus
guucuuggguagaggcggcuggauuaggaggaauuugggcgagg

SEQ ID NO: 81217 - RNA, 41 nt, Mus musculus
ucagccuucuacauccugugcuuuacuguggcugugggcga

SEQ ID NO: 81218 - RNA, 45 nt, Mus musculus
uaauugguguccaguguaugugcaagggagcacagucacgguaag

SEQ ID NO: 81219 - RNA, 46 nt, Mus musculus
cugaauuuaagugauuuguuuuauucuaucuuuuguuauuguggcu

SEQ ID NO: 81220 - RNA, 41 nt, Mus musculus
ucaauuguugcaucuuuuggucuggggagccauuucagaaa

SEQ ID NO: 81221 - RNA, 42 nt, Mus musculus
uuccucaccuugguuaaaaaaugaguucaaaguuagccagag

SEQ ID NO: 81222 - RNA, 46 nt, Mus musculus
guauauucauuuaucccaugcaacccucagcaccguccguccuguu

SEQ ID NO: 81223 - RNA, 39 nt, Mus musculus
uucacuuaagaaggaauggccaucugacacaagugccag

SEQ ID NO: 81224 - RNA, 44 nt, Mus musculus
ugucugagugcucacaucugggugauugaguaguucucgccuca

SEQ ID NO: 81225 - RNA, 46 nt, Mus musculus
cuuggagacuuuagcaaugugugagaacacuucugauugccuuuau

SEQ ID NO: 81226 - RNA, 45 nt, Mus musculus
gcauugacugaggaguauuuuucucuauacuacagguacugcaga

SEQ ID NO: 81227 - RNA, 52 nt, Mus musculus
gcuguaaccucauccuugcuggagagaggauaagauaguaagauggaaagcc

SEQ ID NO: 81228 - RNA, 45 nt, Mus musculus
uaaaauauauaaaugaaucuuuaaaaaaaaaacaaacugccgggc

SEQ ID NO: 81229 - RNA, 95 nt, Mus musculus
aauagggaauguuuuacccuugagcaaaaauagggugcuaaaaugggaaagaacaacaagaugacacacaagggcuugaaaaaugacaacaggac

SEQ ID NO: 81230 - RNA, 56 nt, Mus musculus
uuacccugcugauacaacuacagaugggacaguaaauguugagcauucuuggauca

SEQ ID NO: 81231 - RNA, 46 nt, Mus musculus
uuaagauuaguuuguuuacuaaaggauaaaaaugguaacgguggag

SEQ ID NO: 81232 - RNA, 42 nt, Mus musculus
aggcuugcuugcuuuuuugaaauaacauuaaacaguuggcag

SEQ ID NO: 81233 - RNA, 46 nt, Mus musculus
cagccucugcugugcuaacuggcuaauaaaaacacaguaggccaag

SEQ ID NO: 81234 - RNA, 46 nt, Mus musculus
cagagugacgggacacucacccuuauccuggugaguaggcauggag

SEQ ID NO: 81235 - RNA, 46 nt, Mus musculus
ucauuucuuccccagcccucccugaauacguucugcaccucuaggu

SEQ ID NO: 81236 - RNA, 46 nt, Mus musculus
agccuguggcagugucacgguauaacagacucagcuagaaagagag

SEQ ID NO: 81237 - RNA, 44 nt, Mus musculus
ggggggugggguuccuugguuugggccaccuuggcagggguaga

SEQ ID NO: 81238 - RNA, 46 nt, Mus musculus
ucccccaagagguucacggaccugccacguggccacuuggcgagau

SEQ ID NO: 81239 - RNA, 26 nt, Mus musculus
uuggcagagagaguagugggcaguca

SEQ ID NO: 81240 - RNA, 24 nt, Mus musculus
uuuggggggaaagguuaggcccug

SEQ ID NO: 81241 - RNA, 42 nt, Mus musculus
gcaaaaugaagacugucucuaacacaggauuagggaggagau

SEQ ID NO: 81242 - RNA, 41 nt, Mus musculus
uacuuugagucuggaucuuauuucugagagcacggggcugg

SEQ ID NO: 81243 - RNA, 45 nt, Mus musculus
aaauugcgauacgccaacaacagcaauuacaaaaaugacgucaug

SEQ ID NO: 81244 - RNA, 23 nt, Mus musculus
gggaguggaagaaggcgggggau

SEQ ID NO: 81245 - RNA, 46 nt, Mus musculus
ccuagaacauucuugccacaucauuuauaguaacagaacuugggaa

SEQ ID NO: 81246 - RNA, 42 nt, Mus musculus
caccuggcgcuauguucaauuuccauagcccaaguaaaggag

SEQ ID NO: 81247 - RNA, 45 nt, Mus musculus
acaacaucaaaaauugguucccuuauugaugucaaccaguccaag

SEQ ID NO: 81248 - RNA, 42 nt, Mus musculus
gacagagagugaacauaggaaaaaacuagagaguaacaggga

SEQ ID NO: 81249 - RNA, 45 nt, Mus musculus
caagauuaaaccaaucuagauauuggauauuguggacacaaggcg

SEQ ID NO: 81250 - RNA, 45 nt, Mus musculus
ccucuuccaucagacucuugucagaaccacuugauguaggccuag

SEQ ID NO: 81251 - RNA, 42 nt, Mus musculus
auuuucaucuguuccauuucaggucuaagaaaagccacaaga

SEQ ID NO: 81252 - RNA, 42 nt, Mus musculus
uugcacuggguaaaccuguaaucccagcacugaggaggaaaa

SEQ ID NO: 81253 - RNA, 45 nt, Mus musculus
gauuuagagcgggaccugugucgucugucucuagaccugcuccga

SEQ ID NO: 81254 - RNA, 45 nt, Mus musculus
uuagaaccuagccaauugaaccuggugaagcauaggagguacagg

SEQ ID NO: 81255 - RNA, 41 nt, Mus musculus
aaaucucuguagcuucuucuucgauggucaggugauggcac

SEQ ID NO: 81256 - RNA, 46 nt, Mus musculus
ggugguguaugcauuucauccaagcuggggacacugaagcaggugg

SEQ ID NO: 81257 - RNA, 46 nt, Mus musculus
gacagacaacaacaacaaaaauaaaacaaaaaagcaccaaaccaag

SEQ ID NO: 81258 - RNA, 46 nt, Mus musculus
uuccuuuuuacauucuuuguggauuaauuacuuuuggguuccuuuu

SEQ ID NO: 81259 - RNA, 45 nt, Mus musculus
uuagugcccuagaagaggacauggaugauguggagucuagugagg

SEQ ID NO: 81260 - RNA, 46 nt, Mus musculus
guugugagccaccaugugguugcugggauuugaacucagaaccauc

SEQ ID NO: 81261 - RNA, 46 nt, Mus musculus
aacuccugcacagugagagagucugugauaucauuuugccccggcu

SEQ ID NO: 81262 - RNA, 42 nt, Mus musculus
gccaccauguaguugcugggauuugaaaucaggaccuucaga

SEQ ID NO: 81263 - RNA, 46 nt, Mus musculus
guggaaaauauaucugacuuaagucaguguuuaacaugaaaugcag

SEQ ID NO: 81264 - RNA, 42 nt, Mus musculus
gccuuggugggccuuaaccccuugggaacauggcugccuucc

SEQ ID NO: 81265 - RNA, 59 nt, Mus musculus
gccuuuguacaaugacuaucgaaaaaucaagagccagaaccgaaauggagguaugaggc

SEQ ID NO: 81266 - RNA, 45 nt, Mus musculus
agcaaucaauugcaguuccugugagccgcauguaaagugccccca

SEQ ID NO: 81267 - RNA, 46 nt, Mus musculus
auugauagucugcuggguccuagauuguuuaucucagggaccagau

SEQ ID NO: 81268 - RNA, 46 nt, Mus musculus
caccagauacugaggguuggugccauggaugcugugggcauccuuc

SEQ ID NO: 81269 - RNA, 42 nt, Mus musculus
uuuaaauaaauacugaaugugacguauuaagcaagccgacgg

SEQ ID NO: 81270 - RNA, 46 nt, Mus musculus
cguauucuacuuucuugggucuagccuucucuuaacaauuggagaa

SEQ ID NO: 81271 - RNA, 46 nt, Mus musculus
aaguagcccaucaauuugugaaccuuuaauccauugaagaggucag

SEQ ID NO: 81272 - RNA, 45 nt, Mus musculus
cauuuagaaaacauaaagccaguguuaauguaauaguacaagggg

SEQ ID NO: 81273 - RNA, 42 nt, Mus musculus
ugccuccugccugcagucugaauucagccuucagguccccag

SEQ ID NO: 81274 - RNA, 42 nt, Mus musculus
acacuugugcuugcuuacaugacacuucacuaacugagcuag

SEQ ID NO: 81275 - RNA, 46 nt, Mus musculus
ucuccuuguggguugcuccuuccugccugccugccugccugccugc

SEQ ID NO: 81276 - RNA, 49 nt, Mus musculus
gccucuauauaaaauauacuaaaucaccuguauuugauuuccaacaaga

SEQ ID NO: 81277 - RNA, 46 nt, Mus musculus
uuggcaggccauugccgaaucgaaaacaguuccaacaaauguacag

SEQ ID NO: 81278 - RNA, 46 nt, Mus musculus
uuuacuauuauacauaaguacacuguagcugacuucggacgcacca

SEQ ID NO: 81279 - RNA, 44 nt, Mus musculus
gcagucagugcucuuacccacugagccauuuuaccagcccccag

SEQ ID NO: 81280 - RNA, 52 nt, Mus musculus
ucauugagcccauuuuguguacuuugacugggugcauuguuuuccuagugag

SEQ ID NO: 81281 - RNA, 45 nt, Mus musculus
ugagauucacaucaagguuggacaguuuguauugauucaggggga

SEQ ID NO: 81282 - RNA, 78 nt, Mus musculus
ccuauguggcuaaacugauugaauuauuucaaaauggugaguuugggccugaaaugggagccuuaucuuauggggcau

SEQ ID NO: 81283 - RNA, 44 nt, Mus musculus
gaaaguuacuaugaaauuuuucaaguaugauuucuuuacaagua

SEQ ID NO: 81284 - RNA, 45 nt, Mus musculus
uacacagagaaaccuccccuccaaaagcaacaacaacaaaagaag

SEQ ID NO: 81285 - RNA, 54 nt, Mus musculus
cuuuuacuuaacacagaugggagggagggaggaaugccugacaagcguggagag

SEQ ID NO: 81286 - RNA, 61 nt, Mus musculus
gucuaagacuuaagagcccuuguguagaacuucaauugaugacuuaguaucgcuacagagu

SEQ ID NO: 81287 - RNA, 86 nt, Mus musculus
uugaauuuugucuuuauauuuauuuaucuccuuuaguguguguguguguguguguguguguguguucaaguucauuauagucugca

SEQ ID NO: 81288 - RNA, 46 nt, Mus musculus
auggucauauaugcauucagucaaaacacucaugcauaucaaauaa

SEQ ID NO: 81289 - RNA, 45 nt, Mus musculus
uggcacacgccuuuaaucccggcacucuggaggcagaggcgguug

SEQ ID NO: 81290 - RNA, 46 nt, Mus musculus
gccaaaaauaaaggaaaguggagcaaccuaaaaaguguuuguggag

SEQ ID NO: 81291 - RNA, 41 nt, Mus musculus
aguuccucccaagaaaugugcacgaguacagugguuuguca

SEQ ID NO: 81292 - RNA, 49 nt, Mus musculus
uucugguaugacuguucugacugggauaacaagauuaauguggagacca

SEQ ID NO: 81293 - RNA, 89 nt, Mus musculus
caguuagcuuuggucaguguuuaucauagcaauagaaaguagcuacagcagaagggcagaggaggaugguguguaaggaacacggagag

SEQ ID NO: 81294 - RNA, 60 nt, Mus musculus
uaaaggcagguagauucuaagccagaggucucaaaaccaaacagagaagagguaaggggg

SEQ ID NO: 81295 - RNA, 45 nt, Mus musculus
auuagccccagaagaagugauuccuguggaucagaaaagugagga

SEQ ID NO: 81296 - RNA, 50 nt, Mus musculus
gggaacaagaagauaguccugaguggcaaaaaccuuuaaaagccaagauu

SEQ ID NO: 81297 - RNA, 45 nt, Mus musculus
cuacauguaaagauugucuucaggaaucccuccuuuaucuuggca

SEQ ID NO: 81298 - RNA, 45 nt, Mus musculus
gugaagaauucccuuuuaucauauagcuuccauauaggaauaaua

SEQ ID NO: 81299 - RNA, 45 nt, Mus musculus
ggguuuaauccccagcacuacauaaaauguagaugguguugaggu

SEQ ID NO: 81300 - RNA, 44 nt, Mus musculus
ccuucgugggcuuaugguuaguuugucaggaagcaccaccauca

SEQ ID NO: 81301 - RNA, 42 nt, Mus musculus
gguugugaaccaccaugugguugcugggauuugaaccuucgg

SEQ ID NO: 81302 - RNA, 45 nt, Mus musculus
guuuuucaugcauauaaucccagcacuugagaggcuaaggcagga

SEQ ID NO: 81303 - RNA, 45 nt, Mus musculus
acaucaaccaggcuuggugguucauacuccugggacuuugaggua

SEQ ID NO: 81304 - RNA, 46 nt, Mus musculus
gauauguauacaauauacuuguaucuauauaaaauaguucugggag

SEQ ID NO: 81305 - RNA, 46 nt, Mus musculus
gaaaagaacugguaugguuuggggugcagcacacuaacaaugcccu

SEQ ID NO: 81306 - RNA, 45 nt, Mus musculus
uuuugacauaucaacauuuauuauagccaauauuuuaggauaaga

SEQ ID NO: 81307 - RNA, 71 nt, Mus musculus
aacaaugccauugucaauguuuuauuccuuucacauuuauaguugguagaguucaaacuggaauagcuagc

SEQ ID NO: 81308 - RNA, 44 nt, Mus musculus
cauuucucuggauugaaaauguccugaacuauuuugccaccaga

SEQ ID NO: 81309 - RNA, 46 nt, Mus musculus
agcuaacuaaaauccucuggguuuuggaagcuggcauggacuagau

SEQ ID NO: 81310 - RNA, 32 nt, Mus musculus
acaucgaugaagaggaugaugauguuccaggu

SEQ ID NO: 81311 - RNA, 42 nt, Mus musculus
cugcugucacuaagaaaaaccuaauguuaaaagcaccccauc

SEQ ID NO: 81312 - RNA, 46 nt, Mus musculus
agcuucccucuccgcuaacaccuuugcaauuacuggucaugcagaa

SEQ ID NO: 81313 - RNA, 46 nt, Mus musculus
aaaacauaaaaagauccuuaaauauagaccagugcagugcugagaa

SEQ ID NO: 81314 - RNA, 42 nt, Mus musculus
acuacuaucauacugauaaugcugugcuuuguguggccaugc

SEQ ID NO: 81315 - RNA, 46 nt, Mus musculus
ugaaagcuuuuauauauuguccuuuaaaauauguauuuauucauga

SEQ ID NO: 81316 - RNA, 46 nt, Mus musculus
auauagcugguauugaagagguaugaacacuuggaaacccagauca

SEQ ID NO: 81317 - RNA, 46 nt, Mus musculus
guaguaaccuuagaugggaguaaacaggucaaaugaacugucagua

SEQ ID NO: 81318 - RNA, 46 nt, Mus musculus
accacaacucucaucucucaccacauuugugcacuagcccccugac

SEQ ID NO: 81319 - RNA, 45 nt, Mus musculus
uuucugacuuaguaaauaguuauaauucuuaacuuuaggccaaaa

SEQ ID NO: 81320 - RNA, 42 nt, Mus musculus
gaguuaugggcaauuguggguugcaugacaugggugcuagga

SEQ ID NO: 81321 - RNA, 50 nt, Mus musculus
uaguauuucagcucugauguugccuacauuuuuuuaaaacugacccagaa

SEQ ID NO: 81322 - RNA, 46 nt, Mus musculus
uaaccaugcuuuucauugaucauaaccacagaucuugagcagagaa

SEQ ID NO: 81323 - RNA, 47 nt, Mus musculus
gagcuucaguuuccugcuccucaucacuucuucagacggacgcacug

SEQ ID NO: 81324 - RNA, 46 nt, Mus musculus
gccuucuuaacacuuuauuuucucacuguaucuuaggccacuuuag

SEQ ID NO: 81325 - RNA, 46 nt, Mus musculus
uuuaaggaggaaggauagaauuagcauaucauaagguuauucugag

SEQ ID NO: 81326 - RNA, 46 nt, Mus musculus
ggggaagcagcuuuaggacuguaauguaugguuuagucaggaggag

SEQ ID NO: 81327 - RNA, 46 nt, Mus musculus
agguuuuggagaucacauucacuggaggacucuggaagauggcaag

SEQ ID NO: 81328 - RNA, 25 nt, Mus musculus
cgauuuacccgacccuugaccuuag

SEQ ID NO: 81329 - RNA, 53 nt, Mus musculus
aagauaacaguuuuguauucauaauggccuuuucauacuccaaguacuuuuga

SEQ ID NO: 81330 - RNA, 48 nt, Mus musculus
cuuuuguucugucccugggaaacugauauuuguguaagacaaccacca

SEQ ID NO: 81331 - RNA, 47 nt, Mus musculus
aaccugugcaggguuauuacugacuguugaccaguggcuaggaggug

SEQ ID NO: 81332 - RNA, 46 nt, Mus musculus
ugaguaugcugucgcugucuucaggcacaccagaagagggcaucag

SEQ ID NO: 81333 - RNA, 47 nt, Mus musculus
uuuaacaagauguguugcuaauuucugguuuugcacaaauaaagaga

SEQ ID NO: 81334 - RNA, 46 nt, Mus musculus
cugaugcccucuucuagugugucugaacacagcuacaguguacuua

SEQ ID NO: 81335 - RNA, 44 nt, Mus musculus
uacagaagucuggccugagugugguuccugaagcccaugggaag

SEQ ID NO: 81336 - RNA, 46 nt, Mus musculus
agucacacacacuacaguuguauuuuauuuuuuauaguguuuggag

SEQ ID NO: 81337 - RNA, 42 nt, Mus musculus
uuucagaacugucccauaauuuuguuaugguaaaucuggagg

SEQ ID NO: 81338 - RNA, 46 nt, Mus musculus
gauuuuaagguauaguuuuagauuuauuauaaagugaaaugggcag

SEQ ID NO: 81339 - RNA, 46 nt, Mus musculus
gccuccuggccugagcaagccuggaauccacuggaaggcuuuggag

SEQ ID NO: 81340 - RNA, 46 nt, Mus musculus
gaugaguugugacaugaaugaguguucuggaagaaaagcagcagag

SEQ ID NO: 81341 - RNA, 46 nt, Mus musculus
cccauuuucuccuacuguacucaagcugaagugaaacaaaccagaa

SEQ ID NO: 81342 - RNA, 47 nt, Mus musculus
cuugguaacccuccuggacuucucccggaaccccugcgcccgcccac

SEQ ID NO: 81343 - RNA, 51 nt, Mus musculus
agacaccaagaaauugccuauaaucaagaaaaaggugaggaaguuggaaga

SEQ ID NO: 81344 - RNA, 52 nt, Mus musculus
uaacaagaagauacaauucaaugcucauaucuggacuaaaucaaaauuccuu

SEQ ID NO: 81345 - RNA, 46 nt, Mus musculus
gcagcuguuaagugcuguaauggaaauguguguauguccaggagag

SEQ ID NO: 81346 - RNA, 94 nt, Mus musculus
cuaaagaaugagacccuaucucaaaacaaagaagauacauaaccagagacaauuuguaaugauaaaagaauaaaagagccggguaugguggcgc

SEQ ID NO: 81347 - RNA, 46 nt, Mus musculus
gguagaggcaaggucauugcuguaaguuaguaaccaacaagcaggc

SEQ ID NO: 81348 - RNA, 46 nt, Mus musculus
aguccuggcuccuagauggagagcuguaggcagcuauugaaugcag

SEQ ID NO: 81349 - RNA, 42 nt, Mus musculus
gagucggaguucuuaaccacagagccaucucuucagccccag

SEQ ID NO: 81350 - RNA, 45 nt, Mus musculus
acuugugucugcuuuuuauuauucuuuuucuuuuacuauacugag

SEQ ID NO: 81351 - RNA, 46 nt, Mus musculus
aauucaaucuauguuuucuuugaguguauugauaugcuggauguga

SEQ ID NO: 81352 - RNA, 46 nt, Mus musculus
aaucccagcauugaaagcuuaguggugcaaacaaaacgucagcaga

SEQ ID NO: 81353 - RNA, 49 nt, Mus musculus
agaugagcuuugaagcaucauuuuugccugagcugcuaagacuauaagg

SEQ ID NO: 81354 - RNA, 47 nt, Mus musculus
agucugaucacacagaaacuucuuggguaaaugagaaaaaaggagag

SEQ ID NO: 81355 - RNA, 45 nt, Mus musculus
cucgaacccagaaaucccccugccucugccucccaagugcuggga

SEQ ID NO: 81356 - RNA, 42 nt, Mus musculus
uaaagccaaauaugaugcaauuuuugacaguuuaagcccagu

SEQ ID NO: 81357 - RNA, 46 nt, Mus musculus
aaccaguguugcucaacucuaaguuaccuguggaaauccuuggaag

SEQ ID NO: 81358 - RNA, 33 nt, Mus musculus
cuuguugggucuuucggagggcaguggugauag

SEQ ID NO: 81359 - RNA, 46 nt, Mus musculus
aauaaauguaaguauugauuucuagaugugaaaucauuuagccaaa

SEQ ID NO: 81360 - RNA, 46 nt, Mus musculus
aaaagcuaaauaugaugaaauuuuucugaaaacugauaaggauaug

SEQ ID NO: 81361 - RNA, 46 nt, Mus musculus
uucaaaagaccaguuugccuuggcuuuucacuuaaucaaucagaag

SEQ ID NO: 81362 - RNA, 46 nt, Mus musculus
gacacaccagaagagggcuuuggaacccauuacagauggcugugag

SEQ ID NO: 81363 - RNA, 42 nt, Mus musculus
aaggaacuagauacccuuaacaaugaaauaguugaccugcag

SEQ ID NO: 81364 - RNA, 46 nt, Mus musculus
aucuuuccaacccccuaagaaguucuugaagucagaaaggugcaag
